United States Patent 7,314,750 (ADDRESSABLE OLIGONUCLEOTIDE ARRAY OF THE RAT GENOME) - sequence listing, part 15

SEQ ID NO: 528521 - DNA, 25 bp, Rattus norvegicus
gttgcatgggtaggagcaccgcact

SEQ ID NO: 528522 - DNA, 25 bp, Rattus norvegicus
gttgcatgtttgaaagttaccaggt

SEQ ID NO: 528523 - DNA, 25 bp, Rattus norvegicus
gttgcatgtttgtaagttaccaggt

SEQ ID NO: 528524 - DNA, 25 bp, Rattus norvegicus
gttgcattcagtctgggttttcttt

SEQ ID NO: 528525 - DNA, 25 bp, Rattus norvegicus
gttgcattcagtgtgggttttcttt

SEQ ID NO: 528526 - DNA, 25 bp, Rattus norvegicus
gttgcattcattcaaccaggccaat

SEQ ID NO: 528527 - DNA, 25 bp, Rattus norvegicus
gttgcattcattgaaccaggccaat

SEQ ID NO: 528528 - DNA, 25 bp, Rattus norvegicus
gttgcattggaacacgttttgtttt

SEQ ID NO: 528529 - DNA, 25 bp, Rattus norvegicus
gttgcattggaagacgttttgtttt

SEQ ID NO: 528530 - DNA, 25 bp, Rattus norvegicus
gttgcattgtgaacctgtagttgac

SEQ ID NO: 528531 - DNA, 25 bp, Rattus norvegicus
gttgcattgtgatcctgtagttgac

SEQ ID NO: 528532 - DNA, 25 bp, Rattus norvegicus
gttgcattgtggagcagaggcctct

SEQ ID NO: 528533 - DNA, 25 bp, Rattus norvegicus
gttgcattgtggtgcagaggcctct

SEQ ID NO: 528534 - DNA, 25 bp, Rattus norvegicus
gttgcattgttcagtttagcccata

SEQ ID NO: 528535 - DNA, 25 bp, Rattus norvegicus
gttgcattgttctgtttagcccata

SEQ ID NO: 528536 - DNA, 25 bp, Rattus norvegicus
gttgcattttaaagtccgttgcttt

SEQ ID NO: 528537 - DNA, 25 bp, Rattus norvegicus
gttgcattttaatgtccgttgcttt

SEQ ID NO: 528538 - DNA, 25 bp, Rattus norvegicus
gttgcattttctccttcaaaagtgg

SEQ ID NO: 528539 - DNA, 25 bp, Rattus norvegicus
gttgcattttctgcttcaaaagtgg

SEQ ID NO: 528540 - DNA, 25 bp, Rattus norvegicus
gttgcattttggatgtacctaattt

SEQ ID NO: 528541 - DNA, 25 bp, Rattus norvegicus
gttgcattttggttgtacctaattt

SEQ ID NO: 528542 - DNA, 25 bp, Rattus norvegicus
gttgccaaaaggatgtgctatccca

SEQ ID NO: 528543 - DNA, 25 bp, Rattus norvegicus
gttgccaaaaggttgtgctatccca

SEQ ID NO: 528544 - DNA, 25 bp, Rattus norvegicus
gttgccaaacttagtcgcatcgata

SEQ ID NO: 528545 - DNA, 25 bp, Rattus norvegicus
gttgccaaactttgtcgcatcgata

SEQ ID NO: 528546 - DNA, 25 bp, Rattus norvegicus
gttgccaaagtcagtattcggtcct

SEQ ID NO: 528547 - DNA, 25 bp, Rattus norvegicus
gttgccaaagtctgtattcggtcct

SEQ ID NO: 528548 - DNA, 25 bp, Rattus norvegicus
gttgccaacaccaggaaaggactct

SEQ ID NO: 528549 - DNA, 25 bp, Rattus norvegicus
gttgccaacacctggaaaggactct

SEQ ID NO: 528550 - DNA, 25 bp, Rattus norvegicus
gttgccaacagccaaatgccatttt

SEQ ID NO: 528551 - DNA, 25 bp, Rattus norvegicus
gttgccaacagcgaaatgccatttt

SEQ ID NO: 528552 - DNA, 25 bp, Rattus norvegicus
gttgccaacgatcatagctgacaat

SEQ ID NO: 528553 - DNA, 25 bp, Rattus norvegicus
gttgccaacgatgatagctgacaat

SEQ ID NO: 528554 - DNA, 25 bp, Rattus norvegicus
gttgccaactagatttcatcaagat

SEQ ID NO: 528555 - DNA, 25 bp, Rattus norvegicus
gttgccaactagttttcatcaagat

SEQ ID NO: 528556 - DNA, 25 bp, Rattus norvegicus
gttgccaacttgaaactgcacttga

SEQ ID NO: 528557 - DNA, 25 bp, Rattus norvegicus
gttgccaacttgagaaccagtgtga

SEQ ID NO: 528558 - DNA, 25 bp, Rattus norvegicus
gttgccaacttgtaactgcacttga

SEQ ID NO: 528559 - DNA, 25 bp, Rattus norvegicus
gttgccaacttgtgaaccagtgtga

SEQ ID NO: 528560 - DNA, 25 bp, Rattus norvegicus
gttgccaaggagatggtcttctttc

SEQ ID NO: 528561 - DNA, 25 bp, Rattus norvegicus
gttgccaaggagttggtcttctttc

SEQ ID NO: 528562 - DNA, 25 bp, Rattus norvegicus
gttgccaagtggcaattccttattt

SEQ ID NO: 528563 - DNA, 25 bp, Rattus norvegicus
gttgccaagtgggaattccttattt

SEQ ID NO: 528564 - DNA, 25 bp, Rattus norvegicus
gttgccacagctactgcttttgacg

SEQ ID NO: 528565 - DNA, 25 bp, Rattus norvegicus
gttgccacagcttctgcttttgacg

SEQ ID NO: 528566 - DNA, 25 bp, Rattus norvegicus
gttgccacccttctggtagtagctg

SEQ ID NO: 528567 - DNA, 25 bp, Rattus norvegicus
gttgccacccttgtggtagtagctg

SEQ ID NO: 528568 - DNA, 25 bp, Rattus norvegicus
gttgccacctgtaggaataaccgct

SEQ ID NO: 528569 - DNA, 25 bp, Rattus norvegicus
gttgccacctgttggaataaccgct

SEQ ID NO: 528570 - DNA, 25 bp, Rattus norvegicus
gttgccaccttgcttcattaaaaca

SEQ ID NO: 528571 - DNA, 25 bp, Rattus norvegicus
gttgccaccttggttcattaaaaca

SEQ ID NO: 528572 - DNA, 25 bp, Rattus norvegicus
gttgccacgcgtctgagaacatgct

SEQ ID NO: 528573 - DNA, 25 bp, Rattus norvegicus
gttgccacgcgtgtgagaacatgct

SEQ ID NO: 528574 - DNA, 25 bp, Rattus norvegicus
gttgccacgctgactgtggatttta

SEQ ID NO: 528575 - DNA, 25 bp, Rattus norvegicus
gttgccacgctgtctgtggatttta

SEQ ID NO: 528576 - DNA, 25 bp, Rattus norvegicus
gttgccactcttaacaaatcttaat

SEQ ID NO: 528577 - DNA, 25 bp, Rattus norvegicus
gttgccactctttacaaatcttaat

SEQ ID NO: 528578 - DNA, 25 bp, Rattus norvegicus
gttgccactgtcactctgaggagga

SEQ ID NO: 528579 - DNA, 25 bp, Rattus norvegicus
gttgccactgtctctctgaggagga

SEQ ID NO: 528580 - DNA, 25 bp, Rattus norvegicus
gttgccagaacgagacagacttact

SEQ ID NO: 528581 - DNA, 25 bp, Rattus norvegicus
gttgccagaacgtgacagacttact

SEQ ID NO: 528582 - DNA, 25 bp, Rattus norvegicus
gttgccagagagacagcccaggttc

SEQ ID NO: 528583 - DNA, 25 bp, Rattus norvegicus
gttgccagagagtcagcccaggttc

SEQ ID NO: 528584 - DNA, 25 bp, Rattus norvegicus
gttgccagagccactggacactttt

SEQ ID NO: 528585 - DNA, 25 bp, Rattus norvegicus
gttgccagagcctctggacactttt

SEQ ID NO: 528586 - DNA, 25 bp, Rattus norvegicus
gttgccagaggccaaccttgttcaa

SEQ ID NO: 528587 - DNA, 25 bp, Rattus norvegicus
gttgccagaggcgaaccttgttcaa

SEQ ID NO: 528588 - DNA, 25 bp, Rattus norvegicus
gttgccagcctaactgatgtttgga

SEQ ID NO: 528589 - DNA, 25 bp, Rattus norvegicus
gttgccagcctatctgatgtttgga

SEQ ID NO: 528590 - DNA, 25 bp, Rattus norvegicus
gttgccagcctcagcagggagagaa

SEQ ID NO: 528591 - DNA, 25 bp, Rattus norvegicus
gttgccagcctctgcagggagagaa

SEQ ID NO: 528592 - DNA, 25 bp, Rattus norvegicus
gttgccagccttctagtgccaagga

SEQ ID NO: 528593 - DNA, 25 bp, Rattus norvegicus
gttgccagccttgtagtgccaagga

SEQ ID NO: 528594 - DNA, 25 bp, Rattus norvegicus
gttgccagctatcatcactgtccaa

SEQ ID NO: 528595 - DNA, 25 bp, Rattus norvegicus
gttgccagctatgatcactgtccaa

SEQ ID NO: 528596 - DNA, 25 bp, Rattus norvegicus
gttgccagctggaccctgctaggga

SEQ ID NO: 528597 - DNA, 25 bp, Rattus norvegicus
gttgccagctggtccctgctaggga

SEQ ID NO: 528598 - DNA, 25 bp, Rattus norvegicus
gttgccaggaaaatacccgacgtct

SEQ ID NO: 528599 - DNA, 25 bp, Rattus norvegicus
gttgccaggaaattacccgacgtct

SEQ ID NO: 528600 - DNA, 25 bp, Rattus norvegicus
gttgccaggcaaagttcaagtccaa

SEQ ID NO: 528601 - DNA, 25 bp, Rattus norvegicus
gttgccaggcaatgttcaagtccaa

SEQ ID NO: 528602 - DNA, 25 bp, Rattus norvegicus
gttgccaggttgacctacagtttaa

SEQ ID NO: 528603 - DNA, 25 bp, Rattus norvegicus
gttgccaggttgtcctacagtttaa

SEQ ID NO: 528604 - DNA, 25 bp, Rattus norvegicus
gttgccagtaccaataaatcattgc

SEQ ID NO: 528605 - DNA, 25 bp, Rattus norvegicus
gttgccagtacctataaatcattgc

SEQ ID NO: 528606 - DNA, 25 bp, Rattus norvegicus
gttgccagtctgctaaaaatccaat

SEQ ID NO: 528607 - DNA, 25 bp, Rattus norvegicus
gttgccagtctggtaaaaatccaat

SEQ ID NO: 528608 - DNA, 25 bp, Rattus norvegicus
gttgccagtgtaatttctctaatgt

SEQ ID NO: 528609 - DNA, 25 bp, Rattus norvegicus
gttgccagtgtattttctctaatgt

SEQ ID NO: 528610 - DNA, 25 bp, Rattus norvegicus
gttgccatagcacccttgatactct

SEQ ID NO: 528611 - DNA, 25 bp, Rattus norvegicus
gttgccatagcagccttgatactct

SEQ ID NO: 528612 - DNA, 25 bp, Rattus norvegicus
gttgccatagtgatcttcactagta

SEQ ID NO: 528613 - DNA, 25 bp, Rattus norvegicus
gttgccatagtgttcttcactagta

SEQ ID NO: 528614 - DNA, 25 bp, Rattus norvegicus
gttgccatatctaaaacttccataa

SEQ ID NO: 528615 - DNA, 25 bp, Rattus norvegicus
gttgccatatcttaaacttccataa

SEQ ID NO: 528616 - DNA, 25 bp, Rattus norvegicus
gttgccatccccaagagcaggagaa

SEQ ID NO: 528617 - DNA, 25 bp, Rattus norvegicus
gttgccatcccctagagcaggagaa

SEQ ID NO: 528618 - DNA, 25 bp, Rattus norvegicus
gttgccatccctctgtaaatagtga

SEQ ID NO: 528619 - DNA, 25 bp, Rattus norvegicus
gttgccatccctgtgtaaatagtga

SEQ ID NO: 528620 - DNA, 25 bp, Rattus norvegicus
gttgccatcctgatattgggagtca

SEQ ID NO: 528621 - DNA, 25 bp, Rattus norvegicus
gttgccatcctgttattgggagtca

SEQ ID NO: 528622 - DNA, 25 bp, Rattus norvegicus
gttgccatccttcagatgaaccttt

SEQ ID NO: 528623 - DNA, 25 bp, Rattus norvegicus
gttgccatccttgagatgaaccttt

SEQ ID NO: 528624 - DNA, 25 bp, Rattus norvegicus
gttgccatctaccttgggataaagc

SEQ ID NO: 528625 - DNA, 25 bp, Rattus norvegicus
gttgccatctacgttgggataaagc

SEQ ID NO: 528626 - DNA, 25 bp, Rattus norvegicus
gttgccatctttacctgttgtttta

SEQ ID NO: 528627 - DNA, 25 bp, Rattus norvegicus
gttgccatcttttcctgttgtttta

SEQ ID NO: 528628 - DNA, 25 bp, Rattus norvegicus
gttgccatgggtacagaagcacata

SEQ ID NO: 528629 - DNA, 25 bp, Rattus norvegicus
gttgccatgggttcagaagcacata

SEQ ID NO: 528630 - DNA, 25 bp, Rattus norvegicus
gttgccatggtgattgatcgcatct

SEQ ID NO: 528631 - DNA, 25 bp, Rattus norvegicus
gttgccatggtgtttgatcgcatct

SEQ ID NO: 528632 - DNA, 25 bp, Rattus norvegicus
gttgccatgtgcagaggagagctct

SEQ ID NO: 528633 - DNA, 25 bp, Rattus norvegicus
gttgccatgtgctgaggagagctct

SEQ ID NO: 528634 - DNA, 25 bp, Rattus norvegicus
gttgccatgttccatgcacacagat

SEQ ID NO: 528635 - DNA, 25 bp, Rattus norvegicus
gttgccatgttcgatgcacacagat

SEQ ID NO: 528636 - DNA, 25 bp, Rattus norvegicus
gttgccattgtcacgccatttaaaa

SEQ ID NO: 528637 - DNA, 25 bp, Rattus norvegicus
gttgccattgtctcgccatttaaaa

SEQ ID NO: 528638 - DNA, 25 bp, Rattus norvegicus
gttgccatttgtctaaatactagtc

SEQ ID NO: 528639 - DNA, 25 bp, Rattus norvegicus
gttgccatttgtgtaaatactagtc

SEQ ID NO: 528640 - DNA, 25 bp, Rattus norvegicus
gttgccattttaaagctagaggagt

SEQ ID NO: 528641 - DNA, 25 bp, Rattus norvegicus
gttgccattttatagctagaggagt

SEQ ID NO: 528642 - DNA, 25 bp, Rattus norvegicus
gttgcccaactaattattgactcca

SEQ ID NO: 528643 - DNA, 25 bp, Rattus norvegicus
gttgcccaactatttattgactcca

SEQ ID NO: 528644 - DNA, 25 bp, Rattus norvegicus
gttgcccacagactcttaaggtact

SEQ ID NO: 528645 - DNA, 25 bp, Rattus norvegicus
gttgcccacagagtcttaaggtact

SEQ ID NO: 528646 - DNA, 25 bp, Rattus norvegicus
gttgcccacagtccctggaaaatta

SEQ ID NO: 528647 - DNA, 25 bp, Rattus norvegicus
gttgcccacagtgcctggaaaatta

SEQ ID NO: 528648 - DNA, 25 bp, Rattus norvegicus
gttgcccacgttatcaaactccgtg

SEQ ID NO: 528649 - DNA, 25 bp, Rattus norvegicus
gttgcccacgttttcaaactccgtg

SEQ ID NO: 528650 - DNA, 25 bp, Rattus norvegicus
gttgcccactgtatgggagcccaga

SEQ ID NO: 528651 - DNA, 25 bp, Rattus norvegicus
gttgcccactgtttgggagcccaga

SEQ ID NO: 528652 - DNA, 25 bp, Rattus norvegicus
gttgcccaggcaaagccagtggtca

SEQ ID NO: 528653 - DNA, 25 bp, Rattus norvegicus
gttgcccaggcatagccagtggtca

SEQ ID NO: 528654 - DNA, 25 bp, Rattus norvegicus
gttgcccaggtgcatctggaaccca

SEQ ID NO: 528655 - DNA, 25 bp, Rattus norvegicus
gttgcccaggtggatctggaaccca

SEQ ID NO: 528656 - DNA, 25 bp, Rattus norvegicus
gttgcccagtacattaagttcgaaa

SEQ ID NO: 528657 - DNA, 25 bp, Rattus norvegicus
gttgcccagtactttaagttcgaaa

SEQ ID NO: 528658 - DNA, 25 bp, Rattus norvegicus
gttgcccagtcaaaacattttgagc

SEQ ID NO: 528659 - DNA, 25 bp, Rattus norvegicus
gttgcccagtcataacattttgagc

SEQ ID NO: 528660 - DNA, 25 bp, Rattus norvegicus
gttgcccatagaattttgtctcgga

SEQ ID NO: 528661 - DNA, 25 bp, Rattus norvegicus
gttgcccatagatttttgtctcgga

SEQ ID NO: 528662 - DNA, 25 bp, Rattus norvegicus
gttgcccatatgcagtgtgacgatg

SEQ ID NO: 528663 - DNA, 25 bp, Rattus norvegicus
gttgcccatatggagtgtgacgatg

SEQ ID NO: 528664 - DNA, 25 bp, Rattus norvegicus
gttgcccatcatcacaccatattta

SEQ ID NO: 528665 - DNA, 25 bp, Rattus norvegicus
gttgcccatcatgacaccatattta

SEQ ID NO: 528666 - DNA, 25 bp, Rattus norvegicus
gttgccccaagtatgaggaccaggt

SEQ ID NO: 528667 - DNA, 25 bp, Rattus norvegicus
gttgccccaagtttgaggaccaggt

SEQ ID NO: 528668 - DNA, 25 bp, Rattus norvegicus
gttgccccagatacttttaacgtca

SEQ ID NO: 528669 - DNA, 25 bp, Rattus norvegicus
gttgccccagattcttttaacgtca

SEQ ID NO: 528670 - DNA, 25 bp, Rattus norvegicus
gttgccccagggatagaaacaagag

SEQ ID NO: 528671 - DNA, 25 bp, Rattus norvegicus
gttgccccagggttagaaacaagag

SEQ ID NO: 528672 - DNA, 25 bp, Rattus norvegicus
gttgcccctaagaatgagtccacaa

SEQ ID NO: 528673 - DNA, 25 bp, Rattus norvegicus
gttgcccctaagtatgagtccacaa

SEQ ID NO: 528674 - DNA, 25 bp, Rattus norvegicus
gttgcccgacagcacagctgagctt

SEQ ID NO: 528675 - DNA, 25 bp, Rattus norvegicus
gttgcccgacaggacagctgagctt

SEQ ID NO: 528676 - DNA, 25 bp, Rattus norvegicus
gttgccctcatcagcaagaaactga

SEQ ID NO: 528677 - DNA, 25 bp, Rattus norvegicus
gttgccctcatctgcaagaaactga

SEQ ID NO: 528678 - DNA, 25 bp, Rattus norvegicus
gttgccctctcaattgaacctagtt

SEQ ID NO: 528679 - DNA, 25 bp, Rattus norvegicus
gttgccctctcatttgaacctagtt

SEQ ID NO: 528680 - DNA, 25 bp, Rattus norvegicus
gttgccctgcttctcaaggaatgta

SEQ ID NO: 528681 - DNA, 25 bp, Rattus norvegicus
gttgccctgcttgtcaaggaatgta

SEQ ID NO: 528682 - DNA, 25 bp, Rattus norvegicus
gttgcccttaaacgagagccttagt

SEQ ID NO: 528683 - DNA, 25 bp, Rattus norvegicus
gttgcccttaaaggagagccttagt

SEQ ID NO: 528684 - DNA, 25 bp, Rattus norvegicus
gttgcccttcaccagaggtctgatg

SEQ ID NO: 528685 - DNA, 25 bp, Rattus norvegicus
gttgcccttcacgagaggtctgatg

SEQ ID NO: 528686 - DNA, 25 bp, Rattus norvegicus
gttgcccttggtatgaaatgtgcta

SEQ ID NO: 528687 - DNA, 25 bp, Rattus norvegicus
gttgcccttggtttgaaatgtgcta

SEQ ID NO: 528688 - DNA, 25 bp, Rattus norvegicus
gttgccgaatgtacactgcgtatcc

SEQ ID NO: 528689 - DNA, 25 bp, Rattus norvegicus
gttgccgaatgttcactgcgtatcc

SEQ ID NO: 528690 - DNA, 25 bp, Rattus norvegicus
gttgccgagaacattttgccgagtg

SEQ ID NO: 528691 - DNA, 25 bp, Rattus norvegicus
gttgccgagaactttttgccgagtg

SEQ ID NO: 528692 - DNA, 25 bp, Rattus norvegicus
gttgccgatcccacaaatgcttgag

SEQ ID NO: 528693 - DNA, 25 bp, Rattus norvegicus
gttgccgatccctcaaatgcttgag

SEQ ID NO: 528694 - DNA, 25 bp, Rattus norvegicus
gttgccgattgacgtgtactgccat

SEQ ID NO: 528695 - DNA, 25 bp, Rattus norvegicus
gttgccgattgaggtgtactgccat

SEQ ID NO: 528696 - DNA, 25 bp, Rattus norvegicus
gttgccgctctgcagacaaactcat

SEQ ID NO: 528697 - DNA, 25 bp, Rattus norvegicus
gttgccgctctggagacaaactcat

SEQ ID NO: 528698 - DNA, 25 bp, Rattus norvegicus
gttgccgctgtcaaatgtggtctgc

SEQ ID NO: 528699 - DNA, 25 bp, Rattus norvegicus
gttgccgctgtctaatgtggtctgc

SEQ ID NO: 528700 - DNA, 25 bp, Rattus norvegicus
gttgccgcttccaggatgacaacaa

SEQ ID NO: 528701 - DNA, 25 bp, Rattus norvegicus
gttgccgcttcctggatgacaacaa

SEQ ID NO: 528702 - DNA, 25 bp, Rattus norvegicus
gttgccggtacacctgattctacag

SEQ ID NO: 528703 - DNA, 25 bp, Rattus norvegicus
gttgccggtacagctgattctacag

SEQ ID NO: 528704 - DNA, 25 bp, Rattus norvegicus
gttgccggtggcatgagaaacatcc

SEQ ID NO: 528705 - DNA, 25 bp, Rattus norvegicus
gttgccggtggcttgagaaacatcc

SEQ ID NO: 528706 - DNA, 25 bp, Rattus norvegicus
gttgcctaaaatagtcatatctatg

SEQ ID NO: 528707 - DNA, 25 bp, Rattus norvegicus
gttgcctaaaattgtcatatctatg

SEQ ID NO: 528708 - DNA, 25 bp, Rattus norvegicus
gttgcctaaacacctgggcgccagg

SEQ ID NO: 528709 - DNA, 25 bp, Rattus norvegicus
gttgcctaaacagctgggcgccagg

SEQ ID NO: 528710 - DNA, 25 bp, Rattus norvegicus
gttgcctaacaactgtcaaagcatg

SEQ ID NO: 528711 - DNA, 25 bp, Rattus norvegicus
gttgcctaacaagtgtcaaagcatg

SEQ ID NO: 528712 - DNA, 25 bp, Rattus norvegicus
gttgcctaacacatctccatgaaga

SEQ ID NO: 528713 - DNA, 25 bp, Rattus norvegicus
gttgcctaacacttctccatgaaga

SEQ ID NO: 528714 - DNA, 25 bp, Rattus norvegicus
gttgcctaagtgattcttgattcat

SEQ ID NO: 528715 - DNA, 25 bp, Rattus norvegicus
gttgcctaagtgtttcttgattcat

SEQ ID NO: 528716 - DNA, 25 bp, Rattus norvegicus
gttgcctacttcatagttcatctca

SEQ ID NO: 528717 - DNA, 25 bp, Rattus norvegicus
gttgcctacttcttagttcatctca

SEQ ID NO: 528718 - DNA, 25 bp, Rattus norvegicus
gttgcctagaagaaccctaatgtgt

SEQ ID NO: 528719 - DNA, 25 bp, Rattus norvegicus
gttgcctagaagtaccctaatgtgt

SEQ ID NO: 528720 - DNA, 25 bp, Rattus norvegicus
gttgcctagcaacacgcttaaatct

SEQ ID NO: 528721 - DNA, 25 bp, Rattus norvegicus
gttgcctagcaagacgcttaaatct

SEQ ID NO: 528722 - DNA, 25 bp, Rattus norvegicus
gttgcctagtggcttagacatttca

SEQ ID NO: 528723 - DNA, 25 bp, Rattus norvegicus
gttgcctagtgggttagacatttca

SEQ ID NO: 528724 - DNA, 25 bp, Rattus norvegicus
gttgcctatgctattggaagtactt

SEQ ID NO: 528725 - DNA, 25 bp, Rattus norvegicus
gttgcctatgcttttggaagtactt

SEQ ID NO: 528726 - DNA, 25 bp, Rattus norvegicus
gttgcctatgtgaaatgttagccca

SEQ ID NO: 528727 - DNA, 25 bp, Rattus norvegicus
gttgcctatgtgtaatgttagccca

SEQ ID NO: 528728 - DNA, 25 bp, Rattus norvegicus
gttgcctcaacaatcatgacactga

SEQ ID NO: 528729 - DNA, 25 bp, Rattus norvegicus
gttgcctcaacattcatgacactga

SEQ ID NO: 528730 - DNA, 25 bp, Rattus norvegicus
gttgcctccaagaattgtgccttat

SEQ ID NO: 528731 - DNA, 25 bp, Rattus norvegicus
gttgcctccaagtattgtgccttat

SEQ ID NO: 528732 - DNA, 25 bp, Rattus norvegicus
gttgcctccgatagaacttgacttt

SEQ ID NO: 528733 - DNA, 25 bp, Rattus norvegicus
gttgcctccgattgaacttgacttt

SEQ ID NO: 528734 - DNA, 25 bp, Rattus norvegicus
gttgcctcgcctagatgctataatg

SEQ ID NO: 528735 - DNA, 25 bp, Rattus norvegicus
gttgcctcgccttgatgctataatg

SEQ ID NO: 528736 - DNA, 25 bp, Rattus norvegicus
gttgcctcggcacctggtgcgaaaa

SEQ ID NO: 528737 - DNA, 25 bp, Rattus norvegicus
gttgcctcggcagctggtgcgaaaa

SEQ ID NO: 528738 - DNA, 25 bp, Rattus norvegicus
gttgcctcgtatagtacattttggg

SEQ ID NO: 528739 - DNA, 25 bp, Rattus norvegicus
gttgcctcgtattgtacattttggg

SEQ ID NO: 528740 - DNA, 25 bp, Rattus norvegicus
gttgcctcttcgattgggagagact

SEQ ID NO: 528741 - DNA, 25 bp, Rattus norvegicus
gttgcctcttcgtttgggagagact

SEQ ID NO: 528742 - DNA, 25 bp, Rattus norvegicus
gttgcctcttgtaatgtggacctct

SEQ ID NO: 528743 - DNA, 25 bp, Rattus norvegicus
gttgcctcttgtcttactttatgga

SEQ ID NO: 528744 - DNA, 25 bp, Rattus norvegicus
gttgcctcttgtgttactttatgga

SEQ ID NO: 528745 - DNA, 25 bp, Rattus norvegicus
gttgcctcttgttatgtggacctct

SEQ ID NO: 528746 - DNA, 25 bp, Rattus norvegicus
gttgcctgaatactttctgcggatt

SEQ ID NO: 528747 - DNA, 25 bp, Rattus norvegicus
gttgcctgaatagtttctgcggatt

SEQ ID NO: 528748 - DNA, 25 bp, Rattus norvegicus
gttgcctgacggctaaatcctgagc

SEQ ID NO: 528749 - DNA, 25 bp, Rattus norvegicus
gttgcctgacgggtaaatcctgagc

SEQ ID NO: 528750 - DNA, 25 bp, Rattus norvegicus
gttgcctgagtacacaatgtgccct

SEQ ID NO: 528751 - DNA, 25 bp, Rattus norvegicus
gttgcctgagtagacaatgtgccct

SEQ ID NO: 528752 - DNA, 25 bp, Rattus norvegicus
gttgcctgcaccaagaacaccaaaa

SEQ ID NO: 528753 - DNA, 25 bp, Rattus norvegicus
gttgcctgcacctagaacaccaaaa

SEQ ID NO: 528754 - DNA, 25 bp, Rattus norvegicus
gttgcctgcatactcatatcgagtg

SEQ ID NO: 528755 - DNA, 25 bp, Rattus norvegicus
gttgcctgcatagtcatatcgagtg

SEQ ID NO: 528756 - DNA, 25 bp, Rattus norvegicus
gttgcctgcatcacaactgaggagt

SEQ ID NO: 528757 - DNA, 25 bp, Rattus norvegicus
gttgcctgcatctcaactgaggagt

SEQ ID NO: 528758 - DNA, 25 bp, Rattus norvegicus
gttgcctgcctgcttgaaacaaaca

SEQ ID NO: 528759 - DNA, 25 bp, Rattus norvegicus
gttgcctgcctggttgaaacaaaca

SEQ ID NO: 528760 - DNA, 25 bp, Rattus norvegicus
gttgcctgctagagtgagattacca

SEQ ID NO: 528761 - DNA, 25 bp, Rattus norvegicus
gttgcctgctagtgtgagattacca

SEQ ID NO: 528762 - DNA, 25 bp, Rattus norvegicus
gttgcctggaatccttactaaagtg

SEQ ID NO: 528763 - DNA, 25 bp, Rattus norvegicus
gttgcctggaatgcttactaaagtg

SEQ ID NO: 528764 - DNA, 25 bp, Rattus norvegicus
gttgcctggactcgtttttacattt

SEQ ID NO: 528765 - DNA, 25 bp, Rattus norvegicus
gttgcctggactggtttttacattt

SEQ ID NO: 528766 - DNA, 25 bp, Rattus norvegicus
gttgcctggcggctacttttctatc

SEQ ID NO: 528767 - DNA, 25 bp, Rattus norvegicus
gttgcctggcgggtacttttctatc

SEQ ID NO: 528768 - DNA, 25 bp, Rattus norvegicus
gttgcctggctactaaagagacttc

SEQ ID NO: 528769 - DNA, 25 bp, Rattus norvegicus
gttgcctggctagtaaagagacttc

SEQ ID NO: 528770 - DNA, 25 bp, Rattus norvegicus
gttgcctgtaacaatagaacttcac

SEQ ID NO: 528771 - DNA, 25 bp, Rattus norvegicus
gttgcctgtaactatagaacttcac

SEQ ID NO: 528772 - DNA, 25 bp, Rattus norvegicus
gttgcctgtaagaggaggtctgtct

SEQ ID NO: 528773 - DNA, 25 bp, Rattus norvegicus
gttgcctgtaagtggaggtctgtct

SEQ ID NO: 528774 - DNA, 25 bp, Rattus norvegicus
gttgcctgtcttaatctgaccatat

SEQ ID NO: 528775 - DNA, 25 bp, Rattus norvegicus
gttgcctgtctttatctgaccatat

SEQ ID NO: 528776 - DNA, 25 bp, Rattus norvegicus
gttgcctgtgcaaactgtttatatt

SEQ ID NO: 528777 - DNA, 25 bp, Rattus norvegicus
gttgcctgtgcatactgtttatatt

SEQ ID NO: 528778 - DNA, 25 bp, Rattus norvegicus
gttgcctgtggcactctttttaaaa

SEQ ID NO: 528779 - DNA, 25 bp, Rattus norvegicus
gttgcctgtggctctctttttaaaa

SEQ ID NO: 528780 - DNA, 25 bp, Rattus norvegicus
gttgcctgtgtaacaatgcctattg

SEQ ID NO: 528781 - DNA, 25 bp, Rattus norvegicus
gttgcctgtgtatcaatgcctattg

SEQ ID NO: 528782 - DNA, 25 bp, Rattus norvegicus
gttgcctgttacacagctatggcat

SEQ ID NO: 528783 - DNA, 25 bp, Rattus norvegicus
gttgcctgttactcagctatggcat

SEQ ID NO: 528784 - DNA, 25 bp, Rattus norvegicus
gttgcctgtttcatttgactcgaga

SEQ ID NO: 528785 - DNA, 25 bp, Rattus norvegicus
gttgcctgtttcttttgactcgaga

SEQ ID NO: 528786 - DNA, 25 bp, Rattus norvegicus
gttgccttaaccctactgaagcatg

SEQ ID NO: 528787 - DNA, 25 bp, Rattus norvegicus
gttgccttaaccgtactgaagcatg

SEQ ID NO: 528788 - DNA, 25 bp, Rattus norvegicus
gttgccttatgaagtgatcctctgc

SEQ ID NO: 528789 - DNA, 25 bp, Rattus norvegicus
gttgccttatgatgtgatcctctgc

SEQ ID NO: 528790 - DNA, 25 bp, Rattus norvegicus
gttgccttcaatcctactcaaagaa

SEQ ID NO: 528791 - DNA, 25 bp, Rattus norvegicus
gttgccttcaatgctactcaaagaa

SEQ ID NO: 528792 - DNA, 25 bp, Rattus norvegicus
gttgccttctgtattttcctaatat

SEQ ID NO: 528793 - DNA, 25 bp, Rattus norvegicus
gttgccttctgttttttcctaatat

SEQ ID NO: 528794 - DNA, 25 bp, Rattus norvegicus
gttgccttgaaaccaggatcctaga

SEQ ID NO: 528795 - DNA, 25 bp, Rattus norvegicus
gttgccttgaaagcaggatcctaga

SEQ ID NO: 528796 - DNA, 25 bp, Rattus norvegicus
gttgccttgaagatagccttctcta

SEQ ID NO: 528797 - DNA, 25 bp, Rattus norvegicus
gttgccttgaagttagccttctcta

SEQ ID NO: 528798 - DNA, 25 bp, Rattus norvegicus
gttgccttggaaactttctgatgta

SEQ ID NO: 528799 - DNA, 25 bp, Rattus norvegicus
gttgccttggaatctttctgatgta

SEQ ID NO: 528800 - DNA, 25 bp, Rattus norvegicus
gttgccttggcacataaatgagcgt

SEQ ID NO: 528801 - DNA, 25 bp, Rattus norvegicus
gttgccttggcagataaatgagcgt

SEQ ID NO: 528802 - DNA, 25 bp, Rattus norvegicus
gttgccttggccctgacagctcttg

SEQ ID NO: 528803 - DNA, 25 bp, Rattus norvegicus
gttgccttggccgtgacagctcttg

SEQ ID NO: 528804 - DNA, 25 bp, Rattus norvegicus
gttgccttggctacaaatggaccta

SEQ ID NO: 528805 - DNA, 25 bp, Rattus norvegicus
gttgccttggcttcaaatggaccta

SEQ ID NO: 528806 - DNA, 25 bp, Rattus norvegicus
gttgccttgggacctatctgattat

SEQ ID NO: 528807 - DNA, 25 bp, Rattus norvegicus
gttgccttgggagctatctgattat

SEQ ID NO: 528808 - DNA, 25 bp, Rattus norvegicus
gttgccttgggcacagtgtttatca

SEQ ID NO: 528809 - DNA, 25 bp, Rattus norvegicus
gttgccttgggctcagtgtttatca

SEQ ID NO: 528810 - DNA, 25 bp, Rattus norvegicus
gttgccttggttctaaaatctgttc

SEQ ID NO: 528811 - DNA, 25 bp, Rattus norvegicus
gttgccttggttgtaaaatctgttc

SEQ ID NO: 528812 - DNA, 25 bp, Rattus norvegicus
gttgccttgttactgatgcttataa

SEQ ID NO: 528813 - DNA, 25 bp, Rattus norvegicus
gttgccttgttagtgatgcttataa

SEQ ID NO: 528814 - DNA, 25 bp, Rattus norvegicus
gttgcctttactctattttctatga

SEQ ID NO: 528815 - DNA, 25 bp, Rattus norvegicus
gttgcctttactgtattttctatga

SEQ ID NO: 528816 - DNA, 25 bp, Rattus norvegicus
gttgcctttgccaggaggagaatgt

SEQ ID NO: 528817 - DNA, 25 bp, Rattus norvegicus
gttgcctttgcctggaggagaatgt

SEQ ID NO: 528818 - DNA, 25 bp, Rattus norvegicus
gttgcctttggcagtctttgcactt

SEQ ID NO: 528819 - DNA, 25 bp, Rattus norvegicus
gttgcctttggctgtctttgcactt

SEQ ID NO: 528820 - DNA, 25 bp, Rattus norvegicus
gttgcctttgttcttacttctgtga

SEQ ID NO: 528821 - DNA, 25 bp, Rattus norvegicus
gttgcctttgttgttacttctgtga

SEQ ID NO: 528822 - DNA, 25 bp, Rattus norvegicus
gttgccttttaactacttggtagct

SEQ ID NO: 528823 - DNA, 25 bp, Rattus norvegicus
gttgccttttaagtacttggtagct

SEQ ID NO: 528824 - DNA, 25 bp, Rattus norvegicus
gttgccttttcgctatcagagctac

SEQ ID NO: 528825 - DNA, 25 bp, Rattus norvegicus
gttgccttttcggtatcagagctac

SEQ ID NO: 528826 - DNA, 25 bp, Rattus norvegicus
gttgccttttggaatcagcctgact

SEQ ID NO: 528827 - DNA, 25 bp, Rattus norvegicus
gttgccttttggtatcagcctgact

SEQ ID NO: 528828 - DNA, 25 bp, Rattus norvegicus
gttgcctttttaacactgatcctgc

SEQ ID NO: 528829 - DNA, 25 bp, Rattus norvegicus
gttgcctttttacctgagcagaaca

SEQ ID NO: 528830 - DNA, 25 bp, Rattus norvegicus
gttgcctttttagctgagcagaaca

SEQ ID NO: 528831 - DNA, 25 bp, Rattus norvegicus
gttgcctttttatcactgatcctgc

SEQ ID NO: 528832 - DNA, 25 bp, Rattus norvegicus
gttgcctttttgctggtatagatgt

SEQ ID NO: 528833 - DNA, 25 bp, Rattus norvegicus
gttgcctttttggtggtatagatgt

SEQ ID NO: 528834 - DNA, 25 bp, Rattus norvegicus
gttgcgaaagtgagaccagcagtcg

SEQ ID NO: 528835 - DNA, 25 bp, Rattus norvegicus
gttgcgaaagtgtgaccagcagtcg

SEQ ID NO: 528836 - DNA, 25 bp, Rattus norvegicus
gttgcgaagcaaacagaacccacat

SEQ ID NO: 528837 - DNA, 25 bp, Rattus norvegicus
gttgcgaagcaatcagaacccacat

SEQ ID NO: 528838 - DNA, 25 bp, Rattus norvegicus
gttgcgacatacactggaacatcca

SEQ ID NO: 528839 - DNA, 25 bp, Rattus norvegicus
gttgcgacatactctggaacatcca

SEQ ID NO: 528840 - DNA, 25 bp, Rattus norvegicus
gttgcgacatcacgcctagctcgac

SEQ ID NO: 528841 - DNA, 25 bp, Rattus norvegicus
gttgcgacatcaggcctagctcgac

SEQ ID NO: 528842 - DNA, 25 bp, Rattus norvegicus
gttgcgagaactagttgaccagtga

SEQ ID NO: 528843 - DNA, 25 bp, Rattus norvegicus
gttgcgagaacttgttgaccagtga

SEQ ID NO: 528844 - DNA, 25 bp, Rattus norvegicus
gttgcgagctacagtatgccctcaa

SEQ ID NO: 528845 - DNA, 25 bp, Rattus norvegicus
gttgcgagctactgtatgccctcaa

SEQ ID NO: 528846 - DNA, 25 bp, Rattus norvegicus
gttgcgataatcacctgtgtactat

SEQ ID NO: 528847 - DNA, 25 bp, Rattus norvegicus
gttgcgataatctcctgtgtactat

SEQ ID NO: 528848 - DNA, 25 bp, Rattus norvegicus
gttgcgatttgtagtctagacccct

SEQ ID NO: 528849 - DNA, 25 bp, Rattus norvegicus
gttgcgatttgttgtctagacccct

SEQ ID NO: 528850 - DNA, 25 bp, Rattus norvegicus
gttgcgcaacaacactggagttcct

SEQ ID NO: 528851 - DNA, 25 bp, Rattus norvegicus
gttgcgcaacaagactggagttcct

SEQ ID NO: 528852 - DNA, 25 bp, Rattus norvegicus
gttgcgccaaccactgagcggcctt

SEQ ID NO: 528853 - DNA, 25 bp, Rattus norvegicus
gttgcgccaacctctgagcggcctt

SEQ ID NO: 528854 - DNA, 25 bp, Rattus norvegicus
gttgcgcccacaaagggcgacggtc

SEQ ID NO: 528855 - DNA, 25 bp, Rattus norvegicus
gttgcgcccacatagggcgacggtc

SEQ ID NO: 528856 - DNA, 25 bp, Rattus norvegicus
gttgcgcgatcactacttgctgact

SEQ ID NO: 528857 - DNA, 25 bp, Rattus norvegicus
gttgcgcgatcagtacttgctgact

SEQ ID NO: 528858 - DNA, 25 bp, Rattus norvegicus
gttgcgcgcgcaagcgtgaaaacgc

SEQ ID NO: 528859 - DNA, 25 bp, Rattus norvegicus
gttgcgcgcgcatgcgtgaaaacgc

SEQ ID NO: 528860 - DNA, 25 bp, Rattus norvegicus
gttgcgctttagatgccattgtcca

SEQ ID NO: 528861 - DNA, 25 bp, Rattus norvegicus
gttgcgctttagttgccattgtcca

SEQ ID NO: 528862 - DNA, 25 bp, Rattus norvegicus
gttgcggagcttcccctgtgctcgc

SEQ ID NO: 528863 - DNA, 25 bp, Rattus norvegicus
gttgcggagcttgccctgtgctcgc

SEQ ID NO: 528864 - DNA, 25 bp, Rattus norvegicus
gttgcggcgctcaggagaggccccg

SEQ ID NO: 528865 - DNA, 25 bp, Rattus norvegicus
gttgcggcgctctggagaggccccg

SEQ ID NO: 528866 - DNA, 25 bp, Rattus norvegicus
gttgcgggtcatcgccaaggaatcc

SEQ ID NO: 528867 - DNA, 25 bp, Rattus norvegicus
gttgcgggtcatggccaaggaatcc

SEQ ID NO: 528868 - DNA, 25 bp, Rattus norvegicus
gttgcgtcattaaacattctgcatt

SEQ ID NO: 528869 - DNA, 25 bp, Rattus norvegicus
gttgcgtcattatacattctgcatt

SEQ ID NO: 528870 - DNA, 25 bp, Rattus norvegicus
gttgcgtccaaccaatcccgagagg

SEQ ID NO: 528871 - DNA, 25 bp, Rattus norvegicus
gttgcgtccaacgaatcccgagagg

SEQ ID NO: 528872 - DNA, 25 bp, Rattus norvegicus
gttgcgtcccttattgtagaacatt

SEQ ID NO: 528873 - DNA, 25 bp, Rattus norvegicus
gttgcgtccctttttgtagaacatt

SEQ ID NO: 528874 - DNA, 25 bp, Rattus norvegicus
gttgcgtctttgatgatttgctctg

SEQ ID NO: 528875 - DNA, 25 bp, Rattus norvegicus
gttgcgtctttgttgatttgctctg

SEQ ID NO: 528876 - DNA, 25 bp, Rattus norvegicus
gttgcgtggctgaaacccctttggg

SEQ ID NO: 528877 - DNA, 25 bp, Rattus norvegicus
gttgcgtggctgtaacccctttggg

SEQ ID NO: 528878 - DNA, 25 bp, Rattus norvegicus
gttgcgttacacaagacatgctaag

SEQ ID NO: 528879 - DNA, 25 bp, Rattus norvegicus
gttgcgttacactagacatgctaag

SEQ ID NO: 528880 - DNA, 25 bp, Rattus norvegicus
gttgcgttaggaactgctctcgcaa

SEQ ID NO: 528881 - DNA, 25 bp, Rattus norvegicus
gttgcgttaggatctgctctcgcaa

SEQ ID NO: 528882 - DNA, 25 bp, Rattus norvegicus
gttgctaaaatcctaacccaccaag

SEQ ID NO: 528883 - DNA, 25 bp, Rattus norvegicus
gttgctaaaatcgtaacccaccaag

SEQ ID NO: 528884 - DNA, 25 bp, Rattus norvegicus
gttgctaaatgtccagtttcccgga

SEQ ID NO: 528885 - DNA, 25 bp, Rattus norvegicus
gttgctaaatgtgcagtttcccgga

SEQ ID NO: 528886 - DNA, 25 bp, Rattus norvegicus
gttgctaacctcatgttgtgtaagc

SEQ ID NO: 528887 - DNA, 25 bp, Rattus norvegicus
gttgctaacctcttgttgtgtaagc

SEQ ID NO: 528888 - DNA, 25 bp, Rattus norvegicus
gttgctaacgtacatgaagtcactt

SEQ ID NO: 528889 - DNA, 25 bp, Rattus norvegicus
gttgctaacgtagatgaagtcactt

SEQ ID NO: 528890 - DNA, 25 bp, Rattus norvegicus
gttgctaagcaaccacctgaagcat

SEQ ID NO: 528891 - DNA, 25 bp, Rattus norvegicus
gttgctaagcaagcacctgaagcat

SEQ ID NO: 528892 - DNA, 25 bp, Rattus norvegicus
gttgctaataggagcttacagagta

SEQ ID NO: 528893 - DNA, 25 bp, Rattus norvegicus
gttgctaataggtgcttacagagta

SEQ ID NO: 528894 - DNA, 25 bp, Rattus norvegicus
gttgctaatcttaaacctccagttg

SEQ ID NO: 528895 - DNA, 25 bp, Rattus norvegicus
gttgctaatcttaacatatatattc

SEQ ID NO: 528896 - DNA, 25 bp, Rattus norvegicus
gttgctaatctttaacctccagttg

SEQ ID NO: 528897 - DNA, 25 bp, Rattus norvegicus
gttgctaatctttacatatatattc

SEQ ID NO: 528898 - DNA, 25 bp, Rattus norvegicus
gttgctaattataatactacaccgt

SEQ ID NO: 528899 - DNA, 25 bp, Rattus norvegicus
gttgctaattattatactacaccgt

SEQ ID NO: 528900 - DNA, 25 bp, Rattus norvegicus
gttgctacacccaaattatggatgt

SEQ ID NO: 528901 - DNA, 25 bp, Rattus norvegicus
gttgctacaccctaattatggatgt

SEQ ID NO: 528902 - DNA, 25 bp, Rattus norvegicus
gttgctacccaaatctctgggtgca

SEQ ID NO: 528903 - DNA, 25 bp, Rattus norvegicus
gttgctacccaattctctgggtgca

SEQ ID NO: 528904 - DNA, 25 bp, Rattus norvegicus
gttgctactgttattgtttttccag

SEQ ID NO: 528905 - DNA, 25 bp, Rattus norvegicus
gttgctactgtttttgtttttccag

SEQ ID NO: 528906 - DNA, 25 bp, Rattus norvegicus
gttgctacttaaaccatccatattg

SEQ ID NO: 528907 - DNA, 25 bp, Rattus norvegicus
gttgctacttaatccatccatattg

SEQ ID NO: 528908 - DNA, 25 bp, Rattus norvegicus
gttgctacttgcaatcgtcttgctc

SEQ ID NO: 528909 - DNA, 25 bp, Rattus norvegicus
gttgctacttgctatcgtcttgctc

SEQ ID NO: 528910 - DNA, 25 bp, Rattus norvegicus
gttgctagaactaaggccggtacca

SEQ ID NO: 528911 - DNA, 25 bp, Rattus norvegicus
gttgctagaacttaggccggtacca

SEQ ID NO: 528912 - DNA, 25 bp, Rattus norvegicus
gttgctagagacattcgtcaggtca

SEQ ID NO: 528913 - DNA, 25 bp, Rattus norvegicus
gttgctagagactttcgtcaggtca

SEQ ID NO: 528914 - DNA, 25 bp, Rattus norvegicus
gttgctagagtgacctttgtatgta

SEQ ID NO: 528915 - DNA, 25 bp, Rattus norvegicus
gttgctagagtgtcctttgtatgta

SEQ ID NO: 528916 - DNA, 25 bp, Rattus norvegicus
gttgctagcattaggctcgtctatc

SEQ ID NO: 528917 - DNA, 25 bp, Rattus norvegicus
gttgctagcattaggttctttctcc

SEQ ID NO: 528918 - DNA, 25 bp, Rattus norvegicus
gttgctagcatttggctcgtctatc

SEQ ID NO: 528919 - DNA, 25 bp, Rattus norvegicus
gttgctagcatttggttctttctcc

SEQ ID NO: 528920 - DNA, 25 bp, Rattus norvegicus
gttgctaggagaacagccaggcccc

SEQ ID NO: 528921 - DNA, 25 bp, Rattus norvegicus
gttgctaggagaccatctgtgcccc

SEQ ID NO: 528922 - DNA, 25 bp, Rattus norvegicus
gttgctaggagagcatctgtgcccc

SEQ ID NO: 528923 - DNA, 25 bp, Rattus norvegicus
gttgctaggagatcagccaggcccc

SEQ ID NO: 528924 - DNA, 25 bp, Rattus norvegicus
gttgctagggcgaccgcggcttcca

SEQ ID NO: 528925 - DNA, 25 bp, Rattus norvegicus
gttgctagggcgtccgcggcttcca

SEQ ID NO: 528926 - DNA, 25 bp, Rattus norvegicus
gttgctagtaaccaccacagactga

SEQ ID NO: 528927 - DNA, 25 bp, Rattus norvegicus
gttgctagtaacgaccacagactga

SEQ ID NO: 528928 - DNA, 25 bp, Rattus norvegicus
gttgctataagaatgtacctgtgaa

SEQ ID NO: 528929 - DNA, 25 bp, Rattus norvegicus
gttgctataagattgtacctgtgaa

SEQ ID NO: 528930 - DNA, 25 bp, Rattus norvegicus
gttgctatccaacagttccgtgtca

SEQ ID NO: 528931 - DNA, 25 bp, Rattus norvegicus
gttgctatccaagagttccgtgtca

SEQ ID NO: 528932 - DNA, 25 bp, Rattus norvegicus
gttgctatcccacaataaatatgaa

SEQ ID NO: 528933 - DNA, 25 bp, Rattus norvegicus
gttgctatcccagaataaatatgaa

SEQ ID NO: 528934 - DNA, 25 bp, Rattus norvegicus
gttgctatgacaattaccctcgtaa

SEQ ID NO: 528935 - DNA, 25 bp, Rattus norvegicus
gttgctatgacatttaccctcgtaa

SEQ ID NO: 528936 - DNA, 25 bp, Rattus norvegicus
gttgctatgcaactgtttaatgatg

SEQ ID NO: 528937 - DNA, 25 bp, Rattus norvegicus
gttgctatgcaagtgtttaatgatg

SEQ ID NO: 528938 - DNA, 25 bp, Rattus norvegicus
gttgctatgcttctgtcttgaattt

SEQ ID NO: 528939 - DNA, 25 bp, Rattus norvegicus
gttgctatgcttgtgtcttgaattt

SEQ ID NO: 528940 - DNA, 25 bp, Rattus norvegicus
gttgctatggaaagtcctccagcgt

SEQ ID NO: 528941 - DNA, 25 bp, Rattus norvegicus
gttgctatggaatgtcctccagcgt

SEQ ID NO: 528942 - DNA, 25 bp, Rattus norvegicus
gttgctatggcaactccttaccagc

SEQ ID NO: 528943 - DNA, 25 bp, Rattus norvegicus
gttgctatggcatctccttaccagc

SEQ ID NO: 528944 - DNA, 25 bp, Rattus norvegicus
gttgctattaaacatgtgtcatgct

SEQ ID NO: 528945 - DNA, 25 bp, Rattus norvegicus
gttgctattaaagatgtgtcatgct

SEQ ID NO: 528946 - DNA, 25 bp, Rattus norvegicus
gttgctattaacaatgctgccatta

SEQ ID NO: 528947 - DNA, 25 bp, Rattus norvegicus
gttgctattaactatgctgccatta

SEQ ID NO: 528948 - DNA, 25 bp, Rattus norvegicus
gttgctattcccctagatgctagac

SEQ ID NO: 528949 - DNA, 25 bp, Rattus norvegicus
gttgctattcccgtagatgctagac

SEQ ID NO: 528950 - DNA, 25 bp, Rattus norvegicus
gttgctattctgcacacatatcgga

SEQ ID NO: 528951 - DNA, 25 bp, Rattus norvegicus
gttgctattctggacacatatcgga

SEQ ID NO: 528952 - DNA, 25 bp, Rattus norvegicus
gttgctattgcaccttcacctgcta

SEQ ID NO: 528953 - DNA, 25 bp, Rattus norvegicus
gttgctattgcagcttcacctgcta

SEQ ID NO: 528954 - DNA, 25 bp, Rattus norvegicus
gttgctatttaaagttgtcttcctc

SEQ ID NO: 528955 - DNA, 25 bp, Rattus norvegicus
gttgctatttaatgttgtcttcctc

SEQ ID NO: 528956 - DNA, 25 bp, Rattus norvegicus
gttgctatttctctggctaaccaat

SEQ ID NO: 528957 - DNA, 25 bp, Rattus norvegicus
gttgctatttctgtggctaaccaat

SEQ ID NO: 528958 - DNA, 25 bp, Rattus norvegicus
gttgctatttgactgtgaccatttt

SEQ ID NO: 528959 - DNA, 25 bp, Rattus norvegicus
gttgctatttgagtgtgaccatttt

SEQ ID NO: 528960 - DNA, 25 bp, Rattus norvegicus
gttgctcaaaggaacgaagtctcag

SEQ ID NO: 528961 - DNA, 25 bp, Rattus norvegicus
gttgctcaaaggtacgaagtctcag

SEQ ID NO: 528962 - DNA, 25 bp, Rattus norvegicus
gttgctcaactgattcatatgttta

SEQ ID NO: 528963 - DNA, 25 bp, Rattus norvegicus
gttgctcaactgtttcatatgttta

SEQ ID NO: 528964 - DNA, 25 bp, Rattus norvegicus
gttgctcaatttactggacattacc

SEQ ID NO: 528965 - DNA, 25 bp, Rattus norvegicus
gttgctcaattttctggacattacc

SEQ ID NO: 528966 - DNA, 25 bp, Rattus norvegicus
gttgctcacactctgtttggtgaca

SEQ ID NO: 528967 - DNA, 25 bp, Rattus norvegicus
gttgctcacactgtgtttggtgaca

SEQ ID NO: 528968 - DNA, 25 bp, Rattus norvegicus
gttgctcactctagactcgacaaaa

SEQ ID NO: 528969 - DNA, 25 bp, Rattus norvegicus
gttgctcactcttgactcgacaaaa

SEQ ID NO: 528970 - DNA, 25 bp, Rattus norvegicus
gttgctcagaatcttttctttccag

SEQ ID NO: 528971 - DNA, 25 bp, Rattus norvegicus
gttgctcagaatgttttctttccag

SEQ ID NO: 528972 - DNA, 25 bp, Rattus norvegicus
gttgctcagactatcaactgaatcc

SEQ ID NO: 528973 - DNA, 25 bp, Rattus norvegicus
gttgctcagactttcaactgaatcc

SEQ ID NO: 528974 - DNA, 25 bp, Rattus norvegicus
gttgctcagcaaattcgtacctact

SEQ ID NO: 528975 - DNA, 25 bp, Rattus norvegicus
gttgctcagcaatttcgtacctact

SEQ ID NO: 528976 - DNA, 25 bp, Rattus norvegicus
gttgctcaggctattgcttcaaggc

SEQ ID NO: 528977 - DNA, 25 bp, Rattus norvegicus
gttgctcaggcttttgcttcaaggc

SEQ ID NO: 528978 - DNA, 25 bp, Rattus norvegicus
gttgctcagtaacaaggcttgccag

SEQ ID NO: 528979 - DNA, 25 bp, Rattus norvegicus
gttgctcagtaacagcccttgagtc

SEQ ID NO: 528980 - DNA, 25 bp, Rattus norvegicus
gttgctcagtaagaaggcttgccag

SEQ ID NO: 528981 - DNA, 25 bp, Rattus norvegicus
gttgctcagtaagagcccttgagtc

SEQ ID NO: 528982 - DNA, 25 bp, Rattus norvegicus
gttgctcagtgacgatcaccaccgg

SEQ ID NO: 528983 - DNA, 25 bp, Rattus norvegicus
gttgctcagtgaggatcaccaccgg

SEQ ID NO: 528984 - DNA, 25 bp, Rattus norvegicus
gttgctcataagacatggttcagtg

SEQ ID NO: 528985 - DNA, 25 bp, Rattus norvegicus
gttgctcataagtcatggttcagtg

SEQ ID NO: 528986 - DNA, 25 bp, Rattus norvegicus
gttgctcatgttaatctgggacccc

SEQ ID NO: 528987 - DNA, 25 bp, Rattus norvegicus
gttgctcatgtttatctgggacccc

SEQ ID NO: 528988 - DNA, 25 bp, Rattus norvegicus
gttgctccaagccaggtaactatga

SEQ ID NO: 528989 - DNA, 25 bp, Rattus norvegicus
gttgctccaagcgaggtaactatga

SEQ ID NO: 528990 - DNA, 25 bp, Rattus norvegicus
gttgctcccaggacccaagaggcat

SEQ ID NO: 528991 - DNA, 25 bp, Rattus norvegicus
gttgctcccaggtcccaagaggcat

SEQ ID NO: 528992 - DNA, 25 bp, Rattus norvegicus
gttgctcccataaacacacttattg

SEQ ID NO: 528993 - DNA, 25 bp, Rattus norvegicus
gttgctcccatatacacacttattg

SEQ ID NO: 528994 - DNA, 25 bp, Rattus norvegicus
gttgctcctgaacctgaagttactt

SEQ ID NO: 528995 - DNA, 25 bp, Rattus norvegicus
gttgctcctgaagctgaagttactt

SEQ ID NO: 528996 - DNA, 25 bp, Rattus norvegicus
gttgctcgtccaataccaagtggtc

SEQ ID NO: 528997 - DNA, 25 bp, Rattus norvegicus
gttgctcgtccattaccaagtggtc

SEQ ID NO: 528998 - DNA, 25 bp, Rattus norvegicus
gttgctcgtcctcagtgtgcggcta

SEQ ID NO: 528999 - DNA, 25 bp, Rattus norvegicus
gttgctcgtcctgagtgtgcggcta

SEQ ID NO: 529000 - DNA, 25 bp, Rattus norvegicus
gttgctcgtctaatttactatatat

SEQ ID NO: 529001 - DNA, 25 bp, Rattus norvegicus
gttgctcgtctattttactatatat

SEQ ID NO: 529002 - DNA, 25 bp, Rattus norvegicus
gttgctctaatgagttgatctctgt

SEQ ID NO: 529003 - DNA, 25 bp, Rattus norvegicus
gttgctctaatgtgttgatctctgt

SEQ ID NO: 529004 - DNA, 25 bp, Rattus norvegicus
gttgctctattcctcatgggcatca

SEQ ID NO: 529005 - DNA, 25 bp, Rattus norvegicus
gttgctctattcgtcatgggcatca

SEQ ID NO: 529006 - DNA, 25 bp, Rattus norvegicus
gttgctctcttgatttgtcttgcca

SEQ ID NO: 529007 - DNA, 25 bp, Rattus norvegicus
gttgctctcttgttttgtcttgcca

SEQ ID NO: 529008 - DNA, 25 bp, Rattus norvegicus
gttgctctggacactaaacgatgac

SEQ ID NO: 529009 - DNA, 25 bp, Rattus norvegicus
gttgctctggactctaaacgatgac

SEQ ID NO: 529010 - DNA, 25 bp, Rattus norvegicus
gttgctctgtctcgctcaggagtga

SEQ ID NO: 529011 - DNA, 25 bp, Rattus norvegicus
gttgctctgtctggctcaggagtga

SEQ ID NO: 529012 - DNA, 25 bp, Rattus norvegicus
gttgctctgtgtatatctcctggaa

SEQ ID NO: 529013 - DNA, 25 bp, Rattus norvegicus
gttgctctgtgtttatctcctggaa

SEQ ID NO: 529014 - DNA, 25 bp, Rattus norvegicus
gttgctcttataccacaatacatcg

SEQ ID NO: 529015 - DNA, 25 bp, Rattus norvegicus
gttgctcttatagcacaatacatcg

SEQ ID NO: 529016 - DNA, 25 bp, Rattus norvegicus
gttgctcttcaacgttttggtcaat

SEQ ID NO: 529017 - DNA, 25 bp, Rattus norvegicus
gttgctcttcaaggttttggtcaat

SEQ ID NO: 529018 - DNA, 25 bp, Rattus norvegicus
gttgctcttctgagatatatcgggt

SEQ ID NO: 529019 - DNA, 25 bp, Rattus norvegicus
gttgctcttctgtgatatatcgggt

SEQ ID NO: 529020 - DNA, 25 bp, Rattus norvegicus
gttgctcttgttaccttttgtcata

SEQ ID NO: 529021 - DNA, 25 bp, Rattus norvegicus
gttgctcttgtttccttttgtcata

SEQ ID NO: 529022 - DNA, 25 bp, Rattus norvegicus
gttgctctttacattcttttcttaa

SEQ ID NO: 529023 - DNA, 25 bp, Rattus norvegicus
gttgctctttactttcttttcttaa

SEQ ID NO: 529024 - DNA, 25 bp, Rattus norvegicus
gttgctctttatccctttgtacaag

SEQ ID NO: 529025 - DNA, 25 bp, Rattus norvegicus
gttgctctttatgcctttgtacaag

SEQ ID NO: 529026 - DNA, 25 bp, Rattus norvegicus
gttgctgaaactcaagcggctctta

SEQ ID NO: 529027 - DNA, 25 bp, Rattus norvegicus
gttgctgaaactgaagcggctctta

SEQ ID NO: 529028 - DNA, 25 bp, Rattus norvegicus
gttgctgaacctcagattgccatgt

SEQ ID NO: 529029 - DNA, 25 bp, Rattus norvegicus
gttgctgaacctgagattgccatgt

SEQ ID NO: 529030 - DNA, 25 bp, Rattus norvegicus
gttgctgacgttcccacgctgtgag

SEQ ID NO: 529031 - DNA, 25 bp, Rattus norvegicus
gttgctgacgttgccacgctgtgag

SEQ ID NO: 529032 - DNA, 25 bp, Rattus norvegicus
gttgctgactagatttacctgtttt

SEQ ID NO: 529033 - DNA, 25 bp, Rattus norvegicus
gttgctgactagttttacctgtttt

SEQ ID NO: 529034 - DNA, 25 bp, Rattus norvegicus
gttgctgagggcagaggtccatcat

SEQ ID NO: 529035 - DNA, 25 bp, Rattus norvegicus
gttgctgagggctgaggtccatcat

SEQ ID NO: 529036 - DNA, 25 bp, Rattus norvegicus
gttgctgaggtcatcacaggtcaca

SEQ ID NO: 529037 - DNA, 25 bp, Rattus norvegicus
gttgctgaggtcttcacaggtcaca

SEQ ID NO: 529038 - DNA, 25 bp, Rattus norvegicus
gttgctgagttgattgtgctgccct

SEQ ID NO: 529039 - DNA, 25 bp, Rattus norvegicus
gttgctgagttgtttgtgctgccct

SEQ ID NO: 529040 - DNA, 25 bp, Rattus norvegicus
gttgctgattgtccaaaagggctat

SEQ ID NO: 529041 - DNA, 25 bp, Rattus norvegicus
gttgctgattgtgcaaaagggctat

SEQ ID NO: 529042 - DNA, 25 bp, Rattus norvegicus
gttgctgatttgaccatttctttcc

SEQ ID NO: 529043 - DNA, 25 bp, Rattus norvegicus
gttgctgatttgtccatttctttcc

SEQ ID NO: 529044 - DNA, 25 bp, Rattus norvegicus
gttgctgcaactctgcactgaacaa

SEQ ID NO: 529045 - DNA, 25 bp, Rattus norvegicus
gttgctgcaactgtgcactgaacaa

SEQ ID NO: 529046 - DNA, 25 bp, Rattus norvegicus
gttgctgcacttcgttcattctgaa

SEQ ID NO: 529047 - DNA, 25 bp, Rattus norvegicus
gttgctgcacttggttcattctgaa

SEQ ID NO: 529048 - DNA, 25 bp, Rattus norvegicus
gttgctgcattaacttctcttgtct

SEQ ID NO: 529049 - DNA, 25 bp, Rattus norvegicus
gttgctgcattatcttctcttgtct

SEQ ID NO: 529050 - DNA, 25 bp, Rattus norvegicus
gttgctgcatttccgaaacggcatg

SEQ ID NO: 529051 - DNA, 25 bp, Rattus norvegicus
gttgctgcatttgcgaaacggcatg

SEQ ID NO: 529052 - DNA, 25 bp, Rattus norvegicus
gttgctgccaataaccaagatgcta

SEQ ID NO: 529053 - DNA, 25 bp, Rattus norvegicus
gttgctgccaattaccaagatgcta

SEQ ID NO: 529054 - DNA, 25 bp, Rattus norvegicus
gttgctgccataatcttttgatgat

SEQ ID NO: 529055 - DNA, 25 bp, Rattus norvegicus
gttgctgccatacagtttgtggttt

SEQ ID NO: 529056 - DNA, 25 bp, Rattus norvegicus
gttgctgccatagagtttgtggttt

SEQ ID NO: 529057 - DNA, 25 bp, Rattus norvegicus
gttgctgccatattcttttgatgat

SEQ ID NO: 529058 - DNA, 25 bp, Rattus norvegicus
gttgctgccctgaacatggaatgtt

SEQ ID NO: 529059 - DNA, 25 bp, Rattus norvegicus
gttgctgccctgtacatggaatgtt

SEQ ID NO: 529060 - DNA, 25 bp, Rattus norvegicus
gttgctgctaatctgaagaaaccta

SEQ ID NO: 529061 - DNA, 25 bp, Rattus norvegicus
gttgctgctaatgtgaagaaaccta

SEQ ID NO: 529062 - DNA, 25 bp, Rattus norvegicus
gttgctgctactcctagcattgcag

SEQ ID NO: 529063 - DNA, 25 bp, Rattus norvegicus
gttgctgctactgctagcattgcag

SEQ ID NO: 529064 - DNA, 25 bp, Rattus norvegicus
gttgctgctagacttcagtgtactg

SEQ ID NO: 529065 - DNA, 25 bp, Rattus norvegicus
gttgctgctagagttcagtgtactg

SEQ ID NO: 529066 - DNA, 25 bp, Rattus norvegicus
gttgctgctcctcaaattcaagtga

SEQ ID NO: 529067 - DNA, 25 bp, Rattus norvegicus
gttgctgctcctgaaattcaagtga

SEQ ID NO: 529068 - DNA, 25 bp, Rattus norvegicus
gttgctgctgacaatgcctaagaaa

SEQ ID NO: 529069 - DNA, 25 bp, Rattus norvegicus
gttgctgctgactatgcctaagaaa

SEQ ID NO: 529070 - DNA, 25 bp, Rattus norvegicus
gttgctgctggaaatgctgaccttt

SEQ ID NO: 529071 - DNA, 25 bp, Rattus norvegicus
gttgctgctggatatgctgaccttt

SEQ ID NO: 529072 - DNA, 25 bp, Rattus norvegicus
gttgctgctgtgataaagtaatggg

SEQ ID NO: 529073 - DNA, 25 bp, Rattus norvegicus
gttgctgctgtgttaaagtaatggg

SEQ ID NO: 529074 - DNA, 25 bp, Rattus norvegicus
gttgctgctgttcatgcataacaca

SEQ ID NO: 529075 - DNA, 25 bp, Rattus norvegicus
gttgctgctgttgatgcataacaca

SEQ ID NO: 529076 - DNA, 25 bp, Rattus norvegicus
gttgctgcttacaccaagtttcagg

SEQ ID NO: 529077 - DNA, 25 bp, Rattus norvegicus
gttgctgcttactccaagtttcagg

SEQ ID NO: 529078 - DNA, 25 bp, Rattus norvegicus
gttgctgcttggatattgactggaa

SEQ ID NO: 529079 - DNA, 25 bp, Rattus norvegicus
gttgctgcttggttattgactggaa

SEQ ID NO: 529080 - DNA, 25 bp, Rattus norvegicus
gttgctgcttttcggtttttgataa

SEQ ID NO: 529081 - DNA, 25 bp, Rattus norvegicus
gttgctgcttttgggtttttgataa

SEQ ID NO: 529082 - DNA, 25 bp, Rattus norvegicus
gttgctggatctcctgtttgaagcg

SEQ ID NO: 529083 - DNA, 25 bp, Rattus norvegicus
gttgctggatctgctgtttgaagcg

SEQ ID NO: 529084 - DNA, 25 bp, Rattus norvegicus
gttgctggatttatgctctttccat

SEQ ID NO: 529085 - DNA, 25 bp, Rattus norvegicus
gttgctggatttcatggtgcctcac

SEQ ID NO: 529086 - DNA, 25 bp, Rattus norvegicus
gttgctggatttgatggtgcctcac

SEQ ID NO: 529087 - DNA, 25 bp, Rattus norvegicus
gttgctggatttttgctctttccat

SEQ ID NO: 529088 - DNA, 25 bp, Rattus norvegicus
gttgctggccatcagaagccatcag

SEQ ID NO: 529089 - DNA, 25 bp, Rattus norvegicus
gttgctggccatctagggcagacac

SEQ ID NO: 529090 - DNA, 25 bp, Rattus norvegicus
gttgctggccatgagaagccatcag

SEQ ID NO: 529091 - DNA, 25 bp, Rattus norvegicus
gttgctggccatgtagggcagacac

SEQ ID NO: 529092 - DNA, 25 bp, Rattus norvegicus
gttgctgggacacttctgaggactc

SEQ ID NO: 529093 - DNA, 25 bp, Rattus norvegicus
gttgctgggacagttctgaggactc

SEQ ID NO: 529094 - DNA, 25 bp, Rattus norvegicus
gttgctgggcagctagattctgctt

SEQ ID NO: 529095 - DNA, 25 bp, Rattus norvegicus
gttgctgggcaggtagattctgctt

SEQ ID NO: 529096 - DNA, 25 bp, Rattus norvegicus
gttgctgggcataccatctatttgg

SEQ ID NO: 529097 - DNA, 25 bp, Rattus norvegicus
gttgctgggcattccatctatttgg

SEQ ID NO: 529098 - DNA, 25 bp, Rattus norvegicus
gttgctgggtccacacatacagagg

SEQ ID NO: 529099 - DNA, 25 bp, Rattus norvegicus
gttgctgggtcctcacatacagagg

SEQ ID NO: 529100 - DNA, 25 bp, Rattus norvegicus
gttgctgggtggaaggaactccatc

SEQ ID NO: 529101 - DNA, 25 bp, Rattus norvegicus
gttgctgggtggtaggaactccatc

SEQ ID NO: 529102 - DNA, 25 bp, Rattus norvegicus
gttgctggttctcaataacaatgcc

SEQ ID NO: 529103 - DNA, 25 bp, Rattus norvegicus
gttgctggttctgaataacaatgcc

SEQ ID NO: 529104 - DNA, 25 bp, Rattus norvegicus
gttgctggttggattcatctctaat

SEQ ID NO: 529105 - DNA, 25 bp, Rattus norvegicus
gttgctggttggtttcatctctaat

SEQ ID NO: 529106 - DNA, 25 bp, Rattus norvegicus
gttgctgtaaacactcatagttgtc

SEQ ID NO: 529107 - DNA, 25 bp, Rattus norvegicus
gttgctgtaaactctcatagttgtc

SEQ ID NO: 529108 - DNA, 25 bp, Rattus norvegicus
gttgctgtacctatttctctggata

SEQ ID NO: 529109 - DNA, 25 bp, Rattus norvegicus
gttgctgtacctttttctctggata

SEQ ID NO: 529110 - DNA, 25 bp, Rattus norvegicus
gttgctgtacgcactgaacctgaag

SEQ ID NO: 529111 - DNA, 25 bp, Rattus norvegicus
gttgctgtacgctctgaacctgaag

SEQ ID NO: 529112 - DNA, 25 bp, Rattus norvegicus
gttgctgtactgatagtagctgctt

SEQ ID NO: 529113 - DNA, 25 bp, Rattus norvegicus
gttgctgtactgttagtagctgctt

SEQ ID NO: 529114 - DNA, 25 bp, Rattus norvegicus
gttgctgtcattccttgtcaagtgt

SEQ ID NO: 529115 - DNA, 25 bp, Rattus norvegicus
gttgctgtcattgcttgtcaagtgt

SEQ ID NO: 529116 - DNA, 25 bp, Rattus norvegicus
gttgctgtccagatcgaaatcgagt

SEQ ID NO: 529117 - DNA, 25 bp, Rattus norvegicus
gttgctgtccagttcgaaatcgagt

SEQ ID NO: 529118 - DNA, 25 bp, Rattus norvegicus
gttgctgtccttattcccagtaaaa

SEQ ID NO: 529119 - DNA, 25 bp, Rattus norvegicus
gttgctgtcctttttcccagtaaaa

SEQ ID NO: 529120 - DNA, 25 bp, Rattus norvegicus
gttgctgtgcgcattcaccttaaag

SEQ ID NO: 529121 - DNA, 25 bp, Rattus norvegicus
gttgctgtgcgctttcaccttaaag

SEQ ID NO: 529122 - DNA, 25 bp, Rattus norvegicus
gttgctgtgggcatcacgggaccca

SEQ ID NO: 529123 - DNA, 25 bp, Rattus norvegicus
gttgctgtgggcttcacgggaccca

SEQ ID NO: 529124 - DNA, 25 bp, Rattus norvegicus
gttgctgtggttcccggagttgcgg

SEQ ID NO: 529125 - DNA, 25 bp, Rattus norvegicus
gttgctgtggttgccggagttgcgg

SEQ ID NO: 529126 - DNA, 25 bp, Rattus norvegicus
gttgctgtgtaaatattgtcttgta

SEQ ID NO: 529127 - DNA, 25 bp, Rattus norvegicus
gttgctgtgtaattattgtcttgta

SEQ ID NO: 529128 - DNA, 25 bp, Rattus norvegicus
gttgctgtgtgtagaaggtctgaca

SEQ ID NO: 529129 - DNA, 25 bp, Rattus norvegicus
gttgctgtgtgttgaaggtctgaca

SEQ ID NO: 529130 - DNA, 25 bp, Rattus norvegicus
gttgctgtgttgactcctagcctga

SEQ ID NO: 529131 - DNA, 25 bp, Rattus norvegicus
gttgctgtgttgtctcctagcctga

SEQ ID NO: 529132 - DNA, 25 bp, Rattus norvegicus
gttgctgttagcatgtcctcaggat

SEQ ID NO: 529133 - DNA, 25 bp, Rattus norvegicus
gttgctgttagcttgtcctcaggat

SEQ ID NO: 529134 - DNA, 25 bp, Rattus norvegicus
gttgctgttattcttttgccttctt

SEQ ID NO: 529135 - DNA, 25 bp, Rattus norvegicus
gttgctgttattgttttgccttctt

SEQ ID NO: 529136 - DNA, 25 bp, Rattus norvegicus
gttgctgttgtaaataccttggtta

SEQ ID NO: 529137 - DNA, 25 bp, Rattus norvegicus
gttgctgttgtatataccttggtta

SEQ ID NO: 529138 - DNA, 25 bp, Rattus norvegicus
gttgctgttgtcaatgtacactcct

SEQ ID NO: 529139 - DNA, 25 bp, Rattus norvegicus
gttgctgttgtctatgtacactcct

SEQ ID NO: 529140 - DNA, 25 bp, Rattus norvegicus
gttgctgttgttcaagtgtcctgct

SEQ ID NO: 529141 - DNA, 25 bp, Rattus norvegicus
gttgctgttgttccacacatatgtg

SEQ ID NO: 529142 - DNA, 25 bp, Rattus norvegicus
gttgctgttgttcttcacattgagt

SEQ ID NO: 529143 - DNA, 25 bp, Rattus norvegicus
gttgctgttgttgaagtgtcctgct

SEQ ID NO: 529144 - DNA, 25 bp, Rattus norvegicus
gttgctgttgttgcacacatatgtg

SEQ ID NO: 529145 - DNA, 25 bp, Rattus norvegicus
gttgctgttgttgttcacattgagt

SEQ ID NO: 529146 - DNA, 25 bp, Rattus norvegicus
gttgctgtttcacactttgctttat

SEQ ID NO: 529147 - DNA, 25 bp, Rattus norvegicus
gttgctgtttcagactttgctttat

SEQ ID NO: 529148 - DNA, 25 bp, Rattus norvegicus
gttgctgttttgagcgtcagttctt

SEQ ID NO: 529149 - DNA, 25 bp, Rattus norvegicus
gttgctgttttgtgcgtcagttctt

SEQ ID NO: 529150 - DNA, 25 bp, Rattus norvegicus
gttgctgtttttacctttggagttg

SEQ ID NO: 529151 - DNA, 25 bp, Rattus norvegicus
gttgctgttttttcctttggagttg

SEQ ID NO: 529152 - DNA, 25 bp, Rattus norvegicus
gttgcttaaagtatgcagtaccctt

SEQ ID NO: 529153 - DNA, 25 bp, Rattus norvegicus
gttgcttaaagtttgcagtaccctt

SEQ ID NO: 529154 - DNA, 25 bp, Rattus norvegicus
gttgcttaactgatttatttgaagg

SEQ ID NO: 529155 - DNA, 25 bp, Rattus norvegicus
gttgcttaactgttttatttgaagg

SEQ ID NO: 529156 - DNA, 25 bp, Rattus norvegicus
gttgcttaatcgaataggttgtacc

SEQ ID NO: 529157 - DNA, 25 bp, Rattus norvegicus
gttgcttaatcgtataggttgtacc

SEQ ID NO: 529158 - DNA, 25 bp, Rattus norvegicus
gttgcttacaggcagtgacacagaa

SEQ ID NO: 529159 - DNA, 25 bp, Rattus norvegicus
gttgcttacagggagtgacacagaa

SEQ ID NO: 529160 - DNA, 25 bp, Rattus norvegicus
gttgcttacttcacgagagtcacct

SEQ ID NO: 529161 - DNA, 25 bp, Rattus norvegicus
gttgcttacttctcgagagtcacct

SEQ ID NO: 529162 - DNA, 25 bp, Rattus norvegicus
gttgcttagctgcacttcttcagaa

SEQ ID NO: 529163 - DNA, 25 bp, Rattus norvegicus
gttgcttagctggacttcttcagaa

SEQ ID NO: 529164 - DNA, 25 bp, Rattus norvegicus
gttgcttagcttatccaaaggtctg

SEQ ID NO: 529165 - DNA, 25 bp, Rattus norvegicus
gttgcttagcttttccaaaggtctg

SEQ ID NO: 529166 - DNA, 25 bp, Rattus norvegicus
gttgcttaggcaaatcttttgttct

SEQ ID NO: 529167 - DNA, 25 bp, Rattus norvegicus
gttgcttaggcatatcttttgttct

SEQ ID NO: 529168 - DNA, 25 bp, Rattus norvegicus
gttgcttataagatatccctctcca

SEQ ID NO: 529169 - DNA, 25 bp, Rattus norvegicus
gttgcttataagttatccctctcca

SEQ ID NO: 529170 - DNA, 25 bp, Rattus norvegicus
gttgcttatatcacagtcatgcccg

SEQ ID NO: 529171 - DNA, 25 bp, Rattus norvegicus
gttgcttatatctcagtcatgcccg

SEQ ID NO: 529172 - DNA, 25 bp, Rattus norvegicus
gttgcttatatgatggtgcctcaca

SEQ ID NO: 529173 - DNA, 25 bp, Rattus norvegicus
gttgcttatatgttggtgcctcaca

SEQ ID NO: 529174 - DNA, 25 bp, Rattus norvegicus
gttgcttatgtcactttggtggcca

SEQ ID NO: 529175 - DNA, 25 bp, Rattus norvegicus
gttgcttatgtctctttggtggcca

SEQ ID NO: 529176 - DNA, 25 bp, Rattus norvegicus
gttgcttattctaagcacgctgacc

SEQ ID NO: 529177 - DNA, 25 bp, Rattus norvegicus
gttgcttattcttagcacgctgacc

SEQ ID NO: 529178 - DNA, 25 bp, Rattus norvegicus
gttgcttatttacgcttctttccct

SEQ ID NO: 529179 - DNA, 25 bp, Rattus norvegicus
gttgcttatttaggcttctttccct

SEQ ID NO: 529180 - DNA, 25 bp, Rattus norvegicus
gttgcttcaaagatatcccaagagt

SEQ ID NO: 529181 - DNA, 25 bp, Rattus norvegicus
gttgcttcaaagttatcccaagagt

SEQ ID NO: 529182 - DNA, 25 bp, Rattus norvegicus
gttgcttcactcaccaagtctagat

SEQ ID NO: 529183 - DNA, 25 bp, Rattus norvegicus
gttgcttcactcctggactatgatt

SEQ ID NO: 529184 - DNA, 25 bp, Rattus norvegicus
gttgcttcactcgtggactatgatt

SEQ ID NO: 529185 - DNA, 25 bp, Rattus norvegicus
gttgcttcactctccaagtctagat

SEQ ID NO: 529186 - DNA, 25 bp, Rattus norvegicus
gttgcttcagaactgactttcccct

SEQ ID NO: 529187 - DNA, 25 bp, Rattus norvegicus
gttgcttcagaagtgactttcccct

SEQ ID NO: 529188 - DNA, 25 bp, Rattus norvegicus
gttgcttcagccaaaggagacagat

SEQ ID NO: 529189 - DNA, 25 bp, Rattus norvegicus
gttgcttcagcctaaggagacagat

SEQ ID NO: 529190 - DNA, 25 bp, Rattus norvegicus
gttgcttcccaaatttgatcacttt

SEQ ID NO: 529191 - DNA, 25 bp, Rattus norvegicus
gttgcttcccaattttgatcacttt

SEQ ID NO: 529192 - DNA, 25 bp, Rattus norvegicus
gttgcttcccttctacgtaacaggt

SEQ ID NO: 529193 - DNA, 25 bp, Rattus norvegicus
gttgcttcccttgtacgtaacaggt

SEQ ID NO: 529194 - DNA, 25 bp, Rattus norvegicus
gttgcttctcacatcgatgcagtgt

SEQ ID NO: 529195 - DNA, 25 bp, Rattus norvegicus
gttgcttctcacttcgatgcagtgt

SEQ ID NO: 529196 - DNA, 25 bp, Rattus norvegicus
gttgcttctccacgtcgctgtcttc

SEQ ID NO: 529197 - DNA, 25 bp, Rattus norvegicus
gttgcttctccaggtcgctgtcttc

SEQ ID NO: 529198 - DNA, 25 bp, Rattus norvegicus
gttgcttctgccaaccttataaata

SEQ ID NO: 529199 - DNA, 25 bp, Rattus norvegicus
gttgcttctgcctaccttataaata

SEQ ID NO: 529200 - DNA, 25 bp, Rattus norvegicus
gttgcttcttaaagagcttccagct

SEQ ID NO: 529201 - DNA, 25 bp, Rattus norvegicus
gttgcttcttaatgagcttccagct

SEQ ID NO: 529202 - DNA, 25 bp, Rattus norvegicus
gttgcttcttgtcctgttataattt

SEQ ID NO: 529203 - DNA, 25 bp, Rattus norvegicus
gttgcttcttgtgctgttataattt

SEQ ID NO: 529204 - DNA, 25 bp, Rattus norvegicus
gttgcttcttttcgccatacatcat

SEQ ID NO: 529205 - DNA, 25 bp, Rattus norvegicus
gttgcttcttttggccatacatcat

SEQ ID NO: 529206 - DNA, 25 bp, Rattus norvegicus
gttgcttgaatgatgatgtgcctca

SEQ ID NO: 529207 - DNA, 25 bp, Rattus norvegicus
gttgcttgaatgttgatgtgcctca

SEQ ID NO: 529208 - DNA, 25 bp, Rattus norvegicus
gttgcttgacaacaggctagccctt

SEQ ID NO: 529209 - DNA, 25 bp, Rattus norvegicus
gttgcttgacaagaggctagccctt

SEQ ID NO: 529210 - DNA, 25 bp, Rattus norvegicus
gttgcttgataactgggcctctgga

SEQ ID NO: 529211 - DNA, 25 bp, Rattus norvegicus
gttgcttgataagtgggcctctgga

SEQ ID NO: 529212 - DNA, 25 bp, Rattus norvegicus
gttgcttgatctactgttgacctaa

SEQ ID NO: 529213 - DNA, 25 bp, Rattus norvegicus
gttgcttgatcttctgttgacctaa

SEQ ID NO: 529214 - DNA, 25 bp, Rattus norvegicus
gttgcttgcataacttagctactgc

SEQ ID NO: 529215 - DNA, 25 bp, Rattus norvegicus
gttgcttgcatatcttagctactgc

SEQ ID NO: 529216 - DNA, 25 bp, Rattus norvegicus
gttgcttgcctgctttactgtgtac

SEQ ID NO: 529217 - DNA, 25 bp, Rattus norvegicus
gttgcttgcctggtttactgtgtac

SEQ ID NO: 529218 - DNA, 25 bp, Rattus norvegicus
gttgcttgctacacctaagaacata

SEQ ID NO: 529219 - DNA, 25 bp, Rattus norvegicus
gttgcttgctactcctaagaacata

SEQ ID NO: 529220 - DNA, 25 bp, Rattus norvegicus
gttgcttggactaaaccaggcatgt

SEQ ID NO: 529221 - DNA, 25 bp, Rattus norvegicus
gttgcttggacttaaccaggcatgt

SEQ ID NO: 529222 - DNA, 25 bp, Rattus norvegicus
gttgcttggcaaacctttgacttca

SEQ ID NO: 529223 - DNA, 25 bp, Rattus norvegicus
gttgcttggcaatcctttgacttca

SEQ ID NO: 529224 - DNA, 25 bp, Rattus norvegicus
gttgcttggtgtatccactattcta

SEQ ID NO: 529225 - DNA, 25 bp, Rattus norvegicus
gttgcttggtgtttccactattcta

SEQ ID NO: 529226 - DNA, 25 bp, Rattus norvegicus
gttgcttggttgatagactttcgtt

SEQ ID NO: 529227 - DNA, 25 bp, Rattus norvegicus
gttgcttggttgttagactttcgtt

SEQ ID NO: 529228 - DNA, 25 bp, Rattus norvegicus
gttgcttgtagacgctgggtttccc

SEQ ID NO: 529229 - DNA, 25 bp, Rattus norvegicus
gttgcttgtagaggctgggtttccc

SEQ ID NO: 529230 - DNA, 25 bp, Rattus norvegicus
gttgcttgtagcagtttctctccaa

SEQ ID NO: 529231 - DNA, 25 bp, Rattus norvegicus
gttgcttgtagctgtttctctccaa

SEQ ID NO: 529232 - DNA, 25 bp, Rattus norvegicus
gttgcttgtttgatgtcaggtcatg

SEQ ID NO: 529233 - DNA, 25 bp, Rattus norvegicus
gttgcttgtttgttgtcaggtcatg

SEQ ID NO: 529234 - DNA, 25 bp, Rattus norvegicus
gttgctttaataaacaggcccaagt

SEQ ID NO: 529235 - DNA, 25 bp, Rattus norvegicus
gttgctttaatatacaggcccaagt

SEQ ID NO: 529236 - DNA, 25 bp, Rattus norvegicus
gttgctttaatcaaatctttcctgt

SEQ ID NO: 529237 - DNA, 25 bp, Rattus norvegicus
gttgctttaatcagtgctcactgaa

SEQ ID NO: 529238 - DNA, 25 bp, Rattus norvegicus
gttgctttaatctaatctttcctgt

SEQ ID NO: 529239 - DNA, 25 bp, Rattus norvegicus
gttgctttaatctgtgctcactgaa

SEQ ID NO: 529240 - DNA, 25 bp, Rattus norvegicus
gttgctttactcagtcagtgactta

SEQ ID NO: 529241 - DNA, 25 bp, Rattus norvegicus
gttgctttactctgtcagtgactta

SEQ ID NO: 529242 - DNA, 25 bp, Rattus norvegicus
gttgctttactgacagcaggtgtcc

SEQ ID NO: 529243 - DNA, 25 bp, Rattus norvegicus
gttgctttactgtcagcaggtgtcc

SEQ ID NO: 529244 - DNA, 25 bp, Rattus norvegicus
gttgctttagtccttgtgttttatc

SEQ ID NO: 529245 - DNA, 25 bp, Rattus norvegicus
gttgctttagtcgttgtgttttatc

SEQ ID NO: 529246 - DNA, 25 bp, Rattus norvegicus
gttgctttatgtagacttcttttgg

SEQ ID NO: 529247 - DNA, 25 bp, Rattus norvegicus
gttgctttatgttgacttcttttgg

SEQ ID NO: 529248 - DNA, 25 bp, Rattus norvegicus
gttgctttccaaaaagcccaggaga

SEQ ID NO: 529249 - DNA, 25 bp, Rattus norvegicus
gttgctttccaataagcccaggaga

SEQ ID NO: 529250 - DNA, 25 bp, Rattus norvegicus
gttgctttcccaatcttgaattttg

SEQ ID NO: 529251 - DNA, 25 bp, Rattus norvegicus
gttgctttcccattcttgaattttg

SEQ ID NO: 529252 - DNA, 25 bp, Rattus norvegicus
gttgctttccctacatagtctttta

SEQ ID NO: 529253 - DNA, 25 bp, Rattus norvegicus
gttgctttcccttcatagtctttta

SEQ ID NO: 529254 - DNA, 25 bp, Rattus norvegicus
gttgctttcctcacagagtattaca

SEQ ID NO: 529255 - DNA, 25 bp, Rattus norvegicus
gttgctttcctctcagagtattaca

SEQ ID NO: 529256 - DNA, 25 bp, Rattus norvegicus
gttgctttcctgataccagatcgtt

SEQ ID NO: 529257 - DNA, 25 bp, Rattus norvegicus
gttgctttcctgttaccagatcgtt

SEQ ID NO: 529258 - DNA, 25 bp, Rattus norvegicus
gttgctttccttccatggtggctca

SEQ ID NO: 529259 - DNA, 25 bp, Rattus norvegicus
gttgctttccttgcatggtggctca

SEQ ID NO: 529260 - DNA, 25 bp, Rattus norvegicus
gttgctttctatattgtctcctgac

SEQ ID NO: 529261 - DNA, 25 bp, Rattus norvegicus
gttgctttctatctatagctcccta

SEQ ID NO: 529262 - DNA, 25 bp, Rattus norvegicus
gttgctttctatgtatagctcccta

SEQ ID NO: 529263 - DNA, 25 bp, Rattus norvegicus
gttgctttctattttgtctcctgac

SEQ ID NO: 529264 - DNA, 25 bp, Rattus norvegicus
gttgctttctcacggaggaccttaa

SEQ ID NO: 529265 - DNA, 25 bp, Rattus norvegicus
gttgctttctcagggaggaccttaa

SEQ ID NO: 529266 - DNA, 25 bp, Rattus norvegicus
gttgctttgcagctggactcagtaa

SEQ ID NO: 529267 - DNA, 25 bp, Rattus norvegicus
gttgctttgcaggtggactcagtaa

SEQ ID NO: 529268 - DNA, 25 bp, Rattus norvegicus
gttgctttgcccagtttcaacaagc

SEQ ID NO: 529269 - DNA, 25 bp, Rattus norvegicus
gttgctttgccctgtttcaacaagc

SEQ ID NO: 529270 - DNA, 25 bp, Rattus norvegicus
gttgctttgctcagatcctatttaa

SEQ ID NO: 529271 - DNA, 25 bp, Rattus norvegicus
gttgctttgctctgatcctatttaa

SEQ ID NO: 529272 - DNA, 25 bp, Rattus norvegicus
gttgctttgtccacaagtggacatg

SEQ ID NO: 529273 - DNA, 25 bp, Rattus norvegicus
gttgctttgtcctcaagtggacatg

SEQ ID NO: 529274 - DNA, 25 bp, Rattus norvegicus
gttgcttttaagacctttttctctg

SEQ ID NO: 529275 - DNA, 25 bp, Rattus norvegicus
gttgcttttaagtcctttttctctg

SEQ ID NO: 529276 - DNA, 25 bp, Rattus norvegicus
gttgcttttactaacatgcctctag

SEQ ID NO: 529277 - DNA, 25 bp, Rattus norvegicus
gttgcttttacttacatgcctctag

SEQ ID NO: 529278 - DNA, 25 bp, Rattus norvegicus
gttgcttttagaattccatgctgaa

SEQ ID NO: 529279 - DNA, 25 bp, Rattus norvegicus
gttgcttttagatttccatgctgaa

SEQ ID NO: 529280 - DNA, 25 bp, Rattus norvegicus
gttgcttttagtcatcaggctgcca

SEQ ID NO: 529281 - DNA, 25 bp, Rattus norvegicus
gttgcttttagtgatcaggctgcca

SEQ ID NO: 529282 - DNA, 25 bp, Rattus norvegicus
gttgcttttatacaggatccaggtt

SEQ ID NO: 529283 - DNA, 25 bp, Rattus norvegicus
gttgcttttatagaggatccaggtt

SEQ ID NO: 529284 - DNA, 25 bp, Rattus norvegicus
gttgcttttcacaccacagaaacca

SEQ ID NO: 529285 - DNA, 25 bp, Rattus norvegicus
gttgcttttcactccacagaaacca

SEQ ID NO: 529286 - DNA, 25 bp, Rattus norvegicus
gttgcttttcctcagcaggatggga

SEQ ID NO: 529287 - DNA, 25 bp, Rattus norvegicus
gttgcttttcctgagcaggatggga

SEQ ID NO: 529288 - DNA, 25 bp, Rattus norvegicus
gttgcttttcgcacatgtagtactg

SEQ ID NO: 529289 - DNA, 25 bp, Rattus norvegicus
gttgcttttcgctcatgtagtactg

SEQ ID NO: 529290 - DNA, 25 bp, Rattus norvegicus
gttgcttttctgattgccatagtca

SEQ ID NO: 529291 - DNA, 25 bp, Rattus norvegicus
gttgcttttctgtttgccatagtca

SEQ ID NO: 529292 - DNA, 25 bp, Rattus norvegicus
gttgcttttgtaagtttcttccttt

SEQ ID NO: 529293 - DNA, 25 bp, Rattus norvegicus
gttgcttttgtatgtttcttccttt

SEQ ID NO: 529294 - DNA, 25 bp, Rattus norvegicus
gttgctttttgtctcctccaatagc

SEQ ID NO: 529295 - DNA, 25 bp, Rattus norvegicus
gttgctttttgtgtcctccaatagc

SEQ ID NO: 529296 - DNA, 25 bp, Rattus norvegicus
gttggaaaacatcagcactctcatc

SEQ ID NO: 529297 - DNA, 25 bp, Rattus norvegicus
gttggaaaacatgagcactctcatc

SEQ ID NO: 529298 - DNA, 25 bp, Rattus norvegicus
gttggaaacaaaacacagctcgcat

SEQ ID NO: 529299 - DNA, 25 bp, Rattus norvegicus
gttggaaacaaatcacagctcgcat

SEQ ID NO: 529300 - DNA, 25 bp, Rattus norvegicus
gttggaaacagtagtcttcggcgtt

SEQ ID NO: 529301 - DNA, 25 bp, Rattus norvegicus
gttggaaacagttgtcttcggcgtt

SEQ ID NO: 529302 - DNA, 25 bp, Rattus norvegicus
gttggaaacctcctctgtgcagaga

SEQ ID NO: 529303 - DNA, 25 bp, Rattus norvegicus
gttggaaacctcgtctgtgcagaga

SEQ ID NO: 529304 - DNA, 25 bp, Rattus norvegicus
gttggaaacgtacctgcaaggccga

SEQ ID NO: 529305 - DNA, 25 bp, Rattus norvegicus
gttggaaacgtagctgcaaggccga

SEQ ID NO: 529306 - DNA, 25 bp, Rattus norvegicus
gttggaaatcatactcctccaggct

SEQ ID NO: 529307 - DNA, 25 bp, Rattus norvegicus
gttggaaatcattctcctccaggct

SEQ ID NO: 529308 - DNA, 25 bp, Rattus norvegicus
gttggaaatgatatacatgtcagtt

SEQ ID NO: 529309 - DNA, 25 bp, Rattus norvegicus
gttggaaatgatttacatgtcagtt

SEQ ID NO: 529310 - DNA, 25 bp, Rattus norvegicus
gttggaacacaaagtctaagatcag

SEQ ID NO: 529311 - DNA, 25 bp, Rattus norvegicus
gttggaacacaatgtctaagatcag

SEQ ID NO: 529312 - DNA, 25 bp, Rattus norvegicus
gttggaacacagcatcgaggtaacc

SEQ ID NO: 529313 - DNA, 25 bp, Rattus norvegicus
gttggaacacaggatcgaggtaacc

SEQ ID NO: 529314 - DNA, 25 bp, Rattus norvegicus
gttggaaccactcaggctgcaagaa

SEQ ID NO: 529315 - DNA, 25 bp, Rattus norvegicus
gttggaaccactgaggctgcaagaa

SEQ ID NO: 529316 - DNA, 25 bp, Rattus norvegicus
gttggaacctacaacgagcccaggt

SEQ ID NO: 529317 - DNA, 25 bp, Rattus norvegicus
gttggaacctactacgagcccaggt

SEQ ID NO: 529318 - DNA, 25 bp, Rattus norvegicus
gttggaactgaacctgggcaccagc

SEQ ID NO: 529319 - DNA, 25 bp, Rattus norvegicus
gttggaactgaagctgggcaccagc

SEQ ID NO: 529320 - DNA, 25 bp, Rattus norvegicus
gttggaagagtcattgagaagccca

SEQ ID NO: 529321 - DNA, 25 bp, Rattus norvegicus
gttggaagagtctttgagaagccca

SEQ ID NO: 529322 - DNA, 25 bp, Rattus norvegicus
gttggaagccagagagcctcagagc

SEQ ID NO: 529323 - DNA, 25 bp, Rattus norvegicus
gttggaagccagtgagcctcagagc

SEQ ID NO: 529324 - DNA, 25 bp, Rattus norvegicus
gttggaagctggagctgaccccaat

SEQ ID NO: 529325 - DNA, 25 bp, Rattus norvegicus
gttggaagctggtgctgaccccaat

SEQ ID NO: 529326 - DNA, 25 bp, Rattus norvegicus
gttggaaggattacccttgctgacc

SEQ ID NO: 529327 - DNA, 25 bp, Rattus norvegicus
gttggaaggatttcccttgctgacc

SEQ ID NO: 529328 - DNA, 25 bp, Rattus norvegicus
gttggaagtctaatactggcagctc

SEQ ID NO: 529329 - DNA, 25 bp, Rattus norvegicus
gttggaagtctattactggcagctc

SEQ ID NO: 529330 - DNA, 25 bp, Rattus norvegicus
gttggaagttccagaatcgctccag

SEQ ID NO: 529331 - DNA, 25 bp, Rattus norvegicus
gttggaagttcctgaatcgctccag

SEQ ID NO: 529332 - DNA, 25 bp, Rattus norvegicus
gttggaatcacgactcgacgcatgt

SEQ ID NO: 529333 - DNA, 25 bp, Rattus norvegicus
gttggaatcacgtctcgacgcatgt

SEQ ID NO: 529334 - DNA, 25 bp, Rattus norvegicus
gttggaattattacctgtcccattc

SEQ ID NO: 529335 - DNA, 25 bp, Rattus norvegicus
gttggaattatttcctgtcccattc

SEQ ID NO: 529336 - DNA, 25 bp, Rattus norvegicus
gttggacaaaacacgcagctggcgt

SEQ ID NO: 529337 - DNA, 25 bp, Rattus norvegicus
gttggacaaaactcgcagctggcgt

SEQ ID NO: 529338 - DNA, 25 bp, Rattus norvegicus
gttggacaaacacaccagctgctgc

SEQ ID NO: 529339 - DNA, 25 bp, Rattus norvegicus
gttggacaaacagaccagctgctgc

SEQ ID NO: 529340 - DNA, 25 bp, Rattus norvegicus
gttggacaacagagcacttttggtg

SEQ ID NO: 529341 - DNA, 25 bp, Rattus norvegicus
gttggacaacagtgcacttttggtg

SEQ ID NO: 529342 - DNA, 25 bp, Rattus norvegicus
gttggacaatacatctctcatctga

SEQ ID NO: 529343 - DNA, 25 bp, Rattus norvegicus
gttggacaatacttctctcatctga

SEQ ID NO: 529344 - DNA, 25 bp, Rattus norvegicus
gttggacaatctcaagtcacttctt

SEQ ID NO: 529345 - DNA, 25 bp, Rattus norvegicus
gttggacaatctgaagtcacttctt

SEQ ID NO: 529346 - DNA, 25 bp, Rattus norvegicus
gttggacacatcagtcttgccaaat

SEQ ID NO: 529347 - DNA, 25 bp, Rattus norvegicus
gttggacacatctgtcttgccaaat

SEQ ID NO: 529348 - DNA, 25 bp, Rattus norvegicus
gttggacaccgcatcattgaggtca

SEQ ID NO: 529349 - DNA, 25 bp, Rattus norvegicus
gttggacaccgcttcattgaggtca

SEQ ID NO: 529350 - DNA, 25 bp, Rattus norvegicus
gttggacactacactatggatttgc

SEQ ID NO: 529351 - DNA, 25 bp, Rattus norvegicus
gttggacactactctatggatttgc

SEQ ID NO: 529352 - DNA, 25 bp, Rattus norvegicus
gttggacactctcggcaaacttact

SEQ ID NO: 529353 - DNA, 25 bp, Rattus norvegicus
gttggacactctgggcaaacttact

SEQ ID NO: 529354 - DNA, 25 bp, Rattus norvegicus
gttggacagccccaggtgactgctt

SEQ ID NO: 529355 - DNA, 25 bp, Rattus norvegicus
gttggacagcccgaggtgactgctt

SEQ ID NO: 529356 - DNA, 25 bp, Rattus norvegicus
gttggacagtgcagaatccccaaat

SEQ ID NO: 529357 - DNA, 25 bp, Rattus norvegicus
gttggacagtgctgaatccccaaat

SEQ ID NO: 529358 - DNA, 25 bp, Rattus norvegicus
gttggacagtttcccttaaagcgac

SEQ ID NO: 529359 - DNA, 25 bp, Rattus norvegicus
gttggacagtttgccttaaagcgac

SEQ ID NO: 529360 - DNA, 25 bp, Rattus norvegicus
gttggacattatatcttcagtattt

SEQ ID NO: 529361 - DNA, 25 bp, Rattus norvegicus
gttggacattatttcttcagtattt

SEQ ID NO: 529362 - DNA, 25 bp, Rattus norvegicus
gttggacattgtatcacacatacat

SEQ ID NO: 529363 - DNA, 25 bp, Rattus norvegicus
gttggacattgtttcacacatacat

SEQ ID NO: 529364 - DNA, 25 bp, Rattus norvegicus
gttggaccaagtcatgacacccctc

SEQ ID NO: 529365 - DNA, 25 bp, Rattus norvegicus
gttggaccaagtgatgacacccctc

SEQ ID NO: 529366 - DNA, 25 bp, Rattus norvegicus
gttggaccacctacaggttcagcaa

SEQ ID NO: 529367 - DNA, 25 bp, Rattus norvegicus
gttggaccaccttcaggttcagcaa

SEQ ID NO: 529368 - DNA, 25 bp, Rattus norvegicus
gttggaccagacaggatgttctctc

SEQ ID NO: 529369 - DNA, 25 bp, Rattus norvegicus
gttggaccagactggatgttctctc

SEQ ID NO: 529370 - DNA, 25 bp, Rattus norvegicus
gttggaccatagcacacaaggctgt

SEQ ID NO: 529371 - DNA, 25 bp, Rattus norvegicus
gttggaccataggacacaaggctgt

SEQ ID NO: 529372 - DNA, 25 bp, Rattus norvegicus
gttggacccaacatgctaatggaga

SEQ ID NO: 529373 - DNA, 25 bp, Rattus norvegicus
gttggacccaacttgctaatggaga

SEQ ID NO: 529374 - DNA, 25 bp, Rattus norvegicus
gttggaccgaagctcagctcttgga

SEQ ID NO: 529375 - DNA, 25 bp, Rattus norvegicus
gttggaccgaaggtcagctcttgga

SEQ ID NO: 529376 - DNA, 25 bp, Rattus norvegicus
gttggacctattctagtcactgtaa

SEQ ID NO: 529377 - DNA, 25 bp, Rattus norvegicus
gttggacctattgtagtcactgtaa

SEQ ID NO: 529378 - DNA, 25 bp, Rattus norvegicus
gttggacctgtgatgaaagtttctg

SEQ ID NO: 529379 - DNA, 25 bp, Rattus norvegicus
gttggacctgtgttgaaagtttctg

SEQ ID NO: 529380 - DNA, 25 bp, Rattus norvegicus
gttggaccttctctaaacatgtgga

SEQ ID NO: 529381 - DNA, 25 bp, Rattus norvegicus
gttggaccttctgtaaacatgtgga

SEQ ID NO: 529382 - DNA, 25 bp, Rattus norvegicus
gttggacgcaggagattggctccta

SEQ ID NO: 529383 - DNA, 25 bp, Rattus norvegicus
gttggacgcaggtgattggctccta

SEQ ID NO: 529384 - DNA, 25 bp, Rattus norvegicus
gttggacgctctcagagtgatccgc

SEQ ID NO: 529385 - DNA, 25 bp, Rattus norvegicus
gttggacgctctgagagtgatccgc

SEQ ID NO: 529386 - DNA, 25 bp, Rattus norvegicus
gttggacggttgactccagattgga

SEQ ID NO: 529387 - DNA, 25 bp, Rattus norvegicus
gttggacggttgtctccagattgga

SEQ ID NO: 529388 - DNA, 25 bp, Rattus norvegicus
gttggactaattcatgcttcataat

SEQ ID NO: 529389 - DNA, 25 bp, Rattus norvegicus
gttggactaattgatgcttcataat

SEQ ID NO: 529390 - DNA, 25 bp, Rattus norvegicus
gttggactatttaggacctggacat

SEQ ID NO: 529391 - DNA, 25 bp, Rattus norvegicus
gttggactattttggacctggacat

SEQ ID NO: 529392 - DNA, 25 bp, Rattus norvegicus
gttggactcacacaagcggcgccgt

SEQ ID NO: 529393 - DNA, 25 bp, Rattus norvegicus
gttggactcacagaagcggcgccgt

SEQ ID NO: 529394 - DNA, 25 bp, Rattus norvegicus
gttggactctctcatcaaggctacg

SEQ ID NO: 529395 - DNA, 25 bp, Rattus norvegicus
gttggactctctgatcaaggctacg

SEQ ID NO: 529396 - DNA, 25 bp, Rattus norvegicus
gttggactggccattgttacaccat

SEQ ID NO: 529397 - DNA, 25 bp, Rattus norvegicus
gttggactggcctttgttacaccat

SEQ ID NO: 529398 - DNA, 25 bp, Rattus norvegicus
gttggactgttacgatccgacttta

SEQ ID NO: 529399 - DNA, 25 bp, Rattus norvegicus
gttggactgttaggatccgacttta

SEQ ID NO: 529400 - DNA, 25 bp, Rattus norvegicus
gttggacttcaaccgcaaagcacga

SEQ ID NO: 529401 - DNA, 25 bp, Rattus norvegicus
gttggacttcaagcgcaaagcacga

SEQ ID NO: 529402 - DNA, 25 bp, Rattus norvegicus
gttggacttgcacatcacaccactg

SEQ ID NO: 529403 - DNA, 25 bp, Rattus norvegicus
gttggacttgcagatcacaccactg

SEQ ID NO: 529404 - DNA, 25 bp, Rattus norvegicus
gttggacttgtcctcctggtatcaa

SEQ ID NO: 529405 - DNA, 25 bp, Rattus norvegicus
gttggacttgtcgtcctggtatcaa

SEQ ID NO: 529406 - DNA, 25 bp, Rattus norvegicus
gttggagaaactatgcacaagacaa

SEQ ID NO: 529407 - DNA, 25 bp, Rattus norvegicus
gttggagaaactttgcacaagacaa

SEQ ID NO: 529408 - DNA, 25 bp, Rattus norvegicus
gttggagaaataccaccagcccatc

SEQ ID NO: 529409 - DNA, 25 bp, Rattus norvegicus
gttggagaaatagcaccagcccatc

SEQ ID NO: 529410 - DNA, 25 bp, Rattus norvegicus
gttggagaacgtagctgctgctgct

SEQ ID NO: 529411 - DNA, 25 bp, Rattus norvegicus
gttggagaacgttgctgctgctgct

SEQ ID NO: 529412 - DNA, 25 bp, Rattus norvegicus
gttggagaactacatggaccccatg

SEQ ID NO: 529413 - DNA, 25 bp, Rattus norvegicus
gttggagaactagatggaccccatg

SEQ ID NO: 529414 - DNA, 25 bp, Rattus norvegicus
gttggagacaatcactggctgtatt

SEQ ID NO: 529415 - DNA, 25 bp, Rattus norvegicus
gttggagacaatgactggctgtatt

SEQ ID NO: 529416 - DNA, 25 bp, Rattus norvegicus
gttggagacattccagatcactcag

SEQ ID NO: 529417 - DNA, 25 bp, Rattus norvegicus
gttggagacattgcagatcactcag

SEQ ID NO: 529418 - DNA, 25 bp, Rattus norvegicus
gttggagacgcacctcatcaggtaa

SEQ ID NO: 529419 - DNA, 25 bp, Rattus norvegicus
gttggagacgcagctcatcaggtaa

SEQ ID NO: 529420 - DNA, 25 bp, Rattus norvegicus
gttggagacttacctccggacttgc

SEQ ID NO: 529421 - DNA, 25 bp, Rattus norvegicus
gttggagacttagctccggacttgc

SEQ ID NO: 529422 - DNA, 25 bp, Rattus norvegicus
gttggagagaaactgctacaagcaa

SEQ ID NO: 529423 - DNA, 25 bp, Rattus norvegicus
gttggagagaaagtgctacaagcaa

SEQ ID NO: 529424 - DNA, 25 bp, Rattus norvegicus
gttggagagaccagcaaggttcccc

SEQ ID NO: 529425 - DNA, 25 bp, Rattus norvegicus
gttggagagacctgcaaggttcccc

SEQ ID NO: 529426 - DNA, 25 bp, Rattus norvegicus
gttggagaggaactctcctgcctgt

SEQ ID NO: 529427 - DNA, 25 bp, Rattus norvegicus
gttggagaggaagtctcctgcctgt

SEQ ID NO: 529428 - DNA, 25 bp, Rattus norvegicus
gttggagattccagacctatttccc

SEQ ID NO: 529429 - DNA, 25 bp, Rattus norvegicus
gttggagattcctgacctatttccc

SEQ ID NO: 529430 - DNA, 25 bp, Rattus norvegicus
gttggagcaagtacttctctgtctc

SEQ ID NO: 529431 - DNA, 25 bp, Rattus norvegicus
gttggagcaagttcttctctgtctc

SEQ ID NO: 529432 - DNA, 25 bp, Rattus norvegicus
gttggagcacgacctggccatcaaa

SEQ ID NO: 529433 - DNA, 25 bp, Rattus norvegicus
gttggagcacgagctggccatcaaa

SEQ ID NO: 529434 - DNA, 25 bp, Rattus norvegicus
gttggagcactgcaatctgttattt

SEQ ID NO: 529435 - DNA, 25 bp, Rattus norvegicus
gttggagcactggaatctgttattt

SEQ ID NO: 529436 - DNA, 25 bp, Rattus norvegicus
gttggagcattgaccatgtcaccac

SEQ ID NO: 529437 - DNA, 25 bp, Rattus norvegicus
gttggagcattgtccatgtcaccac

SEQ ID NO: 529438 - DNA, 25 bp, Rattus norvegicus
gttggagccaacattcacaagcaga

SEQ ID NO: 529439 - DNA, 25 bp, Rattus norvegicus
gttggagccaactttcacaagcaga

SEQ ID NO: 529440 - DNA, 25 bp, Rattus norvegicus
gttggagccaggaactctttagtgt

SEQ ID NO: 529441 - DNA, 25 bp, Rattus norvegicus
gttggagccaggtactctttagtgt

SEQ ID NO: 529442 - DNA, 25 bp, Rattus norvegicus
gttggagccttacttacaccacatg

SEQ ID NO: 529443 - DNA, 25 bp, Rattus norvegicus
gttggagccttagttacaccacatg

SEQ ID NO: 529444 - DNA, 25 bp, Rattus norvegicus
gttggagcgactcggtactgtcccc

SEQ ID NO: 529445 - DNA, 25 bp, Rattus norvegicus
gttggagcgactgggtactgtcccc

SEQ ID NO: 529446 - DNA, 25 bp, Rattus norvegicus
gttggagcgttgaactcaaacccta

SEQ ID NO: 529447 - DNA, 25 bp, Rattus norvegicus
gttggagcgttgtactcaaacccta

SEQ ID NO: 529448 - DNA, 25 bp, Rattus norvegicus
gttggagctcatcaatcagctggat

SEQ ID NO: 529449 - DNA, 25 bp, Rattus norvegicus
gttggagctcatgaatcagctggat

SEQ ID NO: 529450 - DNA, 25 bp, Rattus norvegicus
gttggagctctgatctcttgagttc

SEQ ID NO: 529451 - DNA, 25 bp, Rattus norvegicus
gttggagctctgttctcttgagttc

SEQ ID NO: 529452 - DNA, 25 bp, Rattus norvegicus
gttggaggaatcacttcctcactac

SEQ ID NO: 529453 - DNA, 25 bp, Rattus norvegicus
gttggaggaatctcttcctcactac

SEQ ID NO: 529454 - DNA, 25 bp, Rattus norvegicus
gttggaggaggtacttacccagctg

SEQ ID NO: 529455 - DNA, 25 bp, Rattus norvegicus
gttggaggaggttcttacccagctg

SEQ ID NO: 529456 - DNA, 25 bp, Rattus norvegicus
gttggaggcaagagacatggctctc

SEQ ID NO: 529457 - DNA, 25 bp, Rattus norvegicus
gttggaggcaagtgacatggctctc

SEQ ID NO: 529458 - DNA, 25 bp, Rattus norvegicus
gttggaggcactcgaaacttctggc

SEQ ID NO: 529459 - DNA, 25 bp, Rattus norvegicus
gttggaggcactggaaacttctggc

SEQ ID NO: 529460 - DNA, 25 bp, Rattus norvegicus
gttggaggcatgaccttgctgccaa

SEQ ID NO: 529461 - DNA, 25 bp, Rattus norvegicus
gttggaggcatgtccttgctgccaa

SEQ ID NO: 529462 - DNA, 25 bp, Rattus norvegicus
gttggaggcctcatgtaatccatta

SEQ ID NO: 529463 - DNA, 25 bp, Rattus norvegicus
gttggaggcctcttgtaatccatta

SEQ ID NO: 529464 - DNA, 25 bp, Rattus norvegicus
gttggaggctacaggacgtctcaaa

SEQ ID NO: 529465 - DNA, 25 bp, Rattus norvegicus
gttggaggctactggacgtctcaaa

SEQ ID NO: 529466 - DNA, 25 bp, Rattus norvegicus
gttggagggctacataaggacacta

SEQ ID NO: 529467 - DNA, 25 bp, Rattus norvegicus
gttggagggctagataaggacacta

SEQ ID NO: 529468 - DNA, 25 bp, Rattus norvegicus
gttggaggttatcaaggaagacacc

SEQ ID NO: 529469 - DNA, 25 bp, Rattus norvegicus
gttggaggttatgaaggaagacacc

SEQ ID NO: 529470 - DNA, 25 bp, Rattus norvegicus
gttggagtctttctctgtacaggaa

SEQ ID NO: 529471 - DNA, 25 bp, Rattus norvegicus
gttggagtctttgtctgtacaggaa

SEQ ID NO: 529472 - DNA, 25 bp, Rattus norvegicus
gttggagttggactacaggtatcta

SEQ ID NO: 529473 - DNA, 25 bp, Rattus norvegicus
gttggagttggagtacaggtatcta

SEQ ID NO: 529474 - DNA, 25 bp, Rattus norvegicus
gttggagtttctcggcaacatattg

SEQ ID NO: 529475 - DNA, 25 bp, Rattus norvegicus
gttggagtttctgggcaacatattg

SEQ ID NO: 529476 - DNA, 25 bp, Rattus norvegicus
gttggataaccacccagctcttcag

SEQ ID NO: 529477 - DNA, 25 bp, Rattus norvegicus
gttggataaccagccagctcttcag

SEQ ID NO: 529478 - DNA, 25 bp, Rattus norvegicus
gttggatagagcattggacgccttg

SEQ ID NO: 529479 - DNA, 25 bp, Rattus norvegicus
gttggatagagctttggacgccttg

SEQ ID NO: 529480 - DNA, 25 bp, Rattus norvegicus
gttggatagctaaacccttctgtta

SEQ ID NO: 529481 - DNA, 25 bp, Rattus norvegicus
gttggatagctatacccttctgtta

SEQ ID NO: 529482 - DNA, 25 bp, Rattus norvegicus
gttggatatccaaacgtctgaaaat

SEQ ID NO: 529483 - DNA, 25 bp, Rattus norvegicus
gttggatatccatacgtctgaaaat

SEQ ID NO: 529484 - DNA, 25 bp, Rattus norvegicus
gttggatatttcacttgcgttcctc

SEQ ID NO: 529485 - DNA, 25 bp, Rattus norvegicus
gttggatatttctcttgcgttcctc

SEQ ID NO: 529486 - DNA, 25 bp, Rattus norvegicus
gttggatcagatcaactcttgtctg

SEQ ID NO: 529487 - DNA, 25 bp, Rattus norvegicus
gttggatcagatgaactcttgtctg

SEQ ID NO: 529488 - DNA, 25 bp, Rattus norvegicus
gttggatcagcccatgacagagatt

SEQ ID NO: 529489 - DNA, 25 bp, Rattus norvegicus
gttggatcagccgatgacagagatt

SEQ ID NO: 529490 - DNA, 25 bp, Rattus norvegicus
gttggatcaggaagccaagcttaaa

SEQ ID NO: 529491 - DNA, 25 bp, Rattus norvegicus
gttggatcaggatgccaagcttaaa

SEQ ID NO: 529492 - DNA, 25 bp, Rattus norvegicus
gttggatcaggcctgaacccgtcca

SEQ ID NO: 529493 - DNA, 25 bp, Rattus norvegicus
gttggatcaggcgtgaacccgtcca

SEQ ID NO: 529494 - DNA, 25 bp, Rattus norvegicus
gttggatccagcactagtcacaaac

SEQ ID NO: 529495 - DNA, 25 bp, Rattus norvegicus
gttggatccagctctagtcacaaac

SEQ ID NO: 529496 - DNA, 25 bp, Rattus norvegicus
gttggatctcccagagctgcagtta

SEQ ID NO: 529497 - DNA, 25 bp, Rattus norvegicus
gttggatctccctgagctgcagtta

SEQ ID NO: 529498 - DNA, 25 bp, Rattus norvegicus
gttggatgacaacacctcttgaaaa

SEQ ID NO: 529499 - DNA, 25 bp, Rattus norvegicus
gttggatgacaagacctcttgaaaa

SEQ ID NO: 529500 - DNA, 25 bp, Rattus norvegicus
gttggatgccatacactcggaggtg

SEQ ID NO: 529501 - DNA, 25 bp, Rattus norvegicus
gttggatgccattcactcggaggtg

SEQ ID NO: 529502 - DNA, 25 bp, Rattus norvegicus
gttggatggagcagccctgagcctt

SEQ ID NO: 529503 - DNA, 25 bp, Rattus norvegicus
gttggatggagctgccctgagcctt

SEQ ID NO: 529504 - DNA, 25 bp, Rattus norvegicus
gttggatggatcatcagccctggaa

SEQ ID NO: 529505 - DNA, 25 bp, Rattus norvegicus
gttggatggatcttcagccctggaa

SEQ ID NO: 529506 - DNA, 25 bp, Rattus norvegicus
gttggatggattcccgatgcagcac

SEQ ID NO: 529507 - DNA, 25 bp, Rattus norvegicus
gttggatggattgccgatgcagcac

SEQ ID NO: 529508 - DNA, 25 bp, Rattus norvegicus
gttggatgtagtatcccttagaaag

SEQ ID NO: 529509 - DNA, 25 bp, Rattus norvegicus
gttggatgtagtttcccttagaaag

SEQ ID NO: 529510 - DNA, 25 bp, Rattus norvegicus
gttggatgtgggaacctcagaactg

SEQ ID NO: 529511 - DNA, 25 bp, Rattus norvegicus
gttggatgtgggtacctcagaactg

SEQ ID NO: 529512 - DNA, 25 bp, Rattus norvegicus
gttggatgttgtcaaatggcctctc

SEQ ID NO: 529513 - DNA, 25 bp, Rattus norvegicus
gttggatgttgtgaaatggcctctc

SEQ ID NO: 529514 - DNA, 25 bp, Rattus norvegicus
gttggattacatacttttgctttta

SEQ ID NO: 529515 - DNA, 25 bp, Rattus norvegicus
gttggattacattcttttgctttta

SEQ ID NO: 529516 - DNA, 25 bp, Rattus norvegicus
gttggattatgtaacttttcctaag

SEQ ID NO: 529517 - DNA, 25 bp, Rattus norvegicus
gttggattatgttacttttcctaag

SEQ ID NO: 529518 - DNA, 25 bp, Rattus norvegicus
gttggattcactatagctcttccgc

SEQ ID NO: 529519 - DNA, 25 bp, Rattus norvegicus
gttggattcactttagctcttccgc

SEQ ID NO: 529520 - DNA, 25 bp, Rattus norvegicus
gttggattcgctactttccagtata

SEQ ID NO: 529521 - DNA, 25 bp, Rattus norvegicus
gttggattcgcttctttccagtata

SEQ ID NO: 529522 - DNA, 25 bp, Rattus norvegicus
gttggattctcaccactctttttgg

SEQ ID NO: 529523 - DNA, 25 bp, Rattus norvegicus
gttggattctcagcactctttttgg

SEQ ID NO: 529524 - DNA, 25 bp, Rattus norvegicus
gttggattgcttcttcacacagagg

SEQ ID NO: 529525 - DNA, 25 bp, Rattus norvegicus
gttggattgcttgttcacacagagg

SEQ ID NO: 529526 - DNA, 25 bp, Rattus norvegicus
gttggattggaccaaggagcttcca

SEQ ID NO: 529527 - DNA, 25 bp, Rattus norvegicus
gttggattggacgaaggagcttcca

SEQ ID NO: 529528 - DNA, 25 bp, Rattus norvegicus
gttggatttacaaacctgacactac

SEQ ID NO: 529529 - DNA, 25 bp, Rattus norvegicus
gttggatttacatacctgacactac

SEQ ID NO: 529530 - DNA, 25 bp, Rattus norvegicus
gttggatttacgactgtcccttgca

SEQ ID NO: 529531 - DNA, 25 bp, Rattus norvegicus
gttggatttacgtctgtcccttgca

SEQ ID NO: 529532 - DNA, 25 bp, Rattus norvegicus
gttggatttcataaagtgactggat

SEQ ID NO: 529533 - DNA, 25 bp, Rattus norvegicus
gttggatttcattaagtgactggat

SEQ ID NO: 529534 - DNA, 25 bp, Rattus norvegicus
gttggatttgcaaactggaggaatt

SEQ ID NO: 529535 - DNA, 25 bp, Rattus norvegicus
gttggatttgcatactggaggaatt

SEQ ID NO: 529536 - DNA, 25 bp, Rattus norvegicus
gttggcaaaaccactacagcttctc

SEQ ID NO: 529537 - DNA, 25 bp, Rattus norvegicus
gttggcaaaacctctacagcttctc

SEQ ID NO: 529538 - DNA, 25 bp, Rattus norvegicus
gttggcaaacgcagaaacgcactgt

SEQ ID NO: 529539 - DNA, 25 bp, Rattus norvegicus
gttggcaaacgctgaaacgcactgt

SEQ ID NO: 529540 - DNA, 25 bp, Rattus norvegicus
gttggcaaagcactcctctggagac

SEQ ID NO: 529541 - DNA, 25 bp, Rattus norvegicus
gttggcaaagcagtcctctggagac

SEQ ID NO: 529542 - DNA, 25 bp, Rattus norvegicus
gttggcaacaccagtgtaaccgtga

SEQ ID NO: 529543 - DNA, 25 bp, Rattus norvegicus
gttggcaacacctgtgtaaccgtga

SEQ ID NO: 529544 - DNA, 25 bp, Rattus norvegicus
gttggcaacatgcagggccttctct

SEQ ID NO: 529545 - DNA, 25 bp, Rattus norvegicus
gttggcaacatggagggccttctct

SEQ ID NO: 529546 - DNA, 25 bp, Rattus norvegicus
gttggcaacattctttagaatcctt

SEQ ID NO: 529547 - DNA, 25 bp, Rattus norvegicus
gttggcaacattgtttagaatcctt

SEQ ID NO: 529548 - DNA, 25 bp, Rattus norvegicus
gttggcaacggacggagctctcacc

SEQ ID NO: 529549 - DNA, 25 bp, Rattus norvegicus
gttggcaacggagggagctctcacc

SEQ ID NO: 529550 - DNA, 25 bp, Rattus norvegicus
gttggcaactggactgtgcagacaa

SEQ ID NO: 529551 - DNA, 25 bp, Rattus norvegicus
gttggcaactggtctgtgcagacaa

SEQ ID NO: 529552 - DNA, 25 bp, Rattus norvegicus
gttggcaagcgcctggatcaccacg

SEQ ID NO: 529553 - DNA, 25 bp, Rattus norvegicus
gttggcaagcgcgtggatcaccacg

SEQ ID NO: 529554 - DNA, 25 bp, Rattus norvegicus
gttggcaaggctagcttcacatttt

SEQ ID NO: 529555 - DNA, 25 bp, Rattus norvegicus
gttggcaaggcttgcttcacatttt

SEQ ID NO: 529556 - DNA, 25 bp, Rattus norvegicus
gttggcaataccaaatgtcgcgtcc

SEQ ID NO: 529557 - DNA, 25 bp, Rattus norvegicus
gttggcaatacctaatgtcgcgtcc

SEQ ID NO: 529558 - DNA, 25 bp, Rattus norvegicus
gttggcaatgttacttctcatcgaa

SEQ ID NO: 529559 - DNA, 25 bp, Rattus norvegicus
gttggcaatgtttcttctcatcgaa

SEQ ID NO: 529560 - DNA, 25 bp, Rattus norvegicus
gttggcaattgcagcctgtacagcc

SEQ ID NO: 529561 - DNA, 25 bp, Rattus norvegicus
gttggcaattgctgcctgtacagcc

SEQ ID NO: 529562 - DNA, 25 bp, Rattus norvegicus
gttggcaatttgatttatcctctca

SEQ ID NO: 529563 - DNA, 25 bp, Rattus norvegicus
gttggcaatttgttttatcctctca

SEQ ID NO: 529564 - DNA, 25 bp, Rattus norvegicus
gttggcacaagacttccgcaagttt

SEQ ID NO: 529565 - DNA, 25 bp, Rattus norvegicus
gttggcacaagagttccgcaagttt

SEQ ID NO: 529566 - DNA, 25 bp, Rattus norvegicus
gttggcacacgcacaccaatgagat

SEQ ID NO: 529567 - DNA, 25 bp, Rattus norvegicus
gttggcacacgctcaccaatgagat

SEQ ID NO: 529568 - DNA, 25 bp, Rattus norvegicus
gttggcacagaacctctccatggac

SEQ ID NO: 529569 - DNA, 25 bp, Rattus norvegicus
gttggcacagaagctctccatggac

SEQ ID NO: 529570 - DNA, 25 bp, Rattus norvegicus
gttggcacagttcgctcaaccccag

SEQ ID NO: 529571 - DNA, 25 bp, Rattus norvegicus
gttggcacagttggctcaaccccag

SEQ ID NO: 529572 - DNA, 25 bp, Rattus norvegicus
gttggcaccaacagcagaacgagaa

SEQ ID NO: 529573 - DNA, 25 bp, Rattus norvegicus
gttggcaccaactgcagaacgagaa

SEQ ID NO: 529574 - DNA, 25 bp, Rattus norvegicus
gttggcaccacgagtagatgcgcag

SEQ ID NO: 529575 - DNA, 25 bp, Rattus norvegicus
gttggcaccacgtgtagatgcgcag

SEQ ID NO: 529576 - DNA, 25 bp, Rattus norvegicus
gttggcaccactacaggaactaatt

SEQ ID NO: 529577 - DNA, 25 bp, Rattus norvegicus
gttggcaccacttcaggaactaatt

SEQ ID NO: 529578 - DNA, 25 bp, Rattus norvegicus
gttggcaccatcagagcatcagccg

SEQ ID NO: 529579 - DNA, 25 bp, Rattus norvegicus
gttggcaccatctgagcatcagccg

SEQ ID NO: 529580 - DNA, 25 bp, Rattus norvegicus
gttggcactgtaatatattataaca

SEQ ID NO: 529581 - DNA, 25 bp, Rattus norvegicus
gttggcactgtattatattataaca

SEQ ID NO: 529582 - DNA, 25 bp, Rattus norvegicus
gttggcagaaagctgaccctcagat

SEQ ID NO: 529583 - DNA, 25 bp, Rattus norvegicus
gttggcagaaaggtgaccctcagat

SEQ ID NO: 529584 - DNA, 25 bp, Rattus norvegicus
gttggcagagagacctatcatcttg

SEQ ID NO: 529585 - DNA, 25 bp, Rattus norvegicus
gttggcagagagtcctatcatcttg

SEQ ID NO: 529586 - DNA, 25 bp, Rattus norvegicus
gttggcagatccatccacagaggag

SEQ ID NO: 529587 - DNA, 25 bp, Rattus norvegicus
gttggcagatccttccacagaggag

SEQ ID NO: 529588 - DNA, 25 bp, Rattus norvegicus
gttggcagcagtccattcccaagga

SEQ ID NO: 529589 - DNA, 25 bp, Rattus norvegicus
gttggcagcagtgcattcccaagga

SEQ ID NO: 529590 - DNA, 25 bp, Rattus norvegicus
gttggcagccccaggcagagaactc

SEQ ID NO: 529591 - DNA, 25 bp, Rattus norvegicus
gttggcagcccctggcagagaactc

SEQ ID NO: 529592 - DNA, 25 bp, Rattus norvegicus
gttggcaggacaagtattccaatta

SEQ ID NO: 529593 - DNA, 25 bp, Rattus norvegicus
gttggcaggacatgtattccaatta

SEQ ID NO: 529594 - DNA, 25 bp, Rattus norvegicus
gttggcaggccaatggtacacgaag

SEQ ID NO: 529595 - DNA, 25 bp, Rattus norvegicus
gttggcaggccattggtacacgaag

SEQ ID NO: 529596 - DNA, 25 bp, Rattus norvegicus
gttggcaggctcaggttaaaccatg

SEQ ID NO: 529597 - DNA, 25 bp, Rattus norvegicus
gttggcaggctctggttaaaccatg

SEQ ID NO: 529598 - DNA, 25 bp, Rattus norvegicus
gttggcagtgcccaattcctagata

SEQ ID NO: 529599 - DNA, 25 bp, Rattus norvegicus
gttggcagtgccgaattcctagata

SEQ ID NO: 529600 - DNA, 25 bp, Rattus norvegicus
gttggcataaaacccacagactatt

SEQ ID NO: 529601 - DNA, 25 bp, Rattus norvegicus
gttggcataaaagccacagactatt

SEQ ID NO: 529602 - DNA, 25 bp, Rattus norvegicus
gttggcatagtacacagtctttagt

SEQ ID NO: 529603 - DNA, 25 bp, Rattus norvegicus
gttggcatagtagacagtctttagt

SEQ ID NO: 529604 - DNA, 25 bp, Rattus norvegicus
gttggcatatttagactgttctggg

SEQ ID NO: 529605 - DNA, 25 bp, Rattus norvegicus
gttggcatattttgactgttctggg

SEQ ID NO: 529606 - DNA, 25 bp, Rattus norvegicus
gttggcatcaaaatcaaggcccttc

SEQ ID NO: 529607 - DNA, 25 bp, Rattus norvegicus
gttggcatcaaattcaaggcccttc

SEQ ID NO: 529608 - DNA, 25 bp, Rattus norvegicus
gttggcatctgcaggttcaaacaaa

SEQ ID NO: 529609 - DNA, 25 bp, Rattus norvegicus
gttggcatctgctggttcaaacaaa

SEQ ID NO: 529610 - DNA, 25 bp, Rattus norvegicus
gttggcatgaggcattaccacttga

SEQ ID NO: 529611 - DNA, 25 bp, Rattus norvegicus
gttggcatgagggattaccacttga

SEQ ID NO: 529612 - DNA, 25 bp, Rattus norvegicus
gttggcatgatccttctactctatt

SEQ ID NO: 529613 - DNA, 25 bp, Rattus norvegicus
gttggcatgatcgttctactctatt

SEQ ID NO: 529614 - DNA, 25 bp, Rattus norvegicus
gttggcatgtggaaaagccacgctt

SEQ ID NO: 529615 - DNA, 25 bp, Rattus norvegicus
gttggcatgtggtaaagccacgctt

SEQ ID NO: 529616 - DNA, 25 bp, Rattus norvegicus
gttggcattaataaccagcctccca

SEQ ID NO: 529617 - DNA, 25 bp, Rattus norvegicus
gttggcattaattaccagcctccca

SEQ ID NO: 529618 - DNA, 25 bp, Rattus norvegicus
gttggcattcatcatttgctggctt

SEQ ID NO: 529619 - DNA, 25 bp, Rattus norvegicus
gttggcattcatgatttgctggctt

SEQ ID NO: 529620 - DNA, 25 bp, Rattus norvegicus
gttggcattgccaatcagtgggctt

SEQ ID NO: 529621 - DNA, 25 bp, Rattus norvegicus
gttggcattgcctatcagtgggctt

SEQ ID NO: 529622 - DNA, 25 bp, Rattus norvegicus
gttggcatttctagtgcctgggttt

SEQ ID NO: 529623 - DNA, 25 bp, Rattus norvegicus
gttggcatttcttgtgcctgggttt

SEQ ID NO: 529624 - DNA, 25 bp, Rattus norvegicus
gttggcattttgaagcctggtccca

SEQ ID NO: 529625 - DNA, 25 bp, Rattus norvegicus
gttggcattttgtagcctggtccca

SEQ ID NO: 529626 - DNA, 25 bp, Rattus norvegicus
gttggcatttttcgagggctcctca

SEQ ID NO: 529627 - DNA, 25 bp, Rattus norvegicus
gttggcatttttggagggctcctca

SEQ ID NO: 529628 - DNA, 25 bp, Rattus norvegicus
gttggccaaccacaagcggttcagt

SEQ ID NO: 529629 - DNA, 25 bp, Rattus norvegicus
gttggccaaccagaagcggttcagt

SEQ ID NO: 529630 - DNA, 25 bp, Rattus norvegicus
gttggccaacttagtcattcatgga

SEQ ID NO: 529631 - DNA, 25 bp, Rattus norvegicus
gttggccaactttgtcattcatgga

SEQ ID NO: 529632 - DNA, 25 bp, Rattus norvegicus
gttggccacaggatatcagagtaaa

SEQ ID NO: 529633 - DNA, 25 bp, Rattus norvegicus
gttggccacaggttatcagagtaaa

SEQ ID NO: 529634 - DNA, 25 bp, Rattus norvegicus
gttggccagactagaaggacttcct

SEQ ID NO: 529635 - DNA, 25 bp, Rattus norvegicus
gttggccagacttgaaggacttcct

SEQ ID NO: 529636 - DNA, 25 bp, Rattus norvegicus
gttggccagaggacaatctcaggag

SEQ ID NO: 529637 - DNA, 25 bp, Rattus norvegicus
gttggccagaggtcaatctcaggag

SEQ ID NO: 529638 - DNA, 25 bp, Rattus norvegicus
gttggccagcatacaggtgcacata

SEQ ID NO: 529639 - DNA, 25 bp, Rattus norvegicus
gttggccagcattcaggtgcacata

SEQ ID NO: 529640 - DNA, 25 bp, Rattus norvegicus
gttggccatcaccagctactctata

SEQ ID NO: 529641 - DNA, 25 bp, Rattus norvegicus
gttggccatcacgagctactctata

SEQ ID NO: 529642 - DNA, 25 bp, Rattus norvegicus
gttggccatctgagctaagccttaa

SEQ ID NO: 529643 - DNA, 25 bp, Rattus norvegicus
gttggccatctgtgctaagccttaa

SEQ ID NO: 529644 - DNA, 25 bp, Rattus norvegicus
gttggccatgtcatctcagaggatc

SEQ ID NO: 529645 - DNA, 25 bp, Rattus norvegicus
gttggccatgtcttctcagaggatc

SEQ ID NO: 529646 - DNA, 25 bp, Rattus norvegicus
gttggccatgtgaagcagactactg

SEQ ID NO: 529647 - DNA, 25 bp, Rattus norvegicus
gttggccatgtgtagcagactactg

SEQ ID NO: 529648 - DNA, 25 bp, Rattus norvegicus
gttggcccaataaacagctatcatc

SEQ ID NO: 529649 - DNA, 25 bp, Rattus norvegicus
gttggcccaatatacagctatcatc

SEQ ID NO: 529650 - DNA, 25 bp, Rattus norvegicus
gttggcccaattatgcagatgagta

SEQ ID NO: 529651 - DNA, 25 bp, Rattus norvegicus
gttggcccaattttgcagatgagta

SEQ ID NO: 529652 - DNA, 25 bp, Rattus norvegicus
gttggccccaagatgggtgctctca

SEQ ID NO: 529653 - DNA, 25 bp, Rattus norvegicus
gttggccccaagttgggtgctctca

SEQ ID NO: 529654 - DNA, 25 bp, Rattus norvegicus
gttggccccagaacagacccggagg

SEQ ID NO: 529655 - DNA, 25 bp, Rattus norvegicus
gttggccccagatcagacccggagg

SEQ ID NO: 529656 - DNA, 25 bp, Rattus norvegicus
gttggcccctacagtagacttcaag

SEQ ID NO: 529657 - DNA, 25 bp, Rattus norvegicus
gttggcccctactgtagacttcaag

SEQ ID NO: 529658 - DNA, 25 bp, Rattus norvegicus
gttggcccctcacttaattggagaa

SEQ ID NO: 529659 - DNA, 25 bp, Rattus norvegicus
gttggcccctcagttaattggagaa

SEQ ID NO: 529660 - DNA, 25 bp, Rattus norvegicus
gttggcccgatgcttccccaaagat

SEQ ID NO: 529661 - DNA, 25 bp, Rattus norvegicus
gttggcccgatggttccccaaagat

SEQ ID NO: 529662 - DNA, 25 bp, Rattus norvegicus
gttggccctggactgaatgctgaca

SEQ ID NO: 529663 - DNA, 25 bp, Rattus norvegicus
gttggccctggagtgaatgctgaca

SEQ ID NO: 529664 - DNA, 25 bp, Rattus norvegicus
gttggccggcagaaaacaccaggtt

SEQ ID NO: 529665 - DNA, 25 bp, Rattus norvegicus
gttggccggcagtaaacaccaggtt

SEQ ID NO: 529666 - DNA, 25 bp, Rattus norvegicus
gttggcctatacacctctagatgag

SEQ ID NO: 529667 - DNA, 25 bp, Rattus norvegicus
gttggcctatactcctctagatgag

SEQ ID NO: 529668 - DNA, 25 bp, Rattus norvegicus
gttggcctatgtaactctgtgtatg

SEQ ID NO: 529669 - DNA, 25 bp, Rattus norvegicus
gttggcctatgttactctgtgtatg

SEQ ID NO: 529670 - DNA, 25 bp, Rattus norvegicus
gttggcctccatatcaaagtcttta

SEQ ID NO: 529671 - DNA, 25 bp, Rattus norvegicus
gttggcctccatttcaaagtcttta

SEQ ID NO: 529672 - DNA, 25 bp, Rattus norvegicus
gttggcctcctcaaagaatttctgc

SEQ ID NO: 529673 - DNA, 25 bp, Rattus norvegicus
gttggcctcctctaagaatttctgc

SEQ ID NO: 529674 - DNA, 25 bp, Rattus norvegicus
gttggcctcgaaatcacagatctgc

SEQ ID NO: 529675 - DNA, 25 bp, Rattus norvegicus
gttggcctcgaattcacagatctgc

SEQ ID NO: 529676 - DNA, 25 bp, Rattus norvegicus
gttggcctctcaccagcttaagtag

SEQ ID NO: 529677 - DNA, 25 bp, Rattus norvegicus
gttggcctctcagcagcttaagtag

SEQ ID NO: 529678 - DNA, 25 bp, Rattus norvegicus
gttggcctgataaagactgcgtctg

SEQ ID NO: 529679 - DNA, 25 bp, Rattus norvegicus
gttggcctgatatagactgcgtctg

SEQ ID NO: 529680 - DNA, 25 bp, Rattus norvegicus
gttggcctggaaccggcccgaccag

SEQ ID NO: 529681 - DNA, 25 bp, Rattus norvegicus
gttggcctggaagcggcccgaccag

SEQ ID NO: 529682 - DNA, 25 bp, Rattus norvegicus
gttggcctggcgatgccttggtaaa

SEQ ID NO: 529683 - DNA, 25 bp, Rattus norvegicus
gttggcctggcgttgccttggtaaa

SEQ ID NO: 529684 - DNA, 25 bp, Rattus norvegicus
gttggcctgttactgatatgaaagt

SEQ ID NO: 529685 - DNA, 25 bp, Rattus norvegicus
gttggcctgttagtgatatgaaagt

SEQ ID NO: 529686 - DNA, 25 bp, Rattus norvegicus
gttggccttcaaagatctgtatttt

SEQ ID NO: 529687 - DNA, 25 bp, Rattus norvegicus
gttggccttcaatgatctgtatttt

SEQ ID NO: 529688 - DNA, 25 bp, Rattus norvegicus
gttggccttcataccatacatggat

SEQ ID NO: 529689 - DNA, 25 bp, Rattus norvegicus
gttggccttcattccatacatggat

SEQ ID NO: 529690 - DNA, 25 bp, Rattus norvegicus
gttggccttgggaagggtctcctca

SEQ ID NO: 529691 - DNA, 25 bp, Rattus norvegicus
gttggccttgggtagggtctcctca

SEQ ID NO: 529692 - DNA, 25 bp, Rattus norvegicus
gttggcctttaaactgattgttgca

SEQ ID NO: 529693 - DNA, 25 bp, Rattus norvegicus
gttggcctttaatctgattgttgca

SEQ ID NO: 529694 - DNA, 25 bp, Rattus norvegicus
gttggcgagccaacttgtacgttct

SEQ ID NO: 529695 - DNA, 25 bp, Rattus norvegicus
gttggcgagccatcttgtacgttct

SEQ ID NO: 529696 - DNA, 25 bp, Rattus norvegicus
gttggcgctctgagtccaggaagca

SEQ ID NO: 529697 - DNA, 25 bp, Rattus norvegicus
gttggcgctctgtgtccaggaagca

SEQ ID NO: 529698 - DNA, 25 bp, Rattus norvegicus
gttggcggccgtaaagatactaaat

SEQ ID NO: 529699 - DNA, 25 bp, Rattus norvegicus
gttggcggccgttaagatactaaat

SEQ ID NO: 529700 - DNA, 25 bp, Rattus norvegicus
gttggcggtaccaggtgactgtcac

SEQ ID NO: 529701 - DNA, 25 bp, Rattus norvegicus
gttggcggtacctggtgactgtcac

SEQ ID NO: 529702 - DNA, 25 bp, Rattus norvegicus
gttggcgttcacatatatctcattg

SEQ ID NO: 529703 - DNA, 25 bp, Rattus norvegicus
gttggcgttcacttatatctcattg

SEQ ID NO: 529704 - DNA, 25 bp, Rattus norvegicus
gttggcgttggccttggctgcggcg

SEQ ID NO: 529705 - DNA, 25 bp, Rattus norvegicus
gttggcgttggcgttggctgcggcg

SEQ ID NO: 529706 - DNA, 25 bp, Rattus norvegicus
gttggctaaaacaggtgtccatcac

SEQ ID NO: 529707 - DNA, 25 bp, Rattus norvegicus
gttggctaaaactggtgtccatcac

SEQ ID NO: 529708 - DNA, 25 bp, Rattus norvegicus
gttggctacaggcagagcccagctt

SEQ ID NO: 529709 - DNA, 25 bp, Rattus norvegicus
gttggctacagggagagcccagctt

SEQ ID NO: 529710 - DNA, 25 bp, Rattus norvegicus
gttggctaccgtaacatataatggc

SEQ ID NO: 529711 - DNA, 25 bp, Rattus norvegicus
gttggctaccgttacatataatggc

SEQ ID NO: 529712 - DNA, 25 bp, Rattus norvegicus
gttggctactatcctgatgcttcct

SEQ ID NO: 529713 - DNA, 25 bp, Rattus norvegicus
gttggctactatgctgatgcttcct

SEQ ID NO: 529714 - DNA, 25 bp, Rattus norvegicus
gttggctattgtccatcgtgttgta

SEQ ID NO: 529715 - DNA, 25 bp, Rattus norvegicus
gttggctattgtgcatcgtgttgta

SEQ ID NO: 529716 - DNA, 25 bp, Rattus norvegicus
gttggctcaacacaatcccagcatg

SEQ ID NO: 529717 - DNA, 25 bp, Rattus norvegicus
gttggctcaacagaatcccagcatg

SEQ ID NO: 529718 - DNA, 25 bp, Rattus norvegicus
gttggctcagacattggtgttccac

SEQ ID NO: 529719 - DNA, 25 bp, Rattus norvegicus
gttggctcagactttggtgttccac

SEQ ID NO: 529720 - DNA, 25 bp, Rattus norvegicus
gttggctcagagagcatgctgtttg

SEQ ID NO: 529721 - DNA, 25 bp, Rattus norvegicus
gttggctcagagctttatctaagga

SEQ ID NO: 529722 - DNA, 25 bp, Rattus norvegicus
gttggctcagaggtttatctaagga

SEQ ID NO: 529723 - DNA, 25 bp, Rattus norvegicus
gttggctcagagtgcatgctgtttg

SEQ ID NO: 529724 - DNA, 25 bp, Rattus norvegicus
gttggctcaggcatgggattctcag

SEQ ID NO: 529725 - DNA, 25 bp, Rattus norvegicus
gttggctcaggcttgggattctcag

SEQ ID NO: 529726 - DNA, 25 bp, Rattus norvegicus
gttggctcatagatctttcaggtca

SEQ ID NO: 529727 - DNA, 25 bp, Rattus norvegicus
gttggctcatagttctttcaggtca

SEQ ID NO: 529728 - DNA, 25 bp, Rattus norvegicus
gttggctccataattaatagcactt

SEQ ID NO: 529729 - DNA, 25 bp, Rattus norvegicus
gttggctccatatttaatagcactt

SEQ ID NO: 529730 - DNA, 25 bp, Rattus norvegicus
gttggctcccatcgaacacgtagtg

SEQ ID NO: 529731 - DNA, 25 bp, Rattus norvegicus
gttggctcccatggaacacgtagtg

SEQ ID NO: 529732 - DNA, 25 bp, Rattus norvegicus
gttggctcccgtaaggccacaatta

SEQ ID NO: 529733 - DNA, 25 bp, Rattus norvegicus
gttggctcccgttaggccacaatta

SEQ ID NO: 529734 - DNA, 25 bp, Rattus norvegicus
gttggctcctaactgtagcttttcc

SEQ ID NO: 529735 - DNA, 25 bp, Rattus norvegicus
gttggctcctaagtgtagcttttcc

SEQ ID NO: 529736 - DNA, 25 bp, Rattus norvegicus
gttggctcctggaaatcagccatca

SEQ ID NO: 529737 - DNA, 25 bp, Rattus norvegicus
gttggctcctggtaatcagccatca

SEQ ID NO: 529738 - DNA, 25 bp, Rattus norvegicus
gttggctcggctagttttgttgttt

SEQ ID NO: 529739 - DNA, 25 bp, Rattus norvegicus
gttggctcggcttgttttgttgttt

SEQ ID NO: 529740 - DNA, 25 bp, Rattus norvegicus
gttggctcgtgaaccaaactcaggg

SEQ ID NO: 529741 - DNA, 25 bp, Rattus norvegicus
gttggctcgtgatccaaactcaggg

SEQ ID NO: 529742 - DNA, 25 bp, Rattus norvegicus
gttggctctcacactattttacaga

SEQ ID NO: 529743 - DNA, 25 bp, Rattus norvegicus
gttggctctcactctattttacaga

SEQ ID NO: 529744 - DNA, 25 bp, Rattus norvegicus
gttggctctccgacctgagtgtgcc

SEQ ID NO: 529745 - DNA, 25 bp, Rattus norvegicus
gttggctctccgtcctgagtgtgcc

SEQ ID NO: 529746 - DNA, 25 bp, Rattus norvegicus
gttggctctgtgcaaatcactcttt

SEQ ID NO: 529747 - DNA, 25 bp, Rattus norvegicus
gttggctctgtggaaatcactcttt

SEQ ID NO: 529748 - DNA, 25 bp, Rattus norvegicus
gttggctgacacagacatagacctt

SEQ ID NO: 529749 - DNA, 25 bp, Rattus norvegicus
gttggctgacactgacatagacctt

SEQ ID NO: 529750 - DNA, 25 bp, Rattus norvegicus
gttggctgacttaggaatctttctt

SEQ ID NO: 529751 - DNA, 25 bp, Rattus norvegicus
gttggctgactttggaatctttctt

SEQ ID NO: 529752 - DNA, 25 bp, Rattus norvegicus
gttggctgccatccctgctgatgga

SEQ ID NO: 529753 - DNA, 25 bp, Rattus norvegicus
gttggctgccatgcctgctgatgga

SEQ ID NO: 529754 - DNA, 25 bp, Rattus norvegicus
gttggctgcctgaagaaaccccaca

SEQ ID NO: 529755 - DNA, 25 bp, Rattus norvegicus
gttggctgcctgtagaaaccccaca

SEQ ID NO: 529756 - DNA, 25 bp, Rattus norvegicus
gttggctgctgccttgcatgtccca

SEQ ID NO: 529757 - DNA, 25 bp, Rattus norvegicus
gttggctgctgcgttgcatgtccca

SEQ ID NO: 529758 - DNA, 25 bp, Rattus norvegicus
gttggctggagaacctcctcaacaa

SEQ ID NO: 529759 - DNA, 25 bp, Rattus norvegicus
gttggctggagatcctcctcaacaa

SEQ ID NO: 529760 - DNA, 25 bp, Rattus norvegicus
gttggctgtcagagccaaacctgat

SEQ ID NO: 529761 - DNA, 25 bp, Rattus norvegicus
gttggctgtcagtgccaaacctgat

SEQ ID NO: 529762 - DNA, 25 bp, Rattus norvegicus
gttggctgtcctattaagaatgaga

SEQ ID NO: 529763 - DNA, 25 bp, Rattus norvegicus
gttggctgtccttttaagaatgaga

SEQ ID NO: 529764 - DNA, 25 bp, Rattus norvegicus
gttggctgtctgaccatttacacat

SEQ ID NO: 529765 - DNA, 25 bp, Rattus norvegicus
gttggctgtctgtccatttacacat

SEQ ID NO: 529766 - DNA, 25 bp, Rattus norvegicus
gttggctgtgccatctgagtttgga

SEQ ID NO: 529767 - DNA, 25 bp, Rattus norvegicus
gttggctgtgccttctgagtttgga

SEQ ID NO: 529768 - DNA, 25 bp, Rattus norvegicus
gttggctgtttgctgtgtattacac

SEQ ID NO: 529769 - DNA, 25 bp, Rattus norvegicus
gttggctgtttggtgtgtattacac

SEQ ID NO: 529770 - DNA, 25 bp, Rattus norvegicus
gttggcttacagaggtctagaggtt

SEQ ID NO: 529771 - DNA, 25 bp, Rattus norvegicus
gttggcttacagtggtctagaggtt

SEQ ID NO: 529772 - DNA, 25 bp, Rattus norvegicus
gttggcttagaacacctacactcag

SEQ ID NO: 529773 - DNA, 25 bp, Rattus norvegicus
gttggcttagaagacctacactcag

SEQ ID NO: 529774 - DNA, 25 bp, Rattus norvegicus
gttggcttagctcaggatgtaaaca

SEQ ID NO: 529775 - DNA, 25 bp, Rattus norvegicus
gttggcttagctgaggatgtaaaca

SEQ ID NO: 529776 - DNA, 25 bp, Rattus norvegicus
gttggctttcagaaatcacttggga

SEQ ID NO: 529777 - DNA, 25 bp, Rattus norvegicus
gttggctttcagtaatcacttggga

SEQ ID NO: 529778 - DNA, 25 bp, Rattus norvegicus
gttggctttccacaactagcaccat

SEQ ID NO: 529779 - DNA, 25 bp, Rattus norvegicus
gttggctttccagaactagcaccat

SEQ ID NO: 529780 - DNA, 25 bp, Rattus norvegicus
gttggctttctgctgtggacatcaa

SEQ ID NO: 529781 - DNA, 25 bp, Rattus norvegicus
gttggctttctggtgtggacatcaa

SEQ ID NO: 529782 - DNA, 25 bp, Rattus norvegicus
gttggcttttttcgtgttttatgat

SEQ ID NO: 529783 - DNA, 25 bp, Rattus norvegicus
gttggcttttttggtgttttatgat

SEQ ID NO: 529784 - DNA, 25 bp, Rattus norvegicus
gttgggaaagccctccccagctgtt

SEQ ID NO: 529785 - DNA, 25 bp, Rattus norvegicus
gttgggaaagccgtccccagctgtt

SEQ ID NO: 529786 - DNA, 25 bp, Rattus norvegicus
gttgggaaagtcaggcatcccctgc

SEQ ID NO: 529787 - DNA, 25 bp, Rattus norvegicus
gttgggaaagtctggcatcccctgc

SEQ ID NO: 529788 - DNA, 25 bp, Rattus norvegicus
gttgggaaatcacctagccttggct

SEQ ID NO: 529789 - DNA, 25 bp, Rattus norvegicus
gttgggaaatcagctagccttggct

SEQ ID NO: 529790 - DNA, 25 bp, Rattus norvegicus
gttgggaactgacctctgcaagaac

SEQ ID NO: 529791 - DNA, 25 bp, Rattus norvegicus
gttgggaactgagctctgcaagaac

SEQ ID NO: 529792 - DNA, 25 bp, Rattus norvegicus
gttgggaagcaaccaccaggttttt

SEQ ID NO: 529793 - DNA, 25 bp, Rattus norvegicus
gttgggaagcaagcaccaggttttt

SEQ ID NO: 529794 - DNA, 25 bp, Rattus norvegicus
gttgggaagctgattctacgaatat

SEQ ID NO: 529795 - DNA, 25 bp, Rattus norvegicus
gttgggaagctgtttctacgaatat

SEQ ID NO: 529796 - DNA, 25 bp, Rattus norvegicus
gttgggaatgcaatgtgctgctgcc

SEQ ID NO: 529797 - DNA, 25 bp, Rattus norvegicus
gttgggaatgcattgtgctgctgcc

SEQ ID NO: 529798 - DNA, 25 bp, Rattus norvegicus
gttgggacacttcgtcacaagcctc

SEQ ID NO: 529799 - DNA, 25 bp, Rattus norvegicus
gttgggacacttggtcacaagcctc

SEQ ID NO: 529800 - DNA, 25 bp, Rattus norvegicus
gttgggacagccaaactcattttta

SEQ ID NO: 529801 - DNA, 25 bp, Rattus norvegicus
gttgggacagcctaactcattttta

SEQ ID NO: 529802 - DNA, 25 bp, Rattus norvegicus
gttgggaccattccttaccttattt

SEQ ID NO: 529803 - DNA, 25 bp, Rattus norvegicus
gttgggaccattgcttaccttattt

SEQ ID NO: 529804 - DNA, 25 bp, Rattus norvegicus
gttgggaccctcaagagaaatgaca

SEQ ID NO: 529805 - DNA, 25 bp, Rattus norvegicus
gttgggaccctctagagaaatgaca

SEQ ID NO: 529806 - DNA, 25 bp, Rattus norvegicus
gttgggacctgtctgggcaacccat

SEQ ID NO: 529807 - DNA, 25 bp, Rattus norvegicus
gttgggacctgtgtgggcaacccat

SEQ ID NO: 529808 - DNA, 25 bp, Rattus norvegicus
gttgggacgaaacaccagctagtca

SEQ ID NO: 529809 - DNA, 25 bp, Rattus norvegicus
gttgggacgaaagaccagctagtca

SEQ ID NO: 529810 - DNA, 25 bp, Rattus norvegicus
gttgggacgttcagcatgacttcgc

SEQ ID NO: 529811 - DNA, 25 bp, Rattus norvegicus
gttgggacgttctgcatgacttcgc

SEQ ID NO: 529812 - DNA, 25 bp, Rattus norvegicus
gttgggactaacctgacatggacaa

SEQ ID NO: 529813 - DNA, 25 bp, Rattus norvegicus
gttgggactaacgtgacatggacaa

SEQ ID NO: 529814 - DNA, 25 bp, Rattus norvegicus
gttgggactacacatacgccaccat

SEQ ID NO: 529815 - DNA, 25 bp, Rattus norvegicus
gttgggactacagatacgccaccat

SEQ ID NO: 529816 - DNA, 25 bp, Rattus norvegicus
gttgggacttctcagaacattggtc

SEQ ID NO: 529817 - DNA, 25 bp, Rattus norvegicus
gttgggacttctgagaacattggtc

SEQ ID NO: 529818 - DNA, 25 bp, Rattus norvegicus
gttgggagcccaatggacacaccac

SEQ ID NO: 529819 - DNA, 25 bp, Rattus norvegicus
gttgggagcccattggacacaccac

SEQ ID NO: 529820 - DNA, 25 bp, Rattus norvegicus
gttgggaggaagacctgtgccactc

SEQ ID NO: 529821 - DNA, 25 bp, Rattus norvegicus
gttgggaggaagtcctgtgccactc

SEQ ID NO: 529822 - DNA, 25 bp, Rattus norvegicus
gttgggatatctacggactgtaaaa

SEQ ID NO: 529823 - DNA, 25 bp, Rattus norvegicus
gttgggatatcttcggactgtaaaa

SEQ ID NO: 529824 - DNA, 25 bp, Rattus norvegicus
gttgggatccacagagcgtgatgca

SEQ ID NO: 529825 - DNA, 25 bp, Rattus norvegicus
gttgggatccactgagcgtgatgca

SEQ ID NO: 529826 - DNA, 25 bp, Rattus norvegicus
gttgggatgccacgaagccactgta

SEQ ID NO: 529827 - DNA, 25 bp, Rattus norvegicus
gttgggatgccaggaagccactgta

SEQ ID NO: 529828 - DNA, 25 bp, Rattus norvegicus
gttgggatgcccattttgtacataa

SEQ ID NO: 529829 - DNA, 25 bp, Rattus norvegicus
gttgggatgccctttttgtacataa

SEQ ID NO: 529830 - DNA, 25 bp, Rattus norvegicus
gttgggattattccacatgtggcta

SEQ ID NO: 529831 - DNA, 25 bp, Rattus norvegicus
gttgggattattgcacatgtggcta

SEQ ID NO: 529832 - DNA, 25 bp, Rattus norvegicus
gttgggattgataacaggctgcacc

SEQ ID NO: 529833 - DNA, 25 bp, Rattus norvegicus
gttgggattgattacaggctgcacc

SEQ ID NO: 529834 - DNA, 25 bp, Rattus norvegicus
gttgggatttgcagtttaacttctc

SEQ ID NO: 529835 - DNA, 25 bp, Rattus norvegicus
gttgggatttgctgtttaacttctc

SEQ ID NO: 529836 - DNA, 25 bp, Rattus norvegicus
gttgggattttacatagcttgcatt

SEQ ID NO: 529837 - DNA, 25 bp, Rattus norvegicus
gttgggattttagatagcttgcatt

SEQ ID NO: 529838 - DNA, 25 bp, Rattus norvegicus
gttgggattttcaacaggttctgtt

SEQ ID NO: 529839 - DNA, 25 bp, Rattus norvegicus
gttgggattttctacaggttctgtt

SEQ ID NO: 529840 - DNA, 25 bp, Rattus norvegicus
gttgggcaaactcgctctgcagcta

SEQ ID NO: 529841 - DNA, 25 bp, Rattus norvegicus
gttgggcaaactggctctgcagcta

SEQ ID NO: 529842 - DNA, 25 bp, Rattus norvegicus
gttgggcaagccaaaaactcaccat

SEQ ID NO: 529843 - DNA, 25 bp, Rattus norvegicus
gttgggcaagcctaaaactcaccat

SEQ ID NO: 529844 - DNA, 25 bp, Rattus norvegicus
gttgggcaagtacgtttctcagtcc

SEQ ID NO: 529845 - DNA, 25 bp, Rattus norvegicus
gttgggcaagtaggtttctcagtcc

SEQ ID NO: 529846 - DNA, 25 bp, Rattus norvegicus
gttgggcaatcaagaatcagtcatc

SEQ ID NO: 529847 - DNA, 25 bp, Rattus norvegicus
gttgggcaatcatgaatcagtcatc

SEQ ID NO: 529848 - DNA, 25 bp, Rattus norvegicus
gttgggcactaacagctcctggtaa

SEQ ID NO: 529849 - DNA, 25 bp, Rattus norvegicus
gttgggcactaagagctcctggtaa

SEQ ID NO: 529850 - DNA, 25 bp, Rattus norvegicus
gttgggcagacaaacagctactaga

SEQ ID NO: 529851 - DNA, 25 bp, Rattus norvegicus
gttgggcagacatacagctactaga

SEQ ID NO: 529852 - DNA, 25 bp, Rattus norvegicus
gttgggcagccaatggatagtatca

SEQ ID NO: 529853 - DNA, 25 bp, Rattus norvegicus
gttgggcagccattggatagtatca

SEQ ID NO: 529854 - DNA, 25 bp, Rattus norvegicus
gttgggcagcccattcacaaagtgg

SEQ ID NO: 529855 - DNA, 25 bp, Rattus norvegicus
gttgggcagccctttcacaaagtgg

SEQ ID NO: 529856 - DNA, 25 bp, Rattus norvegicus
gttgggcagctacccactattttcg

SEQ ID NO: 529857 - DNA, 25 bp, Rattus norvegicus
gttgggcagctagccactattttcg

SEQ ID NO: 529858 - DNA, 25 bp, Rattus norvegicus
gttgggcaggatataatggtctcat

SEQ ID NO: 529859 - DNA, 25 bp, Rattus norvegicus
gttgggcaggatttaatggtctcat

SEQ ID NO: 529860 - DNA, 25 bp, Rattus norvegicus
gttgggcatactaacgaggctgctc

SEQ ID NO: 529861 - DNA, 25 bp, Rattus norvegicus
gttgggcatacttacgaggctgctc

SEQ ID NO: 529862 - DNA, 25 bp, Rattus norvegicus
gttgggcatcgcatgcaatgagacc

SEQ ID NO: 529863 - DNA, 25 bp, Rattus norvegicus
gttgggcatcgcttgcaatgagacc

SEQ ID NO: 529864 - DNA, 25 bp, Rattus norvegicus
gttgggcattcaactttttaactga

SEQ ID NO: 529865 - DNA, 25 bp, Rattus norvegicus
gttgggcattcatctttttaactga

SEQ ID NO: 529866 - DNA, 25 bp, Rattus norvegicus
gttgggcattggcacagctgtacca

SEQ ID NO: 529867 - DNA, 25 bp, Rattus norvegicus
gttgggcattgggacagctgtacca

SEQ ID NO: 529868 - DNA, 25 bp, Rattus norvegicus
gttgggccacttctgtgcgtaaaga

SEQ ID NO: 529869 - DNA, 25 bp, Rattus norvegicus
gttgggccacttgtgtgcgtaaaga

SEQ ID NO: 529870 - DNA, 25 bp, Rattus norvegicus
gttgggccaggaatgttagcagaaa

SEQ ID NO: 529871 - DNA, 25 bp, Rattus norvegicus
gttgggccaggattgttagcagaaa

SEQ ID NO: 529872 - DNA, 25 bp, Rattus norvegicus
gttgggccatttctgtcatggactc

SEQ ID NO: 529873 - DNA, 25 bp, Rattus norvegicus
gttgggccatttgtgtcatggactc

SEQ ID NO: 529874 - DNA, 25 bp, Rattus norvegicus
gttgggccctagatgtagacattct

SEQ ID NO: 529875 - DNA, 25 bp, Rattus norvegicus
gttgggccctagttgtagacattct

SEQ ID NO: 529876 - DNA, 25 bp, Rattus norvegicus
gttgggcccttcaaactgaggtcaa

SEQ ID NO: 529877 - DNA, 25 bp, Rattus norvegicus
gttgggcccttctaactgaggtcaa

SEQ ID NO: 529878 - DNA, 25 bp, Rattus norvegicus
gttgggccggaacctcatcacaaaa

SEQ ID NO: 529879 - DNA, 25 bp, Rattus norvegicus
gttgggccggaagctcatcacaaaa

SEQ ID NO: 529880 - DNA, 25 bp, Rattus norvegicus
gttgggcgatgacaccaggtcatat

SEQ ID NO: 529881 - DNA, 25 bp, Rattus norvegicus
gttgggcgatgagaccaggtcatat

SEQ ID NO: 529882 - DNA, 25 bp, Rattus norvegicus
gttgggcgcacacgacgacactcca

SEQ ID NO: 529883 - DNA, 25 bp, Rattus norvegicus
gttgggcgcacaggacgacactcca

SEQ ID NO: 529884 - DNA, 25 bp, Rattus norvegicus
gttgggctaatcacactgcatctga

SEQ ID NO: 529885 - DNA, 25 bp, Rattus norvegicus
gttgggctaatctcactgcatctga

SEQ ID NO: 529886 - DNA, 25 bp, Rattus norvegicus
gttgggctcaatagttactggtaaa

SEQ ID NO: 529887 - DNA, 25 bp, Rattus norvegicus
gttgggctcaattgttactggtaaa

SEQ ID NO: 529888 - DNA, 25 bp, Rattus norvegicus
gttgggctcgtcctgcaagatcgca

SEQ ID NO: 529889 - DNA, 25 bp, Rattus norvegicus
gttgggctcgtcgtgcaagatcgca

SEQ ID NO: 529890 - DNA, 25 bp, Rattus norvegicus
gttgggctctcaatttgtgactttt

SEQ ID NO: 529891 - DNA, 25 bp, Rattus norvegicus
gttgggctctcattttgtgactttt

SEQ ID NO: 529892 - DNA, 25 bp, Rattus norvegicus
gttgggctctgtcatcattattttg

SEQ ID NO: 529893 - DNA, 25 bp, Rattus norvegicus
gttgggctctgtgatcattattttg

SEQ ID NO: 529894 - DNA, 25 bp, Rattus norvegicus
gttgggctgggcaaacactttcttg

SEQ ID NO: 529895 - DNA, 25 bp, Rattus norvegicus
gttgggctgggctaacactttcttg

SEQ ID NO: 529896 - DNA, 25 bp, Rattus norvegicus
gttgggctgtttaaagtccagggat

SEQ ID NO: 529897 - DNA, 25 bp, Rattus norvegicus
gttgggctgtttagcttaacaaact

SEQ ID NO: 529898 - DNA, 25 bp, Rattus norvegicus
gttgggctgttttaagtccagggat

SEQ ID NO: 529899 - DNA, 25 bp, Rattus norvegicus
gttgggctgttttgcttaacaaact

SEQ ID NO: 529900 - DNA, 25 bp, Rattus norvegicus
gttgggcttcagaattctgatctca

SEQ ID NO: 529901 - DNA, 25 bp, Rattus norvegicus
gttgggcttcagtattctgatctca

SEQ ID NO: 529902 - DNA, 25 bp, Rattus norvegicus
gttgggcttctactcacatatgtat

SEQ ID NO: 529903 - DNA, 25 bp, Rattus norvegicus
gttgggcttctagtcacatatgtat

SEQ ID NO: 529904 - DNA, 25 bp, Rattus norvegicus
gttgggctttatcctggtctcagat

SEQ ID NO: 529905 - DNA, 25 bp, Rattus norvegicus
gttgggctttatgctggtctcagat

SEQ ID NO: 529906 - DNA, 25 bp, Rattus norvegicus
gttgggtaggtaatctcacagattt

SEQ ID NO: 529907 - DNA, 25 bp, Rattus norvegicus
gttgggtaggtattctcacagattt

SEQ ID NO: 529908 - DNA, 25 bp, Rattus norvegicus
gttgggtattgaatctgctgtcaca

SEQ ID NO: 529909 - DNA, 25 bp, Rattus norvegicus
gttgggtattgattctgctgtcaca

SEQ ID NO: 529910 - DNA, 25 bp, Rattus norvegicus
gttgggtcaaaacctcccagagcta

SEQ ID NO: 529911 - DNA, 25 bp, Rattus norvegicus
gttgggtcaaaagctcccagagcta

SEQ ID NO: 529912 - DNA, 25 bp, Rattus norvegicus
gttgggtcaacgcacgacacaccac

SEQ ID NO: 529913 - DNA, 25 bp, Rattus norvegicus
gttgggtcaacggacgacacaccac

SEQ ID NO: 529914 - DNA, 25 bp, Rattus norvegicus
gttgggtcaagtcaaagccccgctt

SEQ ID NO: 529915 - DNA, 25 bp, Rattus norvegicus
gttgggtcaagtgaaagccccgctt

SEQ ID NO: 529916 - DNA, 25 bp, Rattus norvegicus
gttgggtcagttctagccctgagat

SEQ ID NO: 529917 - DNA, 25 bp, Rattus norvegicus
gttgggtcagttgtagccctgagat

SEQ ID NO: 529918 - DNA, 25 bp, Rattus norvegicus
gttgggtccaacagtgataatcaca

SEQ ID NO: 529919 - DNA, 25 bp, Rattus norvegicus
gttgggtccaactgtgataatcaca

SEQ ID NO: 529920 - DNA, 25 bp, Rattus norvegicus
gttgggtccaatcttaagattcagt

SEQ ID NO: 529921 - DNA, 25 bp, Rattus norvegicus
gttgggtccaatgttaagattcagt

SEQ ID NO: 529922 - DNA, 25 bp, Rattus norvegicus
gttgggtctgttagtacacatcttt

SEQ ID NO: 529923 - DNA, 25 bp, Rattus norvegicus
gttgggtctgtttgtacacatcttt

SEQ ID NO: 529924 - DNA, 25 bp, Rattus norvegicus
gttgggtgcatacatttggcagtat

SEQ ID NO: 529925 - DNA, 25 bp, Rattus norvegicus
gttgggtgcatagatttggcagtat

SEQ ID NO: 529926 - DNA, 25 bp, Rattus norvegicus
gttgggtggaatctttgctttgctc

SEQ ID NO: 529927 - DNA, 25 bp, Rattus norvegicus
gttgggtggaatgtttgctttgctc

SEQ ID NO: 529928 - DNA, 25 bp, Rattus norvegicus
gttgggtgggcccaaatgaccctca

SEQ ID NO: 529929 - DNA, 25 bp, Rattus norvegicus
gttgggtgggccgaaatgaccctca

SEQ ID NO: 529930 - DNA, 25 bp, Rattus norvegicus
gttgggttagatccttaaacggtag

SEQ ID NO: 529931 - DNA, 25 bp, Rattus norvegicus
gttgggttagatctccaggactcat

SEQ ID NO: 529932 - DNA, 25 bp, Rattus norvegicus
gttgggttagatgcttaaacggtag

SEQ ID NO: 529933 - DNA, 25 bp, Rattus norvegicus
gttgggttagatgtccaggactcat

SEQ ID NO: 529934 - DNA, 25 bp, Rattus norvegicus
gttgggttcaaaacctgcatcgcct

SEQ ID NO: 529935 - DNA, 25 bp, Rattus norvegicus
gttgggttcaaatcctgcatcgcct

SEQ ID NO: 529936 - DNA, 25 bp, Rattus norvegicus
gttgggttcaacctcccgagaatgg

SEQ ID NO: 529937 - DNA, 25 bp, Rattus norvegicus
gttgggttcaacgtcccgagaatgg

SEQ ID NO: 529938 - DNA, 25 bp, Rattus norvegicus
gttgggttcagtattcttcacagga

SEQ ID NO: 529939 - DNA, 25 bp, Rattus norvegicus
gttgggttcagttttcttcacagga

SEQ ID NO: 529940 - DNA, 25 bp, Rattus norvegicus
gttgggttctacacatttgtactat

SEQ ID NO: 529941 - DNA, 25 bp, Rattus norvegicus
gttgggttctactcatttgtactat

SEQ ID NO: 529942 - DNA, 25 bp, Rattus norvegicus
gttgggttcttgactcacttaagtt

SEQ ID NO: 529943 - DNA, 25 bp, Rattus norvegicus
gttgggttcttgtctcacttaagtt

SEQ ID NO: 529944 - DNA, 25 bp, Rattus norvegicus
gttgggttgaagcattccctacaaa

SEQ ID NO: 529945 - DNA, 25 bp, Rattus norvegicus
gttgggttgaaggattccctacaaa

SEQ ID NO: 529946 - DNA, 25 bp, Rattus norvegicus
gttgggttgtacactcagagtcatc

SEQ ID NO: 529947 - DNA, 25 bp, Rattus norvegicus
gttgggttgtactctcagagtcatc

SEQ ID NO: 529948 - DNA, 25 bp, Rattus norvegicus
gttgggtttatgacacttcagttcc

SEQ ID NO: 529949 - DNA, 25 bp, Rattus norvegicus
gttgggtttatgtcacttcagttcc

SEQ ID NO: 529950 - DNA, 25 bp, Rattus norvegicus
gttgggtttggtactgtccttacag

SEQ ID NO: 529951 - DNA, 25 bp, Rattus norvegicus
gttgggtttggttctgtccttacag

SEQ ID NO: 529952 - DNA, 25 bp, Rattus norvegicus
gttggtaaaccgagagccacccaat

SEQ ID NO: 529953 - DNA, 25 bp, Rattus norvegicus
gttggtaaaccgtgagccacccaat

SEQ ID NO: 529954 - DNA, 25 bp, Rattus norvegicus
gttggtaaagtccagcagctcttgt

SEQ ID NO: 529955 - DNA, 25 bp, Rattus norvegicus
gttggtaaagtcgagcagctcttgt

SEQ ID NO: 529956 - DNA, 25 bp, Rattus norvegicus
gttggtaaccgtctcttaggcattc

SEQ ID NO: 529957 - DNA, 25 bp, Rattus norvegicus
gttggtaaccgtgtcttaggcattc

SEQ ID NO: 529958 - DNA, 25 bp, Rattus norvegicus
gttggtaagtttctagcagttggac

SEQ ID NO: 529959 - DNA, 25 bp, Rattus norvegicus
gttggtaagtttgtagcagttggac

SEQ ID NO: 529960 - DNA, 25 bp, Rattus norvegicus
gttggtaataatcttaacctgctat

SEQ ID NO: 529961 - DNA, 25 bp, Rattus norvegicus
gttggtaataatgttaacctgctat

SEQ ID NO: 529962 - DNA, 25 bp, Rattus norvegicus
gttggtaatcttcccataagccttc

SEQ ID NO: 529963 - DNA, 25 bp, Rattus norvegicus
gttggtaatcttgccataagccttc

SEQ ID NO: 529964 - DNA, 25 bp, Rattus norvegicus
gttggtaatgagagtcccctgatgg

SEQ ID NO: 529965 - DNA, 25 bp, Rattus norvegicus
gttggtaatgagtgtcccctgatgg

SEQ ID NO: 529966 - DNA, 25 bp, Rattus norvegicus
gttggtacaccacccttctgcagaa

SEQ ID NO: 529967 - DNA, 25 bp, Rattus norvegicus
gttggtacaccagccttctgcagaa

SEQ ID NO: 529968 - DNA, 25 bp, Rattus norvegicus
gttggtacacttattcatctctgtc

SEQ ID NO: 529969 - DNA, 25 bp, Rattus norvegicus
gttggtacactttttcatctctgtc

SEQ ID NO: 529970 - DNA, 25 bp, Rattus norvegicus
gttggtaccaggactgaaaccttca

SEQ ID NO: 529971 - DNA, 25 bp, Rattus norvegicus
gttggtaccaggcagcgcctacaaa

SEQ ID NO: 529972 - DNA, 25 bp, Rattus norvegicus
gttggtaccagggagcgcctacaaa

SEQ ID NO: 529973 - DNA, 25 bp, Rattus norvegicus
gttggtaccaggtctgaaaccttca

SEQ ID NO: 529974 - DNA, 25 bp, Rattus norvegicus
gttggtacccaactctgaattctgc

SEQ ID NO: 529975 - DNA, 25 bp, Rattus norvegicus
gttggtacccaagtctgaattctgc

SEQ ID NO: 529976 - DNA, 25 bp, Rattus norvegicus
gttggtacctggagtggctccacct

SEQ ID NO: 529977 - DNA, 25 bp, Rattus norvegicus
gttggtacctggtgtggctccacct

SEQ ID NO: 529978 - DNA, 25 bp, Rattus norvegicus
gttggtacttttcgcattatgacaa

SEQ ID NO: 529979 - DNA, 25 bp, Rattus norvegicus
gttggtacttttggcattatgacaa

SEQ ID NO: 529980 - DNA, 25 bp, Rattus norvegicus
gttggtataaagcagcacatgcaca

SEQ ID NO: 529981 - DNA, 25 bp, Rattus norvegicus
gttggtataaaggagcacatgcaca

SEQ ID NO: 529982 - DNA, 25 bp, Rattus norvegicus
gttggtatcagcaagagacctaaaa

SEQ ID NO: 529983 - DNA, 25 bp, Rattus norvegicus
gttggtatcagctagagacctaaaa

SEQ ID NO: 529984 - DNA, 25 bp, Rattus norvegicus
gttggtatcattaccttatctcttt

SEQ ID NO: 529985 - DNA, 25 bp, Rattus norvegicus
gttggtatcatttccttatctcttt

SEQ ID NO: 529986 - DNA, 25 bp, Rattus norvegicus
gttggtatctgcattgttactcctc

SEQ ID NO: 529987 - DNA, 25 bp, Rattus norvegicus
gttggtatctgctttgttactcctc

SEQ ID NO: 529988 - DNA, 25 bp, Rattus norvegicus
gttggtatgtctctgtctaggcatt

SEQ ID NO: 529989 - DNA, 25 bp, Rattus norvegicus
gttggtatgtctgtgtctaggcatt

SEQ ID NO: 529990 - DNA, 25 bp, Rattus norvegicus
gttggtatgtgtccaaatccctgct

SEQ ID NO: 529991 - DNA, 25 bp, Rattus norvegicus
gttggtatgtgtgcaaatccctgct

SEQ ID NO: 529992 - DNA, 25 bp, Rattus norvegicus
gttggtattacaaaacataacctga

SEQ ID NO: 529993 - DNA, 25 bp, Rattus norvegicus
gttggtattacataacataacctga

SEQ ID NO: 529994 - DNA, 25 bp, Rattus norvegicus
gttggtattgttcaaacgggtacat

SEQ ID NO: 529995 - DNA, 25 bp, Rattus norvegicus
gttggtattgttgaaacgggtacat

SEQ ID NO: 529996 - DNA, 25 bp, Rattus norvegicus
gttggtcaacataagcctccatcaa

SEQ ID NO: 529997 - DNA, 25 bp, Rattus norvegicus
gttggtcaacatattctggttcttc

SEQ ID NO: 529998 - DNA, 25 bp, Rattus norvegicus
gttggtcaacattagcctccatcaa

SEQ ID NO: 529999 - DNA, 25 bp, Rattus norvegicus
gttggtcaacattttctggttcttc

SEQ ID NO: 530000 - DNA, 25 bp, Rattus norvegicus
gttggtcactgtcccttacgtgaaa

SEQ ID NO: 530001 - DNA, 25 bp, Rattus norvegicus
gttggtcactgtgccttacgtgaaa

SEQ ID NO: 530002 - DNA, 25 bp, Rattus norvegicus
gttggtcacttgagactgaatgtct

SEQ ID NO: 530003 - DNA, 25 bp, Rattus norvegicus
gttggtcacttgtgactgaatgtct

SEQ ID NO: 530004 - DNA, 25 bp, Rattus norvegicus
gttggtcagccaaagactttcctat

SEQ ID NO: 530005 - DNA, 25 bp, Rattus norvegicus
gttggtcagccaatccaaggagctt

SEQ ID NO: 530006 - DNA, 25 bp, Rattus norvegicus
gttggtcagccatagactttcctat

SEQ ID NO: 530007 - DNA, 25 bp, Rattus norvegicus
gttggtcagccattccaaggagctt

SEQ ID NO: 530008 - DNA, 25 bp, Rattus norvegicus
gttggtcatcaacacaagttcagat

SEQ ID NO: 530009 - DNA, 25 bp, Rattus norvegicus
gttggtcatcaagacaagttcagat

SEQ ID NO: 530010 - DNA, 25 bp, Rattus norvegicus
gttggtcatccccaggtttttatca

SEQ ID NO: 530011 - DNA, 25 bp, Rattus norvegicus
gttggtcatcccgaggtttttatca

SEQ ID NO: 530012 - DNA, 25 bp, Rattus norvegicus
gttggtcattatcttctcttacata

SEQ ID NO: 530013 - DNA, 25 bp, Rattus norvegicus
gttggtcattatgttctcttacata

SEQ ID NO: 530014 - DNA, 25 bp, Rattus norvegicus
gttggtcattttactccctcaatga

SEQ ID NO: 530015 - DNA, 25 bp, Rattus norvegicus
gttggtcatttttctccctcaatga

SEQ ID NO: 530016 - DNA, 25 bp, Rattus norvegicus
gttggtccacaacaacccaagatct

SEQ ID NO: 530017 - DNA, 25 bp, Rattus norvegicus
gttggtccacaagaacccaagatct

SEQ ID NO: 530018 - DNA, 25 bp, Rattus norvegicus
gttggtccacggcaaccagcgtgaa

SEQ ID NO: 530019 - DNA, 25 bp, Rattus norvegicus
gttggtccacgggaaccagcgtgaa

SEQ ID NO: 530020 - DNA, 25 bp, Rattus norvegicus
gttggtccagatagctatttccttg

SEQ ID NO: 530021 - DNA, 25 bp, Rattus norvegicus
gttggtccagattgctatttccttg

SEQ ID NO: 530022 - DNA, 25 bp, Rattus norvegicus
gttggtccaggaagcatctatcaaa

SEQ ID NO: 530023 - DNA, 25 bp, Rattus norvegicus
gttggtccaggatgcatctatcaaa

SEQ ID NO: 530024 - DNA, 25 bp, Rattus norvegicus
gttggtccatgaatcaaactccata

SEQ ID NO: 530025 - DNA, 25 bp, Rattus norvegicus
gttggtccatgattcaaactccata

SEQ ID NO: 530026 - DNA, 25 bp, Rattus norvegicus
gttggtcccataatttgtttgctta

SEQ ID NO: 530027 - DNA, 25 bp, Rattus norvegicus
gttggtcccatattttgtttgctta

SEQ ID NO: 530028 - DNA, 25 bp, Rattus norvegicus
gttggtccgatgatgctggacatga

SEQ ID NO: 530029 - DNA, 25 bp, Rattus norvegicus
gttggtccgatgttgctggacatga

SEQ ID NO: 530030 - DNA, 25 bp, Rattus norvegicus
gttggtcgtgggacttatcattgcc

SEQ ID NO: 530031 - DNA, 25 bp, Rattus norvegicus
gttggtcgtgggtcttatcattgcc

SEQ ID NO: 530032 - DNA, 25 bp, Rattus norvegicus
gttggtctacctaggataaacccag

SEQ ID NO: 530033 - DNA, 25 bp, Rattus norvegicus
gttggtctaccttggataaacccag

SEQ ID NO: 530034 - DNA, 25 bp, Rattus norvegicus
gttggtctatatcccacctgtcttt

SEQ ID NO: 530035 - DNA, 25 bp, Rattus norvegicus
gttggtctatatgccacctgtcttt

SEQ ID NO: 530036 - DNA, 25 bp, Rattus norvegicus
gttggtctcaccagtttttagaagt

SEQ ID NO: 530037 - DNA, 25 bp, Rattus norvegicus
gttggtctcacctgtttttagaagt

SEQ ID NO: 530038 - DNA, 25 bp, Rattus norvegicus
gttggtctcattcatctaagttcct

SEQ ID NO: 530039 - DNA, 25 bp, Rattus norvegicus
gttggtctcattgatctaagttcct

SEQ ID NO: 530040 - DNA, 25 bp, Rattus norvegicus
gttggtctcttaacaccagttgcta

SEQ ID NO: 530041 - DNA, 25 bp, Rattus norvegicus
gttggtctcttatcaccagttgcta

SEQ ID NO: 530042 - DNA, 25 bp, Rattus norvegicus
gttggtctgaacatcctgtattgta

SEQ ID NO: 530043 - DNA, 25 bp, Rattus norvegicus
gttggtctgaacttcctgtattgta

SEQ ID NO: 530044 - DNA, 25 bp, Rattus norvegicus
gttggtcttatgctgcttaattcag

SEQ ID NO: 530045 - DNA, 25 bp, Rattus norvegicus
gttggtcttatggtgcttaattcag

SEQ ID NO: 530046 - DNA, 25 bp, Rattus norvegicus
gttggtcttcatacaaagtctttgg

SEQ ID NO: 530047 - DNA, 25 bp, Rattus norvegicus
gttggtcttcattcaaagtctttgg

SEQ ID NO: 530048 - DNA, 25 bp, Rattus norvegicus
gttggtcttgataggcacatccatc

SEQ ID NO: 530049 - DNA, 25 bp, Rattus norvegicus
gttggtcttgattggcacatccatc

SEQ ID NO: 530050 - DNA, 25 bp, Rattus norvegicus
gttggtctttgtcccaggtctatct

SEQ ID NO: 530051 - DNA, 25 bp, Rattus norvegicus
gttggtctttgtgccaggtctatct

SEQ ID NO: 530052 - DNA, 25 bp, Rattus norvegicus
gttggtgaaaacatgtgcccctctg

SEQ ID NO: 530053 - DNA, 25 bp, Rattus norvegicus
gttggtgaaaacttgtgcccctctg

SEQ ID NO: 530054 - DNA, 25 bp, Rattus norvegicus
gttggtgaactccttgtcggtcaaa

SEQ ID NO: 530055 - DNA, 25 bp, Rattus norvegicus
gttggtgaactcgttgtcggtcaaa

SEQ ID NO: 530056 - DNA, 25 bp, Rattus norvegicus
gttggtgacaccactcgacttgtgg

SEQ ID NO: 530057 - DNA, 25 bp, Rattus norvegicus
gttggtgacacctctcgacttgtgg

SEQ ID NO: 530058 - DNA, 25 bp, Rattus norvegicus
gttggtgacagcaactgatccctgc

SEQ ID NO: 530059 - DNA, 25 bp, Rattus norvegicus
gttggtgacagctactgatccctgc

SEQ ID NO: 530060 - DNA, 25 bp, Rattus norvegicus
gttggtgacatcactcaagcgtgat

SEQ ID NO: 530061 - DNA, 25 bp, Rattus norvegicus
gttggtgacatctctcaagcgtgat

SEQ ID NO: 530062 - DNA, 25 bp, Rattus norvegicus
gttggtgaccctagattttatgaga

SEQ ID NO: 530063 - DNA, 25 bp, Rattus norvegicus
gttggtgacccttgattttatgaga

SEQ ID NO: 530064 - DNA, 25 bp, Rattus norvegicus
gttggtgactgtaaggcgttttcgc

SEQ ID NO: 530065 - DNA, 25 bp, Rattus norvegicus
gttggtgactgttaggcgttttcgc

SEQ ID NO: 530066 - DNA, 25 bp, Rattus norvegicus
gttggtgactttacatctcatggga

SEQ ID NO: 530067 - DNA, 25 bp, Rattus norvegicus
gttggtgacttttcatctcatggga

SEQ ID NO: 530068 - DNA, 25 bp, Rattus norvegicus
gttggtgagctcaggttcattgaaa

SEQ ID NO: 530069 - DNA, 25 bp, Rattus norvegicus
gttggtgagctctggttcattgaaa

SEQ ID NO: 530070 - DNA, 25 bp, Rattus norvegicus
gttggtgatttacccaaagccgcac

SEQ ID NO: 530071 - DNA, 25 bp, Rattus norvegicus
gttggtgatttagccaaagccgcac

SEQ ID NO: 530072 - DNA, 25 bp, Rattus norvegicus
gttggtgcagttacttactatcagg

SEQ ID NO: 530073 - DNA, 25 bp, Rattus norvegicus
gttggtgcagtttcttactatcagg

SEQ ID NO: 530074 - DNA, 25 bp, Rattus norvegicus
gttggtgcccatagtgggtcctgca

SEQ ID NO: 530075 - DNA, 25 bp, Rattus norvegicus
gttggtgcccattgtgggtcctgca

SEQ ID NO: 530076 - DNA, 25 bp, Rattus norvegicus
gttggtgcggtcacagctgaatcag

SEQ ID NO: 530077 - DNA, 25 bp, Rattus norvegicus
gttggtgcggtctcagctgaatcag

SEQ ID NO: 530078 - DNA, 25 bp, Rattus norvegicus
gttggtgcttctaacatcagttcta

SEQ ID NO: 530079 - DNA, 25 bp, Rattus norvegicus
gttggtgcttcttacatcagttcta

SEQ ID NO: 530080 - DNA, 25 bp, Rattus norvegicus
gttggtggagtaaatgtccttaatt

SEQ ID NO: 530081 - DNA, 25 bp, Rattus norvegicus
gttggtggagtatatgtccttaatt

SEQ ID NO: 530082 - DNA, 25 bp, Rattus norvegicus
gttggtggcacactttttatccagg

SEQ ID NO: 530083 - DNA, 25 bp, Rattus norvegicus
gttggtggcacagtttttatccagg

SEQ ID NO: 530084 - DNA, 25 bp, Rattus norvegicus
gttggtggctacaatgctcagcttc

SEQ ID NO: 530085 - DNA, 25 bp, Rattus norvegicus
gttggtggctactatgctcagcttc

SEQ ID NO: 530086 - DNA, 25 bp, Rattus norvegicus
gttggtggcttgaaacttctagcta

SEQ ID NO: 530087 - DNA, 25 bp, Rattus norvegicus
gttggtggcttgtaacttctagcta

SEQ ID NO: 530088 - DNA, 25 bp, Rattus norvegicus
gttggtggtgtaccttgttcagctc

SEQ ID NO: 530089 - DNA, 25 bp, Rattus norvegicus
gttggtggtgtagcttgttcagctc

SEQ ID NO: 530090 - DNA, 25 bp, Rattus norvegicus
gttggtggtttgcaccctgagtact

SEQ ID NO: 530091 - DNA, 25 bp, Rattus norvegicus
gttggtggtttggaccctgagtact

SEQ ID NO: 530092 - DNA, 25 bp, Rattus norvegicus
gttggtgtactcaatggccttggca

SEQ ID NO: 530093 - DNA, 25 bp, Rattus norvegicus
gttggtgtactctatggccttggca

SEQ ID NO: 530094 - DNA, 25 bp, Rattus norvegicus
gttggtgtatccactgtcacaggaa

SEQ ID NO: 530095 - DNA, 25 bp, Rattus norvegicus
gttggtgtatcctctgtcacaggaa

SEQ ID NO: 530096 - DNA, 25 bp, Rattus norvegicus
gttggtgtccaaacacagaactatt

SEQ ID NO: 530097 - DNA, 25 bp, Rattus norvegicus
gttggtgtccaatcacagaactatt

SEQ ID NO: 530098 - DNA, 25 bp, Rattus norvegicus
gttggtgtcccaagatccctagctt

SEQ ID NO: 530099 - DNA, 25 bp, Rattus norvegicus
gttggtgtcccatgatccctagctt

SEQ ID NO: 530100 - DNA, 25 bp, Rattus norvegicus
gttggtgtccccacgttcccgagat

SEQ ID NO: 530101 - DNA, 25 bp, Rattus norvegicus
gttggtgtcccccagcgcagagcca

SEQ ID NO: 530102 - DNA, 25 bp, Rattus norvegicus
gttggtgtccccgagcgcagagcca

SEQ ID NO: 530103 - DNA, 25 bp, Rattus norvegicus
gttggtgtcccctcgttcccgagat

SEQ ID NO: 530104 - DNA, 25 bp, Rattus norvegicus
gttggtgtcctgcaatactgcttca

SEQ ID NO: 530105 - DNA, 25 bp, Rattus norvegicus
gttggtgtcctggaatactgcttca

SEQ ID NO: 530106 - DNA, 25 bp, Rattus norvegicus
gttggtgtctttctgcacttagaat

SEQ ID NO: 530107 - DNA, 25 bp, Rattus norvegicus
gttggtgtctttgtgcacttagaat

SEQ ID NO: 530108 - DNA, 25 bp, Rattus norvegicus
gttggtgtgcgaagccaaagagctc

SEQ ID NO: 530109 - DNA, 25 bp, Rattus norvegicus
gttggtgtgcgatgccaaagagctc

SEQ ID NO: 530110 - DNA, 25 bp, Rattus norvegicus
gttggtgtgtctaacaaggcctcag

SEQ ID NO: 530111 - DNA, 25 bp, Rattus norvegicus
gttggtgtgtcttacaaggcctcag

SEQ ID NO: 530112 - DNA, 25 bp, Rattus norvegicus
gttggtgttctgactaaactccact

SEQ ID NO: 530113 - DNA, 25 bp, Rattus norvegicus
gttggtgttctgtctaaactccact

SEQ ID NO: 530114 - DNA, 25 bp, Rattus norvegicus
gttggtgttttgcttgaatctactt

SEQ ID NO: 530115 - DNA, 25 bp, Rattus norvegicus
gttggtgttttggttgaatctactt

SEQ ID NO: 530116 - DNA, 25 bp, Rattus norvegicus
gttggttataacagatctgacattg

SEQ ID NO: 530117 - DNA, 25 bp, Rattus norvegicus
gttggttataactgatctgacattg

SEQ ID NO: 530118 - DNA, 25 bp, Rattus norvegicus
gttggttatgacacgcctgaaggca

SEQ ID NO: 530119 - DNA, 25 bp, Rattus norvegicus
gttggttatgactcgcctgaaggca

SEQ ID NO: 530120 - DNA, 25 bp, Rattus norvegicus
gttggttcactccagacgggatctt

SEQ ID NO: 530121 - DNA, 25 bp, Rattus norvegicus
gttggttcactcgagacgggatctt

SEQ ID NO: 530122 - DNA, 25 bp, Rattus norvegicus
gttggttccatgacagttttcaaac

SEQ ID NO: 530123 - DNA, 25 bp, Rattus norvegicus
gttggttccatgtcagttttcaaac

SEQ ID NO: 530124 - DNA, 25 bp, Rattus norvegicus
gttggttcccacagtagacggtgtc

SEQ ID NO: 530125 - DNA, 25 bp, Rattus norvegicus
gttggttcccactgtagacggtgtc

SEQ ID NO: 530126 - DNA, 25 bp, Rattus norvegicus
gttggttcccatctaaagaagcagc

SEQ ID NO: 530127 - DNA, 25 bp, Rattus norvegicus
gttggttcccatgtaaagaagcagc

SEQ ID NO: 530128 - DNA, 25 bp, Rattus norvegicus
gttggttcctatacagtatttcctg

SEQ ID NO: 530129 - DNA, 25 bp, Rattus norvegicus
gttggttcctattcagtatttcctg

SEQ ID NO: 530130 - DNA, 25 bp, Rattus norvegicus
gttggttccttgagtttattgctat

SEQ ID NO: 530131 - DNA, 25 bp, Rattus norvegicus
gttggttccttgtgtttattgctat

SEQ ID NO: 530132 - DNA, 25 bp, Rattus norvegicus
gttggttcgttacttctagtttgat

SEQ ID NO: 530133 - DNA, 25 bp, Rattus norvegicus
gttggttcgttagttctagtttgat

SEQ ID NO: 530134 - DNA, 25 bp, Rattus norvegicus
gttggttctccaagggacgttgcat

SEQ ID NO: 530135 - DNA, 25 bp, Rattus norvegicus
gttggttctccatgggacgttgcat

SEQ ID NO: 530136 - DNA, 25 bp, Rattus norvegicus
gttggttctgagaatatcacttatg

SEQ ID NO: 530137 - DNA, 25 bp, Rattus norvegicus
gttggttctgagtatatcacttatg

SEQ ID NO: 530138 - DNA, 25 bp, Rattus norvegicus
gttggttcttctaagtcttcctgac

SEQ ID NO: 530139 - DNA, 25 bp, Rattus norvegicus
gttggttcttcttagtcttcctgac

SEQ ID NO: 530140 - DNA, 25 bp, Rattus norvegicus
gttggttgccacatgttgggattca

SEQ ID NO: 530141 - DNA, 25 bp, Rattus norvegicus
gttggttgccacttgttgggattca

SEQ ID NO: 530142 - DNA, 25 bp, Rattus norvegicus
gttggttgcttaatttcccctcttg

SEQ ID NO: 530143 - DNA, 25 bp, Rattus norvegicus
gttggttgcttattttcccctcttg

SEQ ID NO: 530144 - DNA, 25 bp, Rattus norvegicus
gttggttggcctagctaaatccaca

SEQ ID NO: 530145 - DNA, 25 bp, Rattus norvegicus
gttggttggccttgctaaatccaca

SEQ ID NO: 530146 - DNA, 25 bp, Rattus norvegicus
gttggttggtgcaacaaagcctcac

SEQ ID NO: 530147 - DNA, 25 bp, Rattus norvegicus
gttggttggtgctacaaagcctcac

SEQ ID NO: 530148 - DNA, 25 bp, Rattus norvegicus
gttggttgtcttattcaaagctcca

SEQ ID NO: 530149 - DNA, 25 bp, Rattus norvegicus
gttggttgtctttttcaaagctcca

SEQ ID NO: 530150 - DNA, 25 bp, Rattus norvegicus
gttggtttaccaaagtctgctgact

SEQ ID NO: 530151 - DNA, 25 bp, Rattus norvegicus
gttggtttaccatagtctgctgact

SEQ ID NO: 530152 - DNA, 25 bp, Rattus norvegicus
gttggtttcagacaatatgttcaca

SEQ ID NO: 530153 - DNA, 25 bp, Rattus norvegicus
gttggtttcagagaatatgttcaca

SEQ ID NO: 530154 - DNA, 25 bp, Rattus norvegicus
gttggtttcataaggatctcgcttt

SEQ ID NO: 530155 - DNA, 25 bp, Rattus norvegicus
gttggtttcatatggatctcgcttt

SEQ ID NO: 530156 - DNA, 25 bp, Rattus norvegicus
gttggtttcctaatcttcagagcca

SEQ ID NO: 530157 - DNA, 25 bp, Rattus norvegicus
gttggtttcctattcttcagagcca

SEQ ID NO: 530158 - DNA, 25 bp, Rattus norvegicus
gttggtttctatctgatccacgctg

SEQ ID NO: 530159 - DNA, 25 bp, Rattus norvegicus
gttggtttctatgtgatccacgctg

SEQ ID NO: 530160 - DNA, 25 bp, Rattus norvegicus
gttggtttgcatctgtacttacttc

SEQ ID NO: 530161 - DNA, 25 bp, Rattus norvegicus
gttggtttgcatgtgtacttacttc

SEQ ID NO: 530162 - DNA, 25 bp, Rattus norvegicus
gttggtttgctcactgaaggctaat

SEQ ID NO: 530163 - DNA, 25 bp, Rattus norvegicus
gttggtttgctctctgaaggctaat

SEQ ID NO: 530164 - DNA, 25 bp, Rattus norvegicus
gttggtttggcaagaaagctccgga

SEQ ID NO: 530165 - DNA, 25 bp, Rattus norvegicus
gttggtttggcatgaaagctccgga

SEQ ID NO: 530166 - DNA, 25 bp, Rattus norvegicus
gttggttttaccattctgtggatat

SEQ ID NO: 530167 - DNA, 25 bp, Rattus norvegicus
gttggttttacctttctgtggatat

SEQ ID NO: 530168 - DNA, 25 bp, Rattus norvegicus
gttggttttagtattggtgagccat

SEQ ID NO: 530169 - DNA, 25 bp, Rattus norvegicus
gttggttttagttttggtgagccat

SEQ ID NO: 530170 - DNA, 25 bp, Rattus norvegicus
gttggttttatgacctgcatcccat

SEQ ID NO: 530171 - DNA, 25 bp, Rattus norvegicus
gttggttttatgtcctgcatcccat

SEQ ID NO: 530172 - DNA, 25 bp, Rattus norvegicus
gttggttttcttatcatactacata

SEQ ID NO: 530173 - DNA, 25 bp, Rattus norvegicus
gttggttttcttttcatactacata

SEQ ID NO: 530174 - DNA, 25 bp, Rattus norvegicus
gttggttttgtgctttatgaagctc

SEQ ID NO: 530175 - DNA, 25 bp, Rattus norvegicus
gttggttttgtggtttatgaagctc

SEQ ID NO: 530176 - DNA, 25 bp, Rattus norvegicus
gttgtaaaacttagcctcggcttct

SEQ ID NO: 530177 - DNA, 25 bp, Rattus norvegicus
gttgtaaaactttgcctcggcttct

SEQ ID NO: 530178 - DNA, 25 bp, Rattus norvegicus
gttgtaaaccatcttctgaagccat

SEQ ID NO: 530179 - DNA, 25 bp, Rattus norvegicus
gttgtaaaccatgttctgaagccat

SEQ ID NO: 530180 - DNA, 25 bp, Rattus norvegicus
gttgtaaaggctcaaccactccctg

SEQ ID NO: 530181 - DNA, 25 bp, Rattus norvegicus
gttgtaaaggctgaaccactccctg

SEQ ID NO: 530182 - DNA, 25 bp, Rattus norvegicus
gttgtaaagtacactcttccgcatc

SEQ ID NO: 530183 - DNA, 25 bp, Rattus norvegicus
gttgtaaagtactctcttccgcatc

SEQ ID NO: 530184 - DNA, 25 bp, Rattus norvegicus
gttgtaaagttgactgcgtccctgt

SEQ ID NO: 530185 - DNA, 25 bp, Rattus norvegicus
gttgtaaagttgtctgcgtccctgt

SEQ ID NO: 530186 - DNA, 25 bp, Rattus norvegicus
gttgtaaatcacagtagcctcctac

SEQ ID NO: 530187 - DNA, 25 bp, Rattus norvegicus
gttgtaaatcactgtagcctcctac

SEQ ID NO: 530188 - DNA, 25 bp, Rattus norvegicus
gttgtaaatggcatggctgccctca

SEQ ID NO: 530189 - DNA, 25 bp, Rattus norvegicus
gttgtaaatggcttggctgccctca

SEQ ID NO: 530190 - DNA, 25 bp, Rattus norvegicus
gttgtaaatgttaccgcttcctaca

SEQ ID NO: 530191 - DNA, 25 bp, Rattus norvegicus
gttgtaaatgtttccgcttcctaca

SEQ ID NO: 530192 - DNA, 25 bp, Rattus norvegicus
gttgtaacacaaacactcccatagt

SEQ ID NO: 530193 - DNA, 25 bp, Rattus norvegicus
gttgtaacacaatcactcccatagt

SEQ ID NO: 530194 - DNA, 25 bp, Rattus norvegicus
gttgtaacagctccgtttgcgaaga

SEQ ID NO: 530195 - DNA, 25 bp, Rattus norvegicus
gttgtaacagctgcgtttgcgaaga

SEQ ID NO: 530196 - DNA, 25 bp, Rattus norvegicus
gttgtaaccaaactgtccgatttca

SEQ ID NO: 530197 - DNA, 25 bp, Rattus norvegicus
gttgtaaccaaagtgtccgatttca

SEQ ID NO: 530198 - DNA, 25 bp, Rattus norvegicus
gttgtaacccagcatcaatcttgtg

SEQ ID NO: 530199 - DNA, 25 bp, Rattus norvegicus
gttgtaacccaggatcaatcttgtg

SEQ ID NO: 530200 - DNA, 25 bp, Rattus norvegicus
gttgtaactctcactgtagtcatgg

SEQ ID NO: 530201 - DNA, 25 bp, Rattus norvegicus
gttgtaactctctctgtagtcatgg

SEQ ID NO: 530202 - DNA, 25 bp, Rattus norvegicus
gttgtaactgcaacttttggaatct

SEQ ID NO: 530203 - DNA, 25 bp, Rattus norvegicus
gttgtaactgcatcttttggaatct

SEQ ID NO: 530204 - DNA, 25 bp, Rattus norvegicus
gttgtaacttaacacccatcctgaa

SEQ ID NO: 530205 - DNA, 25 bp, Rattus norvegicus
gttgtaacttaagacccatcctgaa

SEQ ID NO: 530206 - DNA, 25 bp, Rattus norvegicus
gttgtaagattcatccgggcagcaa

SEQ ID NO: 530207 - DNA, 25 bp, Rattus norvegicus
gttgtaagattcttccgggcagcaa

SEQ ID NO: 530208 - DNA, 25 bp, Rattus norvegicus
gttgtaagcgcgctcctcggactca

SEQ ID NO: 530209 - DNA, 25 bp, Rattus norvegicus
gttgtaagcgcggtcctcggactca

SEQ ID NO: 530210 - DNA, 25 bp, Rattus norvegicus
gttgtaagctatatgtctcctgcac

SEQ ID NO: 530211 - DNA, 25 bp, Rattus norvegicus
gttgtaagctatttgtctcctgcac

SEQ ID NO: 530212 - DNA, 25 bp, Rattus norvegicus
gttgtaagcttccatctgggcgact

SEQ ID NO: 530213 - DNA, 25 bp, Rattus norvegicus
gttgtaagcttcgatctgggcgact

SEQ ID NO: 530214 - DNA, 25 bp, Rattus norvegicus
gttgtaataacaacctccctattca

SEQ ID NO: 530215 - DNA, 25 bp, Rattus norvegicus
gttgtaataacatcctccctattca

SEQ ID NO: 530216 - DNA, 25 bp, Rattus norvegicus
gttgtaatatacaaatccttttctg

SEQ ID NO: 530217 - DNA, 25 bp, Rattus norvegicus
gttgtaatatactaatccttttctg

SEQ ID NO: 530218 - DNA, 25 bp, Rattus norvegicus
gttgtaatatggctgctggccttgc

SEQ ID NO: 530219 - DNA, 25 bp, Rattus norvegicus
gttgtaatatgggtgctggccttgc

SEQ ID NO: 530220 - DNA, 25 bp, Rattus norvegicus
gttgtaatcactaaggtcccacgga

SEQ ID NO: 530221 - DNA, 25 bp, Rattus norvegicus
gttgtaatcacttaggtcccacgga

SEQ ID NO: 530222 - DNA, 25 bp, Rattus norvegicus
gttgtaatcttgagagcctacccca

SEQ ID NO: 530223 - DNA, 25 bp, Rattus norvegicus
gttgtaatcttgtgagcctacccca

SEQ ID NO: 530224 - DNA, 25 bp, Rattus norvegicus
gttgtaatgcatcagaccggtgaca

SEQ ID NO: 530225 - DNA, 25 bp, Rattus norvegicus
gttgtaatgcatgagaccggtgaca

SEQ ID NO: 530226 - DNA, 25 bp, Rattus norvegicus
gttgtacaaattactgattgccctt

SEQ ID NO: 530227 - DNA, 25 bp, Rattus norvegicus
gttgtacaaatttctgattgccctt

SEQ ID NO: 530228 - DNA, 25 bp, Rattus norvegicus
gttgtacaagcaactggacagcagt

SEQ ID NO: 530229 - DNA, 25 bp, Rattus norvegicus
gttgtacaagcatctggacagcagt

SEQ ID NO: 530230 - DNA, 25 bp, Rattus norvegicus
gttgtacagcacacagctatcacac

SEQ ID NO: 530231 - DNA, 25 bp, Rattus norvegicus
gttgtacagcactcagctatcacac

SEQ ID NO: 530232 - DNA, 25 bp, Rattus norvegicus
gttgtacagctcatgcaacagctcc

SEQ ID NO: 530233 - DNA, 25 bp, Rattus norvegicus
gttgtacagctcttgcaacagctcc

SEQ ID NO: 530234 - DNA, 25 bp, Rattus norvegicus
gttgtacaggccaagttgtcattgc

SEQ ID NO: 530235 - DNA, 25 bp, Rattus norvegicus
gttgtacaggcctagttgtcattgc

SEQ ID NO: 530236 - DNA, 25 bp, Rattus norvegicus
gttgtacatacaaagctatcatgag

SEQ ID NO: 530237 - DNA, 25 bp, Rattus norvegicus
gttgtacatacatagctatcatgag

SEQ ID NO: 530238 - DNA, 25 bp, Rattus norvegicus
gttgtacatctcctcagtggtcatc

SEQ ID NO: 530239 - DNA, 25 bp, Rattus norvegicus
gttgtacatctcgtcagtggtcatc

SEQ ID NO: 530240 - DNA, 25 bp, Rattus norvegicus
gttgtacattatctttgcagttgct

SEQ ID NO: 530241 - DNA, 25 bp, Rattus norvegicus
gttgtacattatgtttgcagttgct

SEQ ID NO: 530242 - DNA, 25 bp, Rattus norvegicus
gttgtacattgcatggaagcccaat

SEQ ID NO: 530243 - DNA, 25 bp, Rattus norvegicus
gttgtacattgcttggaagcccaat

SEQ ID NO: 530244 - DNA, 25 bp, Rattus norvegicus
gttgtaccaaccaaagcatcttgat

SEQ ID NO: 530245 - DNA, 25 bp, Rattus norvegicus
gttgtaccaacccaatggcaggtct

SEQ ID NO: 530246 - DNA, 25 bp, Rattus norvegicus
gttgtaccaaccgaatggcaggtct

SEQ ID NO: 530247 - DNA, 25 bp, Rattus norvegicus
gttgtaccaacctaagcatcttgat

SEQ ID NO: 530248 - DNA, 25 bp, Rattus norvegicus
gttgtaccacatcgacagccagata

SEQ ID NO: 530249 - DNA, 25 bp, Rattus norvegicus
gttgtaccacatggacagccagata

SEQ ID NO: 530250 - DNA, 25 bp, Rattus norvegicus
gttgtaccagcgcatgccttggaaa

SEQ ID NO: 530251 - DNA, 25 bp, Rattus norvegicus
gttgtaccagcggatgccttggaaa

SEQ ID NO: 530252 - DNA, 25 bp, Rattus norvegicus
gttgtaccagttaggctcatcggag

SEQ ID NO: 530253 - DNA, 25 bp, Rattus norvegicus
gttgtaccagtttggctcatcggag

SEQ ID NO: 530254 - DNA, 25 bp, Rattus norvegicus
gttgtaccctagactacagactcag

SEQ ID NO: 530255 - DNA, 25 bp, Rattus norvegicus
gttgtaccctagtctacagactcag

SEQ ID NO: 530256 - DNA, 25 bp, Rattus norvegicus
gttgtaccctctctagataagccta

SEQ ID NO: 530257 - DNA, 25 bp, Rattus norvegicus
gttgtaccctctgtagataagccta

SEQ ID NO: 530258 - DNA, 25 bp, Rattus norvegicus
gttgtaccgtttcaagccggacaat

SEQ ID NO: 530259 - DNA, 25 bp, Rattus norvegicus
gttgtaccgtttgaagccggacaat

SEQ ID NO: 530260 - DNA, 25 bp, Rattus norvegicus
gttgtacctagtctcggcagttgag

SEQ ID NO: 530261 - DNA, 25 bp, Rattus norvegicus
gttgtacctagtgtcggcagttgag

SEQ ID NO: 530262 - DNA, 25 bp, Rattus norvegicus
gttgtacgctatcaggcaaagcctc

SEQ ID NO: 530263 - DNA, 25 bp, Rattus norvegicus
gttgtacgctatgaggcaaagcctc

SEQ ID NO: 530264 - DNA, 25 bp, Rattus norvegicus
gttgtacgtctcagggatgcccgga

SEQ ID NO: 530265 - DNA, 25 bp, Rattus norvegicus
gttgtacgtctctgggatgcccgga

SEQ ID NO: 530266 - DNA, 25 bp, Rattus norvegicus
gttgtacgtgaaacacagccttcat

SEQ ID NO: 530267 - DNA, 25 bp, Rattus norvegicus
gttgtacgtgaatcacagccttcat

SEQ ID NO: 530268 - DNA, 25 bp, Rattus norvegicus
gttgtactcttgattcaaagtgtat

SEQ ID NO: 530269 - DNA, 25 bp, Rattus norvegicus
gttgtactcttgtttcaaagtgtat

SEQ ID NO: 530270 - DNA, 25 bp, Rattus norvegicus
gttgtactgtaacttacacacacac

SEQ ID NO: 530271 - DNA, 25 bp, Rattus norvegicus
gttgtactgtaagttacacacacac

SEQ ID NO: 530272 - DNA, 25 bp, Rattus norvegicus
gttgtactgtgacaagcacgcccgc

SEQ ID NO: 530273 - DNA, 25 bp, Rattus norvegicus
gttgtactgtgagaagcacgcccgc

SEQ ID NO: 530274 - DNA, 25 bp, Rattus norvegicus
gttgtacttaatatttactgtctgt

SEQ ID NO: 530275 - DNA, 25 bp, Rattus norvegicus
gttgtacttaatttttactgtctgt

SEQ ID NO: 530276 - DNA, 25 bp, Rattus norvegicus
gttgtagaaaacacactaattcctg

SEQ ID NO: 530277 - DNA, 25 bp, Rattus norvegicus
gttgtagaaaactcactaattcctg

SEQ ID NO: 530278 - DNA, 25 bp, Rattus norvegicus
gttgtagacttaacctgtcgtttca

SEQ ID NO: 530279 - DNA, 25 bp, Rattus norvegicus
gttgtagacttatcctgtcgtttca

SEQ ID NO: 530280 - DNA, 25 bp, Rattus norvegicus
gttgtagatatgaccacactttggg

SEQ ID NO: 530281 - DNA, 25 bp, Rattus norvegicus
gttgtagatatgtccacactttggg

SEQ ID NO: 530282 - DNA, 25 bp, Rattus norvegicus
gttgtagcaattattgcctgcagca

SEQ ID NO: 530283 - DNA, 25 bp, Rattus norvegicus
gttgtagcaatttttgcctgcagca

SEQ ID NO: 530284 - DNA, 25 bp, Rattus norvegicus
gttgtagccatcaaggacctgaagg

SEQ ID NO: 530285 - DNA, 25 bp, Rattus norvegicus
gttgtagccatctaggacctgaagg

SEQ ID NO: 530286 - DNA, 25 bp, Rattus norvegicus
gttgtagccgtcattagaactgttg

SEQ ID NO: 530287 - DNA, 25 bp, Rattus norvegicus
gttgtagccgtctttagaactgttg

SEQ ID NO: 530288 - DNA, 25 bp, Rattus norvegicus
gttgtagcctcaatcaatttcctat

SEQ ID NO: 530289 - DNA, 25 bp, Rattus norvegicus
gttgtagcctcattcaatttcctat

SEQ ID NO: 530290 - DNA, 25 bp, Rattus norvegicus
gttgtagccttacccctgaattctg

SEQ ID NO: 530291 - DNA, 25 bp, Rattus norvegicus
gttgtagccttagccctgaattctg

SEQ ID NO: 530292 - DNA, 25 bp, Rattus norvegicus
gttgtagcgagtacttgtcagcact

SEQ ID NO: 530293 - DNA, 25 bp, Rattus norvegicus
gttgtagcgagttcttgtcagcact

SEQ ID NO: 530294 - DNA, 25 bp, Rattus norvegicus
gttgtagctaccaccaaagaacgca

SEQ ID NO: 530295 - DNA, 25 bp, Rattus norvegicus
gttgtagctacctccaaagaacgca

SEQ ID NO: 530296 - DNA, 25 bp, Rattus norvegicus
gttgtagctcatacctttgttgaac

SEQ ID NO: 530297 - DNA, 25 bp, Rattus norvegicus
gttgtagctcattcctttgttgaac

SEQ ID NO: 530298 - DNA, 25 bp, Rattus norvegicus
gttgtagctgcaaaatcgacatctt

SEQ ID NO: 530299 - DNA, 25 bp, Rattus norvegicus
gttgtagctgcataatcgacatctt

SEQ ID NO: 530300 - DNA, 25 bp, Rattus norvegicus
gttgtagctgctctttctcaggccc

SEQ ID NO: 530301 - DNA, 25 bp, Rattus norvegicus
gttgtagctgctgtttctcaggccc

SEQ ID NO: 530302 - DNA, 25 bp, Rattus norvegicus
gttgtaggccttatctatgagccct

SEQ ID NO: 530303 - DNA, 25 bp, Rattus norvegicus
gttgtaggccttttctatgagccct

SEQ ID NO: 530304 - DNA, 25 bp, Rattus norvegicus
gttgtagggaagactagcagctcaa

SEQ ID NO: 530305 - DNA, 25 bp, Rattus norvegicus
gttgtagggaagtctagcagctcaa

SEQ ID NO: 530306 - DNA, 25 bp, Rattus norvegicus
gttgtagggttgagaactccagttc

SEQ ID NO: 530307 - DNA, 25 bp, Rattus norvegicus
gttgtagggttgtgaactccagttc

SEQ ID NO: 530308 - DNA, 25 bp, Rattus norvegicus
gttgtaggtcagaagcagctgtcct

SEQ ID NO: 530309 - DNA, 25 bp, Rattus norvegicus
gttgtaggtcagtagcagctgtcct

SEQ ID NO: 530310 - DNA, 25 bp, Rattus norvegicus
gttgtagtagaaaaggcatctgctt

SEQ ID NO: 530311 - DNA, 25 bp, Rattus norvegicus
gttgtagtagaataggcatctgctt

SEQ ID NO: 530312 - DNA, 25 bp, Rattus norvegicus
gttgtagtatagacatgaccttggg

SEQ ID NO: 530313 - DNA, 25 bp, Rattus norvegicus
gttgtagtatagtcatgaccttggg

SEQ ID NO: 530314 - DNA, 25 bp, Rattus norvegicus
gttgtagtgcatctcttcaggagtt

SEQ ID NO: 530315 - DNA, 25 bp, Rattus norvegicus
gttgtagtgcatgtcttcaggagtt

SEQ ID NO: 530316 - DNA, 25 bp, Rattus norvegicus
gttgtagtttttaattcatgctgaa

SEQ ID NO: 530317 - DNA, 25 bp, Rattus norvegicus
gttgtagttttttattcatgctgaa

SEQ ID NO: 530318 - DNA, 25 bp, Rattus norvegicus
gttgtataaccactttatcttcaat

SEQ ID NO: 530319 - DNA, 25 bp, Rattus norvegicus
gttgtataaccagtttatcttcaat

SEQ ID NO: 530320 - DNA, 25 bp, Rattus norvegicus
gttgtataagaaccacttatcccaa

SEQ ID NO: 530321 - DNA, 25 bp, Rattus norvegicus
gttgtataagaagcacttatcccaa

SEQ ID NO: 530322 - DNA, 25 bp, Rattus norvegicus
gttgtataatgcctaggacactcag

SEQ ID NO: 530323 - DNA, 25 bp, Rattus norvegicus
gttgtataatgcgtaggacactcag

SEQ ID NO: 530324 - DNA, 25 bp, Rattus norvegicus
gttgtatacaatacacgactcaggg

SEQ ID NO: 530325 - DNA, 25 bp, Rattus norvegicus
gttgtatacaattcacgactcaggg

SEQ ID NO: 530326 - DNA, 25 bp, Rattus norvegicus
gttgtatacccaaatacgcaccgaa

SEQ ID NO: 530327 - DNA, 25 bp, Rattus norvegicus
gttgtatacccatatacgcaccgaa

SEQ ID NO: 530328 - DNA, 25 bp, Rattus norvegicus
gttgtatatttcaccgtatccgatt

SEQ ID NO: 530329 - DNA, 25 bp, Rattus norvegicus
gttgtatatttctccgtatccgatt

SEQ ID NO: 530330 - DNA, 25 bp, Rattus norvegicus
gttgtatccacaattccctttgtga

SEQ ID NO: 530331 - DNA, 25 bp, Rattus norvegicus
gttgtatccacatttccctttgtga

SEQ ID NO: 530332 - DNA, 25 bp, Rattus norvegicus
gttgtatctataatccacatgtgga

SEQ ID NO: 530333 - DNA, 25 bp, Rattus norvegicus
gttgtatctatattccacatgtgga

SEQ ID NO: 530334 - DNA, 25 bp, Rattus norvegicus
gttgtatctgtaacactggcactga

SEQ ID NO: 530335 - DNA, 25 bp, Rattus norvegicus
gttgtatctgtatcactggcactga

SEQ ID NO: 530336 - DNA, 25 bp, Rattus norvegicus
gttgtatctgttccatttgtgcata

SEQ ID NO: 530337 - DNA, 25 bp, Rattus norvegicus
gttgtatctgttgcatttgtgcata

SEQ ID NO: 530338 - DNA, 25 bp, Rattus norvegicus
gttgtatcttttcctggccatgggc

SEQ ID NO: 530339 - DNA, 25 bp, Rattus norvegicus
gttgtatcttttgctggccatgggc

SEQ ID NO: 530340 - DNA, 25 bp, Rattus norvegicus
gttgtatgaggaaccacactattgt

SEQ ID NO: 530341 - DNA, 25 bp, Rattus norvegicus
gttgtatgaggaccctgaccctgga

SEQ ID NO: 530342 - DNA, 25 bp, Rattus norvegicus
gttgtatgaggagcctgaccctgga

SEQ ID NO: 530343 - DNA, 25 bp, Rattus norvegicus
gttgtatgaggatccacactattgt

SEQ ID NO: 530344 - DNA, 25 bp, Rattus norvegicus
gttgtatgtaaaatgccccgtttct

SEQ ID NO: 530345 - DNA, 25 bp, Rattus norvegicus
gttgtatgtaaattgccccgtttct

SEQ ID NO: 530346 - DNA, 25 bp, Rattus norvegicus
gttgtatgtattccattgtcttttt

SEQ ID NO: 530347 - DNA, 25 bp, Rattus norvegicus
gttgtatgtattgcattgtcttttt

SEQ ID NO: 530348 - DNA, 25 bp, Rattus norvegicus
gttgtattacaaatcctggctgctt

SEQ ID NO: 530349 - DNA, 25 bp, Rattus norvegicus
gttgtattacaattcctggctgctt

SEQ ID NO: 530350 - DNA, 25 bp, Rattus norvegicus
gttgtattagaacagcccaggccac

SEQ ID NO: 530351 - DNA, 25 bp, Rattus norvegicus
gttgtattagaagagcccaggccac

SEQ ID NO: 530352 - DNA, 25 bp, Rattus norvegicus
gttgtattattcattgtggtcggtg

SEQ ID NO: 530353 - DNA, 25 bp, Rattus norvegicus
gttgtattattctttgtggtcggtg

SEQ ID NO: 530354 - DNA, 25 bp, Rattus norvegicus
gttgtattctcaaatgtgtctccta

SEQ ID NO: 530355 - DNA, 25 bp, Rattus norvegicus
gttgtattctcatatgtgtctccta

SEQ ID NO: 530356 - DNA, 25 bp, Rattus norvegicus
gttgtattctcccagagcacaagtc

SEQ ID NO: 530357 - DNA, 25 bp, Rattus norvegicus
gttgtattctccgagagcacaagtc

SEQ ID NO: 530358 - DNA, 25 bp, Rattus norvegicus
gttgtatttgtgcagctggccactt

SEQ ID NO: 530359 - DNA, 25 bp, Rattus norvegicus
gttgtatttgtggagctggccactt

SEQ ID NO: 530360 - DNA, 25 bp, Rattus norvegicus
gttgtattttagatgctcttcatct

SEQ ID NO: 530361 - DNA, 25 bp, Rattus norvegicus
gttgtattttagttgctcttcatct

SEQ ID NO: 530362 - DNA, 25 bp, Rattus norvegicus
gttgtcaactctcgataagctctag

SEQ ID NO: 530363 - DNA, 25 bp, Rattus norvegicus
gttgtcaactctggataagctctag

SEQ ID NO: 530364 - DNA, 25 bp, Rattus norvegicus
gttgtcaactgccattgctttgcat

SEQ ID NO: 530365 - DNA, 25 bp, Rattus norvegicus
gttgtcaactgcgattgctttgcat

SEQ ID NO: 530366 - DNA, 25 bp, Rattus norvegicus
gttgtcaagaacagtgggcctcacc

SEQ ID NO: 530367 - DNA, 25 bp, Rattus norvegicus
gttgtcaagaactgtgggcctcacc

SEQ ID NO: 530368 - DNA, 25 bp, Rattus norvegicus
gttgtcaatgtacccacatgtcttc

SEQ ID NO: 530369 - DNA, 25 bp, Rattus norvegicus
gttgtcaatgtagccacatgtcttc

SEQ ID NO: 530370 - DNA, 25 bp, Rattus norvegicus
gttgtcaccactacgaaggagctgt

SEQ ID NO: 530371 - DNA, 25 bp, Rattus norvegicus
gttgtcaccacttcgaaggagctgt

SEQ ID NO: 530372 - DNA, 25 bp, Rattus norvegicus
gttgtcacccaactgttagtctaca

SEQ ID NO: 530373 - DNA, 25 bp, Rattus norvegicus
gttgtcacccaagtgttagtctaca

SEQ ID NO: 530374 - DNA, 25 bp, Rattus norvegicus
gttgtcacccacactttaaaggcaa

SEQ ID NO: 530375 - DNA, 25 bp, Rattus norvegicus
gttgtcacccactctttaaaggcaa

SEQ ID NO: 530376 - DNA, 25 bp, Rattus norvegicus
gttgtcactatgcaacattttctgt

SEQ ID NO: 530377 - DNA, 25 bp, Rattus norvegicus
gttgtcactatggaacattttctgt

SEQ ID NO: 530378 - DNA, 25 bp, Rattus norvegicus
gttgtcactgccataattctaatgt

SEQ ID NO: 530379 - DNA, 25 bp, Rattus norvegicus
gttgtcactgccttaattctaatgt

SEQ ID NO: 530380 - DNA, 25 bp, Rattus norvegicus
gttgtcactgttcatccaacttgat

SEQ ID NO: 530381 - DNA, 25 bp, Rattus norvegicus
gttgtcactgttgatccaacttgat

SEQ ID NO: 530382 - DNA, 25 bp, Rattus norvegicus
gttgtcacttaaatatcatccagat

SEQ ID NO: 530383 - DNA, 25 bp, Rattus norvegicus
gttgtcacttaattatcatccagat

SEQ ID NO: 530384 - DNA, 25 bp, Rattus norvegicus
gttgtcagacaacacagtcagctag

SEQ ID NO: 530385 - DNA, 25 bp, Rattus norvegicus
gttgtcagacaagacagtcagctag

SEQ ID NO: 530386 - DNA, 25 bp, Rattus norvegicus
gttgtcagacccctgtgttggcagc

SEQ ID NO: 530387 - DNA, 25 bp, Rattus norvegicus
gttgtcagacccgtgtgttggcagc

SEQ ID NO: 530388 - DNA, 25 bp, Rattus norvegicus
gttgtcagatatcccagtagttccc

SEQ ID NO: 530389 - DNA, 25 bp, Rattus norvegicus
gttgtcagatatgccagtagttccc

SEQ ID NO: 530390 - DNA, 25 bp, Rattus norvegicus
gttgtcagggttactttgcagctaa

SEQ ID NO: 530391 - DNA, 25 bp, Rattus norvegicus
gttgtcagggtttctttgcagctaa

SEQ ID NO: 530392 - DNA, 25 bp, Rattus norvegicus
gttgtcaggttgaagctccatcaga

SEQ ID NO: 530393 - DNA, 25 bp, Rattus norvegicus
gttgtcaggttgtagctccatcaga

SEQ ID NO: 530394 - DNA, 25 bp, Rattus norvegicus
gttgtcagtcacagcacacatcgga

SEQ ID NO: 530395 - DNA, 25 bp, Rattus norvegicus
gttgtcagtcactgcacacatcgga

SEQ ID NO: 530396 - DNA, 25 bp, Rattus norvegicus
gttgtcatcggcagccagagacttg

SEQ ID NO: 530397 - DNA, 25 bp, Rattus norvegicus
gttgtcatcggctgccagagacttg

SEQ ID NO: 530398 - DNA, 25 bp, Rattus norvegicus
gttgtcatcgttctcttacccataa

SEQ ID NO: 530399 - DNA, 25 bp, Rattus norvegicus
gttgtcatcgttgtcttacccataa

SEQ ID NO: 530400 - DNA, 25 bp, Rattus norvegicus
gttgtcatgcggctgaaccttcagg

SEQ ID NO: 530401 - DNA, 25 bp, Rattus norvegicus
gttgtcatgcgggtgaaccttcagg

SEQ ID NO: 530402 - DNA, 25 bp, Rattus norvegicus
gttgtcattacaactgtttcatgtt

SEQ ID NO: 530403 - DNA, 25 bp, Rattus norvegicus
gttgtcattacatctgtttcatgtt

SEQ ID NO: 530404 - DNA, 25 bp, Rattus norvegicus
gttgtcattcaaccagagtttccct

SEQ ID NO: 530405 - DNA, 25 bp, Rattus norvegicus
gttgtcattcaagcagagtttccct

SEQ ID NO: 530406 - DNA, 25 bp, Rattus norvegicus
gttgtcattcctcgtggaggcacta

SEQ ID NO: 530407 - DNA, 25 bp, Rattus norvegicus
gttgtcattcctggtggaggcacta

SEQ ID NO: 530408 - DNA, 25 bp, Rattus norvegicus
gttgtcattgtcactctttcacatt

SEQ ID NO: 530409 - DNA, 25 bp, Rattus norvegicus
gttgtcattgtcattttctggcctc

SEQ ID NO: 530410 - DNA, 25 bp, Rattus norvegicus
gttgtcattgtctctctttcacatt

SEQ ID NO: 530411 - DNA, 25 bp, Rattus norvegicus
gttgtcattgtctttttctggcctc

SEQ ID NO: 530412 - DNA, 25 bp, Rattus norvegicus
gttgtcattttgcactatcaagcca

SEQ ID NO: 530413 - DNA, 25 bp, Rattus norvegicus
gttgtcattttggactatcaagcca

SEQ ID NO: 530414 - DNA, 25 bp, Rattus norvegicus
gttgtccaatggcagaaaccccagc

SEQ ID NO: 530415 - DNA, 25 bp, Rattus norvegicus
gttgtccaatgggagaaaccccagc

SEQ ID NO: 530416 - DNA, 25 bp, Rattus norvegicus
gttgtccaccttatttcagttgcag

SEQ ID NO: 530417 - DNA, 25 bp, Rattus norvegicus
gttgtccaccttttttcagttgcag

SEQ ID NO: 530418 - DNA, 25 bp, Rattus norvegicus
gttgtccacgagagcatagcggtct

SEQ ID NO: 530419 - DNA, 25 bp, Rattus norvegicus
gttgtccacgagtgcatagcggtct

SEQ ID NO: 530420 - DNA, 25 bp, Rattus norvegicus
gttgtccacggtcatggtctttgtg

SEQ ID NO: 530421 - DNA, 25 bp, Rattus norvegicus
gttgtccacggtgatggtctttgtg

SEQ ID NO: 530422 - DNA, 25 bp, Rattus norvegicus
gttgtccacgtgatcctagagcaga

SEQ ID NO: 530423 - DNA, 25 bp, Rattus norvegicus
gttgtccacgtgttcctagagcaga

SEQ ID NO: 530424 - DNA, 25 bp, Rattus norvegicus
gttgtccagcccatttcttttgaga

SEQ ID NO: 530425 - DNA, 25 bp, Rattus norvegicus
gttgtccagcccttttcttttgaga

SEQ ID NO: 530426 - DNA, 25 bp, Rattus norvegicus
gttgtccatatcactcaaggaaaaa

SEQ ID NO: 530427 - DNA, 25 bp, Rattus norvegicus
gttgtccatatctctcaaggaaaaa

SEQ ID NO: 530428 - DNA, 25 bp, Rattus norvegicus
gttgtccatcctcaatttgtgtctg

SEQ ID NO: 530429 - DNA, 25 bp, Rattus norvegicus
gttgtccatcctgaatttgtgtctg

SEQ ID NO: 530430 - DNA, 25 bp, Rattus norvegicus
gttgtccatgttaggccagagtgat

SEQ ID NO: 530431 - DNA, 25 bp, Rattus norvegicus
gttgtccatgttcctccttggcggt

SEQ ID NO: 530432 - DNA, 25 bp, Rattus norvegicus
gttgtccatgttgctccttggcggt

SEQ ID NO: 530433 - DNA, 25 bp, Rattus norvegicus
gttgtccatgtttggccagagtgat

SEQ ID NO: 530434 - DNA, 25 bp, Rattus norvegicus
gttgtcccaatcatcagtctttcat

SEQ ID NO: 530435 - DNA, 25 bp, Rattus norvegicus
gttgtcccaatcttcagtctttcat

SEQ ID NO: 530436 - DNA, 25 bp, Rattus norvegicus
gttgtccccaagagaggtatatcat

SEQ ID NO: 530437 - DNA, 25 bp, Rattus norvegicus
gttgtccccaagtgaggtatatcat

SEQ ID NO: 530438 - DNA, 25 bp, Rattus norvegicus
gttgtcccctcacagtgtgctagaa

SEQ ID NO: 530439 - DNA, 25 bp, Rattus norvegicus
gttgtcccctcagagtgtgctagaa

SEQ ID NO: 530440 - DNA, 25 bp, Rattus norvegicus
gttgtcccgaggaaacttcattcac

SEQ ID NO: 530441 - DNA, 25 bp, Rattus norvegicus
gttgtcccgaggtaacttcattcac

SEQ ID NO: 530442 - DNA, 25 bp, Rattus norvegicus
gttgtccctagcaaaaccgctgagc

SEQ ID NO: 530443 - DNA, 25 bp, Rattus norvegicus
gttgtccctagctaaaccgctgagc

SEQ ID NO: 530444 - DNA, 25 bp, Rattus norvegicus
gttgtccctgaaacctaacaagcac

SEQ ID NO: 530445 - DNA, 25 bp, Rattus norvegicus
gttgtccctgaatcctaacaagcac

SEQ ID NO: 530446 - DNA, 25 bp, Rattus norvegicus
gttgtccctggtctctatgtatttc

SEQ ID NO: 530447 - DNA, 25 bp, Rattus norvegicus
gttgtccctggtgtctatgtatttc

SEQ ID NO: 530448 - DNA, 25 bp, Rattus norvegicus
gttgtccgactgatgacagttctga

SEQ ID NO: 530449 - DNA, 25 bp, Rattus norvegicus
gttgtccgactgttgacagttctga

SEQ ID NO: 530450 - DNA, 25 bp, Rattus norvegicus
gttgtccgttttcctttgtgaacca

SEQ ID NO: 530451 - DNA, 25 bp, Rattus norvegicus
gttgtccgttttgctttgtgaacca

SEQ ID NO: 530452 - DNA, 25 bp, Rattus norvegicus
gttgtcctactccagcattcaaggg

SEQ ID NO: 530453 - DNA, 25 bp, Rattus norvegicus
gttgtcctactcgagcattcaaggg

SEQ ID NO: 530454 - DNA, 25 bp, Rattus norvegicus
gttgtcctagccatagtcttcgtaa

SEQ ID NO: 530455 - DNA, 25 bp, Rattus norvegicus
gttgtcctagccttagtcttcgtaa

SEQ ID NO: 530456 - DNA, 25 bp, Rattus norvegicus
gttgtcctagctaggaactcagtcc

SEQ ID NO: 530457 - DNA, 25 bp, Rattus norvegicus
gttgtcctagcttggaactcagtcc

SEQ ID NO: 530458 - DNA, 25 bp, Rattus norvegicus
gttgtcctagttcagattttaccct

SEQ ID NO: 530459 - DNA, 25 bp, Rattus norvegicus
gttgtcctagttgagattttaccct

SEQ ID NO: 530460 - DNA, 25 bp, Rattus norvegicus
gttgtcctcagcaaactgggaactg

SEQ ID NO: 530461 - DNA, 25 bp, Rattus norvegicus
gttgtcctcagctaactgggaactg

SEQ ID NO: 530462 - DNA, 25 bp, Rattus norvegicus
gttgtcctcctaactgacacatgta

SEQ ID NO: 530463 - DNA, 25 bp, Rattus norvegicus
gttgtcctcctatctgacacatgta

SEQ ID NO: 530464 - DNA, 25 bp, Rattus norvegicus
gttgtcctcggcaaattgggcatga

SEQ ID NO: 530465 - DNA, 25 bp, Rattus norvegicus
gttgtcctcggctaattgggcatga

SEQ ID NO: 530466 - DNA, 25 bp, Rattus norvegicus
gttgtcctctgacttaaatatgtat

SEQ ID NO: 530467 - DNA, 25 bp, Rattus norvegicus
gttgtcctctgagttaaatatgtat

SEQ ID NO: 530468 - DNA, 25 bp, Rattus norvegicus
gttgtcctctgcagtaaaaagtctg

SEQ ID NO: 530469 - DNA, 25 bp, Rattus norvegicus
gttgtcctctgctgtaaaaagtctg

SEQ ID NO: 530470 - DNA, 25 bp, Rattus norvegicus
gttgtcctctgtccagaaaacaggt

SEQ ID NO: 530471 - DNA, 25 bp, Rattus norvegicus
gttgtcctctgtgcagaaaacaggt

SEQ ID NO: 530472 - DNA, 25 bp, Rattus norvegicus
gttgtccttaggaattgaccctgga

SEQ ID NO: 530473 - DNA, 25 bp, Rattus norvegicus
gttgtccttaggtattgaccctgga

SEQ ID NO: 530474 - DNA, 25 bp, Rattus norvegicus
gttgtccttatcaccaagtatttgt

SEQ ID NO: 530475 - DNA, 25 bp, Rattus norvegicus
gttgtccttatctccaagtatttgt

SEQ ID NO: 530476 - DNA, 25 bp, Rattus norvegicus
gttgtccttccaaggatgtgcaatt

SEQ ID NO: 530477 - DNA, 25 bp, Rattus norvegicus
gttgtccttccatggatgtgcaatt

SEQ ID NO: 530478 - DNA, 25 bp, Rattus norvegicus
gttgtcctttacagtccacatacat

SEQ ID NO: 530479 - DNA, 25 bp, Rattus norvegicus
gttgtcctttactgtccacatacat

SEQ ID NO: 530480 - DNA, 25 bp, Rattus norvegicus
gttgtcctttgtcttttctgtctca

SEQ ID NO: 530481 - DNA, 25 bp, Rattus norvegicus
gttgtcctttgtgttttctgtctca

SEQ ID NO: 530482 - DNA, 25 bp, Rattus norvegicus
gttgtccttttaaaatgtagctcac

SEQ ID NO: 530483 - DNA, 25 bp, Rattus norvegicus
gttgtccttttaagccaacacctaa

SEQ ID NO: 530484 - DNA, 25 bp, Rattus norvegicus
gttgtccttttataatgtagctcac

SEQ ID NO: 530485 - DNA, 25 bp, Rattus norvegicus
gttgtccttttatgccaacacctaa

SEQ ID NO: 530486 - DNA, 25 bp, Rattus norvegicus
gttgtcgacatgaagatttcctgtt

SEQ ID NO: 530487 - DNA, 25 bp, Rattus norvegicus
gttgtcgacatgtagatttcctgtt

SEQ ID NO: 530488 - DNA, 25 bp, Rattus norvegicus
gttgtcgactgcagttgtacatact

SEQ ID NO: 530489 - DNA, 25 bp, Rattus norvegicus
gttgtcgactgctgttgtacatact

SEQ ID NO: 530490 - DNA, 25 bp, Rattus norvegicus
gttgtcgctggactttagcttttcc

SEQ ID NO: 530491 - DNA, 25 bp, Rattus norvegicus
gttgtcgctggagtttagcttttcc

SEQ ID NO: 530492 - DNA, 25 bp, Rattus norvegicus
gttgtcggcttaattttctggtact

SEQ ID NO: 530493 - DNA, 25 bp, Rattus norvegicus
gttgtcggcttatttttctggtact

SEQ ID NO: 530494 - DNA, 25 bp, Rattus norvegicus
gttgtcgtctttatgtcaggtgtat

SEQ ID NO: 530495 - DNA, 25 bp, Rattus norvegicus
gttgtcgtctttttgtcaggtgtat

SEQ ID NO: 530496 - DNA, 25 bp, Rattus norvegicus
gttgtcgttttaacatctccacgtc

SEQ ID NO: 530497 - DNA, 25 bp, Rattus norvegicus
gttgtcgttttatcatctccacgtc

SEQ ID NO: 530498 - DNA, 25 bp, Rattus norvegicus
gttgtctaaattcttcttaactcct

SEQ ID NO: 530499 - DNA, 25 bp, Rattus norvegicus
gttgtctaaattgttcttaactcct

SEQ ID NO: 530500 - DNA, 25 bp, Rattus norvegicus
gttgtctaattcaagccaagcttct

SEQ ID NO: 530501 - DNA, 25 bp, Rattus norvegicus
gttgtctaattctagccaagcttct

SEQ ID NO: 530502 - DNA, 25 bp, Rattus norvegicus
gttgtctacacgaaggtttcctgtt

SEQ ID NO: 530503 - DNA, 25 bp, Rattus norvegicus
gttgtctacacgaataacctgtaaa

SEQ ID NO: 530504 - DNA, 25 bp, Rattus norvegicus
gttgtctacacgtaggtttcctgtt

SEQ ID NO: 530505 - DNA, 25 bp, Rattus norvegicus
gttgtctacacgtataacctgtaaa

SEQ ID NO: 530506 - DNA, 25 bp, Rattus norvegicus
gttgtctacagacatgcctacgggc

SEQ ID NO: 530507 - DNA, 25 bp, Rattus norvegicus
gttgtctacagagatgcctacgggc

SEQ ID NO: 530508 - DNA, 25 bp, Rattus norvegicus
gttgtctacagtactttaaggttct

SEQ ID NO: 530509 - DNA, 25 bp, Rattus norvegicus
gttgtctacagtccaaatccatgtt

SEQ ID NO: 530510 - DNA, 25 bp, Rattus norvegicus
gttgtctacagtgcaaatccatgtt

SEQ ID NO: 530511 - DNA, 25 bp, Rattus norvegicus
gttgtctacagttctttaaggttct

SEQ ID NO: 530512 - DNA, 25 bp, Rattus norvegicus
gttgtctacttaactttacctatgg

SEQ ID NO: 530513 - DNA, 25 bp, Rattus norvegicus
gttgtctacttatctttacctatgg

SEQ ID NO: 530514 - DNA, 25 bp, Rattus norvegicus
gttgtctcacagaaaatctatagct

SEQ ID NO: 530515 - DNA, 25 bp, Rattus norvegicus
gttgtctcacagtaaatctatagct

SEQ ID NO: 530516 - DNA, 25 bp, Rattus norvegicus
gttgtctccaccagcatcagaagga

SEQ ID NO: 530517 - DNA, 25 bp, Rattus norvegicus
gttgtctccacctgcatcagaagga

SEQ ID NO: 530518 - DNA, 25 bp, Rattus norvegicus
gttgtctccatgactgactgactgt

SEQ ID NO: 530519 - DNA, 25 bp, Rattus norvegicus
gttgtctccatgtctgactgactgt

SEQ ID NO: 530520 - DNA, 25 bp, Rattus norvegicus
gttgtctccccacagcatttgaaga

SEQ ID NO: 530521 - DNA, 25 bp, Rattus norvegicus
gttgtctccccagagcatttgaaga

SEQ ID NO: 530522 - DNA, 25 bp, Rattus norvegicus
gttgtctcctatagcctggacagga

SEQ ID NO: 530523 - DNA, 25 bp, Rattus norvegicus
gttgtctcctattgcctggacagga

SEQ ID NO: 530524 - DNA, 25 bp, Rattus norvegicus
gttgtctcctgtcacttcaacagca

SEQ ID NO: 530525 - DNA, 25 bp, Rattus norvegicus
gttgtctcctgtgacttcaacagca

SEQ ID NO: 530526 - DNA, 25 bp, Rattus norvegicus
gttgtctcttctaagcttccaaatg

SEQ ID NO: 530527 - DNA, 25 bp, Rattus norvegicus
gttgtctcttcttagcttccaaatg

SEQ ID NO: 530528 - DNA, 25 bp, Rattus norvegicus
gttgtctcttgaaatatctatagca

SEQ ID NO: 530529 - DNA, 25 bp, Rattus norvegicus
gttgtctcttgatatatctatagca

SEQ ID NO: 530530 - DNA, 25 bp, Rattus norvegicus
gttgtctgactgatgttttgtggtt

SEQ ID NO: 530531 - DNA, 25 bp, Rattus norvegicus
gttgtctgactgttgttttgtggtt

SEQ ID NO: 530532 - DNA, 25 bp, Rattus norvegicus
gttgtctgagacatcctaaccatga

SEQ ID NO: 530533 - DNA, 25 bp, Rattus norvegicus
gttgtctgagacttcctaaccatga

SEQ ID NO: 530534 - DNA, 25 bp, Rattus norvegicus
gttgtctgcaagagaggcatcgtct

SEQ ID NO: 530535 - DNA, 25 bp, Rattus norvegicus
gttgtctgcaagtgaggcatcgtct

SEQ ID NO: 530536 - DNA, 25 bp, Rattus norvegicus
gttgtctgcacacctcaaggaggca

SEQ ID NO: 530537 - DNA, 25 bp, Rattus norvegicus
gttgtctgcacagctcaaggaggca

SEQ ID NO: 530538 - DNA, 25 bp, Rattus norvegicus
gttgtctgcagaacttcctctgata

SEQ ID NO: 530539 - DNA, 25 bp, Rattus norvegicus
gttgtctgcagatcttcctctgata

SEQ ID NO: 530540 - DNA, 25 bp, Rattus norvegicus
gttgtctgccagatactgctactta

SEQ ID NO: 530541 - DNA, 25 bp, Rattus norvegicus
gttgtctgccagttactgctactta

SEQ ID NO: 530542 - DNA, 25 bp, Rattus norvegicus
gttgtctgccctcagctatccatgc

SEQ ID NO: 530543 - DNA, 25 bp, Rattus norvegicus
gttgtctgccctgagctatccatgc

SEQ ID NO: 530544 - DNA, 25 bp, Rattus norvegicus
gttgtctgcttgctctgttcacaca

SEQ ID NO: 530545 - DNA, 25 bp, Rattus norvegicus
gttgtctgcttggtctgttcacaca

SEQ ID NO: 530546 - DNA, 25 bp, Rattus norvegicus
gttgtctggaaactccggctgcaat

SEQ ID NO: 530547 - DNA, 25 bp, Rattus norvegicus
gttgtctggaaagtccggctgcaat

SEQ ID NO: 530548 - DNA, 25 bp, Rattus norvegicus
gttgtctggctgataacacttgttt

SEQ ID NO: 530549 - DNA, 25 bp, Rattus norvegicus
gttgtctggctgttaacacttgttt

SEQ ID NO: 530550 - DNA, 25 bp, Rattus norvegicus
gttgtctgggagacacagttcacca

SEQ ID NO: 530551 - DNA, 25 bp, Rattus norvegicus
gttgtctgggagtcacagttcacca

SEQ ID NO: 530552 - DNA, 25 bp, Rattus norvegicus
gttgtctgtaaccaatcacctgttc

SEQ ID NO: 530553 - DNA, 25 bp, Rattus norvegicus
gttgtctgtaacgaatcacctgttc

SEQ ID NO: 530554 - DNA, 25 bp, Rattus norvegicus
gttgtctgtacaacaaagaagccat

SEQ ID NO: 530555 - DNA, 25 bp, Rattus norvegicus
gttgtctgtacatcaaagaagccat

SEQ ID NO: 530556 - DNA, 25 bp, Rattus norvegicus
gttgtctgtatcatgaattatgtca

SEQ ID NO: 530557 - DNA, 25 bp, Rattus norvegicus
gttgtctgtatcttgaattatgtca

SEQ ID NO: 530558 - DNA, 25 bp, Rattus norvegicus
gttgtctgtctgaggactgacactt

SEQ ID NO: 530559 - DNA, 25 bp, Rattus norvegicus
gttgtctgtctgtggactgacactt

SEQ ID NO: 530560 - DNA, 25 bp, Rattus norvegicus
gttgtctgtgaacatgcgccacgtg

SEQ ID NO: 530561 - DNA, 25 bp, Rattus norvegicus
gttgtctgtgaagatgcgccacgtg

SEQ ID NO: 530562 - DNA, 25 bp, Rattus norvegicus
gttgtctgtggcatggttactccca

SEQ ID NO: 530563 - DNA, 25 bp, Rattus norvegicus
gttgtctgtggcttggttactccca

SEQ ID NO: 530564 - DNA, 25 bp, Rattus norvegicus
gttgtctgtggtagtcacccagcat

SEQ ID NO: 530565 - DNA, 25 bp, Rattus norvegicus
gttgtctgtggttgtcacccagcat

SEQ ID NO: 530566 - DNA, 25 bp, Rattus norvegicus
gttgtctgtttgagtgatttgtttc

SEQ ID NO: 530567 - DNA, 25 bp, Rattus norvegicus
gttgtctgtttgtgtgatttgtttc

SEQ ID NO: 530568 - DNA, 25 bp, Rattus norvegicus
gttgtcttaaaaccgcggcacctac

SEQ ID NO: 530569 - DNA, 25 bp, Rattus norvegicus
gttgtcttaaaagcgcggcacctac

SEQ ID NO: 530570 - DNA, 25 bp, Rattus norvegicus
gttgtcttaactctcttctcaaagg

SEQ ID NO: 530571 - DNA, 25 bp, Rattus norvegicus
gttgtcttaactgtcttctcaaagg

SEQ ID NO: 530572 - DNA, 25 bp, Rattus norvegicus
gttgtcttctacactaggatgacat

SEQ ID NO: 530573 - DNA, 25 bp, Rattus norvegicus
gttgtcttctactctaggatgacat

SEQ ID NO: 530574 - DNA, 25 bp, Rattus norvegicus
gttgtcttcttcatgcttcgaaata

SEQ ID NO: 530575 - DNA, 25 bp, Rattus norvegicus
gttgtcttcttcttgcttcgaaata

SEQ ID NO: 530576 - DNA, 25 bp, Rattus norvegicus
gttgtcttggtacaagacgatctat

SEQ ID NO: 530577 - DNA, 25 bp, Rattus norvegicus
gttgtcttggtagaagacgatctat

SEQ ID NO: 530578 - DNA, 25 bp, Rattus norvegicus
gttgtcttgtctagcgtttggtaac

SEQ ID NO: 530579 - DNA, 25 bp, Rattus norvegicus
gttgtcttgtctatatttgcttacc

SEQ ID NO: 530580 - DNA, 25 bp, Rattus norvegicus
gttgtcttgtcttgcgtttggtaac

SEQ ID NO: 530581 - DNA, 25 bp, Rattus norvegicus
gttgtcttgtctttatttgcttacc

SEQ ID NO: 530582 - DNA, 25 bp, Rattus norvegicus
gttgtctttatcaaccttacctgaa

SEQ ID NO: 530583 - DNA, 25 bp, Rattus norvegicus
gttgtctttatctaccttacctgaa

SEQ ID NO: 530584 - DNA, 25 bp, Rattus norvegicus
gttgtctttattcatagccgcttgg

SEQ ID NO: 530585 - DNA, 25 bp, Rattus norvegicus
gttgtctttattgatagccgcttgg

SEQ ID NO: 530586 - DNA, 25 bp, Rattus norvegicus
gttgtctttcgccagtgtgtaatga

SEQ ID NO: 530587 - DNA, 25 bp, Rattus norvegicus
gttgtctttcgcgagtgtgtaatga

SEQ ID NO: 530588 - DNA, 25 bp, Rattus norvegicus
gttgtctttctacccgatgaagcag

SEQ ID NO: 530589 - DNA, 25 bp, Rattus norvegicus
gttgtctttctagccgatgaagcag

SEQ ID NO: 530590 - DNA, 25 bp, Rattus norvegicus
gttgtctttggaagtgatgcccaca

SEQ ID NO: 530591 - DNA, 25 bp, Rattus norvegicus
gttgtctttggatgtgatgcccaca

SEQ ID NO: 530592 - DNA, 25 bp, Rattus norvegicus
gttgtcttttgaacatgttcaccaa

SEQ ID NO: 530593 - DNA, 25 bp, Rattus norvegicus
gttgtcttttgatcatgttcaccaa

SEQ ID NO: 530594 - DNA, 25 bp, Rattus norvegicus
gttgtgaaataaagccctcctctgg

SEQ ID NO: 530595 - DNA, 25 bp, Rattus norvegicus
gttgtgaaataatgccctcctctgg

SEQ ID NO: 530596 - DNA, 25 bp, Rattus norvegicus
gttgtgaacagcagcagcgtgctta

SEQ ID NO: 530597 - DNA, 25 bp, Rattus norvegicus
gttgtgaacagctgcagcgtgctta

SEQ ID NO: 530598 - DNA, 25 bp, Rattus norvegicus
gttgtgaaccatcagaccttcagca

SEQ ID NO: 530599 - DNA, 25 bp, Rattus norvegicus
gttgtgaaccatgagaccttcagca

SEQ ID NO: 530600 - DNA, 25 bp, Rattus norvegicus
gttgtgaactccagttctgcttgtc

SEQ ID NO: 530601 - DNA, 25 bp, Rattus norvegicus
gttgtgaactcctgttctgcttgtc

SEQ ID NO: 530602 - DNA, 25 bp, Rattus norvegicus
gttgtgaactgtagccaggtaccca

SEQ ID NO: 530603 - DNA, 25 bp, Rattus norvegicus
gttgtgaactgttgccaggtaccca

SEQ ID NO: 530604 - DNA, 25 bp, Rattus norvegicus
gttgtgaagcccacgctgcaggagc

SEQ ID NO: 530605 - DNA, 25 bp, Rattus norvegicus
gttgtgaagccctcgctgcaggagc

SEQ ID NO: 530606 - DNA, 25 bp, Rattus norvegicus
gttgtgaagtacaccttataccgga

SEQ ID NO: 530607 - DNA, 25 bp, Rattus norvegicus
gttgtgaagtactccttataccgga

SEQ ID NO: 530608 - DNA, 25 bp, Rattus norvegicus
gttgtgaatattatctctcccgtag

SEQ ID NO: 530609 - DNA, 25 bp, Rattus norvegicus
gttgtgaatattttctctcccgtag

SEQ ID NO: 530610 - DNA, 25 bp, Rattus norvegicus
gttgtgaatcgcatcccgtatataa

SEQ ID NO: 530611 - DNA, 25 bp, Rattus norvegicus
gttgtgaatcgcttcccgtatataa

SEQ ID NO: 530612 - DNA, 25 bp, Rattus norvegicus
gttgtgacaataaatagtccgtggg

SEQ ID NO: 530613 - DNA, 25 bp, Rattus norvegicus
gttgtgacaatatatagtccgtggg

SEQ ID NO: 530614 - DNA, 25 bp, Rattus norvegicus
gttgtgaccatccagcggagcaaga

SEQ ID NO: 530615 - DNA, 25 bp, Rattus norvegicus
gttgtgaccatcgagcggagcaaga

SEQ ID NO: 530616 - DNA, 25 bp, Rattus norvegicus
gttgtgacccaaattactctgataa

SEQ ID NO: 530617 - DNA, 25 bp, Rattus norvegicus
gttgtgacccaatttactctgataa

SEQ ID NO: 530618 - DNA, 25 bp, Rattus norvegicus
gttgtgacgaacacaaatcctttct

SEQ ID NO: 530619 - DNA, 25 bp, Rattus norvegicus
gttgtgacgaactcaaatcctttct

SEQ ID NO: 530620 - DNA, 25 bp, Rattus norvegicus
gttgtgacttagcattcatcgcatg

SEQ ID NO: 530621 - DNA, 25 bp, Rattus norvegicus
gttgtgacttaggattcatcgcatg

SEQ ID NO: 530622 - DNA, 25 bp, Rattus norvegicus
gttgtgagaaacatttccttgattt

SEQ ID NO: 530623 - DNA, 25 bp, Rattus norvegicus
gttgtgagaaacttttccttgattt

SEQ ID NO: 530624 - DNA, 25 bp, Rattus norvegicus
gttgtgagcacgaccatcatttatt

SEQ ID NO: 530625 - DNA, 25 bp, Rattus norvegicus
gttgtgagcacgtccatcatttatt

SEQ ID NO: 530626 - DNA, 25 bp, Rattus norvegicus
gttgtgagctctctgtgatggcctc

SEQ ID NO: 530627 - DNA, 25 bp, Rattus norvegicus
gttgtgagctctgtgtgatggcctc

SEQ ID NO: 530628 - DNA, 25 bp, Rattus norvegicus
gttgtgaggtgaccgactgccattc

SEQ ID NO: 530629 - DNA, 25 bp, Rattus norvegicus
gttgtgaggtgagcgactgccattc

SEQ ID NO: 530630 - DNA, 25 bp, Rattus norvegicus
gttgtgagtcaaactgctgccttta

SEQ ID NO: 530631 - DNA, 25 bp, Rattus norvegicus
gttgtgagtcaatctgctgccttta

SEQ ID NO: 530632 - DNA, 25 bp, Rattus norvegicus
gttgtgatagtcaaccttccaaggt

SEQ ID NO: 530633 - DNA, 25 bp, Rattus norvegicus
gttgtgatagtctaccttccaaggt

SEQ ID NO: 530634 - DNA, 25 bp, Rattus norvegicus
gttgtgatctcaaaggaacttctcc

SEQ ID NO: 530635 - DNA, 25 bp, Rattus norvegicus
gttgtgatctcataggaacttctcc

SEQ ID NO: 530636 - DNA, 25 bp, Rattus norvegicus
gttgtgatgtccatttatttttctc

SEQ ID NO: 530637 - DNA, 25 bp, Rattus norvegicus
gttgtgatgtccttttatttttctc

SEQ ID NO: 530638 - DNA, 25 bp, Rattus norvegicus
gttgtgattagcctaagacctcaag

SEQ ID NO: 530639 - DNA, 25 bp, Rattus norvegicus
gttgtgattagcgtaagacctcaag

SEQ ID NO: 530640 - DNA, 25 bp, Rattus norvegicus
gttgtgattcccactggaccgagaa

SEQ ID NO: 530641 - DNA, 25 bp, Rattus norvegicus
gttgtgattccctctggaccgagaa

SEQ ID NO: 530642 - DNA, 25 bp, Rattus norvegicus
gttgtgattcctcgagtctaggcca

SEQ ID NO: 530643 - DNA, 25 bp, Rattus norvegicus
gttgtgattcctggagtctaggcca

SEQ ID NO: 530644 - DNA, 25 bp, Rattus norvegicus
gttgtgattctgatatgcatttgtg

SEQ ID NO: 530645 - DNA, 25 bp, Rattus norvegicus
gttgtgattctgttatgcatttgtg

SEQ ID NO: 530646 - DNA, 25 bp, Rattus norvegicus
gttgtgattgaaatcctgggctcac

SEQ ID NO: 530647 - DNA, 25 bp, Rattus norvegicus
gttgtgattgaattcctgggctcac

SEQ ID NO: 530648 - DNA, 25 bp, Rattus norvegicus
gttgtgcaaatgatcagcattgatg

SEQ ID NO: 530649 - DNA, 25 bp, Rattus norvegicus
gttgtgcaaatgttcagcattgatg

SEQ ID NO: 530650 - DNA, 25 bp, Rattus norvegicus
gttgtgcaatacagttgtagcctct

SEQ ID NO: 530651 - DNA, 25 bp, Rattus norvegicus
gttgtgcaatactgttgtagcctct

SEQ ID NO: 530652 - DNA, 25 bp, Rattus norvegicus
gttgtgcaatggaggcagccaacct

SEQ ID NO: 530653 - DNA, 25 bp, Rattus norvegicus
gttgtgcaatggtggcagccaacct

SEQ ID NO: 530654 - DNA, 25 bp, Rattus norvegicus
gttgtgcacatgcttgcctgcacag

SEQ ID NO: 530655 - DNA, 25 bp, Rattus norvegicus
gttgtgcacatggttgcctgcacag

SEQ ID NO: 530656 - DNA, 25 bp, Rattus norvegicus
gttgtgcaccaaactgtggctggac

SEQ ID NO: 530657 - DNA, 25 bp, Rattus norvegicus
gttgtgcaccaatctgtggctggac

SEQ ID NO: 530658 - DNA, 25 bp, Rattus norvegicus
gttgtgcataacctccaagatctcc

SEQ ID NO: 530659 - DNA, 25 bp, Rattus norvegicus
gttgtgcataacgtccaagatctcc

SEQ ID NO: 530660 - DNA, 25 bp, Rattus norvegicus
gttgtgcatatcagtatctaccggg

SEQ ID NO: 530661 - DNA, 25 bp, Rattus norvegicus
gttgtgcatatctgtatctaccggg

SEQ ID NO: 530662 - DNA, 25 bp, Rattus norvegicus
gttgtgcatttgaaccttacgtctt

SEQ ID NO: 530663 - DNA, 25 bp, Rattus norvegicus
gttgtgcatttgtaccttacgtctt

SEQ ID NO: 530664 - DNA, 25 bp, Rattus norvegicus
gttgtgccacggcatgaaatcataa

SEQ ID NO: 530665 - DNA, 25 bp, Rattus norvegicus
gttgtgccacgggatgaaatcataa

SEQ ID NO: 530666 - DNA, 25 bp, Rattus norvegicus
gttgtgccagcaccccacagttcga

SEQ ID NO: 530667 - DNA, 25 bp, Rattus norvegicus
gttgtgccagcagcccacagttcga

SEQ ID NO: 530668 - DNA, 25 bp, Rattus norvegicus
gttgtgccctagactgaaagttaat

SEQ ID NO: 530669 - DNA, 25 bp, Rattus norvegicus
gttgtgccctagtctgaaagttaat

SEQ ID NO: 530670 - DNA, 25 bp, Rattus norvegicus
gttgtgcctgctaccattaaacagt

SEQ ID NO: 530671 - DNA, 25 bp, Rattus norvegicus
gttgtgcctgcttccattaaacagt

SEQ ID NO: 530672 - DNA, 25 bp, Rattus norvegicus
gttgtgcgctcaactcttattaaaa

SEQ ID NO: 530673 - DNA, 25 bp, Rattus norvegicus
gttgtgcgctcatctcttattaaaa

SEQ ID NO: 530674 - DNA, 25 bp, Rattus norvegicus
gttgtgctaacgctaagccatttct

SEQ ID NO: 530675 - DNA, 25 bp, Rattus norvegicus
gttgtgctaacggtaagccatttct

SEQ ID NO: 530676 - DNA, 25 bp, Rattus norvegicus
gttgtgctaactaactccatatatg

SEQ ID NO: 530677 - DNA, 25 bp, Rattus norvegicus
gttgtgctaacttactccatatatg

SEQ ID NO: 530678 - DNA, 25 bp, Rattus norvegicus
gttgtgctcagaataggcccattgg

SEQ ID NO: 530679 - DNA, 25 bp, Rattus norvegicus
gttgtgctcagattaggcccattgg

SEQ ID NO: 530680 - DNA, 25 bp, Rattus norvegicus
gttgtgctccggacgccgccaggct

SEQ ID NO: 530681 - DNA, 25 bp, Rattus norvegicus
gttgtgctccggtcgccgccaggct

SEQ ID NO: 530682 - DNA, 25 bp, Rattus norvegicus
gttgtgctctacagtgtatctatat

SEQ ID NO: 530683 - DNA, 25 bp, Rattus norvegicus
gttgtgctctactgtgtatctatat

SEQ ID NO: 530684 - DNA, 25 bp, Rattus norvegicus
gttgtgctctagaaactgtcctggc

SEQ ID NO: 530685 - DNA, 25 bp, Rattus norvegicus
gttgtgctctagtaactgtcctggc

SEQ ID NO: 530686 - DNA, 25 bp, Rattus norvegicus
gttgtgctctgtatactttatgacc

SEQ ID NO: 530687 - DNA, 25 bp, Rattus norvegicus
gttgtgctctgtttactttatgacc

SEQ ID NO: 530688 - DNA, 25 bp, Rattus norvegicus
gttgtgctgactacaaattctgatg

SEQ ID NO: 530689 - DNA, 25 bp, Rattus norvegicus
gttgtgctgacttcaaattctgatg

SEQ ID NO: 530690 - DNA, 25 bp, Rattus norvegicus
gttgtgctgatactgcagtagcccc

SEQ ID NO: 530691 - DNA, 25 bp, Rattus norvegicus
gttgtgctgatagtgcagtagcccc

SEQ ID NO: 530692 - DNA, 25 bp, Rattus norvegicus
gttgtgctgattatgttgaaccgaa

SEQ ID NO: 530693 - DNA, 25 bp, Rattus norvegicus
gttgtgctgattttgttgaaccgaa

SEQ ID NO: 530694 - DNA, 25 bp, Rattus norvegicus
gttgtgctttatcccagaagtcact

SEQ ID NO: 530695 - DNA, 25 bp, Rattus norvegicus
gttgtgctttatgccagaagtcact

SEQ ID NO: 530696 - DNA, 25 bp, Rattus norvegicus
gttgtggacaagctcctcagtgtga

SEQ ID NO: 530697 - DNA, 25 bp, Rattus norvegicus
gttgtggacaaggtcctcagtgtga

SEQ ID NO: 530698 - DNA, 25 bp, Rattus norvegicus
gttgtggacaggacggtttctctcc

SEQ ID NO: 530699 - DNA, 25 bp, Rattus norvegicus
gttgtggacaggtcggtttctctcc

SEQ ID NO: 530700 - DNA, 25 bp, Rattus norvegicus
gttgtggacctactgtctactataa

SEQ ID NO: 530701 - DNA, 25 bp, Rattus norvegicus
gttgtggacctagtgtctactataa

SEQ ID NO: 530702 - DNA, 25 bp, Rattus norvegicus
gttgtggagaacatcatgctgatca

SEQ ID NO: 530703 - DNA, 25 bp, Rattus norvegicus
gttgtggagaacttcatgctgatca

SEQ ID NO: 530704 - DNA, 25 bp, Rattus norvegicus
gttgtggatgtgactgtattctgta

SEQ ID NO: 530705 - DNA, 25 bp, Rattus norvegicus
gttgtggatgtgtctgtattctgta

SEQ ID NO: 530706 - DNA, 25 bp, Rattus norvegicus
gttgtggcaagtcttaacctttgga

SEQ ID NO: 530707 - DNA, 25 bp, Rattus norvegicus
gttgtggcaagtgttaacctttgga

SEQ ID NO: 530708 - DNA, 25 bp, Rattus norvegicus
gttgtggccacaacgagaagtgctc

SEQ ID NO: 530709 - DNA, 25 bp, Rattus norvegicus
gttgtggccacatcgagaagtgctc

SEQ ID NO: 530710 - DNA, 25 bp, Rattus norvegicus
gttgtggccttcactgtcaataaat

SEQ ID NO: 530711 - DNA, 25 bp, Rattus norvegicus
gttgtggccttctctgtcaataaat

SEQ ID NO: 530712 - DNA, 25 bp, Rattus norvegicus
gttgtggctgcacagtagtgaaccc

SEQ ID NO: 530713 - DNA, 25 bp, Rattus norvegicus
gttgtggctgcagagtagtgaaccc

SEQ ID NO: 530714 - DNA, 25 bp, Rattus norvegicus
gttgtgggaacaactcgaggcttga

SEQ ID NO: 530715 - DNA, 25 bp, Rattus norvegicus
gttgtgggaacacggctcgctcttc

SEQ ID NO: 530716 - DNA, 25 bp, Rattus norvegicus
gttgtgggaacagggctcgctcttc

SEQ ID NO: 530717 - DNA, 25 bp, Rattus norvegicus
gttgtgggaacatctcgaggcttga

SEQ ID NO: 530718 - DNA, 25 bp, Rattus norvegicus
gttgtgggacccaaactgagttcct

SEQ ID NO: 530719 - DNA, 25 bp, Rattus norvegicus
gttgtgggaccctaactgagttcct

SEQ ID NO: 530720 - DNA, 25 bp, Rattus norvegicus
gttgtgggacgcatacttgaggaaa

SEQ ID NO: 530721 - DNA, 25 bp, Rattus norvegicus
gttgtgggacgcttacttgaggaaa

SEQ ID NO: 530722 - DNA, 25 bp, Rattus norvegicus
gttgtgggtggtaatgaatcatctg

SEQ ID NO: 530723 - DNA, 25 bp, Rattus norvegicus
gttgtgggtggttatgaatcatctg

SEQ ID NO: 530724 - DNA, 25 bp, Rattus norvegicus
gttgtggtacaacttatgactcaag

SEQ ID NO: 530725 - DNA, 25 bp, Rattus norvegicus
gttgtggtacaagttatgactcaag

SEQ ID NO: 530726 - DNA, 25 bp, Rattus norvegicus
gttgtggtagacatctgtgacatct

SEQ ID NO: 530727 - DNA, 25 bp, Rattus norvegicus
gttgtggtagacttctgtgacatct

SEQ ID NO: 530728 - DNA, 25 bp, Rattus norvegicus
gttgtggtgaacagttatagcttgt

SEQ ID NO: 530729 - DNA, 25 bp, Rattus norvegicus
gttgtggtgaactgttatagcttgt

SEQ ID NO: 530730 - DNA, 25 bp, Rattus norvegicus
gttgtggtgactcccgactgtaaaa

SEQ ID NO: 530731 - DNA, 25 bp, Rattus norvegicus
gttgtggtgactgccgactgtaaaa

SEQ ID NO: 530732 - DNA, 25 bp, Rattus norvegicus
gttgtggttcctcacaaatgctgtc

SEQ ID NO: 530733 - DNA, 25 bp, Rattus norvegicus
gttgtggttcctgacaaatgctgtc

SEQ ID NO: 530734 - DNA, 25 bp, Rattus norvegicus
gttgtggtttgacggcttcttaatc

SEQ ID NO: 530735 - DNA, 25 bp, Rattus norvegicus
gttgtggtttgagggcttcttaatc

SEQ ID NO: 530736 - DNA, 25 bp, Rattus norvegicus
gttgtgtaagaaccaggcttcccaa

SEQ ID NO: 530737 - DNA, 25 bp, Rattus norvegicus
gttgtgtaagaagcaggcttcccaa

SEQ ID NO: 530738 - DNA, 25 bp, Rattus norvegicus
gttgtgtagattaaccccttccatg

SEQ ID NO: 530739 - DNA, 25 bp, Rattus norvegicus
gttgtgtagatttaccccttccatg

SEQ ID NO: 530740 - DNA, 25 bp, Rattus norvegicus
gttgtgtcaccccagctagaatgct

SEQ ID NO: 530741 - DNA, 25 bp, Rattus norvegicus
gttgtgtcacccgagctagaatgct

SEQ ID NO: 530742 - DNA, 25 bp, Rattus norvegicus
gttgtgtcactcaatggtctaccta

SEQ ID NO: 530743 - DNA, 25 bp, Rattus norvegicus
gttgtgtcactctatggtctaccta

SEQ ID NO: 530744 - DNA, 25 bp, Rattus norvegicus
gttgtgtcatgtcctccaatttgtt

SEQ ID NO: 530745 - DNA, 25 bp, Rattus norvegicus
gttgtgtcatgtgctccaatttgtt

SEQ ID NO: 530746 - DNA, 25 bp, Rattus norvegicus
gttgtgtccagcaccaagtatggct

SEQ ID NO: 530747 - DNA, 25 bp, Rattus norvegicus
gttgtgtccagctccaagtatggct

SEQ ID NO: 530748 - DNA, 25 bp, Rattus norvegicus
gttgtgtccataagctctggcttag

SEQ ID NO: 530749 - DNA, 25 bp, Rattus norvegicus
gttgtgtccatatgctctggcttag

SEQ ID NO: 530750 - DNA, 25 bp, Rattus norvegicus
gttgtgtccccaccagcaaaacgag

SEQ ID NO: 530751 - DNA, 25 bp, Rattus norvegicus
gttgtgtccccagcagcaaaacgag

SEQ ID NO: 530752 - DNA, 25 bp, Rattus norvegicus
gttgtgtctcttctcgtatgtggcc

SEQ ID NO: 530753 - DNA, 25 bp, Rattus norvegicus
gttgtgtctcttgtcgtatgtggcc

SEQ ID NO: 530754 - DNA, 25 bp, Rattus norvegicus
gttgtgtctgatccagcttttcagt

SEQ ID NO: 530755 - DNA, 25 bp, Rattus norvegicus
gttgtgtctgatcgtagtcttactt

SEQ ID NO: 530756 - DNA, 25 bp, Rattus norvegicus
gttgtgtctgatgcagcttttcagt

SEQ ID NO: 530757 - DNA, 25 bp, Rattus norvegicus
gttgtgtctgatggtagtcttactt

SEQ ID NO: 530758 - DNA, 25 bp, Rattus norvegicus
gttgtgtcttccaagttggatcagt

SEQ ID NO: 530759 - DNA, 25 bp, Rattus norvegicus
gttgtgtcttcctagttggatcagt

SEQ ID NO: 530760 - DNA, 25 bp, Rattus norvegicus
gttgtgtgaacaagcttccgactgc

SEQ ID NO: 530761 - DNA, 25 bp, Rattus norvegicus
gttgtgtgaacatgcttccgactgc

SEQ ID NO: 530762 - DNA, 25 bp, Rattus norvegicus
gttgtgtgaatgaccttttccattt

SEQ ID NO: 530763 - DNA, 25 bp, Rattus norvegicus
gttgtgtgaatgtccttttccattt

SEQ ID NO: 530764 - DNA, 25 bp, Rattus norvegicus
gttgtgtgagtgaaagctgcctgtc

SEQ ID NO: 530765 - DNA, 25 bp, Rattus norvegicus
gttgtgtgagtgtaagctgcctgtc

SEQ ID NO: 530766 - DNA, 25 bp, Rattus norvegicus
gttgtgtgatttattccttctggtt

SEQ ID NO: 530767 - DNA, 25 bp, Rattus norvegicus
gttgtgtgattttttccttctggtt

SEQ ID NO: 530768 - DNA, 25 bp, Rattus norvegicus
gttgtgtgcccaattattgcagatc

SEQ ID NO: 530769 - DNA, 25 bp, Rattus norvegicus
gttgtgtgcccatttattgcagatc

SEQ ID NO: 530770 - DNA, 25 bp, Rattus norvegicus
gttgtgtgcgttagtatctcatgga

SEQ ID NO: 530771 - DNA, 25 bp, Rattus norvegicus
gttgtgtgcgtttgtatctcatgga

SEQ ID NO: 530772 - DNA, 25 bp, Rattus norvegicus
gttgtgtggcctagagagactttag

SEQ ID NO: 530773 - DNA, 25 bp, Rattus norvegicus
gttgtgtggccttgagagactttag

SEQ ID NO: 530774 - DNA, 25 bp, Rattus norvegicus
gttgtgtggtccatatttgccatac

SEQ ID NO: 530775 - DNA, 25 bp, Rattus norvegicus
gttgtgtggtccttatttgccatac

SEQ ID NO: 530776 - DNA, 25 bp, Rattus norvegicus
gttgtgtgtcctatagattcattct

SEQ ID NO: 530777 - DNA, 25 bp, Rattus norvegicus
gttgtgtgtcctttagattcattct

SEQ ID NO: 530778 - DNA, 25 bp, Rattus norvegicus
gttgtgtgtttactcctggccaggc

SEQ ID NO: 530779 - DNA, 25 bp, Rattus norvegicus
gttgtgtgtttagtcctggccaggc

SEQ ID NO: 530780 - DNA, 25 bp, Rattus norvegicus
gttgtgttactcagccataaccttc

SEQ ID NO: 530781 - DNA, 25 bp, Rattus norvegicus
gttgtgttactctgccataaccttc

SEQ ID NO: 530782 - DNA, 25 bp, Rattus norvegicus
gttgtgttcagcctggccgaagctt

SEQ ID NO: 530783 - DNA, 25 bp, Rattus norvegicus
gttgtgttcagcgtggccgaagctt

SEQ ID NO: 530784 - DNA, 25 bp, Rattus norvegicus
gttgtgttcatgacatttaagccat

SEQ ID NO: 530785 - DNA, 25 bp, Rattus norvegicus
gttgtgttcatgtcatttaagccat

SEQ ID NO: 530786 - DNA, 25 bp, Rattus norvegicus
gttgtgttctttccagaccctgaaa

SEQ ID NO: 530787 - DNA, 25 bp, Rattus norvegicus
gttgtgttctttgcagaccctgaaa

SEQ ID NO: 530788 - DNA, 25 bp, Rattus norvegicus
gttgtgttgccgaaaatgtccttaa

SEQ ID NO: 530789 - DNA, 25 bp, Rattus norvegicus
gttgtgttgccgtaaatgtccttaa

SEQ ID NO: 530790 - DNA, 25 bp, Rattus norvegicus
gttgtgttggttctctcttctcttt

SEQ ID NO: 530791 - DNA, 25 bp, Rattus norvegicus
gttgtgttggttgtctcttctcttt

SEQ ID NO: 530792 - DNA, 25 bp, Rattus norvegicus
gttgtgtttataatcttggcctttt

SEQ ID NO: 530793 - DNA, 25 bp, Rattus norvegicus
gttgtgtttatattcttggcctttt

SEQ ID NO: 530794 - DNA, 25 bp, Rattus norvegicus
gttgtgtttcccatttatctgtgaa

SEQ ID NO: 530795 - DNA, 25 bp, Rattus norvegicus
gttgtgtttcccttttatctgtgaa

SEQ ID NO: 530796 - DNA, 25 bp, Rattus norvegicus
gttgtgtttgacactccaccttgag

SEQ ID NO: 530797 - DNA, 25 bp, Rattus norvegicus
gttgtgtttgactctccaccttgag

SEQ ID NO: 530798 - DNA, 25 bp, Rattus norvegicus
gttgtgtttggtacatatacaagcc

SEQ ID NO: 530799 - DNA, 25 bp, Rattus norvegicus
gttgtgtttggttcatatacaagcc

SEQ ID NO: 530800 - DNA, 25 bp, Rattus norvegicus
gttgtgtttgtacgcttgtaccgtc

SEQ ID NO: 530801 - DNA, 25 bp, Rattus norvegicus
gttgtgtttgtaggcttgtaccgtc

SEQ ID NO: 530802 - DNA, 25 bp, Rattus norvegicus
gttgtgttttacagcctgtcattta

SEQ ID NO: 530803 - DNA, 25 bp, Rattus norvegicus
gttgtgttttactgcctgtcattta

SEQ ID NO: 530804 - DNA, 25 bp, Rattus norvegicus
gttgttaagaccaccgactgctctt

SEQ ID NO: 530805 - DNA, 25 bp, Rattus norvegicus
gttgttaagacctccgactgctctt

SEQ ID NO: 530806 - DNA, 25 bp, Rattus norvegicus
gttgttaagccaaggactctgttta

SEQ ID NO: 530807 - DNA, 25 bp, Rattus norvegicus
gttgttaagccatggactctgttta

SEQ ID NO: 530808 - DNA, 25 bp, Rattus norvegicus
gttgttaatgacctggtgacctttg

SEQ ID NO: 530809 - DNA, 25 bp, Rattus norvegicus
gttgttaatgacgtggtgacctttg

SEQ ID NO: 530810 - DNA, 25 bp, Rattus norvegicus
gttgttacaaacactaggccagtct

SEQ ID NO: 530811 - DNA, 25 bp, Rattus norvegicus
gttgttacaaactctaggccagtct

SEQ ID NO: 530812 - DNA, 25 bp, Rattus norvegicus
gttgttacagcaagtcaagcctcaa

SEQ ID NO: 530813 - DNA, 25 bp, Rattus norvegicus
gttgttacagcatgtcaagcctcaa

SEQ ID NO: 530814 - DNA, 25 bp, Rattus norvegicus
gttgttaccattcttgcaccgttta

SEQ ID NO: 530815 - DNA, 25 bp, Rattus norvegicus
gttgttaccattgttgcaccgttta

SEQ ID NO: 530816 - DNA, 25 bp, Rattus norvegicus
gttgttacctataagactgctcttg

SEQ ID NO: 530817 - DNA, 25 bp, Rattus norvegicus
gttgttacctattagactgctcttg

SEQ ID NO: 530818 - DNA, 25 bp, Rattus norvegicus
gttgttacctcacaagcgaggcctc

SEQ ID NO: 530819 - DNA, 25 bp, Rattus norvegicus
gttgttacctcagaagcgaggcctc

SEQ ID NO: 530820 - DNA, 25 bp, Rattus norvegicus
gttgttactgacactgatttctaag

SEQ ID NO: 530821 - DNA, 25 bp, Rattus norvegicus
gttgttactgactctgatttctaag

SEQ ID NO: 530822 - DNA, 25 bp, Rattus norvegicus
gttgttactgttacctgtgaagcac

SEQ ID NO: 530823 - DNA, 25 bp, Rattus norvegicus
gttgttactgttcttaggaattgca

SEQ ID NO: 530824 - DNA, 25 bp, Rattus norvegicus
gttgttactgttgttaggaattgca

SEQ ID NO: 530825 - DNA, 25 bp, Rattus norvegicus
gttgttactgtttcctgtgaagcac

SEQ ID NO: 530826 - DNA, 25 bp, Rattus norvegicus
gttgttagacagaacctgtgtcgtc

SEQ ID NO: 530827 - DNA, 25 bp, Rattus norvegicus
gttgttagacagtacctgtgtcgtc

SEQ ID NO: 530828 - DNA, 25 bp, Rattus norvegicus
gttgttagagcactgtccttgtgat

SEQ ID NO: 530829 - DNA, 25 bp, Rattus norvegicus
gttgttagagcagtgtccttgtgat

SEQ ID NO: 530830 - DNA, 25 bp, Rattus norvegicus
gttgttagcaagagccacatggttt

SEQ ID NO: 530831 - DNA, 25 bp, Rattus norvegicus
gttgttagcaagtgccacatggttt

SEQ ID NO: 530832 - DNA, 25 bp, Rattus norvegicus
gttgttatactaattctgcacttaa

SEQ ID NO: 530833 - DNA, 25 bp, Rattus norvegicus
gttgttatactatttctgcacttaa

SEQ ID NO: 530834 - DNA, 25 bp, Rattus norvegicus
gttgttatatcacctcctgggagta

SEQ ID NO: 530835 - DNA, 25 bp, Rattus norvegicus
gttgttatatcagctcctgggagta

SEQ ID NO: 530836 - DNA, 25 bp, Rattus norvegicus
gttgttatcagtcatgatgcccagg

SEQ ID NO: 530837 - DNA, 25 bp, Rattus norvegicus
gttgttatcagtgatgatgcccagg

SEQ ID NO: 530838 - DNA, 25 bp, Rattus norvegicus
gttgttatctccaagtctcctagga

SEQ ID NO: 530839 - DNA, 25 bp, Rattus norvegicus
gttgttatctcctagtctcctagga

SEQ ID NO: 530840 - DNA, 25 bp, Rattus norvegicus
gttgttatggttcctttgtcatttt

SEQ ID NO: 530841 - DNA, 25 bp, Rattus norvegicus
gttgttatggttgctttgtcatttt

SEQ ID NO: 530842 - DNA, 25 bp, Rattus norvegicus
gttgttatgtatcgctatgtgactc

SEQ ID NO: 530843 - DNA, 25 bp, Rattus norvegicus
gttgttatgtatggctatgtgactc

SEQ ID NO: 530844 - DNA, 25 bp, Rattus norvegicus
gttgttattacaaccttgtggcgct

SEQ ID NO: 530845 - DNA, 25 bp, Rattus norvegicus
gttgttattacatccttgtggcgct

SEQ ID NO: 530846 - DNA, 25 bp, Rattus norvegicus
gttgttcaactgaactggctggtat

SEQ ID NO: 530847 - DNA, 25 bp, Rattus norvegicus
gttgttcaactgtactggctggtat

SEQ ID NO: 530848 - DNA, 25 bp, Rattus norvegicus
gttgttcaatggactttagcctctg

SEQ ID NO: 530849 - DNA, 25 bp, Rattus norvegicus
gttgttcaatggtctttagcctctg

SEQ ID NO: 530850 - DNA, 25 bp, Rattus norvegicus
gttgttcatcctatgacttcgattc

SEQ ID NO: 530851 - DNA, 25 bp, Rattus norvegicus
gttgttcatcctttgacttcgattc

SEQ ID NO: 530852 - DNA, 25 bp, Rattus norvegicus
gttgttcattttctgggaagtctgt

SEQ ID NO: 530853 - DNA, 25 bp, Rattus norvegicus
gttgttcattttgtgggaagtctgt

SEQ ID NO: 530854 - DNA, 25 bp, Rattus norvegicus
gttgttccctccacacaaagaaaat

SEQ ID NO: 530855 - DNA, 25 bp, Rattus norvegicus
gttgttccctcctcacaaagaaaat

SEQ ID NO: 530856 - DNA, 25 bp, Rattus norvegicus
gttgttccgagaactgactttctcc

SEQ ID NO: 530857 - DNA, 25 bp, Rattus norvegicus
gttgttccgagatctgactttctcc

SEQ ID NO: 530858 - DNA, 25 bp, Rattus norvegicus
gttgttcctggaagtcgttctctac

SEQ ID NO: 530859 - DNA, 25 bp, Rattus norvegicus
gttgttcctggatgtcgttctctac

SEQ ID NO: 530860 - DNA, 25 bp, Rattus norvegicus
gttgttcctggcagaaattcttacc

SEQ ID NO: 530861 - DNA, 25 bp, Rattus norvegicus
gttgttcctggctgaaattcttacc

SEQ ID NO: 530862 - DNA, 25 bp, Rattus norvegicus
gttgttcctggtagttgttcactgc

SEQ ID NO: 530863 - DNA, 25 bp, Rattus norvegicus
gttgttcctggttgttgttcactgc

SEQ ID NO: 530864 - DNA, 25 bp, Rattus norvegicus
gttgttcgaacaatgtgtcttggac

SEQ ID NO: 530865 - DNA, 25 bp, Rattus norvegicus
gttgttcgaacattgtgtcttggac

SEQ ID NO: 530866 - DNA, 25 bp, Rattus norvegicus
gttgttcgtagccacacattatctc

SEQ ID NO: 530867 - DNA, 25 bp, Rattus norvegicus
gttgttcgtagcgacacattatctc

SEQ ID NO: 530868 - DNA, 25 bp, Rattus norvegicus
gttgttcgtcagaagttttgccttt

SEQ ID NO: 530869 - DNA, 25 bp, Rattus norvegicus
gttgttcgtcagtagttttgccttt

SEQ ID NO: 530870 - DNA, 25 bp, Rattus norvegicus
gttgttctatgcaaactggcttttt

SEQ ID NO: 530871 - DNA, 25 bp, Rattus norvegicus
gttgttctatgctaactggcttttt

SEQ ID NO: 530872 - DNA, 25 bp, Rattus norvegicus
gttgttctcacacttccgtgacgga

SEQ ID NO: 530873 - DNA, 25 bp, Rattus norvegicus
gttgttctcacagttccgtgacgga

SEQ ID NO: 530874 - DNA, 25 bp, Rattus norvegicus
gttgttctccatcataacggcacta

SEQ ID NO: 530875 - DNA, 25 bp, Rattus norvegicus
gttgttctccatgataacggcacta

SEQ ID NO: 530876 - DNA, 25 bp, Rattus norvegicus
gttgttctctcacgaaagaccactc

SEQ ID NO: 530877 - DNA, 25 bp, Rattus norvegicus
gttgttctctcaggaaagaccactc

SEQ ID NO: 530878 - DNA, 25 bp, Rattus norvegicus
gttgttctctgcctatttctaattt

SEQ ID NO: 530879 - DNA, 25 bp, Rattus norvegicus
gttgttctctgcgtatttctaattt

SEQ ID NO: 530880 - DNA, 25 bp, Rattus norvegicus
gttgttctgaaaaccgctgtccgca

SEQ ID NO: 530881 - DNA, 25 bp, Rattus norvegicus
gttgttctgaaatccgctgtccgca

SEQ ID NO: 530882 - DNA, 25 bp, Rattus norvegicus
gttgttctgcccctaagtgactaga

SEQ ID NO: 530883 - DNA, 25 bp, Rattus norvegicus
gttgttctgcccgtaagtgactaga

SEQ ID NO: 530884 - DNA, 25 bp, Rattus norvegicus
gttgttctgctaatccatgatcatc

SEQ ID NO: 530885 - DNA, 25 bp, Rattus norvegicus
gttgttctgctattccatgatcatc

SEQ ID NO: 530886 - DNA, 25 bp, Rattus norvegicus
gttgttctgcttctaaccctcgttg

SEQ ID NO: 530887 - DNA, 25 bp, Rattus norvegicus
gttgttctgcttgtaaccctcgttg

SEQ ID NO: 530888 - DNA, 25 bp, Rattus norvegicus
gttgttctggaaacagtaggaccaa

SEQ ID NO: 530889 - DNA, 25 bp, Rattus norvegicus
gttgttctggaatcagtaggaccaa

SEQ ID NO: 530890 - DNA, 25 bp, Rattus norvegicus
gttgttctggatctgttcaaaggac

SEQ ID NO: 530891 - DNA, 25 bp, Rattus norvegicus
gttgttctggatgtgttcaaaggac

SEQ ID NO: 530892 - DNA, 25 bp, Rattus norvegicus
gttgttctgtctagttgggcacaaa

SEQ ID NO: 530893 - DNA, 25 bp, Rattus norvegicus
gttgttctgtcttgttgggcacaaa

SEQ ID NO: 530894 - DNA, 25 bp, Rattus norvegicus
gttgttcttgcactgttggtatctt

SEQ ID NO: 530895 - DNA, 25 bp, Rattus norvegicus
gttgttcttgcagtgttggtatctt

SEQ ID NO: 530896 - DNA, 25 bp, Rattus norvegicus
gttgttcttgttcaggtgggcttta

SEQ ID NO: 530897 - DNA, 25 bp, Rattus norvegicus
gttgttcttgttgaggtgggcttta

SEQ ID NO: 530898 - DNA, 25 bp, Rattus norvegicus
gttgttgaacccaagagtttctata

SEQ ID NO: 530899 - DNA, 25 bp, Rattus norvegicus
gttgttgaaccctagagtttctata

SEQ ID NO: 530900 - DNA, 25 bp, Rattus norvegicus
gttgttgaattgatgtgaccaccct

SEQ ID NO: 530901 - DNA, 25 bp, Rattus norvegicus
gttgttgaattgttgtgaccaccct

SEQ ID NO: 530902 - DNA, 25 bp, Rattus norvegicus
gttgttgaatttcaaaggctttgta

SEQ ID NO: 530903 - DNA, 25 bp, Rattus norvegicus
gttgttgaatttgaaaggctttgta

SEQ ID NO: 530904 - DNA, 25 bp, Rattus norvegicus
gttgttgacagtagtcactggccat

SEQ ID NO: 530905 - DNA, 25 bp, Rattus norvegicus
gttgttgacagttgtcactggccat

SEQ ID NO: 530906 - DNA, 25 bp, Rattus norvegicus
gttgttgacggtccactgagttcat

SEQ ID NO: 530907 - DNA, 25 bp, Rattus norvegicus
gttgttgacggtgcactgagttcat

SEQ ID NO: 530908 - DNA, 25 bp, Rattus norvegicus
gttgttgatcatctgtccatgtatt

SEQ ID NO: 530909 - DNA, 25 bp, Rattus norvegicus
gttgttgatcatgtgtccatgtatt

SEQ ID NO: 530910 - DNA, 25 bp, Rattus norvegicus
gttgttgattcactttctaccttgc

SEQ ID NO: 530911 - DNA, 25 bp, Rattus norvegicus
gttgttgattcagtttctaccttgc

SEQ ID NO: 530912 - DNA, 25 bp, Rattus norvegicus
gttgttgatttcacggaggatggta

SEQ ID NO: 530913 - DNA, 25 bp, Rattus norvegicus
gttgttgatttctcggaggatggta

SEQ ID NO: 530914 - DNA, 25 bp, Rattus norvegicus
gttgttgcagctagtactattaaaa

SEQ ID NO: 530915 - DNA, 25 bp, Rattus norvegicus
gttgttgcagcttgtactattaaaa

SEQ ID NO: 530916 - DNA, 25 bp, Rattus norvegicus
gttgttgccatgctaatcactgaag

SEQ ID NO: 530917 - DNA, 25 bp, Rattus norvegicus
gttgttgccatggtaatcactgaag

SEQ ID NO: 530918 - DNA, 25 bp, Rattus norvegicus
gttgttgcccacagaacattttaat

SEQ ID NO: 530919 - DNA, 25 bp, Rattus norvegicus
gttgttgcccactgaacattttaat

SEQ ID NO: 530920 - DNA, 25 bp, Rattus norvegicus
gttgttgccgcaccttaattaagga

SEQ ID NO: 530921 - DNA, 25 bp, Rattus norvegicus
gttgttgccgcagcttaattaagga

SEQ ID NO: 530922 - DNA, 25 bp, Rattus norvegicus
gttgttgccggcagcaagtgccatc

SEQ ID NO: 530923 - DNA, 25 bp, Rattus norvegicus
gttgttgccggctgcaagtgccatc

SEQ ID NO: 530924 - DNA, 25 bp, Rattus norvegicus
gttgttgctaacacaccagtttctt

SEQ ID NO: 530925 - DNA, 25 bp, Rattus norvegicus
gttgttgctaactcaccagtttctt

SEQ ID NO: 530926 - DNA, 25 bp, Rattus norvegicus
gttgttgctataataactgcgtttc

SEQ ID NO: 530927 - DNA, 25 bp, Rattus norvegicus
gttgttgctatattaactgcgtttc

SEQ ID NO: 530928 - DNA, 25 bp, Rattus norvegicus
gttgttgctatgaactcccggaaaa

SEQ ID NO: 530929 - DNA, 25 bp, Rattus norvegicus
gttgttgctatgtactcccggaaaa

SEQ ID NO: 530930 - DNA, 25 bp, Rattus norvegicus
gttgttgctattctggttctttttt

SEQ ID NO: 530931 - DNA, 25 bp, Rattus norvegicus
gttgttgctattgtggttctttttt

SEQ ID NO: 530932 - DNA, 25 bp, Rattus norvegicus
gttgttgctgctcttcttacaaaga

SEQ ID NO: 530933 - DNA, 25 bp, Rattus norvegicus
gttgttgctgctgttcttacaaaga

SEQ ID NO: 530934 - DNA, 25 bp, Rattus norvegicus
gttgttgctgttctacataatgtaa

SEQ ID NO: 530935 - DNA, 25 bp, Rattus norvegicus
gttgttgctgttcttatttactgtg

SEQ ID NO: 530936 - DNA, 25 bp, Rattus norvegicus
gttgttgctgttgtacataatgtaa

SEQ ID NO: 530937 - DNA, 25 bp, Rattus norvegicus
gttgttgctgttgttatttactgtg

SEQ ID NO: 530938 - DNA, 25 bp, Rattus norvegicus
gttgttggatacctttttcatgatg

SEQ ID NO: 530939 - DNA, 25 bp, Rattus norvegicus
gttgttggatacgtttttcatgatg

SEQ ID NO: 530940 - DNA, 25 bp, Rattus norvegicus
gttgttggatcacgaagccaagctt

SEQ ID NO: 530941 - DNA, 25 bp, Rattus norvegicus
gttgttggatcaggaagccaagctt

SEQ ID NO: 530942 - DNA, 25 bp, Rattus norvegicus
gttgttggcaagaccaggaagcgac

SEQ ID NO: 530943 - DNA, 25 bp, Rattus norvegicus
gttgttggcaagtccaggaagcgac

SEQ ID NO: 530944 - DNA, 25 bp, Rattus norvegicus
gttgttggcgatccccagaatctca

SEQ ID NO: 530945 - DNA, 25 bp, Rattus norvegicus
gttgttggcgatgcccagaatctca

SEQ ID NO: 530946 - DNA, 25 bp, Rattus norvegicus
gttgttggtcttctgtgatcttcac

SEQ ID NO: 530947 - DNA, 25 bp, Rattus norvegicus
gttgttggtcttgtgtgatcttcac

SEQ ID NO: 530948 - DNA, 25 bp, Rattus norvegicus
gttgttggtgacattcttcagctcc

SEQ ID NO: 530949 - DNA, 25 bp, Rattus norvegicus
gttgttggtgactttcttcagctcc

SEQ ID NO: 530950 - DNA, 25 bp, Rattus norvegicus
gttgttgtaactctccactcatgta

SEQ ID NO: 530951 - DNA, 25 bp, Rattus norvegicus
gttgttgtaactgtccactcatgta

SEQ ID NO: 530952 - DNA, 25 bp, Rattus norvegicus
gttgttgtaattattccctgagggc

SEQ ID NO: 530953 - DNA, 25 bp, Rattus norvegicus
gttgttgtaatttttccctgagggc

SEQ ID NO: 530954 - DNA, 25 bp, Rattus norvegicus
gttgttgtacccagggcgtgacaat

SEQ ID NO: 530955 - DNA, 25 bp, Rattus norvegicus
gttgttgtaccctgggcgtgacaat

SEQ ID NO: 530956 - DNA, 25 bp, Rattus norvegicus
gttgttgtaggaacatcgctgtgga

SEQ ID NO: 530957 - DNA, 25 bp, Rattus norvegicus
gttgttgtaggatcatcgctgtgga

SEQ ID NO: 530958 - DNA, 25 bp, Rattus norvegicus
gttgttgtgcacatcaagagccatg

SEQ ID NO: 530959 - DNA, 25 bp, Rattus norvegicus
gttgttgtgcacttcaagagccatg

SEQ ID NO: 530960 - DNA, 25 bp, Rattus norvegicus
gttgttgtgttcattaagcccctca

SEQ ID NO: 530961 - DNA, 25 bp, Rattus norvegicus
gttgttgtgttctttaagcccctca

SEQ ID NO: 530962 - DNA, 25 bp, Rattus norvegicus
gttgttgttcaacagttcagcctaa

SEQ ID NO: 530963 - DNA, 25 bp, Rattus norvegicus
gttgttgttcaagagttcagcctaa

SEQ ID NO: 530964 - DNA, 25 bp, Rattus norvegicus
gttgttgttctcataaacacccagc

SEQ ID NO: 530965 - DNA, 25 bp, Rattus norvegicus
gttgttgttctcttaaacacccagc

SEQ ID NO: 530966 - DNA, 25 bp, Rattus norvegicus
gttgttgttgacagagaccttttct

SEQ ID NO: 530967 - DNA, 25 bp, Rattus norvegicus
gttgttgttgactgagaccttttct

SEQ ID NO: 530968 - DNA, 25 bp, Rattus norvegicus
gttgtttaaacacagggcagctcca

SEQ ID NO: 530969 - DNA, 25 bp, Rattus norvegicus
gttgtttaaacagagggcagctcca

SEQ ID NO: 530970 - DNA, 25 bp, Rattus norvegicus
gttgtttaatgaagtcactcgtctg

SEQ ID NO: 530971 - DNA, 25 bp, Rattus norvegicus
gttgtttaatgatgtcactcgtctg

SEQ ID NO: 530972 - DNA, 25 bp, Rattus norvegicus
gttgtttacaagcagcccacagtag

SEQ ID NO: 530973 - DNA, 25 bp, Rattus norvegicus
gttgtttacaaggagcccacagtag

SEQ ID NO: 530974 - DNA, 25 bp, Rattus norvegicus
gttgtttaggaactctcttctccct

SEQ ID NO: 530975 - DNA, 25 bp, Rattus norvegicus
gttgtttaggaagtctcttctccct

SEQ ID NO: 530976 - DNA, 25 bp, Rattus norvegicus
gttgtttaggtaccctttcctgtga

SEQ ID NO: 530977 - DNA, 25 bp, Rattus norvegicus
gttgtttaggtagcctttcctgtga

SEQ ID NO: 530978 - DNA, 25 bp, Rattus norvegicus
gttgtttagtatcctgagtctctca

SEQ ID NO: 530979 - DNA, 25 bp, Rattus norvegicus
gttgtttagtatgctgagtctctca

SEQ ID NO: 530980 - DNA, 25 bp, Rattus norvegicus
gttgtttagtttcgcaacactgccc

SEQ ID NO: 530981 - DNA, 25 bp, Rattus norvegicus
gttgtttagtttggcaacactgccc

SEQ ID NO: 530982 - DNA, 25 bp, Rattus norvegicus
gttgtttatataccccaaagccatc

SEQ ID NO: 530983 - DNA, 25 bp, Rattus norvegicus
gttgtttatatagcccaaagccatc

SEQ ID NO: 530984 - DNA, 25 bp, Rattus norvegicus
gttgtttatatcacttggcagacca

SEQ ID NO: 530985 - DNA, 25 bp, Rattus norvegicus
gttgtttatatctcttggcagacca

SEQ ID NO: 530986 - DNA, 25 bp, Rattus norvegicus
gttgtttatctactggtctgtggcc

SEQ ID NO: 530987 - DNA, 25 bp, Rattus norvegicus
gttgtttatctagtggtctgtggcc

SEQ ID NO: 530988 - DNA, 25 bp, Rattus norvegicus
gttgtttatttgatatctctccgag

SEQ ID NO: 530989 - DNA, 25 bp, Rattus norvegicus
gttgtttatttgttatctctccgag

SEQ ID NO: 530990 - DNA, 25 bp, Rattus norvegicus
gttgtttcatggagtccttgacatc

SEQ ID NO: 530991 - DNA, 25 bp, Rattus norvegicus
gttgtttcatggtgtccttgacatc

SEQ ID NO: 530992 - DNA, 25 bp, Rattus norvegicus
gttgtttccaacatgctgctttctg

SEQ ID NO: 530993 - DNA, 25 bp, Rattus norvegicus
gttgtttccaacttgctgctttctg

SEQ ID NO: 530994 - DNA, 25 bp, Rattus norvegicus
gttgtttccataccaacatttgatt

SEQ ID NO: 530995 - DNA, 25 bp, Rattus norvegicus
gttgtttccatagcaacatttgatt

SEQ ID NO: 530996 - DNA, 25 bp, Rattus norvegicus
gttgtttcgcttcctgcttgaattc

SEQ ID NO: 530997 - DNA, 25 bp, Rattus norvegicus
gttgtttcgcttgctgcttgaattc

SEQ ID NO: 530998 - DNA, 25 bp, Rattus norvegicus
gttgtttctattaggagccatccaa

SEQ ID NO: 530999 - DNA, 25 bp, Rattus norvegicus
gttgtttctatttggagccatccaa

SEQ ID NO: 531000 - DNA, 25 bp, Rattus norvegicus
gttgtttctcctatcaaatatgtga

SEQ ID NO: 531001 - DNA, 25 bp, Rattus norvegicus
gttgtttctcctttcaaatatgtga

SEQ ID NO: 531002 - DNA, 25 bp, Rattus norvegicus
gttgtttctcgtatgtttcaatgta

SEQ ID NO: 531003 - DNA, 25 bp, Rattus norvegicus
gttgtttctcgtttgtttcaatgta

SEQ ID NO: 531004 - DNA, 25 bp, Rattus norvegicus
gttgtttctgtaaaactcctcacca

SEQ ID NO: 531005 - DNA, 25 bp, Rattus norvegicus
gttgtttctgtaaacgtagtgccct

SEQ ID NO: 531006 - DNA, 25 bp, Rattus norvegicus
gttgtttctgtataactcctcacca

SEQ ID NO: 531007 - DNA, 25 bp, Rattus norvegicus
gttgtttctgtatacgtagtgccct

SEQ ID NO: 531008 - DNA, 25 bp, Rattus norvegicus
gttgtttcttcaataaaatctctca

SEQ ID NO: 531009 - DNA, 25 bp, Rattus norvegicus
gttgtttcttcattaaaatctctca

SEQ ID NO: 531010 - DNA, 25 bp, Rattus norvegicus
gttgtttctttcaagtggtctttgt

SEQ ID NO: 531011 - DNA, 25 bp, Rattus norvegicus
gttgtttctttctagtggtctttgt

SEQ ID NO: 531012 - DNA, 25 bp, Rattus norvegicus
gttgtttgcaacatacattttgtaa

SEQ ID NO: 531013 - DNA, 25 bp, Rattus norvegicus
gttgtttgcaacttacattttgtaa

SEQ ID NO: 531014 - DNA, 25 bp, Rattus norvegicus
gttgtttgctgtcttctaagttcca

SEQ ID NO: 531015 - DNA, 25 bp, Rattus norvegicus
gttgtttgctgtgttctaagttcca

SEQ ID NO: 531016 - DNA, 25 bp, Rattus norvegicus
gttgtttggatgctttgtgtcagaa

SEQ ID NO: 531017 - DNA, 25 bp, Rattus norvegicus
gttgtttggatggtttgtgtcagaa

SEQ ID NO: 531018 - DNA, 25 bp, Rattus norvegicus
gttgtttggcttatgtatttctgtg

SEQ ID NO: 531019 - DNA, 25 bp, Rattus norvegicus
gttgtttggcttttgtatttctgtg

SEQ ID NO: 531020 - DNA, 25 bp, Rattus norvegicus
gttgtttgtctgattcacgtgaatg

SEQ ID NO: 531021 - DNA, 25 bp, Rattus norvegicus
gttgtttgtctgtttcacgtgaatg

SEQ ID NO: 531022 - DNA, 25 bp, Rattus norvegicus
gttgtttgtttactcttgtctcaga

SEQ ID NO: 531023 - DNA, 25 bp, Rattus norvegicus
gttgtttgtttagtcttgtctcaga

SEQ ID NO: 531024 - DNA, 25 bp, Rattus norvegicus
gttgttttacaaatgcagatctcaa

SEQ ID NO: 531025 - DNA, 25 bp, Rattus norvegicus
gttgttttacaattgcagatctcaa

SEQ ID NO: 531026 - DNA, 25 bp, Rattus norvegicus
gttgttttacacacaaggtctcctg

SEQ ID NO: 531027 - DNA, 25 bp, Rattus norvegicus
gttgttttacactcaaggtctcctg

SEQ ID NO: 531028 - DNA, 25 bp, Rattus norvegicus
gttgttttacagattgttgtcctct

SEQ ID NO: 531029 - DNA, 25 bp, Rattus norvegicus
gttgttttacagctgtgttaccctt

SEQ ID NO: 531030 - DNA, 25 bp, Rattus norvegicus
gttgttttacaggtgtgttaccctt

SEQ ID NO: 531031 - DNA, 25 bp, Rattus norvegicus
gttgttttacagtttgttgtcctct

SEQ ID NO: 531032 - DNA, 25 bp, Rattus norvegicus
gttgttttaccaccgtcgggatgat

SEQ ID NO: 531033 - DNA, 25 bp, Rattus norvegicus
gttgttttaccagcgtcgggatgat

SEQ ID NO: 531034 - DNA, 25 bp, Rattus norvegicus
gttgttttataaaagcatcaagtga

SEQ ID NO: 531035 - DNA, 25 bp, Rattus norvegicus
gttgttttataatagcatcaagtga

SEQ ID NO: 531036 - DNA, 25 bp, Rattus norvegicus
gttgttttccaacgcggttgcggct

SEQ ID NO: 531037 - DNA, 25 bp, Rattus norvegicus
gttgttttccaaggcggttgcggct

SEQ ID NO: 531038 - DNA, 25 bp, Rattus norvegicus
gttgttttccgtcacagaagctgca

SEQ ID NO: 531039 - DNA, 25 bp, Rattus norvegicus
gttgttttccgtgacagaagctgca

SEQ ID NO: 531040 - DNA, 25 bp, Rattus norvegicus
gttgttttctttacaattggtcatg

SEQ ID NO: 531041 - DNA, 25 bp, Rattus norvegicus
gttgttttcttttcaattggtcatg

SEQ ID NO: 531042 - DNA, 25 bp, Rattus norvegicus
gttgttttgttgaagctatcccatt

SEQ ID NO: 531043 - DNA, 25 bp, Rattus norvegicus
gttgttttgttgctgatgtttccat

SEQ ID NO: 531044 - DNA, 25 bp, Rattus norvegicus
gttgttttgttggtgatgtttccat

SEQ ID NO: 531045 - DNA, 25 bp, Rattus norvegicus
gttgttttgttgtagctatcccatt

SEQ ID NO: 531046 - DNA, 25 bp, Rattus norvegicus
gttgtttttatacgagttgccttgg

SEQ ID NO: 531047 - DNA, 25 bp, Rattus norvegicus
gttgtttttataggagttgccttgg

SEQ ID NO: 531048 - DNA, 25 bp, Rattus norvegicus
gttgtttttcccagcaggccaggtg

SEQ ID NO: 531049 - DNA, 25 bp, Rattus norvegicus
gttgtttttccctgcaggccaggtg

SEQ ID NO: 531050 - DNA, 25 bp, Rattus norvegicus
gttgtttttgtcaacactagctgtt

SEQ ID NO: 531051 - DNA, 25 bp, Rattus norvegicus
gttgtttttgtctacactagctgtt

SEQ ID NO: 531052 - DNA, 25 bp, Rattus norvegicus
gtttaaaacctacggcatctgcggg

SEQ ID NO: 531053 - DNA, 25 bp, Rattus norvegicus
gtttaaaacctagggcatctgcggg

SEQ ID NO: 531054 - DNA, 25 bp, Rattus norvegicus
gtttaaaactgcatcctaacctgat

SEQ ID NO: 531055 - DNA, 25 bp, Rattus norvegicus
gtttaaaactgcttcctaacctgat

SEQ ID NO: 531056 - DNA, 25 bp, Rattus norvegicus
gtttaaaatgctcttctctgacttg

SEQ ID NO: 531057 - DNA, 25 bp, Rattus norvegicus
gtttaaaatgctgttctctgacttg

SEQ ID NO: 531058 - DNA, 25 bp, Rattus norvegicus
gtttaaacagatctctgctgcgctt

SEQ ID NO: 531059 - DNA, 25 bp, Rattus norvegicus
gtttaaacagatgtctgctgcgctt

SEQ ID NO: 531060 - DNA, 25 bp, Rattus norvegicus
gtttaaacctgaccatttcctgaat

SEQ ID NO: 531061 - DNA, 25 bp, Rattus norvegicus
gtttaaacctgagcatttcctgaat

SEQ ID NO: 531062 - DNA, 25 bp, Rattus norvegicus
gtttaaacctgccatgacagaggca

SEQ ID NO: 531063 - DNA, 25 bp, Rattus norvegicus
gtttaaacctgcgatgacagaggca

SEQ ID NO: 531064 - DNA, 25 bp, Rattus norvegicus
gtttaaactccgattgcagacagtg

SEQ ID NO: 531065 - DNA, 25 bp, Rattus norvegicus
gtttaaactccgtttgcagacagtg

SEQ ID NO: 531066 - DNA, 25 bp, Rattus norvegicus
gtttaaactggaccaaggctctcag

SEQ ID NO: 531067 - DNA, 25 bp, Rattus norvegicus
gtttaaactggagcaaggctctcag

SEQ ID NO: 531068 - DNA, 25 bp, Rattus norvegicus
gtttaaagaactctcccctcatgag

SEQ ID NO: 531069 - DNA, 25 bp, Rattus norvegicus
gtttaaagaactgtcccctcatgag

SEQ ID NO: 531070 - DNA, 25 bp, Rattus norvegicus
gtttaaagacgactgtgcctgaggt

SEQ ID NO: 531071 - DNA, 25 bp, Rattus norvegicus
gtttaaagacgagtgtgcctgaggt

SEQ ID NO: 531072 - DNA, 25 bp, Rattus norvegicus
gtttaaagccaaatgccaattcagt

SEQ ID NO: 531073 - DNA, 25 bp, Rattus norvegicus
gtttaaagccaattgccaattcagt

SEQ ID NO: 531074 - DNA, 25 bp, Rattus norvegicus
gtttaaagggaacttggctgacaga

SEQ ID NO: 531075 - DNA, 25 bp, Rattus norvegicus
gtttaaagggaagttggctgacaga

SEQ ID NO: 531076 - DNA, 25 bp, Rattus norvegicus
gtttaaatcaacctctctctacctt

SEQ ID NO: 531077 - DNA, 25 bp, Rattus norvegicus
gtttaaatcaacgtctctctacctt

SEQ ID NO: 531078 - DNA, 25 bp, Rattus norvegicus
gtttaaatcacaaccatcaccagtt

SEQ ID NO: 531079 - DNA, 25 bp, Rattus norvegicus
gtttaaatcacatccatcaccagtt

SEQ ID NO: 531080 - DNA, 25 bp, Rattus norvegicus
gtttaaatcgtcatcatggtcttga

SEQ ID NO: 531081 - DNA, 25 bp, Rattus norvegicus
gtttaaatcgtcttcatggtcttga

SEQ ID NO: 531082 - DNA, 25 bp, Rattus norvegicus
gtttaaatctgtacagtctcacggg

SEQ ID NO: 531083 - DNA, 25 bp, Rattus norvegicus
gtttaaatctgttcagtctcacggg

SEQ ID NO: 531084 - DNA, 25 bp, Rattus norvegicus
gtttaaatgaacactttgccccaag

SEQ ID NO: 531085 - DNA, 25 bp, Rattus norvegicus
gtttaaatgaactctttgccccaag

SEQ ID NO: 531086 - DNA, 25 bp, Rattus norvegicus
gtttaaatgccgacttgcttctgta

SEQ ID NO: 531087 - DNA, 25 bp, Rattus norvegicus
gtttaaatgccgtcttgcttctgta

SEQ ID NO: 531088 - DNA, 25 bp, Rattus norvegicus
gtttaaattctgatcaacacagcag

SEQ ID NO: 531089 - DNA, 25 bp, Rattus norvegicus
gtttaaattctgttcaacacagcag

SEQ ID NO: 531090 - DNA, 25 bp, Rattus norvegicus
gtttaaattgccacagctgcagcac

SEQ ID NO: 531091 - DNA, 25 bp, Rattus norvegicus
gtttaaattgcctcagctgcagcac

SEQ ID NO: 531092 - DNA, 25 bp, Rattus norvegicus
gtttaacacaaaatacctgctctca

SEQ ID NO: 531093 - DNA, 25 bp, Rattus norvegicus
gtttaacacaaattacctgctctca

SEQ ID NO: 531094 - DNA, 25 bp, Rattus norvegicus
gtttaacactttattcctgagacag

SEQ ID NO: 531095 - DNA, 25 bp, Rattus norvegicus
gtttaacacttttttcctgagacag

SEQ ID NO: 531096 - DNA, 25 bp, Rattus norvegicus
gtttaacagcaacagccagctcatg

SEQ ID NO: 531097 - DNA, 25 bp, Rattus norvegicus
gtttaacagcaagagccagctcatg

SEQ ID NO: 531098 - DNA, 25 bp, Rattus norvegicus
gtttaacagtccacgagatccctga

SEQ ID NO: 531099 - DNA, 25 bp, Rattus norvegicus
gtttaacagtcctcgagatccctga

SEQ ID NO: 531100 - DNA, 25 bp, Rattus norvegicus
gtttaacatcatatcacagcatctg

SEQ ID NO: 531101 - DNA, 25 bp, Rattus norvegicus
gtttaacatcatttcacagcatctg

SEQ ID NO: 531102 - DNA, 25 bp, Rattus norvegicus
gtttaacatgctaggttctctgctc

SEQ ID NO: 531103 - DNA, 25 bp, Rattus norvegicus
gtttaacatgcttggttctctgctc

SEQ ID NO: 531104 - DNA, 25 bp, Rattus norvegicus
gtttaacattccatacatgccctac

SEQ ID NO: 531105 - DNA, 25 bp, Rattus norvegicus
gtttaacattccttacatgccctac

SEQ ID NO: 531106 - DNA, 25 bp, Rattus norvegicus
gtttaacctacaatagtcaacctca

SEQ ID NO: 531107 - DNA, 25 bp, Rattus norvegicus
gtttaacctacattagtcaacctca

SEQ ID NO: 531108 - DNA, 25 bp, Rattus norvegicus
gtttaacctgctcacacatgtggag

SEQ ID NO: 531109 - DNA, 25 bp, Rattus norvegicus
gtttaacctgctgacacatgtggag

SEQ ID NO: 531110 - DNA, 25 bp, Rattus norvegicus
gtttaaccttgacctgatcactcct

SEQ ID NO: 531111 - DNA, 25 bp, Rattus norvegicus
gtttaaccttgagctgatcactcct

SEQ ID NO: 531112 - DNA, 25 bp, Rattus norvegicus
gtttaacctttccaaatgcatatac

SEQ ID NO: 531113 - DNA, 25 bp, Rattus norvegicus
gtttaacctttcgaaatgcatatac

SEQ ID NO: 531114 - DNA, 25 bp, Rattus norvegicus
gtttaacgccaacttcattacagat

SEQ ID NO: 531115 - DNA, 25 bp, Rattus norvegicus
gtttaacgccaagttcattacagat

SEQ ID NO: 531116 - DNA, 25 bp, Rattus norvegicus
gtttaactgaccactctgcataatt

SEQ ID NO: 531117 - DNA, 25 bp, Rattus norvegicus
gtttaactgacctctctgcataatt

SEQ ID NO: 531118 - DNA, 25 bp, Rattus norvegicus
gtttaactgcatctccaaaagggtg

SEQ ID NO: 531119 - DNA, 25 bp, Rattus norvegicus
gtttaactgcatgtccaaaagggtg

SEQ ID NO: 531120 - DNA, 25 bp, Rattus norvegicus
gtttaactgcctctaggctgtgcaa

SEQ ID NO: 531121 - DNA, 25 bp, Rattus norvegicus
gtttaactgcctgtaggctgtgcaa

SEQ ID NO: 531122 - DNA, 25 bp, Rattus norvegicus
gtttaactgctgaaatccctttgta

SEQ ID NO: 531123 - DNA, 25 bp, Rattus norvegicus
gtttaactgctgtaatccctttgta

SEQ ID NO: 531124 - DNA, 25 bp, Rattus norvegicus
gtttaactgtccatcattagcacca

SEQ ID NO: 531125 - DNA, 25 bp, Rattus norvegicus
gtttaactgtccttcattagcacca

SEQ ID NO: 531126 - DNA, 25 bp, Rattus norvegicus
gtttaacttaccacaactgccatta

SEQ ID NO: 531127 - DNA, 25 bp, Rattus norvegicus
gtttaacttaccaggtgatcctgga

SEQ ID NO: 531128 - DNA, 25 bp, Rattus norvegicus
gtttaacttacctcaactgccatta

SEQ ID NO: 531129 - DNA, 25 bp, Rattus norvegicus
gtttaacttacctggtgatcctgga

SEQ ID NO: 531130 - DNA, 25 bp, Rattus norvegicus
gtttaacttccaacctgagtacagt

SEQ ID NO: 531131 - DNA, 25 bp, Rattus norvegicus
gtttaacttccatcctgagtacagt

SEQ ID NO: 531132 - DNA, 25 bp, Rattus norvegicus
gtttaacttttcacttgcaagcaag

SEQ ID NO: 531133 - DNA, 25 bp, Rattus norvegicus
gtttaacttttctcttgcaagcaag

SEQ ID NO: 531134 - DNA, 25 bp, Rattus norvegicus
gtttaacttttgctacttctcagga

SEQ ID NO: 531135 - DNA, 25 bp, Rattus norvegicus
gtttaacttttggtacttctcagga

SEQ ID NO: 531136 - DNA, 25 bp, Rattus norvegicus
gtttaagaaactccctagccactcc

SEQ ID NO: 531137 - DNA, 25 bp, Rattus norvegicus
gtttaagaaactgcctagccactcc

SEQ ID NO: 531138 - DNA, 25 bp, Rattus norvegicus
gtttaagaacatcacgccatcgccc

SEQ ID NO: 531139 - DNA, 25 bp, Rattus norvegicus
gtttaagaacatctccattccacat

SEQ ID NO: 531140 - DNA, 25 bp, Rattus norvegicus
gtttaagaacatgacgccatcgccc

SEQ ID NO: 531141 - DNA, 25 bp, Rattus norvegicus
gtttaagaacatgtccattccacat

SEQ ID NO: 531142 - DNA, 25 bp, Rattus norvegicus
gtttaagaatgcactgcacctgctt

SEQ ID NO: 531143 - DNA, 25 bp, Rattus norvegicus
gtttaagaatgctctgcacctgctt

SEQ ID NO: 531144 - DNA, 25 bp, Rattus norvegicus
gtttaagatacacatttaaggttgg

SEQ ID NO: 531145 - DNA, 25 bp, Rattus norvegicus
gtttaagatacagatttaaggttgg

SEQ ID NO: 531146 - DNA, 25 bp, Rattus norvegicus
gtttaagcaatgacacctcacgtag

SEQ ID NO: 531147 - DNA, 25 bp, Rattus norvegicus
gtttaagcaatgtcacctcacgtag

SEQ ID NO: 531148 - DNA, 25 bp, Rattus norvegicus
gtttaagcagacattccagccaggt

SEQ ID NO: 531149 - DNA, 25 bp, Rattus norvegicus
gtttaagcagactttccagccaggt

SEQ ID NO: 531150 - DNA, 25 bp, Rattus norvegicus
gtttaagcagccaattgggcctctt

SEQ ID NO: 531151 - DNA, 25 bp, Rattus norvegicus
gtttaagcagcctattgggcctctt

SEQ ID NO: 531152 - DNA, 25 bp, Rattus norvegicus
gtttaagcccagacttggcttcata

SEQ ID NO: 531153 - DNA, 25 bp, Rattus norvegicus
gtttaagcccagtcttggcttcata

SEQ ID NO: 531154 - DNA, 25 bp, Rattus norvegicus
gtttaagcctacaacaagtgtttct

SEQ ID NO: 531155 - DNA, 25 bp, Rattus norvegicus
gtttaagcctactacaagtgtttct

SEQ ID NO: 531156 - DNA, 25 bp, Rattus norvegicus
gtttaagccttcatctattacacgg

SEQ ID NO: 531157 - DNA, 25 bp, Rattus norvegicus
gtttaagccttcttctattacacgg

SEQ ID NO: 531158 - DNA, 25 bp, Rattus norvegicus
gtttaagcctttactatacctgata

SEQ ID NO: 531159 - DNA, 25 bp, Rattus norvegicus
gtttaagccttttctatacctgata

SEQ ID NO: 531160 - DNA, 25 bp, Rattus norvegicus
gtttaagctaaccacatactgctgt

SEQ ID NO: 531161 - DNA, 25 bp, Rattus norvegicus
gtttaagctaacgacatactgctgt

SEQ ID NO: 531162 - DNA, 25 bp, Rattus norvegicus
gtttaagctcttacaattccagggt

SEQ ID NO: 531163 - DNA, 25 bp, Rattus norvegicus
gtttaagctctttcaattccagggt

SEQ ID NO: 531164 - DNA, 25 bp, Rattus norvegicus
gtttaagctgtgcaggttggccatt

SEQ ID NO: 531165 - DNA, 25 bp, Rattus norvegicus
gtttaagctgtggaggttggccatt

SEQ ID NO: 531166 - DNA, 25 bp, Rattus norvegicus
gtttaaggccatcttactactaagt

SEQ ID NO: 531167 - DNA, 25 bp, Rattus norvegicus
gtttaaggccatgttactactaagt

SEQ ID NO: 531168 - DNA, 25 bp, Rattus norvegicus
gtttaaggccttcggtcatgtctaa

SEQ ID NO: 531169 - DNA, 25 bp, Rattus norvegicus
gtttaaggccttgggtcatgtctaa

SEQ ID NO: 531170 - DNA, 25 bp, Rattus norvegicus
gtttaaggcttcatccaacttcact

SEQ ID NO: 531171 - DNA, 25 bp, Rattus norvegicus
gtttaaggcttcttccaacttcact

SEQ ID NO: 531172 - DNA, 25 bp, Rattus norvegicus
gtttaagggataaacctctgcctaa

SEQ ID NO: 531173 - DNA, 25 bp, Rattus norvegicus
gtttaagggatatacctctgcctaa

SEQ ID NO: 531174 - DNA, 25 bp, Rattus norvegicus
gtttaagtaagcaagccttttcaca

SEQ ID NO: 531175 - DNA, 25 bp, Rattus norvegicus
gtttaagtaagctagccttttcaca

SEQ ID NO: 531176 - DNA, 25 bp, Rattus norvegicus
gtttaagtccacagcattgttcgat

SEQ ID NO: 531177 - DNA, 25 bp, Rattus norvegicus
gtttaagtccactgcattgttcgat

SEQ ID NO: 531178 - DNA, 25 bp, Rattus norvegicus
gtttaagtctttccatttcagaact

SEQ ID NO: 531179 - DNA, 25 bp, Rattus norvegicus
gtttaagtctttgcatttcagaact

SEQ ID NO: 531180 - DNA, 25 bp, Rattus norvegicus
gtttaagtggctcatcccagacagt

SEQ ID NO: 531181 - DNA, 25 bp, Rattus norvegicus
gtttaagtggctgatcccagacagt

SEQ ID NO: 531182 - DNA, 25 bp, Rattus norvegicus
gtttaatacaaactatccaactata

SEQ ID NO: 531183 - DNA, 25 bp, Rattus norvegicus
gtttaatacaaagtatccaactata

SEQ ID NO: 531184 - DNA, 25 bp, Rattus norvegicus
gtttaatacactcggctgaaaggtc

SEQ ID NO: 531185 - DNA, 25 bp, Rattus norvegicus
gtttaatacactgggctgaaaggtc

SEQ ID NO: 531186 - DNA, 25 bp, Rattus norvegicus
gtttaatagagtcctttagtcctat

SEQ ID NO: 531187 - DNA, 25 bp, Rattus norvegicus
gtttaatagagtgctttagtcctat

SEQ ID NO: 531188 - DNA, 25 bp, Rattus norvegicus
gtttaatatcatctctggtggtgaa

SEQ ID NO: 531189 - DNA, 25 bp, Rattus norvegicus
gtttaatatcatgtctggtggtgaa

SEQ ID NO: 531190 - DNA, 25 bp, Rattus norvegicus
gtttaatatctgacttttgaaatgc

SEQ ID NO: 531191 - DNA, 25 bp, Rattus norvegicus
gtttaatatctgtcttttgaaatgc

SEQ ID NO: 531192 - DNA, 25 bp, Rattus norvegicus
gtttaatatgtcagtttccctgtct

SEQ ID NO: 531193 - DNA, 25 bp, Rattus norvegicus
gtttaatatgtctgtttccctgtct

SEQ ID NO: 531194 - DNA, 25 bp, Rattus norvegicus
gtttaatattctcttcattcccttc

SEQ ID NO: 531195 - DNA, 25 bp, Rattus norvegicus
gtttaatattctgttcattcccttc

SEQ ID NO: 531196 - DNA, 25 bp, Rattus norvegicus
gtttaatattgcctcaggtcgtcgt

SEQ ID NO: 531197 - DNA, 25 bp, Rattus norvegicus
gtttaatattgcgtcaggtcgtcgt

SEQ ID NO: 531198 - DNA, 25 bp, Rattus norvegicus
gtttaatccataccaatccaggaca

SEQ ID NO: 531199 - DNA, 25 bp, Rattus norvegicus
gtttaatccatagcaatccaggaca

SEQ ID NO: 531200 - DNA, 25 bp, Rattus norvegicus
gtttaatcggctccgtctctcaggg

SEQ ID NO: 531201 - DNA, 25 bp, Rattus norvegicus
gtttaatcggctgcgtctctcaggg

SEQ ID NO: 531202 - DNA, 25 bp, Rattus norvegicus
gtttaatcttgaactccagatgccc

SEQ ID NO: 531203 - DNA, 25 bp, Rattus norvegicus
gtttaatcttgatctccagatgccc

SEQ ID NO: 531204 - DNA, 25 bp, Rattus norvegicus
gtttaatgacatatccatcttcttt

SEQ ID NO: 531205 - DNA, 25 bp, Rattus norvegicus
gtttaatgacatttccatcttcttt

SEQ ID NO: 531206 - DNA, 25 bp, Rattus norvegicus
gtttaatgtgccatggtcttgcaaa

SEQ ID NO: 531207 - DNA, 25 bp, Rattus norvegicus
gtttaatgtgccttggtcttgcaaa

SEQ ID NO: 531208 - DNA, 25 bp, Rattus norvegicus
gtttaatgttgcatactctttcata

SEQ ID NO: 531209 - DNA, 25 bp, Rattus norvegicus
gtttaatgttgcttactctttcata

SEQ ID NO: 531210 - DNA, 25 bp, Rattus norvegicus
gtttaattagctaactctctggtct

SEQ ID NO: 531211 - DNA, 25 bp, Rattus norvegicus
gtttaattagcttactctctggtct

SEQ ID NO: 531212 - DNA, 25 bp, Rattus norvegicus
gtttaattcatcatttaggctacca

SEQ ID NO: 531213 - DNA, 25 bp, Rattus norvegicus
gtttaattcatcttttaggctacca

SEQ ID NO: 531214 - DNA, 25 bp, Rattus norvegicus
gtttaattgcacatcttccgtagtt

SEQ ID NO: 531215 - DNA, 25 bp, Rattus norvegicus
gtttaattgcacttcttccgtagtt

SEQ ID NO: 531216 - DNA, 25 bp, Rattus norvegicus
gtttaattgctgatgaagatacgca

SEQ ID NO: 531217 - DNA, 25 bp, Rattus norvegicus
gtttaattgctgttgaagatacgca

SEQ ID NO: 531218 - DNA, 25 bp, Rattus norvegicus
gtttaatttcatcccaactgtagac

SEQ ID NO: 531219 - DNA, 25 bp, Rattus norvegicus
gtttaatttcatgccaactgtagac

SEQ ID NO: 531220 - DNA, 25 bp, Rattus norvegicus
gtttaatttggtatctgtccggact

SEQ ID NO: 531221 - DNA, 25 bp, Rattus norvegicus
gtttaatttggtttctgtccggact

SEQ ID NO: 531222 - DNA, 25 bp, Rattus norvegicus
gtttacaaacgccacaccgctacat

SEQ ID NO: 531223 - DNA, 25 bp, Rattus norvegicus
gtttacaaacgcgacaccgctacat

SEQ ID NO: 531224 - DNA, 25 bp, Rattus norvegicus
gtttacaaatatcttccttctggcc

SEQ ID NO: 531225 - DNA, 25 bp, Rattus norvegicus
gtttacaaatatgttccttctggcc

SEQ ID NO: 531226 - DNA, 25 bp, Rattus norvegicus
gtttacaacaggatgctcacgtgat

SEQ ID NO: 531227 - DNA, 25 bp, Rattus norvegicus
gtttacaacaggttgctcacgtgat

SEQ ID NO: 531228 - DNA, 25 bp, Rattus norvegicus
gtttacaacttaagtgcctctgcct

SEQ ID NO: 531229 - DNA, 25 bp, Rattus norvegicus
gtttacaacttacgctgaggctgat

SEQ ID NO: 531230 - DNA, 25 bp, Rattus norvegicus
gtttacaacttaggctgaggctgat

SEQ ID NO: 531231 - DNA, 25 bp, Rattus norvegicus
gtttacaacttatgtgcctctgcct

SEQ ID NO: 531232 - DNA, 25 bp, Rattus norvegicus
gtttacaagcccagtatcatgtctg

SEQ ID NO: 531233 - DNA, 25 bp, Rattus norvegicus
gtttacaagccctgtatcatgtctg

SEQ ID NO: 531234 - DNA, 25 bp, Rattus norvegicus
gtttacacacatacaggcattttgc

SEQ ID NO: 531235 - DNA, 25 bp, Rattus norvegicus
gtttacacacattcaggcattttgc

SEQ ID NO: 531236 - DNA, 25 bp, Rattus norvegicus
gtttacacatctatctgcctcaatc

SEQ ID NO: 531237 - DNA, 25 bp, Rattus norvegicus
gtttacacatctttctgcctcaatc

SEQ ID NO: 531238 - DNA, 25 bp, Rattus norvegicus
gtttacacatttagcacttgggagg

SEQ ID NO: 531239 - DNA, 25 bp, Rattus norvegicus
gtttacacattttgcacttgggagg

SEQ ID NO: 531240 - DNA, 25 bp, Rattus norvegicus
gtttacaccagactggccagctatt

SEQ ID NO: 531241 - DNA, 25 bp, Rattus norvegicus
gtttacaccagagtggccagctatt

SEQ ID NO: 531242 - DNA, 25 bp, Rattus norvegicus
gtttacaccctacacatgagagaga

SEQ ID NO: 531243 - DNA, 25 bp, Rattus norvegicus
gtttacaccctagacatgagagaga

SEQ ID NO: 531244 - DNA, 25 bp, Rattus norvegicus
gtttacacctgcacaccaagataca

SEQ ID NO: 531245 - DNA, 25 bp, Rattus norvegicus
gtttacacctgctcaccaagataca

SEQ ID NO: 531246 - DNA, 25 bp, Rattus norvegicus
gtttacacgtcacttcctctcataa

SEQ ID NO: 531247 - DNA, 25 bp, Rattus norvegicus
gtttacacgtcagttcctctcataa

SEQ ID NO: 531248 - DNA, 25 bp, Rattus norvegicus
gtttacactgctcacaattcaagtt

SEQ ID NO: 531249 - DNA, 25 bp, Rattus norvegicus
gtttacactgctgacaattcaagtt

SEQ ID NO: 531250 - DNA, 25 bp, Rattus norvegicus
gtttacactgttagcttcctactaa

SEQ ID NO: 531251 - DNA, 25 bp, Rattus norvegicus
gtttacactgtttgcttcctactaa

SEQ ID NO: 531252 - DNA, 25 bp, Rattus norvegicus
gtttacactttgacaaggcccagtt

SEQ ID NO: 531253 - DNA, 25 bp, Rattus norvegicus
gtttacactttgagccatcttgggt

SEQ ID NO: 531254 - DNA, 25 bp, Rattus norvegicus
gtttacactttgtcaaggcccagtt

SEQ ID NO: 531255 - DNA, 25 bp, Rattus norvegicus
gtttacactttgtgccatcttgggt

SEQ ID NO: 531256 - DNA, 25 bp, Rattus norvegicus
gtttacagaatgatctggttgatta

SEQ ID NO: 531257 - DNA, 25 bp, Rattus norvegicus
gtttacagaatgttctggttgatta

SEQ ID NO: 531258 - DNA, 25 bp, Rattus norvegicus
gtttacagagcactttgtggcgctt

SEQ ID NO: 531259 - DNA, 25 bp, Rattus norvegicus
gtttacagagcagtttgtggcgctt

SEQ ID NO: 531260 - DNA, 25 bp, Rattus norvegicus
gtttacagaggcatgccaacgccta

SEQ ID NO: 531261 - DNA, 25 bp, Rattus norvegicus
gtttacagaggcttgccaacgccta

SEQ ID NO: 531262 - DNA, 25 bp, Rattus norvegicus
gtttacagagttccaggttatccag

SEQ ID NO: 531263 - DNA, 25 bp, Rattus norvegicus
gtttacagagttgcaggttatccag

SEQ ID NO: 531264 - DNA, 25 bp, Rattus norvegicus
gtttacagatgtatccactgagcgt

SEQ ID NO: 531265 - DNA, 25 bp, Rattus norvegicus
gtttacagatgtttccactgagcgt

SEQ ID NO: 531266 - DNA, 25 bp, Rattus norvegicus
gtttacagctcactccactttcaca

SEQ ID NO: 531267 - DNA, 25 bp, Rattus norvegicus
gtttacagctcagtccactttcaca

SEQ ID NO: 531268 - DNA, 25 bp, Rattus norvegicus
gtttacaggcggcattcctactggt

SEQ ID NO: 531269 - DNA, 25 bp, Rattus norvegicus
gtttacaggcgggattcctactggt

SEQ ID NO: 531270 - DNA, 25 bp, Rattus norvegicus
gtttacagtattcatggcccattga

SEQ ID NO: 531271 - DNA, 25 bp, Rattus norvegicus
gtttacagtattgatggcccattga

SEQ ID NO: 531272 - DNA, 25 bp, Rattus norvegicus
gtttacagtcctcaatcaagtctat

SEQ ID NO: 531273 - DNA, 25 bp, Rattus norvegicus
gtttacagtcctgaatcaagtctat

SEQ ID NO: 531274 - DNA, 25 bp, Rattus norvegicus
gtttacagttcacaccacagatgtg

SEQ ID NO: 531275 - DNA, 25 bp, Rattus norvegicus
gtttacagttcagaccacagatgtg

SEQ ID NO: 531276 - DNA, 25 bp, Rattus norvegicus
gtttacagttccagaagtgcgtcga

SEQ ID NO: 531277 - DNA, 25 bp, Rattus norvegicus
gtttacagttcctgaagtgcgtcga

SEQ ID NO: 531278 - DNA, 25 bp, Rattus norvegicus
gtttacagttttctgctgggccaca

SEQ ID NO: 531279 - DNA, 25 bp, Rattus norvegicus
gtttacagttttgtgctgggccaca

SEQ ID NO: 531280 - DNA, 25 bp, Rattus norvegicus
gtttacatacccactagctcccaat

SEQ ID NO: 531281 - DNA, 25 bp, Rattus norvegicus
gtttacataccctctagctcccaat

SEQ ID NO: 531282 - DNA, 25 bp, Rattus norvegicus
gtttacatacgcatatcgctgcact

SEQ ID NO: 531283 - DNA, 25 bp, Rattus norvegicus
gtttacatacgcttatcgctgcact

SEQ ID NO: 531284 - DNA, 25 bp, Rattus norvegicus
gtttacatatggcttcccttggaag

SEQ ID NO: 531285 - DNA, 25 bp, Rattus norvegicus
gtttacatatgggttcccttggaag

SEQ ID NO: 531286 - DNA, 25 bp, Rattus norvegicus
gtttacatcatcagcatttccctat

SEQ ID NO: 531287 - DNA, 25 bp, Rattus norvegicus
gtttacatcatctgcatttccctat

SEQ ID NO: 531288 - DNA, 25 bp, Rattus norvegicus
gtttacatctgtcttcacgaggttt

SEQ ID NO: 531289 - DNA, 25 bp, Rattus norvegicus
gtttacatctgtgttcacgaggttt

SEQ ID NO: 531290 - DNA, 25 bp, Rattus norvegicus
gtttacatgaaactgacccgaggtt

SEQ ID NO: 531291 - DNA, 25 bp, Rattus norvegicus
gtttacatgaaagtgacccgaggtt

SEQ ID NO: 531292 - DNA, 25 bp, Rattus norvegicus
gtttacatgaataccagctactctt

SEQ ID NO: 531293 - DNA, 25 bp, Rattus norvegicus
gtttacatgaattccagctactctt

SEQ ID NO: 531294 - DNA, 25 bp, Rattus norvegicus
gtttacatgcttatttgataaccca

SEQ ID NO: 531295 - DNA, 25 bp, Rattus norvegicus
gtttacatgcttttttgataaccca

SEQ ID NO: 531296 - DNA, 25 bp, Rattus norvegicus
gtttacattacacagagcaagctta

SEQ ID NO: 531297 - DNA, 25 bp, Rattus norvegicus
gtttacattacagagagcaagctta

SEQ ID NO: 531298 - DNA, 25 bp, Rattus norvegicus
gtttacattcttaaggtcctgggag

SEQ ID NO: 531299 - DNA, 25 bp, Rattus norvegicus
gtttacattctttaggtcctgggag

SEQ ID NO: 531300 - DNA, 25 bp, Rattus norvegicus
gtttacattgcactagcattgtggg

SEQ ID NO: 531301 - DNA, 25 bp, Rattus norvegicus
gtttacattgcagtagcattgtggg

SEQ ID NO: 531302 - DNA, 25 bp, Rattus norvegicus
gtttacattgctacgatcctttgac

SEQ ID NO: 531303 - DNA, 25 bp, Rattus norvegicus
gtttacattgcttcgatcctttgac

SEQ ID NO: 531304 - DNA, 25 bp, Rattus norvegicus
gtttacattgtacactgcgaccacc

SEQ ID NO: 531305 - DNA, 25 bp, Rattus norvegicus
gtttacattgtagactgcgaccacc

SEQ ID NO: 531306 - DNA, 25 bp, Rattus norvegicus
gtttacatttggctgcagctcaact

SEQ ID NO: 531307 - DNA, 25 bp, Rattus norvegicus
gtttacatttgggtgcagctcaact

SEQ ID NO: 531308 - DNA, 25 bp, Rattus norvegicus
gtttaccaaactctgtgcttggctg

SEQ ID NO: 531309 - DNA, 25 bp, Rattus norvegicus
gtttaccaaactgtgtgcttggctg

SEQ ID NO: 531310 - DNA, 25 bp, Rattus norvegicus
gtttaccaagaaatgcactcccttc

SEQ ID NO: 531311 - DNA, 25 bp, Rattus norvegicus
gtttaccaagaattgcactcccttc

SEQ ID NO: 531312 - DNA, 25 bp, Rattus norvegicus
gtttaccaagataacccagtacctg

SEQ ID NO: 531313 - DNA, 25 bp, Rattus norvegicus
gtttaccaagatctactgtccgccc

SEQ ID NO: 531314 - DNA, 25 bp, Rattus norvegicus
gtttaccaagatgtactgtccgccc

SEQ ID NO: 531315 - DNA, 25 bp, Rattus norvegicus
gtttaccaagattacccagtacctg

SEQ ID NO: 531316 - DNA, 25 bp, Rattus norvegicus
gtttaccaagcaagggccacggaca

SEQ ID NO: 531317 - DNA, 25 bp, Rattus norvegicus
gtttaccaagcatgggccacggaca

SEQ ID NO: 531318 - DNA, 25 bp, Rattus norvegicus
gtttaccacacgaagaacaggcgcc

SEQ ID NO: 531319 - DNA, 25 bp, Rattus norvegicus
gtttaccacacgtagaacaggcgcc

SEQ ID NO: 531320 - DNA, 25 bp, Rattus norvegicus
gtttaccactgaccggctatttgat

SEQ ID NO: 531321 - DNA, 25 bp, Rattus norvegicus
gtttaccactgagcggctatttgat

SEQ ID NO: 531322 - DNA, 25 bp, Rattus norvegicus
gtttaccagacaatcttgtactttt

SEQ ID NO: 531323 - DNA, 25 bp, Rattus norvegicus
gtttaccagacattcttgtactttt

SEQ ID NO: 531324 - DNA, 25 bp, Rattus norvegicus
gtttaccagagtcgaaatggccaga

SEQ ID NO: 531325 - DNA, 25 bp, Rattus norvegicus
gtttaccagagtggaaatggccaga

SEQ ID NO: 531326 - DNA, 25 bp, Rattus norvegicus
gtttaccagtgtaccttccaaggag

SEQ ID NO: 531327 - DNA, 25 bp, Rattus norvegicus
gtttaccagtgttccttccaaggag

SEQ ID NO: 531328 - DNA, 25 bp, Rattus norvegicus
gtttaccagtttctatacgttacat

SEQ ID NO: 531329 - DNA, 25 bp, Rattus norvegicus
gtttaccagtttgtatacgttacat

SEQ ID NO: 531330 - DNA, 25 bp, Rattus norvegicus
gtttaccatcacatctttcttatac

SEQ ID NO: 531331 - DNA, 25 bp, Rattus norvegicus
gtttaccatcacttctttcttatac

SEQ ID NO: 531332 - DNA, 25 bp, Rattus norvegicus
gtttaccattaaatgctttgttcta

SEQ ID NO: 531333 - DNA, 25 bp, Rattus norvegicus
gtttaccattaattgctttgttcta

SEQ ID NO: 531334 - DNA, 25 bp, Rattus norvegicus
gtttacccaaagagaggcaccgctg

SEQ ID NO: 531335 - DNA, 25 bp, Rattus norvegicus
gtttacccaaagtgaggcaccgctg

SEQ ID NO: 531336 - DNA, 25 bp, Rattus norvegicus
gtttacccaagaacacttttgcgat

SEQ ID NO: 531337 - DNA, 25 bp, Rattus norvegicus
gtttacccaagatcacttttgcgat

SEQ ID NO: 531338 - DNA, 25 bp, Rattus norvegicus
gtttacccaagtactataatcagat

SEQ ID NO: 531339 - DNA, 25 bp, Rattus norvegicus
gtttacccaagttctataatcagat

SEQ ID NO: 531340 - DNA, 25 bp, Rattus norvegicus
gtttacccagaacgcaggtgcactt

SEQ ID NO: 531341 - DNA, 25 bp, Rattus norvegicus
gtttacccagaaggcaggtgcactt

SEQ ID NO: 531342 - DNA, 25 bp, Rattus norvegicus
gtttacccaggaacattcctttggt

SEQ ID NO: 531343 - DNA, 25 bp, Rattus norvegicus
gtttacccaggatcattcctttggt

SEQ ID NO: 531344 - DNA, 25 bp, Rattus norvegicus
gtttacccataaatcctgagagaat

SEQ ID NO: 531345 - DNA, 25 bp, Rattus norvegicus
gtttacccataattcctgagagaat

SEQ ID NO: 531346 - DNA, 25 bp, Rattus norvegicus
gtttaccctggaattccacagcatt

SEQ ID NO: 531347 - DNA, 25 bp, Rattus norvegicus
gtttaccctggatttccacagcatt

SEQ ID NO: 531348 - DNA, 25 bp, Rattus norvegicus
gtttaccgcacgcagacgtttggaa

SEQ ID NO: 531349 - DNA, 25 bp, Rattus norvegicus
gtttaccgcacggagacgtttggaa

SEQ ID NO: 531350 - DNA, 25 bp, Rattus norvegicus
gtttaccgtctgacggatgcgcagg

SEQ ID NO: 531351 - DNA, 25 bp, Rattus norvegicus
gtttaccgtctgtcggatgcgcagg

SEQ ID NO: 531352 - DNA, 25 bp, Rattus norvegicus
gtttacctaagcaaccaagtcactt

SEQ ID NO: 531353 - DNA, 25 bp, Rattus norvegicus
gtttacctaagctaccaagtcactt

SEQ ID NO: 531354 - DNA, 25 bp, Rattus norvegicus
gtttacctacaccattttggtgcaa

SEQ ID NO: 531355 - DNA, 25 bp, Rattus norvegicus
gtttacctacacgattttggtgcaa

SEQ ID NO: 531356 - DNA, 25 bp, Rattus norvegicus
gtttacctactcagctcttcctagt

SEQ ID NO: 531357 - DNA, 25 bp, Rattus norvegicus
gtttacctactctgctcttcctagt

SEQ ID NO: 531358 - DNA, 25 bp, Rattus norvegicus
gtttacctcacacacttttgagcac

SEQ ID NO: 531359 - DNA, 25 bp, Rattus norvegicus
gtttacctcacagacttttgagcac

SEQ ID NO: 531360 - DNA, 25 bp, Rattus norvegicus
gtttacctcagactcaaactcttga

SEQ ID NO: 531361 - DNA, 25 bp, Rattus norvegicus
gtttacctcagagtcaaactcttga

SEQ ID NO: 531362 - DNA, 25 bp, Rattus norvegicus
gtttacctcatgaatccgggcacct

SEQ ID NO: 531363 - DNA, 25 bp, Rattus norvegicus
gtttacctcatgtatccgggcacct

SEQ ID NO: 531364 - DNA, 25 bp, Rattus norvegicus
gtttacctccaaataaggctgcact

SEQ ID NO: 531365 - DNA, 25 bp, Rattus norvegicus
gtttacctccaattaaggctgcact

SEQ ID NO: 531366 - DNA, 25 bp, Rattus norvegicus
gtttacctgaatctttttgcaacca

SEQ ID NO: 531367 - DNA, 25 bp, Rattus norvegicus
gtttacctgaatgtttttgcaacca

SEQ ID NO: 531368 - DNA, 25 bp, Rattus norvegicus
gtttacctgatcattctgggtctta

SEQ ID NO: 531369 - DNA, 25 bp, Rattus norvegicus
gtttacctgatctttctgggtctta

SEQ ID NO: 531370 - DNA, 25 bp, Rattus norvegicus
gtttacctgtagcaaatgtttacat

SEQ ID NO: 531371 - DNA, 25 bp, Rattus norvegicus
gtttacctgtaggaaatgtttacat

SEQ ID NO: 531372 - DNA, 25 bp, Rattus norvegicus
gtttacctgtatatgctttgctgtg

SEQ ID NO: 531373 - DNA, 25 bp, Rattus norvegicus
gtttacctgtatttgctttgctgtg

SEQ ID NO: 531374 - DNA, 25 bp, Rattus norvegicus
gtttacctgtgtaggctcgctcgca

SEQ ID NO: 531375 - DNA, 25 bp, Rattus norvegicus
gtttacctgtgttggctcgctcgca

SEQ ID NO: 531376 - DNA, 25 bp, Rattus norvegicus
gtttaccttgttccatgaatctcca

SEQ ID NO: 531377 - DNA, 25 bp, Rattus norvegicus
gtttaccttgttgcatgaatctcca

SEQ ID NO: 531378 - DNA, 25 bp, Rattus norvegicus
gtttacgacgatagggactgatgtt

SEQ ID NO: 531379 - DNA, 25 bp, Rattus norvegicus
gtttacgacgattgggactgatgtt

SEQ ID NO: 531380 - DNA, 25 bp, Rattus norvegicus
gtttacgagagcagccccgggcaaa

SEQ ID NO: 531381 - DNA, 25 bp, Rattus norvegicus
gtttacgagagctgccccgggcaaa

SEQ ID NO: 531382 - DNA, 25 bp, Rattus norvegicus
gtttacgcacatcgcctcaggaaag

SEQ ID NO: 531383 - DNA, 25 bp, Rattus norvegicus
gtttacgcacatggcctcaggaaag

SEQ ID NO: 531384 - DNA, 25 bp, Rattus norvegicus
gtttacggcaatcttccgtcggaag

SEQ ID NO: 531385 - DNA, 25 bp, Rattus norvegicus
gtttacggcaatgttccgtcggaag

SEQ ID NO: 531386 - DNA, 25 bp, Rattus norvegicus
gtttacgttaggagactgagacatc

SEQ ID NO: 531387 - DNA, 25 bp, Rattus norvegicus
gtttacgttaggtgactgagacatc

SEQ ID NO: 531388 - DNA, 25 bp, Rattus norvegicus
gtttactaacgcaccaatcagttca

SEQ ID NO: 531389 - DNA, 25 bp, Rattus norvegicus
gtttactaacgctccaatcagttca

SEQ ID NO: 531390 - DNA, 25 bp, Rattus norvegicus
gtttactacaaactcctgtggccag

SEQ ID NO: 531391 - DNA, 25 bp, Rattus norvegicus
gtttactacaaagtcctgtggccag

SEQ ID NO: 531392 - DNA, 25 bp, Rattus norvegicus
gtttactactcacatgccacgcatt

SEQ ID NO: 531393 - DNA, 25 bp, Rattus norvegicus
gtttactactcagatgccacgcatt

SEQ ID NO: 531394 - DNA, 25 bp, Rattus norvegicus
gtttactagcacctgccagagaggc

SEQ ID NO: 531395 - DNA, 25 bp, Rattus norvegicus
gtttactagcacgtgccagagaggc

SEQ ID NO: 531396 - DNA, 25 bp, Rattus norvegicus
gtttactagtacacacagtgttaca

SEQ ID NO: 531397 - DNA, 25 bp, Rattus norvegicus
gtttactagtactcacagtgttaca

SEQ ID NO: 531398 - DNA, 25 bp, Rattus norvegicus
gtttactatacacaggatgagcatc

SEQ ID NO: 531399 - DNA, 25 bp, Rattus norvegicus
gtttactatacagaggatgagcatc

SEQ ID NO: 531400 - DNA, 25 bp, Rattus norvegicus
gtttactatggaaatgctgcggcag

SEQ ID NO: 531401 - DNA, 25 bp, Rattus norvegicus
gtttactatggacttcgatgctgaa

SEQ ID NO: 531402 - DNA, 25 bp, Rattus norvegicus
gtttactatggagttcgatgctgaa

SEQ ID NO: 531403 - DNA, 25 bp, Rattus norvegicus
gtttactatggatatgctgcggcag

SEQ ID NO: 531404 - DNA, 25 bp, Rattus norvegicus
gtttactatttgattgggtactgat

SEQ ID NO: 531405 - DNA, 25 bp, Rattus norvegicus
gtttactatttgtttgggtactgat

SEQ ID NO: 531406 - DNA, 25 bp, Rattus norvegicus
gtttactcacctaatgccatggcaa

SEQ ID NO: 531407 - DNA, 25 bp, Rattus norvegicus
gtttactcaccttatgccatggcaa

SEQ ID NO: 531408 - DNA, 25 bp, Rattus norvegicus
gtttactcaggtatcacacgttatt

SEQ ID NO: 531409 - DNA, 25 bp, Rattus norvegicus
gtttactcaggtttcacacgttatt

SEQ ID NO: 531410 - DNA, 25 bp, Rattus norvegicus
gtttactcagtacaatgtgccttta

SEQ ID NO: 531411 - DNA, 25 bp, Rattus norvegicus
gtttactcagtagaatgtgccttta

SEQ ID NO: 531412 - DNA, 25 bp, Rattus norvegicus
gtttactcagtgatggcgttttgga

SEQ ID NO: 531413 - DNA, 25 bp, Rattus norvegicus
gtttactcagtgttggcgttttgga

SEQ ID NO: 531414 - DNA, 25 bp, Rattus norvegicus
gtttactcattaacttctatcattt

SEQ ID NO: 531415 - DNA, 25 bp, Rattus norvegicus
gtttactcattatcttctatcattt

SEQ ID NO: 531416 - DNA, 25 bp, Rattus norvegicus
gtttactccaggctttatctgttct

SEQ ID NO: 531417 - DNA, 25 bp, Rattus norvegicus
gtttactccagggtttatctgttct

SEQ ID NO: 531418 - DNA, 25 bp, Rattus norvegicus
gtttactcgataagaccttaccttg

SEQ ID NO: 531419 - DNA, 25 bp, Rattus norvegicus
gtttactcgatatgaccttaccttg

SEQ ID NO: 531420 - DNA, 25 bp, Rattus norvegicus
gtttactcgatgcaacttacttagg

SEQ ID NO: 531421 - DNA, 25 bp, Rattus norvegicus
gtttactcgatggaacttacttagg

SEQ ID NO: 531422 - DNA, 25 bp, Rattus norvegicus
gtttactctacacatgctctacctg

SEQ ID NO: 531423 - DNA, 25 bp, Rattus norvegicus
gtttactctacagatgctctacctg

SEQ ID NO: 531424 - DNA, 25 bp, Rattus norvegicus
gtttactctcttctaccacagaaca

SEQ ID NO: 531425 - DNA, 25 bp, Rattus norvegicus
gtttactctcttgtaccacagaaca

SEQ ID NO: 531426 - DNA, 25 bp, Rattus norvegicus
gtttactcttgaattcccattacct

SEQ ID NO: 531427 - DNA, 25 bp, Rattus norvegicus
gtttactcttgatttcccattacct

SEQ ID NO: 531428 - DNA, 25 bp, Rattus norvegicus
gtttactcttgtaagcagtcattac

SEQ ID NO: 531429 - DNA, 25 bp, Rattus norvegicus
gtttactcttgttagcagtcattac

SEQ ID NO: 531430 - DNA, 25 bp, Rattus norvegicus
gtttactgaaatactagggcctgtg

SEQ ID NO: 531431 - DNA, 25 bp, Rattus norvegicus
gtttactgaaattctagggcctgtg

SEQ ID NO: 531432 - DNA, 25 bp, Rattus norvegicus
gtttactgacttctcacacatagca

SEQ ID NO: 531433 - DNA, 25 bp, Rattus norvegicus
gtttactgacttgtcacacatagca

SEQ ID NO: 531434 - DNA, 25 bp, Rattus norvegicus
gtttactgcaagattttacgcttga

SEQ ID NO: 531435 - DNA, 25 bp, Rattus norvegicus
gtttactgcaagtttttacgcttga

SEQ ID NO: 531436 - DNA, 25 bp, Rattus norvegicus
gtttactgctccactcagctttatt

SEQ ID NO: 531437 - DNA, 25 bp, Rattus norvegicus
gtttactgctcctctcagctttatt

SEQ ID NO: 531438 - DNA, 25 bp, Rattus norvegicus
gtttactgctgtaactccagtgtca

SEQ ID NO: 531439 - DNA, 25 bp, Rattus norvegicus
gtttactgctgttactccagtgtca

SEQ ID NO: 531440 - DNA, 25 bp, Rattus norvegicus
gtttactggccgatatcattacctc

SEQ ID NO: 531441 - DNA, 25 bp, Rattus norvegicus
gtttactggccgttatcattacctc

SEQ ID NO: 531442 - DNA, 25 bp, Rattus norvegicus
gtttactggctgctgttttgttttg

SEQ ID NO: 531443 - DNA, 25 bp, Rattus norvegicus
gtttactggctggtgttttgttttg

SEQ ID NO: 531444 - DNA, 25 bp, Rattus norvegicus
gtttactggtgaacgttgccaaaac

SEQ ID NO: 531445 - DNA, 25 bp, Rattus norvegicus
gtttactggtgatcgttgccaaaac

SEQ ID NO: 531446 - DNA, 25 bp, Rattus norvegicus
gtttactggttcatagtcagtgtca

SEQ ID NO: 531447 - DNA, 25 bp, Rattus norvegicus
gtttactggttcttagtcagtgtca

SEQ ID NO: 531448 - DNA, 25 bp, Rattus norvegicus
gtttactgtgggactcacagcttgt

SEQ ID NO: 531449 - DNA, 25 bp, Rattus norvegicus
gtttactgtgggtctcacagcttgt

SEQ ID NO: 531450 - DNA, 25 bp, Rattus norvegicus
gtttactgtgtgcttttttctatga

SEQ ID NO: 531451 - DNA, 25 bp, Rattus norvegicus
gtttactgtgtggttttttctatga

SEQ ID NO: 531452 - DNA, 25 bp, Rattus norvegicus
gtttactgttctaatctcaaggctg

SEQ ID NO: 531453 - DNA, 25 bp, Rattus norvegicus
gtttactgttcttatctcaaggctg

SEQ ID NO: 531454 - DNA, 25 bp, Rattus norvegicus
gtttacttacccaggaatcagtcta

SEQ ID NO: 531455 - DNA, 25 bp, Rattus norvegicus
gtttacttaccctggaatcagtcta

SEQ ID NO: 531456 - DNA, 25 bp, Rattus norvegicus
gtttacttcagacatttcggcgggt

SEQ ID NO: 531457 - DNA, 25 bp, Rattus norvegicus
gtttacttcagagatttcggcgggt

SEQ ID NO: 531458 - DNA, 25 bp, Rattus norvegicus
gtttacttccggctcaggagatgga

SEQ ID NO: 531459 - DNA, 25 bp, Rattus norvegicus
gtttacttccgggtcaggagatgga

SEQ ID NO: 531460 - DNA, 25 bp, Rattus norvegicus
gtttacttcctaacactcacatgtg

SEQ ID NO: 531461 - DNA, 25 bp, Rattus norvegicus
gtttacttcctatcactcacatgtg

SEQ ID NO: 531462 - DNA, 25 bp, Rattus norvegicus
gtttactttcacaccatttgtgaca

SEQ ID NO: 531463 - DNA, 25 bp, Rattus norvegicus
gtttactttcactccatttgtgaca

SEQ ID NO: 531464 - DNA, 25 bp, Rattus norvegicus
gtttactttgataccatcgtcctct

SEQ ID NO: 531465 - DNA, 25 bp, Rattus norvegicus
gtttactttgattccatcgtcctct

SEQ ID NO: 531466 - DNA, 25 bp, Rattus norvegicus
gtttactttgggacactcttagatg

SEQ ID NO: 531467 - DNA, 25 bp, Rattus norvegicus
gtttactttgggtcactcttagatg

SEQ ID NO: 531468 - DNA, 25 bp, Rattus norvegicus
gtttactttttcatcctgtctgaga

SEQ ID NO: 531469 - DNA, 25 bp, Rattus norvegicus
gtttactttttcttcctgtctgaga

SEQ ID NO: 531470 - DNA, 25 bp, Rattus norvegicus
gtttagaaccggctattccaaccag

SEQ ID NO: 531471 - DNA, 25 bp, Rattus norvegicus
gtttagaaccgggtattccaaccag

SEQ ID NO: 531472 - DNA, 25 bp, Rattus norvegicus
gtttagaagccacagcagtcgcagg

SEQ ID NO: 531473 - DNA, 25 bp, Rattus norvegicus
gtttagaagccagagcagtcgcagg

SEQ ID NO: 531474 - DNA, 25 bp, Rattus norvegicus
gtttagaatcaacactccctgagat

SEQ ID NO: 531475 - DNA, 25 bp, Rattus norvegicus
gtttagaatcaagactccctgagat

SEQ ID NO: 531476 - DNA, 25 bp, Rattus norvegicus
gtttagacacaaagccattgggagt

SEQ ID NO: 531477 - DNA, 25 bp, Rattus norvegicus
gtttagacacaatgccattgggagt

SEQ ID NO: 531478 - DNA, 25 bp, Rattus norvegicus
gtttagacactgaacactggccaga

SEQ ID NO: 531479 - DNA, 25 bp, Rattus norvegicus
gtttagacactgtacactggccaga

SEQ ID NO: 531480 - DNA, 25 bp, Rattus norvegicus
gtttagactcttagtttgctggata

SEQ ID NO: 531481 - DNA, 25 bp, Rattus norvegicus
gtttagactctttgtttgctggata

SEQ ID NO: 531482 - DNA, 25 bp, Rattus norvegicus
gtttagagagccaggtttgctgtga

SEQ ID NO: 531483 - DNA, 25 bp, Rattus norvegicus
gtttagagagcctggtttgctgtga

SEQ ID NO: 531484 - DNA, 25 bp, Rattus norvegicus
gtttagagctaaattctttcctgaa

SEQ ID NO: 531485 - DNA, 25 bp, Rattus norvegicus
gtttagagctaatttctttcctgaa

SEQ ID NO: 531486 - DNA, 25 bp, Rattus norvegicus
gtttagagtattcccctaactatga

SEQ ID NO: 531487 - DNA, 25 bp, Rattus norvegicus
gtttagagtattgccctaactatga

SEQ ID NO: 531488 - DNA, 25 bp, Rattus norvegicus
gtttagagtgccaggtcttagacca

SEQ ID NO: 531489 - DNA, 25 bp, Rattus norvegicus
gtttagagtgcctggtcttagacca

SEQ ID NO: 531490 - DNA, 25 bp, Rattus norvegicus
gtttagagttccactttttcactat

SEQ ID NO: 531491 - DNA, 25 bp, Rattus norvegicus
gtttagagttcctctttttcactat

SEQ ID NO: 531492 - DNA, 25 bp, Rattus norvegicus
gtttagatgctaccaccgcatgtgc

SEQ ID NO: 531493 - DNA, 25 bp, Rattus norvegicus
gtttagatgctagcaccgcatgtgc

SEQ ID NO: 531494 - DNA, 25 bp, Rattus norvegicus
gtttagatgtttaagggccctgtct

SEQ ID NO: 531495 - DNA, 25 bp, Rattus norvegicus
gtttagatgttttagggccctgtct

SEQ ID NO: 531496 - DNA, 25 bp, Rattus norvegicus
gtttagcaaaacacctctttcaagt

SEQ ID NO: 531497 - DNA, 25 bp, Rattus norvegicus
gtttagcaaaactcctctttcaagt

SEQ ID NO: 531498 - DNA, 25 bp, Rattus norvegicus
gtttagcaaagacccctgtagccat

SEQ ID NO: 531499 - DNA, 25 bp, Rattus norvegicus
gtttagcaaagagccctgtagccat

SEQ ID NO: 531500 - DNA, 25 bp, Rattus norvegicus
gtttagcaacacagaggcagccata

SEQ ID NO: 531501 - DNA, 25 bp, Rattus norvegicus
gtttagcaacactgaggcagccata

SEQ ID NO: 531502 - DNA, 25 bp, Rattus norvegicus
gtttagcaactcattagcctcttac

SEQ ID NO: 531503 - DNA, 25 bp, Rattus norvegicus
gtttagcaactctttagcctcttac

SEQ ID NO: 531504 - DNA, 25 bp, Rattus norvegicus
gtttagcaatggagggtggtcccta

SEQ ID NO: 531505 - DNA, 25 bp, Rattus norvegicus
gtttagcaatggtgggtggtcccta

SEQ ID NO: 531506 - DNA, 25 bp, Rattus norvegicus
gtttagcacgtaatcgacttcctgt

SEQ ID NO: 531507 - DNA, 25 bp, Rattus norvegicus
gtttagcacgtattcgacttcctgt

SEQ ID NO: 531508 - DNA, 25 bp, Rattus norvegicus
gtttagcagcgacagattccaaggg

SEQ ID NO: 531509 - DNA, 25 bp, Rattus norvegicus
gtttagcagcgagagattccaaggg

SEQ ID NO: 531510 - DNA, 25 bp, Rattus norvegicus
gtttagcagctgaaactgccctcag

SEQ ID NO: 531511 - DNA, 25 bp, Rattus norvegicus
gtttagcagctgtaactgccctcag

SEQ ID NO: 531512 - DNA, 25 bp, Rattus norvegicus
gtttagcagttgctctttggtattt

SEQ ID NO: 531513 - DNA, 25 bp, Rattus norvegicus
gtttagcagttggtctttggtattt

SEQ ID NO: 531514 - DNA, 25 bp, Rattus norvegicus
gtttagcatactcccgcgtgcttgg

SEQ ID NO: 531515 - DNA, 25 bp, Rattus norvegicus
gtttagcatactgccgcgtgcttgg

SEQ ID NO: 531516 - DNA, 25 bp, Rattus norvegicus
gtttagcattccagtgagtcattaa

SEQ ID NO: 531517 - DNA, 25 bp, Rattus norvegicus
gtttagcattcctgtgagtcattaa

SEQ ID NO: 531518 - DNA, 25 bp, Rattus norvegicus
gtttagccaaacagtctgtgactcg

SEQ ID NO: 531519 - DNA, 25 bp, Rattus norvegicus
gtttagccaaactgtctgtgactcg

SEQ ID NO: 531520 - DNA, 25 bp, Rattus norvegicus
gtttagccagctcttttatctcttc

SEQ ID NO: 531521 - DNA, 25 bp, Rattus norvegicus
gtttagccagctgttttatctcttc

SEQ ID NO: 531522 - DNA, 25 bp, Rattus norvegicus
gtttagccagggaggacacagctta

SEQ ID NO: 531523 - DNA, 25 bp, Rattus norvegicus
gtttagccagggtggacacagctta

SEQ ID NO: 531524 - DNA, 25 bp, Rattus norvegicus
gtttagccaggtaatttctcctaat

SEQ ID NO: 531525 - DNA, 25 bp, Rattus norvegicus
gtttagccaggttatttctcctaat

SEQ ID NO: 531526 - DNA, 25 bp, Rattus norvegicus
gtttagcccaccaaccttgatgact

SEQ ID NO: 531527 - DNA, 25 bp, Rattus norvegicus
gtttagcccacctaccttgatgact

SEQ ID NO: 531528 - DNA, 25 bp, Rattus norvegicus
gtttagcccgcaaggagatgttctt

SEQ ID NO: 531529 - DNA, 25 bp, Rattus norvegicus
gtttagcccgcatggagatgttctt

SEQ ID NO: 531530 - DNA, 25 bp, Rattus norvegicus
gtttagcctggcatccataaagagt

SEQ ID NO: 531531 - DNA, 25 bp, Rattus norvegicus
gtttagcctggcttccataaagagt

SEQ ID NO: 531532 - DNA, 25 bp, Rattus norvegicus
gtttagctaaagacacattccaggt

SEQ ID NO: 531533 - DNA, 25 bp, Rattus norvegicus
gtttagctaaagtcacattccaggt

SEQ ID NO: 531534 - DNA, 25 bp, Rattus norvegicus
gtttagctactcatgaatgttagat

SEQ ID NO: 531535 - DNA, 25 bp, Rattus norvegicus
gtttagctactcttgaatgttagat

SEQ ID NO: 531536 - DNA, 25 bp, Rattus norvegicus
gtttagctgggcctgatggcacaca

SEQ ID NO: 531537 - DNA, 25 bp, Rattus norvegicus
gtttagctgggcgtgatggcacaca

SEQ ID NO: 531538 - DNA, 25 bp, Rattus norvegicus
gtttagcttcaactatgtctttcct

SEQ ID NO: 531539 - DNA, 25 bp, Rattus norvegicus
gtttagcttcaagtatgtctttcct

SEQ ID NO: 531540 - DNA, 25 bp, Rattus norvegicus
gtttagcttctaaacatacgggttt

SEQ ID NO: 531541 - DNA, 25 bp, Rattus norvegicus
gtttagcttctatacatacgggttt

SEQ ID NO: 531542 - DNA, 25 bp, Rattus norvegicus
gtttagcttgagatcacggcatttg

SEQ ID NO: 531543 - DNA, 25 bp, Rattus norvegicus
gtttagcttgagttcacggcatttg

SEQ ID NO: 531544 - DNA, 25 bp, Rattus norvegicus
gtttagcttgtcatcttaactcgtg

SEQ ID NO: 531545 - DNA, 25 bp, Rattus norvegicus
gtttagcttgtcttcttaactcgtg

SEQ ID NO: 531546 - DNA, 25 bp, Rattus norvegicus
gtttaggacccacagaaagtgcctg

SEQ ID NO: 531547 - DNA, 25 bp, Rattus norvegicus
gtttaggacccagagaaagtgcctg

SEQ ID NO: 531548 - DNA, 25 bp, Rattus norvegicus
gtttagggaacaagtaagctccttt

SEQ ID NO: 531549 - DNA, 25 bp, Rattus norvegicus
gtttagggaacatgtaagctccttt

SEQ ID NO: 531550 - DNA, 25 bp, Rattus norvegicus
gtttagggagcaagcgcacacgagt

SEQ ID NO: 531551 - DNA, 25 bp, Rattus norvegicus
gtttagggagcatgcgcacacgagt

SEQ ID NO: 531552 - DNA, 25 bp, Rattus norvegicus
gtttaggtaccacatgcacaccaga

SEQ ID NO: 531553 - DNA, 25 bp, Rattus norvegicus
gtttaggtaccagatgcacaccaga

SEQ ID NO: 531554 - DNA, 25 bp, Rattus norvegicus
gtttaggtcccacaatgtttaacat

SEQ ID NO: 531555 - DNA, 25 bp, Rattus norvegicus
gtttaggtcccagaatgtttaacat

SEQ ID NO: 531556 - DNA, 25 bp, Rattus norvegicus
gtttaggttaccaccacacacagtt

SEQ ID NO: 531557 - DNA, 25 bp, Rattus norvegicus
gtttaggttacctccacacacagtt

SEQ ID NO: 531558 - DNA, 25 bp, Rattus norvegicus
gtttagtaaaatcctgctggtcaaa

SEQ ID NO: 531559 - DNA, 25 bp, Rattus norvegicus
gtttagtaaaatgctgctggtcaaa

SEQ ID NO: 531560 - DNA, 25 bp, Rattus norvegicus
gtttagtaaacaaagcccagcacca

SEQ ID NO: 531561 - DNA, 25 bp, Rattus norvegicus
gtttagtaaacatagcccagcacca

SEQ ID NO: 531562 - DNA, 25 bp, Rattus norvegicus
gtttagtagactccaagaccacgtt

SEQ ID NO: 531563 - DNA, 25 bp, Rattus norvegicus
gtttagtagactgcaagaccacgtt

SEQ ID NO: 531564 - DNA, 25 bp, Rattus norvegicus
gtttagtatggccttggtgtgcata

SEQ ID NO: 531565 - DNA, 25 bp, Rattus norvegicus
gtttagtatggcgttggtgtgcata

SEQ ID NO: 531566 - DNA, 25 bp, Rattus norvegicus
gtttagtcaaatacgaacccactcg

SEQ ID NO: 531567 - DNA, 25 bp, Rattus norvegicus
gtttagtcaaattcgaacccactcg

SEQ ID NO: 531568 - DNA, 25 bp, Rattus norvegicus
gtttagtcacccattcaaattcttg

SEQ ID NO: 531569 - DNA, 25 bp, Rattus norvegicus
gtttagtcaccctttcaaattcttg

SEQ ID NO: 531570 - DNA, 25 bp, Rattus norvegicus
gtttagtcatggactttaagtcagt

SEQ ID NO: 531571 - DNA, 25 bp, Rattus norvegicus
gtttagtcatggtctttaagtcagt

SEQ ID NO: 531572 - DNA, 25 bp, Rattus norvegicus
gtttagtccacacgattactgccag

SEQ ID NO: 531573 - DNA, 25 bp, Rattus norvegicus
gtttagtccacaggattactgccag

SEQ ID NO: 531574 - DNA, 25 bp, Rattus norvegicus
gtttagtccccaaagatccaatgct

SEQ ID NO: 531575 - DNA, 25 bp, Rattus norvegicus
gtttagtccccatagatccaatgct

SEQ ID NO: 531576 - DNA, 25 bp, Rattus norvegicus
gtttagtccctacaacctcataaag

SEQ ID NO: 531577 - DNA, 25 bp, Rattus norvegicus
gtttagtccctagaacctcataaag

SEQ ID NO: 531578 - DNA, 25 bp, Rattus norvegicus
gtttagtctggaaactggtctgttt

SEQ ID NO: 531579 - DNA, 25 bp, Rattus norvegicus
gtttagtctggatactggtctgttt

SEQ ID NO: 531580 - DNA, 25 bp, Rattus norvegicus
gtttagtgaggccttacctctccca

SEQ ID NO: 531581 - DNA, 25 bp, Rattus norvegicus
gtttagtgaggcgttacctctccca

SEQ ID NO: 531582 - DNA, 25 bp, Rattus norvegicus
gtttagtgcccaacagtgcattgca

SEQ ID NO: 531583 - DNA, 25 bp, Rattus norvegicus
gtttagtgcccatcagtgcattgca

SEQ ID NO: 531584 - DNA, 25 bp, Rattus norvegicus
gtttagtgtcatcctctggtttata

SEQ ID NO: 531585 - DNA, 25 bp, Rattus norvegicus
gtttagtgtcatgctctggtttata

SEQ ID NO: 531586 - DNA, 25 bp, Rattus norvegicus
gtttagttactcctgggtatcctca

SEQ ID NO: 531587 - DNA, 25 bp, Rattus norvegicus
gtttagttactcgtgggtatcctca

SEQ ID NO: 531588 - DNA, 25 bp, Rattus norvegicus
gtttagttagcacctattttgtact

SEQ ID NO: 531589 - DNA, 25 bp, Rattus norvegicus
gtttagttagcagctattttgtact

SEQ ID NO: 531590 - DNA, 25 bp, Rattus norvegicus
gtttagttcctaccactgagttcta

SEQ ID NO: 531591 - DNA, 25 bp, Rattus norvegicus
gtttagttcctagcactgagttcta

SEQ ID NO: 531592 - DNA, 25 bp, Rattus norvegicus
gtttagttcttcacgttctagtctc

SEQ ID NO: 531593 - DNA, 25 bp, Rattus norvegicus
gtttagttcttctcgttctagtctc

SEQ ID NO: 531594 - DNA, 25 bp, Rattus norvegicus
gtttagttgctgcttttctgtggcg

SEQ ID NO: 531595 - DNA, 25 bp, Rattus norvegicus
gtttagttgctggttttctgtggcg

SEQ ID NO: 531596 - DNA, 25 bp, Rattus norvegicus
gtttagtttctacctcaaggctttg

SEQ ID NO: 531597 - DNA, 25 bp, Rattus norvegicus
gtttagtttctagctcaaggctttg

SEQ ID NO: 531598 - DNA, 25 bp, Rattus norvegicus
gtttagtttgtgatagattccttat

SEQ ID NO: 531599 - DNA, 25 bp, Rattus norvegicus
gtttagtttgtgttagattccttat

SEQ ID NO: 531600 - DNA, 25 bp, Rattus norvegicus
gtttataaagtcaagtgagtgtcca

SEQ ID NO: 531601 - DNA, 25 bp, Rattus norvegicus
gtttataaagtctagtgagtgtcca

SEQ ID NO: 531602 - DNA, 25 bp, Rattus norvegicus
gtttataaagtgctcagtcaaagcc

SEQ ID NO: 531603 - DNA, 25 bp, Rattus norvegicus
gtttataaagtggtcagtcaaagcc

SEQ ID NO: 531604 - DNA, 25 bp, Rattus norvegicus
gtttataactacaaccacctcatgc

SEQ ID NO: 531605 - DNA, 25 bp, Rattus norvegicus
gtttataactactaccacctcatgc

SEQ ID NO: 531606 - DNA, 25 bp, Rattus norvegicus
gtttataactgaaccattgctagta

SEQ ID NO: 531607 - DNA, 25 bp, Rattus norvegicus
gtttataactgatccattgctagta

SEQ ID NO: 531608 - DNA, 25 bp, Rattus norvegicus
gtttataactttacctgatgtgaca

SEQ ID NO: 531609 - DNA, 25 bp, Rattus norvegicus
gtttataacttttcctgatgtgaca

SEQ ID NO: 531610 - DNA, 25 bp, Rattus norvegicus
gtttataagccacacaatgtctgag

SEQ ID NO: 531611 - DNA, 25 bp, Rattus norvegicus
gtttataagccagacaatgtctgag

SEQ ID NO: 531612 - DNA, 25 bp, Rattus norvegicus
gtttataatatgatcattcctactg

SEQ ID NO: 531613 - DNA, 25 bp, Rattus norvegicus
gtttataatatgttcattcctactg

SEQ ID NO: 531614 - DNA, 25 bp, Rattus norvegicus
gtttataatctcagcccttggaagg

SEQ ID NO: 531615 - DNA, 25 bp, Rattus norvegicus
gtttataatctctgcccttggaagg

SEQ ID NO: 531616 - DNA, 25 bp, Rattus norvegicus
gtttatacccaactgaactacagaa

SEQ ID NO: 531617 - DNA, 25 bp, Rattus norvegicus
gtttatacccaagtgaactacagaa

SEQ ID NO: 531618 - DNA, 25 bp, Rattus norvegicus
gtttataccgagaaagctggcagtt

SEQ ID NO: 531619 - DNA, 25 bp, Rattus norvegicus
gtttataccgagtaagctggcagtt

SEQ ID NO: 531620 - DNA, 25 bp, Rattus norvegicus
gtttatacctgcctctctggttcct

SEQ ID NO: 531621 - DNA, 25 bp, Rattus norvegicus
gtttatacctgcgtctctggttcct

SEQ ID NO: 531622 - DNA, 25 bp, Rattus norvegicus
gtttataccttcattattcacatac

SEQ ID NO: 531623 - DNA, 25 bp, Rattus norvegicus
gtttataccttctttattcacatac

SEQ ID NO: 531624 - DNA, 25 bp, Rattus norvegicus
gtttatactcagaactgacgcctcc

SEQ ID NO: 531625 - DNA, 25 bp, Rattus norvegicus
gtttatactcagtactgacgcctcc

SEQ ID NO: 531626 - DNA, 25 bp, Rattus norvegicus
gtttatactcatatggactcctgtc

SEQ ID NO: 531627 - DNA, 25 bp, Rattus norvegicus
gtttatactcatttggactcctgtc

SEQ ID NO: 531628 - DNA, 25 bp, Rattus norvegicus
gtttatactgctagggctgggcctc

SEQ ID NO: 531629 - DNA, 25 bp, Rattus norvegicus
gtttatactgcttgggctgggcctc

SEQ ID NO: 531630 - DNA, 25 bp, Rattus norvegicus
gtttatactgtcatggcttcctacc

SEQ ID NO: 531631 - DNA, 25 bp, Rattus norvegicus
gtttatactgtcttggcttcctacc

SEQ ID NO: 531632 - DNA, 25 bp, Rattus norvegicus
gtttatagcctgatagaccctgata

SEQ ID NO: 531633 - DNA, 25 bp, Rattus norvegicus
gtttatagcctgcaaatgtagacgc

SEQ ID NO: 531634 - DNA, 25 bp, Rattus norvegicus
gtttatagcctggaaatgtagacgc

SEQ ID NO: 531635 - DNA, 25 bp, Rattus norvegicus
gtttatagcctgttagaccctgata

SEQ ID NO: 531636 - DNA, 25 bp, Rattus norvegicus
gtttatagtcctcactaccacctga

SEQ ID NO: 531637 - DNA, 25 bp, Rattus norvegicus
gtttatagtcctgactaccacctga

SEQ ID NO: 531638 - DNA, 25 bp, Rattus norvegicus
gtttatagttttcacaactttcata

SEQ ID NO: 531639 - DNA, 25 bp, Rattus norvegicus
gtttatagttttgacaactttcata

SEQ ID NO: 531640 - DNA, 25 bp, Rattus norvegicus
gtttatataaaaccattcagaagac

SEQ ID NO: 531641 - DNA, 25 bp, Rattus norvegicus
gtttatataaaagcattcagaagac

SEQ ID NO: 531642 - DNA, 25 bp, Rattus norvegicus
gtttatatacctcagagcctgctat

SEQ ID NO: 531643 - DNA, 25 bp, Rattus norvegicus
gtttatatacctgagagcctgctat

SEQ ID NO: 531644 - DNA, 25 bp, Rattus norvegicus
gtttatatagcacctggcagccggg

SEQ ID NO: 531645 - DNA, 25 bp, Rattus norvegicus
gtttatatagcagctggcagccggg

SEQ ID NO: 531646 - DNA, 25 bp, Rattus norvegicus
gtttatatagtaacttgcgccttca

SEQ ID NO: 531647 - DNA, 25 bp, Rattus norvegicus
gtttatatagtatcttgcgccttca

SEQ ID NO: 531648 - DNA, 25 bp, Rattus norvegicus
gtttatatatacatgtatgtgcaaa

SEQ ID NO: 531649 - DNA, 25 bp, Rattus norvegicus
gtttatatatacttgtatgtgcaaa

SEQ ID NO: 531650 - DNA, 25 bp, Rattus norvegicus
gtttatatcaacacagcccaggagt

SEQ ID NO: 531651 - DNA, 25 bp, Rattus norvegicus
gtttatatcaactcagcccaggagt

SEQ ID NO: 531652 - DNA, 25 bp, Rattus norvegicus
gtttatatcggaagccacatgcctt

SEQ ID NO: 531653 - DNA, 25 bp, Rattus norvegicus
gtttatatcggatgccacatgcctt

SEQ ID NO: 531654 - DNA, 25 bp, Rattus norvegicus
gtttatattagaacacttccaaagg

SEQ ID NO: 531655 - DNA, 25 bp, Rattus norvegicus
gtttatattagacagcacagctcaa

SEQ ID NO: 531656 - DNA, 25 bp, Rattus norvegicus
gtttatattagagagcacagctcaa

SEQ ID NO: 531657 - DNA, 25 bp, Rattus norvegicus
gtttatattagatcacttccaaagg

SEQ ID NO: 531658 - DNA, 25 bp, Rattus norvegicus
gtttatattcatactgggagccatt

SEQ ID NO: 531659 - DNA, 25 bp, Rattus norvegicus
gtttatattcattctgggagccatt

SEQ ID NO: 531660 - DNA, 25 bp, Rattus norvegicus
gtttatattcccagtatctatgtat

SEQ ID NO: 531661 - DNA, 25 bp, Rattus norvegicus
gtttatattccctgtatctatgtat

SEQ ID NO: 531662 - DNA, 25 bp, Rattus norvegicus
gtttatattctgatagttatcctgt

SEQ ID NO: 531663 - DNA, 25 bp, Rattus norvegicus
gtttatattctgttagttatcctgt

SEQ ID NO: 531664 - DNA, 25 bp, Rattus norvegicus
gtttatcaacatacctagcgagtat

SEQ ID NO: 531665 - DNA, 25 bp, Rattus norvegicus
gtttatcaacattcctagcgagtat

SEQ ID NO: 531666 - DNA, 25 bp, Rattus norvegicus
gtttatcacaccactgcctccttga

SEQ ID NO: 531667 - DNA, 25 bp, Rattus norvegicus
gtttatcacacctctgcctccttga

SEQ ID NO: 531668 - DNA, 25 bp, Rattus norvegicus
gtttatcacactccctggtatgtaa

SEQ ID NO: 531669 - DNA, 25 bp, Rattus norvegicus
gtttatcacactgcctggtatgtaa

SEQ ID NO: 531670 - DNA, 25 bp, Rattus norvegicus
gtttatcaccccagcatattttgca

SEQ ID NO: 531671 - DNA, 25 bp, Rattus norvegicus
gtttatcacccctgcatattttgca

SEQ ID NO: 531672 - DNA, 25 bp, Rattus norvegicus
gtttatcacctgcaagggcccagca

SEQ ID NO: 531673 - DNA, 25 bp, Rattus norvegicus
gtttatcacctggaagggcccagca

SEQ ID NO: 531674 - DNA, 25 bp, Rattus norvegicus
gtttatcagccaattctgttgtgaa

SEQ ID NO: 531675 - DNA, 25 bp, Rattus norvegicus
gtttatcagccatttctgttgtgaa

SEQ ID NO: 531676 - DNA, 25 bp, Rattus norvegicus
gtttatcagcttatccggtaacagt

SEQ ID NO: 531677 - DNA, 25 bp, Rattus norvegicus
gtttatcagcttttccggtaacagt

SEQ ID NO: 531678 - DNA, 25 bp, Rattus norvegicus
gtttatcaggtaaaggtgactgcca

SEQ ID NO: 531679 - DNA, 25 bp, Rattus norvegicus
gtttatcaggtataggtgactgcca

SEQ ID NO: 531680 - DNA, 25 bp, Rattus norvegicus
gtttatcatacaatcttttgcaata

SEQ ID NO: 531681 - DNA, 25 bp, Rattus norvegicus
gtttatcatacattcttttgcaata

SEQ ID NO: 531682 - DNA, 25 bp, Rattus norvegicus
gtttatcataccacaggagttctat

SEQ ID NO: 531683 - DNA, 25 bp, Rattus norvegicus
gtttatcatacctcaggagttctat

SEQ ID NO: 531684 - DNA, 25 bp, Rattus norvegicus
gtttatcatcgcacctgagagagtt

SEQ ID NO: 531685 - DNA, 25 bp, Rattus norvegicus
gtttatcatcgctcctgagagagtt

SEQ ID NO: 531686 - DNA, 25 bp, Rattus norvegicus
gtttatcatctgacaccaagccaat

SEQ ID NO: 531687 - DNA, 25 bp, Rattus norvegicus
gtttatcatctgtcaccaagccaat

SEQ ID NO: 531688 - DNA, 25 bp, Rattus norvegicus
gtttatcatggtaattctctgaatg

SEQ ID NO: 531689 - DNA, 25 bp, Rattus norvegicus
gtttatcatggttattctctgaatg

SEQ ID NO: 531690 - DNA, 25 bp, Rattus norvegicus
gtttatccagtgagacccaagctag

SEQ ID NO: 531691 - DNA, 25 bp, Rattus norvegicus
gtttatccagtgtgacccaagctag

SEQ ID NO: 531692 - DNA, 25 bp, Rattus norvegicus
gtttatccagttctgagtccatcag

SEQ ID NO: 531693 - DNA, 25 bp, Rattus norvegicus
gtttatccagttgtgagtccatcag

SEQ ID NO: 531694 - DNA, 25 bp, Rattus norvegicus
gtttatccatgaattcagccaccac

SEQ ID NO: 531695 - DNA, 25 bp, Rattus norvegicus
gtttatccatgatttcagccaccac

SEQ ID NO: 531696 - DNA, 25 bp, Rattus norvegicus
gtttatccatgcatcgttgagactt

SEQ ID NO: 531697 - DNA, 25 bp, Rattus norvegicus
gtttatccatgcttcgttgagactt

SEQ ID NO: 531698 - DNA, 25 bp, Rattus norvegicus
gtttatcctaatatcagacccactc

SEQ ID NO: 531699 - DNA, 25 bp, Rattus norvegicus
gtttatcctaatttcagacccactc

SEQ ID NO: 531700 - DNA, 25 bp, Rattus norvegicus
gtttatcctagaatgggttcctgaa

SEQ ID NO: 531701 - DNA, 25 bp, Rattus norvegicus
gtttatcctagattgggttcctgaa

SEQ ID NO: 531702 - DNA, 25 bp, Rattus norvegicus
gtttatcctgtaattttgcattaat

SEQ ID NO: 531703 - DNA, 25 bp, Rattus norvegicus
gtttatcctgtatttttgcattaat

SEQ ID NO: 531704 - DNA, 25 bp, Rattus norvegicus
gtttatcgaattatctctgcttgat

SEQ ID NO: 531705 - DNA, 25 bp, Rattus norvegicus
gtttatcgaattttctctgcttgat

SEQ ID NO: 531706 - DNA, 25 bp, Rattus norvegicus
gtttatcgtcttactcgacacataa

SEQ ID NO: 531707 - DNA, 25 bp, Rattus norvegicus
gtttatcgtctttctcgacacataa

SEQ ID NO: 531708 - DNA, 25 bp, Rattus norvegicus
gtttatcgtgatcgcataagcccaa

SEQ ID NO: 531709 - DNA, 25 bp, Rattus norvegicus
gtttatcgtgatggcataagcccaa

SEQ ID NO: 531710 - DNA, 25 bp, Rattus norvegicus
gtttatctaattacgctggtggcat

SEQ ID NO: 531711 - DNA, 25 bp, Rattus norvegicus
gtttatctaatttcgctggtggcat

SEQ ID NO: 531712 - DNA, 25 bp, Rattus norvegicus
gtttatctagatctccggcaaaagt

SEQ ID NO: 531713 - DNA, 25 bp, Rattus norvegicus
gtttatctagatgtccggcaaaagt

SEQ ID NO: 531714 - DNA, 25 bp, Rattus norvegicus
gtttatctatggctctgcatctgct

SEQ ID NO: 531715 - DNA, 25 bp, Rattus norvegicus
gtttatctatgggtctgcatctgct

SEQ ID NO: 531716 - DNA, 25 bp, Rattus norvegicus
gtttatctatttactgggtatctcc

SEQ ID NO: 531717 - DNA, 25 bp, Rattus norvegicus
gtttatctattttctgggtatctcc

SEQ ID NO: 531718 - DNA, 25 bp, Rattus norvegicus
gtttatctcaaaccagggacccatg

SEQ ID NO: 531719 - DNA, 25 bp, Rattus norvegicus
gtttatctcaaagcagggacccatg

SEQ ID NO: 531720 - DNA, 25 bp, Rattus norvegicus
gtttatctcgaccacatctttttac

SEQ ID NO: 531721 - DNA, 25 bp, Rattus norvegicus
gtttatctcgacgacatctttttac

SEQ ID NO: 531722 - DNA, 25 bp, Rattus norvegicus
gtttatctctaaaatgcatagttca

SEQ ID NO: 531723 - DNA, 25 bp, Rattus norvegicus
gtttatctctaatatgcatagttca

SEQ ID NO: 531724 - DNA, 25 bp, Rattus norvegicus
gtttatctcttgcacacatcaaatg

SEQ ID NO: 531725 - DNA, 25 bp, Rattus norvegicus
gtttatctcttggacacatcaaatg

SEQ ID NO: 531726 - DNA, 25 bp, Rattus norvegicus
gtttatctggctcagtggtcactag

SEQ ID NO: 531727 - DNA, 25 bp, Rattus norvegicus
gtttatctggctgagtggtcactag

SEQ ID NO: 531728 - DNA, 25 bp, Rattus norvegicus
gtttatctgggcaccgtactggaaa

SEQ ID NO: 531729 - DNA, 25 bp, Rattus norvegicus
gtttatctgggctccgtactggaaa

SEQ ID NO: 531730 - DNA, 25 bp, Rattus norvegicus
gtttatctttccagttcttttgttg

SEQ ID NO: 531731 - DNA, 25 bp, Rattus norvegicus
gtttatctttcctgttcttttgttg

SEQ ID NO: 531732 - DNA, 25 bp, Rattus norvegicus
gtttatctttgtacagaacctctga

SEQ ID NO: 531733 - DNA, 25 bp, Rattus norvegicus
gtttatctttgttcagaacctctga

SEQ ID NO: 531734 - DNA, 25 bp, Rattus norvegicus
gtttatcttttacattaggacaggt

SEQ ID NO: 531735 - DNA, 25 bp, Rattus norvegicus
gtttatcttttagattaggacaggt

SEQ ID NO: 531736 - DNA, 25 bp, Rattus norvegicus
gtttatgaaatgctggaccgcctgc

SEQ ID NO: 531737 - DNA, 25 bp, Rattus norvegicus
gtttatgaaatggtggaccgcctgc

SEQ ID NO: 531738 - DNA, 25 bp, Rattus norvegicus
gtttatgaacttattccaggcccat

SEQ ID NO: 531739 - DNA, 25 bp, Rattus norvegicus
gtttatgaactttttccaggcccat

SEQ ID NO: 531740 - DNA, 25 bp, Rattus norvegicus
gtttatgaagcactgcaccagccag

SEQ ID NO: 531741 - DNA, 25 bp, Rattus norvegicus
gtttatgaagcagtgcaccagccag

SEQ ID NO: 531742 - DNA, 25 bp, Rattus norvegicus
gtttatgaagcgattctgcagccat

SEQ ID NO: 531743 - DNA, 25 bp, Rattus norvegicus
gtttatgaagcgtttctgcagccat

SEQ ID NO: 531744 - DNA, 25 bp, Rattus norvegicus
gtttatgacatcactagtagtcgca

SEQ ID NO: 531745 - DNA, 25 bp, Rattus norvegicus
gtttatgacatctctagtagtcgca

SEQ ID NO: 531746 - DNA, 25 bp, Rattus norvegicus
gtttatgacccacccaacatggatg

SEQ ID NO: 531747 - DNA, 25 bp, Rattus norvegicus
gtttatgacccagccaacatggatg

SEQ ID NO: 531748 - DNA, 25 bp, Rattus norvegicus
gtttatgacttcacttcatttcctg

SEQ ID NO: 531749 - DNA, 25 bp, Rattus norvegicus
gtttatgacttctcttcatttcctg

SEQ ID NO: 531750 - DNA, 25 bp, Rattus norvegicus
gtttatgagagactagacttccttg

SEQ ID NO: 531751 - DNA, 25 bp, Rattus norvegicus
gtttatgagagagtagacttccttg

SEQ ID NO: 531752 - DNA, 25 bp, Rattus norvegicus
gtttatgagcatccatatcttttca

SEQ ID NO: 531753 - DNA, 25 bp, Rattus norvegicus
gtttatgagcatgcatatcttttca

SEQ ID NO: 531754 - DNA, 25 bp, Rattus norvegicus
gtttatgctgatacacagtgatttc

SEQ ID NO: 531755 - DNA, 25 bp, Rattus norvegicus
gtttatgctgattcacagtgatttc

SEQ ID NO: 531756 - DNA, 25 bp, Rattus norvegicus
gtttatgctgcacctagaattcctt

SEQ ID NO: 531757 - DNA, 25 bp, Rattus norvegicus
gtttatgctgcagctagaattcctt

SEQ ID NO: 531758 - DNA, 25 bp, Rattus norvegicus
gtttatgctggtcctctgagatctg

SEQ ID NO: 531759 - DNA, 25 bp, Rattus norvegicus
gtttatgctggtgctctgagatctg

SEQ ID NO: 531760 - DNA, 25 bp, Rattus norvegicus
gtttatgctgtcacaggatgccgag

SEQ ID NO: 531761 - DNA, 25 bp, Rattus norvegicus
gtttatgctgtctcaggatgccgag

SEQ ID NO: 531762 - DNA, 25 bp, Rattus norvegicus
gtttatgcttaacctggctttcttc

SEQ ID NO: 531763 - DNA, 25 bp, Rattus norvegicus
gtttatgcttaagctggctttcttc

SEQ ID NO: 531764 - DNA, 25 bp, Rattus norvegicus
gtttatgcttctacatccagtttgt

SEQ ID NO: 531765 - DNA, 25 bp, Rattus norvegicus
gtttatgcttcttcatccagtttgt

SEQ ID NO: 531766 - DNA, 25 bp, Rattus norvegicus
gtttatggacatactgccctttttt

SEQ ID NO: 531767 - DNA, 25 bp, Rattus norvegicus
gtttatggacattctgccctttttt

SEQ ID NO: 531768 - DNA, 25 bp, Rattus norvegicus
gtttatggcattcacctactgcaat

SEQ ID NO: 531769 - DNA, 25 bp, Rattus norvegicus
gtttatggcattgacctactgcaat

SEQ ID NO: 531770 - DNA, 25 bp, Rattus norvegicus
gtttatgtagcaaccactgcggact

SEQ ID NO: 531771 - DNA, 25 bp, Rattus norvegicus
gtttatgtagcatccactgcggact

SEQ ID NO: 531772 - DNA, 25 bp, Rattus norvegicus
gtttatgtaggtaccctcatcgaac

SEQ ID NO: 531773 - DNA, 25 bp, Rattus norvegicus
gtttatgtaggttccctcatcgaac

SEQ ID NO: 531774 - DNA, 25 bp, Rattus norvegicus
gtttatgtcaccagtgctgcgacaa

SEQ ID NO: 531775 - DNA, 25 bp, Rattus norvegicus
gtttatgtcacctgtgctgcgacaa

SEQ ID NO: 531776 - DNA, 25 bp, Rattus norvegicus
gtttatgtcagcattatctcggaat

SEQ ID NO: 531777 - DNA, 25 bp, Rattus norvegicus
gtttatgtcagctttatctcggaat

SEQ ID NO: 531778 - DNA, 25 bp, Rattus norvegicus
gtttatgtctaaaagcagttcgagt

SEQ ID NO: 531779 - DNA, 25 bp, Rattus norvegicus
gtttatgtctaatagcagttcgagt

SEQ ID NO: 531780 - DNA, 25 bp, Rattus norvegicus
gtttatgtgcaccaccaccatctga

SEQ ID NO: 531781 - DNA, 25 bp, Rattus norvegicus
gtttatgtgcacgaccaccatctga

SEQ ID NO: 531782 - DNA, 25 bp, Rattus norvegicus
gtttatgtgtctatccattgctttc

SEQ ID NO: 531783 - DNA, 25 bp, Rattus norvegicus
gtttatgtgtctttccattgctttc

SEQ ID NO: 531784 - DNA, 25 bp, Rattus norvegicus
gtttatgttagtcggcttttctgtt

SEQ ID NO: 531785 - DNA, 25 bp, Rattus norvegicus
gtttatgttagtgggcttttctgtt

SEQ ID NO: 531786 - DNA, 25 bp, Rattus norvegicus
gtttatgttcatctctcctttctaa

SEQ ID NO: 531787 - DNA, 25 bp, Rattus norvegicus
gtttatgttcatgtctcctttctaa

SEQ ID NO: 531788 - DNA, 25 bp, Rattus norvegicus
gtttattaaccaaacctgtcctgag

SEQ ID NO: 531789 - DNA, 25 bp, Rattus norvegicus
gtttattaaccatacctgtcctgag

SEQ ID NO: 531790 - DNA, 25 bp, Rattus norvegicus
gtttattaatgccttttccagccag

SEQ ID NO: 531791 - DNA, 25 bp, Rattus norvegicus
gtttattaatgcgttttccagccag

SEQ ID NO: 531792 - DNA, 25 bp, Rattus norvegicus
gtttattaccatctgctgggactgg

SEQ ID NO: 531793 - DNA, 25 bp, Rattus norvegicus
gtttattaccatgtgctgggactgg

SEQ ID NO: 531794 - DNA, 25 bp, Rattus norvegicus
gtttattaccttatcagtcccgtga

SEQ ID NO: 531795 - DNA, 25 bp, Rattus norvegicus
gtttattaccttttcagtcccgtga

SEQ ID NO: 531796 - DNA, 25 bp, Rattus norvegicus
gtttattacgtaagtctggttctca

SEQ ID NO: 531797 - DNA, 25 bp, Rattus norvegicus
gtttattacgtatgtctggttctca

SEQ ID NO: 531798 - DNA, 25 bp, Rattus norvegicus
gtttattataagcaccctatgctgt

SEQ ID NO: 531799 - DNA, 25 bp, Rattus norvegicus
gtttattataaggaccctatgctgt

SEQ ID NO: 531800 - DNA, 25 bp, Rattus norvegicus
gtttattatccaaagcaggtacaat

SEQ ID NO: 531801 - DNA, 25 bp, Rattus norvegicus
gtttattatccatagcaggtacaat

SEQ ID NO: 531802 - DNA, 25 bp, Rattus norvegicus
gtttattcaggtcctttaacatttt

SEQ ID NO: 531803 - DNA, 25 bp, Rattus norvegicus
gtttattcaggtgctttaacatttt

SEQ ID NO: 531804 - DNA, 25 bp, Rattus norvegicus
gtttattcagtcaccactctataaa

SEQ ID NO: 531805 - DNA, 25 bp, Rattus norvegicus
gtttattcagtctccactctataaa

SEQ ID NO: 531806 - DNA, 25 bp, Rattus norvegicus
gtttattcattcacacattgacttt

SEQ ID NO: 531807 - DNA, 25 bp, Rattus norvegicus
gtttattcattctcacattgacttt

SEQ ID NO: 531808 - DNA, 25 bp, Rattus norvegicus
gtttattcatttccgtgcttggttt

SEQ ID NO: 531809 - DNA, 25 bp, Rattus norvegicus
gtttattcatttgcgtgcttggttt

SEQ ID NO: 531810 - DNA, 25 bp, Rattus norvegicus
gtttattccatcacagcgtttttca

SEQ ID NO: 531811 - DNA, 25 bp, Rattus norvegicus
gtttattccatctcagcgtttttca

SEQ ID NO: 531812 - DNA, 25 bp, Rattus norvegicus
gtttattcccaactatgcctttaag

SEQ ID NO: 531813 - DNA, 25 bp, Rattus norvegicus
gtttattcccaagtatgcctttaag

SEQ ID NO: 531814 - DNA, 25 bp, Rattus norvegicus
gtttattcctacattgaatgccgtg

SEQ ID NO: 531815 - DNA, 25 bp, Rattus norvegicus
gtttattcctactttgaatgccgtg

SEQ ID NO: 531816 - DNA, 25 bp, Rattus norvegicus
gtttattcctcaagcgggcgagcct

SEQ ID NO: 531817 - DNA, 25 bp, Rattus norvegicus
gtttattcctcatgcgggcgagcct

SEQ ID NO: 531818 - DNA, 25 bp, Rattus norvegicus
gtttattcgaagcaactgggaggca

SEQ ID NO: 531819 - DNA, 25 bp, Rattus norvegicus
gtttattcgaaggaactgggaggca

SEQ ID NO: 531820 - DNA, 25 bp, Rattus norvegicus
gtttattgcaagcatcattcagtgt

SEQ ID NO: 531821 - DNA, 25 bp, Rattus norvegicus
gtttattgcaaggatcattcagtgt

SEQ ID NO: 531822 - DNA, 25 bp, Rattus norvegicus
gtttattgcagcatttctttccctg

SEQ ID NO: 531823 - DNA, 25 bp, Rattus norvegicus
gtttattgcagcttttctttccctg

SEQ ID NO: 531824 - DNA, 25 bp, Rattus norvegicus
gtttattgcaggcacgcagcaggcc

SEQ ID NO: 531825 - DNA, 25 bp, Rattus norvegicus
gtttattgcagggacgcagcaggcc

SEQ ID NO: 531826 - DNA, 25 bp, Rattus norvegicus
gtttattggtatattgcaggtcccc

SEQ ID NO: 531827 - DNA, 25 bp, Rattus norvegicus
gtttattggtattttgcaggtcccc

SEQ ID NO: 531828 - DNA, 25 bp, Rattus norvegicus
gtttattgttctacaatcccagccc

SEQ ID NO: 531829 - DNA, 25 bp, Rattus norvegicus
gtttattgttcttcaatcccagccc

SEQ ID NO: 531830 - DNA, 25 bp, Rattus norvegicus
gtttattgtttaaagccccagccag

SEQ ID NO: 531831 - DNA, 25 bp, Rattus norvegicus
gtttattgtttatagccccagccag

SEQ ID NO: 531832 - DNA, 25 bp, Rattus norvegicus
gtttatttaaacaatgctggctttg

SEQ ID NO: 531833 - DNA, 25 bp, Rattus norvegicus
gtttatttaaactatgctggctttg

SEQ ID NO: 531834 - DNA, 25 bp, Rattus norvegicus
gtttatttcctcaatccccataata

SEQ ID NO: 531835 - DNA, 25 bp, Rattus norvegicus
gtttatttcctctatccccataata

SEQ ID NO: 531836 - DNA, 25 bp, Rattus norvegicus
gtttatttctcaagtgcactgctga

SEQ ID NO: 531837 - DNA, 25 bp, Rattus norvegicus
gtttatttctcatgtgcactgctga

SEQ ID NO: 531838 - DNA, 25 bp, Rattus norvegicus
gtttatttcttgatcacgtacccat

SEQ ID NO: 531839 - DNA, 25 bp, Rattus norvegicus
gtttatttcttgttcacgtacccat

SEQ ID NO: 531840 - DNA, 25 bp, Rattus norvegicus
gtttatttgaagctctgggtgccta

SEQ ID NO: 531841 - DNA, 25 bp, Rattus norvegicus
gtttatttgaaggtctgggtgccta

SEQ ID NO: 531842 - DNA, 25 bp, Rattus norvegicus
gtttatttgacactgttttgactca

SEQ ID NO: 531843 - DNA, 25 bp, Rattus norvegicus
gtttatttgacagtgttttgactca

SEQ ID NO: 531844 - DNA, 25 bp, Rattus norvegicus
gtttatttgcacactatttaaccat

SEQ ID NO: 531845 - DNA, 25 bp, Rattus norvegicus
gtttatttgcacaggtactgacatt

SEQ ID NO: 531846 - DNA, 25 bp, Rattus norvegicus
gtttatttgcactctatttaaccat

SEQ ID NO: 531847 - DNA, 25 bp, Rattus norvegicus
gtttatttgcactggtactgacatt

SEQ ID NO: 531848 - DNA, 25 bp, Rattus norvegicus
gtttatttgcataatctgagttgtt

SEQ ID NO: 531849 - DNA, 25 bp, Rattus norvegicus
gtttatttgcattatctgagttgtt

SEQ ID NO: 531850 - DNA, 25 bp, Rattus norvegicus
gtttatttgcttagagcccagtcca

SEQ ID NO: 531851 - DNA, 25 bp, Rattus norvegicus
gtttatttgctttgagcccagtcca

SEQ ID NO: 531852 - DNA, 25 bp, Rattus norvegicus
gtttatttgtaactctaacagcaga

SEQ ID NO: 531853 - DNA, 25 bp, Rattus norvegicus
gtttatttgtaagtctaacagcaga

SEQ ID NO: 531854 - DNA, 25 bp, Rattus norvegicus
gtttatttgtatatctagtctagtt

SEQ ID NO: 531855 - DNA, 25 bp, Rattus norvegicus
gtttatttgtatttctagtctagtt

SEQ ID NO: 531856 - DNA, 25 bp, Rattus norvegicus
gtttattttcgacaaccacatcaga

SEQ ID NO: 531857 - DNA, 25 bp, Rattus norvegicus
gtttattttcgagaaccacatcaga

SEQ ID NO: 531858 - DNA, 25 bp, Rattus norvegicus
gtttattttctgcaagcgacttgac

SEQ ID NO: 531859 - DNA, 25 bp, Rattus norvegicus
gtttattttctggaagcgacttgac

SEQ ID NO: 531860 - DNA, 25 bp, Rattus norvegicus
gtttattttgctacgtctcagacac

SEQ ID NO: 531861 - DNA, 25 bp, Rattus norvegicus
gtttattttgcttcgtctcagacac

SEQ ID NO: 531862 - DNA, 25 bp, Rattus norvegicus
gtttattttggcaaacagttgcaga

SEQ ID NO: 531863 - DNA, 25 bp, Rattus norvegicus
gtttattttggctaacagttgcaga

SEQ ID NO: 531864 - DNA, 25 bp, Rattus norvegicus
gtttattttgtaattagtcccacat

SEQ ID NO: 531865 - DNA, 25 bp, Rattus norvegicus
gtttattttgtatttagtcccacat

SEQ ID NO: 531866 - DNA, 25 bp, Rattus norvegicus
gtttcaaaaccgagggcctgcctgc

SEQ ID NO: 531867 - DNA, 25 bp, Rattus norvegicus
gtttcaaaaccgtgggcctgcctgc

SEQ ID NO: 531868 - DNA, 25 bp, Rattus norvegicus
gtttcaaaagctcatgtcaggacca

SEQ ID NO: 531869 - DNA, 25 bp, Rattus norvegicus
gtttcaaaagctgatgtcaggacca

SEQ ID NO: 531870 - DNA, 25 bp, Rattus norvegicus
gtttcaaaagtcatatttgctcaag

SEQ ID NO: 531871 - DNA, 25 bp, Rattus norvegicus
gtttcaaaagtcttatttgctcaag

SEQ ID NO: 531872 - DNA, 25 bp, Rattus norvegicus
gtttcaaaatgtccttagggtatca

SEQ ID NO: 531873 - DNA, 25 bp, Rattus norvegicus
gtttcaaaatgtgcttagggtatca

SEQ ID NO: 531874 - DNA, 25 bp, Rattus norvegicus
gtttcaaacattctcaagaattcat

SEQ ID NO: 531875 - DNA, 25 bp, Rattus norvegicus
gtttcaaacattgtcaagaattcat

SEQ ID NO: 531876 - DNA, 25 bp, Rattus norvegicus
gtttcaaaccagaactaaggagcat

SEQ ID NO: 531877 - DNA, 25 bp, Rattus norvegicus
gtttcaaaccagtactaaggagcat

SEQ ID NO: 531878 - DNA, 25 bp, Rattus norvegicus
gtttcaaacgccatggagcagaagt

SEQ ID NO: 531879 - DNA, 25 bp, Rattus norvegicus
gtttcaaacgccttggagcagaagt

SEQ ID NO: 531880 - DNA, 25 bp, Rattus norvegicus
gtttcaaacggaagctttctaagca

SEQ ID NO: 531881 - DNA, 25 bp, Rattus norvegicus
gtttcaaacggatgctttctaagca

SEQ ID NO: 531882 - DNA, 25 bp, Rattus norvegicus
gtttcaaactgtctcttgagcagga

SEQ ID NO: 531883 - DNA, 25 bp, Rattus norvegicus
gtttcaaactgtgtcttgagcagga

SEQ ID NO: 531884 - DNA, 25 bp, Rattus norvegicus
gtttcaaagccaacacatctgctgg

SEQ ID NO: 531885 - DNA, 25 bp, Rattus norvegicus
gtttcaaagccatcacatctgctgg

SEQ ID NO: 531886 - DNA, 25 bp, Rattus norvegicus
gtttcaaaggcaccatcggcagttt

SEQ ID NO: 531887 - DNA, 25 bp, Rattus norvegicus
gtttcaaaggcagcatcggcagttt

SEQ ID NO: 531888 - DNA, 25 bp, Rattus norvegicus
gtttcaaatggccaagtctcccaag

SEQ ID NO: 531889 - DNA, 25 bp, Rattus norvegicus
gtttcaaatggcgaagtctcccaag

SEQ ID NO: 531890 - DNA, 25 bp, Rattus norvegicus
gtttcaacaactattccacaagatg

SEQ ID NO: 531891 - DNA, 25 bp, Rattus norvegicus
gtttcaacaacttttccacaagatg

SEQ ID NO: 531892 - DNA, 25 bp, Rattus norvegicus
gtttcaacatctacaatctcttctc

SEQ ID NO: 531893 - DNA, 25 bp, Rattus norvegicus
gtttcaacatcttcaatctcttctc

SEQ ID NO: 531894 - DNA, 25 bp, Rattus norvegicus
gtttcaacctaaccatgtgataata

SEQ ID NO: 531895 - DNA, 25 bp, Rattus norvegicus
gtttcaacctaagcatgtgataata

SEQ ID NO: 531896 - DNA, 25 bp, Rattus norvegicus
gtttcaactgaaccgtttgctattc

SEQ ID NO: 531897 - DNA, 25 bp, Rattus norvegicus
gtttcaactgaagcgtttgctattc

SEQ ID NO: 531898 - DNA, 25 bp, Rattus norvegicus
gtttcaacttaaccttgctactttg

SEQ ID NO: 531899 - DNA, 25 bp, Rattus norvegicus
gtttcaacttaagcttgctactttg

SEQ ID NO: 531900 - DNA, 25 bp, Rattus norvegicus
gtttcaactttaatcttatacgtgg

SEQ ID NO: 531901 - DNA, 25 bp, Rattus norvegicus
gtttcaactttattcttatacgtgg

SEQ ID NO: 531902 - DNA, 25 bp, Rattus norvegicus
gtttcaacttttattactaccactg

SEQ ID NO: 531903 - DNA, 25 bp, Rattus norvegicus
gtttcaacttttctctaatttactg

SEQ ID NO: 531904 - DNA, 25 bp, Rattus norvegicus
gtttcaacttttgtctaatttactg

SEQ ID NO: 531905 - DNA, 25 bp, Rattus norvegicus
gtttcaactttttttactaccactg

SEQ ID NO: 531906 - DNA, 25 bp, Rattus norvegicus
gtttcaagaagcatgcacttcccct

SEQ ID NO: 531907 - DNA, 25 bp, Rattus norvegicus
gtttcaagaagcttgcacttcccct

SEQ ID NO: 531908 - DNA, 25 bp, Rattus norvegicus
gtttcaagagagaatcaacagatca

SEQ ID NO: 531909 - DNA, 25 bp, Rattus norvegicus
gtttcaagagagtatcaacagatca

SEQ ID NO: 531910 - DNA, 25 bp, Rattus norvegicus
gtttcaagatcaccagtgtcactgt

SEQ ID NO: 531911 - DNA, 25 bp, Rattus norvegicus
gtttcaagatcagcagtgtcactgt

SEQ ID NO: 531912 - DNA, 25 bp, Rattus norvegicus
gtttcaagattcagtgccaccaaga

SEQ ID NO: 531913 - DNA, 25 bp, Rattus norvegicus
gtttcaagattctgtgccaccaaga

SEQ ID NO: 531914 - DNA, 25 bp, Rattus norvegicus
gtttcaaggaggctttcagctgcaa

SEQ ID NO: 531915 - DNA, 25 bp, Rattus norvegicus
gtttcaaggagggtttcagctgcaa

SEQ ID NO: 531916 - DNA, 25 bp, Rattus norvegicus
gtttcaaggctgcatctcagcacag

SEQ ID NO: 531917 - DNA, 25 bp, Rattus norvegicus
gtttcaaggctggatctcagcacag

SEQ ID NO: 531918 - DNA, 25 bp, Rattus norvegicus
gtttcaagtcttcaacgtacactag

SEQ ID NO: 531919 - DNA, 25 bp, Rattus norvegicus
gtttcaagtcttgaacgtacactag

SEQ ID NO: 531920 - DNA, 25 bp, Rattus norvegicus
gtttcaagttcaagctttctggttt

SEQ ID NO: 531921 - DNA, 25 bp, Rattus norvegicus
gtttcaagttcatgctttctggttt

SEQ ID NO: 531922 - DNA, 25 bp, Rattus norvegicus
gtttcaataacaatccttcagacga

SEQ ID NO: 531923 - DNA, 25 bp, Rattus norvegicus
gtttcaataacattccttcagacga

SEQ ID NO: 531924 - DNA, 25 bp, Rattus norvegicus
gtttcaataggacagcacttgccta

SEQ ID NO: 531925 - DNA, 25 bp, Rattus norvegicus
gtttcaataggagagcacttgccta

SEQ ID NO: 531926 - DNA, 25 bp, Rattus norvegicus
gtttcaatgaaccagctatgtaatg

SEQ ID NO: 531927 - DNA, 25 bp, Rattus norvegicus
gtttcaatgaacgagctatgtaatg

SEQ ID NO: 531928 - DNA, 25 bp, Rattus norvegicus
gtttcacacaagattttaatccaga

SEQ ID NO: 531929 - DNA, 25 bp, Rattus norvegicus
gtttcacacaagtttttaatccaga

SEQ ID NO: 531930 - DNA, 25 bp, Rattus norvegicus
gtttcacaccctacaagcaggctgt

SEQ ID NO: 531931 - DNA, 25 bp, Rattus norvegicus
gtttcacacccttcaagcaggctgt

SEQ ID NO: 531932 - DNA, 25 bp, Rattus norvegicus
gtttcacagacaaccttcaatgtag

SEQ ID NO: 531933 - DNA, 25 bp, Rattus norvegicus
gtttcacagacatccttcaatgtag

SEQ ID NO: 531934 - DNA, 25 bp, Rattus norvegicus
gtttcacagcgtatttggaaagcat

SEQ ID NO: 531935 - DNA, 25 bp, Rattus norvegicus
gtttcacagcgtttttggaaagcat

SEQ ID NO: 531936 - DNA, 25 bp, Rattus norvegicus
gtttcacagctgaaatcattgaggc

SEQ ID NO: 531937 - DNA, 25 bp, Rattus norvegicus
gtttcacagctgtaatcattgaggc

SEQ ID NO: 531938 - DNA, 25 bp, Rattus norvegicus
gtttcacaggaacaaagcttgtgct

SEQ ID NO: 531939 - DNA, 25 bp, Rattus norvegicus
gtttcacaggaagaaagcttgtgct

SEQ ID NO: 531940 - DNA, 25 bp, Rattus norvegicus
gtttcacagtaacctagtcttcccc

SEQ ID NO: 531941 - DNA, 25 bp, Rattus norvegicus
gtttcacagtaagctagtcttcccc

SEQ ID NO: 531942 - DNA, 25 bp, Rattus norvegicus
gtttcacagtccatctttaagtctc

SEQ ID NO: 531943 - DNA, 25 bp, Rattus norvegicus
gtttcacagtccttctttaagtctc

SEQ ID NO: 531944 - DNA, 25 bp, Rattus norvegicus
gtttcacagtgcaatctttgtccca

SEQ ID NO: 531945 - DNA, 25 bp, Rattus norvegicus
gtttcacagtgctatctttgtccca

SEQ ID NO: 531946 - DNA, 25 bp, Rattus norvegicus
gtttcacatcttcttacacagctta

SEQ ID NO: 531947 - DNA, 25 bp, Rattus norvegicus
gtttcacatcttgttacacagctta

SEQ ID NO: 531948 - DNA, 25 bp, Rattus norvegicus
gtttcacattctacctttgttgtaa

SEQ ID NO: 531949 - DNA, 25 bp, Rattus norvegicus
gtttcacattctctggacaccgaag

SEQ ID NO: 531950 - DNA, 25 bp, Rattus norvegicus
gtttcacattctgtggacaccgaag

SEQ ID NO: 531951 - DNA, 25 bp, Rattus norvegicus
gtttcacattcttcctttgttgtaa

SEQ ID NO: 531952 - DNA, 25 bp, Rattus norvegicus
gtttcacatttcatgagcagcctag

SEQ ID NO: 531953 - DNA, 25 bp, Rattus norvegicus
gtttcacatttcttgagcagcctag

SEQ ID NO: 531954 - DNA, 25 bp, Rattus norvegicus
gtttcaccatctctaatatcactca

SEQ ID NO: 531955 - DNA, 25 bp, Rattus norvegicus
gtttcaccatctgtaatatcactca

SEQ ID NO: 531956 - DNA, 25 bp, Rattus norvegicus
gtttcacccagcacggaaagtcaga

SEQ ID NO: 531957 - DNA, 25 bp, Rattus norvegicus
gtttcacccagctcggaaagtcaga

SEQ ID NO: 531958 - DNA, 25 bp, Rattus norvegicus
gtttcaccccaaaaggcatcgttga

SEQ ID NO: 531959 - DNA, 25 bp, Rattus norvegicus
gtttcaccccaataggcatcgttga

SEQ ID NO: 531960 - DNA, 25 bp, Rattus norvegicus
gtttcaccgataaccagtctggagt

SEQ ID NO: 531961 - DNA, 25 bp, Rattus norvegicus
gtttcaccgatatccagtctggagt

SEQ ID NO: 531962 - DNA, 25 bp, Rattus norvegicus
gtttcaccgggaagaaccactaggc

SEQ ID NO: 531963 - DNA, 25 bp, Rattus norvegicus
gtttcaccgggatgaaccactaggc

SEQ ID NO: 531964 - DNA, 25 bp, Rattus norvegicus
gtttcacctaataaacatacccaat

SEQ ID NO: 531965 - DNA, 25 bp, Rattus norvegicus
gtttcacctaattaacatacccaat

SEQ ID NO: 531966 - DNA, 25 bp, Rattus norvegicus
gtttcacctcgaaaggctgcagtgt

SEQ ID NO: 531967 - DNA, 25 bp, Rattus norvegicus
gtttcacctcgataggctgcagtgt

SEQ ID NO: 531968 - DNA, 25 bp, Rattus norvegicus
gtttcaccttccaaacttcatgtat

SEQ ID NO: 531969 - DNA, 25 bp, Rattus norvegicus
gtttcaccttcctaacttcatgtat

SEQ ID NO: 531970 - DNA, 25 bp, Rattus norvegicus
gtttcaccttgtaaactctgggaag

SEQ ID NO: 531971 - DNA, 25 bp, Rattus norvegicus
gtttcaccttgttaactctgggaag

SEQ ID NO: 531972 - DNA, 25 bp, Rattus norvegicus
gtttcacgatccagttgcaaatcat

SEQ ID NO: 531973 - DNA, 25 bp, Rattus norvegicus
gtttcacgatcctgttgcaaatcat

SEQ ID NO: 531974 - DNA, 25 bp, Rattus norvegicus
gtttcacgccgtcacatatacaatg

SEQ ID NO: 531975 - DNA, 25 bp, Rattus norvegicus
gtttcacgccgtgacatatacaatg

SEQ ID NO: 531976 - DNA, 25 bp, Rattus norvegicus
gtttcacgtcagaagtagccatggc

SEQ ID NO: 531977 - DNA, 25 bp, Rattus norvegicus
gtttcacgtcagtagtagccatggc

SEQ ID NO: 531978 - DNA, 25 bp, Rattus norvegicus
gtttcactacgaatccgcatattgt

SEQ ID NO: 531979 - DNA, 25 bp, Rattus norvegicus
gtttcactacgattccgcatattgt

SEQ ID NO: 531980 - DNA, 25 bp, Rattus norvegicus
gtttcactagtaagtcaccatggtt

SEQ ID NO: 531981 - DNA, 25 bp, Rattus norvegicus
gtttcactagtatgtcaccatggtt

SEQ ID NO: 531982 - DNA, 25 bp, Rattus norvegicus
gtttcactcattattatcctctttc

SEQ ID NO: 531983 - DNA, 25 bp, Rattus norvegicus
gtttcactcatttttatcctctttc

SEQ ID NO: 531984 - DNA, 25 bp, Rattus norvegicus
gtttcactcggaaactttgctggac

SEQ ID NO: 531985 - DNA, 25 bp, Rattus norvegicus
gtttcactcggatactttgctggac

SEQ ID NO: 531986 - DNA, 25 bp, Rattus norvegicus
gtttcactcttgaaatttttgtgca

SEQ ID NO: 531987 - DNA, 25 bp, Rattus norvegicus
gtttcactcttgtaatttttgtgca

SEQ ID NO: 531988 - DNA, 25 bp, Rattus norvegicus
gtttcactgcctaagaagctgtcat

SEQ ID NO: 531989 - DNA, 25 bp, Rattus norvegicus
gtttcactgccttagaagctgtcat

SEQ ID NO: 531990 - DNA, 25 bp, Rattus norvegicus
gtttcactgtaccttcggaatgctt

SEQ ID NO: 531991 - DNA, 25 bp, Rattus norvegicus
gtttcactgtacgttcggaatgctt

SEQ ID NO: 531992 - DNA, 25 bp, Rattus norvegicus
gtttcactgtctagggttgtcttaa

SEQ ID NO: 531993 - DNA, 25 bp, Rattus norvegicus
gtttcactgtcttgggttgtcttaa

SEQ ID NO: 531994 - DNA, 25 bp, Rattus norvegicus
gtttcactgtgtagctgctgggatg

SEQ ID NO: 531995 - DNA, 25 bp, Rattus norvegicus
gtttcactgtgttgctgctgggatg

SEQ ID NO: 531996 - DNA, 25 bp, Rattus norvegicus
gtttcacttacgataaatgttgctc

SEQ ID NO: 531997 - DNA, 25 bp, Rattus norvegicus
gtttcacttacgttaaatgttgctc

SEQ ID NO: 531998 - DNA, 25 bp, Rattus norvegicus
gtttcacttatgatttccctcaacc

SEQ ID NO: 531999 - DNA, 25 bp, Rattus norvegicus
gtttcacttatgttttccctcaacc

SEQ ID NO: 532000 - DNA, 25 bp, Rattus norvegicus
gtttcacttgtacattctcattggg

SEQ ID NO: 532001 - DNA, 25 bp, Rattus norvegicus
gtttcacttgtagattctcattggg

SEQ ID NO: 532002 - DNA, 25 bp, Rattus norvegicus
gtttcagaaacaaccgagagctcct

SEQ ID NO: 532003 - DNA, 25 bp, Rattus norvegicus
gtttcagaaacatccgagagctcct

SEQ ID NO: 532004 - DNA, 25 bp, Rattus norvegicus
gtttcagaacaacagtattttatga

SEQ ID NO: 532005 - DNA, 25 bp, Rattus norvegicus
gtttcagaacaagagtattttatga

SEQ ID NO: 532006 - DNA, 25 bp, Rattus norvegicus
gtttcagaacacattaggccatatt

SEQ ID NO: 532007 - DNA, 25 bp, Rattus norvegicus
gtttcagaacactttaggccatatt

SEQ ID NO: 532008 - DNA, 25 bp, Rattus norvegicus
gtttcagaatccacagaactgcttc

SEQ ID NO: 532009 - DNA, 25 bp, Rattus norvegicus
gtttcagaatcctcagaactgcttc

SEQ ID NO: 532010 - DNA, 25 bp, Rattus norvegicus
gtttcagactacataaagaccccat

SEQ ID NO: 532011 - DNA, 25 bp, Rattus norvegicus
gtttcagactacttaaagaccccat

SEQ ID NO: 532012 - DNA, 25 bp, Rattus norvegicus
gtttcagagagacccaccaagagtg

SEQ ID NO: 532013 - DNA, 25 bp, Rattus norvegicus
gtttcagagagagccaccaagagtg

SEQ ID NO: 532014 - DNA, 25 bp, Rattus norvegicus
gtttcagaggcacgtcaggagctta

SEQ ID NO: 532015 - DNA, 25 bp, Rattus norvegicus
gtttcagaggcaggtcaggagctta

SEQ ID NO: 532016 - DNA, 25 bp, Rattus norvegicus
gtttcagaggccaaggagcaccact

SEQ ID NO: 532017 - DNA, 25 bp, Rattus norvegicus
gtttcagaggcctaggagcaccact

SEQ ID NO: 532018 - DNA, 25 bp, Rattus norvegicus
gtttcagagggacacctacgacttc

SEQ ID NO: 532019 - DNA, 25 bp, Rattus norvegicus
gtttcagagggagacctacgacttc

SEQ ID NO: 532020 - DNA, 25 bp, Rattus norvegicus
gtttcagagtcacaattaggcactt

SEQ ID NO: 532021 - DNA, 25 bp, Rattus norvegicus
gtttcagagtcagaattaggcactt

SEQ ID NO: 532022 - DNA, 25 bp, Rattus norvegicus
gtttcagagtttcagtgggcgccca

SEQ ID NO: 532023 - DNA, 25 bp, Rattus norvegicus
gtttcagagtttgagtgggcgccca

SEQ ID NO: 532024 - DNA, 25 bp, Rattus norvegicus
gtttcagattcactcataggcacac

SEQ ID NO: 532025 - DNA, 25 bp, Rattus norvegicus
gtttcagattcagtcataggcacac

SEQ ID NO: 532026 - DNA, 25 bp, Rattus norvegicus
gtttcagattgaagtccatcatcca

SEQ ID NO: 532027 - DNA, 25 bp, Rattus norvegicus
gtttcagattgatgtccatcatcca

SEQ ID NO: 532028 - DNA, 25 bp, Rattus norvegicus
gtttcagcaaagctaccacactgga

SEQ ID NO: 532029 - DNA, 25 bp, Rattus norvegicus
gtttcagcaaaggtaccacactgga

SEQ ID NO: 532030 - DNA, 25 bp, Rattus norvegicus
gtttcagcacaaccgggtgcagcct

SEQ ID NO: 532031 - DNA, 25 bp, Rattus norvegicus
gtttcagcacaagcgggtgcagcct

SEQ ID NO: 532032 - DNA, 25 bp, Rattus norvegicus
gtttcagcagacacaagtcaccttt

SEQ ID NO: 532033 - DNA, 25 bp, Rattus norvegicus
gtttcagcagactcaagtcaccttt

SEQ ID NO: 532034 - DNA, 25 bp, Rattus norvegicus
gtttcagccagtattgaacctcgaa

SEQ ID NO: 532035 - DNA, 25 bp, Rattus norvegicus
gtttcagccagttttgaacctcgaa

SEQ ID NO: 532036 - DNA, 25 bp, Rattus norvegicus
gtttcagccccaagtagaaaaccta

SEQ ID NO: 532037 - DNA, 25 bp, Rattus norvegicus
gtttcagccccacaggtttggcaga

SEQ ID NO: 532038 - DNA, 25 bp, Rattus norvegicus
gtttcagccccagaggtttggcaga

SEQ ID NO: 532039 - DNA, 25 bp, Rattus norvegicus
gtttcagccccatgtagaaaaccta

SEQ ID NO: 532040 - DNA, 25 bp, Rattus norvegicus
gtttcagccctgaaaaagaaatgtt

SEQ ID NO: 532041 - DNA, 25 bp, Rattus norvegicus
gtttcagccctgtaaaagaaatgtt

SEQ ID NO: 532042 - DNA, 25 bp, Rattus norvegicus
gtttcagcctggaagtgagggctct

SEQ ID NO: 532043 - DNA, 25 bp, Rattus norvegicus
gtttcagcctggcttgcagagccca

SEQ ID NO: 532044 - DNA, 25 bp, Rattus norvegicus
gtttcagcctgggttgcagagccca

SEQ ID NO: 532045 - DNA, 25 bp, Rattus norvegicus
gtttcagcctggtagtgagggctct

SEQ ID NO: 532046 - DNA, 25 bp, Rattus norvegicus
gtttcagctatcactggatgattct

SEQ ID NO: 532047 - DNA, 25 bp, Rattus norvegicus
gtttcagctatctctggatgattct

SEQ ID NO: 532048 - DNA, 25 bp, Rattus norvegicus
gtttcagctgcaaagtgtactaccg

SEQ ID NO: 532049 - DNA, 25 bp, Rattus norvegicus
gtttcagctgcatagtgtactaccg

SEQ ID NO: 532050 - DNA, 25 bp, Rattus norvegicus
gtttcagctgctcgcaattaaccct

SEQ ID NO: 532051 - DNA, 25 bp, Rattus norvegicus
gtttcagctgctggcaattaaccct

SEQ ID NO: 532052 - DNA, 25 bp, Rattus norvegicus
gtttcaggcctacatgggctaacca

SEQ ID NO: 532053 - DNA, 25 bp, Rattus norvegicus
gtttcaggcctagatgggctaacca

SEQ ID NO: 532054 - DNA, 25 bp, Rattus norvegicus
gtttcaggcctgaacttagtctagg

SEQ ID NO: 532055 - DNA, 25 bp, Rattus norvegicus
gtttcaggcctgtacttagtctagg

SEQ ID NO: 532056 - DNA, 25 bp, Rattus norvegicus
gtttcaggcggcatggcacatgttg

SEQ ID NO: 532057 - DNA, 25 bp, Rattus norvegicus
gtttcaggcggcttggcacatgttg

SEQ ID NO: 532058 - DNA, 25 bp, Rattus norvegicus
gtttcaggcgtcaggaccaaggctc

SEQ ID NO: 532059 - DNA, 25 bp, Rattus norvegicus
gtttcaggcgtctggaccaaggctc

SEQ ID NO: 532060 - DNA, 25 bp, Rattus norvegicus
gtttcaggctgaccaaagtctaagt

SEQ ID NO: 532061 - DNA, 25 bp, Rattus norvegicus
gtttcaggctgagcaaagtctaagt

SEQ ID NO: 532062 - DNA, 25 bp, Rattus norvegicus
gtttcagggacaatcattctctagg

SEQ ID NO: 532063 - DNA, 25 bp, Rattus norvegicus
gtttcagggacattcattctctagg

SEQ ID NO: 532064 - DNA, 25 bp, Rattus norvegicus
gtttcagggccgaatgccttgcaat

SEQ ID NO: 532065 - DNA, 25 bp, Rattus norvegicus
gtttcagggccgtatgccttgcaat

SEQ ID NO: 532066 - DNA, 25 bp, Rattus norvegicus
gtttcaggtcagctgtagttgcaca

SEQ ID NO: 532067 - DNA, 25 bp, Rattus norvegicus
gtttcaggtcaggtgtagttgcaca

SEQ ID NO: 532068 - DNA, 25 bp, Rattus norvegicus
gtttcaggtccaagagcttcagcaa

SEQ ID NO: 532069 - DNA, 25 bp, Rattus norvegicus
gtttcaggtccatgagcttcagcaa

SEQ ID NO: 532070 - DNA, 25 bp, Rattus norvegicus
gtttcaggtttacagccactggaca

SEQ ID NO: 532071 - DNA, 25 bp, Rattus norvegicus
gtttcaggtttagagccactggaca

SEQ ID NO: 532072 - DNA, 25 bp, Rattus norvegicus
gtttcagtaccactctctagatgtg

SEQ ID NO: 532073 - DNA, 25 bp, Rattus norvegicus
gtttcagtaccagtctctagatgtg

SEQ ID NO: 532074 - DNA, 25 bp, Rattus norvegicus
gtttcagtcattccatatttgtgta

SEQ ID NO: 532075 - DNA, 25 bp, Rattus norvegicus
gtttcagtcattgcatatttgtgta

SEQ ID NO: 532076 - DNA, 25 bp, Rattus norvegicus
gtttcagtcccacaaatttaccctg

SEQ ID NO: 532077 - DNA, 25 bp, Rattus norvegicus
gtttcagtcccagaaatttaccctg

SEQ ID NO: 532078 - DNA, 25 bp, Rattus norvegicus
gtttcagtctcacttttgttggtac

SEQ ID NO: 532079 - DNA, 25 bp, Rattus norvegicus
gtttcagtctcagttttgttggtac

SEQ ID NO: 532080 - DNA, 25 bp, Rattus norvegicus
gtttcagtctggagacttgtggcca

SEQ ID NO: 532081 - DNA, 25 bp, Rattus norvegicus
gtttcagtctggtgacttgtggcca

SEQ ID NO: 532082 - DNA, 25 bp, Rattus norvegicus
gtttcagtgaaaccattctagcaga

SEQ ID NO: 532083 - DNA, 25 bp, Rattus norvegicus
gtttcagtgaaagcattctagcaga

SEQ ID NO: 532084 - DNA, 25 bp, Rattus norvegicus
gtttcagtgactactgtttgctaca

SEQ ID NO: 532085 - DNA, 25 bp, Rattus norvegicus
gtttcagtgacttctgtttgctaca

SEQ ID NO: 532086 - DNA, 25 bp, Rattus norvegicus
gtttcagtgatgaccacaaccttct

SEQ ID NO: 532087 - DNA, 25 bp, Rattus norvegicus
gtttcagtgatgtccacaaccttct

SEQ ID NO: 532088 - DNA, 25 bp, Rattus norvegicus
gtttcagtgattacagtgacggccg

SEQ ID NO: 532089 - DNA, 25 bp, Rattus norvegicus
gtttcagtgatttcagtgacggccg

SEQ ID NO: 532090 - DNA, 25 bp, Rattus norvegicus
gtttcagtgcagctaggactgttac

SEQ ID NO: 532091 - DNA, 25 bp, Rattus norvegicus
gtttcagtgcaggtaggactgttac

SEQ ID NO: 532092 - DNA, 25 bp, Rattus norvegicus
gtttcagtgctgagaagggaccata

SEQ ID NO: 532093 - DNA, 25 bp, Rattus norvegicus
gtttcagtgctgagagcctggacag

SEQ ID NO: 532094 - DNA, 25 bp, Rattus norvegicus
gtttcagtgctgtgaagggaccata

SEQ ID NO: 532095 - DNA, 25 bp, Rattus norvegicus
gtttcagtgctgtgagcctggacag

SEQ ID NO: 532096 - DNA, 25 bp, Rattus norvegicus
gtttcagtgtcaaagatggccccag

SEQ ID NO: 532097 - DNA, 25 bp, Rattus norvegicus
gtttcagtgtcatagatggccccag

SEQ ID NO: 532098 - DNA, 25 bp, Rattus norvegicus
gtttcagtgttcacacctctagaaa

SEQ ID NO: 532099 - DNA, 25 bp, Rattus norvegicus
gtttcagtgttctcacctctagaaa

SEQ ID NO: 532100 - DNA, 25 bp, Rattus norvegicus
gtttcagtgtttccagctcataaaa

SEQ ID NO: 532101 - DNA, 25 bp, Rattus norvegicus
gtttcagtgtttgcagctcataaaa

SEQ ID NO: 532102 - DNA, 25 bp, Rattus norvegicus
gtttcagttgtgcttctaatctaga

SEQ ID NO: 532103 - DNA, 25 bp, Rattus norvegicus
gtttcagttgtggttctaatctaga

SEQ ID NO: 532104 - DNA, 25 bp, Rattus norvegicus
gtttcagtttgcagtcttaggtccc

SEQ ID NO: 532105 - DNA, 25 bp, Rattus norvegicus
gtttcagtttgctgtcttaggtccc

SEQ ID NO: 532106 - DNA, 25 bp, Rattus norvegicus
gtttcagttttaaacttcacagaag

SEQ ID NO: 532107 - DNA, 25 bp, Rattus norvegicus
gtttcagttttatacttcacagaag

SEQ ID NO: 532108 - DNA, 25 bp, Rattus norvegicus
gtttcagttttcataaggacagcga

SEQ ID NO: 532109 - DNA, 25 bp, Rattus norvegicus
gtttcagttttcttaaggacagcga

SEQ ID NO: 532110 - DNA, 25 bp, Rattus norvegicus
gtttcagttttgactttacagccag

SEQ ID NO: 532111 - DNA, 25 bp, Rattus norvegicus
gtttcagttttgtctttacagccag

SEQ ID NO: 532112 - DNA, 25 bp, Rattus norvegicus
gtttcataactgaaggaagttccta

SEQ ID NO: 532113 - DNA, 25 bp, Rattus norvegicus
gtttcataactgtaggaagttccta

SEQ ID NO: 532114 - DNA, 25 bp, Rattus norvegicus
gtttcataatatctttgccacgatg

SEQ ID NO: 532115 - DNA, 25 bp, Rattus norvegicus
gtttcataatatgtttgccacgatg

SEQ ID NO: 532116 - DNA, 25 bp, Rattus norvegicus
gtttcataccaacttcctgaattta

SEQ ID NO: 532117 - DNA, 25 bp, Rattus norvegicus
gtttcataccaagttcctgaattta

SEQ ID NO: 532118 - DNA, 25 bp, Rattus norvegicus
gtttcatactgactcactggttaca

SEQ ID NO: 532119 - DNA, 25 bp, Rattus norvegicus
gtttcatactgagtcactggttaca

SEQ ID NO: 532120 - DNA, 25 bp, Rattus norvegicus
gtttcatagctgctcgtgctgctgg

SEQ ID NO: 532121 - DNA, 25 bp, Rattus norvegicus
gtttcatagctggtcgtgctgctgg

SEQ ID NO: 532122 - DNA, 25 bp, Rattus norvegicus
gtttcatagtaaactttcctgtcca

SEQ ID NO: 532123 - DNA, 25 bp, Rattus norvegicus
gtttcatagtaatctttcctgtcca

SEQ ID NO: 532124 - DNA, 25 bp, Rattus norvegicus
gtttcatatactaccgatgctcttc

SEQ ID NO: 532125 - DNA, 25 bp, Rattus norvegicus
gtttcatatacttccgatgctcttc

SEQ ID NO: 532126 - DNA, 25 bp, Rattus norvegicus
gtttcatatcctcgctgagttctca

SEQ ID NO: 532127 - DNA, 25 bp, Rattus norvegicus
gtttcatatcctggctgagttctca

SEQ ID NO: 532128 - DNA, 25 bp, Rattus norvegicus
gtttcatattggagcgaggctgccc

SEQ ID NO: 532129 - DNA, 25 bp, Rattus norvegicus
gtttcatattggtgcgaggctgccc

SEQ ID NO: 532130 - DNA, 25 bp, Rattus norvegicus
gtttcatatttaccaatatccaagg

SEQ ID NO: 532131 - DNA, 25 bp, Rattus norvegicus
gtttcatatttagcaatatccaagg

SEQ ID NO: 532132 - DNA, 25 bp, Rattus norvegicus
gtttcatcaagtaaattctggtttt

SEQ ID NO: 532133 - DNA, 25 bp, Rattus norvegicus
gtttcatcaagttaattctggtttt

SEQ ID NO: 532134 - DNA, 25 bp, Rattus norvegicus
gtttcatcacggcataatgtcccta

SEQ ID NO: 532135 - DNA, 25 bp, Rattus norvegicus
gtttcatcacgggataatgtcccta

SEQ ID NO: 532136 - DNA, 25 bp, Rattus norvegicus
gtttcatcatagctcttcagttgtg

SEQ ID NO: 532137 - DNA, 25 bp, Rattus norvegicus
gtttcatcataggtcttcagttgtg

SEQ ID NO: 532138 - DNA, 25 bp, Rattus norvegicus
gtttcatccattcacagcatatatt

SEQ ID NO: 532139 - DNA, 25 bp, Rattus norvegicus
gtttcatccattgacagcatatatt

SEQ ID NO: 532140 - DNA, 25 bp, Rattus norvegicus
gtttcatccctacctctgcataagt

SEQ ID NO: 532141 - DNA, 25 bp, Rattus norvegicus
gtttcatccctagctctgcataagt

SEQ ID NO: 532142 - DNA, 25 bp, Rattus norvegicus
gtttcatcccttcaaacacagactg

SEQ ID NO: 532143 - DNA, 25 bp, Rattus norvegicus
gtttcatcccttgaaacacagactg

SEQ ID NO: 532144 - DNA, 25 bp, Rattus norvegicus
gtttcatcctcacctctgacaatta

SEQ ID NO: 532145 - DNA, 25 bp, Rattus norvegicus
gtttcatcctcagctctgacaatta

SEQ ID NO: 532146 - DNA, 25 bp, Rattus norvegicus
gtttcatcctctccatattaccatt

SEQ ID NO: 532147 - DNA, 25 bp, Rattus norvegicus
gtttcatcctctgcatattaccatt

SEQ ID NO: 532148 - DNA, 25 bp, Rattus norvegicus
gtttcatcctggatcatagtgttta

SEQ ID NO: 532149 - DNA, 25 bp, Rattus norvegicus
gtttcatcctggttcatagtgttta

SEQ ID NO: 532150 - DNA, 25 bp, Rattus norvegicus
gtttcatcgacaccatggccaagag

SEQ ID NO: 532151 - DNA, 25 bp, Rattus norvegicus
gtttcatcgacagcatggccaagag

SEQ ID NO: 532152 - DNA, 25 bp, Rattus norvegicus
gtttcatcgctgaggaattcttgac

SEQ ID NO: 532153 - DNA, 25 bp, Rattus norvegicus
gtttcatcgctgtggaattcttgac

SEQ ID NO: 532154 - DNA, 25 bp, Rattus norvegicus
gtttcatctgtcctcacctgagtga

SEQ ID NO: 532155 - DNA, 25 bp, Rattus norvegicus
gtttcatctgtcgtcacctgagtga

SEQ ID NO: 532156 - DNA, 25 bp, Rattus norvegicus
gtttcatcttcacctaccagtatga

SEQ ID NO: 532157 - DNA, 25 bp, Rattus norvegicus
gtttcatcttcagctaccagtatga

SEQ ID NO: 532158 - DNA, 25 bp, Rattus norvegicus
gtttcatcttggcttatgggatttt

SEQ ID NO: 532159 - DNA, 25 bp, Rattus norvegicus
gtttcatcttgggttatgggatttt

SEQ ID NO: 532160 - DNA, 25 bp, Rattus norvegicus
gtttcatgcgacagcttcactggat

SEQ ID NO: 532161 - DNA, 25 bp, Rattus norvegicus
gtttcatgcgactgcttcactggat

SEQ ID NO: 532162 - DNA, 25 bp, Rattus norvegicus
gtttcatgctagatgtcctatgtat

SEQ ID NO: 532163 - DNA, 25 bp, Rattus norvegicus
gtttcatgctagttgtcctatgtat

SEQ ID NO: 532164 - DNA, 25 bp, Rattus norvegicus
gtttcatggacacatctgctctcat

SEQ ID NO: 532165 - DNA, 25 bp, Rattus norvegicus
gtttcatggacagatctgctctcat

SEQ ID NO: 532166 - DNA, 25 bp, Rattus norvegicus
gtttcatggactagtttcttgctac

SEQ ID NO: 532167 - DNA, 25 bp, Rattus norvegicus
gtttcatggacttgtttcttgctac

SEQ ID NO: 532168 - DNA, 25 bp, Rattus norvegicus
gtttcatggccacctagggctcagg

SEQ ID NO: 532169 - DNA, 25 bp, Rattus norvegicus
gtttcatggccagctagggctcagg

SEQ ID NO: 532170 - DNA, 25 bp, Rattus norvegicus
gtttcatggctcaaatgtcaccttc

SEQ ID NO: 532171 - DNA, 25 bp, Rattus norvegicus
gtttcatggctctaatgtcaccttc

SEQ ID NO: 532172 - DNA, 25 bp, Rattus norvegicus
gtttcatgtggcacagggtgaccat

SEQ ID NO: 532173 - DNA, 25 bp, Rattus norvegicus
gtttcatgtggctcagggtgaccat

SEQ ID NO: 532174 - DNA, 25 bp, Rattus norvegicus
gtttcatgtggtaggttctttctca

SEQ ID NO: 532175 - DNA, 25 bp, Rattus norvegicus
gtttcatgtggttggttctttctca

SEQ ID NO: 532176 - DNA, 25 bp, Rattus norvegicus
gtttcattagcaccaccattcttca

SEQ ID NO: 532177 - DNA, 25 bp, Rattus norvegicus
gtttcattagcagcaccattcttca

SEQ ID NO: 532178 - DNA, 25 bp, Rattus norvegicus
gtttcattagcccactgaagcctca

SEQ ID NO: 532179 - DNA, 25 bp, Rattus norvegicus
gtttcattagccgactgaagcctca

SEQ ID NO: 532180 - DNA, 25 bp, Rattus norvegicus
gtttcattatgtacgctaccatccg

SEQ ID NO: 532181 - DNA, 25 bp, Rattus norvegicus
gtttcattatgttcgctaccatccg

SEQ ID NO: 532182 - DNA, 25 bp, Rattus norvegicus
gtttcattcaacaccatcagatatt

SEQ ID NO: 532183 - DNA, 25 bp, Rattus norvegicus
gtttcattcaactccatcagatatt

SEQ ID NO: 532184 - DNA, 25 bp, Rattus norvegicus
gtttcattcaccagaagcgtacaaa

SEQ ID NO: 532185 - DNA, 25 bp, Rattus norvegicus
gtttcattcacctgaagcgtacaaa

SEQ ID NO: 532186 - DNA, 25 bp, Rattus norvegicus
gtttcattcagtcccgttaggttgt

SEQ ID NO: 532187 - DNA, 25 bp, Rattus norvegicus
gtttcattcagtgccgttaggttgt

SEQ ID NO: 532188 - DNA, 25 bp, Rattus norvegicus
gtttcattccagatggccctgtggc

SEQ ID NO: 532189 - DNA, 25 bp, Rattus norvegicus
gtttcattccagttggccctgtggc

SEQ ID NO: 532190 - DNA, 25 bp, Rattus norvegicus
gtttcattgactcctcttagacaca

SEQ ID NO: 532191 - DNA, 25 bp, Rattus norvegicus
gtttcattgactgctcttagacaca

SEQ ID NO: 532192 - DNA, 25 bp, Rattus norvegicus
gtttcattgtttatcgcctgcttca

SEQ ID NO: 532193 - DNA, 25 bp, Rattus norvegicus
gtttcattgtttttcgcctgcttca

SEQ ID NO: 532194 - DNA, 25 bp, Rattus norvegicus
gtttcatttataccagagatccctg

SEQ ID NO: 532195 - DNA, 25 bp, Rattus norvegicus
gtttcatttatagcagagatccctg

SEQ ID NO: 532196 - DNA, 25 bp, Rattus norvegicus
gtttcatttcaccactgaacctcaa

SEQ ID NO: 532197 - DNA, 25 bp, Rattus norvegicus
gtttcatttcacgactgaacctcaa

SEQ ID NO: 532198 - DNA, 25 bp, Rattus norvegicus
gtttcatttcctcaaggtgttcggt

SEQ ID NO: 532199 - DNA, 25 bp, Rattus norvegicus
gtttcatttcctccttgtggtatga

SEQ ID NO: 532200 - DNA, 25 bp, Rattus norvegicus
gtttcatttcctgaaggtgttcggt

SEQ ID NO: 532201 - DNA, 25 bp, Rattus norvegicus
gtttcatttcctgcttgtggtatga

SEQ ID NO: 532202 - DNA, 25 bp, Rattus norvegicus
gtttcatttgaccacgtatcacctt

SEQ ID NO: 532203 - DNA, 25 bp, Rattus norvegicus
gtttcatttgacgacgtatcacctt

SEQ ID NO: 532204 - DNA, 25 bp, Rattus norvegicus
gtttcatttgtaatggaatttctct

SEQ ID NO: 532205 - DNA, 25 bp, Rattus norvegicus
gtttcatttgtattggaatttctct

SEQ ID NO: 532206 - DNA, 25 bp, Rattus norvegicus
gtttcattttataattgactcagca

SEQ ID NO: 532207 - DNA, 25 bp, Rattus norvegicus
gtttcattttattattgactcagca

SEQ ID NO: 532208 - DNA, 25 bp, Rattus norvegicus
gtttcattttgtcaacagctcgatt

SEQ ID NO: 532209 - DNA, 25 bp, Rattus norvegicus
gtttcattttgtgaacagctcgatt

SEQ ID NO: 532210 - DNA, 25 bp, Rattus norvegicus
gtttcatttttacacatctctataa

SEQ ID NO: 532211 - DNA, 25 bp, Rattus norvegicus
gtttcatttttagacatctctataa

SEQ ID NO: 532212 - DNA, 25 bp, Rattus norvegicus
gtttccaaaactctattctcagctg

SEQ ID NO: 532213 - DNA, 25 bp, Rattus norvegicus
gtttccaaaactgtattctcagctg

SEQ ID NO: 532214 - DNA, 25 bp, Rattus norvegicus
gtttccaaaagcactggtgttgacc

SEQ ID NO: 532215 - DNA, 25 bp, Rattus norvegicus
gtttccaaaagctctggtgttgacc

SEQ ID NO: 532216 - DNA, 25 bp, Rattus norvegicus
gtttccaaaaggacttgattcaatc

SEQ ID NO: 532217 - DNA, 25 bp, Rattus norvegicus
gtttccaaaaggtcttgattcaatc

SEQ ID NO: 532218 - DNA, 25 bp, Rattus norvegicus
gtttccaaaagtctcattcttaatc

SEQ ID NO: 532219 - DNA, 25 bp, Rattus norvegicus
gtttccaaaagtgtcattcttaatc

SEQ ID NO: 532220 - DNA, 25 bp, Rattus norvegicus
gtttccaaactcaagcatctgtgat

SEQ ID NO: 532221 - DNA, 25 bp, Rattus norvegicus
gtttccaaactctagcatctgtgat

SEQ ID NO: 532222 - DNA, 25 bp, Rattus norvegicus
gtttccaaagataccctgggctatc

SEQ ID NO: 532223 - DNA, 25 bp, Rattus norvegicus
gtttccaaagattccctgggctatc

SEQ ID NO: 532224 - DNA, 25 bp, Rattus norvegicus
gtttccaaatataacctgcttctca

SEQ ID NO: 532225 - DNA, 25 bp, Rattus norvegicus
gtttccaaatattacctgcttctca

SEQ ID NO: 532226 - DNA, 25 bp, Rattus norvegicus
gtttccaaatctactttcctatcaa

SEQ ID NO: 532227 - DNA, 25 bp, Rattus norvegicus
gtttccaaatcttctttcctatcaa

SEQ ID NO: 532228 - DNA, 25 bp, Rattus norvegicus
gtttccaaccccatgacttatggga

SEQ ID NO: 532229 - DNA, 25 bp, Rattus norvegicus
gtttccaaccccttgacttatggga

SEQ ID NO: 532230 - DNA, 25 bp, Rattus norvegicus
gtttccaacctgctgatcgatgaca

SEQ ID NO: 532231 - DNA, 25 bp, Rattus norvegicus
gtttccaacctggtgatcgatgaca

SEQ ID NO: 532232 - DNA, 25 bp, Rattus norvegicus
gtttccaactacagccagagctttc

SEQ ID NO: 532233 - DNA, 25 bp, Rattus norvegicus
gtttccaactactgccagagctttc

SEQ ID NO: 532234 - DNA, 25 bp, Rattus norvegicus
gtttccaagaaaccttcactccttg

SEQ ID NO: 532235 - DNA, 25 bp, Rattus norvegicus
gtttccaagaaagcttcactccttg

SEQ ID NO: 532236 - DNA, 25 bp, Rattus norvegicus
gtttccaagacaacttagactttct

SEQ ID NO: 532237 - DNA, 25 bp, Rattus norvegicus
gtttccaagacatcttagactttct

SEQ ID NO: 532238 - DNA, 25 bp, Rattus norvegicus
gtttccaaggacattaccagcctga

SEQ ID NO: 532239 - DNA, 25 bp, Rattus norvegicus
gtttccaaggactttaccagcctga

SEQ ID NO: 532240 - DNA, 25 bp, Rattus norvegicus
gtttccaaggtcagtctcaaggctt

SEQ ID NO: 532241 - DNA, 25 bp, Rattus norvegicus
gtttccaaggtctgtctcaaggctt

SEQ ID NO: 532242 - DNA, 25 bp, Rattus norvegicus
gtttccaagtcactgatttctgctg

SEQ ID NO: 532243 - DNA, 25 bp, Rattus norvegicus
gtttccaagtcagtgatttctgctg

SEQ ID NO: 532244 - DNA, 25 bp, Rattus norvegicus
gtttccaagttgattcctgaggccc

SEQ ID NO: 532245 - DNA, 25 bp, Rattus norvegicus
gtttccaagttgtttcctgaggccc

SEQ ID NO: 532246 - DNA, 25 bp, Rattus norvegicus
gtttccacacacacgtaaagattga

SEQ ID NO: 532247 - DNA, 25 bp, Rattus norvegicus
gtttccacacactcgtaaagattga

SEQ ID NO: 532248 - DNA, 25 bp, Rattus norvegicus
gtttccacacagatgagtatgttac

SEQ ID NO: 532249 - DNA, 25 bp, Rattus norvegicus
gtttccacacagttgagtatgttac

SEQ ID NO: 532250 - DNA, 25 bp, Rattus norvegicus
gtttccacagggacctgctaaggat

SEQ ID NO: 532251 - DNA, 25 bp, Rattus norvegicus
gtttccacagggtcctgctaaggat

SEQ ID NO: 532252 - DNA, 25 bp, Rattus norvegicus
gtttccacatttctacaaatgggaa

SEQ ID NO: 532253 - DNA, 25 bp, Rattus norvegicus
gtttccacatttgtacaaatgggaa

SEQ ID NO: 532254 - DNA, 25 bp, Rattus norvegicus
gtttccacccagatgagttgacaca

SEQ ID NO: 532255 - DNA, 25 bp, Rattus norvegicus
gtttccacccagttgagttgacaca

SEQ ID NO: 532256 - DNA, 25 bp, Rattus norvegicus
gtttccacccatctgttttgagtat

SEQ ID NO: 532257 - DNA, 25 bp, Rattus norvegicus
gtttccacccatgtgttttgagtat

SEQ ID NO: 532258 - DNA, 25 bp, Rattus norvegicus
gtttccacctaacatttgttactat

SEQ ID NO: 532259 - DNA, 25 bp, Rattus norvegicus
gtttccacctaagatttgttactat

SEQ ID NO: 532260 - DNA, 25 bp, Rattus norvegicus
gtttccactaacacctggacagttt

SEQ ID NO: 532261 - DNA, 25 bp, Rattus norvegicus
gtttccactaactcctggacagttt

SEQ ID NO: 532262 - DNA, 25 bp, Rattus norvegicus
gtttccactgacagtataggctcct

SEQ ID NO: 532263 - DNA, 25 bp, Rattus norvegicus
gtttccactgactgtataggctcct

SEQ ID NO: 532264 - DNA, 25 bp, Rattus norvegicus
gtttccactgcaatccgtcattgaa

SEQ ID NO: 532265 - DNA, 25 bp, Rattus norvegicus
gtttccactgcactttagtcagagg

SEQ ID NO: 532266 - DNA, 25 bp, Rattus norvegicus
gtttccactgcagtttagtcagagg

SEQ ID NO: 532267 - DNA, 25 bp, Rattus norvegicus
gtttccactgcattccgtcattgaa

SEQ ID NO: 532268 - DNA, 25 bp, Rattus norvegicus
gtttccactgtgctcaatacgctgg

SEQ ID NO: 532269 - DNA, 25 bp, Rattus norvegicus
gtttccactgtggtcaatacgctgg

SEQ ID NO: 532270 - DNA, 25 bp, Rattus norvegicus
gtttccacttggatgtgagcaggca

SEQ ID NO: 532271 - DNA, 25 bp, Rattus norvegicus
gtttccacttggttgtgagcaggca

SEQ ID NO: 532272 - DNA, 25 bp, Rattus norvegicus
gtttccagaaaccacagccaagacc

SEQ ID NO: 532273 - DNA, 25 bp, Rattus norvegicus
gtttccagaaacgacagccaagacc

SEQ ID NO: 532274 - DNA, 25 bp, Rattus norvegicus
gtttccagacacagtgctactgaca

SEQ ID NO: 532275 - DNA, 25 bp, Rattus norvegicus
gtttccagacactgtgctactgaca

SEQ ID NO: 532276 - DNA, 25 bp, Rattus norvegicus
gtttccagagcaccaacagggcagt

SEQ ID NO: 532277 - DNA, 25 bp, Rattus norvegicus
gtttccagagcagcaacagggcagt

SEQ ID NO: 532278 - DNA, 25 bp, Rattus norvegicus
gtttccagagctcggcagaacccat

SEQ ID NO: 532279 - DNA, 25 bp, Rattus norvegicus
gtttccagagctgggcagaacccat

SEQ ID NO: 532280 - DNA, 25 bp, Rattus norvegicus
gtttccagaggtacctttaccatgg

SEQ ID NO: 532281 - DNA, 25 bp, Rattus norvegicus
gtttccagaggttcctttaccatgg

SEQ ID NO: 532282 - DNA, 25 bp, Rattus norvegicus
gtttccagcaagatatcgagttcag

SEQ ID NO: 532283 - DNA, 25 bp, Rattus norvegicus
gtttccagcaagttatcgagttcag

SEQ ID NO: 532284 - DNA, 25 bp, Rattus norvegicus
gtttccagcaataagcaccaaccgt

SEQ ID NO: 532285 - DNA, 25 bp, Rattus norvegicus
gtttccagcaattagcaccaaccgt

SEQ ID NO: 532286 - DNA, 25 bp, Rattus norvegicus
gtttccagcagcatcagtctgtgtc

SEQ ID NO: 532287 - DNA, 25 bp, Rattus norvegicus
gtttccagcagcttcagtctgtgtc

SEQ ID NO: 532288 - DNA, 25 bp, Rattus norvegicus
gtttccagctcccagaagttgggtt

SEQ ID NO: 532289 - DNA, 25 bp, Rattus norvegicus
gtttccagctccgagaagttgggtt

SEQ ID NO: 532290 - DNA, 25 bp, Rattus norvegicus
gtttccagctctcaagtggctaaaa

SEQ ID NO: 532291 - DNA, 25 bp, Rattus norvegicus
gtttccagctctgaagtggctaaaa

SEQ ID NO: 532292 - DNA, 25 bp, Rattus norvegicus
gtttccagctgtatttatatgattg

SEQ ID NO: 532293 - DNA, 25 bp, Rattus norvegicus
gtttccagctgtttttatatgattg

SEQ ID NO: 532294 - DNA, 25 bp, Rattus norvegicus
gtttccaggcagagatgaagctccc

SEQ ID NO: 532295 - DNA, 25 bp, Rattus norvegicus
gtttccaggcagtgatgaagctccc

SEQ ID NO: 532296 - DNA, 25 bp, Rattus norvegicus
gtttccaggctccagggattcaaaa

SEQ ID NO: 532297 - DNA, 25 bp, Rattus norvegicus
gtttccaggctcgagggattcaaaa

SEQ ID NO: 532298 - DNA, 25 bp, Rattus norvegicus
gtttccagggacaaagtggcatcct

SEQ ID NO: 532299 - DNA, 25 bp, Rattus norvegicus
gtttccagggactaagtggcatcct

SEQ ID NO: 532300 - DNA, 25 bp, Rattus norvegicus
gtttccagggccatgtttacagtaa

SEQ ID NO: 532301 - DNA, 25 bp, Rattus norvegicus
gtttccagggccttgtttacagtaa

SEQ ID NO: 532302 - DNA, 25 bp, Rattus norvegicus
gtttccaggtcaccatctagtgagt

SEQ ID NO: 532303 - DNA, 25 bp, Rattus norvegicus
gtttccaggtcagcatctagtgagt

SEQ ID NO: 532304 - DNA, 25 bp, Rattus norvegicus
gtttccaggtctatgaccagaccca

SEQ ID NO: 532305 - DNA, 25 bp, Rattus norvegicus
gtttccaggtctctttctaggtgca

SEQ ID NO: 532306 - DNA, 25 bp, Rattus norvegicus
gtttccaggtctgtttctaggtgca

SEQ ID NO: 532307 - DNA, 25 bp, Rattus norvegicus
gtttccaggtctttgaccagaccca

SEQ ID NO: 532308 - DNA, 25 bp, Rattus norvegicus
gtttccagtagccaatttttcacct

SEQ ID NO: 532309 - DNA, 25 bp, Rattus norvegicus
gtttccagtagcgaatttttcacct

SEQ ID NO: 532310 - DNA, 25 bp, Rattus norvegicus
gtttccagtattagtctgacgcgca

SEQ ID NO: 532311 - DNA, 25 bp, Rattus norvegicus
gtttccagtatttgtctgacgcgca

SEQ ID NO: 532312 - DNA, 25 bp, Rattus norvegicus
gtttccagtgcacagagcgacctaa

SEQ ID NO: 532313 - DNA, 25 bp, Rattus norvegicus
gtttccagtgcagagagcgacctaa

SEQ ID NO: 532314 - DNA, 25 bp, Rattus norvegicus
gtttccagttagaacacacacatat

SEQ ID NO: 532315 - DNA, 25 bp, Rattus norvegicus
gtttccagttagtacacacacatat

SEQ ID NO: 532316 - DNA, 25 bp, Rattus norvegicus
gtttccagttcaaccgacaaaagtg

SEQ ID NO: 532317 - DNA, 25 bp, Rattus norvegicus
gtttccagttcatccgacaaaagtg

SEQ ID NO: 532318 - DNA, 25 bp, Rattus norvegicus
gtttccagttgaccacaccattttg

SEQ ID NO: 532319 - DNA, 25 bp, Rattus norvegicus
gtttccagttgagcacaccattttg

SEQ ID NO: 532320 - DNA, 25 bp, Rattus norvegicus
gtttccataaccattctgaccagag

SEQ ID NO: 532321 - DNA, 25 bp, Rattus norvegicus
gtttccataacctttctgaccagag

SEQ ID NO: 532322 - DNA, 25 bp, Rattus norvegicus
gtttccatagagatgggcgccctgt

SEQ ID NO: 532323 - DNA, 25 bp, Rattus norvegicus
gtttccatagagttgggcgccctgt

SEQ ID NO: 532324 - DNA, 25 bp, Rattus norvegicus
gtttccatatgaactgttgtctgct

SEQ ID NO: 532325 - DNA, 25 bp, Rattus norvegicus
gtttccatatgatctgttgtctgct

SEQ ID NO: 532326 - DNA, 25 bp, Rattus norvegicus
gtttccatatgtcgagtttactgga

SEQ ID NO: 532327 - DNA, 25 bp, Rattus norvegicus
gtttccatatgtggagtttactgga

SEQ ID NO: 532328 - DNA, 25 bp, Rattus norvegicus
gtttccatattgaggttgctgccta

SEQ ID NO: 532329 - DNA, 25 bp, Rattus norvegicus
gtttccatattgtggttgctgccta

SEQ ID NO: 532330 - DNA, 25 bp, Rattus norvegicus
gtttccatcaagaccaagattggcc

SEQ ID NO: 532331 - DNA, 25 bp, Rattus norvegicus
gtttccatcaagtccaagattggcc

SEQ ID NO: 532332 - DNA, 25 bp, Rattus norvegicus
gtttccatcacactggtcccatgat

SEQ ID NO: 532333 - DNA, 25 bp, Rattus norvegicus
gtttccatcacagtggtcccatgat

SEQ ID NO: 532334 - DNA, 25 bp, Rattus norvegicus
gtttccatcaccaaatggcaggatt

SEQ ID NO: 532335 - DNA, 25 bp, Rattus norvegicus
gtttccatcacctaatggcaggatt

SEQ ID NO: 532336 - DNA, 25 bp, Rattus norvegicus
gtttccatcatgcaagccactctgc

SEQ ID NO: 532337 - DNA, 25 bp, Rattus norvegicus
gtttccatcatggaagccactctgc

SEQ ID NO: 532338 - DNA, 25 bp, Rattus norvegicus
gtttccatccacagctttgttcatg

SEQ ID NO: 532339 - DNA, 25 bp, Rattus norvegicus
gtttccatccactgctttgttcatg

SEQ ID NO: 532340 - DNA, 25 bp, Rattus norvegicus
gtttccatccagaacaggctctaat

SEQ ID NO: 532341 - DNA, 25 bp, Rattus norvegicus
gtttccatccagtacaggctctaat

SEQ ID NO: 532342 - DNA, 25 bp, Rattus norvegicus
gtttccatcgaaacctcttcaagtt

SEQ ID NO: 532343 - DNA, 25 bp, Rattus norvegicus
gtttccatcgaatcctcttcaagtt

SEQ ID NO: 532344 - DNA, 25 bp, Rattus norvegicus
gtttccatctctataattatttatt

SEQ ID NO: 532345 - DNA, 25 bp, Rattus norvegicus
gtttccatctctttaattatttatt

SEQ ID NO: 532346 - DNA, 25 bp, Rattus norvegicus
gtttccatctgccaggcttacagaa

SEQ ID NO: 532347 - DNA, 25 bp, Rattus norvegicus
gtttccatctgcgaggcttacagaa

SEQ ID NO: 532348 - DNA, 25 bp, Rattus norvegicus
gtttccatgctcactacattgctca

SEQ ID NO: 532349 - DNA, 25 bp, Rattus norvegicus
gtttccatgctctctacattgctca

SEQ ID NO: 532350 - DNA, 25 bp, Rattus norvegicus
gtttccatggacacattctccatga

SEQ ID NO: 532351 - DNA, 25 bp, Rattus norvegicus
gtttccatggactcattctccatga

SEQ ID NO: 532352 - DNA, 25 bp, Rattus norvegicus
gtttccatggagactagcaggctga

SEQ ID NO: 532353 - DNA, 25 bp, Rattus norvegicus
gtttccatggagtctagcaggctga

SEQ ID NO: 532354 - DNA, 25 bp, Rattus norvegicus
gtttccatggccaaatcctacaagg

SEQ ID NO: 532355 - DNA, 25 bp, Rattus norvegicus
gtttccatggcctaatcctacaagg

SEQ ID NO: 532356 - DNA, 25 bp, Rattus norvegicus
gtttccatgggaagacttttcatag

SEQ ID NO: 532357 - DNA, 25 bp, Rattus norvegicus
gtttccatgggatgacttttcatag

SEQ ID NO: 532358 - DNA, 25 bp, Rattus norvegicus
gtttccatgtctcctagccatttag

SEQ ID NO: 532359 - DNA, 25 bp, Rattus norvegicus
gtttccatgtctgctagccatttag

SEQ ID NO: 532360 - DNA, 25 bp, Rattus norvegicus
gtttccattactccaactagaccta

SEQ ID NO: 532361 - DNA, 25 bp, Rattus norvegicus
gtttccattactgcaactagaccta

SEQ ID NO: 532362 - DNA, 25 bp, Rattus norvegicus
gtttccattccaatcaacaaaatgt

SEQ ID NO: 532363 - DNA, 25 bp, Rattus norvegicus
gtttccattccattcaacaaaatgt

SEQ ID NO: 532364 - DNA, 25 bp, Rattus norvegicus
gtttccattcgtccctcttgaggaa

SEQ ID NO: 532365 - DNA, 25 bp, Rattus norvegicus
gtttccattcgtgcctcttgaggaa

SEQ ID NO: 532366 - DNA, 25 bp, Rattus norvegicus
gtttccattgaaatttcagctctga

SEQ ID NO: 532367 - DNA, 25 bp, Rattus norvegicus
gtttccattgaattttcagctctga

SEQ ID NO: 532368 - DNA, 25 bp, Rattus norvegicus
gtttccattgtgactgtcattacca

SEQ ID NO: 532369 - DNA, 25 bp, Rattus norvegicus
gtttccattgtgtctgtcattacca

SEQ ID NO: 532370 - DNA, 25 bp, Rattus norvegicus
gtttccattttgatgctgcattgca

SEQ ID NO: 532371 - DNA, 25 bp, Rattus norvegicus
gtttccattttgttgctgcattgca

SEQ ID NO: 532372 - DNA, 25 bp, Rattus norvegicus
gtttcccaaaccagagtcaattgct

SEQ ID NO: 532373 - DNA, 25 bp, Rattus norvegicus
gtttcccaaacctgagtcaattgct

SEQ ID NO: 532374 - DNA, 25 bp, Rattus norvegicus
gtttcccaaagcattacccgcatgg

SEQ ID NO: 532375 - DNA, 25 bp, Rattus norvegicus
gtttcccaaagctttacccgcatgg

SEQ ID NO: 532376 - DNA, 25 bp, Rattus norvegicus
gtttcccaaaggaaatgtaggctct

SEQ ID NO: 532377 - DNA, 25 bp, Rattus norvegicus
gtttcccaaaggtaatgtaggctct

SEQ ID NO: 532378 - DNA, 25 bp, Rattus norvegicus
gtttcccaacaaatactgcctctta

SEQ ID NO: 532379 - DNA, 25 bp, Rattus norvegicus
gtttcccaacaattactgcctctta

SEQ ID NO: 532380 - DNA, 25 bp, Rattus norvegicus
gtttcccaactcacatgtgttgcgg

SEQ ID NO: 532381 - DNA, 25 bp, Rattus norvegicus
gtttcccaactctcatgtgttgcgg

SEQ ID NO: 532382 - DNA, 25 bp, Rattus norvegicus
gtttcccaagcaaatatccatcagc

SEQ ID NO: 532383 - DNA, 25 bp, Rattus norvegicus
gtttcccaagcatatatccatcagc

SEQ ID NO: 532384 - DNA, 25 bp, Rattus norvegicus
gtttcccacaatcactgtacatgat

SEQ ID NO: 532385 - DNA, 25 bp, Rattus norvegicus
gtttcccacaatgactgtacatgat

SEQ ID NO: 532386 - DNA, 25 bp, Rattus norvegicus
gtttcccacacacaatgactttgag

SEQ ID NO: 532387 - DNA, 25 bp, Rattus norvegicus
gtttcccacacagaatgactttgag

SEQ ID NO: 532388 - DNA, 25 bp, Rattus norvegicus
gtttcccacagacccatgtctaaag

SEQ ID NO: 532389 - DNA, 25 bp, Rattus norvegicus
gtttcccacagagccatgtctaaag

SEQ ID NO: 532390 - DNA, 25 bp, Rattus norvegicus
gtttcccacctaagattccagggag

SEQ ID NO: 532391 - DNA, 25 bp, Rattus norvegicus
gtttcccacctatgattccagggag

SEQ ID NO: 532392 - DNA, 25 bp, Rattus norvegicus
gtttcccactgaagcactcttaggt

SEQ ID NO: 532393 - DNA, 25 bp, Rattus norvegicus
gtttcccactgatgcactcttaggt

SEQ ID NO: 532394 - DNA, 25 bp, Rattus norvegicus
gtttcccaggcaatgcttagacttt

SEQ ID NO: 532395 - DNA, 25 bp, Rattus norvegicus
gtttcccaggcattgcttagacttt

SEQ ID NO: 532396 - DNA, 25 bp, Rattus norvegicus
gtttcccagtgcaaaaggtctgccc

SEQ ID NO: 532397 - DNA, 25 bp, Rattus norvegicus
gtttcccagtgctaaaggtctgccc

SEQ ID NO: 532398 - DNA, 25 bp, Rattus norvegicus
gtttcccatcctaatgatgtacatg

SEQ ID NO: 532399 - DNA, 25 bp, Rattus norvegicus
gtttcccatccttatgatgtacatg

SEQ ID NO: 532400 - DNA, 25 bp, Rattus norvegicus
gtttcccatcggcatctaatttgag

SEQ ID NO: 532401 - DNA, 25 bp, Rattus norvegicus
gtttcccatcgggatctaatttgag

SEQ ID NO: 532402 - DNA, 25 bp, Rattus norvegicus
gtttcccatgatagaggtgcagctc

SEQ ID NO: 532403 - DNA, 25 bp, Rattus norvegicus
gtttcccatgattgaggtgcagctc

SEQ ID NO: 532404 - DNA, 25 bp, Rattus norvegicus
gtttcccatggaagagacgcctctg

SEQ ID NO: 532405 - DNA, 25 bp, Rattus norvegicus
gtttcccatggatgagacgcctctg

SEQ ID NO: 532406 - DNA, 25 bp, Rattus norvegicus
gtttcccatggtactgtgggatata

SEQ ID NO: 532407 - DNA, 25 bp, Rattus norvegicus
gtttcccatggttctgtgggatata

SEQ ID NO: 532408 - DNA, 25 bp, Rattus norvegicus
gtttcccattctcaaatacttcctt

SEQ ID NO: 532409 - DNA, 25 bp, Rattus norvegicus
gtttcccattctgaaatacttcctt

SEQ ID NO: 532410 - DNA, 25 bp, Rattus norvegicus
gtttccccaccaatagactgtgagc

SEQ ID NO: 532411 - DNA, 25 bp, Rattus norvegicus
gtttccccaccattagactgtgagc

SEQ ID NO: 532412 - DNA, 25 bp, Rattus norvegicus
gtttccccacctcaagagagggctg

SEQ ID NO: 532413 - DNA, 25 bp, Rattus norvegicus
gtttccccacctctaagtaattgca

SEQ ID NO: 532414 - DNA, 25 bp, Rattus norvegicus
gtttccccacctgaagagagggctg

SEQ ID NO: 532415 - DNA, 25 bp, Rattus norvegicus
gtttccccacctgtaagtaattgca

SEQ ID NO: 532416 - DNA, 25 bp, Rattus norvegicus
gtttccccactcaggaatcagtgtg

SEQ ID NO: 532417 - DNA, 25 bp, Rattus norvegicus
gtttccccactctggaatcagtgtg

SEQ ID NO: 532418 - DNA, 25 bp, Rattus norvegicus
gtttccccagtcactaatactacaa

SEQ ID NO: 532419 - DNA, 25 bp, Rattus norvegicus
gtttccccagtctctaatactacaa

SEQ ID NO: 532420 - DNA, 25 bp, Rattus norvegicus
gtttccccatccacaaagagctgta

SEQ ID NO: 532421 - DNA, 25 bp, Rattus norvegicus
gtttccccatcctcaaagagctgta

SEQ ID NO: 532422 - DNA, 25 bp, Rattus norvegicus
gtttccccatctcgacacagagagc

SEQ ID NO: 532423 - DNA, 25 bp, Rattus norvegicus
gtttccccatctggacacagagagc

SEQ ID NO: 532424 - DNA, 25 bp, Rattus norvegicus
gtttccccgtggctgatgcagcata

SEQ ID NO: 532425 - DNA, 25 bp, Rattus norvegicus
gtttccccgtgggtgatgcagcata

SEQ ID NO: 532426 - DNA, 25 bp, Rattus norvegicus
gtttcccctctgcagaaagcggctg

SEQ ID NO: 532427 - DNA, 25 bp, Rattus norvegicus
gtttcccctctggagaaagcggctg

SEQ ID NO: 532428 - DNA, 25 bp, Rattus norvegicus
gtttcccctgggataatgcattgcc

SEQ ID NO: 532429 - DNA, 25 bp, Rattus norvegicus
gtttcccctgggttaatgcattgcc

SEQ ID NO: 532430 - DNA, 25 bp, Rattus norvegicus
gtttccccttttctggctagaagca

SEQ ID NO: 532431 - DNA, 25 bp, Rattus norvegicus
gtttccccttttgtggctagaagca

SEQ ID NO: 532432 - DNA, 25 bp, Rattus norvegicus
gtttcccgaggaaaactgtgagtta

SEQ ID NO: 532433 - DNA, 25 bp, Rattus norvegicus
gtttcccgaggataactgtgagtta

SEQ ID NO: 532434 - DNA, 25 bp, Rattus norvegicus
gtttcccgccctccagttctgagaa

SEQ ID NO: 532435 - DNA, 25 bp, Rattus norvegicus
gtttcccgccctgcagttctgagaa

SEQ ID NO: 532436 - DNA, 25 bp, Rattus norvegicus
gtttcccggagcacagtaggtaaag

SEQ ID NO: 532437 - DNA, 25 bp, Rattus norvegicus
gtttcccggagctcagtaggtaaag

SEQ ID NO: 532438 - DNA, 25 bp, Rattus norvegicus
gtttcccgggcaatactggccgccg

SEQ ID NO: 532439 - DNA, 25 bp, Rattus norvegicus
gtttcccgggcattactggccgccg

SEQ ID NO: 532440 - DNA, 25 bp, Rattus norvegicus
gtttcccggtgtctttgaagtcaca

SEQ ID NO: 532441 - DNA, 25 bp, Rattus norvegicus
gtttcccggtgtgtttgaagtcaca

SEQ ID NO: 532442 - DNA, 25 bp, Rattus norvegicus
gtttccctaaaaaccaccatggcat

SEQ ID NO: 532443 - DNA, 25 bp, Rattus norvegicus
gtttccctaaaatccaccatggcat

SEQ ID NO: 532444 - DNA, 25 bp, Rattus norvegicus
gtttccctagcgaaaactccacgag

SEQ ID NO: 532445 - DNA, 25 bp, Rattus norvegicus
gtttccctagcgtaaactccacgag

SEQ ID NO: 532446 - DNA, 25 bp, Rattus norvegicus
gtttccctaggcatgtacccaagga

SEQ ID NO: 532447 - DNA, 25 bp, Rattus norvegicus
gtttccctaggcttgtacccaagga

SEQ ID NO: 532448 - DNA, 25 bp, Rattus norvegicus
gtttccctcaaacactccaggagat

SEQ ID NO: 532449 - DNA, 25 bp, Rattus norvegicus
gtttccctcaaagactccaggagat

SEQ ID NO: 532450 - DNA, 25 bp, Rattus norvegicus
gtttccctcaggaccagtagatatt

SEQ ID NO: 532451 - DNA, 25 bp, Rattus norvegicus
gtttccctcaggtccagtagatatt

SEQ ID NO: 532452 - DNA, 25 bp, Rattus norvegicus
gtttccctccagcaatagcatcttg

SEQ ID NO: 532453 - DNA, 25 bp, Rattus norvegicus
gtttccctccaggaatagcatcttg

SEQ ID NO: 532454 - DNA, 25 bp, Rattus norvegicus
gtttccctctacagttgagtggact

SEQ ID NO: 532455 - DNA, 25 bp, Rattus norvegicus
gtttccctctactgttgagtggact

SEQ ID NO: 532456 - DNA, 25 bp, Rattus norvegicus
gtttccctctagaatttacctcaag

SEQ ID NO: 532457 - DNA, 25 bp, Rattus norvegicus
gtttccctctagcattaggccataa

SEQ ID NO: 532458 - DNA, 25 bp, Rattus norvegicus
gtttccctctaggattaggccataa

SEQ ID NO: 532459 - DNA, 25 bp, Rattus norvegicus
gtttccctctagtatttacctcaag

SEQ ID NO: 532460 - DNA, 25 bp, Rattus norvegicus
gtttccctctgaccaattaaccaca

SEQ ID NO: 532461 - DNA, 25 bp, Rattus norvegicus
gtttccctctgagcaattaaccaca

SEQ ID NO: 532462 - DNA, 25 bp, Rattus norvegicus
gtttccctctgcagttcagaactat

SEQ ID NO: 532463 - DNA, 25 bp, Rattus norvegicus
gtttccctctgctgttcagaactat

SEQ ID NO: 532464 - DNA, 25 bp, Rattus norvegicus
gtttccctgaaaagactctcttcta

SEQ ID NO: 532465 - DNA, 25 bp, Rattus norvegicus
gtttccctgaaatgactctcttcta

SEQ ID NO: 532466 - DNA, 25 bp, Rattus norvegicus
gtttccctgcttatgtactccagag

SEQ ID NO: 532467 - DNA, 25 bp, Rattus norvegicus
gtttccctgcttttgtactccagag

SEQ ID NO: 532468 - DNA, 25 bp, Rattus norvegicus
gtttccctgttgctgcagtttctta

SEQ ID NO: 532469 - DNA, 25 bp, Rattus norvegicus
gtttccctgttggtgcagtttctta

SEQ ID NO: 532470 - DNA, 25 bp, Rattus norvegicus
gtttcccttaatactcttgtgacta

SEQ ID NO: 532471 - DNA, 25 bp, Rattus norvegicus
gtttcccttaattctcttgtgacta

SEQ ID NO: 532472 - DNA, 25 bp, Rattus norvegicus
gtttcccttgatctttgtcattgtt

SEQ ID NO: 532473 - DNA, 25 bp, Rattus norvegicus
gtttcccttgatgtttgtcattgtt

SEQ ID NO: 532474 - DNA, 25 bp, Rattus norvegicus
gtttcccttgctcaatgcattttgt

SEQ ID NO: 532475 - DNA, 25 bp, Rattus norvegicus
gtttcccttgctgaatgcattttgt

SEQ ID NO: 532476 - DNA, 25 bp, Rattus norvegicus
gtttcccttgggaggcttctctgtg

SEQ ID NO: 532477 - DNA, 25 bp, Rattus norvegicus
gtttcccttgggtggcttctctgtg

SEQ ID NO: 532478 - DNA, 25 bp, Rattus norvegicus
gtttcccttgtgagtggatgataag

SEQ ID NO: 532479 - DNA, 25 bp, Rattus norvegicus
gtttcccttgtgtgtggatgataag

SEQ ID NO: 532480 - DNA, 25 bp, Rattus norvegicus
gtttccctttctcattcttaatctg

SEQ ID NO: 532481 - DNA, 25 bp, Rattus norvegicus
gtttccctttctgattcttaatctg

SEQ ID NO: 532482 - DNA, 25 bp, Rattus norvegicus
gtttccgacggtaccattagagcta

SEQ ID NO: 532483 - DNA, 25 bp, Rattus norvegicus
gtttccgacggttccattagagcta

SEQ ID NO: 532484 - DNA, 25 bp, Rattus norvegicus
gtttccgagtgtctggttgtgtctc

SEQ ID NO: 532485 - DNA, 25 bp, Rattus norvegicus
gtttccgagtgtgtggttgtgtctc

SEQ ID NO: 532486 - DNA, 25 bp, Rattus norvegicus
gtttccgcagccactattgttagtc

SEQ ID NO: 532487 - DNA, 25 bp, Rattus norvegicus
gtttccgcagcctctattgttagtc

SEQ ID NO: 532488 - DNA, 25 bp, Rattus norvegicus
gtttccgccaatcccaaagactaag

SEQ ID NO: 532489 - DNA, 25 bp, Rattus norvegicus
gtttccgccaatgccaaagactaag

SEQ ID NO: 532490 - DNA, 25 bp, Rattus norvegicus
gtttccgccagcagagagatcgcag

SEQ ID NO: 532491 - DNA, 25 bp, Rattus norvegicus
gtttccgccagctgagagatcgcag

SEQ ID NO: 532492 - DNA, 25 bp, Rattus norvegicus
gtttccgcccttcttgtgcatagaa

SEQ ID NO: 532493 - DNA, 25 bp, Rattus norvegicus
gtttccgcccttgttgtgcatagaa

SEQ ID NO: 532494 - DNA, 25 bp, Rattus norvegicus
gtttccggaagactgatctctgatg

SEQ ID NO: 532495 - DNA, 25 bp, Rattus norvegicus
gtttccggaagagtgatctctgatg

SEQ ID NO: 532496 - DNA, 25 bp, Rattus norvegicus
gtttccggaggacaactgttcgatt

SEQ ID NO: 532497 - DNA, 25 bp, Rattus norvegicus
gtttccggaggagaactgttcgatt

SEQ ID NO: 532498 - DNA, 25 bp, Rattus norvegicus
gtttccgggcgcatgagacacagcc

SEQ ID NO: 532499 - DNA, 25 bp, Rattus norvegicus
gtttccgggcgcttgagacacagcc

SEQ ID NO: 532500 - DNA, 25 bp, Rattus norvegicus
gtttccgtccgtctgtcgtgaacag

SEQ ID NO: 532501 - DNA, 25 bp, Rattus norvegicus
gtttccgtccgtgtgtcgtgaacag

SEQ ID NO: 532502 - DNA, 25 bp, Rattus norvegicus
gtttccgtctcgacatcatgcagaa

SEQ ID NO: 532503 - DNA, 25 bp, Rattus norvegicus
gtttccgtctcgtcatcatgcagaa

SEQ ID NO: 532504 - DNA, 25 bp, Rattus norvegicus
gtttccgtcttgacgtcatgcagac

SEQ ID NO: 532505 - DNA, 25 bp, Rattus norvegicus
gtttccgtcttgtcgtcatgcagac

SEQ ID NO: 532506 - DNA, 25 bp, Rattus norvegicus
gtttccgtgattaaacagtctgttt

SEQ ID NO: 532507 - DNA, 25 bp, Rattus norvegicus
gtttccgtgatttaacagtctgttt

SEQ ID NO: 532508 - DNA, 25 bp, Rattus norvegicus
gtttccgtgccaatcttgctgagaa

SEQ ID NO: 532509 - DNA, 25 bp, Rattus norvegicus
gtttccgtgccattcttgctgagaa

SEQ ID NO: 532510 - DNA, 25 bp, Rattus norvegicus
gtttccgtgttgattcttagccagc

SEQ ID NO: 532511 - DNA, 25 bp, Rattus norvegicus
gtttccgtgttgtttcttagccagc

SEQ ID NO: 532512 - DNA, 25 bp, Rattus norvegicus
gtttccgttaaccatatccgtcata

SEQ ID NO: 532513 - DNA, 25 bp, Rattus norvegicus
gtttccgttaacgatatccgtcata

SEQ ID NO: 532514 - DNA, 25 bp, Rattus norvegicus
gtttccgttgaactagctctgttag

SEQ ID NO: 532515 - DNA, 25 bp, Rattus norvegicus
gtttccgttgaagtagctctgttag

SEQ ID NO: 532516 - DNA, 25 bp, Rattus norvegicus
gtttcctaaaccataccaacacaga

SEQ ID NO: 532517 - DNA, 25 bp, Rattus norvegicus
gtttcctaaaccttaccaacacaga

SEQ ID NO: 532518 - DNA, 25 bp, Rattus norvegicus
gtttcctaaatccttgcctttcgct

SEQ ID NO: 532519 - DNA, 25 bp, Rattus norvegicus
gtttcctaaatcgttgcctttcgct

SEQ ID NO: 532520 - DNA, 25 bp, Rattus norvegicus
gtttcctaacagaatattgtcatgg

SEQ ID NO: 532521 - DNA, 25 bp, Rattus norvegicus
gtttcctaacagtatattgtcatgg

SEQ ID NO: 532522 - DNA, 25 bp, Rattus norvegicus
gtttcctaaccaagtcctgaactag

SEQ ID NO: 532523 - DNA, 25 bp, Rattus norvegicus
gtttcctaaccatgtcctgaactag

SEQ ID NO: 532524 - DNA, 25 bp, Rattus norvegicus
gtttcctaagtgaagccaactgact

SEQ ID NO: 532525 - DNA, 25 bp, Rattus norvegicus
gtttcctaagtgtagccaactgact

SEQ ID NO: 532526 - DNA, 25 bp, Rattus norvegicus
gtttcctaataaatgagcctaccag

SEQ ID NO: 532527 - DNA, 25 bp, Rattus norvegicus
gtttcctaataattgagcctaccag

SEQ ID NO: 532528 - DNA, 25 bp, Rattus norvegicus
gtttcctaatatcctgggcctggca

SEQ ID NO: 532529 - DNA, 25 bp, Rattus norvegicus
gtttcctaatatgctgggcctggca

SEQ ID NO: 532530 - DNA, 25 bp, Rattus norvegicus
gtttcctaatgcatacacagagtgt

SEQ ID NO: 532531 - DNA, 25 bp, Rattus norvegicus
gtttcctaatgcttacacagagtgt

SEQ ID NO: 532532 - DNA, 25 bp, Rattus norvegicus
gtttcctacgtcacgtgtatacagt

SEQ ID NO: 532533 - DNA, 25 bp, Rattus norvegicus
gtttcctacgtctcgtgtatacagt

SEQ ID NO: 532534 - DNA, 25 bp, Rattus norvegicus
gtttcctactgtatcctgactagaa

SEQ ID NO: 532535 - DNA, 25 bp, Rattus norvegicus
gtttcctactgtttcctgactagaa

SEQ ID NO: 532536 - DNA, 25 bp, Rattus norvegicus
gtttcctagtgcctcgcatgtaata

SEQ ID NO: 532537 - DNA, 25 bp, Rattus norvegicus
gtttcctagtgcgtcgcatgtaata

SEQ ID NO: 532538 - DNA, 25 bp, Rattus norvegicus
gtttcctatgaaagctgtctacaga

SEQ ID NO: 532539 - DNA, 25 bp, Rattus norvegicus
gtttcctatgaaatctgtgacctct

SEQ ID NO: 532540 - DNA, 25 bp, Rattus norvegicus
gtttcctatgaatgctgtctacaga

SEQ ID NO: 532541 - DNA, 25 bp, Rattus norvegicus
gtttcctatgaattctgtgacctct

SEQ ID NO: 532542 - DNA, 25 bp, Rattus norvegicus
gtttcctcaaacctataagcttcct

SEQ ID NO: 532543 - DNA, 25 bp, Rattus norvegicus
gtttcctcaaaccttggctcaaaga

SEQ ID NO: 532544 - DNA, 25 bp, Rattus norvegicus
gtttcctcaaacgtataagcttcct

SEQ ID NO: 532545 - DNA, 25 bp, Rattus norvegicus
gtttcctcaaacgttggctcaaaga

SEQ ID NO: 532546 - DNA, 25 bp, Rattus norvegicus
gtttcctcaaagaaccgagatcctg

SEQ ID NO: 532547 - DNA, 25 bp, Rattus norvegicus
gtttcctcaaagtaccgagatcctg

SEQ ID NO: 532548 - DNA, 25 bp, Rattus norvegicus
gtttcctcaacaactgcactggagt

SEQ ID NO: 532549 - DNA, 25 bp, Rattus norvegicus
gtttcctcaacatctgcactggagt

SEQ ID NO: 532550 - DNA, 25 bp, Rattus norvegicus
gtttcctcaagtaggcactgatgtt

SEQ ID NO: 532551 - DNA, 25 bp, Rattus norvegicus
gtttcctcaagttggcactgatgtt

SEQ ID NO: 532552 - DNA, 25 bp, Rattus norvegicus
gtttcctcagctctattttcatatg

SEQ ID NO: 532553 - DNA, 25 bp, Rattus norvegicus
gtttcctcagctgtattttcatatg

SEQ ID NO: 532554 - DNA, 25 bp, Rattus norvegicus
gtttcctcatctccaaggtggacta

SEQ ID NO: 532555 - DNA, 25 bp, Rattus norvegicus
gtttcctcatctgcaaggtggacta

SEQ ID NO: 532556 - DNA, 25 bp, Rattus norvegicus
gtttcctccagtagacagatttgaa

SEQ ID NO: 532557 - DNA, 25 bp, Rattus norvegicus
gtttcctccagttgacagatttgaa

SEQ ID NO: 532558 - DNA, 25 bp, Rattus norvegicus
gtttcctccctaaattgaagtccat

SEQ ID NO: 532559 - DNA, 25 bp, Rattus norvegicus
gtttcctccctatattgaagtccat

SEQ ID NO: 532560 - DNA, 25 bp, Rattus norvegicus
gtttcctcctaaacccaccatggag

SEQ ID NO: 532561 - DNA, 25 bp, Rattus norvegicus
gtttcctcctaatcccaccatggag

SEQ ID NO: 532562 - DNA, 25 bp, Rattus norvegicus
gtttcctcctctatacaagatgatg

SEQ ID NO: 532563 - DNA, 25 bp, Rattus norvegicus
gtttcctcctctttacaagatgatg

SEQ ID NO: 532564 - DNA, 25 bp, Rattus norvegicus
gtttcctcctttaatgaagtgtcca

SEQ ID NO: 532565 - DNA, 25 bp, Rattus norvegicus
gtttcctccttttatgaagtgtcca

SEQ ID NO: 532566 - DNA, 25 bp, Rattus norvegicus
gtttcctcgattctaaagttcagtt

SEQ ID NO: 532567 - DNA, 25 bp, Rattus norvegicus
gtttcctcgattgtaaagttcagtt

SEQ ID NO: 532568 - DNA, 25 bp, Rattus norvegicus
gtttcctctaaacaagacataagat

SEQ ID NO: 532569 - DNA, 25 bp, Rattus norvegicus
gtttcctctaaagaagacataagat

SEQ ID NO: 532570 - DNA, 25 bp, Rattus norvegicus
gtttcctctagtatcctgctgtaaa

SEQ ID NO: 532571 - DNA, 25 bp, Rattus norvegicus
gtttcctctagtttcctgctgtaaa

SEQ ID NO: 532572 - DNA, 25 bp, Rattus norvegicus
gtttcctctcctagcatttatttaa

SEQ ID NO: 532573 - DNA, 25 bp, Rattus norvegicus
gtttcctctccttgcatttatttaa

SEQ ID NO: 532574 - DNA, 25 bp, Rattus norvegicus
gtttcctctcttccagttagtagta

SEQ ID NO: 532575 - DNA, 25 bp, Rattus norvegicus
gtttcctctcttgcagttagtagta

SEQ ID NO: 532576 - DNA, 25 bp, Rattus norvegicus
gtttcctctgctcagatgcgtggaa

SEQ ID NO: 532577 - DNA, 25 bp, Rattus norvegicus
gtttcctctgctgagatgcgtggaa

SEQ ID NO: 532578 - DNA, 25 bp, Rattus norvegicus
gtttcctctgtactaacagcatcct

SEQ ID NO: 532579 - DNA, 25 bp, Rattus norvegicus
gtttcctctgtagtaacagcatcct

SEQ ID NO: 532580 - DNA, 25 bp, Rattus norvegicus
gtttcctctgttacccatttaagat

SEQ ID NO: 532581 - DNA, 25 bp, Rattus norvegicus
gtttcctctgtttcccatttaagat

SEQ ID NO: 532582 - DNA, 25 bp, Rattus norvegicus
gtttcctcttatacaagccatgcac

SEQ ID NO: 532583 - DNA, 25 bp, Rattus norvegicus
gtttcctcttattcaagccatgcac

SEQ ID NO: 532584 - DNA, 25 bp, Rattus norvegicus
gtttcctgaaatacactcagtggct

SEQ ID NO: 532585 - DNA, 25 bp, Rattus norvegicus
gtttcctgaaattcactcagtggct

SEQ ID NO: 532586 - DNA, 25 bp, Rattus norvegicus
gtttcctgaacgagttgcttctata

SEQ ID NO: 532587 - DNA, 25 bp, Rattus norvegicus
gtttcctgaacgtgttgcttctata

SEQ ID NO: 532588 - DNA, 25 bp, Rattus norvegicus
gtttcctgaagaagatgcgccaccg

SEQ ID NO: 532589 - DNA, 25 bp, Rattus norvegicus
gtttcctgaagatgatgcgccaccg

SEQ ID NO: 532590 - DNA, 25 bp, Rattus norvegicus
gtttcctgagagattgtcctaaaag

SEQ ID NO: 532591 - DNA, 25 bp, Rattus norvegicus
gtttcctgagagtttgtcctaaaag

SEQ ID NO: 532592 - DNA, 25 bp, Rattus norvegicus
gtttcctgagggagtttttgcttca

SEQ ID NO: 532593 - DNA, 25 bp, Rattus norvegicus
gtttcctgagggtgtttttgcttca

SEQ ID NO: 532594 - DNA, 25 bp, Rattus norvegicus
gtttcctgatggaggtgcatttttc

SEQ ID NO: 532595 - DNA, 25 bp, Rattus norvegicus
gtttcctgatggtggtgcatttttc

SEQ ID NO: 532596 - DNA, 25 bp, Rattus norvegicus
gtttcctgatgtactgactttccaa

SEQ ID NO: 532597 - DNA, 25 bp, Rattus norvegicus
gtttcctgatgttctgactttccaa

SEQ ID NO: 532598 - DNA, 25 bp, Rattus norvegicus
gtttcctgctaaatggtgcttgtct

SEQ ID NO: 532599 - DNA, 25 bp, Rattus norvegicus
gtttcctgctaattggtgcttgtct

SEQ ID NO: 532600 - DNA, 25 bp, Rattus norvegicus
gtttcctgctgcatcaagcacacag

SEQ ID NO: 532601 - DNA, 25 bp, Rattus norvegicus
gtttcctgctgcttcaagcacacag

SEQ ID NO: 532602 - DNA, 25 bp, Rattus norvegicus
gtttcctgcttaacaccgtagatga

SEQ ID NO: 532603 - DNA, 25 bp, Rattus norvegicus
gtttcctgcttatcaccgtagatga

SEQ ID NO: 532604 - DNA, 25 bp, Rattus norvegicus
gtttcctgcttcactggtacaataa

SEQ ID NO: 532605 - DNA, 25 bp, Rattus norvegicus
gtttcctgcttcctcttaagttaca

SEQ ID NO: 532606 - DNA, 25 bp, Rattus norvegicus
gtttcctgcttcgtcttaagttaca

SEQ ID NO: 532607 - DNA, 25 bp, Rattus norvegicus
gtttcctgcttctctggtacaataa

SEQ ID NO: 532608 - DNA, 25 bp, Rattus norvegicus
gtttcctggagaaatttctacccaa

SEQ ID NO: 532609 - DNA, 25 bp, Rattus norvegicus
gtttcctggagatatttctacccaa

SEQ ID NO: 532610 - DNA, 25 bp, Rattus norvegicus
gtttcctggcagcataagacatgaa

SEQ ID NO: 532611 - DNA, 25 bp, Rattus norvegicus
gtttcctggcaggataagacatgaa

SEQ ID NO: 532612 - DNA, 25 bp, Rattus norvegicus
gtttcctggccaccaataagctcca

SEQ ID NO: 532613 - DNA, 25 bp, Rattus norvegicus
gtttcctggccagcaataagctcca

SEQ ID NO: 532614 - DNA, 25 bp, Rattus norvegicus
gtttcctgggacaattaggtcacct

SEQ ID NO: 532615 - DNA, 25 bp, Rattus norvegicus
gtttcctgggactattaggtcacct

SEQ ID NO: 532616 - DNA, 25 bp, Rattus norvegicus
gtttcctgggatcactgagttggca

SEQ ID NO: 532617 - DNA, 25 bp, Rattus norvegicus
gtttcctgggatgactgagttggca

SEQ ID NO: 532618 - DNA, 25 bp, Rattus norvegicus
gtttcctgggctatgctagtagcaa

SEQ ID NO: 532619 - DNA, 25 bp, Rattus norvegicus
gtttcctgggctttgctagtagcaa

SEQ ID NO: 532620 - DNA, 25 bp, Rattus norvegicus
gtttcctggtccagattatcctctt

SEQ ID NO: 532621 - DNA, 25 bp, Rattus norvegicus
gtttcctggtcccatacttctaaag

SEQ ID NO: 532622 - DNA, 25 bp, Rattus norvegicus
gtttcctggtccgatacttctaaag

SEQ ID NO: 532623 - DNA, 25 bp, Rattus norvegicus
gtttcctggtcctgattatcctctt

SEQ ID NO: 532624 - DNA, 25 bp, Rattus norvegicus
gtttcctggtgaactgacagtacat

SEQ ID NO: 532625 - DNA, 25 bp, Rattus norvegicus
gtttcctggtgatctgacagtacat

SEQ ID NO: 532626 - DNA, 25 bp, Rattus norvegicus
gtttcctgtattaatcctttgacca

SEQ ID NO: 532627 - DNA, 25 bp, Rattus norvegicus
gtttcctgtatttatcctttgacca

SEQ ID NO: 532628 - DNA, 25 bp, Rattus norvegicus
gtttcctgtctaagatggcgtgtct

SEQ ID NO: 532629 - DNA, 25 bp, Rattus norvegicus
gtttcctgtctatgatggcgtgtct

SEQ ID NO: 532630 - DNA, 25 bp, Rattus norvegicus
gtttcctgtctgagctttgcaagca

SEQ ID NO: 532631 - DNA, 25 bp, Rattus norvegicus
gtttcctgtctgtgctttgcaagca

SEQ ID NO: 532632 - DNA, 25 bp, Rattus norvegicus
gtttcctgtcttatactgatactta

SEQ ID NO: 532633 - DNA, 25 bp, Rattus norvegicus
gtttcctgtcttttactgatactta

SEQ ID NO: 532634 - DNA, 25 bp, Rattus norvegicus
gtttcctgtgggagagctgagaaca

SEQ ID NO: 532635 - DNA, 25 bp, Rattus norvegicus
gtttcctgtgggtgagctgagaaca

SEQ ID NO: 532636 - DNA, 25 bp, Rattus norvegicus
gtttcctgtgttccataatctattt

SEQ ID NO: 532637 - DNA, 25 bp, Rattus norvegicus
gtttcctgtgttgcataatctattt

SEQ ID NO: 532638 - DNA, 25 bp, Rattus norvegicus
gtttcctgttctcgttactttgtga

SEQ ID NO: 532639 - DNA, 25 bp, Rattus norvegicus
gtttcctgttctctttccatttaat

SEQ ID NO: 532640 - DNA, 25 bp, Rattus norvegicus
gtttcctgttctggttactttgtga

SEQ ID NO: 532641 - DNA, 25 bp, Rattus norvegicus
gtttcctgttctgtttccatttaat

SEQ ID NO: 532642 - DNA, 25 bp, Rattus norvegicus
gtttccttagggatattctgccctt

SEQ ID NO: 532643 - DNA, 25 bp, Rattus norvegicus
gtttccttagggttattctgccctt

SEQ ID NO: 532644 - DNA, 25 bp, Rattus norvegicus
gtttccttagtacttatgggtctct

SEQ ID NO: 532645 - DNA, 25 bp, Rattus norvegicus
gtttccttagtagttatgggtctct

SEQ ID NO: 532646 - DNA, 25 bp, Rattus norvegicus
gtttccttatacatttgtctaactt

SEQ ID NO: 532647 - DNA, 25 bp, Rattus norvegicus
gtttccttatacttttgtctaactt

SEQ ID NO: 532648 - DNA, 25 bp, Rattus norvegicus
gtttccttatatacgctaaataaag

SEQ ID NO: 532649 - DNA, 25 bp, Rattus norvegicus
gtttccttatattcgctaaataaag

SEQ ID NO: 532650 - DNA, 25 bp, Rattus norvegicus
gtttccttatgcatcacacacagta

SEQ ID NO: 532651 - DNA, 25 bp, Rattus norvegicus
gtttccttatgcttcacacacagta

SEQ ID NO: 532652 - DNA, 25 bp, Rattus norvegicus
gtttccttattcatccaacagtgat

SEQ ID NO: 532653 - DNA, 25 bp, Rattus norvegicus
gtttccttattcttccaacagtgat

SEQ ID NO: 532654 - DNA, 25 bp, Rattus norvegicus
gtttccttcaccattttgtgtgatc

SEQ ID NO: 532655 - DNA, 25 bp, Rattus norvegicus
gtttccttcacctttttgtgtgatc

SEQ ID NO: 532656 - DNA, 25 bp, Rattus norvegicus
gtttccttcctcagcagatagagct

SEQ ID NO: 532657 - DNA, 25 bp, Rattus norvegicus
gtttccttcctctgcagatagagct

SEQ ID NO: 532658 - DNA, 25 bp, Rattus norvegicus
gtttccttctggacctatcaaagtt

SEQ ID NO: 532659 - DNA, 25 bp, Rattus norvegicus
gtttccttctggtcctatcaaagtt

SEQ ID NO: 532660 - DNA, 25 bp, Rattus norvegicus
gtttccttcttccagaatctcggat

SEQ ID NO: 532661 - DNA, 25 bp, Rattus norvegicus
gtttccttcttcctactcagagtgg

SEQ ID NO: 532662 - DNA, 25 bp, Rattus norvegicus
gtttccttcttcgagaatctcggat

SEQ ID NO: 532663 - DNA, 25 bp, Rattus norvegicus
gtttccttcttcgtactcagagtgg

SEQ ID NO: 532664 - DNA, 25 bp, Rattus norvegicus
gtttccttgaacatgcttcttgaga

SEQ ID NO: 532665 - DNA, 25 bp, Rattus norvegicus
gtttccttgaacttgcttcttgaga

SEQ ID NO: 532666 - DNA, 25 bp, Rattus norvegicus
gtttccttggaccagtacaagcaga

SEQ ID NO: 532667 - DNA, 25 bp, Rattus norvegicus
gtttccttggacgagtacaagcaga

SEQ ID NO: 532668 - DNA, 25 bp, Rattus norvegicus
gtttccttggctcgcatgtgcaaag

SEQ ID NO: 532669 - DNA, 25 bp, Rattus norvegicus
gtttccttggctggcatgtgcaaag

SEQ ID NO: 532670 - DNA, 25 bp, Rattus norvegicus
gtttccttgggtaactagctcaaat

SEQ ID NO: 532671 - DNA, 25 bp, Rattus norvegicus
gtttccttgggttactagctcaaat

SEQ ID NO: 532672 - DNA, 25 bp, Rattus norvegicus
gtttccttgtatatgatttgagcca

SEQ ID NO: 532673 - DNA, 25 bp, Rattus norvegicus
gtttccttgtatttgatttgagcca

SEQ ID NO: 532674 - DNA, 25 bp, Rattus norvegicus
gtttccttgtgtatttctgtgagtg

SEQ ID NO: 532675 - DNA, 25 bp, Rattus norvegicus
gtttccttgtgtcggtgtactcaca

SEQ ID NO: 532676 - DNA, 25 bp, Rattus norvegicus
gtttccttgtgtgggtgtactcaca

SEQ ID NO: 532677 - DNA, 25 bp, Rattus norvegicus
gtttccttgtgtttttctgtgagtg

SEQ ID NO: 532678 - DNA, 25 bp, Rattus norvegicus
gtttcctttaagacaggctacctct

SEQ ID NO: 532679 - DNA, 25 bp, Rattus norvegicus
gtttcctttaagtcaggctacctct

SEQ ID NO: 532680 - DNA, 25 bp, Rattus norvegicus
gtttcctttagcacacacattgcac

SEQ ID NO: 532681 - DNA, 25 bp, Rattus norvegicus
gtttcctttagctcacacattgcac

SEQ ID NO: 532682 - DNA, 25 bp, Rattus norvegicus
gtttcctttcagaagacatggcttt

SEQ ID NO: 532683 - DNA, 25 bp, Rattus norvegicus
gtttcctttcagtagacatggcttt

SEQ ID NO: 532684 - DNA, 25 bp, Rattus norvegicus
gtttcctttccaaaagactggaatc

SEQ ID NO: 532685 - DNA, 25 bp, Rattus norvegicus
gtttcctttccataagactggaatc

SEQ ID NO: 532686 - DNA, 25 bp, Rattus norvegicus
gtttcctttcccaagagttgtctat

SEQ ID NO: 532687 - DNA, 25 bp, Rattus norvegicus
gtttcctttccctagagttgtctat

SEQ ID NO: 532688 - DNA, 25 bp, Rattus norvegicus
gtttcctttcctacattatcatcgt

SEQ ID NO: 532689 - DNA, 25 bp, Rattus norvegicus
gtttcctttccttcattatcatcgt

SEQ ID NO: 532690 - DNA, 25 bp, Rattus norvegicus
gtttcctttctcacatgtgaaccag

SEQ ID NO: 532691 - DNA, 25 bp, Rattus norvegicus
gtttcctttctctcatgtgaaccag

SEQ ID NO: 532692 - DNA, 25 bp, Rattus norvegicus
gtttcctttgtcatcagctttgata

SEQ ID NO: 532693 - DNA, 25 bp, Rattus norvegicus
gtttcctttgtcttcagctttgata

SEQ ID NO: 532694 - DNA, 25 bp, Rattus norvegicus
gtttcctttttaactgctgttacca

SEQ ID NO: 532695 - DNA, 25 bp, Rattus norvegicus
gtttcctttttatctgctgttacca

SEQ ID NO: 532696 - DNA, 25 bp, Rattus norvegicus
gtttcctttttcaagatattgcttt

SEQ ID NO: 532697 - DNA, 25 bp, Rattus norvegicus
gtttcctttttctagatattgcttt

SEQ ID NO: 532698 - DNA, 25 bp, Rattus norvegicus
gtttcctttttgcagccattaactt

SEQ ID NO: 532699 - DNA, 25 bp, Rattus norvegicus
gtttcctttttggagccattaactt

SEQ ID NO: 532700 - DNA, 25 bp, Rattus norvegicus
gtttcgaaattcctctgttgcaatg

SEQ ID NO: 532701 - DNA, 25 bp, Rattus norvegicus
gtttcgaaattcgtctgttgcaatg

SEQ ID NO: 532702 - DNA, 25 bp, Rattus norvegicus
gtttcgaactctagatccatctttg

SEQ ID NO: 532703 - DNA, 25 bp, Rattus norvegicus
gtttcgaactcttgatccatctttg

SEQ ID NO: 532704 - DNA, 25 bp, Rattus norvegicus
gtttcgaacttgcagaactgtacac

SEQ ID NO: 532705 - DNA, 25 bp, Rattus norvegicus
gtttcgaacttggagaactgtacac

SEQ ID NO: 532706 - DNA, 25 bp, Rattus norvegicus
gtttcgaccagacatttggatctat

SEQ ID NO: 532707 - DNA, 25 bp, Rattus norvegicus
gtttcgaccagagatttggatctat

SEQ ID NO: 532708 - DNA, 25 bp, Rattus norvegicus
gtttcgagactgcatatcaagcttt

SEQ ID NO: 532709 - DNA, 25 bp, Rattus norvegicus
gtttcgagactggatatcaagcttt

SEQ ID NO: 532710 - DNA, 25 bp, Rattus norvegicus
gtttcgagagtcctgtgtcttccat

SEQ ID NO: 532711 - DNA, 25 bp, Rattus norvegicus
gtttcgagagtcgtgtgtcttccat

SEQ ID NO: 532712 - DNA, 25 bp, Rattus norvegicus
gtttcgagcactagtcggatttgtt

SEQ ID NO: 532713 - DNA, 25 bp, Rattus norvegicus
gtttcgagcacttgtcggatttgtt

SEQ ID NO: 532714 - DNA, 25 bp, Rattus norvegicus
gtttcgagtaacaccgtcacaaatt

SEQ ID NO: 532715 - DNA, 25 bp, Rattus norvegicus
gtttcgagtaactccgtcacaaatt

SEQ ID NO: 532716 - DNA, 25 bp, Rattus norvegicus
gtttcgagtataacaaccctctctt

SEQ ID NO: 532717 - DNA, 25 bp, Rattus norvegicus
gtttcgagtatatcaaccctctctt

SEQ ID NO: 532718 - DNA, 25 bp, Rattus norvegicus
gtttcgagtctcatctcaaggtgac

SEQ ID NO: 532719 - DNA, 25 bp, Rattus norvegicus
gtttcgagtctcttctcaaggtgac

SEQ ID NO: 532720 - DNA, 25 bp, Rattus norvegicus
gtttcgatgatgaaggcggcctcct

SEQ ID NO: 532721 - DNA, 25 bp, Rattus norvegicus
gtttcgatgatgtaggcggcctcct

SEQ ID NO: 532722 - DNA, 25 bp, Rattus norvegicus
gtttcgcaatttagcatctgggtta

SEQ ID NO: 532723 - DNA, 25 bp, Rattus norvegicus
gtttcgcaattttgcatctgggtta

SEQ ID NO: 532724 - DNA, 25 bp, Rattus norvegicus
gtttcgcatgagaattttctccttt

SEQ ID NO: 532725 - DNA, 25 bp, Rattus norvegicus
gtttcgcatgagtattttctccttt

SEQ ID NO: 532726 - DNA, 25 bp, Rattus norvegicus
gtttcgccaagcatcagatactgaa

SEQ ID NO: 532727 - DNA, 25 bp, Rattus norvegicus
gtttcgccaagcttcagatactgaa

SEQ ID NO: 532728 - DNA, 25 bp, Rattus norvegicus
gtttcgccattgataacctcagaag

SEQ ID NO: 532729 - DNA, 25 bp, Rattus norvegicus
gtttcgccattgttaacctcagaag

SEQ ID NO: 532730 - DNA, 25 bp, Rattus norvegicus
gtttcgcccagacatggatacacat

SEQ ID NO: 532731 - DNA, 25 bp, Rattus norvegicus
gtttcgcccagagatggatacacat

SEQ ID NO: 532732 - DNA, 25 bp, Rattus norvegicus
gtttcgccttcgaggagttttatca

SEQ ID NO: 532733 - DNA, 25 bp, Rattus norvegicus
gtttcgccttcgtggagttttatca

SEQ ID NO: 532734 - DNA, 25 bp, Rattus norvegicus
gtttcgctaacaagtacctattcac

SEQ ID NO: 532735 - DNA, 25 bp, Rattus norvegicus
gtttcgctaacatgtacctattcac

SEQ ID NO: 532736 - DNA, 25 bp, Rattus norvegicus
gtttcgctcgtgctttctagaggaa

SEQ ID NO: 532737 - DNA, 25 bp, Rattus norvegicus
gtttcgctcgtggtttctagaggaa

SEQ ID NO: 532738 - DNA, 25 bp, Rattus norvegicus
gtttcgctttccaggacatcgacaa

SEQ ID NO: 532739 - DNA, 25 bp, Rattus norvegicus
gtttcgctttcctggacatcgacaa

SEQ ID NO: 532740 - DNA, 25 bp, Rattus norvegicus
gtttcgctttgaattcaccttcaga

SEQ ID NO: 532741 - DNA, 25 bp, Rattus norvegicus
gtttcgctttgatttcaccttcaga

SEQ ID NO: 532742 - DNA, 25 bp, Rattus norvegicus
gtttcggactcaaaagccaagaact

SEQ ID NO: 532743 - DNA, 25 bp, Rattus norvegicus
gtttcggactcataagccaagaact

SEQ ID NO: 532744 - DNA, 25 bp, Rattus norvegicus
gtttcggcaactcctagagcctggg

SEQ ID NO: 532745 - DNA, 25 bp, Rattus norvegicus
gtttcggcaactgctagagcctggg

SEQ ID NO: 532746 - DNA, 25 bp, Rattus norvegicus
gtttcgggaagccacctgatgcata

SEQ ID NO: 532747 - DNA, 25 bp, Rattus norvegicus
gtttcgggaagcgacctgatgcata

SEQ ID NO: 532748 - DNA, 25 bp, Rattus norvegicus
gtttcgggtggcactgaagactttt

SEQ ID NO: 532749 - DNA, 25 bp, Rattus norvegicus
gtttcgggtggctctgaagactttt

SEQ ID NO: 532750 - DNA, 25 bp, Rattus norvegicus
gtttcggtaagcacttcatggtcag

SEQ ID NO: 532751 - DNA, 25 bp, Rattus norvegicus
gtttcggtaagctcttcatggtcag

SEQ ID NO: 532752 - DNA, 25 bp, Rattus norvegicus
gtttcggtacacacttcagtcatgt

SEQ ID NO: 532753 - DNA, 25 bp, Rattus norvegicus
gtttcggtacactcttcagtcatgt

SEQ ID NO: 532754 - DNA, 25 bp, Rattus norvegicus
gtttcggtcaacagtggtgacacac

SEQ ID NO: 532755 - DNA, 25 bp, Rattus norvegicus
gtttcggtcaactgtggtgacacac

SEQ ID NO: 532756 - DNA, 25 bp, Rattus norvegicus
gtttcggtcatgaatgtctactttg

SEQ ID NO: 532757 - DNA, 25 bp, Rattus norvegicus
gtttcggtcatgtatgtctactttg

SEQ ID NO: 532758 - DNA, 25 bp, Rattus norvegicus
gtttcggtgttgatgctgctagtta

SEQ ID NO: 532759 - DNA, 25 bp, Rattus norvegicus
gtttcggtgttgttgctgctagtta

SEQ ID NO: 532760 - DNA, 25 bp, Rattus norvegicus
gtttcggttatgactcttttcagtt

SEQ ID NO: 532761 - DNA, 25 bp, Rattus norvegicus
gtttcggttatgtctcttttcagtt

SEQ ID NO: 532762 - DNA, 25 bp, Rattus norvegicus
gtttcggttctacaggtctattgac

SEQ ID NO: 532763 - DNA, 25 bp, Rattus norvegicus
gtttcggttctagaggtctattgac

SEQ ID NO: 532764 - DNA, 25 bp, Rattus norvegicus
gtttcggtttcgctttatgtgacag

SEQ ID NO: 532765 - DNA, 25 bp, Rattus norvegicus
gtttcggtttcggtttatgtgacag

SEQ ID NO: 532766 - DNA, 25 bp, Rattus norvegicus
gtttcgtagtaacatttcacttgta

SEQ ID NO: 532767 - DNA, 25 bp, Rattus norvegicus
gtttcgtagtaagatttcacttgta

SEQ ID NO: 532768 - DNA, 25 bp, Rattus norvegicus
gtttcgtccctacaggcttggtaag

SEQ ID NO: 532769 - DNA, 25 bp, Rattus norvegicus
gtttcgtccctagaggcttggtaag

SEQ ID NO: 532770 - DNA, 25 bp, Rattus norvegicus
gtttcgtctcgaaggctttaatgat

SEQ ID NO: 532771 - DNA, 25 bp, Rattus norvegicus
gtttcgtctcgatggctttaatgat

SEQ ID NO: 532772 - DNA, 25 bp, Rattus norvegicus
gtttcgtgagccaagacactgactt

SEQ ID NO: 532773 - DNA, 25 bp, Rattus norvegicus
gtttcgtgagcctagacactgactt

SEQ ID NO: 532774 - DNA, 25 bp, Rattus norvegicus
gtttcgtgatctagaaagccctcgg

SEQ ID NO: 532775 - DNA, 25 bp, Rattus norvegicus
gtttcgtgatcttgaaagccctcgg

SEQ ID NO: 532776 - DNA, 25 bp, Rattus norvegicus
gtttcgtgccacattgttcttactt

SEQ ID NO: 532777 - DNA, 25 bp, Rattus norvegicus
gtttcgtgccactttgttcttactt

SEQ ID NO: 532778 - DNA, 25 bp, Rattus norvegicus
gtttcgtgtatcatacagacatgta

SEQ ID NO: 532779 - DNA, 25 bp, Rattus norvegicus
gtttcgtgtatcttacagacatgta

SEQ ID NO: 532780 - DNA, 25 bp, Rattus norvegicus
gtttcgtgtctcagatttcttttgt

SEQ ID NO: 532781 - DNA, 25 bp, Rattus norvegicus
gtttcgtgtctctgatttcttttgt

SEQ ID NO: 532782 - DNA, 25 bp, Rattus norvegicus
gtttcgttattgaggttggactggc

SEQ ID NO: 532783 - DNA, 25 bp, Rattus norvegicus
gtttcgttattgtggttggactggc

SEQ ID NO: 532784 - DNA, 25 bp, Rattus norvegicus
gtttcgttcattcatttcctttcca

SEQ ID NO: 532785 - DNA, 25 bp, Rattus norvegicus
gtttcgttcattgatttcctttcca

SEQ ID NO: 532786 - DNA, 25 bp, Rattus norvegicus
gtttcgttcgatcagactgggcctt

SEQ ID NO: 532787 - DNA, 25 bp, Rattus norvegicus
gtttcgttcgatgagactgggcctt

SEQ ID NO: 532788 - DNA, 25 bp, Rattus norvegicus
gtttcgttgcacaaactgctggttt

SEQ ID NO: 532789 - DNA, 25 bp, Rattus norvegicus
gtttcgttgcactaactgctggttt

SEQ ID NO: 532790 - DNA, 25 bp, Rattus norvegicus
gtttcgtttcgcatttgtagcgcag

SEQ ID NO: 532791 - DNA, 25 bp, Rattus norvegicus
gtttcgtttcgcttttgtagcgcag

SEQ ID NO: 532792 - DNA, 25 bp, Rattus norvegicus
gtttctaaaactccttgcactgccc

SEQ ID NO: 532793 - DNA, 25 bp, Rattus norvegicus
gtttctaaaactgcttgcactgccc

SEQ ID NO: 532794 - DNA, 25 bp, Rattus norvegicus
gtttctaaacctaacaggtctctgg

SEQ ID NO: 532795 - DNA, 25 bp, Rattus norvegicus
gtttctaaacctctgggtgtgtcca

SEQ ID NO: 532796 - DNA, 25 bp, Rattus norvegicus
gtttctaaacctgtgggtgtgtcca

SEQ ID NO: 532797 - DNA, 25 bp, Rattus norvegicus
gtttctaaaccttacaggtctctgg

SEQ ID NO: 532798 - DNA, 25 bp, Rattus norvegicus
gtttctaaacttctcattgccaagt

SEQ ID NO: 532799 - DNA, 25 bp, Rattus norvegicus
gtttctaaacttgtcattgccaagt

SEQ ID NO: 532800 - DNA, 25 bp, Rattus norvegicus
gtttctaacagacgcggacaccaaa

SEQ ID NO: 532801 - DNA, 25 bp, Rattus norvegicus
gtttctaacagaggcggacaccaaa

SEQ ID NO: 532802 - DNA, 25 bp, Rattus norvegicus
gtttctaaccatctccaggacattg

SEQ ID NO: 532803 - DNA, 25 bp, Rattus norvegicus
gtttctaaccatgtccaggacattg

SEQ ID NO: 532804 - DNA, 25 bp, Rattus norvegicus
gtttctaaccttctgagaggctcta

SEQ ID NO: 532805 - DNA, 25 bp, Rattus norvegicus
gtttctaaccttgtgagaggctcta

SEQ ID NO: 532806 - DNA, 25 bp, Rattus norvegicus
gtttctaacgcgcaagcagttctgt

SEQ ID NO: 532807 - DNA, 25 bp, Rattus norvegicus
gtttctaacgcggaagcagttctgt

SEQ ID NO: 532808 - DNA, 25 bp, Rattus norvegicus
gtttctaagaacataactgcagtct

SEQ ID NO: 532809 - DNA, 25 bp, Rattus norvegicus
gtttctaagaacttaactgcagtct

SEQ ID NO: 532810 - DNA, 25 bp, Rattus norvegicus
gtttctaagcaacggcccagcgata

SEQ ID NO: 532811 - DNA, 25 bp, Rattus norvegicus
gtttctaagcaagggcccagcgata

SEQ ID NO: 532812 - DNA, 25 bp, Rattus norvegicus
gtttctaaggtcctgttcatttctc

SEQ ID NO: 532813 - DNA, 25 bp, Rattus norvegicus
gtttctaaggtcgtgttcatttctc

SEQ ID NO: 532814 - DNA, 25 bp, Rattus norvegicus
gtttctaagtttcagtgctcacagc

SEQ ID NO: 532815 - DNA, 25 bp, Rattus norvegicus
gtttctaagtttgagtgctcacagc

SEQ ID NO: 532816 - DNA, 25 bp, Rattus norvegicus
gtttctaatacactttctgtctgtg

SEQ ID NO: 532817 - DNA, 25 bp, Rattus norvegicus
gtttctaatacagtttctgtctgtg

SEQ ID NO: 532818 - DNA, 25 bp, Rattus norvegicus
gtttctaatccccttttgcttatga

SEQ ID NO: 532819 - DNA, 25 bp, Rattus norvegicus
gtttctaatcccgttttgcttatga

SEQ ID NO: 532820 - DNA, 25 bp, Rattus norvegicus
gtttctaatgctaagactcagtctg

SEQ ID NO: 532821 - DNA, 25 bp, Rattus norvegicus
gtttctaatgcttagactcagtctg

SEQ ID NO: 532822 - DNA, 25 bp, Rattus norvegicus
gtttctacagaactgcccttgtcta

SEQ ID NO: 532823 - DNA, 25 bp, Rattus norvegicus
gtttctacagaagtgcccttgtcta

SEQ ID NO: 532824 - DNA, 25 bp, Rattus norvegicus
gtttctacagttagcagcgcagtgg

SEQ ID NO: 532825 - DNA, 25 bp, Rattus norvegicus
gtttctacagttatcctattgcacg

SEQ ID NO: 532826 - DNA, 25 bp, Rattus norvegicus
gtttctacagtttgcagcgcagtgg

SEQ ID NO: 532827 - DNA, 25 bp, Rattus norvegicus
gtttctacagttttcctattgcacg

SEQ ID NO: 532828 - DNA, 25 bp, Rattus norvegicus
gtttctaccctgaagtccaatggga

SEQ ID NO: 532829 - DNA, 25 bp, Rattus norvegicus
gtttctaccctgtagtccaatggga

SEQ ID NO: 532830 - DNA, 25 bp, Rattus norvegicus
gtttctacctcaagctacaggatga

SEQ ID NO: 532831 - DNA, 25 bp, Rattus norvegicus
gtttctacctcatgctacaggatga

SEQ ID NO: 532832 - DNA, 25 bp, Rattus norvegicus
gtttctacctctacccaggacatta

SEQ ID NO: 532833 - DNA, 25 bp, Rattus norvegicus
gtttctacctcttcccaggacatta

SEQ ID NO: 532834 - DNA, 25 bp, Rattus norvegicus
gtttctaccttcaagcagacagaca

SEQ ID NO: 532835 - DNA, 25 bp, Rattus norvegicus
gtttctaccttctagcagacagaca

SEQ ID NO: 532836 - DNA, 25 bp, Rattus norvegicus
gtttctactcacaagatccagggct

SEQ ID NO: 532837 - DNA, 25 bp, Rattus norvegicus
gtttctactcactagatccagggct

SEQ ID NO: 532838 - DNA, 25 bp, Rattus norvegicus
gtttctactgatcatcttcctggat

SEQ ID NO: 532839 - DNA, 25 bp, Rattus norvegicus
gtttctactgatgatcttcctggat

SEQ ID NO: 532840 - DNA, 25 bp, Rattus norvegicus
gtttctactgggaattcattttctt

SEQ ID NO: 532841 - DNA, 25 bp, Rattus norvegicus
gtttctactgggtattcattttctt

SEQ ID NO: 532842 - DNA, 25 bp, Rattus norvegicus
gtttctactgtcacaataactggat

SEQ ID NO: 532843 - DNA, 25 bp, Rattus norvegicus
gtttctactgtctcaataactggat

SEQ ID NO: 532844 - DNA, 25 bp, Rattus norvegicus
gtttctacttagattaggcggactg

SEQ ID NO: 532845 - DNA, 25 bp, Rattus norvegicus
gtttctacttagtttaggcggactg

SEQ ID NO: 532846 - DNA, 25 bp, Rattus norvegicus
gtttctagaactcccgctcagctta

SEQ ID NO: 532847 - DNA, 25 bp, Rattus norvegicus
gtttctagaactgccgctcagctta

SEQ ID NO: 532848 - DNA, 25 bp, Rattus norvegicus
gtttctagacatacaacgtttggag

SEQ ID NO: 532849 - DNA, 25 bp, Rattus norvegicus
gtttctagacattcaacgtttggag

SEQ ID NO: 532850 - DNA, 25 bp, Rattus norvegicus
gtttctagacctactttacctcaga

SEQ ID NO: 532851 - DNA, 25 bp, Rattus norvegicus
gtttctagaccttctttacctcaga

SEQ ID NO: 532852 - DNA, 25 bp, Rattus norvegicus
gtttctagactacagcagccaagga

SEQ ID NO: 532853 - DNA, 25 bp, Rattus norvegicus
gtttctagactagagcagccaagga

SEQ ID NO: 532854 - DNA, 25 bp, Rattus norvegicus
gtttctagagacagcaggaccttct

SEQ ID NO: 532855 - DNA, 25 bp, Rattus norvegicus
gtttctagagactgcaggaccttct

SEQ ID NO: 532856 - DNA, 25 bp, Rattus norvegicus
gtttctagagagactttgctgggca

SEQ ID NO: 532857 - DNA, 25 bp, Rattus norvegicus
gtttctagagagtctttgctgggca

SEQ ID NO: 532858 - DNA, 25 bp, Rattus norvegicus
gtttctagagttagctttgggtcga

SEQ ID NO: 532859 - DNA, 25 bp, Rattus norvegicus
gtttctagagtttgctttgggtcga

SEQ ID NO: 532860 - DNA, 25 bp, Rattus norvegicus
gtttctagcaaacctggcttctgga

SEQ ID NO: 532861 - DNA, 25 bp, Rattus norvegicus
gtttctagcaaagctggcttctgga

SEQ ID NO: 532862 - DNA, 25 bp, Rattus norvegicus
gtttctagcactcgtgtcaggctgc

SEQ ID NO: 532863 - DNA, 25 bp, Rattus norvegicus
gtttctagcactggtgtcaggctgc

SEQ ID NO: 532864 - DNA, 25 bp, Rattus norvegicus
gtttctagccacacctgttgacagt

SEQ ID NO: 532865 - DNA, 25 bp, Rattus norvegicus
gtttctagccactcctgttgacagt

SEQ ID NO: 532866 - DNA, 25 bp, Rattus norvegicus
gtttctagccagaggatttccttct

SEQ ID NO: 532867 - DNA, 25 bp, Rattus norvegicus
gtttctagccagtggatttccttct

SEQ ID NO: 532868 - DNA, 25 bp, Rattus norvegicus
gtttctagcggaattatatgggttc

SEQ ID NO: 532869 - DNA, 25 bp, Rattus norvegicus
gtttctagcggatttatatgggttc

SEQ ID NO: 532870 - DNA, 25 bp, Rattus norvegicus
gtttctaggtgtctgctgcgataaa

SEQ ID NO: 532871 - DNA, 25 bp, Rattus norvegicus
gtttctaggtgtgtgctgcgataaa

SEQ ID NO: 532872 - DNA, 25 bp, Rattus norvegicus
gtttctagtcagatcttcaaagggt

SEQ ID NO: 532873 - DNA, 25 bp, Rattus norvegicus
gtttctagtcagttcttcaaagggt

SEQ ID NO: 532874 - DNA, 25 bp, Rattus norvegicus
gtttctagtcccatcttcaatgtca

SEQ ID NO: 532875 - DNA, 25 bp, Rattus norvegicus
gtttctagtcccttcttcaatgtca

SEQ ID NO: 532876 - DNA, 25 bp, Rattus norvegicus
gtttctagtctcagccagtatggaa

SEQ ID NO: 532877 - DNA, 25 bp, Rattus norvegicus
gtttctagtctctgccagtatggaa

SEQ ID NO: 532878 - DNA, 25 bp, Rattus norvegicus
gtttctagtcttctttgggtcgact

SEQ ID NO: 532879 - DNA, 25 bp, Rattus norvegicus
gtttctagtcttgtttgggtcgact

SEQ ID NO: 532880 - DNA, 25 bp, Rattus norvegicus
gtttctagtttcagacccacggtag

SEQ ID NO: 532881 - DNA, 25 bp, Rattus norvegicus
gtttctagtttctgacccacggtag

SEQ ID NO: 532882 - DNA, 25 bp, Rattus norvegicus
gtttctataggtagctgcacacggt

SEQ ID NO: 532883 - DNA, 25 bp, Rattus norvegicus
gtttctataggttgctgcacacggt

SEQ ID NO: 532884 - DNA, 25 bp, Rattus norvegicus
gtttctatattgagcttccaccatc

SEQ ID NO: 532885 - DNA, 25 bp, Rattus norvegicus
gtttctatattgtgcttccaccatc

SEQ ID NO: 532886 - DNA, 25 bp, Rattus norvegicus
gtttctatcacacatgcgcatgggt

SEQ ID NO: 532887 - DNA, 25 bp, Rattus norvegicus
gtttctatcacagatgcgcatgggt

SEQ ID NO: 532888 - DNA, 25 bp, Rattus norvegicus
gtttctatcagtatcgtttttgcag

SEQ ID NO: 532889 - DNA, 25 bp, Rattus norvegicus
gtttctatcagtttcgtttttgcag

SEQ ID NO: 532890 - DNA, 25 bp, Rattus norvegicus
gtttctatccagcactttcttaagt

SEQ ID NO: 532891 - DNA, 25 bp, Rattus norvegicus
gtttctatccaggactttcttaagt

SEQ ID NO: 532892 - DNA, 25 bp, Rattus norvegicus
gtttctatcgctacattttcttttc

SEQ ID NO: 532893 - DNA, 25 bp, Rattus norvegicus
gtttctatcgcttcattttcttttc

SEQ ID NO: 532894 - DNA, 25 bp, Rattus norvegicus
gtttctatgaccattcagactctga

SEQ ID NO: 532895 - DNA, 25 bp, Rattus norvegicus
gtttctatgacctttcagactctga

SEQ ID NO: 532896 - DNA, 25 bp, Rattus norvegicus
gtttctatggatagcctgttctcta

SEQ ID NO: 532897 - DNA, 25 bp, Rattus norvegicus
gtttctatggattgcctgttctcta

SEQ ID NO: 532898 - DNA, 25 bp, Rattus norvegicus
gtttctatggcaaccttagtgctca

SEQ ID NO: 532899 - DNA, 25 bp, Rattus norvegicus
gtttctatggcaactggttattctt

SEQ ID NO: 532900 - DNA, 25 bp, Rattus norvegicus
gtttctatggcatccttagtgctca

SEQ ID NO: 532901 - DNA, 25 bp, Rattus norvegicus
gtttctatggcatctggttattctt

SEQ ID NO: 532902 - DNA, 25 bp, Rattus norvegicus
gtttctatgtcaacttatgcctagg

SEQ ID NO: 532903 - DNA, 25 bp, Rattus norvegicus
gtttctatgtcatcttatgcctagg

SEQ ID NO: 532904 - DNA, 25 bp, Rattus norvegicus
gtttctattactcttctggttccag

SEQ ID NO: 532905 - DNA, 25 bp, Rattus norvegicus
gtttctattactgttctggttccag

SEQ ID NO: 532906 - DNA, 25 bp, Rattus norvegicus
gtttctattcttcttggtcaccatc

SEQ ID NO: 532907 - DNA, 25 bp, Rattus norvegicus
gtttctattcttgttggtcaccatc

SEQ ID NO: 532908 - DNA, 25 bp, Rattus norvegicus
gtttctattgacctttgagtttcta

SEQ ID NO: 532909 - DNA, 25 bp, Rattus norvegicus
gtttctattgacgtttgagtttcta

SEQ ID NO: 532910 - DNA, 25 bp, Rattus norvegicus
gtttctattgggaaccactgccata

SEQ ID NO: 532911 - DNA, 25 bp, Rattus norvegicus
gtttctattgggtaccactgccata

SEQ ID NO: 532912 - DNA, 25 bp, Rattus norvegicus
gtttctcaaggtatgacgctttcct

SEQ ID NO: 532913 - DNA, 25 bp, Rattus norvegicus
gtttctcaaggtttgacgctttcct

SEQ ID NO: 532914 - DNA, 25 bp, Rattus norvegicus
gtttctcaatccatgggacatatga

SEQ ID NO: 532915 - DNA, 25 bp, Rattus norvegicus
gtttctcaatccttgggacatatga

SEQ ID NO: 532916 - DNA, 25 bp, Rattus norvegicus
gtttctcacaaacgcccaagcaggg

SEQ ID NO: 532917 - DNA, 25 bp, Rattus norvegicus
gtttctcacaaaggcccaagcaggg

SEQ ID NO: 532918 - DNA, 25 bp, Rattus norvegicus
gtttctcaccctatggtatggttat

SEQ ID NO: 532919 - DNA, 25 bp, Rattus norvegicus
gtttctcaccctttggtatggttat

SEQ ID NO: 532920 - DNA, 25 bp, Rattus norvegicus
gtttctcactttatgcttcactgaa

SEQ ID NO: 532921 - DNA, 25 bp, Rattus norvegicus
gtttctcactttttgcttcactgaa

SEQ ID NO: 532922 - DNA, 25 bp, Rattus norvegicus
gtttctcagaaaaattgacctacct

SEQ ID NO: 532923 - DNA, 25 bp, Rattus norvegicus
gtttctcagaaatattgacctacct

SEQ ID NO: 532924 - DNA, 25 bp, Rattus norvegicus
gtttctcagacaccatacaatgcga

SEQ ID NO: 532925 - DNA, 25 bp, Rattus norvegicus
gtttctcagacagcatacaatgcga

SEQ ID NO: 532926 - DNA, 25 bp, Rattus norvegicus
gtttctcagagacaccatgggtatc

SEQ ID NO: 532927 - DNA, 25 bp, Rattus norvegicus
gtttctcagagagaccatgggtatc

SEQ ID NO: 532928 - DNA, 25 bp, Rattus norvegicus
gtttctcagcaaagcattggtcatg

SEQ ID NO: 532929 - DNA, 25 bp, Rattus norvegicus
gtttctcagcaaaggaataccttat

SEQ ID NO: 532930 - DNA, 25 bp, Rattus norvegicus
gtttctcagcaatgcattggtcatg

SEQ ID NO: 532931 - DNA, 25 bp, Rattus norvegicus
gtttctcagcaatggaataccttat

SEQ ID NO: 532932 - DNA, 25 bp, Rattus norvegicus
gtttctcagcacatcgcaggcgtca

SEQ ID NO: 532933 - DNA, 25 bp, Rattus norvegicus
gtttctcagcacttcgcaggcgtca

SEQ ID NO: 532934 - DNA, 25 bp, Rattus norvegicus
gtttctcagtccaacagagcaggca

SEQ ID NO: 532935 - DNA, 25 bp, Rattus norvegicus
gtttctcagtcctacagagcaggca

SEQ ID NO: 532936 - DNA, 25 bp, Rattus norvegicus
gtttctcatccaagcggcagtcgtt

SEQ ID NO: 532937 - DNA, 25 bp, Rattus norvegicus
gtttctcatccatgcggcagtcgtt

SEQ ID NO: 532938 - DNA, 25 bp, Rattus norvegicus
gtttctcatgaacggtctgttcgta

SEQ ID NO: 532939 - DNA, 25 bp, Rattus norvegicus
gtttctcatgaactcatccacttcc

SEQ ID NO: 532940 - DNA, 25 bp, Rattus norvegicus
gtttctcatgaagggtctgttcgta

SEQ ID NO: 532941 - DNA, 25 bp, Rattus norvegicus
gtttctcatgaagtcatccacttcc

SEQ ID NO: 532942 - DNA, 25 bp, Rattus norvegicus
gtttctcatgacatatttccctttg

SEQ ID NO: 532943 - DNA, 25 bp, Rattus norvegicus
gtttctcatgacttatttccctttg

SEQ ID NO: 532944 - DNA, 25 bp, Rattus norvegicus
gtttctcatgtaacagtcctcaacc

SEQ ID NO: 532945 - DNA, 25 bp, Rattus norvegicus
gtttctcatgtatcagtcctcaacc

SEQ ID NO: 532946 - DNA, 25 bp, Rattus norvegicus
gtttctccaacacacttaagaaatg

SEQ ID NO: 532947 - DNA, 25 bp, Rattus norvegicus
gtttctccaacagacttaagaaatg

SEQ ID NO: 532948 - DNA, 25 bp, Rattus norvegicus
gtttctccacacaaacttccaaggg

SEQ ID NO: 532949 - DNA, 25 bp, Rattus norvegicus
gtttctccacactaacttccaaggg

SEQ ID NO: 532950 - DNA, 25 bp, Rattus norvegicus
gtttctccaggtacagggaactcta

SEQ ID NO: 532951 - DNA, 25 bp, Rattus norvegicus
gtttctccaggttcagggaactcta

SEQ ID NO: 532952 - DNA, 25 bp, Rattus norvegicus
gtttctccagtgcacaccttaaagt

SEQ ID NO: 532953 - DNA, 25 bp, Rattus norvegicus
gtttctccagtggacaccttaaagt

SEQ ID NO: 532954 - DNA, 25 bp, Rattus norvegicus
gtttctcccaaaatcttatgcttct

SEQ ID NO: 532955 - DNA, 25 bp, Rattus norvegicus
gtttctcccaaattcttatgcttct

SEQ ID NO: 532956 - DNA, 25 bp, Rattus norvegicus
gtttctcccctgatgcagacagaag

SEQ ID NO: 532957 - DNA, 25 bp, Rattus norvegicus
gtttctcccctgttgcagacagaag

SEQ ID NO: 532958 - DNA, 25 bp, Rattus norvegicus
gtttctcccgggaaagattactgca

SEQ ID NO: 532959 - DNA, 25 bp, Rattus norvegicus
gtttctcccgggtaagattactgca

SEQ ID NO: 532960 - DNA, 25 bp, Rattus norvegicus
gtttctccctctcatcggagagtaa

SEQ ID NO: 532961 - DNA, 25 bp, Rattus norvegicus
gtttctccctctgatcggagagtaa

SEQ ID NO: 532962 - DNA, 25 bp, Rattus norvegicus
gtttctcccttgagagtactttcca

SEQ ID NO: 532963 - DNA, 25 bp, Rattus norvegicus
gtttctcccttgcagaggtaaccag

SEQ ID NO: 532964 - DNA, 25 bp, Rattus norvegicus
gtttctcccttggagaggtaaccag

SEQ ID NO: 532965 - DNA, 25 bp, Rattus norvegicus
gtttctcccttgtgagtactttcca

SEQ ID NO: 532966 - DNA, 25 bp, Rattus norvegicus
gtttctcctagtcccctgtaaatag

SEQ ID NO: 532967 - DNA, 25 bp, Rattus norvegicus
gtttctcctagtgccctgtaaatag

SEQ ID NO: 532968 - DNA, 25 bp, Rattus norvegicus
gtttctcctcttaacgaaagcttca

SEQ ID NO: 532969 - DNA, 25 bp, Rattus norvegicus
gtttctcctctttacgaaagcttca

SEQ ID NO: 532970 - DNA, 25 bp, Rattus norvegicus
gtttctcctgaaatgttaccagcct

SEQ ID NO: 532971 - DNA, 25 bp, Rattus norvegicus
gtttctcctgaattgttaccagcct

SEQ ID NO: 532972 - DNA, 25 bp, Rattus norvegicus
gtttctcctgagagcctaaaggctt

SEQ ID NO: 532973 - DNA, 25 bp, Rattus norvegicus
gtttctcctgagtgcctaaaggctt

SEQ ID NO: 532974 - DNA, 25 bp, Rattus norvegicus
gtttctcctgcacatatcacatatg

SEQ ID NO: 532975 - DNA, 25 bp, Rattus norvegicus
gtttctcctgcagatatcacatatg

SEQ ID NO: 532976 - DNA, 25 bp, Rattus norvegicus
gtttctcctgcgaatagtacacgag

SEQ ID NO: 532977 - DNA, 25 bp, Rattus norvegicus
gtttctcctgcgtatagtacacgag

SEQ ID NO: 532978 - DNA, 25 bp, Rattus norvegicus
gtttctcctgctatgaggttgttca

SEQ ID NO: 532979 - DNA, 25 bp, Rattus norvegicus
gtttctcctgctttgaggttgttca

SEQ ID NO: 532980 - DNA, 25 bp, Rattus norvegicus
gtttctcctgtgcatatttccccag

SEQ ID NO: 532981 - DNA, 25 bp, Rattus norvegicus
gtttctcctgtggatatttccccag

SEQ ID NO: 532982 - DNA, 25 bp, Rattus norvegicus
gtttctccttcaactccaaaagcag

SEQ ID NO: 532983 - DNA, 25 bp, Rattus norvegicus
gtttctccttcatctccaaaagcag

SEQ ID NO: 532984 - DNA, 25 bp, Rattus norvegicus
gtttctccttccaagaagaatccca

SEQ ID NO: 532985 - DNA, 25 bp, Rattus norvegicus
gtttctccttcctagaagaatccca

SEQ ID NO: 532986 - DNA, 25 bp, Rattus norvegicus
gtttctcctttcacactgataacta

SEQ ID NO: 532987 - DNA, 25 bp, Rattus norvegicus
gtttctcctttcatctagtcatcaa

SEQ ID NO: 532988 - DNA, 25 bp, Rattus norvegicus
gtttctcctttctcactgataacta

SEQ ID NO: 532989 - DNA, 25 bp, Rattus norvegicus
gtttctcctttcttctagtcatcaa

SEQ ID NO: 532990 - DNA, 25 bp, Rattus norvegicus
gtttctcgaactcagaggatcctgc

SEQ ID NO: 532991 - DNA, 25 bp, Rattus norvegicus
gtttctcgaactgagaggatcctgc

SEQ ID NO: 532992 - DNA, 25 bp, Rattus norvegicus
gtttctcgatatatttcttattgga

SEQ ID NO: 532993 - DNA, 25 bp, Rattus norvegicus
gtttctcgatatttttcttattgga

SEQ ID NO: 532994 - DNA, 25 bp, Rattus norvegicus
gtttctcgtatccatgcgcacacgt

SEQ ID NO: 532995 - DNA, 25 bp, Rattus norvegicus
gtttctcgtatcgatgcgcacacgt

SEQ ID NO: 532996 - DNA, 25 bp, Rattus norvegicus
gtttctctacaaagattgctgtgca

SEQ ID NO: 532997 - DNA, 25 bp, Rattus norvegicus
gtttctctacaatgattgctgtgca

SEQ ID NO: 532998 - DNA, 25 bp, Rattus norvegicus
gtttctctagccatgagttgtctga

SEQ ID NO: 532999 - DNA, 25 bp, Rattus norvegicus
gtttctctagccttgagttgtctga

SEQ ID NO: 533000 - DNA, 25 bp, Rattus norvegicus
gtttctctagcgcttttggccttgc

SEQ ID NO: 533001 - DNA, 25 bp, Rattus norvegicus
gtttctctagcggttttggccttgc

SEQ ID NO: 533002 - DNA, 25 bp, Rattus norvegicus
gtttctctatgtctgctaggagctt

SEQ ID NO: 533003 - DNA, 25 bp, Rattus norvegicus
gtttctctatgtgtgctaggagctt

SEQ ID NO: 533004 - DNA, 25 bp, Rattus norvegicus
gtttctctatttacatccctacaga

SEQ ID NO: 533005 - DNA, 25 bp, Rattus norvegicus
gtttctctattttcatccctacaga

SEQ ID NO: 533006 - DNA, 25 bp, Rattus norvegicus
gtttctctcactagtccagtgctga

SEQ ID NO: 533007 - DNA, 25 bp, Rattus norvegicus
gtttctctcacttgtccagtgctga

SEQ ID NO: 533008 - DNA, 25 bp, Rattus norvegicus
gtttctctcagactactttatcaca

SEQ ID NO: 533009 - DNA, 25 bp, Rattus norvegicus
gtttctctcagagtactttatcaca

SEQ ID NO: 533010 - DNA, 25 bp, Rattus norvegicus
gtttctctcagcaagcatttagcac

SEQ ID NO: 533011 - DNA, 25 bp, Rattus norvegicus
gtttctctcagctagcatttagcac

SEQ ID NO: 533012 - DNA, 25 bp, Rattus norvegicus
gtttctctccaacttgcgatatact

SEQ ID NO: 533013 - DNA, 25 bp, Rattus norvegicus
gtttctctccaagttgcgatatact

SEQ ID NO: 533014 - DNA, 25 bp, Rattus norvegicus
gtttctctcccaacgctgaagcggt

SEQ ID NO: 533015 - DNA, 25 bp, Rattus norvegicus
gtttctctcccatcgctgaagcggt

SEQ ID NO: 533016 - DNA, 25 bp, Rattus norvegicus
gtttctctcgaaagcagttgtccca

SEQ ID NO: 533017 - DNA, 25 bp, Rattus norvegicus
gtttctctcgaatgcagttgtccca

SEQ ID NO: 533018 - DNA, 25 bp, Rattus norvegicus
gtttctctctcccagtaagaagcag

SEQ ID NO: 533019 - DNA, 25 bp, Rattus norvegicus
gtttctctctccgagtaagaagcag

SEQ ID NO: 533020 - DNA, 25 bp, Rattus norvegicus
gtttctctctttaaacttctggcaa

SEQ ID NO: 533021 - DNA, 25 bp, Rattus norvegicus
gtttctctcttttaacttctggcaa

SEQ ID NO: 533022 - DNA, 25 bp, Rattus norvegicus
gtttctctgaaacaccatcattgct

SEQ ID NO: 533023 - DNA, 25 bp, Rattus norvegicus
gtttctctgaaagaccatcattgct

SEQ ID NO: 533024 - DNA, 25 bp, Rattus norvegicus
gtttctctgaagaaccagtttcctc

SEQ ID NO: 533025 - DNA, 25 bp, Rattus norvegicus
gtttctctgaagacatgggtagtgc

SEQ ID NO: 533026 - DNA, 25 bp, Rattus norvegicus
gtttctctgaagtaccagtttcctc

SEQ ID NO: 533027 - DNA, 25 bp, Rattus norvegicus
gtttctctgaagtcatgggtagtgc

SEQ ID NO: 533028 - DNA, 25 bp, Rattus norvegicus
gtttctctgctcagacagttgacga

SEQ ID NO: 533029 - DNA, 25 bp, Rattus norvegicus
gtttctctgctctgacagttgacga

SEQ ID NO: 533030 - DNA, 25 bp, Rattus norvegicus
gtttctctggagactgtcacagttt

SEQ ID NO: 533031 - DNA, 25 bp, Rattus norvegicus
gtttctctggagtctgtcacagttt

SEQ ID NO: 533032 - DNA, 25 bp, Rattus norvegicus
gtttctctggctcagattcctagaa

SEQ ID NO: 533033 - DNA, 25 bp, Rattus norvegicus
gtttctctggctgagattcctagaa

SEQ ID NO: 533034 - DNA, 25 bp, Rattus norvegicus
gtttctctgggaatcactgactggt

SEQ ID NO: 533035 - DNA, 25 bp, Rattus norvegicus
gtttctctgggattcactgactggt

SEQ ID NO: 533036 - DNA, 25 bp, Rattus norvegicus
gtttctctggtaaatggcttctggg

SEQ ID NO: 533037 - DNA, 25 bp, Rattus norvegicus
gtttctctggtatatggcttctggg

SEQ ID NO: 533038 - DNA, 25 bp, Rattus norvegicus
gtttctctggtgcttacttattcca

SEQ ID NO: 533039 - DNA, 25 bp, Rattus norvegicus
gtttctctggtggttacttattcca

SEQ ID NO: 533040 - DNA, 25 bp, Rattus norvegicus
gtttctcttccaagaccatagactt

SEQ ID NO: 533041 - DNA, 25 bp, Rattus norvegicus
gtttctcttccatgaccatagactt

SEQ ID NO: 533042 - DNA, 25 bp, Rattus norvegicus
gtttctcttcctaagttttatcacg

SEQ ID NO: 533043 - DNA, 25 bp, Rattus norvegicus
gtttctcttccttagttttatcacg

SEQ ID NO: 533044 - DNA, 25 bp, Rattus norvegicus
gtttctcttctgaggactgctgtgt

SEQ ID NO: 533045 - DNA, 25 bp, Rattus norvegicus
gtttctcttctgtggactgctgtgt

SEQ ID NO: 533046 - DNA, 25 bp, Rattus norvegicus
gtttctcttcttatcgtgagcaatt

SEQ ID NO: 533047 - DNA, 25 bp, Rattus norvegicus
gtttctcttcttttcgtgagcaatt

SEQ ID NO: 533048 - DNA, 25 bp, Rattus norvegicus
gtttctcttgaaaactttctgccca

SEQ ID NO: 533049 - DNA, 25 bp, Rattus norvegicus
gtttctcttgaactctgtcctaagt

SEQ ID NO: 533050 - DNA, 25 bp, Rattus norvegicus
gtttctcttgaagtctgtcctaagt

SEQ ID NO: 533051 - DNA, 25 bp, Rattus norvegicus
gtttctcttgaatactttctgccca

SEQ ID NO: 533052 - DNA, 25 bp, Rattus norvegicus
gtttctcttgtcctctcaagttaat

SEQ ID NO: 533053 - DNA, 25 bp, Rattus norvegicus
gtttctcttgtcgtctcaagttaat

SEQ ID NO: 533054 - DNA, 25 bp, Rattus norvegicus
gtttctcttgttaatggttattatc

SEQ ID NO: 533055 - DNA, 25 bp, Rattus norvegicus
gtttctcttgtttatggttattatc

SEQ ID NO: 533056 - DNA, 25 bp, Rattus norvegicus
gtttctctttataccagagccatgg

SEQ ID NO: 533057 - DNA, 25 bp, Rattus norvegicus
gtttctctttattccagagccatgg

SEQ ID NO: 533058 - DNA, 25 bp, Rattus norvegicus
gtttctgaaaacactcacacacctt

SEQ ID NO: 533059 - DNA, 25 bp, Rattus norvegicus
gtttctgaaaactctcacacacctt

SEQ ID NO: 533060 - DNA, 25 bp, Rattus norvegicus
gtttctgaaagacaccccactgtga

SEQ ID NO: 533061 - DNA, 25 bp, Rattus norvegicus
gtttctgaaagagaccccactgtga

SEQ ID NO: 533062 - DNA, 25 bp, Rattus norvegicus
gtttctgaacacagagagcctacta

SEQ ID NO: 533063 - DNA, 25 bp, Rattus norvegicus
gtttctgaacactgagagcctacta

SEQ ID NO: 533064 - DNA, 25 bp, Rattus norvegicus
gtttctgaacatagagacttttctt

SEQ ID NO: 533065 - DNA, 25 bp, Rattus norvegicus
gtttctgaacattgagacttttctt

SEQ ID NO: 533066 - DNA, 25 bp, Rattus norvegicus
gtttctgaagatcaacacattttta

SEQ ID NO: 533067 - DNA, 25 bp, Rattus norvegicus
gtttctgaagatgaacacattttta

SEQ ID NO: 533068 - DNA, 25 bp, Rattus norvegicus
gtttctgaagctaactgggtattcc

SEQ ID NO: 533069 - DNA, 25 bp, Rattus norvegicus
gtttctgaagctcgagtacttccca

SEQ ID NO: 533070 - DNA, 25 bp, Rattus norvegicus
gtttctgaagctggagtacttccca

SEQ ID NO: 533071 - DNA, 25 bp, Rattus norvegicus
gtttctgaagcttactgggtattcc

SEQ ID NO: 533072 - DNA, 25 bp, Rattus norvegicus
gtttctgaatgaatccctcccaatt

SEQ ID NO: 533073 - DNA, 25 bp, Rattus norvegicus
gtttctgaatgattccctcccaatt

SEQ ID NO: 533074 - DNA, 25 bp, Rattus norvegicus
gtttctgacaggcacgacacagtga

SEQ ID NO: 533075 - DNA, 25 bp, Rattus norvegicus
gtttctgacagggacgacacagtga

SEQ ID NO: 533076 - DNA, 25 bp, Rattus norvegicus
gtttctgacattctcatagtctgta

SEQ ID NO: 533077 - DNA, 25 bp, Rattus norvegicus
gtttctgacattgtcatagtctgta

SEQ ID NO: 533078 - DNA, 25 bp, Rattus norvegicus
gtttctgacccaaactagggctgtg

SEQ ID NO: 533079 - DNA, 25 bp, Rattus norvegicus
gtttctgacccatactagggctgtg

SEQ ID NO: 533080 - DNA, 25 bp, Rattus norvegicus
gtttctgactgtaataagcctggtt

SEQ ID NO: 533081 - DNA, 25 bp, Rattus norvegicus
gtttctgactgttataagcctggtt

SEQ ID NO: 533082 - DNA, 25 bp, Rattus norvegicus
gtttctgagaacatgccaccgtatg

SEQ ID NO: 533083 - DNA, 25 bp, Rattus norvegicus
gtttctgagaacttgccaccgtatg

SEQ ID NO: 533084 - DNA, 25 bp, Rattus norvegicus
gtttctgagaatccatgggttagac

SEQ ID NO: 533085 - DNA, 25 bp, Rattus norvegicus
gtttctgagaatgcatgggttagac

SEQ ID NO: 533086 - DNA, 25 bp, Rattus norvegicus
gtttctgagcagagagaaggtgaac

SEQ ID NO: 533087 - DNA, 25 bp, Rattus norvegicus
gtttctgagcagtgagaaggtgaac

SEQ ID NO: 533088 - DNA, 25 bp, Rattus norvegicus
gtttctgagcatacaaactccgcac

SEQ ID NO: 533089 - DNA, 25 bp, Rattus norvegicus
gtttctgagcattcaaactccgcac

SEQ ID NO: 533090 - DNA, 25 bp, Rattus norvegicus
gtttctgagctcagttctgtgttcc

SEQ ID NO: 533091 - DNA, 25 bp, Rattus norvegicus
gtttctgagctctgttctgtgttcc

SEQ ID NO: 533092 - DNA, 25 bp, Rattus norvegicus
gtttctgagggccacctggtctgca

SEQ ID NO: 533093 - DNA, 25 bp, Rattus norvegicus
gtttctgagggcgacctggtctgca

SEQ ID NO: 533094 - DNA, 25 bp, Rattus norvegicus
gtttctgagtgtacacgttgcgctg

SEQ ID NO: 533095 - DNA, 25 bp, Rattus norvegicus
gtttctgagtgttcacgttgcgctg

SEQ ID NO: 533096 - DNA, 25 bp, Rattus norvegicus
gtttctgatcaaaagctgtgagtgc

SEQ ID NO: 533097 - DNA, 25 bp, Rattus norvegicus
gtttctgatcaatagctgtgagtgc

SEQ ID NO: 533098 - DNA, 25 bp, Rattus norvegicus
gtttctgatctacctctttatggtg

SEQ ID NO: 533099 - DNA, 25 bp, Rattus norvegicus
gtttctgatctagctctttatggtg

SEQ ID NO: 533100 - DNA, 25 bp, Rattus norvegicus
gtttctgatcttcccgagtgctgga

SEQ ID NO: 533101 - DNA, 25 bp, Rattus norvegicus
gtttctgatcttgccgagtgctgga

SEQ ID NO: 533102 - DNA, 25 bp, Rattus norvegicus
gtttctgattatatttatgcccatt

SEQ ID NO: 533103 - DNA, 25 bp, Rattus norvegicus
gtttctgattatttttatgcccatt

SEQ ID NO: 533104 - DNA, 25 bp, Rattus norvegicus
gtttctgcaaacatgattaaggtca

SEQ ID NO: 533105 - DNA, 25 bp, Rattus norvegicus
gtttctgcaaacttgattaaggtca

SEQ ID NO: 533106 - DNA, 25 bp, Rattus norvegicus
gtttctgcaaccaacaacctggaag

SEQ ID NO: 533107 - DNA, 25 bp, Rattus norvegicus
gtttctgcaacctacaacctggaag

SEQ ID NO: 533108 - DNA, 25 bp, Rattus norvegicus
gtttctgcaactattaatgatctta

SEQ ID NO: 533109 - DNA, 25 bp, Rattus norvegicus
gtttctgcaactcctgggcaataaa

SEQ ID NO: 533110 - DNA, 25 bp, Rattus norvegicus
gtttctgcaactgctgggcaataaa

SEQ ID NO: 533111 - DNA, 25 bp, Rattus norvegicus
gtttctgcaacttttaatgatctta

SEQ ID NO: 533112 - DNA, 25 bp, Rattus norvegicus
gtttctgcagccaccttttggaaat

SEQ ID NO: 533113 - DNA, 25 bp, Rattus norvegicus
gtttctgcagcctccttttggaaat

SEQ ID NO: 533114 - DNA, 25 bp, Rattus norvegicus
gtttctgcagctcgtaatattccct

SEQ ID NO: 533115 - DNA, 25 bp, Rattus norvegicus
gtttctgcagctggtaatattccct

SEQ ID NO: 533116 - DNA, 25 bp, Rattus norvegicus
gtttctgcaggacaaaggcctcctc

SEQ ID NO: 533117 - DNA, 25 bp, Rattus norvegicus
gtttctgcaggagaaaggcctcctc

SEQ ID NO: 533118 - DNA, 25 bp, Rattus norvegicus
gtttctgcagtcacctgttcatgtg

SEQ ID NO: 533119 - DNA, 25 bp, Rattus norvegicus
gtttctgcagtctcctgttcatgtg

SEQ ID NO: 533120 - DNA, 25 bp, Rattus norvegicus
gtttctgcagttctcatagcgacca

SEQ ID NO: 533121 - DNA, 25 bp, Rattus norvegicus
gtttctgcagttgtcatagcgacca

SEQ ID NO: 533122 - DNA, 25 bp, Rattus norvegicus
gtttctgcatgacagtgtcccacaa

SEQ ID NO: 533123 - DNA, 25 bp, Rattus norvegicus
gtttctgcatgagagtgtcccacaa

SEQ ID NO: 533124 - DNA, 25 bp, Rattus norvegicus
gtttctgccaaaacctgtatgacca

SEQ ID NO: 533125 - DNA, 25 bp, Rattus norvegicus
gtttctgccaaatcctgtatgacca

SEQ ID NO: 533126 - DNA, 25 bp, Rattus norvegicus
gtttctgccaacatagttctgccag

SEQ ID NO: 533127 - DNA, 25 bp, Rattus norvegicus
gtttctgccaacttagttctgccag

SEQ ID NO: 533128 - DNA, 25 bp, Rattus norvegicus
gtttctgccaccactcacatctggg

SEQ ID NO: 533129 - DNA, 25 bp, Rattus norvegicus
gtttctgccacctctcacatctggg

SEQ ID NO: 533130 - DNA, 25 bp, Rattus norvegicus
gtttctgccaggagtggtgacctga

SEQ ID NO: 533131 - DNA, 25 bp, Rattus norvegicus
gtttctgccaggtgtggtgacctga

SEQ ID NO: 533132 - DNA, 25 bp, Rattus norvegicus
gtttctgccattatctcttggtgac

SEQ ID NO: 533133 - DNA, 25 bp, Rattus norvegicus
gtttctgccattctgattttctaag

SEQ ID NO: 533134 - DNA, 25 bp, Rattus norvegicus
gtttctgccattgtgattttctaag

SEQ ID NO: 533135 - DNA, 25 bp, Rattus norvegicus
gtttctgccattttctcttggtgac

SEQ ID NO: 533136 - DNA, 25 bp, Rattus norvegicus
gtttctgcccatagattggactcag

SEQ ID NO: 533137 - DNA, 25 bp, Rattus norvegicus
gtttctgcccattgattggactcag

SEQ ID NO: 533138 - DNA, 25 bp, Rattus norvegicus
gtttctgccctaatcagaggagtcc

SEQ ID NO: 533139 - DNA, 25 bp, Rattus norvegicus
gtttctgccctattcagaggagtcc

SEQ ID NO: 533140 - DNA, 25 bp, Rattus norvegicus
gtttctgccgtacgatcagtcagat

SEQ ID NO: 533141 - DNA, 25 bp, Rattus norvegicus
gtttctgccgtaggatcagtcagat

SEQ ID NO: 533142 - DNA, 25 bp, Rattus norvegicus
gtttctgcctttaagggtacatgat

SEQ ID NO: 533143 - DNA, 25 bp, Rattus norvegicus
gtttctgccttttagggtacatgat

SEQ ID NO: 533144 - DNA, 25 bp, Rattus norvegicus
gtttctgctatcctggctcagtaga

SEQ ID NO: 533145 - DNA, 25 bp, Rattus norvegicus
gtttctgctatcgtggctcagtaga

SEQ ID NO: 533146 - DNA, 25 bp, Rattus norvegicus
gtttctgctgacctcttgacatgtt

SEQ ID NO: 533147 - DNA, 25 bp, Rattus norvegicus
gtttctgctgacgtcttgacatgtt

SEQ ID NO: 533148 - DNA, 25 bp, Rattus norvegicus
gtttctgctgcaagagtgtagctcg

SEQ ID NO: 533149 - DNA, 25 bp, Rattus norvegicus
gtttctgctgcatgagtgtagctcg

SEQ ID NO: 533150 - DNA, 25 bp, Rattus norvegicus
gtttctgctgtgcttttccctaata

SEQ ID NO: 533151 - DNA, 25 bp, Rattus norvegicus
gtttctgctgtggttttccctaata

SEQ ID NO: 533152 - DNA, 25 bp, Rattus norvegicus
gtttctgctgttcaagattcctgaa

SEQ ID NO: 533153 - DNA, 25 bp, Rattus norvegicus
gtttctgctgttgaagattcctgaa

SEQ ID NO: 533154 - DNA, 25 bp, Rattus norvegicus
gtttctgcttatattttctggagta

SEQ ID NO: 533155 - DNA, 25 bp, Rattus norvegicus
gtttctgcttattttttctggagta

SEQ ID NO: 533156 - DNA, 25 bp, Rattus norvegicus
gtttctggaaacacacctggctatg

SEQ ID NO: 533157 - DNA, 25 bp, Rattus norvegicus
gtttctggaaactcacctggctatg

SEQ ID NO: 533158 - DNA, 25 bp, Rattus norvegicus
gtttctggaacaagactggtcacaa

SEQ ID NO: 533159 - DNA, 25 bp, Rattus norvegicus
gtttctggaacatgactggtcacaa

SEQ ID NO: 533160 - DNA, 25 bp, Rattus norvegicus
gtttctggacttaacaaccttgtga

SEQ ID NO: 533161 - DNA, 25 bp, Rattus norvegicus
gtttctggactttacaaccttgtga

SEQ ID NO: 533162 - DNA, 25 bp, Rattus norvegicus
gtttctggagccatgcaacacatac

SEQ ID NO: 533163 - DNA, 25 bp, Rattus norvegicus
gtttctggagccttgcaacacatac

SEQ ID NO: 533164 - DNA, 25 bp, Rattus norvegicus
gtttctggaggacgcgaaggtcctg

SEQ ID NO: 533165 - DNA, 25 bp, Rattus norvegicus
gtttctggaggaggcgaaggtcctg

SEQ ID NO: 533166 - DNA, 25 bp, Rattus norvegicus
gtttctggatggaggttacttctca

SEQ ID NO: 533167 - DNA, 25 bp, Rattus norvegicus
gtttctggatggtggttacttctca

SEQ ID NO: 533168 - DNA, 25 bp, Rattus norvegicus
gtttctggcagacgtgttttcatac

SEQ ID NO: 533169 - DNA, 25 bp, Rattus norvegicus
gtttctggcagaggtgttttcatac

SEQ ID NO: 533170 - DNA, 25 bp, Rattus norvegicus
gtttctggcatcaacaaatactcgt

SEQ ID NO: 533171 - DNA, 25 bp, Rattus norvegicus
gtttctggcatctacaaatactcgt

SEQ ID NO: 533172 - DNA, 25 bp, Rattus norvegicus
gtttctggcccaaacattgtgtaca

SEQ ID NO: 533173 - DNA, 25 bp, Rattus norvegicus
gtttctggcccatacattgtgtaca

SEQ ID NO: 533174 - DNA, 25 bp, Rattus norvegicus
gtttctggcctactcacaatcaagt

SEQ ID NO: 533175 - DNA, 25 bp, Rattus norvegicus
gtttctggcctagtcacaatcaagt

SEQ ID NO: 533176 - DNA, 25 bp, Rattus norvegicus
gtttctggcttaccttctggtagaa

SEQ ID NO: 533177 - DNA, 25 bp, Rattus norvegicus
gtttctggcttagcttctggtagaa

SEQ ID NO: 533178 - DNA, 25 bp, Rattus norvegicus
gtttctggcttcatatttcttcctt

SEQ ID NO: 533179 - DNA, 25 bp, Rattus norvegicus
gtttctggcttcttatttcttcctt

SEQ ID NO: 533180 - DNA, 25 bp, Rattus norvegicus
gtttctgggagaagctgcagcgcac

SEQ ID NO: 533181 - DNA, 25 bp, Rattus norvegicus
gtttctgggagatgctgcagcgcac

SEQ ID NO: 533182 - DNA, 25 bp, Rattus norvegicus
gtttctgggcaacaattaccttgag

SEQ ID NO: 533183 - DNA, 25 bp, Rattus norvegicus
gtttctgggcaagaattaccttgag

SEQ ID NO: 533184 - DNA, 25 bp, Rattus norvegicus
gtttctgggcttaggagcttttcca

SEQ ID NO: 533185 - DNA, 25 bp, Rattus norvegicus
gtttctgggcttcgctgattgtaaa

SEQ ID NO: 533186 - DNA, 25 bp, Rattus norvegicus
gtttctgggcttggctgattgtaaa

SEQ ID NO: 533187 - DNA, 25 bp, Rattus norvegicus
gtttctgggctttggagcttttcca

SEQ ID NO: 533188 - DNA, 25 bp, Rattus norvegicus
gtttctggtccaatatctggcaact

SEQ ID NO: 533189 - DNA, 25 bp, Rattus norvegicus
gtttctggtccattatctggcaact

SEQ ID NO: 533190 - DNA, 25 bp, Rattus norvegicus
gtttctggtgttctgattctacttg

SEQ ID NO: 533191 - DNA, 25 bp, Rattus norvegicus
gtttctggtgttgtgattctacttg

SEQ ID NO: 533192 - DNA, 25 bp, Rattus norvegicus
gtttctgtaaacctatccaatatgt

SEQ ID NO: 533193 - DNA, 25 bp, Rattus norvegicus
gtttctgtaaacgtatccaatatgt

SEQ ID NO: 533194 - DNA, 25 bp, Rattus norvegicus
gtttctgtaacaccctgagctggac

SEQ ID NO: 533195 - DNA, 25 bp, Rattus norvegicus
gtttctgtaacagcctgagctggac

SEQ ID NO: 533196 - DNA, 25 bp, Rattus norvegicus
gtttctgtaagtctagtttaccata

SEQ ID NO: 533197 - DNA, 25 bp, Rattus norvegicus
gtttctgtaagtgtagtttaccata

SEQ ID NO: 533198 - DNA, 25 bp, Rattus norvegicus
gtttctgtacagaaataagcacgca

SEQ ID NO: 533199 - DNA, 25 bp, Rattus norvegicus
gtttctgtacagtaataagcacgca

SEQ ID NO: 533200 - DNA, 25 bp, Rattus norvegicus
gtttctgtacatatccaggttcctt

SEQ ID NO: 533201 - DNA, 25 bp, Rattus norvegicus
gtttctgtacatttccaggttcctt

SEQ ID NO: 533202 - DNA, 25 bp, Rattus norvegicus
gtttctgtactgactcttctcaaga

SEQ ID NO: 533203 - DNA, 25 bp, Rattus norvegicus
gtttctgtactgtctcttctcaaga

SEQ ID NO: 533204 - DNA, 25 bp, Rattus norvegicus
gtttctgtatacatctaccattgaa

SEQ ID NO: 533205 - DNA, 25 bp, Rattus norvegicus
gtttctgtatacttctaccattgaa

SEQ ID NO: 533206 - DNA, 25 bp, Rattus norvegicus
gtttctgtcatcacacttgcaggat

SEQ ID NO: 533207 - DNA, 25 bp, Rattus norvegicus
gtttctgtcatctcacttgcaggat

SEQ ID NO: 533208 - DNA, 25 bp, Rattus norvegicus
gtttctgtcattactgtatccgcgg

SEQ ID NO: 533209 - DNA, 25 bp, Rattus norvegicus
gtttctgtcatttctgtatccgcgg

SEQ ID NO: 533210 - DNA, 25 bp, Rattus norvegicus
gtttctgtccccagatgtggtgtca

SEQ ID NO: 533211 - DNA, 25 bp, Rattus norvegicus
gtttctgtcccctgatgtggtgtca

SEQ ID NO: 533212 - DNA, 25 bp, Rattus norvegicus
gtttctgtccttacagttgttggca

SEQ ID NO: 533213 - DNA, 25 bp, Rattus norvegicus
gtttctgtcctttcagttgttggca

SEQ ID NO: 533214 - DNA, 25 bp, Rattus norvegicus
gtttctgtcgttctttctattccac

SEQ ID NO: 533215 - DNA, 25 bp, Rattus norvegicus
gtttctgtcgttgtttctattccac

SEQ ID NO: 533216 - DNA, 25 bp, Rattus norvegicus
gtttctgtctaactgtcctcaacat

SEQ ID NO: 533217 - DNA, 25 bp, Rattus norvegicus
gtttctgtctaagtgtcctcaacat

SEQ ID NO: 533218 - DNA, 25 bp, Rattus norvegicus
gtttctgtctccattgaaggccaag

SEQ ID NO: 533219 - DNA, 25 bp, Rattus norvegicus
gtttctgtctcctttgaaggccaag

SEQ ID NO: 533220 - DNA, 25 bp, Rattus norvegicus
gtttctgtcttgagtgtgtgccgcc

SEQ ID NO: 533221 - DNA, 25 bp, Rattus norvegicus
gtttctgtcttgtgtgtgtgccgcc

SEQ ID NO: 533222 - DNA, 25 bp, Rattus norvegicus
gtttctgtgagcacattttgcacat

SEQ ID NO: 533223 - DNA, 25 bp, Rattus norvegicus
gtttctgtgagctcattttgcacat

SEQ ID NO: 533224 - DNA, 25 bp, Rattus norvegicus
gtttctgtgcagattatctactttc

SEQ ID NO: 533225 - DNA, 25 bp, Rattus norvegicus
gtttctgtgcagtttatctactttc

SEQ ID NO: 533226 - DNA, 25 bp, Rattus norvegicus
gtttctgtgggacacctacatcctg

SEQ ID NO: 533227 - DNA, 25 bp, Rattus norvegicus
gtttctgtgggagacctacatcctg

SEQ ID NO: 533228 - DNA, 25 bp, Rattus norvegicus
gtttctgtggttctacaatgccgga

SEQ ID NO: 533229 - DNA, 25 bp, Rattus norvegicus
gtttctgtggttgtacaatgccgga

SEQ ID NO: 533230 - DNA, 25 bp, Rattus norvegicus
gtttctgtgtacacccctgcctgtt

SEQ ID NO: 533231 - DNA, 25 bp, Rattus norvegicus
gtttctgtgtactcccctgcctgtt

SEQ ID NO: 533232 - DNA, 25 bp, Rattus norvegicus
gtttctgttacaatacacctctgta

SEQ ID NO: 533233 - DNA, 25 bp, Rattus norvegicus
gtttctgttacacctacaaggcacg

SEQ ID NO: 533234 - DNA, 25 bp, Rattus norvegicus
gtttctgttacagctacaaggcacg

SEQ ID NO: 533235 - DNA, 25 bp, Rattus norvegicus
gtttctgttacattacacctctgta

SEQ ID NO: 533236 - DNA, 25 bp, Rattus norvegicus
gtttctgttctcacctctgattcag

SEQ ID NO: 533237 - DNA, 25 bp, Rattus norvegicus
gtttctgttctctcctctgattcag

SEQ ID NO: 533238 - DNA, 25 bp, Rattus norvegicus
gtttctgtttctctatgcttagact

SEQ ID NO: 533239 - DNA, 25 bp, Rattus norvegicus
gtttctgtttctgtatgcttagact

SEQ ID NO: 533240 - DNA, 25 bp, Rattus norvegicus
gtttctgttttgctggtgattggtt

SEQ ID NO: 533241 - DNA, 25 bp, Rattus norvegicus
gtttctgttttggtggtgattggtt

SEQ ID NO: 533242 - DNA, 25 bp, Rattus norvegicus
gtttcttaaattctcatcagggtgg

SEQ ID NO: 533243 - DNA, 25 bp, Rattus norvegicus
gtttcttaaattgtcatcagggtgg

SEQ ID NO: 533244 - DNA, 25 bp, Rattus norvegicus
gtttcttaactcaatcgatctccat

SEQ ID NO: 533245 - DNA, 25 bp, Rattus norvegicus
gtttcttaactctatcgatctccat

SEQ ID NO: 533246 - DNA, 25 bp, Rattus norvegicus
gtttcttaagctctggtacttccgc

SEQ ID NO: 533247 - DNA, 25 bp, Rattus norvegicus
gtttcttaagctgtggtacttccgc

SEQ ID NO: 533248 - DNA, 25 bp, Rattus norvegicus
gtttcttaatgtcatccacgtctcc

SEQ ID NO: 533249 - DNA, 25 bp, Rattus norvegicus
gtttcttaatgtgatccacgtctcc

SEQ ID NO: 533250 - DNA, 25 bp, Rattus norvegicus
gtttcttacactatgtgcttcggga

SEQ ID NO: 533251 - DNA, 25 bp, Rattus norvegicus
gtttcttacactttgtgcttcggga

SEQ ID NO: 533252 - DNA, 25 bp, Rattus norvegicus
gtttcttacagaaagctttgtagca

SEQ ID NO: 533253 - DNA, 25 bp, Rattus norvegicus
gtttcttacagatagctttgtagca

SEQ ID NO: 533254 - DNA, 25 bp, Rattus norvegicus
gtttcttacagcacctgaacactta

SEQ ID NO: 533255 - DNA, 25 bp, Rattus norvegicus
gtttcttacagctcctgaacactta

SEQ ID NO: 533256 - DNA, 25 bp, Rattus norvegicus
gtttcttaggaaatgcagcagactc

SEQ ID NO: 533257 - DNA, 25 bp, Rattus norvegicus
gtttcttaggaattgcagcagactc

SEQ ID NO: 533258 - DNA, 25 bp, Rattus norvegicus
gtttcttaggctccagggtttccag

SEQ ID NO: 533259 - DNA, 25 bp, Rattus norvegicus
gtttcttaggctgcagggtttccag

SEQ ID NO: 533260 - DNA, 25 bp, Rattus norvegicus
gtttcttagtgaaacccagtctttc

SEQ ID NO: 533261 - DNA, 25 bp, Rattus norvegicus
gtttcttagtgatacccagtctttc

SEQ ID NO: 533262 - DNA, 25 bp, Rattus norvegicus
gtttcttagttactgcacacctact

SEQ ID NO: 533263 - DNA, 25 bp, Rattus norvegicus
gtttcttagttagtgcacacctact

SEQ ID NO: 533264 - DNA, 25 bp, Rattus norvegicus
gtttcttagtttagtctgtgagcca

SEQ ID NO: 533265 - DNA, 25 bp, Rattus norvegicus
gtttcttagttttgtctgtgagcca

SEQ ID NO: 533266 - DNA, 25 bp, Rattus norvegicus
gtttcttatccgcaacagaagaatt

SEQ ID NO: 533267 - DNA, 25 bp, Rattus norvegicus
gtttcttatccggaacagaagaatt

SEQ ID NO: 533268 - DNA, 25 bp, Rattus norvegicus
gtttcttcaactctggtatcttcat

SEQ ID NO: 533269 - DNA, 25 bp, Rattus norvegicus
gtttcttcaactgtggtatcttcat

SEQ ID NO: 533270 - DNA, 25 bp, Rattus norvegicus
gtttcttcaagcataaggcccagcg

SEQ ID NO: 533271 - DNA, 25 bp, Rattus norvegicus
gtttcttcaagcttaaggcccagcg

SEQ ID NO: 533272 - DNA, 25 bp, Rattus norvegicus
gtttcttcacccaactatgcatttg

SEQ ID NO: 533273 - DNA, 25 bp, Rattus norvegicus
gtttcttcaccctactatgcatttg

SEQ ID NO: 533274 - DNA, 25 bp, Rattus norvegicus
gtttcttcacgcctatggcttaatc

SEQ ID NO: 533275 - DNA, 25 bp, Rattus norvegicus
gtttcttcacgcgtatggcttaatc

SEQ ID NO: 533276 - DNA, 25 bp, Rattus norvegicus
gtttcttcagaaacccaatgcattt

SEQ ID NO: 533277 - DNA, 25 bp, Rattus norvegicus
gtttcttcagaatcccaatgcattt

SEQ ID NO: 533278 - DNA, 25 bp, Rattus norvegicus
gtttcttcagatattgctcctcttt

SEQ ID NO: 533279 - DNA, 25 bp, Rattus norvegicus
gtttcttcagattttgctcctcttt

SEQ ID NO: 533280 - DNA, 25 bp, Rattus norvegicus
gtttcttcagctagagtcattgggc

SEQ ID NO: 533281 - DNA, 25 bp, Rattus norvegicus
gtttcttcagcttgagtcattgggc

SEQ ID NO: 533282 - DNA, 25 bp, Rattus norvegicus
gtttcttcagtgcatgttaattcca

SEQ ID NO: 533283 - DNA, 25 bp, Rattus norvegicus
gtttcttcagtggatgttaattcca

SEQ ID NO: 533284 - DNA, 25 bp, Rattus norvegicus
gtttcttcatcacttcaattcctga

SEQ ID NO: 533285 - DNA, 25 bp, Rattus norvegicus
gtttcttcatcagttcaattcctga

SEQ ID NO: 533286 - DNA, 25 bp, Rattus norvegicus
gtttcttccactaggactggatggc

SEQ ID NO: 533287 - DNA, 25 bp, Rattus norvegicus
gtttcttccacttggactggatggc

SEQ ID NO: 533288 - DNA, 25 bp, Rattus norvegicus
gtttcttccagtcggtaaatggcca

SEQ ID NO: 533289 - DNA, 25 bp, Rattus norvegicus
gtttcttccagtgggtaaatggcca

SEQ ID NO: 533290 - DNA, 25 bp, Rattus norvegicus
gtttcttccctaagtctgaactttg

SEQ ID NO: 533291 - DNA, 25 bp, Rattus norvegicus
gtttcttccctatgtctgaactttg

SEQ ID NO: 533292 - DNA, 25 bp, Rattus norvegicus
gtttcttcctatcagtatccttctg

SEQ ID NO: 533293 - DNA, 25 bp, Rattus norvegicus
gtttcttcctatgagtatccttctg

SEQ ID NO: 533294 - DNA, 25 bp, Rattus norvegicus
gtttcttcctctatgtaacttgtag

SEQ ID NO: 533295 - DNA, 25 bp, Rattus norvegicus
gtttcttcctctttgtaacttgtag

SEQ ID NO: 533296 - DNA, 25 bp, Rattus norvegicus
gtttcttcctgcaatgtttatgaca

SEQ ID NO: 533297 - DNA, 25 bp, Rattus norvegicus
gtttcttcctgctatgtttatgaca

SEQ ID NO: 533298 - DNA, 25 bp, Rattus norvegicus
gtttcttcgctgaacgtaactatat

SEQ ID NO: 533299 - DNA, 25 bp, Rattus norvegicus
gtttcttcgctgtacgtaactatat

SEQ ID NO: 533300 - DNA, 25 bp, Rattus norvegicus
gtttcttcgtcgataattcagcccc

SEQ ID NO: 533301 - DNA, 25 bp, Rattus norvegicus
gtttcttcgtcgttaattcagcccc

SEQ ID NO: 533302 - DNA, 25 bp, Rattus norvegicus
gtttcttctagactcacgcttacag

SEQ ID NO: 533303 - DNA, 25 bp, Rattus norvegicus
gtttcttctagagtcacgcttacag

SEQ ID NO: 533304 - DNA, 25 bp, Rattus norvegicus
gtttcttctgccataagttcaacca

SEQ ID NO: 533305 - DNA, 25 bp, Rattus norvegicus
gtttcttctgccttaagttcaacca

SEQ ID NO: 533306 - DNA, 25 bp, Rattus norvegicus
gtttcttctggaaaacctggagcac

SEQ ID NO: 533307 - DNA, 25 bp, Rattus norvegicus
gtttcttctggaacaaaccgccatt

SEQ ID NO: 533308 - DNA, 25 bp, Rattus norvegicus
gtttcttctggataacctggagcac

SEQ ID NO: 533309 - DNA, 25 bp, Rattus norvegicus
gtttcttctggatcaaaccgccatt

SEQ ID NO: 533310 - DNA, 25 bp, Rattus norvegicus
gtttcttctgtcactggctgctaga

SEQ ID NO: 533311 - DNA, 25 bp, Rattus norvegicus
gtttcttctgtctctggctgctaga

SEQ ID NO: 533312 - DNA, 25 bp, Rattus norvegicus
gtttcttctgtgagagtgctccttg

SEQ ID NO: 533313 - DNA, 25 bp, Rattus norvegicus
gtttcttctgtgtgagtgctccttg

SEQ ID NO: 533314 - DNA, 25 bp, Rattus norvegicus
gtttcttcttataacagaacacaga

SEQ ID NO: 533315 - DNA, 25 bp, Rattus norvegicus
gtttcttcttattacagaacacaga

SEQ ID NO: 533316 - DNA, 25 bp, Rattus norvegicus
gtttcttctttgagctactaacaaa

SEQ ID NO: 533317 - DNA, 25 bp, Rattus norvegicus
gtttcttctttgtgctactaacaaa

SEQ ID NO: 533318 - DNA, 25 bp, Rattus norvegicus
gtttcttgacaaagtggaggcctct

SEQ ID NO: 533319 - DNA, 25 bp, Rattus norvegicus
gtttcttgacaatgtggaggcctct

SEQ ID NO: 533320 - DNA, 25 bp, Rattus norvegicus
gtttcttgagatcagtgggccattt

SEQ ID NO: 533321 - DNA, 25 bp, Rattus norvegicus
gtttcttgagatgagtgggccattt

SEQ ID NO: 533322 - DNA, 25 bp, Rattus norvegicus
gtttcttgagccatgataccttatg

SEQ ID NO: 533323 - DNA, 25 bp, Rattus norvegicus
gtttcttgagccttgataccttatg

SEQ ID NO: 533324 - DNA, 25 bp, Rattus norvegicus
gtttcttgatatacacctgactggc

SEQ ID NO: 533325 - DNA, 25 bp, Rattus norvegicus
gtttcttgatattcacctgactggc

SEQ ID NO: 533326 - DNA, 25 bp, Rattus norvegicus
gtttcttgatcacagtacattggag

SEQ ID NO: 533327 - DNA, 25 bp, Rattus norvegicus
gtttcttgatcagagtacattggag

SEQ ID NO: 533328 - DNA, 25 bp, Rattus norvegicus
gtttcttgcctaacttacaggccat

SEQ ID NO: 533329 - DNA, 25 bp, Rattus norvegicus
gtttcttgcctatcttacaggccat

SEQ ID NO: 533330 - DNA, 25 bp, Rattus norvegicus
gtttcttgctgcagtaacttaccag

SEQ ID NO: 533331 - DNA, 25 bp, Rattus norvegicus
gtttcttgctgctgtaacttaccag

SEQ ID NO: 533332 - DNA, 25 bp, Rattus norvegicus
gtttcttggtttaagcactttattg

SEQ ID NO: 533333 - DNA, 25 bp, Rattus norvegicus
gtttcttggttttagcactttattg

SEQ ID NO: 533334 - DNA, 25 bp, Rattus norvegicus
gtttcttgtcataattagttccatt

SEQ ID NO: 533335 - DNA, 25 bp, Rattus norvegicus
gtttcttgtcattattagttccatt

SEQ ID NO: 533336 - DNA, 25 bp, Rattus norvegicus
gtttcttgtctactagatgtcccag

SEQ ID NO: 533337 - DNA, 25 bp, Rattus norvegicus
gtttcttgtctagtagatgtcccag

SEQ ID NO: 533338 - DNA, 25 bp, Rattus norvegicus
gtttcttgtgagaactccagttgct

SEQ ID NO: 533339 - DNA, 25 bp, Rattus norvegicus
gtttcttgtgagtactccagttgct

SEQ ID NO: 533340 - DNA, 25 bp, Rattus norvegicus
gtttcttgtgatattcttgggctct

SEQ ID NO: 533341 - DNA, 25 bp, Rattus norvegicus
gtttcttgtgattttcttgggctct

SEQ ID NO: 533342 - DNA, 25 bp, Rattus norvegicus
gtttcttgtgcactagaactcaaca

SEQ ID NO: 533343 - DNA, 25 bp, Rattus norvegicus
gtttcttgtgcagtagaactcaaca

SEQ ID NO: 533344 - DNA, 25 bp, Rattus norvegicus
gtttcttgtgtaaagtgcaggctct

SEQ ID NO: 533345 - DNA, 25 bp, Rattus norvegicus
gtttcttgtgtatagtgcaggctct

SEQ ID NO: 533346 - DNA, 25 bp, Rattus norvegicus
gtttcttgtgttctggtgaactccc

SEQ ID NO: 533347 - DNA, 25 bp, Rattus norvegicus
gtttcttgtgttgtggtgaactccc

SEQ ID NO: 533348 - DNA, 25 bp, Rattus norvegicus
gtttcttgttaccagagccttggca

SEQ ID NO: 533349 - DNA, 25 bp, Rattus norvegicus
gtttcttgttacgagagccttggca

SEQ ID NO: 533350 - DNA, 25 bp, Rattus norvegicus
gtttcttgttctcggaggtcaaagc

SEQ ID NO: 533351 - DNA, 25 bp, Rattus norvegicus
gtttcttgttctgggaggtcaaagc

SEQ ID NO: 533352 - DNA, 25 bp, Rattus norvegicus
gtttcttgttttcccatagctgtag

SEQ ID NO: 533353 - DNA, 25 bp, Rattus norvegicus
gtttcttgttttgccatagctgtag

SEQ ID NO: 533354 - DNA, 25 bp, Rattus norvegicus
gtttctttaatgaggtcatcaccag

SEQ ID NO: 533355 - DNA, 25 bp, Rattus norvegicus
gtttctttaatgtggtcatcaccag

SEQ ID NO: 533356 - DNA, 25 bp, Rattus norvegicus
gtttctttagtgaaggcccagccat

SEQ ID NO: 533357 - DNA, 25 bp, Rattus norvegicus
gtttctttagtgtaggcccagccat

SEQ ID NO: 533358 - DNA, 25 bp, Rattus norvegicus
gtttctttcactccacactaatagg

SEQ ID NO: 533359 - DNA, 25 bp, Rattus norvegicus
gtttctttcactgcacactaatagg

SEQ ID NO: 533360 - DNA, 25 bp, Rattus norvegicus
gtttctttcagtaacttgtttcagt

SEQ ID NO: 533361 - DNA, 25 bp, Rattus norvegicus
gtttctttcagttacttgtttcagt

SEQ ID NO: 533362 - DNA, 25 bp, Rattus norvegicus
gtttctttcgctctcttatgcagta

SEQ ID NO: 533363 - DNA, 25 bp, Rattus norvegicus
gtttctttcgctgtcttatgcagta

SEQ ID NO: 533364 - DNA, 25 bp, Rattus norvegicus
gtttctttctgaatgtttgcatgtt

SEQ ID NO: 533365 - DNA, 25 bp, Rattus norvegicus
gtttctttctgattgtttgcatgtt

SEQ ID NO: 533366 - DNA, 25 bp, Rattus norvegicus
gtttctttctgtcggtgaacactag

SEQ ID NO: 533367 - DNA, 25 bp, Rattus norvegicus
gtttctttctgtgggtgaacactag

SEQ ID NO: 533368 - DNA, 25 bp, Rattus norvegicus
gtttctttgaatactggcatggctc

SEQ ID NO: 533369 - DNA, 25 bp, Rattus norvegicus
gtttctttgaattctggcatggctc

SEQ ID NO: 533370 - DNA, 25 bp, Rattus norvegicus
gtttctttgatcacagtttcttcaa

SEQ ID NO: 533371 - DNA, 25 bp, Rattus norvegicus
gtttctttgatctcagtttcttcaa

SEQ ID NO: 533372 - DNA, 25 bp, Rattus norvegicus
gtttctttgatgcagttacgtggca

SEQ ID NO: 533373 - DNA, 25 bp, Rattus norvegicus
gtttctttgatggagttacgtggca

SEQ ID NO: 533374 - DNA, 25 bp, Rattus norvegicus
gtttctttgcacataagcagccatg

SEQ ID NO: 533375 - DNA, 25 bp, Rattus norvegicus
gtttctttgcacttaagcagccatg

SEQ ID NO: 533376 - DNA, 25 bp, Rattus norvegicus
gtttctttgcgaatactgttcattg

SEQ ID NO: 533377 - DNA, 25 bp, Rattus norvegicus
gtttctttgcgattactgttcattg

SEQ ID NO: 533378 - DNA, 25 bp, Rattus norvegicus
gtttctttgctaatctacattgatg

SEQ ID NO: 533379 - DNA, 25 bp, Rattus norvegicus
gtttctttgctattctacattgatg

SEQ ID NO: 533380 - DNA, 25 bp, Rattus norvegicus
gtttctttgtgtccgttttctactg

SEQ ID NO: 533381 - DNA, 25 bp, Rattus norvegicus
gtttctttgtgtcgtcttctccccg

SEQ ID NO: 533382 - DNA, 25 bp, Rattus norvegicus
gtttctttgtgtgcgttttctactg

SEQ ID NO: 533383 - DNA, 25 bp, Rattus norvegicus
gtttctttgtgtggtcttctccccg

SEQ ID NO: 533384 - DNA, 25 bp, Rattus norvegicus
gtttctttgttaaatcatcacggcg

SEQ ID NO: 533385 - DNA, 25 bp, Rattus norvegicus
gtttctttgttatatcatcacggcg

SEQ ID NO: 533386 - DNA, 25 bp, Rattus norvegicus
gtttcttttatgctaaatccctgaa

SEQ ID NO: 533387 - DNA, 25 bp, Rattus norvegicus
gtttcttttatggtaaatccctgaa

SEQ ID NO: 533388 - DNA, 25 bp, Rattus norvegicus
gtttcttttattctggctggttctt

SEQ ID NO: 533389 - DNA, 25 bp, Rattus norvegicus
gtttcttttattgtggctggttctt

SEQ ID NO: 533390 - DNA, 25 bp, Rattus norvegicus
gtttcttttcagaatgcgtaattaa

SEQ ID NO: 533391 - DNA, 25 bp, Rattus norvegicus
gtttcttttcagatgcaacacgtgt

SEQ ID NO: 533392 - DNA, 25 bp, Rattus norvegicus
gtttcttttcagtatgcgtaattaa

SEQ ID NO: 533393 - DNA, 25 bp, Rattus norvegicus
gtttcttttcagttgcaacacgtgt

SEQ ID NO: 533394 - DNA, 25 bp, Rattus norvegicus
gtttcttttcctaggcaatgctgaa

SEQ ID NO: 533395 - DNA, 25 bp, Rattus norvegicus
gtttcttttccttggcaatgctgaa

SEQ ID NO: 533396 - DNA, 25 bp, Rattus norvegicus
gtttcttttctacttttggtgacag

SEQ ID NO: 533397 - DNA, 25 bp, Rattus norvegicus
gtttcttttctagttttggtgacag

SEQ ID NO: 533398 - DNA, 25 bp, Rattus norvegicus
gtttcttttctcaatccgttgagga

SEQ ID NO: 533399 - DNA, 25 bp, Rattus norvegicus
gtttcttttctctatccgttgagga

SEQ ID NO: 533400 - DNA, 25 bp, Rattus norvegicus
gtttcttttcttcagatcggcccga

SEQ ID NO: 533401 - DNA, 25 bp, Rattus norvegicus
gtttcttttcttgagatcggcccga

SEQ ID NO: 533402 - DNA, 25 bp, Rattus norvegicus
gtttcttttgccatgtaccagattt

SEQ ID NO: 533403 - DNA, 25 bp, Rattus norvegicus
gtttcttttgccttgtaccagattt

SEQ ID NO: 533404 - DNA, 25 bp, Rattus norvegicus
gtttcttttgctagtcgtagggtct

SEQ ID NO: 533405 - DNA, 25 bp, Rattus norvegicus
gtttcttttgcttgtcgtagggtct

SEQ ID NO: 533406 - DNA, 25 bp, Rattus norvegicus
gtttcttttgtgatgtttgcttcag

SEQ ID NO: 533407 - DNA, 25 bp, Rattus norvegicus
gtttcttttgtgttgtttgcttcag

SEQ ID NO: 533408 - DNA, 25 bp, Rattus norvegicus
gtttctttttgaacattttctcggt

SEQ ID NO: 533409 - DNA, 25 bp, Rattus norvegicus
gtttctttttgatcattttctcggt

SEQ ID NO: 533410 - DNA, 25 bp, Rattus norvegicus
gtttgaaacggcaactcttcggtca

SEQ ID NO: 533411 - DNA, 25 bp, Rattus norvegicus
gtttgaaacggctactcttcggtca

SEQ ID NO: 533412 - DNA, 25 bp, Rattus norvegicus
gtttgaaagaagcttcacacccagt

SEQ ID NO: 533413 - DNA, 25 bp, Rattus norvegicus
gtttgaaagaaggttcacacccagt

SEQ ID NO: 533414 - DNA, 25 bp, Rattus norvegicus
gtttgaaagattctactgagtccat

SEQ ID NO: 533415 - DNA, 25 bp, Rattus norvegicus
gtttgaaagattgtactgagtccat

SEQ ID NO: 533416 - DNA, 25 bp, Rattus norvegicus
gtttgaaatccgcaccacagacgac

SEQ ID NO: 533417 - DNA, 25 bp, Rattus norvegicus
gtttgaaatccggaccacagacgac

SEQ ID NO: 533418 - DNA, 25 bp, Rattus norvegicus
gtttgaaattccatgccatcaccag

SEQ ID NO: 533419 - DNA, 25 bp, Rattus norvegicus
gtttgaaattccctggccatgctga

SEQ ID NO: 533420 - DNA, 25 bp, Rattus norvegicus
gtttgaaattccgtggccatgctga

SEQ ID NO: 533421 - DNA, 25 bp, Rattus norvegicus
gtttgaaattccttgccatcaccag

SEQ ID NO: 533422 - DNA, 25 bp, Rattus norvegicus
gtttgaacaaggcatgttccttaaa

SEQ ID NO: 533423 - DNA, 25 bp, Rattus norvegicus
gtttgaacaagggatgttccttaaa

SEQ ID NO: 533424 - DNA, 25 bp, Rattus norvegicus
gtttgaacaccactgcccatctaaa

SEQ ID NO: 533425 - DNA, 25 bp, Rattus norvegicus
gtttgaacaccagtgcccatctaaa

SEQ ID NO: 533426 - DNA, 25 bp, Rattus norvegicus
gtttgaacacggagcctctgtctgt

SEQ ID NO: 533427 - DNA, 25 bp, Rattus norvegicus
gtttgaacacggtgcctctgtctgt

SEQ ID NO: 533428 - DNA, 25 bp, Rattus norvegicus
gtttgaacagttcgtccccagttgg

SEQ ID NO: 533429 - DNA, 25 bp, Rattus norvegicus
gtttgaacagttggtccccagttgg

SEQ ID NO: 533430 - DNA, 25 bp, Rattus norvegicus
gtttgaacataccatactgctgcgc

SEQ ID NO: 533431 - DNA, 25 bp, Rattus norvegicus
gtttgaacatacgatactgctgcgc

SEQ ID NO: 533432 - DNA, 25 bp, Rattus norvegicus
gtttgaaccaatcgcctagctttgt

SEQ ID NO: 533433 - DNA, 25 bp, Rattus norvegicus
gtttgaaccaatggcctagctttgt

SEQ ID NO: 533434 - DNA, 25 bp, Rattus norvegicus
gtttgaaccagacatcagtcaccgt

SEQ ID NO: 533435 - DNA, 25 bp, Rattus norvegicus
gtttgaaccagagatcagtcaccgt

SEQ ID NO: 533436 - DNA, 25 bp, Rattus norvegicus
gtttgaaccatgcaacccacagagg

SEQ ID NO: 533437 - DNA, 25 bp, Rattus norvegicus
gtttgaaccatggaacccacagagg

SEQ ID NO: 533438 - DNA, 25 bp, Rattus norvegicus
gtttgaacctaaatctggctggctg

SEQ ID NO: 533439 - DNA, 25 bp, Rattus norvegicus
gtttgaacctaattctggctggctg

SEQ ID NO: 533440 - DNA, 25 bp, Rattus norvegicus
gtttgaacggttctctctgtcctct

SEQ ID NO: 533441 - DNA, 25 bp, Rattus norvegicus
gtttgaacggttgtctctgtcctct

SEQ ID NO: 533442 - DNA, 25 bp, Rattus norvegicus
gtttgaactaccagcaacggcctaa

SEQ ID NO: 533443 - DNA, 25 bp, Rattus norvegicus
gtttgaactacctgcaacggcctaa

SEQ ID NO: 533444 - DNA, 25 bp, Rattus norvegicus
gtttgaacttctctaccttgtataa

SEQ ID NO: 533445 - DNA, 25 bp, Rattus norvegicus
gtttgaacttctgtaccttgtataa

SEQ ID NO: 533446 - DNA, 25 bp, Rattus norvegicus
gtttgaagaattccccatgacccct

SEQ ID NO: 533447 - DNA, 25 bp, Rattus norvegicus
gtttgaagaattgcccatgacccct

SEQ ID NO: 533448 - DNA, 25 bp, Rattus norvegicus
gtttgaagacaacacccggaaggtg

SEQ ID NO: 533449 - DNA, 25 bp, Rattus norvegicus
gtttgaagacaagacccggaaggtg

SEQ ID NO: 533450 - DNA, 25 bp, Rattus norvegicus
gtttgaagactaccatccacaggct

SEQ ID NO: 533451 - DNA, 25 bp, Rattus norvegicus
gtttgaagactagcatccacaggct

SEQ ID NO: 533452 - DNA, 25 bp, Rattus norvegicus
gtttgaagatgtcagttcccacctt

SEQ ID NO: 533453 - DNA, 25 bp, Rattus norvegicus
gtttgaagatgtgagttcccacctt

SEQ ID NO: 533454 - DNA, 25 bp, Rattus norvegicus
gtttgaagcaacagcggtgtccagt

SEQ ID NO: 533455 - DNA, 25 bp, Rattus norvegicus
gtttgaagcaactgcggtgtccagt

SEQ ID NO: 533456 - DNA, 25 bp, Rattus norvegicus
gtttgaagctggacccagcagccta

SEQ ID NO: 533457 - DNA, 25 bp, Rattus norvegicus
gtttgaagctggtcccagcagccta

SEQ ID NO: 533458 - DNA, 25 bp, Rattus norvegicus
gtttgaagcttcaaccaccaaagtt

SEQ ID NO: 533459 - DNA, 25 bp, Rattus norvegicus
gtttgaagcttctaccaccaaagtt

SEQ ID NO: 533460 - DNA, 25 bp, Rattus norvegicus
gtttgaagtcatatatctcccctag

SEQ ID NO: 533461 - DNA, 25 bp, Rattus norvegicus
gtttgaagtcatttatctcccctag

SEQ ID NO: 533462 - DNA, 25 bp, Rattus norvegicus
gtttgaagttcaacctgagactctt

SEQ ID NO: 533463 - DNA, 25 bp, Rattus norvegicus
gtttgaagttcatcctgagactctt

SEQ ID NO: 533464 - DNA, 25 bp, Rattus norvegicus
gtttgaagttggactttctgagcta

SEQ ID NO: 533465 - DNA, 25 bp, Rattus norvegicus
gtttgaagttggtctttctgagcta

SEQ ID NO: 533466 - DNA, 25 bp, Rattus norvegicus
gtttgaagtttgatggtgactccac

SEQ ID NO: 533467 - DNA, 25 bp, Rattus norvegicus
gtttgaagtttgttggtgactccac

SEQ ID NO: 533468 - DNA, 25 bp, Rattus norvegicus
gtttgaatagttcttctctccacta

SEQ ID NO: 533469 - DNA, 25 bp, Rattus norvegicus
gtttgaatagttgttctctccacta

SEQ ID NO: 533470 - DNA, 25 bp, Rattus norvegicus
gtttgaatctgaccggtcgctgagc

SEQ ID NO: 533471 - DNA, 25 bp, Rattus norvegicus
gtttgaatctgagcggtcgctgagc

SEQ ID NO: 533472 - DNA, 25 bp, Rattus norvegicus
gtttgaatgattatgctctatgaca

SEQ ID NO: 533473 - DNA, 25 bp, Rattus norvegicus
gtttgaatgattttgctctatgaca

SEQ ID NO: 533474 - DNA, 25 bp, Rattus norvegicus
gtttgaatggcaaccgtagcgcaca

SEQ ID NO: 533475 - DNA, 25 bp, Rattus norvegicus
gtttgaatggcatccgtagcgcaca

SEQ ID NO: 533476 - DNA, 25 bp, Rattus norvegicus
gtttgacaaccactacctatacatc

SEQ ID NO: 533477 - DNA, 25 bp, Rattus norvegicus
gtttgacaaccagtacctatacatc

SEQ ID NO: 533478 - DNA, 25 bp, Rattus norvegicus
gtttgacaacccaagttccattctt

SEQ ID NO: 533479 - DNA, 25 bp, Rattus norvegicus
gtttgacaaccctagttccattctt

SEQ ID NO: 533480 - DNA, 25 bp, Rattus norvegicus
gtttgacaagcacgtgccatcccta

SEQ ID NO: 533481 - DNA, 25 bp, Rattus norvegicus
gtttgacaagcaggtgccatcccta

SEQ ID NO: 533482 - DNA, 25 bp, Rattus norvegicus
gtttgacaatacaccatgcacacag

SEQ ID NO: 533483 - DNA, 25 bp, Rattus norvegicus
gtttgacaatactccatgcacacag

SEQ ID NO: 533484 - DNA, 25 bp, Rattus norvegicus
gtttgacaatgtattcccatgattt

SEQ ID NO: 533485 - DNA, 25 bp, Rattus norvegicus
gtttgacaatgttttcccatgattt

SEQ ID NO: 533486 - DNA, 25 bp, Rattus norvegicus
gtttgacacaaactcgcacaaccat

SEQ ID NO: 533487 - DNA, 25 bp, Rattus norvegicus
gtttgacacaaagtcgcacaaccat

SEQ ID NO: 533488 - DNA, 25 bp, Rattus norvegicus
gtttgacaccttaaagcactttatt

SEQ ID NO: 533489 - DNA, 25 bp, Rattus norvegicus
gtttgacacctttaagcactttatt

SEQ ID NO: 533490 - DNA, 25 bp, Rattus norvegicus
gtttgacagtcgagaaatgccacct

SEQ ID NO: 533491 - DNA, 25 bp, Rattus norvegicus
gtttgacagtcgtgaaatgccacct

SEQ ID NO: 533492 - DNA, 25 bp, Rattus norvegicus
gtttgacatgaccatctcgagctgt

SEQ ID NO: 533493 - DNA, 25 bp, Rattus norvegicus
gtttgacatgacgatctcgagctgt

SEQ ID NO: 533494 - DNA, 25 bp, Rattus norvegicus
gtttgacatgccacatatctgatga

SEQ ID NO: 533495 - DNA, 25 bp, Rattus norvegicus
gtttgacatgcctcatatctgatga

SEQ ID NO: 533496 - DNA, 25 bp, Rattus norvegicus
gtttgaccaaccatatctacacaca

SEQ ID NO: 533497 - DNA, 25 bp, Rattus norvegicus
gtttgaccaaccttatctacacaca

SEQ ID NO: 533498 - DNA, 25 bp, Rattus norvegicus
gtttgaccagacaatagctcagatt

SEQ ID NO: 533499 - DNA, 25 bp, Rattus norvegicus
gtttgaccagactatagctcagatt

SEQ ID NO: 533500 - DNA, 25 bp, Rattus norvegicus
gtttgaccattccacgctgtcagca

SEQ ID NO: 533501 - DNA, 25 bp, Rattus norvegicus
gtttgaccattcgacgctgtcagca

SEQ ID NO: 533502 - DNA, 25 bp, Rattus norvegicus
gtttgaccgtcccatgcccaaatcg

SEQ ID NO: 533503 - DNA, 25 bp, Rattus norvegicus
gtttgaccgtccgatgcccaaatcg

SEQ ID NO: 533504 - DNA, 25 bp, Rattus norvegicus
gtttgacctaatattgcagtctttg

SEQ ID NO: 533505 - DNA, 25 bp, Rattus norvegicus
gtttgacctaattttgcagtctttg

SEQ ID NO: 533506 - DNA, 25 bp, Rattus norvegicus
gtttgacctcacacatagtcctggc

SEQ ID NO: 533507 - DNA, 25 bp, Rattus norvegicus
gtttgacctcactcatagtcctggc

SEQ ID NO: 533508 - DNA, 25 bp, Rattus norvegicus
gtttgacctctaacaccatttttca

SEQ ID NO: 533509 - DNA, 25 bp, Rattus norvegicus
gtttgacctctatcaccatttttca

SEQ ID NO: 533510 - DNA, 25 bp, Rattus norvegicus
gtttgacctgatcactgatgttgta

SEQ ID NO: 533511 - DNA, 25 bp, Rattus norvegicus
gtttgacctgatgactgatgttgta

SEQ ID NO: 533512 - DNA, 25 bp, Rattus norvegicus
gtttgacctgttaaactaagcactg

SEQ ID NO: 533513 - DNA, 25 bp, Rattus norvegicus
gtttgacctgtttaactaagcactg

SEQ ID NO: 533514 - DNA, 25 bp, Rattus norvegicus
gtttgaccttgcaaatcgcaggcag

SEQ ID NO: 533515 - DNA, 25 bp, Rattus norvegicus
gtttgaccttgctaatcgcaggcag

SEQ ID NO: 533516 - DNA, 25 bp, Rattus norvegicus
gtttgacgagctcagggctgttcct

SEQ ID NO: 533517 - DNA, 25 bp, Rattus norvegicus
gtttgacgagctgagggctgttcct

SEQ ID NO: 533518 - DNA, 25 bp, Rattus norvegicus
gtttgacgaggaagagctcatggca

SEQ ID NO: 533519 - DNA, 25 bp, Rattus norvegicus
gtttgacgaggatgagctcatggca

SEQ ID NO: 533520 - DNA, 25 bp, Rattus norvegicus
gtttgacggtgtcattgctctgaca

SEQ ID NO: 533521 - DNA, 25 bp, Rattus norvegicus
gtttgacggtgtgattgctctgaca

SEQ ID NO: 533522 - DNA, 25 bp, Rattus norvegicus
gtttgacgtcagacagagctgtgac

SEQ ID NO: 533523 - DNA, 25 bp, Rattus norvegicus
gtttgacgtcagtcagagctgtgac

SEQ ID NO: 533524 - DNA, 25 bp, Rattus norvegicus
gtttgacgtgatcttctcttactga

SEQ ID NO: 533525 - DNA, 25 bp, Rattus norvegicus
gtttgacgtgatgttctcttactga

SEQ ID NO: 533526 - DNA, 25 bp, Rattus norvegicus
gtttgacgtgtcatcctgatattga

SEQ ID NO: 533527 - DNA, 25 bp, Rattus norvegicus
gtttgacgtgtcttcctgatattga

SEQ ID NO: 533528 - DNA, 25 bp, Rattus norvegicus
gtttgacgttacatccttacagttg

SEQ ID NO: 533529 - DNA, 25 bp, Rattus norvegicus
gtttgacgttacttccttacagttg

SEQ ID NO: 533530 - DNA, 25 bp, Rattus norvegicus
gtttgacgtttcagaggcttccaga

SEQ ID NO: 533531 - DNA, 25 bp, Rattus norvegicus
gtttgacgtttctgaggcttccaga

SEQ ID NO: 533532 - DNA, 25 bp, Rattus norvegicus
gtttgactaaccagctgagagccga

SEQ ID NO: 533533 - DNA, 25 bp, Rattus norvegicus
gtttgactaacctgctgagagccga

SEQ ID NO: 533534 - DNA, 25 bp, Rattus norvegicus
gtttgactacacagactcctttcta

SEQ ID NO: 533535 - DNA, 25 bp, Rattus norvegicus
gtttgactacactgactcctttcta

SEQ ID NO: 533536 - DNA, 25 bp, Rattus norvegicus
gtttgactacctacggagcgttctg

SEQ ID NO: 533537 - DNA, 25 bp, Rattus norvegicus
gtttgactaccttcggagcgttctg

SEQ ID NO: 533538 - DNA, 25 bp, Rattus norvegicus
gtttgactcaatacttgatctcaga

SEQ ID NO: 533539 - DNA, 25 bp, Rattus norvegicus
gtttgactcaattcttgatctcaga

SEQ ID NO: 533540 - DNA, 25 bp, Rattus norvegicus
gtttgactgcaaattccattttctt

SEQ ID NO: 533541 - DNA, 25 bp, Rattus norvegicus
gtttgactgcaatttccattttctt

SEQ ID NO: 533542 - DNA, 25 bp, Rattus norvegicus
gtttgactgctcatcattgtgtaag

SEQ ID NO: 533543 - DNA, 25 bp, Rattus norvegicus
gtttgactgctcttcattgtgtaag

SEQ ID NO: 533544 - DNA, 25 bp, Rattus norvegicus
gtttgactgcttctgataatcgttc

SEQ ID NO: 533545 - DNA, 25 bp, Rattus norvegicus
gtttgactgcttgtgataatcgttc

SEQ ID NO: 533546 - DNA, 25 bp, Rattus norvegicus
gtttgactggaaactgtacactgtt

SEQ ID NO: 533547 - DNA, 25 bp, Rattus norvegicus
gtttgactggaacgacccactggtc

SEQ ID NO: 533548 - DNA, 25 bp, Rattus norvegicus
gtttgactggaaggacccactggtc

SEQ ID NO: 533549 - DNA, 25 bp, Rattus norvegicus
gtttgactggaatctgtacactgtt

SEQ ID NO: 533550 - DNA, 25 bp, Rattus norvegicus
gtttgactgtaccatcgactgttat

SEQ ID NO: 533551 - DNA, 25 bp, Rattus norvegicus
gtttgactgtacgatcgactgttat

SEQ ID NO: 533552 - DNA, 25 bp, Rattus norvegicus
gtttgacttcataaaactatccttt

SEQ ID NO: 533553 - DNA, 25 bp, Rattus norvegicus
gtttgacttcattaaactatccttt

SEQ ID NO: 533554 - DNA, 25 bp, Rattus norvegicus
gtttgacttcgtatttgaccttcag

SEQ ID NO: 533555 - DNA, 25 bp, Rattus norvegicus
gtttgacttcgtttttgaccttcag

SEQ ID NO: 533556 - DNA, 25 bp, Rattus norvegicus
gtttgacttgtgcagggacacccag

SEQ ID NO: 533557 - DNA, 25 bp, Rattus norvegicus
gtttgacttgtggagggacacccag

SEQ ID NO: 533558 - DNA, 25 bp, Rattus norvegicus
gtttgactttagattcctctgctcc

SEQ ID NO: 533559 - DNA, 25 bp, Rattus norvegicus
gtttgactttagtttcctctgctcc

SEQ ID NO: 533560 - DNA, 25 bp, Rattus norvegicus
gtttgagaacgccaactgtgccatg

SEQ ID NO: 533561 - DNA, 25 bp, Rattus norvegicus
gtttgagaacgcgaactgtgccatg

SEQ ID NO: 533562 - DNA, 25 bp, Rattus norvegicus
gtttgagaatgaaggcgccctccac

SEQ ID NO: 533563 - DNA, 25 bp, Rattus norvegicus
gtttgagaatgatggcgccctccac

SEQ ID NO: 533564 - DNA, 25 bp, Rattus norvegicus
gtttgagactatcctgagctacatt

SEQ ID NO: 533565 - DNA, 25 bp, Rattus norvegicus
gtttgagactatgctgagctacatt

SEQ ID NO: 533566 - DNA, 25 bp, Rattus norvegicus
gtttgagatagtaagaccctgactt

SEQ ID NO: 533567 - DNA, 25 bp, Rattus norvegicus
gtttgagatagttagaccctgactt

SEQ ID NO: 533568 - DNA, 25 bp, Rattus norvegicus
gtttgagatatgagagacactgtct

SEQ ID NO: 533569 - DNA, 25 bp, Rattus norvegicus
gtttgagatatgtgagacactgtct

SEQ ID NO: 533570 - DNA, 25 bp, Rattus norvegicus
gtttgagatcagattggcctacaga

SEQ ID NO: 533571 - DNA, 25 bp, Rattus norvegicus
gtttgagatcagtttggcctacaga

SEQ ID NO: 533572 - DNA, 25 bp, Rattus norvegicus
gtttgagatctaagatccccggaat

SEQ ID NO: 533573 - DNA, 25 bp, Rattus norvegicus
gtttgagatctatgatccccggaat

SEQ ID NO: 533574 - DNA, 25 bp, Rattus norvegicus
gtttgagatgctagtgataccagaa

SEQ ID NO: 533575 - DNA, 25 bp, Rattus norvegicus
gtttgagatgcttgtgataccagaa

SEQ ID NO: 533576 - DNA, 25 bp, Rattus norvegicus
gtttgagcaactaactaaccacgtt

SEQ ID NO: 533577 - DNA, 25 bp, Rattus norvegicus
gtttgagcaacttactaaccacgtt

SEQ ID NO: 533578 - DNA, 25 bp, Rattus norvegicus
gtttgagcacagacttggttccaca

SEQ ID NO: 533579 - DNA, 25 bp, Rattus norvegicus
gtttgagcacagtcttggttccaca

SEQ ID NO: 533580 - DNA, 25 bp, Rattus norvegicus
gtttgagcaccacaaagccttggat

SEQ ID NO: 533581 - DNA, 25 bp, Rattus norvegicus
gtttgagcaccacggagtctgcgca

SEQ ID NO: 533582 - DNA, 25 bp, Rattus norvegicus
gtttgagcaccagaaagccttggat

SEQ ID NO: 533583 - DNA, 25 bp, Rattus norvegicus
gtttgagcaccagggagtctgcgca

SEQ ID NO: 533584 - DNA, 25 bp, Rattus norvegicus
gtttgagcacctcattacctagagt

SEQ ID NO: 533585 - DNA, 25 bp, Rattus norvegicus
gtttgagcacctgattacctagagt

SEQ ID NO: 533586 - DNA, 25 bp, Rattus norvegicus
gtttgagcagagaccccgagcagtg

SEQ ID NO: 533587 - DNA, 25 bp, Rattus norvegicus
gtttgagcagagtccccgagcagtg

SEQ ID NO: 533588 - DNA, 25 bp, Rattus norvegicus
gtttgagcatacatgagccagcagt

SEQ ID NO: 533589 - DNA, 25 bp, Rattus norvegicus
gtttgagcatacttgagccagcagt

SEQ ID NO: 533590 - DNA, 25 bp, Rattus norvegicus
gtttgagccagtagggtccagctgc

SEQ ID NO: 533591 - DNA, 25 bp, Rattus norvegicus
gtttgagccagttgggtccagctgc

SEQ ID NO: 533592 - DNA, 25 bp, Rattus norvegicus
gtttgagccatccagtggacatctt

SEQ ID NO: 533593 - DNA, 25 bp, Rattus norvegicus
gtttgagccatcgagtggacatctt

SEQ ID NO: 533594 - DNA, 25 bp, Rattus norvegicus
gtttgagccccaacttctgatggaa

SEQ ID NO: 533595 - DNA, 25 bp, Rattus norvegicus
gtttgagccccacgaacacttaact

SEQ ID NO: 533596 - DNA, 25 bp, Rattus norvegicus
gtttgagccccaggaacacttaact

SEQ ID NO: 533597 - DNA, 25 bp, Rattus norvegicus
gtttgagccccatcttctgatggaa

SEQ ID NO: 533598 - DNA, 25 bp, Rattus norvegicus
gtttgagccctcaaccttgagaaat

SEQ ID NO: 533599 - DNA, 25 bp, Rattus norvegicus
gtttgagccctctaccttgagaaat

SEQ ID NO: 533600 - DNA, 25 bp, Rattus norvegicus
gtttgagcgcttaaaccaggccaac

SEQ ID NO: 533601 - DNA, 25 bp, Rattus norvegicus
gtttgagcgctttaaccaggccaac

SEQ ID NO: 533602 - DNA, 25 bp, Rattus norvegicus
gtttgagctgctatacgcctatgaa

SEQ ID NO: 533603 - DNA, 25 bp, Rattus norvegicus
gtttgagctgctttacgcctatgaa

SEQ ID NO: 533604 - DNA, 25 bp, Rattus norvegicus
gtttgaggagaaccaatgtgtattg

SEQ ID NO: 533605 - DNA, 25 bp, Rattus norvegicus
gtttgaggagaagcaatgtgtattg

SEQ ID NO: 533606 - DNA, 25 bp, Rattus norvegicus
gtttgaggatgtcgctctccatcac

SEQ ID NO: 533607 - DNA, 25 bp, Rattus norvegicus
gtttgaggatgtggctctccatcac

SEQ ID NO: 533608 - DNA, 25 bp, Rattus norvegicus
gtttgaggccaaccatgactatatg

SEQ ID NO: 533609 - DNA, 25 bp, Rattus norvegicus
gtttgaggccaagcatgactatatg

SEQ ID NO: 533610 - DNA, 25 bp, Rattus norvegicus
gtttgaggctcacatggtctactat

SEQ ID NO: 533611 - DNA, 25 bp, Rattus norvegicus
gtttgaggctcagatggtctactat

SEQ ID NO: 533612 - DNA, 25 bp, Rattus norvegicus
gtttgaggtcaaatctgtgttcgta

SEQ ID NO: 533613 - DNA, 25 bp, Rattus norvegicus
gtttgaggtcaattctgtgttcgta

SEQ ID NO: 533614 - DNA, 25 bp, Rattus norvegicus
gtttgaggtggaactgctcaagatt

SEQ ID NO: 533615 - DNA, 25 bp, Rattus norvegicus
gtttgaggtggatctgctcaagatt

SEQ ID NO: 533616 - DNA, 25 bp, Rattus norvegicus
gtttgaggtttcagctgaagccact

SEQ ID NO: 533617 - DNA, 25 bp, Rattus norvegicus
gtttgaggtttctgctgaagccact

SEQ ID NO: 533618 - DNA, 25 bp, Rattus norvegicus
gtttgagtaatcatcggctccttcc

SEQ ID NO: 533619 - DNA, 25 bp, Rattus norvegicus
gtttgagtaatcttcggctccttcc

SEQ ID NO: 533620 - DNA, 25 bp, Rattus norvegicus
gtttgagtacacagtcgccaatcta

SEQ ID NO: 533621 - DNA, 25 bp, Rattus norvegicus
gtttgagtacactgtcgccaatcta

SEQ ID NO: 533622 - DNA, 25 bp, Rattus norvegicus
gtttgagtcaccacatcaggctcct

SEQ ID NO: 533623 - DNA, 25 bp, Rattus norvegicus
gtttgagtcacctcatcaggctcct

SEQ ID NO: 533624 - DNA, 25 bp, Rattus norvegicus
gtttgagtcctaccaccaacatcat

SEQ ID NO: 533625 - DNA, 25 bp, Rattus norvegicus
gtttgagtcctagcaccaacatcat

SEQ ID NO: 533626 - DNA, 25 bp, Rattus norvegicus
gtttgagtcctcagcctgcagagtc

SEQ ID NO: 533627 - DNA, 25 bp, Rattus norvegicus
gtttgagtcctctgcctgcagagtc

SEQ ID NO: 533628 - DNA, 25 bp, Rattus norvegicus
gtttgagtgggcaatggaccattaa

SEQ ID NO: 533629 - DNA, 25 bp, Rattus norvegicus
gtttgagtgggctatggaccattaa

SEQ ID NO: 533630 - DNA, 25 bp, Rattus norvegicus
gtttgagtggtgaagcccttgtgtt

SEQ ID NO: 533631 - DNA, 25 bp, Rattus norvegicus
gtttgagtggtgtagcccttgtgtt

SEQ ID NO: 533632 - DNA, 25 bp, Rattus norvegicus
gtttgagtgtcaactggcttgttaa

SEQ ID NO: 533633 - DNA, 25 bp, Rattus norvegicus
gtttgagtgtcatctggcttgttaa

SEQ ID NO: 533634 - DNA, 25 bp, Rattus norvegicus
gtttgagttcaaaggaccgcaggct

SEQ ID NO: 533635 - DNA, 25 bp, Rattus norvegicus
gtttgagttcaatggaccgcaggct

SEQ ID NO: 533636 - DNA, 25 bp, Rattus norvegicus
gtttgagttcccctacgtggcacat

SEQ ID NO: 533637 - DNA, 25 bp, Rattus norvegicus
gtttgagttcccgtacgtggcacat

SEQ ID NO: 533638 - DNA, 25 bp, Rattus norvegicus
gtttgataagcaatgcctaaccgct

SEQ ID NO: 533639 - DNA, 25 bp, Rattus norvegicus
gtttgataagcattgcctaaccgct

SEQ ID NO: 533640 - DNA, 25 bp, Rattus norvegicus
gtttgatacgacaggcatgaacgcc

SEQ ID NO: 533641 - DNA, 25 bp, Rattus norvegicus
gtttgatacgactggcatgaacgcc

SEQ ID NO: 533642 - DNA, 25 bp, Rattus norvegicus
gtttgatactaacaatccaccaggt

SEQ ID NO: 533643 - DNA, 25 bp, Rattus norvegicus
gtttgatactaagaatccaccaggt

SEQ ID NO: 533644 - DNA, 25 bp, Rattus norvegicus
gtttgatactgaatacatgagccat

SEQ ID NO: 533645 - DNA, 25 bp, Rattus norvegicus
gtttgatactgattacatgagccat

SEQ ID NO: 533646 - DNA, 25 bp, Rattus norvegicus
gtttgatactgtactcatctttgtg

SEQ ID NO: 533647 - DNA, 25 bp, Rattus norvegicus
gtttgatactgttctcatctttgtg

SEQ ID NO: 533648 - DNA, 25 bp, Rattus norvegicus
gtttgataggagcaggccacccagt

SEQ ID NO: 533649 - DNA, 25 bp, Rattus norvegicus
gtttgataggaggaggccacccagt

SEQ ID NO: 533650 - DNA, 25 bp, Rattus norvegicus
gtttgatcaaagaatcccatctgga

SEQ ID NO: 533651 - DNA, 25 bp, Rattus norvegicus
gtttgatcaaagtatcccatctgga

SEQ ID NO: 533652 - DNA, 25 bp, Rattus norvegicus
gtttgatcactgctatcacggcgaa

SEQ ID NO: 533653 - DNA, 25 bp, Rattus norvegicus
gtttgatcactggtatcacggcgaa

SEQ ID NO: 533654 - DNA, 25 bp, Rattus norvegicus
gtttgatcagtcatgcctgctgtgg

SEQ ID NO: 533655 - DNA, 25 bp, Rattus norvegicus
gtttgatcagtcttgcctgctgtgg

SEQ ID NO: 533656 - DNA, 25 bp, Rattus norvegicus
gtttgatcatcacaggcacatgcat

SEQ ID NO: 533657 - DNA, 25 bp, Rattus norvegicus
gtttgatcatcagaggcacatgcat

SEQ ID NO: 533658 - DNA, 25 bp, Rattus norvegicus
gtttgatccaaactttcagctcctc

SEQ ID NO: 533659 - DNA, 25 bp, Rattus norvegicus
gtttgatccaaagtttcagctcctc

SEQ ID NO: 533660 - DNA, 25 bp, Rattus norvegicus
gtttgatccatgaaggcgttcccca

SEQ ID NO: 533661 - DNA, 25 bp, Rattus norvegicus
gtttgatccatgtaggcgttcccca

SEQ ID NO: 533662 - DNA, 25 bp, Rattus norvegicus
gtttgatccattagttgttccaact

SEQ ID NO: 533663 - DNA, 25 bp, Rattus norvegicus
gtttgatccatttgttgttccaact

SEQ ID NO: 533664 - DNA, 25 bp, Rattus norvegicus
gtttgatcccacctgcataatgtac

SEQ ID NO: 533665 - DNA, 25 bp, Rattus norvegicus
gtttgatcccacgtgcataatgtac

SEQ ID NO: 533666 - DNA, 25 bp, Rattus norvegicus
gtttgatccttcaggatcatcccca

SEQ ID NO: 533667 - DNA, 25 bp, Rattus norvegicus
gtttgatccttctggatcatcccca

SEQ ID NO: 533668 - DNA, 25 bp, Rattus norvegicus
gtttgatcgcggcagccagtttgct

SEQ ID NO: 533669 - DNA, 25 bp, Rattus norvegicus
gtttgatcgcgggagccagtttgct

SEQ ID NO: 533670 - DNA, 25 bp, Rattus norvegicus
gtttgatctctgcaagccaaaagct

SEQ ID NO: 533671 - DNA, 25 bp, Rattus norvegicus
gtttgatctctggaagccaaaagct

SEQ ID NO: 533672 - DNA, 25 bp, Rattus norvegicus
gtttgatctgatctatgccaagcgt

SEQ ID NO: 533673 - DNA, 25 bp, Rattus norvegicus
gtttgatctgatgtatgccaagcgt

SEQ ID NO: 533674 - DNA, 25 bp, Rattus norvegicus
gtttgatctggtagtcacactgcat

SEQ ID NO: 533675 - DNA, 25 bp, Rattus norvegicus
gtttgatctggttgtcacactgcat

SEQ ID NO: 533676 - DNA, 25 bp, Rattus norvegicus
gtttgatcttatatttctctcttct

SEQ ID NO: 533677 - DNA, 25 bp, Rattus norvegicus
gtttgatcttatttttctctcttct

SEQ ID NO: 533678 - DNA, 25 bp, Rattus norvegicus
gtttgatcttcaagcactgcgataa

SEQ ID NO: 533679 - DNA, 25 bp, Rattus norvegicus
gtttgatcttcatgcactgcgataa

SEQ ID NO: 533680 - DNA, 25 bp, Rattus norvegicus
gtttgatcttgaaaaagccctggaa

SEQ ID NO: 533681 - DNA, 25 bp, Rattus norvegicus
gtttgatcttgataaagccctggaa

SEQ ID NO: 533682 - DNA, 25 bp, Rattus norvegicus
gtttgatctttgacatcaggatatc

SEQ ID NO: 533683 - DNA, 25 bp, Rattus norvegicus
gtttgatctttgtcatcaggatatc

SEQ ID NO: 533684 - DNA, 25 bp, Rattus norvegicus
gtttgatgacagattggcctcttat

SEQ ID NO: 533685 - DNA, 25 bp, Rattus norvegicus
gtttgatgacagtttggcctcttat

SEQ ID NO: 533686 - DNA, 25 bp, Rattus norvegicus
gtttgatgccaaacatcctagaaga

SEQ ID NO: 533687 - DNA, 25 bp, Rattus norvegicus
gtttgatgccaacctcgacgtggga

SEQ ID NO: 533688 - DNA, 25 bp, Rattus norvegicus
gtttgatgccaagctcgacgtggga

SEQ ID NO: 533689 - DNA, 25 bp, Rattus norvegicus
gtttgatgccaatcatcctagaaga

SEQ ID NO: 533690 - DNA, 25 bp, Rattus norvegicus
gtttgatgccgaatctgccgagtga

SEQ ID NO: 533691 - DNA, 25 bp, Rattus norvegicus
gtttgatgccgattctgccgagtga

SEQ ID NO: 533692 - DNA, 25 bp, Rattus norvegicus
gtttgatgctggatgaccttaagcc

SEQ ID NO: 533693 - DNA, 25 bp, Rattus norvegicus
gtttgatgctggttgaccttaagcc

SEQ ID NO: 533694 - DNA, 25 bp, Rattus norvegicus
gtttgatgctttctcaacacggaag

SEQ ID NO: 533695 - DNA, 25 bp, Rattus norvegicus
gtttgatgctttgtcaacacggaag

SEQ ID NO: 533696 - DNA, 25 bp, Rattus norvegicus
gtttgatggcataccttagacttga

SEQ ID NO: 533697 - DNA, 25 bp, Rattus norvegicus
gtttgatggcattccttagacttga

SEQ ID NO: 533698 - DNA, 25 bp, Rattus norvegicus
gtttgatggctgatttgactttaaa

SEQ ID NO: 533699 - DNA, 25 bp, Rattus norvegicus
gtttgatggctgttttgactttaaa

SEQ ID NO: 533700 - DNA, 25 bp, Rattus norvegicus
gtttgatgtcccctttacggtgcac

SEQ ID NO: 533701 - DNA, 25 bp, Rattus norvegicus
gtttgatgtcccgtttacggtgcac

SEQ ID NO: 533702 - DNA, 25 bp, Rattus norvegicus
gtttgatgtctccttatacgctgta

SEQ ID NO: 533703 - DNA, 25 bp, Rattus norvegicus
gtttgatgtctcgttatacgctgta

SEQ ID NO: 533704 - DNA, 25 bp, Rattus norvegicus
gtttgatgtgagaacgccctgtcct

SEQ ID NO: 533705 - DNA, 25 bp, Rattus norvegicus
gtttgatgtgagtacgccctgtcct

SEQ ID NO: 533706 - DNA, 25 bp, Rattus norvegicus
gtttgattcaacacttgctctcctt

SEQ ID NO: 533707 - DNA, 25 bp, Rattus norvegicus
gtttgattcaactcttgctctcctt

SEQ ID NO: 533708 - DNA, 25 bp, Rattus norvegicus
gtttgattcactacactggttccag

SEQ ID NO: 533709 - DNA, 25 bp, Rattus norvegicus
gtttgattcacttcactggttccag

SEQ ID NO: 533710 - DNA, 25 bp, Rattus norvegicus
gtttgattcctcattctatttcatg

SEQ ID NO: 533711 - DNA, 25 bp, Rattus norvegicus
gtttgattcctctttctatttcatg

SEQ ID NO: 533712 - DNA, 25 bp, Rattus norvegicus
gtttgattctgacgtttcactcgtt

SEQ ID NO: 533713 - DNA, 25 bp, Rattus norvegicus
gtttgattctgaggtttcactcgtt

SEQ ID NO: 533714 - DNA, 25 bp, Rattus norvegicus
gtttgattgctacaactctgctaga

SEQ ID NO: 533715 - DNA, 25 bp, Rattus norvegicus
gtttgattgctagaactctgctaga

SEQ ID NO: 533716 - DNA, 25 bp, Rattus norvegicus
gtttgatttagtacagaccctagtg

SEQ ID NO: 533717 - DNA, 25 bp, Rattus norvegicus
gtttgatttagttcagaccctagtg

SEQ ID NO: 533718 - DNA, 25 bp, Rattus norvegicus
gtttgatttcatatacgcactgctt

SEQ ID NO: 533719 - DNA, 25 bp, Rattus norvegicus
gtttgatttcatttacgcactgctt

SEQ ID NO: 533720 - DNA, 25 bp, Rattus norvegicus
gtttgcaaaaaccatccaggactag

SEQ ID NO: 533721 - DNA, 25 bp, Rattus norvegicus
gtttgcaaaaacgatccaggactag

SEQ ID NO: 533722 - DNA, 25 bp, Rattus norvegicus
gtttgcaaacgaataccgagaggcg

SEQ ID NO: 533723 - DNA, 25 bp, Rattus norvegicus
gtttgcaaacgattaccgagaggcg

SEQ ID NO: 533724 - DNA, 25 bp, Rattus norvegicus
gtttgcaaagaccttatccctttca

SEQ ID NO: 533725 - DNA, 25 bp, Rattus norvegicus
gtttgcaaagacgttatccctttca

SEQ ID NO: 533726 - DNA, 25 bp, Rattus norvegicus
gtttgcaacccacttaggactcgtt

SEQ ID NO: 533727 - DNA, 25 bp, Rattus norvegicus
gtttgcaacccagttaggactcgtt

SEQ ID NO: 533728 - DNA, 25 bp, Rattus norvegicus
gtttgcaaggtactggagacctgct

SEQ ID NO: 533729 - DNA, 25 bp, Rattus norvegicus
gtttgcaaggtagtggagacctgct

SEQ ID NO: 533730 - DNA, 25 bp, Rattus norvegicus
gtttgcaagtttcgtttccacgact

SEQ ID NO: 533731 - DNA, 25 bp, Rattus norvegicus
gtttgcaagtttggtttccacgact

SEQ ID NO: 533732 - DNA, 25 bp, Rattus norvegicus
gtttgcaatatccatttaccacagt

SEQ ID NO: 533733 - DNA, 25 bp, Rattus norvegicus
gtttgcaatatcgatttaccacagt

SEQ ID NO: 533734 - DNA, 25 bp, Rattus norvegicus
gtttgcaattcgagctgatcatgat

SEQ ID NO: 533735 - DNA, 25 bp, Rattus norvegicus
gtttgcaattcgtgctgatcatgat

SEQ ID NO: 533736 - DNA, 25 bp, Rattus norvegicus
gtttgcacaacacagactctgcatc

SEQ ID NO: 533737 - DNA, 25 bp, Rattus norvegicus
gtttgcacaacagagactctgcatc

SEQ ID NO: 533738 - DNA, 25 bp, Rattus norvegicus
gtttgcacacacaggtagctatgat

SEQ ID NO: 533739 - DNA, 25 bp, Rattus norvegicus
gtttgcacacactggtagctatgat

SEQ ID NO: 533740 - DNA, 25 bp, Rattus norvegicus
gtttgcacaccaagcatgaggtcta

SEQ ID NO: 533741 - DNA, 25 bp, Rattus norvegicus
gtttgcacaccatgcatgaggtcta

SEQ ID NO: 533742 - DNA, 25 bp, Rattus norvegicus
gtttgcacagaactccacagcactg

SEQ ID NO: 533743 - DNA, 25 bp, Rattus norvegicus
gtttgcacagaagtccacagcactg

SEQ ID NO: 533744 - DNA, 25 bp, Rattus norvegicus
gtttgcacagcacataaccgggatg

SEQ ID NO: 533745 - DNA, 25 bp, Rattus norvegicus
gtttgcacagcagataaccgggatg

SEQ ID NO: 533746 - DNA, 25 bp, Rattus norvegicus
gtttgcaccatgctcatgcattatt

SEQ ID NO: 533747 - DNA, 25 bp, Rattus norvegicus
gtttgcaccatggtcatgcattatt

SEQ ID NO: 533748 - DNA, 25 bp, Rattus norvegicus
gtttgcacgcctaggagacaacctg

SEQ ID NO: 533749 - DNA, 25 bp, Rattus norvegicus
gtttgcacgccttggagacaacctg

SEQ ID NO: 533750 - DNA, 25 bp, Rattus norvegicus
gtttgcactatcaccacctggcaag

SEQ ID NO: 533751 - DNA, 25 bp, Rattus norvegicus
gtttgcactatctccacctggcaag

SEQ ID NO: 533752 - DNA, 25 bp, Rattus norvegicus
gtttgcactttgacatgacgccttt

SEQ ID NO: 533753 - DNA, 25 bp, Rattus norvegicus
gtttgcactttgactgtaatcacac

SEQ ID NO: 533754 - DNA, 25 bp, Rattus norvegicus
gtttgcactttgctcacaatgcttc

SEQ ID NO: 533755 - DNA, 25 bp, Rattus norvegicus
gtttgcactttggtcacaatgcttc

SEQ ID NO: 533756 - DNA, 25 bp, Rattus norvegicus
gtttgcactttgtcatgacgccttt

SEQ ID NO: 533757 - DNA, 25 bp, Rattus norvegicus
gtttgcactttgtctgtaatcacac

SEQ ID NO: 533758 - DNA, 25 bp, Rattus norvegicus
gtttgcagacttctcagatgaccag

SEQ ID NO: 533759 - DNA, 25 bp, Rattus norvegicus
gtttgcagacttgtcagatgaccag

SEQ ID NO: 533760 - DNA, 25 bp, Rattus norvegicus
gtttgcagatgcatagagccactgt

SEQ ID NO: 533761 - DNA, 25 bp, Rattus norvegicus
gtttgcagatgcttagagccactgt

SEQ ID NO: 533762 - DNA, 25 bp, Rattus norvegicus
gtttgcagcaggacttttcataaca

SEQ ID NO: 533763 - DNA, 25 bp, Rattus norvegicus
gtttgcagcaggtcttttcataaca

SEQ ID NO: 533764 - DNA, 25 bp, Rattus norvegicus
gtttgcagcatcagagtccaacagc

SEQ ID NO: 533765 - DNA, 25 bp, Rattus norvegicus
gtttgcagcatctgagtccaacagc

SEQ ID NO: 533766 - DNA, 25 bp, Rattus norvegicus
gtttgcagcatgaacttgcacagat

SEQ ID NO: 533767 - DNA, 25 bp, Rattus norvegicus
gtttgcagcatgtacttgcacagat

SEQ ID NO: 533768 - DNA, 25 bp, Rattus norvegicus
gtttgcagccagaatacggagattt

SEQ ID NO: 533769 - DNA, 25 bp, Rattus norvegicus
gtttgcagccagtatacggagattt

SEQ ID NO: 533770 - DNA, 25 bp, Rattus norvegicus
gtttgcagccctaatagtcttagga

SEQ ID NO: 533771 - DNA, 25 bp, Rattus norvegicus
gtttgcagcccttatagtcttagga

SEQ ID NO: 533772 - DNA, 25 bp, Rattus norvegicus
gtttgcagcgcaacagttcgggaga

SEQ ID NO: 533773 - DNA, 25 bp, Rattus norvegicus
gtttgcagcgcatcagttcgggaga

SEQ ID NO: 533774 - DNA, 25 bp, Rattus norvegicus
gtttgcagcggaatactggacatca

SEQ ID NO: 533775 - DNA, 25 bp, Rattus norvegicus
gtttgcagcggattactggacatca

SEQ ID NO: 533776 - DNA, 25 bp, Rattus norvegicus
gtttgcaggaataaaccggcgccat

SEQ ID NO: 533777 - DNA, 25 bp, Rattus norvegicus
gtttgcaggaattaaccggcgccat

SEQ ID NO: 533778 - DNA, 25 bp, Rattus norvegicus
gtttgcagtcatcggaacctcggag

SEQ ID NO: 533779 - DNA, 25 bp, Rattus norvegicus
gtttgcagtcatgggaacctcggag

SEQ ID NO: 533780 - DNA, 25 bp, Rattus norvegicus
gtttgcagtccaattctgttagatc

SEQ ID NO: 533781 - DNA, 25 bp, Rattus norvegicus
gtttgcagtccatttctgttagatc

SEQ ID NO: 533782 - DNA, 25 bp, Rattus norvegicus
gtttgcagtgctcaggatcacgcta

SEQ ID NO: 533783 - DNA, 25 bp, Rattus norvegicus
gtttgcagtgctgaggatcacgcta

SEQ ID NO: 533784 - DNA, 25 bp, Rattus norvegicus
gtttgcataaacacccacagaacta

SEQ ID NO: 533785 - DNA, 25 bp, Rattus norvegicus
gtttgcataaactcccacagaacta

SEQ ID NO: 533786 - DNA, 25 bp, Rattus norvegicus
gtttgcatatgtaagaactgctcca

SEQ ID NO: 533787 - DNA, 25 bp, Rattus norvegicus
gtttgcatatgttagaactgctcca

SEQ ID NO: 533788 - DNA, 25 bp, Rattus norvegicus
gtttgcatcaatacaccatcgtttt

SEQ ID NO: 533789 - DNA, 25 bp, Rattus norvegicus
gtttgcatcaattcaccatcgtttt

SEQ ID NO: 533790 - DNA, 25 bp, Rattus norvegicus
gtttgcatcataatgtcatcttggg

SEQ ID NO: 533791 - DNA, 25 bp, Rattus norvegicus
gtttgcatcatattgtcatcttggg

SEQ ID NO: 533792 - DNA, 25 bp, Rattus norvegicus
gtttgcatcatgactactgtgtttg

SEQ ID NO: 533793 - DNA, 25 bp, Rattus norvegicus
gtttgcatcatgtctactgtgtttg

SEQ ID NO: 533794 - DNA, 25 bp, Rattus norvegicus
gtttgcatcattaggaacagtccag

SEQ ID NO: 533795 - DNA, 25 bp, Rattus norvegicus
gtttgcatcatttggaacagtccag

SEQ ID NO: 533796 - DNA, 25 bp, Rattus norvegicus
gtttgcatccagaggtcttcctcat

SEQ ID NO: 533797 - DNA, 25 bp, Rattus norvegicus
gtttgcatccagtggtcttcctcat

SEQ ID NO: 533798 - DNA, 25 bp, Rattus norvegicus
gtttgcatcctaactcaacatccta

SEQ ID NO: 533799 - DNA, 25 bp, Rattus norvegicus
gtttgcatcctatctcaacatccta

SEQ ID NO: 533800 - DNA, 25 bp, Rattus norvegicus
gtttgcatcttcaggatcattcttg

SEQ ID NO: 533801 - DNA, 25 bp, Rattus norvegicus
gtttgcatcttctggatcattcttg

SEQ ID NO: 533802 - DNA, 25 bp, Rattus norvegicus
gtttgcatgcacaggcgtatgaata

SEQ ID NO: 533803 - DNA, 25 bp, Rattus norvegicus
gtttgcatgcactggcgtatgaata

SEQ ID NO: 533804 - DNA, 25 bp, Rattus norvegicus
gtttgcatggaccatcttgcctgta

SEQ ID NO: 533805 - DNA, 25 bp, Rattus norvegicus
gtttgcatggacgatcttgcctgta

SEQ ID NO: 533806 - DNA, 25 bp, Rattus norvegicus
gtttgcatggcaaacaccactcact

SEQ ID NO: 533807 - DNA, 25 bp, Rattus norvegicus
gtttgcatggcacttaaggactgaa

SEQ ID NO: 533808 - DNA, 25 bp, Rattus norvegicus
gtttgcatggcagttaaggactgaa

SEQ ID NO: 533809 - DNA, 25 bp, Rattus norvegicus
gtttgcatggcatacaccactcact

SEQ ID NO: 533810 - DNA, 25 bp, Rattus norvegicus
gtttgcatgtatctattggtaccac

SEQ ID NO: 533811 - DNA, 25 bp, Rattus norvegicus
gtttgcatgtatgtattggtaccac

SEQ ID NO: 533812 - DNA, 25 bp, Rattus norvegicus
gtttgcattaccattaccatcttgt

SEQ ID NO: 533813 - DNA, 25 bp, Rattus norvegicus
gtttgcattacctttaccatcttgt

SEQ ID NO: 533814 - DNA, 25 bp, Rattus norvegicus
gtttgcattatcagtggtctcacca

SEQ ID NO: 533815 - DNA, 25 bp, Rattus norvegicus
gtttgcattatctgtggtctcacca

SEQ ID NO: 533816 - DNA, 25 bp, Rattus norvegicus
gtttgcattcggcagctgaacgtct

SEQ ID NO: 533817 - DNA, 25 bp, Rattus norvegicus
gtttgcattcgggagctgaacgtct

SEQ ID NO: 533818 - DNA, 25 bp, Rattus norvegicus
gtttgcatttcaccaaccacctgta

SEQ ID NO: 533819 - DNA, 25 bp, Rattus norvegicus
gtttgcatttcagcaaccacctgta

SEQ ID NO: 533820 - DNA, 25 bp, Rattus norvegicus
gtttgcattttgcataatctccatg

SEQ ID NO: 533821 - DNA, 25 bp, Rattus norvegicus
gtttgcattttggataatctccatg

SEQ ID NO: 533822 - DNA, 25 bp, Rattus norvegicus
gtttgccaatagatacccactgtac

SEQ ID NO: 533823 - DNA, 25 bp, Rattus norvegicus
gtttgccaatagttacccactgtac

SEQ ID NO: 533824 - DNA, 25 bp, Rattus norvegicus
gtttgccacactacatgctgtatat

SEQ ID NO: 533825 - DNA, 25 bp, Rattus norvegicus
gtttgccacacttcatgctgtatat

SEQ ID NO: 533826 - DNA, 25 bp, Rattus norvegicus
gtttgccaccaacatgacttcaagt

SEQ ID NO: 533827 - DNA, 25 bp, Rattus norvegicus
gtttgccaccaagatgacttcaagt

SEQ ID NO: 533828 - DNA, 25 bp, Rattus norvegicus
gtttgccaccacagggacttggatc

SEQ ID NO: 533829 - DNA, 25 bp, Rattus norvegicus
gtttgccaccactgggacttggatc

SEQ ID NO: 533830 - DNA, 25 bp, Rattus norvegicus
gtttgccacccacgatgtctgtgag

SEQ ID NO: 533831 - DNA, 25 bp, Rattus norvegicus
gtttgccacccaggatgtctgtgag

SEQ ID NO: 533832 - DNA, 25 bp, Rattus norvegicus
gtttgccacctaaacgtacgcattt

SEQ ID NO: 533833 - DNA, 25 bp, Rattus norvegicus
gtttgccacctatacgtacgcattt

SEQ ID NO: 533834 - DNA, 25 bp, Rattus norvegicus
gtttgccacgtgagaagcagcaccg

SEQ ID NO: 533835 - DNA, 25 bp, Rattus norvegicus
gtttgccacgtgtgaagcagcaccg

SEQ ID NO: 533836 - DNA, 25 bp, Rattus norvegicus
gtttgccactacatttcaacagttt

SEQ ID NO: 533837 - DNA, 25 bp, Rattus norvegicus
gtttgccactacttttcaacagttt

SEQ ID NO: 533838 - DNA, 25 bp, Rattus norvegicus
gtttgccacttaaccaatcagagcc

SEQ ID NO: 533839 - DNA, 25 bp, Rattus norvegicus
gtttgccacttatccaatcagagcc

SEQ ID NO: 533840 - DNA, 25 bp, Rattus norvegicus
gtttgccaggaactgcaccttgtat

SEQ ID NO: 533841 - DNA, 25 bp, Rattus norvegicus
gtttgccaggaagtgcaccttgtat

SEQ ID NO: 533842 - DNA, 25 bp, Rattus norvegicus
gtttgccatgctatgtttgctcatc

SEQ ID NO: 533843 - DNA, 25 bp, Rattus norvegicus
gtttgccatgctttgtttgctcatc

SEQ ID NO: 533844 - DNA, 25 bp, Rattus norvegicus
gtttgccatggactcagactgaagc

SEQ ID NO: 533845 - DNA, 25 bp, Rattus norvegicus
gtttgccatggagtcagactgaagc

SEQ ID NO: 533846 - DNA, 25 bp, Rattus norvegicus
gtttgccattgtacccacaactgtt

SEQ ID NO: 533847 - DNA, 25 bp, Rattus norvegicus
gtttgccattgttcccacaactgtt

SEQ ID NO: 533848 - DNA, 25 bp, Rattus norvegicus
gtttgccattttcatgccttgtata

SEQ ID NO: 533849 - DNA, 25 bp, Rattus norvegicus
gtttgccattttcctgacactaaga

SEQ ID NO: 533850 - DNA, 25 bp, Rattus norvegicus
gtttgccattttgatgccttgtata

SEQ ID NO: 533851 - DNA, 25 bp, Rattus norvegicus
gtttgccattttgctgacactaaga

SEQ ID NO: 533852 - DNA, 25 bp, Rattus norvegicus
gtttgcccaaagagagacatttaca

SEQ ID NO: 533853 - DNA, 25 bp, Rattus norvegicus
gtttgcccaaagtgagacatttaca

SEQ ID NO: 533854 - DNA, 25 bp, Rattus norvegicus
gtttgcccaagcattacccatttga

SEQ ID NO: 533855 - DNA, 25 bp, Rattus norvegicus
gtttgcccaagctttacccatttga

SEQ ID NO: 533856 - DNA, 25 bp, Rattus norvegicus
gtttgcccaatgacactggcagtca

SEQ ID NO: 533857 - DNA, 25 bp, Rattus norvegicus
gtttgcccaatgtcactggcagtca

SEQ ID NO: 533858 - DNA, 25 bp, Rattus norvegicus
gtttgcccacaaatttagcttccat

SEQ ID NO: 533859 - DNA, 25 bp, Rattus norvegicus
gtttgcccacaattttagcttccat

SEQ ID NO: 533860 - DNA, 25 bp, Rattus norvegicus
gtttgcccactgatcttgaagccaa

SEQ ID NO: 533861 - DNA, 25 bp, Rattus norvegicus
gtttgcccactgttcttgaagccaa

SEQ ID NO: 533862 - DNA, 25 bp, Rattus norvegicus
gtttgccccagacgctgatggagat

SEQ ID NO: 533863 - DNA, 25 bp, Rattus norvegicus
gtttgccccagaggctgatggagat

SEQ ID NO: 533864 - DNA, 25 bp, Rattus norvegicus
gtttgcccctgtactgtagagagga

SEQ ID NO: 533865 - DNA, 25 bp, Rattus norvegicus
gtttgcccctgttctgtagagagga

SEQ ID NO: 533866 - DNA, 25 bp, Rattus norvegicus
gtttgcccgcacactgttttaacac

SEQ ID NO: 533867 - DNA, 25 bp, Rattus norvegicus
gtttgcccgcactctgttttaacac

SEQ ID NO: 533868 - DNA, 25 bp, Rattus norvegicus
gtttgccctcataccatggatgatg

SEQ ID NO: 533869 - DNA, 25 bp, Rattus norvegicus
gtttgccctcattccatggatgatg

SEQ ID NO: 533870 - DNA, 25 bp, Rattus norvegicus
gtttgccctctaatgccactagaaa

SEQ ID NO: 533871 - DNA, 25 bp, Rattus norvegicus
gtttgccctctattgccactagaaa

SEQ ID NO: 533872 - DNA, 25 bp, Rattus norvegicus
gtttgccctgcacaattgtgtggtg

SEQ ID NO: 533873 - DNA, 25 bp, Rattus norvegicus
gtttgccctgcagaattgtgtggtg

SEQ ID NO: 533874 - DNA, 25 bp, Rattus norvegicus
gtttgcccttcacttcatgtacatg

SEQ ID NO: 533875 - DNA, 25 bp, Rattus norvegicus
gtttgcccttcagttcatgtacatg

SEQ ID NO: 533876 - DNA, 25 bp, Rattus norvegicus
gtttgcccttctctgaaggtggaag

SEQ ID NO: 533877 - DNA, 25 bp, Rattus norvegicus
gtttgcccttctgtgaaggtggaag

SEQ ID NO: 533878 - DNA, 25 bp, Rattus norvegicus
gtttgccgaactcttactgttatgg

SEQ ID NO: 533879 - DNA, 25 bp, Rattus norvegicus
gtttgccgaactgttactgttatgg

SEQ ID NO: 533880 - DNA, 25 bp, Rattus norvegicus
gtttgccgaagcaccgtgaaaggtt

SEQ ID NO: 533881 - DNA, 25 bp, Rattus norvegicus
gtttgccgaagctccgtgaaaggtt

SEQ ID NO: 533882 - DNA, 25 bp, Rattus norvegicus
gtttgccgcaaacctgccaactggg

SEQ ID NO: 533883 - DNA, 25 bp, Rattus norvegicus
gtttgccgcaaagctgccaactggg

SEQ ID NO: 533884 - DNA, 25 bp, Rattus norvegicus
gtttgccgggctcctttgtgaagaa

SEQ ID NO: 533885 - DNA, 25 bp, Rattus norvegicus
gtttgccgggctgctttgtgaagaa

SEQ ID NO: 533886 - DNA, 25 bp, Rattus norvegicus
gtttgccggttaaaaagctgttcat

SEQ ID NO: 533887 - DNA, 25 bp, Rattus norvegicus
gtttgccggttataaagctgttcat

SEQ ID NO: 533888 - DNA, 25 bp, Rattus norvegicus
gtttgcctaaccacttatgtctttc

SEQ ID NO: 533889 - DNA, 25 bp, Rattus norvegicus
gtttgcctaacctcttatgtctttc

SEQ ID NO: 533890 - DNA, 25 bp, Rattus norvegicus
gtttgcctactacaaattgaacgat

SEQ ID NO: 533891 - DNA, 25 bp, Rattus norvegicus
gtttgcctactagaaattgaacgat

SEQ ID NO: 533892 - DNA, 25 bp, Rattus norvegicus
gtttgcctagcaaatgtccactttt

SEQ ID NO: 533893 - DNA, 25 bp, Rattus norvegicus
gtttgcctagcatatgtccactttt

SEQ ID NO: 533894 - DNA, 25 bp, Rattus norvegicus
gtttgcctagcgataaaaagctgag

SEQ ID NO: 533895 - DNA, 25 bp, Rattus norvegicus
gtttgcctagcgttaaaaagctgag

SEQ ID NO: 533896 - DNA, 25 bp, Rattus norvegicus
gtttgcctatgtatatgtgcgctgt

SEQ ID NO: 533897 - DNA, 25 bp, Rattus norvegicus
gtttgcctatgtttatgtgcgctgt

SEQ ID NO: 533898 - DNA, 25 bp, Rattus norvegicus
gtttgcctcatcatcagcgttctat

SEQ ID NO: 533899 - DNA, 25 bp, Rattus norvegicus
gtttgcctcatcttcagcgttctat

SEQ ID NO: 533900 - DNA, 25 bp, Rattus norvegicus
gtttgcctcgtgctacccaggaaga

SEQ ID NO: 533901 - DNA, 25 bp, Rattus norvegicus
gtttgcctcgtggtacccaggaaga

SEQ ID NO: 533902 - DNA, 25 bp, Rattus norvegicus
gtttgcctctaacctggacgactgc

SEQ ID NO: 533903 - DNA, 25 bp, Rattus norvegicus
gtttgcctctaagctggacgactgc

SEQ ID NO: 533904 - DNA, 25 bp, Rattus norvegicus
gtttgcctctctaccaggaatcata

SEQ ID NO: 533905 - DNA, 25 bp, Rattus norvegicus
gtttgcctctcttccaggaatcata

SEQ ID NO: 533906 - DNA, 25 bp, Rattus norvegicus
gtttgcctctgaactgctaattcca

SEQ ID NO: 533907 - DNA, 25 bp, Rattus norvegicus
gtttgcctctgatctgctaattcca

SEQ ID NO: 533908 - DNA, 25 bp, Rattus norvegicus
gtttgcctctgtctgaaattcactg

SEQ ID NO: 533909 - DNA, 25 bp, Rattus norvegicus
gtttgcctctgtgtgaaattcactg

SEQ ID NO: 533910 - DNA, 25 bp, Rattus norvegicus
gtttgcctctttctcaagtggaatc

SEQ ID NO: 533911 - DNA, 25 bp, Rattus norvegicus
gtttgcctctttgtcaagtggaatc

SEQ ID NO: 533912 - DNA, 25 bp, Rattus norvegicus
gtttgcctgcagaaggactcatcgc

SEQ ID NO: 533913 - DNA, 25 bp, Rattus norvegicus
gtttgcctgcagtaggactcatcgc

SEQ ID NO: 533914 - DNA, 25 bp, Rattus norvegicus
gtttgcctgttgacagagaccttat

SEQ ID NO: 533915 - DNA, 25 bp, Rattus norvegicus
gtttgcctgttgtcagagaccttat

SEQ ID NO: 533916 - DNA, 25 bp, Rattus norvegicus
gtttgccttaatacttacctcattt

SEQ ID NO: 533917 - DNA, 25 bp, Rattus norvegicus
gtttgccttaattcttacctcattt

SEQ ID NO: 533918 - DNA, 25 bp, Rattus norvegicus
gtttgccttagcaggatagctactc

SEQ ID NO: 533919 - DNA, 25 bp, Rattus norvegicus
gtttgccttagctggatagctactc

SEQ ID NO: 533920 - DNA, 25 bp, Rattus norvegicus
gtttgccttattatgaaagctgatc

SEQ ID NO: 533921 - DNA, 25 bp, Rattus norvegicus
gtttgccttattttgaaagctgatc

SEQ ID NO: 533922 - DNA, 25 bp, Rattus norvegicus
gtttgccttgacacagatcactttg

SEQ ID NO: 533923 - DNA, 25 bp, Rattus norvegicus
gtttgccttgactcagatcactttg

SEQ ID NO: 533924 - DNA, 25 bp, Rattus norvegicus
gtttgccttgcaagcctatgagagc

SEQ ID NO: 533925 - DNA, 25 bp, Rattus norvegicus
gtttgccttgcatgcctatgagagc

SEQ ID NO: 533926 - DNA, 25 bp, Rattus norvegicus
gtttgccttggaatcagtgtccatt

SEQ ID NO: 533927 - DNA, 25 bp, Rattus norvegicus
gtttgccttggattcagtgtccatt

SEQ ID NO: 533928 - DNA, 25 bp, Rattus norvegicus
gtttgcctttatattacagtacttc

SEQ ID NO: 533929 - DNA, 25 bp, Rattus norvegicus
gtttgcctttattttacagtacttc

SEQ ID NO: 533930 - DNA, 25 bp, Rattus norvegicus
gtttgcctttctctcttactgctta

SEQ ID NO: 533931 - DNA, 25 bp, Rattus norvegicus
gtttgcctttctgtcttactgctta

SEQ ID NO: 533932 - DNA, 25 bp, Rattus norvegicus
gtttgcgaatcgattgagtgctagt

SEQ ID NO: 533933 - DNA, 25 bp, Rattus norvegicus
gtttgcgaatcgtttgagtgctagt

SEQ ID NO: 533934 - DNA, 25 bp, Rattus norvegicus
gtttgcgagcagcagtctgaactct

SEQ ID NO: 533935 - DNA, 25 bp, Rattus norvegicus
gtttgcgagcaggagtctgaactct

SEQ ID NO: 533936 - DNA, 25 bp, Rattus norvegicus
gtttgcgattccaagggctttttca

SEQ ID NO: 533937 - DNA, 25 bp, Rattus norvegicus
gtttgcgattcctagggctttttca

SEQ ID NO: 533938 - DNA, 25 bp, Rattus norvegicus
gtttgcggatgaagcactttaccaa

SEQ ID NO: 533939 - DNA, 25 bp, Rattus norvegicus
gtttgcggatgatgcactttaccaa

SEQ ID NO: 533940 - DNA, 25 bp, Rattus norvegicus
gtttgcgggactagcagctgatttt

SEQ ID NO: 533941 - DNA, 25 bp, Rattus norvegicus
gtttgcgggacttgcagctgatttt

SEQ ID NO: 533942 - DNA, 25 bp, Rattus norvegicus
gtttgcgtagtgacttcactgcatt

SEQ ID NO: 533943 - DNA, 25 bp, Rattus norvegicus
gtttgcgtagtgtcttcactgcatt

SEQ ID NO: 533944 - DNA, 25 bp, Rattus norvegicus
gtttgcgtgtgcatgcatctgttta

SEQ ID NO: 533945 - DNA, 25 bp, Rattus norvegicus
gtttgcgtgtgcttgcatctgttta

SEQ ID NO: 533946 - DNA, 25 bp, Rattus norvegicus
gtttgcgtgtttatggatggaagta

SEQ ID NO: 533947 - DNA, 25 bp, Rattus norvegicus
gtttgcgtgtttttggatggaagta

SEQ ID NO: 533948 - DNA, 25 bp, Rattus norvegicus
gtttgctacctccactgtgttgcag

SEQ ID NO: 533949 - DNA, 25 bp, Rattus norvegicus
gtttgctacctcgactgtgttgcag

SEQ ID NO: 533950 - DNA, 25 bp, Rattus norvegicus
gtttgctactgaagactgactcgct

SEQ ID NO: 533951 - DNA, 25 bp, Rattus norvegicus
gtttgctactgatgactgactcgct

SEQ ID NO: 533952 - DNA, 25 bp, Rattus norvegicus
gtttgctactgtaaaccttgaactt

SEQ ID NO: 533953 - DNA, 25 bp, Rattus norvegicus
gtttgctactgttaaccttgaactt

SEQ ID NO: 533954 - DNA, 25 bp, Rattus norvegicus
gtttgctagtaactcctttacacta

SEQ ID NO: 533955 - DNA, 25 bp, Rattus norvegicus
gtttgctagtaagtcctttacacta

SEQ ID NO: 533956 - DNA, 25 bp, Rattus norvegicus
gtttgctagtttaatgcacccattg

SEQ ID NO: 533957 - DNA, 25 bp, Rattus norvegicus
gtttgctagttttatgcacccattg

SEQ ID NO: 533958 - DNA, 25 bp, Rattus norvegicus
gtttgctatctccaactgttacatt

SEQ ID NO: 533959 - DNA, 25 bp, Rattus norvegicus
gtttgctatctcgaactgttacatt

SEQ ID NO: 533960 - DNA, 25 bp, Rattus norvegicus
gtttgctatcttctgttgtggttaa

SEQ ID NO: 533961 - DNA, 25 bp, Rattus norvegicus
gtttgctatcttgtgttgtggttaa

SEQ ID NO: 533962 - DNA, 25 bp, Rattus norvegicus
gtttgctatggcagttgtctgatta

SEQ ID NO: 533963 - DNA, 25 bp, Rattus norvegicus
gtttgctatggctgttgtctgatta

SEQ ID NO: 533964 - DNA, 25 bp, Rattus norvegicus
gtttgctattaaacgaggactgagt

SEQ ID NO: 533965 - DNA, 25 bp, Rattus norvegicus
gtttgctattaatcgaggactgagt

SEQ ID NO: 533966 - DNA, 25 bp, Rattus norvegicus
gtttgctatttgctacggaccagga

SEQ ID NO: 533967 - DNA, 25 bp, Rattus norvegicus
gtttgctatttggtacggaccagga

SEQ ID NO: 533968 - DNA, 25 bp, Rattus norvegicus
gtttgctcacaaaccatctgcaaag

SEQ ID NO: 533969 - DNA, 25 bp, Rattus norvegicus
gtttgctcacaatccatctgcaaag

SEQ ID NO: 533970 - DNA, 25 bp, Rattus norvegicus
gtttgctcacctccatggttatttt

SEQ ID NO: 533971 - DNA, 25 bp, Rattus norvegicus
gtttgctcacctgcatggttatttt

SEQ ID NO: 533972 - DNA, 25 bp, Rattus norvegicus
gtttgctcatggacaagtttgccca

SEQ ID NO: 533973 - DNA, 25 bp, Rattus norvegicus
gtttgctcatggtcaagtttgccca

SEQ ID NO: 533974 - DNA, 25 bp, Rattus norvegicus
gtttgctccaagaacttttatgacc

SEQ ID NO: 533975 - DNA, 25 bp, Rattus norvegicus
gtttgctccaagtacttttatgacc

SEQ ID NO: 533976 - DNA, 25 bp, Rattus norvegicus
gtttgctccgcactgaatttgtact

SEQ ID NO: 533977 - DNA, 25 bp, Rattus norvegicus
gtttgctccgcagtgaatttgtact

SEQ ID NO: 533978 - DNA, 25 bp, Rattus norvegicus
gtttgctccgttatcatgacgattt

SEQ ID NO: 533979 - DNA, 25 bp, Rattus norvegicus
gtttgctccgttttcatgacgattt

SEQ ID NO: 533980 - DNA, 25 bp, Rattus norvegicus
gtttgctcggtactgaagccaggtc

SEQ ID NO: 533981 - DNA, 25 bp, Rattus norvegicus
gtttgctcggtagtgaagccaggtc

SEQ ID NO: 533982 - DNA, 25 bp, Rattus norvegicus
gtttgctctgagaagtcacctagtc

SEQ ID NO: 533983 - DNA, 25 bp, Rattus norvegicus
gtttgctctgagtagtcacctagtc

SEQ ID NO: 533984 - DNA, 25 bp, Rattus norvegicus
gtttgctctgccatagtgtacacat

SEQ ID NO: 533985 - DNA, 25 bp, Rattus norvegicus
gtttgctctgccttagtgtacacat

SEQ ID NO: 533986 - DNA, 25 bp, Rattus norvegicus
gtttgctctgtcaatggacaataaa

SEQ ID NO: 533987 - DNA, 25 bp, Rattus norvegicus
gtttgctctgtctatggacaataaa

SEQ ID NO: 533988 - DNA, 25 bp, Rattus norvegicus
gtttgctctgtgaagcccttaggaa

SEQ ID NO: 533989 - DNA, 25 bp, Rattus norvegicus
gtttgctctgtgacgggagacctca

SEQ ID NO: 533990 - DNA, 25 bp, Rattus norvegicus
gtttgctctgtgtagcccttaggaa

SEQ ID NO: 533991 - DNA, 25 bp, Rattus norvegicus
gtttgctctgtgtcgggagacctca

SEQ ID NO: 533992 - DNA, 25 bp, Rattus norvegicus
gtttgctcttctcagtgagtacatg

SEQ ID NO: 533993 - DNA, 25 bp, Rattus norvegicus
gtttgctcttctgagtgagtacatg

SEQ ID NO: 533994 - DNA, 25 bp, Rattus norvegicus
gtttgctcttgtattctagctttga

SEQ ID NO: 533995 - DNA, 25 bp, Rattus norvegicus
gtttgctcttgttttctagctttga

SEQ ID NO: 533996 - DNA, 25 bp, Rattus norvegicus
gtttgctctttacctgctcagtgaa

SEQ ID NO: 533997 - DNA, 25 bp, Rattus norvegicus
gtttgctctttagctgctcagtgaa

SEQ ID NO: 533998 - DNA, 25 bp, Rattus norvegicus
gtttgctgaattcttggctctggag

SEQ ID NO: 533999 - DNA, 25 bp, Rattus norvegicus
gtttgctgaattgttggctctggag

SEQ ID NO: 534000 - DNA, 25 bp, Rattus norvegicus
gtttgctgagacatgaattcctttg

SEQ ID NO: 534001 - DNA, 25 bp, Rattus norvegicus
gtttgctgagacttgaattcctttg

SEQ ID NO: 534002 - DNA, 25 bp, Rattus norvegicus
gtttgctgagataggaacgttcctc

SEQ ID NO: 534003 - DNA, 25 bp, Rattus norvegicus
gtttgctgagattggaacgttcctc

SEQ ID NO: 534004 - DNA, 25 bp, Rattus norvegicus
gtttgctgcagacgcctccagagga

SEQ ID NO: 534005 - DNA, 25 bp, Rattus norvegicus
gtttgctgcagaggcctccagagga

SEQ ID NO: 534006 - DNA, 25 bp, Rattus norvegicus
gtttgctgccaactatttatattaa

SEQ ID NO: 534007 - DNA, 25 bp, Rattus norvegicus
gtttgctgccaagtatttatattaa

SEQ ID NO: 534008 - DNA, 25 bp, Rattus norvegicus
gtttgctgccacaataaaatcacat

SEQ ID NO: 534009 - DNA, 25 bp, Rattus norvegicus
gtttgctgccactataaaatcacat

SEQ ID NO: 534010 - DNA, 25 bp, Rattus norvegicus
gtttgctgccctcggacgagtgaac

SEQ ID NO: 534011 - DNA, 25 bp, Rattus norvegicus
gtttgctgccctgggacgagtgaac

SEQ ID NO: 534012 - DNA, 25 bp, Rattus norvegicus
gtttgctgcctaatgcaaggctggt

SEQ ID NO: 534013 - DNA, 25 bp, Rattus norvegicus
gtttgctgcctattgcaaggctggt

SEQ ID NO: 534014 - DNA, 25 bp, Rattus norvegicus
gtttgctgcgttagtggtagcttta

SEQ ID NO: 534015 - DNA, 25 bp, Rattus norvegicus
gtttgctgcgtttgtggtagcttta

SEQ ID NO: 534016 - DNA, 25 bp, Rattus norvegicus
gtttgctgctaaattccaatgtaga

SEQ ID NO: 534017 - DNA, 25 bp, Rattus norvegicus
gtttgctgctaacgtcaacccatca

SEQ ID NO: 534018 - DNA, 25 bp, Rattus norvegicus
gtttgctgctaaggtcaacccatca

SEQ ID NO: 534019 - DNA, 25 bp, Rattus norvegicus
gtttgctgctaatttccaatgtaga

SEQ ID NO: 534020 - DNA, 25 bp, Rattus norvegicus
gtttgctgctccctaaagccgaagg

SEQ ID NO: 534021 - DNA, 25 bp, Rattus norvegicus
gtttgctgctccgtaaagccgaagg

SEQ ID NO: 534022 - DNA, 25 bp, Rattus norvegicus
gtttgctgctttcagtacctctgta

SEQ ID NO: 534023 - DNA, 25 bp, Rattus norvegicus
gtttgctgctttgagtacctctgta

SEQ ID NO: 534024 - DNA, 25 bp, Rattus norvegicus
gtttgctggcgaagttaactgctaa

SEQ ID NO: 534025 - DNA, 25 bp, Rattus norvegicus
gtttgctggcgatgttaactgctaa

SEQ ID NO: 534026 - DNA, 25 bp, Rattus norvegicus
gtttgctggctaaaccgacaacttg

SEQ ID NO: 534027 - DNA, 25 bp, Rattus norvegicus
gtttgctggctactttgtcctgtgc

SEQ ID NO: 534028 - DNA, 25 bp, Rattus norvegicus
gtttgctggctagtttgtcctgtgc

SEQ ID NO: 534029 - DNA, 25 bp, Rattus norvegicus
gtttgctggctataccgacaacttg

SEQ ID NO: 534030 - DNA, 25 bp, Rattus norvegicus
gtttgctggctccaaggtcacacac

SEQ ID NO: 534031 - DNA, 25 bp, Rattus norvegicus
gtttgctggctcgaaggtcacacac

SEQ ID NO: 534032 - DNA, 25 bp, Rattus norvegicus
gtttgctggtccctggtttataaga

SEQ ID NO: 534033 - DNA, 25 bp, Rattus norvegicus
gtttgctggtccgtggtttataaga

SEQ ID NO: 534034 - DNA, 25 bp, Rattus norvegicus
gtttgctggtctctggtttgtaatc

SEQ ID NO: 534035 - DNA, 25 bp, Rattus norvegicus
gtttgctggtctgtggtttgtaatc

SEQ ID NO: 534036 - DNA, 25 bp, Rattus norvegicus
gtttgctgtcctacttgcttaagta

SEQ ID NO: 534037 - DNA, 25 bp, Rattus norvegicus
gtttgctgtccttcttgcttaagta

SEQ ID NO: 534038 - DNA, 25 bp, Rattus norvegicus
gtttgctgtgaaacctgaccacgtt

SEQ ID NO: 534039 - DNA, 25 bp, Rattus norvegicus
gtttgctgtgaatcctgaccacgtt

SEQ ID NO: 534040 - DNA, 25 bp, Rattus norvegicus
gtttgctgtgagacttccacattta

SEQ ID NO: 534041 - DNA, 25 bp, Rattus norvegicus
gtttgctgtgagcaacggcacccag

SEQ ID NO: 534042 - DNA, 25 bp, Rattus norvegicus
gtttgctgtgaggaacggcacccag

SEQ ID NO: 534043 - DNA, 25 bp, Rattus norvegicus
gtttgctgtgagtcttccacattta

SEQ ID NO: 534044 - DNA, 25 bp, Rattus norvegicus
gtttgctgtgcaatgccaacatttt

SEQ ID NO: 534045 - DNA, 25 bp, Rattus norvegicus
gtttgctgtgcattgccaacatttt

SEQ ID NO: 534046 - DNA, 25 bp, Rattus norvegicus
gtttgctgtggcatatttgtgtact

SEQ ID NO: 534047 - DNA, 25 bp, Rattus norvegicus
gtttgctgtggccattgtaatttaa

SEQ ID NO: 534048 - DNA, 25 bp, Rattus norvegicus
gtttgctgtggcgattgtaatttaa

SEQ ID NO: 534049 - DNA, 25 bp, Rattus norvegicus
gtttgctgtggcttatttgtgtact

SEQ ID NO: 534050 - DNA, 25 bp, Rattus norvegicus
gtttgctgttgtaacagagctacct

SEQ ID NO: 534051 - DNA, 25 bp, Rattus norvegicus
gtttgctgttgttacagagctacct

SEQ ID NO: 534052 - DNA, 25 bp, Rattus norvegicus
gtttgctgtttgaatccaatgcaca

SEQ ID NO: 534053 - DNA, 25 bp, Rattus norvegicus
gtttgctgtttgtatccaatgcaca

SEQ ID NO: 534054 - DNA, 25 bp, Rattus norvegicus
gtttgcttaaccatagctccaagaa

SEQ ID NO: 534055 - DNA, 25 bp, Rattus norvegicus
gtttgcttaaccttagctccaagaa

SEQ ID NO: 534056 - DNA, 25 bp, Rattus norvegicus
gtttgcttacttactatactgctga

SEQ ID NO: 534057 - DNA, 25 bp, Rattus norvegicus
gtttgcttacttcttgcatgaccat

SEQ ID NO: 534058 - DNA, 25 bp, Rattus norvegicus
gtttgcttacttgttgcatgaccat

SEQ ID NO: 534059 - DNA, 25 bp, Rattus norvegicus
gtttgcttactttctatactgctga

SEQ ID NO: 534060 - DNA, 25 bp, Rattus norvegicus
gtttgcttagctctgttttcctaat

SEQ ID NO: 534061 - DNA, 25 bp, Rattus norvegicus
gtttgcttagctgtgttttcctaat

SEQ ID NO: 534062 - DNA, 25 bp, Rattus norvegicus
gtttgcttatggaaaatttgcctga

SEQ ID NO: 534063 - DNA, 25 bp, Rattus norvegicus
gtttgcttatggtaaatttgcctga

SEQ ID NO: 534064 - DNA, 25 bp, Rattus norvegicus
gtttgcttatttctcatacttctga

SEQ ID NO: 534065 - DNA, 25 bp, Rattus norvegicus
gtttgcttatttgtcatacttctga

SEQ ID NO: 534066 - DNA, 25 bp, Rattus norvegicus
gtttgcttccaaaatggcttcgtat

SEQ ID NO: 534067 - DNA, 25 bp, Rattus norvegicus
gtttgcttccaatatggcttcgtat

SEQ ID NO: 534068 - DNA, 25 bp, Rattus norvegicus
gtttgcttccacaacatttttgagg

SEQ ID NO: 534069 - DNA, 25 bp, Rattus norvegicus
gtttgcttccactacatttttgagg

SEQ ID NO: 534070 - DNA, 25 bp, Rattus norvegicus
gtttgcttccatatgtagtctctcc

SEQ ID NO: 534071 - DNA, 25 bp, Rattus norvegicus
gtttgcttccatttgtagtctctcc

SEQ ID NO: 534072 - DNA, 25 bp, Rattus norvegicus
gtttgcttccggctttaaatctaag

SEQ ID NO: 534073 - DNA, 25 bp, Rattus norvegicus
gtttgcttccgggtttaaatctaag

SEQ ID NO: 534074 - DNA, 25 bp, Rattus norvegicus
gtttgcttccttccttcaaaatgta

SEQ ID NO: 534075 - DNA, 25 bp, Rattus norvegicus
gtttgcttccttgcttcaaaatgta

SEQ ID NO: 534076 - DNA, 25 bp, Rattus norvegicus
gtttgcttctcaaacatcttggttt

SEQ ID NO: 534077 - DNA, 25 bp, Rattus norvegicus
gtttgcttctcatacatcttggttt

SEQ ID NO: 534078 - DNA, 25 bp, Rattus norvegicus
gtttgcttctttagaaatcgtgtga

SEQ ID NO: 534079 - DNA, 25 bp, Rattus norvegicus
gtttgcttcttttgaaatcgtgtga

SEQ ID NO: 534080 - DNA, 25 bp, Rattus norvegicus
gtttgcttgcttagtgttgtagatg

SEQ ID NO: 534081 - DNA, 25 bp, Rattus norvegicus
gtttgcttgctttgtgttgtagatg

SEQ ID NO: 534082 - DNA, 25 bp, Rattus norvegicus
gtttgcttgtataagctgtgccttc

SEQ ID NO: 534083 - DNA, 25 bp, Rattus norvegicus
gtttgcttgtattagctgtgccttc

SEQ ID NO: 534084 - DNA, 25 bp, Rattus norvegicus
gtttgcttgtctataattctgttta

SEQ ID NO: 534085 - DNA, 25 bp, Rattus norvegicus
gtttgcttgtctttaattctgttta

SEQ ID NO: 534086 - DNA, 25 bp, Rattus norvegicus
gtttgctttatacttccccagaatc

SEQ ID NO: 534087 - DNA, 25 bp, Rattus norvegicus
gtttgctttatagttccccagaatc

SEQ ID NO: 534088 - DNA, 25 bp, Rattus norvegicus
gtttgctttattaagcccagacact

SEQ ID NO: 534089 - DNA, 25 bp, Rattus norvegicus
gtttgctttatttagcccagacact

SEQ ID NO: 534090 - DNA, 25 bp, Rattus norvegicus
gtttgctttcaaatccaagaggagc

SEQ ID NO: 534091 - DNA, 25 bp, Rattus norvegicus
gtttgctttcaattccaagaggagc

SEQ ID NO: 534092 - DNA, 25 bp, Rattus norvegicus
gtttgctttctcagccaattaaaga

SEQ ID NO: 534093 - DNA, 25 bp, Rattus norvegicus
gtttgctttctctgccaattaaaga

SEQ ID NO: 534094 - DNA, 25 bp, Rattus norvegicus
gtttgctttcttcacatattctttc

SEQ ID NO: 534095 - DNA, 25 bp, Rattus norvegicus
gtttgctttcttcgtgtggttttca

SEQ ID NO: 534096 - DNA, 25 bp, Rattus norvegicus
gtttgctttcttgacatattctttc

SEQ ID NO: 534097 - DNA, 25 bp, Rattus norvegicus
gtttgctttcttggtgtggttttca

SEQ ID NO: 534098 - DNA, 25 bp, Rattus norvegicus
gtttgctttgtactggcatacagat

SEQ ID NO: 534099 - DNA, 25 bp, Rattus norvegicus
gtttgctttgtagtggcatacagat

SEQ ID NO: 534100 - DNA, 25 bp, Rattus norvegicus
gtttgcttttccatgtggagtttat

SEQ ID NO: 534101 - DNA, 25 bp, Rattus norvegicus
gtttgcttttccttgtggagtttat

SEQ ID NO: 534102 - DNA, 25 bp, Rattus norvegicus
gtttgcttttctctacctggtaact

SEQ ID NO: 534103 - DNA, 25 bp, Rattus norvegicus
gtttgcttttctgtacctggtaact

SEQ ID NO: 534104 - DNA, 25 bp, Rattus norvegicus
gtttgctttttaactgcctctcaga

SEQ ID NO: 534105 - DNA, 25 bp, Rattus norvegicus
gtttgctttttacatcttagcgtta

SEQ ID NO: 534106 - DNA, 25 bp, Rattus norvegicus
gtttgctttttagatcttagcgtta

SEQ ID NO: 534107 - DNA, 25 bp, Rattus norvegicus
gtttgctttttatctgcctctcaga

SEQ ID NO: 534108 - DNA, 25 bp, Rattus norvegicus
gtttggaacgatcttctctctctca

SEQ ID NO: 534109 - DNA, 25 bp, Rattus norvegicus
gtttggaacgatgttctctctctca

SEQ ID NO: 534110 - DNA, 25 bp, Rattus norvegicus
gtttggaactcacgtgactaggaat

SEQ ID NO: 534111 - DNA, 25 bp, Rattus norvegicus
gtttggaactcaggtgactaggaat

SEQ ID NO: 534112 - DNA, 25 bp, Rattus norvegicus
gtttggaactccacgttagaagcga

SEQ ID NO: 534113 - DNA, 25 bp, Rattus norvegicus
gtttggaactcctcgttagaagcga

SEQ ID NO: 534114 - DNA, 25 bp, Rattus norvegicus
gtttggaactttatgaacaccctga

SEQ ID NO: 534115 - DNA, 25 bp, Rattus norvegicus
gtttggaactttttgaacaccctga

SEQ ID NO: 534116 - DNA, 25 bp, Rattus norvegicus
gtttggaagtccctattgtcagtga

SEQ ID NO: 534117 - DNA, 25 bp, Rattus norvegicus
gtttggaagtccgtattgtcagtga

SEQ ID NO: 534118 - DNA, 25 bp, Rattus norvegicus
gtttggaatatgaggtgactctgca

SEQ ID NO: 534119 - DNA, 25 bp, Rattus norvegicus
gtttggaatatgtggtgactctgca

SEQ ID NO: 534120 - DNA, 25 bp, Rattus norvegicus
gtttggaatgcaccacattgctgat

SEQ ID NO: 534121 - DNA, 25 bp, Rattus norvegicus
gtttggaatgcagcacattgctgat

SEQ ID NO: 534122 - DNA, 25 bp, Rattus norvegicus
gtttggaatggactcagactctgca

SEQ ID NO: 534123 - DNA, 25 bp, Rattus norvegicus
gtttggaatggagtcagactctgca

SEQ ID NO: 534124 - DNA, 25 bp, Rattus norvegicus
gtttggaattcaatacatcatcttc

SEQ ID NO: 534125 - DNA, 25 bp, Rattus norvegicus
gtttggaattcattacatcatcttc

SEQ ID NO: 534126 - DNA, 25 bp, Rattus norvegicus
gtttggaattgacccagtcacctca

SEQ ID NO: 534127 - DNA, 25 bp, Rattus norvegicus
gtttggaattgagccagtcacctca

SEQ ID NO: 534128 - DNA, 25 bp, Rattus norvegicus
gtttggacaaagcttcagggatttt

SEQ ID NO: 534129 - DNA, 25 bp, Rattus norvegicus
gtttggacaaaggttcagggatttt

SEQ ID NO: 534130 - DNA, 25 bp, Rattus norvegicus
gtttggacacgacgtcaaggactgt

SEQ ID NO: 534131 - DNA, 25 bp, Rattus norvegicus
gtttggacacgaggtcaaggactgt

SEQ ID NO: 534132 - DNA, 25 bp, Rattus norvegicus
gtttggacatatcaagacttgggtt

SEQ ID NO: 534133 - DNA, 25 bp, Rattus norvegicus
gtttggacatatgaagacttgggtt

SEQ ID NO: 534134 - DNA, 25 bp, Rattus norvegicus
gtttggacattcaagggcctggtat

SEQ ID NO: 534135 - DNA, 25 bp, Rattus norvegicus
gtttggacattctagggcctggtat

SEQ ID NO: 534136 - DNA, 25 bp, Rattus norvegicus
gtttggaccattatcggccggaagt

SEQ ID NO: 534137 - DNA, 25 bp, Rattus norvegicus
gtttggaccattttcggccggaagt

SEQ ID NO: 534138 - DNA, 25 bp, Rattus norvegicus
gtttggacgtttctgatccagcaga

SEQ ID NO: 534139 - DNA, 25 bp, Rattus norvegicus
gtttggacgtttgtgatccagcaga

SEQ ID NO: 534140 - DNA, 25 bp, Rattus norvegicus
gtttggactcttacaatcctggctt

SEQ ID NO: 534141 - DNA, 25 bp, Rattus norvegicus
gtttggactctttcaatcctggctt

SEQ ID NO: 534142 - DNA, 25 bp, Rattus norvegicus
gtttggagccctatttctgggcaat

SEQ ID NO: 534143 - DNA, 25 bp, Rattus norvegicus
gtttggagccctttttctgggcaat

SEQ ID NO: 534144 - DNA, 25 bp, Rattus norvegicus
gtttggagcctgattgactttgcaa

SEQ ID NO: 534145 - DNA, 25 bp, Rattus norvegicus
gtttggagcctgtttgactttgcaa

SEQ ID NO: 534146 - DNA, 25 bp, Rattus norvegicus
gtttggagctttaaattttcattgc

SEQ ID NO: 534147 - DNA, 25 bp, Rattus norvegicus
gtttggagcttttaattttcattgc

SEQ ID NO: 534148 - DNA, 25 bp, Rattus norvegicus
gtttggaggaatactgcaccaccct

SEQ ID NO: 534149 - DNA, 25 bp, Rattus norvegicus
gtttggaggaattctgcaccaccct

SEQ ID NO: 534150 - DNA, 25 bp, Rattus norvegicus
gtttggaggccaccgtctgacgtta

SEQ ID NO: 534151 - DNA, 25 bp, Rattus norvegicus
gtttggaggccagcgtctgacgtta

SEQ ID NO: 534152 - DNA, 25 bp, Rattus norvegicus
gtttggataaacacctcagacatta

SEQ ID NO: 534153 - DNA, 25 bp, Rattus norvegicus
gtttggataaactcctcagacatta

SEQ ID NO: 534154 - DNA, 25 bp, Rattus norvegicus
gtttggatcaaaacaagacccagct

SEQ ID NO: 534155 - DNA, 25 bp, Rattus norvegicus
gtttggatcaaatcaagacccagct

SEQ ID NO: 534156 - DNA, 25 bp, Rattus norvegicus
gtttggatccacagtacataaaaag

SEQ ID NO: 534157 - DNA, 25 bp, Rattus norvegicus
gtttggatccactgtacataaaaag

SEQ ID NO: 534158 - DNA, 25 bp, Rattus norvegicus
gtttggatccccatgaaaggctgga

SEQ ID NO: 534159 - DNA, 25 bp, Rattus norvegicus
gtttggatccccttgaaaggctgga

SEQ ID NO: 534160 - DNA, 25 bp, Rattus norvegicus
gtttggatcctcatcatttcatttg

SEQ ID NO: 534161 - DNA, 25 bp, Rattus norvegicus
gtttggatcctcttcatttcatttg

SEQ ID NO: 534162 - DNA, 25 bp, Rattus norvegicus
gtttggatccttaagcacagctttg

SEQ ID NO: 534163 - DNA, 25 bp, Rattus norvegicus
gtttggatcctttagcacagctttg

SEQ ID NO: 534164 - DNA, 25 bp, Rattus norvegicus
gtttggatttccattatactgtgaa

SEQ ID NO: 534165 - DNA, 25 bp, Rattus norvegicus
gtttggatttcctttatactgtgaa

SEQ ID NO: 534166 - DNA, 25 bp, Rattus norvegicus
gtttggcaatcccactaaccaccat

SEQ ID NO: 534167 - DNA, 25 bp, Rattus norvegicus
gtttggcaatccgactaaccaccat

SEQ ID NO: 534168 - DNA, 25 bp, Rattus norvegicus
gtttggcacaaactgtcgcggctgt

SEQ ID NO: 534169 - DNA, 25 bp, Rattus norvegicus
gtttggcacaaagtgtcgcggctgt

SEQ ID NO: 534170 - DNA, 25 bp, Rattus norvegicus
gtttggcacacgatattatctgctt

SEQ ID NO: 534171 - DNA, 25 bp, Rattus norvegicus
gtttggcacacgttattatctgctt

SEQ ID NO: 534172 - DNA, 25 bp, Rattus norvegicus
gtttggcacatcattcttcaattgt

SEQ ID NO: 534173 - DNA, 25 bp, Rattus norvegicus
gtttggcacatctttcttcaattgt

SEQ ID NO: 534174 - DNA, 25 bp, Rattus norvegicus
gtttggcagttgatggtcattataa

SEQ ID NO: 534175 - DNA, 25 bp, Rattus norvegicus
gtttggcagttgttggtcattataa

SEQ ID NO: 534176 - DNA, 25 bp, Rattus norvegicus
gtttggcatagtaccagtctgtctt

SEQ ID NO: 534177 - DNA, 25 bp, Rattus norvegicus
gtttggcatagttccagtctgtctt

SEQ ID NO: 534178 - DNA, 25 bp, Rattus norvegicus
gtttggcatctaattcttttccgca

SEQ ID NO: 534179 - DNA, 25 bp, Rattus norvegicus
gtttggcatctatttcttttccgca

SEQ ID NO: 534180 - DNA, 25 bp, Rattus norvegicus
gtttggcatgggacaatcctctgtt

SEQ ID NO: 534181 - DNA, 25 bp, Rattus norvegicus
gtttggcatgggtcaatcctctgtt

SEQ ID NO: 534182 - DNA, 25 bp, Rattus norvegicus
gtttggcattctaagtcatagcagt

SEQ ID NO: 534183 - DNA, 25 bp, Rattus norvegicus
gtttggcattcttagtcatagcagt

SEQ ID NO: 534184 - DNA, 25 bp, Rattus norvegicus
gtttggcatttactatgtgcttatg

SEQ ID NO: 534185 - DNA, 25 bp, Rattus norvegicus
gtttggcatttagtatgtgcttatg

SEQ ID NO: 534186 - DNA, 25 bp, Rattus norvegicus
gtttggccagagagcccagaggaaa

SEQ ID NO: 534187 - DNA, 25 bp, Rattus norvegicus
gtttggccagagtgcccagaggaaa

SEQ ID NO: 534188 - DNA, 25 bp, Rattus norvegicus
gtttggccagctcaccaggaagcaa

SEQ ID NO: 534189 - DNA, 25 bp, Rattus norvegicus
gtttggccagctgaccaggaagcaa

SEQ ID NO: 534190 - DNA, 25 bp, Rattus norvegicus
gtttggccagttcatctttttctaa

SEQ ID NO: 534191 - DNA, 25 bp, Rattus norvegicus
gtttggccagttgatctttttctaa

SEQ ID NO: 534192 - DNA, 25 bp, Rattus norvegicus
gtttggcccttaagcttttacatct

SEQ ID NO: 534193 - DNA, 25 bp, Rattus norvegicus
gtttggcccttatgcttttacatct

SEQ ID NO: 534194 - DNA, 25 bp, Rattus norvegicus
gtttggccggtactgtagcaatctt

SEQ ID NO: 534195 - DNA, 25 bp, Rattus norvegicus
gtttggccggtagtgtagcaatctt

SEQ ID NO: 534196 - DNA, 25 bp, Rattus norvegicus
gtttggccgtccctctgacctctgt

SEQ ID NO: 534197 - DNA, 25 bp, Rattus norvegicus
gtttggccgtccgtctgacctctgt

SEQ ID NO: 534198 - DNA, 25 bp, Rattus norvegicus
gtttggcctcaccatcaattctaaa

SEQ ID NO: 534199 - DNA, 25 bp, Rattus norvegicus
gtttggcctcacgatcaattctaaa

SEQ ID NO: 534200 - DNA, 25 bp, Rattus norvegicus
gtttggcctcctcgtgagaagattg

SEQ ID NO: 534201 - DNA, 25 bp, Rattus norvegicus
gtttggcctcctggtgagaagattg

SEQ ID NO: 534202 - DNA, 25 bp, Rattus norvegicus
gtttggcctgaactgttggaagctt

SEQ ID NO: 534203 - DNA, 25 bp, Rattus norvegicus
gtttggcctgaagtgttggaagctt

SEQ ID NO: 534204 - DNA, 25 bp, Rattus norvegicus
gtttggcctgctccagagaacattg

SEQ ID NO: 534205 - DNA, 25 bp, Rattus norvegicus
gtttggcctgctgcagagaacattg

SEQ ID NO: 534206 - DNA, 25 bp, Rattus norvegicus
gtttggcgggaaaacaacgctgctt

SEQ ID NO: 534207 - DNA, 25 bp, Rattus norvegicus
gtttggcgggaatacaacgctgctt

SEQ ID NO: 534208 - DNA, 25 bp, Rattus norvegicus
gtttggcgtcctcgtcatatttggg

SEQ ID NO: 534209 - DNA, 25 bp, Rattus norvegicus
gtttggcgtcctggtcatatttggg

SEQ ID NO: 534210 - DNA, 25 bp, Rattus norvegicus
gtttggctaatacaggcattgcatt

SEQ ID NO: 534211 - DNA, 25 bp, Rattus norvegicus
gtttggctaatagaggcattgcatt

SEQ ID NO: 534212 - DNA, 25 bp, Rattus norvegicus
gtttggctacacatcggagatctct

SEQ ID NO: 534213 - DNA, 25 bp, Rattus norvegicus
gtttggctacacttcggagatctct

SEQ ID NO: 534214 - DNA, 25 bp, Rattus norvegicus
gtttggctacttcgaatacgcccaa

SEQ ID NO: 534215 - DNA, 25 bp, Rattus norvegicus
gtttggctacttggaatacgcccaa

SEQ ID NO: 534216 - DNA, 25 bp, Rattus norvegicus
gtttggctatcaacgaagcgtcccc

SEQ ID NO: 534217 - DNA, 25 bp, Rattus norvegicus
gtttggctatcatcgaagcgtcccc

SEQ ID NO: 534218 - DNA, 25 bp, Rattus norvegicus
gtttggctcactcgtatagagcgct

SEQ ID NO: 534219 - DNA, 25 bp, Rattus norvegicus
gtttggctcactggtatagagcgct

SEQ ID NO: 534220 - DNA, 25 bp, Rattus norvegicus
gtttggctccatacttagtctatga

SEQ ID NO: 534221 - DNA, 25 bp, Rattus norvegicus
gtttggctccattcttagtctatga

SEQ ID NO: 534222 - DNA, 25 bp, Rattus norvegicus
gtttggctccctcagatgcgagtgt

SEQ ID NO: 534223 - DNA, 25 bp, Rattus norvegicus
gtttggctccctgagatgcgagtgt

SEQ ID NO: 534224 - DNA, 25 bp, Rattus norvegicus
gtttggctccttctccagagctgag

SEQ ID NO: 534225 - DNA, 25 bp, Rattus norvegicus
gtttggctccttgtccagagctgag

SEQ ID NO: 534226 - DNA, 25 bp, Rattus norvegicus
gtttggctctagatctggccaggca

SEQ ID NO: 534227 - DNA, 25 bp, Rattus norvegicus
gtttggctctagttctggccaggca

SEQ ID NO: 534228 - DNA, 25 bp, Rattus norvegicus
gtttggctctccataaatcgtatcc

SEQ ID NO: 534229 - DNA, 25 bp, Rattus norvegicus
gtttggctctccttaaatcgtatcc

SEQ ID NO: 534230 - DNA, 25 bp, Rattus norvegicus
gtttggctctggacacttaaagtgg

SEQ ID NO: 534231 - DNA, 25 bp, Rattus norvegicus
gtttggctctggtcacttaaagtgg

SEQ ID NO: 534232 - DNA, 25 bp, Rattus norvegicus
gtttggctgcataatacaccttgga

SEQ ID NO: 534233 - DNA, 25 bp, Rattus norvegicus
gtttggctgcattatacaccttgga

SEQ ID NO: 534234 - DNA, 25 bp, Rattus norvegicus
gtttggctgcttaactgtgaactat

SEQ ID NO: 534235 - DNA, 25 bp, Rattus norvegicus
gtttggctgcttctaaaaagcgtgt

SEQ ID NO: 534236 - DNA, 25 bp, Rattus norvegicus
gtttggctgcttgtaaaaagcgtgt

SEQ ID NO: 534237 - DNA, 25 bp, Rattus norvegicus
gtttggctgctttactgtgaactat

SEQ ID NO: 534238 - DNA, 25 bp, Rattus norvegicus
gtttggcttaaaacaccattttaga

SEQ ID NO: 534239 - DNA, 25 bp, Rattus norvegicus
gtttggcttaaatcaccattttaga

SEQ ID NO: 534240 - DNA, 25 bp, Rattus norvegicus
gtttggcttcatattatactgtttt

SEQ ID NO: 534241 - DNA, 25 bp, Rattus norvegicus
gtttggcttcattttatactgtttt

SEQ ID NO: 534242 - DNA, 25 bp, Rattus norvegicus
gtttggcttccaagctaagtcataa

SEQ ID NO: 534243 - DNA, 25 bp, Rattus norvegicus
gtttggcttccatgctaagtcataa

SEQ ID NO: 534244 - DNA, 25 bp, Rattus norvegicus
gtttggcttctcagtttcctatggg

SEQ ID NO: 534245 - DNA, 25 bp, Rattus norvegicus
gtttggcttctctgtttcctatggg

SEQ ID NO: 534246 - DNA, 25 bp, Rattus norvegicus
gtttggcttgtgaaatgctcttaat

SEQ ID NO: 534247 - DNA, 25 bp, Rattus norvegicus
gtttggcttgtgtaatgctcttaat

SEQ ID NO: 534248 - DNA, 25 bp, Rattus norvegicus
gtttggctttgaagtgctggattcc

SEQ ID NO: 534249 - DNA, 25 bp, Rattus norvegicus
gtttggctttgatgtgctggattcc

SEQ ID NO: 534250 - DNA, 25 bp, Rattus norvegicus
gtttggcttttgcagcacattagag

SEQ ID NO: 534251 - DNA, 25 bp, Rattus norvegicus
gtttggcttttggagcacattagag

SEQ ID NO: 534252 - DNA, 25 bp, Rattus norvegicus
gtttgggaagaaagctcactagatt

SEQ ID NO: 534253 - DNA, 25 bp, Rattus norvegicus
gtttgggaagaatgctcactagatt

SEQ ID NO: 534254 - DNA, 25 bp, Rattus norvegicus
gtttgggagacacttcgaagctaca

SEQ ID NO: 534255 - DNA, 25 bp, Rattus norvegicus
gtttgggagacagttcgaagctaca

SEQ ID NO: 534256 - DNA, 25 bp, Rattus norvegicus
gtttgggatttgcacacgataccta

SEQ ID NO: 534257 - DNA, 25 bp, Rattus norvegicus
gtttgggatttggacacgataccta

SEQ ID NO: 534258 - DNA, 25 bp, Rattus norvegicus
gtttgggattttcacagcgttatgt

SEQ ID NO: 534259 - DNA, 25 bp, Rattus norvegicus
gtttgggattttgacagcgttatgt

SEQ ID NO: 534260 - DNA, 25 bp, Rattus norvegicus
gtttgggcaaatatccgcaggtctc

SEQ ID NO: 534261 - DNA, 25 bp, Rattus norvegicus
gtttgggcaaatttccgcaggtctc

SEQ ID NO: 534262 - DNA, 25 bp, Rattus norvegicus
gtttgggccaagactgtaaaaagct

SEQ ID NO: 534263 - DNA, 25 bp, Rattus norvegicus
gtttgggccaagtctgtaaaaagct

SEQ ID NO: 534264 - DNA, 25 bp, Rattus norvegicus
gtttgggccagactactgacatttt

SEQ ID NO: 534265 - DNA, 25 bp, Rattus norvegicus
gtttgggccagagtactgacatttt

SEQ ID NO: 534266 - DNA, 25 bp, Rattus norvegicus
gtttgggccataaacataacactgt

SEQ ID NO: 534267 - DNA, 25 bp, Rattus norvegicus
gtttgggccatatacataacactgt

SEQ ID NO: 534268 - DNA, 25 bp, Rattus norvegicus
gtttgggccttcacaaatacagggc

SEQ ID NO: 534269 - DNA, 25 bp, Rattus norvegicus
gtttgggccttctcaaatacagggc

SEQ ID NO: 534270 - DNA, 25 bp, Rattus norvegicus
gtttgggctcatagtccatggctag

SEQ ID NO: 534271 - DNA, 25 bp, Rattus norvegicus
gtttgggctcattgtccatggctag

SEQ ID NO: 534272 - DNA, 25 bp, Rattus norvegicus
gtttgggctctgaaccaagattgca

SEQ ID NO: 534273 - DNA, 25 bp, Rattus norvegicus
gtttgggctctgtaccaagattgca

SEQ ID NO: 534274 - DNA, 25 bp, Rattus norvegicus
gtttgggcttcaacatcatgggcgg

SEQ ID NO: 534275 - DNA, 25 bp, Rattus norvegicus
gtttgggcttcatcatcatgggcgg

SEQ ID NO: 534276 - DNA, 25 bp, Rattus norvegicus
gtttgggtatctctttctggtgtca

SEQ ID NO: 534277 - DNA, 25 bp, Rattus norvegicus
gtttgggtatctgtttctggtgtca

SEQ ID NO: 534278 - DNA, 25 bp, Rattus norvegicus
gtttgggtccatatttgcaacactt

SEQ ID NO: 534279 - DNA, 25 bp, Rattus norvegicus
gtttgggtccatttttgcaacactt

SEQ ID NO: 534280 - DNA, 25 bp, Rattus norvegicus
gtttgggttcacatgtggtgctgct

SEQ ID NO: 534281 - DNA, 25 bp, Rattus norvegicus
gtttgggttcacttgtggtgctgct

SEQ ID NO: 534282 - DNA, 25 bp, Rattus norvegicus
gtttgggttccaatgttaagtgcac

SEQ ID NO: 534283 - DNA, 25 bp, Rattus norvegicus
gtttgggttccattgttaagtgcac

SEQ ID NO: 534284 - DNA, 25 bp, Rattus norvegicus
gtttggtacaacaccttcacacttt

SEQ ID NO: 534285 - DNA, 25 bp, Rattus norvegicus
gtttggtacaactccttcacacttt

SEQ ID NO: 534286 - DNA, 25 bp, Rattus norvegicus
gtttggtacacaattccttcagcag

SEQ ID NO: 534287 - DNA, 25 bp, Rattus norvegicus
gtttggtacacatttccttcagcag

SEQ ID NO: 534288 - DNA, 25 bp, Rattus norvegicus
gtttggtaccaaagccgtgcagcac

SEQ ID NO: 534289 - DNA, 25 bp, Rattus norvegicus
gtttggtaccaatgccgtgcagcac

SEQ ID NO: 534290 - DNA, 25 bp, Rattus norvegicus
gtttggtaccagcacttgtttgtag

SEQ ID NO: 534291 - DNA, 25 bp, Rattus norvegicus
gtttggtaccaggacttgtttgtag

SEQ ID NO: 534292 - DNA, 25 bp, Rattus norvegicus
gtttggtaggtgactcacaagcaca

SEQ ID NO: 534293 - DNA, 25 bp, Rattus norvegicus
gtttggtaggtgtctcacaagcaca

SEQ ID NO: 534294 - DNA, 25 bp, Rattus norvegicus
gtttggtagtcaagcagtcactctc

SEQ ID NO: 534295 - DNA, 25 bp, Rattus norvegicus
gtttggtagtcacctagcttaatat

SEQ ID NO: 534296 - DNA, 25 bp, Rattus norvegicus
gtttggtagtcagctagcttaatat

SEQ ID NO: 534297 - DNA, 25 bp, Rattus norvegicus
gtttggtagtcatgcagtcactctc

SEQ ID NO: 534298 - DNA, 25 bp, Rattus norvegicus
gtttggtatgttccttttagcattc

SEQ ID NO: 534299 - DNA, 25 bp, Rattus norvegicus
gtttggtatgttgcttttagcattc

SEQ ID NO: 534300 - DNA, 25 bp, Rattus norvegicus
gtttggtcactgctctgtagttcca

SEQ ID NO: 534301 - DNA, 25 bp, Rattus norvegicus
gtttggtcactggtctgtagttcca

SEQ ID NO: 534302 - DNA, 25 bp, Rattus norvegicus
gtttggtcatgtaactgcacagcag

SEQ ID NO: 534303 - DNA, 25 bp, Rattus norvegicus
gtttggtcatgttactgcacagcag

SEQ ID NO: 534304 - DNA, 25 bp, Rattus norvegicus
gtttggtccattcgttactttgaat

SEQ ID NO: 534305 - DNA, 25 bp, Rattus norvegicus
gtttggtccattggttactttgaat

SEQ ID NO: 534306 - DNA, 25 bp, Rattus norvegicus
gtttggtcctcaagatactgctctt

SEQ ID NO: 534307 - DNA, 25 bp, Rattus norvegicus
gtttggtcctcatgatactgctctt

SEQ ID NO: 534308 - DNA, 25 bp, Rattus norvegicus
gtttggtccttaatctttgtatcaa

SEQ ID NO: 534309 - DNA, 25 bp, Rattus norvegicus
gtttggtccttattctttgtatcaa

SEQ ID NO: 534310 - DNA, 25 bp, Rattus norvegicus
gtttggtcgagtctttgtgtgttat

SEQ ID NO: 534311 - DNA, 25 bp, Rattus norvegicus
gtttggtcgagtgtttgtgtgttat

SEQ ID NO: 534312 - DNA, 25 bp, Rattus norvegicus
gtttggtctcaaacaatggctgtat

SEQ ID NO: 534313 - DNA, 25 bp, Rattus norvegicus
gtttggtctcaatcaatggctgtat

SEQ ID NO: 534314 - DNA, 25 bp, Rattus norvegicus
gtttggtgacctaactctcttatac

SEQ ID NO: 534315 - DNA, 25 bp, Rattus norvegicus
gtttggtgaccttactctcttatac

SEQ ID NO: 534316 - DNA, 25 bp, Rattus norvegicus
gtttggtgcccaagtaagtcaagag

SEQ ID NO: 534317 - DNA, 25 bp, Rattus norvegicus
gtttggtgcccaatccctttatcca

SEQ ID NO: 534318 - DNA, 25 bp, Rattus norvegicus
gtttggtgcccatgtaagtcaagag

SEQ ID NO: 534319 - DNA, 25 bp, Rattus norvegicus
gtttggtgcccattccctttatcca

SEQ ID NO: 534320 - DNA, 25 bp, Rattus norvegicus
gtttggtgtatgagactgtctcctg

SEQ ID NO: 534321 - DNA, 25 bp, Rattus norvegicus
gtttggtgtatgtgactgtctcctg

SEQ ID NO: 534322 - DNA, 25 bp, Rattus norvegicus
gtttggtgtgccatccggaacctct

SEQ ID NO: 534323 - DNA, 25 bp, Rattus norvegicus
gtttggtgtgccttccggaacctct

SEQ ID NO: 534324 - DNA, 25 bp, Rattus norvegicus
gtttggttacaaaacattttcacat

SEQ ID NO: 534325 - DNA, 25 bp, Rattus norvegicus
gtttggttacaatacattttcacat

SEQ ID NO: 534326 - DNA, 25 bp, Rattus norvegicus
gtttggttaccaccatttcaacttg

SEQ ID NO: 534327 - DNA, 25 bp, Rattus norvegicus
gtttggttaccagcatttcaacttg

SEQ ID NO: 534328 - DNA, 25 bp, Rattus norvegicus
gtttggttacttctaattgtgctta

SEQ ID NO: 534329 - DNA, 25 bp, Rattus norvegicus
gtttggttacttgtaattgtgctta

SEQ ID NO: 534330 - DNA, 25 bp, Rattus norvegicus
gtttggttcacccattctctacgag

SEQ ID NO: 534331 - DNA, 25 bp, Rattus norvegicus
gtttggttcaccgattctctacgag

SEQ ID NO: 534332 - DNA, 25 bp, Rattus norvegicus
gtttggttcagtaaatcagccacct

SEQ ID NO: 534333 - DNA, 25 bp, Rattus norvegicus
gtttggttcagttaatcagccacct

SEQ ID NO: 534334 - DNA, 25 bp, Rattus norvegicus
gtttggttcctaccgcccaagtcag

SEQ ID NO: 534335 - DNA, 25 bp, Rattus norvegicus
gtttggttcctagcgcccaagtcag

SEQ ID NO: 534336 - DNA, 25 bp, Rattus norvegicus
gtttggttctcactcctcacatggg

SEQ ID NO: 534337 - DNA, 25 bp, Rattus norvegicus
gtttggttctcagtcctcacatggg

SEQ ID NO: 534338 - DNA, 25 bp, Rattus norvegicus
gtttggttctcccttaagctaactg

SEQ ID NO: 534339 - DNA, 25 bp, Rattus norvegicus
gtttggttctccgttaagctaactg

SEQ ID NO: 534340 - DNA, 25 bp, Rattus norvegicus
gtttggttcttacacgtgctaattc

SEQ ID NO: 534341 - DNA, 25 bp, Rattus norvegicus
gtttggttcttagacgtgctaattc

SEQ ID NO: 534342 - DNA, 25 bp, Rattus norvegicus
gtttggttctttcgcacatcaggca

SEQ ID NO: 534343 - DNA, 25 bp, Rattus norvegicus
gtttggttctttggcacatcaggca

SEQ ID NO: 534344 - DNA, 25 bp, Rattus norvegicus
gtttggtttcatatatcatatgtca

SEQ ID NO: 534345 - DNA, 25 bp, Rattus norvegicus
gtttggtttcatttatcatatgtca

SEQ ID NO: 534346 - DNA, 25 bp, Rattus norvegicus
gtttggtttccacatgctaattgtt

SEQ ID NO: 534347 - DNA, 25 bp, Rattus norvegicus
gtttggtttccagatgctaattgtt

SEQ ID NO: 534348 - DNA, 25 bp, Rattus norvegicus
gtttggtttgcaccatctgagtcca

SEQ ID NO: 534349 - DNA, 25 bp, Rattus norvegicus
gtttggtttgcagcatctgagtcca

SEQ ID NO: 534350 - DNA, 25 bp, Rattus norvegicus
gtttggtttggcattactttgctgt

SEQ ID NO: 534351 - DNA, 25 bp, Rattus norvegicus
gtttggtttggctttactttgctgt

SEQ ID NO: 534352 - DNA, 25 bp, Rattus norvegicus
gtttggttttcaaccaagagcagtt

SEQ ID NO: 534353 - DNA, 25 bp, Rattus norvegicus
gtttggttttcatccaagagcagtt

SEQ ID NO: 534354 - DNA, 25 bp, Rattus norvegicus
gtttgtaaacgtacagtgtcttcat

SEQ ID NO: 534355 - DNA, 25 bp, Rattus norvegicus
gtttgtaaacgttcagtgtcttcat

SEQ ID NO: 534356 - DNA, 25 bp, Rattus norvegicus
gtttgtaaatccatagacgcttgag

SEQ ID NO: 534357 - DNA, 25 bp, Rattus norvegicus
gtttgtaaatccttagacgcttgag

SEQ ID NO: 534358 - DNA, 25 bp, Rattus norvegicus
gtttgtaagactattccccagcata

SEQ ID NO: 534359 - DNA, 25 bp, Rattus norvegicus
gtttgtaagacttttccccagcata

SEQ ID NO: 534360 - DNA, 25 bp, Rattus norvegicus
gtttgtaattaaatcctcaccaggt

SEQ ID NO: 534361 - DNA, 25 bp, Rattus norvegicus
gtttgtaattaattcctcaccaggt

SEQ ID NO: 534362 - DNA, 25 bp, Rattus norvegicus
gtttgtacacgtcaaggccacagat

SEQ ID NO: 534363 - DNA, 25 bp, Rattus norvegicus
gtttgtacacgtgaaggccacagat

SEQ ID NO: 534364 - DNA, 25 bp, Rattus norvegicus
gtttgtacagtaatgagcctagcat

SEQ ID NO: 534365 - DNA, 25 bp, Rattus norvegicus
gtttgtacagtattgagcctagcat

SEQ ID NO: 534366 - DNA, 25 bp, Rattus norvegicus
gtttgtaccacaacacacacttgtc

SEQ ID NO: 534367 - DNA, 25 bp, Rattus norvegicus
gtttgtaccacatcacacacttgtc

SEQ ID NO: 534368 - DNA, 25 bp, Rattus norvegicus
gtttgtacccacattctgtttcaat

SEQ ID NO: 534369 - DNA, 25 bp, Rattus norvegicus
gtttgtacccactttctgtttcaat

SEQ ID NO: 534370 - DNA, 25 bp, Rattus norvegicus
gtttgtaccgcaccaaggattcctt

SEQ ID NO: 534371 - DNA, 25 bp, Rattus norvegicus
gtttgtaccgcagcaaggattcctt

SEQ ID NO: 534372 - DNA, 25 bp, Rattus norvegicus
gtttgtacctgcctagcaacagtgt

SEQ ID NO: 534373 - DNA, 25 bp, Rattus norvegicus
gtttgtacctgcgtagcaacagtgt

SEQ ID NO: 534374 - DNA, 25 bp, Rattus norvegicus
gtttgtacggctaggatacagctct

SEQ ID NO: 534375 - DNA, 25 bp, Rattus norvegicus
gtttgtacggcttggatacagctct

SEQ ID NO: 534376 - DNA, 25 bp, Rattus norvegicus
gtttgtacgtgtcgctcattactcc

SEQ ID NO: 534377 - DNA, 25 bp, Rattus norvegicus
gtttgtacgtgtggctcattactcc

SEQ ID NO: 534378 - DNA, 25 bp, Rattus norvegicus
gtttgtactccacgaacactctgag

SEQ ID NO: 534379 - DNA, 25 bp, Rattus norvegicus
gtttgtactccaggaacactctgag

SEQ ID NO: 534380 - DNA, 25 bp, Rattus norvegicus
gtttgtactgggagctctggaccaa

SEQ ID NO: 534381 - DNA, 25 bp, Rattus norvegicus
gtttgtactgggtgctctggaccaa

SEQ ID NO: 534382 - DNA, 25 bp, Rattus norvegicus
gtttgtactgtaaccctttgcttca

SEQ ID NO: 534383 - DNA, 25 bp, Rattus norvegicus
gtttgtactgtatccctttgcttca

SEQ ID NO: 534384 - DNA, 25 bp, Rattus norvegicus
gtttgtactgtccatgacacctgat

SEQ ID NO: 534385 - DNA, 25 bp, Rattus norvegicus
gtttgtactgtcgatgacacctgat

SEQ ID NO: 534386 - DNA, 25 bp, Rattus norvegicus
gtttgtacttgacgtatgtaccatt

SEQ ID NO: 534387 - DNA, 25 bp, Rattus norvegicus
gtttgtacttgaggtatgtaccatt

SEQ ID NO: 534388 - DNA, 25 bp, Rattus norvegicus
gtttgtagactaagcttctggcatt

SEQ ID NO: 534389 - DNA, 25 bp, Rattus norvegicus
gtttgtagactatgcttctggcatt

SEQ ID NO: 534390 - DNA, 25 bp, Rattus norvegicus
gtttgtagcagtagcttgctttgga

SEQ ID NO: 534391 - DNA, 25 bp, Rattus norvegicus
gtttgtagcagttgcttgctttgga

SEQ ID NO: 534392 - DNA, 25 bp, Rattus norvegicus
gtttgtagcgttattaagtcactca

SEQ ID NO: 534393 - DNA, 25 bp, Rattus norvegicus
gtttgtagcgtttttaagtcactca

SEQ ID NO: 534394 - DNA, 25 bp, Rattus norvegicus
gtttgtagctgactccatcttttaa

SEQ ID NO: 534395 - DNA, 25 bp, Rattus norvegicus
gtttgtagctgagtccatcttttaa

SEQ ID NO: 534396 - DNA, 25 bp, Rattus norvegicus
gtttgtaggccccactagcctcaaa

SEQ ID NO: 534397 - DNA, 25 bp, Rattus norvegicus
gtttgtaggcccgactagcctcaaa

SEQ ID NO: 534398 - DNA, 25 bp, Rattus norvegicus
gtttgtatacttcgtgtgtgagcca

SEQ ID NO: 534399 - DNA, 25 bp, Rattus norvegicus
gtttgtatacttggtgtgtgagcca

SEQ ID NO: 534400 - DNA, 25 bp, Rattus norvegicus
gtttgtatatgcacaccctagagag

SEQ ID NO: 534401 - DNA, 25 bp, Rattus norvegicus
gtttgtatatgctcaccctagagag

SEQ ID NO: 534402 - DNA, 25 bp, Rattus norvegicus
gtttgtatatttccaagccctttgt

SEQ ID NO: 534403 - DNA, 25 bp, Rattus norvegicus
gtttgtatatttgcaagccctttgt

SEQ ID NO: 534404 - DNA, 25 bp, Rattus norvegicus
gtttgtatcacaaggactcgggcag

SEQ ID NO: 534405 - DNA, 25 bp, Rattus norvegicus
gtttgtatcacatggactcgggcag

SEQ ID NO: 534406 - DNA, 25 bp, Rattus norvegicus
gtttgtatccatctcagtgtccaga

SEQ ID NO: 534407 - DNA, 25 bp, Rattus norvegicus
gtttgtatccatgtcagtgtccaga

SEQ ID NO: 534408 - DNA, 25 bp, Rattus norvegicus
gtttgtatccctactccaagcagag

SEQ ID NO: 534409 - DNA, 25 bp, Rattus norvegicus
gtttgtatcccttctccaagcagag

SEQ ID NO: 534410 - DNA, 25 bp, Rattus norvegicus
gtttgtatgaatatacctccaggga

SEQ ID NO: 534411 - DNA, 25 bp, Rattus norvegicus
gtttgtatgaatttacctccaggga

SEQ ID NO: 534412 - DNA, 25 bp, Rattus norvegicus
gtttgtatgctcaactgtgtttgta

SEQ ID NO: 534413 - DNA, 25 bp, Rattus norvegicus
gtttgtatgctctactgtgtttgta

SEQ ID NO: 534414 - DNA, 25 bp, Rattus norvegicus
gtttgtatgtcaagctcttctgaag

SEQ ID NO: 534415 - DNA, 25 bp, Rattus norvegicus
gtttgtatgtcatgctcttctgaag

SEQ ID NO: 534416 - DNA, 25 bp, Rattus norvegicus
gtttgtatgtgcacagccaatgggc

SEQ ID NO: 534417 - DNA, 25 bp, Rattus norvegicus
gtttgtatgtgctcagccaatgggc

SEQ ID NO: 534418 - DNA, 25 bp, Rattus norvegicus
gtttgtatttctccagtttctgaca

SEQ ID NO: 534419 - DNA, 25 bp, Rattus norvegicus
gtttgtatttctgcagtttctgaca

SEQ ID NO: 534420 - DNA, 25 bp, Rattus norvegicus
gtttgtattttgcttcattagtagc

SEQ ID NO: 534421 - DNA, 25 bp, Rattus norvegicus
gtttgtattttggttcattagtagc

SEQ ID NO: 534422 - DNA, 25 bp, Rattus norvegicus
gtttgtcaaaaacccggagctctgg

SEQ ID NO: 534423 - DNA, 25 bp, Rattus norvegicus
gtttgtcaaaaagccggagctctgg

SEQ ID NO: 534424 - DNA, 25 bp, Rattus norvegicus
gtttgtcaaacactgctttcacttt

SEQ ID NO: 534425 - DNA, 25 bp, Rattus norvegicus
gtttgtcaaacagtgctttcacttt

SEQ ID NO: 534426 - DNA, 25 bp, Rattus norvegicus
gtttgtcaaaggatgcatgccccat

SEQ ID NO: 534427 - DNA, 25 bp, Rattus norvegicus
gtttgtcaaaggttgcatgccccat

SEQ ID NO: 534428 - DNA, 25 bp, Rattus norvegicus
gtttgtcaacatctaatgcccctga

SEQ ID NO: 534429 - DNA, 25 bp, Rattus norvegicus
gtttgtcaacatgtaatgcccctga

SEQ ID NO: 534430 - DNA, 25 bp, Rattus norvegicus
gtttgtcaacccatgtatgaacctg

SEQ ID NO: 534431 - DNA, 25 bp, Rattus norvegicus
gtttgtcaacccttgtatgaacctg

SEQ ID NO: 534432 - DNA, 25 bp, Rattus norvegicus
gtttgtcacacactcggttttataa

SEQ ID NO: 534433 - DNA, 25 bp, Rattus norvegicus
gtttgtcacacagtcggttttataa

SEQ ID NO: 534434 - DNA, 25 bp, Rattus norvegicus
gtttgtcacacccaccattttaacg

SEQ ID NO: 534435 - DNA, 25 bp, Rattus norvegicus
gtttgtcacaccgaccattttaacg

SEQ ID NO: 534436 - DNA, 25 bp, Rattus norvegicus
gtttgtcacagccatttagccaagc

SEQ ID NO: 534437 - DNA, 25 bp, Rattus norvegicus
gtttgtcacagcgatttagccaagc

SEQ ID NO: 534438 - DNA, 25 bp, Rattus norvegicus
gtttgtcaccatagccatggttggt

SEQ ID NO: 534439 - DNA, 25 bp, Rattus norvegicus
gtttgtcaccattgccatggttggt

SEQ ID NO: 534440 - DNA, 25 bp, Rattus norvegicus
gtttgtcaccccacgataaagaaag

SEQ ID NO: 534441 - DNA, 25 bp, Rattus norvegicus
gtttgtcacccctcgataaagaaag

SEQ ID NO: 534442 - DNA, 25 bp, Rattus norvegicus
gtttgtcactgcaatctcaaaagac

SEQ ID NO: 534443 - DNA, 25 bp, Rattus norvegicus
gtttgtcactgctatctcaaaagac

SEQ ID NO: 534444 - DNA, 25 bp, Rattus norvegicus
gtttgtcagcatagactagagccaa

SEQ ID NO: 534445 - DNA, 25 bp, Rattus norvegicus
gtttgtcagcattgactagagccaa

SEQ ID NO: 534446 - DNA, 25 bp, Rattus norvegicus
gtttgtcagttcaggagtagccttt

SEQ ID NO: 534447 - DNA, 25 bp, Rattus norvegicus
gtttgtcagttctggagtagccttt

SEQ ID NO: 534448 - DNA, 25 bp, Rattus norvegicus
gtttgtcataacctattgtgcgtaa

SEQ ID NO: 534449 - DNA, 25 bp, Rattus norvegicus
gtttgtcataacgtattgtgcgtaa

SEQ ID NO: 534450 - DNA, 25 bp, Rattus norvegicus
gtttgtcatcagcttcctagtatgc

SEQ ID NO: 534451 - DNA, 25 bp, Rattus norvegicus
gtttgtcatcaggttcctagtatgc

SEQ ID NO: 534452 - DNA, 25 bp, Rattus norvegicus
gtttgtcatctgctgttgtatctca

SEQ ID NO: 534453 - DNA, 25 bp, Rattus norvegicus
gtttgtcatctggtgttgtatctca

SEQ ID NO: 534454 - DNA, 25 bp, Rattus norvegicus
gtttgtcattctagatcagctgtgt

SEQ ID NO: 534455 - DNA, 25 bp, Rattus norvegicus
gtttgtcattcttgatcagctgtgt

SEQ ID NO: 534456 - DNA, 25 bp, Rattus norvegicus
gtttgtcattgaaaccctcgttatg

SEQ ID NO: 534457 - DNA, 25 bp, Rattus norvegicus
gtttgtcattgataccctcgttatg

SEQ ID NO: 534458 - DNA, 25 bp, Rattus norvegicus
gtttgtccaagaaacttagtcctat

SEQ ID NO: 534459 - DNA, 25 bp, Rattus norvegicus
gtttgtccaagatacttagtcctat

SEQ ID NO: 534460 - DNA, 25 bp, Rattus norvegicus
gtttgtccacagagacttagctgca

SEQ ID NO: 534461 - DNA, 25 bp, Rattus norvegicus
gtttgtccacagtgacttagctgca

SEQ ID NO: 534462 - DNA, 25 bp, Rattus norvegicus
gtttgtccactcagaattcttttga

SEQ ID NO: 534463 - DNA, 25 bp, Rattus norvegicus
gtttgtccactctgaattcttttga

SEQ ID NO: 534464 - DNA, 25 bp, Rattus norvegicus
gtttgtccagtcaacactgacaggc

SEQ ID NO: 534465 - DNA, 25 bp, Rattus norvegicus
gtttgtccagtctacactgacaggc

SEQ ID NO: 534466 - DNA, 25 bp, Rattus norvegicus
gtttgtccagtgatagtcatattgt

SEQ ID NO: 534467 - DNA, 25 bp, Rattus norvegicus
gtttgtccagtgttagtcatattgt

SEQ ID NO: 534468 - DNA, 25 bp, Rattus norvegicus
gtttgtccagttaagcacgtaatcg

SEQ ID NO: 534469 - DNA, 25 bp, Rattus norvegicus
gtttgtccagtttagcacgtaatcg

SEQ ID NO: 534470 - DNA, 25 bp, Rattus norvegicus
gtttgtccattaattcagtttggtg

SEQ ID NO: 534471 - DNA, 25 bp, Rattus norvegicus
gtttgtccattatttcagtttggtg

SEQ ID NO: 534472 - DNA, 25 bp, Rattus norvegicus
gtttgtcccaacaaccagagagaaa

SEQ ID NO: 534473 - DNA, 25 bp, Rattus norvegicus
gtttgtcccaactaccagagagaaa

SEQ ID NO: 534474 - DNA, 25 bp, Rattus norvegicus
gtttgtcccaagatgacatccctga

SEQ ID NO: 534475 - DNA, 25 bp, Rattus norvegicus
gtttgtcccaagttgacatccctga

SEQ ID NO: 534476 - DNA, 25 bp, Rattus norvegicus
gtttgtcccatactgcatcctgtat

SEQ ID NO: 534477 - DNA, 25 bp, Rattus norvegicus
gtttgtcccatagtgcatcctgtat

SEQ ID NO: 534478 - DNA, 25 bp, Rattus norvegicus
gtttgtcccgacattgatatgctat

SEQ ID NO: 534479 - DNA, 25 bp, Rattus norvegicus
gtttgtcccgactttgatatgctat

SEQ ID NO: 534480 - DNA, 25 bp, Rattus norvegicus
gtttgtcccggaatacttggaggct

SEQ ID NO: 534481 - DNA, 25 bp, Rattus norvegicus
gtttgtcccggattacttggaggct

SEQ ID NO: 534482 - DNA, 25 bp, Rattus norvegicus
gtttgtccgcacattaaagagctct

SEQ ID NO: 534483 - DNA, 25 bp, Rattus norvegicus
gtttgtccgcactttaaagagctct

SEQ ID NO: 534484 - DNA, 25 bp, Rattus norvegicus
gtttgtcctggaaaatagtgttcgt

SEQ ID NO: 534485 - DNA, 25 bp, Rattus norvegicus
gtttgtcctggataatagtgttcgt

SEQ ID NO: 534486 - DNA, 25 bp, Rattus norvegicus
gtttgtcctgtaagttggatcctga

SEQ ID NO: 534487 - DNA, 25 bp, Rattus norvegicus
gtttgtcctgtaattcagccatcca

SEQ ID NO: 534488 - DNA, 25 bp, Rattus norvegicus
gtttgtcctgtatgttggatcctga

SEQ ID NO: 534489 - DNA, 25 bp, Rattus norvegicus
gtttgtcctgtatttcagccatcca

SEQ ID NO: 534490 - DNA, 25 bp, Rattus norvegicus
gtttgtccttatattatgtcctgta

SEQ ID NO: 534491 - DNA, 25 bp, Rattus norvegicus
gtttgtccttattttatgtcctgta

SEQ ID NO: 534492 - DNA, 25 bp, Rattus norvegicus
gtttgtccttgtaaatagcttccca

SEQ ID NO: 534493 - DNA, 25 bp, Rattus norvegicus
gtttgtccttgttaatagcttccca

SEQ ID NO: 534494 - DNA, 25 bp, Rattus norvegicus
gtttgtcgacaaatctgccataaaa

SEQ ID NO: 534495 - DNA, 25 bp, Rattus norvegicus
gtttgtcgacaattctgccataaaa

SEQ ID NO: 534496 - DNA, 25 bp, Rattus norvegicus
gtttgtcggccaatgttgaaaagca

SEQ ID NO: 534497 - DNA, 25 bp, Rattus norvegicus
gtttgtcggccattgttgaaaagca

SEQ ID NO: 534498 - DNA, 25 bp, Rattus norvegicus
gtttgtctacacacaggctgcggaa

SEQ ID NO: 534499 - DNA, 25 bp, Rattus norvegicus
gtttgtctacactcaggctgcggaa

SEQ ID NO: 534500 - DNA, 25 bp, Rattus norvegicus
gtttgtctacttccactctgtgtaa

SEQ ID NO: 534501 - DNA, 25 bp, Rattus norvegicus
gtttgtctacttcgccttaggctac

SEQ ID NO: 534502 - DNA, 25 bp, Rattus norvegicus
gtttgtctacttgcactctgtgtaa

SEQ ID NO: 534503 - DNA, 25 bp, Rattus norvegicus
gtttgtctacttggccttaggctac

SEQ ID NO: 534504 - DNA, 25 bp, Rattus norvegicus
gtttgtctaggaagctttagcccgt

SEQ ID NO: 534505 - DNA, 25 bp, Rattus norvegicus
gtttgtctaggatgctttagcccgt

SEQ ID NO: 534506 - DNA, 25 bp, Rattus norvegicus
gtttgtctagtgctcttggtttcca

SEQ ID NO: 534507 - DNA, 25 bp, Rattus norvegicus
gtttgtctagtggtcttggtttcca

SEQ ID NO: 534508 - DNA, 25 bp, Rattus norvegicus
gtttgtctatagacttctgtgtcct

SEQ ID NO: 534509 - DNA, 25 bp, Rattus norvegicus
gtttgtctatagtcttctgtgtcct

SEQ ID NO: 534510 - DNA, 25 bp, Rattus norvegicus
gtttgtctcactcaggtcttataag

SEQ ID NO: 534511 - DNA, 25 bp, Rattus norvegicus
gtttgtctcactgaggtcttataag

SEQ ID NO: 534512 - DNA, 25 bp, Rattus norvegicus
gtttgtctccttcgtgattctaaat

SEQ ID NO: 534513 - DNA, 25 bp, Rattus norvegicus
gtttgtctccttggtgattctaaat

SEQ ID NO: 534514 - DNA, 25 bp, Rattus norvegicus
gtttgtctcggtacatgtcctaaga

SEQ ID NO: 534515 - DNA, 25 bp, Rattus norvegicus
gtttgtctcggttcatgtcctaaga

SEQ ID NO: 534516 - DNA, 25 bp, Rattus norvegicus
gtttgtctcttaccaagtcctatgg

SEQ ID NO: 534517 - DNA, 25 bp, Rattus norvegicus
gtttgtctcttagcaagtcctatgg

SEQ ID NO: 534518 - DNA, 25 bp, Rattus norvegicus
gtttgtctgcagaacctggacttcc

SEQ ID NO: 534519 - DNA, 25 bp, Rattus norvegicus
gtttgtctgcagtacctggacttcc

SEQ ID NO: 534520 - DNA, 25 bp, Rattus norvegicus
gtttgtcttagaattactgccaggt

SEQ ID NO: 534521 - DNA, 25 bp, Rattus norvegicus
gtttgtcttagatttactgccaggt

SEQ ID NO: 534522 - DNA, 25 bp, Rattus norvegicus
gtttgtcttatcagcatgggtatta

SEQ ID NO: 534523 - DNA, 25 bp, Rattus norvegicus
gtttgtcttatctgcatgggtatta

SEQ ID NO: 534524 - DNA, 25 bp, Rattus norvegicus
gtttgtcttcccattgtgcaagcat

SEQ ID NO: 534525 - DNA, 25 bp, Rattus norvegicus
gtttgtcttccctttgtgcaagcat

SEQ ID NO: 534526 - DNA, 25 bp, Rattus norvegicus
gtttgtcttccgagagtcagccata

SEQ ID NO: 534527 - DNA, 25 bp, Rattus norvegicus
gtttgtcttccgtgagtcagccata

SEQ ID NO: 534528 - DNA, 25 bp, Rattus norvegicus
gtttgtcttctaatttgtacgttgg

SEQ ID NO: 534529 - DNA, 25 bp, Rattus norvegicus
gtttgtcttctattttgtacgttgg

SEQ ID NO: 534530 - DNA, 25 bp, Rattus norvegicus
gtttgtcttctgaaaatagcggctc

SEQ ID NO: 534531 - DNA, 25 bp, Rattus norvegicus
gtttgtcttctgtaaatagcggctc

SEQ ID NO: 534532 - DNA, 25 bp, Rattus norvegicus
gtttgtctttccactgtatatgcca

SEQ ID NO: 534533 - DNA, 25 bp, Rattus norvegicus
gtttgtctttccagactctgttttc

SEQ ID NO: 534534 - DNA, 25 bp, Rattus norvegicus
gtttgtctttcctctgtatatgcca

SEQ ID NO: 534535 - DNA, 25 bp, Rattus norvegicus
gtttgtctttcctgactctgttttc

SEQ ID NO: 534536 - DNA, 25 bp, Rattus norvegicus
gtttgtctttgaccaacccatgcaa

SEQ ID NO: 534537 - DNA, 25 bp, Rattus norvegicus
gtttgtctttgagcaacccatgcaa

SEQ ID NO: 534538 - DNA, 25 bp, Rattus norvegicus
gtttgtctttggcaatgtgtgttct

SEQ ID NO: 534539 - DNA, 25 bp, Rattus norvegicus
gtttgtctttgggaatgtgtgttct

SEQ ID NO: 534540 - DNA, 25 bp, Rattus norvegicus
gtttgtctttgtatgagtacctctc

SEQ ID NO: 534541 - DNA, 25 bp, Rattus norvegicus
gtttgtctttgtttgagtacctctc

SEQ ID NO: 534542 - DNA, 25 bp, Rattus norvegicus
gtttgtcttttcagctctcattgaa

SEQ ID NO: 534543 - DNA, 25 bp, Rattus norvegicus
gtttgtcttttctgctctcattgaa

SEQ ID NO: 534544 - DNA, 25 bp, Rattus norvegicus
gtttgtgaactgaattactcctggc

SEQ ID NO: 534545 - DNA, 25 bp, Rattus norvegicus
gtttgtgaactgtattactcctggc

SEQ ID NO: 534546 - DNA, 25 bp, Rattus norvegicus
gtttgtgaagttatccatgcccagt

SEQ ID NO: 534547 - DNA, 25 bp, Rattus norvegicus
gtttgtgaagttttccatgcccagt

SEQ ID NO: 534548 - DNA, 25 bp, Rattus norvegicus
gtttgtgaatgccaaccccagccaa

SEQ ID NO: 534549 - DNA, 25 bp, Rattus norvegicus
gtttgtgaatgcgaaccccagccaa

SEQ ID NO: 534550 - DNA, 25 bp, Rattus norvegicus
gtttgtgacaacaccatcccattct

SEQ ID NO: 534551 - DNA, 25 bp, Rattus norvegicus
gtttgtgacaactccatcccattct

SEQ ID NO: 534552 - DNA, 25 bp, Rattus norvegicus
gtttgtgacagtcaactcctgttct

SEQ ID NO: 534553 - DNA, 25 bp, Rattus norvegicus
gtttgtgacagtgaactcctgttct

SEQ ID NO: 534554 - DNA, 25 bp, Rattus norvegicus
gtttgtgaccctacatacatacata

SEQ ID NO: 534555 - DNA, 25 bp, Rattus norvegicus
gtttgtgaccctcctgattatataa

SEQ ID NO: 534556 - DNA, 25 bp, Rattus norvegicus
gtttgtgaccctgctgattatataa

SEQ ID NO: 534557 - DNA, 25 bp, Rattus norvegicus
gtttgtgacccttcatacatacata

SEQ ID NO: 534558 - DNA, 25 bp, Rattus norvegicus
gtttgtgactctaaatgcccactgt

SEQ ID NO: 534559 - DNA, 25 bp, Rattus norvegicus
gtttgtgactcttaatgcccactgt

SEQ ID NO: 534560 - DNA, 25 bp, Rattus norvegicus
gtttgtgagcctagatgcctgtaac

SEQ ID NO: 534561 - DNA, 25 bp, Rattus norvegicus
gtttgtgagccttgatgcctgtaac

SEQ ID NO: 534562 - DNA, 25 bp, Rattus norvegicus
gtttgtgagttgatctcggcttctc

SEQ ID NO: 534563 - DNA, 25 bp, Rattus norvegicus
gtttgtgagttgttctcggcttctc

SEQ ID NO: 534564 - DNA, 25 bp, Rattus norvegicus
gtttgtgatcatatcgtaagctcga

SEQ ID NO: 534565 - DNA, 25 bp, Rattus norvegicus
gtttgtgatcatttcgtaagctcga

SEQ ID NO: 534566 - DNA, 25 bp, Rattus norvegicus
gtttgtgcaaacaagccttcattgt

SEQ ID NO: 534567 - DNA, 25 bp, Rattus norvegicus
gtttgtgcaaactagccttcattgt

SEQ ID NO: 534568 - DNA, 25 bp, Rattus norvegicus
gtttgtgcatcccaggaagctgcca

SEQ ID NO: 534569 - DNA, 25 bp, Rattus norvegicus
gtttgtgcatccgaggaagctgcca

SEQ ID NO: 534570 - DNA, 25 bp, Rattus norvegicus
gtttgtgccaatagaccttgccatg

SEQ ID NO: 534571 - DNA, 25 bp, Rattus norvegicus
gtttgtgccaattgaccttgccatg

SEQ ID NO: 534572 - DNA, 25 bp, Rattus norvegicus
gtttgtgccacaattcagttgagtt

SEQ ID NO: 534573 - DNA, 25 bp, Rattus norvegicus
gtttgtgccacactgcattttgact

SEQ ID NO: 534574 - DNA, 25 bp, Rattus norvegicus
gtttgtgccacagtgcattttgact

SEQ ID NO: 534575 - DNA, 25 bp, Rattus norvegicus
gtttgtgccacatttcagttgagtt

SEQ ID NO: 534576 - DNA, 25 bp, Rattus norvegicus
gtttgtgcccaaacatggcgaactc

SEQ ID NO: 534577 - DNA, 25 bp, Rattus norvegicus
gtttgtgcccaatcatggcgaactc

SEQ ID NO: 534578 - DNA, 25 bp, Rattus norvegicus
gtttgtgcccatacatttcagctga

SEQ ID NO: 534579 - DNA, 25 bp, Rattus norvegicus
gtttgtgcccatatgacctgagatg

SEQ ID NO: 534580 - DNA, 25 bp, Rattus norvegicus
gtttgtgcccattcatttcagctga

SEQ ID NO: 534581 - DNA, 25 bp, Rattus norvegicus
gtttgtgcccatttgacctgagatg

SEQ ID NO: 534582 - DNA, 25 bp, Rattus norvegicus
gtttgtgctgagcttctcattgaac

SEQ ID NO: 534583 - DNA, 25 bp, Rattus norvegicus
gtttgtgctgaggttctcattgaac

SEQ ID NO: 534584 - DNA, 25 bp, Rattus norvegicus
gtttgtggactaagacgaaaggaac

SEQ ID NO: 534585 - DNA, 25 bp, Rattus norvegicus
gtttgtggactatgacgaaaggaac

SEQ ID NO: 534586 - DNA, 25 bp, Rattus norvegicus
gtttgtggagcactgtcctgagcac

SEQ ID NO: 534587 - DNA, 25 bp, Rattus norvegicus
gtttgtggagcagtgtcctgagcac

SEQ ID NO: 534588 - DNA, 25 bp, Rattus norvegicus
gtttgtggatatactccctgtggag

SEQ ID NO: 534589 - DNA, 25 bp, Rattus norvegicus
gtttgtggatattctccctgtggag

SEQ ID NO: 534590 - DNA, 25 bp, Rattus norvegicus
gtttgtggatctcaaccccgacagc

SEQ ID NO: 534591 - DNA, 25 bp, Rattus norvegicus
gtttgtggatctgaaccccgacagc

SEQ ID NO: 534592 - DNA, 25 bp, Rattus norvegicus
gtttgtggccacatgaggatcggcc

SEQ ID NO: 534593 - DNA, 25 bp, Rattus norvegicus
gtttgtggccacttgaggatcggcc

SEQ ID NO: 534594 - DNA, 25 bp, Rattus norvegicus
gtttgtggctctctatactacatta

SEQ ID NO: 534595 - DNA, 25 bp, Rattus norvegicus
gtttgtggctctgtatactacatta

SEQ ID NO: 534596 - DNA, 25 bp, Rattus norvegicus
gtttgtgggcttccagatgctcagt

SEQ ID NO: 534597 - DNA, 25 bp, Rattus norvegicus
gtttgtgggcttgcagatgctcagt

SEQ ID NO: 534598 - DNA, 25 bp, Rattus norvegicus
gtttgtgtacatccagagcagctca

SEQ ID NO: 534599 - DNA, 25 bp, Rattus norvegicus
gtttgtgtacatgcagagcagctca

SEQ ID NO: 534600 - DNA, 25 bp, Rattus norvegicus
gtttgtgtacgtcagcaccatgcct

SEQ ID NO: 534601 - DNA, 25 bp, Rattus norvegicus
gtttgtgtacgtgagcaccatgcct

SEQ ID NO: 534602 - DNA, 25 bp, Rattus norvegicus
gtttgtgtcactcagattatgcact

SEQ ID NO: 534603 - DNA, 25 bp, Rattus norvegicus
gtttgtgtcactgagattatgcact

SEQ ID NO: 534604 - DNA, 25 bp, Rattus norvegicus
gtttgtgtcaggctcagcagatgaa

SEQ ID NO: 534605 - DNA, 25 bp, Rattus norvegicus
gtttgtgtcagggtcagcagatgaa

SEQ ID NO: 534606 - DNA, 25 bp, Rattus norvegicus
gtttgtgtccaacggagccccagag

SEQ ID NO: 534607 - DNA, 25 bp, Rattus norvegicus
gtttgtgtccaagggagccccagag

SEQ ID NO: 534608 - DNA, 25 bp, Rattus norvegicus
gtttgtgtcctgatgagatgtgtca

SEQ ID NO: 534609 - DNA, 25 bp, Rattus norvegicus
gtttgtgtcctgttgagatgtgtca

SEQ ID NO: 534610 - DNA, 25 bp, Rattus norvegicus
gtttgtgtcttgaacactttgccaa

SEQ ID NO: 534611 - DNA, 25 bp, Rattus norvegicus
gtttgtgtcttgattgttcgcccca

SEQ ID NO: 534612 - DNA, 25 bp, Rattus norvegicus
gtttgtgtcttgtacactttgccaa

SEQ ID NO: 534613 - DNA, 25 bp, Rattus norvegicus
gtttgtgtcttgtttgttcgcccca

SEQ ID NO: 534614 - DNA, 25 bp, Rattus norvegicus
gtttgtgtgagcatagccccataca

SEQ ID NO: 534615 - DNA, 25 bp, Rattus norvegicus
gtttgtgtgagcttagccccataca

SEQ ID NO: 534616 - DNA, 25 bp, Rattus norvegicus
gtttgtgtgcacagtcaggttcatc

SEQ ID NO: 534617 - DNA, 25 bp, Rattus norvegicus
gtttgtgtgcactgtcaggttcatc

SEQ ID NO: 534618 - DNA, 25 bp, Rattus norvegicus
gtttgtgtggctaatgcacctttct

SEQ ID NO: 534619 - DNA, 25 bp, Rattus norvegicus
gtttgtgtggcttatgcacctttct

SEQ ID NO: 534620 - DNA, 25 bp, Rattus norvegicus
gtttgtgtgtagaactgacttttta

SEQ ID NO: 534621 - DNA, 25 bp, Rattus norvegicus
gtttgtgtgtagtactgacttttta

SEQ ID NO: 534622 - DNA, 25 bp, Rattus norvegicus
gtttgtgttcgtatgtggtttctag

SEQ ID NO: 534623 - DNA, 25 bp, Rattus norvegicus
gtttgtgttcgtttgtggtttctag

SEQ ID NO: 534624 - DNA, 25 bp, Rattus norvegicus
gtttgtgttgagacaccattctcca

SEQ ID NO: 534625 - DNA, 25 bp, Rattus norvegicus
gtttgtgttgagtcaccattctcca

SEQ ID NO: 534626 - DNA, 25 bp, Rattus norvegicus
gtttgtgtttagagtgtttctctga

SEQ ID NO: 534627 - DNA, 25 bp, Rattus norvegicus
gtttgtgtttagtgtgtttctctga

SEQ ID NO: 534628 - DNA, 25 bp, Rattus norvegicus
gtttgttaacagagtcctcggttgt

SEQ ID NO: 534629 - DNA, 25 bp, Rattus norvegicus
gtttgttaacagtgtcctcggttgt

SEQ ID NO: 534630 - DNA, 25 bp, Rattus norvegicus
gtttgttaagcaccctgttggaaga

SEQ ID NO: 534631 - DNA, 25 bp, Rattus norvegicus
gtttgttaagcagcctgttggaaga

SEQ ID NO: 534632 - DNA, 25 bp, Rattus norvegicus
gtttgttaagccctgtggatgaaag

SEQ ID NO: 534633 - DNA, 25 bp, Rattus norvegicus
gtttgttaagccgtgtggatgaaag

SEQ ID NO: 534634 - DNA, 25 bp, Rattus norvegicus
gtttgttacaccagcagaggagaaa

SEQ ID NO: 534635 - DNA, 25 bp, Rattus norvegicus
gtttgttacacctgcagaggagaaa

SEQ ID NO: 534636 - DNA, 25 bp, Rattus norvegicus
gtttgttacaggactaatctgccct

SEQ ID NO: 534637 - DNA, 25 bp, Rattus norvegicus
gtttgttacaggtctaatctgccct

SEQ ID NO: 534638 - DNA, 25 bp, Rattus norvegicus
gtttgttacataaatcctctgggat

SEQ ID NO: 534639 - DNA, 25 bp, Rattus norvegicus
gtttgttacatatatcctctgggat

SEQ ID NO: 534640 - DNA, 25 bp, Rattus norvegicus
gtttgttaccaaatttgaagcccat

SEQ ID NO: 534641 - DNA, 25 bp, Rattus norvegicus
gtttgttaccaattttgaagcccat

SEQ ID NO: 534642 - DNA, 25 bp, Rattus norvegicus
gtttgttacctcaaaaagcagggct

SEQ ID NO: 534643 - DNA, 25 bp, Rattus norvegicus
gtttgttacctctaaaagcagggct

SEQ ID NO: 534644 - DNA, 25 bp, Rattus norvegicus
gtttgttatagcatggccctgagga

SEQ ID NO: 534645 - DNA, 25 bp, Rattus norvegicus
gtttgttatagcttggccctgagga

SEQ ID NO: 534646 - DNA, 25 bp, Rattus norvegicus
gtttgttattgcatgtgtttgtttg

SEQ ID NO: 534647 - DNA, 25 bp, Rattus norvegicus
gtttgttattgcttgtgtttgtttg

SEQ ID NO: 534648 - DNA, 25 bp, Rattus norvegicus
gtttgttcactgaacttggtctgca

SEQ ID NO: 534649 - DNA, 25 bp, Rattus norvegicus
gtttgttcactgtacttggtctgca

SEQ ID NO: 534650 - DNA, 25 bp, Rattus norvegicus
gtttgttcatctatattctggtttg

SEQ ID NO: 534651 - DNA, 25 bp, Rattus norvegicus
gtttgttcatctttattctggtttg

SEQ ID NO: 534652 - DNA, 25 bp, Rattus norvegicus
gtttgttcattaaatacattggtgt

SEQ ID NO: 534653 - DNA, 25 bp, Rattus norvegicus
gtttgttcattatatacattggtgt

SEQ ID NO: 534654 - DNA, 25 bp, Rattus norvegicus
gtttgttccaacagtgtttccattc

SEQ ID NO: 534655 - DNA, 25 bp, Rattus norvegicus
gtttgttccaactgtgtttccattc

SEQ ID NO: 534656 - DNA, 25 bp, Rattus norvegicus
gtttgttccattcccatagttctct

SEQ ID NO: 534657 - DNA, 25 bp, Rattus norvegicus
gtttgttccattgccatagttctct

SEQ ID NO: 534658 - DNA, 25 bp, Rattus norvegicus
gtttgttcctatatttctcttagat

SEQ ID NO: 534659 - DNA, 25 bp, Rattus norvegicus
gtttgttcctatttttctcttagat

SEQ ID NO: 534660 - DNA, 25 bp, Rattus norvegicus
gtttgttcctgaatccatgtgcttt

SEQ ID NO: 534661 - DNA, 25 bp, Rattus norvegicus
gtttgttcctgattccatgtgcttt

SEQ ID NO: 534662 - DNA, 25 bp, Rattus norvegicus
gtttgttccttgagagggttgcatt

SEQ ID NO: 534663 - DNA, 25 bp, Rattus norvegicus
gtttgttccttgtgagggttgcatt

SEQ ID NO: 534664 - DNA, 25 bp, Rattus norvegicus
gtttgttctgacaggagtgctcaca

SEQ ID NO: 534665 - DNA, 25 bp, Rattus norvegicus
gtttgttctgactggagtgctcaca

SEQ ID NO: 534666 - DNA, 25 bp, Rattus norvegicus
gtttgttctgataatgtgattccca

SEQ ID NO: 534667 - DNA, 25 bp, Rattus norvegicus
gtttgttctgattatgtgattccca

SEQ ID NO: 534668 - DNA, 25 bp, Rattus norvegicus
gtttgttctggtcctaaccgcccat

SEQ ID NO: 534669 - DNA, 25 bp, Rattus norvegicus
gtttgttctggtgctaaccgcccat

SEQ ID NO: 534670 - DNA, 25 bp, Rattus norvegicus
gtttgttctgttcatttcggaggga

SEQ ID NO: 534671 - DNA, 25 bp, Rattus norvegicus
gtttgttctgttgatttcggaggga

SEQ ID NO: 534672 - DNA, 25 bp, Rattus norvegicus
gtttgttcttttatctactctcttt

SEQ ID NO: 534673 - DNA, 25 bp, Rattus norvegicus
gtttgttcttttttctactctcttt

SEQ ID NO: 534674 - DNA, 25 bp, Rattus norvegicus
gtttgttgaactaggactcaggtca

SEQ ID NO: 534675 - DNA, 25 bp, Rattus norvegicus
gtttgttgaactatgttgcactgta

SEQ ID NO: 534676 - DNA, 25 bp, Rattus norvegicus
gtttgttgaacttggactcaggtca

SEQ ID NO: 534677 - DNA, 25 bp, Rattus norvegicus
gtttgttgaactttgttgcactgta

SEQ ID NO: 534678 - DNA, 25 bp, Rattus norvegicus
gtttgttgaataccacaattcttta

SEQ ID NO: 534679 - DNA, 25 bp, Rattus norvegicus
gtttgttgaatagcacaattcttta

SEQ ID NO: 534680 - DNA, 25 bp, Rattus norvegicus
gtttgttgacacaccggttattggc

SEQ ID NO: 534681 - DNA, 25 bp, Rattus norvegicus
gtttgttgacactccggttattggc

SEQ ID NO: 534682 - DNA, 25 bp, Rattus norvegicus
gtttgttgagctacattcttcattg

SEQ ID NO: 534683 - DNA, 25 bp, Rattus norvegicus
gtttgttgagcttcattcttcattg

SEQ ID NO: 534684 - DNA, 25 bp, Rattus norvegicus
gtttgttgaggtcagcatgctgttt

SEQ ID NO: 534685 - DNA, 25 bp, Rattus norvegicus
gtttgttgaggtgagcatgctgttt

SEQ ID NO: 534686 - DNA, 25 bp, Rattus norvegicus
gtttgttgcctaattacacgtcgaa

SEQ ID NO: 534687 - DNA, 25 bp, Rattus norvegicus
gtttgttgcctatttacacgtcgaa

SEQ ID NO: 534688 - DNA, 25 bp, Rattus norvegicus
gtttgttgcctgatcttagtttcat

SEQ ID NO: 534689 - DNA, 25 bp, Rattus norvegicus
gtttgttgcctgttcttagtttcat

SEQ ID NO: 534690 - DNA, 25 bp, Rattus norvegicus
gtttgttgctttagacagggtcctt

SEQ ID NO: 534691 - DNA, 25 bp, Rattus norvegicus
gtttgttgcttttgacagggtcctt

SEQ ID NO: 534692 - DNA, 25 bp, Rattus norvegicus
gtttgttgtaacatgctctgtggat

SEQ ID NO: 534693 - DNA, 25 bp, Rattus norvegicus
gtttgttgtaacttgctctgtggat

SEQ ID NO: 534694 - DNA, 25 bp, Rattus norvegicus
gtttgttgtcgcagttttgactaac

SEQ ID NO: 534695 - DNA, 25 bp, Rattus norvegicus
gtttgttgtcgctgttttgactaac

SEQ ID NO: 534696 - DNA, 25 bp, Rattus norvegicus
gtttgttgtctgcagctttaaggat

SEQ ID NO: 534697 - DNA, 25 bp, Rattus norvegicus
gtttgttgtctggagctttaaggat

SEQ ID NO: 534698 - DNA, 25 bp, Rattus norvegicus
gtttgttgtgggatccaatccagtt

SEQ ID NO: 534699 - DNA, 25 bp, Rattus norvegicus
gtttgttgtgggttccaatccagtt

SEQ ID NO: 534700 - DNA, 25 bp, Rattus norvegicus
gtttgtttaaagctgctctcaccct

SEQ ID NO: 534701 - DNA, 25 bp, Rattus norvegicus
gtttgtttaaaggtgctctcaccct

SEQ ID NO: 534702 - DNA, 25 bp, Rattus norvegicus
gtttgtttagctaagacgtcgagtg

SEQ ID NO: 534703 - DNA, 25 bp, Rattus norvegicus
gtttgtttagcttagacgtcgagtg

SEQ ID NO: 534704 - DNA, 25 bp, Rattus norvegicus
gtttgtttcacaatcaccacagaat

SEQ ID NO: 534705 - DNA, 25 bp, Rattus norvegicus
gtttgtttcacaatctcaggtcatt

SEQ ID NO: 534706 - DNA, 25 bp, Rattus norvegicus
gtttgtttcacattcaccacagaat

SEQ ID NO: 534707 - DNA, 25 bp, Rattus norvegicus
gtttgtttcacattctcaggtcatt

SEQ ID NO: 534708 - DNA, 25 bp, Rattus norvegicus
gtttgtttcagcatagatttcatca

SEQ ID NO: 534709 - DNA, 25 bp, Rattus norvegicus
gtttgtttcagcttagatttcatca

SEQ ID NO: 534710 - DNA, 25 bp, Rattus norvegicus
gtttgtttcatgagcaggttctaga

SEQ ID NO: 534711 - DNA, 25 bp, Rattus norvegicus
gtttgtttcatgtgcaggttctaga

SEQ ID NO: 534712 - DNA, 25 bp, Rattus norvegicus
gtttgtttccatagcttctaatcag

SEQ ID NO: 534713 - DNA, 25 bp, Rattus norvegicus
gtttgtttccattgcttctaatcag

SEQ ID NO: 534714 - DNA, 25 bp, Rattus norvegicus
gtttgtttccctctattgcagaagc

SEQ ID NO: 534715 - DNA, 25 bp, Rattus norvegicus
gtttgtttccctgtattgcagaagc

SEQ ID NO: 534716 - DNA, 25 bp, Rattus norvegicus
gtttgtttcctaatctctatggctg

SEQ ID NO: 534717 - DNA, 25 bp, Rattus norvegicus
gtttgtttcctacgagaaagcacag

SEQ ID NO: 534718 - DNA, 25 bp, Rattus norvegicus
gtttgtttcctacttcatgcttata

SEQ ID NO: 534719 - DNA, 25 bp, Rattus norvegicus
gtttgtttcctaggagaaagcacag

SEQ ID NO: 534720 - DNA, 25 bp, Rattus norvegicus
gtttgtttcctagttcatgcttata

SEQ ID NO: 534721 - DNA, 25 bp, Rattus norvegicus
gtttgtttcctattctctatggctg

SEQ ID NO: 534722 - DNA, 25 bp, Rattus norvegicus
gtttgtttctgcacaactactgtac

SEQ ID NO: 534723 - DNA, 25 bp, Rattus norvegicus
gtttgtttctgctcaactactgtac

SEQ ID NO: 534724 - DNA, 25 bp, Rattus norvegicus
gtttgtttcttccatgcttgtgaac

SEQ ID NO: 534725 - DNA, 25 bp, Rattus norvegicus
gtttgtttcttcgatgcttgtgaac

SEQ ID NO: 534726 - DNA, 25 bp, Rattus norvegicus
gtttgtttctttctcatttgctgtt

SEQ ID NO: 534727 - DNA, 25 bp, Rattus norvegicus
gtttgtttctttgtcatttgctgtt

SEQ ID NO: 534728 - DNA, 25 bp, Rattus norvegicus
gtttgtttggctaaactgtctctca

SEQ ID NO: 534729 - DNA, 25 bp, Rattus norvegicus
gtttgtttggcttaactgtctctca

SEQ ID NO: 534730 - DNA, 25 bp, Rattus norvegicus
gtttgtttggttcatattgctgttc

SEQ ID NO: 534731 - DNA, 25 bp, Rattus norvegicus
gtttgtttggttgatattgctgttc

SEQ ID NO: 534732 - DNA, 25 bp, Rattus norvegicus
gtttgtttgtatactgtttctccaa

SEQ ID NO: 534733 - DNA, 25 bp, Rattus norvegicus
gtttgtttgtattctgtttctccaa

SEQ ID NO: 534734 - DNA, 25 bp, Rattus norvegicus
gtttgtttgtcccagggatgccaca

SEQ ID NO: 534735 - DNA, 25 bp, Rattus norvegicus
gtttgtttgtccgagggatgccaca

SEQ ID NO: 534736 - DNA, 25 bp, Rattus norvegicus
gtttgtttgtctaaatgcctgtctt

SEQ ID NO: 534737 - DNA, 25 bp, Rattus norvegicus
gtttgtttgtctatctccacattaa

SEQ ID NO: 534738 - DNA, 25 bp, Rattus norvegicus
gtttgtttgtctctgcgtttaattg

SEQ ID NO: 534739 - DNA, 25 bp, Rattus norvegicus
gtttgtttgtctgtgcgtttaattg

SEQ ID NO: 534740 - DNA, 25 bp, Rattus norvegicus
gtttgtttgtcttaatgcctgtctt

SEQ ID NO: 534741 - DNA, 25 bp, Rattus norvegicus
gtttgtttgtctttctccacattaa

SEQ ID NO: 534742 - DNA, 25 bp, Rattus norvegicus
gtttgtttgttcattatatacattg

SEQ ID NO: 534743 - DNA, 25 bp, Rattus norvegicus
gtttgtttgttctttatatacattg

SEQ ID NO: 534744 - DNA, 25 bp, Rattus norvegicus
gtttgttttcatacagtgtctcctg

SEQ ID NO: 534745 - DNA, 25 bp, Rattus norvegicus
gtttgttttcattcagtgtctcctg

SEQ ID NO: 534746 - DNA, 25 bp, Rattus norvegicus
gtttgttttccaattcttccagcaa

SEQ ID NO: 534747 - DNA, 25 bp, Rattus norvegicus
gtttgttttccatttcttccagcaa

SEQ ID NO: 534748 - DNA, 25 bp, Rattus norvegicus
gtttgttttctcaatatcattttgt

SEQ ID NO: 534749 - DNA, 25 bp, Rattus norvegicus
gtttgttttctcaccaaactccatg

SEQ ID NO: 534750 - DNA, 25 bp, Rattus norvegicus
gtttgttttctctatatcattttgt

SEQ ID NO: 534751 - DNA, 25 bp, Rattus norvegicus
gtttgttttctctccaaactccatg

SEQ ID NO: 534752 - DNA, 25 bp, Rattus norvegicus
gtttgttttgccaatgtgagtgaaa

SEQ ID NO: 534753 - DNA, 25 bp, Rattus norvegicus
gtttgttttgcctatgtgagtgaaa

SEQ ID NO: 534754 - DNA, 25 bp, Rattus norvegicus
gtttgttttgctatggaatccacca

SEQ ID NO: 534755 - DNA, 25 bp, Rattus norvegicus
gtttgttttgctttggaatccacca

SEQ ID NO: 534756 - DNA, 25 bp, Rattus norvegicus
gtttgttttgtgaccaagccgtgta

SEQ ID NO: 534757 - DNA, 25 bp, Rattus norvegicus
gtttgttttgtgtccaagccgtgta

SEQ ID NO: 534758 - DNA, 25 bp, Rattus norvegicus
gtttgttttttaacctgttagctct

SEQ ID NO: 534759 - DNA, 25 bp, Rattus norvegicus
gtttgttttttatcctgttagctct

SEQ ID NO: 534760 - DNA, 25 bp, Rattus norvegicus
gttttaaaagccacacctgaaatga

SEQ ID NO: 534761 - DNA, 25 bp, Rattus norvegicus
gttttaaaagcctcacctgaaatga

SEQ ID NO: 534762 - DNA, 25 bp, Rattus norvegicus
gttttaaaatttagcctgcattctg

SEQ ID NO: 534763 - DNA, 25 bp, Rattus norvegicus
gttttaaaattttgcctgcattctg

SEQ ID NO: 534764 - DNA, 25 bp, Rattus norvegicus
gttttaaagaacacaccagggctgt

SEQ ID NO: 534765 - DNA, 25 bp, Rattus norvegicus
gttttaaagaactcaccagggctgt

SEQ ID NO: 534766 - DNA, 25 bp, Rattus norvegicus
gttttaaagagacatttgagcccct

SEQ ID NO: 534767 - DNA, 25 bp, Rattus norvegicus
gttttaaagagagatttgagcccct

SEQ ID NO: 534768 - DNA, 25 bp, Rattus norvegicus
gttttaaatatccttcctctcatag

SEQ ID NO: 534769 - DNA, 25 bp, Rattus norvegicus
gttttaaatatcgttcctctcatag

SEQ ID NO: 534770 - DNA, 25 bp, Rattus norvegicus
gttttaaattatcagtcgacggagg

SEQ ID NO: 534771 - DNA, 25 bp, Rattus norvegicus
gttttaaattatgagtcgacggagg

SEQ ID NO: 534772 - DNA, 25 bp, Rattus norvegicus
gttttaaatttcagccaggcctgag

SEQ ID NO: 534773 - DNA, 25 bp, Rattus norvegicus
gttttaaatttctgccaggcctgag

SEQ ID NO: 534774 - DNA, 25 bp, Rattus norvegicus
gttttaacacacagcttggagaaga

SEQ ID NO: 534775 - DNA, 25 bp, Rattus norvegicus
gttttaacacactgcttggagaaga

SEQ ID NO: 534776 - DNA, 25 bp, Rattus norvegicus
gttttaacaggtcatgcatattgct

SEQ ID NO: 534777 - DNA, 25 bp, Rattus norvegicus
gttttaacaggtgatgcatattgct

SEQ ID NO: 534778 - DNA, 25 bp, Rattus norvegicus
gttttaacagtcaattctctctaag

SEQ ID NO: 534779 - DNA, 25 bp, Rattus norvegicus
gttttaacagtctattctctctaag

SEQ ID NO: 534780 - DNA, 25 bp, Rattus norvegicus
gttttaactaggaaactcacatcca

SEQ ID NO: 534781 - DNA, 25 bp, Rattus norvegicus
gttttaactaggtaactcacatcca

SEQ ID NO: 534782 - DNA, 25 bp, Rattus norvegicus
gttttaactctgagctctaccctag

SEQ ID NO: 534783 - DNA, 25 bp, Rattus norvegicus
gttttaactctgtgctctaccctag

SEQ ID NO: 534784 - DNA, 25 bp, Rattus norvegicus
gttttaactgttagctgacagattc

SEQ ID NO: 534785 - DNA, 25 bp, Rattus norvegicus
gttttaactgtttgctgacagattc

SEQ ID NO: 534786 - DNA, 25 bp, Rattus norvegicus
gttttaagcctgctcagatgctaca

SEQ ID NO: 534787 - DNA, 25 bp, Rattus norvegicus
gttttaagcctggtcagatgctaca

SEQ ID NO: 534788 - DNA, 25 bp, Rattus norvegicus
gttttaaggctaccatggtcttcag

SEQ ID NO: 534789 - DNA, 25 bp, Rattus norvegicus
gttttaaggctagcatggtcttcag

SEQ ID NO: 534790 - DNA, 25 bp, Rattus norvegicus
gttttaatatgaaatcagccatcat

SEQ ID NO: 534791 - DNA, 25 bp, Rattus norvegicus
gttttaatatgatatcagccatcat

SEQ ID NO: 534792 - DNA, 25 bp, Rattus norvegicus
gttttaatcaaacctatgcattcat

SEQ ID NO: 534793 - DNA, 25 bp, Rattus norvegicus
gttttaatcaaagctatgcattcat

SEQ ID NO: 534794 - DNA, 25 bp, Rattus norvegicus
gttttaatccacatcaggatgcata

SEQ ID NO: 534795 - DNA, 25 bp, Rattus norvegicus
gttttaatccacttcaggatgcata

SEQ ID NO: 534796 - DNA, 25 bp, Rattus norvegicus
gttttaatcgtgaagccgtggctgt

SEQ ID NO: 534797 - DNA, 25 bp, Rattus norvegicus
gttttaatcgtgtagccgtggctgt

SEQ ID NO: 534798 - DNA, 25 bp, Rattus norvegicus
gttttaatcttaccactgtgcatgt

SEQ ID NO: 534799 - DNA, 25 bp, Rattus norvegicus
gttttaatcttagcactgtgcatgt

SEQ ID NO: 534800 - DNA, 25 bp, Rattus norvegicus
gttttaatgaggagcccgcgcccct

SEQ ID NO: 534801 - DNA, 25 bp, Rattus norvegicus
gttttaatgaggtgcccgcgcccct

SEQ ID NO: 534802 - DNA, 25 bp, Rattus norvegicus
gttttaatgctgatagttgtcatga

SEQ ID NO: 534803 - DNA, 25 bp, Rattus norvegicus
gttttaatgctgttagttgtcatga

SEQ ID NO: 534804 - DNA, 25 bp, Rattus norvegicus
gttttaattgcacagacacacggac

SEQ ID NO: 534805 - DNA, 25 bp, Rattus norvegicus
gttttaattgcagagacacacggac

SEQ ID NO: 534806 - DNA, 25 bp, Rattus norvegicus
gttttaatttttaacacacatgcac

SEQ ID NO: 534807 - DNA, 25 bp, Rattus norvegicus
gttttaattttttacacacatgcac

SEQ ID NO: 534808 - DNA, 25 bp, Rattus norvegicus
gttttacaaaacagcctggccatag

SEQ ID NO: 534809 - DNA, 25 bp, Rattus norvegicus
gttttacaaaactgcctggccatag

SEQ ID NO: 534810 - DNA, 25 bp, Rattus norvegicus
gttttacaaattccctctgacccat

SEQ ID NO: 534811 - DNA, 25 bp, Rattus norvegicus
gttttacaaattgcctctgacccat

SEQ ID NO: 534812 - DNA, 25 bp, Rattus norvegicus
gttttacaacacctgtctccttgat

SEQ ID NO: 534813 - DNA, 25 bp, Rattus norvegicus
gttttacaacacgtgtctccttgat

SEQ ID NO: 534814 - DNA, 25 bp, Rattus norvegicus
gttttacaacctcgcactgtccaga

SEQ ID NO: 534815 - DNA, 25 bp, Rattus norvegicus
gttttacaacctggcactgtccaga

SEQ ID NO: 534816 - DNA, 25 bp, Rattus norvegicus
gttttacaagccctctaagcgattc

SEQ ID NO: 534817 - DNA, 25 bp, Rattus norvegicus
gttttacaagccgtctaagcgattc

SEQ ID NO: 534818 - DNA, 25 bp, Rattus norvegicus
gttttacaattaaagcaccctggaa

SEQ ID NO: 534819 - DNA, 25 bp, Rattus norvegicus
gttttacaattatagcaccctggaa

SEQ ID NO: 534820 - DNA, 25 bp, Rattus norvegicus
gttttacacactctcccaactcatg

SEQ ID NO: 534821 - DNA, 25 bp, Rattus norvegicus
gttttacacactgtcccaactcatg

SEQ ID NO: 534822 - DNA, 25 bp, Rattus norvegicus
gttttacactagcactatatcagcc

SEQ ID NO: 534823 - DNA, 25 bp, Rattus norvegicus
gttttacactaggactatatcagcc

SEQ ID NO: 534824 - DNA, 25 bp, Rattus norvegicus
gttttacactggatcgctcatggag

SEQ ID NO: 534825 - DNA, 25 bp, Rattus norvegicus
gttttacactggttcgctcatggag

SEQ ID NO: 534826 - DNA, 25 bp, Rattus norvegicus
gttttacagcacagcatctgacctg

SEQ ID NO: 534827 - DNA, 25 bp, Rattus norvegicus
gttttacagcactgcatctgacctg

SEQ ID NO: 534828 - DNA, 25 bp, Rattus norvegicus
gttttacagctcctaccacatgcat

SEQ ID NO: 534829 - DNA, 25 bp, Rattus norvegicus
gttttacagctcgtaccacatgcat

SEQ ID NO: 534830 - DNA, 25 bp, Rattus norvegicus
gttttacagctgcagagtgccttca

SEQ ID NO: 534831 - DNA, 25 bp, Rattus norvegicus
gttttacagctgcagcccgacaatg

SEQ ID NO: 534832 - DNA, 25 bp, Rattus norvegicus
gttttacagctggagagtgccttca

SEQ ID NO: 534833 - DNA, 25 bp, Rattus norvegicus
gttttacagctggagcccgacaatg

SEQ ID NO: 534834 - DNA, 25 bp, Rattus norvegicus
gttttacagggaactctaatgccaa

SEQ ID NO: 534835 - DNA, 25 bp, Rattus norvegicus
gttttacagggatctctaatgccaa

SEQ ID NO: 534836 - DNA, 25 bp, Rattus norvegicus
gttttacatattaagcactttggaa

SEQ ID NO: 534837 - DNA, 25 bp, Rattus norvegicus
gttttacatatttagcactttggaa

SEQ ID NO: 534838 - DNA, 25 bp, Rattus norvegicus
gttttacatgacatcagggctctat

SEQ ID NO: 534839 - DNA, 25 bp, Rattus norvegicus
gttttacatgacttcagggctctat

SEQ ID NO: 534840 - DNA, 25 bp, Rattus norvegicus
gttttacatgtacactgtctctgcc

SEQ ID NO: 534841 - DNA, 25 bp, Rattus norvegicus
gttttacatgtagactgtctctgcc

SEQ ID NO: 534842 - DNA, 25 bp, Rattus norvegicus
gttttacatgtgatccctaaaggca

SEQ ID NO: 534843 - DNA, 25 bp, Rattus norvegicus
gttttacatgtgttccctaaaggca

SEQ ID NO: 534844 - DNA, 25 bp, Rattus norvegicus
gttttaccaactcacaaagcttctg

SEQ ID NO: 534845 - DNA, 25 bp, Rattus norvegicus
gttttaccaactgacaaagcttctg

SEQ ID NO: 534846 - DNA, 25 bp, Rattus norvegicus
gttttaccaataacattccttttct

SEQ ID NO: 534847 - DNA, 25 bp, Rattus norvegicus
gttttaccaatatcattccttttct

SEQ ID NO: 534848 - DNA, 25 bp, Rattus norvegicus
gttttaccctatatgttcaccattg

SEQ ID NO: 534849 - DNA, 25 bp, Rattus norvegicus
gttttaccctatttgttcaccattg

SEQ ID NO: 534850 - DNA, 25 bp, Rattus norvegicus
gttttaccggcaatgggcactgaaa

SEQ ID NO: 534851 - DNA, 25 bp, Rattus norvegicus
gttttaccggcattgggcactgaaa

SEQ ID NO: 534852 - DNA, 25 bp, Rattus norvegicus
gttttacctgccaagttacacatga

SEQ ID NO: 534853 - DNA, 25 bp, Rattus norvegicus
gttttacctgcctagttacacatga

SEQ ID NO: 534854 - DNA, 25 bp, Rattus norvegicus
gttttacctgtaccatgtttgtgat

SEQ ID NO: 534855 - DNA, 25 bp, Rattus norvegicus
gttttacctgtagcatgtttgtgat

SEQ ID NO: 534856 - DNA, 25 bp, Rattus norvegicus
gttttacctgtgaatcagggacact

SEQ ID NO: 534857 - DNA, 25 bp, Rattus norvegicus
gttttacctgtgtatcagggacact

SEQ ID NO: 534858 - DNA, 25 bp, Rattus norvegicus
gttttacgcactctgtgatcagctg

SEQ ID NO: 534859 - DNA, 25 bp, Rattus norvegicus
gttttacgcactgtgtgatcagctg

SEQ ID NO: 534860 - DNA, 25 bp, Rattus norvegicus
gttttacggcaaaatcatcaccaca

SEQ ID NO: 534861 - DNA, 25 bp, Rattus norvegicus
gttttacggcaatatcatcaccaca

SEQ ID NO: 534862 - DNA, 25 bp, Rattus norvegicus
gttttacggctgaagtgactgtcga

SEQ ID NO: 534863 - DNA, 25 bp, Rattus norvegicus
gttttacggctgtagtgactgtcga

SEQ ID NO: 534864 - DNA, 25 bp, Rattus norvegicus
gttttactaacaagctctggaatat

SEQ ID NO: 534865 - DNA, 25 bp, Rattus norvegicus
gttttactaacatgctctggaatat

SEQ ID NO: 534866 - DNA, 25 bp, Rattus norvegicus
gttttactagaccatctctgcacaa

SEQ ID NO: 534867 - DNA, 25 bp, Rattus norvegicus
gttttactagacgatctctgcacaa

SEQ ID NO: 534868 - DNA, 25 bp, Rattus norvegicus
gttttactagggacagttcctctga

SEQ ID NO: 534869 - DNA, 25 bp, Rattus norvegicus
gttttactagggtcagttcctctga

SEQ ID NO: 534870 - DNA, 25 bp, Rattus norvegicus
gttttactatgacactagacccagt

SEQ ID NO: 534871 - DNA, 25 bp, Rattus norvegicus
gttttactatgagactagacccagt

SEQ ID NO: 534872 - DNA, 25 bp, Rattus norvegicus
gttttactcactcgaagtgtcctga

SEQ ID NO: 534873 - DNA, 25 bp, Rattus norvegicus
gttttactcactggaagtgtcctga

SEQ ID NO: 534874 - DNA, 25 bp, Rattus norvegicus
gttttactcattagacacttcactg

SEQ ID NO: 534875 - DNA, 25 bp, Rattus norvegicus
gttttactcatttgacacttcactg

SEQ ID NO: 534876 - DNA, 25 bp, Rattus norvegicus
gttttactggccaccatgtgtcttt

SEQ ID NO: 534877 - DNA, 25 bp, Rattus norvegicus
gttttactggccatttgaattcttt

SEQ ID NO: 534878 - DNA, 25 bp, Rattus norvegicus
gttttactggcctccatgtgtcttt

SEQ ID NO: 534879 - DNA, 25 bp, Rattus norvegicus
gttttactggccttttgaattcttt

SEQ ID NO: 534880 - DNA, 25 bp, Rattus norvegicus
gttttactttgccatatccattgag

SEQ ID NO: 534881 - DNA, 25 bp, Rattus norvegicus
gttttactttgcgatatccattgag

SEQ ID NO: 534882 - DNA, 25 bp, Rattus norvegicus
gttttagaacacagatgcacacatg

SEQ ID NO: 534883 - DNA, 25 bp, Rattus norvegicus
gttttagaacactgatgcacacatg

SEQ ID NO: 534884 - DNA, 25 bp, Rattus norvegicus
gttttagaacgcctgctcagtaaca

SEQ ID NO: 534885 - DNA, 25 bp, Rattus norvegicus
gttttagaacgcgtgctcagtaaca

SEQ ID NO: 534886 - DNA, 25 bp, Rattus norvegicus
gttttagaaggtcctggcccaatgt

SEQ ID NO: 534887 - DNA, 25 bp, Rattus norvegicus
gttttagaaggtgctggcccaatgt

SEQ ID NO: 534888 - DNA, 25 bp, Rattus norvegicus
gttttagaagttatgccttgccaag

SEQ ID NO: 534889 - DNA, 25 bp, Rattus norvegicus
gttttagaagttttgccttgccaag

SEQ ID NO: 534890 - DNA, 25 bp, Rattus norvegicus
gttttagacacaatccacgcaaatg

SEQ ID NO: 534891 - DNA, 25 bp, Rattus norvegicus
gttttagacacattccacgcaaatg

SEQ ID NO: 534892 - DNA, 25 bp, Rattus norvegicus
gttttagacactactacctcagctt

SEQ ID NO: 534893 - DNA, 25 bp, Rattus norvegicus
gttttagacacttctacctcagctt

SEQ ID NO: 534894 - DNA, 25 bp, Rattus norvegicus
gttttagacagcaccagaatatatt

SEQ ID NO: 534895 - DNA, 25 bp, Rattus norvegicus
gttttagacagctccagaatatatt

SEQ ID NO: 534896 - DNA, 25 bp, Rattus norvegicus
gttttagactggagctggaccgcgt

SEQ ID NO: 534897 - DNA, 25 bp, Rattus norvegicus
gttttagactggtgctggaccgcgt

SEQ ID NO: 534898 - DNA, 25 bp, Rattus norvegicus
gttttagactgtactcaggttggga

SEQ ID NO: 534899 - DNA, 25 bp, Rattus norvegicus
gttttagactgttctcaggttggga

SEQ ID NO: 534900 - DNA, 25 bp, Rattus norvegicus
gttttagagctgagaccgtccttcc

SEQ ID NO: 534901 - DNA, 25 bp, Rattus norvegicus
gttttagagctgtgaccgtccttcc

SEQ ID NO: 534902 - DNA, 25 bp, Rattus norvegicus
gttttagcacaacttcctaggcctg

SEQ ID NO: 534903 - DNA, 25 bp, Rattus norvegicus
gttttagcacaagttcctaggcctg

SEQ ID NO: 534904 - DNA, 25 bp, Rattus norvegicus
gttttagcagagctgttcctctcat

SEQ ID NO: 534905 - DNA, 25 bp, Rattus norvegicus
gttttagcagaggtgttcctctcat

SEQ ID NO: 534906 - DNA, 25 bp, Rattus norvegicus
gttttagcagcacatcgttactcaa

SEQ ID NO: 534907 - DNA, 25 bp, Rattus norvegicus
gttttagcagcagatcgttactcaa

SEQ ID NO: 534908 - DNA, 25 bp, Rattus norvegicus
gttttagcatgactgattcgctcat

SEQ ID NO: 534909 - DNA, 25 bp, Rattus norvegicus
gttttagcatgagtgattcgctcat

SEQ ID NO: 534910 - DNA, 25 bp, Rattus norvegicus
gttttagccacgacagtgttctgtg

SEQ ID NO: 534911 - DNA, 25 bp, Rattus norvegicus
gttttagccacgtcagtgttctgtg

SEQ ID NO: 534912 - DNA, 25 bp, Rattus norvegicus
gttttagccagtatttaatatctca

SEQ ID NO: 534913 - DNA, 25 bp, Rattus norvegicus
gttttagccagtttttaatatctca

SEQ ID NO: 534914 - DNA, 25 bp, Rattus norvegicus
gttttagcggctactgtattcatag

SEQ ID NO: 534915 - DNA, 25 bp, Rattus norvegicus
gttttagcggcttctgtattcatag

SEQ ID NO: 534916 - DNA, 25 bp, Rattus norvegicus
gttttagctgccataatccatgctg

SEQ ID NO: 534917 - DNA, 25 bp, Rattus norvegicus
gttttagctgccttaatccatgctg

SEQ ID NO: 534918 - DNA, 25 bp, Rattus norvegicus
gttttaggcagaacctctacttggg

SEQ ID NO: 534919 - DNA, 25 bp, Rattus norvegicus
gttttaggcagatcctctacttggg

SEQ ID NO: 534920 - DNA, 25 bp, Rattus norvegicus
gttttaggcattcccaatctcccgt

SEQ ID NO: 534921 - DNA, 25 bp, Rattus norvegicus
gttttaggcattgccaatctcccgt

SEQ ID NO: 534922 - DNA, 25 bp, Rattus norvegicus
gttttaggccctatgcacaccaacg

SEQ ID NO: 534923 - DNA, 25 bp, Rattus norvegicus
gttttaggccctttgcacaccaacg

SEQ ID NO: 534924 - DNA, 25 bp, Rattus norvegicus
gttttagtaactattctgtgcattt

SEQ ID NO: 534925 - DNA, 25 bp, Rattus norvegicus
gttttagtaacttttctgtgcattt

SEQ ID NO: 534926 - DNA, 25 bp, Rattus norvegicus
gttttagtacagctttcttaaattg

SEQ ID NO: 534927 - DNA, 25 bp, Rattus norvegicus
gttttagtacaggtttcttaaattg

SEQ ID NO: 534928 - DNA, 25 bp, Rattus norvegicus
gttttagtcaacattgcttgtccca

SEQ ID NO: 534929 - DNA, 25 bp, Rattus norvegicus
gttttagtcaactttgcttgtccca

SEQ ID NO: 534930 - DNA, 25 bp, Rattus norvegicus
gttttagtgtgtctctcaatggttc

SEQ ID NO: 534931 - DNA, 25 bp, Rattus norvegicus
gttttagtgtgtgtctcaatggttc

SEQ ID NO: 534932 - DNA, 25 bp, Rattus norvegicus
gttttagttcatattctccgtgtcc

SEQ ID NO: 534933 - DNA, 25 bp, Rattus norvegicus
gttttagttcattttctccgtgtcc

SEQ ID NO: 534934 - DNA, 25 bp, Rattus norvegicus
gttttagttcctagcatcatcagat

SEQ ID NO: 534935 - DNA, 25 bp, Rattus norvegicus
gttttagttccttgcatcatcagat

SEQ ID NO: 534936 - DNA, 25 bp, Rattus norvegicus
gttttagttgcaactttccatccta

SEQ ID NO: 534937 - DNA, 25 bp, Rattus norvegicus
gttttagttgcatctttccatccta

SEQ ID NO: 534938 - DNA, 25 bp, Rattus norvegicus
gttttagttgtcattgtgtctccca

SEQ ID NO: 534939 - DNA, 25 bp, Rattus norvegicus
gttttagttgtctttgtgtctccca

SEQ ID NO: 534940 - DNA, 25 bp, Rattus norvegicus
gttttagtttgaatcgcctgtgcag

SEQ ID NO: 534941 - DNA, 25 bp, Rattus norvegicus
gttttagtttgattcgcctgtgcag

SEQ ID NO: 534942 - DNA, 25 bp, Rattus norvegicus
gttttataatccagctacaagtctg

SEQ ID NO: 534943 - DNA, 25 bp, Rattus norvegicus
gttttataatcctgctacaagtctg

SEQ ID NO: 534944 - DNA, 25 bp, Rattus norvegicus
gttttataatcgaatctgtctgaca

SEQ ID NO: 534945 - DNA, 25 bp, Rattus norvegicus
gttttataatcgtatctgtctgaca

SEQ ID NO: 534946 - DNA, 25 bp, Rattus norvegicus
gttttatacccacaaatcaccttgc

SEQ ID NO: 534947 - DNA, 25 bp, Rattus norvegicus
gttttatacccagaaatcaccttgc

SEQ ID NO: 534948 - DNA, 25 bp, Rattus norvegicus
gttttatacctcaagtactgatatt

SEQ ID NO: 534949 - DNA, 25 bp, Rattus norvegicus
gttttatacctctagtactgatatt

SEQ ID NO: 534950 - DNA, 25 bp, Rattus norvegicus
gttttatacgacagcctctgagttg

SEQ ID NO: 534951 - DNA, 25 bp, Rattus norvegicus
gttttatacgactgcctctgagttg

SEQ ID NO: 534952 - DNA, 25 bp, Rattus norvegicus
gttttatacttcatgacagggtcag

SEQ ID NO: 534953 - DNA, 25 bp, Rattus norvegicus
gttttatacttcttgacagggtcag

SEQ ID NO: 534954 - DNA, 25 bp, Rattus norvegicus
gttttatagcccaaaggtcctgcag

SEQ ID NO: 534955 - DNA, 25 bp, Rattus norvegicus
gttttatagccctaaggtcctgcag

SEQ ID NO: 534956 - DNA, 25 bp, Rattus norvegicus
gttttatatataccctgtccacagg

SEQ ID NO: 534957 - DNA, 25 bp, Rattus norvegicus
gttttatatatagcctgtccacagg

SEQ ID NO: 534958 - DNA, 25 bp, Rattus norvegicus
gttttatatcctatcttcagccatt

SEQ ID NO: 534959 - DNA, 25 bp, Rattus norvegicus
gttttatatcctttcttcagccatt

SEQ ID NO: 534960 - DNA, 25 bp, Rattus norvegicus
gttttatattgcctttgctcttgcc

SEQ ID NO: 534961 - DNA, 25 bp, Rattus norvegicus
gttttatattgcgtttgctcttgcc

SEQ ID NO: 534962 - DNA, 25 bp, Rattus norvegicus
gttttatcaacccactttgatcttt

SEQ ID NO: 534963 - DNA, 25 bp, Rattus norvegicus
gttttatcaaccgactttgatcttt

SEQ ID NO: 534964 - DNA, 25 bp, Rattus norvegicus
gttttatcactcacctggattgggc

SEQ ID NO: 534965 - DNA, 25 bp, Rattus norvegicus
gttttatcactctcctggattgggc

SEQ ID NO: 534966 - DNA, 25 bp, Rattus norvegicus
gttttatcactgcaccaccattggt

SEQ ID NO: 534967 - DNA, 25 bp, Rattus norvegicus
gttttatcactggaccaccattggt

SEQ ID NO: 534968 - DNA, 25 bp, Rattus norvegicus
gttttatcagtgctgctcagtcagg

SEQ ID NO: 534969 - DNA, 25 bp, Rattus norvegicus
gttttatcagtggtgctcagtcagg

SEQ ID NO: 534970 - DNA, 25 bp, Rattus norvegicus
gttttatccaccagacacattcttg

SEQ ID NO: 534971 - DNA, 25 bp, Rattus norvegicus
gttttatccacctgacacattcttg

SEQ ID NO: 534972 - DNA, 25 bp, Rattus norvegicus
gttttatctgaacttccagctgtgg

SEQ ID NO: 534973 - DNA, 25 bp, Rattus norvegicus
gttttatctgaagttccagctgtgg

SEQ ID NO: 534974 - DNA, 25 bp, Rattus norvegicus
gttttatctgacatgatcacattgt

SEQ ID NO: 534975 - DNA, 25 bp, Rattus norvegicus
gttttatctgacttgatcacattgt

SEQ ID NO: 534976 - DNA, 25 bp, Rattus norvegicus
gttttatctgcgatttatgtcactc

SEQ ID NO: 534977 - DNA, 25 bp, Rattus norvegicus
gttttatctgcgttttatgtcactc

SEQ ID NO: 534978 - DNA, 25 bp, Rattus norvegicus
gttttatctgtaagcaactgcctac

SEQ ID NO: 534979 - DNA, 25 bp, Rattus norvegicus
gttttatctgtatgcaactgcctac

SEQ ID NO: 534980 - DNA, 25 bp, Rattus norvegicus
gttttatcttgaccacactgtacag

SEQ ID NO: 534981 - DNA, 25 bp, Rattus norvegicus
gttttatcttgagcacactgtacag

SEQ ID NO: 534982 - DNA, 25 bp, Rattus norvegicus
gttttatcttgtaatctcctgttca

SEQ ID NO: 534983 - DNA, 25 bp, Rattus norvegicus
gttttatcttgttatctcctgttca

SEQ ID NO: 534984 - DNA, 25 bp, Rattus norvegicus
gttttatgaacaccagctgcacgat

SEQ ID NO: 534985 - DNA, 25 bp, Rattus norvegicus
gttttatgaacagcagctgcacgat

SEQ ID NO: 534986 - DNA, 25 bp, Rattus norvegicus
gttttatgactgactgcttgtttga

SEQ ID NO: 534987 - DNA, 25 bp, Rattus norvegicus
gttttatgactgtctgcttgtttga

SEQ ID NO: 534988 - DNA, 25 bp, Rattus norvegicus
gttttatgacttacaacctcaggtg

SEQ ID NO: 534989 - DNA, 25 bp, Rattus norvegicus
gttttatgactttcaacctcaggtg

SEQ ID NO: 534990 - DNA, 25 bp, Rattus norvegicus
gttttatgagctccagtcaagcctt

SEQ ID NO: 534991 - DNA, 25 bp, Rattus norvegicus
gttttatgagctgcagtcaagcctt

SEQ ID NO: 534992 - DNA, 25 bp, Rattus norvegicus
gttttatgcacaagccttggcgtga

SEQ ID NO: 534993 - DNA, 25 bp, Rattus norvegicus
gttttatgcacatgccttggcgtga

SEQ ID NO: 534994 - DNA, 25 bp, Rattus norvegicus
gttttatgctctattttactcattg

SEQ ID NO: 534995 - DNA, 25 bp, Rattus norvegicus
gttttatgctcttttttactcattg

SEQ ID NO: 534996 - DNA, 25 bp, Rattus norvegicus
gttttatgctgtcgtagacgtgtca

SEQ ID NO: 534997 - DNA, 25 bp, Rattus norvegicus
gttttatgctgtggtagacgtgtca

SEQ ID NO: 534998 - DNA, 25 bp, Rattus norvegicus
gttttatggctgaccttacacttcc

SEQ ID NO: 534999 - DNA, 25 bp, Rattus norvegicus
gttttatggctgtccttacacttcc

SEQ ID NO: 535000 - DNA, 25 bp, Rattus norvegicus
gttttatgtctgctacttccacacg

SEQ ID NO: 535001 - DNA, 25 bp, Rattus norvegicus
gttttatgtctggtacttccacacg

SEQ ID NO: 535002 - DNA, 25 bp, Rattus norvegicus
gttttatgtttcagtctttctcaca

SEQ ID NO: 535003 - DNA, 25 bp, Rattus norvegicus
gttttatgtttctgtctttctcaca

SEQ ID NO: 535004 - DNA, 25 bp, Rattus norvegicus
gttttattctgtcacaagcctgatg

SEQ ID NO: 535005 - DNA, 25 bp, Rattus norvegicus
gttttattctgtgacaagcctgatg

SEQ ID NO: 535006 - DNA, 25 bp, Rattus norvegicus
gttttattctttcgagtctgacagc

SEQ ID NO: 535007 - DNA, 25 bp, Rattus norvegicus
gttttattctttggagtctgacagc

SEQ ID NO: 535008 - DNA, 25 bp, Rattus norvegicus
gttttattgggcagctgccaaccat

SEQ ID NO: 535009 - DNA, 25 bp, Rattus norvegicus
gttttattgggctgctgccaaccat

SEQ ID NO: 535010 - DNA, 25 bp, Rattus norvegicus
gttttattgtccaagttaagctgtg

SEQ ID NO: 535011 - DNA, 25 bp, Rattus norvegicus
gttttattgtcctagttaagctgtg

SEQ ID NO: 535012 - DNA, 25 bp, Rattus norvegicus
gttttattgttcctgtctgcctttt

SEQ ID NO: 535013 - DNA, 25 bp, Rattus norvegicus
gttttattgttcgtgtctgcctttt

SEQ ID NO: 535014 - DNA, 25 bp, Rattus norvegicus
gttttattgtttcctgcactagcca

SEQ ID NO: 535015 - DNA, 25 bp, Rattus norvegicus
gttttattgtttgctgcactagcca

SEQ ID NO: 535016 - DNA, 25 bp, Rattus norvegicus
gttttatttaagctcctgcgggaca

SEQ ID NO: 535017 - DNA, 25 bp, Rattus norvegicus
gttttatttaaggtcctgcgggaca

SEQ ID NO: 535018 - DNA, 25 bp, Rattus norvegicus
gttttatttctcaaccagtcttaat

SEQ ID NO: 535019 - DNA, 25 bp, Rattus norvegicus
gttttatttctctaccagtcttaat

SEQ ID NO: 535020 - DNA, 25 bp, Rattus norvegicus
gttttatttgttcttcttctgccta

SEQ ID NO: 535021 - DNA, 25 bp, Rattus norvegicus
gttttatttgttgttcttctgccta

SEQ ID NO: 535022 - DNA, 25 bp, Rattus norvegicus
gttttattttgcagtctactctgga

SEQ ID NO: 535023 - DNA, 25 bp, Rattus norvegicus
gttttattttgctgtctactctgga

SEQ ID NO: 535024 - DNA, 25 bp, Rattus norvegicus
gttttatttttcagcagtactagga

SEQ ID NO: 535025 - DNA, 25 bp, Rattus norvegicus
gttttatttttctgcagtactagga

SEQ ID NO: 535026 - DNA, 25 bp, Rattus norvegicus
gttttcaaaactctcctcactggat

SEQ ID NO: 535027 - DNA, 25 bp, Rattus norvegicus
gttttcaaaactgtcctcactggat

SEQ ID NO: 535028 - DNA, 25 bp, Rattus norvegicus
gttttcaaacaccatcaaccacagg

SEQ ID NO: 535029 - DNA, 25 bp, Rattus norvegicus
gttttcaaacacgatcaaccacagg

SEQ ID NO: 535030 - DNA, 25 bp, Rattus norvegicus
gttttcaaacctcctctgagagatt

SEQ ID NO: 535031 - DNA, 25 bp, Rattus norvegicus
gttttcaaacctgctctgagagatt

SEQ ID NO: 535032 - DNA, 25 bp, Rattus norvegicus
gttttcaacatacccaatgtgcctg

SEQ ID NO: 535033 - DNA, 25 bp, Rattus norvegicus
gttttcaacatagccaatgtgcctg

SEQ ID NO: 535034 - DNA, 25 bp, Rattus norvegicus
gttttcaaccaaaccatcaactagt

SEQ ID NO: 535035 - DNA, 25 bp, Rattus norvegicus
gttttcaaccaatccatcaactagt

SEQ ID NO: 535036 - DNA, 25 bp, Rattus norvegicus
gttttcaacgtgaggcactgtcttt

SEQ ID NO: 535037 - DNA, 25 bp, Rattus norvegicus
gttttcaacgtgtggcactgtcttt

SEQ ID NO: 535038 - DNA, 25 bp, Rattus norvegicus
gttttcaagacaattatcctgctca

SEQ ID NO: 535039 - DNA, 25 bp, Rattus norvegicus
gttttcaagacatttatcctgctca

SEQ ID NO: 535040 - DNA, 25 bp, Rattus norvegicus
gttttcaaggataccatggtcccag

SEQ ID NO: 535041 - DNA, 25 bp, Rattus norvegicus
gttttcaaggatcgaactccgccct

SEQ ID NO: 535042 - DNA, 25 bp, Rattus norvegicus
gttttcaaggatcgattgctttctc

SEQ ID NO: 535043 - DNA, 25 bp, Rattus norvegicus
gttttcaaggatggaactccgccct

SEQ ID NO: 535044 - DNA, 25 bp, Rattus norvegicus
gttttcaaggatggattgctttctc

SEQ ID NO: 535045 - DNA, 25 bp, Rattus norvegicus
gttttcaaggattccatggtcccag

SEQ ID NO: 535046 - DNA, 25 bp, Rattus norvegicus
gttttcaatggaatctaaccagcac

SEQ ID NO: 535047 - DNA, 25 bp, Rattus norvegicus
gttttcaatggattctaaccagcac

SEQ ID NO: 535048 - DNA, 25 bp, Rattus norvegicus
gttttcaattctctctagatgcgaa

SEQ ID NO: 535049 - DNA, 25 bp, Rattus norvegicus
gttttcaattctgtctagatgcgaa

SEQ ID NO: 535050 - DNA, 25 bp, Rattus norvegicus
gttttcacaaaacagcccattaatt

SEQ ID NO: 535051 - DNA, 25 bp, Rattus norvegicus
gttttcacaaaagagcccattaatt

SEQ ID NO: 535052 - DNA, 25 bp, Rattus norvegicus
gttttcacaagcaggccatggaatt

SEQ ID NO: 535053 - DNA, 25 bp, Rattus norvegicus
gttttcacaagctggccatggaatt

SEQ ID NO: 535054 - DNA, 25 bp, Rattus norvegicus
gttttcacactgcagttgggaacta

SEQ ID NO: 535055 - DNA, 25 bp, Rattus norvegicus
gttttcacactggagttgggaacta

SEQ ID NO: 535056 - DNA, 25 bp, Rattus norvegicus
gttttcacaggccttcagtggacca

SEQ ID NO: 535057 - DNA, 25 bp, Rattus norvegicus
gttttcacaggcgttcagtggacca

SEQ ID NO: 535058 - DNA, 25 bp, Rattus norvegicus
gttttcaccataatcctagtaccta

SEQ ID NO: 535059 - DNA, 25 bp, Rattus norvegicus
gttttcaccatattcctagtaccta

SEQ ID NO: 535060 - DNA, 25 bp, Rattus norvegicus
gttttcaccattacttttcctgaca

SEQ ID NO: 535061 - DNA, 25 bp, Rattus norvegicus
gttttcaccatttcttttcctgaca

SEQ ID NO: 535062 - DNA, 25 bp, Rattus norvegicus
gttttcacctcaagactaacctgta

SEQ ID NO: 535063 - DNA, 25 bp, Rattus norvegicus
gttttcacctcatgactaacctgta

SEQ ID NO: 535064 - DNA, 25 bp, Rattus norvegicus
gttttcacgatcactgcactagttg

SEQ ID NO: 535065 - DNA, 25 bp, Rattus norvegicus
gttttcacgatctctgcactagttg

SEQ ID NO: 535066 - DNA, 25 bp, Rattus norvegicus
gttttcactcaaagggacatttcaa

SEQ ID NO: 535067 - DNA, 25 bp, Rattus norvegicus
gttttcactcaatgggacatttcaa

SEQ ID NO: 535068 - DNA, 25 bp, Rattus norvegicus
gttttcactctgaaacttttccatg

SEQ ID NO: 535069 - DNA, 25 bp, Rattus norvegicus
gttttcactctgtaacttttccatg

SEQ ID NO: 535070 - DNA, 25 bp, Rattus norvegicus
gttttcactggaatttatctctctc

SEQ ID NO: 535071 - DNA, 25 bp, Rattus norvegicus
gttttcactggattttatctctctc

SEQ ID NO: 535072 - DNA, 25 bp, Rattus norvegicus
gttttcactgtccattgctttgtgt

SEQ ID NO: 535073 - DNA, 25 bp, Rattus norvegicus
gttttcactgtcgattgctttgtgt

SEQ ID NO: 535074 - DNA, 25 bp, Rattus norvegicus
gttttcacttagatactggactgca

SEQ ID NO: 535075 - DNA, 25 bp, Rattus norvegicus
gttttcacttagttactggactgca

SEQ ID NO: 535076 - DNA, 25 bp, Rattus norvegicus
gttttcacttgacactgagtaatcg

SEQ ID NO: 535077 - DNA, 25 bp, Rattus norvegicus
gttttcacttgagactgagtaatcg

SEQ ID NO: 535078 - DNA, 25 bp, Rattus norvegicus
gttttcacttggcataattggaaat

SEQ ID NO: 535079 - DNA, 25 bp, Rattus norvegicus
gttttcacttgggataattggaaat

SEQ ID NO: 535080 - DNA, 25 bp, Rattus norvegicus
gttttcactttgactttacctaatg

SEQ ID NO: 535081 - DNA, 25 bp, Rattus norvegicus
gttttcactttgtctttacctaatg

SEQ ID NO: 535082 - DNA, 25 bp, Rattus norvegicus
gttttcacttttcatttctgggtct

SEQ ID NO: 535083 - DNA, 25 bp, Rattus norvegicus
gttttcacttttgatttctgggtct

SEQ ID NO: 535084 - DNA, 25 bp, Rattus norvegicus
gttttcagagcaccaaggaacattg

SEQ ID NO: 535085 - DNA, 25 bp, Rattus norvegicus
gttttcagagcagcaaggaacattg

SEQ ID NO: 535086 - DNA, 25 bp, Rattus norvegicus
gttttcagaggaatggccaccgctc

SEQ ID NO: 535087 - DNA, 25 bp, Rattus norvegicus
gttttcagaggattggccaccgctc

SEQ ID NO: 535088 - DNA, 25 bp, Rattus norvegicus
gttttcagatgacaaccttacattt

SEQ ID NO: 535089 - DNA, 25 bp, Rattus norvegicus
gttttcagatgagaaccttacattt

SEQ ID NO: 535090 - DNA, 25 bp, Rattus norvegicus
gttttcagatttacacgtgacccag

SEQ ID NO: 535091 - DNA, 25 bp, Rattus norvegicus
gttttcagattttcacgtgacccag

SEQ ID NO: 535092 - DNA, 25 bp, Rattus norvegicus
gttttcagcatgaccttgtcctttc

SEQ ID NO: 535093 - DNA, 25 bp, Rattus norvegicus
gttttcagcatgtccttgtcctttc

SEQ ID NO: 535094 - DNA, 25 bp, Rattus norvegicus
gttttcagccccaacaactgtgaga

SEQ ID NO: 535095 - DNA, 25 bp, Rattus norvegicus
gttttcagcccctacaactgtgaga

SEQ ID NO: 535096 - DNA, 25 bp, Rattus norvegicus
gttttcagctcaaccaatggacttc

SEQ ID NO: 535097 - DNA, 25 bp, Rattus norvegicus
gttttcagctcatccaatggacttc

SEQ ID NO: 535098 - DNA, 25 bp, Rattus norvegicus
gttttcagctctattgactgggata

SEQ ID NO: 535099 - DNA, 25 bp, Rattus norvegicus
gttttcagctcttttgactgggata

SEQ ID NO: 535100 - DNA, 25 bp, Rattus norvegicus
gttttcagcttgacatctaagacag

SEQ ID NO: 535101 - DNA, 25 bp, Rattus norvegicus
gttttcagcttgtcatctaagacag

SEQ ID NO: 535102 - DNA, 25 bp, Rattus norvegicus
gttttcaggataattgccactcata

SEQ ID NO: 535103 - DNA, 25 bp, Rattus norvegicus
gttttcaggatatttgccactcata

SEQ ID NO: 535104 - DNA, 25 bp, Rattus norvegicus
gttttcaggcatctctctgtattcc

SEQ ID NO: 535105 - DNA, 25 bp, Rattus norvegicus
gttttcaggcatgtctctgtattcc

SEQ ID NO: 535106 - DNA, 25 bp, Rattus norvegicus
gttttcaggctgaggtagcacgtgt

SEQ ID NO: 535107 - DNA, 25 bp, Rattus norvegicus
gttttcaggctgtggtagcacgtgt

SEQ ID NO: 535108 - DNA, 25 bp, Rattus norvegicus
gttttcagggatcgctgtttgctgt

SEQ ID NO: 535109 - DNA, 25 bp, Rattus norvegicus
gttttcagggatggctgtttgctgt

SEQ ID NO: 535110 - DNA, 25 bp, Rattus norvegicus
gttttcagggcacttcttcaaatca

SEQ ID NO: 535111 - DNA, 25 bp, Rattus norvegicus
gttttcagggcagttcttcaaatca

SEQ ID NO: 535112 - DNA, 25 bp, Rattus norvegicus
gttttcagggttacaggaggcagct

SEQ ID NO: 535113 - DNA, 25 bp, Rattus norvegicus
gttttcagggttcctagtttgtgag

SEQ ID NO: 535114 - DNA, 25 bp, Rattus norvegicus
gttttcagggttgctagtttgtgag

SEQ ID NO: 535115 - DNA, 25 bp, Rattus norvegicus
gttttcagggtttcaggaggcagct

SEQ ID NO: 535116 - DNA, 25 bp, Rattus norvegicus
gttttcaggtctattctacttcaga

SEQ ID NO: 535117 - DNA, 25 bp, Rattus norvegicus
gttttcaggtcttttctacttcaga

SEQ ID NO: 535118 - DNA, 25 bp, Rattus norvegicus
gttttcagtcctaaagtgccatgca

SEQ ID NO: 535119 - DNA, 25 bp, Rattus norvegicus
gttttcagtccttaagtgccatgca

SEQ ID NO: 535120 - DNA, 25 bp, Rattus norvegicus
gttttcagtgctacatgtgtgtaca

SEQ ID NO: 535121 - DNA, 25 bp, Rattus norvegicus
gttttcagtgcttcatgtgtgtaca

SEQ ID NO: 535122 - DNA, 25 bp, Rattus norvegicus
gttttcagtggtcttatgcatagca

SEQ ID NO: 535123 - DNA, 25 bp, Rattus norvegicus
gttttcagtggtgttatgcatagca

SEQ ID NO: 535124 - DNA, 25 bp, Rattus norvegicus
gttttcataggcctaagcatcgggt

SEQ ID NO: 535125 - DNA, 25 bp, Rattus norvegicus
gttttcataggcgtaagcatcgggt

SEQ ID NO: 535126 - DNA, 25 bp, Rattus norvegicus
gttttcatagttagacccaccatat

SEQ ID NO: 535127 - DNA, 25 bp, Rattus norvegicus
gttttcatagtttgacccaccatat

SEQ ID NO: 535128 - DNA, 25 bp, Rattus norvegicus
gttttcatcggcagtcaccagtgct

SEQ ID NO: 535129 - DNA, 25 bp, Rattus norvegicus
gttttcatcggctgtcaccagtgct

SEQ ID NO: 535130 - DNA, 25 bp, Rattus norvegicus
gttttcatctctagactaagctcct

SEQ ID NO: 535131 - DNA, 25 bp, Rattus norvegicus
gttttcatctcttgactaagctcct

SEQ ID NO: 535132 - DNA, 25 bp, Rattus norvegicus
gttttcatgaatcacagcttcttct

SEQ ID NO: 535133 - DNA, 25 bp, Rattus norvegicus
gttttcatgaatgacagcttcttct

SEQ ID NO: 535134 - DNA, 25 bp, Rattus norvegicus
gttttcattctgctgcttttattac

SEQ ID NO: 535135 - DNA, 25 bp, Rattus norvegicus
gttttcattctggtgcttttattac

SEQ ID NO: 535136 - DNA, 25 bp, Rattus norvegicus
gttttcattgctctggaccacttaa

SEQ ID NO: 535137 - DNA, 25 bp, Rattus norvegicus
gttttcattgctgtggaccacttaa

SEQ ID NO: 535138 - DNA, 25 bp, Rattus norvegicus
gttttcattgtcacaccataaggcc

SEQ ID NO: 535139 - DNA, 25 bp, Rattus norvegicus
gttttcattgtctcaccataaggcc

SEQ ID NO: 535140 - DNA, 25 bp, Rattus norvegicus
gttttcatttcaactgactcttaga

SEQ ID NO: 535141 - DNA, 25 bp, Rattus norvegicus
gttttcatttcatctgactcttaga

SEQ ID NO: 535142 - DNA, 25 bp, Rattus norvegicus
gttttcatttggatcttagtctttg

SEQ ID NO: 535143 - DNA, 25 bp, Rattus norvegicus
gttttcatttggttcttagtctttg

SEQ ID NO: 535144 - DNA, 25 bp, Rattus norvegicus
gttttccaagtaaaagcctgcaccc

SEQ ID NO: 535145 - DNA, 25 bp, Rattus norvegicus
gttttccaagtataagcctgcaccc

SEQ ID NO: 535146 - DNA, 25 bp, Rattus norvegicus
gttttccaatataagacagttctat

SEQ ID NO: 535147 - DNA, 25 bp, Rattus norvegicus
gttttccaatatagacctgacactg

SEQ ID NO: 535148 - DNA, 25 bp, Rattus norvegicus
gttttccaatattagacagttctat

SEQ ID NO: 535149 - DNA, 25 bp, Rattus norvegicus
gttttccaatattgacctgacactg

SEQ ID NO: 535150 - DNA, 25 bp, Rattus norvegicus
gttttccacaacaattgctgtcagg

SEQ ID NO: 535151 - DNA, 25 bp, Rattus norvegicus
gttttccacaactattgctgtcagg

SEQ ID NO: 535152 - DNA, 25 bp, Rattus norvegicus
gttttccacacaccactttatttat

SEQ ID NO: 535153 - DNA, 25 bp, Rattus norvegicus
gttttccacacagcactttatttat

SEQ ID NO: 535154 - DNA, 25 bp, Rattus norvegicus
gttttccacgtgacagtttcctaat

SEQ ID NO: 535155 - DNA, 25 bp, Rattus norvegicus
gttttccacgtgtcagtttcctaat

SEQ ID NO: 535156 - DNA, 25 bp, Rattus norvegicus
gttttccactccaactctagtgtga

SEQ ID NO: 535157 - DNA, 25 bp, Rattus norvegicus
gttttccactcctactctagtgtga

SEQ ID NO: 535158 - DNA, 25 bp, Rattus norvegicus
gttttccactgaagtctaaaagcct

SEQ ID NO: 535159 - DNA, 25 bp, Rattus norvegicus
gttttccactgatgtctaaaagcct

SEQ ID NO: 535160 - DNA, 25 bp, Rattus norvegicus
gttttccagatgacctaggacccgt

SEQ ID NO: 535161 - DNA, 25 bp, Rattus norvegicus
gttttccagatgtcctaggacccgt

SEQ ID NO: 535162 - DNA, 25 bp, Rattus norvegicus
gttttccagtacacggcagggccct

SEQ ID NO: 535163 - DNA, 25 bp, Rattus norvegicus
gttttccagtactcggcagggccct

SEQ ID NO: 535164 - DNA, 25 bp, Rattus norvegicus
gttttccagttgctctttatcttga

SEQ ID NO: 535165 - DNA, 25 bp, Rattus norvegicus
gttttccagttggtctttatcttga

SEQ ID NO: 535166 - DNA, 25 bp, Rattus norvegicus
gttttccagtttagaggctgctcct

SEQ ID NO: 535167 - DNA, 25 bp, Rattus norvegicus
gttttccagtttcttaatgccaaat

SEQ ID NO: 535168 - DNA, 25 bp, Rattus norvegicus
gttttccagtttgttaatgccaaat

SEQ ID NO: 535169 - DNA, 25 bp, Rattus norvegicus
gttttccagttttgaggctgctcct

SEQ ID NO: 535170 - DNA, 25 bp, Rattus norvegicus
gttttccataatagttagtccccat

SEQ ID NO: 535171 - DNA, 25 bp, Rattus norvegicus
gttttccataattgttagtccccat

SEQ ID NO: 535172 - DNA, 25 bp, Rattus norvegicus
gttttccataccacctcagagataa

SEQ ID NO: 535173 - DNA, 25 bp, Rattus norvegicus
gttttccatacctcctcagagataa

SEQ ID NO: 535174 - DNA, 25 bp, Rattus norvegicus
gttttccatctcagtattcccataa

SEQ ID NO: 535175 - DNA, 25 bp, Rattus norvegicus
gttttccatctctgtattcccataa

SEQ ID NO: 535176 - DNA, 25 bp, Rattus norvegicus
gttttccattgtccccagcagtagc

SEQ ID NO: 535177 - DNA, 25 bp, Rattus norvegicus
gttttccattgtgcccagcagtagc

SEQ ID NO: 535178 - DNA, 25 bp, Rattus norvegicus
gttttcccactaacatgacagcagc

SEQ ID NO: 535179 - DNA, 25 bp, Rattus norvegicus
gttttcccactatcatgacagcagc

SEQ ID NO: 535180 - DNA, 25 bp, Rattus norvegicus
gttttcccacttctgcttgtttgtt

SEQ ID NO: 535181 - DNA, 25 bp, Rattus norvegicus
gttttcccacttgtgcttgtttgtt

SEQ ID NO: 535182 - DNA, 25 bp, Rattus norvegicus
gttttcccagttccctagcctggaa

SEQ ID NO: 535183 - DNA, 25 bp, Rattus norvegicus
gttttcccagttccgagacatagtg

SEQ ID NO: 535184 - DNA, 25 bp, Rattus norvegicus
gttttcccagttgcctagcctggaa

SEQ ID NO: 535185 - DNA, 25 bp, Rattus norvegicus
gttttcccagttgcgagacatagtg

SEQ ID NO: 535186 - DNA, 25 bp, Rattus norvegicus
gttttcccatgtctatcttcagata

SEQ ID NO: 535187 - DNA, 25 bp, Rattus norvegicus
gttttcccatgtgtatcttcagata

SEQ ID NO: 535188 - DNA, 25 bp, Rattus norvegicus
gttttccccatcaacccttatggtg

SEQ ID NO: 535189 - DNA, 25 bp, Rattus norvegicus
gttttccccatctacccttatggtg

SEQ ID NO: 535190 - DNA, 25 bp, Rattus norvegicus
gttttccctactctcaatggacaga

SEQ ID NO: 535191 - DNA, 25 bp, Rattus norvegicus
gttttccctactgtcaatggacaga

SEQ ID NO: 535192 - DNA, 25 bp, Rattus norvegicus
gttttccctctcacgtgggcaataa

SEQ ID NO: 535193 - DNA, 25 bp, Rattus norvegicus
gttttccctctctcgtgggcaataa

SEQ ID NO: 535194 - DNA, 25 bp, Rattus norvegicus
gttttccctgctaccaaatctgtag

SEQ ID NO: 535195 - DNA, 25 bp, Rattus norvegicus
gttttccctgcttccaaatctgtag

SEQ ID NO: 535196 - DNA, 25 bp, Rattus norvegicus
gttttccctgtccttatgatcactc

SEQ ID NO: 535197 - DNA, 25 bp, Rattus norvegicus
gttttccctgtcgttatgatcactc

SEQ ID NO: 535198 - DNA, 25 bp, Rattus norvegicus
gttttcccttcaaatggttgtctgg

SEQ ID NO: 535199 - DNA, 25 bp, Rattus norvegicus
gttttcccttcatatggttgtctgg

SEQ ID NO: 535200 - DNA, 25 bp, Rattus norvegicus
gttttcccttgactgtctttgagac

SEQ ID NO: 535201 - DNA, 25 bp, Rattus norvegicus
gttttcccttgagtgtctttgagac

SEQ ID NO: 535202 - DNA, 25 bp, Rattus norvegicus
gttttccggcagatttgattcgtat

SEQ ID NO: 535203 - DNA, 25 bp, Rattus norvegicus
gttttccggcagttttgattcgtat

SEQ ID NO: 535204 - DNA, 25 bp, Rattus norvegicus
gttttccggtacattgtagctgagc

SEQ ID NO: 535205 - DNA, 25 bp, Rattus norvegicus
gttttccggtactttgtagctgagc

SEQ ID NO: 535206 - DNA, 25 bp, Rattus norvegicus
gttttcctaagacagctcaacttta

SEQ ID NO: 535207 - DNA, 25 bp, Rattus norvegicus
gttttcctaagagagctcaacttta

SEQ ID NO: 535208 - DNA, 25 bp, Rattus norvegicus
gttttcctagctatccgacttcttt

SEQ ID NO: 535209 - DNA, 25 bp, Rattus norvegicus
gttttcctagctttccgacttcttt

SEQ ID NO: 535210 - DNA, 25 bp, Rattus norvegicus
gttttcctatttctctcaggagcaa

SEQ ID NO: 535211 - DNA, 25 bp, Rattus norvegicus
gttttcctatttgtctcaggagcaa

SEQ ID NO: 535212 - DNA, 25 bp, Rattus norvegicus
gttttcctcaccatggagactcctg

SEQ ID NO: 535213 - DNA, 25 bp, Rattus norvegicus
gttttcctcaccttggagactcctg

SEQ ID NO: 535214 - DNA, 25 bp, Rattus norvegicus
gttttcctcagaattggtctctcag

SEQ ID NO: 535215 - DNA, 25 bp, Rattus norvegicus
gttttcctcagatttggtctctcag

SEQ ID NO: 535216 - DNA, 25 bp, Rattus norvegicus
gttttcctcagtctctcgttgaaag

SEQ ID NO: 535217 - DNA, 25 bp, Rattus norvegicus
gttttcctcagtgtctcgttgaaag

SEQ ID NO: 535218 - DNA, 25 bp, Rattus norvegicus
gttttcctccaacactttcatggat

SEQ ID NO: 535219 - DNA, 25 bp, Rattus norvegicus
gttttcctccaagactttcatggat

SEQ ID NO: 535220 - DNA, 25 bp, Rattus norvegicus
gttttcctcccacaagagctgagat

SEQ ID NO: 535221 - DNA, 25 bp, Rattus norvegicus
gttttcctcccagaagagctgagat

SEQ ID NO: 535222 - DNA, 25 bp, Rattus norvegicus
gttttcctcctgacggactaaatgt

SEQ ID NO: 535223 - DNA, 25 bp, Rattus norvegicus
gttttcctcctgtcggactaaatgt

SEQ ID NO: 535224 - DNA, 25 bp, Rattus norvegicus
gttttcctcgcaaagatactctcta

SEQ ID NO: 535225 - DNA, 25 bp, Rattus norvegicus
gttttcctcgcatagatactctcta

SEQ ID NO: 535226 - DNA, 25 bp, Rattus norvegicus
gttttcctcttgcttttttcatgta

SEQ ID NO: 535227 - DNA, 25 bp, Rattus norvegicus
gttttcctcttggttttttcatgta

SEQ ID NO: 535228 - DNA, 25 bp, Rattus norvegicus
gttttcctgaggacattatccatga

SEQ ID NO: 535229 - DNA, 25 bp, Rattus norvegicus
gttttcctgaggtcattatccatga

SEQ ID NO: 535230 - DNA, 25 bp, Rattus norvegicus
gttttcctgcatcttctttggagca

SEQ ID NO: 535231 - DNA, 25 bp, Rattus norvegicus
gttttcctgcatgttctttggagca

SEQ ID NO: 535232 - DNA, 25 bp, Rattus norvegicus
gttttcctgtaactccaggacctag

SEQ ID NO: 535233 - DNA, 25 bp, Rattus norvegicus
gttttcctgtaagtccaggacctag

SEQ ID NO: 535234 - DNA, 25 bp, Rattus norvegicus
gttttcctgtttccactatttcttt

SEQ ID NO: 535235 - DNA, 25 bp, Rattus norvegicus
gttttcctgtttgcactatttcttt

SEQ ID NO: 535236 - DNA, 25 bp, Rattus norvegicus
gttttccttaggcattcagccgata

SEQ ID NO: 535237 - DNA, 25 bp, Rattus norvegicus
gttttccttagggattcagccgata

SEQ ID NO: 535238 - DNA, 25 bp, Rattus norvegicus
gttttccttcacagtaggctggaat

SEQ ID NO: 535239 - DNA, 25 bp, Rattus norvegicus
gttttccttcactgtaggctggaat

SEQ ID NO: 535240 - DNA, 25 bp, Rattus norvegicus
gttttccttctcaagattagccata

SEQ ID NO: 535241 - DNA, 25 bp, Rattus norvegicus
gttttccttctcacatggactaagg

SEQ ID NO: 535242 - DNA, 25 bp, Rattus norvegicus
gttttccttctctagattagccata

SEQ ID NO: 535243 - DNA, 25 bp, Rattus norvegicus
gttttccttctctcatggactaagg

SEQ ID NO: 535244 - DNA, 25 bp, Rattus norvegicus
gttttccttgagatacctgtcttta

SEQ ID NO: 535245 - DNA, 25 bp, Rattus norvegicus
gttttccttgagttacctgtcttta

SEQ ID NO: 535246 - DNA, 25 bp, Rattus norvegicus
gttttccttgtgatcagagtgactt

SEQ ID NO: 535247 - DNA, 25 bp, Rattus norvegicus
gttttccttgtgttcagagtgactt

SEQ ID NO: 535248 - DNA, 25 bp, Rattus norvegicus
gttttcctttacatagacagagagc

SEQ ID NO: 535249 - DNA, 25 bp, Rattus norvegicus
gttttcctttacatttgctgatgtt

SEQ ID NO: 535250 - DNA, 25 bp, Rattus norvegicus
gttttcctttacttagacagagagc

SEQ ID NO: 535251 - DNA, 25 bp, Rattus norvegicus
gttttcctttacttttgctgatgtt

SEQ ID NO: 535252 - DNA, 25 bp, Rattus norvegicus
gttttcctttgaacggtagcatttt

SEQ ID NO: 535253 - DNA, 25 bp, Rattus norvegicus
gttttcctttgatcggtagcatttt

SEQ ID NO: 535254 - DNA, 25 bp, Rattus norvegicus
gttttcctttggacagactcactgt

SEQ ID NO: 535255 - DNA, 25 bp, Rattus norvegicus
gttttcctttggtcagactcactgt

SEQ ID NO: 535256 - DNA, 25 bp, Rattus norvegicus
gttttcctttgtattcacttccatt

SEQ ID NO: 535257 - DNA, 25 bp, Rattus norvegicus
gttttcctttgttttcacttccatt

SEQ ID NO: 535258 - DNA, 25 bp, Rattus norvegicus
gttttccttttcaataacactctga

SEQ ID NO: 535259 - DNA, 25 bp, Rattus norvegicus
gttttccttttcaggtgccgtagag

SEQ ID NO: 535260 - DNA, 25 bp, Rattus norvegicus
gttttccttttctataacactctga

SEQ ID NO: 535261 - DNA, 25 bp, Rattus norvegicus
gttttccttttctggtgccgtagag

SEQ ID NO: 535262 - DNA, 25 bp, Rattus norvegicus
gttttccttttgctatatgttgtct

SEQ ID NO: 535263 - DNA, 25 bp, Rattus norvegicus
gttttccttttggtatatgttgtct

SEQ ID NO: 535264 - DNA, 25 bp, Rattus norvegicus
gttttcgaaatgcacttctaggctt

SEQ ID NO: 535265 - DNA, 25 bp, Rattus norvegicus
gttttcgaaatggacttctaggctt

SEQ ID NO: 535266 - DNA, 25 bp, Rattus norvegicus
gttttcgaaggaatatctacataat

SEQ ID NO: 535267 - DNA, 25 bp, Rattus norvegicus
gttttcgaaggattatctacataat

SEQ ID NO: 535268 - DNA, 25 bp, Rattus norvegicus
gttttcgagcaacttctgaagcaac

SEQ ID NO: 535269 - DNA, 25 bp, Rattus norvegicus
gttttcgagcaagttctgaagcaac

SEQ ID NO: 535270 - DNA, 25 bp, Rattus norvegicus
gttttcgattttaggcgttcagtag

SEQ ID NO: 535271 - DNA, 25 bp, Rattus norvegicus
gttttcgatttttggcgttcagtag

SEQ ID NO: 535272 - DNA, 25 bp, Rattus norvegicus
gttttcggaatgctgggaccacaca

SEQ ID NO: 535273 - DNA, 25 bp, Rattus norvegicus
gttttcggaatggtgggaccacaca

SEQ ID NO: 535274 - DNA, 25 bp, Rattus norvegicus
gttttcggactaatttactggctat

SEQ ID NO: 535275 - DNA, 25 bp, Rattus norvegicus
gttttcggactattttactggctat

SEQ ID NO: 535276 - DNA, 25 bp, Rattus norvegicus
gttttcggttttctctgacctgtga

SEQ ID NO: 535277 - DNA, 25 bp, Rattus norvegicus
gttttcggttttgtctgacctgtga

SEQ ID NO: 535278 - DNA, 25 bp, Rattus norvegicus
gttttcgtcattagccagcctaaag

SEQ ID NO: 535279 - DNA, 25 bp, Rattus norvegicus
gttttcgtcatttgccagcctaaag

SEQ ID NO: 535280 - DNA, 25 bp, Rattus norvegicus
gttttcgtctggaactagttcatca

SEQ ID NO: 535281 - DNA, 25 bp, Rattus norvegicus
gttttcgtctggtactagttcatca

SEQ ID NO: 535282 - DNA, 25 bp, Rattus norvegicus
gttttcgttttgaatgccacatcct

SEQ ID NO: 535283 - DNA, 25 bp, Rattus norvegicus
gttttcgttttgtatgccacatcct

SEQ ID NO: 535284 - DNA, 25 bp, Rattus norvegicus
gttttctaaactaacctctgagtat

SEQ ID NO: 535285 - DNA, 25 bp, Rattus norvegicus
gttttctaaacttacctctgagtat

SEQ ID NO: 535286 - DNA, 25 bp, Rattus norvegicus
gttttctaacagcagcgacctaggt

SEQ ID NO: 535287 - DNA, 25 bp, Rattus norvegicus
gttttctaacaggagcgacctaggt

SEQ ID NO: 535288 - DNA, 25 bp, Rattus norvegicus
gttttctacagtaactttgcgattt

SEQ ID NO: 535289 - DNA, 25 bp, Rattus norvegicus
gttttctacagttactttgcgattt

SEQ ID NO: 535290 - DNA, 25 bp, Rattus norvegicus
gttttctaccatatgatgtctgtga

SEQ ID NO: 535291 - DNA, 25 bp, Rattus norvegicus
gttttctaccatttgatgtctgtga

SEQ ID NO: 535292 - DNA, 25 bp, Rattus norvegicus
gttttctactgcatcttcaatggag

SEQ ID NO: 535293 - DNA, 25 bp, Rattus norvegicus
gttttctactgcttcttcaatggag

SEQ ID NO: 535294 - DNA, 25 bp, Rattus norvegicus
gttttctaggaaactcgtaaggcat

SEQ ID NO: 535295 - DNA, 25 bp, Rattus norvegicus
gttttctaggaatctcgtaaggcat

SEQ ID NO: 535296 - DNA, 25 bp, Rattus norvegicus
gttttctagtgcatgtttcctactg

SEQ ID NO: 535297 - DNA, 25 bp, Rattus norvegicus
gttttctagtgcttgtttcctactg

SEQ ID NO: 535298 - DNA, 25 bp, Rattus norvegicus
gttttctatcttagttcttttccat

SEQ ID NO: 535299 - DNA, 25 bp, Rattus norvegicus
gttttctatctttgttcttttccat

SEQ ID NO: 535300 - DNA, 25 bp, Rattus norvegicus
gttttctatgcacctcgtctgagaa

SEQ ID NO: 535301 - DNA, 25 bp, Rattus norvegicus
gttttctatgcagctcgtctgagaa

SEQ ID NO: 535302 - DNA, 25 bp, Rattus norvegicus
gttttctatggtcctctactgccaa

SEQ ID NO: 535303 - DNA, 25 bp, Rattus norvegicus
gttttctatggtgctctactgccaa

SEQ ID NO: 535304 - DNA, 25 bp, Rattus norvegicus
gttttctatttgactttatttcagg

SEQ ID NO: 535305 - DNA, 25 bp, Rattus norvegicus
gttttctatttgtctttatttcagg

SEQ ID NO: 535306 - DNA, 25 bp, Rattus norvegicus
gttttctcaatgatctcctgcagga

SEQ ID NO: 535307 - DNA, 25 bp, Rattus norvegicus
gttttctcaatgttctcctgcagga

SEQ ID NO: 535308 - DNA, 25 bp, Rattus norvegicus
gttttctcactgcaacagtatcctc

SEQ ID NO: 535309 - DNA, 25 bp, Rattus norvegicus
gttttctcactggaacagtatcctc

SEQ ID NO: 535310 - DNA, 25 bp, Rattus norvegicus
gttttctcagctcaaggtcctacat

SEQ ID NO: 535311 - DNA, 25 bp, Rattus norvegicus
gttttctcagctgaaggtcctacat

SEQ ID NO: 535312 - DNA, 25 bp, Rattus norvegicus
gttttctcattcaaacagagtcctt

SEQ ID NO: 535313 - DNA, 25 bp, Rattus norvegicus
gttttctcattctaacagagtcctt

SEQ ID NO: 535314 - DNA, 25 bp, Rattus norvegicus
gttttctccaaactacgagcagtgt

SEQ ID NO: 535315 - DNA, 25 bp, Rattus norvegicus
gttttctccaaagtacgagcagtgt

SEQ ID NO: 535316 - DNA, 25 bp, Rattus norvegicus
gttttctccccgcttttggatgaag

SEQ ID NO: 535317 - DNA, 25 bp, Rattus norvegicus
gttttctccccggttttggatgaag

SEQ ID NO: 535318 - DNA, 25 bp, Rattus norvegicus
gttttctccgtcaaagacctatgga

SEQ ID NO: 535319 - DNA, 25 bp, Rattus norvegicus
gttttctccgtctaagacctatgga

SEQ ID NO: 535320 - DNA, 25 bp, Rattus norvegicus
gttttctccttacattcaccttaga

SEQ ID NO: 535321 - DNA, 25 bp, Rattus norvegicus
gttttctccttagattcaccttaga

SEQ ID NO: 535322 - DNA, 25 bp, Rattus norvegicus
gttttctctacacatgacagcccag

SEQ ID NO: 535323 - DNA, 25 bp, Rattus norvegicus
gttttctctacagatgacagcccag

SEQ ID NO: 535324 - DNA, 25 bp, Rattus norvegicus
gttttctctgatctctatacgccat

SEQ ID NO: 535325 - DNA, 25 bp, Rattus norvegicus
gttttctctgatgtctatacgccat

SEQ ID NO: 535326 - DNA, 25 bp, Rattus norvegicus
gttttctctgcaagtccctaagaat

SEQ ID NO: 535327 - DNA, 25 bp, Rattus norvegicus
gttttctctgcatgtccctaagaat

SEQ ID NO: 535328 - DNA, 25 bp, Rattus norvegicus
gttttctctggtcttagcctttgag

SEQ ID NO: 535329 - DNA, 25 bp, Rattus norvegicus
gttttctctggtgttagcctttgag

SEQ ID NO: 535330 - DNA, 25 bp, Rattus norvegicus
gttttctcttcaacaggaacttgta

SEQ ID NO: 535331 - DNA, 25 bp, Rattus norvegicus
gttttctcttcatcaggaacttgta

SEQ ID NO: 535332 - DNA, 25 bp, Rattus norvegicus
gttttctcttctctggtaataaatg

SEQ ID NO: 535333 - DNA, 25 bp, Rattus norvegicus
gttttctcttctgtggtaataaatg

SEQ ID NO: 535334 - DNA, 25 bp, Rattus norvegicus
gttttctctttaacttgtctcttca

SEQ ID NO: 535335 - DNA, 25 bp, Rattus norvegicus
gttttctctttatcttgtctcttca

SEQ ID NO: 535336 - DNA, 25 bp, Rattus norvegicus
gttttctcttttcttgtgttacagg

SEQ ID NO: 535337 - DNA, 25 bp, Rattus norvegicus
gttttctcttttgttgtgttacagg

SEQ ID NO: 535338 - DNA, 25 bp, Rattus norvegicus
gttttctgaattctatttgccctgc

SEQ ID NO: 535339 - DNA, 25 bp, Rattus norvegicus
gttttctgaattgtatttgccctgc

SEQ ID NO: 535340 - DNA, 25 bp, Rattus norvegicus
gttttctgaggacatacatgcactg

SEQ ID NO: 535341 - DNA, 25 bp, Rattus norvegicus
gttttctgaggagatacatgcactg

SEQ ID NO: 535342 - DNA, 25 bp, Rattus norvegicus
gttttctgccacctggactacatga

SEQ ID NO: 535343 - DNA, 25 bp, Rattus norvegicus
gttttctgccacgtggactacatga

SEQ ID NO: 535344 - DNA, 25 bp, Rattus norvegicus
gttttctgccctacaagcataggtg

SEQ ID NO: 535345 - DNA, 25 bp, Rattus norvegicus
gttttctgcccttcaagcataggtg

SEQ ID NO: 535346 - DNA, 25 bp, Rattus norvegicus
gttttctgcctcaagagagcaggaa

SEQ ID NO: 535347 - DNA, 25 bp, Rattus norvegicus
gttttctgcctctagagagcaggaa

SEQ ID NO: 535348 - DNA, 25 bp, Rattus norvegicus
gttttctgcctgaaatcagtgagtg

SEQ ID NO: 535349 - DNA, 25 bp, Rattus norvegicus
gttttctgcctgtaatcagtgagtg

SEQ ID NO: 535350 - DNA, 25 bp, Rattus norvegicus
gttttctgcgtgaatttgcactcca

SEQ ID NO: 535351 - DNA, 25 bp, Rattus norvegicus
gttttctgcgtgtatttgcactcca

SEQ ID NO: 535352 - DNA, 25 bp, Rattus norvegicus
gttttctgctgtagtgatgtacact

SEQ ID NO: 535353 - DNA, 25 bp, Rattus norvegicus
gttttctgctgttgtgatgtacact

SEQ ID NO: 535354 - DNA, 25 bp, Rattus norvegicus
gttttctggaaacacattctctatt

SEQ ID NO: 535355 - DNA, 25 bp, Rattus norvegicus
gttttctggaaagacattctctatt

SEQ ID NO: 535356 - DNA, 25 bp, Rattus norvegicus
gttttctggacccagctctatttca

SEQ ID NO: 535357 - DNA, 25 bp, Rattus norvegicus
gttttctggaccgagctctatttca

SEQ ID NO: 535358 - DNA, 25 bp, Rattus norvegicus
gttttctgggacacgcttggtggaa

SEQ ID NO: 535359 - DNA, 25 bp, Rattus norvegicus
gttttctgggactcgcttggtggaa

SEQ ID NO: 535360 - DNA, 25 bp, Rattus norvegicus
gttttctgggccctgtagtgattca

SEQ ID NO: 535361 - DNA, 25 bp, Rattus norvegicus
gttttctgggccgtgtagtgattca

SEQ ID NO: 535362 - DNA, 25 bp, Rattus norvegicus
gttttctgggttatcagtgtcctag

SEQ ID NO: 535363 - DNA, 25 bp, Rattus norvegicus
gttttctgggttttcagtgtcctag

SEQ ID NO: 535364 - DNA, 25 bp, Rattus norvegicus
gttttctgtaaaagtcctcccaaag

SEQ ID NO: 535365 - DNA, 25 bp, Rattus norvegicus
gttttctgtaaatgtcctcccaaag

SEQ ID NO: 535366 - DNA, 25 bp, Rattus norvegicus
gttttctgtctcaaatctgaatttt

SEQ ID NO: 535367 - DNA, 25 bp, Rattus norvegicus
gttttctgtctctaatctgaatttt

SEQ ID NO: 535368 - DNA, 25 bp, Rattus norvegicus
gttttctgtcttctatcgatctgtg

SEQ ID NO: 535369 - DNA, 25 bp, Rattus norvegicus
gttttctgtcttgtatcgatctgtg

SEQ ID NO: 535370 - DNA, 25 bp, Rattus norvegicus
gttttctgtgctccatgtgcaatat

SEQ ID NO: 535371 - DNA, 25 bp, Rattus norvegicus
gttttctgtgctgcatgtgcaatat

SEQ ID NO: 535372 - DNA, 25 bp, Rattus norvegicus
gttttctgttgtccggacttgaaca

SEQ ID NO: 535373 - DNA, 25 bp, Rattus norvegicus
gttttctgttgtgcggacttgaaca

SEQ ID NO: 535374 - DNA, 25 bp, Rattus norvegicus
gttttcttaccaccaggtcacagat

SEQ ID NO: 535375 - DNA, 25 bp, Rattus norvegicus
gttttcttaccagcaggtcacagat

SEQ ID NO: 535376 - DNA, 25 bp, Rattus norvegicus
gttttcttagaacgccataccctgc

SEQ ID NO: 535377 - DNA, 25 bp, Rattus norvegicus
gttttcttagaaggccataccctgc

SEQ ID NO: 535378 - DNA, 25 bp, Rattus norvegicus
gttttcttagatcgcatcctgcgct

SEQ ID NO: 535379 - DNA, 25 bp, Rattus norvegicus
gttttcttagatggcatcctgcgct

SEQ ID NO: 535380 - DNA, 25 bp, Rattus norvegicus
gttttcttagttacaagcttcactt

SEQ ID NO: 535381 - DNA, 25 bp, Rattus norvegicus
gttttcttagtttcaagcttcactt

SEQ ID NO: 535382 - DNA, 25 bp, Rattus norvegicus
gttttcttataaacctcctttgtat

SEQ ID NO: 535383 - DNA, 25 bp, Rattus norvegicus
gttttcttataatcctcctttgtat

SEQ ID NO: 535384 - DNA, 25 bp, Rattus norvegicus
gttttcttcattacatgcaaagatt

SEQ ID NO: 535385 - DNA, 25 bp, Rattus norvegicus
gttttcttcatttcatgcaaagatt

SEQ ID NO: 535386 - DNA, 25 bp, Rattus norvegicus
gttttcttcctgaggagccgggcga

SEQ ID NO: 535387 - DNA, 25 bp, Rattus norvegicus
gttttcttcctgtggagccgggcga

SEQ ID NO: 535388 - DNA, 25 bp, Rattus norvegicus
gttttcttcgggagcatgggccctt

SEQ ID NO: 535389 - DNA, 25 bp, Rattus norvegicus
gttttcttcgggtgcatgggccctt

SEQ ID NO: 535390 - DNA, 25 bp, Rattus norvegicus
gttttcttctacactattgatgcag

SEQ ID NO: 535391 - DNA, 25 bp, Rattus norvegicus
gttttcttctactctattgatgcag

SEQ ID NO: 535392 - DNA, 25 bp, Rattus norvegicus
gttttcttctataacgttgtccttg

SEQ ID NO: 535393 - DNA, 25 bp, Rattus norvegicus
gttttcttctattacgttgtccttg

SEQ ID NO: 535394 - DNA, 25 bp, Rattus norvegicus
gttttcttctctactaactttgcag

SEQ ID NO: 535395 - DNA, 25 bp, Rattus norvegicus
gttttcttctcttctaactttgcag

SEQ ID NO: 535396 - DNA, 25 bp, Rattus norvegicus
gttttcttctgaccggtatctttta

SEQ ID NO: 535397 - DNA, 25 bp, Rattus norvegicus
gttttcttctgagcggtatctttta

SEQ ID NO: 535398 - DNA, 25 bp, Rattus norvegicus
gttttcttctggatgcctctgaaat

SEQ ID NO: 535399 - DNA, 25 bp, Rattus norvegicus
gttttcttctggttgcctctgaaat

SEQ ID NO: 535400 - DNA, 25 bp, Rattus norvegicus
gttttcttctgtaaacctgaacgat

SEQ ID NO: 535401 - DNA, 25 bp, Rattus norvegicus
gttttcttctgttaacctgaacgat

SEQ ID NO: 535402 - DNA, 25 bp, Rattus norvegicus
gttttcttgcttatcacttaccatg

SEQ ID NO: 535403 - DNA, 25 bp, Rattus norvegicus
gttttcttgcttttcacttaccatg

SEQ ID NO: 535404 - DNA, 25 bp, Rattus norvegicus
gttttcttggcaactgtttacatta

SEQ ID NO: 535405 - DNA, 25 bp, Rattus norvegicus
gttttcttggcaagggaggcttttc

SEQ ID NO: 535406 - DNA, 25 bp, Rattus norvegicus
gttttcttggcatctgtttacatta

SEQ ID NO: 535407 - DNA, 25 bp, Rattus norvegicus
gttttcttggcatgggaggcttttc

SEQ ID NO: 535408 - DNA, 25 bp, Rattus norvegicus
gttttcttgtacaaccgagcaccac

SEQ ID NO: 535409 - DNA, 25 bp, Rattus norvegicus
gttttcttgtactaccgagcaccac

SEQ ID NO: 535410 - DNA, 25 bp, Rattus norvegicus
gttttcttgtgacatgtactgacga

SEQ ID NO: 535411 - DNA, 25 bp, Rattus norvegicus
gttttcttgtgagatgtactgacga

SEQ ID NO: 535412 - DNA, 25 bp, Rattus norvegicus
gttttctttacaactgtccatgtca

SEQ ID NO: 535413 - DNA, 25 bp, Rattus norvegicus
gttttctttacatctgtccatgtca

SEQ ID NO: 535414 - DNA, 25 bp, Rattus norvegicus
gttttctttactctgatttcacaaa

SEQ ID NO: 535415 - DNA, 25 bp, Rattus norvegicus
gttttctttactgtgatttcacaaa

SEQ ID NO: 535416 - DNA, 25 bp, Rattus norvegicus
gttttctttagcctggcctatccag

SEQ ID NO: 535417 - DNA, 25 bp, Rattus norvegicus
gttttctttagcgtggcctatccag

SEQ ID NO: 535418 - DNA, 25 bp, Rattus norvegicus
gttttctttcaaccaccagttgcag

SEQ ID NO: 535419 - DNA, 25 bp, Rattus norvegicus
gttttctttcaagcaccagttgcag

SEQ ID NO: 535420 - DNA, 25 bp, Rattus norvegicus
gttttctttcgcacttgtatgggtt

SEQ ID NO: 535421 - DNA, 25 bp, Rattus norvegicus
gttttctttcgctcttgtatgggtt

SEQ ID NO: 535422 - DNA, 25 bp, Rattus norvegicus
gttttctttctaattctgtcatcta

SEQ ID NO: 535423 - DNA, 25 bp, Rattus norvegicus
gttttctttctatttctgtcatcta

SEQ ID NO: 535424 - DNA, 25 bp, Rattus norvegicus
gttttctttctgcttgcagggacca

SEQ ID NO: 535425 - DNA, 25 bp, Rattus norvegicus
gttttctttctggttgcagggacca

SEQ ID NO: 535426 - DNA, 25 bp, Rattus norvegicus
gttttctttcttaaggcctggcatt

SEQ ID NO: 535427 - DNA, 25 bp, Rattus norvegicus
gttttctttctttaggcctggcatt

SEQ ID NO: 535428 - DNA, 25 bp, Rattus norvegicus
gttttctttgttcggcaatcagcca

SEQ ID NO: 535429 - DNA, 25 bp, Rattus norvegicus
gttttctttgttgggcaatcagcca

SEQ ID NO: 535430 - DNA, 25 bp, Rattus norvegicus
gttttcttttcacttccagatatgg

SEQ ID NO: 535431 - DNA, 25 bp, Rattus norvegicus
gttttcttttcagttccagatatgg

SEQ ID NO: 535432 - DNA, 25 bp, Rattus norvegicus
gttttcttttctaactcaatactct

SEQ ID NO: 535433 - DNA, 25 bp, Rattus norvegicus
gttttcttttcttactcaatactct

SEQ ID NO: 535434 - DNA, 25 bp, Rattus norvegicus
gttttcttttgcctgtaagctcaga

SEQ ID NO: 535435 - DNA, 25 bp, Rattus norvegicus
gttttcttttgcgtgtaagctcaga

SEQ ID NO: 535436 - DNA, 25 bp, Rattus norvegicus
gttttgaaaccaacttacatacaca

SEQ ID NO: 535437 - DNA, 25 bp, Rattus norvegicus
gttttgaaaccatcttacatacaca

SEQ ID NO: 535438 - DNA, 25 bp, Rattus norvegicus
gttttgaaactacagtctcttgtca

SEQ ID NO: 535439 - DNA, 25 bp, Rattus norvegicus
gttttgaaactagagtctcttgtca

SEQ ID NO: 535440 - DNA, 25 bp, Rattus norvegicus
gttttgaaccttatgctctacagtc

SEQ ID NO: 535441 - DNA, 25 bp, Rattus norvegicus
gttttgaaccttttgctctacagtc

SEQ ID NO: 535442 - DNA, 25 bp, Rattus norvegicus
gttttgaactcgcaagcacccaaga

SEQ ID NO: 535443 - DNA, 25 bp, Rattus norvegicus
gttttgaactcggaagcacccaaga

SEQ ID NO: 535444 - DNA, 25 bp, Rattus norvegicus
gttttgaagccaccaagttccaccc

SEQ ID NO: 535445 - DNA, 25 bp, Rattus norvegicus
gttttgaagccagcaagttccaccc

SEQ ID NO: 535446 - DNA, 25 bp, Rattus norvegicus
gttttgaagctgatatgccctcttt

SEQ ID NO: 535447 - DNA, 25 bp, Rattus norvegicus
gttttgaagctgttatgccctcttt

SEQ ID NO: 535448 - DNA, 25 bp, Rattus norvegicus
gttttgaaggccatccatggagcca

SEQ ID NO: 535449 - DNA, 25 bp, Rattus norvegicus
gttttgaaggccttccatggagcca

SEQ ID NO: 535450 - DNA, 25 bp, Rattus norvegicus
gttttgaagttcacccttgactgca

SEQ ID NO: 535451 - DNA, 25 bp, Rattus norvegicus
gttttgaagttctcccttgactgca

SEQ ID NO: 535452 - DNA, 25 bp, Rattus norvegicus
gttttgaatactcagccaccttggc

SEQ ID NO: 535453 - DNA, 25 bp, Rattus norvegicus
gttttgaatactgagccaccttggc

SEQ ID NO: 535454 - DNA, 25 bp, Rattus norvegicus
gttttgacagagagccctggctgct

SEQ ID NO: 535455 - DNA, 25 bp, Rattus norvegicus
gttttgacagagtgccctggctgct

SEQ ID NO: 535456 - DNA, 25 bp, Rattus norvegicus
gttttgaccgcacaccagataattt

SEQ ID NO: 535457 - DNA, 25 bp, Rattus norvegicus
gttttgaccgcagaccagataattt

SEQ ID NO: 535458 - DNA, 25 bp, Rattus norvegicus
gttttgactacactattccatacat

SEQ ID NO: 535459 - DNA, 25 bp, Rattus norvegicus
gttttgactacagtattccatacat

SEQ ID NO: 535460 - DNA, 25 bp, Rattus norvegicus
gttttgactgcaccagagacttcta

SEQ ID NO: 535461 - DNA, 25 bp, Rattus norvegicus
gttttgactgcagcagagacttcta

SEQ ID NO: 535462 - DNA, 25 bp, Rattus norvegicus
gttttgacttcacacttgtgggctc

SEQ ID NO: 535463 - DNA, 25 bp, Rattus norvegicus
gttttgacttcagacttgtgggctc

SEQ ID NO: 535464 - DNA, 25 bp, Rattus norvegicus
gttttgacttgtaccaagagcccct

SEQ ID NO: 535465 - DNA, 25 bp, Rattus norvegicus
gttttgacttgttccaagagcccct

SEQ ID NO: 535466 - DNA, 25 bp, Rattus norvegicus
gttttgagaactcccaagccttcct

SEQ ID NO: 535467 - DNA, 25 bp, Rattus norvegicus
gttttgagaactgccaagccttcct

SEQ ID NO: 535468 - DNA, 25 bp, Rattus norvegicus
gttttgagacaacgctctggcccga

SEQ ID NO: 535469 - DNA, 25 bp, Rattus norvegicus
gttttgagacaaggctctggcccga

SEQ ID NO: 535470 - DNA, 25 bp, Rattus norvegicus
gttttgagcattacctcttgggaat

SEQ ID NO: 535471 - DNA, 25 bp, Rattus norvegicus
gttttgagcatttcctcttgggaat

SEQ ID NO: 535472 - DNA, 25 bp, Rattus norvegicus
gttttgagccagagttgtctcactc

SEQ ID NO: 535473 - DNA, 25 bp, Rattus norvegicus
gttttgagccagtgttgtctcactc

SEQ ID NO: 535474 - DNA, 25 bp, Rattus norvegicus
gttttgagctaactgcatttgcgag

SEQ ID NO: 535475 - DNA, 25 bp, Rattus norvegicus
gttttgagctaagtgcatttgcgag

SEQ ID NO: 535476 - DNA, 25 bp, Rattus norvegicus
gttttgagctgacctctgtaggcaa

SEQ ID NO: 535477 - DNA, 25 bp, Rattus norvegicus
gttttgagctgagctctgtaggcaa

SEQ ID NO: 535478 - DNA, 25 bp, Rattus norvegicus
gttttgaggtcccatccccagatga

SEQ ID NO: 535479 - DNA, 25 bp, Rattus norvegicus
gttttgaggtccgatccccagatga

SEQ ID NO: 535480 - DNA, 25 bp, Rattus norvegicus
gttttgagtcagaatcagcccttca

SEQ ID NO: 535481 - DNA, 25 bp, Rattus norvegicus
gttttgagtcagtatcagcccttca

SEQ ID NO: 535482 - DNA, 25 bp, Rattus norvegicus
gttttgatactacgacccgaatggt

SEQ ID NO: 535483 - DNA, 25 bp, Rattus norvegicus
gttttgatactaggacccgaatggt

SEQ ID NO: 535484 - DNA, 25 bp, Rattus norvegicus
gttttgatcaagagtgacctagttt

SEQ ID NO: 535485 - DNA, 25 bp, Rattus norvegicus
gttttgatcaagtgtgacctagttt

SEQ ID NO: 535486 - DNA, 25 bp, Rattus norvegicus
gttttgatcacacagcttactgctg

SEQ ID NO: 535487 - DNA, 25 bp, Rattus norvegicus
gttttgatcacagagcttactgctg

SEQ ID NO: 535488 - DNA, 25 bp, Rattus norvegicus
gttttgatccacatagtttctccca

SEQ ID NO: 535489 - DNA, 25 bp, Rattus norvegicus
gttttgatccacttagtttctccca

SEQ ID NO: 535490 - DNA, 25 bp, Rattus norvegicus
gttttgatccataaaattgacagta

SEQ ID NO: 535491 - DNA, 25 bp, Rattus norvegicus
gttttgatccatctttctgtgacat

SEQ ID NO: 535492 - DNA, 25 bp, Rattus norvegicus
gttttgatccatgtttctgtgacat

SEQ ID NO: 535493 - DNA, 25 bp, Rattus norvegicus
gttttgatccattaaattgacagta

SEQ ID NO: 535494 - DNA, 25 bp, Rattus norvegicus
gttttgatctcccactgtttataag

SEQ ID NO: 535495 - DNA, 25 bp, Rattus norvegicus
gttttgatctccgactgtttataag

SEQ ID NO: 535496 - DNA, 25 bp, Rattus norvegicus
gttttgatgtatatgggcaaccttt

SEQ ID NO: 535497 - DNA, 25 bp, Rattus norvegicus
gttttgatgtatttgggcaaccttt

SEQ ID NO: 535498 - DNA, 25 bp, Rattus norvegicus
gttttgattacacccacacggtcgc

SEQ ID NO: 535499 - DNA, 25 bp, Rattus norvegicus
gttttgattacagccacacggtcgc

SEQ ID NO: 535500 - DNA, 25 bp, Rattus norvegicus
gttttgattggtagaagctccttta

SEQ ID NO: 535501 - DNA, 25 bp, Rattus norvegicus
gttttgattggttgaagctccttta

SEQ ID NO: 535502 - DNA, 25 bp, Rattus norvegicus
gttttgatttctatagcctgcagca

SEQ ID NO: 535503 - DNA, 25 bp, Rattus norvegicus
gttttgatttctttagcctgcagca

SEQ ID NO: 535504 - DNA, 25 bp, Rattus norvegicus
gttttgcaaagactacactactggg

SEQ ID NO: 535505 - DNA, 25 bp, Rattus norvegicus
gttttgcaaagagtacactactggg

SEQ ID NO: 535506 - DNA, 25 bp, Rattus norvegicus
gttttgcaagaaatagggagtcaca

SEQ ID NO: 535507 - DNA, 25 bp, Rattus norvegicus
gttttgcaagaattagggagtcaca

SEQ ID NO: 535508 - DNA, 25 bp, Rattus norvegicus
gttttgcaatttaagcgatgttcat

SEQ ID NO: 535509 - DNA, 25 bp, Rattus norvegicus
gttttgcaattttagcgatgttcat

SEQ ID NO: 535510 - DNA, 25 bp, Rattus norvegicus
gttttgcactttatcatttccttgt

SEQ ID NO: 535511 - DNA, 25 bp, Rattus norvegicus
gttttgcactttttcatttccttgt

SEQ ID NO: 535512 - DNA, 25 bp, Rattus norvegicus
gttttgcagaagaagccctgatccc

SEQ ID NO: 535513 - DNA, 25 bp, Rattus norvegicus
gttttgcagaagtagccctgatccc

SEQ ID NO: 535514 - DNA, 25 bp, Rattus norvegicus
gttttgcagaggctgcaagctcctt

SEQ ID NO: 535515 - DNA, 25 bp, Rattus norvegicus
gttttgcagagggtgcaagctcctt

SEQ ID NO: 535516 - DNA, 25 bp, Rattus norvegicus
gttttgcatatgaccagcactgact

SEQ ID NO: 535517 - DNA, 25 bp, Rattus norvegicus
gttttgcatatgtccagcactgact

SEQ ID NO: 535518 - DNA, 25 bp, Rattus norvegicus
gttttgcatgcacctgtgtgaaagc

SEQ ID NO: 535519 - DNA, 25 bp, Rattus norvegicus
gttttgcatgcagctgtgtgaaagc

SEQ ID NO: 535520 - DNA, 25 bp, Rattus norvegicus
gttttgcatggccatcacacaggtt

SEQ ID NO: 535521 - DNA, 25 bp, Rattus norvegicus
gttttgcatggcgatcacacaggtt

SEQ ID NO: 535522 - DNA, 25 bp, Rattus norvegicus
gttttgcatggtaataagccaccat

SEQ ID NO: 535523 - DNA, 25 bp, Rattus norvegicus
gttttgcatggttataagccaccat

SEQ ID NO: 535524 - DNA, 25 bp, Rattus norvegicus
gttttgcatgtcaaagcctgggcct

SEQ ID NO: 535525 - DNA, 25 bp, Rattus norvegicus
gttttgcatgtctaagcctgggcct

SEQ ID NO: 535526 - DNA, 25 bp, Rattus norvegicus
gttttgcattacctactcttttctc

SEQ ID NO: 535527 - DNA, 25 bp, Rattus norvegicus
gttttgcattacgtactcttttctc

SEQ ID NO: 535528 - DNA, 25 bp, Rattus norvegicus
gttttgcattgcatagattcttcag

SEQ ID NO: 535529 - DNA, 25 bp, Rattus norvegicus
gttttgcattgcttagattcttcag

SEQ ID NO: 535530 - DNA, 25 bp, Rattus norvegicus
gttttgcatttgactcatgttcaga

SEQ ID NO: 535531 - DNA, 25 bp, Rattus norvegicus
gttttgcatttgtctcatgttcaga

SEQ ID NO: 535532 - DNA, 25 bp, Rattus norvegicus
gttttgcattttagattggcctatt

SEQ ID NO: 535533 - DNA, 25 bp, Rattus norvegicus
gttttgcattttccattcagacaca

SEQ ID NO: 535534 - DNA, 25 bp, Rattus norvegicus
gttttgcattttgcattcagacaca

SEQ ID NO: 535535 - DNA, 25 bp, Rattus norvegicus
gttttgcatttttgattggcctatt

SEQ ID NO: 535536 - DNA, 25 bp, Rattus norvegicus
gttttgccagctatgtcactacaga

SEQ ID NO: 535537 - DNA, 25 bp, Rattus norvegicus
gttttgccagctttgtcactacaga

SEQ ID NO: 535538 - DNA, 25 bp, Rattus norvegicus
gttttgccagttatttcagacagta

SEQ ID NO: 535539 - DNA, 25 bp, Rattus norvegicus
gttttgccagttttttcagacagta

SEQ ID NO: 535540 - DNA, 25 bp, Rattus norvegicus
gttttgccccacaagaaaatggaga

SEQ ID NO: 535541 - DNA, 25 bp, Rattus norvegicus
gttttgccccactagaaaatggaga

SEQ ID NO: 535542 - DNA, 25 bp, Rattus norvegicus
gttttgcctacacagtgccctgaaa

SEQ ID NO: 535543 - DNA, 25 bp, Rattus norvegicus
gttttgcctacagagtgccctgaaa

SEQ ID NO: 535544 - DNA, 25 bp, Rattus norvegicus
gttttgcctcaaactagacacagtt

SEQ ID NO: 535545 - DNA, 25 bp, Rattus norvegicus
gttttgcctcaatctagacacagtt

SEQ ID NO: 535546 - DNA, 25 bp, Rattus norvegicus
gttttgcctcctctctcactaggga

SEQ ID NO: 535547 - DNA, 25 bp, Rattus norvegicus
gttttgcctcctgtctcactaggga

SEQ ID NO: 535548 - DNA, 25 bp, Rattus norvegicus
gttttgcctctgacttttggcttta

SEQ ID NO: 535549 - DNA, 25 bp, Rattus norvegicus
gttttgcctctgtcttttggcttta

SEQ ID NO: 535550 - DNA, 25 bp, Rattus norvegicus
gttttgcctgccatatagaatcatc

SEQ ID NO: 535551 - DNA, 25 bp, Rattus norvegicus
gttttgcctgccttatagaatcatc

SEQ ID NO: 535552 - DNA, 25 bp, Rattus norvegicus
gttttgcctttgagttctgttttga

SEQ ID NO: 535553 - DNA, 25 bp, Rattus norvegicus
gttttgcctttgtgttctgttttga

SEQ ID NO: 535554 - DNA, 25 bp, Rattus norvegicus
gttttgcgaacgatctcaagccgaa

SEQ ID NO: 535555 - DNA, 25 bp, Rattus norvegicus
gttttgcgaacgttctcaagccgaa

SEQ ID NO: 535556 - DNA, 25 bp, Rattus norvegicus
gttttgcgctcccagccagagtgcg

SEQ ID NO: 535557 - DNA, 25 bp, Rattus norvegicus
gttttgcgctccgagccagagtgcg

SEQ ID NO: 535558 - DNA, 25 bp, Rattus norvegicus
gttttgcgtgctatgagggtcattt

SEQ ID NO: 535559 - DNA, 25 bp, Rattus norvegicus
gttttgcgtgctttgagggtcattt

SEQ ID NO: 535560 - DNA, 25 bp, Rattus norvegicus
gttttgctaaaccaacgatcagttc

SEQ ID NO: 535561 - DNA, 25 bp, Rattus norvegicus
gttttgctaaacgaacgatcagttc

SEQ ID NO: 535562 - DNA, 25 bp, Rattus norvegicus
gttttgctatgtaggcatggccagc

SEQ ID NO: 535563 - DNA, 25 bp, Rattus norvegicus
gttttgctatgttggcatggccagc

SEQ ID NO: 535564 - DNA, 25 bp, Rattus norvegicus
gttttgctcagcacctgtaattcta

SEQ ID NO: 535565 - DNA, 25 bp, Rattus norvegicus
gttttgctcagctcctgtaattcta

SEQ ID NO: 535566 - DNA, 25 bp, Rattus norvegicus
gttttgctcttgatgttgtttactt

SEQ ID NO: 535567 - DNA, 25 bp, Rattus norvegicus
gttttgctcttgttgttgtttactt

SEQ ID NO: 535568 - DNA, 25 bp, Rattus norvegicus
gttttgctgacactttaccaacccg

SEQ ID NO: 535569 - DNA, 25 bp, Rattus norvegicus
gttttgctgacagtttaccaacccg

SEQ ID NO: 535570 - DNA, 25 bp, Rattus norvegicus
gttttgctgatactccaggctggcc

SEQ ID NO: 535571 - DNA, 25 bp, Rattus norvegicus
gttttgctgatagtccaggctggcc

SEQ ID NO: 535572 - DNA, 25 bp, Rattus norvegicus
gttttgctgcaaccatattccttaa

SEQ ID NO: 535573 - DNA, 25 bp, Rattus norvegicus
gttttgctgcaagcatattccttaa

SEQ ID NO: 535574 - DNA, 25 bp, Rattus norvegicus
gttttgctgccactgtatgatctgt

SEQ ID NO: 535575 - DNA, 25 bp, Rattus norvegicus
gttttgctgccagtgtatgatctgt

SEQ ID NO: 535576 - DNA, 25 bp, Rattus norvegicus
gttttgctgcccagctcaggtgtga

SEQ ID NO: 535577 - DNA, 25 bp, Rattus norvegicus
gttttgctgccctgctcaggtgtga

SEQ ID NO: 535578 - DNA, 25 bp, Rattus norvegicus
gttttgctggccataactggtatca

SEQ ID NO: 535579 - DNA, 25 bp, Rattus norvegicus
gttttgctggccttaactggtatca

SEQ ID NO: 535580 - DNA, 25 bp, Rattus norvegicus
gttttgctggttatgttggactcct

SEQ ID NO: 535581 - DNA, 25 bp, Rattus norvegicus
gttttgctggttttgttggactcct

SEQ ID NO: 535582 - DNA, 25 bp, Rattus norvegicus
gttttgctgtgaagtactgctttaa

SEQ ID NO: 535583 - DNA, 25 bp, Rattus norvegicus
gttttgctgtgatgtactgctttaa

SEQ ID NO: 535584 - DNA, 25 bp, Rattus norvegicus
gttttgcttgttactgtgtattttg

SEQ ID NO: 535585 - DNA, 25 bp, Rattus norvegicus
gttttgcttgtttctgtgtattttg

SEQ ID NO: 535586 - DNA, 25 bp, Rattus norvegicus
gttttgctttgcagacctggttgac

SEQ ID NO: 535587 - DNA, 25 bp, Rattus norvegicus
gttttgctttgctgacctggttgac

SEQ ID NO: 535588 - DNA, 25 bp, Rattus norvegicus
gttttgctttggaatttcagacatt

SEQ ID NO: 535589 - DNA, 25 bp, Rattus norvegicus
gttttgctttggcttatggtcacga

SEQ ID NO: 535590 - DNA, 25 bp, Rattus norvegicus
gttttgctttgggttatggtcacga

SEQ ID NO: 535591 - DNA, 25 bp, Rattus norvegicus
gttttgctttggtatttcagacatt

SEQ ID NO: 535592 - DNA, 25 bp, Rattus norvegicus
gttttgcttttacatcgttagctcg

SEQ ID NO: 535593 - DNA, 25 bp, Rattus norvegicus
gttttgcttttacttgtcgtgaact

SEQ ID NO: 535594 - DNA, 25 bp, Rattus norvegicus
gttttgcttttagatcgttagctcg

SEQ ID NO: 535595 - DNA, 25 bp, Rattus norvegicus
gttttgcttttagttgtcgtgaact

SEQ ID NO: 535596 - DNA, 25 bp, Rattus norvegicus
gttttggaaaccctgaaatggagat

SEQ ID NO: 535597 - DNA, 25 bp, Rattus norvegicus
gttttggaaaccgtgaaatggagat

SEQ ID NO: 535598 - DNA, 25 bp, Rattus norvegicus
gttttggaacaaatgcctggctgag

SEQ ID NO: 535599 - DNA, 25 bp, Rattus norvegicus
gttttggaacaattgcctggctgag

SEQ ID NO: 535600 - DNA, 25 bp, Rattus norvegicus
gttttggaacagcatagccattcat

SEQ ID NO: 535601 - DNA, 25 bp, Rattus norvegicus
gttttggaacaggatagccattcat

SEQ ID NO: 535602 - DNA, 25 bp, Rattus norvegicus
gttttggaacctcgctgagtgctgt

SEQ ID NO: 535603 - DNA, 25 bp, Rattus norvegicus
gttttggaacctggctgagtgctgt

SEQ ID NO: 535604 - DNA, 25 bp, Rattus norvegicus
gttttggagcggatcacattcagcc

SEQ ID NO: 535605 - DNA, 25 bp, Rattus norvegicus
gttttggagcggttcacattcagcc

SEQ ID NO: 535606 - DNA, 25 bp, Rattus norvegicus
gttttggatcaccattctccctatc

SEQ ID NO: 535607 - DNA, 25 bp, Rattus norvegicus
gttttggatcacgattctccctatc

SEQ ID NO: 535608 - DNA, 25 bp, Rattus norvegicus
gttttggatccaagaaatcactgaa

SEQ ID NO: 535609 - DNA, 25 bp, Rattus norvegicus
gttttggatccatgaaatcactgaa

SEQ ID NO: 535610 - DNA, 25 bp, Rattus norvegicus
gttttggcagtcatgttggcttaaa

SEQ ID NO: 535611 - DNA, 25 bp, Rattus norvegicus
gttttggcagtcttgttggcttaaa

SEQ ID NO: 535612 - DNA, 25 bp, Rattus norvegicus
gttttggccagcagtaacatgcttt

SEQ ID NO: 535613 - DNA, 25 bp, Rattus norvegicus
gttttggccagctgtaacatgcttt

SEQ ID NO: 535614 - DNA, 25 bp, Rattus norvegicus
gttttggcccaaatactcattctca

SEQ ID NO: 535615 - DNA, 25 bp, Rattus norvegicus
gttttggcccaattactcattctca

SEQ ID NO: 535616 - DNA, 25 bp, Rattus norvegicus
gttttggcccatacaaatgttttct

SEQ ID NO: 535617 - DNA, 25 bp, Rattus norvegicus
gttttggcccattcaaatgttttct

SEQ ID NO: 535618 - DNA, 25 bp, Rattus norvegicus
gttttggcctaaccaactatggcta

SEQ ID NO: 535619 - DNA, 25 bp, Rattus norvegicus
gttttggcctaagcaactatggcta

SEQ ID NO: 535620 - DNA, 25 bp, Rattus norvegicus
gttttggccttgctggctcgcgtca

SEQ ID NO: 535621 - DNA, 25 bp, Rattus norvegicus
gttttggccttggtggctcgcgtca

SEQ ID NO: 535622 - DNA, 25 bp, Rattus norvegicus
gttttggcgttaccattgatcgtca

SEQ ID NO: 535623 - DNA, 25 bp, Rattus norvegicus
gttttggcgttagcattgatcgtca

SEQ ID NO: 535624 - DNA, 25 bp, Rattus norvegicus
gttttggctaacatgtctggactac

SEQ ID NO: 535625 - DNA, 25 bp, Rattus norvegicus
gttttggctaacttgtctggactac

SEQ ID NO: 535626 - DNA, 25 bp, Rattus norvegicus
gttttggcttttaacatttgttatg

SEQ ID NO: 535627 - DNA, 25 bp, Rattus norvegicus
gttttggctttttacatttgttatg

SEQ ID NO: 535628 - DNA, 25 bp, Rattus norvegicus
gttttgggaaccactggtatcatcc

SEQ ID NO: 535629 - DNA, 25 bp, Rattus norvegicus
gttttgggaacctctggtatcatcc

SEQ ID NO: 535630 - DNA, 25 bp, Rattus norvegicus
gttttgggccatctgtttcttccac

SEQ ID NO: 535631 - DNA, 25 bp, Rattus norvegicus
gttttgggccatgtgtttcttccac

SEQ ID NO: 535632 - DNA, 25 bp, Rattus norvegicus
gttttgggtcaaaggcatcaacttc

SEQ ID NO: 535633 - DNA, 25 bp, Rattus norvegicus
gttttgggtcaatggcatcaacttc

SEQ ID NO: 535634 - DNA, 25 bp, Rattus norvegicus
gttttggtatttcatccttagtggt

SEQ ID NO: 535635 - DNA, 25 bp, Rattus norvegicus
gttttggtatttgatccttagtggt

SEQ ID NO: 535636 - DNA, 25 bp, Rattus norvegicus
gttttggtcttccatgtttcatcct

SEQ ID NO: 535637 - DNA, 25 bp, Rattus norvegicus
gttttggtcttcgatgtttcatcct

SEQ ID NO: 535638 - DNA, 25 bp, Rattus norvegicus
gttttggtctttctgcaataatcga

SEQ ID NO: 535639 - DNA, 25 bp, Rattus norvegicus
gttttggtctttgtgcaataatcga

SEQ ID NO: 535640 - DNA, 25 bp, Rattus norvegicus
gttttggtgaggaagcctggctata

SEQ ID NO: 535641 - DNA, 25 bp, Rattus norvegicus
gttttggtgaggtagcctggctata

SEQ ID NO: 535642 - DNA, 25 bp, Rattus norvegicus
gttttggtgcaactacaactgtcgt

SEQ ID NO: 535643 - DNA, 25 bp, Rattus norvegicus
gttttggtgcaagtacaactgtcgt

SEQ ID NO: 535644 - DNA, 25 bp, Rattus norvegicus
gttttggtgttaatcgtctacatac

SEQ ID NO: 535645 - DNA, 25 bp, Rattus norvegicus
gttttggtgttattcgtctacatac

SEQ ID NO: 535646 - DNA, 25 bp, Rattus norvegicus
gttttggtttttctagcatcccttg

SEQ ID NO: 535647 - DNA, 25 bp, Rattus norvegicus
gttttggtttttgtagcatcccttg

SEQ ID NO: 535648 - DNA, 25 bp, Rattus norvegicus
gttttgtaagcaactggactgtcac

SEQ ID NO: 535649 - DNA, 25 bp, Rattus norvegicus
gttttgtaagcatctggactgtcac

SEQ ID NO: 535650 - DNA, 25 bp, Rattus norvegicus
gttttgtaagtcagagttttcctca

SEQ ID NO: 535651 - DNA, 25 bp, Rattus norvegicus
gttttgtaagtctgagttttcctca

SEQ ID NO: 535652 - DNA, 25 bp, Rattus norvegicus
gttttgtaatcgagggttgcttcta

SEQ ID NO: 535653 - DNA, 25 bp, Rattus norvegicus
gttttgtaatcgtgggttgcttcta

SEQ ID NO: 535654 - DNA, 25 bp, Rattus norvegicus
gttttgtacaaacctaccctgaaag

SEQ ID NO: 535655 - DNA, 25 bp, Rattus norvegicus
gttttgtacaaagctaccctgaaag

SEQ ID NO: 535656 - DNA, 25 bp, Rattus norvegicus
gttttgtaccaaactcatctgatgt

SEQ ID NO: 535657 - DNA, 25 bp, Rattus norvegicus
gttttgtaccaatctcatctgatgt

SEQ ID NO: 535658 - DNA, 25 bp, Rattus norvegicus
gttttgtaccacctgctctagaaaa

SEQ ID NO: 535659 - DNA, 25 bp, Rattus norvegicus
gttttgtaccacgtgctctagaaaa

SEQ ID NO: 535660 - DNA, 25 bp, Rattus norvegicus
gttttgtacctaagtctcctctaca

SEQ ID NO: 535661 - DNA, 25 bp, Rattus norvegicus
gttttgtacctatgtctcctctaca

SEQ ID NO: 535662 - DNA, 25 bp, Rattus norvegicus
gttttgtacctgatcatgtgactca

SEQ ID NO: 535663 - DNA, 25 bp, Rattus norvegicus
gttttgtacctgttcatgtgactca

SEQ ID NO: 535664 - DNA, 25 bp, Rattus norvegicus
gttttgtagaacactcgtgcctgtt

SEQ ID NO: 535665 - DNA, 25 bp, Rattus norvegicus
gttttgtagaactctcgtgcctgtt

SEQ ID NO: 535666 - DNA, 25 bp, Rattus norvegicus
gttttgtagcaaagcacctcatcaa

SEQ ID NO: 535667 - DNA, 25 bp, Rattus norvegicus
gttttgtagcaaagtgcccacactg

SEQ ID NO: 535668 - DNA, 25 bp, Rattus norvegicus
gttttgtagcaatgcacctcatcaa

SEQ ID NO: 535669 - DNA, 25 bp, Rattus norvegicus
gttttgtagcaatgtgcccacactg

SEQ ID NO: 535670 - DNA, 25 bp, Rattus norvegicus
gttttgtagcctcttactattatag

SEQ ID NO: 535671 - DNA, 25 bp, Rattus norvegicus
gttttgtagcctgttactattatag

SEQ ID NO: 535672 - DNA, 25 bp, Rattus norvegicus
gttttgtatctcagtgcagagcgca

SEQ ID NO: 535673 - DNA, 25 bp, Rattus norvegicus
gttttgtatctctgtgcagagcgca

SEQ ID NO: 535674 - DNA, 25 bp, Rattus norvegicus
gttttgtatttaatctcagccactt

SEQ ID NO: 535675 - DNA, 25 bp, Rattus norvegicus
gttttgtatttattctcagccactt

SEQ ID NO: 535676 - DNA, 25 bp, Rattus norvegicus
gttttgtatttcacctctttcagta

SEQ ID NO: 535677 - DNA, 25 bp, Rattus norvegicus
gttttgtatttctcctctttcagta

SEQ ID NO: 535678 - DNA, 25 bp, Rattus norvegicus
gttttgtattttccacttgaccccg

SEQ ID NO: 535679 - DNA, 25 bp, Rattus norvegicus
gttttgtattttgcacttgaccccg

SEQ ID NO: 535680 - DNA, 25 bp, Rattus norvegicus
gttttgtcaactactaactgggtca

SEQ ID NO: 535681 - DNA, 25 bp, Rattus norvegicus
gttttgtcaacttctaactgggtca

SEQ ID NO: 535682 - DNA, 25 bp, Rattus norvegicus
gttttgtcaatcagaagtcctgctg

SEQ ID NO: 535683 - DNA, 25 bp, Rattus norvegicus
gttttgtcaatctgaagtcctgctg

SEQ ID NO: 535684 - DNA, 25 bp, Rattus norvegicus
gttttgtcactaactcatgatgtat

SEQ ID NO: 535685 - DNA, 25 bp, Rattus norvegicus
gttttgtcactatctcatgatgtat

SEQ ID NO: 535686 - DNA, 25 bp, Rattus norvegicus
gttttgtcatttctgttgaggctct

SEQ ID NO: 535687 - DNA, 25 bp, Rattus norvegicus
gttttgtcatttgtgttgaggctct

SEQ ID NO: 535688 - DNA, 25 bp, Rattus norvegicus
gttttgtccatacaacaaccatcag

SEQ ID NO: 535689 - DNA, 25 bp, Rattus norvegicus
gttttgtccatagaacaaccatcag

SEQ ID NO: 535690 - DNA, 25 bp, Rattus norvegicus
gttttgtccatcagagtaaaggttg

SEQ ID NO: 535691 - DNA, 25 bp, Rattus norvegicus
gttttgtccatctgagtaaaggttg

SEQ ID NO: 535692 - DNA, 25 bp, Rattus norvegicus
gttttgtcccacagcactggaacta

SEQ ID NO: 535693 - DNA, 25 bp, Rattus norvegicus
gttttgtcccactgcactggaacta

SEQ ID NO: 535694 - DNA, 25 bp, Rattus norvegicus
gttttgtccttacaagagctgtgcc

SEQ ID NO: 535695 - DNA, 25 bp, Rattus norvegicus
gttttgtccttagaagagctgtgcc

SEQ ID NO: 535696 - DNA, 25 bp, Rattus norvegicus
gttttgtccttcagcagctgtcatg

SEQ ID NO: 535697 - DNA, 25 bp, Rattus norvegicus
gttttgtccttctgcagctgtcatg

SEQ ID NO: 535698 - DNA, 25 bp, Rattus norvegicus
gttttgtctagaacctgccacacat

SEQ ID NO: 535699 - DNA, 25 bp, Rattus norvegicus
gttttgtctagatcctgccacacat

SEQ ID NO: 535700 - DNA, 25 bp, Rattus norvegicus
gttttgtctcaactgcagggcactc

SEQ ID NO: 535701 - DNA, 25 bp, Rattus norvegicus
gttttgtctcaagtgcagggcactc

SEQ ID NO: 535702 - DNA, 25 bp, Rattus norvegicus
gttttgtctcataagttcttctcga

SEQ ID NO: 535703 - DNA, 25 bp, Rattus norvegicus
gttttgtctcattagttcttctcga

SEQ ID NO: 535704 - DNA, 25 bp, Rattus norvegicus
gttttgtctcctacgagatctgaga

SEQ ID NO: 535705 - DNA, 25 bp, Rattus norvegicus
gttttgtctccttcgagatctgaga

SEQ ID NO: 535706 - DNA, 25 bp, Rattus norvegicus
gttttgtctctgcaagaaaatgcca

SEQ ID NO: 535707 - DNA, 25 bp, Rattus norvegicus
gttttgtctctggaagaaaatgcca

SEQ ID NO: 535708 - DNA, 25 bp, Rattus norvegicus
gttttgtctcttagcctaggaaatc

SEQ ID NO: 535709 - DNA, 25 bp, Rattus norvegicus
gttttgtctctttgcctaggaaatc

SEQ ID NO: 535710 - DNA, 25 bp, Rattus norvegicus
gttttgtcttaaagccgtggcaccg

SEQ ID NO: 535711 - DNA, 25 bp, Rattus norvegicus
gttttgtcttaatgccgtggcaccg

SEQ ID NO: 535712 - DNA, 25 bp, Rattus norvegicus
gttttgtcttataccttaatctgat

SEQ ID NO: 535713 - DNA, 25 bp, Rattus norvegicus
gttttgtcttattccttaatctgat

SEQ ID NO: 535714 - DNA, 25 bp, Rattus norvegicus
gttttgtctttaacattatgcttcg

SEQ ID NO: 535715 - DNA, 25 bp, Rattus norvegicus
gttttgtctttatcattatgcttcg

SEQ ID NO: 535716 - DNA, 25 bp, Rattus norvegicus
gttttgtgaaacatctcagctgagt

SEQ ID NO: 535717 - DNA, 25 bp, Rattus norvegicus
gttttgtgaaacttctcagctgagt

SEQ ID NO: 535718 - DNA, 25 bp, Rattus norvegicus
gttttgtgaaggcaatgcgggcaca

SEQ ID NO: 535719 - DNA, 25 bp, Rattus norvegicus
gttttgtgaagggaatgcgggcaca

SEQ ID NO: 535720 - DNA, 25 bp, Rattus norvegicus
gttttgtgacacagggtcccagggc

SEQ ID NO: 535721 - DNA, 25 bp, Rattus norvegicus
gttttgtgacactgggtcccagggc

SEQ ID NO: 535722 - DNA, 25 bp, Rattus norvegicus
gttttgtgaccaacggagctcagat

SEQ ID NO: 535723 - DNA, 25 bp, Rattus norvegicus
gttttgtgaccatcggagctcagat

SEQ ID NO: 535724 - DNA, 25 bp, Rattus norvegicus
gttttgtgcacccatattttgagag

SEQ ID NO: 535725 - DNA, 25 bp, Rattus norvegicus
gttttgtgcaccgatattttgagag

SEQ ID NO: 535726 - DNA, 25 bp, Rattus norvegicus
gttttgtgccttaatgtatttgcct

SEQ ID NO: 535727 - DNA, 25 bp, Rattus norvegicus
gttttgtgcctttatgtatttgcct

SEQ ID NO: 535728 - DNA, 25 bp, Rattus norvegicus
gttttgtgcttcattcaatattggg

SEQ ID NO: 535729 - DNA, 25 bp, Rattus norvegicus
gttttgtgcttctttcaatattggg

SEQ ID NO: 535730 - DNA, 25 bp, Rattus norvegicus
gttttgtggcaacacttcagccttt

SEQ ID NO: 535731 - DNA, 25 bp, Rattus norvegicus
gttttgtggcaagacttcagccttt

SEQ ID NO: 535732 - DNA, 25 bp, Rattus norvegicus
gttttgtggcacagggtagccctaa

SEQ ID NO: 535733 - DNA, 25 bp, Rattus norvegicus
gttttgtggcactgggtagccctaa

SEQ ID NO: 535734 - DNA, 25 bp, Rattus norvegicus
gttttgtggttcatgcctcacggac

SEQ ID NO: 535735 - DNA, 25 bp, Rattus norvegicus
gttttgtggttcttgcctcacggac

SEQ ID NO: 535736 - DNA, 25 bp, Rattus norvegicus
gttttgtggtttctaactcccattg

SEQ ID NO: 535737 - DNA, 25 bp, Rattus norvegicus
gttttgtggtttgtaactcccattg

SEQ ID NO: 535738 - DNA, 25 bp, Rattus norvegicus
gttttgtgtaatactgccagcccat

SEQ ID NO: 535739 - DNA, 25 bp, Rattus norvegicus
gttttgtgtaattctgccagcccat

SEQ ID NO: 535740 - DNA, 25 bp, Rattus norvegicus
gttttgtgtcaacccgagctcatgg

SEQ ID NO: 535741 - DNA, 25 bp, Rattus norvegicus
gttttgtgtcaagccgagctcatgg

SEQ ID NO: 535742 - DNA, 25 bp, Rattus norvegicus
gttttgtgtgaaactaaccggactt

SEQ ID NO: 535743 - DNA, 25 bp, Rattus norvegicus
gttttgtgtgaatctaaccggactt

SEQ ID NO: 535744 - DNA, 25 bp, Rattus norvegicus
gttttgtgttagcagcggaaaaaat

SEQ ID NO: 535745 - DNA, 25 bp, Rattus norvegicus
gttttgtgttaggagcggaaaaaat

SEQ ID NO: 535746 - DNA, 25 bp, Rattus norvegicus
gttttgttaactactccacacttca

SEQ ID NO: 535747 - DNA, 25 bp, Rattus norvegicus
gttttgttaacttctccacacttca

SEQ ID NO: 535748 - DNA, 25 bp, Rattus norvegicus
gttttgttaatcatgtagcccaggc

SEQ ID NO: 535749 - DNA, 25 bp, Rattus norvegicus
gttttgttaatcttgtagcccaggc

SEQ ID NO: 535750 - DNA, 25 bp, Rattus norvegicus
gttttgttacatcgaggtgtttcta

SEQ ID NO: 535751 - DNA, 25 bp, Rattus norvegicus
gttttgttacatggaggtgtttcta

SEQ ID NO: 535752 - DNA, 25 bp, Rattus norvegicus
gttttgttcagtctgttgcacctat

SEQ ID NO: 535753 - DNA, 25 bp, Rattus norvegicus
gttttgttcagtgtgttgcacctat

SEQ ID NO: 535754 - DNA, 25 bp, Rattus norvegicus
gttttgttccacagatctacccatt

SEQ ID NO: 535755 - DNA, 25 bp, Rattus norvegicus
gttttgttccactgatctacccatt

SEQ ID NO: 535756 - DNA, 25 bp, Rattus norvegicus
gttttgttctaaagcccatttcagt

SEQ ID NO: 535757 - DNA, 25 bp, Rattus norvegicus
gttttgttctaatgcccatttcagt

SEQ ID NO: 535758 - DNA, 25 bp, Rattus norvegicus
gttttgttctatccttagactggaa

SEQ ID NO: 535759 - DNA, 25 bp, Rattus norvegicus
gttttgttctatgcttagactggaa

SEQ ID NO: 535760 - DNA, 25 bp, Rattus norvegicus
gttttgttctgtatctgaagcaaaa

SEQ ID NO: 535761 - DNA, 25 bp, Rattus norvegicus
gttttgttctgtttctgaagcaaaa

SEQ ID NO: 535762 - DNA, 25 bp, Rattus norvegicus
gttttgttgcaaacttgtaccaaat

SEQ ID NO: 535763 - DNA, 25 bp, Rattus norvegicus
gttttgttgcaatcttgtaccaaat

SEQ ID NO: 535764 - DNA, 25 bp, Rattus norvegicus
gttttgttgcttaacgtgtccttgt

SEQ ID NO: 535765 - DNA, 25 bp, Rattus norvegicus
gttttgttgctttacgtgtccttgt

SEQ ID NO: 535766 - DNA, 25 bp, Rattus norvegicus
gttttgttggctctttccacattta

SEQ ID NO: 535767 - DNA, 25 bp, Rattus norvegicus
gttttgttggctgtttccacattta

SEQ ID NO: 535768 - DNA, 25 bp, Rattus norvegicus
gttttgttgttaagactcttgtgtc

SEQ ID NO: 535769 - DNA, 25 bp, Rattus norvegicus
gttttgttgttatgactcttgtgtc

SEQ ID NO: 535770 - DNA, 25 bp, Rattus norvegicus
gttttgtttacaatctctcaggcct

SEQ ID NO: 535771 - DNA, 25 bp, Rattus norvegicus
gttttgtttacattctctcaggcct

SEQ ID NO: 535772 - DNA, 25 bp, Rattus norvegicus
gttttgtttcaaattggatccccat

SEQ ID NO: 535773 - DNA, 25 bp, Rattus norvegicus
gttttgtttcaacccagactgacca

SEQ ID NO: 535774 - DNA, 25 bp, Rattus norvegicus
gttttgtttcaagccagactgacca

SEQ ID NO: 535775 - DNA, 25 bp, Rattus norvegicus
gttttgtttcaatttggatccccat

SEQ ID NO: 535776 - DNA, 25 bp, Rattus norvegicus
gttttgtttgctatgactcaaggtc

SEQ ID NO: 535777 - DNA, 25 bp, Rattus norvegicus
gttttgtttgctttgactcaaggtc

SEQ ID NO: 535778 - DNA, 25 bp, Rattus norvegicus
gttttgttttcaacttccctggcac

SEQ ID NO: 535779 - DNA, 25 bp, Rattus norvegicus
gttttgttttcatcttccctggcac

SEQ ID NO: 535780 - DNA, 25 bp, Rattus norvegicus
gttttgttttccagtggacgccgag

SEQ ID NO: 535781 - DNA, 25 bp, Rattus norvegicus
gttttgttttcctgtggacgccgag

SEQ ID NO: 535782 - DNA, 25 bp, Rattus norvegicus
gttttgttttctcctgacttctgac

SEQ ID NO: 535783 - DNA, 25 bp, Rattus norvegicus
gttttgttttctgctgacttctgac

SEQ ID NO: 535784 - DNA, 25 bp, Rattus norvegicus
gttttgttttgaagagactcctctc

SEQ ID NO: 535785 - DNA, 25 bp, Rattus norvegicus
gttttgttttgatgagactcctctc

SEQ ID NO: 535786 - DNA, 25 bp, Rattus norvegicus
gttttgttttgcaggcagacaagct

SEQ ID NO: 535787 - DNA, 25 bp, Rattus norvegicus
gttttgttttgctggcagacaagct

SEQ ID NO: 535788 - DNA, 25 bp, Rattus norvegicus
gttttgttttgtcgacccgcctgag

SEQ ID NO: 535789 - DNA, 25 bp, Rattus norvegicus
gttttgttttgtggacccgcctgag

SEQ ID NO: 535790 - DNA, 25 bp, Rattus norvegicus
gtttttaaacaaagcagccctcaga

SEQ ID NO: 535791 - DNA, 25 bp, Rattus norvegicus
gtttttaaacaatgcagccctcaga

SEQ ID NO: 535792 - DNA, 25 bp, Rattus norvegicus
gtttttaaacacacactctccatct

SEQ ID NO: 535793 - DNA, 25 bp, Rattus norvegicus
gtttttaaacaccagcgacccagca

SEQ ID NO: 535794 - DNA, 25 bp, Rattus norvegicus
gtttttaaacacgagcgacccagca

SEQ ID NO: 535795 - DNA, 25 bp, Rattus norvegicus
gtttttaaacactcactctccatct

SEQ ID NO: 535796 - DNA, 25 bp, Rattus norvegicus
gtttttaaatctagtcacgggacat

SEQ ID NO: 535797 - DNA, 25 bp, Rattus norvegicus
gtttttaaatctctgctattctggg

SEQ ID NO: 535798 - DNA, 25 bp, Rattus norvegicus
gtttttaaatctgtgctattctggg

SEQ ID NO: 535799 - DNA, 25 bp, Rattus norvegicus
gtttttaaatcttgtcacgggacat

SEQ ID NO: 535800 - DNA, 25 bp, Rattus norvegicus
gtttttaaccctcagagaactctca

SEQ ID NO: 535801 - DNA, 25 bp, Rattus norvegicus
gtttttaaccctgagagaactctca

SEQ ID NO: 535802 - DNA, 25 bp, Rattus norvegicus
gtttttaactgtacagtggcagcaa

SEQ ID NO: 535803 - DNA, 25 bp, Rattus norvegicus
gtttttaactgttcagtggcagcaa

SEQ ID NO: 535804 - DNA, 25 bp, Rattus norvegicus
gtttttaagagccatgtccacccat

SEQ ID NO: 535805 - DNA, 25 bp, Rattus norvegicus
gtttttaagagcgatgtccacccat

SEQ ID NO: 535806 - DNA, 25 bp, Rattus norvegicus
gtttttaagatccttgcatcctgac

SEQ ID NO: 535807 - DNA, 25 bp, Rattus norvegicus
gtttttaagatcgttgcatcctgac

SEQ ID NO: 535808 - DNA, 25 bp, Rattus norvegicus
gtttttaagcaaaatgaggccacct

SEQ ID NO: 535809 - DNA, 25 bp, Rattus norvegicus
gtttttaagcaatatgaggccacct

SEQ ID NO: 535810 - DNA, 25 bp, Rattus norvegicus
gtttttaaggacctcctgctgcaga

SEQ ID NO: 535811 - DNA, 25 bp, Rattus norvegicus
gtttttaaggacgtcctgctgcaga

SEQ ID NO: 535812 - DNA, 25 bp, Rattus norvegicus
gtttttaaggctcatctcactttcc

SEQ ID NO: 535813 - DNA, 25 bp, Rattus norvegicus
gtttttaaggctgatctcactttcc

SEQ ID NO: 535814 - DNA, 25 bp, Rattus norvegicus
gtttttaagtgcctgtcattctgaa

SEQ ID NO: 535815 - DNA, 25 bp, Rattus norvegicus
gtttttaagtgcgtgtcattctgaa

SEQ ID NO: 535816 - DNA, 25 bp, Rattus norvegicus
gtttttaagtttaccatccagtgct

SEQ ID NO: 535817 - DNA, 25 bp, Rattus norvegicus
gtttttaagttttccatccagtgct

SEQ ID NO: 535818 - DNA, 25 bp, Rattus norvegicus
gtttttaatatcaactctcttggcg

SEQ ID NO: 535819 - DNA, 25 bp, Rattus norvegicus
gtttttaatatctactctcttggcg

SEQ ID NO: 535820 - DNA, 25 bp, Rattus norvegicus
gtttttaattgtctcaaaggccaag

SEQ ID NO: 535821 - DNA, 25 bp, Rattus norvegicus
gtttttaattgtgtcaaaggccaag

SEQ ID NO: 535822 - DNA, 25 bp, Rattus norvegicus
gtttttacaaaaccttgctggatgg

SEQ ID NO: 535823 - DNA, 25 bp, Rattus norvegicus
gtttttacaaaagcttgctggatgg

SEQ ID NO: 535824 - DNA, 25 bp, Rattus norvegicus
gtttttacaaagaatttccctgatg

SEQ ID NO: 535825 - DNA, 25 bp, Rattus norvegicus
gtttttacaaagtatttccctgatg

SEQ ID NO: 535826 - DNA, 25 bp, Rattus norvegicus
gtttttacaacaatcctttctgcag

SEQ ID NO: 535827 - DNA, 25 bp, Rattus norvegicus
gtttttacaacattcctttctgcag

SEQ ID NO: 535828 - DNA, 25 bp, Rattus norvegicus
gtttttacatagacaaccatctgtg

SEQ ID NO: 535829 - DNA, 25 bp, Rattus norvegicus
gtttttacatagtcaaccatctgtg

SEQ ID NO: 535830 - DNA, 25 bp, Rattus norvegicus
gtttttacatgcatatacctctcag

SEQ ID NO: 535831 - DNA, 25 bp, Rattus norvegicus
gtttttacatgcttatacctctcag

SEQ ID NO: 535832 - DNA, 25 bp, Rattus norvegicus
gtttttaccaagaccatgtgcgaat

SEQ ID NO: 535833 - DNA, 25 bp, Rattus norvegicus
gtttttaccaagtccatgtgcgaat

SEQ ID NO: 535834 - DNA, 25 bp, Rattus norvegicus
gtttttaccactcttcttagctttg

SEQ ID NO: 535835 - DNA, 25 bp, Rattus norvegicus
gtttttaccactgttcttagctttg

SEQ ID NO: 535836 - DNA, 25 bp, Rattus norvegicus
gtttttaccagcacttgtgcaatga

SEQ ID NO: 535837 - DNA, 25 bp, Rattus norvegicus
gtttttaccagctcttgtgcaatga

SEQ ID NO: 535838 - DNA, 25 bp, Rattus norvegicus
gtttttaccccacattcattcactg

SEQ ID NO: 535839 - DNA, 25 bp, Rattus norvegicus
gtttttaccccagattcattcactg

SEQ ID NO: 535840 - DNA, 25 bp, Rattus norvegicus
gtttttacccgacgaatgccaagca

SEQ ID NO: 535841 - DNA, 25 bp, Rattus norvegicus
gtttttacccgaggaatgccaagca

SEQ ID NO: 535842 - DNA, 25 bp, Rattus norvegicus
gtttttacctccaagcatatgctac

SEQ ID NO: 535843 - DNA, 25 bp, Rattus norvegicus
gtttttacctcctagcatatgctac

SEQ ID NO: 535844 - DNA, 25 bp, Rattus norvegicus
gtttttactgatcttcgtgctggcc

SEQ ID NO: 535845 - DNA, 25 bp, Rattus norvegicus
gtttttactgatgttcgtgctggcc

SEQ ID NO: 535846 - DNA, 25 bp, Rattus norvegicus
gtttttacttcactctttgtttctg

SEQ ID NO: 535847 - DNA, 25 bp, Rattus norvegicus
gtttttacttcagtctttgtttctg

SEQ ID NO: 535848 - DNA, 25 bp, Rattus norvegicus
gtttttagactaccctgaggtcact

SEQ ID NO: 535849 - DNA, 25 bp, Rattus norvegicus
gtttttagactagcctgaggtcact

SEQ ID NO: 535850 - DNA, 25 bp, Rattus norvegicus
gtttttagacttctcctggactagt

SEQ ID NO: 535851 - DNA, 25 bp, Rattus norvegicus
gtttttagacttgtcctggactagt

SEQ ID NO: 535852 - DNA, 25 bp, Rattus norvegicus
gtttttagagctctcatagtcgctt

SEQ ID NO: 535853 - DNA, 25 bp, Rattus norvegicus
gtttttagagctgtcatagtcgctt

SEQ ID NO: 535854 - DNA, 25 bp, Rattus norvegicus
gtttttagccctaagatctttgatc

SEQ ID NO: 535855 - DNA, 25 bp, Rattus norvegicus
gtttttagcccttagatctttgatc

SEQ ID NO: 535856 - DNA, 25 bp, Rattus norvegicus
gtttttagctgaagttgccctcttt

SEQ ID NO: 535857 - DNA, 25 bp, Rattus norvegicus
gtttttagctgatgttgccctcttt

SEQ ID NO: 535858 - DNA, 25 bp, Rattus norvegicus
gtttttagtgctcacgtatacccca

SEQ ID NO: 535859 - DNA, 25 bp, Rattus norvegicus
gtttttagtgctgacgtatacccca

SEQ ID NO: 535860 - DNA, 25 bp, Rattus norvegicus
gtttttagtttgaggcttaggatgc

SEQ ID NO: 535861 - DNA, 25 bp, Rattus norvegicus
gtttttagtttgtggcttaggatgc

SEQ ID NO: 535862 - DNA, 25 bp, Rattus norvegicus
gtttttataattccctcattttgga

SEQ ID NO: 535863 - DNA, 25 bp, Rattus norvegicus
gtttttataattgcctcattttgga

SEQ ID NO: 535864 - DNA, 25 bp, Rattus norvegicus
gtttttatacaaagggactcctaat

SEQ ID NO: 535865 - DNA, 25 bp, Rattus norvegicus
gtttttatacaatgggactcctaat

SEQ ID NO: 535866 - DNA, 25 bp, Rattus norvegicus
gtttttatactccacatgctgcttg

SEQ ID NO: 535867 - DNA, 25 bp, Rattus norvegicus
gtttttatactcgacatgctgcttg

SEQ ID NO: 535868 - DNA, 25 bp, Rattus norvegicus
gtttttatcagtacctgtccagaca

SEQ ID NO: 535869 - DNA, 25 bp, Rattus norvegicus
gtttttatcagttcctgtccagaca

SEQ ID NO: 535870 - DNA, 25 bp, Rattus norvegicus
gtttttatcattaccgtagctcagt

SEQ ID NO: 535871 - DNA, 25 bp, Rattus norvegicus
gtttttatcatttccgtagctcagt

SEQ ID NO: 535872 - DNA, 25 bp, Rattus norvegicus
gtttttatccagaaagcgcaggcca

SEQ ID NO: 535873 - DNA, 25 bp, Rattus norvegicus
gtttttatccagcacacatgatgct

SEQ ID NO: 535874 - DNA, 25 bp, Rattus norvegicus
gtttttatccaggacacatgatgct

SEQ ID NO: 535875 - DNA, 25 bp, Rattus norvegicus
gtttttatccagtaagcgcaggcca

SEQ ID NO: 535876 - DNA, 25 bp, Rattus norvegicus
gtttttatctacctcttagcagaac

SEQ ID NO: 535877 - DNA, 25 bp, Rattus norvegicus
gtttttatctacgtcttagcagaac

SEQ ID NO: 535878 - DNA, 25 bp, Rattus norvegicus
gtttttatgtctcgacggctctgac

SEQ ID NO: 535879 - DNA, 25 bp, Rattus norvegicus
gtttttatgtctggacggctctgac

SEQ ID NO: 535880 - DNA, 25 bp, Rattus norvegicus
gtttttattactagactttgcccat

SEQ ID NO: 535881 - DNA, 25 bp, Rattus norvegicus
gtttttattacttgactttgcccat

SEQ ID NO: 535882 - DNA, 25 bp, Rattus norvegicus
gtttttattgcaatctgtagtgcca

SEQ ID NO: 535883 - DNA, 25 bp, Rattus norvegicus
gtttttattgcattctgtagtgcca

SEQ ID NO: 535884 - DNA, 25 bp, Rattus norvegicus
gtttttatttaacttggccaatcag

SEQ ID NO: 535885 - DNA, 25 bp, Rattus norvegicus
gtttttatttaagttggccaatcag

SEQ ID NO: 535886 - DNA, 25 bp, Rattus norvegicus
gtttttatttacagttgctcttcaa

SEQ ID NO: 535887 - DNA, 25 bp, Rattus norvegicus
gtttttatttactgttgctcttcaa

SEQ ID NO: 535888 - DNA, 25 bp, Rattus norvegicus
gtttttcaaatacctggcattcatc

SEQ ID NO: 535889 - DNA, 25 bp, Rattus norvegicus
gtttttcaaatagctggcattcatc

SEQ ID NO: 535890 - DNA, 25 bp, Rattus norvegicus
gtttttcaactgacacggcagggtc

SEQ ID NO: 535891 - DNA, 25 bp, Rattus norvegicus
gtttttcaactgtcacggcagggtc

SEQ ID NO: 535892 - DNA, 25 bp, Rattus norvegicus
gtttttcaaggtatgatttcatctc

SEQ ID NO: 535893 - DNA, 25 bp, Rattus norvegicus
gtttttcaaggtttgatttcatctc

SEQ ID NO: 535894 - DNA, 25 bp, Rattus norvegicus
gtttttcaatgtatcctgacaccca

SEQ ID NO: 535895 - DNA, 25 bp, Rattus norvegicus
gtttttcaatgtttcctgacaccca

SEQ ID NO: 535896 - DNA, 25 bp, Rattus norvegicus
gtttttcacactatgattgctggca

SEQ ID NO: 535897 - DNA, 25 bp, Rattus norvegicus
gtttttcacactttgattgctggca

SEQ ID NO: 535898 - DNA, 25 bp, Rattus norvegicus
gtttttcagacaaggtctcatcgcc

SEQ ID NO: 535899 - DNA, 25 bp, Rattus norvegicus
gtttttcagacatggtctcatcgcc

SEQ ID NO: 535900 - DNA, 25 bp, Rattus norvegicus
gtttttcagcaaagagtcctcagca

SEQ ID NO: 535901 - DNA, 25 bp, Rattus norvegicus
gtttttcagcaatgagtcctcagca

SEQ ID NO: 535902 - DNA, 25 bp, Rattus norvegicus
gtttttcagcctatcccacaggaaa

SEQ ID NO: 535903 - DNA, 25 bp, Rattus norvegicus
gtttttcagcctttcccacaggaaa

SEQ ID NO: 535904 - DNA, 25 bp, Rattus norvegicus
gtttttcaggcgagctgtgtgagca

SEQ ID NO: 535905 - DNA, 25 bp, Rattus norvegicus
gtttttcaggcgtgctgtgtgagca

SEQ ID NO: 535906 - DNA, 25 bp, Rattus norvegicus
gtttttcatactctactgtgcactt

SEQ ID NO: 535907 - DNA, 25 bp, Rattus norvegicus
gtttttcatactgtactgtgcactt

SEQ ID NO: 535908 - DNA, 25 bp, Rattus norvegicus
gtttttcatagccttgactccattt

SEQ ID NO: 535909 - DNA, 25 bp, Rattus norvegicus
gtttttcatagcgttgactccattt

SEQ ID NO: 535910 - DNA, 25 bp, Rattus norvegicus
gtttttcatatgctggtaccttctt

SEQ ID NO: 535911 - DNA, 25 bp, Rattus norvegicus
gtttttcatatggtggtaccttctt

SEQ ID NO: 535912 - DNA, 25 bp, Rattus norvegicus
gtttttcatcaaccactcagaggcc

SEQ ID NO: 535913 - DNA, 25 bp, Rattus norvegicus
gtttttcatcaagcactcagaggcc

SEQ ID NO: 535914 - DNA, 25 bp, Rattus norvegicus
gtttttcatctactctgttctcaga

SEQ ID NO: 535915 - DNA, 25 bp, Rattus norvegicus
gtttttcatctagtctgttctcaga

SEQ ID NO: 535916 - DNA, 25 bp, Rattus norvegicus
gtttttcatgcaactcatattctct

SEQ ID NO: 535917 - DNA, 25 bp, Rattus norvegicus
gtttttcatgcatctcatattctct

SEQ ID NO: 535918 - DNA, 25 bp, Rattus norvegicus
gtttttccaatccactgggtactgt

SEQ ID NO: 535919 - DNA, 25 bp, Rattus norvegicus
gtttttccaatcgactgggtactgt

SEQ ID NO: 535920 - DNA, 25 bp, Rattus norvegicus
gtttttccaatgattcaggtgtcca

SEQ ID NO: 535921 - DNA, 25 bp, Rattus norvegicus
gtttttccaatgatttttacactat

SEQ ID NO: 535922 - DNA, 25 bp, Rattus norvegicus
gtttttccaatgtttcaggtgtcca

SEQ ID NO: 535923 - DNA, 25 bp, Rattus norvegicus
gtttttccaatgttttttacactat

SEQ ID NO: 535924 - DNA, 25 bp, Rattus norvegicus
gtttttccaggaagcagtctcacat

SEQ ID NO: 535925 - DNA, 25 bp, Rattus norvegicus
gtttttccaggatgcagtctcacat

SEQ ID NO: 535926 - DNA, 25 bp, Rattus norvegicus
gtttttccatctattatgaactcga

SEQ ID NO: 535927 - DNA, 25 bp, Rattus norvegicus
gtttttccatcttttatgaactcga

SEQ ID NO: 535928 - DNA, 25 bp, Rattus norvegicus
gtttttccattgataacatcagttc

SEQ ID NO: 535929 - DNA, 25 bp, Rattus norvegicus
gtttttccattgttaacatcagttc

SEQ ID NO: 535930 - DNA, 25 bp, Rattus norvegicus
gtttttcccacactcgtgttcttca

SEQ ID NO: 535931 - DNA, 25 bp, Rattus norvegicus
gtttttcccacagtcgtgttcttca

SEQ ID NO: 535932 - DNA, 25 bp, Rattus norvegicus
gtttttcccacgacatgatactgta

SEQ ID NO: 535933 - DNA, 25 bp, Rattus norvegicus
gtttttcccacgtcatgatactgta

SEQ ID NO: 535934 - DNA, 25 bp, Rattus norvegicus
gtttttcccatcacattgacacttt

SEQ ID NO: 535935 - DNA, 25 bp, Rattus norvegicus
gtttttcccatctcattgacacttt

SEQ ID NO: 535936 - DNA, 25 bp, Rattus norvegicus
gtttttccccatattcttctaacat

SEQ ID NO: 535937 - DNA, 25 bp, Rattus norvegicus
gtttttccccattttcttctaacat

SEQ ID NO: 535938 - DNA, 25 bp, Rattus norvegicus
gtttttccctctaggtgcatgtaaa

SEQ ID NO: 535939 - DNA, 25 bp, Rattus norvegicus
gtttttccctcttggtgcatgtaaa

SEQ ID NO: 535940 - DNA, 25 bp, Rattus norvegicus
gtttttccgaataagcatcttcctg

SEQ ID NO: 535941 - DNA, 25 bp, Rattus norvegicus
gtttttccgaattagcatcttcctg

SEQ ID NO: 535942 - DNA, 25 bp, Rattus norvegicus
gtttttccgactcatgatagcaggg

SEQ ID NO: 535943 - DNA, 25 bp, Rattus norvegicus
gtttttccgactgatgatagcaggg

SEQ ID NO: 535944 - DNA, 25 bp, Rattus norvegicus
gtttttccgcagaaggctgagccag

SEQ ID NO: 535945 - DNA, 25 bp, Rattus norvegicus
gtttttccgcagtaggctgagccag

SEQ ID NO: 535946 - DNA, 25 bp, Rattus norvegicus
gtttttccgcttatgcagtatcatg

SEQ ID NO: 535947 - DNA, 25 bp, Rattus norvegicus
gtttttccgcttttgcagtatcatg

SEQ ID NO: 535948 - DNA, 25 bp, Rattus norvegicus
gtttttcctaacagtcatctacggt

SEQ ID NO: 535949 - DNA, 25 bp, Rattus norvegicus
gtttttcctaactgtcatctacggt

SEQ ID NO: 535950 - DNA, 25 bp, Rattus norvegicus
gtttttcctacactgcaatctcagc

SEQ ID NO: 535951 - DNA, 25 bp, Rattus norvegicus
gtttttcctacagtgcaatctcagc

SEQ ID NO: 535952 - DNA, 25 bp, Rattus norvegicus
gtttttcctaccatattcctgacaa

SEQ ID NO: 535953 - DNA, 25 bp, Rattus norvegicus
gtttttcctaccttattcctgacaa

SEQ ID NO: 535954 - DNA, 25 bp, Rattus norvegicus
gtttttcctatgaacttcattaaag

SEQ ID NO: 535955 - DNA, 25 bp, Rattus norvegicus
gtttttcctatgtacttcattaaag

SEQ ID NO: 535956 - DNA, 25 bp, Rattus norvegicus
gtttttcctcataagatagtcactg

SEQ ID NO: 535957 - DNA, 25 bp, Rattus norvegicus
gtttttcctcattagatagtcactg

SEQ ID NO: 535958 - DNA, 25 bp, Rattus norvegicus
gtttttcctcgtaatttgtatcact

SEQ ID NO: 535959 - DNA, 25 bp, Rattus norvegicus
gtttttcctcgttatttgtatcact

SEQ ID NO: 535960 - DNA, 25 bp, Rattus norvegicus
gtttttcctctcctaagggcttgat

SEQ ID NO: 535961 - DNA, 25 bp, Rattus norvegicus
gtttttcctctcgtaagggcttgat

SEQ ID NO: 535962 - DNA, 25 bp, Rattus norvegicus
gtttttcctgaaccatagcagtgat

SEQ ID NO: 535963 - DNA, 25 bp, Rattus norvegicus
gtttttcctgaagcatagcagtgat

SEQ ID NO: 535964 - DNA, 25 bp, Rattus norvegicus
gtttttcctgtgagatgcatgtgct

SEQ ID NO: 535965 - DNA, 25 bp, Rattus norvegicus
gtttttcctgtgtgatgcatgtgct

SEQ ID NO: 535966 - DNA, 25 bp, Rattus norvegicus
gtttttccttagcacatagatcata

SEQ ID NO: 535967 - DNA, 25 bp, Rattus norvegicus
gtttttccttaggacatagatcata

SEQ ID NO: 535968 - DNA, 25 bp, Rattus norvegicus
gtttttcgaaatcttgatgctcagt

SEQ ID NO: 535969 - DNA, 25 bp, Rattus norvegicus
gtttttcgaaatgttgatgctcagt

SEQ ID NO: 535970 - DNA, 25 bp, Rattus norvegicus
gtttttcgctccaggatccaagcat

SEQ ID NO: 535971 - DNA, 25 bp, Rattus norvegicus
gtttttcgctcctggatccaagcat

SEQ ID NO: 535972 - DNA, 25 bp, Rattus norvegicus
gtttttcgctttcttttgatgccca

SEQ ID NO: 535973 - DNA, 25 bp, Rattus norvegicus
gtttttcgctttgttttgatgccca

SEQ ID NO: 535974 - DNA, 25 bp, Rattus norvegicus
gtttttcgtaggcttcatacagcag

SEQ ID NO: 535975 - DNA, 25 bp, Rattus norvegicus
gtttttcgtagggttcatacagcag

SEQ ID NO: 535976 - DNA, 25 bp, Rattus norvegicus
gtttttcgttttctatgtggctgac

SEQ ID NO: 535977 - DNA, 25 bp, Rattus norvegicus
gtttttcgttttgtatgtggctgac

SEQ ID NO: 535978 - DNA, 25 bp, Rattus norvegicus
gtttttctaagacagctcaatggct

SEQ ID NO: 535979 - DNA, 25 bp, Rattus norvegicus
gtttttctaagagagctcaatggct

SEQ ID NO: 535980 - DNA, 25 bp, Rattus norvegicus
gtttttctaagtacaggatggacac

SEQ ID NO: 535981 - DNA, 25 bp, Rattus norvegicus
gtttttctaagttcaggatggacac

SEQ ID NO: 535982 - DNA, 25 bp, Rattus norvegicus
gtttttctaatcctgttatctcctg

SEQ ID NO: 535983 - DNA, 25 bp, Rattus norvegicus
gtttttctaatcgtgttatctcctg

SEQ ID NO: 535984 - DNA, 25 bp, Rattus norvegicus
gtttttctacaccttaagtcatgtt

SEQ ID NO: 535985 - DNA, 25 bp, Rattus norvegicus
gtttttctacacgttaagtcatgtt

SEQ ID NO: 535986 - DNA, 25 bp, Rattus norvegicus
gtttttctacctctgtattttatgc

SEQ ID NO: 535987 - DNA, 25 bp, Rattus norvegicus
gtttttctacctgtgtattttatgc

SEQ ID NO: 535988 - DNA, 25 bp, Rattus norvegicus
gtttttctactcaatgtgctgctgc

SEQ ID NO: 535989 - DNA, 25 bp, Rattus norvegicus
gtttttctactctatgtgctgctgc

SEQ ID NO: 535990 - DNA, 25 bp, Rattus norvegicus
gtttttctagctcttgttgatcatc

SEQ ID NO: 535991 - DNA, 25 bp, Rattus norvegicus
gtttttctagctgttgttgatcatc

SEQ ID NO: 535992 - DNA, 25 bp, Rattus norvegicus
gtttttctagggaccagacacccag

SEQ ID NO: 535993 - DNA, 25 bp, Rattus norvegicus
gtttttctagggtccagacacccag

SEQ ID NO: 535994 - DNA, 25 bp, Rattus norvegicus
gtttttctagtccaagccctgacaa

SEQ ID NO: 535995 - DNA, 25 bp, Rattus norvegicus
gtttttctagtcgaagccctgacaa

SEQ ID NO: 535996 - DNA, 25 bp, Rattus norvegicus
gtttttctatctccttgtcttattt

SEQ ID NO: 535997 - DNA, 25 bp, Rattus norvegicus
gtttttctatctgcttgtcttattt

SEQ ID NO: 535998 - DNA, 25 bp, Rattus norvegicus
gtttttctcactagcattcattctg

SEQ ID NO: 535999 - DNA, 25 bp, Rattus norvegicus
gtttttctcacttgcattcattctg

SEQ ID NO: 536000 - DNA, 25 bp, Rattus norvegicus
gtttttctccaaaggacagaagcat

SEQ ID NO: 536001 - DNA, 25 bp, Rattus norvegicus
gtttttctccaatggacagaagcat

SEQ ID NO: 536002 - DNA, 25 bp, Rattus norvegicus
gtttttctccagataaccagtgtct

SEQ ID NO: 536003 - DNA, 25 bp, Rattus norvegicus
gtttttctccagttaaccagtgtct

SEQ ID NO: 536004 - DNA, 25 bp, Rattus norvegicus
gtttttctctcaactctggaagact

SEQ ID NO: 536005 - DNA, 25 bp, Rattus norvegicus
gtttttctctcatctctggaagact

SEQ ID NO: 536006 - DNA, 25 bp, Rattus norvegicus
gtttttctctcccaataagtctttg

SEQ ID NO: 536007 - DNA, 25 bp, Rattus norvegicus
gtttttctctccgaataagtctttg

SEQ ID NO: 536008 - DNA, 25 bp, Rattus norvegicus
gtttttctctcgcatactgtgattt

SEQ ID NO: 536009 - DNA, 25 bp, Rattus norvegicus
gtttttctctcggatactgtgattt

SEQ ID NO: 536010 - DNA, 25 bp, Rattus norvegicus
gtttttctctgccaagctgaagtca

SEQ ID NO: 536011 - DNA, 25 bp, Rattus norvegicus
gtttttctctgcgaagctgaagtca

SEQ ID NO: 536012 - DNA, 25 bp, Rattus norvegicus
gtttttctgcccctagataactatg

SEQ ID NO: 536013 - DNA, 25 bp, Rattus norvegicus
gtttttctgcccgtagataactatg

SEQ ID NO: 536014 - DNA, 25 bp, Rattus norvegicus
gtttttctgcctctgaacttgtgag

SEQ ID NO: 536015 - DNA, 25 bp, Rattus norvegicus
gtttttctgcctgtgaacttgtgag

SEQ ID NO: 536016 - DNA, 25 bp, Rattus norvegicus
gtttttctgcttacaatggcttgca

SEQ ID NO: 536017 - DNA, 25 bp, Rattus norvegicus
gtttttctgcttcttttagtcacca

SEQ ID NO: 536018 - DNA, 25 bp, Rattus norvegicus
gtttttctgcttgttttagtcacca

SEQ ID NO: 536019 - DNA, 25 bp, Rattus norvegicus
gtttttctgctttcaatggcttgca

SEQ ID NO: 536020 - DNA, 25 bp, Rattus norvegicus
gtttttcttcatattagttgcatgt

SEQ ID NO: 536021 - DNA, 25 bp, Rattus norvegicus
gtttttcttcattttagttgcatgt

SEQ ID NO: 536022 - DNA, 25 bp, Rattus norvegicus
gtttttcttccacacagagttgcag

SEQ ID NO: 536023 - DNA, 25 bp, Rattus norvegicus
gtttttcttccagacagagttgcag

SEQ ID NO: 536024 - DNA, 25 bp, Rattus norvegicus
gtttttcttggtaacaattacagca

SEQ ID NO: 536025 - DNA, 25 bp, Rattus norvegicus
gtttttcttggttacaattacagca

SEQ ID NO: 536026 - DNA, 25 bp, Rattus norvegicus
gtttttctttcaacagatctagcaa

SEQ ID NO: 536027 - DNA, 25 bp, Rattus norvegicus
gtttttctttcatcagatctagcaa

SEQ ID NO: 536028 - DNA, 25 bp, Rattus norvegicus
gtttttctttctcagaccctagcac

SEQ ID NO: 536029 - DNA, 25 bp, Rattus norvegicus
gtttttctttctcttgtcaaggctc

SEQ ID NO: 536030 - DNA, 25 bp, Rattus norvegicus
gtttttctttctgagaccctagcac

SEQ ID NO: 536031 - DNA, 25 bp, Rattus norvegicus
gtttttctttctgttgtcaaggctc

SEQ ID NO: 536032 - DNA, 25 bp, Rattus norvegicus
gtttttgaacagagctcattccctt

SEQ ID NO: 536033 - DNA, 25 bp, Rattus norvegicus
gtttttgaacagtgctcattccctt

SEQ ID NO: 536034 - DNA, 25 bp, Rattus norvegicus
gtttttgaaggtatcatcactttga

SEQ ID NO: 536035 - DNA, 25 bp, Rattus norvegicus
gtttttgaaggtttcatcactttga

SEQ ID NO: 536036 - DNA, 25 bp, Rattus norvegicus
gtttttgaagtaacagtgtgacaga

SEQ ID NO: 536037 - DNA, 25 bp, Rattus norvegicus
gtttttgaagtatcagtgtgacaga

SEQ ID NO: 536038 - DNA, 25 bp, Rattus norvegicus
gtttttgacaagatgcccttggcca

SEQ ID NO: 536039 - DNA, 25 bp, Rattus norvegicus
gtttttgacaagttgcccttggcca

SEQ ID NO: 536040 - DNA, 25 bp, Rattus norvegicus
gtttttgaccacagatgaccctgag

SEQ ID NO: 536041 - DNA, 25 bp, Rattus norvegicus
gtttttgaccactgatgaccctgag

SEQ ID NO: 536042 - DNA, 25 bp, Rattus norvegicus
gtttttgactcaattaccatagcac

SEQ ID NO: 536043 - DNA, 25 bp, Rattus norvegicus
gtttttgactcatttaccatagcac

SEQ ID NO: 536044 - DNA, 25 bp, Rattus norvegicus
gtttttgagatgagcctaccctttc

SEQ ID NO: 536045 - DNA, 25 bp, Rattus norvegicus
gtttttgagatgtgcctaccctttc

SEQ ID NO: 536046 - DNA, 25 bp, Rattus norvegicus
gtttttgagctgaaagtgaccttag

SEQ ID NO: 536047 - DNA, 25 bp, Rattus norvegicus
gtttttgagctgtaagtgaccttag

SEQ ID NO: 536048 - DNA, 25 bp, Rattus norvegicus
gtttttgatcaccttatcttgccta

SEQ ID NO: 536049 - DNA, 25 bp, Rattus norvegicus
gtttttgatcacgttatcttgccta

SEQ ID NO: 536050 - DNA, 25 bp, Rattus norvegicus
gtttttgatgaaatgggctccctgt

SEQ ID NO: 536051 - DNA, 25 bp, Rattus norvegicus
gtttttgatgaattgggctccctgt

SEQ ID NO: 536052 - DNA, 25 bp, Rattus norvegicus
gtttttgatgtcaagcactgctcat

SEQ ID NO: 536053 - DNA, 25 bp, Rattus norvegicus
gtttttgatgtctagcactgctcat

SEQ ID NO: 536054 - DNA, 25 bp, Rattus norvegicus
gtttttgattctcttctcaccttta

SEQ ID NO: 536055 - DNA, 25 bp, Rattus norvegicus
gtttttgattctgttctcaccttta

SEQ ID NO: 536056 - DNA, 25 bp, Rattus norvegicus
gtttttgcaagaagactcctagaaa

SEQ ID NO: 536057 - DNA, 25 bp, Rattus norvegicus
gtttttgcaagatgactcctagaaa

SEQ ID NO: 536058 - DNA, 25 bp, Rattus norvegicus
gtttttgcagaaatccttacggtgt

SEQ ID NO: 536059 - DNA, 25 bp, Rattus norvegicus
gtttttgcagaattccttacggtgt

SEQ ID NO: 536060 - DNA, 25 bp, Rattus norvegicus
gtttttgcagatcacatttctttga

SEQ ID NO: 536061 - DNA, 25 bp, Rattus norvegicus
gtttttgcagatgacatttctttga

SEQ ID NO: 536062 - DNA, 25 bp, Rattus norvegicus
gtttttgcagcaaagactggactaa

SEQ ID NO: 536063 - DNA, 25 bp, Rattus norvegicus
gtttttgcagcatagactggactaa

SEQ ID NO: 536064 - DNA, 25 bp, Rattus norvegicus
gtttttgcaggcatctccaagagaa

SEQ ID NO: 536065 - DNA, 25 bp, Rattus norvegicus
gtttttgcaggcttctccaagagaa

SEQ ID NO: 536066 - DNA, 25 bp, Rattus norvegicus
gtttttgcagtcaggacacggaaat

SEQ ID NO: 536067 - DNA, 25 bp, Rattus norvegicus
gtttttgcagtcagggaccgcagtc

SEQ ID NO: 536068 - DNA, 25 bp, Rattus norvegicus
gtttttgcagtctggacacggaaat

SEQ ID NO: 536069 - DNA, 25 bp, Rattus norvegicus
gtttttgcagtctgggaccgcagtc

SEQ ID NO: 536070 - DNA, 25 bp, Rattus norvegicus
gtttttgccctaagttctagactca

SEQ ID NO: 536071 - DNA, 25 bp, Rattus norvegicus
gtttttgccctatgttctagactca

SEQ ID NO: 536072 - DNA, 25 bp, Rattus norvegicus
gtttttgccgggaaagtcgctacat

SEQ ID NO: 536073 - DNA, 25 bp, Rattus norvegicus
gtttttgccgggtaagtcgctacat

SEQ ID NO: 536074 - DNA, 25 bp, Rattus norvegicus
gtttttgctatgctgtttactacat

SEQ ID NO: 536075 - DNA, 25 bp, Rattus norvegicus
gtttttgctatggtgtttactacat

SEQ ID NO: 536076 - DNA, 25 bp, Rattus norvegicus
gtttttgctgtaccactgaagtgaa

SEQ ID NO: 536077 - DNA, 25 bp, Rattus norvegicus
gtttttgctgtagcactgaagtgaa

SEQ ID NO: 536078 - DNA, 25 bp, Rattus norvegicus
gtttttgctgtcattttggtcattg

SEQ ID NO: 536079 - DNA, 25 bp, Rattus norvegicus
gtttttgctgtctttttggtcattg

SEQ ID NO: 536080 - DNA, 25 bp, Rattus norvegicus
gtttttggcagcagcgacatctttt

SEQ ID NO: 536081 - DNA, 25 bp, Rattus norvegicus
gtttttggcagctgcgacatctttt

SEQ ID NO: 536082 - DNA, 25 bp, Rattus norvegicus
gtttttggcagtcgctcagagctca

SEQ ID NO: 536083 - DNA, 25 bp, Rattus norvegicus
gtttttggcagtggctcagagctca

SEQ ID NO: 536084 - DNA, 25 bp, Rattus norvegicus
gtttttggcataaatcacccttagc

SEQ ID NO: 536085 - DNA, 25 bp, Rattus norvegicus
gtttttggcatatatcacccttagc

SEQ ID NO: 536086 - DNA, 25 bp, Rattus norvegicus
gtttttggctacaaactgtcacagt

SEQ ID NO: 536087 - DNA, 25 bp, Rattus norvegicus
gtttttggctactaactgtcacagt

SEQ ID NO: 536088 - DNA, 25 bp, Rattus norvegicus
gtttttgggaagctcctatcgaaca

SEQ ID NO: 536089 - DNA, 25 bp, Rattus norvegicus
gtttttgggaaggtcctatcgaaca

SEQ ID NO: 536090 - DNA, 25 bp, Rattus norvegicus
gtttttgggcaaccacccagttctg

SEQ ID NO: 536091 - DNA, 25 bp, Rattus norvegicus
gtttttgggcaagcacccagttctg

SEQ ID NO: 536092 - DNA, 25 bp, Rattus norvegicus
gtttttggggcacaagctctcttga

SEQ ID NO: 536093 - DNA, 25 bp, Rattus norvegicus
gtttttggggcagaagctctcttga

SEQ ID NO: 536094 - DNA, 25 bp, Rattus norvegicus
gtttttggtatcctgtgtactccag

SEQ ID NO: 536095 - DNA, 25 bp, Rattus norvegicus
gtttttggtatcgtgtgtactccag

SEQ ID NO: 536096 - DNA, 25 bp, Rattus norvegicus
gtttttggtctgacagggccttaca

SEQ ID NO: 536097 - DNA, 25 bp, Rattus norvegicus
gtttttggtctgtcagggccttaca

SEQ ID NO: 536098 - DNA, 25 bp, Rattus norvegicus
gtttttggtgaacacagttctctat

SEQ ID NO: 536099 - DNA, 25 bp, Rattus norvegicus
gtttttggtgaagacagttctctat

SEQ ID NO: 536100 - DNA, 25 bp, Rattus norvegicus
gtttttggttttctgaggcaagatc

SEQ ID NO: 536101 - DNA, 25 bp, Rattus norvegicus
gtttttggttttgtgaggcaagatc

SEQ ID NO: 536102 - DNA, 25 bp, Rattus norvegicus
gtttttgtactcattcatgctttat

SEQ ID NO: 536103 - DNA, 25 bp, Rattus norvegicus
gtttttgtactctttcatgctttat

SEQ ID NO: 536104 - DNA, 25 bp, Rattus norvegicus
gtttttgtagccaagacatccatct

SEQ ID NO: 536105 - DNA, 25 bp, Rattus norvegicus
gtttttgtagcctagacatccatct

SEQ ID NO: 536106 - DNA, 25 bp, Rattus norvegicus
gtttttgtagtgctgacttgtctac

SEQ ID NO: 536107 - DNA, 25 bp, Rattus norvegicus
gtttttgtagtggtgacttgtctac

SEQ ID NO: 536108 - DNA, 25 bp, Rattus norvegicus
gtttttgtatagcttgctgggacaa

SEQ ID NO: 536109 - DNA, 25 bp, Rattus norvegicus
gtttttgtataggttgctgggacaa

SEQ ID NO: 536110 - DNA, 25 bp, Rattus norvegicus
gtttttgtcaccatgtgctgaattt

SEQ ID NO: 536111 - DNA, 25 bp, Rattus norvegicus
gtttttgtcaccttgtgctgaattt

SEQ ID NO: 536112 - DNA, 25 bp, Rattus norvegicus
gtttttgtcattaggcaaacccaga

SEQ ID NO: 536113 - DNA, 25 bp, Rattus norvegicus
gtttttgtcatttggcaaacccaga

SEQ ID NO: 536114 - DNA, 25 bp, Rattus norvegicus
gtttttgtcctaagctaacattggc

SEQ ID NO: 536115 - DNA, 25 bp, Rattus norvegicus
gtttttgtcctaatctcttcaatca

SEQ ID NO: 536116 - DNA, 25 bp, Rattus norvegicus
gtttttgtcctatgctaacattggc

SEQ ID NO: 536117 - DNA, 25 bp, Rattus norvegicus
gtttttgtcctattctcttcaatca

SEQ ID NO: 536118 - DNA, 25 bp, Rattus norvegicus
gtttttgtgagcatctatactgatc

SEQ ID NO: 536119 - DNA, 25 bp, Rattus norvegicus
gtttttgtgagcttctatactgatc

SEQ ID NO: 536120 - DNA, 25 bp, Rattus norvegicus
gtttttgtgattcatccaggccatt

SEQ ID NO: 536121 - DNA, 25 bp, Rattus norvegicus
gtttttgtgattgatccaggccatt

SEQ ID NO: 536122 - DNA, 25 bp, Rattus norvegicus
gtttttgtgctgacaccttaatgca

SEQ ID NO: 536123 - DNA, 25 bp, Rattus norvegicus
gtttttgtgctgtcaccttaatgca

SEQ ID NO: 536124 - DNA, 25 bp, Rattus norvegicus
gtttttgtgtctactgtttatttat

SEQ ID NO: 536125 - DNA, 25 bp, Rattus norvegicus
gtttttgtgtcttctgtttatttat

SEQ ID NO: 536126 - DNA, 25 bp, Rattus norvegicus
gtttttgttacgctttgacactgga

SEQ ID NO: 536127 - DNA, 25 bp, Rattus norvegicus
gtttttgttacggtttgacactgga

SEQ ID NO: 536128 - DNA, 25 bp, Rattus norvegicus
gtttttgttagtcttgcatgcttaa

SEQ ID NO: 536129 - DNA, 25 bp, Rattus norvegicus
gtttttgttagtgttgcatgcttaa

SEQ ID NO: 536130 - DNA, 25 bp, Rattus norvegicus
gtttttgttattccagtccctggtc

SEQ ID NO: 536131 - DNA, 25 bp, Rattus norvegicus
gtttttgttattgcagtccctggtc

SEQ ID NO: 536132 - DNA, 25 bp, Rattus norvegicus
gtttttgttctcacagacagtctta

SEQ ID NO: 536133 - DNA, 25 bp, Rattus norvegicus
gtttttgttctctcagacagtctta

SEQ ID NO: 536134 - DNA, 25 bp, Rattus norvegicus
gtttttgttgctcagactaacccat

SEQ ID NO: 536135 - DNA, 25 bp, Rattus norvegicus
gtttttgttgctgagactaacccat

SEQ ID NO: 536136 - DNA, 25 bp, Rattus norvegicus
gtttttgtttatatgcctctagaat

SEQ ID NO: 536137 - DNA, 25 bp, Rattus norvegicus
gtttttgtttatttgcctctagaat

SEQ ID NO: 536138 - DNA, 25 bp, Rattus norvegicus
gtttttgtttctcgttgcttaaatg

SEQ ID NO: 536139 - DNA, 25 bp, Rattus norvegicus
gtttttgtttctggttgcttaaatg

SEQ ID NO: 536140 - DNA, 25 bp, Rattus norvegicus
gtttttgtttgaattcagcttcagg

SEQ ID NO: 536141 - DNA, 25 bp, Rattus norvegicus
gtttttgtttgatttcagcttcagg

SEQ ID NO: 536142 - DNA, 25 bp, Rattus norvegicus
gtttttgttttacctcatgagcaca

SEQ ID NO: 536143 - DNA, 25 bp, Rattus norvegicus
gtttttgttttagctcatgagcaca

SEQ ID NO: 536144 - DNA, 25 bp, Rattus norvegicus
gtttttgttttcacgtcatttggat

SEQ ID NO: 536145 - DNA, 25 bp, Rattus norvegicus
gtttttgttttcctccttgcttgct

SEQ ID NO: 536146 - DNA, 25 bp, Rattus norvegicus
gtttttgttttcgtccttgcttgct

SEQ ID NO: 536147 - DNA, 25 bp, Rattus norvegicus
gtttttgttttctcgtcatttggat

SEQ ID NO: 536148 - DNA, 25 bp, Rattus norvegicus
gttttttaactcatcatattctctt

SEQ ID NO: 536149 - DNA, 25 bp, Rattus norvegicus
gttttttaactcttcatattctctt

SEQ ID NO: 536150 - DNA, 25 bp, Rattus norvegicus
gttttttaatccatcagtaaccgca

SEQ ID NO: 536151 - DNA, 25 bp, Rattus norvegicus
gttttttaatccttcagtaaccgca

SEQ ID NO: 536152 - DNA, 25 bp, Rattus norvegicus
gttttttaatttccaggctcagcct

SEQ ID NO: 536153 - DNA, 25 bp, Rattus norvegicus
gttttttaatttgcaggctcagcct

SEQ ID NO: 536154 - DNA, 25 bp, Rattus norvegicus
gttttttacaaaagttgcctaactg

SEQ ID NO: 536155 - DNA, 25 bp, Rattus norvegicus
gttttttacaaatgttgcctaactg

SEQ ID NO: 536156 - DNA, 25 bp, Rattus norvegicus
gttttttacagcacaagtggccttt

SEQ ID NO: 536157 - DNA, 25 bp, Rattus norvegicus
gttttttacagctcaagtggccttt

SEQ ID NO: 536158 - DNA, 25 bp, Rattus norvegicus
gttttttaccaaccatcatggcctt

SEQ ID NO: 536159 - DNA, 25 bp, Rattus norvegicus
gttttttaccaagcatcatggcctt

SEQ ID NO: 536160 - DNA, 25 bp, Rattus norvegicus
gttttttatctactcatggctttta

SEQ ID NO: 536161 - DNA, 25 bp, Rattus norvegicus
gttttttatctagtcatggctttta

SEQ ID NO: 536162 - DNA, 25 bp, Rattus norvegicus
gttttttatgcactctcaacccgta

SEQ ID NO: 536163 - DNA, 25 bp, Rattus norvegicus
gttttttatgcagtctcaacccgta

SEQ ID NO: 536164 - DNA, 25 bp, Rattus norvegicus
gttttttcaaccatccagaactgtg

SEQ ID NO: 536165 - DNA, 25 bp, Rattus norvegicus
gttttttcaaccttccagaactgtg

SEQ ID NO: 536166 - DNA, 25 bp, Rattus norvegicus
gttttttcatcccaattgcacttcg

SEQ ID NO: 536167 - DNA, 25 bp, Rattus norvegicus
gttttttcatccgaattgcacttcg

SEQ ID NO: 536168 - DNA, 25 bp, Rattus norvegicus
gttttttccaacacatacacatttt

SEQ ID NO: 536169 - DNA, 25 bp, Rattus norvegicus
gttttttccaactcatacacatttt

SEQ ID NO: 536170 - DNA, 25 bp, Rattus norvegicus
gttttttcctccacttcttgtgaag

SEQ ID NO: 536171 - DNA, 25 bp, Rattus norvegicus
gttttttcctcctcttcttgtgaag

SEQ ID NO: 536172 - DNA, 25 bp, Rattus norvegicus
gttttttcttccagcgtaaggcatc

SEQ ID NO: 536173 - DNA, 25 bp, Rattus norvegicus
gttttttcttcctgcgtaaggcatc

SEQ ID NO: 536174 - DNA, 25 bp, Rattus norvegicus
gttttttctttgcagccagttacct

SEQ ID NO: 536175 - DNA, 25 bp, Rattus norvegicus
gttttttctttggagccagttacct

SEQ ID NO: 536176 - DNA, 25 bp, Rattus norvegicus
gttttttgaaaccagcgccaaggat

SEQ ID NO: 536177 - DNA, 25 bp, Rattus norvegicus
gttttttgaaacgagcgccaaggat

SEQ ID NO: 536178 - DNA, 25 bp, Rattus norvegicus
gttttttgactgagataccctagtg

SEQ ID NO: 536179 - DNA, 25 bp, Rattus norvegicus
gttttttgactgtgataccctagtg

SEQ ID NO: 536180 - DNA, 25 bp, Rattus norvegicus
gttttttgaggtactgaaatctact

SEQ ID NO: 536181 - DNA, 25 bp, Rattus norvegicus
gttttttgaggttctgaaatctact

SEQ ID NO: 536182 - DNA, 25 bp, Rattus norvegicus
gttttttgatgaaggccccgaagaa

SEQ ID NO: 536183 - DNA, 25 bp, Rattus norvegicus
gttttttgatgatggccccgaagaa

SEQ ID NO: 536184 - DNA, 25 bp, Rattus norvegicus
gttttttgatgtactgcacttttgt

SEQ ID NO: 536185 - DNA, 25 bp, Rattus norvegicus
gttttttgatgttctgcacttttgt

SEQ ID NO: 536186 - DNA, 25 bp, Rattus norvegicus
gttttttgcatactttgcatcttta

SEQ ID NO: 536187 - DNA, 25 bp, Rattus norvegicus
gttttttgcatagtttgcatcttta

SEQ ID NO: 536188 - DNA, 25 bp, Rattus norvegicus
gttttttgcatgataatatctttcg

SEQ ID NO: 536189 - DNA, 25 bp, Rattus norvegicus
gttttttgcatgttaatatctttcg

SEQ ID NO: 536190 - DNA, 25 bp, Rattus norvegicus
gttttttgtaccactataatctcta

SEQ ID NO: 536191 - DNA, 25 bp, Rattus norvegicus
gttttttgtacctctataatctcta

SEQ ID NO: 536192 - DNA, 25 bp, Rattus norvegicus
gttttttgtcgtaacatgtatcaat

SEQ ID NO: 536193 - DNA, 25 bp, Rattus norvegicus
gttttttgtcgttacatgtatcaat

SEQ ID NO: 536194 - DNA, 25 bp, Rattus norvegicus
gttttttgtctaaatcagaagtcat

SEQ ID NO: 536195 - DNA, 25 bp, Rattus norvegicus
gttttttgtctatatcagaagtcat

SEQ ID NO: 536196 - DNA, 25 bp, Rattus norvegicus
gtttttttgtgtaagctccagccat

SEQ ID NO: 536197 - DNA, 25 bp, Rattus norvegicus
gtttttttgtgttagctccagccat

SEQ ID NO: 536198 - DNA, 25 bp, Rattus norvegicus
taaaaaacatcaattcgcctccgtg

SEQ ID NO: 536199 - DNA, 25 bp, Rattus norvegicus
taaaaaacatcatttcgcctccgtg

SEQ ID NO: 536200 - DNA, 25 bp, Rattus norvegicus
taaaaaacgtcccagtgactgatat

SEQ ID NO: 536201 - DNA, 25 bp, Rattus norvegicus
taaaaaacgtccgagtgactgatat

SEQ ID NO: 536202 - DNA, 25 bp, Rattus norvegicus
taaaaaacttttaccctgcacagag

SEQ ID NO: 536203 - DNA, 25 bp, Rattus norvegicus
taaaaaactttttccctgcacagag

SEQ ID NO: 536204 - DNA, 25 bp, Rattus norvegicus
taaaaaagcagtctcgtgggttcca

SEQ ID NO: 536205 - DNA, 25 bp, Rattus norvegicus
taaaaaagcagtgtcgtgggttcca

SEQ ID NO: 536206 - DNA, 25 bp, Rattus norvegicus
taaaaaagcatcatgcactggctga

SEQ ID NO: 536207 - DNA, 25 bp, Rattus norvegicus
taaaaaagcatcttgcactggctga

SEQ ID NO: 536208 - DNA, 25 bp, Rattus norvegicus
taaaaaagctggcactttggtacct

SEQ ID NO: 536209 - DNA, 25 bp, Rattus norvegicus
taaaaaagctgggactttggtacct

SEQ ID NO: 536210 - DNA, 25 bp, Rattus norvegicus
taaaaacacaatacccatcccttag

SEQ ID NO: 536211 - DNA, 25 bp, Rattus norvegicus
taaaaacacaattcccatcccttag

SEQ ID NO: 536212 - DNA, 25 bp, Rattus norvegicus
taaaaacactcacattacttcccaa

SEQ ID NO: 536213 - DNA, 25 bp, Rattus norvegicus
taaaaacactcagattacttcccaa

SEQ ID NO: 536214 - DNA, 25 bp, Rattus norvegicus
taaaaaccatccctacttcgacgtg

SEQ ID NO: 536215 - DNA, 25 bp, Rattus norvegicus
taaaaaccatccgtacttcgacgtg

SEQ ID NO: 536216 - DNA, 25 bp, Rattus norvegicus
taaaaacccagtccatgtctgccct

SEQ ID NO: 536217 - DNA, 25 bp, Rattus norvegicus
taaaaacccagtgcatgtctgccct

SEQ ID NO: 536218 - DNA, 25 bp, Rattus norvegicus
taaaaacccatgacctttctgttct

SEQ ID NO: 536219 - DNA, 25 bp, Rattus norvegicus
taaaaacccatgtcctttctgttct

SEQ ID NO: 536220 - DNA, 25 bp, Rattus norvegicus
taaaaaccctccacattcaagtcag

SEQ ID NO: 536221 - DNA, 25 bp, Rattus norvegicus
taaaaaccctcctcattcaagtcag

SEQ ID NO: 536222 - DNA, 25 bp, Rattus norvegicus
taaaaacgtcttagccgttagctag

SEQ ID NO: 536223 - DNA, 25 bp, Rattus norvegicus
taaaaacgtctttgccgttagctag

SEQ ID NO: 536224 - DNA, 25 bp, Rattus norvegicus
taaaaacgtgccagcctgtgtggca

SEQ ID NO: 536225 - DNA, 25 bp, Rattus norvegicus
taaaaacgtgcctgcctgtgtggca

SEQ ID NO: 536226 - DNA, 25 bp, Rattus norvegicus
taaaaactaatgattccttctgtgg

SEQ ID NO: 536227 - DNA, 25 bp, Rattus norvegicus
taaaaactaatgtttccttctgtgg

SEQ ID NO: 536228 - DNA, 25 bp, Rattus norvegicus
taaaaactcgagatttttctccatc

SEQ ID NO: 536229 - DNA, 25 bp, Rattus norvegicus
taaaaactcgagttttttctccatc

SEQ ID NO: 536230 - DNA, 25 bp, Rattus norvegicus
taaaaactgtgtaacagccccggct

SEQ ID NO: 536231 - DNA, 25 bp, Rattus norvegicus
taaaaactgtgttacagccccggct

SEQ ID NO: 536232 - DNA, 25 bp, Rattus norvegicus
taaaaactgtttctgacgtctttgt

SEQ ID NO: 536233 - DNA, 25 bp, Rattus norvegicus
taaaaactgtttgtgacgtctttgt

SEQ ID NO: 536234 - DNA, 25 bp, Rattus norvegicus
taaaaacttctgcagcctgattatg

SEQ ID NO: 536235 - DNA, 25 bp, Rattus norvegicus
taaaaacttctggagcctgattatg

SEQ ID NO: 536236 - DNA, 25 bp, Rattus norvegicus
taaaaagaaactctgtcccaccatc

SEQ ID NO: 536237 - DNA, 25 bp, Rattus norvegicus
taaaaagaaactgtgtcccaccatc

SEQ ID NO: 536238 - DNA, 25 bp, Rattus norvegicus
taaaaagaaagaaatactcagtcgg

SEQ ID NO: 536239 - DNA, 25 bp, Rattus norvegicus
taaaaagaaagatatactcagtcgg

SEQ ID NO: 536240 - DNA, 25 bp, Rattus norvegicus
taaaaagaacccatgtcgggctgga

SEQ ID NO: 536241 - DNA, 25 bp, Rattus norvegicus
taaaaagaacccttgtcgggctgga

SEQ ID NO: 536242 - DNA, 25 bp, Rattus norvegicus
taaaaagaatctaccgccaactcct

SEQ ID NO: 536243 - DNA, 25 bp, Rattus norvegicus
taaaaagaatcttccgccaactcct

SEQ ID NO: 536244 - DNA, 25 bp, Rattus norvegicus
taaaaagaggacagcagagatggga

SEQ ID NO: 536245 - DNA, 25 bp, Rattus norvegicus
taaaaagaggactgcagagatggga

SEQ ID NO: 536246 - DNA, 25 bp, Rattus norvegicus
taaaaagcagccagctgcttcccgt

SEQ ID NO: 536247 - DNA, 25 bp, Rattus norvegicus
taaaaagcagcctgctgcttcccgt

SEQ ID NO: 536248 - DNA, 25 bp, Rattus norvegicus
taaaaagcatgactctcttcacccg

SEQ ID NO: 536249 - DNA, 25 bp, Rattus norvegicus
taaaaagcatgagtctcttcacccg

SEQ ID NO: 536250 - DNA, 25 bp, Rattus norvegicus
taaaaagccagacgtgtccttctcc

SEQ ID NO: 536251 - DNA, 25 bp, Rattus norvegicus
taaaaagccagaggtgtccttctcc

SEQ ID NO: 536252 - DNA, 25 bp, Rattus norvegicus
taaaaagcccagacgtggtgtaact

SEQ ID NO: 536253 - DNA, 25 bp, Rattus norvegicus
taaaaagcccagatctcctaaaaga

SEQ ID NO: 536254 - DNA, 25 bp, Rattus norvegicus
taaaaagcccagtcgtggtgtaact

SEQ ID NO: 536255 - DNA, 25 bp, Rattus norvegicus
taaaaagcccagttctcctaaaaga

SEQ ID NO: 536256 - DNA, 25 bp, Rattus norvegicus
taaaaagctggtccactgcggtggc

SEQ ID NO: 536257 - DNA, 25 bp, Rattus norvegicus
taaaaagctggtgcactgcggtggc

SEQ ID NO: 536258 - DNA, 25 bp, Rattus norvegicus
taaaaaggagcccttccagcctctg

SEQ ID NO: 536259 - DNA, 25 bp, Rattus norvegicus
taaaaaggagccgttccagcctctg

SEQ ID NO: 536260 - DNA, 25 bp, Rattus norvegicus
taaaaaggcactacctctcaaccta

SEQ ID NO: 536261 - DNA, 25 bp, Rattus norvegicus
taaaaaggcacttcctctcaaccta

SEQ ID NO: 536262 - DNA, 25 bp, Rattus norvegicus
taaaaaggctgcacgtgctatctcc

SEQ ID NO: 536263 - DNA, 25 bp, Rattus norvegicus
taaaaaggctgctcgtgctatctcc

SEQ ID NO: 536264 - DNA, 25 bp, Rattus norvegicus
taaaaagtcactcttcgccctaagc

SEQ ID NO: 536265 - DNA, 25 bp, Rattus norvegicus
taaaaagtcactgttcgccctaagc

SEQ ID NO: 536266 - DNA, 25 bp, Rattus norvegicus
taaaaagtctgccaccaaacgcctg

SEQ ID NO: 536267 - DNA, 25 bp, Rattus norvegicus
taaaaagtctgcgaccaaacgcctg

SEQ ID NO: 536268 - DNA, 25 bp, Rattus norvegicus
taaaaagtgccacatactcgccctg

SEQ ID NO: 536269 - DNA, 25 bp, Rattus norvegicus
taaaaagtgccagatactcgccctg

SEQ ID NO: 536270 - DNA, 25 bp, Rattus norvegicus
taaaaagtgtggcaggcagaacgaa

SEQ ID NO: 536271 - DNA, 25 bp, Rattus norvegicus
taaaaagtgtgggaggcagaacgaa

SEQ ID NO: 536272 - DNA, 25 bp, Rattus norvegicus
taaaaagttcctcggcactgcgggc

SEQ ID NO: 536273 - DNA, 25 bp, Rattus norvegicus
taaaaagttcctgggcactgcgggc

SEQ ID NO: 536274 - DNA, 25 bp, Rattus norvegicus
taaaaagttgccagctacccacaag

SEQ ID NO: 536275 - DNA, 25 bp, Rattus norvegicus
taaaaagttgcctgctacccacaag

SEQ ID NO: 536276 - DNA, 25 bp, Rattus norvegicus
taaaaagttgtcactcatcctcatc

SEQ ID NO: 536277 - DNA, 25 bp, Rattus norvegicus
taaaaagttgtctctcatcctcatc

SEQ ID NO: 536278 - DNA, 25 bp, Rattus norvegicus
taaaaagtttctctatgctcgggca

SEQ ID NO: 536279 - DNA, 25 bp, Rattus norvegicus
taaaaagtttctgtatgctcgggca

SEQ ID NO: 536280 - DNA, 25 bp, Rattus norvegicus
taaaaataacacactgccccttagc

SEQ ID NO: 536281 - DNA, 25 bp, Rattus norvegicus
taaaaataacactctgccccttagc

SEQ ID NO: 536282 - DNA, 25 bp, Rattus norvegicus
taaaaatagctcacacaacctccac

SEQ ID NO: 536283 - DNA, 25 bp, Rattus norvegicus
taaaaatagctctcacaacctccac

SEQ ID NO: 536284 - DNA, 25 bp, Rattus norvegicus
taaaaatatcttccattttccactt

SEQ ID NO: 536285 - DNA, 25 bp, Rattus norvegicus
taaaaatatcttgcattttccactt

SEQ ID NO: 536286 - DNA, 25 bp, Rattus norvegicus
taaaaatatgatatcctctctctct

SEQ ID NO: 536287 - DNA, 25 bp, Rattus norvegicus
taaaaatatgatttcctctctctct

SEQ ID NO: 536288 - DNA, 25 bp, Rattus norvegicus
taaaaatcaagaagcctgcccggat

SEQ ID NO: 536289 - DNA, 25 bp, Rattus norvegicus
taaaaatcaagatgcctgcccggat

SEQ ID NO: 536290 - DNA, 25 bp, Rattus norvegicus
taaaaatcacatcgcaaaatcctgt

SEQ ID NO: 536291 - DNA, 25 bp, Rattus norvegicus
taaaaatcacatggcaaaatcctgt

SEQ ID NO: 536292 - DNA, 25 bp, Rattus norvegicus
taaaaatcaccgctctcttgtcagc

SEQ ID NO: 536293 - DNA, 25 bp, Rattus norvegicus
taaaaatcaccggtctcttgtcagc

SEQ ID NO: 536294 - DNA, 25 bp, Rattus norvegicus
taaaaatctcatctcctctttgtca

SEQ ID NO: 536295 - DNA, 25 bp, Rattus norvegicus
taaaaatctcatgtcctctttgtca

SEQ ID NO: 536296 - DNA, 25 bp, Rattus norvegicus
taaaaatctcctcagccatacattg

SEQ ID NO: 536297 - DNA, 25 bp, Rattus norvegicus
taaaaatctcctgagccatacattg

SEQ ID NO: 536298 - DNA, 25 bp, Rattus norvegicus
taaaaatgacggagggtggctcaca

SEQ ID NO: 536299 - DNA, 25 bp, Rattus norvegicus
taaaaatgacggtgggtggctcaca

SEQ ID NO: 536300 - DNA, 25 bp, Rattus norvegicus
taaaaatgagccattccactctcca

SEQ ID NO: 536301 - DNA, 25 bp, Rattus norvegicus
taaaaatgagcctttccactctcca

SEQ ID NO: 536302 - DNA, 25 bp, Rattus norvegicus
taaaaatgccagaccgcgctttgct

SEQ ID NO: 536303 - DNA, 25 bp, Rattus norvegicus
taaaaatgccagtccgcgctttgct

SEQ ID NO: 536304 - DNA, 25 bp, Rattus norvegicus
taaaaatgcccacgcttcctacagc

SEQ ID NO: 536305 - DNA, 25 bp, Rattus norvegicus
taaaaatgcccaggcttcctacagc

SEQ ID NO: 536306 - DNA, 25 bp, Rattus norvegicus
taaaaatgcctgaccattcttcctg

SEQ ID NO: 536307 - DNA, 25 bp, Rattus norvegicus
taaaaatgcctgtccattcttcctg

SEQ ID NO: 536308 - DNA, 25 bp, Rattus norvegicus
taaaaatgctcaaggctcgtgccga

SEQ ID NO: 536309 - DNA, 25 bp, Rattus norvegicus
taaaaatgctcatggctcgtgccga

SEQ ID NO: 536310 - DNA, 25 bp, Rattus norvegicus
taaaaatgtcagaggcctcggtccc

SEQ ID NO: 536311 - DNA, 25 bp, Rattus norvegicus
taaaaatgtcagtggcctcggtccc

SEQ ID NO: 536312 - DNA, 25 bp, Rattus norvegicus
taaaaatgtcatctggccagcccat

SEQ ID NO: 536313 - DNA, 25 bp, Rattus norvegicus
taaaaatgtcatgtggccagcccat

SEQ ID NO: 536314 - DNA, 25 bp, Rattus norvegicus
taaaaatgttaaccctatgctacct

SEQ ID NO: 536315 - DNA, 25 bp, Rattus norvegicus
taaaaatgttaagcctatgctacct

SEQ ID NO: 536316 - DNA, 25 bp, Rattus norvegicus
taaaaattagacctcacaacaaagt

SEQ ID NO: 536317 - DNA, 25 bp, Rattus norvegicus
taaaaattagacgtcacaacaaagt

SEQ ID NO: 536318 - DNA, 25 bp, Rattus norvegicus
taaaaattccacacactgtagcccc

SEQ ID NO: 536319 - DNA, 25 bp, Rattus norvegicus
taaaaattccactcactgtagcccc

SEQ ID NO: 536320 - DNA, 25 bp, Rattus norvegicus
taaaaattcctaatcctgccagtca

SEQ ID NO: 536321 - DNA, 25 bp, Rattus norvegicus
taaaaattcctattcctgccagtca

SEQ ID NO: 536322 - DNA, 25 bp, Rattus norvegicus
taaaaatttgtcagaggctgcttcc

SEQ ID NO: 536323 - DNA, 25 bp, Rattus norvegicus
taaaaatttgtctgaggctgcttcc

SEQ ID NO: 536324 - DNA, 25 bp, Rattus norvegicus
taaaacaaatccaccttccgcgtcg

SEQ ID NO: 536325 - DNA, 25 bp, Rattus norvegicus
taaaacaaatcctccttccgcgtcg

SEQ ID NO: 536326 - DNA, 25 bp, Rattus norvegicus
taaaacacacctcgcttcactttga

SEQ ID NO: 536327 - DNA, 25 bp, Rattus norvegicus
taaaacacacctggcttcactttga

SEQ ID NO: 536328 - DNA, 25 bp, Rattus norvegicus
taaaacaccaagcacatcaggcata

SEQ ID NO: 536329 - DNA, 25 bp, Rattus norvegicus
taaaacaccaaggacatcaggcata

SEQ ID NO: 536330 - DNA, 25 bp, Rattus norvegicus
taaaacaccacgacagaaagcaatt

SEQ ID NO: 536331 - DNA, 25 bp, Rattus norvegicus
taaaacaccacgtcagaaagcaatt

SEQ ID NO: 536332 - DNA, 25 bp, Rattus norvegicus
taaaacacctgtactagatgagagt

SEQ ID NO: 536333 - DNA, 25 bp, Rattus norvegicus
taaaacacctgttctagatgagagt

SEQ ID NO: 536334 - DNA, 25 bp, Rattus norvegicus
taaaacaccttcattgttgtgaggg

SEQ ID NO: 536335 - DNA, 25 bp, Rattus norvegicus
taaaacaccttctttgttgtgaggg

SEQ ID NO: 536336 - DNA, 25 bp, Rattus norvegicus
taaaacacgaaccaaacgcccagag

SEQ ID NO: 536337 - DNA, 25 bp, Rattus norvegicus
taaaacacgaacgaaacgcccagag

SEQ ID NO: 536338 - DNA, 25 bp, Rattus norvegicus
taaaacacttcgctgaaagcctctc

SEQ ID NO: 536339 - DNA, 25 bp, Rattus norvegicus
taaaacacttcggtgaaagcctctc

SEQ ID NO: 536340 - DNA, 25 bp, Rattus norvegicus
taaaacagcctgctgatgtccggat

SEQ ID NO: 536341 - DNA, 25 bp, Rattus norvegicus
taaaacagcctggtgatgtccggat

SEQ ID NO: 536342 - DNA, 25 bp, Rattus norvegicus
taaaacagctctcgttctttcagtc

SEQ ID NO: 536343 - DNA, 25 bp, Rattus norvegicus
taaaacagctctggttctttcagtc

SEQ ID NO: 536344 - DNA, 25 bp, Rattus norvegicus
taaaacagtccccttgcaaactcta

SEQ ID NO: 536345 - DNA, 25 bp, Rattus norvegicus
taaaacagtcccgttgcaaactcta

SEQ ID NO: 536346 - DNA, 25 bp, Rattus norvegicus
taaaacagtcttcctcctggtttcc

SEQ ID NO: 536347 - DNA, 25 bp, Rattus norvegicus
taaaacagtcttgctcctggtttcc

SEQ ID NO: 536348 - DNA, 25 bp, Rattus norvegicus
taaaacagttccatctcttacagct

SEQ ID NO: 536349 - DNA, 25 bp, Rattus norvegicus
taaaacagttccttctcttacagct

SEQ ID NO: 536350 - DNA, 25 bp, Rattus norvegicus
taaaacataactacaccgaggcctc

SEQ ID NO: 536351 - DNA, 25 bp, Rattus norvegicus
taaaacataacttcaccgaggcctc

SEQ ID NO: 536352 - DNA, 25 bp, Rattus norvegicus
taaaacatctttctgatccttggtc

SEQ ID NO: 536353 - DNA, 25 bp, Rattus norvegicus
taaaacatctttgtgatccttggtc

SEQ ID NO: 536354 - DNA, 25 bp, Rattus norvegicus
taaaacatgacacctgaccctgcgc

SEQ ID NO: 536355 - DNA, 25 bp, Rattus norvegicus
taaaacatgacagctgaccctgcgc

SEQ ID NO: 536356 - DNA, 25 bp, Rattus norvegicus
taaaacatggctacccttcaaaaca

SEQ ID NO: 536357 - DNA, 25 bp, Rattus norvegicus
taaaacatggctataaccctcagcg

SEQ ID NO: 536358 - DNA, 25 bp, Rattus norvegicus
taaaacatggcttcccttcaaaaca

SEQ ID NO: 536359 - DNA, 25 bp, Rattus norvegicus
taaaacatggctttaaccctcagcg

SEQ ID NO: 536360 - DNA, 25 bp, Rattus norvegicus
taaaacatgtccactgagatccaag

SEQ ID NO: 536361 - DNA, 25 bp, Rattus norvegicus
taaaacatgtcctctgagatccaag

SEQ ID NO: 536362 - DNA, 25 bp, Rattus norvegicus
taaaaccacttcatcaccaatttct

SEQ ID NO: 536363 - DNA, 25 bp, Rattus norvegicus
taaaaccacttcttcaccaatttct

SEQ ID NO: 536364 - DNA, 25 bp, Rattus norvegicus
taaaaccagagtcatcaagacgatt

SEQ ID NO: 536365 - DNA, 25 bp, Rattus norvegicus
taaaaccagagtgatcaagacgatt

SEQ ID NO: 536366 - DNA, 25 bp, Rattus norvegicus
taaaaccagggactagagagccact

SEQ ID NO: 536367 - DNA, 25 bp, Rattus norvegicus
taaaaccagggagtagagagccact

SEQ ID NO: 536368 - DNA, 25 bp, Rattus norvegicus
taaaaccatagtccccatctgtctg

SEQ ID NO: 536369 - DNA, 25 bp, Rattus norvegicus
taaaaccatagtgcccatctgtctg

SEQ ID NO: 536370 - DNA, 25 bp, Rattus norvegicus
taaaaccatccacaacgtgtgcgtc

SEQ ID NO: 536371 - DNA, 25 bp, Rattus norvegicus
taaaaccatccagaacgtgtgcgtc

SEQ ID NO: 536372 - DNA, 25 bp, Rattus norvegicus
taaaaccatctgatgagtagccatg

SEQ ID NO: 536373 - DNA, 25 bp, Rattus norvegicus
taaaaccatctgttgagtagccatg

SEQ ID NO: 536374 - DNA, 25 bp, Rattus norvegicus
taaaaccatggaacaggctgcagca

SEQ ID NO: 536375 - DNA, 25 bp, Rattus norvegicus
taaaaccatggatcaggctgcagca

SEQ ID NO: 536376 - DNA, 25 bp, Rattus norvegicus
taaaacccaactctggttcttccag

SEQ ID NO: 536377 - DNA, 25 bp, Rattus norvegicus
taaaacccaactgtggttcttccag

SEQ ID NO: 536378 - DNA, 25 bp, Rattus norvegicus
taaaacccagctagtctttttgtga

SEQ ID NO: 536379 - DNA, 25 bp, Rattus norvegicus
taaaacccagcttgtctttttgtga

SEQ ID NO: 536380 - DNA, 25 bp, Rattus norvegicus
taaaacccctagattttgacttgca

SEQ ID NO: 536381 - DNA, 25 bp, Rattus norvegicus
taaaacccctagtttttgacttgca

SEQ ID NO: 536382 - DNA, 25 bp, Rattus norvegicus
taaaacccggtaacacgaccacatg

SEQ ID NO: 536383 - DNA, 25 bp, Rattus norvegicus
taaaacccggtatcacgaccacatg

SEQ ID NO: 536384 - DNA, 25 bp, Rattus norvegicus
taaaaccctcgtccagtgaaattag

SEQ ID NO: 536385 - DNA, 25 bp, Rattus norvegicus
taaaaccctcgtgcagtgaaattag

SEQ ID NO: 536386 - DNA, 25 bp, Rattus norvegicus
taaaaccctgcaagcttctttattc

SEQ ID NO: 536387 - DNA, 25 bp, Rattus norvegicus
taaaaccctgcatgcttctttattc

SEQ ID NO: 536388 - DNA, 25 bp, Rattus norvegicus
taaaaccctgccaagtattactgta

SEQ ID NO: 536389 - DNA, 25 bp, Rattus norvegicus
taaaaccctgcctagtattactgta

SEQ ID NO: 536390 - DNA, 25 bp, Rattus norvegicus
taaaaccctgtcatttagaggcaac

SEQ ID NO: 536391 - DNA, 25 bp, Rattus norvegicus
taaaaccctgtcttttagaggcaac

SEQ ID NO: 536392 - DNA, 25 bp, Rattus norvegicus
taaaacctactgcacatcgctgagt

SEQ ID NO: 536393 - DNA, 25 bp, Rattus norvegicus
taaaacctactggacatcgctgagt

SEQ ID NO: 536394 - DNA, 25 bp, Rattus norvegicus
taaaacctagtcaatggctgggcta

SEQ ID NO: 536395 - DNA, 25 bp, Rattus norvegicus
taaaacctagtctatggctgggcta

SEQ ID NO: 536396 - DNA, 25 bp, Rattus norvegicus
taaaacctagtgactctcaagctgc

SEQ ID NO: 536397 - DNA, 25 bp, Rattus norvegicus
taaaacctagtgtctctcaagctgc

SEQ ID NO: 536398 - DNA, 25 bp, Rattus norvegicus
taaaacctattcagatctccggctt

SEQ ID NO: 536399 - DNA, 25 bp, Rattus norvegicus
taaaacctattctgatctccggctt

SEQ ID NO: 536400 - DNA, 25 bp, Rattus norvegicus
taaaacctcatgaattgtgctgtgt

SEQ ID NO: 536401 - DNA, 25 bp, Rattus norvegicus
taaaacctcatgtattgtgctgtgt

SEQ ID NO: 536402 - DNA, 25 bp, Rattus norvegicus
taaaacctcctcataggattgcctc

SEQ ID NO: 536403 - DNA, 25 bp, Rattus norvegicus
taaaacctcctcttaggattgcctc

SEQ ID NO: 536404 - DNA, 25 bp, Rattus norvegicus
taaaacctctccacggtgaaaatag

SEQ ID NO: 536405 - DNA, 25 bp, Rattus norvegicus
taaaacctctcctcggtgaaaatag

SEQ ID NO: 536406 - DNA, 25 bp, Rattus norvegicus
taaaacctctggcttcttggaatat

SEQ ID NO: 536407 - DNA, 25 bp, Rattus norvegicus
taaaacctctgggttcttggaatat

SEQ ID NO: 536408 - DNA, 25 bp, Rattus norvegicus
taaaacctcttcaaaaacacaattg

SEQ ID NO: 536409 - DNA, 25 bp, Rattus norvegicus
taaaacctcttctaaaacacaattg

SEQ ID NO: 536410 - DNA, 25 bp, Rattus norvegicus
taaaacctgttcagacccagacgtg

SEQ ID NO: 536411 - DNA, 25 bp, Rattus norvegicus
taaaacctgttctgacccagacgtg

SEQ ID NO: 536412 - DNA, 25 bp, Rattus norvegicus
taaaacgaatgtctgggatgatccg

SEQ ID NO: 536413 - DNA, 25 bp, Rattus norvegicus
taaaacgaatgtgtgggatgatccg

SEQ ID NO: 536414 - DNA, 25 bp, Rattus norvegicus
taaaacgagcaaacacccgtgtcca

SEQ ID NO: 536415 - DNA, 25 bp, Rattus norvegicus
taaaacgagcaatcacccgtgtcca

SEQ ID NO: 536416 - DNA, 25 bp, Rattus norvegicus
taaaacgagtatcacaggccctgta

SEQ ID NO: 536417 - DNA, 25 bp, Rattus norvegicus
taaaacgagtatgacaggccctgta

SEQ ID NO: 536418 - DNA, 25 bp, Rattus norvegicus
taaaacgcactcctcaagactttgt

SEQ ID NO: 536419 - DNA, 25 bp, Rattus norvegicus
taaaacgcactcgtcaagactttgt

SEQ ID NO: 536420 - DNA, 25 bp, Rattus norvegicus
taaaacgctgttcgctagggctaat

SEQ ID NO: 536421 - DNA, 25 bp, Rattus norvegicus
taaaacgctgttggctagggctaat

SEQ ID NO: 536422 - DNA, 25 bp, Rattus norvegicus
taaaacgctttaaccaaactatgtg

SEQ ID NO: 536423 - DNA, 25 bp, Rattus norvegicus
taaaacgctttatccaaactatgtg

SEQ ID NO: 536424 - DNA, 25 bp, Rattus norvegicus
taaaacggaggcagcggagagacat

SEQ ID NO: 536425 - DNA, 25 bp, Rattus norvegicus
taaaacggaggctgcggagagacat

SEQ ID NO: 536426 - DNA, 25 bp, Rattus norvegicus
taaaacggcgggaactctggtccag

SEQ ID NO: 536427 - DNA, 25 bp, Rattus norvegicus
taaaacggcgggtactctggtccag

SEQ ID NO: 536428 - DNA, 25 bp, Rattus norvegicus
taaaacgtggctcgtcttgtcactg

SEQ ID NO: 536429 - DNA, 25 bp, Rattus norvegicus
taaaacgtggctggtcttgtcactg

SEQ ID NO: 536430 - DNA, 25 bp, Rattus norvegicus
taaaacgttacaaagcgacagctat

SEQ ID NO: 536431 - DNA, 25 bp, Rattus norvegicus
taaaacgttacatagcgacagctat

SEQ ID NO: 536432 - DNA, 25 bp, Rattus norvegicus
taaaacgttatacggctggcaagct

SEQ ID NO: 536433 - DNA, 25 bp, Rattus norvegicus
taaaacgttatagggctggcaagct

SEQ ID NO: 536434 - DNA, 25 bp, Rattus norvegicus
taaaactaaagtacctgtcctcctg

SEQ ID NO: 536435 - DNA, 25 bp, Rattus norvegicus
taaaactaaagttcctgtcctcctg

SEQ ID NO: 536436 - DNA, 25 bp, Rattus norvegicus
taaaactacaacctgatctaccctc

SEQ ID NO: 536437 - DNA, 25 bp, Rattus norvegicus
taaaactacaacgtgatctaccctc

SEQ ID NO: 536438 - DNA, 25 bp, Rattus norvegicus
taaaactacctgagttcgtcacaag

SEQ ID NO: 536439 - DNA, 25 bp, Rattus norvegicus
taaaactacctgtgttcgtcacaag

SEQ ID NO: 536440 - DNA, 25 bp, Rattus norvegicus
taaaactagtccagcaggttctctg

SEQ ID NO: 536441 - DNA, 25 bp, Rattus norvegicus
taaaactagtcctgcaggttctctg

SEQ ID NO: 536442 - DNA, 25 bp, Rattus norvegicus
taaaactcaccaatgactgcagctg

SEQ ID NO: 536443 - DNA, 25 bp, Rattus norvegicus
taaaactcaccattgactgcagctg

SEQ ID NO: 536444 - DNA, 25 bp, Rattus norvegicus
taaaactcacccatcccattttcag

SEQ ID NO: 536445 - DNA, 25 bp, Rattus norvegicus
taaaactcacccttcccattttcag

SEQ ID NO: 536446 - DNA, 25 bp, Rattus norvegicus
taaaactcacttcctgatctctccg

SEQ ID NO: 536447 - DNA, 25 bp, Rattus norvegicus
taaaactcacttgctgatctctccg

SEQ ID NO: 536448 - DNA, 25 bp, Rattus norvegicus
taaaactcatcccatggccacttag

SEQ ID NO: 536449 - DNA, 25 bp, Rattus norvegicus
taaaactcatccgatggccacttag

SEQ ID NO: 536450 - DNA, 25 bp, Rattus norvegicus
taaaactccaagatgcttctaccct

SEQ ID NO: 536451 - DNA, 25 bp, Rattus norvegicus
taaaactccaagttgcttctaccct

SEQ ID NO: 536452 - DNA, 25 bp, Rattus norvegicus
taaaactcccataatcctaaccata

SEQ ID NO: 536453 - DNA, 25 bp, Rattus norvegicus
taaaactcccattatcctaaccata

SEQ ID NO: 536454 - DNA, 25 bp, Rattus norvegicus
taaaactccctaagaggtcactctt

SEQ ID NO: 536455 - DNA, 25 bp, Rattus norvegicus
taaaactccctatgaggtcactctt

SEQ ID NO: 536456 - DNA, 25 bp, Rattus norvegicus
taaaactcctttagtctcccataca

SEQ ID NO: 536457 - DNA, 25 bp, Rattus norvegicus
taaaactccttttgtctcccataca

SEQ ID NO: 536458 - DNA, 25 bp, Rattus norvegicus
taaaactctagacctggcggcagct

SEQ ID NO: 536459 - DNA, 25 bp, Rattus norvegicus
taaaactctagagctggcggcagct

SEQ ID NO: 536460 - DNA, 25 bp, Rattus norvegicus
taaaactctagcattgtgtccctgt

SEQ ID NO: 536461 - DNA, 25 bp, Rattus norvegicus
taaaactctagctttgtgtccctgt

SEQ ID NO: 536462 - DNA, 25 bp, Rattus norvegicus
taaaactctgctaagatgccccaat

SEQ ID NO: 536463 - DNA, 25 bp, Rattus norvegicus
taaaactctgcttagatgccccaat

SEQ ID NO: 536464 - DNA, 25 bp, Rattus norvegicus
taaaactgagccattgaactgcaat

SEQ ID NO: 536465 - DNA, 25 bp, Rattus norvegicus
taaaactgagcctttgaactgcaat

SEQ ID NO: 536466 - DNA, 25 bp, Rattus norvegicus
taaaactgcaggaccttagctatcc

SEQ ID NO: 536467 - DNA, 25 bp, Rattus norvegicus
taaaactgcaggtccttagctatcc

SEQ ID NO: 536468 - DNA, 25 bp, Rattus norvegicus
taaaactgccaaatgctcgcctggt

SEQ ID NO: 536469 - DNA, 25 bp, Rattus norvegicus
taaaactgccaattgctcgcctggt

SEQ ID NO: 536470 - DNA, 25 bp, Rattus norvegicus
taaaactgccgacctttttcttgtt

SEQ ID NO: 536471 - DNA, 25 bp, Rattus norvegicus
taaaactgccgagctttttcttgtt

SEQ ID NO: 536472 - DNA, 25 bp, Rattus norvegicus
taaaactgcgttatagcttctcatt

SEQ ID NO: 536473 - DNA, 25 bp, Rattus norvegicus
taaaactgcgttttagcttctcatt

SEQ ID NO: 536474 - DNA, 25 bp, Rattus norvegicus
taaaactggcaacccgtccaggagt

SEQ ID NO: 536475 - DNA, 25 bp, Rattus norvegicus
taaaactggcaagccgtccaggagt

SEQ ID NO: 536476 - DNA, 25 bp, Rattus norvegicus
taaaactggcatcagggcgccttgc

SEQ ID NO: 536477 - DNA, 25 bp, Rattus norvegicus
taaaactggcatgagggcgccttgc

SEQ ID NO: 536478 - DNA, 25 bp, Rattus norvegicus
taaaactgggaccagctgctctctt

SEQ ID NO: 536479 - DNA, 25 bp, Rattus norvegicus
taaaactgggacgagctgctctctt

SEQ ID NO: 536480 - DNA, 25 bp, Rattus norvegicus
taaaactggtgacccaagccgggac

SEQ ID NO: 536481 - DNA, 25 bp, Rattus norvegicus
taaaactggtgagccaagccgggac

SEQ ID NO: 536482 - DNA, 25 bp, Rattus norvegicus
taaaactggttcctagctcctattc

SEQ ID NO: 536483 - DNA, 25 bp, Rattus norvegicus
taaaactggttcgtagctcctattc

SEQ ID NO: 536484 - DNA, 25 bp, Rattus norvegicus
taaaactggtttctgtgtgggcttt

SEQ ID NO: 536485 - DNA, 25 bp, Rattus norvegicus
taaaactggtttgtgtgtgggcttt

SEQ ID NO: 536486 - DNA, 25 bp, Rattus norvegicus
taaaactgtagaccttgcctcccta

SEQ ID NO: 536487 - DNA, 25 bp, Rattus norvegicus
taaaactgtagagcttgcctcccta

SEQ ID NO: 536488 - DNA, 25 bp, Rattus norvegicus
taaaacttcagtcctttgtgcctct

SEQ ID NO: 536489 - DNA, 25 bp, Rattus norvegicus
taaaacttcagtgctttgtgcctct

SEQ ID NO: 536490 - DNA, 25 bp, Rattus norvegicus
taaaacttccagacaccagaggtcc

SEQ ID NO: 536491 - DNA, 25 bp, Rattus norvegicus
taaaacttccagtcaccagaggtcc

SEQ ID NO: 536492 - DNA, 25 bp, Rattus norvegicus
taaaacttcctcactgtcttttcta

SEQ ID NO: 536493 - DNA, 25 bp, Rattus norvegicus
taaaacttcctctctgtcttttcta

SEQ ID NO: 536494 - DNA, 25 bp, Rattus norvegicus
taaaacttcgatcgacctgttctcc

SEQ ID NO: 536495 - DNA, 25 bp, Rattus norvegicus
taaaacttcgatggacctgttctcc

SEQ ID NO: 536496 - DNA, 25 bp, Rattus norvegicus
taaaacttctgtaatctgccccatg

SEQ ID NO: 536497 - DNA, 25 bp, Rattus norvegicus
taaaacttctgttatctgccccatg

SEQ ID NO: 536498 - DNA, 25 bp, Rattus norvegicus
taaaacttgataatgccctctctgc

SEQ ID NO: 536499 - DNA, 25 bp, Rattus norvegicus
taaaacttgatattgccctctctgc

SEQ ID NO: 536500 - DNA, 25 bp, Rattus norvegicus
taaaacttgtgccaggttctacctc

SEQ ID NO: 536501 - DNA, 25 bp, Rattus norvegicus
taaaacttgtgcgaggttctacctc

SEQ ID NO: 536502 - DNA, 25 bp, Rattus norvegicus
taaaacttgttacctggtccctgag

SEQ ID NO: 536503 - DNA, 25 bp, Rattus norvegicus
taaaacttgttagctggtccctgag

SEQ ID NO: 536504 - DNA, 25 bp, Rattus norvegicus
taaaactttacaaaccctctgagcc

SEQ ID NO: 536505 - DNA, 25 bp, Rattus norvegicus
taaaactttacataccctctgagcc

SEQ ID NO: 536506 - DNA, 25 bp, Rattus norvegicus
taaaactttcctcatccttcttagc

SEQ ID NO: 536507 - DNA, 25 bp, Rattus norvegicus
taaaactttcctgatccttcttagc

SEQ ID NO: 536508 - DNA, 25 bp, Rattus norvegicus
taaaactttttgaacatccgtgttg

SEQ ID NO: 536509 - DNA, 25 bp, Rattus norvegicus
taaaactttttgtacatccgtgttg

SEQ ID NO: 536510 - DNA, 25 bp, Rattus norvegicus
taaaagaaacaacacctgccacacc

SEQ ID NO: 536511 - DNA, 25 bp, Rattus norvegicus
taaaagaaacaagacctgccacacc

SEQ ID NO: 536512 - DNA, 25 bp, Rattus norvegicus
taaaagaaagctctcccgctcacca

SEQ ID NO: 536513 - DNA, 25 bp, Rattus norvegicus
taaaagaaagctgtcccgctcacca

SEQ ID NO: 536514 - DNA, 25 bp, Rattus norvegicus
taaaagaacagtactgcgccctcca

SEQ ID NO: 536515 - DNA, 25 bp, Rattus norvegicus
taaaagaacagttctgcgccctcca

SEQ ID NO: 536516 - DNA, 25 bp, Rattus norvegicus
taaaagaactgtacaccctcctgaa

SEQ ID NO: 536517 - DNA, 25 bp, Rattus norvegicus
taaaagaactgttcaccctcctgaa

SEQ ID NO: 536518 - DNA, 25 bp, Rattus norvegicus
taaaagaatcccctctcttagtcca

SEQ ID NO: 536519 - DNA, 25 bp, Rattus norvegicus
taaaagaatcccgtctcttagtcca

SEQ ID NO: 536520 - DNA, 25 bp, Rattus norvegicus
taaaagacagcccatgtcctgctgc

SEQ ID NO: 536521 - DNA, 25 bp, Rattus norvegicus
taaaagacagccgatgtcctgctgc

SEQ ID NO: 536522 - DNA, 25 bp, Rattus norvegicus
taaaagactatcctcactctgcatt

SEQ ID NO: 536523 - DNA, 25 bp, Rattus norvegicus
taaaagactatcgtcactctgcatt

SEQ ID NO: 536524 - DNA, 25 bp, Rattus norvegicus
taaaagactccccatgataacctgt

SEQ ID NO: 536525 - DNA, 25 bp, Rattus norvegicus
taaaagactcccgatgataacctgt

SEQ ID NO: 536526 - DNA, 25 bp, Rattus norvegicus
taaaagactttcactgggccggaga

SEQ ID NO: 536527 - DNA, 25 bp, Rattus norvegicus
taaaagactttctctgggccggaga

SEQ ID NO: 536528 - DNA, 25 bp, Rattus norvegicus
taaaagagagatctgcaccatctgt

SEQ ID NO: 536529 - DNA, 25 bp, Rattus norvegicus
taaaagagagatgtgcaccatctgt

SEQ ID NO: 536530 - DNA, 25 bp, Rattus norvegicus
taaaagaggtaccagcctgtcctcc

SEQ ID NO: 536531 - DNA, 25 bp, Rattus norvegicus
taaaagaggtacgagcctgtcctcc

SEQ ID NO: 536532 - DNA, 25 bp, Rattus norvegicus
taaaagagtacacattgccccggga

SEQ ID NO: 536533 - DNA, 25 bp, Rattus norvegicus
taaaagagtacagattgccccggga

SEQ ID NO: 536534 - DNA, 25 bp, Rattus norvegicus
taaaagatcaataacctgggctgga

SEQ ID NO: 536535 - DNA, 25 bp, Rattus norvegicus
taaaagatcaattacctgggctgga

SEQ ID NO: 536536 - DNA, 25 bp, Rattus norvegicus
taaaagatgacaccaccaccaaacg

SEQ ID NO: 536537 - DNA, 25 bp, Rattus norvegicus
taaaagatgacagcaccaccaaacg

SEQ ID NO: 536538 - DNA, 25 bp, Rattus norvegicus
taaaagatgatcactggccctgtgg

SEQ ID NO: 536539 - DNA, 25 bp, Rattus norvegicus
taaaagatgatctctggccctgtgg

SEQ ID NO: 536540 - DNA, 25 bp, Rattus norvegicus
taaaagcaacccactccatggaaat

SEQ ID NO: 536541 - DNA, 25 bp, Rattus norvegicus
taaaagcaaccctctccatggaaat

SEQ ID NO: 536542 - DNA, 25 bp, Rattus norvegicus
taaaagcaaggacctgccaccgtcc

SEQ ID NO: 536543 - DNA, 25 bp, Rattus norvegicus
taaaagcaaggagctgccaccgtcc

SEQ ID NO: 536544 - DNA, 25 bp, Rattus norvegicus
taaaagcacccacacttacagcagt

SEQ ID NO: 536545 - DNA, 25 bp, Rattus norvegicus
taaaagcacccagacttacagcagt

SEQ ID NO: 536546 - DNA, 25 bp, Rattus norvegicus
taaaagcacgtgcaatctgggcaac

SEQ ID NO: 536547 - DNA, 25 bp, Rattus norvegicus
taaaagcacgtggaatctgggcaac

SEQ ID NO: 536548 - DNA, 25 bp, Rattus norvegicus
taaaagcacgttaattgtaaccaga

SEQ ID NO: 536549 - DNA, 25 bp, Rattus norvegicus
taaaagcacgtttattgtaaccaga

SEQ ID NO: 536550 - DNA, 25 bp, Rattus norvegicus
taaaagcacttacctgaatgtcagc

SEQ ID NO: 536551 - DNA, 25 bp, Rattus norvegicus
taaaagcacttagctgaatgtcagc

SEQ ID NO: 536552 - DNA, 25 bp, Rattus norvegicus
taaaagcagagcaacatcccttccc

SEQ ID NO: 536553 - DNA, 25 bp, Rattus norvegicus
taaaagcagagctacatcccttccc

SEQ ID NO: 536554 - DNA, 25 bp, Rattus norvegicus
taaaagcaggttagcctcgcagcag

SEQ ID NO: 536555 - DNA, 25 bp, Rattus norvegicus
taaaagcaggtttgcctcgcagcag

SEQ ID NO: 536556 - DNA, 25 bp, Rattus norvegicus
taaaagcataacagccggcagacct

SEQ ID NO: 536557 - DNA, 25 bp, Rattus norvegicus
taaaagcataactgccggcagacct

SEQ ID NO: 536558 - DNA, 25 bp, Rattus norvegicus
taaaagcatgctacagttccaccac

SEQ ID NO: 536559 - DNA, 25 bp, Rattus norvegicus
taaaagcatgcttcagttccaccac

SEQ ID NO: 536560 - DNA, 25 bp, Rattus norvegicus
taaaagcatggaacctccacccaaa

SEQ ID NO: 536561 - DNA, 25 bp, Rattus norvegicus
taaaagcatggatcctccacccaaa

SEQ ID NO: 536562 - DNA, 25 bp, Rattus norvegicus
taaaagccaccaacaggacctgtca

SEQ ID NO: 536563 - DNA, 25 bp, Rattus norvegicus
taaaagccaccatcaggacctgtca

SEQ ID NO: 536564 - DNA, 25 bp, Rattus norvegicus
taaaagccacccacagagtgtcctt

SEQ ID NO: 536565 - DNA, 25 bp, Rattus norvegicus
taaaagccaccctcagagtgtcctt

SEQ ID NO: 536566 - DNA, 25 bp, Rattus norvegicus
taaaagccactgactgcgctctaga

SEQ ID NO: 536567 - DNA, 25 bp, Rattus norvegicus
taaaagccactgtctgcgctctaga

SEQ ID NO: 536568 - DNA, 25 bp, Rattus norvegicus
taaaagcccagtcagcccttaacca

SEQ ID NO: 536569 - DNA, 25 bp, Rattus norvegicus
taaaagcccagtgagcccttaacca

SEQ ID NO: 536570 - DNA, 25 bp, Rattus norvegicus
taaaagcccataacccttgagaatg

SEQ ID NO: 536571 - DNA, 25 bp, Rattus norvegicus
taaaagcccatatcccttgagaatg

SEQ ID NO: 536572 - DNA, 25 bp, Rattus norvegicus
taaaagccccaaaggacggcaggat

SEQ ID NO: 536573 - DNA, 25 bp, Rattus norvegicus
taaaagccccaatggacggcaggat

SEQ ID NO: 536574 - DNA, 25 bp, Rattus norvegicus
taaaagcctcatctgcttcctgtgt

SEQ ID NO: 536575 - DNA, 25 bp, Rattus norvegicus
taaaagcctcatgtgcttcctgtgt

SEQ ID NO: 536576 - DNA, 25 bp, Rattus norvegicus
taaaagcctcgaactgtacctgcat

SEQ ID NO: 536577 - DNA, 25 bp, Rattus norvegicus
taaaagcctcgatctgtacctgcat

SEQ ID NO: 536578 - DNA, 25 bp, Rattus norvegicus
taaaagcctgtgacgtgtgccgcta

SEQ ID NO: 536579 - DNA, 25 bp, Rattus norvegicus
taaaagcctgtgtcgtgtgccgcta

SEQ ID NO: 536580 - DNA, 25 bp, Rattus norvegicus
taaaagctagatcctctgtgagagt

SEQ ID NO: 536581 - DNA, 25 bp, Rattus norvegicus
taaaagctagatgctctgtgagagt

SEQ ID NO: 536582 - DNA, 25 bp, Rattus norvegicus
taaaagctccaacctccacaaaaca

SEQ ID NO: 536583 - DNA, 25 bp, Rattus norvegicus
taaaagctccaagctccacaaaaca

SEQ ID NO: 536584 - DNA, 25 bp, Rattus norvegicus
taaaagctccctagaactctgcaga

SEQ ID NO: 536585 - DNA, 25 bp, Rattus norvegicus
taaaagctcccttgaactctgcaga

SEQ ID NO: 536586 - DNA, 25 bp, Rattus norvegicus
taaaagctgcttatccagtcttcag

SEQ ID NO: 536587 - DNA, 25 bp, Rattus norvegicus
taaaagctgcttttccagtcttcag

SEQ ID NO: 536588 - DNA, 25 bp, Rattus norvegicus
taaaagctgttccttgcagggtcac

SEQ ID NO: 536589 - DNA, 25 bp, Rattus norvegicus
taaaagctgttcgttgcagggtcac

SEQ ID NO: 536590 - DNA, 25 bp, Rattus norvegicus
taaaagcttttcacttccgttgctc

SEQ ID NO: 536591 - DNA, 25 bp, Rattus norvegicus
taaaagcttttctcttccgttgctc

SEQ ID NO: 536592 - DNA, 25 bp, Rattus norvegicus
taaaagcttttgaactccatcgaaa

SEQ ID NO: 536593 - DNA, 25 bp, Rattus norvegicus
taaaagcttttgtactccatcgaaa

SEQ ID NO: 536594 - DNA, 25 bp, Rattus norvegicus
taaaagctttttccaggtctgctgc

SEQ ID NO: 536595 - DNA, 25 bp, Rattus norvegicus
taaaagctttttgcaggtctgctgc

SEQ ID NO: 536596 - DNA, 25 bp, Rattus norvegicus
taaaaggactgacctgcaacctctc

SEQ ID NO: 536597 - DNA, 25 bp, Rattus norvegicus
taaaaggactgagctgcaacctctc

SEQ ID NO: 536598 - DNA, 25 bp, Rattus norvegicus
taaaaggagcacacgggccccttca

SEQ ID NO: 536599 - DNA, 25 bp, Rattus norvegicus
taaaaggagcactcgggccccttca

SEQ ID NO: 536600 - DNA, 25 bp, Rattus norvegicus
taaaaggagccccatcacaatctca

SEQ ID NO: 536601 - DNA, 25 bp, Rattus norvegicus
taaaaggagcccgatcacaatctca

SEQ ID NO: 536602 - DNA, 25 bp, Rattus norvegicus
taaaaggcacacaacatctgaaata

SEQ ID NO: 536603 - DNA, 25 bp, Rattus norvegicus
taaaaggcacactacatctgaaata

SEQ ID NO: 536604 - DNA, 25 bp, Rattus norvegicus
taaaaggcagacattgggctggaga

SEQ ID NO: 536605 - DNA, 25 bp, Rattus norvegicus
taaaaggcagactttgggctggaga

SEQ ID NO: 536606 - DNA, 25 bp, Rattus norvegicus
taaaaggcagcaccacacatggccg

SEQ ID NO: 536607 - DNA, 25 bp, Rattus norvegicus
taaaaggcagcagcacacatggccg

SEQ ID NO: 536608 - DNA, 25 bp, Rattus norvegicus
taaaaggcatagaggcactcacctt

SEQ ID NO: 536609 - DNA, 25 bp, Rattus norvegicus
taaaaggcatagtggcactcacctt

SEQ ID NO: 536610 - DNA, 25 bp, Rattus norvegicus
taaaaggccagcacattagttccag

SEQ ID NO: 536611 - DNA, 25 bp, Rattus norvegicus
taaaaggccagctcattagttccag

SEQ ID NO: 536612 - DNA, 25 bp, Rattus norvegicus
taaaaggccctcaagaacattaaat

SEQ ID NO: 536613 - DNA, 25 bp, Rattus norvegicus
taaaaggccctctagaacattaaat

SEQ ID NO: 536614 - DNA, 25 bp, Rattus norvegicus
taaaaggccgttcctcggtgtgtga

SEQ ID NO: 536615 - DNA, 25 bp, Rattus norvegicus
taaaaggccgttgctcggtgtgtga

SEQ ID NO: 536616 - DNA, 25 bp, Rattus norvegicus
taaaaggcggttctctacttcccag

SEQ ID NO: 536617 - DNA, 25 bp, Rattus norvegicus
taaaaggcggttgtctacttcccag

SEQ ID NO: 536618 - DNA, 25 bp, Rattus norvegicus
taaaaggctacccacggatgaggtt

SEQ ID NO: 536619 - DNA, 25 bp, Rattus norvegicus
taaaaggctaccgacggatgaggtt

SEQ ID NO: 536620 - DNA, 25 bp, Rattus norvegicus
taaaaggctcctaccgttgggtgag

SEQ ID NO: 536621 - DNA, 25 bp, Rattus norvegicus
taaaaggctccttccgttgggtgag

SEQ ID NO: 536622 - DNA, 25 bp, Rattus norvegicus
taaaaggcttggcaccaggcttcgg

SEQ ID NO: 536623 - DNA, 25 bp, Rattus norvegicus
taaaaggcttgggaccaggcttcgg

SEQ ID NO: 536624 - DNA, 25 bp, Rattus norvegicus
taaaaggcttttagtggtgcctttg

SEQ ID NO: 536625 - DNA, 25 bp, Rattus norvegicus
taaaaggcttttccctctcgtgcag

SEQ ID NO: 536626 - DNA, 25 bp, Rattus norvegicus
taaaaggcttttgcctctcgtgcag

SEQ ID NO: 536627 - DNA, 25 bp, Rattus norvegicus
taaaaggctttttgtggtgcctttg

SEQ ID NO: 536628 - DNA, 25 bp, Rattus norvegicus
taaaaggtctttcgcactggtgtaa

SEQ ID NO: 536629 - DNA, 25 bp, Rattus norvegicus
taaaaggtctttggcactggtgtaa

SEQ ID NO: 536630 - DNA, 25 bp, Rattus norvegicus
taaaaggtgaccctgtgaaccgctc

SEQ ID NO: 536631 - DNA, 25 bp, Rattus norvegicus
taaaaggtgaccgtgtgaaccgctc

SEQ ID NO: 536632 - DNA, 25 bp, Rattus norvegicus
taaaaggttgcaaactgagccaagt

SEQ ID NO: 536633 - DNA, 25 bp, Rattus norvegicus
taaaaggttgcatactgagccaagt

SEQ ID NO: 536634 - DNA, 25 bp, Rattus norvegicus
taaaaggttgctactcttcctgcag

SEQ ID NO: 536635 - DNA, 25 bp, Rattus norvegicus
taaaaggttgctcctccacattatc

SEQ ID NO: 536636 - DNA, 25 bp, Rattus norvegicus
taaaaggttgctgctccacattatc

SEQ ID NO: 536637 - DNA, 25 bp, Rattus norvegicus
taaaaggttgcttctcttcctgcag

SEQ ID NO: 536638 - DNA, 25 bp, Rattus norvegicus
taaaagtaaatgatgcgccataagg

SEQ ID NO: 536639 - DNA, 25 bp, Rattus norvegicus
taaaagtaaatgttgcgccataagg

SEQ ID NO: 536640 - DNA, 25 bp, Rattus norvegicus
taaaagtacctcatgctagccaaat

SEQ ID NO: 536641 - DNA, 25 bp, Rattus norvegicus
taaaagtacctcttgctagccaaat

SEQ ID NO: 536642 - DNA, 25 bp, Rattus norvegicus
taaaagtattttatgactcctacat

SEQ ID NO: 536643 - DNA, 25 bp, Rattus norvegicus
taaaagtattttttgactcctacat

SEQ ID NO: 536644 - DNA, 25 bp, Rattus norvegicus
taaaagtcacttacccaaatggctg

SEQ ID NO: 536645 - DNA, 25 bp, Rattus norvegicus
taaaagtcactttcccaaatggctg

SEQ ID NO: 536646 - DNA, 25 bp, Rattus norvegicus
taaaagtcagaccaacccataggga

SEQ ID NO: 536647 - DNA, 25 bp, Rattus norvegicus
taaaagtcagacgaacccataggga

SEQ ID NO: 536648 - DNA, 25 bp, Rattus norvegicus
taaaagtcagcccagcttccagtgg

SEQ ID NO: 536649 - DNA, 25 bp, Rattus norvegicus
taaaagtcagccgagcttccagtgg

SEQ ID NO: 536650 - DNA, 25 bp, Rattus norvegicus
taaaagtcatcaacattcaagtttg

SEQ ID NO: 536651 - DNA, 25 bp, Rattus norvegicus
taaaagtcatcatcattcaagtttg

SEQ ID NO: 536652 - DNA, 25 bp, Rattus norvegicus
taaaagtctgaaacgccgctgcctt

SEQ ID NO: 536653 - DNA, 25 bp, Rattus norvegicus
taaaagtctgaatcgccgctgcctt

SEQ ID NO: 536654 - DNA, 25 bp, Rattus norvegicus
taaaagtctttacctacccattagg

SEQ ID NO: 536655 - DNA, 25 bp, Rattus norvegicus
taaaagtctttagctacccattagg

SEQ ID NO: 536656 - DNA, 25 bp, Rattus norvegicus
taaaagtgaactcccgttcccatag

SEQ ID NO: 536657 - DNA, 25 bp, Rattus norvegicus
taaaagtgaactgccgttcccatag

SEQ ID NO: 536658 - DNA, 25 bp, Rattus norvegicus
taaaagtgcaccatggatcaccact

SEQ ID NO: 536659 - DNA, 25 bp, Rattus norvegicus
taaaagtgcaccttggatcaccact

SEQ ID NO: 536660 - DNA, 25 bp, Rattus norvegicus
taaaagtggtgtctccctgggacca

SEQ ID NO: 536661 - DNA, 25 bp, Rattus norvegicus
taaaagtggtgtgtccctgggacca

SEQ ID NO: 536662 - DNA, 25 bp, Rattus norvegicus
taaaagttctccagtgtccccaaga

SEQ ID NO: 536663 - DNA, 25 bp, Rattus norvegicus
taaaagttctcctgtgtccccaaga

SEQ ID NO: 536664 - DNA, 25 bp, Rattus norvegicus
taaaagttctctccctttgcgtgac

SEQ ID NO: 536665 - DNA, 25 bp, Rattus norvegicus
taaaagttctctgcctttgcgtgac

SEQ ID NO: 536666 - DNA, 25 bp, Rattus norvegicus
taaaagtttattatgccggtgcaga

SEQ ID NO: 536667 - DNA, 25 bp, Rattus norvegicus
taaaagtttattttgccggtgcaga

SEQ ID NO: 536668 - DNA, 25 bp, Rattus norvegicus
taaaagtttctccaattgctaaatt

SEQ ID NO: 536669 - DNA, 25 bp, Rattus norvegicus
taaaagtttctcgaattgctaaatt

SEQ ID NO: 536670 - DNA, 25 bp, Rattus norvegicus
taaaataaccatcagttccttcacc

SEQ ID NO: 536671 - DNA, 25 bp, Rattus norvegicus
taaaataaccatgagttccttcacc

SEQ ID NO: 536672 - DNA, 25 bp, Rattus norvegicus
taaaataaccctcggcaggtgcttg

SEQ ID NO: 536673 - DNA, 25 bp, Rattus norvegicus
taaaataaccctgggcaggtgcttg

SEQ ID NO: 536674 - DNA, 25 bp, Rattus norvegicus
taaaataaggaaatgggcttggcgg

SEQ ID NO: 536675 - DNA, 25 bp, Rattus norvegicus
taaaataaggaattgggcttggcgg

SEQ ID NO: 536676 - DNA, 25 bp, Rattus norvegicus
taaaatacacacattgcatatcaaa

SEQ ID NO: 536677 - DNA, 25 bp, Rattus norvegicus
taaaatacacactttgcatatcaaa

SEQ ID NO: 536678 - DNA, 25 bp, Rattus norvegicus
taaaatacacccctcttgacctgtt

SEQ ID NO: 536679 - DNA, 25 bp, Rattus norvegicus
taaaatacacccgtcttgacctgtt

SEQ ID NO: 536680 - DNA, 25 bp, Rattus norvegicus
taaaatacagctaacctttaacctg

SEQ ID NO: 536681 - DNA, 25 bp, Rattus norvegicus
taaaatacagcttacctttaacctg

SEQ ID NO: 536682 - DNA, 25 bp, Rattus norvegicus
taaaataccagcagctgcccagttg

SEQ ID NO: 536683 - DNA, 25 bp, Rattus norvegicus
taaaataccagctgctgcccagttg

SEQ ID NO: 536684 - DNA, 25 bp, Rattus norvegicus
taaaatacctctatagctgggtggg

SEQ ID NO: 536685 - DNA, 25 bp, Rattus norvegicus
taaaatacctctttagctgggtggg

SEQ ID NO: 536686 - DNA, 25 bp, Rattus norvegicus
taaaatactgttcggccacttttgt

SEQ ID NO: 536687 - DNA, 25 bp, Rattus norvegicus
taaaatactgttgggccacttttgt

SEQ ID NO: 536688 - DNA, 25 bp, Rattus norvegicus
taaaatacttgaagccctggccagc

SEQ ID NO: 536689 - DNA, 25 bp, Rattus norvegicus
taaaatacttgatgccctggccagc

SEQ ID NO: 536690 - DNA, 25 bp, Rattus norvegicus
taaaatagacatcagccgcattggc

SEQ ID NO: 536691 - DNA, 25 bp, Rattus norvegicus
taaaatagacatgagccgcattggc

SEQ ID NO: 536692 - DNA, 25 bp, Rattus norvegicus
taaaatagagtacctccctggtggg

SEQ ID NO: 536693 - DNA, 25 bp, Rattus norvegicus
taaaatagagtagctccctggtggg

SEQ ID NO: 536694 - DNA, 25 bp, Rattus norvegicus
taaaatagcccccattcctcaaagg

SEQ ID NO: 536695 - DNA, 25 bp, Rattus norvegicus
taaaatagccccgattcctcaaagg

SEQ ID NO: 536696 - DNA, 25 bp, Rattus norvegicus
taaaataggaatccattatgagtgc

SEQ ID NO: 536697 - DNA, 25 bp, Rattus norvegicus
taaaataggaatgcattatgagtgc

SEQ ID NO: 536698 - DNA, 25 bp, Rattus norvegicus
taaaatagggttcagccttgccggt

SEQ ID NO: 536699 - DNA, 25 bp, Rattus norvegicus
taaaatagggttgagccttgccggt

SEQ ID NO: 536700 - DNA, 25 bp, Rattus norvegicus
taaaatagtcaacgtcatcggttcg

SEQ ID NO: 536701 - DNA, 25 bp, Rattus norvegicus
taaaatagtcaaggtcatcggttcg

SEQ ID NO: 536702 - DNA, 25 bp, Rattus norvegicus
taaaatatcagcaaggccgtaccta

SEQ ID NO: 536703 - DNA, 25 bp, Rattus norvegicus
taaaatatcagctaggccgtaccta

SEQ ID NO: 536704 - DNA, 25 bp, Rattus norvegicus
taaaatatcgccaggcctcagatgt

SEQ ID NO: 536705 - DNA, 25 bp, Rattus norvegicus
taaaatatcgcctggcctcagatgt

SEQ ID NO: 536706 - DNA, 25 bp, Rattus norvegicus
taaaatatgtccattctcccatttc

SEQ ID NO: 536707 - DNA, 25 bp, Rattus norvegicus
taaaatatgtcctttctcccatttc

SEQ ID NO: 536708 - DNA, 25 bp, Rattus norvegicus
taaaatattaccatctccctcttct

SEQ ID NO: 536709 - DNA, 25 bp, Rattus norvegicus
taaaatattaccttctccctcttct

SEQ ID NO: 536710 - DNA, 25 bp, Rattus norvegicus
taaaatattcacaccacttccttgt

SEQ ID NO: 536711 - DNA, 25 bp, Rattus norvegicus
taaaatattcactccacttccttgt

SEQ ID NO: 536712 - DNA, 25 bp, Rattus norvegicus
taaaatcagataaagggctcccctc

SEQ ID NO: 536713 - DNA, 25 bp, Rattus norvegicus
taaaatcagatatagggctcccctc

SEQ ID NO: 536714 - DNA, 25 bp, Rattus norvegicus
taaaatcatgttacccaggtttcct

SEQ ID NO: 536715 - DNA, 25 bp, Rattus norvegicus
taaaatcatgtttcccaggtttcct

SEQ ID NO: 536716 - DNA, 25 bp, Rattus norvegicus
taaaatccaaagattcaaggcggtg

SEQ ID NO: 536717 - DNA, 25 bp, Rattus norvegicus
taaaatccaaagtttcaaggcggtg

SEQ ID NO: 536718 - DNA, 25 bp, Rattus norvegicus
taaaatccaccaacactgtgagtaa

SEQ ID NO: 536719 - DNA, 25 bp, Rattus norvegicus
taaaatccaccatcactgtgagtaa

SEQ ID NO: 536720 - DNA, 25 bp, Rattus norvegicus
taaaatccatacctgtatttacaca

SEQ ID NO: 536721 - DNA, 25 bp, Rattus norvegicus
taaaatccatacgtgtatttacaca

SEQ ID NO: 536722 - DNA, 25 bp, Rattus norvegicus
taaaatcccaggctcccctgtgaag

SEQ ID NO: 536723 - DNA, 25 bp, Rattus norvegicus
taaaatcccagggtcccctgtgaag

SEQ ID NO: 536724 - DNA, 25 bp, Rattus norvegicus
taaaatcccttcacctacatgttct

SEQ ID NO: 536725 - DNA, 25 bp, Rattus norvegicus
taaaatcccttcatcgacgctgagc

SEQ ID NO: 536726 - DNA, 25 bp, Rattus norvegicus
taaaatcccttctcctacatgttct

SEQ ID NO: 536727 - DNA, 25 bp, Rattus norvegicus
taaaatcccttcttcgacgctgagc

SEQ ID NO: 536728 - DNA, 25 bp, Rattus norvegicus
taaaatccttctatcacctttgaat

SEQ ID NO: 536729 - DNA, 25 bp, Rattus norvegicus
taaaatccttctttcacctttgaat

SEQ ID NO: 536730 - DNA, 25 bp, Rattus norvegicus
taaaatccttggaaagcccactgtt

SEQ ID NO: 536731 - DNA, 25 bp, Rattus norvegicus
taaaatccttggtaagcccactgtt

SEQ ID NO: 536732 - DNA, 25 bp, Rattus norvegicus
taaaatcctttaagtctgctctccc

SEQ ID NO: 536733 - DNA, 25 bp, Rattus norvegicus
taaaatcctttatgtctgctctccc

SEQ ID NO: 536734 - DNA, 25 bp, Rattus norvegicus
taaaatcgacatacagctccgtgga

SEQ ID NO: 536735 - DNA, 25 bp, Rattus norvegicus
taaaatcgacattcagctccgtgga

SEQ ID NO: 536736 - DNA, 25 bp, Rattus norvegicus
taaaatcgattcattgccgcagcag

SEQ ID NO: 536737 - DNA, 25 bp, Rattus norvegicus
taaaatcgattctttgccgcagcag

SEQ ID NO: 536738 - DNA, 25 bp, Rattus norvegicus
taaaatcgcagtaaatagctcgcct

SEQ ID NO: 536739 - DNA, 25 bp, Rattus norvegicus
taaaatcgcagttaatagctcgcct

SEQ ID NO: 536740 - DNA, 25 bp, Rattus norvegicus
taaaatctaaggagtcccagttctg

SEQ ID NO: 536741 - DNA, 25 bp, Rattus norvegicus
taaaatctaaggtgtcccagttctg

SEQ ID NO: 536742 - DNA, 25 bp, Rattus norvegicus
taaaatctcaatactctccccagaa

SEQ ID NO: 536743 - DNA, 25 bp, Rattus norvegicus
taaaatctcaattctctccccagaa

SEQ ID NO: 536744 - DNA, 25 bp, Rattus norvegicus
taaaatctccctaaaaatgcaccgt

SEQ ID NO: 536745 - DNA, 25 bp, Rattus norvegicus
taaaatctcccttaaaatgcaccgt

SEQ ID NO: 536746 - DNA, 25 bp, Rattus norvegicus
taaaatctgcgaacactgttgcccc

SEQ ID NO: 536747 - DNA, 25 bp, Rattus norvegicus
taaaatctgcgatcactgttgcccc

SEQ ID NO: 536748 - DNA, 25 bp, Rattus norvegicus
taaaatctgcttatgcccagtgagc

SEQ ID NO: 536749 - DNA, 25 bp, Rattus norvegicus
taaaatctgcttttgcccagtgagc

SEQ ID NO: 536750 - DNA, 25 bp, Rattus norvegicus
taaaatctgtctagacccaggtaaa

SEQ ID NO: 536751 - DNA, 25 bp, Rattus norvegicus
taaaatctgtcttgacccaggtaaa

SEQ ID NO: 536752 - DNA, 25 bp, Rattus norvegicus
taaaatcttcatcagggccgtgtca

SEQ ID NO: 536753 - DNA, 25 bp, Rattus norvegicus
taaaatcttcatgagggccgtgtca

SEQ ID NO: 536754 - DNA, 25 bp, Rattus norvegicus
taaaatcttgacagttttcagccag

SEQ ID NO: 536755 - DNA, 25 bp, Rattus norvegicus
taaaatcttgactgttttcagccag

SEQ ID NO: 536756 - DNA, 25 bp, Rattus norvegicus
taaaatcttggtcgtcctaaactag

SEQ ID NO: 536757 - DNA, 25 bp, Rattus norvegicus
taaaatcttggtggtcctaaactag

SEQ ID NO: 536758 - DNA, 25 bp, Rattus norvegicus
taaaatgaacatctagtcctcgtag

SEQ ID NO: 536759 - DNA, 25 bp, Rattus norvegicus
taaaatgaacatgtagtcctcgtag

SEQ ID NO: 536760 - DNA, 25 bp, Rattus norvegicus
taaaatgatcctagcccagcggtgg

SEQ ID NO: 536761 - DNA, 25 bp, Rattus norvegicus
taaaatgatccttgcccagcggtgg

SEQ ID NO: 536762 - DNA, 25 bp, Rattus norvegicus
taaaatgcaccgaccttcagcctga

SEQ ID NO: 536763 - DNA, 25 bp, Rattus norvegicus
taaaatgcaccgtccttcagcctga

SEQ ID NO: 536764 - DNA, 25 bp, Rattus norvegicus
taaaatgccatcaacttcagaggtt

SEQ ID NO: 536765 - DNA, 25 bp, Rattus norvegicus
taaaatgccatctacttcagaggtt

SEQ ID NO: 536766 - DNA, 25 bp, Rattus norvegicus
taaaatgcccaaactcctctcagat

SEQ ID NO: 536767 - DNA, 25 bp, Rattus norvegicus
taaaatgcccaatctcctctcagat

SEQ ID NO: 536768 - DNA, 25 bp, Rattus norvegicus
taaaatgctaccaaccctgtgtctg

SEQ ID NO: 536769 - DNA, 25 bp, Rattus norvegicus
taaaatgctacctaccctgtgtctg

SEQ ID NO: 536770 - DNA, 25 bp, Rattus norvegicus
taaaatgctactctcggccaggtaa

SEQ ID NO: 536771 - DNA, 25 bp, Rattus norvegicus
taaaatgctactgtcggccaggtaa

SEQ ID NO: 536772 - DNA, 25 bp, Rattus norvegicus
taaaatgctttgctttctggtgctg

SEQ ID NO: 536773 - DNA, 25 bp, Rattus norvegicus
taaaatgctttggtttctggtgctg

SEQ ID NO: 536774 - DNA, 25 bp, Rattus norvegicus
taaaatgcttttagttcttcagtgg

SEQ ID NO: 536775 - DNA, 25 bp, Rattus norvegicus
taaaatgctttttgttcttcagtgg

SEQ ID NO: 536776 - DNA, 25 bp, Rattus norvegicus
taaaatggagaaagccccttggatg

SEQ ID NO: 536777 - DNA, 25 bp, Rattus norvegicus
taaaatggagaatgccccttggatg

SEQ ID NO: 536778 - DNA, 25 bp, Rattus norvegicus
taaaatggagctatctgcagggtag

SEQ ID NO: 536779 - DNA, 25 bp, Rattus norvegicus
taaaatggagctttctgcagggtag

SEQ ID NO: 536780 - DNA, 25 bp, Rattus norvegicus
taaaatggatggcttctgtcccgtc

SEQ ID NO: 536781 - DNA, 25 bp, Rattus norvegicus
taaaatggatgggttctgtcccgtc

SEQ ID NO: 536782 - DNA, 25 bp, Rattus norvegicus
taaaatggcaagcatcatgtctgtt

SEQ ID NO: 536783 - DNA, 25 bp, Rattus norvegicus
taaaatggcaaggatcatgtctgtt

SEQ ID NO: 536784 - DNA, 25 bp, Rattus norvegicus
taaaatggccttaaaaagaagctat

SEQ ID NO: 536785 - DNA, 25 bp, Rattus norvegicus
taaaatggcctttaaaagaagctat

SEQ ID NO: 536786 - DNA, 25 bp, Rattus norvegicus
taaaatggctccatcaagacagaat

SEQ ID NO: 536787 - DNA, 25 bp, Rattus norvegicus
taaaatggctccttcaagacagaat

SEQ ID NO: 536788 - DNA, 25 bp, Rattus norvegicus
taaaatggctttactaactgttggt

SEQ ID NO: 536789 - DNA, 25 bp, Rattus norvegicus
taaaatggctttccgatacccagag

SEQ ID NO: 536790 - DNA, 25 bp, Rattus norvegicus
taaaatggctttgcgatacccagag

SEQ ID NO: 536791 - DNA, 25 bp, Rattus norvegicus
taaaatggcttttctaactgttggt

SEQ ID NO: 536792 - DNA, 25 bp, Rattus norvegicus
taaaatgggaacaacaggccttgcc

SEQ ID NO: 536793 - DNA, 25 bp, Rattus norvegicus
taaaatgggaactacaggccttgcc

SEQ ID NO: 536794 - DNA, 25 bp, Rattus norvegicus
taaaatgggctgagcttcagagagc

SEQ ID NO: 536795 - DNA, 25 bp, Rattus norvegicus
taaaatgggctgtgcttcagagagc

SEQ ID NO: 536796 - DNA, 25 bp, Rattus norvegicus
taaaatggtgacaccatgttcttcc

SEQ ID NO: 536797 - DNA, 25 bp, Rattus norvegicus
taaaatggtgactccatgttcttcc

SEQ ID NO: 536798 - DNA, 25 bp, Rattus norvegicus
taaaatgtacatatctgccaactgt

SEQ ID NO: 536799 - DNA, 25 bp, Rattus norvegicus
taaaatgtacatttctgccaactgt

SEQ ID NO: 536800 - DNA, 25 bp, Rattus norvegicus
taaaatgtaccgagaacccctctca

SEQ ID NO: 536801 - DNA, 25 bp, Rattus norvegicus
taaaatgtaccgtgaacccctctca

SEQ ID NO: 536802 - DNA, 25 bp, Rattus norvegicus
taaaatgtatttcctcacttctaga

SEQ ID NO: 536803 - DNA, 25 bp, Rattus norvegicus
taaaatgtatttgctcacttctaga

SEQ ID NO: 536804 - DNA, 25 bp, Rattus norvegicus
taaaatgtccttccaggtgggcaaa

SEQ ID NO: 536805 - DNA, 25 bp, Rattus norvegicus
taaaatgtccttgcaggtgggcaaa

SEQ ID NO: 536806 - DNA, 25 bp, Rattus norvegicus
taaaatgtctacaccaaggcctctc

SEQ ID NO: 536807 - DNA, 25 bp, Rattus norvegicus
taaaatgtctactccaaggcctctc

SEQ ID NO: 536808 - DNA, 25 bp, Rattus norvegicus
taaaatgtctgtctctgatgggttt

SEQ ID NO: 536809 - DNA, 25 bp, Rattus norvegicus
taaaatgtctgtgtctgatgggttt

SEQ ID NO: 536810 - DNA, 25 bp, Rattus norvegicus
taaaatgtgcagctctgtctccatg

SEQ ID NO: 536811 - DNA, 25 bp, Rattus norvegicus
taaaatgtgcaggtctgtctccatg

SEQ ID NO: 536812 - DNA, 25 bp, Rattus norvegicus
taaaatgtgcgtcttctcctcatgg

SEQ ID NO: 536813 - DNA, 25 bp, Rattus norvegicus
taaaatgtgcgtgttctcctcatgg

SEQ ID NO: 536814 - DNA, 25 bp, Rattus norvegicus
taaaatgtggtcaccctttgtaggc

SEQ ID NO: 536815 - DNA, 25 bp, Rattus norvegicus
taaaatgtggtctccctttgtaggc

SEQ ID NO: 536816 - DNA, 25 bp, Rattus norvegicus
taaaatgtgtctcacccggctttca

SEQ ID NO: 536817 - DNA, 25 bp, Rattus norvegicus
taaaatgtgtctgacccggctttca

SEQ ID NO: 536818 - DNA, 25 bp, Rattus norvegicus
taaaatgttctccattccatccctt

SEQ ID NO: 536819 - DNA, 25 bp, Rattus norvegicus
taaaatgttctcgattccatccctt

SEQ ID NO: 536820 - DNA, 25 bp, Rattus norvegicus
taaaattaattgcacctttggtctg

SEQ ID NO: 536821 - DNA, 25 bp, Rattus norvegicus
taaaattaattggacctttggtctg

SEQ ID NO: 536822 - DNA, 25 bp, Rattus norvegicus
taaaattaccgaccacaccctgtag

SEQ ID NO: 536823 - DNA, 25 bp, Rattus norvegicus
taaaattaccgagcacaccctgtag

SEQ ID NO: 536824 - DNA, 25 bp, Rattus norvegicus
taaaattatctactgcacttgagca

SEQ ID NO: 536825 - DNA, 25 bp, Rattus norvegicus
taaaattatctagtgcacttgagca

SEQ ID NO: 536826 - DNA, 25 bp, Rattus norvegicus
taaaattatctcacatcggtccgga

SEQ ID NO: 536827 - DNA, 25 bp, Rattus norvegicus
taaaattatctctcatcggtccgga

SEQ ID NO: 536828 - DNA, 25 bp, Rattus norvegicus
taaaattccattcagcactcttgga

SEQ ID NO: 536829 - DNA, 25 bp, Rattus norvegicus
taaaattccattgagcactcttgga

SEQ ID NO: 536830 - DNA, 25 bp, Rattus norvegicus
taaaattcccaactgccaaagcaag

SEQ ID NO: 536831 - DNA, 25 bp, Rattus norvegicus
taaaattcccaagtgccaaagcaag

SEQ ID NO: 536832 - DNA, 25 bp, Rattus norvegicus
taaaattccttgatgcgcctgcttt

SEQ ID NO: 536833 - DNA, 25 bp, Rattus norvegicus
taaaattccttgttgcgcctgcttt

SEQ ID NO: 536834 - DNA, 25 bp, Rattus norvegicus
taaaattcctttagcagtgctcgct

SEQ ID NO: 536835 - DNA, 25 bp, Rattus norvegicus
taaaattccttttgcagtgctcgct

SEQ ID NO: 536836 - DNA, 25 bp, Rattus norvegicus
taaaattctgatatagctctcacag

SEQ ID NO: 536837 - DNA, 25 bp, Rattus norvegicus
taaaattctgatttagctctcacag

SEQ ID NO: 536838 - DNA, 25 bp, Rattus norvegicus
taaaattctgctcctgactaataat

SEQ ID NO: 536839 - DNA, 25 bp, Rattus norvegicus
taaaattctgctgctgactaataat

SEQ ID NO: 536840 - DNA, 25 bp, Rattus norvegicus
taaaattctggacctccttgttgcc

SEQ ID NO: 536841 - DNA, 25 bp, Rattus norvegicus
taaaattctggagctccttgttgcc

SEQ ID NO: 536842 - DNA, 25 bp, Rattus norvegicus
taaaattctgtacatttccctgtaa

SEQ ID NO: 536843 - DNA, 25 bp, Rattus norvegicus
taaaattctgtagatttccctgtaa

SEQ ID NO: 536844 - DNA, 25 bp, Rattus norvegicus
taaaattgctggcttgtttggtaag

SEQ ID NO: 536845 - DNA, 25 bp, Rattus norvegicus
taaaattgctgggttgtttggtaag

SEQ ID NO: 536846 - DNA, 25 bp, Rattus norvegicus
taaaattggcatattccaccccatt

SEQ ID NO: 536847 - DNA, 25 bp, Rattus norvegicus
taaaattggcattttccaccccatt

SEQ ID NO: 536848 - DNA, 25 bp, Rattus norvegicus
taaaattgtcagattaacccggctg

SEQ ID NO: 536849 - DNA, 25 bp, Rattus norvegicus
taaaattgtcagtttaacccggctg

SEQ ID NO: 536850 - DNA, 25 bp, Rattus norvegicus
taaaattgtgtccaagtgccctgcc

SEQ ID NO: 536851 - DNA, 25 bp, Rattus norvegicus
taaaattgtgtcgaagtgccctgcc

SEQ ID NO: 536852 - DNA, 25 bp, Rattus norvegicus
taaaatttacatagcataccataat

SEQ ID NO: 536853 - DNA, 25 bp, Rattus norvegicus
taaaatttacattgcataccataat

SEQ ID NO: 536854 - DNA, 25 bp, Rattus norvegicus
taaaatttcatgaccttggctttag

SEQ ID NO: 536855 - DNA, 25 bp, Rattus norvegicus
taaaatttcatgtccttggctttag

SEQ ID NO: 536856 - DNA, 25 bp, Rattus norvegicus
taaaatttccttacatagtagacag

SEQ ID NO: 536857 - DNA, 25 bp, Rattus norvegicus
taaaatttcctttcatagtagacag

SEQ ID NO: 536858 - DNA, 25 bp, Rattus norvegicus
taaaattttgctccagatcctgatt

SEQ ID NO: 536859 - DNA, 25 bp, Rattus norvegicus
taaaattttgctgcagatcctgatt

SEQ ID NO: 536860 - DNA, 25 bp, Rattus norvegicus
taaacaaacctcacctgggtcattt

SEQ ID NO: 536861 - DNA, 25 bp, Rattus norvegicus
taaacaaacctctcctgggtcattt

SEQ ID NO: 536862 - DNA, 25 bp, Rattus norvegicus
taaacaaacggccaatcaacttcag

SEQ ID NO: 536863 - DNA, 25 bp, Rattus norvegicus
taaacaaacggcgaatcaacttcag

SEQ ID NO: 536864 - DNA, 25 bp, Rattus norvegicus
taaacaaagctgacgaagctgcacc

SEQ ID NO: 536865 - DNA, 25 bp, Rattus norvegicus
taaacaaagctgtcgaagctgcacc

SEQ ID NO: 536866 - DNA, 25 bp, Rattus norvegicus
taaacaaaggtgaccaagtctacaa

SEQ ID NO: 536867 - DNA, 25 bp, Rattus norvegicus
taaacaaaggtgtccaagtctacaa

SEQ ID NO: 536868 - DNA, 25 bp, Rattus norvegicus
taaacaaattgcatggtaagccaca

SEQ ID NO: 536869 - DNA, 25 bp, Rattus norvegicus
taaacaaattgcttggtaagccaca

SEQ ID NO: 536870 - DNA, 25 bp, Rattus norvegicus
taaacaacactgacgggtcaccttt

SEQ ID NO: 536871 - DNA, 25 bp, Rattus norvegicus
taaacaacactgtcgggtcaccttt

SEQ ID NO: 536872 - DNA, 25 bp, Rattus norvegicus
taaacaagacccacagcctgtgtcc

SEQ ID NO: 536873 - DNA, 25 bp, Rattus norvegicus
taaacaagaccctcagcctgtgtcc

SEQ ID NO: 536874 - DNA, 25 bp, Rattus norvegicus
taaacaagcagaagggcacacccta

SEQ ID NO: 536875 - DNA, 25 bp, Rattus norvegicus
taaacaagcagatgggcacacccta

SEQ ID NO: 536876 - DNA, 25 bp, Rattus norvegicus
taaacaaggtcaaccgcttaggcct

SEQ ID NO: 536877 - DNA, 25 bp, Rattus norvegicus
taaacaaggtcatccgcttaggcct

SEQ ID NO: 536878 - DNA, 25 bp, Rattus norvegicus
taaacaagtcacacatagcaacagt

SEQ ID NO: 536879 - DNA, 25 bp, Rattus norvegicus
taaacaagtcactcatagcaacagt

SEQ ID NO: 536880 - DNA, 25 bp, Rattus norvegicus
taaacaagtcgcattcctattccag

SEQ ID NO: 536881 - DNA, 25 bp, Rattus norvegicus
taaacaagtcgctttcctattccag

SEQ ID NO: 536882 - DNA, 25 bp, Rattus norvegicus
taaacaagttacacaccagggccca

SEQ ID NO: 536883 - DNA, 25 bp, Rattus norvegicus
taaacaagttactcaccagggccca

SEQ ID NO: 536884 - DNA, 25 bp, Rattus norvegicus
taaacaagttgaatttcccgactct

SEQ ID NO: 536885 - DNA, 25 bp, Rattus norvegicus
taaacaagttgattttcccgactct

SEQ ID NO: 536886 - DNA, 25 bp, Rattus norvegicus
taaacaatacccaatgaccctagaa

SEQ ID NO: 536887 - DNA, 25 bp, Rattus norvegicus
taaacaataccctatgaccctagaa

SEQ ID NO: 536888 - DNA, 25 bp, Rattus norvegicus
taaacaatgacacggaaggaagctg

SEQ ID NO: 536889 - DNA, 25 bp, Rattus norvegicus
taaacaatgacagggaaggaagctg

SEQ ID NO: 536890 - DNA, 25 bp, Rattus norvegicus
taaacaatggccaccttggctcatt

SEQ ID NO: 536891 - DNA, 25 bp, Rattus norvegicus
taaacaatggcctccttggctcatt

SEQ ID NO: 536892 - DNA, 25 bp, Rattus norvegicus
taaacaattgtacgcagcttctcaa

SEQ ID NO: 536893 - DNA, 25 bp, Rattus norvegicus
taaacaattgtaggcagcttctcaa

SEQ ID NO: 536894 - DNA, 25 bp, Rattus norvegicus
taaacacaaaatacgccttcttggt

SEQ ID NO: 536895 - DNA, 25 bp, Rattus norvegicus
taaacacaaaattcgccttcttggt

SEQ ID NO: 536896 - DNA, 25 bp, Rattus norvegicus
taaacacaacctcctgcatgacaga

SEQ ID NO: 536897 - DNA, 25 bp, Rattus norvegicus
taaacacaacctgctgcatgacaga

SEQ ID NO: 536898 - DNA, 25 bp, Rattus norvegicus
taaacacaccccacagcaatctgtg

SEQ ID NO: 536899 - DNA, 25 bp, Rattus norvegicus
taaacacacccctcagcaatctgtg

SEQ ID NO: 536900 - DNA, 25 bp, Rattus norvegicus
taaacacagaatacacaacattgga

SEQ ID NO: 536901 - DNA, 25 bp, Rattus norvegicus
taaacacagaattcacaacattgga

SEQ ID NO: 536902 - DNA, 25 bp, Rattus norvegicus
taaacacagcctaggagctctctga

SEQ ID NO: 536903 - DNA, 25 bp, Rattus norvegicus
taaacacagccttggagctctctga

SEQ ID NO: 536904 - DNA, 25 bp, Rattus norvegicus
taaacacaggagcacacggaggctg

SEQ ID NO: 536905 - DNA, 25 bp, Rattus norvegicus
taaacacaggaggacacggaggctg

SEQ ID NO: 536906 - DNA, 25 bp, Rattus norvegicus
taaacacagtcgaggccaatgcagc

SEQ ID NO: 536907 - DNA, 25 bp, Rattus norvegicus
taaacacagtcgtggccaatgcagc

SEQ ID NO: 536908 - DNA, 25 bp, Rattus norvegicus
taaacacagttcctactggcatatt

SEQ ID NO: 536909 - DNA, 25 bp, Rattus norvegicus
taaacacagttcgtactggcatatt

SEQ ID NO: 536910 - DNA, 25 bp, Rattus norvegicus
taaacacatcgaaatgggccacagt

SEQ ID NO: 536911 - DNA, 25 bp, Rattus norvegicus
taaacacatcgatatgggccacagt

SEQ ID NO: 536912 - DNA, 25 bp, Rattus norvegicus
taaacacattcccaccctatataaa

SEQ ID NO: 536913 - DNA, 25 bp, Rattus norvegicus
taaacacattccgaccctatataaa

SEQ ID NO: 536914 - DNA, 25 bp, Rattus norvegicus
taaacacattcgaattcacactgga

SEQ ID NO: 536915 - DNA, 25 bp, Rattus norvegicus
taaacacattcgtattcacactgga

SEQ ID NO: 536916 - DNA, 25 bp, Rattus norvegicus
taaacaccagcaacttcagggccag

SEQ ID NO: 536917 - DNA, 25 bp, Rattus norvegicus
taaacaccagcatcttcagggccag

SEQ ID NO: 536918 - DNA, 25 bp, Rattus norvegicus
taaacaccagttacaattctttcaa

SEQ ID NO: 536919 - DNA, 25 bp, Rattus norvegicus
taaacaccagtttcaattctttcaa

SEQ ID NO: 536920 - DNA, 25 bp, Rattus norvegicus
taaacaccatgtagcgtcgttctcc

SEQ ID NO: 536921 - DNA, 25 bp, Rattus norvegicus
taaacaccatgttgcgtcgttctcc

SEQ ID NO: 536922 - DNA, 25 bp, Rattus norvegicus
taaacaccattgaccaacagttccg

SEQ ID NO: 536923 - DNA, 25 bp, Rattus norvegicus
taaacaccattgtccaacagttccg

SEQ ID NO: 536924 - DNA, 25 bp, Rattus norvegicus
taaacaccccttctctgaaaactgc

SEQ ID NO: 536925 - DNA, 25 bp, Rattus norvegicus
taaacaccccttgtctgaaaactgc

SEQ ID NO: 536926 - DNA, 25 bp, Rattus norvegicus
taaacacccggcatgtgctttgcat

SEQ ID NO: 536927 - DNA, 25 bp, Rattus norvegicus
taaacacccggcttgtgctttgcat

SEQ ID NO: 536928 - DNA, 25 bp, Rattus norvegicus
taaacaccggcaatctggacctctg

SEQ ID NO: 536929 - DNA, 25 bp, Rattus norvegicus
taaacaccggcattctggacctctg

SEQ ID NO: 536930 - DNA, 25 bp, Rattus norvegicus
taaacacctctgaccctgagggcag

SEQ ID NO: 536931 - DNA, 25 bp, Rattus norvegicus
taaacacctctgaggcaagctccag

SEQ ID NO: 536932 - DNA, 25 bp, Rattus norvegicus
taaacacctctgtccctgagggcag

SEQ ID NO: 536933 - DNA, 25 bp, Rattus norvegicus
taaacacctctgtggcaagctccag

SEQ ID NO: 536934 - DNA, 25 bp, Rattus norvegicus
taaacacctcttatgggtatgcctt

SEQ ID NO: 536935 - DNA, 25 bp, Rattus norvegicus
taaacacctcttttgggtatgcctt

SEQ ID NO: 536936 - DNA, 25 bp, Rattus norvegicus
taaacacctgtaattgcgccggacc

SEQ ID NO: 536937 - DNA, 25 bp, Rattus norvegicus
taaacacctgtatttgcgccggacc

SEQ ID NO: 536938 - DNA, 25 bp, Rattus norvegicus
taaacacggatgattctaaccacgg

SEQ ID NO: 536939 - DNA, 25 bp, Rattus norvegicus
taaacacggatgtttctaaccacgg

SEQ ID NO: 536940 - DNA, 25 bp, Rattus norvegicus
taaacacgggcaacttgcagaccca

SEQ ID NO: 536941 - DNA, 25 bp, Rattus norvegicus
taaacacgggcatcttgcagaccca

SEQ ID NO: 536942 - DNA, 25 bp, Rattus norvegicus
taaacacggtttaccagccaagctg

SEQ ID NO: 536943 - DNA, 25 bp, Rattus norvegicus
taaacacggttttccagccaagctg

SEQ ID NO: 536944 - DNA, 25 bp, Rattus norvegicus
taaacacgtccgctctgaagtttct

SEQ ID NO: 536945 - DNA, 25 bp, Rattus norvegicus
taaacacgtccggtctgaagtttct

SEQ ID NO: 536946 - DNA, 25 bp, Rattus norvegicus
taaacacgtttcacactcaagtgaa

SEQ ID NO: 536947 - DNA, 25 bp, Rattus norvegicus
taaacacgtttctcactcaagtgaa

SEQ ID NO: 536948 - DNA, 25 bp, Rattus norvegicus
taaacactacgcattcgggcgttct

SEQ ID NO: 536949 - DNA, 25 bp, Rattus norvegicus
taaacactacgctttcgggcgttct

SEQ ID NO: 536950 - DNA, 25 bp, Rattus norvegicus
taaacactacggatccaacagcttc

SEQ ID NO: 536951 - DNA, 25 bp, Rattus norvegicus
taaacactacggttccaacagcttc

SEQ ID NO: 536952 - DNA, 25 bp, Rattus norvegicus
taaacactatcccagtctagtcctt

SEQ ID NO: 536953 - DNA, 25 bp, Rattus norvegicus
taaacactatccgagtctagtcctt

SEQ ID NO: 536954 - DNA, 25 bp, Rattus norvegicus
taaacactcattctgttaccttgtg

SEQ ID NO: 536955 - DNA, 25 bp, Rattus norvegicus
taaacactcattgtgttaccttgtg

SEQ ID NO: 536956 - DNA, 25 bp, Rattus norvegicus
taaacactccctaaggctttcagga

SEQ ID NO: 536957 - DNA, 25 bp, Rattus norvegicus
taaacactcccttaggctttcagga

SEQ ID NO: 536958 - DNA, 25 bp, Rattus norvegicus
taaacactcgtgacgtctgtaccgt

SEQ ID NO: 536959 - DNA, 25 bp, Rattus norvegicus
taaacactcgtgtcgtctgtaccgt

SEQ ID NO: 536960 - DNA, 25 bp, Rattus norvegicus
taaacactctgtccgactttcagct

SEQ ID NO: 536961 - DNA, 25 bp, Rattus norvegicus
taaacactctgtgcgactttcagct

SEQ ID NO: 536962 - DNA, 25 bp, Rattus norvegicus
taaacactgaacaggtcctctttcg

SEQ ID NO: 536963 - DNA, 25 bp, Rattus norvegicus
taaacactgaactggtcctctttcg

SEQ ID NO: 536964 - DNA, 25 bp, Rattus norvegicus
taaacactgctgaactagggaccat

SEQ ID NO: 536965 - DNA, 25 bp, Rattus norvegicus
taaacactgctgtactagggaccat

SEQ ID NO: 536966 - DNA, 25 bp, Rattus norvegicus
taaacactggatccttggcacctac

SEQ ID NO: 536967 - DNA, 25 bp, Rattus norvegicus
taaacactggatgcttggcacctac

SEQ ID NO: 536968 - DNA, 25 bp, Rattus norvegicus
taaacactggtgcactgcccagctg

SEQ ID NO: 536969 - DNA, 25 bp, Rattus norvegicus
taaacactggtggactgcccagctg

SEQ ID NO: 536970 - DNA, 25 bp, Rattus norvegicus
taaacactggttcatctctgaggcc

SEQ ID NO: 536971 - DNA, 25 bp, Rattus norvegicus
taaacactggttgatctctgaggcc

SEQ ID NO: 536972 - DNA, 25 bp, Rattus norvegicus
taaacactgtaaaatctatccaaat

SEQ ID NO: 536973 - DNA, 25 bp, Rattus norvegicus
taaacactgtaatatctatccaaat

SEQ ID NO: 536974 - DNA, 25 bp, Rattus norvegicus
taaacactgttaactctgcgttcca

SEQ ID NO: 536975 - DNA, 25 bp, Rattus norvegicus
taaacactgttatctctgcgttcca

SEQ ID NO: 536976 - DNA, 25 bp, Rattus norvegicus
taaacacttctgagggccgccgcgc

SEQ ID NO: 536977 - DNA, 25 bp, Rattus norvegicus
taaacacttctgtgggccgccgcgc

SEQ ID NO: 536978 - DNA, 25 bp, Rattus norvegicus
taaacactttgcatgcttgaccttc

SEQ ID NO: 536979 - DNA, 25 bp, Rattus norvegicus
taaacactttgcttgcttgaccttc

SEQ ID NO: 536980 - DNA, 25 bp, Rattus norvegicus
taaacacttttcacttcacatacct

SEQ ID NO: 536981 - DNA, 25 bp, Rattus norvegicus
taaacacttttctcttcacatacct

SEQ ID NO: 536982 - DNA, 25 bp, Rattus norvegicus
taaacagacactcccgtgctgattg

SEQ ID NO: 536983 - DNA, 25 bp, Rattus norvegicus
taaacagacactgccgtgctgattg

SEQ ID NO: 536984 - DNA, 25 bp, Rattus norvegicus
taaacagacttgagttcccgggctt

SEQ ID NO: 536985 - DNA, 25 bp, Rattus norvegicus
taaacagacttgtgttcccgggctt

SEQ ID NO: 536986 - DNA, 25 bp, Rattus norvegicus
taaacagagcaccatgcagctttag

SEQ ID NO: 536987 - DNA, 25 bp, Rattus norvegicus
taaacagagcacgatgcagctttag

SEQ ID NO: 536988 - DNA, 25 bp, Rattus norvegicus
taaacagagcatccgtacagggact

SEQ ID NO: 536989 - DNA, 25 bp, Rattus norvegicus
taaacagagcatgcgtacagggact

SEQ ID NO: 536990 - DNA, 25 bp, Rattus norvegicus
taaacagcaattcggccggcaggat

SEQ ID NO: 536991 - DNA, 25 bp, Rattus norvegicus
taaacagcaattgggccggcaggat

SEQ ID NO: 536992 - DNA, 25 bp, Rattus norvegicus
taaacagcacatcccaggtgctatc

SEQ ID NO: 536993 - DNA, 25 bp, Rattus norvegicus
taaacagcacatgccaggtgctatc

SEQ ID NO: 536994 - DNA, 25 bp, Rattus norvegicus
taaacagccatcagagtccagtcat

SEQ ID NO: 536995 - DNA, 25 bp, Rattus norvegicus
taaacagccatctgagtccagtcat

SEQ ID NO: 536996 - DNA, 25 bp, Rattus norvegicus
taaacagcccggatgcagacagacg

SEQ ID NO: 536997 - DNA, 25 bp, Rattus norvegicus
taaacagcccggttgcagacagacg

SEQ ID NO: 536998 - DNA, 25 bp, Rattus norvegicus
taaacagccctcctagcaacacagt

SEQ ID NO: 536999 - DNA, 25 bp, Rattus norvegicus
taaacagccctcgtagcaacacagt

SEQ ID NO: 537000 - DNA, 25 bp, Rattus norvegicus
taaacagcccttagtgcttccgtgt

SEQ ID NO: 537001 - DNA, 25 bp, Rattus norvegicus
taaacagccctttgtgcttccgtgt

SEQ ID NO: 537002 - DNA, 25 bp, Rattus norvegicus
taaacagcggagagcgtctcagagt

SEQ ID NO: 537003 - DNA, 25 bp, Rattus norvegicus
taaacagcggagtgcgtctcagagt

SEQ ID NO: 537004 - DNA, 25 bp, Rattus norvegicus
taaacagctcaaacctttttcgcct

SEQ ID NO: 537005 - DNA, 25 bp, Rattus norvegicus
taaacagctcaatcctttttcgcct

SEQ ID NO: 537006 - DNA, 25 bp, Rattus norvegicus
taaacagctctgattgagcactatt

SEQ ID NO: 537007 - DNA, 25 bp, Rattus norvegicus
taaacagctctgtttgagcactatt

SEQ ID NO: 537008 - DNA, 25 bp, Rattus norvegicus
taaacagctgtcagtgcgggtcctg

SEQ ID NO: 537009 - DNA, 25 bp, Rattus norvegicus
taaacagctgtctgtgcgggtcctg

SEQ ID NO: 537010 - DNA, 25 bp, Rattus norvegicus
taaacagcttccaaccagcatgtcc

SEQ ID NO: 537011 - DNA, 25 bp, Rattus norvegicus
taaacagcttcctaccagcatgtcc

SEQ ID NO: 537012 - DNA, 25 bp, Rattus norvegicus
taaacagctttcagtcctctggtga

SEQ ID NO: 537013 - DNA, 25 bp, Rattus norvegicus
taaacagctttccttctgcggcttc

SEQ ID NO: 537014 - DNA, 25 bp, Rattus norvegicus
taaacagctttcgttctgcggcttc

SEQ ID NO: 537015 - DNA, 25 bp, Rattus norvegicus
taaacagctttctgtcctctggtga

SEQ ID NO: 537016 - DNA, 25 bp, Rattus norvegicus
taaacaggactaaccaccctaatca

SEQ ID NO: 537017 - DNA, 25 bp, Rattus norvegicus
taaacaggactatccaccctaatca

SEQ ID NO: 537018 - DNA, 25 bp, Rattus norvegicus
taaacaggctctattcccgtgtaag

SEQ ID NO: 537019 - DNA, 25 bp, Rattus norvegicus
taaacaggctcttttcccgtgtaag

SEQ ID NO: 537020 - DNA, 25 bp, Rattus norvegicus
taaacaggtagccaagcccactctt

SEQ ID NO: 537021 - DNA, 25 bp, Rattus norvegicus
taaacaggtagcgaagcccactctt

SEQ ID NO: 537022 - DNA, 25 bp, Rattus norvegicus
taaacaggttttaccatagaggcac

SEQ ID NO: 537023 - DNA, 25 bp, Rattus norvegicus
taaacaggtttttccatagaggcac

SEQ ID NO: 537024 - DNA, 25 bp, Rattus norvegicus
taaacagtatggaccacgggcccca

SEQ ID NO: 537025 - DNA, 25 bp, Rattus norvegicus
taaacagtatggtccacgggcccca

SEQ ID NO: 537026 - DNA, 25 bp, Rattus norvegicus
taaacagtattcatccatagttcct

SEQ ID NO: 537027 - DNA, 25 bp, Rattus norvegicus
taaacagtattcttccatagttcct

SEQ ID NO: 537028 - DNA, 25 bp, Rattus norvegicus
taaacagtctctcgtcttttaaagg

SEQ ID NO: 537029 - DNA, 25 bp, Rattus norvegicus
taaacagtctctggtcttttaaagg

SEQ ID NO: 537030 - DNA, 25 bp, Rattus norvegicus
taaacagtctggatggccagccaac

SEQ ID NO: 537031 - DNA, 25 bp, Rattus norvegicus
taaacagtctggttggccagccaac

SEQ ID NO: 537032 - DNA, 25 bp, Rattus norvegicus
taaacagtgcaaacggccttgagat

SEQ ID NO: 537033 - DNA, 25 bp, Rattus norvegicus
taaacagtgcaatcggccttgagat

SEQ ID NO: 537034 - DNA, 25 bp, Rattus norvegicus
taaacagtgctacccataaggactc

SEQ ID NO: 537035 - DNA, 25 bp, Rattus norvegicus
taaacagtgctagccataaggactc

SEQ ID NO: 537036 - DNA, 25 bp, Rattus norvegicus
taaacagtgggactcttaaatttgc

SEQ ID NO: 537037 - DNA, 25 bp, Rattus norvegicus
taaacagtgggagtcttaaatttgc

SEQ ID NO: 537038 - DNA, 25 bp, Rattus norvegicus
taaacagttcaccaggattatttct

SEQ ID NO: 537039 - DNA, 25 bp, Rattus norvegicus
taaacagttcacgaggattatttct

SEQ ID NO: 537040 - DNA, 25 bp, Rattus norvegicus
taaacagttgctaccttgtataaaa

SEQ ID NO: 537041 - DNA, 25 bp, Rattus norvegicus
taaacagttgcttccttgtataaaa

SEQ ID NO: 537042 - DNA, 25 bp, Rattus norvegicus
taaacagtttcaaccactgagcccc

SEQ ID NO: 537043 - DNA, 25 bp, Rattus norvegicus
taaacagtttcatccactgagcccc

SEQ ID NO: 537044 - DNA, 25 bp, Rattus norvegicus
taaacatactatcgcgtccctgtag

SEQ ID NO: 537045 - DNA, 25 bp, Rattus norvegicus
taaacatactatggcgtccctgtag

SEQ ID NO: 537046 - DNA, 25 bp, Rattus norvegicus
taaacatagcatccctctcaatcct

SEQ ID NO: 537047 - DNA, 25 bp, Rattus norvegicus
taaacatagcatgcctctcaatcct

SEQ ID NO: 537048 - DNA, 25 bp, Rattus norvegicus
taaacatcaactatactttctaggt

SEQ ID NO: 537049 - DNA, 25 bp, Rattus norvegicus
taaacatcaactttactttctaggt

SEQ ID NO: 537050 - DNA, 25 bp, Rattus norvegicus
taaacatccacgcagtgtagcctac

SEQ ID NO: 537051 - DNA, 25 bp, Rattus norvegicus
taaacatccacggagtgtagcctac

SEQ ID NO: 537052 - DNA, 25 bp, Rattus norvegicus
taaacatcctatatctgagagacag

SEQ ID NO: 537053 - DNA, 25 bp, Rattus norvegicus
taaacatcctatttctgagagacag

SEQ ID NO: 537054 - DNA, 25 bp, Rattus norvegicus
taaacatctagcatttccccaaatg

SEQ ID NO: 537055 - DNA, 25 bp, Rattus norvegicus
taaacatctagcttttccccaaatg

SEQ ID NO: 537056 - DNA, 25 bp, Rattus norvegicus
taaacatctgctagcacggtggcct

SEQ ID NO: 537057 - DNA, 25 bp, Rattus norvegicus
taaacatctgcttgcacggtggcct

SEQ ID NO: 537058 - DNA, 25 bp, Rattus norvegicus
taaacatctggaatccctgccgtaa

SEQ ID NO: 537059 - DNA, 25 bp, Rattus norvegicus
taaacatctggattccctgccgtaa

SEQ ID NO: 537060 - DNA, 25 bp, Rattus norvegicus
taaacatctggcctcggactacttg

SEQ ID NO: 537061 - DNA, 25 bp, Rattus norvegicus
taaacatctggcgtcggactacttg

SEQ ID NO: 537062 - DNA, 25 bp, Rattus norvegicus
taaacatctgtgctctccaatggac

SEQ ID NO: 537063 - DNA, 25 bp, Rattus norvegicus
taaacatctgtggtctccaatggac

SEQ ID NO: 537064 - DNA, 25 bp, Rattus norvegicus
taaacatctttcaatcctggacctg

SEQ ID NO: 537065 - DNA, 25 bp, Rattus norvegicus
taaacatctttctatcctggacctg

SEQ ID NO: 537066 - DNA, 25 bp, Rattus norvegicus
taaacatgcataagtctatttcccc

SEQ ID NO: 537067 - DNA, 25 bp, Rattus norvegicus
taaacatgcatatgtctatttcccc

SEQ ID NO: 537068 - DNA, 25 bp, Rattus norvegicus
taaacatggatgacgacaggccttc

SEQ ID NO: 537069 - DNA, 25 bp, Rattus norvegicus
taaacatggatgtcgacaggccttc

SEQ ID NO: 537070 - DNA, 25 bp, Rattus norvegicus
taaacatgttctctctctgtgaggg

SEQ ID NO: 537071 - DNA, 25 bp, Rattus norvegicus
taaacatgttctgtctctgtgaggg

SEQ ID NO: 537072 - DNA, 25 bp, Rattus norvegicus
taaacatgttgcatcccactatgga

SEQ ID NO: 537073 - DNA, 25 bp, Rattus norvegicus
taaacatgttgcttcccactatgga

SEQ ID NO: 537074 - DNA, 25 bp, Rattus norvegicus
taaacattcaatatttccctctgtt

SEQ ID NO: 537075 - DNA, 25 bp, Rattus norvegicus
taaacattcaatttttccctctgtt

SEQ ID NO: 537076 - DNA, 25 bp, Rattus norvegicus
taaacattcagacagcgagacatgc

SEQ ID NO: 537077 - DNA, 25 bp, Rattus norvegicus
taaacattcagagagcgagacatgc

SEQ ID NO: 537078 - DNA, 25 bp, Rattus norvegicus
taaacattcatgctctcaggcaaat

SEQ ID NO: 537079 - DNA, 25 bp, Rattus norvegicus
taaacattcatggtctcaggcaaat

SEQ ID NO: 537080 - DNA, 25 bp, Rattus norvegicus
taaacattcccacctattgggccct

SEQ ID NO: 537081 - DNA, 25 bp, Rattus norvegicus
taaacattcccagctattgggccct

SEQ ID NO: 537082 - DNA, 25 bp, Rattus norvegicus
taaacattcccgctttctgatcttg

SEQ ID NO: 537083 - DNA, 25 bp, Rattus norvegicus
taaacattcccggtttctgatcttg

SEQ ID NO: 537084 - DNA, 25 bp, Rattus norvegicus
taaacattcctaacagcatggcaat

SEQ ID NO: 537085 - DNA, 25 bp, Rattus norvegicus
taaacattcctatcagcatggcaat

SEQ ID NO: 537086 - DNA, 25 bp, Rattus norvegicus
taaacattctttattctccactgaa

SEQ ID NO: 537087 - DNA, 25 bp, Rattus norvegicus
taaacattcttttttctccactgaa

SEQ ID NO: 537088 - DNA, 25 bp, Rattus norvegicus
taaacattgcccagagttcctctgt

SEQ ID NO: 537089 - DNA, 25 bp, Rattus norvegicus
taaacattgccctgagttcctctgt

SEQ ID NO: 537090 - DNA, 25 bp, Rattus norvegicus
taaacattgtgtaccttcagccagc

SEQ ID NO: 537091 - DNA, 25 bp, Rattus norvegicus
taaacattgtgttccttcagccagc

SEQ ID NO: 537092 - DNA, 25 bp, Rattus norvegicus
taaacatttacaacttagcatcata

SEQ ID NO: 537093 - DNA, 25 bp, Rattus norvegicus
taaacatttacatcttagcatcata

SEQ ID NO: 537094 - DNA, 25 bp, Rattus norvegicus
taaacatttcccctctggttattct

SEQ ID NO: 537095 - DNA, 25 bp, Rattus norvegicus
taaacatttcccgtctggttattct

SEQ ID NO: 537096 - DNA, 25 bp, Rattus norvegicus
taaacatttcctaaagctgctttac

SEQ ID NO: 537097 - DNA, 25 bp, Rattus norvegicus
taaacatttccttaagctgctttac

SEQ ID NO: 537098 - DNA, 25 bp, Rattus norvegicus
taaacatttcgtagtggttcgtcgc

SEQ ID NO: 537099 - DNA, 25 bp, Rattus norvegicus
taaacatttcgttgtggttcgtcgc

SEQ ID NO: 537100 - DNA, 25 bp, Rattus norvegicus
taaacatttcttaccctgcggattt

SEQ ID NO: 537101 - DNA, 25 bp, Rattus norvegicus
taaacatttctttccctgcggattt

SEQ ID NO: 537102 - DNA, 25 bp, Rattus norvegicus
taaacatttgccctgtgcactcttc

SEQ ID NO: 537103 - DNA, 25 bp, Rattus norvegicus
taaacatttgccgtgtgcactcttc

SEQ ID NO: 537104 - DNA, 25 bp, Rattus norvegicus
taaacattttgcaggttcctgtaaa

SEQ ID NO: 537105 - DNA, 25 bp, Rattus norvegicus
taaacattttgctggttcctgtaaa

SEQ ID NO: 537106 - DNA, 25 bp, Rattus norvegicus
taaaccaaatctctgccccatgggt

SEQ ID NO: 537107 - DNA, 25 bp, Rattus norvegicus
taaaccaaatctgtgccccatgggt

SEQ ID NO: 537108 - DNA, 25 bp, Rattus norvegicus
taaaccaaatgcaactgcttccctg

SEQ ID NO: 537109 - DNA, 25 bp, Rattus norvegicus
taaaccaaatgcagctgtgtgacat

SEQ ID NO: 537110 - DNA, 25 bp, Rattus norvegicus
taaaccaaatgctactgcttccctg

SEQ ID NO: 537111 - DNA, 25 bp, Rattus norvegicus
taaaccaaatgctgctgtgtgacat

SEQ ID NO: 537112 - DNA, 25 bp, Rattus norvegicus
taaaccaaatgtccgttcccttctg

SEQ ID NO: 537113 - DNA, 25 bp, Rattus norvegicus
taaaccaaatgtgcgttcccttctg

SEQ ID NO: 537114 - DNA, 25 bp, Rattus norvegicus
taaaccaaccaacacagcgttatcc

SEQ ID NO: 537115 - DNA, 25 bp, Rattus norvegicus
taaaccaaccaagacagcgttatcc

SEQ ID NO: 537116 - DNA, 25 bp, Rattus norvegicus
taaaccaaggaaccagaccggaatg

SEQ ID NO: 537117 - DNA, 25 bp, Rattus norvegicus
taaaccaaggaagcagaccggaatg

SEQ ID NO: 537118 - DNA, 25 bp, Rattus norvegicus
taaaccaatccacactatcatcctg

SEQ ID NO: 537119 - DNA, 25 bp, Rattus norvegicus
taaaccaatccagactatcatcctg

SEQ ID NO: 537120 - DNA, 25 bp, Rattus norvegicus
taaaccaatcccaattccatcaaca

SEQ ID NO: 537121 - DNA, 25 bp, Rattus norvegicus
taaaccaatccctattccatcaaca

SEQ ID NO: 537122 - DNA, 25 bp, Rattus norvegicus
taaaccaatgggactcttgtcccga

SEQ ID NO: 537123 - DNA, 25 bp, Rattus norvegicus
taaaccaatgggtctcttgtcccga

SEQ ID NO: 537124 - DNA, 25 bp, Rattus norvegicus
taaaccaattacacattatcttggg

SEQ ID NO: 537125 - DNA, 25 bp, Rattus norvegicus
taaaccaattactcattatcttggg

SEQ ID NO: 537126 - DNA, 25 bp, Rattus norvegicus
taaaccaccaccctacataaaactg

SEQ ID NO: 537127 - DNA, 25 bp, Rattus norvegicus
taaaccaccaccgtacataaaactg

SEQ ID NO: 537128 - DNA, 25 bp, Rattus norvegicus
taaaccaccatgagctcctgaaaga

SEQ ID NO: 537129 - DNA, 25 bp, Rattus norvegicus
taaaccaccatgtgctcctgaaaga

SEQ ID NO: 537130 - DNA, 25 bp, Rattus norvegicus
taaaccacccttaagagcaggctcc

SEQ ID NO: 537131 - DNA, 25 bp, Rattus norvegicus
taaaccaccctttagagcaggctcc

SEQ ID NO: 537132 - DNA, 25 bp, Rattus norvegicus
taaaccacctgtctacaatgaatcg

SEQ ID NO: 537133 - DNA, 25 bp, Rattus norvegicus
taaaccacctgtgtacaatgaatcg

SEQ ID NO: 537134 - DNA, 25 bp, Rattus norvegicus
taaaccacgggtcttaaatctgtag

SEQ ID NO: 537135 - DNA, 25 bp, Rattus norvegicus
taaaccacgggtgttaaatctgtag

SEQ ID NO: 537136 - DNA, 25 bp, Rattus norvegicus
taaaccactgctcagggagaggacc

SEQ ID NO: 537137 - DNA, 25 bp, Rattus norvegicus
taaaccactgctgagggagaggacc

SEQ ID NO: 537138 - DNA, 25 bp, Rattus norvegicus
taaaccacttccaatatttctccca

SEQ ID NO: 537139 - DNA, 25 bp, Rattus norvegicus
taaaccacttcctatatttctccca

SEQ ID NO: 537140 - DNA, 25 bp, Rattus norvegicus
taaaccagaaatatccacgttagag

SEQ ID NO: 537141 - DNA, 25 bp, Rattus norvegicus
taaaccagaaatttccacgttagag

SEQ ID NO: 537142 - DNA, 25 bp, Rattus norvegicus
taaaccagacatccttacgaacact

SEQ ID NO: 537143 - DNA, 25 bp, Rattus norvegicus
taaaccagacatgcttacgaacact

SEQ ID NO: 537144 - DNA, 25 bp, Rattus norvegicus
taaaccagaggcaccgggcgaagat

SEQ ID NO: 537145 - DNA, 25 bp, Rattus norvegicus
taaaccagaggctccgggcgaagat

SEQ ID NO: 537146 - DNA, 25 bp, Rattus norvegicus
taaaccagctgaattttctcctgct

SEQ ID NO: 537147 - DNA, 25 bp, Rattus norvegicus
taaaccagctgatttttctcctgct

SEQ ID NO: 537148 - DNA, 25 bp, Rattus norvegicus
taaaccaggcgcagtactgcggagt

SEQ ID NO: 537149 - DNA, 25 bp, Rattus norvegicus
taaaccaggcgctgtactgcggagt

SEQ ID NO: 537150 - DNA, 25 bp, Rattus norvegicus
taaaccaggctgctcatataaactc

SEQ ID NO: 537151 - DNA, 25 bp, Rattus norvegicus
taaaccaggctggtcatataaactc

SEQ ID NO: 537152 - DNA, 25 bp, Rattus norvegicus
taaaccagggtcctgacatcacaga

SEQ ID NO: 537153 - DNA, 25 bp, Rattus norvegicus
taaaccagggtcgtgacatcacaga

SEQ ID NO: 537154 - DNA, 25 bp, Rattus norvegicus
taaaccaggtgtaacaacgctccat

SEQ ID NO: 537155 - DNA, 25 bp, Rattus norvegicus
taaaccaggtgttacaacgctccat

SEQ ID NO: 537156 - DNA, 25 bp, Rattus norvegicus
taaaccagtcctccttatataattt

SEQ ID NO: 537157 - DNA, 25 bp, Rattus norvegicus
taaaccagtcctgcttatataattt

SEQ ID NO: 537158 - DNA, 25 bp, Rattus norvegicus
taaaccagtgtacaggtccaccatc

SEQ ID NO: 537159 - DNA, 25 bp, Rattus norvegicus
taaaccagtgtagaggtccaccatc

SEQ ID NO: 537160 - DNA, 25 bp, Rattus norvegicus
taaaccataattccatgcaccaatg

SEQ ID NO: 537161 - DNA, 25 bp, Rattus norvegicus
taaaccataattgcatgcaccaatg

SEQ ID NO: 537162 - DNA, 25 bp, Rattus norvegicus
taaaccatattaccaccacagtctg

SEQ ID NO: 537163 - DNA, 25 bp, Rattus norvegicus
taaaccatattagcaccacagtctg

SEQ ID NO: 537164 - DNA, 25 bp, Rattus norvegicus
taaaccatcatgacttagcctccag

SEQ ID NO: 537165 - DNA, 25 bp, Rattus norvegicus
taaaccatcatgtcttagcctccag

SEQ ID NO: 537166 - DNA, 25 bp, Rattus norvegicus
taaaccatccaaacctgggcaggct

SEQ ID NO: 537167 - DNA, 25 bp, Rattus norvegicus
taaaccatccaatcctgggcaggct

SEQ ID NO: 537168 - DNA, 25 bp, Rattus norvegicus
taaaccatccatccaggcagtcaat

SEQ ID NO: 537169 - DNA, 25 bp, Rattus norvegicus
taaaccatccatctagaccttcagg

SEQ ID NO: 537170 - DNA, 25 bp, Rattus norvegicus
taaaccatccatgcaggcagtcaat

SEQ ID NO: 537171 - DNA, 25 bp, Rattus norvegicus
taaaccatccatgtagaccttcagg

SEQ ID NO: 537172 - DNA, 25 bp, Rattus norvegicus
taaaccatctgtcgctttgaatgat

SEQ ID NO: 537173 - DNA, 25 bp, Rattus norvegicus
taaaccatctgtggctttgaatgat

SEQ ID NO: 537174 - DNA, 25 bp, Rattus norvegicus
taaaccatgtaacgctcacactcaa

SEQ ID NO: 537175 - DNA, 25 bp, Rattus norvegicus
taaaccatgtaaggctcacactcaa

SEQ ID NO: 537176 - DNA, 25 bp, Rattus norvegicus
taaaccatgtgaactattctcctag

SEQ ID NO: 537177 - DNA, 25 bp, Rattus norvegicus
taaaccatgtgatctattctcctag

SEQ ID NO: 537178 - DNA, 25 bp, Rattus norvegicus
taaaccatgtgcactttgtaatcag

SEQ ID NO: 537179 - DNA, 25 bp, Rattus norvegicus
taaaccatgtgctctttgtaatcag

SEQ ID NO: 537180 - DNA, 25 bp, Rattus norvegicus
taaaccattaatccgctatctcttc

SEQ ID NO: 537181 - DNA, 25 bp, Rattus norvegicus
taaaccattaatgcgctatctcttc

SEQ ID NO: 537182 - DNA, 25 bp, Rattus norvegicus
taaaccattacgatgtcatcagagg

SEQ ID NO: 537183 - DNA, 25 bp, Rattus norvegicus
taaaccattacgttgtcatcagagg

SEQ ID NO: 537184 - DNA, 25 bp, Rattus norvegicus
taaaccattggaaccactttgggcg

SEQ ID NO: 537185 - DNA, 25 bp, Rattus norvegicus
taaaccattggatccactttgggcg

SEQ ID NO: 537186 - DNA, 25 bp, Rattus norvegicus
taaaccattgttacctatccttccg

SEQ ID NO: 537187 - DNA, 25 bp, Rattus norvegicus
taaaccattgtttcctatccttccg

SEQ ID NO: 537188 - DNA, 25 bp, Rattus norvegicus
taaaccatttccagtgatccttctt

SEQ ID NO: 537189 - DNA, 25 bp, Rattus norvegicus
taaaccatttcctgtgatccttctt

SEQ ID NO: 537190 - DNA, 25 bp, Rattus norvegicus
taaaccattttcctctatttcaaat

SEQ ID NO: 537191 - DNA, 25 bp, Rattus norvegicus
taaaccattttcgtctatttcaaat

SEQ ID NO: 537192 - DNA, 25 bp, Rattus norvegicus
taaacccaatcaatagactcctttt

SEQ ID NO: 537193 - DNA, 25 bp, Rattus norvegicus
taaacccaatcattagactcctttt

SEQ ID NO: 537194 - DNA, 25 bp, Rattus norvegicus
taaacccagaatctccactcaaagg

SEQ ID NO: 537195 - DNA, 25 bp, Rattus norvegicus
taaacccagaatgtccactcaaagg

SEQ ID NO: 537196 - DNA, 25 bp, Rattus norvegicus
taaacccagccactcctgtcttgga

SEQ ID NO: 537197 - DNA, 25 bp, Rattus norvegicus
taaacccagccagtcctgtcttgga

SEQ ID NO: 537198 - DNA, 25 bp, Rattus norvegicus
taaacccagctgactgcttatctgt

SEQ ID NO: 537199 - DNA, 25 bp, Rattus norvegicus
taaacccagctgtctgcttatctgt

SEQ ID NO: 537200 - DNA, 25 bp, Rattus norvegicus
taaacccatagcactcttttcctga

SEQ ID NO: 537201 - DNA, 25 bp, Rattus norvegicus
taaacccatagctctcttttcctga

SEQ ID NO: 537202 - DNA, 25 bp, Rattus norvegicus
taaacccatcaaagatgctcctcgc

SEQ ID NO: 537203 - DNA, 25 bp, Rattus norvegicus
taaacccatcaatgatgctcctcgc

SEQ ID NO: 537204 - DNA, 25 bp, Rattus norvegicus
taaacccatgttatctagccagctg

SEQ ID NO: 537205 - DNA, 25 bp, Rattus norvegicus
taaacccatgttttctagccagctg

SEQ ID NO: 537206 - DNA, 25 bp, Rattus norvegicus
taaacccatttaaccatgagtccct

SEQ ID NO: 537207 - DNA, 25 bp, Rattus norvegicus
taaacccatttatccatgagtccct

SEQ ID NO: 537208 - DNA, 25 bp, Rattus norvegicus
taaaccccacgtcttgtgggactga

SEQ ID NO: 537209 - DNA, 25 bp, Rattus norvegicus
taaaccccacgtgttgtgggactga

SEQ ID NO: 537210 - DNA, 25 bp, Rattus norvegicus
taaaccccagcccttgagaggtaga

SEQ ID NO: 537211 - DNA, 25 bp, Rattus norvegicus
taaaccccagccgttgagaggtaga

SEQ ID NO: 537212 - DNA, 25 bp, Rattus norvegicus
taaacccggtttagcttaagcacat

SEQ ID NO: 537213 - DNA, 25 bp, Rattus norvegicus
taaacccggttttgcttaagcacat

SEQ ID NO: 537214 - DNA, 25 bp, Rattus norvegicus
taaacccgtcgcctagaccttcagg

SEQ ID NO: 537215 - DNA, 25 bp, Rattus norvegicus
taaacccgtcgcgtagaccttcagg

SEQ ID NO: 537216 - DNA, 25 bp, Rattus norvegicus
taaacccgtggcaaagtctgagtcc

SEQ ID NO: 537217 - DNA, 25 bp, Rattus norvegicus
taaacccgtggctaagtctgagtcc

SEQ ID NO: 537218 - DNA, 25 bp, Rattus norvegicus
taaaccctctgcatcaaataatgat

SEQ ID NO: 537219 - DNA, 25 bp, Rattus norvegicus
taaaccctctgcttcaaataatgat

SEQ ID NO: 537220 - DNA, 25 bp, Rattus norvegicus
taaaccctgctgctacgtgccatga

SEQ ID NO: 537221 - DNA, 25 bp, Rattus norvegicus
taaaccctgctggtacgtgccatga

SEQ ID NO: 537222 - DNA, 25 bp, Rattus norvegicus
taaaccctgggtctgtttcaagctg

SEQ ID NO: 537223 - DNA, 25 bp, Rattus norvegicus
taaaccctgggtgtgtttcaagctg

SEQ ID NO: 537224 - DNA, 25 bp, Rattus norvegicus
taaaccctgtggacttgcatatttt

SEQ ID NO: 537225 - DNA, 25 bp, Rattus norvegicus
taaaccctgtggtcttgcatatttt

SEQ ID NO: 537226 - DNA, 25 bp, Rattus norvegicus
taaacccttgggaatatttgacatc

SEQ ID NO: 537227 - DNA, 25 bp, Rattus norvegicus
taaacccttgggtatatttgacatc

SEQ ID NO: 537228 - DNA, 25 bp, Rattus norvegicus
taaacccttggtactggctctggct

SEQ ID NO: 537229 - DNA, 25 bp, Rattus norvegicus
taaacccttggttctggctctggct

SEQ ID NO: 537230 - DNA, 25 bp, Rattus norvegicus
taaacccttgtaccctggtcctgtg

SEQ ID NO: 537231 - DNA, 25 bp, Rattus norvegicus
taaacccttgtagcctggtcctgtg

SEQ ID NO: 537232 - DNA, 25 bp, Rattus norvegicus
taaacccttttcattggctgtatct

SEQ ID NO: 537233 - DNA, 25 bp, Rattus norvegicus
taaacccttttctttggctgtatct

SEQ ID NO: 537234 - DNA, 25 bp, Rattus norvegicus
taaaccgactcgatcaggctgcaca

SEQ ID NO: 537235 - DNA, 25 bp, Rattus norvegicus
taaaccgactcgttcaggctgcaca

SEQ ID NO: 537236 - DNA, 25 bp, Rattus norvegicus
taaaccgagacccttagtccagtcg

SEQ ID NO: 537237 - DNA, 25 bp, Rattus norvegicus
taaaccgagaccgttagtccagtcg

SEQ ID NO: 537238 - DNA, 25 bp, Rattus norvegicus
taaaccgagactcggtgctgtccta

SEQ ID NO: 537239 - DNA, 25 bp, Rattus norvegicus
taaaccgagactgggtgctgtccta

SEQ ID NO: 537240 - DNA, 25 bp, Rattus norvegicus
taaaccgagcttccttacttcagaa

SEQ ID NO: 537241 - DNA, 25 bp, Rattus norvegicus
taaaccgagcttgcttacttcagaa

SEQ ID NO: 537242 - DNA, 25 bp, Rattus norvegicus
taaaccgagtgaccgcagccgtgaa

SEQ ID NO: 537243 - DNA, 25 bp, Rattus norvegicus
taaaccgagtgagcgcagccgtgaa

SEQ ID NO: 537244 - DNA, 25 bp, Rattus norvegicus
taaaccgcttacatccagtcacaat

SEQ ID NO: 537245 - DNA, 25 bp, Rattus norvegicus
taaaccgcttacttccagtcacaat

SEQ ID NO: 537246 - DNA, 25 bp, Rattus norvegicus
taaaccgggagaagcggcacctcat

SEQ ID NO: 537247 - DNA, 25 bp, Rattus norvegicus
taaaccgggagatgcggcacctcat

SEQ ID NO: 537248 - DNA, 25 bp, Rattus norvegicus
taaaccggttctcggtgtgcactca

SEQ ID NO: 537249 - DNA, 25 bp, Rattus norvegicus
taaaccggttctgggtgtgcactca

SEQ ID NO: 537250 - DNA, 25 bp, Rattus norvegicus
taaaccggttgacagacttacctca

SEQ ID NO: 537251 - DNA, 25 bp, Rattus norvegicus
taaaccggttgagagacttacctca

SEQ ID NO: 537252 - DNA, 25 bp, Rattus norvegicus
taaaccgtggttatggtcacagtcg

SEQ ID NO: 537253 - DNA, 25 bp, Rattus norvegicus
taaaccgtggttttggtcacagtcg

SEQ ID NO: 537254 - DNA, 25 bp, Rattus norvegicus
taaaccgttaagaggcctaagcaca

SEQ ID NO: 537255 - DNA, 25 bp, Rattus norvegicus
taaaccgttaagtggcctaagcaca

SEQ ID NO: 537256 - DNA, 25 bp, Rattus norvegicus
taaaccgttgtcagctctaacacca

SEQ ID NO: 537257 - DNA, 25 bp, Rattus norvegicus
taaaccgttgtctgctctaacacca

SEQ ID NO: 537258 - DNA, 25 bp, Rattus norvegicus
taaacctaaagcactagtcgcccct

SEQ ID NO: 537259 - DNA, 25 bp, Rattus norvegicus
taaacctaaagctctagtcgcccct

SEQ ID NO: 537260 - DNA, 25 bp, Rattus norvegicus
taaacctaacacattcctcagcata

SEQ ID NO: 537261 - DNA, 25 bp, Rattus norvegicus
taaacctaacactttcctcagcata

SEQ ID NO: 537262 - DNA, 25 bp, Rattus norvegicus
taaacctaaccacttcgtgtgtcct

SEQ ID NO: 537263 - DNA, 25 bp, Rattus norvegicus
taaacctaaccagttcgtgtgtcct

SEQ ID NO: 537264 - DNA, 25 bp, Rattus norvegicus
taaacctaggctatactgggcaaac

SEQ ID NO: 537265 - DNA, 25 bp, Rattus norvegicus
taaacctaggctttactgggcaaac

SEQ ID NO: 537266 - DNA, 25 bp, Rattus norvegicus
taaacctcacaaacttgaccttacg

SEQ ID NO: 537267 - DNA, 25 bp, Rattus norvegicus
taaacctcacaatcttgaccttacg

SEQ ID NO: 537268 - DNA, 25 bp, Rattus norvegicus
taaacctcagtccagtgttgtgccg

SEQ ID NO: 537269 - DNA, 25 bp, Rattus norvegicus
taaacctcagtcgagtgttgtgccg

SEQ ID NO: 537270 - DNA, 25 bp, Rattus norvegicus
taaacctcagtgagggctactgccc

SEQ ID NO: 537271 - DNA, 25 bp, Rattus norvegicus
taaacctcagtgtgggctactgccc

SEQ ID NO: 537272 - DNA, 25 bp, Rattus norvegicus
taaacctcattaccactcaatactg

SEQ ID NO: 537273 - DNA, 25 bp, Rattus norvegicus
taaacctcattagcactcaatactg

SEQ ID NO: 537274 - DNA, 25 bp, Rattus norvegicus
taaacctcatttagccttttgccct

SEQ ID NO: 537275 - DNA, 25 bp, Rattus norvegicus
taaacctcattttgccttttgccct

SEQ ID NO: 537276 - DNA, 25 bp, Rattus norvegicus
taaacctcgaatcgctttctgactg

SEQ ID NO: 537277 - DNA, 25 bp, Rattus norvegicus
taaacctcgaatggctttctgactg

SEQ ID NO: 537278 - DNA, 25 bp, Rattus norvegicus
taaacctcgtacaggaaagcactcc

SEQ ID NO: 537279 - DNA, 25 bp, Rattus norvegicus
taaacctcgtactggaaagcactcc

SEQ ID NO: 537280 - DNA, 25 bp, Rattus norvegicus
taaacctctcatccttaagttttag

SEQ ID NO: 537281 - DNA, 25 bp, Rattus norvegicus
taaacctctcatgcttaagttttag

SEQ ID NO: 537282 - DNA, 25 bp, Rattus norvegicus
taaacctctctgctcttgtaaaatg

SEQ ID NO: 537283 - DNA, 25 bp, Rattus norvegicus
taaacctctctggtcttgtaaaatg

SEQ ID NO: 537284 - DNA, 25 bp, Rattus norvegicus
taaacctctgagatgacaattgcat

SEQ ID NO: 537285 - DNA, 25 bp, Rattus norvegicus
taaacctctgagttgacaattgcat

SEQ ID NO: 537286 - DNA, 25 bp, Rattus norvegicus
taaacctctggccaaccttgggagg

SEQ ID NO: 537287 - DNA, 25 bp, Rattus norvegicus
taaacctctggcgaaccttgggagg

SEQ ID NO: 537288 - DNA, 25 bp, Rattus norvegicus
taaacctctgtcactaactgtgaaa

SEQ ID NO: 537289 - DNA, 25 bp, Rattus norvegicus
taaacctctgtctctaactgtgaaa

SEQ ID NO: 537290 - DNA, 25 bp, Rattus norvegicus
taaacctcttccagagccctattga

SEQ ID NO: 537291 - DNA, 25 bp, Rattus norvegicus
taaacctcttcctgagccctattga

SEQ ID NO: 537292 - DNA, 25 bp, Rattus norvegicus
taaacctgcagtctgttctttctcg

SEQ ID NO: 537293 - DNA, 25 bp, Rattus norvegicus
taaacctgcagtgtgttctttctcg

SEQ ID NO: 537294 - DNA, 25 bp, Rattus norvegicus
taaacctgcatccatttaagaggac

SEQ ID NO: 537295 - DNA, 25 bp, Rattus norvegicus
taaacctgcatcgatttaagaggac

SEQ ID NO: 537296 - DNA, 25 bp, Rattus norvegicus
taaacctgccttcctgaatactctg

SEQ ID NO: 537297 - DNA, 25 bp, Rattus norvegicus
taaacctgccttgctgaatactctg

SEQ ID NO: 537298 - DNA, 25 bp, Rattus norvegicus
taaacctgctgacctccatctgtaa

SEQ ID NO: 537299 - DNA, 25 bp, Rattus norvegicus
taaacctgctgagctccatctgtaa

SEQ ID NO: 537300 - DNA, 25 bp, Rattus norvegicus
taaacctgtgaaaacttgaacccca

SEQ ID NO: 537301 - DNA, 25 bp, Rattus norvegicus
taaacctgtgaatacttgaacccca

SEQ ID NO: 537302 - DNA, 25 bp, Rattus norvegicus
taaacctgtgcccttcataatgaat

SEQ ID NO: 537303 - DNA, 25 bp, Rattus norvegicus
taaacctgtgccgttcataatgaat

SEQ ID NO: 537304 - DNA, 25 bp, Rattus norvegicus
taaacctgtggaaaacgttcagaag

SEQ ID NO: 537305 - DNA, 25 bp, Rattus norvegicus
taaacctgtggataacgttcagaag

SEQ ID NO: 537306 - DNA, 25 bp, Rattus norvegicus
taaaccttacatacatctgtgcccc

SEQ ID NO: 537307 - DNA, 25 bp, Rattus norvegicus
taaaccttacattcatctgtgcccc

SEQ ID NO: 537308 - DNA, 25 bp, Rattus norvegicus
taaaccttcctaagttgttacatgt

SEQ ID NO: 537309 - DNA, 25 bp, Rattus norvegicus
taaaccttcctatgttgttacatgt

SEQ ID NO: 537310 - DNA, 25 bp, Rattus norvegicus
taaaccttctcgataacatctctcc

SEQ ID NO: 537311 - DNA, 25 bp, Rattus norvegicus
taaaccttctcgttaacatctctcc

SEQ ID NO: 537312 - DNA, 25 bp, Rattus norvegicus
taaaccttgctaatctctcttgtct

SEQ ID NO: 537313 - DNA, 25 bp, Rattus norvegicus
taaaccttgctattctctcttgtct

SEQ ID NO: 537314 - DNA, 25 bp, Rattus norvegicus
taaaccttggataggcctttggaat

SEQ ID NO: 537315 - DNA, 25 bp, Rattus norvegicus
taaaccttggattggcctttggaat

SEQ ID NO: 537316 - DNA, 25 bp, Rattus norvegicus
taaaccttgtacatggtcagtctgg

SEQ ID NO: 537317 - DNA, 25 bp, Rattus norvegicus
taaaccttgtacttggtcagtctgg

SEQ ID NO: 537318 - DNA, 25 bp, Rattus norvegicus
taaacctttgccatagctcacagtt

SEQ ID NO: 537319 - DNA, 25 bp, Rattus norvegicus
taaacctttgccttagctcacagtt

SEQ ID NO: 537320 - DNA, 25 bp, Rattus norvegicus
taaacctttggccttatatacttgg

SEQ ID NO: 537321 - DNA, 25 bp, Rattus norvegicus
taaacctttggcgttatatacttgg

SEQ ID NO: 537322 - DNA, 25 bp, Rattus norvegicus
taaacctttgttaatgttatcgcct

SEQ ID NO: 537323 - DNA, 25 bp, Rattus norvegicus
taaacctttgtttatgttatcgcct

SEQ ID NO: 537324 - DNA, 25 bp, Rattus norvegicus
taaaccttttctatcccaagctgat

SEQ ID NO: 537325 - DNA, 25 bp, Rattus norvegicus
taaaccttttctttcccaagctgat

SEQ ID NO: 537326 - DNA, 25 bp, Rattus norvegicus
taaaccttttgccagactaaccaga

SEQ ID NO: 537327 - DNA, 25 bp, Rattus norvegicus
taaaccttttgcgagactaaccaga

SEQ ID NO: 537328 - DNA, 25 bp, Rattus norvegicus
taaacgaagcctaagccccaacatg

SEQ ID NO: 537329 - DNA, 25 bp, Rattus norvegicus
taaacgaagccttagccccaacatg

SEQ ID NO: 537330 - DNA, 25 bp, Rattus norvegicus
taaacgacacgtatctcttttgcgt

SEQ ID NO: 537331 - DNA, 25 bp, Rattus norvegicus
taaacgacacgtttctcttttgcgt

SEQ ID NO: 537332 - DNA, 25 bp, Rattus norvegicus
taaacgactactcagcttgtaccac

SEQ ID NO: 537333 - DNA, 25 bp, Rattus norvegicus
taaacgactactgagcttgtaccac

SEQ ID NO: 537334 - DNA, 25 bp, Rattus norvegicus
taaacgactcgcaccaggtggctga

SEQ ID NO: 537335 - DNA, 25 bp, Rattus norvegicus
taaacgactcgctccaggtggctga

SEQ ID NO: 537336 - DNA, 25 bp, Rattus norvegicus
taaacgacttgcacttctctgtagc

SEQ ID NO: 537337 - DNA, 25 bp, Rattus norvegicus
taaacgacttgctcttctctgtagc

SEQ ID NO: 537338 - DNA, 25 bp, Rattus norvegicus
taaacgagccaacaggtgccctgca

SEQ ID NO: 537339 - DNA, 25 bp, Rattus norvegicus
taaacgagccaagaggtgccctgca

SEQ ID NO: 537340 - DNA, 25 bp, Rattus norvegicus
taaacgagcttcatcagcaacagcc

SEQ ID NO: 537341 - DNA, 25 bp, Rattus norvegicus
taaacgagcttcttcagcaacagcc

SEQ ID NO: 537342 - DNA, 25 bp, Rattus norvegicus
taaacgagtgcccagctgaatccag

SEQ ID NO: 537343 - DNA, 25 bp, Rattus norvegicus
taaacgagtgccgagctgaatccag

SEQ ID NO: 537344 - DNA, 25 bp, Rattus norvegicus
taaacgcaccctacctgatgatgat

SEQ ID NO: 537345 - DNA, 25 bp, Rattus norvegicus
taaacgcacccttcctgatgatgat

SEQ ID NO: 537346 - DNA, 25 bp, Rattus norvegicus
taaacgcatcttcaggaggccgcca

SEQ ID NO: 537347 - DNA, 25 bp, Rattus norvegicus
taaacgcatcttgaggaggccgcca

SEQ ID NO: 537348 - DNA, 25 bp, Rattus norvegicus
taaacgccaagaagccaggctcttc

SEQ ID NO: 537349 - DNA, 25 bp, Rattus norvegicus
taaacgccaagatgccaggctcttc

SEQ ID NO: 537350 - DNA, 25 bp, Rattus norvegicus
taaacgccatctcacatgcttggtc

SEQ ID NO: 537351 - DNA, 25 bp, Rattus norvegicus
taaacgccatctgacatgcttggtc

SEQ ID NO: 537352 - DNA, 25 bp, Rattus norvegicus
taaacgccttggaggagggccagat

SEQ ID NO: 537353 - DNA, 25 bp, Rattus norvegicus
taaacgccttggtggagggccagat

SEQ ID NO: 537354 - DNA, 25 bp, Rattus norvegicus
taaacgcctttgagtgaagcttgct

SEQ ID NO: 537355 - DNA, 25 bp, Rattus norvegicus
taaacgcctttgtgtgaagcttgct

SEQ ID NO: 537356 - DNA, 25 bp, Rattus norvegicus
taaacgcgctggaacaggagctcgg

SEQ ID NO: 537357 - DNA, 25 bp, Rattus norvegicus
taaacgcgctggtacaggagctcgg

SEQ ID NO: 537358 - DNA, 25 bp, Rattus norvegicus
taaacgcggcatccagcagtttctc

SEQ ID NO: 537359 - DNA, 25 bp, Rattus norvegicus
taaacgcggcatgcagcagtttctc

SEQ ID NO: 537360 - DNA, 25 bp, Rattus norvegicus
taaacgctccaacaccagagtgcct

SEQ ID NO: 537361 - DNA, 25 bp, Rattus norvegicus
taaacgctccaagaccagagtgcct

SEQ ID NO: 537362 - DNA, 25 bp, Rattus norvegicus
taaacgctcgagattttcctagcca

SEQ ID NO: 537363 - DNA, 25 bp, Rattus norvegicus
taaacgctcgagtttttcctagcca

SEQ ID NO: 537364 - DNA, 25 bp, Rattus norvegicus
taaacgctgctaatctgagagccat

SEQ ID NO: 537365 - DNA, 25 bp, Rattus norvegicus
taaacgctgctattctgagagccat

SEQ ID NO: 537366 - DNA, 25 bp, Rattus norvegicus
taaacgctgctgatggttctaaaaa

SEQ ID NO: 537367 - DNA, 25 bp, Rattus norvegicus
taaacgctgctgttggttctaaaaa

SEQ ID NO: 537368 - DNA, 25 bp, Rattus norvegicus
taaacgctgtcactgctgatggctc

SEQ ID NO: 537369 - DNA, 25 bp, Rattus norvegicus
taaacgctgtcagtgctgatggctc

SEQ ID NO: 537370 - DNA, 25 bp, Rattus norvegicus
taaacggaaggcctcatgctttaga

SEQ ID NO: 537371 - DNA, 25 bp, Rattus norvegicus
taaacggaaggcgtcatgctttaga

SEQ ID NO: 537372 - DNA, 25 bp, Rattus norvegicus
taaacggcaggacaacagatttggt

SEQ ID NO: 537373 - DNA, 25 bp, Rattus norvegicus
taaacggcaggagaacagatttggt

SEQ ID NO: 537374 - DNA, 25 bp, Rattus norvegicus
taaacggcagtgacgaggaacccca

SEQ ID NO: 537375 - DNA, 25 bp, Rattus norvegicus
taaacggcagtgtcgaggaacccca

SEQ ID NO: 537376 - DNA, 25 bp, Rattus norvegicus
taaacgggacttattcagaccagtg

SEQ ID NO: 537377 - DNA, 25 bp, Rattus norvegicus
taaacgggactttttcagaccagtg

SEQ ID NO: 537378 - DNA, 25 bp, Rattus norvegicus
taaacgggagtaactgcttcagtac

SEQ ID NO: 537379 - DNA, 25 bp, Rattus norvegicus
taaacgggagtatctgcttcagtac

SEQ ID NO: 537380 - DNA, 25 bp, Rattus norvegicus
taaacgggcggcctagattccagct

SEQ ID NO: 537381 - DNA, 25 bp, Rattus norvegicus
taaacgggcggcgtagattccagct

SEQ ID NO: 537382 - DNA, 25 bp, Rattus norvegicus
taaacgggtcctccaaggctggttt

SEQ ID NO: 537383 - DNA, 25 bp, Rattus norvegicus
taaacgggtcctgcaaggctggttt

SEQ ID NO: 537384 - DNA, 25 bp, Rattus norvegicus
taaacgggtgtcaccaaactgcttc

SEQ ID NO: 537385 - DNA, 25 bp, Rattus norvegicus
taaacgggtgtctccaaactgcttc

SEQ ID NO: 537386 - DNA, 25 bp, Rattus norvegicus
taaacgggttttatctcaatggaag

SEQ ID NO: 537387 - DNA, 25 bp, Rattus norvegicus
taaacgggttttttctcaatggaag

SEQ ID NO: 537388 - DNA, 25 bp, Rattus norvegicus
taaacggtaggtagcgaggctccct

SEQ ID NO: 537389 - DNA, 25 bp, Rattus norvegicus
taaacggtaggttgcgaggctccct

SEQ ID NO: 537390 - DNA, 25 bp, Rattus norvegicus
taaacggtgaccaatgtttaaggct

SEQ ID NO: 537391 - DNA, 25 bp, Rattus norvegicus
taaacggtgacctatgtttaaggct

SEQ ID NO: 537392 - DNA, 25 bp, Rattus norvegicus
taaacggtgcaacaatggtaacaac

SEQ ID NO: 537393 - DNA, 25 bp, Rattus norvegicus
taaacggtgcaagaatggtaacaac

SEQ ID NO: 537394 - DNA, 25 bp, Rattus norvegicus
taaacggttcagattcctctgcact

SEQ ID NO: 537395 - DNA, 25 bp, Rattus norvegicus
taaacggttcagtttcctctgcact

SEQ ID NO: 537396 - DNA, 25 bp, Rattus norvegicus
taaacggttcttcgtctcgagtctt

SEQ ID NO: 537397 - DNA, 25 bp, Rattus norvegicus
taaacggttcttggtctcgagtctt

SEQ ID NO: 537398 - DNA, 25 bp, Rattus norvegicus
taaacgtccctaatttccacatcta

SEQ ID NO: 537399 - DNA, 25 bp, Rattus norvegicus
taaacgtccctattttccacatcta

SEQ ID NO: 537400 - DNA, 25 bp, Rattus norvegicus
taaacgtcgccacaaaggttggatt

SEQ ID NO: 537401 - DNA, 25 bp, Rattus norvegicus
taaacgtcgccagaaaggttggatt

SEQ ID NO: 537402 - DNA, 25 bp, Rattus norvegicus
taaacgtgcagcacatcgctcataa

SEQ ID NO: 537403 - DNA, 25 bp, Rattus norvegicus
taaacgtgcagctcatcgctcataa

SEQ ID NO: 537404 - DNA, 25 bp, Rattus norvegicus
taaacgtgcgtactgtcaaaggaac

SEQ ID NO: 537405 - DNA, 25 bp, Rattus norvegicus
taaacgtgcgtagtgtcaaaggaac

SEQ ID NO: 537406 - DNA, 25 bp, Rattus norvegicus
taaacgtggccaaccttagatcggg

SEQ ID NO: 537407 - DNA, 25 bp, Rattus norvegicus
taaacgtggccatccttagatcggg

SEQ ID NO: 537408 - DNA, 25 bp, Rattus norvegicus
taaacgtgttcactaaaaccacagg

SEQ ID NO: 537409 - DNA, 25 bp, Rattus norvegicus
taaacgtgttcagtaaaaccacagg

SEQ ID NO: 537410 - DNA, 25 bp, Rattus norvegicus
taaacgttgcatactttgaacctaa

SEQ ID NO: 537411 - DNA, 25 bp, Rattus norvegicus
taaacgttgcattctttgaacctaa

SEQ ID NO: 537412 - DNA, 25 bp, Rattus norvegicus
taaactaagcccattgcaatgtccc

SEQ ID NO: 537413 - DNA, 25 bp, Rattus norvegicus
taaactaagccctttgcaatgtccc

SEQ ID NO: 537414 - DNA, 25 bp, Rattus norvegicus
taaactaagttgatgcacctttcct

SEQ ID NO: 537415 - DNA, 25 bp, Rattus norvegicus
taaactaagttgttgcacctttcct

SEQ ID NO: 537416 - DNA, 25 bp, Rattus norvegicus
taaactaatcttcggctaggcgtgg

SEQ ID NO: 537417 - DNA, 25 bp, Rattus norvegicus
taaactaatcttgggctaggcgtgg

SEQ ID NO: 537418 - DNA, 25 bp, Rattus norvegicus
taaactaattggctcccagcctggc

SEQ ID NO: 537419 - DNA, 25 bp, Rattus norvegicus
taaactaattgggtcccagcctggc

SEQ ID NO: 537420 - DNA, 25 bp, Rattus norvegicus
taaactacagatctggtggctagac

SEQ ID NO: 537421 - DNA, 25 bp, Rattus norvegicus
taaactacagatgtggtggctagac

SEQ ID NO: 537422 - DNA, 25 bp, Rattus norvegicus
taaactaccgaaagacgcaggtctg

SEQ ID NO: 537423 - DNA, 25 bp, Rattus norvegicus
taaactaccgaatgacgcaggtctg

SEQ ID NO: 537424 - DNA, 25 bp, Rattus norvegicus
taaactacctaacgacagcttccaa

SEQ ID NO: 537425 - DNA, 25 bp, Rattus norvegicus
taaactacctaaggacagcttccaa

SEQ ID NO: 537426 - DNA, 25 bp, Rattus norvegicus
taaactacctatcgtgcctgttgct

SEQ ID NO: 537427 - DNA, 25 bp, Rattus norvegicus
taaactacctatggtgcctgttgct

SEQ ID NO: 537428 - DNA, 25 bp, Rattus norvegicus
taaactaccttgcagactttctcac

SEQ ID NO: 537429 - DNA, 25 bp, Rattus norvegicus
taaactaccttggagactttctcac

SEQ ID NO: 537430 - DNA, 25 bp, Rattus norvegicus
taaactactcccacctggagggtag

SEQ ID NO: 537431 - DNA, 25 bp, Rattus norvegicus
taaactactccctcctggagggtag

SEQ ID NO: 537432 - DNA, 25 bp, Rattus norvegicus
taaactactctgcttaactcctcct

SEQ ID NO: 537433 - DNA, 25 bp, Rattus norvegicus
taaactactctggttaactcctcct

SEQ ID NO: 537434 - DNA, 25 bp, Rattus norvegicus
taaactactcttatcctcacataga

SEQ ID NO: 537435 - DNA, 25 bp, Rattus norvegicus
taaactactcttttcctcacataga

SEQ ID NO: 537436 - DNA, 25 bp, Rattus norvegicus
taaactacttagaaactgcctgacc

SEQ ID NO: 537437 - DNA, 25 bp, Rattus norvegicus
taaactacttagtaactgcctgacc

SEQ ID NO: 537438 - DNA, 25 bp, Rattus norvegicus
taaactagacacagttggtccctcc

SEQ ID NO: 537439 - DNA, 25 bp, Rattus norvegicus
taaactagacactgttggtccctcc

SEQ ID NO: 537440 - DNA, 25 bp, Rattus norvegicus
taaactagatcccagtcacagctcg

SEQ ID NO: 537441 - DNA, 25 bp, Rattus norvegicus
taaactagatccgagtcacagctcg

SEQ ID NO: 537442 - DNA, 25 bp, Rattus norvegicus
taaactagctctacctccctggaag

SEQ ID NO: 537443 - DNA, 25 bp, Rattus norvegicus
taaactagctcttcctccctggaag

SEQ ID NO: 537444 - DNA, 25 bp, Rattus norvegicus
taaactagctttacccttggcggtg

SEQ ID NO: 537445 - DNA, 25 bp, Rattus norvegicus
taaactagcttttcccttggcggtg

SEQ ID NO: 537446 - DNA, 25 bp, Rattus norvegicus
taaactatacacagcccttggtggc

SEQ ID NO: 537447 - DNA, 25 bp, Rattus norvegicus
taaactatacactgcccttggtggc

SEQ ID NO: 537448 - DNA, 25 bp, Rattus norvegicus
taaactatatatctgctccccggga

SEQ ID NO: 537449 - DNA, 25 bp, Rattus norvegicus
taaactatatatgtgctccccggga

SEQ ID NO: 537450 - DNA, 25 bp, Rattus norvegicus
taaactattcctcggcctggatggc

SEQ ID NO: 537451 - DNA, 25 bp, Rattus norvegicus
taaactattcctgggcctggatggc

SEQ ID NO: 537452 - DNA, 25 bp, Rattus norvegicus
taaactattcttatcctgtctgtgc

SEQ ID NO: 537453 - DNA, 25 bp, Rattus norvegicus
taaactattcttttcctgtctgtgc

SEQ ID NO: 537454 - DNA, 25 bp, Rattus norvegicus
taaactattgttatcagctgagaat

SEQ ID NO: 537455 - DNA, 25 bp, Rattus norvegicus
taaactattgttttcagctgagaat

SEQ ID NO: 537456 - DNA, 25 bp, Rattus norvegicus
taaactcacattctgatggtagatg

SEQ ID NO: 537457 - DNA, 25 bp, Rattus norvegicus
taaactcacattgtgatggtagatg

SEQ ID NO: 537458 - DNA, 25 bp, Rattus norvegicus
taaactcaccttccagggtgggtct

SEQ ID NO: 537459 - DNA, 25 bp, Rattus norvegicus
taaactcaccttgcagggtgggtct

SEQ ID NO: 537460 - DNA, 25 bp, Rattus norvegicus
taaactcatagcaacccttctgctt

SEQ ID NO: 537461 - DNA, 25 bp, Rattus norvegicus
taaactcatagctacccttctgctt

SEQ ID NO: 537462 - DNA, 25 bp, Rattus norvegicus
taaactccatcaaggctttcacact

SEQ ID NO: 537463 - DNA, 25 bp, Rattus norvegicus
taaactccatcatggctttcacact

SEQ ID NO: 537464 - DNA, 25 bp, Rattus norvegicus
taaactccatgcagtactctccttg

SEQ ID NO: 537465 - DNA, 25 bp, Rattus norvegicus
taaactccatgctgtactctccttg

SEQ ID NO: 537466 - DNA, 25 bp, Rattus norvegicus
taaactccatgtattctttgggcct

SEQ ID NO: 537467 - DNA, 25 bp, Rattus norvegicus
taaactccatgttttctttgggcct

SEQ ID NO: 537468 - DNA, 25 bp, Rattus norvegicus
taaactcctcataaaggcccttcag

SEQ ID NO: 537469 - DNA, 25 bp, Rattus norvegicus
taaactcctcattaaggcccttcag

SEQ ID NO: 537470 - DNA, 25 bp, Rattus norvegicus
taaactcctgccctttgagattcaa

SEQ ID NO: 537471 - DNA, 25 bp, Rattus norvegicus
taaactcctgccgtttgagattcaa

SEQ ID NO: 537472 - DNA, 25 bp, Rattus norvegicus
taaactccttcgagcagctgtgcat

SEQ ID NO: 537473 - DNA, 25 bp, Rattus norvegicus
taaactccttcgtgcagctgtgcat

SEQ ID NO: 537474 - DNA, 25 bp, Rattus norvegicus
taaactcggcccatgtggacaggct

SEQ ID NO: 537475 - DNA, 25 bp, Rattus norvegicus
taaactcggcccttgtggacaggct

SEQ ID NO: 537476 - DNA, 25 bp, Rattus norvegicus
taaactcgggtgatgccagcttcag

SEQ ID NO: 537477 - DNA, 25 bp, Rattus norvegicus
taaactcgggtgttgccagcttcag

SEQ ID NO: 537478 - DNA, 25 bp, Rattus norvegicus
taaactctacgacgccgactttgtt

SEQ ID NO: 537479 - DNA, 25 bp, Rattus norvegicus
taaactctacgaggccgactttgtt

SEQ ID NO: 537480 - DNA, 25 bp, Rattus norvegicus
taaactctactgaggtactcatcag

SEQ ID NO: 537481 - DNA, 25 bp, Rattus norvegicus
taaactctactgtggtactcatcag

SEQ ID NO: 537482 - DNA, 25 bp, Rattus norvegicus
taaactctcaaaccttgggaggcgg

SEQ ID NO: 537483 - DNA, 25 bp, Rattus norvegicus
taaactctcaaagcttgggaggcgg

SEQ ID NO: 537484 - DNA, 25 bp, Rattus norvegicus
taaactctcaccatataaaccctgt

SEQ ID NO: 537485 - DNA, 25 bp, Rattus norvegicus
taaactctcaccttataaaccctgt

SEQ ID NO: 537486 - DNA, 25 bp, Rattus norvegicus
taaactctcatcagttggtagaaca

SEQ ID NO: 537487 - DNA, 25 bp, Rattus norvegicus
taaactctcatctgttggtagaaca

SEQ ID NO: 537488 - DNA, 25 bp, Rattus norvegicus
taaactctctgaactactgtcaatt

SEQ ID NO: 537489 - DNA, 25 bp, Rattus norvegicus
taaactctctgatctactgtcaatt

SEQ ID NO: 537490 - DNA, 25 bp, Rattus norvegicus
taaactctcttgagcctcagcagtg

SEQ ID NO: 537491 - DNA, 25 bp, Rattus norvegicus
taaactctcttgtgcctcagcagtg

SEQ ID NO: 537492 - DNA, 25 bp, Rattus norvegicus
taaactctgaaaaacctccttgctt

SEQ ID NO: 537493 - DNA, 25 bp, Rattus norvegicus
taaactctgaaatacctccttgctt

SEQ ID NO: 537494 - DNA, 25 bp, Rattus norvegicus
taaactctgctccatacacttgtat

SEQ ID NO: 537495 - DNA, 25 bp, Rattus norvegicus
taaactctgctcgatacacttgtat

SEQ ID NO: 537496 - DNA, 25 bp, Rattus norvegicus
taaactctgctgctttttaaagggc

SEQ ID NO: 537497 - DNA, 25 bp, Rattus norvegicus
taaactctgctggtttttaaagggc

SEQ ID NO: 537498 - DNA, 25 bp, Rattus norvegicus
taaactctggcgaggattaccgagg

SEQ ID NO: 537499 - DNA, 25 bp, Rattus norvegicus
taaactctggcgtggattaccgagg

SEQ ID NO: 537500 - DNA, 25 bp, Rattus norvegicus
taaactctgggcagagctgtgctcc

SEQ ID NO: 537501 - DNA, 25 bp, Rattus norvegicus
taaactctgggctgagctgtgctcc

SEQ ID NO: 537502 - DNA, 25 bp, Rattus norvegicus
taaactcttaaaacttctctcctgg

SEQ ID NO: 537503 - DNA, 25 bp, Rattus norvegicus
taaactcttaaatcttctctcctgg

SEQ ID NO: 537504 - DNA, 25 bp, Rattus norvegicus
taaactcttcctacagacctggcag

SEQ ID NO: 537505 - DNA, 25 bp, Rattus norvegicus
taaactcttccttcagacctggcag

SEQ ID NO: 537506 - DNA, 25 bp, Rattus norvegicus
taaactcttctcaggagctcaagta

SEQ ID NO: 537507 - DNA, 25 bp, Rattus norvegicus
taaactcttctctggagctcaagta

SEQ ID NO: 537508 - DNA, 25 bp, Rattus norvegicus
taaactgaacatctgcggtcctgcc

SEQ ID NO: 537509 - DNA, 25 bp, Rattus norvegicus
taaactgaacatgtgcggtcctgcc

SEQ ID NO: 537510 - DNA, 25 bp, Rattus norvegicus
taaactgaacccatttcctaccgag

SEQ ID NO: 537511 - DNA, 25 bp, Rattus norvegicus
taaactgaacccttttcctaccgag

SEQ ID NO: 537512 - DNA, 25 bp, Rattus norvegicus
taaactgacacgactcctgcaggat

SEQ ID NO: 537513 - DNA, 25 bp, Rattus norvegicus
taaactgacacgtctcctgcaggat

SEQ ID NO: 537514 - DNA, 25 bp, Rattus norvegicus
taaactgacagccatggaccctctt

SEQ ID NO: 537515 - DNA, 25 bp, Rattus norvegicus
taaactgacagcgatggaccctctt

SEQ ID NO: 537516 - DNA, 25 bp, Rattus norvegicus
taaactgactcacatacacggccca

SEQ ID NO: 537517 - DNA, 25 bp, Rattus norvegicus
taaactgactcagatacacggccca

SEQ ID NO: 537518 - DNA, 25 bp, Rattus norvegicus
taaactgataatagcctttgaaggc

SEQ ID NO: 537519 - DNA, 25 bp, Rattus norvegicus
taaactgataattgcctttgaaggc

SEQ ID NO: 537520 - DNA, 25 bp, Rattus norvegicus
taaactgatcttcgtaatactgtac

SEQ ID NO: 537521 - DNA, 25 bp, Rattus norvegicus
taaactgatcttggtaatactgtac

SEQ ID NO: 537522 - DNA, 25 bp, Rattus norvegicus
taaactgcagccacgagctctggaa

SEQ ID NO: 537523 - DNA, 25 bp, Rattus norvegicus
taaactgcagcctcgagctctggaa

SEQ ID NO: 537524 - DNA, 25 bp, Rattus norvegicus
taaactgcatggcttttatacagct

SEQ ID NO: 537525 - DNA, 25 bp, Rattus norvegicus
taaactgcatgggttttatacagct

SEQ ID NO: 537526 - DNA, 25 bp, Rattus norvegicus
taaactgccaagaaccagattttta

SEQ ID NO: 537527 - DNA, 25 bp, Rattus norvegicus
taaactgccaagtaccagattttta

SEQ ID NO: 537528 - DNA, 25 bp, Rattus norvegicus
taaactgccagacttttcaaaccgg

SEQ ID NO: 537529 - DNA, 25 bp, Rattus norvegicus
taaactgccagagttttcaaaccgg

SEQ ID NO: 537530 - DNA, 25 bp, Rattus norvegicus
taaactgcccttcggtaaggatact

SEQ ID NO: 537531 - DNA, 25 bp, Rattus norvegicus
taaactgcccttgggtaaggatact

SEQ ID NO: 537532 - DNA, 25 bp, Rattus norvegicus
taaactgcctcgagcttccgagatg

SEQ ID NO: 537533 - DNA, 25 bp, Rattus norvegicus
taaactgcctcgtgcttccgagatg

SEQ ID NO: 537534 - DNA, 25 bp, Rattus norvegicus
taaactgctcctcaaatcatcttgg

SEQ ID NO: 537535 - DNA, 25 bp, Rattus norvegicus
taaactgctcctgaaatcatcttgg

SEQ ID NO: 537536 - DNA, 25 bp, Rattus norvegicus
taaactgctcttcccaaagacccaa

SEQ ID NO: 537537 - DNA, 25 bp, Rattus norvegicus
taaactgctcttgccaaagacccaa

SEQ ID NO: 537538 - DNA, 25 bp, Rattus norvegicus
taaactgctgcactatcacatgaag

SEQ ID NO: 537539 - DNA, 25 bp, Rattus norvegicus
taaactgctgcagtatcacatgaag

SEQ ID NO: 537540 - DNA, 25 bp, Rattus norvegicus
taaactgctggtaggcaacaagagt

SEQ ID NO: 537541 - DNA, 25 bp, Rattus norvegicus
taaactgctggttggcaacaagagt

SEQ ID NO: 537542 - DNA, 25 bp, Rattus norvegicus
taaactgcttacaatgatccaggag

SEQ ID NO: 537543 - DNA, 25 bp, Rattus norvegicus
taaactgcttactatgatccaggag

SEQ ID NO: 537544 - DNA, 25 bp, Rattus norvegicus
taaactggaataactctcctttagt

SEQ ID NO: 537545 - DNA, 25 bp, Rattus norvegicus
taaactggaatatctctcctttagt

SEQ ID NO: 537546 - DNA, 25 bp, Rattus norvegicus
taaactggatctctgtggcctaggt

SEQ ID NO: 537547 - DNA, 25 bp, Rattus norvegicus
taaactggatctgtgtggcctaggt

SEQ ID NO: 537548 - DNA, 25 bp, Rattus norvegicus
taaactggctgaccggttctttggc

SEQ ID NO: 537549 - DNA, 25 bp, Rattus norvegicus
taaactggctgagcggttctttggc

SEQ ID NO: 537550 - DNA, 25 bp, Rattus norvegicus
taaactgggctcatgcatgacctat

SEQ ID NO: 537551 - DNA, 25 bp, Rattus norvegicus
taaactgggctcttgcatgacctat

SEQ ID NO: 537552 - DNA, 25 bp, Rattus norvegicus
taaactgggcttcaaggtctttaag

SEQ ID NO: 537553 - DNA, 25 bp, Rattus norvegicus
taaactgggcttgaaggtctttaag

SEQ ID NO: 537554 - DNA, 25 bp, Rattus norvegicus
taaactgggtggaggtgtacggcaa

SEQ ID NO: 537555 - DNA, 25 bp, Rattus norvegicus
taaactgggtggtggtgtacggcaa

SEQ ID NO: 537556 - DNA, 25 bp, Rattus norvegicus
taaactgggttgatacattcaaaag

SEQ ID NO: 537557 - DNA, 25 bp, Rattus norvegicus
taaactgggttgttacattcaaaag

SEQ ID NO: 537558 - DNA, 25 bp, Rattus norvegicus
taaactggtaagagcacgcctttcc

SEQ ID NO: 537559 - DNA, 25 bp, Rattus norvegicus
taaactggtaagtgcacgcctttcc

SEQ ID NO: 537560 - DNA, 25 bp, Rattus norvegicus
taaactggttccacggtttccagat

SEQ ID NO: 537561 - DNA, 25 bp, Rattus norvegicus
taaactggttcctcggtttccagat

SEQ ID NO: 537562 - DNA, 25 bp, Rattus norvegicus
taaactgtaacactctctttggaac

SEQ ID NO: 537563 - DNA, 25 bp, Rattus norvegicus
taaactgtaacagtctctttggaac

SEQ ID NO: 537564 - DNA, 25 bp, Rattus norvegicus
taaactgtaaccatctcatgctgcc

SEQ ID NO: 537565 - DNA, 25 bp, Rattus norvegicus
taaactgtaaccttctcatgctgcc

SEQ ID NO: 537566 - DNA, 25 bp, Rattus norvegicus
taaactgtaagtccctttctggagg

SEQ ID NO: 537567 - DNA, 25 bp, Rattus norvegicus
taaactgtaagtgcctttctggagg

SEQ ID NO: 537568 - DNA, 25 bp, Rattus norvegicus
taaactgtacaaccaccatgcacgt

SEQ ID NO: 537569 - DNA, 25 bp, Rattus norvegicus
taaactgtacaagcaccatgcacgt

SEQ ID NO: 537570 - DNA, 25 bp, Rattus norvegicus
taaactgtacttatactcatgctga

SEQ ID NO: 537571 - DNA, 25 bp, Rattus norvegicus
taaactgtacttctttactctggta

SEQ ID NO: 537572 - DNA, 25 bp, Rattus norvegicus
taaactgtacttgtttactctggta

SEQ ID NO: 537573 - DNA, 25 bp, Rattus norvegicus
taaactgtacttttactcatgctga

SEQ ID NO: 537574 - DNA, 25 bp, Rattus norvegicus
taaactgtagccaatagcgtccaag

SEQ ID NO: 537575 - DNA, 25 bp, Rattus norvegicus
taaactgtagcctatagcgtccaag

SEQ ID NO: 537576 - DNA, 25 bp, Rattus norvegicus
taaactgtagtcatgtcttccaccc

SEQ ID NO: 537577 - DNA, 25 bp, Rattus norvegicus
taaactgtagtcttgtcttccaccc

SEQ ID NO: 537578 - DNA, 25 bp, Rattus norvegicus
taaactgtcagtccttatgccaaaa

SEQ ID NO: 537579 - DNA, 25 bp, Rattus norvegicus
taaactgtcagtgcttatgccaaaa

SEQ ID NO: 537580 - DNA, 25 bp, Rattus norvegicus
taaactgtcctgacatctgccaggc

SEQ ID NO: 537581 - DNA, 25 bp, Rattus norvegicus
taaactgtcctgtcatctgccaggc

SEQ ID NO: 537582 - DNA, 25 bp, Rattus norvegicus
taaactgtctcccaaggcatgcaag

SEQ ID NO: 537583 - DNA, 25 bp, Rattus norvegicus
taaactgtctccgaaggcatgcaag

SEQ ID NO: 537584 - DNA, 25 bp, Rattus norvegicus
taaactgtctgcattttcattcccc

SEQ ID NO: 537585 - DNA, 25 bp, Rattus norvegicus
taaactgtctgctttttcattcccc

SEQ ID NO: 537586 - DNA, 25 bp, Rattus norvegicus
taaactgtcttcatcctgactatga

SEQ ID NO: 537587 - DNA, 25 bp, Rattus norvegicus
taaactgtcttcttcctgactatga

SEQ ID NO: 537588 - DNA, 25 bp, Rattus norvegicus
taaactgtgttacctgatgctgcaa

SEQ ID NO: 537589 - DNA, 25 bp, Rattus norvegicus
taaactgtgttagctgatgctgcaa

SEQ ID NO: 537590 - DNA, 25 bp, Rattus norvegicus
taaactgttgctatgcttcctgcta

SEQ ID NO: 537591 - DNA, 25 bp, Rattus norvegicus
taaactgttgctttgcttcctgcta

SEQ ID NO: 537592 - DNA, 25 bp, Rattus norvegicus
taaactgttgttcccagggtcttcc

SEQ ID NO: 537593 - DNA, 25 bp, Rattus norvegicus
taaactgttgttgccagggtcttcc

SEQ ID NO: 537594 - DNA, 25 bp, Rattus norvegicus
taaactgtttggaaggtgctgggca

SEQ ID NO: 537595 - DNA, 25 bp, Rattus norvegicus
taaactgtttggtaggtgctgggca

SEQ ID NO: 537596 - DNA, 25 bp, Rattus norvegicus
taaacttaaaacaactgtcgtgtct

SEQ ID NO: 537597 - DNA, 25 bp, Rattus norvegicus
taaacttaaaactactgtcgtgtct

SEQ ID NO: 537598 - DNA, 25 bp, Rattus norvegicus
taaacttaatgacaaaccgaaggag

SEQ ID NO: 537599 - DNA, 25 bp, Rattus norvegicus
taaacttaatgagaaaccgaaggag

SEQ ID NO: 537600 - DNA, 25 bp, Rattus norvegicus
taaacttacacaaactcagcctgcg

SEQ ID NO: 537601 - DNA, 25 bp, Rattus norvegicus
taaacttacacatactcagcctgcg

SEQ ID NO: 537602 - DNA, 25 bp, Rattus norvegicus
taaacttacagcaggcaatgccttg

SEQ ID NO: 537603 - DNA, 25 bp, Rattus norvegicus
taaacttacagctggcaatgccttg

SEQ ID NO: 537604 - DNA, 25 bp, Rattus norvegicus
taaacttagttgctaatacccgtct

SEQ ID NO: 537605 - DNA, 25 bp, Rattus norvegicus
taaacttagttggtaatacccgtct

SEQ ID NO: 537606 - DNA, 25 bp, Rattus norvegicus
taaacttcacctcagggttcctcat

SEQ ID NO: 537607 - DNA, 25 bp, Rattus norvegicus
taaacttcacctgagggttcctcat

SEQ ID NO: 537608 - DNA, 25 bp, Rattus norvegicus
taaacttcagcaacccttacagtat

SEQ ID NO: 537609 - DNA, 25 bp, Rattus norvegicus
taaacttcagcatcccttacagtat

SEQ ID NO: 537610 - DNA, 25 bp, Rattus norvegicus
taaacttcaggacatgctccaagca

SEQ ID NO: 537611 - DNA, 25 bp, Rattus norvegicus
taaacttcaggagatgctccaagca

SEQ ID NO: 537612 - DNA, 25 bp, Rattus norvegicus
taaacttcagtcacggtgatggtgt

SEQ ID NO: 537613 - DNA, 25 bp, Rattus norvegicus
taaacttcagtctcggtgatggtgt

SEQ ID NO: 537614 - DNA, 25 bp, Rattus norvegicus
taaacttcatgaatgaccctgccaa

SEQ ID NO: 537615 - DNA, 25 bp, Rattus norvegicus
taaacttcatgattgaccctgccaa

SEQ ID NO: 537616 - DNA, 25 bp, Rattus norvegicus
taaacttccagtactgggctctcaa

SEQ ID NO: 537617 - DNA, 25 bp, Rattus norvegicus
taaacttccagttctgggctctcaa

SEQ ID NO: 537618 - DNA, 25 bp, Rattus norvegicus
taaacttcccaccagtcgtggtgaa

SEQ ID NO: 537619 - DNA, 25 bp, Rattus norvegicus
taaacttcccacgagtcgtggtgaa

SEQ ID NO: 537620 - DNA, 25 bp, Rattus norvegicus
taaacttcccctactgtcggagcgg

SEQ ID NO: 537621 - DNA, 25 bp, Rattus norvegicus
taaacttccccttctgtcggagcgg

SEQ ID NO: 537622 - DNA, 25 bp, Rattus norvegicus
taaacttccgtaacagtccttagat

SEQ ID NO: 537623 - DNA, 25 bp, Rattus norvegicus
taaacttccgtatcagtccttagat

SEQ ID NO: 537624 - DNA, 25 bp, Rattus norvegicus
taaacttcgcccatggcttaaggat

SEQ ID NO: 537625 - DNA, 25 bp, Rattus norvegicus
taaacttcgcccttggcttaaggat

SEQ ID NO: 537626 - DNA, 25 bp, Rattus norvegicus
taaacttctcatccaatcttttgta

SEQ ID NO: 537627 - DNA, 25 bp, Rattus norvegicus
taaacttctcatgcaatcttttgta

SEQ ID NO: 537628 - DNA, 25 bp, Rattus norvegicus
taaacttctcctctatatactctgc

SEQ ID NO: 537629 - DNA, 25 bp, Rattus norvegicus
taaacttctcctgtatatactctgc

SEQ ID NO: 537630 - DNA, 25 bp, Rattus norvegicus
taaacttctgacatcttggctgtat

SEQ ID NO: 537631 - DNA, 25 bp, Rattus norvegicus
taaacttctgacttcttggctgtat

SEQ ID NO: 537632 - DNA, 25 bp, Rattus norvegicus
taaacttcttaacttccgggatgag

SEQ ID NO: 537633 - DNA, 25 bp, Rattus norvegicus
taaacttcttaagttccgggatgag

SEQ ID NO: 537634 - DNA, 25 bp, Rattus norvegicus
taaacttcttatacctctcaagtcc

SEQ ID NO: 537635 - DNA, 25 bp, Rattus norvegicus
taaacttcttattcctctcaagtcc

SEQ ID NO: 537636 - DNA, 25 bp, Rattus norvegicus
taaacttgagtgatcaggagcaggg

SEQ ID NO: 537637 - DNA, 25 bp, Rattus norvegicus
taaacttgagtgttcaggagcaggg

SEQ ID NO: 537638 - DNA, 25 bp, Rattus norvegicus
taaacttgctggattcgtgtagcca

SEQ ID NO: 537639 - DNA, 25 bp, Rattus norvegicus
taaacttgctggtttcgtgtagcca

SEQ ID NO: 537640 - DNA, 25 bp, Rattus norvegicus
taaacttggacacagctggagcaca

SEQ ID NO: 537641 - DNA, 25 bp, Rattus norvegicus
taaacttggacagagctggagcaca

SEQ ID NO: 537642 - DNA, 25 bp, Rattus norvegicus
taaacttgggtcaccaggcttggct

SEQ ID NO: 537643 - DNA, 25 bp, Rattus norvegicus
taaacttgggtcaggcctcatgatg

SEQ ID NO: 537644 - DNA, 25 bp, Rattus norvegicus
taaacttgggtctccaggcttggct

SEQ ID NO: 537645 - DNA, 25 bp, Rattus norvegicus
taaacttgggtctggcctcatgatg

SEQ ID NO: 537646 - DNA, 25 bp, Rattus norvegicus
taaacttggtctaggctgcattctt

SEQ ID NO: 537647 - DNA, 25 bp, Rattus norvegicus
taaacttggtcttggctgcattctt

SEQ ID NO: 537648 - DNA, 25 bp, Rattus norvegicus
taaactttagctaatggccctactc

SEQ ID NO: 537649 - DNA, 25 bp, Rattus norvegicus
taaactttagcttatggccctactc

SEQ ID NO: 537650 - DNA, 25 bp, Rattus norvegicus
taaactttattgcatcccttagaat

SEQ ID NO: 537651 - DNA, 25 bp, Rattus norvegicus
taaactttattggatcccttagaat

SEQ ID NO: 537652 - DNA, 25 bp, Rattus norvegicus
taaactttcaggatctatgcaaatg

SEQ ID NO: 537653 - DNA, 25 bp, Rattus norvegicus
taaactttcaggttctatgcaaatg

SEQ ID NO: 537654 - DNA, 25 bp, Rattus norvegicus
taaactttctctagcttcccttttg

SEQ ID NO: 537655 - DNA, 25 bp, Rattus norvegicus
taaactttctcttgcttcccttttg

SEQ ID NO: 537656 - DNA, 25 bp, Rattus norvegicus
taaactttgctcagagaagcgcctt

SEQ ID NO: 537657 - DNA, 25 bp, Rattus norvegicus
taaactttgctctgagaagcgcctt

SEQ ID NO: 537658 - DNA, 25 bp, Rattus norvegicus
taaactttggccaggtgtccactta

SEQ ID NO: 537659 - DNA, 25 bp, Rattus norvegicus
taaactttggcctggtgtccactta

SEQ ID NO: 537660 - DNA, 25 bp, Rattus norvegicus
taaactttgtatagtcctcccagtg

SEQ ID NO: 537661 - DNA, 25 bp, Rattus norvegicus
taaactttgtattgtcctcccagtg

SEQ ID NO: 537662 - DNA, 25 bp, Rattus norvegicus
taaacttttgatccttctgcctatg

SEQ ID NO: 537663 - DNA, 25 bp, Rattus norvegicus
taaacttttgatgcttctgcctatg

SEQ ID NO: 537664 - DNA, 25 bp, Rattus norvegicus
taaactttttctcagggcctaactg

SEQ ID NO: 537665 - DNA, 25 bp, Rattus norvegicus
taaactttttctgagggcctaactg

SEQ ID NO: 537666 - DNA, 25 bp, Rattus norvegicus
taaactttttgtcccttaggttatg

SEQ ID NO: 537667 - DNA, 25 bp, Rattus norvegicus
taaactttttgtgccttaggttatg

SEQ ID NO: 537668 - DNA, 25 bp, Rattus norvegicus
taaacttttttgatatatggtgatt

SEQ ID NO: 537669 - DNA, 25 bp, Rattus norvegicus
taaacttttttgttatatggtgatt

SEQ ID NO: 537670 - DNA, 25 bp, Rattus norvegicus
taaagaaaacccaccgagcttcaga

SEQ ID NO: 537671 - DNA, 25 bp, Rattus norvegicus
taaagaaaaccctccgagcttcaga

SEQ ID NO: 537672 - DNA, 25 bp, Rattus norvegicus
taaagaaaccccaactgagcttccg

SEQ ID NO: 537673 - DNA, 25 bp, Rattus norvegicus
taaagaaacccctactgagcttccg

SEQ ID NO: 537674 - DNA, 25 bp, Rattus norvegicus
taaagaaagcctcctgttgcctggg

SEQ ID NO: 537675 - DNA, 25 bp, Rattus norvegicus
taaagaaagcctgctgttgcctggg

SEQ ID NO: 537676 - DNA, 25 bp, Rattus norvegicus
taaagaaagcgcatccacctgagct

SEQ ID NO: 537677 - DNA, 25 bp, Rattus norvegicus
taaagaaagcgcttccacctgagct

SEQ ID NO: 537678 - DNA, 25 bp, Rattus norvegicus
taaagaaagcttcccaggtcctatc

SEQ ID NO: 537679 - DNA, 25 bp, Rattus norvegicus
taaagaaagcttgccaggtcctatc

SEQ ID NO: 537680 - DNA, 25 bp, Rattus norvegicus
taaagaaaggtcaccccaatgccct

SEQ ID NO: 537681 - DNA, 25 bp, Rattus norvegicus
taaagaaaggtctccccaatgccct

SEQ ID NO: 537682 - DNA, 25 bp, Rattus norvegicus
taaagaaatccaaccccgccaggtg

SEQ ID NO: 537683 - DNA, 25 bp, Rattus norvegicus
taaagaaatccatccccgccaggtg

SEQ ID NO: 537684 - DNA, 25 bp, Rattus norvegicus
taaagaaattccacagccaactgat

SEQ ID NO: 537685 - DNA, 25 bp, Rattus norvegicus
taaagaaattcctcagccaactgat

SEQ ID NO: 537686 - DNA, 25 bp, Rattus norvegicus
taaagaaatttcacaggccacccca

SEQ ID NO: 537687 - DNA, 25 bp, Rattus norvegicus
taaagaaatttctcaggccacccca

SEQ ID NO: 537688 - DNA, 25 bp, Rattus norvegicus
taaagaacaaacctcatcctaagtg

SEQ ID NO: 537689 - DNA, 25 bp, Rattus norvegicus
taaagaacaaacgtcatcctaagtg

SEQ ID NO: 537690 - DNA, 25 bp, Rattus norvegicus
taaagaacaaggcatccctcgggtc

SEQ ID NO: 537691 - DNA, 25 bp, Rattus norvegicus
taaagaacaagggatccctcgggtc

SEQ ID NO: 537692 - DNA, 25 bp, Rattus norvegicus
taaagaacatatactaccctcccta

SEQ ID NO: 537693 - DNA, 25 bp, Rattus norvegicus
taaagaacatattctaccctcccta

SEQ ID NO: 537694 - DNA, 25 bp, Rattus norvegicus
taaagaacatggaaccctttggtgg

SEQ ID NO: 537695 - DNA, 25 bp, Rattus norvegicus
taaagaacatggtaccctttggtgg

SEQ ID NO: 537696 - DNA, 25 bp, Rattus norvegicus
taaagaaccagtaaccctcgagact

SEQ ID NO: 537697 - DNA, 25 bp, Rattus norvegicus
taaagaaccagttaccctcgagact

SEQ ID NO: 537698 - DNA, 25 bp, Rattus norvegicus
taaagaacggcgacttaaccgcact

SEQ ID NO: 537699 - DNA, 25 bp, Rattus norvegicus
taaagaacggcgtcttaaccgcact

SEQ ID NO: 537700 - DNA, 25 bp, Rattus norvegicus
taaagaactgttacccctctgttgt

SEQ ID NO: 537701 - DNA, 25 bp, Rattus norvegicus
taaagaactgtttcccctctgttgt

SEQ ID NO: 537702 - DNA, 25 bp, Rattus norvegicus
taaagaacttggcttctactcccat

SEQ ID NO: 537703 - DNA, 25 bp, Rattus norvegicus
taaagaacttgggttctactcccat

SEQ ID NO: 537704 - DNA, 25 bp, Rattus norvegicus
taaagaagcttaagcactcctcctt

SEQ ID NO: 537705 - DNA, 25 bp, Rattus norvegicus
taaagaagcttatgcactcctcctt

SEQ ID NO: 537706 - DNA, 25 bp, Rattus norvegicus
taaagaaggtgtcttccccctgcgg

SEQ ID NO: 537707 - DNA, 25 bp, Rattus norvegicus
taaagaaggtgtgttccccctgcgg

SEQ ID NO: 537708 - DNA, 25 bp, Rattus norvegicus
taaagaaggttaccgccatgctagg

SEQ ID NO: 537709 - DNA, 25 bp, Rattus norvegicus
taaagaaggttagcgccatgctagg

SEQ ID NO: 537710 - DNA, 25 bp, Rattus norvegicus
taaagaatcattctgcaaccccagc

SEQ ID NO: 537711 - DNA, 25 bp, Rattus norvegicus
taaagaatcattgtgcaaccccagc

SEQ ID NO: 537712 - DNA, 25 bp, Rattus norvegicus
taaagaatcgcccatcgatgccaca

SEQ ID NO: 537713 - DNA, 25 bp, Rattus norvegicus
taaagaatcgccgatcgatgccaca

SEQ ID NO: 537714 - DNA, 25 bp, Rattus norvegicus
taaagaatctgtctccaagccatcc

SEQ ID NO: 537715 - DNA, 25 bp, Rattus norvegicus
taaagaatctgtgtccaagccatcc

SEQ ID NO: 537716 - DNA, 25 bp, Rattus norvegicus
taaagacaacttcacagcggcaggt

SEQ ID NO: 537717 - DNA, 25 bp, Rattus norvegicus
taaagacaacttgacagcggcaggt

SEQ ID NO: 537718 - DNA, 25 bp, Rattus norvegicus
taaagacaccacctaaacgtccagg

SEQ ID NO: 537719 - DNA, 25 bp, Rattus norvegicus
taaagacaccacgtaaacgtccagg

SEQ ID NO: 537720 - DNA, 25 bp, Rattus norvegicus
taaagacacccaccagccagagtta

SEQ ID NO: 537721 - DNA, 25 bp, Rattus norvegicus
taaagacacccagcagccagagtta

SEQ ID NO: 537722 - DNA, 25 bp, Rattus norvegicus
taaagacacctacagccaggagctg

SEQ ID NO: 537723 - DNA, 25 bp, Rattus norvegicus
taaagacacctagagccaggagctg

SEQ ID NO: 537724 - DNA, 25 bp, Rattus norvegicus
taaagacacggcatgcatttccggc

SEQ ID NO: 537725 - DNA, 25 bp, Rattus norvegicus
taaagacacggcttgcatttccggc

SEQ ID NO: 537726 - DNA, 25 bp, Rattus norvegicus
taaagacactgcactcaggtcaact

SEQ ID NO: 537727 - DNA, 25 bp, Rattus norvegicus
taaagacactgctctcaggtcaact

SEQ ID NO: 537728 - DNA, 25 bp, Rattus norvegicus
taaagacactggctctgggacatct

SEQ ID NO: 537729 - DNA, 25 bp, Rattus norvegicus
taaagacactgggtctgggacatct

SEQ ID NO: 537730 - DNA, 25 bp, Rattus norvegicus
taaagacacttgctaccaacactgc

SEQ ID NO: 537731 - DNA, 25 bp, Rattus norvegicus
taaagacacttggtaccaacactgc

SEQ ID NO: 537732 - DNA, 25 bp, Rattus norvegicus
taaagacagaatccaatccattgaa

SEQ ID NO: 537733 - DNA, 25 bp, Rattus norvegicus
taaagacagaatgcaatccattgaa

SEQ ID NO: 537734 - DNA, 25 bp, Rattus norvegicus
taaagacagactccaacattgccct

SEQ ID NO: 537735 - DNA, 25 bp, Rattus norvegicus
taaagacagactgcaacattgccct

SEQ ID NO: 537736 - DNA, 25 bp, Rattus norvegicus
taaagacagcctacatgtccagccg

SEQ ID NO: 537737 - DNA, 25 bp, Rattus norvegicus
taaagacagccttcatgtccagccg

SEQ ID NO: 537738 - DNA, 25 bp, Rattus norvegicus
taaagacataccaggcagtcacttc

SEQ ID NO: 537739 - DNA, 25 bp, Rattus norvegicus
taaagacatacctggcagtcacttc

SEQ ID NO: 537740 - DNA, 25 bp, Rattus norvegicus
taaagacatgctcgcgagcggtacc

SEQ ID NO: 537741 - DNA, 25 bp, Rattus norvegicus
taaagacatgctggcgagcggtacc

SEQ ID NO: 537742 - DNA, 25 bp, Rattus norvegicus
taaagaccaaacaattccctgccct

SEQ ID NO: 537743 - DNA, 25 bp, Rattus norvegicus
taaagaccaaactattccctgccct

SEQ ID NO: 537744 - DNA, 25 bp, Rattus norvegicus
taaagaccaattacagaatcgagct

SEQ ID NO: 537745 - DNA, 25 bp, Rattus norvegicus
taaagaccaatttcagaatcgagct

SEQ ID NO: 537746 - DNA, 25 bp, Rattus norvegicus
taaagacccaccatgggaatcctgg

SEQ ID NO: 537747 - DNA, 25 bp, Rattus norvegicus
taaagacccaccttgggaatcctgg

SEQ ID NO: 537748 - DNA, 25 bp, Rattus norvegicus
taaagaccctgacgctggtacacgc

SEQ ID NO: 537749 - DNA, 25 bp, Rattus norvegicus
taaagaccctgaggctggtacacgc

SEQ ID NO: 537750 - DNA, 25 bp, Rattus norvegicus
taaagaccgagacccctagggacta

SEQ ID NO: 537751 - DNA, 25 bp, Rattus norvegicus
taaagaccgagagccctagggacta

SEQ ID NO: 537752 - DNA, 25 bp, Rattus norvegicus
taaagaccgatgatgcaggctcccc

SEQ ID NO: 537753 - DNA, 25 bp, Rattus norvegicus
taaagaccgatgttgcaggctcccc

SEQ ID NO: 537754 - DNA, 25 bp, Rattus norvegicus
taaagaccggacaccctcaagtcaa

SEQ ID NO: 537755 - DNA, 25 bp, Rattus norvegicus
taaagaccggactccctcaagtcaa

SEQ ID NO: 537756 - DNA, 25 bp, Rattus norvegicus
taaagaccgtgtcagccctgctggt

SEQ ID NO: 537757 - DNA, 25 bp, Rattus norvegicus
taaagaccgtgtgagccctgctggt

SEQ ID NO: 537758 - DNA, 25 bp, Rattus norvegicus
taaagacctagacccctggtgccaa

SEQ ID NO: 537759 - DNA, 25 bp, Rattus norvegicus
taaagacctagagccctggtgccaa

SEQ ID NO: 537760 - DNA, 25 bp, Rattus norvegicus
taaagacctagtctttccaaaagct

SEQ ID NO: 537761 - DNA, 25 bp, Rattus norvegicus
taaagacctagtgtttccaaaagct

SEQ ID NO: 537762 - DNA, 25 bp, Rattus norvegicus
taaagacctggcaggtttttcctgt

SEQ ID NO: 537763 - DNA, 25 bp, Rattus norvegicus
taaagacctggctggtttttcctgt

SEQ ID NO: 537764 - DNA, 25 bp, Rattus norvegicus
taaagacgacagagcaccgaagttc

SEQ ID NO: 537765 - DNA, 25 bp, Rattus norvegicus
taaagacgacagtgcaccgaagttc

SEQ ID NO: 537766 - DNA, 25 bp, Rattus norvegicus
taaagacgacgccttgcttgggctc

SEQ ID NO: 537767 - DNA, 25 bp, Rattus norvegicus
taaagacgacgcgttgcttgggctc

SEQ ID NO: 537768 - DNA, 25 bp, Rattus norvegicus
taaagacgcgtacactctgcactga

SEQ ID NO: 537769 - DNA, 25 bp, Rattus norvegicus
taaagacgcgtagactctgcactga

SEQ ID NO: 537770 - DNA, 25 bp, Rattus norvegicus
taaagacgttgtcttccacgtgggt

SEQ ID NO: 537771 - DNA, 25 bp, Rattus norvegicus
taaagacgttgtgttccacgtgggt

SEQ ID NO: 537772 - DNA, 25 bp, Rattus norvegicus
taaagactcaggctgccgcagagag

SEQ ID NO: 537773 - DNA, 25 bp, Rattus norvegicus
taaagactcagggtgccgcagagag

SEQ ID NO: 537774 - DNA, 25 bp, Rattus norvegicus
taaagactccccaagattgattgtg

SEQ ID NO: 537775 - DNA, 25 bp, Rattus norvegicus
taaagactcccctagattgattgtg

SEQ ID NO: 537776 - DNA, 25 bp, Rattus norvegicus
taaagactccgtcttaactgtgtaa

SEQ ID NO: 537777 - DNA, 25 bp, Rattus norvegicus
taaagactccgtgttaactgtgtaa

SEQ ID NO: 537778 - DNA, 25 bp, Rattus norvegicus
taaagactcggacctgcgctcggtg

SEQ ID NO: 537779 - DNA, 25 bp, Rattus norvegicus
taaagactcggagctgcgctcggtg

SEQ ID NO: 537780 - DNA, 25 bp, Rattus norvegicus
taaagactctgcaatcagcctaaat

SEQ ID NO: 537781 - DNA, 25 bp, Rattus norvegicus
taaagactctgctatcagcctaaat

SEQ ID NO: 537782 - DNA, 25 bp, Rattus norvegicus
taaagactgatcaccattcccgagg

SEQ ID NO: 537783 - DNA, 25 bp, Rattus norvegicus
taaagactgatctccattcccgagg

SEQ ID NO: 537784 - DNA, 25 bp, Rattus norvegicus
taaagactgattacaccgtgcctat

SEQ ID NO: 537785 - DNA, 25 bp, Rattus norvegicus
taaagactgatttcaccgtgcctat

SEQ ID NO: 537786 - DNA, 25 bp, Rattus norvegicus
taaagacttggtatttccctgcctg

SEQ ID NO: 537787 - DNA, 25 bp, Rattus norvegicus
taaagacttggtttttccctgcctg

SEQ ID NO: 537788 - DNA, 25 bp, Rattus norvegicus
taaagactttcactgttggacctaa

SEQ ID NO: 537789 - DNA, 25 bp, Rattus norvegicus
taaagactttcagtgttggacctaa

SEQ ID NO: 537790 - DNA, 25 bp, Rattus norvegicus
taaagagaacctcgctcttcgccca

SEQ ID NO: 537791 - DNA, 25 bp, Rattus norvegicus
taaagagaacctggctcttcgccca

SEQ ID NO: 537792 - DNA, 25 bp, Rattus norvegicus
taaagagacattcccttcccaaatg

SEQ ID NO: 537793 - DNA, 25 bp, Rattus norvegicus
taaagagacattgccttcccaaatg

SEQ ID NO: 537794 - DNA, 25 bp, Rattus norvegicus
taaagagactcgatcctaacccgag

SEQ ID NO: 537795 - DNA, 25 bp, Rattus norvegicus
taaagagactcgttcctaacccgag

SEQ ID NO: 537796 - DNA, 25 bp, Rattus norvegicus
taaagagactgtaatttgtcccatg

SEQ ID NO: 537797 - DNA, 25 bp, Rattus norvegicus
taaagagactgttatttgtcccatg

SEQ ID NO: 537798 - DNA, 25 bp, Rattus norvegicus
taaagagagattacaccccttccta

SEQ ID NO: 537799 - DNA, 25 bp, Rattus norvegicus
taaagagagatttcaccccttccta

SEQ ID NO: 537800 - DNA, 25 bp, Rattus norvegicus
taaagagagcggacactggttaaca

SEQ ID NO: 537801 - DNA, 25 bp, Rattus norvegicus
taaagagagcggtcactggttaaca

SEQ ID NO: 537802 - DNA, 25 bp, Rattus norvegicus
taaagagagttccaacacctgcaaa

SEQ ID NO: 537803 - DNA, 25 bp, Rattus norvegicus
taaagagagttcgaacacctgcaaa

SEQ ID NO: 537804 - DNA, 25 bp, Rattus norvegicus
taaagagatcttcccaccagtgctg

SEQ ID NO: 537805 - DNA, 25 bp, Rattus norvegicus
taaagagatcttgccaccagtgctg

SEQ ID NO: 537806 - DNA, 25 bp, Rattus norvegicus
taaagagcatttcccaggactccat

SEQ ID NO: 537807 - DNA, 25 bp, Rattus norvegicus
taaagagcatttgccaggactccat

SEQ ID NO: 537808 - DNA, 25 bp, Rattus norvegicus
taaagagccatcaccattttcctta

SEQ ID NO: 537809 - DNA, 25 bp, Rattus norvegicus
taaagagccatctccattttcctta

SEQ ID NO: 537810 - DNA, 25 bp, Rattus norvegicus
taaagagcctgaatctaccctccga

SEQ ID NO: 537811 - DNA, 25 bp, Rattus norvegicus
taaagagcctgattctaccctccga

SEQ ID NO: 537812 - DNA, 25 bp, Rattus norvegicus
taaagagctcacactttcccatgtg

SEQ ID NO: 537813 - DNA, 25 bp, Rattus norvegicus
taaagagctcactctttcccatgtg

SEQ ID NO: 537814 - DNA, 25 bp, Rattus norvegicus
taaagagctctcacaaggtctctcc

SEQ ID NO: 537815 - DNA, 25 bp, Rattus norvegicus
taaagagctctccagtgcactgtgt

SEQ ID NO: 537816 - DNA, 25 bp, Rattus norvegicus
taaagagctctcgagtgcactgtgt

SEQ ID NO: 537817 - DNA, 25 bp, Rattus norvegicus
taaagagctctctcaaggtctctcc

SEQ ID NO: 537818 - DNA, 25 bp, Rattus norvegicus
taaagagctgcacggatacatcgaa

SEQ ID NO: 537819 - DNA, 25 bp, Rattus norvegicus
taaagagctgcagggatacatcgaa

SEQ ID NO: 537820 - DNA, 25 bp, Rattus norvegicus
taaagagctggtaagttctagtaca

SEQ ID NO: 537821 - DNA, 25 bp, Rattus norvegicus
taaagagctggttagttctagtaca

SEQ ID NO: 537822 - DNA, 25 bp, Rattus norvegicus
taaagagcttagcagcaacccactg

SEQ ID NO: 537823 - DNA, 25 bp, Rattus norvegicus
taaagagcttaggagcaacccactg

SEQ ID NO: 537824 - DNA, 25 bp, Rattus norvegicus
taaagagcttctactgttccttcgt

SEQ ID NO: 537825 - DNA, 25 bp, Rattus norvegicus
taaagagcttcttctgttccttcgt

SEQ ID NO: 537826 - DNA, 25 bp, Rattus norvegicus
taaagaggagaccagatggtgacaa

SEQ ID NO: 537827 - DNA, 25 bp, Rattus norvegicus
taaagaggagacgagatggtgacaa

SEQ ID NO: 537828 - DNA, 25 bp, Rattus norvegicus
taaagaggcattagccgttccctta

SEQ ID NO: 537829 - DNA, 25 bp, Rattus norvegicus
taaagaggcatttgccgttccctta

SEQ ID NO: 537830 - DNA, 25 bp, Rattus norvegicus
taaagagggcggaccctgaacctgc

SEQ ID NO: 537831 - DNA, 25 bp, Rattus norvegicus
taaagagggcggtccctgaacctgc

SEQ ID NO: 537832 - DNA, 25 bp, Rattus norvegicus
taaagagggtggagccttcatctcc

SEQ ID NO: 537833 - DNA, 25 bp, Rattus norvegicus
taaagagggtggtgccttcatctcc

SEQ ID NO: 537834 - DNA, 25 bp, Rattus norvegicus
taaagagtactcagcctctaaacac

SEQ ID NO: 537835 - DNA, 25 bp, Rattus norvegicus
taaagagtactctgcctctaaacac

SEQ ID NO: 537836 - DNA, 25 bp, Rattus norvegicus
taaagagtcatcatccttttgtatc

SEQ ID NO: 537837 - DNA, 25 bp, Rattus norvegicus
taaagagtcatcttccttttgtatc

SEQ ID NO: 537838 - DNA, 25 bp, Rattus norvegicus
taaagagttgagaggcagtgcagaa

SEQ ID NO: 537839 - DNA, 25 bp, Rattus norvegicus
taaagagttgagtggcagtgcagaa

SEQ ID NO: 537840 - DNA, 25 bp, Rattus norvegicus
taaagagttggcctgggcagcttgt

SEQ ID NO: 537841 - DNA, 25 bp, Rattus norvegicus
taaagagttggcgtgggcagcttgt

SEQ ID NO: 537842 - DNA, 25 bp, Rattus norvegicus
taaagataacctcgcactctccaca

SEQ ID NO: 537843 - DNA, 25 bp, Rattus norvegicus
taaagataacctggcactctccaca

SEQ ID NO: 537844 - DNA, 25 bp, Rattus norvegicus
taaagataatgtccgtccccaatgt

SEQ ID NO: 537845 - DNA, 25 bp, Rattus norvegicus
taaagataatgtgcgtccccaatgt

SEQ ID NO: 537846 - DNA, 25 bp, Rattus norvegicus
taaagatacagaatcactcccctcc

SEQ ID NO: 537847 - DNA, 25 bp, Rattus norvegicus
taaagatacagattcactcccctcc

SEQ ID NO: 537848 - DNA, 25 bp, Rattus norvegicus
taaagatagcatcctctgggccagc

SEQ ID NO: 537849 - DNA, 25 bp, Rattus norvegicus
taaagatagcatgctctgggccagc

SEQ ID NO: 537850 - DNA, 25 bp, Rattus norvegicus
taaagatccaccagcgtgggcacac

SEQ ID NO: 537851 - DNA, 25 bp, Rattus norvegicus
taaagatccacctgcgtgggcacac

SEQ ID NO: 537852 - DNA, 25 bp, Rattus norvegicus
taaagatctaagatcgacccctggg

SEQ ID NO: 537853 - DNA, 25 bp, Rattus norvegicus
taaagatctaagttcgacccctggg

SEQ ID NO: 537854 - DNA, 25 bp, Rattus norvegicus
taaagatctacaaccctgtctgtct

SEQ ID NO: 537855 - DNA, 25 bp, Rattus norvegicus
taaagatctacaatggagccccact

SEQ ID NO: 537856 - DNA, 25 bp, Rattus norvegicus
taaagatctacatccctgtctgtct

SEQ ID NO: 537857 - DNA, 25 bp, Rattus norvegicus
taaagatctacattggagccccact

SEQ ID NO: 537858 - DNA, 25 bp, Rattus norvegicus
taaagatgagccctgcttctcagtt

SEQ ID NO: 537859 - DNA, 25 bp, Rattus norvegicus
taaagatgagccgtgcttctcagtt

SEQ ID NO: 537860 - DNA, 25 bp, Rattus norvegicus
taaagatgccccaagcttgcagatc

SEQ ID NO: 537861 - DNA, 25 bp, Rattus norvegicus
taaagatgcccctagcttgcagatc

SEQ ID NO: 537862 - DNA, 25 bp, Rattus norvegicus
taaagatgccctcattgaccacttc

SEQ ID NO: 537863 - DNA, 25 bp, Rattus norvegicus
taaagatgccctgattgaccacttc

SEQ ID NO: 537864 - DNA, 25 bp, Rattus norvegicus
taaagatgcctgctggttccactgt

SEQ ID NO: 537865 - DNA, 25 bp, Rattus norvegicus
taaagatgcctggtggttccactgt

SEQ ID NO: 537866 - DNA, 25 bp, Rattus norvegicus
taaagatggtttcacaggattgcac

SEQ ID NO: 537867 - DNA, 25 bp, Rattus norvegicus
taaagatggtttgacaggattgcac

SEQ ID NO: 537868 - DNA, 25 bp, Rattus norvegicus
taaagatgtcctctactgcagggag

SEQ ID NO: 537869 - DNA, 25 bp, Rattus norvegicus
taaagatgtcctgtactgcagggag

SEQ ID NO: 537870 - DNA, 25 bp, Rattus norvegicus
taaagatgtcttcctctgtgagtaa

SEQ ID NO: 537871 - DNA, 25 bp, Rattus norvegicus
taaagatgtcttgctctgtgagtaa

SEQ ID NO: 537872 - DNA, 25 bp, Rattus norvegicus
taaagatgtgatctgccccttactt

SEQ ID NO: 537873 - DNA, 25 bp, Rattus norvegicus
taaagatgtgatgtgccccttactt

SEQ ID NO: 537874 - DNA, 25 bp, Rattus norvegicus
taaagatgttccagcgcttatgcat

SEQ ID NO: 537875 - DNA, 25 bp, Rattus norvegicus
taaagatgttcctgcgcttatgcat

SEQ ID NO: 537876 - DNA, 25 bp, Rattus norvegicus
taaagattcaatactcggccagtaa

SEQ ID NO: 537877 - DNA, 25 bp, Rattus norvegicus
taaagattcaattctcggccagtaa

SEQ ID NO: 537878 - DNA, 25 bp, Rattus norvegicus
taaagattcacacacagctctttgc

SEQ ID NO: 537879 - DNA, 25 bp, Rattus norvegicus
taaagattcacagacagctctttgc

SEQ ID NO: 537880 - DNA, 25 bp, Rattus norvegicus
taaagattcctacagggtcccttgt

SEQ ID NO: 537881 - DNA, 25 bp, Rattus norvegicus
taaagattcctaccatccttcctaa

SEQ ID NO: 537882 - DNA, 25 bp, Rattus norvegicus
taaagattcctagagggtcccttgt

SEQ ID NO: 537883 - DNA, 25 bp, Rattus norvegicus
taaagattcctagcatccttcctaa

SEQ ID NO: 537884 - DNA, 25 bp, Rattus norvegicus
taaagattgccacactggctgtgcc

SEQ ID NO: 537885 - DNA, 25 bp, Rattus norvegicus
taaagattgccagactggctgtgcc

SEQ ID NO: 537886 - DNA, 25 bp, Rattus norvegicus
taaagattgcttatgtagcccacaa

SEQ ID NO: 537887 - DNA, 25 bp, Rattus norvegicus
taaagattgcttttgtagcccacaa

SEQ ID NO: 537888 - DNA, 25 bp, Rattus norvegicus
taaagattgtgtaactgcctgtcat

SEQ ID NO: 537889 - DNA, 25 bp, Rattus norvegicus
taaagattgtgtcgcattcgggaac

SEQ ID NO: 537890 - DNA, 25 bp, Rattus norvegicus
taaagattgtgtggcattcgggaac

SEQ ID NO: 537891 - DNA, 25 bp, Rattus norvegicus
taaagattgtgttactgcctgtcat

SEQ ID NO: 537892 - DNA, 25 bp, Rattus norvegicus
taaagcaaaccaagccgatcttttg

SEQ ID NO: 537893 - DNA, 25 bp, Rattus norvegicus
taaagcaaaccatgccgatcttttg

SEQ ID NO: 537894 - DNA, 25 bp, Rattus norvegicus
taaagcaaccctatgctcttgctgg

SEQ ID NO: 537895 - DNA, 25 bp, Rattus norvegicus
taaagcaaccctttgctcttgctgg

SEQ ID NO: 537896 - DNA, 25 bp, Rattus norvegicus
taaagcaactgcctgtagcttgctc

SEQ ID NO: 537897 - DNA, 25 bp, Rattus norvegicus
taaagcaactgcgtgtagcttgctc

SEQ ID NO: 537898 - DNA, 25 bp, Rattus norvegicus
taaagcaagaccactcccgtggtgg

SEQ ID NO: 537899 - DNA, 25 bp, Rattus norvegicus
taaagcaagacctctcccgtggtgg

SEQ ID NO: 537900 - DNA, 25 bp, Rattus norvegicus
taaagcaagcgtcactgccctatgc

SEQ ID NO: 537901 - DNA, 25 bp, Rattus norvegicus
taaagcaagcgtgactgccctatgc

SEQ ID NO: 537902 - DNA, 25 bp, Rattus norvegicus
taaagcaattctaccccttagcaga

SEQ ID NO: 537903 - DNA, 25 bp, Rattus norvegicus
taaagcaattctctgacgacgccca

SEQ ID NO: 537904 - DNA, 25 bp, Rattus norvegicus
taaagcaattctgtgacgacgccca

SEQ ID NO: 537905 - DNA, 25 bp, Rattus norvegicus
taaagcaattcttccccttagcaga

SEQ ID NO: 537906 - DNA, 25 bp, Rattus norvegicus
taaagcacaagcctggccctgtgac

SEQ ID NO: 537907 - DNA, 25 bp, Rattus norvegicus
taaagcacaagcgtggccctgtgac

SEQ ID NO: 537908 - DNA, 25 bp, Rattus norvegicus
taaagcacaagtcatcagaggaaat

SEQ ID NO: 537909 - DNA, 25 bp, Rattus norvegicus
taaagcacaagtgatcagaggaaat

SEQ ID NO: 537910 - DNA, 25 bp, Rattus norvegicus
taaagcaccacgaggctctagacag

SEQ ID NO: 537911 - DNA, 25 bp, Rattus norvegicus
taaagcaccacgtggctctagacag

SEQ ID NO: 537912 - DNA, 25 bp, Rattus norvegicus
taaagcacccatacatgccttggaa

SEQ ID NO: 537913 - DNA, 25 bp, Rattus norvegicus
taaagcacccattcatgccttggaa

SEQ ID NO: 537914 - DNA, 25 bp, Rattus norvegicus
taaagcactgccagattgattcctg

SEQ ID NO: 537915 - DNA, 25 bp, Rattus norvegicus
taaagcactgccatctctggaacta

SEQ ID NO: 537916 - DNA, 25 bp, Rattus norvegicus
taaagcactgcctgattgattcctg

SEQ ID NO: 537917 - DNA, 25 bp, Rattus norvegicus
taaagcactgccttctctggaacta

SEQ ID NO: 537918 - DNA, 25 bp, Rattus norvegicus
taaagcactgttcacctgctcaggt

SEQ ID NO: 537919 - DNA, 25 bp, Rattus norvegicus
taaagcactgttgacctgctcaggt

SEQ ID NO: 537920 - DNA, 25 bp, Rattus norvegicus
taaagcacttccaaacttctaccaa

SEQ ID NO: 537921 - DNA, 25 bp, Rattus norvegicus
taaagcacttcctaacttctaccaa

SEQ ID NO: 537922 - DNA, 25 bp, Rattus norvegicus
taaagcactttcctaggtggtttct

SEQ ID NO: 537923 - DNA, 25 bp, Rattus norvegicus
taaagcactttcgtaggtggtttct

SEQ ID NO: 537924 - DNA, 25 bp, Rattus norvegicus
taaagcagagagaatccccttccaa

SEQ ID NO: 537925 - DNA, 25 bp, Rattus norvegicus
taaagcagagagtatccccttccaa

SEQ ID NO: 537926 - DNA, 25 bp, Rattus norvegicus
taaagcagattcctgttgcctccaa

SEQ ID NO: 537927 - DNA, 25 bp, Rattus norvegicus
taaagcagattcgtgttgcctccaa

SEQ ID NO: 537928 - DNA, 25 bp, Rattus norvegicus
taaagcagccctcgtcagtggtgct

SEQ ID NO: 537929 - DNA, 25 bp, Rattus norvegicus
taaagcagccctggtcagtggtgct

SEQ ID NO: 537930 - DNA, 25 bp, Rattus norvegicus
taaagcagcttcatctgcgtgtcgc

SEQ ID NO: 537931 - DNA, 25 bp, Rattus norvegicus
taaagcagcttcttctgcgtgtcgc

SEQ ID NO: 537932 - DNA, 25 bp, Rattus norvegicus
taaagcagctttaccggcgtgtcgc

SEQ ID NO: 537933 - DNA, 25 bp, Rattus norvegicus
taaagcagcttttccggcgtgtcgc

SEQ ID NO: 537934 - DNA, 25 bp, Rattus norvegicus
taaagcaggcgcacaatggcctttc

SEQ ID NO: 537935 - DNA, 25 bp, Rattus norvegicus
taaagcaggcgctcaatggcctttc

SEQ ID NO: 537936 - DNA, 25 bp, Rattus norvegicus
taaagcaggcgtctgccttctgtgt

SEQ ID NO: 537937 - DNA, 25 bp, Rattus norvegicus
taaagcaggcgtgtgccttctgtgt

SEQ ID NO: 537938 - DNA, 25 bp, Rattus norvegicus
taaagcagtatgacatcccacaggg

SEQ ID NO: 537939 - DNA, 25 bp, Rattus norvegicus
taaagcagtatgtcatcccacaggg

SEQ ID NO: 537940 - DNA, 25 bp, Rattus norvegicus
taaagcagtctgatactcccatcat

SEQ ID NO: 537941 - DNA, 25 bp, Rattus norvegicus
taaagcagtctgttactcccatcat

SEQ ID NO: 537942 - DNA, 25 bp, Rattus norvegicus
taaagcagtgtcatttgcagggcat

SEQ ID NO: 537943 - DNA, 25 bp, Rattus norvegicus
taaagcagtgtcttttgcagggcat

SEQ ID NO: 537944 - DNA, 25 bp, Rattus norvegicus
taaagcatcagaccggcaaccgaaa

SEQ ID NO: 537945 - DNA, 25 bp, Rattus norvegicus
taaagcatcagagcggcaaccgaaa

SEQ ID NO: 537946 - DNA, 25 bp, Rattus norvegicus
taaagcatctttcttctccatggcc

SEQ ID NO: 537947 - DNA, 25 bp, Rattus norvegicus
taaagcatctttgttctccatggcc

SEQ ID NO: 537948 - DNA, 25 bp, Rattus norvegicus
taaagcattactcatgccacgggtc

SEQ ID NO: 537949 - DNA, 25 bp, Rattus norvegicus
taaagcattactgatgccacgggtc

SEQ ID NO: 537950 - DNA, 25 bp, Rattus norvegicus
taaagcattccacaaaccctgccaa

SEQ ID NO: 537951 - DNA, 25 bp, Rattus norvegicus
taaagcattccagaaaccctgccaa

SEQ ID NO: 537952 - DNA, 25 bp, Rattus norvegicus
taaagcattctgactccgagagtct

SEQ ID NO: 537953 - DNA, 25 bp, Rattus norvegicus
taaagcattctgtctccgagagtct

SEQ ID NO: 537954 - DNA, 25 bp, Rattus norvegicus
taaagcattttgactgtgtccaggt

SEQ ID NO: 537955 - DNA, 25 bp, Rattus norvegicus
taaagcattttgtctgtgtccaggt

SEQ ID NO: 537956 - DNA, 25 bp, Rattus norvegicus
taaagccaaattccccaacgtgtct

SEQ ID NO: 537957 - DNA, 25 bp, Rattus norvegicus
taaagccaaattgcccaacgtgtct

SEQ ID NO: 537958 - DNA, 25 bp, Rattus norvegicus
taaagccaagacctgtctggagatg

SEQ ID NO: 537959 - DNA, 25 bp, Rattus norvegicus
taaagccaagacgtgtctggagatg

SEQ ID NO: 537960 - DNA, 25 bp, Rattus norvegicus
taaagccacggcatcagaccagaag

SEQ ID NO: 537961 - DNA, 25 bp, Rattus norvegicus
taaagccacggcttcagaccagaag

SEQ ID NO: 537962 - DNA, 25 bp, Rattus norvegicus
taaagccacttcagcctttgtttct

SEQ ID NO: 537963 - DNA, 25 bp, Rattus norvegicus
taaagccacttctgcctttgtttct

SEQ ID NO: 537964 - DNA, 25 bp, Rattus norvegicus
taaagccagaagacttccctgggat

SEQ ID NO: 537965 - DNA, 25 bp, Rattus norvegicus
taaagccagaagtcttccctgggat

SEQ ID NO: 537966 - DNA, 25 bp, Rattus norvegicus
taaagccagagcagcccaagcacac

SEQ ID NO: 537967 - DNA, 25 bp, Rattus norvegicus
taaagccagagctgcccaagcacac

SEQ ID NO: 537968 - DNA, 25 bp, Rattus norvegicus
taaagccagattcctcccgggctaa

SEQ ID NO: 537969 - DNA, 25 bp, Rattus norvegicus
taaagccagattgctcccgggctaa

SEQ ID NO: 537970 - DNA, 25 bp, Rattus norvegicus
taaagccagctcatactctgataga

SEQ ID NO: 537971 - DNA, 25 bp, Rattus norvegicus
taaagccagctcttactctgataga

SEQ ID NO: 537972 - DNA, 25 bp, Rattus norvegicus
taaagccagggtaggtggctccctg

SEQ ID NO: 537973 - DNA, 25 bp, Rattus norvegicus
taaagccagggttggtggctccctg

SEQ ID NO: 537974 - DNA, 25 bp, Rattus norvegicus
taaagccagttgagtacagccagat

SEQ ID NO: 537975 - DNA, 25 bp, Rattus norvegicus
taaagccagttgtgtacagccagat

SEQ ID NO: 537976 - DNA, 25 bp, Rattus norvegicus
taaagccataaaccgtacagcctga

SEQ ID NO: 537977 - DNA, 25 bp, Rattus norvegicus
taaagccataaagcgtacagcctga

SEQ ID NO: 537978 - DNA, 25 bp, Rattus norvegicus
taaagccatttccttggcacacagc

SEQ ID NO: 537979 - DNA, 25 bp, Rattus norvegicus
taaagccatttcgttggcacacagc

SEQ ID NO: 537980 - DNA, 25 bp, Rattus norvegicus
taaagcccaaagaagtgtaaacaga

SEQ ID NO: 537981 - DNA, 25 bp, Rattus norvegicus
taaagcccaaagtagtgtaaacaga

SEQ ID NO: 537982 - DNA, 25 bp, Rattus norvegicus
taaagcccaggcagtgctaaccttt

SEQ ID NO: 537983 - DNA, 25 bp, Rattus norvegicus
taaagcccaggctgtgctaaccttt

SEQ ID NO: 537984 - DNA, 25 bp, Rattus norvegicus
taaagcccattccattctactttgg

SEQ ID NO: 537985 - DNA, 25 bp, Rattus norvegicus
taaagcccattcgattctactttgg

SEQ ID NO: 537986 - DNA, 25 bp, Rattus norvegicus
taaagccccgacaaaagcccagact

SEQ ID NO: 537987 - DNA, 25 bp, Rattus norvegicus
taaagccccgactaaagcccagact

SEQ ID NO: 537988 - DNA, 25 bp, Rattus norvegicus
taaagccctaggaaggtcaccaggt

SEQ ID NO: 537989 - DNA, 25 bp, Rattus norvegicus
taaagccctaggtaggtcaccaggt

SEQ ID NO: 537990 - DNA, 25 bp, Rattus norvegicus
taaagccctcccagttgcattctca

SEQ ID NO: 537991 - DNA, 25 bp, Rattus norvegicus
taaagccctccctgttgcattctca

SEQ ID NO: 537992 - DNA, 25 bp, Rattus norvegicus
taaagccctgctatcactctggaac

SEQ ID NO: 537993 - DNA, 25 bp, Rattus norvegicus
taaagccctgctttcactctggaac

SEQ ID NO: 537994 - DNA, 25 bp, Rattus norvegicus
taaagccctgtacatatttgcaatt

SEQ ID NO: 537995 - DNA, 25 bp, Rattus norvegicus
taaagccctgtagatatttgcaatt

SEQ ID NO: 537996 - DNA, 25 bp, Rattus norvegicus
taaagccgagagactcacgctggat

SEQ ID NO: 537997 - DNA, 25 bp, Rattus norvegicus
taaagccgagagtctcacgctggat

SEQ ID NO: 537998 - DNA, 25 bp, Rattus norvegicus
taaagccgccacactcttgggaaag

SEQ ID NO: 537999 - DNA, 25 bp, Rattus norvegicus
taaagccgccactctcttgggaaag

SEQ ID NO: 538000 - DNA, 25 bp, Rattus norvegicus
taaagccgcttgagcctttgaatgc

SEQ ID NO: 538001 - DNA, 25 bp, Rattus norvegicus
taaagccgcttgtgcctttgaatgc

SEQ ID NO: 538002 - DNA, 25 bp, Rattus norvegicus
taaagccgtgagctttcctggctct

SEQ ID NO: 538003 - DNA, 25 bp, Rattus norvegicus
taaagccgtgaggtttcctggctct

SEQ ID NO: 538004 - DNA, 25 bp, Rattus norvegicus
taaagcctagtccttaaacactatt

SEQ ID NO: 538005 - DNA, 25 bp, Rattus norvegicus
taaagcctagtcgttaaacactatt

SEQ ID NO: 538006 - DNA, 25 bp, Rattus norvegicus
taaagcctcctgcaagaagccctgc

SEQ ID NO: 538007 - DNA, 25 bp, Rattus norvegicus
taaagcctcctggaagaagccctgc

SEQ ID NO: 538008 - DNA, 25 bp, Rattus norvegicus
taaagcctctgccacacactgaaga

SEQ ID NO: 538009 - DNA, 25 bp, Rattus norvegicus
taaagcctctgcgacacactgaaga

SEQ ID NO: 538010 - DNA, 25 bp, Rattus norvegicus
taaagcctctgtagacctgagctag

SEQ ID NO: 538011 - DNA, 25 bp, Rattus norvegicus
taaagcctctgttgacctgagctag

SEQ ID NO: 538012 - DNA, 25 bp, Rattus norvegicus
taaagcctgaagctgcctggcatct

SEQ ID NO: 538013 - DNA, 25 bp, Rattus norvegicus
taaagcctgaaggtgcctggcatct

SEQ ID NO: 538014 - DNA, 25 bp, Rattus norvegicus
taaagcctgattaacccttcttaag

SEQ ID NO: 538015 - DNA, 25 bp, Rattus norvegicus
taaagcctgatttacccttcttaag

SEQ ID NO: 538016 - DNA, 25 bp, Rattus norvegicus
taaagcctgcgtaggattgcactgg

SEQ ID NO: 538017 - DNA, 25 bp, Rattus norvegicus
taaagcctgcgttggattgcactgg

SEQ ID NO: 538018 - DNA, 25 bp, Rattus norvegicus
taaagcctgctcctgtaactcctgg

SEQ ID NO: 538019 - DNA, 25 bp, Rattus norvegicus
taaagcctgctcgtgtaactcctgg

SEQ ID NO: 538020 - DNA, 25 bp, Rattus norvegicus
taaagcctgctgactaagaattgga

SEQ ID NO: 538021 - DNA, 25 bp, Rattus norvegicus
taaagcctgctgtctaagaattgga

SEQ ID NO: 538022 - DNA, 25 bp, Rattus norvegicus
taaagcctgcttacctaccagatag

SEQ ID NO: 538023 - DNA, 25 bp, Rattus norvegicus
taaagcctgctttcctaccagatag

SEQ ID NO: 538024 - DNA, 25 bp, Rattus norvegicus
taaagcctgtgcagattttacccac

SEQ ID NO: 538025 - DNA, 25 bp, Rattus norvegicus
taaagcctgtgctgattttacccac

SEQ ID NO: 538026 - DNA, 25 bp, Rattus norvegicus
taaagccttagtactcaccacttag

SEQ ID NO: 538027 - DNA, 25 bp, Rattus norvegicus
taaagccttagttctcaccacttag

SEQ ID NO: 538028 - DNA, 25 bp, Rattus norvegicus
taaagccttgacacatctgccaatg

SEQ ID NO: 538029 - DNA, 25 bp, Rattus norvegicus
taaagccttgactcatctgccaatg

SEQ ID NO: 538030 - DNA, 25 bp, Rattus norvegicus
taaagccttgttccaggatcagtga

SEQ ID NO: 538031 - DNA, 25 bp, Rattus norvegicus
taaagccttgttgcaggatcagtga

SEQ ID NO: 538032 - DNA, 25 bp, Rattus norvegicus
taaagcgaacccaagatcccagaga

SEQ ID NO: 538033 - DNA, 25 bp, Rattus norvegicus
taaagcgaaccctagatcccagaga

SEQ ID NO: 538034 - DNA, 25 bp, Rattus norvegicus
taaagcgaccttactcagggcctaa

SEQ ID NO: 538035 - DNA, 25 bp, Rattus norvegicus
taaagcgacctttctcagggcctaa

SEQ ID NO: 538036 - DNA, 25 bp, Rattus norvegicus
taaagcgcacagacagctatgagat

SEQ ID NO: 538037 - DNA, 25 bp, Rattus norvegicus
taaagcgcacagtcagctatgagat

SEQ ID NO: 538038 - DNA, 25 bp, Rattus norvegicus
taaagcgcattgagtgtgtgccaga

SEQ ID NO: 538039 - DNA, 25 bp, Rattus norvegicus
taaagcgcattgtgtgtgtgccaga

SEQ ID NO: 538040 - DNA, 25 bp, Rattus norvegicus
taaagcgccagcaggactacgagga

SEQ ID NO: 538041 - DNA, 25 bp, Rattus norvegicus
taaagcgccagctggactacgagga

SEQ ID NO: 538042 - DNA, 25 bp, Rattus norvegicus
taaagcgctaagacacgcctcctta

SEQ ID NO: 538043 - DNA, 25 bp, Rattus norvegicus
taaagcgctaagtcacgcctcctta

SEQ ID NO: 538044 - DNA, 25 bp, Rattus norvegicus
taaagcggaaacatttttcagacta

SEQ ID NO: 538045 - DNA, 25 bp, Rattus norvegicus
taaagcggaaacttttttcagacta

SEQ ID NO: 538046 - DNA, 25 bp, Rattus norvegicus
taaagcgggctaaggtccctctaaa

SEQ ID NO: 538047 - DNA, 25 bp, Rattus norvegicus
taaagcgggctatggtccctctaaa

SEQ ID NO: 538048 - DNA, 25 bp, Rattus norvegicus
taaagcggtctcactggtgctgcag

SEQ ID NO: 538049 - DNA, 25 bp, Rattus norvegicus
taaagcggtctctctggtgctgcag

SEQ ID NO: 538050 - DNA, 25 bp, Rattus norvegicus
taaagcggtgctagcagagcttcct

SEQ ID NO: 538051 - DNA, 25 bp, Rattus norvegicus
taaagcggtgcttgcagagcttcct

SEQ ID NO: 538052 - DNA, 25 bp, Rattus norvegicus
taaagcgtattacccctcgtcactt

SEQ ID NO: 538053 - DNA, 25 bp, Rattus norvegicus
taaagcgtattagccctcgtcactt

SEQ ID NO: 538054 - DNA, 25 bp, Rattus norvegicus
taaagcgtggtcagttagcaaggcc

SEQ ID NO: 538055 - DNA, 25 bp, Rattus norvegicus
taaagcgtggtctgttagcaaggcc

SEQ ID NO: 538056 - DNA, 25 bp, Rattus norvegicus
taaagcgttgacacattttgaaaat

SEQ ID NO: 538057 - DNA, 25 bp, Rattus norvegicus
taaagcgttgactcattttgaaaat

SEQ ID NO: 538058 - DNA, 25 bp, Rattus norvegicus
taaagctaagctattcccgaatcct

SEQ ID NO: 538059 - DNA, 25 bp, Rattus norvegicus
taaagctaagcttttcccgaatcct

SEQ ID NO: 538060 - DNA, 25 bp, Rattus norvegicus
taaagctacacaagggctgctaggt

SEQ ID NO: 538061 - DNA, 25 bp, Rattus norvegicus
taaagctacacatgggctgctaggt

SEQ ID NO: 538062 - DNA, 25 bp, Rattus norvegicus
taaagctacccaaagagacctctaa

SEQ ID NO: 538063 - DNA, 25 bp, Rattus norvegicus
taaagctacccatagagacctctaa

SEQ ID NO: 538064 - DNA, 25 bp, Rattus norvegicus
taaagctactctattttccaaatgt

SEQ ID NO: 538065 - DNA, 25 bp, Rattus norvegicus
taaagctactcttttttccaaatgt

SEQ ID NO: 538066 - DNA, 25 bp, Rattus norvegicus
taaagctagtccacgaaaacctcgc

SEQ ID NO: 538067 - DNA, 25 bp, Rattus norvegicus
taaagctagtcctcgaaaacctcgc

SEQ ID NO: 538068 - DNA, 25 bp, Rattus norvegicus
taaagctattaacacatggtcgtaa

SEQ ID NO: 538069 - DNA, 25 bp, Rattus norvegicus
taaagctattaagacatggtcgtaa

SEQ ID NO: 538070 - DNA, 25 bp, Rattus norvegicus
taaagctatttccaaaccaacggtg

SEQ ID NO: 538071 - DNA, 25 bp, Rattus norvegicus
taaagctatttcgaaaccaacggtg

SEQ ID NO: 538072 - DNA, 25 bp, Rattus norvegicus
taaagctcacagcactctgggacag

SEQ ID NO: 538073 - DNA, 25 bp, Rattus norvegicus
taaagctcacaggactctgggacag

SEQ ID NO: 538074 - DNA, 25 bp, Rattus norvegicus
taaagctcctttagcccataaacat

SEQ ID NO: 538075 - DNA, 25 bp, Rattus norvegicus
taaagctccttttgcccataaacat

SEQ ID NO: 538076 - DNA, 25 bp, Rattus norvegicus
taaagctcgggaacttcaggccatg

SEQ ID NO: 538077 - DNA, 25 bp, Rattus norvegicus
taaagctcgggatcttcaggccatg

SEQ ID NO: 538078 - DNA, 25 bp, Rattus norvegicus
taaagctctgggatctaatcctgca

SEQ ID NO: 538079 - DNA, 25 bp, Rattus norvegicus
taaagctctgggttctaatcctgca

SEQ ID NO: 538080 - DNA, 25 bp, Rattus norvegicus
taaagctgagccacaacatcctgcg

SEQ ID NO: 538081 - DNA, 25 bp, Rattus norvegicus
taaagctgagcctcaacatcctgcg

SEQ ID NO: 538082 - DNA, 25 bp, Rattus norvegicus
taaagctgaggcacatcttacctcc

SEQ ID NO: 538083 - DNA, 25 bp, Rattus norvegicus
taaagctgaggctcatcttacctcc

SEQ ID NO: 538084 - DNA, 25 bp, Rattus norvegicus
taaagctgccacagttacctcacga

SEQ ID NO: 538085 - DNA, 25 bp, Rattus norvegicus
taaagctgccactgttacctcacga

SEQ ID NO: 538086 - DNA, 25 bp, Rattus norvegicus
taaagctgcctgcagactgcatctc

SEQ ID NO: 538087 - DNA, 25 bp, Rattus norvegicus
taaagctgcctggagactgcatctc

SEQ ID NO: 538088 - DNA, 25 bp, Rattus norvegicus
taaagctgctgtcatggctaccctt

SEQ ID NO: 538089 - DNA, 25 bp, Rattus norvegicus
taaagctgctgtgatggctaccctt

SEQ ID NO: 538090 - DNA, 25 bp, Rattus norvegicus
taaagctgcttcctttccttgagtt

SEQ ID NO: 538091 - DNA, 25 bp, Rattus norvegicus
taaagctgcttcgtttccttgagtt

SEQ ID NO: 538092 - DNA, 25 bp, Rattus norvegicus
taaagctgcttgctctgctgctggc

SEQ ID NO: 538093 - DNA, 25 bp, Rattus norvegicus
taaagctgcttggtctgctgctggc

SEQ ID NO: 538094 - DNA, 25 bp, Rattus norvegicus
taaagctgctttcttaggtccctat

SEQ ID NO: 538095 - DNA, 25 bp, Rattus norvegicus
taaagctgctttgttaggtccctat

SEQ ID NO: 538096 - DNA, 25 bp, Rattus norvegicus
taaagctggagaagccctgtgtctc

SEQ ID NO: 538097 - DNA, 25 bp, Rattus norvegicus
taaagctggagatgccctgtgtctc

SEQ ID NO: 538098 - DNA, 25 bp, Rattus norvegicus
taaagctggatcacaggctttgatc

SEQ ID NO: 538099 - DNA, 25 bp, Rattus norvegicus
taaagctggatctcaggctttgatc

SEQ ID NO: 538100 - DNA, 25 bp, Rattus norvegicus
taaagctggctgatatctcaaaggc

SEQ ID NO: 538101 - DNA, 25 bp, Rattus norvegicus
taaagctggctgttatctcaaaggc

SEQ ID NO: 538102 - DNA, 25 bp, Rattus norvegicus
taaagctggtgacgcccgaagtcct

SEQ ID NO: 538103 - DNA, 25 bp, Rattus norvegicus
taaagctggtgaggcccgaagtcct

SEQ ID NO: 538104 - DNA, 25 bp, Rattus norvegicus
taaagctggtttatcatcctggtct

SEQ ID NO: 538105 - DNA, 25 bp, Rattus norvegicus
taaagctggtttttcatcctggtct

SEQ ID NO: 538106 - DNA, 25 bp, Rattus norvegicus
taaagctgtcagcacgcacgagggt

SEQ ID NO: 538107 - DNA, 25 bp, Rattus norvegicus
taaagctgtcagctggccttcttgg

SEQ ID NO: 538108 - DNA, 25 bp, Rattus norvegicus
taaagctgtcaggacgcacgagggt

SEQ ID NO: 538109 - DNA, 25 bp, Rattus norvegicus
taaagctgtcaggtggccttcttgg

SEQ ID NO: 538110 - DNA, 25 bp, Rattus norvegicus
taaagctgtcccactttggtggcat

SEQ ID NO: 538111 - DNA, 25 bp, Rattus norvegicus
taaagctgtccccttgtgtgtgtct

SEQ ID NO: 538112 - DNA, 25 bp, Rattus norvegicus
taaagctgtcccgttgtgtgtgtct

SEQ ID NO: 538113 - DNA, 25 bp, Rattus norvegicus
taaagctgtccctctttggtggcat

SEQ ID NO: 538114 - DNA, 25 bp, Rattus norvegicus
taaagctgtgtcaaccatgcatggc

SEQ ID NO: 538115 - DNA, 25 bp, Rattus norvegicus
taaagctgtgtctaccatgcatggc

SEQ ID NO: 538116 - DNA, 25 bp, Rattus norvegicus
taaagctgtgtgacactctgcccgt

SEQ ID NO: 538117 - DNA, 25 bp, Rattus norvegicus
taaagctgtgtgtcactctgcccgt

SEQ ID NO: 538118 - DNA, 25 bp, Rattus norvegicus
taaagctgttgcactctgcggatcc

SEQ ID NO: 538119 - DNA, 25 bp, Rattus norvegicus
taaagctgttgctctctgcggatcc

SEQ ID NO: 538120 - DNA, 25 bp, Rattus norvegicus
taaagcttaagcactcaagacctcc

SEQ ID NO: 538121 - DNA, 25 bp, Rattus norvegicus
taaagcttaagctctcaagacctcc

SEQ ID NO: 538122 - DNA, 25 bp, Rattus norvegicus
taaagcttacccattgatacgggag

SEQ ID NO: 538123 - DNA, 25 bp, Rattus norvegicus
taaagcttaccctttgatacgggag

SEQ ID NO: 538124 - DNA, 25 bp, Rattus norvegicus
taaagcttacctcttgcctagtggc

SEQ ID NO: 538125 - DNA, 25 bp, Rattus norvegicus
taaagcttacctgttgcctagtggc

SEQ ID NO: 538126 - DNA, 25 bp, Rattus norvegicus
taaagcttagagacatccatggact

SEQ ID NO: 538127 - DNA, 25 bp, Rattus norvegicus
taaagcttagagtcatccatggact

SEQ ID NO: 538128 - DNA, 25 bp, Rattus norvegicus
taaagcttattgacatcgcctgtgt

SEQ ID NO: 538129 - DNA, 25 bp, Rattus norvegicus
taaagcttattgtcatcgcctgtgt

SEQ ID NO: 538130 - DNA, 25 bp, Rattus norvegicus
taaagcttcaaccaatatctcatgt

SEQ ID NO: 538131 - DNA, 25 bp, Rattus norvegicus
taaagcttcaacgaatatctcatgt

SEQ ID NO: 538132 - DNA, 25 bp, Rattus norvegicus
taaagcttcataatctgtccgtctc

SEQ ID NO: 538133 - DNA, 25 bp, Rattus norvegicus
taaagcttcatattctgtccgtctc

SEQ ID NO: 538134 - DNA, 25 bp, Rattus norvegicus
taaagcttccagagctgtgggcaaa

SEQ ID NO: 538135 - DNA, 25 bp, Rattus norvegicus
taaagcttccagctctgtatctgct

SEQ ID NO: 538136 - DNA, 25 bp, Rattus norvegicus
taaagcttccaggtctgtatctgct

SEQ ID NO: 538137 - DNA, 25 bp, Rattus norvegicus
taaagcttccagtgctgtgggcaaa

SEQ ID NO: 538138 - DNA, 25 bp, Rattus norvegicus
taaagcttccatacagggctgcaga

SEQ ID NO: 538139 - DNA, 25 bp, Rattus norvegicus
taaagcttccattcagggctgcaga

SEQ ID NO: 538140 - DNA, 25 bp, Rattus norvegicus
taaagcttccctattctgttgtctt

SEQ ID NO: 538141 - DNA, 25 bp, Rattus norvegicus
taaagcttcccttttctgttgtctt

SEQ ID NO: 538142 - DNA, 25 bp, Rattus norvegicus
taaagcttccgaccgaatgtgactg

SEQ ID NO: 538143 - DNA, 25 bp, Rattus norvegicus
taaagcttccgagcgaatgtgactg

SEQ ID NO: 538144 - DNA, 25 bp, Rattus norvegicus
taaagcttcgttcagacattttgaa

SEQ ID NO: 538145 - DNA, 25 bp, Rattus norvegicus
taaagcttcgttgagacattttgaa

SEQ ID NO: 538146 - DNA, 25 bp, Rattus norvegicus
taaagcttgatccttgaccagcctt

SEQ ID NO: 538147 - DNA, 25 bp, Rattus norvegicus
taaagcttgatcgttgaccagcctt

SEQ ID NO: 538148 - DNA, 25 bp, Rattus norvegicus
taaagcttggtcccttttttggact

SEQ ID NO: 538149 - DNA, 25 bp, Rattus norvegicus
taaagcttggtcgcttttttggact

SEQ ID NO: 538150 - DNA, 25 bp, Rattus norvegicus
taaagctttctaaaggacctactta

SEQ ID NO: 538151 - DNA, 25 bp, Rattus norvegicus
taaagctttctataggacctactta

SEQ ID NO: 538152 - DNA, 25 bp, Rattus norvegicus
taaagctttgtcctgttcatcactg

SEQ ID NO: 538153 - DNA, 25 bp, Rattus norvegicus
taaagctttgtcgtgttcatcactg

SEQ ID NO: 538154 - DNA, 25 bp, Rattus norvegicus
taaagcttttcgaccttgagacctc

SEQ ID NO: 538155 - DNA, 25 bp, Rattus norvegicus
taaagcttttcgtccttgagacctc

SEQ ID NO: 538156 - DNA, 25 bp, Rattus norvegicus
taaaggaaaccacacctggccaaat

SEQ ID NO: 538157 - DNA, 25 bp, Rattus norvegicus
taaaggaaaccagacctggccaaat

SEQ ID NO: 538158 - DNA, 25 bp, Rattus norvegicus
taaaggaaatgaccctccaccacct

SEQ ID NO: 538159 - DNA, 25 bp, Rattus norvegicus
taaaggaaatgagcctccaccacct

SEQ ID NO: 538160 - DNA, 25 bp, Rattus norvegicus
taaaggaaccctagaatgcataaga

SEQ ID NO: 538161 - DNA, 25 bp, Rattus norvegicus
taaaggaacccttgaatgcataaga

SEQ ID NO: 538162 - DNA, 25 bp, Rattus norvegicus
taaaggaactggaagactccctact

SEQ ID NO: 538163 - DNA, 25 bp, Rattus norvegicus
taaaggaactggtagactccctact

SEQ ID NO: 538164 - DNA, 25 bp, Rattus norvegicus
taaaggaagcttctcatgaccccat

SEQ ID NO: 538165 - DNA, 25 bp, Rattus norvegicus
taaaggaagcttgtcatgaccccat

SEQ ID NO: 538166 - DNA, 25 bp, Rattus norvegicus
taaaggaagtctacccagaagccag

SEQ ID NO: 538167 - DNA, 25 bp, Rattus norvegicus
taaaggaagtcttcccagaagccag

SEQ ID NO: 538168 - DNA, 25 bp, Rattus norvegicus
taaaggaagttaccgccccatcact

SEQ ID NO: 538169 - DNA, 25 bp, Rattus norvegicus
taaaggaagttagcgccccatcact

SEQ ID NO: 538170 - DNA, 25 bp, Rattus norvegicus
taaaggaatgcaacgctaccgctgg

SEQ ID NO: 538171 - DNA, 25 bp, Rattus norvegicus
taaaggaatgcatcgctaccgctgg

SEQ ID NO: 538172 - DNA, 25 bp, Rattus norvegicus
taaaggaatggaagccccaagggca

SEQ ID NO: 538173 - DNA, 25 bp, Rattus norvegicus
taaaggaatggatgccccaagggca

SEQ ID NO: 538174 - DNA, 25 bp, Rattus norvegicus
taaaggaccataattgccttcccgt

SEQ ID NO: 538175 - DNA, 25 bp, Rattus norvegicus
taaaggaccatatttgccttcccgt

SEQ ID NO: 538176 - DNA, 25 bp, Rattus norvegicus
taaaggacctaccaagattgtactt

SEQ ID NO: 538177 - DNA, 25 bp, Rattus norvegicus
taaaggacctacgaagattgtactt

SEQ ID NO: 538178 - DNA, 25 bp, Rattus norvegicus
taaaggacctccatctagaagcccg

SEQ ID NO: 538179 - DNA, 25 bp, Rattus norvegicus
taaaggacctccttctagaagcccg

SEQ ID NO: 538180 - DNA, 25 bp, Rattus norvegicus
taaaggacttccacccatgtgcatg

SEQ ID NO: 538181 - DNA, 25 bp, Rattus norvegicus
taaaggacttcctcccatgtgcatg

SEQ ID NO: 538182 - DNA, 25 bp, Rattus norvegicus
taaaggagaccccagtgttgcacct

SEQ ID NO: 538183 - DNA, 25 bp, Rattus norvegicus
taaaggagacccgagtgttgcacct

SEQ ID NO: 538184 - DNA, 25 bp, Rattus norvegicus
taaaggagaccgcacagagccccga

SEQ ID NO: 538185 - DNA, 25 bp, Rattus norvegicus
taaaggagaccggacagagccccga

SEQ ID NO: 538186 - DNA, 25 bp, Rattus norvegicus
taaaggagcatgatatagctgtctc

SEQ ID NO: 538187 - DNA, 25 bp, Rattus norvegicus
taaaggagcatgttatagctgtctc

SEQ ID NO: 538188 - DNA, 25 bp, Rattus norvegicus
taaaggagcttgctcaggacgctat

SEQ ID NO: 538189 - DNA, 25 bp, Rattus norvegicus
taaaggagcttggtcaggacgctat

SEQ ID NO: 538190 - DNA, 25 bp, Rattus norvegicus
taaaggaggtatatggcaggctgac

SEQ ID NO: 538191 - DNA, 25 bp, Rattus norvegicus
taaaggaggtatttggcaggctgac

SEQ ID NO: 538192 - DNA, 25 bp, Rattus norvegicus
taaaggaggtcaacagcccgtctgt

SEQ ID NO: 538193 - DNA, 25 bp, Rattus norvegicus
taaaggaggtcatcagcccgtctgt

SEQ ID NO: 538194 - DNA, 25 bp, Rattus norvegicus
taaaggatatccacaccaaatggtg

SEQ ID NO: 538195 - DNA, 25 bp, Rattus norvegicus
taaaggatatcctcaccaaatggtg

SEQ ID NO: 538196 - DNA, 25 bp, Rattus norvegicus
taaaggatatttacacgatacaatg

SEQ ID NO: 538197 - DNA, 25 bp, Rattus norvegicus
taaaggatattttcacgatacaatg

SEQ ID NO: 538198 - DNA, 25 bp, Rattus norvegicus
taaaggatcagccattaagtcgttg

SEQ ID NO: 538199 - DNA, 25 bp, Rattus norvegicus
taaaggatcagcgattaagtcgttg

SEQ ID NO: 538200 - DNA, 25 bp, Rattus norvegicus
taaaggatcagtatcctctccttcc

SEQ ID NO: 538201 - DNA, 25 bp, Rattus norvegicus
taaaggatcagtttcctctccttcc

SEQ ID NO: 538202 - DNA, 25 bp, Rattus norvegicus
taaaggatccctcagaagctgtatt

SEQ ID NO: 538203 - DNA, 25 bp, Rattus norvegicus
taaaggatccctgagaagctgtatt

SEQ ID NO: 538204 - DNA, 25 bp, Rattus norvegicus
taaaggatctttcgcctctggataa

SEQ ID NO: 538205 - DNA, 25 bp, Rattus norvegicus
taaaggatctttggcctctggataa

SEQ ID NO: 538206 - DNA, 25 bp, Rattus norvegicus
taaaggatgcatactctgtacccag

SEQ ID NO: 538207 - DNA, 25 bp, Rattus norvegicus
taaaggatgcattctctgtacccag

SEQ ID NO: 538208 - DNA, 25 bp, Rattus norvegicus
taaaggatgccaacacctacctcta

SEQ ID NO: 538209 - DNA, 25 bp, Rattus norvegicus
taaaggatgccatcacctacctcta

SEQ ID NO: 538210 - DNA, 25 bp, Rattus norvegicus
taaaggatgcccctgctgccgagga

SEQ ID NO: 538211 - DNA, 25 bp, Rattus norvegicus
taaaggatgcccgtgctgccgagga

SEQ ID NO: 538212 - DNA, 25 bp, Rattus norvegicus
taaaggattctacaccccagaggct

SEQ ID NO: 538213 - DNA, 25 bp, Rattus norvegicus
taaaggattctagaccccagaggct

SEQ ID NO: 538214 - DNA, 25 bp, Rattus norvegicus
taaaggcaagatcgccaggcaacca

SEQ ID NO: 538215 - DNA, 25 bp, Rattus norvegicus
taaaggcaagatggccaggcaacca

SEQ ID NO: 538216 - DNA, 25 bp, Rattus norvegicus
taaaggcaagcaacgccattgacaa

SEQ ID NO: 538217 - DNA, 25 bp, Rattus norvegicus
taaaggcaagcatcgccattgacaa

SEQ ID NO: 538218 - DNA, 25 bp, Rattus norvegicus
taaaggcaaggcagacatctctcgc

SEQ ID NO: 538219 - DNA, 25 bp, Rattus norvegicus
taaaggcaaggctgacatctctcgc

SEQ ID NO: 538220 - DNA, 25 bp, Rattus norvegicus
taaaggcaaggtctccggtagcttc

SEQ ID NO: 538221 - DNA, 25 bp, Rattus norvegicus
taaaggcaaggtgtccggtagcttc

SEQ ID NO: 538222 - DNA, 25 bp, Rattus norvegicus
taaaggcagctgagcacaatggtgc

SEQ ID NO: 538223 - DNA, 25 bp, Rattus norvegicus
taaaggcagctgtgcacaatggtgc

SEQ ID NO: 538224 - DNA, 25 bp, Rattus norvegicus
taaaggcatgctccagccaacacca

SEQ ID NO: 538225 - DNA, 25 bp, Rattus norvegicus
taaaggcatgctgcagccaacacca

SEQ ID NO: 538226 - DNA, 25 bp, Rattus norvegicus
taaaggccaaatagcagccgcctgt

SEQ ID NO: 538227 - DNA, 25 bp, Rattus norvegicus
taaaggccaaattgcagccgcctgt

SEQ ID NO: 538228 - DNA, 25 bp, Rattus norvegicus
taaaggccaccaagaaagacgatct

SEQ ID NO: 538229 - DNA, 25 bp, Rattus norvegicus
taaaggccaccatgaaagacgatct

SEQ ID NO: 538230 - DNA, 25 bp, Rattus norvegicus
taaaggccaggcacacaccaaacag

SEQ ID NO: 538231 - DNA, 25 bp, Rattus norvegicus
taaaggccaggctcacaccaaacag

SEQ ID NO: 538232 - DNA, 25 bp, Rattus norvegicus
taaaggccatgccaggtcagtccct

SEQ ID NO: 538233 - DNA, 25 bp, Rattus norvegicus
taaaggccatgcgaggtcagtccct

SEQ ID NO: 538234 - DNA, 25 bp, Rattus norvegicus
taaaggccattgatgtttacctggg

SEQ ID NO: 538235 - DNA, 25 bp, Rattus norvegicus
taaaggccattgttgtttacctggg

SEQ ID NO: 538236 - DNA, 25 bp, Rattus norvegicus
taaaggccccgactgcaccaacaag

SEQ ID NO: 538237 - DNA, 25 bp, Rattus norvegicus
taaaggccccgagtgcaccaacaag

SEQ ID NO: 538238 - DNA, 25 bp, Rattus norvegicus
taaaggcccctgcagttctgaacct

SEQ ID NO: 538239 - DNA, 25 bp, Rattus norvegicus
taaaggcccctggagttctgaacct

SEQ ID NO: 538240 - DNA, 25 bp, Rattus norvegicus
taaaggccctcccaggacagatact

SEQ ID NO: 538241 - DNA, 25 bp, Rattus norvegicus
taaaggccctccgaggacagatact

SEQ ID NO: 538242 - DNA, 25 bp, Rattus norvegicus
taaaggccggaacgccccatcagat

SEQ ID NO: 538243 - DNA, 25 bp, Rattus norvegicus
taaaggccggaaggccccatcagat

SEQ ID NO: 538244 - DNA, 25 bp, Rattus norvegicus
taaaggccgtggacagagtggcaac

SEQ ID NO: 538245 - DNA, 25 bp, Rattus norvegicus
taaaggccgtggtcagagtggcaac

SEQ ID NO: 538246 - DNA, 25 bp, Rattus norvegicus
taaaggcctaaaaacacgtcagtgt

SEQ ID NO: 538247 - DNA, 25 bp, Rattus norvegicus
taaaggcctaaatacacgtcagtgt

SEQ ID NO: 538248 - DNA, 25 bp, Rattus norvegicus
taaaggcctttacagtgccctttgt

SEQ ID NO: 538249 - DNA, 25 bp, Rattus norvegicus
taaaggcctttacgtctctcttctc

SEQ ID NO: 538250 - DNA, 25 bp, Rattus norvegicus
taaaggcctttagagtgccctttgt

SEQ ID NO: 538251 - DNA, 25 bp, Rattus norvegicus
taaaggcctttaggtctctcttctc

SEQ ID NO: 538252 - DNA, 25 bp, Rattus norvegicus
taaaggcgcatcagaggacgcacac

SEQ ID NO: 538253 - DNA, 25 bp, Rattus norvegicus
taaaggcgcatctgaggacgcacac

SEQ ID NO: 538254 - DNA, 25 bp, Rattus norvegicus
taaaggcgcgtcctagacttctgtt

SEQ ID NO: 538255 - DNA, 25 bp, Rattus norvegicus
taaaggcgcgtcgtagacttctgtt

SEQ ID NO: 538256 - DNA, 25 bp, Rattus norvegicus
taaaggcgggtcacatggttcctgc

SEQ ID NO: 538257 - DNA, 25 bp, Rattus norvegicus
taaaggcgggtctcatggttcctgc

SEQ ID NO: 538258 - DNA, 25 bp, Rattus norvegicus
taaaggcgttcaagggccgcttgat

SEQ ID NO: 538259 - DNA, 25 bp, Rattus norvegicus
taaaggcgttcatgggccgcttgat

SEQ ID NO: 538260 - DNA, 25 bp, Rattus norvegicus
taaaggcgtttcaaactcgcacttg

SEQ ID NO: 538261 - DNA, 25 bp, Rattus norvegicus
taaaggcgtttctaactcgcacttg

SEQ ID NO: 538262 - DNA, 25 bp, Rattus norvegicus
taaaggctacctctgggttcctttg

SEQ ID NO: 538263 - DNA, 25 bp, Rattus norvegicus
taaaggctacctgtgggttcctttg

SEQ ID NO: 538264 - DNA, 25 bp, Rattus norvegicus
taaaggctcacccatctgctgaaag

SEQ ID NO: 538265 - DNA, 25 bp, Rattus norvegicus
taaaggctcaccgatctgctgaaag

SEQ ID NO: 538266 - DNA, 25 bp, Rattus norvegicus
taaaggctcagcagcgagtacctgt

SEQ ID NO: 538267 - DNA, 25 bp, Rattus norvegicus
taaaggctcagctgcgagtacctgt

SEQ ID NO: 538268 - DNA, 25 bp, Rattus norvegicus
taaaggctccagagtggtggcctat

SEQ ID NO: 538269 - DNA, 25 bp, Rattus norvegicus
taaaggctccagtgtggtggcctat

SEQ ID NO: 538270 - DNA, 25 bp, Rattus norvegicus
taaaggctccggcttttacttggag

SEQ ID NO: 538271 - DNA, 25 bp, Rattus norvegicus
taaaggctccgggttttacttggag

SEQ ID NO: 538272 - DNA, 25 bp, Rattus norvegicus
taaaggctcgccaaacccttgaata

SEQ ID NO: 538273 - DNA, 25 bp, Rattus norvegicus
taaaggctcgcctaacccttgaata

SEQ ID NO: 538274 - DNA, 25 bp, Rattus norvegicus
taaaggctctatctgtttacagtgt

SEQ ID NO: 538275 - DNA, 25 bp, Rattus norvegicus
taaaggctctatgtgtttacagtgt

SEQ ID NO: 538276 - DNA, 25 bp, Rattus norvegicus
taaaggctggaaacatatgcactat

SEQ ID NO: 538277 - DNA, 25 bp, Rattus norvegicus
taaaggctggaatcatatgcactat

SEQ ID NO: 538278 - DNA, 25 bp, Rattus norvegicus
taaaggcttcatatctattctttta

SEQ ID NO: 538279 - DNA, 25 bp, Rattus norvegicus
taaaggcttcatttctattctttta

SEQ ID NO: 538280 - DNA, 25 bp, Rattus norvegicus
taaaggcttgaaatgatccccagaa

SEQ ID NO: 538281 - DNA, 25 bp, Rattus norvegicus
taaaggcttgaattgatccccagaa

SEQ ID NO: 538282 - DNA, 25 bp, Rattus norvegicus
taaaggcttgcaaaccagcctctca

SEQ ID NO: 538283 - DNA, 25 bp, Rattus norvegicus
taaaggcttgcataccagcctctca

SEQ ID NO: 538284 - DNA, 25 bp, Rattus norvegicus
taaaggcttgtcctgtggttttatt

SEQ ID NO: 538285 - DNA, 25 bp, Rattus norvegicus
taaaggcttgtcgtgtggttttatt

SEQ ID NO: 538286 - DNA, 25 bp, Rattus norvegicus
taaaggcttgttctaatggaatcga

SEQ ID NO: 538287 - DNA, 25 bp, Rattus norvegicus
taaaggcttgttgtaatggaatcga

SEQ ID NO: 538288 - DNA, 25 bp, Rattus norvegicus
taaaggcttttaacacctggttcag

SEQ ID NO: 538289 - DNA, 25 bp, Rattus norvegicus
taaaggcttttatcacctggttcag

SEQ ID NO: 538290 - DNA, 25 bp, Rattus norvegicus
taaaggcttttcatgcacggtcctg

SEQ ID NO: 538291 - DNA, 25 bp, Rattus norvegicus
taaaggcttttcttgcacggtcctg

SEQ ID NO: 538292 - DNA, 25 bp, Rattus norvegicus
taaagggaagttcgctgacagaacg

SEQ ID NO: 538293 - DNA, 25 bp, Rattus norvegicus
taaagggaagttggctgacagaacg

SEQ ID NO: 538294 - DNA, 25 bp, Rattus norvegicus
taaagggacccacaatttaatgttg

SEQ ID NO: 538295 - DNA, 25 bp, Rattus norvegicus
taaagggacccagaatttaatgttg

SEQ ID NO: 538296 - DNA, 25 bp, Rattus norvegicus
taaagggacgccagcaattgctcct

SEQ ID NO: 538297 - DNA, 25 bp, Rattus norvegicus
taaagggacgcctgcaattgctcct

SEQ ID NO: 538298 - DNA, 25 bp, Rattus norvegicus
taaagggactgtccgtacgtttctc

SEQ ID NO: 538299 - DNA, 25 bp, Rattus norvegicus
taaagggactgtgcgtacgtttctc

SEQ ID NO: 538300 - DNA, 25 bp, Rattus norvegicus
taaagggagcctatcacagtgggtg

SEQ ID NO: 538301 - DNA, 25 bp, Rattus norvegicus
taaagggagcctttcacagtgggtg

SEQ ID NO: 538302 - DNA, 25 bp, Rattus norvegicus
taaagggattgcactgaagaccacc

SEQ ID NO: 538303 - DNA, 25 bp, Rattus norvegicus
taaagggattgctctgaagaccacc

SEQ ID NO: 538304 - DNA, 25 bp, Rattus norvegicus
taaagggcacgtcatgggctgcctt

SEQ ID NO: 538305 - DNA, 25 bp, Rattus norvegicus
taaagggcacgtgatgggctgcctt

SEQ ID NO: 538306 - DNA, 25 bp, Rattus norvegicus
taaagggcaggcactctaggctgtc

SEQ ID NO: 538307 - DNA, 25 bp, Rattus norvegicus
taaagggcaggctctctaggctgtc

SEQ ID NO: 538308 - DNA, 25 bp, Rattus norvegicus
taaagggcagttacacacagcctgg

SEQ ID NO: 538309 - DNA, 25 bp, Rattus norvegicus
taaagggcagtttcacacagcctgg

SEQ ID NO: 538310 - DNA, 25 bp, Rattus norvegicus
taaagggcatcgcagtcccagactc

SEQ ID NO: 538311 - DNA, 25 bp, Rattus norvegicus
taaagggcatcggagtcccagactc

SEQ ID NO: 538312 - DNA, 25 bp, Rattus norvegicus
taaagggcatctacaggtctgggtc

SEQ ID NO: 538313 - DNA, 25 bp, Rattus norvegicus
taaagggcatcttcaggtctgggtc

SEQ ID NO: 538314 - DNA, 25 bp, Rattus norvegicus
taaagggcctgtagttcaactggga

SEQ ID NO: 538315 - DNA, 25 bp, Rattus norvegicus
taaagggcctgtctctgtgggcatc

SEQ ID NO: 538316 - DNA, 25 bp, Rattus norvegicus
taaagggcctgtgtctgtgggcatc

SEQ ID NO: 538317 - DNA, 25 bp, Rattus norvegicus
taaagggcctgttgttcaactggga

SEQ ID NO: 538318 - DNA, 25 bp, Rattus norvegicus
taaagggccttacggagcttccagt

SEQ ID NO: 538319 - DNA, 25 bp, Rattus norvegicus
taaagggccttagggagcttccagt

SEQ ID NO: 538320 - DNA, 25 bp, Rattus norvegicus
taaagggctcccagggcaaacttct

SEQ ID NO: 538321 - DNA, 25 bp, Rattus norvegicus
taaagggctccctgggcaaacttct

SEQ ID NO: 538322 - DNA, 25 bp, Rattus norvegicus
taaagggctgctcctatacctcttg

SEQ ID NO: 538323 - DNA, 25 bp, Rattus norvegicus
taaagggctgctgctatacctcttg

SEQ ID NO: 538324 - DNA, 25 bp, Rattus norvegicus
taaagggctggcacagttccctagt

SEQ ID NO: 538325 - DNA, 25 bp, Rattus norvegicus
taaagggctggctcagttccctagt

SEQ ID NO: 538326 - DNA, 25 bp, Rattus norvegicus
taaagggcttctagaatatttcaca

SEQ ID NO: 538327 - DNA, 25 bp, Rattus norvegicus
taaagggcttcttgaatatttcaca

SEQ ID NO: 538328 - DNA, 25 bp, Rattus norvegicus
taaaggggtctacaccctcaacttg

SEQ ID NO: 538329 - DNA, 25 bp, Rattus norvegicus
taaaggggtctagaccctcaacttg

SEQ ID NO: 538330 - DNA, 25 bp, Rattus norvegicus
taaagggtaaagcaccccatccagt

SEQ ID NO: 538331 - DNA, 25 bp, Rattus norvegicus
taaagggtaaaggaccccatccagt

SEQ ID NO: 538332 - DNA, 25 bp, Rattus norvegicus
taaagggtcactatgatcactacat

SEQ ID NO: 538333 - DNA, 25 bp, Rattus norvegicus
taaagggtcactttgatcactacat

SEQ ID NO: 538334 - DNA, 25 bp, Rattus norvegicus
taaagggtccacaggtcctcggaag

SEQ ID NO: 538335 - DNA, 25 bp, Rattus norvegicus
taaagggtccactggtcctcggaag

SEQ ID NO: 538336 - DNA, 25 bp, Rattus norvegicus
taaagggttcatagggtgtcacctt

SEQ ID NO: 538337 - DNA, 25 bp, Rattus norvegicus
taaagggttcattgggtgtcacctt

SEQ ID NO: 538338 - DNA, 25 bp, Rattus norvegicus
taaagggttcctaggactccagcca

SEQ ID NO: 538339 - DNA, 25 bp, Rattus norvegicus
taaagggttccttggactccagcca

SEQ ID NO: 538340 - DNA, 25 bp, Rattus norvegicus
taaagggttgagacagacaccgccc

SEQ ID NO: 538341 - DNA, 25 bp, Rattus norvegicus
taaagggttgagtcagacaccgccc

SEQ ID NO: 538342 - DNA, 25 bp, Rattus norvegicus
taaaggtagactatcctgtcgccca

SEQ ID NO: 538343 - DNA, 25 bp, Rattus norvegicus
taaaggtagactttcctgtcgccca

SEQ ID NO: 538344 - DNA, 25 bp, Rattus norvegicus
taaaggtagccaacatacataggat

SEQ ID NO: 538345 - DNA, 25 bp, Rattus norvegicus
taaaggtagccatcatacataggat

SEQ ID NO: 538346 - DNA, 25 bp, Rattus norvegicus
taaaggtcatttctctggttctctg

SEQ ID NO: 538347 - DNA, 25 bp, Rattus norvegicus
taaaggtcatttgtctggttctctg

SEQ ID NO: 538348 - DNA, 25 bp, Rattus norvegicus
taaaggtcctaaccctcattctacc

SEQ ID NO: 538349 - DNA, 25 bp, Rattus norvegicus
taaaggtcctaagcctcattctacc

SEQ ID NO: 538350 - DNA, 25 bp, Rattus norvegicus
taaaggtcctggagtcatcctgggc

SEQ ID NO: 538351 - DNA, 25 bp, Rattus norvegicus
taaaggtcctggtgtcatcctgggc

SEQ ID NO: 538352 - DNA, 25 bp, Rattus norvegicus
taaaggtctccaaagcatctgcaga

SEQ ID NO: 538353 - DNA, 25 bp, Rattus norvegicus
taaaggtctccatagcatctgcaga

SEQ ID NO: 538354 - DNA, 25 bp, Rattus norvegicus
taaaggtctttccactcctgttcat

SEQ ID NO: 538355 - DNA, 25 bp, Rattus norvegicus
taaaggtctttcgactcctgttcat

SEQ ID NO: 538356 - DNA, 25 bp, Rattus norvegicus
taaaggtgaagcagagccctacaga

SEQ ID NO: 538357 - DNA, 25 bp, Rattus norvegicus
taaaggtgaagctgagccctacaga

SEQ ID NO: 538358 - DNA, 25 bp, Rattus norvegicus
taaaggtgacgcctgggccaagtac

SEQ ID NO: 538359 - DNA, 25 bp, Rattus norvegicus
taaaggtgacgcgtgggccaagtac

SEQ ID NO: 538360 - DNA, 25 bp, Rattus norvegicus
taaaggtgcctgctgtcaatacaga

SEQ ID NO: 538361 - DNA, 25 bp, Rattus norvegicus
taaaggtgcctggtgtcaatacaga

SEQ ID NO: 538362 - DNA, 25 bp, Rattus norvegicus
taaaggtgcggcactgatgtctgcg

SEQ ID NO: 538363 - DNA, 25 bp, Rattus norvegicus
taaaggtgcggctctgatgtctgcg

SEQ ID NO: 538364 - DNA, 25 bp, Rattus norvegicus
taaaggtgcttcagctgccacaggt

SEQ ID NO: 538365 - DNA, 25 bp, Rattus norvegicus
taaaggtgcttctgctgccacaggt

SEQ ID NO: 538366 - DNA, 25 bp, Rattus norvegicus
taaaggtgcttgacaccaaggctga

SEQ ID NO: 538367 - DNA, 25 bp, Rattus norvegicus
taaaggtgcttgtcaccaaggctga

SEQ ID NO: 538368 - DNA, 25 bp, Rattus norvegicus
taaaggtggcacactgctctccaag

SEQ ID NO: 538369 - DNA, 25 bp, Rattus norvegicus
taaaggtggcactctgctctccaag

SEQ ID NO: 538370 - DNA, 25 bp, Rattus norvegicus
taaaggtggttaatccctgggcact

SEQ ID NO: 538371 - DNA, 25 bp, Rattus norvegicus
taaaggtggttattccctgggcact

SEQ ID NO: 538372 - DNA, 25 bp, Rattus norvegicus
taaaggtgtcacaaccagcgcctgg

SEQ ID NO: 538373 - DNA, 25 bp, Rattus norvegicus
taaaggtgtcactaccagcgcctgg

SEQ ID NO: 538374 - DNA, 25 bp, Rattus norvegicus
taaaggtgtctgctatgtccagccc

SEQ ID NO: 538375 - DNA, 25 bp, Rattus norvegicus
taaaggtgtctggtatgtccagccc

SEQ ID NO: 538376 - DNA, 25 bp, Rattus norvegicus
taaaggtgtgtcatcccgcctccca

SEQ ID NO: 538377 - DNA, 25 bp, Rattus norvegicus
taaaggtgtgtcttcccgcctccca

SEQ ID NO: 538378 - DNA, 25 bp, Rattus norvegicus
taaaggtgtttgctttttgaactgt

SEQ ID NO: 538379 - DNA, 25 bp, Rattus norvegicus
taaaggtgtttggtttttgaactgt

SEQ ID NO: 538380 - DNA, 25 bp, Rattus norvegicus
taaaggttccagcagagtgctctgc

SEQ ID NO: 538381 - DNA, 25 bp, Rattus norvegicus
taaaggttccaggagagtgctctgc

SEQ ID NO: 538382 - DNA, 25 bp, Rattus norvegicus
taaaggttccgacagtgcataagtt

SEQ ID NO: 538383 - DNA, 25 bp, Rattus norvegicus
taaaggttccgagagtgcataagtt

SEQ ID NO: 538384 - DNA, 25 bp, Rattus norvegicus
taaaggttgcctacagctaacggat

SEQ ID NO: 538385 - DNA, 25 bp, Rattus norvegicus
taaaggttgccttcagctaacggat

SEQ ID NO: 538386 - DNA, 25 bp, Rattus norvegicus
taaaggtttacaattggcaggatta

SEQ ID NO: 538387 - DNA, 25 bp, Rattus norvegicus
taaaggtttacatttggcaggatta

SEQ ID NO: 538388 - DNA, 25 bp, Rattus norvegicus
taaaggtttcttatcagtatgcgta

SEQ ID NO: 538389 - DNA, 25 bp, Rattus norvegicus
taaaggtttcttttcagtatgcgta

SEQ ID NO: 538390 - DNA, 25 bp, Rattus norvegicus
taaagtaaaactcgccctcagcaca

SEQ ID NO: 538391 - DNA, 25 bp, Rattus norvegicus
taaagtaaaactggccctcagcaca

SEQ ID NO: 538392 - DNA, 25 bp, Rattus norvegicus
taaagtaaccctctcataggtctgt

SEQ ID NO: 538393 - DNA, 25 bp, Rattus norvegicus
taaagtaaccctgtcataggtctgt

SEQ ID NO: 538394 - DNA, 25 bp, Rattus norvegicus
taaagtaaggctctctctttcccca

SEQ ID NO: 538395 - DNA, 25 bp, Rattus norvegicus
taaagtaaggctgtctctttcccca

SEQ ID NO: 538396 - DNA, 25 bp, Rattus norvegicus
taaagtaatatccttccccaacaag

SEQ ID NO: 538397 - DNA, 25 bp, Rattus norvegicus
taaagtaatatcgttccccaacaag

SEQ ID NO: 538398 - DNA, 25 bp, Rattus norvegicus
taaagtaatccgatcaccctgacct

SEQ ID NO: 538399 - DNA, 25 bp, Rattus norvegicus
taaagtaatccgttcaccctgacct

SEQ ID NO: 538400 - DNA, 25 bp, Rattus norvegicus
taaagtacactcctctttctgcaga

SEQ ID NO: 538401 - DNA, 25 bp, Rattus norvegicus
taaagtacactcgtctttctgcaga

SEQ ID NO: 538402 - DNA, 25 bp, Rattus norvegicus
taaagtacactgaccctaccttaat

SEQ ID NO: 538403 - DNA, 25 bp, Rattus norvegicus
taaagtacactgtccctaccttaat

SEQ ID NO: 538404 - DNA, 25 bp, Rattus norvegicus
taaagtacagtgcagtggacccagg

SEQ ID NO: 538405 - DNA, 25 bp, Rattus norvegicus
taaagtacagtggagtggacccagg

SEQ ID NO: 538406 - DNA, 25 bp, Rattus norvegicus
taaagtacccaacgctcggaggcac

SEQ ID NO: 538407 - DNA, 25 bp, Rattus norvegicus
taaagtacccaaggctcggaggcac

SEQ ID NO: 538408 - DNA, 25 bp, Rattus norvegicus
taaagtacccggctgtgaaacaatc

SEQ ID NO: 538409 - DNA, 25 bp, Rattus norvegicus
taaagtacccgggtgtgaaacaatc

SEQ ID NO: 538410 - DNA, 25 bp, Rattus norvegicus
taaagtaccgacacctataagggct

SEQ ID NO: 538411 - DNA, 25 bp, Rattus norvegicus
taaagtaccgactcctataagggct

SEQ ID NO: 538412 - DNA, 25 bp, Rattus norvegicus
taaagtaccgttagctcagacagga

SEQ ID NO: 538413 - DNA, 25 bp, Rattus norvegicus
taaagtaccgtttgctcagacagga

SEQ ID NO: 538414 - DNA, 25 bp, Rattus norvegicus
taaagtacctgtcctcctggagatt

SEQ ID NO: 538415 - DNA, 25 bp, Rattus norvegicus
taaagtacctgtgctcctggagatt

SEQ ID NO: 538416 - DNA, 25 bp, Rattus norvegicus
taaagtagccacctttctttcgctg

SEQ ID NO: 538417 - DNA, 25 bp, Rattus norvegicus
taaagtagccacgtttctttcgctg

SEQ ID NO: 538418 - DNA, 25 bp, Rattus norvegicus
taaagtagctagagcagagccctgt

SEQ ID NO: 538419 - DNA, 25 bp, Rattus norvegicus
taaagtagctagtgcagagccctgt

SEQ ID NO: 538420 - DNA, 25 bp, Rattus norvegicus
taaagtagctatattggtggatttt

SEQ ID NO: 538421 - DNA, 25 bp, Rattus norvegicus
taaagtagctattttggtggatttt

SEQ ID NO: 538422 - DNA, 25 bp, Rattus norvegicus
taaagtaggaggaggcgggtccttg

SEQ ID NO: 538423 - DNA, 25 bp, Rattus norvegicus
taaagtaggaggtggcgggtccttg

SEQ ID NO: 538424 - DNA, 25 bp, Rattus norvegicus
taaagtaggcacaccaatgtccctc

SEQ ID NO: 538425 - DNA, 25 bp, Rattus norvegicus
taaagtaggcactccaatgtccctc

SEQ ID NO: 538426 - DNA, 25 bp, Rattus norvegicus
taaagtaggtcgctgctgggcttct

SEQ ID NO: 538427 - DNA, 25 bp, Rattus norvegicus
taaagtaggtcggtgctgggcttct

SEQ ID NO: 538428 - DNA, 25 bp, Rattus norvegicus
taaagtagttgaccttgctctcctc

SEQ ID NO: 538429 - DNA, 25 bp, Rattus norvegicus
taaagtagttgagcttgctctcctc

SEQ ID NO: 538430 - DNA, 25 bp, Rattus norvegicus
taaagtatcagacccttcttcctca

SEQ ID NO: 538431 - DNA, 25 bp, Rattus norvegicus
taaagtatcagagccttcttcctca

SEQ ID NO: 538432 - DNA, 25 bp, Rattus norvegicus
taaagtatcctgctgtttcttctgg

SEQ ID NO: 538433 - DNA, 25 bp, Rattus norvegicus
taaagtatcctggtgtttcttctgg

SEQ ID NO: 538434 - DNA, 25 bp, Rattus norvegicus
taaagtatctgtcttatcccttata

SEQ ID NO: 538435 - DNA, 25 bp, Rattus norvegicus
taaagtatctgtgttatcccttata

SEQ ID NO: 538436 - DNA, 25 bp, Rattus norvegicus
taaagtatctttcctggtatcagga

SEQ ID NO: 538437 - DNA, 25 bp, Rattus norvegicus
taaagtatctttgctggtatcagga

SEQ ID NO: 538438 - DNA, 25 bp, Rattus norvegicus
taaagtattccgcttcgacaagtac

SEQ ID NO: 538439 - DNA, 25 bp, Rattus norvegicus
taaagtattccggttcgacaagtac

SEQ ID NO: 538440 - DNA, 25 bp, Rattus norvegicus
taaagtattgctatgcctccacaat

SEQ ID NO: 538441 - DNA, 25 bp, Rattus norvegicus
taaagtattgctttgcctccacaat

SEQ ID NO: 538442 - DNA, 25 bp, Rattus norvegicus
taaagtattttcagtgtgttcccgg

SEQ ID NO: 538443 - DNA, 25 bp, Rattus norvegicus
taaagtattttctgtgtgttcccgg

SEQ ID NO: 538444 - DNA, 25 bp, Rattus norvegicus
taaagtcagaccagtctcttctcag

SEQ ID NO: 538445 - DNA, 25 bp, Rattus norvegicus
taaagtcagacctgtctcttctcag

SEQ ID NO: 538446 - DNA, 25 bp, Rattus norvegicus
taaagtccaattcagcccatgcacc

SEQ ID NO: 538447 - DNA, 25 bp, Rattus norvegicus
taaagtccaattgagcccatgcacc

SEQ ID NO: 538448 - DNA, 25 bp, Rattus norvegicus
taaagtccacccagtggtgtcattt

SEQ ID NO: 538449 - DNA, 25 bp, Rattus norvegicus
taaagtccaccctgtggtgtcattt

SEQ ID NO: 538450 - DNA, 25 bp, Rattus norvegicus
taaagtcccaacatccagagttaat

SEQ ID NO: 538451 - DNA, 25 bp, Rattus norvegicus
taaagtcccaacttccagagttaat

SEQ ID NO: 538452 - DNA, 25 bp, Rattus norvegicus
taaagtccccagagggtctccagaa

SEQ ID NO: 538453 - DNA, 25 bp, Rattus norvegicus
taaagtccccagtgggtctccagaa

SEQ ID NO: 538454 - DNA, 25 bp, Rattus norvegicus
taaagtccggcacacagcaggtgct

SEQ ID NO: 538455 - DNA, 25 bp, Rattus norvegicus
taaagtccggcagacagcaggtgct

SEQ ID NO: 538456 - DNA, 25 bp, Rattus norvegicus
taaagtcctaagatgctctcaggca

SEQ ID NO: 538457 - DNA, 25 bp, Rattus norvegicus
taaagtcctaagttgctctcaggca

SEQ ID NO: 538458 - DNA, 25 bp, Rattus norvegicus
taaagtcctggacgacgcgtggacc

SEQ ID NO: 538459 - DNA, 25 bp, Rattus norvegicus
taaagtcctggaggacgcgtggacc

SEQ ID NO: 538460 - DNA, 25 bp, Rattus norvegicus
taaagtcctgttcacatcacacatg

SEQ ID NO: 538461 - DNA, 25 bp, Rattus norvegicus
taaagtcctgttgacatcacacatg

SEQ ID NO: 538462 - DNA, 25 bp, Rattus norvegicus
taaagtccttcactatttatggcca

SEQ ID NO: 538463 - DNA, 25 bp, Rattus norvegicus
taaagtccttcagtatttatggcca

SEQ ID NO: 538464 - DNA, 25 bp, Rattus norvegicus
taaagtccttggcatacacccaacc

SEQ ID NO: 538465 - DNA, 25 bp, Rattus norvegicus
taaagtccttgggatacacccaacc

SEQ ID NO: 538466 - DNA, 25 bp, Rattus norvegicus
taaagtccttttatgtatgatggta

SEQ ID NO: 538467 - DNA, 25 bp, Rattus norvegicus
taaagtccttttttgtatgatggta

SEQ ID NO: 538468 - DNA, 25 bp, Rattus norvegicus
taaagtcgccgcacgtgtgggttag

SEQ ID NO: 538469 - DNA, 25 bp, Rattus norvegicus
taaagtcgccgctcgtgtgggttag

SEQ ID NO: 538470 - DNA, 25 bp, Rattus norvegicus
taaagtcggcctaggctacacagtg

SEQ ID NO: 538471 - DNA, 25 bp, Rattus norvegicus
taaagtcggccttggctacacagtg

SEQ ID NO: 538472 - DNA, 25 bp, Rattus norvegicus
taaagtcgttccatgcagcaacgct

SEQ ID NO: 538473 - DNA, 25 bp, Rattus norvegicus
taaagtcgttccttgcagcaacgct

SEQ ID NO: 538474 - DNA, 25 bp, Rattus norvegicus
taaagtctacgtacacacgtgtttc

SEQ ID NO: 538475 - DNA, 25 bp, Rattus norvegicus
taaagtctacgttcacacgtgtttc

SEQ ID NO: 538476 - DNA, 25 bp, Rattus norvegicus
taaagtctactgatacctgttaatt

SEQ ID NO: 538477 - DNA, 25 bp, Rattus norvegicus
taaagtctactgttacctgttaatt

SEQ ID NO: 538478 - DNA, 25 bp, Rattus norvegicus
taaagtctcactatactttgtctct

SEQ ID NO: 538479 - DNA, 25 bp, Rattus norvegicus
taaagtctcactttactttgtctct

SEQ ID NO: 538480 - DNA, 25 bp, Rattus norvegicus
taaagtctctgaacacaaaggtgga

SEQ ID NO: 538481 - DNA, 25 bp, Rattus norvegicus
taaagtctctgatcacaaaggtgga

SEQ ID NO: 538482 - DNA, 25 bp, Rattus norvegicus
taaagtctcttaaacatctgatgtc

SEQ ID NO: 538483 - DNA, 25 bp, Rattus norvegicus
taaagtctcttatacatctgatgtc

SEQ ID NO: 538484 - DNA, 25 bp, Rattus norvegicus
taaagtctgctcaggactggacagg

SEQ ID NO: 538485 - DNA, 25 bp, Rattus norvegicus
taaagtctgctcatgcagctttaga

SEQ ID NO: 538486 - DNA, 25 bp, Rattus norvegicus
taaagtctgctctggactggacagg

SEQ ID NO: 538487 - DNA, 25 bp, Rattus norvegicus
taaagtctgctcttgcagctttaga

SEQ ID NO: 538488 - DNA, 25 bp, Rattus norvegicus
taaagtctgggccttttcttccgag

SEQ ID NO: 538489 - DNA, 25 bp, Rattus norvegicus
taaagtctgggcgttttcttccgag

SEQ ID NO: 538490 - DNA, 25 bp, Rattus norvegicus
taaagtctgtggattttaaccatct

SEQ ID NO: 538491 - DNA, 25 bp, Rattus norvegicus
taaagtctgtggtttttaaccatct

SEQ ID NO: 538492 - DNA, 25 bp, Rattus norvegicus
taaagtcttcccagtgtcctagcac

SEQ ID NO: 538493 - DNA, 25 bp, Rattus norvegicus
taaagtcttccctgtgtcctagcac

SEQ ID NO: 538494 - DNA, 25 bp, Rattus norvegicus
taaagtcttgccctttttgctttct

SEQ ID NO: 538495 - DNA, 25 bp, Rattus norvegicus
taaagtcttgccgtttttgctttct

SEQ ID NO: 538496 - DNA, 25 bp, Rattus norvegicus
taaagtcttggaaggtgtcgaggca

SEQ ID NO: 538497 - DNA, 25 bp, Rattus norvegicus
taaagtcttggatggtgtcgaggca

SEQ ID NO: 538498 - DNA, 25 bp, Rattus norvegicus
taaagtgacagacccatagctgcct

SEQ ID NO: 538499 - DNA, 25 bp, Rattus norvegicus
taaagtgacagacggcagcgcattt

SEQ ID NO: 538500 - DNA, 25 bp, Rattus norvegicus
taaagtgacagagccatagctgcct

SEQ ID NO: 538501 - DNA, 25 bp, Rattus norvegicus
taaagtgacagagggcagcgcattt

SEQ ID NO: 538502 - DNA, 25 bp, Rattus norvegicus
taaagtgacctgattcctctcactg

SEQ ID NO: 538503 - DNA, 25 bp, Rattus norvegicus
taaagtgacctgtttcctctcactg

SEQ ID NO: 538504 - DNA, 25 bp, Rattus norvegicus
taaagtgactgcatatcacccgaaa

SEQ ID NO: 538505 - DNA, 25 bp, Rattus norvegicus
taaagtgactgcttatcacccgaaa

SEQ ID NO: 538506 - DNA, 25 bp, Rattus norvegicus
taaagtgaggcgagtgaagaccatt

SEQ ID NO: 538507 - DNA, 25 bp, Rattus norvegicus
taaagtgaggcgtgtgaagaccatt

SEQ ID NO: 538508 - DNA, 25 bp, Rattus norvegicus
taaagtgatgtcaccccattcctaa

SEQ ID NO: 538509 - DNA, 25 bp, Rattus norvegicus
taaagtgatgtctccccattcctaa

SEQ ID NO: 538510 - DNA, 25 bp, Rattus norvegicus
taaagtgattatcttcccctcccta

SEQ ID NO: 538511 - DNA, 25 bp, Rattus norvegicus
taaagtgattatgttcccctcccta

SEQ ID NO: 538512 - DNA, 25 bp, Rattus norvegicus
taaagtgcaacccttcaatgtggac

SEQ ID NO: 538513 - DNA, 25 bp, Rattus norvegicus
taaagtgcaaccgttcaatgtggac

SEQ ID NO: 538514 - DNA, 25 bp, Rattus norvegicus
taaagtgcacataacctgaaacccc

SEQ ID NO: 538515 - DNA, 25 bp, Rattus norvegicus
taaagtgcacattacctgaaacccc

SEQ ID NO: 538516 - DNA, 25 bp, Rattus norvegicus
taaagtgcccatccagccatttttc

SEQ ID NO: 538517 - DNA, 25 bp, Rattus norvegicus
taaagtgcccatgcagccatttttc

SEQ ID NO: 538518 - DNA, 25 bp, Rattus norvegicus
taaagtgccccaatgcagctagcag

SEQ ID NO: 538519 - DNA, 25 bp, Rattus norvegicus
taaagtgccccaccatggaacattc

SEQ ID NO: 538520 - DNA, 25 bp, Rattus norvegicus
taaagtgccccagcatggaacattc

SEQ ID NO: 538521 - DNA, 25 bp, Rattus norvegicus
taaagtgccccattgcagctagcag

SEQ ID NO: 538522 - DNA, 25 bp, Rattus norvegicus
taaagtgcccgacctgatcagaacc

SEQ ID NO: 538523 - DNA, 25 bp, Rattus norvegicus
taaagtgcccgagctgatcagaacc

SEQ ID NO: 538524 - DNA, 25 bp, Rattus norvegicus
taaagtgcctgcagggatttagctc

SEQ ID NO: 538525 - DNA, 25 bp, Rattus norvegicus
taaagtgcctgctgggatttagctc

SEQ ID NO: 538526 - DNA, 25 bp, Rattus norvegicus
taaagtgcctttatatctttcgtag

SEQ ID NO: 538527 - DNA, 25 bp, Rattus norvegicus
taaagtgcctttttatctttcgtag

SEQ ID NO: 538528 - DNA, 25 bp, Rattus norvegicus
taaagtgctcatccagattctacag

SEQ ID NO: 538529 - DNA, 25 bp, Rattus norvegicus
taaagtgctcatgcagattctacag

SEQ ID NO: 538530 - DNA, 25 bp, Rattus norvegicus
taaagtgctctgatggattgccaag

SEQ ID NO: 538531 - DNA, 25 bp, Rattus norvegicus
taaagtgctctgctctcacatgact

SEQ ID NO: 538532 - DNA, 25 bp, Rattus norvegicus
taaagtgctctggtctcacatgact

SEQ ID NO: 538533 - DNA, 25 bp, Rattus norvegicus
taaagtgctctgttggattgccaag

SEQ ID NO: 538534 - DNA, 25 bp, Rattus norvegicus
taaagtgctgtcattcacgatccct

SEQ ID NO: 538535 - DNA, 25 bp, Rattus norvegicus
taaagtgctgtctttcacgatccct

SEQ ID NO: 538536 - DNA, 25 bp, Rattus norvegicus
taaagtgcttgcagcacaggcccaa

SEQ ID NO: 538537 - DNA, 25 bp, Rattus norvegicus
taaagtgcttgctgcacaggcccaa

SEQ ID NO: 538538 - DNA, 25 bp, Rattus norvegicus
taaagtggacttagccgatattggc

SEQ ID NO: 538539 - DNA, 25 bp, Rattus norvegicus
taaagtggactttgccgatattggc

SEQ ID NO: 538540 - DNA, 25 bp, Rattus norvegicus
taaagtggagctatcctctcgttaa

SEQ ID NO: 538541 - DNA, 25 bp, Rattus norvegicus
taaagtggagctttcctctcgttaa

SEQ ID NO: 538542 - DNA, 25 bp, Rattus norvegicus
taaagtggcctgacccattgcagct

SEQ ID NO: 538543 - DNA, 25 bp, Rattus norvegicus
taaagtggcctgtcccattgcagct

SEQ ID NO: 538544 - DNA, 25 bp, Rattus norvegicus
taaagtggcgtaatcgttcctccaa

SEQ ID NO: 538545 - DNA, 25 bp, Rattus norvegicus
taaagtggcgtattcgttcctccaa

SEQ ID NO: 538546 - DNA, 25 bp, Rattus norvegicus
taaagtggcgtgcaggcttcctcag

SEQ ID NO: 538547 - DNA, 25 bp, Rattus norvegicus
taaagtggcgtggaggcttcctcag

SEQ ID NO: 538548 - DNA, 25 bp, Rattus norvegicus
taaagtggcttcatcatgggccggt

SEQ ID NO: 538549 - DNA, 25 bp, Rattus norvegicus
taaagtggcttcttcatgggccggt

SEQ ID NO: 538550 - DNA, 25 bp, Rattus norvegicus
taaagtgggatgactcagggccttg

SEQ ID NO: 538551 - DNA, 25 bp, Rattus norvegicus
taaagtgggatgtctcagggccttg

SEQ ID NO: 538552 - DNA, 25 bp, Rattus norvegicus
taaagtgggcctccttattcgtctc

SEQ ID NO: 538553 - DNA, 25 bp, Rattus norvegicus
taaagtgggcctgcttattcgtctc

SEQ ID NO: 538554 - DNA, 25 bp, Rattus norvegicus
taaagtggtccccttcatttcttga

SEQ ID NO: 538555 - DNA, 25 bp, Rattus norvegicus
taaagtggtcccgttcatttcttga

SEQ ID NO: 538556 - DNA, 25 bp, Rattus norvegicus
taaagtggtctcctccgatgtatag

SEQ ID NO: 538557 - DNA, 25 bp, Rattus norvegicus
taaagtggtctcgtccgatgtatag

SEQ ID NO: 538558 - DNA, 25 bp, Rattus norvegicus
taaagtgtacacactgcaccctgat

SEQ ID NO: 538559 - DNA, 25 bp, Rattus norvegicus
taaagtgtacactctgcaccctgat

SEQ ID NO: 538560 - DNA, 25 bp, Rattus norvegicus
taaagtgtcactctggttgccacca

SEQ ID NO: 538561 - DNA, 25 bp, Rattus norvegicus
taaagtgtcactgtggttgccacca

SEQ ID NO: 538562 - DNA, 25 bp, Rattus norvegicus
taaagtgtccttaaatctcccctgt

SEQ ID NO: 538563 - DNA, 25 bp, Rattus norvegicus
taaagtgtcctttaatctcccctgt

SEQ ID NO: 538564 - DNA, 25 bp, Rattus norvegicus
taaagtgtcttcaagccatattggc

SEQ ID NO: 538565 - DNA, 25 bp, Rattus norvegicus
taaagtgtcttctagccatattggc

SEQ ID NO: 538566 - DNA, 25 bp, Rattus norvegicus
taaagtgtgcggcttcctgacagag

SEQ ID NO: 538567 - DNA, 25 bp, Rattus norvegicus
taaagtgtgcgggttcctgacagag

SEQ ID NO: 538568 - DNA, 25 bp, Rattus norvegicus
taaagtgtgtggctttgacctgtgt

SEQ ID NO: 538569 - DNA, 25 bp, Rattus norvegicus
taaagtgtgtgggtttgacctgtgt

SEQ ID NO: 538570 - DNA, 25 bp, Rattus norvegicus
taaagtgttcaaacggactctagaa

SEQ ID NO: 538571 - DNA, 25 bp, Rattus norvegicus
taaagtgttcaatcggactctagaa

SEQ ID NO: 538572 - DNA, 25 bp, Rattus norvegicus
taaagtgttcacctcacaagccttg

SEQ ID NO: 538573 - DNA, 25 bp, Rattus norvegicus
taaagtgttcacgtcacaagccttg

SEQ ID NO: 538574 - DNA, 25 bp, Rattus norvegicus
taaagtgttccgaggctggtttact

SEQ ID NO: 538575 - DNA, 25 bp, Rattus norvegicus
taaagtgttccgtggctggtttact

SEQ ID NO: 538576 - DNA, 25 bp, Rattus norvegicus
taaagttaacaaccctccataccca

SEQ ID NO: 538577 - DNA, 25 bp, Rattus norvegicus
taaagttaacaagcctccataccca

SEQ ID NO: 538578 - DNA, 25 bp, Rattus norvegicus
taaagttacagacctggaggccgag

SEQ ID NO: 538579 - DNA, 25 bp, Rattus norvegicus
taaagttacagagctggaggccgag

SEQ ID NO: 538580 - DNA, 25 bp, Rattus norvegicus
taaagttaccctccactgcatagta

SEQ ID NO: 538581 - DNA, 25 bp, Rattus norvegicus
taaagttaccctgcactgcatagta

SEQ ID NO: 538582 - DNA, 25 bp, Rattus norvegicus
taaagttatcttccagccacgagaa

SEQ ID NO: 538583 - DNA, 25 bp, Rattus norvegicus
taaagttatcttgcagccacgagaa

SEQ ID NO: 538584 - DNA, 25 bp, Rattus norvegicus
taaagttcacgcacatcttgcaaag

SEQ ID NO: 538585 - DNA, 25 bp, Rattus norvegicus
taaagttcacgctcatcttgcaaag

SEQ ID NO: 538586 - DNA, 25 bp, Rattus norvegicus
taaagttcaggtctggaagccccaa

SEQ ID NO: 538587 - DNA, 25 bp, Rattus norvegicus
taaagttcaggtgtggaagccccaa

SEQ ID NO: 538588 - DNA, 25 bp, Rattus norvegicus
taaagttcatggatctctggctcgt

SEQ ID NO: 538589 - DNA, 25 bp, Rattus norvegicus
taaagttcatggttctctggctcgt

SEQ ID NO: 538590 - DNA, 25 bp, Rattus norvegicus
taaagttcccagctttagtggtctg

SEQ ID NO: 538591 - DNA, 25 bp, Rattus norvegicus
taaagttcccaggtttagtggtctg

SEQ ID NO: 538592 - DNA, 25 bp, Rattus norvegicus
taaagttccttgatattggcgtcaa

SEQ ID NO: 538593 - DNA, 25 bp, Rattus norvegicus
taaagttccttgttattggcgtcaa

SEQ ID NO: 538594 - DNA, 25 bp, Rattus norvegicus
taaagttcgcgtctcttggactaat

SEQ ID NO: 538595 - DNA, 25 bp, Rattus norvegicus
taaagttcgcgtgtcttggactaat

SEQ ID NO: 538596 - DNA, 25 bp, Rattus norvegicus
taaagttcggtcatgcttgtccctt

SEQ ID NO: 538597 - DNA, 25 bp, Rattus norvegicus
taaagttcggtcttgcttgtccctt

SEQ ID NO: 538598 - DNA, 25 bp, Rattus norvegicus
taaagttctgcaccagatgcctgct

SEQ ID NO: 538599 - DNA, 25 bp, Rattus norvegicus
taaagttctgcagcagatgcctgct

SEQ ID NO: 538600 - DNA, 25 bp, Rattus norvegicus
taaagttctgccacagactttcggc

SEQ ID NO: 538601 - DNA, 25 bp, Rattus norvegicus
taaagttctgcctcagactttcggc

SEQ ID NO: 538602 - DNA, 25 bp, Rattus norvegicus
taaagttctggcatagcatccatga

SEQ ID NO: 538603 - DNA, 25 bp, Rattus norvegicus
taaagttctggcttagcatccatga

SEQ ID NO: 538604 - DNA, 25 bp, Rattus norvegicus
taaagttcttacctcagtgagtgag

SEQ ID NO: 538605 - DNA, 25 bp, Rattus norvegicus
taaagttcttacgtcagtgagtgag

SEQ ID NO: 538606 - DNA, 25 bp, Rattus norvegicus
taaagttcttggaggaggtcggctt

SEQ ID NO: 538607 - DNA, 25 bp, Rattus norvegicus
taaagttcttggtggaggtcggctt

SEQ ID NO: 538608 - DNA, 25 bp, Rattus norvegicus
taaagttggcacctggcttcagtgt

SEQ ID NO: 538609 - DNA, 25 bp, Rattus norvegicus
taaagttggcacgtggcttcagtgt

SEQ ID NO: 538610 - DNA, 25 bp, Rattus norvegicus
taaagttggccgagactccatactt

SEQ ID NO: 538611 - DNA, 25 bp, Rattus norvegicus
taaagttggccgtgactccatactt

SEQ ID NO: 538612 - DNA, 25 bp, Rattus norvegicus
taaagttggctacaccttgttcgag

SEQ ID NO: 538613 - DNA, 25 bp, Rattus norvegicus
taaagttggctagaccttgttcgag

SEQ ID NO: 538614 - DNA, 25 bp, Rattus norvegicus
taaagttggtttccagtgtctaacg

SEQ ID NO: 538615 - DNA, 25 bp, Rattus norvegicus
taaagttggtttgcagtgtctaacg

SEQ ID NO: 538616 - DNA, 25 bp, Rattus norvegicus
taaagttgtcccaggtgtgccctgc

SEQ ID NO: 538617 - DNA, 25 bp, Rattus norvegicus
taaagttgtccctggtgtgccctgc

SEQ ID NO: 538618 - DNA, 25 bp, Rattus norvegicus
taaagttgtcctcttgacctaccca

SEQ ID NO: 538619 - DNA, 25 bp, Rattus norvegicus
taaagttgtcctgttgacctaccca

SEQ ID NO: 538620 - DNA, 25 bp, Rattus norvegicus
taaagttgtgggagttctcgtctca

SEQ ID NO: 538621 - DNA, 25 bp, Rattus norvegicus
taaagttgtgggtgttctcgtctca

SEQ ID NO: 538622 - DNA, 25 bp, Rattus norvegicus
taaagtttaaccagtccccagagat

SEQ ID NO: 538623 - DNA, 25 bp, Rattus norvegicus
taaagtttaacctgtccccagagat

SEQ ID NO: 538624 - DNA, 25 bp, Rattus norvegicus
taaagtttacccagttacactgatc

SEQ ID NO: 538625 - DNA, 25 bp, Rattus norvegicus
taaagtttaccctgttacactgatc

SEQ ID NO: 538626 - DNA, 25 bp, Rattus norvegicus
taaagtttctccaaccgttctggtg

SEQ ID NO: 538627 - DNA, 25 bp, Rattus norvegicus
taaagtttctcccttctcctggcag

SEQ ID NO: 538628 - DNA, 25 bp, Rattus norvegicus
taaagtttctccgttctcctggcag

SEQ ID NO: 538629 - DNA, 25 bp, Rattus norvegicus
taaagtttctcctaccgttctggtg

SEQ ID NO: 538630 - DNA, 25 bp, Rattus norvegicus
taaagtttctgccaccataccgaga

SEQ ID NO: 538631 - DNA, 25 bp, Rattus norvegicus
taaagtttctgcgaccataccgaga

SEQ ID NO: 538632 - DNA, 25 bp, Rattus norvegicus
taaagtttgactcacttgggtttct

SEQ ID NO: 538633 - DNA, 25 bp, Rattus norvegicus
taaagtttgactgacttgggtttct

SEQ ID NO: 538634 - DNA, 25 bp, Rattus norvegicus
taaagtttgcccacagttggataaa

SEQ ID NO: 538635 - DNA, 25 bp, Rattus norvegicus
taaagtttgccctcagttggataaa

SEQ ID NO: 538636 - DNA, 25 bp, Rattus norvegicus
taaagtttgggcatcttcttgtctc

SEQ ID NO: 538637 - DNA, 25 bp, Rattus norvegicus
taaagtttgggcttcttcttgtctc

SEQ ID NO: 538638 - DNA, 25 bp, Rattus norvegicus
taaagttttacacctcaatttggtt

SEQ ID NO: 538639 - DNA, 25 bp, Rattus norvegicus
taaagttttacagctcaatttggtt

SEQ ID NO: 538640 - DNA, 25 bp, Rattus norvegicus
taaagttttcctaatttctcgcctg

SEQ ID NO: 538641 - DNA, 25 bp, Rattus norvegicus
taaagttttccttatttctcgcctg

SEQ ID NO: 538642 - DNA, 25 bp, Rattus norvegicus
taaataaaacctctctcccactcag

SEQ ID NO: 538643 - DNA, 25 bp, Rattus norvegicus
taaataaaacctgtctcccactcag

SEQ ID NO: 538644 - DNA, 25 bp, Rattus norvegicus
taaataaaagcgatcccattcgttg

SEQ ID NO: 538645 - DNA, 25 bp, Rattus norvegicus
taaataaaagcgttcccattcgttg

SEQ ID NO: 538646 - DNA, 25 bp, Rattus norvegicus
taaataaactatatccagctttgaa

SEQ ID NO: 538647 - DNA, 25 bp, Rattus norvegicus
taaataaactatttccagctttgaa

SEQ ID NO: 538648 - DNA, 25 bp, Rattus norvegicus
taaataaactcgatctttctccttg

SEQ ID NO: 538649 - DNA, 25 bp, Rattus norvegicus
taaataaactcgttctttctccttg

SEQ ID NO: 538650 - DNA, 25 bp, Rattus norvegicus
taaataaacttcctctaccacactg

SEQ ID NO: 538651 - DNA, 25 bp, Rattus norvegicus
taaataaacttcgtctaccacactg

SEQ ID NO: 538652 - DNA, 25 bp, Rattus norvegicus
taaataaagaccactctaccctcat

SEQ ID NO: 538653 - DNA, 25 bp, Rattus norvegicus
taaataaagacctctctaccctcat

SEQ ID NO: 538654 - DNA, 25 bp, Rattus norvegicus
taaataaatggaaggcattggcctg

SEQ ID NO: 538655 - DNA, 25 bp, Rattus norvegicus
taaataaatggatggcattggcctg

SEQ ID NO: 538656 - DNA, 25 bp, Rattus norvegicus
taaataaccacccatcctgtgtact

SEQ ID NO: 538657 - DNA, 25 bp, Rattus norvegicus
taaataaccaccgatcctgtgtact

SEQ ID NO: 538658 - DNA, 25 bp, Rattus norvegicus
taaataacgcatatttccctccttc

SEQ ID NO: 538659 - DNA, 25 bp, Rattus norvegicus
taaataacgcatttttccctccttc

SEQ ID NO: 538660 - DNA, 25 bp, Rattus norvegicus
taaataactggtaccctcagctttc

SEQ ID NO: 538661 - DNA, 25 bp, Rattus norvegicus
taaataactggtccttgcccacaga

SEQ ID NO: 538662 - DNA, 25 bp, Rattus norvegicus
taaataactggtgcttgcccacaga

SEQ ID NO: 538663 - DNA, 25 bp, Rattus norvegicus
taaataactggttccctcagctttc

SEQ ID NO: 538664 - DNA, 25 bp, Rattus norvegicus
taaataatttgcaccggaacgcggc

SEQ ID NO: 538665 - DNA, 25 bp, Rattus norvegicus
taaataatttgctccggaacgcggc

SEQ ID NO: 538666 - DNA, 25 bp, Rattus norvegicus
taaatacaatctaactcttcctgcc

SEQ ID NO: 538667 - DNA, 25 bp, Rattus norvegicus
taaatacaatcttactcttcctgcc

SEQ ID NO: 538668 - DNA, 25 bp, Rattus norvegicus
taaatacataccaaaccgtccctgt

SEQ ID NO: 538669 - DNA, 25 bp, Rattus norvegicus
taaatacatacctaaccgtccctgt

SEQ ID NO: 538670 - DNA, 25 bp, Rattus norvegicus
taaatacatagtcactggctcaggg

SEQ ID NO: 538671 - DNA, 25 bp, Rattus norvegicus
taaatacatagtgactggctcaggg

SEQ ID NO: 538672 - DNA, 25 bp, Rattus norvegicus
taaatacatttgacttacctcaata

SEQ ID NO: 538673 - DNA, 25 bp, Rattus norvegicus
taaatacatttgtcttacctcaata

SEQ ID NO: 538674 - DNA, 25 bp, Rattus norvegicus
taaataccattgatacacccgcctt

SEQ ID NO: 538675 - DNA, 25 bp, Rattus norvegicus
taaataccattgttacacccgcctt

SEQ ID NO: 538676 - DNA, 25 bp, Rattus norvegicus
taaatacccagcactgtagtcttcc

SEQ ID NO: 538677 - DNA, 25 bp, Rattus norvegicus
taaatacccagctctgtagtcttcc

SEQ ID NO: 538678 - DNA, 25 bp, Rattus norvegicus
taaatacccatgctcctgccaggtg

SEQ ID NO: 538679 - DNA, 25 bp, Rattus norvegicus
taaatacccatggtcctgccaggtg

SEQ ID NO: 538680 - DNA, 25 bp, Rattus norvegicus
taaatactctcactgcacttgaacc

SEQ ID NO: 538681 - DNA, 25 bp, Rattus norvegicus
taaatactctcagtgcacttgaacc

SEQ ID NO: 538682 - DNA, 25 bp, Rattus norvegicus
taaatactgcacacagcttcctttc

SEQ ID NO: 538683 - DNA, 25 bp, Rattus norvegicus
taaatactgcactcagcttcctttc

SEQ ID NO: 538684 - DNA, 25 bp, Rattus norvegicus
taaatactggctccctggatccgga

SEQ ID NO: 538685 - DNA, 25 bp, Rattus norvegicus
taaatactggctgcctggatccgga

SEQ ID NO: 538686 - DNA, 25 bp, Rattus norvegicus
taaatacttgctccgtgcagcgcgc

SEQ ID NO: 538687 - DNA, 25 bp, Rattus norvegicus
taaatacttgctgcgtgcagcgcgc

SEQ ID NO: 538688 - DNA, 25 bp, Rattus norvegicus
taaatagacccactctgtcctgtgc

SEQ ID NO: 538689 - DNA, 25 bp, Rattus norvegicus
taaatagacccagtctgtcctgtgc

SEQ ID NO: 538690 - DNA, 25 bp, Rattus norvegicus
taaatagacgcactgtcgcttgtcc

SEQ ID NO: 538691 - DNA, 25 bp, Rattus norvegicus
taaatagacgcagtgtcgcttgtcc

SEQ ID NO: 538692 - DNA, 25 bp, Rattus norvegicus
taaatagattgaccctctcagccaa

SEQ ID NO: 538693 - DNA, 25 bp, Rattus norvegicus
taaatagattgagcctctcagccaa

SEQ ID NO: 538694 - DNA, 25 bp, Rattus norvegicus
taaatagcactacgccagtgaccgt

SEQ ID NO: 538695 - DNA, 25 bp, Rattus norvegicus
taaatagcactaggccagtgaccgt

SEQ ID NO: 538696 - DNA, 25 bp, Rattus norvegicus
taaatagccacgcagctatgcctca

SEQ ID NO: 538697 - DNA, 25 bp, Rattus norvegicus
taaatagccacggagctatgcctca

SEQ ID NO: 538698 - DNA, 25 bp, Rattus norvegicus
taaatagccattcctttccatctag

SEQ ID NO: 538699 - DNA, 25 bp, Rattus norvegicus
taaatagccattgctttccatctag

SEQ ID NO: 538700 - DNA, 25 bp, Rattus norvegicus
taaatagccctgaaactttcccatg

SEQ ID NO: 538701 - DNA, 25 bp, Rattus norvegicus
taaatagccctgtaactttcccatg

SEQ ID NO: 538702 - DNA, 25 bp, Rattus norvegicus
taaatagcccttcaacgtttcttca

SEQ ID NO: 538703 - DNA, 25 bp, Rattus norvegicus
taaatagcccttgaacgtttcttca

SEQ ID NO: 538704 - DNA, 25 bp, Rattus norvegicus
taaatagctacgattttcatgtatg

SEQ ID NO: 538705 - DNA, 25 bp, Rattus norvegicus
taaatagctacgtttttcatgtatg

SEQ ID NO: 538706 - DNA, 25 bp, Rattus norvegicus
taaataggcggtaccctcggcaacg

SEQ ID NO: 538707 - DNA, 25 bp, Rattus norvegicus
taaataggcggttccctcggcaacg

SEQ ID NO: 538708 - DNA, 25 bp, Rattus norvegicus
taaatagtttttccccacaccatat

SEQ ID NO: 538709 - DNA, 25 bp, Rattus norvegicus
taaatagtttttgcccacaccatat

SEQ ID NO: 538710 - DNA, 25 bp, Rattus norvegicus
taaatatagcaaccctcacccaggt

SEQ ID NO: 538711 - DNA, 25 bp, Rattus norvegicus
taaatatagcaagcctcacccaggt

SEQ ID NO: 538712 - DNA, 25 bp, Rattus norvegicus
taaatatccctgaggcctggctggc

SEQ ID NO: 538713 - DNA, 25 bp, Rattus norvegicus
taaatatccctgtggcctggctggc

SEQ ID NO: 538714 - DNA, 25 bp, Rattus norvegicus
taaatatccgctcttagtgaactgg

SEQ ID NO: 538715 - DNA, 25 bp, Rattus norvegicus
taaatatccgctgttagtgaactgg

SEQ ID NO: 538716 - DNA, 25 bp, Rattus norvegicus
taaatatccttgagcactggattta

SEQ ID NO: 538717 - DNA, 25 bp, Rattus norvegicus
taaatatccttgtgcactggattta

SEQ ID NO: 538718 - DNA, 25 bp, Rattus norvegicus
taaatatctcatctcttgctttgtt

SEQ ID NO: 538719 - DNA, 25 bp, Rattus norvegicus
taaatatctcatgtcttgctttgtt

SEQ ID NO: 538720 - DNA, 25 bp, Rattus norvegicus
taaatatctcctaccaccatttgga

SEQ ID NO: 538721 - DNA, 25 bp, Rattus norvegicus
taaatatctccttccaccatttgga

SEQ ID NO: 538722 - DNA, 25 bp, Rattus norvegicus
taaatatctgtacagcgggctgacc

SEQ ID NO: 538723 - DNA, 25 bp, Rattus norvegicus
taaatatctgtagagcgggctgacc

SEQ ID NO: 538724 - DNA, 25 bp, Rattus norvegicus
taaatatgcctactcaaactctgtt

SEQ ID NO: 538725 - DNA, 25 bp, Rattus norvegicus
taaatatgcctagtcaaactctgtt

SEQ ID NO: 538726 - DNA, 25 bp, Rattus norvegicus
taaatatgctaacctcttgagaacc

SEQ ID NO: 538727 - DNA, 25 bp, Rattus norvegicus
taaatatgctaagctcttgagaacc

SEQ ID NO: 538728 - DNA, 25 bp, Rattus norvegicus
taaatattcaggcacagaagggttc

SEQ ID NO: 538729 - DNA, 25 bp, Rattus norvegicus
taaatattcagggacagaagggttc

SEQ ID NO: 538730 - DNA, 25 bp, Rattus norvegicus
taaatattcccacaacctcaagggt

SEQ ID NO: 538731 - DNA, 25 bp, Rattus norvegicus
taaatattcccagaacctcaagggt

SEQ ID NO: 538732 - DNA, 25 bp, Rattus norvegicus
taaatattccttcactcggctggat

SEQ ID NO: 538733 - DNA, 25 bp, Rattus norvegicus
taaatattccttgactcggctggat

SEQ ID NO: 538734 - DNA, 25 bp, Rattus norvegicus
taaatattgcctcggtttcaagtcc

SEQ ID NO: 538735 - DNA, 25 bp, Rattus norvegicus
taaatattgcctgggtttcaagtcc

SEQ ID NO: 538736 - DNA, 25 bp, Rattus norvegicus
taaatattggtgaaaatgcccacgt

SEQ ID NO: 538737 - DNA, 25 bp, Rattus norvegicus
taaatattggtgtaaatgcccacgt

SEQ ID NO: 538738 - DNA, 25 bp, Rattus norvegicus
taaatatttcttcctgtcacttccc

SEQ ID NO: 538739 - DNA, 25 bp, Rattus norvegicus
taaatatttcttgctgtcacttccc

SEQ ID NO: 538740 - DNA, 25 bp, Rattus norvegicus
taaatattttgccatggaccataat

SEQ ID NO: 538741 - DNA, 25 bp, Rattus norvegicus
taaatattttgcgatggaccataat

SEQ ID NO: 538742 - DNA, 25 bp, Rattus norvegicus
taaatatttttactggtccagaact

SEQ ID NO: 538743 - DNA, 25 bp, Rattus norvegicus
taaatatttttagtggtccagaact

SEQ ID NO: 538744 - DNA, 25 bp, Rattus norvegicus
taaatcaaagtacgcctcgcgtcct

SEQ ID NO: 538745 - DNA, 25 bp, Rattus norvegicus
taaatcaaagtaggcctcgcgtcct

SEQ ID NO: 538746 - DNA, 25 bp, Rattus norvegicus
taaatcaaatctattccctcgggct

SEQ ID NO: 538747 - DNA, 25 bp, Rattus norvegicus
taaatcaaatcttttccctcgggct

SEQ ID NO: 538748 - DNA, 25 bp, Rattus norvegicus
taaatcaacttaagcccttgcctgt

SEQ ID NO: 538749 - DNA, 25 bp, Rattus norvegicus
taaatcaacttatgcccttgcctgt

SEQ ID NO: 538750 - DNA, 25 bp, Rattus norvegicus
taaatcaagacaccgacctcaggag

SEQ ID NO: 538751 - DNA, 25 bp, Rattus norvegicus
taaatcaagacagcgacctcaggag

SEQ ID NO: 538752 - DNA, 25 bp, Rattus norvegicus
taaatcaagcatctcactgtcactg

SEQ ID NO: 538753 - DNA, 25 bp, Rattus norvegicus
taaatcaagcatgtcactgtcactg

SEQ ID NO: 538754 - DNA, 25 bp, Rattus norvegicus
taaatcaatgccctttttattttgg

SEQ ID NO: 538755 - DNA, 25 bp, Rattus norvegicus
taaatcaatgccgtttttattttgg

SEQ ID NO: 538756 - DNA, 25 bp, Rattus norvegicus
taaatcacaagcactctttcctgtc

SEQ ID NO: 538757 - DNA, 25 bp, Rattus norvegicus
taaatcacaagctctctttcctgtc

SEQ ID NO: 538758 - DNA, 25 bp, Rattus norvegicus
taaatcacagctactagttaggcca

SEQ ID NO: 538759 - DNA, 25 bp, Rattus norvegicus
taaatcacagcttctagttaggcca

SEQ ID NO: 538760 - DNA, 25 bp, Rattus norvegicus
taaatcacatttcatcatgatgatg

SEQ ID NO: 538761 - DNA, 25 bp, Rattus norvegicus
taaatcacatttgatcatgatgatg

SEQ ID NO: 538762 - DNA, 25 bp, Rattus norvegicus
taaatcagaagtcatgtttaccaga

SEQ ID NO: 538763 - DNA, 25 bp, Rattus norvegicus
taaatcagaagtgatgtttaccaga

SEQ ID NO: 538764 - DNA, 25 bp, Rattus norvegicus
taaatcagaatccacctcaggtact

SEQ ID NO: 538765 - DNA, 25 bp, Rattus norvegicus
taaatcagaatcgacctcaggtact

SEQ ID NO: 538766 - DNA, 25 bp, Rattus norvegicus
taaatcagacccagactcaaggcag

SEQ ID NO: 538767 - DNA, 25 bp, Rattus norvegicus
taaatcagaccctgactcaaggcag

SEQ ID NO: 538768 - DNA, 25 bp, Rattus norvegicus
taaatcagagctaccactgccaatg

SEQ ID NO: 538769 - DNA, 25 bp, Rattus norvegicus
taaatcagagcttccactgccaatg

SEQ ID NO: 538770 - DNA, 25 bp, Rattus norvegicus
taaatcagcatcacagtttcacctc

SEQ ID NO: 538771 - DNA, 25 bp, Rattus norvegicus
taaatcagcatctcagtttcacctc

SEQ ID NO: 538772 - DNA, 25 bp, Rattus norvegicus
taaatcaggcagcaacctttcttcc

SEQ ID NO: 538773 - DNA, 25 bp, Rattus norvegicus
taaatcaggcaggaacctttcttcc

SEQ ID NO: 538774 - DNA, 25 bp, Rattus norvegicus
taaatcagtgttatttgctcttgaa

SEQ ID NO: 538775 - DNA, 25 bp, Rattus norvegicus
taaatcagtgttttttgctcttgaa

SEQ ID NO: 538776 - DNA, 25 bp, Rattus norvegicus
taaatcatccccagagcgtctcttt

SEQ ID NO: 538777 - DNA, 25 bp, Rattus norvegicus
taaatcatcccctgagcgtctcttt

SEQ ID NO: 538778 - DNA, 25 bp, Rattus norvegicus
taaatcatccttaagtctgtgcact

SEQ ID NO: 538779 - DNA, 25 bp, Rattus norvegicus
taaatcatcctttagtctgtgcact

SEQ ID NO: 538780 - DNA, 25 bp, Rattus norvegicus
taaatcatgaccacatttccagcct

SEQ ID NO: 538781 - DNA, 25 bp, Rattus norvegicus
taaatcatgacctcatttccagcct

SEQ ID NO: 538782 - DNA, 25 bp, Rattus norvegicus
taaatcatgcatacttggcaaaagt

SEQ ID NO: 538783 - DNA, 25 bp, Rattus norvegicus
taaatcatgcattcttggcaaaagt

SEQ ID NO: 538784 - DNA, 25 bp, Rattus norvegicus
taaatcatgtttcacctgcactgct

SEQ ID NO: 538785 - DNA, 25 bp, Rattus norvegicus
taaatcatgtttgacctgcactgct

SEQ ID NO: 538786 - DNA, 25 bp, Rattus norvegicus
taaatcattgacaccctgtcctgtg

SEQ ID NO: 538787 - DNA, 25 bp, Rattus norvegicus
taaatcattgactccctgtcctgtg

SEQ ID NO: 538788 - DNA, 25 bp, Rattus norvegicus
taaatcattggcactcttgcacgga

SEQ ID NO: 538789 - DNA, 25 bp, Rattus norvegicus
taaatcattggctctcttgcacgga

SEQ ID NO: 538790 - DNA, 25 bp, Rattus norvegicus
taaatcatttaactgaccttcccca

SEQ ID NO: 538791 - DNA, 25 bp, Rattus norvegicus
taaatcatttaagtgaccttcccca

SEQ ID NO: 538792 - DNA, 25 bp, Rattus norvegicus
taaatcatttctctgcctccctaag

SEQ ID NO: 538793 - DNA, 25 bp, Rattus norvegicus
taaatcatttctgtgcctccctaag

SEQ ID NO: 538794 - DNA, 25 bp, Rattus norvegicus
taaatccaaaccactcggagttgtg

SEQ ID NO: 538795 - DNA, 25 bp, Rattus norvegicus
taaatccaaacctctcggagttgtg

SEQ ID NO: 538796 - DNA, 25 bp, Rattus norvegicus
taaatccacctcaggactcacagaa

SEQ ID NO: 538797 - DNA, 25 bp, Rattus norvegicus
taaatccacctctggactcacagaa

SEQ ID NO: 538798 - DNA, 25 bp, Rattus norvegicus
taaatccactgcattacctttctga

SEQ ID NO: 538799 - DNA, 25 bp, Rattus norvegicus
taaatccactgctttacctttctga

SEQ ID NO: 538800 - DNA, 25 bp, Rattus norvegicus
taaatccagagcagtaaacagtcct

SEQ ID NO: 538801 - DNA, 25 bp, Rattus norvegicus
taaatccagagctgtaaacagtcct

SEQ ID NO: 538802 - DNA, 25 bp, Rattus norvegicus
taaatccagccacgtttatctgact

SEQ ID NO: 538803 - DNA, 25 bp, Rattus norvegicus
taaatccagccaggtttatctgact

SEQ ID NO: 538804 - DNA, 25 bp, Rattus norvegicus
taaatccagcttagaggtttccccg

SEQ ID NO: 538805 - DNA, 25 bp, Rattus norvegicus
taaatccagctttgaggtttccccg

SEQ ID NO: 538806 - DNA, 25 bp, Rattus norvegicus
taaatccaggacagcttttattgct

SEQ ID NO: 538807 - DNA, 25 bp, Rattus norvegicus
taaatccaggactgcttttattgct

SEQ ID NO: 538808 - DNA, 25 bp, Rattus norvegicus
taaatccaggttacttccaaggcat

SEQ ID NO: 538809 - DNA, 25 bp, Rattus norvegicus
taaatccaggtttcttccaaggcat

SEQ ID NO: 538810 - DNA, 25 bp, Rattus norvegicus
taaatccagtctacggtgagaagca

SEQ ID NO: 538811 - DNA, 25 bp, Rattus norvegicus
taaatccagtcttcggtgagaagca

SEQ ID NO: 538812 - DNA, 25 bp, Rattus norvegicus
taaatccagttcagcattgcctggg

SEQ ID NO: 538813 - DNA, 25 bp, Rattus norvegicus
taaatccagttctgcattgcctggg

SEQ ID NO: 538814 - DNA, 25 bp, Rattus norvegicus
taaatccatggcagtgtccatttaa

SEQ ID NO: 538815 - DNA, 25 bp, Rattus norvegicus
taaatccatggctgtgtccatttaa

SEQ ID NO: 538816 - DNA, 25 bp, Rattus norvegicus
taaatccattccacaagctagctgt

SEQ ID NO: 538817 - DNA, 25 bp, Rattus norvegicus
taaatccattcctcaagctagctgt

SEQ ID NO: 538818 - DNA, 25 bp, Rattus norvegicus
taaatcccaagtacatcccgcagag

SEQ ID NO: 538819 - DNA, 25 bp, Rattus norvegicus
taaatcccaagttcatcccgcagag

SEQ ID NO: 538820 - DNA, 25 bp, Rattus norvegicus
taaatcccaatcaaacagttcagct

SEQ ID NO: 538821 - DNA, 25 bp, Rattus norvegicus
taaatcccaatctaacagttcagct

SEQ ID NO: 538822 - DNA, 25 bp, Rattus norvegicus
taaatcccaattcttcccttcaact

SEQ ID NO: 538823 - DNA, 25 bp, Rattus norvegicus
taaatcccaattgttcccttcaact

SEQ ID NO: 538824 - DNA, 25 bp, Rattus norvegicus
taaatccccaacagctcacaactat

SEQ ID NO: 538825 - DNA, 25 bp, Rattus norvegicus
taaatccccaaccagatctacggtt

SEQ ID NO: 538826 - DNA, 25 bp, Rattus norvegicus
taaatccccaacgagatctacggtt

SEQ ID NO: 538827 - DNA, 25 bp, Rattus norvegicus
taaatccccaactgctcacaactat

SEQ ID NO: 538828 - DNA, 25 bp, Rattus norvegicus
taaatccccaatcccgactaaatca

SEQ ID NO: 538829 - DNA, 25 bp, Rattus norvegicus
taaatccccaatgccgactaaatca

SEQ ID NO: 538830 - DNA, 25 bp, Rattus norvegicus
taaatcccgatcaggatcttgccga

SEQ ID NO: 538831 - DNA, 25 bp, Rattus norvegicus
taaatcccgatctggatcttgccga

SEQ ID NO: 538832 - DNA, 25 bp, Rattus norvegicus
taaatccgtgtcaaatccttccctt

SEQ ID NO: 538833 - DNA, 25 bp, Rattus norvegicus
taaatccgtgtctaatccttccctt

SEQ ID NO: 538834 - DNA, 25 bp, Rattus norvegicus
taaatcctaaggactcttgccacct

SEQ ID NO: 538835 - DNA, 25 bp, Rattus norvegicus
taaatcctaaggtctcttgccacct

SEQ ID NO: 538836 - DNA, 25 bp, Rattus norvegicus
taaatcctccagagagtaactcatc

SEQ ID NO: 538837 - DNA, 25 bp, Rattus norvegicus
taaatcctccagtgagtaactcatc

SEQ ID NO: 538838 - DNA, 25 bp, Rattus norvegicus
taaatcctccatagtgcctaggtgc

SEQ ID NO: 538839 - DNA, 25 bp, Rattus norvegicus
taaatcctccattgtgcctaggtgc

SEQ ID NO: 538840 - DNA, 25 bp, Rattus norvegicus
taaatcctgatcctttgagagctga

SEQ ID NO: 538841 - DNA, 25 bp, Rattus norvegicus
taaatcctgatcgtttgagagctga

SEQ ID NO: 538842 - DNA, 25 bp, Rattus norvegicus
taaatcctggaacgcagagacaaaa

SEQ ID NO: 538843 - DNA, 25 bp, Rattus norvegicus
taaatcctggaaggcagagacaaaa

SEQ ID NO: 538844 - DNA, 25 bp, Rattus norvegicus
taaatcctggtaactatgctgtcta

SEQ ID NO: 538845 - DNA, 25 bp, Rattus norvegicus
taaatcctggtatctatgctgtcta

SEQ ID NO: 538846 - DNA, 25 bp, Rattus norvegicus
taaatcctgtgtctcattacttgaa

SEQ ID NO: 538847 - DNA, 25 bp, Rattus norvegicus
taaatcctgtgtgtcattacttgaa

SEQ ID NO: 538848 - DNA, 25 bp, Rattus norvegicus
taaatccttcacctgtttctttcat

SEQ ID NO: 538849 - DNA, 25 bp, Rattus norvegicus
taaatccttcacgtgtttctttcat

SEQ ID NO: 538850 - DNA, 25 bp, Rattus norvegicus
taaatccttcctctacatgtaaaca

SEQ ID NO: 538851 - DNA, 25 bp, Rattus norvegicus
taaatccttcctgtacatgtaaaca

SEQ ID NO: 538852 - DNA, 25 bp, Rattus norvegicus
taaatccttggtaaagcggccggct

SEQ ID NO: 538853 - DNA, 25 bp, Rattus norvegicus
taaatccttggttaagcggccggct

SEQ ID NO: 538854 - DNA, 25 bp, Rattus norvegicus
taaatcgactttatcaattgaccat

SEQ ID NO: 538855 - DNA, 25 bp, Rattus norvegicus
taaatcgactttttcaattgaccat

SEQ ID NO: 538856 - DNA, 25 bp, Rattus norvegicus
taaatcgatttacaggcaatacaat

SEQ ID NO: 538857 - DNA, 25 bp, Rattus norvegicus
taaatcgatttagaggcaatacaat

SEQ ID NO: 538858 - DNA, 25 bp, Rattus norvegicus
taaatcgccatcatcgagaccaaga

SEQ ID NO: 538859 - DNA, 25 bp, Rattus norvegicus
taaatcgccatcttcgagaccaaga

SEQ ID NO: 538860 - DNA, 25 bp, Rattus norvegicus
taaatcgctcatccaacctagactt

SEQ ID NO: 538861 - DNA, 25 bp, Rattus norvegicus
taaatcgctcatgcaacctagactt

SEQ ID NO: 538862 - DNA, 25 bp, Rattus norvegicus
taaatcgctcctatacaacatcact

SEQ ID NO: 538863 - DNA, 25 bp, Rattus norvegicus
taaatcgctcctttacaacatcact

SEQ ID NO: 538864 - DNA, 25 bp, Rattus norvegicus
taaatcgctttaactgtcacttcag

SEQ ID NO: 538865 - DNA, 25 bp, Rattus norvegicus
taaatcgctttatctgtcacttcag

SEQ ID NO: 538866 - DNA, 25 bp, Rattus norvegicus
taaatcggccccaaaaagtcctgat

SEQ ID NO: 538867 - DNA, 25 bp, Rattus norvegicus
taaatcggcccctaaaagtcctgat

SEQ ID NO: 538868 - DNA, 25 bp, Rattus norvegicus
taaatcggcgagacctttcaggatc

SEQ ID NO: 538869 - DNA, 25 bp, Rattus norvegicus
taaatcggcgagtcctttcaggatc

SEQ ID NO: 538870 - DNA, 25 bp, Rattus norvegicus
taaatcgtttgaaccccttgtcact

SEQ ID NO: 538871 - DNA, 25 bp, Rattus norvegicus
taaatcgtttgatccccttgtcact

SEQ ID NO: 538872 - DNA, 25 bp, Rattus norvegicus
taaatctaagaacccttccggtgct

SEQ ID NO: 538873 - DNA, 25 bp, Rattus norvegicus
taaatctaagaagccttccggtgct

SEQ ID NO: 538874 - DNA, 25 bp, Rattus norvegicus
taaatctaagtgctatgaatgtggg

SEQ ID NO: 538875 - DNA, 25 bp, Rattus norvegicus
taaatctaagtggtatgaatgtggg

SEQ ID NO: 538876 - DNA, 25 bp, Rattus norvegicus
taaatctaccacatatctcctctaa

SEQ ID NO: 538877 - DNA, 25 bp, Rattus norvegicus
taaatctaccacttatctcctctaa

SEQ ID NO: 538878 - DNA, 25 bp, Rattus norvegicus
taaatctaggtgacagatcactgag

SEQ ID NO: 538879 - DNA, 25 bp, Rattus norvegicus
taaatctaggtgtcagatcactgag

SEQ ID NO: 538880 - DNA, 25 bp, Rattus norvegicus
taaatctatgctctccaatctggaa

SEQ ID NO: 538881 - DNA, 25 bp, Rattus norvegicus
taaatctatgctgtccaatctggaa

SEQ ID NO: 538882 - DNA, 25 bp, Rattus norvegicus
taaatctccaacagtgcgggctttc

SEQ ID NO: 538883 - DNA, 25 bp, Rattus norvegicus
taaatctccaactgtgcgggctttc

SEQ ID NO: 538884 - DNA, 25 bp, Rattus norvegicus
taaatctccagtctgtctgttgtac

SEQ ID NO: 538885 - DNA, 25 bp, Rattus norvegicus
taaatctccagtgtgtctgttgtac

SEQ ID NO: 538886 - DNA, 25 bp, Rattus norvegicus
taaatctccatcatcctgaaacctt

SEQ ID NO: 538887 - DNA, 25 bp, Rattus norvegicus
taaatctccatcttcctgaaacctt

SEQ ID NO: 538888 - DNA, 25 bp, Rattus norvegicus
taaatctcccagctagcaagcccat

SEQ ID NO: 538889 - DNA, 25 bp, Rattus norvegicus
taaatctcccaggtagcaagcccat

SEQ ID NO: 538890 - DNA, 25 bp, Rattus norvegicus
taaatctcccgacgccggttggtgc

SEQ ID NO: 538891 - DNA, 25 bp, Rattus norvegicus
taaatctcccgaggccggttggtgc

SEQ ID NO: 538892 - DNA, 25 bp, Rattus norvegicus
taaatctcctatacctgggcagaac

SEQ ID NO: 538893 - DNA, 25 bp, Rattus norvegicus
taaatctcctattcctgggcagaac

SEQ ID NO: 538894 - DNA, 25 bp, Rattus norvegicus
taaatctcctttacctgttgcaaac

SEQ ID NO: 538895 - DNA, 25 bp, Rattus norvegicus
taaatctccttttcctgttgcaaac

SEQ ID NO: 538896 - DNA, 25 bp, Rattus norvegicus
taaatctcggacacctttaaggacg

SEQ ID NO: 538897 - DNA, 25 bp, Rattus norvegicus
taaatctcggactcctttaaggacg

SEQ ID NO: 538898 - DNA, 25 bp, Rattus norvegicus
taaatctgaatcatgcctgagctaa

SEQ ID NO: 538899 - DNA, 25 bp, Rattus norvegicus
taaatctgaatcttgcctgagctaa

SEQ ID NO: 538900 - DNA, 25 bp, Rattus norvegicus
taaatctgactcattggcttagaag

SEQ ID NO: 538901 - DNA, 25 bp, Rattus norvegicus
taaatctgactctttggcttagaag

SEQ ID NO: 538902 - DNA, 25 bp, Rattus norvegicus
taaatctgaggccagtccggttcat

SEQ ID NO: 538903 - DNA, 25 bp, Rattus norvegicus
taaatctgaggcgagtccggttcat

SEQ ID NO: 538904 - DNA, 25 bp, Rattus norvegicus
taaatctgatgtatcctgtacctgc

SEQ ID NO: 538905 - DNA, 25 bp, Rattus norvegicus
taaatctgatgtttcctgtacctgc

SEQ ID NO: 538906 - DNA, 25 bp, Rattus norvegicus
taaatctgctcacgagactcccgag

SEQ ID NO: 538907 - DNA, 25 bp, Rattus norvegicus
taaatctgctcaggagactcccgag

SEQ ID NO: 538908 - DNA, 25 bp, Rattus norvegicus
taaatctgggagattccccaccgct

SEQ ID NO: 538909 - DNA, 25 bp, Rattus norvegicus
taaatctgggagtttccccaccgct

SEQ ID NO: 538910 - DNA, 25 bp, Rattus norvegicus
taaatctggtggcaaggccaaaaag

SEQ ID NO: 538911 - DNA, 25 bp, Rattus norvegicus
taaatctggtgggaaggccaaaaag

SEQ ID NO: 538912 - DNA, 25 bp, Rattus norvegicus
taaatctgtgatacattgccttaag

SEQ ID NO: 538913 - DNA, 25 bp, Rattus norvegicus
taaatctgtgattcattgccttaag

SEQ ID NO: 538914 - DNA, 25 bp, Rattus norvegicus
taaatctgtgcccttggctggacag

SEQ ID NO: 538915 - DNA, 25 bp, Rattus norvegicus
taaatctgtgccgttggctggacag

SEQ ID NO: 538916 - DNA, 25 bp, Rattus norvegicus
taaatcttaaaacctggccctaatc

SEQ ID NO: 538917 - DNA, 25 bp, Rattus norvegicus
taaatcttaaaagctggccctaatc

SEQ ID NO: 538918 - DNA, 25 bp, Rattus norvegicus
taaatcttaccaacttctctctaac

SEQ ID NO: 538919 - DNA, 25 bp, Rattus norvegicus
taaatcttaccatcttctctctaac

SEQ ID NO: 538920 - DNA, 25 bp, Rattus norvegicus
taaatcttccatctcctgttaccta

SEQ ID NO: 538921 - DNA, 25 bp, Rattus norvegicus
taaatcttccatgtcctgttaccta

SEQ ID NO: 538922 - DNA, 25 bp, Rattus norvegicus
taaatcttggtaaccttctcctatg

SEQ ID NO: 538923 - DNA, 25 bp, Rattus norvegicus
taaatcttggtatccttctcctatg

SEQ ID NO: 538924 - DNA, 25 bp, Rattus norvegicus
taaatcttgtgtaagctgtctgctg

SEQ ID NO: 538925 - DNA, 25 bp, Rattus norvegicus
taaatcttgtgttagctgtctgctg

SEQ ID NO: 538926 - DNA, 25 bp, Rattus norvegicus
taaatgaatgttcggtctccactcc

SEQ ID NO: 538927 - DNA, 25 bp, Rattus norvegicus
taaatgaatgttgggtctccactcc

SEQ ID NO: 538928 - DNA, 25 bp, Rattus norvegicus
taaatgacactgataccatccccag

SEQ ID NO: 538929 - DNA, 25 bp, Rattus norvegicus
taaatgacactgttaccatccccag

SEQ ID NO: 538930 - DNA, 25 bp, Rattus norvegicus
taaatgacagctctgggccatgccc

SEQ ID NO: 538931 - DNA, 25 bp, Rattus norvegicus
taaatgacagctgtgggccatgccc

SEQ ID NO: 538932 - DNA, 25 bp, Rattus norvegicus
taaatgacccagcttttcggttctt

SEQ ID NO: 538933 - DNA, 25 bp, Rattus norvegicus
taaatgacccaggttttcggttctt

SEQ ID NO: 538934 - DNA, 25 bp, Rattus norvegicus
taaatgacctacatgtccctttcag

SEQ ID NO: 538935 - DNA, 25 bp, Rattus norvegicus
taaatgacctacttgtccctttcag

SEQ ID NO: 538936 - DNA, 25 bp, Rattus norvegicus
taaatgagcactacatactgtcagt

SEQ ID NO: 538937 - DNA, 25 bp, Rattus norvegicus
taaatgagcacttcatactgtcagt

SEQ ID NO: 538938 - DNA, 25 bp, Rattus norvegicus
taaatgagcctccttttataagtaa

SEQ ID NO: 538939 - DNA, 25 bp, Rattus norvegicus
taaatgagcctcgttttataagtaa

SEQ ID NO: 538940 - DNA, 25 bp, Rattus norvegicus
taaatgagttgcctttaaatccttt

SEQ ID NO: 538941 - DNA, 25 bp, Rattus norvegicus
taaatgagttgcgtttaaatccttt

SEQ ID NO: 538942 - DNA, 25 bp, Rattus norvegicus
taaatgatctcacacttccctaggg

SEQ ID NO: 538943 - DNA, 25 bp, Rattus norvegicus
taaatgatctcagacttccctaggg

SEQ ID NO: 538944 - DNA, 25 bp, Rattus norvegicus
taaatgattcaaagccccggaaggg

SEQ ID NO: 538945 - DNA, 25 bp, Rattus norvegicus
taaatgattcaatgccccggaaggg

SEQ ID NO: 538946 - DNA, 25 bp, Rattus norvegicus
taaatgattcaccaggcactggcat

SEQ ID NO: 538947 - DNA, 25 bp, Rattus norvegicus
taaatgattcacgaggcactggcat

SEQ ID NO: 538948 - DNA, 25 bp, Rattus norvegicus
taaatgattgtacccactgaacccc

SEQ ID NO: 538949 - DNA, 25 bp, Rattus norvegicus
taaatgattgtagccactgaacccc

SEQ ID NO: 538950 - DNA, 25 bp, Rattus norvegicus
taaatgatttcccaacttccagcta

SEQ ID NO: 538951 - DNA, 25 bp, Rattus norvegicus
taaatgatttccgaacttccagcta

SEQ ID NO: 538952 - DNA, 25 bp, Rattus norvegicus
taaatgcactgactgagctcctcct

SEQ ID NO: 538953 - DNA, 25 bp, Rattus norvegicus
taaatgcactgagtgagctcctcct

SEQ ID NO: 538954 - DNA, 25 bp, Rattus norvegicus
taaatgcagcttagtgacgatcact

SEQ ID NO: 538955 - DNA, 25 bp, Rattus norvegicus
taaatgcagctttgtgacgatcact

SEQ ID NO: 538956 - DNA, 25 bp, Rattus norvegicus
taaatgcaggctcgacttccatcct

SEQ ID NO: 538957 - DNA, 25 bp, Rattus norvegicus
taaatgcaggctggacttccatcct

SEQ ID NO: 538958 - DNA, 25 bp, Rattus norvegicus
taaatgcataggcttcattctgctt

SEQ ID NO: 538959 - DNA, 25 bp, Rattus norvegicus
taaatgcatagggttcattctgctt

SEQ ID NO: 538960 - DNA, 25 bp, Rattus norvegicus
taaatgccacatacaggtaccagca

SEQ ID NO: 538961 - DNA, 25 bp, Rattus norvegicus
taaatgccacattcaggtaccagca

SEQ ID NO: 538962 - DNA, 25 bp, Rattus norvegicus
taaatgccacgcagggctacgatgt

SEQ ID NO: 538963 - DNA, 25 bp, Rattus norvegicus
taaatgccacgctgggctacgatgt

SEQ ID NO: 538964 - DNA, 25 bp, Rattus norvegicus
taaatgccactgacaatcccgcaat

SEQ ID NO: 538965 - DNA, 25 bp, Rattus norvegicus
taaatgccactgtcaatcccgcaat

SEQ ID NO: 538966 - DNA, 25 bp, Rattus norvegicus
taaatgccatccatctgagcactgt

SEQ ID NO: 538967 - DNA, 25 bp, Rattus norvegicus
taaatgccatccttctgagcactgt

SEQ ID NO: 538968 - DNA, 25 bp, Rattus norvegicus
taaatgccattaatccttccctatc

SEQ ID NO: 538969 - DNA, 25 bp, Rattus norvegicus
taaatgccattattccttccctatc

SEQ ID NO: 538970 - DNA, 25 bp, Rattus norvegicus
taaatgccccttatatgctgctcag

SEQ ID NO: 538971 - DNA, 25 bp, Rattus norvegicus
taaatgccccttttatgctgctcag

SEQ ID NO: 538972 - DNA, 25 bp, Rattus norvegicus
taaatgccgcagagacaacatcccc

SEQ ID NO: 538973 - DNA, 25 bp, Rattus norvegicus
taaatgccgcagtgacaacatcccc

SEQ ID NO: 538974 - DNA, 25 bp, Rattus norvegicus
taaatgcctcctctgtgactccaga

SEQ ID NO: 538975 - DNA, 25 bp, Rattus norvegicus
taaatgcctcctgtgtgactccaga

SEQ ID NO: 538976 - DNA, 25 bp, Rattus norvegicus
taaatgcgacttattcccagtccat

SEQ ID NO: 538977 - DNA, 25 bp, Rattus norvegicus
taaatgcgactttttcccagtccat

SEQ ID NO: 538978 - DNA, 25 bp, Rattus norvegicus
taaatgcgggctcagtgtcatcacc

SEQ ID NO: 538979 - DNA, 25 bp, Rattus norvegicus
taaatgcgggctgagtgtcatcacc

SEQ ID NO: 538980 - DNA, 25 bp, Rattus norvegicus
taaatgcgtccaataccaggcttgc

SEQ ID NO: 538981 - DNA, 25 bp, Rattus norvegicus
taaatgcgtccattaccaggcttgc

SEQ ID NO: 538982 - DNA, 25 bp, Rattus norvegicus
taaatgctacttctgcctgtgacta

SEQ ID NO: 538983 - DNA, 25 bp, Rattus norvegicus
taaatgctacttgtgcctgtgacta

SEQ ID NO: 538984 - DNA, 25 bp, Rattus norvegicus
taaatgctatctaagactccttccc

SEQ ID NO: 538985 - DNA, 25 bp, Rattus norvegicus
taaatgctatcttagactccttccc

SEQ ID NO: 538986 - DNA, 25 bp, Rattus norvegicus
taaatgctatgactttaagggtctt

SEQ ID NO: 538987 - DNA, 25 bp, Rattus norvegicus
taaatgctatgagtttaagggtctt

SEQ ID NO: 538988 - DNA, 25 bp, Rattus norvegicus
taaatgctccttccttcaggcgaac

SEQ ID NO: 538989 - DNA, 25 bp, Rattus norvegicus
taaatgctccttgcttcaggcgaac

SEQ ID NO: 538990 - DNA, 25 bp, Rattus norvegicus
taaatgctcgccatacttggtaaga

SEQ ID NO: 538991 - DNA, 25 bp, Rattus norvegicus
taaatgctcgccttacttggtaaga

SEQ ID NO: 538992 - DNA, 25 bp, Rattus norvegicus
taaatgctcttcatctgccttttac

SEQ ID NO: 538993 - DNA, 25 bp, Rattus norvegicus
taaatgctcttcttctgccttttac

SEQ ID NO: 538994 - DNA, 25 bp, Rattus norvegicus
taaatgctctttcggttgatgccga

SEQ ID NO: 538995 - DNA, 25 bp, Rattus norvegicus
taaatgctctttgggttgatgccga

SEQ ID NO: 538996 - DNA, 25 bp, Rattus norvegicus
taaatgctgcacacactaggaccac

SEQ ID NO: 538997 - DNA, 25 bp, Rattus norvegicus
taaatgctgcactcactaggaccac

SEQ ID NO: 538998 - DNA, 25 bp, Rattus norvegicus
taaatgctgctgctcgatacttaac

SEQ ID NO: 538999 - DNA, 25 bp, Rattus norvegicus
taaatgctgctggtcgatacttaac

SEQ ID NO: 539000 - DNA, 25 bp, Rattus norvegicus
taaatgctgcttcctttgtgctgac

SEQ ID NO: 539001 - DNA, 25 bp, Rattus norvegicus
taaatgctgcttgctttgtgctgac

SEQ ID NO: 539002 - DNA, 25 bp, Rattus norvegicus
taaatgctggctcaagtgcaccggc

SEQ ID NO: 539003 - DNA, 25 bp, Rattus norvegicus
taaatgctggctgaagtgcaccggc

SEQ ID NO: 539004 - DNA, 25 bp, Rattus norvegicus
taaatgctgggtatcttttcctgtt

SEQ ID NO: 539005 - DNA, 25 bp, Rattus norvegicus
taaatgctgggtttcttttcctgtt

SEQ ID NO: 539006 - DNA, 25 bp, Rattus norvegicus
taaatgctgtgccaccatgcttgat

SEQ ID NO: 539007 - DNA, 25 bp, Rattus norvegicus
taaatgctgtgcgaccatgcttgat

SEQ ID NO: 539008 - DNA, 25 bp, Rattus norvegicus
taaatgctgttgactttgcctctga

SEQ ID NO: 539009 - DNA, 25 bp, Rattus norvegicus
taaatgctgttgtctttgcctctga

SEQ ID NO: 539010 - DNA, 25 bp, Rattus norvegicus
taaatgcttcatccggtgggttctt

SEQ ID NO: 539011 - DNA, 25 bp, Rattus norvegicus
taaatgcttcatgcggtgggttctt

SEQ ID NO: 539012 - DNA, 25 bp, Rattus norvegicus
taaatgcttctcagtcgtgttttgt

SEQ ID NO: 539013 - DNA, 25 bp, Rattus norvegicus
taaatgcttctctgtcgtgttttgt

SEQ ID NO: 539014 - DNA, 25 bp, Rattus norvegicus
taaatgcttgcgagtcttactgctc

SEQ ID NO: 539015 - DNA, 25 bp, Rattus norvegicus
taaatgcttgcgtgtcttactgctc

SEQ ID NO: 539016 - DNA, 25 bp, Rattus norvegicus
taaatgcttgctagaaactggacca

SEQ ID NO: 539017 - DNA, 25 bp, Rattus norvegicus
taaatgcttgcttgaaactggacca

SEQ ID NO: 539018 - DNA, 25 bp, Rattus norvegicus
taaatgcttttaatccgggctgctt

SEQ ID NO: 539019 - DNA, 25 bp, Rattus norvegicus
taaatgcttttattccgggctgctt

SEQ ID NO: 539020 - DNA, 25 bp, Rattus norvegicus
taaatggaaagtccagggaactcta

SEQ ID NO: 539021 - DNA, 25 bp, Rattus norvegicus
taaatggaaagtgcagggaactcta

SEQ ID NO: 539022 - DNA, 25 bp, Rattus norvegicus
taaatggaactgacttgactggcaa

SEQ ID NO: 539023 - DNA, 25 bp, Rattus norvegicus
taaatggaactgtcttgactggcaa

SEQ ID NO: 539024 - DNA, 25 bp, Rattus norvegicus
taaatggaatgcagcctttgtcata

SEQ ID NO: 539025 - DNA, 25 bp, Rattus norvegicus
taaatggaatgctgcctttgtcata

SEQ ID NO: 539026 - DNA, 25 bp, Rattus norvegicus
taaatggacccaagagccgaaagtg

SEQ ID NO: 539027 - DNA, 25 bp, Rattus norvegicus
taaatggacccatgagccgaaagtg

SEQ ID NO: 539028 - DNA, 25 bp, Rattus norvegicus
taaatggactccatgcccttggcat

SEQ ID NO: 539029 - DNA, 25 bp, Rattus norvegicus
taaatggactccttgcccttggcat

SEQ ID NO: 539030 - DNA, 25 bp, Rattus norvegicus
taaatggagttgacgcactgcgact

SEQ ID NO: 539031 - DNA, 25 bp, Rattus norvegicus
taaatggagttgtcgcactgcgact

SEQ ID NO: 539032 - DNA, 25 bp, Rattus norvegicus
taaatggatgccactccttgacttg

SEQ ID NO: 539033 - DNA, 25 bp, Rattus norvegicus
taaatggatgcctctccttgacttg

SEQ ID NO: 539034 - DNA, 25 bp, Rattus norvegicus
taaatggattcgcactcagccacag

SEQ ID NO: 539035 - DNA, 25 bp, Rattus norvegicus
taaatggattcggactcagccacag

SEQ ID NO: 539036 - DNA, 25 bp, Rattus norvegicus
taaatggcactgactctttttgaga

SEQ ID NO: 539037 - DNA, 25 bp, Rattus norvegicus
taaatggcactgtctctttttgaga

SEQ ID NO: 539038 - DNA, 25 bp, Rattus norvegicus
taaatggcaggcaccagctgagtgg

SEQ ID NO: 539039 - DNA, 25 bp, Rattus norvegicus
taaatggcaggctccagctgagtgg

SEQ ID NO: 539040 - DNA, 25 bp, Rattus norvegicus
taaatggctggcatcttgtttgcaa

SEQ ID NO: 539041 - DNA, 25 bp, Rattus norvegicus
taaatggctggcttcttgtttgcaa

SEQ ID NO: 539042 - DNA, 25 bp, Rattus norvegicus
taaatggctgtcaggtttgcttgga

SEQ ID NO: 539043 - DNA, 25 bp, Rattus norvegicus
taaatggctgtctggtttgcttgga

SEQ ID NO: 539044 - DNA, 25 bp, Rattus norvegicus
taaatgggacccagtgtgacactcg

SEQ ID NO: 539045 - DNA, 25 bp, Rattus norvegicus
taaatgggaccctgtgtgacactcg

SEQ ID NO: 539046 - DNA, 25 bp, Rattus norvegicus
taaatgggacttaagccaaggcagt

SEQ ID NO: 539047 - DNA, 25 bp, Rattus norvegicus
taaatgggactttagccaaggcagt

SEQ ID NO: 539048 - DNA, 25 bp, Rattus norvegicus
taaatgggagctacctaaccctcgt

SEQ ID NO: 539049 - DNA, 25 bp, Rattus norvegicus
taaatgggagcttcctaaccctcgt

SEQ ID NO: 539050 - DNA, 25 bp, Rattus norvegicus
taaatgggcacgctttctcctatcg

SEQ ID NO: 539051 - DNA, 25 bp, Rattus norvegicus
taaatgggcacggtttctcctatcg

SEQ ID NO: 539052 - DNA, 25 bp, Rattus norvegicus
taaatgggccaaaagcttattttct

SEQ ID NO: 539053 - DNA, 25 bp, Rattus norvegicus
taaatgggccaatagcttattttct

SEQ ID NO: 539054 - DNA, 25 bp, Rattus norvegicus
taaatgggcctcaagtggtacttcc

SEQ ID NO: 539055 - DNA, 25 bp, Rattus norvegicus
taaatgggcctctagtggtacttcc

SEQ ID NO: 539056 - DNA, 25 bp, Rattus norvegicus
taaatgggtagaaccctccttctag

SEQ ID NO: 539057 - DNA, 25 bp, Rattus norvegicus
taaatgggtagatccctccttctag

SEQ ID NO: 539058 - DNA, 25 bp, Rattus norvegicus
taaatgggttggatccgctggccga

SEQ ID NO: 539059 - DNA, 25 bp, Rattus norvegicus
taaatgggttggttccgctggccga

SEQ ID NO: 539060 - DNA, 25 bp, Rattus norvegicus
taaatggtcaggaacagattctcac

SEQ ID NO: 539061 - DNA, 25 bp, Rattus norvegicus
taaatggtcaggtacagattctcac

SEQ ID NO: 539062 - DNA, 25 bp, Rattus norvegicus
taaatggtcataattcactcctccc

SEQ ID NO: 539063 - DNA, 25 bp, Rattus norvegicus
taaatggtcatatttcactcctccc

SEQ ID NO: 539064 - DNA, 25 bp, Rattus norvegicus
taaatggttctcacacctggactaa

SEQ ID NO: 539065 - DNA, 25 bp, Rattus norvegicus
taaatggttctctcacctggactaa

SEQ ID NO: 539066 - DNA, 25 bp, Rattus norvegicus
taaatgtaaggacctccacctgcgg

SEQ ID NO: 539067 - DNA, 25 bp, Rattus norvegicus
taaatgtaaggagctccacctgcgg

SEQ ID NO: 539068 - DNA, 25 bp, Rattus norvegicus
taaatgtagcaactcccagtcccaa

SEQ ID NO: 539069 - DNA, 25 bp, Rattus norvegicus
taaatgtagcaagtcccagtcccaa

SEQ ID NO: 539070 - DNA, 25 bp, Rattus norvegicus
taaatgtagctcagacctctcatgc

SEQ ID NO: 539071 - DNA, 25 bp, Rattus norvegicus
taaatgtagctctgacctctcatgc

SEQ ID NO: 539072 - DNA, 25 bp, Rattus norvegicus
taaatgtagcttaccccttttgctg

SEQ ID NO: 539073 - DNA, 25 bp, Rattus norvegicus
taaatgtagctttccccttttgctg

SEQ ID NO: 539074 - DNA, 25 bp, Rattus norvegicus
taaatgtcaaccctcgtgatcgctg

SEQ ID NO: 539075 - DNA, 25 bp, Rattus norvegicus
taaatgtcaaccgtcgtgatcgctg

SEQ ID NO: 539076 - DNA, 25 bp, Rattus norvegicus
taaatgtcaatcagtgtccccatcg

SEQ ID NO: 539077 - DNA, 25 bp, Rattus norvegicus
taaatgtcaatctgtgtccccatcg

SEQ ID NO: 539078 - DNA, 25 bp, Rattus norvegicus
taaatgtcacctagtatctgcccta

SEQ ID NO: 539079 - DNA, 25 bp, Rattus norvegicus
taaatgtcaccttgtatctgcccta

SEQ ID NO: 539080 - DNA, 25 bp, Rattus norvegicus
taaatgtcagtcacctctgttttct

SEQ ID NO: 539081 - DNA, 25 bp, Rattus norvegicus
taaatgtcagtctcctctgttttct

SEQ ID NO: 539082 - DNA, 25 bp, Rattus norvegicus
taaatgtcatctaccaatgcttaat

SEQ ID NO: 539083 - DNA, 25 bp, Rattus norvegicus
taaatgtcatcttccaatgcttaat

SEQ ID NO: 539084 - DNA, 25 bp, Rattus norvegicus
taaatgtccttaagagagttgcctt

SEQ ID NO: 539085 - DNA, 25 bp, Rattus norvegicus
taaatgtccttatgagagttgcctt

SEQ ID NO: 539086 - DNA, 25 bp, Rattus norvegicus
taaatgtctcagagttggcccaccc

SEQ ID NO: 539087 - DNA, 25 bp, Rattus norvegicus
taaatgtctcagtgttggcccaccc

SEQ ID NO: 539088 - DNA, 25 bp, Rattus norvegicus
taaatgtctgccctatctgcttacg

SEQ ID NO: 539089 - DNA, 25 bp, Rattus norvegicus
taaatgtctgccgtatctgcttacg

SEQ ID NO: 539090 - DNA, 25 bp, Rattus norvegicus
taaatgtctgcgagtttctgtgtac

SEQ ID NO: 539091 - DNA, 25 bp, Rattus norvegicus
taaatgtctgcgtgtttctgtgtac

SEQ ID NO: 539092 - DNA, 25 bp, Rattus norvegicus
taaatgtctgttactctgagagtca

SEQ ID NO: 539093 - DNA, 25 bp, Rattus norvegicus
taaatgtctgtttctctgagagtca

SEQ ID NO: 539094 - DNA, 25 bp, Rattus norvegicus
taaatgtcttccatggtgtcatggg

SEQ ID NO: 539095 - DNA, 25 bp, Rattus norvegicus
taaatgtcttccttggtgtcatggg

SEQ ID NO: 539096 - DNA, 25 bp, Rattus norvegicus
taaatgtgactaccctaggctcagg

SEQ ID NO: 539097 - DNA, 25 bp, Rattus norvegicus
taaatgtgactagcctaggctcagg

SEQ ID NO: 539098 - DNA, 25 bp, Rattus norvegicus
taaatgtggtatactcctttccctt

SEQ ID NO: 539099 - DNA, 25 bp, Rattus norvegicus
taaatgtggtattctcctttccctt

SEQ ID NO: 539100 - DNA, 25 bp, Rattus norvegicus
taaatgtgtcacactggaacctagt

SEQ ID NO: 539101 - DNA, 25 bp, Rattus norvegicus
taaatgtgtcactctggaacctagt

SEQ ID NO: 539102 - DNA, 25 bp, Rattus norvegicus
taaatgtgttatccgtctgcagtct

SEQ ID NO: 539103 - DNA, 25 bp, Rattus norvegicus
taaatgtgttatgcgtctgcagtct

SEQ ID NO: 539104 - DNA, 25 bp, Rattus norvegicus
taaatgtgtttcaataatccctcta

SEQ ID NO: 539105 - DNA, 25 bp, Rattus norvegicus
taaatgtgtttctataatccctcta

SEQ ID NO: 539106 - DNA, 25 bp, Rattus norvegicus
taaatgttcaccctgcagatgagag

SEQ ID NO: 539107 - DNA, 25 bp, Rattus norvegicus
taaatgttcaccgtgcagatgagag

SEQ ID NO: 539108 - DNA, 25 bp, Rattus norvegicus
taaatgttccagattagcgagcagg

SEQ ID NO: 539109 - DNA, 25 bp, Rattus norvegicus
taaatgttccagtttagcgagcagg

SEQ ID NO: 539110 - DNA, 25 bp, Rattus norvegicus
taaatgttctctcttgtgctctgtt

SEQ ID NO: 539111 - DNA, 25 bp, Rattus norvegicus
taaatgttctctgttgtgctctgtt

SEQ ID NO: 539112 - DNA, 25 bp, Rattus norvegicus
taaatgttggagctcgtcagggtct

SEQ ID NO: 539113 - DNA, 25 bp, Rattus norvegicus
taaatgttggaggtcgtcagggtct

SEQ ID NO: 539114 - DNA, 25 bp, Rattus norvegicus
taaatgttgtccaggttcaattgcc

SEQ ID NO: 539115 - DNA, 25 bp, Rattus norvegicus
taaatgttgtcctggttcaattgcc

SEQ ID NO: 539116 - DNA, 25 bp, Rattus norvegicus
taaatgttgtctctccccgattttc

SEQ ID NO: 539117 - DNA, 25 bp, Rattus norvegicus
taaatgttgtctgtccccgattttc

SEQ ID NO: 539118 - DNA, 25 bp, Rattus norvegicus
taaatgtttagcacgactttgtaga

SEQ ID NO: 539119 - DNA, 25 bp, Rattus norvegicus
taaatgtttagctcgactttgtaga

SEQ ID NO: 539120 - DNA, 25 bp, Rattus norvegicus
taaatgtttctaccttctgtgccgg

SEQ ID NO: 539121 - DNA, 25 bp, Rattus norvegicus
taaatgtttctagcttctgtgccgg

SEQ ID NO: 539122 - DNA, 25 bp, Rattus norvegicus
taaatgtttctccaaggtcgcttgt

SEQ ID NO: 539123 - DNA, 25 bp, Rattus norvegicus
taaatgtttctcgaaggtcgcttgt

SEQ ID NO: 539124 - DNA, 25 bp, Rattus norvegicus
taaatgtttgtgcaccctcatggtt

SEQ ID NO: 539125 - DNA, 25 bp, Rattus norvegicus
taaatgtttgtggaccctcatggtt

SEQ ID NO: 539126 - DNA, 25 bp, Rattus norvegicus
taaatgtttgttccctatgttttcc

SEQ ID NO: 539127 - DNA, 25 bp, Rattus norvegicus
taaatgtttgttgcctatgttttcc

SEQ ID NO: 539128 - DNA, 25 bp, Rattus norvegicus
taaattaagttccaccagtgcctcc

SEQ ID NO: 539129 - DNA, 25 bp, Rattus norvegicus
taaattaagttcgaccagtgcctcc

SEQ ID NO: 539130 - DNA, 25 bp, Rattus norvegicus
taaattacacacattctgggctgga

SEQ ID NO: 539131 - DNA, 25 bp, Rattus norvegicus
taaattacacactttctgggctgga

SEQ ID NO: 539132 - DNA, 25 bp, Rattus norvegicus
taaattacagaccagcaaagagcat

SEQ ID NO: 539133 - DNA, 25 bp, Rattus norvegicus
taaattacagacgagcaaagagcat

SEQ ID NO: 539134 - DNA, 25 bp, Rattus norvegicus
taaattacaggccaaggtgaaatct

SEQ ID NO: 539135 - DNA, 25 bp, Rattus norvegicus
taaattacaggcgaaggtgaaatct

SEQ ID NO: 539136 - DNA, 25 bp, Rattus norvegicus
taaattacctcactcctcatggtgc

SEQ ID NO: 539137 - DNA, 25 bp, Rattus norvegicus
taaattacctcagtcctcatggtgc

SEQ ID NO: 539138 - DNA, 25 bp, Rattus norvegicus
taaattacttcaactcgccctttag

SEQ ID NO: 539139 - DNA, 25 bp, Rattus norvegicus
taaattacttcatctcgccctttag

SEQ ID NO: 539140 - DNA, 25 bp, Rattus norvegicus
taaattacttgaatctccccttggc

SEQ ID NO: 539141 - DNA, 25 bp, Rattus norvegicus
taaattacttgattctccccttggc

SEQ ID NO: 539142 - DNA, 25 bp, Rattus norvegicus
taaattagagccaccatttccccta

SEQ ID NO: 539143 - DNA, 25 bp, Rattus norvegicus
taaattagagcctccatttccccta

SEQ ID NO: 539144 - DNA, 25 bp, Rattus norvegicus
taaattagctccatgtactccattc

SEQ ID NO: 539145 - DNA, 25 bp, Rattus norvegicus
taaattagctccttgtactccattc

SEQ ID NO: 539146 - DNA, 25 bp, Rattus norvegicus
taaattagtgccctccaattccatc

SEQ ID NO: 539147 - DNA, 25 bp, Rattus norvegicus
taaattagtgccgtccaattccatc

SEQ ID NO: 539148 - DNA, 25 bp, Rattus norvegicus
taaattataaaacctttggcccagt

SEQ ID NO: 539149 - DNA, 25 bp, Rattus norvegicus
taaattataaaagctttggcccagt

SEQ ID NO: 539150 - DNA, 25 bp, Rattus norvegicus
taaattatcgcccttacacctccat

SEQ ID NO: 539151 - DNA, 25 bp, Rattus norvegicus
taaattatcgccgttacacctccat

SEQ ID NO: 539152 - DNA, 25 bp, Rattus norvegicus
taaattatcttccattccgtcgagc

SEQ ID NO: 539153 - DNA, 25 bp, Rattus norvegicus
taaattatcttcgattccgtcgagc

SEQ ID NO: 539154 - DNA, 25 bp, Rattus norvegicus
taaattattgccacagacttcccct

SEQ ID NO: 539155 - DNA, 25 bp, Rattus norvegicus
taaattattgcctcagacttcccct

SEQ ID NO: 539156 - DNA, 25 bp, Rattus norvegicus
taaattatttgaattcccctaccat

SEQ ID NO: 539157 - DNA, 25 bp, Rattus norvegicus
taaattatttgatttcccctaccat

SEQ ID NO: 539158 - DNA, 25 bp, Rattus norvegicus
taaattattttcacattgccattgg

SEQ ID NO: 539159 - DNA, 25 bp, Rattus norvegicus
taaattattttctcattgccattgg

SEQ ID NO: 539160 - DNA, 25 bp, Rattus norvegicus
taaattcaacccatcatacatccta

SEQ ID NO: 539161 - DNA, 25 bp, Rattus norvegicus
taaattcaacccttcatacatccta

SEQ ID NO: 539162 - DNA, 25 bp, Rattus norvegicus
taaattcaggccagctttttcttcc

SEQ ID NO: 539163 - DNA, 25 bp, Rattus norvegicus
taaattcaggcctgctttttcttcc

SEQ ID NO: 539164 - DNA, 25 bp, Rattus norvegicus
taaattcagtgaagtccctccactt

SEQ ID NO: 539165 - DNA, 25 bp, Rattus norvegicus
taaattcagtgatgtccctccactt

SEQ ID NO: 539166 - DNA, 25 bp, Rattus norvegicus
taaattcataatcttccagcccctg

SEQ ID NO: 539167 - DNA, 25 bp, Rattus norvegicus
taaattcataatgttccagcccctg

SEQ ID NO: 539168 - DNA, 25 bp, Rattus norvegicus
taaattcatggtcatgctcctgccc

SEQ ID NO: 539169 - DNA, 25 bp, Rattus norvegicus
taaattcatggtgatgctcctgccc

SEQ ID NO: 539170 - DNA, 25 bp, Rattus norvegicus
taaattcattttaggctacttcggc

SEQ ID NO: 539171 - DNA, 25 bp, Rattus norvegicus
taaattcatttttggctacttcggc

SEQ ID NO: 539172 - DNA, 25 bp, Rattus norvegicus
taaattccaaagagctttctcctcc

SEQ ID NO: 539173 - DNA, 25 bp, Rattus norvegicus
taaattccaaagtgctttctcctcc

SEQ ID NO: 539174 - DNA, 25 bp, Rattus norvegicus
taaattccaaggcacagccagccag

SEQ ID NO: 539175 - DNA, 25 bp, Rattus norvegicus
taaattccaagggacagccagccag

SEQ ID NO: 539176 - DNA, 25 bp, Rattus norvegicus
taaattcccctacagtccatttgct

SEQ ID NO: 539177 - DNA, 25 bp, Rattus norvegicus
taaattcccctagagtccatttgct

SEQ ID NO: 539178 - DNA, 25 bp, Rattus norvegicus
taaattcccctcatggctggagaaa

SEQ ID NO: 539179 - DNA, 25 bp, Rattus norvegicus
taaattcccctcttggctggagaaa

SEQ ID NO: 539180 - DNA, 25 bp, Rattus norvegicus
taaattccggttcattttacttgat

SEQ ID NO: 539181 - DNA, 25 bp, Rattus norvegicus
taaattccggttgattttacttgat

SEQ ID NO: 539182 - DNA, 25 bp, Rattus norvegicus
taaattcctataccttgtcaccata

SEQ ID NO: 539183 - DNA, 25 bp, Rattus norvegicus
taaattcctatagcttgtcaccata

SEQ ID NO: 539184 - DNA, 25 bp, Rattus norvegicus
taaattcctcaacggactgggcaat

SEQ ID NO: 539185 - DNA, 25 bp, Rattus norvegicus
taaattcctcaagggactgggcaat

SEQ ID NO: 539186 - DNA, 25 bp, Rattus norvegicus
taaattcctctccaagcatcatcat

SEQ ID NO: 539187 - DNA, 25 bp, Rattus norvegicus
taaattcctctcgaagcatcatcat

SEQ ID NO: 539188 - DNA, 25 bp, Rattus norvegicus
taaattcctgaacacgggaggcccg

SEQ ID NO: 539189 - DNA, 25 bp, Rattus norvegicus
taaattcctgaagacgggaggcccg

SEQ ID NO: 539190 - DNA, 25 bp, Rattus norvegicus
taaattcctgtgagtgtatcctatg

SEQ ID NO: 539191 - DNA, 25 bp, Rattus norvegicus
taaattcctgtgtgtgtatcctatg

SEQ ID NO: 539192 - DNA, 25 bp, Rattus norvegicus
taaattccttagatacttcaataaa

SEQ ID NO: 539193 - DNA, 25 bp, Rattus norvegicus
taaattccttagttacttcaataaa

SEQ ID NO: 539194 - DNA, 25 bp, Rattus norvegicus
taaattccttccaggctttgtattc

SEQ ID NO: 539195 - DNA, 25 bp, Rattus norvegicus
taaattccttcctggctttgtattc

SEQ ID NO: 539196 - DNA, 25 bp, Rattus norvegicus
taaattccttctcccacctttatat

SEQ ID NO: 539197 - DNA, 25 bp, Rattus norvegicus
taaattccttctgccacctttatat

SEQ ID NO: 539198 - DNA, 25 bp, Rattus norvegicus
taaattcgagatcgtcagatgggac

SEQ ID NO: 539199 - DNA, 25 bp, Rattus norvegicus
taaattcgagatggtcagatgggac

SEQ ID NO: 539200 - DNA, 25 bp, Rattus norvegicus
taaattctaggcatgggcctcctcc

SEQ ID NO: 539201 - DNA, 25 bp, Rattus norvegicus
taaattctaggcttgggcctcctcc

SEQ ID NO: 539202 - DNA, 25 bp, Rattus norvegicus
taaattctcaatatggctgctgaac

SEQ ID NO: 539203 - DNA, 25 bp, Rattus norvegicus
taaattctcaatttggctgctgaac

SEQ ID NO: 539204 - DNA, 25 bp, Rattus norvegicus
taaattctcaccacaacactactta

SEQ ID NO: 539205 - DNA, 25 bp, Rattus norvegicus
taaattctcacctcaacactactta

SEQ ID NO: 539206 - DNA, 25 bp, Rattus norvegicus
taaattctccaaacagggccatctg

SEQ ID NO: 539207 - DNA, 25 bp, Rattus norvegicus
taaattctccaatcagggccatctg

SEQ ID NO: 539208 - DNA, 25 bp, Rattus norvegicus
taaattctccatcactgctatccaa

SEQ ID NO: 539209 - DNA, 25 bp, Rattus norvegicus
taaattctccatgactgctatccaa

SEQ ID NO: 539210 - DNA, 25 bp, Rattus norvegicus
taaattctccctaatatcctaacaa

SEQ ID NO: 539211 - DNA, 25 bp, Rattus norvegicus
taaattctcccttatatcctaacaa

SEQ ID NO: 539212 - DNA, 25 bp, Rattus norvegicus
taaattctccttaccaccattatgc

SEQ ID NO: 539213 - DNA, 25 bp, Rattus norvegicus
taaattctcctttccaccattatgc

SEQ ID NO: 539214 - DNA, 25 bp, Rattus norvegicus
taaattctctctacaccttgtccat

SEQ ID NO: 539215 - DNA, 25 bp, Rattus norvegicus
taaattctctcttcaccttgtccat

SEQ ID NO: 539216 - DNA, 25 bp, Rattus norvegicus
taaattctggctcgctctttgacag

SEQ ID NO: 539217 - DNA, 25 bp, Rattus norvegicus
taaattctggctggctctttgacag

SEQ ID NO: 539218 - DNA, 25 bp, Rattus norvegicus
taaattctgtatcccaagatctgga

SEQ ID NO: 539219 - DNA, 25 bp, Rattus norvegicus
taaattctgtatcccggaggactaa

SEQ ID NO: 539220 - DNA, 25 bp, Rattus norvegicus
taaattctgtatgccaagatctgga

SEQ ID NO: 539221 - DNA, 25 bp, Rattus norvegicus
taaattctgtatgccggaggactaa

SEQ ID NO: 539222 - DNA, 25 bp, Rattus norvegicus
taaattctgtgtcgcttgacccgga

SEQ ID NO: 539223 - DNA, 25 bp, Rattus norvegicus
taaattctgtgtggcttgacccgga

SEQ ID NO: 539224 - DNA, 25 bp, Rattus norvegicus
taaattcttggtcctggctcagcca

SEQ ID NO: 539225 - DNA, 25 bp, Rattus norvegicus
taaattcttggtgctggctcagcca

SEQ ID NO: 539226 - DNA, 25 bp, Rattus norvegicus
taaattgaagtcacctgccgtcctt

SEQ ID NO: 539227 - DNA, 25 bp, Rattus norvegicus
taaattgaagtctcctgccgtcctt

SEQ ID NO: 539228 - DNA, 25 bp, Rattus norvegicus
taaattgacagtccgtctgggctaa

SEQ ID NO: 539229 - DNA, 25 bp, Rattus norvegicus
taaattgacagtgcgtctgggctaa

SEQ ID NO: 539230 - DNA, 25 bp, Rattus norvegicus
taaattgactcccaacacttgcctt

SEQ ID NO: 539231 - DNA, 25 bp, Rattus norvegicus
taaattgactccgaacacttgcctt

SEQ ID NO: 539232 - DNA, 25 bp, Rattus norvegicus
taaattgagcctatggcctcctgta

SEQ ID NO: 539233 - DNA, 25 bp, Rattus norvegicus
taaattgagcctttggcctcctgta

SEQ ID NO: 539234 - DNA, 25 bp, Rattus norvegicus
taaattgcacatatacccagccttt

SEQ ID NO: 539235 - DNA, 25 bp, Rattus norvegicus
taaattgcacatttacccagccttt

SEQ ID NO: 539236 - DNA, 25 bp, Rattus norvegicus
taaattgcagcaacatcaaccctca

SEQ ID NO: 539237 - DNA, 25 bp, Rattus norvegicus
taaattgcagcatcatcaaccctca

SEQ ID NO: 539238 - DNA, 25 bp, Rattus norvegicus
taaattgccaggatttaacctgaag

SEQ ID NO: 539239 - DNA, 25 bp, Rattus norvegicus
taaattgccaggttttaacctgaag

SEQ ID NO: 539240 - DNA, 25 bp, Rattus norvegicus
taaattgccctgactagccttgagc

SEQ ID NO: 539241 - DNA, 25 bp, Rattus norvegicus
taaattgccctgtctagccttgagc

SEQ ID NO: 539242 - DNA, 25 bp, Rattus norvegicus
taaattgcctcacctgcagcacctt

SEQ ID NO: 539243 - DNA, 25 bp, Rattus norvegicus
taaattgcctcagctgcagcacctt

SEQ ID NO: 539244 - DNA, 25 bp, Rattus norvegicus
taaattgccttcaggacaagcccct

SEQ ID NO: 539245 - DNA, 25 bp, Rattus norvegicus
taaattgccttctggacaagcccct

SEQ ID NO: 539246 - DNA, 25 bp, Rattus norvegicus
taaattgctctcatatgcctcctat

SEQ ID NO: 539247 - DNA, 25 bp, Rattus norvegicus
taaattgctctcttatgcctcctat

SEQ ID NO: 539248 - DNA, 25 bp, Rattus norvegicus
taaattgtacttctctctctgcgtg

SEQ ID NO: 539249 - DNA, 25 bp, Rattus norvegicus
taaattgtacttgtctctctgcgtg

SEQ ID NO: 539250 - DNA, 25 bp, Rattus norvegicus
taaattgttcaaattcattctttct

SEQ ID NO: 539251 - DNA, 25 bp, Rattus norvegicus
taaattgttcaatttcattctttct

SEQ ID NO: 539252 - DNA, 25 bp, Rattus norvegicus
taaatttaacgtcacctcttgggag

SEQ ID NO: 539253 - DNA, 25 bp, Rattus norvegicus
taaatttaacgtgacctcttgggag

SEQ ID NO: 539254 - DNA, 25 bp, Rattus norvegicus
taaatttattttctactgccgcttt

SEQ ID NO: 539255 - DNA, 25 bp, Rattus norvegicus
taaatttattttgtactgccgcttt

SEQ ID NO: 539256 - DNA, 25 bp, Rattus norvegicus
taaatttcaacactctctctccagt

SEQ ID NO: 539257 - DNA, 25 bp, Rattus norvegicus
taaatttcaacagtctctctccagt

SEQ ID NO: 539258 - DNA, 25 bp, Rattus norvegicus
taaatttcaccgcaaaagcctcaaa

SEQ ID NO: 539259 - DNA, 25 bp, Rattus norvegicus
taaatttcaccggaaaagcctcaaa

SEQ ID NO: 539260 - DNA, 25 bp, Rattus norvegicus
taaatttcagacctcgctggttctg

SEQ ID NO: 539261 - DNA, 25 bp, Rattus norvegicus
taaatttcagacgtcgctggttctg

SEQ ID NO: 539262 - DNA, 25 bp, Rattus norvegicus
taaatttccaaacaggtccttcatt

SEQ ID NO: 539263 - DNA, 25 bp, Rattus norvegicus
taaatttccaaagaggtccttcatt

SEQ ID NO: 539264 - DNA, 25 bp, Rattus norvegicus
taaatttccctgcacactggcgagt

SEQ ID NO: 539265 - DNA, 25 bp, Rattus norvegicus
taaatttccctggacactggcgagt

SEQ ID NO: 539266 - DNA, 25 bp, Rattus norvegicus
taaatttccggtaccagcacgttgg

SEQ ID NO: 539267 - DNA, 25 bp, Rattus norvegicus
taaatttccggttccagcacgttgg

SEQ ID NO: 539268 - DNA, 25 bp, Rattus norvegicus
taaatttccttaatcttgctttggt

SEQ ID NO: 539269 - DNA, 25 bp, Rattus norvegicus
taaatttccttattcttgctttggt

SEQ ID NO: 539270 - DNA, 25 bp, Rattus norvegicus
taaatttccttgaatccgagcatgg

SEQ ID NO: 539271 - DNA, 25 bp, Rattus norvegicus
taaatttccttgtatccgagcatgg

SEQ ID NO: 539272 - DNA, 25 bp, Rattus norvegicus
taaatttctgccattaattcttttg

SEQ ID NO: 539273 - DNA, 25 bp, Rattus norvegicus
taaatttctgcctttaattcttttg

SEQ ID NO: 539274 - DNA, 25 bp, Rattus norvegicus
taaatttctgtgctggctccttcat

SEQ ID NO: 539275 - DNA, 25 bp, Rattus norvegicus
taaatttctgtggtggctccttcat

SEQ ID NO: 539276 - DNA, 25 bp, Rattus norvegicus
taaatttgctgtactggtattacca

SEQ ID NO: 539277 - DNA, 25 bp, Rattus norvegicus
taaatttgctgttctggtattacca

SEQ ID NO: 539278 - DNA, 25 bp, Rattus norvegicus
taaatttggtctatcgcctggcttc

SEQ ID NO: 539279 - DNA, 25 bp, Rattus norvegicus
taaatttggtctttcgcctggcttc

SEQ ID NO: 539280 - DNA, 25 bp, Rattus norvegicus
taaatttgtaaacctgccctgaacg

SEQ ID NO: 539281 - DNA, 25 bp, Rattus norvegicus
taaatttgtaaagctgccctgaacg

SEQ ID NO: 539282 - DNA, 25 bp, Rattus norvegicus
taaattttcgtaagctgtcaatgga

SEQ ID NO: 539283 - DNA, 25 bp, Rattus norvegicus
taaattttcgtatgctgtcaatgga

SEQ ID NO: 539284 - DNA, 25 bp, Rattus norvegicus
taaattttctaaaccataccaagtg

SEQ ID NO: 539285 - DNA, 25 bp, Rattus norvegicus
taaattttctaatccataccaagtg

SEQ ID NO: 539286 - DNA, 25 bp, Rattus norvegicus
taaattttgacacctctcactcatc

SEQ ID NO: 539287 - DNA, 25 bp, Rattus norvegicus
taaattttgacagctctcactcatc

SEQ ID NO: 539288 - DNA, 25 bp, Rattus norvegicus
taaattttgactaaggttgtacata

SEQ ID NO: 539289 - DNA, 25 bp, Rattus norvegicus
taaattttgacttaggttgtacata

SEQ ID NO: 539290 - DNA, 25 bp, Rattus norvegicus
taaatttttccaacctcgtctctct

SEQ ID NO: 539291 - DNA, 25 bp, Rattus norvegicus
taaatttttccatcctcgtctctct

SEQ ID NO: 539292 - DNA, 25 bp, Rattus norvegicus
taaatttttctgacacacttgctag

SEQ ID NO: 539293 - DNA, 25 bp, Rattus norvegicus
taaatttttctgtcacacttgctag

SEQ ID NO: 539294 - DNA, 25 bp, Rattus norvegicus
taacaaaactgtctttgcaacgttt

SEQ ID NO: 539295 - DNA, 25 bp, Rattus norvegicus
taacaaaactgtgtttgcaacgttt

SEQ ID NO: 539296 - DNA, 25 bp, Rattus norvegicus
taacaaaagctgctttcccctgttg

SEQ ID NO: 539297 - DNA, 25 bp, Rattus norvegicus
taacaaaagctggtttcccctgttg

SEQ ID NO: 539298 - DNA, 25 bp, Rattus norvegicus
taacaaacccgaccaccaaggagat

SEQ ID NO: 539299 - DNA, 25 bp, Rattus norvegicus
taacaaacccgagcaccaaggagat

SEQ ID NO: 539300 - DNA, 25 bp, Rattus norvegicus
taacaaacgtgccattgctcagctc

SEQ ID NO: 539301 - DNA, 25 bp, Rattus norvegicus
taacaaacgtgcgattgctcagctc

SEQ ID NO: 539302 - DNA, 25 bp, Rattus norvegicus
taacaaagccatctagtcctacgct

SEQ ID NO: 539303 - DNA, 25 bp, Rattus norvegicus
taacaaagccatgtagtcctacgct

SEQ ID NO: 539304 - DNA, 25 bp, Rattus norvegicus
taacaaagcggccatgtgcagcact

SEQ ID NO: 539305 - DNA, 25 bp, Rattus norvegicus
taacaaagcggcgatgtgcagcact

SEQ ID NO: 539306 - DNA, 25 bp, Rattus norvegicus
taacaaagctttaggagatctcagg

SEQ ID NO: 539307 - DNA, 25 bp, Rattus norvegicus
taacaaagcttttggagatctcagg

SEQ ID NO: 539308 - DNA, 25 bp, Rattus norvegicus
taacaaaggagcattctccgcgtct

SEQ ID NO: 539309 - DNA, 25 bp, Rattus norvegicus
taacaaaggagctttctccgcgtct

SEQ ID NO: 539310 - DNA, 25 bp, Rattus norvegicus
taacaaatgtttctacccctacaca

SEQ ID NO: 539311 - DNA, 25 bp, Rattus norvegicus
taacaaatgtttgtacccctacaca

SEQ ID NO: 539312 - DNA, 25 bp, Rattus norvegicus
taacaacacaccatttaccttcatt

SEQ ID NO: 539313 - DNA, 25 bp, Rattus norvegicus
taacaacacaccttttaccttcatt

SEQ ID NO: 539314 - DNA, 25 bp, Rattus norvegicus
taacaacacccaatgtccatgtttc

SEQ ID NO: 539315 - DNA, 25 bp, Rattus norvegicus
taacaacacccattgtccatgtttc

SEQ ID NO: 539316 - DNA, 25 bp, Rattus norvegicus
taacaacagcaactctgcgtcccgg

SEQ ID NO: 539317 - DNA, 25 bp, Rattus norvegicus
taacaacagcaagtctgcgtcccgg

SEQ ID NO: 539318 - DNA, 25 bp, Rattus norvegicus
taacaaccacgcattcaaggaccca

SEQ ID NO: 539319 - DNA, 25 bp, Rattus norvegicus
taacaaccacgctttcaaggaccca

SEQ ID NO: 539320 - DNA, 25 bp, Rattus norvegicus
taacaaccagctctactccgaaatg

SEQ ID NO: 539321 - DNA, 25 bp, Rattus norvegicus
taacaaccagctgtactccgaaatg

SEQ ID NO: 539322 - DNA, 25 bp, Rattus norvegicus
taacaacccggacttatgcgtcctc

SEQ ID NO: 539323 - DNA, 25 bp, Rattus norvegicus
taacaacccggagttatgcgtcctc

SEQ ID NO: 539324 - DNA, 25 bp, Rattus norvegicus
taacaacctccgcaagcgattcgga

SEQ ID NO: 539325 - DNA, 25 bp, Rattus norvegicus
taacaacctccggaagcgattcgga

SEQ ID NO: 539326 - DNA, 25 bp, Rattus norvegicus
taacaacgggttaccaacagccgcg

SEQ ID NO: 539327 - DNA, 25 bp, Rattus norvegicus
taacaacgggtttccaacagccgcg

SEQ ID NO: 539328 - DNA, 25 bp, Rattus norvegicus
taacaacggtcacttttatgtggaa

SEQ ID NO: 539329 - DNA, 25 bp, Rattus norvegicus
taacaacggtcagttttatgtggaa

SEQ ID NO: 539330 - DNA, 25 bp, Rattus norvegicus
taacaacgtgccagtgtggtggagc

SEQ ID NO: 539331 - DNA, 25 bp, Rattus norvegicus
taacaacgtgcctgtgtggtggagc

SEQ ID NO: 539332 - DNA, 25 bp, Rattus norvegicus
taacaactcagcaagcacccaaggg

SEQ ID NO: 539333 - DNA, 25 bp, Rattus norvegicus
taacaactcagctagcacccaaggg

SEQ ID NO: 539334 - DNA, 25 bp, Rattus norvegicus
taacaactccaacaccagggtcctt

SEQ ID NO: 539335 - DNA, 25 bp, Rattus norvegicus
taacaactccaagaccagggtcctt

SEQ ID NO: 539336 - DNA, 25 bp, Rattus norvegicus
taacaactctggaggtccttacata

SEQ ID NO: 539337 - DNA, 25 bp, Rattus norvegicus
taacaactctggtggtccttacata

SEQ ID NO: 539338 - DNA, 25 bp, Rattus norvegicus
taacaagaatatccccagtaccaaa

SEQ ID NO: 539339 - DNA, 25 bp, Rattus norvegicus
taacaagaatatgcccagtaccaaa

SEQ ID NO: 539340 - DNA, 25 bp, Rattus norvegicus
taacaagaatgaagaccctgctgct

SEQ ID NO: 539341 - DNA, 25 bp, Rattus norvegicus
taacaagaatgatgaccctgctgct

SEQ ID NO: 539342 - DNA, 25 bp, Rattus norvegicus
taacaagacacaacaggacacgaat

SEQ ID NO: 539343 - DNA, 25 bp, Rattus norvegicus
taacaagacacatcaggacacgaat

SEQ ID NO: 539344 - DNA, 25 bp, Rattus norvegicus
taacaagactgaagtggccgcacct

SEQ ID NO: 539345 - DNA, 25 bp, Rattus norvegicus
taacaagactgatgtggccgcacct

SEQ ID NO: 539346 - DNA, 25 bp, Rattus norvegicus
taacaagccagaccttgctgcctca

SEQ ID NO: 539347 - DNA, 25 bp, Rattus norvegicus
taacaagccagagcttgctgcctca

SEQ ID NO: 539348 - DNA, 25 bp, Rattus norvegicus
taacaagcctagaccggttacaggt

SEQ ID NO: 539349 - DNA, 25 bp, Rattus norvegicus
taacaagcctagtccggttacaggt

SEQ ID NO: 539350 - DNA, 25 bp, Rattus norvegicus
taacaaggacgcactgagcgcttcc

SEQ ID NO: 539351 - DNA, 25 bp, Rattus norvegicus
taacaaggacgctctgagcgcttcc

SEQ ID NO: 539352 - DNA, 25 bp, Rattus norvegicus
taacaaggccccattgcgactaaag

SEQ ID NO: 539353 - DNA, 25 bp, Rattus norvegicus
taacaaggcccctttgcgactaaag

SEQ ID NO: 539354 - DNA, 25 bp, Rattus norvegicus
taacaaggccgcagtgttacttctc

SEQ ID NO: 539355 - DNA, 25 bp, Rattus norvegicus
taacaaggccgctgtgttacttctc

SEQ ID NO: 539356 - DNA, 25 bp, Rattus norvegicus
taacaagggaggagccttccacagt

SEQ ID NO: 539357 - DNA, 25 bp, Rattus norvegicus
taacaagggaggtgccttccacagt

SEQ ID NO: 539358 - DNA, 25 bp, Rattus norvegicus
taacaaggtcttactctacagccca

SEQ ID NO: 539359 - DNA, 25 bp, Rattus norvegicus
taacaaggtctttctctacagccca

SEQ ID NO: 539360 - DNA, 25 bp, Rattus norvegicus
taacaagtcctgacctgaatcctgt

SEQ ID NO: 539361 - DNA, 25 bp, Rattus norvegicus
taacaagtcctgtcctgaatcctgt

SEQ ID NO: 539362 - DNA, 25 bp, Rattus norvegicus
taacaagtctcaactccgaatcagt

SEQ ID NO: 539363 - DNA, 25 bp, Rattus norvegicus
taacaagtctcatctccgaatcagt

SEQ ID NO: 539364 - DNA, 25 bp, Rattus norvegicus
taacaagtgtctctgtgcctctttt

SEQ ID NO: 539365 - DNA, 25 bp, Rattus norvegicus
taacaagtgtctgtgtgcctctttt

SEQ ID NO: 539366 - DNA, 25 bp, Rattus norvegicus
taacaagtgtgcaatgcccatcttc

SEQ ID NO: 539367 - DNA, 25 bp, Rattus norvegicus
taacaagtgtgctatgcccatcttc

SEQ ID NO: 539368 - DNA, 25 bp, Rattus norvegicus
taacaatctattcacaagcctcctg

SEQ ID NO: 539369 - DNA, 25 bp, Rattus norvegicus
taacaatctattgacaagcctcctg

SEQ ID NO: 539370 - DNA, 25 bp, Rattus norvegicus
taacaatctgacagactcggaggaa

SEQ ID NO: 539371 - DNA, 25 bp, Rattus norvegicus
taacaatctgactgactcggaggaa

SEQ ID NO: 539372 - DNA, 25 bp, Rattus norvegicus
taacaatgaaagcacagtgcagcag

SEQ ID NO: 539373 - DNA, 25 bp, Rattus norvegicus
taacaatgaaaggacagtgcagcag

SEQ ID NO: 539374 - DNA, 25 bp, Rattus norvegicus
taacaatgccagagagcgcttgcgt

SEQ ID NO: 539375 - DNA, 25 bp, Rattus norvegicus
taacaatgccagtgagcgcttgcgt

SEQ ID NO: 539376 - DNA, 25 bp, Rattus norvegicus
taacaatgcctcagtctgcagctgg

SEQ ID NO: 539377 - DNA, 25 bp, Rattus norvegicus
taacaatgcctctgtctgcagctgg

SEQ ID NO: 539378 - DNA, 25 bp, Rattus norvegicus
taacaattagcacggcaccggccgg

SEQ ID NO: 539379 - DNA, 25 bp, Rattus norvegicus
taacaattagcagggcaccggccgg

SEQ ID NO: 539380 - DNA, 25 bp, Rattus norvegicus
taacaatttccacttttccagagaa

SEQ ID NO: 539381 - DNA, 25 bp, Rattus norvegicus
taacaatttccagttttccagagaa

SEQ ID NO: 539382 - DNA, 25 bp, Rattus norvegicus
taacaattttgcatcccctgtatcc

SEQ ID NO: 539383 - DNA, 25 bp, Rattus norvegicus
taacaattttgcttcccctgtatcc

SEQ ID NO: 539384 - DNA, 25 bp, Rattus norvegicus
taacacaaaatactgcatgcattct

SEQ ID NO: 539385 - DNA, 25 bp, Rattus norvegicus
taacacaaaatagtgcatgcattct

SEQ ID NO: 539386 - DNA, 25 bp, Rattus norvegicus
taacacaatgctcacttactgctct

SEQ ID NO: 539387 - DNA, 25 bp, Rattus norvegicus
taacacaatgctgacttactgctct

SEQ ID NO: 539388 - DNA, 25 bp, Rattus norvegicus
taacacacatgcaacgagaaaggga

SEQ ID NO: 539389 - DNA, 25 bp, Rattus norvegicus
taacacacatgctacgagaaaggga

SEQ ID NO: 539390 - DNA, 25 bp, Rattus norvegicus
taacacaccaccatagaacacctgt

SEQ ID NO: 539391 - DNA, 25 bp, Rattus norvegicus
taacacaccaccttagaacacctgt

SEQ ID NO: 539392 - DNA, 25 bp, Rattus norvegicus
taacacacggttctggcaagttctc

SEQ ID NO: 539393 - DNA, 25 bp, Rattus norvegicus
taacacacggttgtggcaagttctc

SEQ ID NO: 539394 - DNA, 25 bp, Rattus norvegicus
taacacactataaacttccaagaag

SEQ ID NO: 539395 - DNA, 25 bp, Rattus norvegicus
taacacactatatacttccaagaag

SEQ ID NO: 539396 - DNA, 25 bp, Rattus norvegicus
taacacacttgtaggtactctgctc

SEQ ID NO: 539397 - DNA, 25 bp, Rattus norvegicus
taacacacttgttggtactctgctc

SEQ ID NO: 539398 - DNA, 25 bp, Rattus norvegicus
taacacagacataacctctctggcc

SEQ ID NO: 539399 - DNA, 25 bp, Rattus norvegicus
taacacagacattacctctctggcc

SEQ ID NO: 539400 - DNA, 25 bp, Rattus norvegicus
taacacagagctaccgtagaccttg

SEQ ID NO: 539401 - DNA, 25 bp, Rattus norvegicus
taacacagagcttccgtagaccttg

SEQ ID NO: 539402 - DNA, 25 bp, Rattus norvegicus
taacacagcaacatttacatcagat

SEQ ID NO: 539403 - DNA, 25 bp, Rattus norvegicus
taacacagcaacttttacatcagat

SEQ ID NO: 539404 - DNA, 25 bp, Rattus norvegicus
taacacagcaagactgggtctcctg

SEQ ID NO: 539405 - DNA, 25 bp, Rattus norvegicus
taacacagcaagtctgggtctcctg

SEQ ID NO: 539406 - DNA, 25 bp, Rattus norvegicus
taacacagctcacaagcctctctaa

SEQ ID NO: 539407 - DNA, 25 bp, Rattus norvegicus
taacacagctcagaagcctctctaa

SEQ ID NO: 539408 - DNA, 25 bp, Rattus norvegicus
taacacagtccacttaattaagagg

SEQ ID NO: 539409 - DNA, 25 bp, Rattus norvegicus
taacacagtccagttaattaagagg

SEQ ID NO: 539410 - DNA, 25 bp, Rattus norvegicus
taacacatcagaaagtcgggccagt

SEQ ID NO: 539411 - DNA, 25 bp, Rattus norvegicus
taacacatcagatagtcgggccagt

SEQ ID NO: 539412 - DNA, 25 bp, Rattus norvegicus
taacacatgtctatctcaacactgc

SEQ ID NO: 539413 - DNA, 25 bp, Rattus norvegicus
taacacatgtctttctcaacactgc

SEQ ID NO: 539414 - DNA, 25 bp, Rattus norvegicus
taacacattgtcagtcagtccacac

SEQ ID NO: 539415 - DNA, 25 bp, Rattus norvegicus
taacacattgtctgtcagtccacac

SEQ ID NO: 539416 - DNA, 25 bp, Rattus norvegicus
taacaccaaccccagttgccgggca

SEQ ID NO: 539417 - DNA, 25 bp, Rattus norvegicus
taacaccaacccgagttgccgggca

SEQ ID NO: 539418 - DNA, 25 bp, Rattus norvegicus
taacaccacgttccattagctaagt

SEQ ID NO: 539419 - DNA, 25 bp, Rattus norvegicus
taacaccacgttgcattagctaagt

SEQ ID NO: 539420 - DNA, 25 bp, Rattus norvegicus
taacaccaggttctagcttttcttg

SEQ ID NO: 539421 - DNA, 25 bp, Rattus norvegicus
taacaccaggttgtagcttttcttg

SEQ ID NO: 539422 - DNA, 25 bp, Rattus norvegicus
taacaccagtggctctagcttctgt

SEQ ID NO: 539423 - DNA, 25 bp, Rattus norvegicus
taacaccagtgggtctagcttctgt

SEQ ID NO: 539424 - DNA, 25 bp, Rattus norvegicus
taacaccatggcatcatcagaggat

SEQ ID NO: 539425 - DNA, 25 bp, Rattus norvegicus
taacaccatggcttcatcagaggat

SEQ ID NO: 539426 - DNA, 25 bp, Rattus norvegicus
taacaccattctcggagcctcatct

SEQ ID NO: 539427 - DNA, 25 bp, Rattus norvegicus
taacaccattctgggagcctcatct

SEQ ID NO: 539428 - DNA, 25 bp, Rattus norvegicus
taacaccattggagggcaaacgttt

SEQ ID NO: 539429 - DNA, 25 bp, Rattus norvegicus
taacaccattggtgggcaaacgttt

SEQ ID NO: 539430 - DNA, 25 bp, Rattus norvegicus
taacacccacggcaatggcttaggg

SEQ ID NO: 539431 - DNA, 25 bp, Rattus norvegicus
taacacccacgggaatggcttaggg

SEQ ID NO: 539432 - DNA, 25 bp, Rattus norvegicus
taacacccaggcaccagcaggatct

SEQ ID NO: 539433 - DNA, 25 bp, Rattus norvegicus
taacacccaggctccagcaggatct

SEQ ID NO: 539434 - DNA, 25 bp, Rattus norvegicus
taacacccaggtctaggagcttagg

SEQ ID NO: 539435 - DNA, 25 bp, Rattus norvegicus
taacacccaggtgtaggagcttagg

SEQ ID NO: 539436 - DNA, 25 bp, Rattus norvegicus
taacacccatggctctatgaacagc

SEQ ID NO: 539437 - DNA, 25 bp, Rattus norvegicus
taacacccatgggtctatgaacagc

SEQ ID NO: 539438 - DNA, 25 bp, Rattus norvegicus
taacacccgagcattctgaagtctt

SEQ ID NO: 539439 - DNA, 25 bp, Rattus norvegicus
taacacccgagctttctgaagtctt

SEQ ID NO: 539440 - DNA, 25 bp, Rattus norvegicus
taacaccgaactacctatgttcctc

SEQ ID NO: 539441 - DNA, 25 bp, Rattus norvegicus
taacaccgaacttcctatgttcctc

SEQ ID NO: 539442 - DNA, 25 bp, Rattus norvegicus
taacaccggccccaagtcgagttag

SEQ ID NO: 539443 - DNA, 25 bp, Rattus norvegicus
taacaccggcccgaagtcgagttag

SEQ ID NO: 539444 - DNA, 25 bp, Rattus norvegicus
taacaccgtcctctgttcagggagt

SEQ ID NO: 539445 - DNA, 25 bp, Rattus norvegicus
taacaccgtcctgtgttcagggagt

SEQ ID NO: 539446 - DNA, 25 bp, Rattus norvegicus
taacaccgtgaccaacctgcatgtg

SEQ ID NO: 539447 - DNA, 25 bp, Rattus norvegicus
taacaccgtgacgaacctgcatgtg

SEQ ID NO: 539448 - DNA, 25 bp, Rattus norvegicus
taacaccgtgttctgtgaggcccag

SEQ ID NO: 539449 - DNA, 25 bp, Rattus norvegicus
taacaccgtgttgtgtgaggcccag

SEQ ID NO: 539450 - DNA, 25 bp, Rattus norvegicus
taacaccgttgaagggatcatccct

SEQ ID NO: 539451 - DNA, 25 bp, Rattus norvegicus
taacaccgttgacggcagacactgc

SEQ ID NO: 539452 - DNA, 25 bp, Rattus norvegicus
taacaccgttgagggcagacactgc

SEQ ID NO: 539453 - DNA, 25 bp, Rattus norvegicus
taacaccgttgatgggatcatccct

SEQ ID NO: 539454 - DNA, 25 bp, Rattus norvegicus
taacacctccaacttgtcctgtgac

SEQ ID NO: 539455 - DNA, 25 bp, Rattus norvegicus
taacacctccaagttgtcctgtgac

SEQ ID NO: 539456 - DNA, 25 bp, Rattus norvegicus
taacacctcctacaggccaaggctt

SEQ ID NO: 539457 - DNA, 25 bp, Rattus norvegicus
taacacctcctagaggccaaggctt

SEQ ID NO: 539458 - DNA, 25 bp, Rattus norvegicus
taacacctcgtgctacttacaatgg

SEQ ID NO: 539459 - DNA, 25 bp, Rattus norvegicus
taacacctcgtggtacttacaatgg

SEQ ID NO: 539460 - DNA, 25 bp, Rattus norvegicus
taacacctcttactgatttacccca

SEQ ID NO: 539461 - DNA, 25 bp, Rattus norvegicus
taacacctcttagtgatttacccca

SEQ ID NO: 539462 - DNA, 25 bp, Rattus norvegicus
taacacctgaaacactcctagtact

SEQ ID NO: 539463 - DNA, 25 bp, Rattus norvegicus
taacacctgaaagactcctagtact

SEQ ID NO: 539464 - DNA, 25 bp, Rattus norvegicus
taacacctgaagaagcccaagacgg

SEQ ID NO: 539465 - DNA, 25 bp, Rattus norvegicus
taacacctgaagtagcccaagacgg

SEQ ID NO: 539466 - DNA, 25 bp, Rattus norvegicus
taacacctgcgaagtacttttctct

SEQ ID NO: 539467 - DNA, 25 bp, Rattus norvegicus
taacacctgcgatgtacttttctct

SEQ ID NO: 539468 - DNA, 25 bp, Rattus norvegicus
taacacctggaaccctagaactgaa

SEQ ID NO: 539469 - DNA, 25 bp, Rattus norvegicus
taacacctggaagcctagaactgaa

SEQ ID NO: 539470 - DNA, 25 bp, Rattus norvegicus
taacacctggcgcacaaagcacctt

SEQ ID NO: 539471 - DNA, 25 bp, Rattus norvegicus
taacacctggcggacaaagcacctt

SEQ ID NO: 539472 - DNA, 25 bp, Rattus norvegicus
taacacctgtgcacagacacgatgc

SEQ ID NO: 539473 - DNA, 25 bp, Rattus norvegicus
taacacctgtgctcagacacgatgc

SEQ ID NO: 539474 - DNA, 25 bp, Rattus norvegicus
taacaccttcggaggaggctctgaa

SEQ ID NO: 539475 - DNA, 25 bp, Rattus norvegicus
taacaccttcggtggaggctctgaa

SEQ ID NO: 539476 - DNA, 25 bp, Rattus norvegicus
taacaccttgccaggaggctggacc

SEQ ID NO: 539477 - DNA, 25 bp, Rattus norvegicus
taacaccttgcctggaggctggacc

SEQ ID NO: 539478 - DNA, 25 bp, Rattus norvegicus
taacacgccttccttagcatggctg

SEQ ID NO: 539479 - DNA, 25 bp, Rattus norvegicus
taacacgccttcgttagcatggctg

SEQ ID NO: 539480 - DNA, 25 bp, Rattus norvegicus
taacacggacttcgtgggtgacgca

SEQ ID NO: 539481 - DNA, 25 bp, Rattus norvegicus
taacacggacttggtgggtgacgca

SEQ ID NO: 539482 - DNA, 25 bp, Rattus norvegicus
taacacggatctcagggagcctccc

SEQ ID NO: 539483 - DNA, 25 bp, Rattus norvegicus
taacacggatctgagggagcctccc

SEQ ID NO: 539484 - DNA, 25 bp, Rattus norvegicus
taacacgtgcgaatggaccggacca

SEQ ID NO: 539485 - DNA, 25 bp, Rattus norvegicus
taacacgtgcgattggaccggacca

SEQ ID NO: 539486 - DNA, 25 bp, Rattus norvegicus
taacacgttccgctttatgcagaga

SEQ ID NO: 539487 - DNA, 25 bp, Rattus norvegicus
taacacgttccggtttatgcagaga

SEQ ID NO: 539488 - DNA, 25 bp, Rattus norvegicus
taacactatgggagaagaccagcct

SEQ ID NO: 539489 - DNA, 25 bp, Rattus norvegicus
taacactatgggtgaagaccagcct

SEQ ID NO: 539490 - DNA, 25 bp, Rattus norvegicus
taacactccctaactgtcctgttta

SEQ ID NO: 539491 - DNA, 25 bp, Rattus norvegicus
taacactccctatctgtcctgttta

SEQ ID NO: 539492 - DNA, 25 bp, Rattus norvegicus
taacactgacccctcttactgatgc

SEQ ID NO: 539493 - DNA, 25 bp, Rattus norvegicus
taacactgacccgtcttactgatgc

SEQ ID NO: 539494 - DNA, 25 bp, Rattus norvegicus
taacactgatctctgtgcgctgggc

SEQ ID NO: 539495 - DNA, 25 bp, Rattus norvegicus
taacactgatctgtgtgcgctgggc

SEQ ID NO: 539496 - DNA, 25 bp, Rattus norvegicus
taacactgccttacagagctcagat

SEQ ID NO: 539497 - DNA, 25 bp, Rattus norvegicus
taacactgcctttcagagctcagat

SEQ ID NO: 539498 - DNA, 25 bp, Rattus norvegicus
taacactggcgtccttgtcatgcga

SEQ ID NO: 539499 - DNA, 25 bp, Rattus norvegicus
taacactggcgtgcttgtcatgcga

SEQ ID NO: 539500 - DNA, 25 bp, Rattus norvegicus
taacactgggccatttctaacattt

SEQ ID NO: 539501 - DNA, 25 bp, Rattus norvegicus
taacactgggccttttctaacattt

SEQ ID NO: 539502 - DNA, 25 bp, Rattus norvegicus
taacactgtatgatcgtcgctgtct

SEQ ID NO: 539503 - DNA, 25 bp, Rattus norvegicus
taacactgtatgttcgtcgctgtct

SEQ ID NO: 539504 - DNA, 25 bp, Rattus norvegicus
taacactgtgatcacctgcgtggtc

SEQ ID NO: 539505 - DNA, 25 bp, Rattus norvegicus
taacactgtgatgacctgcgtggtc

SEQ ID NO: 539506 - DNA, 25 bp, Rattus norvegicus
taacactgtgggaacctaccggagc

SEQ ID NO: 539507 - DNA, 25 bp, Rattus norvegicus
taacactgtgggtacctaccggagc

SEQ ID NO: 539508 - DNA, 25 bp, Rattus norvegicus
taacactgttcccactgatctggat

SEQ ID NO: 539509 - DNA, 25 bp, Rattus norvegicus
taacactgttccgactgatctggat

SEQ ID NO: 539510 - DNA, 25 bp, Rattus norvegicus
taacacttcatcacaggccactgtt

SEQ ID NO: 539511 - DNA, 25 bp, Rattus norvegicus
taacacttcatctcaggccactgtt

SEQ ID NO: 539512 - DNA, 25 bp, Rattus norvegicus
taacacttcgtgaatcgagggcaca

SEQ ID NO: 539513 - DNA, 25 bp, Rattus norvegicus
taacacttcgtgtatcgagggcaca

SEQ ID NO: 539514 - DNA, 25 bp, Rattus norvegicus
taacacttctttccgctgggatgaa

SEQ ID NO: 539515 - DNA, 25 bp, Rattus norvegicus
taacacttctttgcgctgggatgaa

SEQ ID NO: 539516 - DNA, 25 bp, Rattus norvegicus
taacacttgatcacccagatgcagt

SEQ ID NO: 539517 - DNA, 25 bp, Rattus norvegicus
taacacttgatctcccagatgcagt

SEQ ID NO: 539518 - DNA, 25 bp, Rattus norvegicus
taacacttggttccaggtcctgcat

SEQ ID NO: 539519 - DNA, 25 bp, Rattus norvegicus
taacacttggttgcaggtcctgcat

SEQ ID NO: 539520 - DNA, 25 bp, Rattus norvegicus
taacacttgtaactccttctgcact

SEQ ID NO: 539521 - DNA, 25 bp, Rattus norvegicus
taacacttgtaagtccttctgcact

SEQ ID NO: 539522 - DNA, 25 bp, Rattus norvegicus
taacacttgttcacatgcaccgagg

SEQ ID NO: 539523 - DNA, 25 bp, Rattus norvegicus
taacacttgttctcatgcaccgagg

SEQ ID NO: 539524 - DNA, 25 bp, Rattus norvegicus
taacactttattacagccagctgat

SEQ ID NO: 539525 - DNA, 25 bp, Rattus norvegicus
taacactttattatcctgggtgtct

SEQ ID NO: 539526 - DNA, 25 bp, Rattus norvegicus
taacactttatttcagccagctgat

SEQ ID NO: 539527 - DNA, 25 bp, Rattus norvegicus
taacactttattttcctgggtgtct

SEQ ID NO: 539528 - DNA, 25 bp, Rattus norvegicus
taacagaaatcgcacccatatggga

SEQ ID NO: 539529 - DNA, 25 bp, Rattus norvegicus
taacagaaatcggacccatatggga

SEQ ID NO: 539530 - DNA, 25 bp, Rattus norvegicus
taacagaacttaacacagttgtgac

SEQ ID NO: 539531 - DNA, 25 bp, Rattus norvegicus
taacagaacttatcacagttgtgac

SEQ ID NO: 539532 - DNA, 25 bp, Rattus norvegicus
taacagaagcctcacactttccctg

SEQ ID NO: 539533 - DNA, 25 bp, Rattus norvegicus
taacagaagcctgacactttccctg

SEQ ID NO: 539534 - DNA, 25 bp, Rattus norvegicus
taacagacacgtcggaatggcctcc

SEQ ID NO: 539535 - DNA, 25 bp, Rattus norvegicus
taacagacacgtgggaatggcctcc

SEQ ID NO: 539536 - DNA, 25 bp, Rattus norvegicus
taacagacctggatcccggatgttc

SEQ ID NO: 539537 - DNA, 25 bp, Rattus norvegicus
taacagacctggttcccggatgttc

SEQ ID NO: 539538 - DNA, 25 bp, Rattus norvegicus
taacagacctttaacaccgagcacg

SEQ ID NO: 539539 - DNA, 25 bp, Rattus norvegicus
taacagaccttttacaccgagcacg

SEQ ID NO: 539540 - DNA, 25 bp, Rattus norvegicus
taacagactctaacctgatcgtaga

SEQ ID NO: 539541 - DNA, 25 bp, Rattus norvegicus
taacagactctatcctgatcgtaga

SEQ ID NO: 539542 - DNA, 25 bp, Rattus norvegicus
taacagagactaacccatgtgggct

SEQ ID NO: 539543 - DNA, 25 bp, Rattus norvegicus
taacagagactatcccatgtgggct

SEQ ID NO: 539544 - DNA, 25 bp, Rattus norvegicus
taacagagcgcactggagagttgac

SEQ ID NO: 539545 - DNA, 25 bp, Rattus norvegicus
taacagagcgcagtggagagttgac

SEQ ID NO: 539546 - DNA, 25 bp, Rattus norvegicus
taacagagcgtcaccactcagagtc

SEQ ID NO: 539547 - DNA, 25 bp, Rattus norvegicus
taacagagcgtctccactcagagtc

SEQ ID NO: 539548 - DNA, 25 bp, Rattus norvegicus
taacagagctatatatcccgctccc

SEQ ID NO: 539549 - DNA, 25 bp, Rattus norvegicus
taacagagctatttatcccgctccc

SEQ ID NO: 539550 - DNA, 25 bp, Rattus norvegicus
taacagaggctaccctgtcctacaa

SEQ ID NO: 539551 - DNA, 25 bp, Rattus norvegicus
taacagaggctagcctgtcctacaa

SEQ ID NO: 539552 - DNA, 25 bp, Rattus norvegicus
taacagagtgtacctccattctcag

SEQ ID NO: 539553 - DNA, 25 bp, Rattus norvegicus
taacagagtgtagctccattctcag

SEQ ID NO: 539554 - DNA, 25 bp, Rattus norvegicus
taacagatcataaaaacacttcgta

SEQ ID NO: 539555 - DNA, 25 bp, Rattus norvegicus
taacagatcatataaacacttcgta

SEQ ID NO: 539556 - DNA, 25 bp, Rattus norvegicus
taacagatttcacccacccagagag

SEQ ID NO: 539557 - DNA, 25 bp, Rattus norvegicus
taacagatttcagccacccagagag

SEQ ID NO: 539558 - DNA, 25 bp, Rattus norvegicus
taacagatttgccagctacctaaag

SEQ ID NO: 539559 - DNA, 25 bp, Rattus norvegicus
taacagatttgcgagctacctaaag

SEQ ID NO: 539560 - DNA, 25 bp, Rattus norvegicus
taacagattttcaggacttcaaggg

SEQ ID NO: 539561 - DNA, 25 bp, Rattus norvegicus
taacagattttctggacttcaaggg

SEQ ID NO: 539562 - DNA, 25 bp, Rattus norvegicus
taacagcaattgaactgggcagaat

SEQ ID NO: 539563 - DNA, 25 bp, Rattus norvegicus
taacagcaattgtactgggcagaat

SEQ ID NO: 539564 - DNA, 25 bp, Rattus norvegicus
taacagcacagaagctctctacctt

SEQ ID NO: 539565 - DNA, 25 bp, Rattus norvegicus
taacagcacagactccagcagcagc

SEQ ID NO: 539566 - DNA, 25 bp, Rattus norvegicus
taacagcacagagtccagcagcagc

SEQ ID NO: 539567 - DNA, 25 bp, Rattus norvegicus
taacagcacagatgctctctacctt

SEQ ID NO: 539568 - DNA, 25 bp, Rattus norvegicus
taacagcaccacactcgaaatgaat

SEQ ID NO: 539569 - DNA, 25 bp, Rattus norvegicus
taacagcaccactctcgaaatgaat

SEQ ID NO: 539570 - DNA, 25 bp, Rattus norvegicus
taacagcacgatcagcagccttact

SEQ ID NO: 539571 - DNA, 25 bp, Rattus norvegicus
taacagcacgatgagcagccttact

SEQ ID NO: 539572 - DNA, 25 bp, Rattus norvegicus
taacagcagcgtatgtacctcttcc

SEQ ID NO: 539573 - DNA, 25 bp, Rattus norvegicus
taacagcagcgtttgtacctcttcc

SEQ ID NO: 539574 - DNA, 25 bp, Rattus norvegicus
taacagcatactataaccctagcac

SEQ ID NO: 539575 - DNA, 25 bp, Rattus norvegicus
taacagcatactttaaccctagcac

SEQ ID NO: 539576 - DNA, 25 bp, Rattus norvegicus
taacagcatcggcatttctcgggat

SEQ ID NO: 539577 - DNA, 25 bp, Rattus norvegicus
taacagcatcgggatttctcgggat

SEQ ID NO: 539578 - DNA, 25 bp, Rattus norvegicus
taacagcatgcacgtgggatcacaa

SEQ ID NO: 539579 - DNA, 25 bp, Rattus norvegicus
taacagcatgcaggtgggatcacaa

SEQ ID NO: 539580 - DNA, 25 bp, Rattus norvegicus
taacagcatggtcggcaaattcaaa

SEQ ID NO: 539581 - DNA, 25 bp, Rattus norvegicus
taacagcatggtgggcaaattcaaa

SEQ ID NO: 539582 - DNA, 25 bp, Rattus norvegicus
taacagcattgactccttggtggca

SEQ ID NO: 539583 - DNA, 25 bp, Rattus norvegicus
taacagcattgagtccttggtggca

SEQ ID NO: 539584 - DNA, 25 bp, Rattus norvegicus
taacagcattggctgctccttcagg

SEQ ID NO: 539585 - DNA, 25 bp, Rattus norvegicus
taacagcattgggtgctccttcagg

SEQ ID NO: 539586 - DNA, 25 bp, Rattus norvegicus
taacagccaaggaatttgagacaga

SEQ ID NO: 539587 - DNA, 25 bp, Rattus norvegicus
taacagccaaggtatttgagacaga

SEQ ID NO: 539588 - DNA, 25 bp, Rattus norvegicus
taacagccacttagtaactctgctc

SEQ ID NO: 539589 - DNA, 25 bp, Rattus norvegicus
taacagccactttgtaactctgctc

SEQ ID NO: 539590 - DNA, 25 bp, Rattus norvegicus
taacagcccagcacccaggaagagt

SEQ ID NO: 539591 - DNA, 25 bp, Rattus norvegicus
taacagcccagctcccaggaagagt

SEQ ID NO: 539592 - DNA, 25 bp, Rattus norvegicus
taacagcccctgatggcgtgggtga

SEQ ID NO: 539593 - DNA, 25 bp, Rattus norvegicus
taacagcccctgttggcgtgggtga

SEQ ID NO: 539594 - DNA, 25 bp, Rattus norvegicus
taacagccctatctctcctggaatt

SEQ ID NO: 539595 - DNA, 25 bp, Rattus norvegicus
taacagccctatgtctcctggaatt

SEQ ID NO: 539596 - DNA, 25 bp, Rattus norvegicus
taacagccctcgatttgccaagttg

SEQ ID NO: 539597 - DNA, 25 bp, Rattus norvegicus
taacagccctcgttttgccaagttg

SEQ ID NO: 539598 - DNA, 25 bp, Rattus norvegicus
taacagcccttgagtcagtaatact

SEQ ID NO: 539599 - DNA, 25 bp, Rattus norvegicus
taacagcccttgtgtcagtaatact

SEQ ID NO: 539600 - DNA, 25 bp, Rattus norvegicus
taacagccggcacacctgagacgga

SEQ ID NO: 539601 - DNA, 25 bp, Rattus norvegicus
taacagccggcagacctgagacgga

SEQ ID NO: 539602 - DNA, 25 bp, Rattus norvegicus
taacagcctctgagagtatgctcat

SEQ ID NO: 539603 - DNA, 25 bp, Rattus norvegicus
taacagcctctgtgagtatgctcat

SEQ ID NO: 539604 - DNA, 25 bp, Rattus norvegicus
taacagcctgtgctcagcttgtcga

SEQ ID NO: 539605 - DNA, 25 bp, Rattus norvegicus
taacagcctgtggtcagcttgtcga

SEQ ID NO: 539606 - DNA, 25 bp, Rattus norvegicus
taacagccttgacagccttggcacg

SEQ ID NO: 539607 - DNA, 25 bp, Rattus norvegicus
taacagccttgagagccttggcacg

SEQ ID NO: 539608 - DNA, 25 bp, Rattus norvegicus
taacagcgcggactccagcagcggc

SEQ ID NO: 539609 - DNA, 25 bp, Rattus norvegicus
taacagcgcggagtccagcagcggc

SEQ ID NO: 539610 - DNA, 25 bp, Rattus norvegicus
taacagcggcagcaagggcgcctca

SEQ ID NO: 539611 - DNA, 25 bp, Rattus norvegicus
taacagcggcaggaagggcgcctca

SEQ ID NO: 539612 - DNA, 25 bp, Rattus norvegicus
taacagcgggcacatcgcttgctca

SEQ ID NO: 539613 - DNA, 25 bp, Rattus norvegicus
taacagcgggcagatcgcttgctca

SEQ ID NO: 539614 - DNA, 25 bp, Rattus norvegicus
taacagcgtcacagcctggcgttgg

SEQ ID NO: 539615 - DNA, 25 bp, Rattus norvegicus
taacagcgtcactgcctggcgttgg

SEQ ID NO: 539616 - DNA, 25 bp, Rattus norvegicus
taacagcgtggaaagacggctccgt

SEQ ID NO: 539617 - DNA, 25 bp, Rattus norvegicus
taacagcgtggatagacggctccgt

SEQ ID NO: 539618 - DNA, 25 bp, Rattus norvegicus
taacagcgtgtaatgtgtctccctt

SEQ ID NO: 539619 - DNA, 25 bp, Rattus norvegicus
taacagcgtgtattgtgtctccctt

SEQ ID NO: 539620 - DNA, 25 bp, Rattus norvegicus
taacagctaccgcatgttctctcat

SEQ ID NO: 539621 - DNA, 25 bp, Rattus norvegicus
taacagctaccggatgttctctcat

SEQ ID NO: 539622 - DNA, 25 bp, Rattus norvegicus
taacagctagtgcaaagcttctgat

SEQ ID NO: 539623 - DNA, 25 bp, Rattus norvegicus
taacagctagtggaaagcttctgat

SEQ ID NO: 539624 - DNA, 25 bp, Rattus norvegicus
taacagctcacaactgttgctcctg

SEQ ID NO: 539625 - DNA, 25 bp, Rattus norvegicus
taacagctcacatctgttgctcctg

SEQ ID NO: 539626 - DNA, 25 bp, Rattus norvegicus
taacagctcccacttgctttttgca

SEQ ID NO: 539627 - DNA, 25 bp, Rattus norvegicus
taacagctcccagttgctttttgca

SEQ ID NO: 539628 - DNA, 25 bp, Rattus norvegicus
taacagctgtaaccctcacactcaa

SEQ ID NO: 539629 - DNA, 25 bp, Rattus norvegicus
taacagctgtaagcctcacactcaa

SEQ ID NO: 539630 - DNA, 25 bp, Rattus norvegicus
taacagctgtctctgctaaggtcag

SEQ ID NO: 539631 - DNA, 25 bp, Rattus norvegicus
taacagctgtctgtgctaaggtcag

SEQ ID NO: 539632 - DNA, 25 bp, Rattus norvegicus
taacagcttgaaccatgactctcca

SEQ ID NO: 539633 - DNA, 25 bp, Rattus norvegicus
taacagcttgaagcatgactctcca

SEQ ID NO: 539634 - DNA, 25 bp, Rattus norvegicus
taacagctttgccttcatctcatag

SEQ ID NO: 539635 - DNA, 25 bp, Rattus norvegicus
taacagctttgcgttcatctcatag

SEQ ID NO: 539636 - DNA, 25 bp, Rattus norvegicus
taacaggacactaagcttggatcag

SEQ ID NO: 539637 - DNA, 25 bp, Rattus norvegicus
taacaggacacttagcttggatcag

SEQ ID NO: 539638 - DNA, 25 bp, Rattus norvegicus
taacaggacccgcaggatccaactt

SEQ ID NO: 539639 - DNA, 25 bp, Rattus norvegicus
taacaggacccggaggatccaactt

SEQ ID NO: 539640 - DNA, 25 bp, Rattus norvegicus
taacaggagtgcagccttagcgacc

SEQ ID NO: 539641 - DNA, 25 bp, Rattus norvegicus
taacaggagtgctgccttagcgacc

SEQ ID NO: 539642 - DNA, 25 bp, Rattus norvegicus
taacaggatctcaccaaactctatc

SEQ ID NO: 539643 - DNA, 25 bp, Rattus norvegicus
taacaggatctctccaaactctatc

SEQ ID NO: 539644 - DNA, 25 bp, Rattus norvegicus
taacaggatgaactggccacaagga

SEQ ID NO: 539645 - DNA, 25 bp, Rattus norvegicus
taacaggatgaagtggccacaagga

SEQ ID NO: 539646 - DNA, 25 bp, Rattus norvegicus
taacaggatttgctctcttagaatg

SEQ ID NO: 539647 - DNA, 25 bp, Rattus norvegicus
taacaggatttggtctcttagaatg

SEQ ID NO: 539648 - DNA, 25 bp, Rattus norvegicus
taacaggcacatcggaactttccaa

SEQ ID NO: 539649 - DNA, 25 bp, Rattus norvegicus
taacaggcacatgggaactttccaa

SEQ ID NO: 539650 - DNA, 25 bp, Rattus norvegicus
taacaggccatgatcagtgtggtat

SEQ ID NO: 539651 - DNA, 25 bp, Rattus norvegicus
taacaggccatgttcagtgtggtat

SEQ ID NO: 539652 - DNA, 25 bp, Rattus norvegicus
taacaggccctcagttattccggaa

SEQ ID NO: 539653 - DNA, 25 bp, Rattus norvegicus
taacaggccctctgttattccggaa

SEQ ID NO: 539654 - DNA, 25 bp, Rattus norvegicus
taacaggcctatcgaaaccctcaga

SEQ ID NO: 539655 - DNA, 25 bp, Rattus norvegicus
taacaggcctatggaaaccctcaga

SEQ ID NO: 539656 - DNA, 25 bp, Rattus norvegicus
taacaggctgccactgtgtgccagc

SEQ ID NO: 539657 - DNA, 25 bp, Rattus norvegicus
taacaggctgcctctgtgtgccagc

SEQ ID NO: 539658 - DNA, 25 bp, Rattus norvegicus
taacagggcccaagactgctgacgt

SEQ ID NO: 539659 - DNA, 25 bp, Rattus norvegicus
taacagggcccatgactgctgacgt

SEQ ID NO: 539660 - DNA, 25 bp, Rattus norvegicus
taacagggctttccagactggtcca

SEQ ID NO: 539661 - DNA, 25 bp, Rattus norvegicus
taacagggctttgcagactggtcca

SEQ ID NO: 539662 - DNA, 25 bp, Rattus norvegicus
taacagggtctcaagtgctgtgaaa

SEQ ID NO: 539663 - DNA, 25 bp, Rattus norvegicus
taacagggtctctagtgctgtgaaa

SEQ ID NO: 539664 - DNA, 25 bp, Rattus norvegicus
taacagggtgcacgcgacagtcatc

SEQ ID NO: 539665 - DNA, 25 bp, Rattus norvegicus
taacagggtgcaggcgacagtcatc

SEQ ID NO: 539666 - DNA, 25 bp, Rattus norvegicus
taacaggtacggaagagcacccctc

SEQ ID NO: 539667 - DNA, 25 bp, Rattus norvegicus
taacaggtacggtagagcacccctc

SEQ ID NO: 539668 - DNA, 25 bp, Rattus norvegicus
taacaggtactgacattccctcgga

SEQ ID NO: 539669 - DNA, 25 bp, Rattus norvegicus
taacaggtactgtcattccctcgga

SEQ ID NO: 539670 - DNA, 25 bp, Rattus norvegicus
taacaggtctcacgctttatttgct

SEQ ID NO: 539671 - DNA, 25 bp, Rattus norvegicus
taacaggtctcaggctttatttgct

SEQ ID NO: 539672 - DNA, 25 bp, Rattus norvegicus
taacaggtctctcgaccccaaaaca

SEQ ID NO: 539673 - DNA, 25 bp, Rattus norvegicus
taacaggtctctggaccccaaaaca

SEQ ID NO: 539674 - DNA, 25 bp, Rattus norvegicus
taacaggtctgcatcagctgacaag

SEQ ID NO: 539675 - DNA, 25 bp, Rattus norvegicus
taacaggtctgcttcagctgacaag

SEQ ID NO: 539676 - DNA, 25 bp, Rattus norvegicus
taacaggtgctcaggaaccaagtaa

SEQ ID NO: 539677 - DNA, 25 bp, Rattus norvegicus
taacaggtgctctggaaccaagtaa

SEQ ID NO: 539678 - DNA, 25 bp, Rattus norvegicus
taacaggttttcatagccagtctag

SEQ ID NO: 539679 - DNA, 25 bp, Rattus norvegicus
taacaggttttcttagccagtctag

SEQ ID NO: 539680 - DNA, 25 bp, Rattus norvegicus
taacagtactgtagtctctcttgac

SEQ ID NO: 539681 - DNA, 25 bp, Rattus norvegicus
taacagtactgttgtctctcttgac

SEQ ID NO: 539682 - DNA, 25 bp, Rattus norvegicus
taacagtagctgacctgttctgggc

SEQ ID NO: 539683 - DNA, 25 bp, Rattus norvegicus
taacagtagctgtcctgttctgggc

SEQ ID NO: 539684 - DNA, 25 bp, Rattus norvegicus
taacagtcaagaagccatgaggcga

SEQ ID NO: 539685 - DNA, 25 bp, Rattus norvegicus
taacagtcaagatgccatgaggcga

SEQ ID NO: 539686 - DNA, 25 bp, Rattus norvegicus
taacagtcaattccctgcctggctt

SEQ ID NO: 539687 - DNA, 25 bp, Rattus norvegicus
taacagtcaattgcctgcctggctt

SEQ ID NO: 539688 - DNA, 25 bp, Rattus norvegicus
taacagtcattgatccgcaaggccc

SEQ ID NO: 539689 - DNA, 25 bp, Rattus norvegicus
taacagtcattgttccgcaaggccc

SEQ ID NO: 539690 - DNA, 25 bp, Rattus norvegicus
taacagtcctcaagtacagacgcct

SEQ ID NO: 539691 - DNA, 25 bp, Rattus norvegicus
taacagtcctcatgtacagacgcct

SEQ ID NO: 539692 - DNA, 25 bp, Rattus norvegicus
taacagtctttgaaatctcctctcc

SEQ ID NO: 539693 - DNA, 25 bp, Rattus norvegicus
taacagtctttgtaatctcctctcc

SEQ ID NO: 539694 - DNA, 25 bp, Rattus norvegicus
taacagtgatgtaccctttgtcccc

SEQ ID NO: 539695 - DNA, 25 bp, Rattus norvegicus
taacagtgatgttccctttgtcccc

SEQ ID NO: 539696 - DNA, 25 bp, Rattus norvegicus
taacagtgccttcctgtttcccatc

SEQ ID NO: 539697 - DNA, 25 bp, Rattus norvegicus
taacagtgccttgctgtttcccatc

SEQ ID NO: 539698 - DNA, 25 bp, Rattus norvegicus
taacagtgcgttaaagtggcgatgg

SEQ ID NO: 539699 - DNA, 25 bp, Rattus norvegicus
taacagtgcgtttaagtggcgatgg

SEQ ID NO: 539700 - DNA, 25 bp, Rattus norvegicus
taacagtgctgccatccgtgcgatt

SEQ ID NO: 539701 - DNA, 25 bp, Rattus norvegicus
taacagtgctgcgatccgtgcgatt

SEQ ID NO: 539702 - DNA, 25 bp, Rattus norvegicus
taacagtggcaaagtaagttggaaa

SEQ ID NO: 539703 - DNA, 25 bp, Rattus norvegicus
taacagtggcaatgtaagttggaaa

SEQ ID NO: 539704 - DNA, 25 bp, Rattus norvegicus
taacagtggccccattccttgaatt

SEQ ID NO: 539705 - DNA, 25 bp, Rattus norvegicus
taacagtggcccgattccttgaatt

SEQ ID NO: 539706 - DNA, 25 bp, Rattus norvegicus
taacagttatcaagacaccccatgc

SEQ ID NO: 539707 - DNA, 25 bp, Rattus norvegicus
taacagttatcatgacaccccatgc

SEQ ID NO: 539708 - DNA, 25 bp, Rattus norvegicus
taacagttgccacctgcctcgtgtc

SEQ ID NO: 539709 - DNA, 25 bp, Rattus norvegicus
taacagttgccagctgcctcgtgtc

SEQ ID NO: 539710 - DNA, 25 bp, Rattus norvegicus
taacagttgtcaacctcattcagtg

SEQ ID NO: 539711 - DNA, 25 bp, Rattus norvegicus
taacagttgtcatcctcattcagtg

SEQ ID NO: 539712 - DNA, 25 bp, Rattus norvegicus
taacagtttcacatagaaccaatat

SEQ ID NO: 539713 - DNA, 25 bp, Rattus norvegicus
taacagtttcacttagaaccaatat

SEQ ID NO: 539714 - DNA, 25 bp, Rattus norvegicus
taacagtttcctccagtagtgcggg

SEQ ID NO: 539715 - DNA, 25 bp, Rattus norvegicus
taacagtttcctcctgcggttgaca

SEQ ID NO: 539716 - DNA, 25 bp, Rattus norvegicus
taacagtttcctgcagtagtgcggg

SEQ ID NO: 539717 - DNA, 25 bp, Rattus norvegicus
taacagtttcctgctgcggttgaca

SEQ ID NO: 539718 - DNA, 25 bp, Rattus norvegicus
taacagtttgttagctacagcgatg

SEQ ID NO: 539719 - DNA, 25 bp, Rattus norvegicus
taacagtttgtttgctacagcgatg

SEQ ID NO: 539720 - DNA, 25 bp, Rattus norvegicus
taacataacagcataaccacttttt

SEQ ID NO: 539721 - DNA, 25 bp, Rattus norvegicus
taacataacagcttaaccacttttt

SEQ ID NO: 539722 - DNA, 25 bp, Rattus norvegicus
taacatacctacctacctcttttat

SEQ ID NO: 539723 - DNA, 25 bp, Rattus norvegicus
taacatacctacgtacctcttttat

SEQ ID NO: 539724 - DNA, 25 bp, Rattus norvegicus
taacataccttcctgtggaccaaaa

SEQ ID NO: 539725 - DNA, 25 bp, Rattus norvegicus
taacataccttcgtgtggaccaaaa

SEQ ID NO: 539726 - DNA, 25 bp, Rattus norvegicus
taacataccttgcagtagcaataaa

SEQ ID NO: 539727 - DNA, 25 bp, Rattus norvegicus
taacataccttggagtagcaataaa

SEQ ID NO: 539728 - DNA, 25 bp, Rattus norvegicus
taacatacttctatagtcaccactt

SEQ ID NO: 539729 - DNA, 25 bp, Rattus norvegicus
taacatacttctttagtcaccactt

SEQ ID NO: 539730 - DNA, 25 bp, Rattus norvegicus
taacatagtcctctgacgcccaaat

SEQ ID NO: 539731 - DNA, 25 bp, Rattus norvegicus
taacatagtcctgtgacgcccaaat

SEQ ID NO: 539732 - DNA, 25 bp, Rattus norvegicus
taacatagtgtgaaggcctgcggcc

SEQ ID NO: 539733 - DNA, 25 bp, Rattus norvegicus
taacatagtgtgtaggcctgcggcc

SEQ ID NO: 539734 - DNA, 25 bp, Rattus norvegicus
taacatatcgggatttctttatagt

SEQ ID NO: 539735 - DNA, 25 bp, Rattus norvegicus
taacatatcgggttttctttatagt

SEQ ID NO: 539736 - DNA, 25 bp, Rattus norvegicus
taacatatgctgctatcctttcaag

SEQ ID NO: 539737 - DNA, 25 bp, Rattus norvegicus
taacatatgctggtatcctttcaag

SEQ ID NO: 539738 - DNA, 25 bp, Rattus norvegicus
taacatcaacatccttgtggcagat

SEQ ID NO: 539739 - DNA, 25 bp, Rattus norvegicus
taacatcaacatgcttgtggcagat

SEQ ID NO: 539740 - DNA, 25 bp, Rattus norvegicus
taacatcaactcatatttggcattt

SEQ ID NO: 539741 - DNA, 25 bp, Rattus norvegicus
taacatcaactcttatttggcattt

SEQ ID NO: 539742 - DNA, 25 bp, Rattus norvegicus
taacatcagagtattcgttaaactt

SEQ ID NO: 539743 - DNA, 25 bp, Rattus norvegicus
taacatcagagttttcgttaaactt

SEQ ID NO: 539744 - DNA, 25 bp, Rattus norvegicus
taacatcagctgagtggcctgtgtg

SEQ ID NO: 539745 - DNA, 25 bp, Rattus norvegicus
taacatcagctgtgtggcctgtgtg

SEQ ID NO: 539746 - DNA, 25 bp, Rattus norvegicus
taacatcagttcactgttcattctg

SEQ ID NO: 539747 - DNA, 25 bp, Rattus norvegicus
taacatcagttctctgttcattctg

SEQ ID NO: 539748 - DNA, 25 bp, Rattus norvegicus
taacatcatccaattcggtgctctc

SEQ ID NO: 539749 - DNA, 25 bp, Rattus norvegicus
taacatcatccatttcggtgctctc

SEQ ID NO: 539750 - DNA, 25 bp, Rattus norvegicus
taacatcatgccaacaaaggagaat

SEQ ID NO: 539751 - DNA, 25 bp, Rattus norvegicus
taacatcatgcctacaaaggagaat

SEQ ID NO: 539752 - DNA, 25 bp, Rattus norvegicus
taacatcatttcacagcatctgggt

SEQ ID NO: 539753 - DNA, 25 bp, Rattus norvegicus
taacatcatttctcagcatctgggt

SEQ ID NO: 539754 - DNA, 25 bp, Rattus norvegicus
taacatcccaataaagtcctcttcc

SEQ ID NO: 539755 - DNA, 25 bp, Rattus norvegicus
taacatcccaattaagtcctcttcc

SEQ ID NO: 539756 - DNA, 25 bp, Rattus norvegicus
taacatcccattcttctctatatca

SEQ ID NO: 539757 - DNA, 25 bp, Rattus norvegicus
taacatcccattgttctctatatca

SEQ ID NO: 539758 - DNA, 25 bp, Rattus norvegicus
taacatccgagacctggtgggccac

SEQ ID NO: 539759 - DNA, 25 bp, Rattus norvegicus
taacatccgagagctggtgggccac

SEQ ID NO: 539760 - DNA, 25 bp, Rattus norvegicus
taacatcctaggactgaagcgctaa

SEQ ID NO: 539761 - DNA, 25 bp, Rattus norvegicus
taacatcctaggtctgaagcgctaa

SEQ ID NO: 539762 - DNA, 25 bp, Rattus norvegicus
taacatcctgttaactgcaagtggc

SEQ ID NO: 539763 - DNA, 25 bp, Rattus norvegicus
taacatcctgtttactgcaagtggc

SEQ ID NO: 539764 - DNA, 25 bp, Rattus norvegicus
taacatccttaaaatccttctgccc

SEQ ID NO: 539765 - DNA, 25 bp, Rattus norvegicus
taacatccttaatatccttctgccc

SEQ ID NO: 539766 - DNA, 25 bp, Rattus norvegicus
taacatcctttaattggccaccaaa

SEQ ID NO: 539767 - DNA, 25 bp, Rattus norvegicus
taacatcctttatttggccaccaaa

SEQ ID NO: 539768 - DNA, 25 bp, Rattus norvegicus
taacatcgccaccaaaagctgcttt

SEQ ID NO: 539769 - DNA, 25 bp, Rattus norvegicus
taacatcgccacgaaaagctgcttt

SEQ ID NO: 539770 - DNA, 25 bp, Rattus norvegicus
taacatcggtttacacattcccttg

SEQ ID NO: 539771 - DNA, 25 bp, Rattus norvegicus
taacatcggttttcacattcccttg

SEQ ID NO: 539772 - DNA, 25 bp, Rattus norvegicus
taacatctcaatccagtcgctagca

SEQ ID NO: 539773 - DNA, 25 bp, Rattus norvegicus
taacatctcaatgcagtcgctagca

SEQ ID NO: 539774 - DNA, 25 bp, Rattus norvegicus
taacatctcacgctgagccaatggt

SEQ ID NO: 539775 - DNA, 25 bp, Rattus norvegicus
taacatctcacggtgagccaatggt

SEQ ID NO: 539776 - DNA, 25 bp, Rattus norvegicus
taacatctccaactgtggactatat

SEQ ID NO: 539777 - DNA, 25 bp, Rattus norvegicus
taacatctccaagtgtggactatat

SEQ ID NO: 539778 - DNA, 25 bp, Rattus norvegicus
taacatctcccgcagcaggacttgg

SEQ ID NO: 539779 - DNA, 25 bp, Rattus norvegicus
taacatctcccggagcaggacttgg

SEQ ID NO: 539780 - DNA, 25 bp, Rattus norvegicus
taacatctctgtcgatcctgtgaca

SEQ ID NO: 539781 - DNA, 25 bp, Rattus norvegicus
taacatctctgtggatcctgtgaca

SEQ ID NO: 539782 - DNA, 25 bp, Rattus norvegicus
taacatgacaggcacgaggacccct

SEQ ID NO: 539783 - DNA, 25 bp, Rattus norvegicus
taacatgacagggacgaggacccct

SEQ ID NO: 539784 - DNA, 25 bp, Rattus norvegicus
taacatgcatgaagtcccaatccct

SEQ ID NO: 539785 - DNA, 25 bp, Rattus norvegicus
taacatgcatgatgtcccaatccct

SEQ ID NO: 539786 - DNA, 25 bp, Rattus norvegicus
taacatgcatggctgtcgagatgag

SEQ ID NO: 539787 - DNA, 25 bp, Rattus norvegicus
taacatgcatgggtgtcgagatgag

SEQ ID NO: 539788 - DNA, 25 bp, Rattus norvegicus
taacatgccattctccttcaacaaa

SEQ ID NO: 539789 - DNA, 25 bp, Rattus norvegicus
taacatgccattgtccttcaacaaa

SEQ ID NO: 539790 - DNA, 25 bp, Rattus norvegicus
taacatgcctgccagagacaatcag

SEQ ID NO: 539791 - DNA, 25 bp, Rattus norvegicus
taacatgcctgcgagagacaatcag

SEQ ID NO: 539792 - DNA, 25 bp, Rattus norvegicus
taacatgcgttcatctattctgaaa

SEQ ID NO: 539793 - DNA, 25 bp, Rattus norvegicus
taacatgcgttcttctattctgaaa

SEQ ID NO: 539794 - DNA, 25 bp, Rattus norvegicus
taacatgcttgacacatcctcctca

SEQ ID NO: 539795 - DNA, 25 bp, Rattus norvegicus
taacatgcttgagacatcctcctca

SEQ ID NO: 539796 - DNA, 25 bp, Rattus norvegicus
taacatgctttcagtgctcaggacc

SEQ ID NO: 539797 - DNA, 25 bp, Rattus norvegicus
taacatgctttctgtgctcaggacc

SEQ ID NO: 539798 - DNA, 25 bp, Rattus norvegicus
taacatggaaagaagccggcttact

SEQ ID NO: 539799 - DNA, 25 bp, Rattus norvegicus
taacatggaaagtagccggcttact

SEQ ID NO: 539800 - DNA, 25 bp, Rattus norvegicus
taacatggaggcctgctcagatgct

SEQ ID NO: 539801 - DNA, 25 bp, Rattus norvegicus
taacatggaggcgtgctcagatgct

SEQ ID NO: 539802 - DNA, 25 bp, Rattus norvegicus
taacatggcacacacatggattccg

SEQ ID NO: 539803 - DNA, 25 bp, Rattus norvegicus
taacatggcacagacatggattccg

SEQ ID NO: 539804 - DNA, 25 bp, Rattus norvegicus
taacatggctttcttcctggaacca

SEQ ID NO: 539805 - DNA, 25 bp, Rattus norvegicus
taacatggctttgttcctggaacca

SEQ ID NO: 539806 - DNA, 25 bp, Rattus norvegicus
taacatgggcatctcctaaggaaat

SEQ ID NO: 539807 - DNA, 25 bp, Rattus norvegicus
taacatgggcatgtcctaaggaaat

SEQ ID NO: 539808 - DNA, 25 bp, Rattus norvegicus
taacatgggcgcaaccccgaagaat

SEQ ID NO: 539809 - DNA, 25 bp, Rattus norvegicus
taacatgggcgctaccccgaagaat

SEQ ID NO: 539810 - DNA, 25 bp, Rattus norvegicus
taacatggtccaattgcttttcttt

SEQ ID NO: 539811 - DNA, 25 bp, Rattus norvegicus
taacatggtccatttgcttttcttt

SEQ ID NO: 539812 - DNA, 25 bp, Rattus norvegicus
taacatggtgttaccagggcctggg

SEQ ID NO: 539813 - DNA, 25 bp, Rattus norvegicus
taacatggtgtttccagggcctggg

SEQ ID NO: 539814 - DNA, 25 bp, Rattus norvegicus
taacatgtccaaaactttaaggctc

SEQ ID NO: 539815 - DNA, 25 bp, Rattus norvegicus
taacatgtccaactacacgctgctg

SEQ ID NO: 539816 - DNA, 25 bp, Rattus norvegicus
taacatgtccaagtacacgctgctg

SEQ ID NO: 539817 - DNA, 25 bp, Rattus norvegicus
taacatgtccaatactttaaggctc

SEQ ID NO: 539818 - DNA, 25 bp, Rattus norvegicus
taacatgtccttattgacttagact

SEQ ID NO: 539819 - DNA, 25 bp, Rattus norvegicus
taacatgtcctttttgacttagact

SEQ ID NO: 539820 - DNA, 25 bp, Rattus norvegicus
taacatgtgactccttttttattat

SEQ ID NO: 539821 - DNA, 25 bp, Rattus norvegicus
taacatgtgactgcttttttattat

SEQ ID NO: 539822 - DNA, 25 bp, Rattus norvegicus
taacatgtgcacacatacacgtgaa

SEQ ID NO: 539823 - DNA, 25 bp, Rattus norvegicus
taacatgtgcactcatacacgtgaa

SEQ ID NO: 539824 - DNA, 25 bp, Rattus norvegicus
taacatgtgccgaacgccagggttt

SEQ ID NO: 539825 - DNA, 25 bp, Rattus norvegicus
taacatgtgccgtacgccagggttt

SEQ ID NO: 539826 - DNA, 25 bp, Rattus norvegicus
taacatgtgcgccatggttcctact

SEQ ID NO: 539827 - DNA, 25 bp, Rattus norvegicus
taacatgtgcgcgatggttcctact

SEQ ID NO: 539828 - DNA, 25 bp, Rattus norvegicus
taacatgttcagctgcgttcgatgc

SEQ ID NO: 539829 - DNA, 25 bp, Rattus norvegicus
taacatgttcaggtgcgttcgatgc

SEQ ID NO: 539830 - DNA, 25 bp, Rattus norvegicus
taacatgttcatcgctcatcttcat

SEQ ID NO: 539831 - DNA, 25 bp, Rattus norvegicus
taacatgttcatggctcatcttcat

SEQ ID NO: 539832 - DNA, 25 bp, Rattus norvegicus
taacatgttttcatggagcctttaa

SEQ ID NO: 539833 - DNA, 25 bp, Rattus norvegicus
taacatgttttcttggagcctttaa

SEQ ID NO: 539834 - DNA, 25 bp, Rattus norvegicus
taacattagcttcgatacatctcag

SEQ ID NO: 539835 - DNA, 25 bp, Rattus norvegicus
taacattagcttggatacatctcag

SEQ ID NO: 539836 - DNA, 25 bp, Rattus norvegicus
taacattcacagaattctcagtcct

SEQ ID NO: 539837 - DNA, 25 bp, Rattus norvegicus
taacattcacagtattctcagtcct

SEQ ID NO: 539838 - DNA, 25 bp, Rattus norvegicus
taacattcactgctgaactgccttc

SEQ ID NO: 539839 - DNA, 25 bp, Rattus norvegicus
taacattcactggtgaactgccttc

SEQ ID NO: 539840 - DNA, 25 bp, Rattus norvegicus
taacattcagtacactttcctcagc

SEQ ID NO: 539841 - DNA, 25 bp, Rattus norvegicus
taacattcagtagactttcctcagc

SEQ ID NO: 539842 - DNA, 25 bp, Rattus norvegicus
taacattctgtcaacattagcctat

SEQ ID NO: 539843 - DNA, 25 bp, Rattus norvegicus
taacattctgtctacattagcctat

SEQ ID NO: 539844 - DNA, 25 bp, Rattus norvegicus
taacattgaactcctggttctcctg

SEQ ID NO: 539845 - DNA, 25 bp, Rattus norvegicus
taacattgaactgctggttctcctg

SEQ ID NO: 539846 - DNA, 25 bp, Rattus norvegicus
taacattgaggtacttggctggaac

SEQ ID NO: 539847 - DNA, 25 bp, Rattus norvegicus
taacattgaggttcttggctggaac

SEQ ID NO: 539848 - DNA, 25 bp, Rattus norvegicus
taacattgctttaattgccacttca

SEQ ID NO: 539849 - DNA, 25 bp, Rattus norvegicus
taacattgcttttattgccacttca

SEQ ID NO: 539850 - DNA, 25 bp, Rattus norvegicus
taacattggaaaaccgtagacctga

SEQ ID NO: 539851 - DNA, 25 bp, Rattus norvegicus
taacattggaaatccgtagacctga

SEQ ID NO: 539852 - DNA, 25 bp, Rattus norvegicus
taacattgtgacattgccgtcaggt

SEQ ID NO: 539853 - DNA, 25 bp, Rattus norvegicus
taacattgtgactttgccgtcaggt

SEQ ID NO: 539854 - DNA, 25 bp, Rattus norvegicus
taacattgttggctccaagcttatt

SEQ ID NO: 539855 - DNA, 25 bp, Rattus norvegicus
taacattgttgggtccaagcttatt

SEQ ID NO: 539856 - DNA, 25 bp, Rattus norvegicus
taacatttcctgagccttggagcca

SEQ ID NO: 539857 - DNA, 25 bp, Rattus norvegicus
taacatttcctgtgccttggagcca

SEQ ID NO: 539858 - DNA, 25 bp, Rattus norvegicus
taacatttctttaacagggctgaaa

SEQ ID NO: 539859 - DNA, 25 bp, Rattus norvegicus
taacatttctttacagcttcctact

SEQ ID NO: 539860 - DNA, 25 bp, Rattus norvegicus
taacatttcttttacagggctgaaa

SEQ ID NO: 539861 - DNA, 25 bp, Rattus norvegicus
taacatttcttttcagcttcctact

SEQ ID NO: 539862 - DNA, 25 bp, Rattus norvegicus
taacattttctaattccccagctga

SEQ ID NO: 539863 - DNA, 25 bp, Rattus norvegicus
taacattttctatttccccagctga

SEQ ID NO: 539864 - DNA, 25 bp, Rattus norvegicus
taaccaaaagtcaacccatcgcagt

SEQ ID NO: 539865 - DNA, 25 bp, Rattus norvegicus
taaccaaaagtctacccatcgcagt

SEQ ID NO: 539866 - DNA, 25 bp, Rattus norvegicus
taaccaaagagtaacctagtagaat

SEQ ID NO: 539867 - DNA, 25 bp, Rattus norvegicus
taaccaaagagttacctagtagaat

SEQ ID NO: 539868 - DNA, 25 bp, Rattus norvegicus
taaccaaaggcaaaggctggcctat

SEQ ID NO: 539869 - DNA, 25 bp, Rattus norvegicus
taaccaaaggcataggctggcctat

SEQ ID NO: 539870 - DNA, 25 bp, Rattus norvegicus
taaccaaagttactgttgtttacag

SEQ ID NO: 539871 - DNA, 25 bp, Rattus norvegicus
taaccaaagttagtgttgtttacag

SEQ ID NO: 539872 - DNA, 25 bp, Rattus norvegicus
taaccaacccttcctgcagtttgag

SEQ ID NO: 539873 - DNA, 25 bp, Rattus norvegicus
taaccaacccttgctgcagtttgag

SEQ ID NO: 539874 - DNA, 25 bp, Rattus norvegicus
taaccaactcagcatggccagcaag

SEQ ID NO: 539875 - DNA, 25 bp, Rattus norvegicus
taaccaactcaggatggccagcaag

SEQ ID NO: 539876 - DNA, 25 bp, Rattus norvegicus
taaccaacttcaacctcaacttaat

SEQ ID NO: 539877 - DNA, 25 bp, Rattus norvegicus
taaccaacttcatcctcaacttaat

SEQ ID NO: 539878 - DNA, 25 bp, Rattus norvegicus
taaccaagaaaaagcctcagggaca

SEQ ID NO: 539879 - DNA, 25 bp, Rattus norvegicus
taaccaagaaaatgcctcagggaca

SEQ ID NO: 539880 - DNA, 25 bp, Rattus norvegicus
taaccaagagctacctgtgacaggg

SEQ ID NO: 539881 - DNA, 25 bp, Rattus norvegicus
taaccaagagcttcctgtgacaggg

SEQ ID NO: 539882 - DNA, 25 bp, Rattus norvegicus
taaccaagaggcatcccaggagggc

SEQ ID NO: 539883 - DNA, 25 bp, Rattus norvegicus
taaccaagaggcttcccaggagggc

SEQ ID NO: 539884 - DNA, 25 bp, Rattus norvegicus
taaccaagcagtatttggctgtagt

SEQ ID NO: 539885 - DNA, 25 bp, Rattus norvegicus
taaccaagcagtttttggctgtagt

SEQ ID NO: 539886 - DNA, 25 bp, Rattus norvegicus
taaccaagcctgcaacgtggtcgcc

SEQ ID NO: 539887 - DNA, 25 bp, Rattus norvegicus
taaccaagcctggaacgtggtcgcc

SEQ ID NO: 539888 - DNA, 25 bp, Rattus norvegicus
taaccaagctgtatacagtagtttg

SEQ ID NO: 539889 - DNA, 25 bp, Rattus norvegicus
taaccaagctgtttacagtagtttg

SEQ ID NO: 539890 - DNA, 25 bp, Rattus norvegicus
taaccaaggcagcaggacacaccct

SEQ ID NO: 539891 - DNA, 25 bp, Rattus norvegicus
taaccaaggcaggaggacacaccct

SEQ ID NO: 539892 - DNA, 25 bp, Rattus norvegicus
taaccaagggagacttcctagagat

SEQ ID NO: 539893 - DNA, 25 bp, Rattus norvegicus
taaccaagggagtcttcctagagat

SEQ ID NO: 539894 - DNA, 25 bp, Rattus norvegicus
taaccaagtcttcttgcaccgcaaa

SEQ ID NO: 539895 - DNA, 25 bp, Rattus norvegicus
taaccaagtcttgttgcaccgcaaa

SEQ ID NO: 539896 - DNA, 25 bp, Rattus norvegicus
taaccaagtggtctagtactaggca

SEQ ID NO: 539897 - DNA, 25 bp, Rattus norvegicus
taaccaagtggtgtagtactaggca

SEQ ID NO: 539898 - DNA, 25 bp, Rattus norvegicus
taaccaatctgaagtaggcctcatt

SEQ ID NO: 539899 - DNA, 25 bp, Rattus norvegicus
taaccaatctgatgtaggcctcatt

SEQ ID NO: 539900 - DNA, 25 bp, Rattus norvegicus
taaccacaactgacatgctcttaca

SEQ ID NO: 539901 - DNA, 25 bp, Rattus norvegicus
taaccacaactgtcatgctcttaca

SEQ ID NO: 539902 - DNA, 25 bp, Rattus norvegicus
taaccacaatcaaatctgcacgctc

SEQ ID NO: 539903 - DNA, 25 bp, Rattus norvegicus
taaccacaatcatatctgcacgctc

SEQ ID NO: 539904 - DNA, 25 bp, Rattus norvegicus
taaccacaccagatggatgcattgg

SEQ ID NO: 539905 - DNA, 25 bp, Rattus norvegicus
taaccacaccagttggatgcattgg

SEQ ID NO: 539906 - DNA, 25 bp, Rattus norvegicus
taaccacaccttattgaaatctgcc

SEQ ID NO: 539907 - DNA, 25 bp, Rattus norvegicus
taaccacacctttttgaaatctgcc

SEQ ID NO: 539908 - DNA, 25 bp, Rattus norvegicus
taaccacacggtacattccagcatt

SEQ ID NO: 539909 - DNA, 25 bp, Rattus norvegicus
taaccacacggttcattccagcatt

SEQ ID NO: 539910 - DNA, 25 bp, Rattus norvegicus
taaccacaggtgctcctttcttgtt

SEQ ID NO: 539911 - DNA, 25 bp, Rattus norvegicus
taaccacaggtggtcctttcttgtt

SEQ ID NO: 539912 - DNA, 25 bp, Rattus norvegicus
taaccacaggttactgaaacttcag

SEQ ID NO: 539913 - DNA, 25 bp, Rattus norvegicus
taaccacaggtttctgaaacttcag

SEQ ID NO: 539914 - DNA, 25 bp, Rattus norvegicus
taaccacatccaagatctacctcag

SEQ ID NO: 539915 - DNA, 25 bp, Rattus norvegicus
taaccacatccatgatctacctcag

SEQ ID NO: 539916 - DNA, 25 bp, Rattus norvegicus
taaccacatcttcaactagcactag

SEQ ID NO: 539917 - DNA, 25 bp, Rattus norvegicus
taaccacatcttgaactagcactag

SEQ ID NO: 539918 - DNA, 25 bp, Rattus norvegicus
taaccacattggaggctttgtccac

SEQ ID NO: 539919 - DNA, 25 bp, Rattus norvegicus
taaccacattggtggctttgtccac

SEQ ID NO: 539920 - DNA, 25 bp, Rattus norvegicus
taaccaccaattacaagcctgtcgc

SEQ ID NO: 539921 - DNA, 25 bp, Rattus norvegicus
taaccaccaatttcaagcctgtcgc

SEQ ID NO: 539922 - DNA, 25 bp, Rattus norvegicus
taaccaccacctatgacttgttagt

SEQ ID NO: 539923 - DNA, 25 bp, Rattus norvegicus
taaccaccacctttgacttgttagt

SEQ ID NO: 539924 - DNA, 25 bp, Rattus norvegicus
taaccaccacgcatgagacatttaa

SEQ ID NO: 539925 - DNA, 25 bp, Rattus norvegicus
taaccaccacgcttgagacatttaa

SEQ ID NO: 539926 - DNA, 25 bp, Rattus norvegicus
taaccacctactcccttaggctatg

SEQ ID NO: 539927 - DNA, 25 bp, Rattus norvegicus
taaccacctactgccttaggctatg

SEQ ID NO: 539928 - DNA, 25 bp, Rattus norvegicus
taaccaccttcactgtgtcagagca

SEQ ID NO: 539929 - DNA, 25 bp, Rattus norvegicus
taaccaccttcagtgtgtcagagca

SEQ ID NO: 539930 - DNA, 25 bp, Rattus norvegicus
taaccacgcagcctgtgagcaggaa

SEQ ID NO: 539931 - DNA, 25 bp, Rattus norvegicus
taaccacgcagcgtgtgagcaggaa

SEQ ID NO: 539932 - DNA, 25 bp, Rattus norvegicus
taaccacgcgaaaacccctatataa

SEQ ID NO: 539933 - DNA, 25 bp, Rattus norvegicus
taaccacgcgaatacccctatataa

SEQ ID NO: 539934 - DNA, 25 bp, Rattus norvegicus
taaccacggagcattacgtcttcat

SEQ ID NO: 539935 - DNA, 25 bp, Rattus norvegicus
taaccacggagctttacgtcttcat

SEQ ID NO: 539936 - DNA, 25 bp, Rattus norvegicus
taaccacgggtcaggaaatgctagg

SEQ ID NO: 539937 - DNA, 25 bp, Rattus norvegicus
taaccacgggtctggaaatgctagg

SEQ ID NO: 539938 - DNA, 25 bp, Rattus norvegicus
taaccacggtgtcctctgcttggca

SEQ ID NO: 539939 - DNA, 25 bp, Rattus norvegicus
taaccacggtgtgctctgcttggca

SEQ ID NO: 539940 - DNA, 25 bp, Rattus norvegicus
taaccacgtcatagatacctactct

SEQ ID NO: 539941 - DNA, 25 bp, Rattus norvegicus
taaccacgtcattgatacctactct

SEQ ID NO: 539942 - DNA, 25 bp, Rattus norvegicus
taaccacgttgtatattccaaagag

SEQ ID NO: 539943 - DNA, 25 bp, Rattus norvegicus
taaccacgttgtttattccaaagag

SEQ ID NO: 539944 - DNA, 25 bp, Rattus norvegicus
taaccactacccattatcctattat

SEQ ID NO: 539945 - DNA, 25 bp, Rattus norvegicus
taaccactaccctttatcctattat

SEQ ID NO: 539946 - DNA, 25 bp, Rattus norvegicus
taaccactgagaaacttttctcccc

SEQ ID NO: 539947 - DNA, 25 bp, Rattus norvegicus
taaccactgagatacttttctcccc

SEQ ID NO: 539948 - DNA, 25 bp, Rattus norvegicus
taaccactgtgcatgcagaggccag

SEQ ID NO: 539949 - DNA, 25 bp, Rattus norvegicus
taaccactgtgcttgcagaggccag

SEQ ID NO: 539950 - DNA, 25 bp, Rattus norvegicus
taaccacttccaccataataatttt

SEQ ID NO: 539951 - DNA, 25 bp, Rattus norvegicus
taaccacttccagcataataatttt

SEQ ID NO: 539952 - DNA, 25 bp, Rattus norvegicus
taaccagaaagcaagcctccacagc

SEQ ID NO: 539953 - DNA, 25 bp, Rattus norvegicus
taaccagaaagctagcctccacagc

SEQ ID NO: 539954 - DNA, 25 bp, Rattus norvegicus
taaccagactctctggagtgacccg

SEQ ID NO: 539955 - DNA, 25 bp, Rattus norvegicus
taaccagactctgtggagtgacccg

SEQ ID NO: 539956 - DNA, 25 bp, Rattus norvegicus
taaccagatgacattcactgcaggg

SEQ ID NO: 539957 - DNA, 25 bp, Rattus norvegicus
taaccagatgactttcactgcaggg

SEQ ID NO: 539958 - DNA, 25 bp, Rattus norvegicus
taaccagatgatcttttcctccctc

SEQ ID NO: 539959 - DNA, 25 bp, Rattus norvegicus
taaccagatgatgttttcctccctc

SEQ ID NO: 539960 - DNA, 25 bp, Rattus norvegicus
taaccagatggtagcctcttaccca

SEQ ID NO: 539961 - DNA, 25 bp, Rattus norvegicus
taaccagatggttgcctcttaccca

SEQ ID NO: 539962 - DNA, 25 bp, Rattus norvegicus
taaccagcactactagtgatcagcg

SEQ ID NO: 539963 - DNA, 25 bp, Rattus norvegicus
taaccagcactagtagtgatcagcg

SEQ ID NO: 539964 - DNA, 25 bp, Rattus norvegicus
taaccagccaacacgcataggatcg

SEQ ID NO: 539965 - DNA, 25 bp, Rattus norvegicus
taaccagccaactcgcataggatcg

SEQ ID NO: 539966 - DNA, 25 bp, Rattus norvegicus
taaccagccattatgtgattccgtg

SEQ ID NO: 539967 - DNA, 25 bp, Rattus norvegicus
taaccagccattttgtgattccgtg

SEQ ID NO: 539968 - DNA, 25 bp, Rattus norvegicus
taaccagcctccagggctgcactgg

SEQ ID NO: 539969 - DNA, 25 bp, Rattus norvegicus
taaccagcctcctgggctgcactgg

SEQ ID NO: 539970 - DNA, 25 bp, Rattus norvegicus
taaccagcgggtcatcggcaaggca

SEQ ID NO: 539971 - DNA, 25 bp, Rattus norvegicus
taaccagcgggtgatcggcaaggca

SEQ ID NO: 539972 - DNA, 25 bp, Rattus norvegicus
taaccagcttgaaacccctcagtgt

SEQ ID NO: 539973 - DNA, 25 bp, Rattus norvegicus
taaccagcttgatacccctcagtgt

SEQ ID NO: 539974 - DNA, 25 bp, Rattus norvegicus
taaccaggatccaggctgttttgct

SEQ ID NO: 539975 - DNA, 25 bp, Rattus norvegicus
taaccaggatcctggctgttttgct

SEQ ID NO: 539976 - DNA, 25 bp, Rattus norvegicus
taaccaggccggaccttgtgcaata

SEQ ID NO: 539977 - DNA, 25 bp, Rattus norvegicus
taaccaggccggtccttgtgcaata

SEQ ID NO: 539978 - DNA, 25 bp, Rattus norvegicus
taaccagggacacgattcgccttta

SEQ ID NO: 539979 - DNA, 25 bp, Rattus norvegicus
taaccagggacaggattcgccttta

SEQ ID NO: 539980 - DNA, 25 bp, Rattus norvegicus
taaccagggacgaccgcggctaccg

SEQ ID NO: 539981 - DNA, 25 bp, Rattus norvegicus
taaccagggacgtccgcggctaccg

SEQ ID NO: 539982 - DNA, 25 bp, Rattus norvegicus
taaccagggcctatcagtttgatat

SEQ ID NO: 539983 - DNA, 25 bp, Rattus norvegicus
taaccagggcctccacagctggagg

SEQ ID NO: 539984 - DNA, 25 bp, Rattus norvegicus
taaccagggcctgcacagctggagg

SEQ ID NO: 539985 - DNA, 25 bp, Rattus norvegicus
taaccagggcctttcagtttgatat

SEQ ID NO: 539986 - DNA, 25 bp, Rattus norvegicus
taaccagggctcatctcaaaagcaa

SEQ ID NO: 539987 - DNA, 25 bp, Rattus norvegicus
taaccagggctcttctcaaaagcaa

SEQ ID NO: 539988 - DNA, 25 bp, Rattus norvegicus
taaccagggtggatggcactgacat

SEQ ID NO: 539989 - DNA, 25 bp, Rattus norvegicus
taaccagggtggttggcactgacat

SEQ ID NO: 539990 - DNA, 25 bp, Rattus norvegicus
taaccaggtgcccaggagaccagat

SEQ ID NO: 539991 - DNA, 25 bp, Rattus norvegicus
taaccaggtgccgaggagaccagat

SEQ ID NO: 539992 - DNA, 25 bp, Rattus norvegicus
taaccagtaactcgctcatcctact

SEQ ID NO: 539993 - DNA, 25 bp, Rattus norvegicus
taaccagtaactggctcatcctact

SEQ ID NO: 539994 - DNA, 25 bp, Rattus norvegicus
taaccagtccataatctttgagaat

SEQ ID NO: 539995 - DNA, 25 bp, Rattus norvegicus
taaccagtccattatctttgagaat

SEQ ID NO: 539996 - DNA, 25 bp, Rattus norvegicus
taaccagtgcaaacagcttccattt

SEQ ID NO: 539997 - DNA, 25 bp, Rattus norvegicus
taaccagtgcaatcagcttccattt

SEQ ID NO: 539998 - DNA, 25 bp, Rattus norvegicus
taaccagtgctgctgacgtgctgag

SEQ ID NO: 539999 - DNA, 25 bp, Rattus norvegicus
taaccagtgctggtgacgtgctgag

SEQ ID NO: 540000 - DNA, 25 bp, Rattus norvegicus
taaccagttcccaccattactgtag

SEQ ID NO: 540001 - DNA, 25 bp, Rattus norvegicus
taaccagttccctccattactgtag

SEQ ID NO: 540002 - DNA, 25 bp, Rattus norvegicus
taaccagttctgaaagattcaggag

SEQ ID NO: 540003 - DNA, 25 bp, Rattus norvegicus
taaccagttctgtaagattcaggag

SEQ ID NO: 540004 - DNA, 25 bp, Rattus norvegicus
taaccatacgccatgctttgggtgg

SEQ ID NO: 540005 - DNA, 25 bp, Rattus norvegicus
taaccatacgccttgctttgggtgg

SEQ ID NO: 540006 - DNA, 25 bp, Rattus norvegicus
taaccatacgtcagtttaccggcca

SEQ ID NO: 540007 - DNA, 25 bp, Rattus norvegicus
taaccatacgtctgtttaccggcca

SEQ ID NO: 540008 - DNA, 25 bp, Rattus norvegicus
taaccatagaccaggagcacacagc

SEQ ID NO: 540009 - DNA, 25 bp, Rattus norvegicus
taaccatagacctggagcacacagc

SEQ ID NO: 540010 - DNA, 25 bp, Rattus norvegicus
taaccatagactacagtttcctgct

SEQ ID NO: 540011 - DNA, 25 bp, Rattus norvegicus
taaccatagacttcagtttcctgct

SEQ ID NO: 540012 - DNA, 25 bp, Rattus norvegicus
taaccatagcttcatttgaccccag

SEQ ID NO: 540013 - DNA, 25 bp, Rattus norvegicus
taaccatagcttgatttgaccccag

SEQ ID NO: 540014 - DNA, 25 bp, Rattus norvegicus
taaccataggtgagcctggcagagc

SEQ ID NO: 540015 - DNA, 25 bp, Rattus norvegicus
taaccataggtgtgcctggcagagc

SEQ ID NO: 540016 - DNA, 25 bp, Rattus norvegicus
taaccatattttaatttcctgccat

SEQ ID NO: 540017 - DNA, 25 bp, Rattus norvegicus
taaccatatttttatttcctgccat

SEQ ID NO: 540018 - DNA, 25 bp, Rattus norvegicus
taaccatcagttaaacctctcctgt

SEQ ID NO: 540019 - DNA, 25 bp, Rattus norvegicus
taaccatcagtttaacctctcctgt

SEQ ID NO: 540020 - DNA, 25 bp, Rattus norvegicus
taaccatccaacatctttcttgagc

SEQ ID NO: 540021 - DNA, 25 bp, Rattus norvegicus
taaccatccaacttctttcttgagc

SEQ ID NO: 540022 - DNA, 25 bp, Rattus norvegicus
taaccatccacaaatgtcctcatat

SEQ ID NO: 540023 - DNA, 25 bp, Rattus norvegicus
taaccatccacatatgtcctcatat

SEQ ID NO: 540024 - DNA, 25 bp, Rattus norvegicus
taaccatccatcctgagactgtgct

SEQ ID NO: 540025 - DNA, 25 bp, Rattus norvegicus
taaccatccatcgtgagactgtgct

SEQ ID NO: 540026 - DNA, 25 bp, Rattus norvegicus
taaccatccctcctggagtgacaag

SEQ ID NO: 540027 - DNA, 25 bp, Rattus norvegicus
taaccatccctcgtggagtgacaag

SEQ ID NO: 540028 - DNA, 25 bp, Rattus norvegicus
taaccatcggctcggccctgcaagg

SEQ ID NO: 540029 - DNA, 25 bp, Rattus norvegicus
taaccatcggctgggccctgcaagg

SEQ ID NO: 540030 - DNA, 25 bp, Rattus norvegicus
taaccatctaaaacccagactgttg

SEQ ID NO: 540031 - DNA, 25 bp, Rattus norvegicus
taaccatctaaatcccagactgttg

SEQ ID NO: 540032 - DNA, 25 bp, Rattus norvegicus
taaccatctgctattcagagccatc

SEQ ID NO: 540033 - DNA, 25 bp, Rattus norvegicus
taaccatctgcttttcagagccatc

SEQ ID NO: 540034 - DNA, 25 bp, Rattus norvegicus
taaccatgaccaccttaagcatcag

SEQ ID NO: 540035 - DNA, 25 bp, Rattus norvegicus
taaccatgaccagcttaagcatcag

SEQ ID NO: 540036 - DNA, 25 bp, Rattus norvegicus
taaccatgacgacggccgttgccaa

SEQ ID NO: 540037 - DNA, 25 bp, Rattus norvegicus
taaccatgacgagggccgttgccaa

SEQ ID NO: 540038 - DNA, 25 bp, Rattus norvegicus
taaccatgattcataccctctcaga

SEQ ID NO: 540039 - DNA, 25 bp, Rattus norvegicus
taaccatgattcttaccctctcaga

SEQ ID NO: 540040 - DNA, 25 bp, Rattus norvegicus
taaccatgcctactaaccagagctg

SEQ ID NO: 540041 - DNA, 25 bp, Rattus norvegicus
taaccatgcctagtaaccagagctg

SEQ ID NO: 540042 - DNA, 25 bp, Rattus norvegicus
taaccatgctatagcccttatcaga

SEQ ID NO: 540043 - DNA, 25 bp, Rattus norvegicus
taaccatgctattgcccttatcaga

SEQ ID NO: 540044 - DNA, 25 bp, Rattus norvegicus
taaccatgctgactgacccttgtgc

SEQ ID NO: 540045 - DNA, 25 bp, Rattus norvegicus
taaccatgctgagtgacccttgtgc

SEQ ID NO: 540046 - DNA, 25 bp, Rattus norvegicus
taaccatggtttaaccgagtagtat

SEQ ID NO: 540047 - DNA, 25 bp, Rattus norvegicus
taaccatggttttaccgagtagtat

SEQ ID NO: 540048 - DNA, 25 bp, Rattus norvegicus
taaccatgtagcatagcaccgggcc

SEQ ID NO: 540049 - DNA, 25 bp, Rattus norvegicus
taaccatgtagcttagcaccgggcc

SEQ ID NO: 540050 - DNA, 25 bp, Rattus norvegicus
taaccatgtgcgaccggaaggcggt

SEQ ID NO: 540051 - DNA, 25 bp, Rattus norvegicus
taaccatgtgcgtccggaaggcggt

SEQ ID NO: 540052 - DNA, 25 bp, Rattus norvegicus
taaccattactcagtgactctccat

SEQ ID NO: 540053 - DNA, 25 bp, Rattus norvegicus
taaccattactctgtgactctccat

SEQ ID NO: 540054 - DNA, 25 bp, Rattus norvegicus
taaccattcacaatttaacataggg

SEQ ID NO: 540055 - DNA, 25 bp, Rattus norvegicus
taaccattcacattttaacataggg

SEQ ID NO: 540056 - DNA, 25 bp, Rattus norvegicus
taaccattccctagacagcacagga

SEQ ID NO: 540057 - DNA, 25 bp, Rattus norvegicus
taaccattcccttgacagcacagga

SEQ ID NO: 540058 - DNA, 25 bp, Rattus norvegicus
taaccattctgtcctggatcagtgt

SEQ ID NO: 540059 - DNA, 25 bp, Rattus norvegicus
taaccattctgtgctggatcagtgt

SEQ ID NO: 540060 - DNA, 25 bp, Rattus norvegicus
taaccattggcaagaagagcaggaa

SEQ ID NO: 540061 - DNA, 25 bp, Rattus norvegicus
taaccattggcatgaagagcaggaa

SEQ ID NO: 540062 - DNA, 25 bp, Rattus norvegicus
taaccattgtgccatttctctagct

SEQ ID NO: 540063 - DNA, 25 bp, Rattus norvegicus
taaccattgtgcgatttctctagct

SEQ ID NO: 540064 - DNA, 25 bp, Rattus norvegicus
taaccatttcctacttgtcactgaa

SEQ ID NO: 540065 - DNA, 25 bp, Rattus norvegicus
taaccatttcctatgtgctgtgcca

SEQ ID NO: 540066 - DNA, 25 bp, Rattus norvegicus
taaccatttccttcttgtcactgaa

SEQ ID NO: 540067 - DNA, 25 bp, Rattus norvegicus
taaccatttcctttgtgctgtgcca

SEQ ID NO: 540068 - DNA, 25 bp, Rattus norvegicus
taacccaaagtgcttttgatcagag

SEQ ID NO: 540069 - DNA, 25 bp, Rattus norvegicus
taacccaaagtggttttgatcagag

SEQ ID NO: 540070 - DNA, 25 bp, Rattus norvegicus
taacccaactcactcactcattttt

SEQ ID NO: 540071 - DNA, 25 bp, Rattus norvegicus
taacccaactcagtcactcattttt

SEQ ID NO: 540072 - DNA, 25 bp, Rattus norvegicus
taacccaactctcctctggataaac

SEQ ID NO: 540073 - DNA, 25 bp, Rattus norvegicus
taacccaactctgctctggataaac

SEQ ID NO: 540074 - DNA, 25 bp, Rattus norvegicus
taacccaagatgatttaccgtctat

SEQ ID NO: 540075 - DNA, 25 bp, Rattus norvegicus
taacccaagatgttttaccgtctat

SEQ ID NO: 540076 - DNA, 25 bp, Rattus norvegicus
taacccaatgtgatccatgacccaa

SEQ ID NO: 540077 - DNA, 25 bp, Rattus norvegicus
taacccaatgtgttccatgacccaa

SEQ ID NO: 540078 - DNA, 25 bp, Rattus norvegicus
taacccaattctcctttgtaaccgg

SEQ ID NO: 540079 - DNA, 25 bp, Rattus norvegicus
taacccaattctgctttgtaaccgg

SEQ ID NO: 540080 - DNA, 25 bp, Rattus norvegicus
taacccacgctcatacaaagcaaag

SEQ ID NO: 540081 - DNA, 25 bp, Rattus norvegicus
taacccacgctcttacaaagcaaag

SEQ ID NO: 540082 - DNA, 25 bp, Rattus norvegicus
taacccagaaggcagctagtggctg

SEQ ID NO: 540083 - DNA, 25 bp, Rattus norvegicus
taacccagaagggagctagtggctg

SEQ ID NO: 540084 - DNA, 25 bp, Rattus norvegicus
taacccagactactaattttactgt

SEQ ID NO: 540085 - DNA, 25 bp, Rattus norvegicus
taacccagactagtaattttactgt

SEQ ID NO: 540086 - DNA, 25 bp, Rattus norvegicus
taacccagagccagtctttactaaa

SEQ ID NO: 540087 - DNA, 25 bp, Rattus norvegicus
taacccagagcctgtctttactaaa

SEQ ID NO: 540088 - DNA, 25 bp, Rattus norvegicus
taacccagagtcagcactcaatgag

SEQ ID NO: 540089 - DNA, 25 bp, Rattus norvegicus
taacccagagtctgcactcaatgag

SEQ ID NO: 540090 - DNA, 25 bp, Rattus norvegicus
taacccagatccaaaaagcgtcgag

SEQ ID NO: 540091 - DNA, 25 bp, Rattus norvegicus
taacccagatcctaaaagcgtcgag

SEQ ID NO: 540092 - DNA, 25 bp, Rattus norvegicus
taacccagccccagtcaaatgttta

SEQ ID NO: 540093 - DNA, 25 bp, Rattus norvegicus
taacccagcccctgtcaaatgttta

SEQ ID NO: 540094 - DNA, 25 bp, Rattus norvegicus
taacccagcgggatcgtctcaggtt

SEQ ID NO: 540095 - DNA, 25 bp, Rattus norvegicus
taacccagcgggttcgtctcaggtt

SEQ ID NO: 540096 - DNA, 25 bp, Rattus norvegicus
taacccaggactaatggaccccaag

SEQ ID NO: 540097 - DNA, 25 bp, Rattus norvegicus
taacccaggacttatggaccccaag

SEQ ID NO: 540098 - DNA, 25 bp, Rattus norvegicus
taacccaggttgatctcaccttctc

SEQ ID NO: 540099 - DNA, 25 bp, Rattus norvegicus
taacccaggttgttctcaccttctc

SEQ ID NO: 540100 - DNA, 25 bp, Rattus norvegicus
taacccagtcttacttcaaggtggt

SEQ ID NO: 540101 - DNA, 25 bp, Rattus norvegicus
taacccagtctttcttcaaggtggt

SEQ ID NO: 540102 - DNA, 25 bp, Rattus norvegicus
taacccagtgaaacaaagaattatt

SEQ ID NO: 540103 - DNA, 25 bp, Rattus norvegicus
taacccagtgaatcaaagaattatt

SEQ ID NO: 540104 - DNA, 25 bp, Rattus norvegicus
taacccatcaccacttctgggtatt

SEQ ID NO: 540105 - DNA, 25 bp, Rattus norvegicus
taacccatcacctcttctgggtatt

SEQ ID NO: 540106 - DNA, 25 bp, Rattus norvegicus
taacccatcgggaagctatgctcag

SEQ ID NO: 540107 - DNA, 25 bp, Rattus norvegicus
taacccatcgggtagctatgctcag

SEQ ID NO: 540108 - DNA, 25 bp, Rattus norvegicus
taacccatggcactttctccttctt

SEQ ID NO: 540109 - DNA, 25 bp, Rattus norvegicus
taacccatggcagtttctccttctt

SEQ ID NO: 540110 - DNA, 25 bp, Rattus norvegicus
taacccattattcacttacctaggc

SEQ ID NO: 540111 - DNA, 25 bp, Rattus norvegicus
taacccattattgacttacctaggc

SEQ ID NO: 540112 - DNA, 25 bp, Rattus norvegicus
taaccccaaaatctgtaggactgtg

SEQ ID NO: 540113 - DNA, 25 bp, Rattus norvegicus
taaccccaaaatgtgtaggactgtg

SEQ ID NO: 540114 - DNA, 25 bp, Rattus norvegicus
taaccccaacagatgaccctctggg

SEQ ID NO: 540115 - DNA, 25 bp, Rattus norvegicus
taaccccaacagttgaccctctggg

SEQ ID NO: 540116 - DNA, 25 bp, Rattus norvegicus
taaccccacagcaacctgaaactgt

SEQ ID NO: 540117 - DNA, 25 bp, Rattus norvegicus
taaccccacagcatctgagctaagg

SEQ ID NO: 540118 - DNA, 25 bp, Rattus norvegicus
taaccccacagctacctgaaactgt

SEQ ID NO: 540119 - DNA, 25 bp, Rattus norvegicus
taaccccacagcttctgagctaagg

SEQ ID NO: 540120 - DNA, 25 bp, Rattus norvegicus
taaccccacccaagtagactagttt

SEQ ID NO: 540121 - DNA, 25 bp, Rattus norvegicus
taaccccacccatgtagactagttt

SEQ ID NO: 540122 - DNA, 25 bp, Rattus norvegicus
taaccccactctccttagagtaata

SEQ ID NO: 540123 - DNA, 25 bp, Rattus norvegicus
taaccccactctgcttagagtaata

SEQ ID NO: 540124 - DNA, 25 bp, Rattus norvegicus
taaccccagaaccactaagttgtat

SEQ ID NO: 540125 - DNA, 25 bp, Rattus norvegicus
taaccccagaacgactaagttgtat

SEQ ID NO: 540126 - DNA, 25 bp, Rattus norvegicus
taaccccagacgcaatgtactcagt

SEQ ID NO: 540127 - DNA, 25 bp, Rattus norvegicus
taaccccagacggaatgtactcagt

SEQ ID NO: 540128 - DNA, 25 bp, Rattus norvegicus
taaccccagcacaccatagatgtct

SEQ ID NO: 540129 - DNA, 25 bp, Rattus norvegicus
taaccccagcactccatagatgtct

SEQ ID NO: 540130 - DNA, 25 bp, Rattus norvegicus
taaccccaggagctcgccagaggaa

SEQ ID NO: 540131 - DNA, 25 bp, Rattus norvegicus
taaccccaggaggtcgccagaggaa

SEQ ID NO: 540132 - DNA, 25 bp, Rattus norvegicus
taaccccagggaattgcaagctcag

SEQ ID NO: 540133 - DNA, 25 bp, Rattus norvegicus
taaccccagggacagcatatcagag

SEQ ID NO: 540134 - DNA, 25 bp, Rattus norvegicus
taaccccagggagagcatatcagag

SEQ ID NO: 540135 - DNA, 25 bp, Rattus norvegicus
taaccccagggatttgcaagctcag

SEQ ID NO: 540136 - DNA, 25 bp, Rattus norvegicus
taaccccatacaatccagactgttc

SEQ ID NO: 540137 - DNA, 25 bp, Rattus norvegicus
taaccccatacattccagactgttc

SEQ ID NO: 540138 - DNA, 25 bp, Rattus norvegicus
taaccccatcgtcctcttggaggat

SEQ ID NO: 540139 - DNA, 25 bp, Rattus norvegicus
taaccccatcgtgctcttggaggat

SEQ ID NO: 540140 - DNA, 25 bp, Rattus norvegicus
taaccccatcttctaagccatcaat

SEQ ID NO: 540141 - DNA, 25 bp, Rattus norvegicus
taaccccatcttgtaagccatcaat

SEQ ID NO: 540142 - DNA, 25 bp, Rattus norvegicus
taaccccatggtagagcagtcacac

SEQ ID NO: 540143 - DNA, 25 bp, Rattus norvegicus
taaccccatggttgagcagtcacac

SEQ ID NO: 540144 - DNA, 25 bp, Rattus norvegicus
taaccccatgtgagtctgaagctcc

SEQ ID NO: 540145 - DNA, 25 bp, Rattus norvegicus
taaccccatgtgtgtctgaagctcc

SEQ ID NO: 540146 - DNA, 25 bp, Rattus norvegicus
taaccccattagacactgaggcaga

SEQ ID NO: 540147 - DNA, 25 bp, Rattus norvegicus
taaccccattagtcactgaggcaga

SEQ ID NO: 540148 - DNA, 25 bp, Rattus norvegicus
taaccccattgcatacgtgtttcca

SEQ ID NO: 540149 - DNA, 25 bp, Rattus norvegicus
taaccccattgcttacgtgtttcca

SEQ ID NO: 540150 - DNA, 25 bp, Rattus norvegicus
taaccccgaggtcctgtccttggag

SEQ ID NO: 540151 - DNA, 25 bp, Rattus norvegicus
taaccccgaggtgctgtccttggag

SEQ ID NO: 540152 - DNA, 25 bp, Rattus norvegicus
taacccctcaccaggatggtttagt

SEQ ID NO: 540153 - DNA, 25 bp, Rattus norvegicus
taacccctcacctggatggtttagt

SEQ ID NO: 540154 - DNA, 25 bp, Rattus norvegicus
taacccctcaggagtcgaacctggc

SEQ ID NO: 540155 - DNA, 25 bp, Rattus norvegicus
taacccctcaggtgtcgaacctggc

SEQ ID NO: 540156 - DNA, 25 bp, Rattus norvegicus
taacccctcagtcatcaaagatacc

SEQ ID NO: 540157 - DNA, 25 bp, Rattus norvegicus
taacccctcagtgatcaaagatacc

SEQ ID NO: 540158 - DNA, 25 bp, Rattus norvegicus
taacccctcatcattactgatcatt

SEQ ID NO: 540159 - DNA, 25 bp, Rattus norvegicus
taacccctcatctttactgatcatt

SEQ ID NO: 540160 - DNA, 25 bp, Rattus norvegicus
taacccctcgtgcatgctcatgtat

SEQ ID NO: 540161 - DNA, 25 bp, Rattus norvegicus
taacccctcgtggatgctcatgtat

SEQ ID NO: 540162 - DNA, 25 bp, Rattus norvegicus
taacccctctctagcaaagacggtg

SEQ ID NO: 540163 - DNA, 25 bp, Rattus norvegicus
taacccctctcttgcaaagacggtg

SEQ ID NO: 540164 - DNA, 25 bp, Rattus norvegicus
taacccctctgcatgtttgggagcc

SEQ ID NO: 540165 - DNA, 25 bp, Rattus norvegicus
taacccctctgcttgtttgggagcc

SEQ ID NO: 540166 - DNA, 25 bp, Rattus norvegicus
taacccctgatcctataaataaagc

SEQ ID NO: 540167 - DNA, 25 bp, Rattus norvegicus
taacccctgatcgtataaataaagc

SEQ ID NO: 540168 - DNA, 25 bp, Rattus norvegicus
taacccctggttacctacaatgtct

SEQ ID NO: 540169 - DNA, 25 bp, Rattus norvegicus
taacccctggtttcctacaatgtct

SEQ ID NO: 540170 - DNA, 25 bp, Rattus norvegicus
taacccctgtgaacaaccctgaaat

SEQ ID NO: 540171 - DNA, 25 bp, Rattus norvegicus
taacccctgtgatcaaccctgaaat

SEQ ID NO: 540172 - DNA, 25 bp, Rattus norvegicus
taacccctgttactcgtaagaatgc

SEQ ID NO: 540173 - DNA, 25 bp, Rattus norvegicus
taacccctgttagtcgtaagaatgc

SEQ ID NO: 540174 - DNA, 25 bp, Rattus norvegicus
taaccccttcccagtacatatgtaa

SEQ ID NO: 540175 - DNA, 25 bp, Rattus norvegicus
taaccccttccctgtacatatgtaa

SEQ ID NO: 540176 - DNA, 25 bp, Rattus norvegicus
taacccctttccacatgcaataaaa

SEQ ID NO: 540177 - DNA, 25 bp, Rattus norvegicus
taacccctttcctcatgcaataaaa

SEQ ID NO: 540178 - DNA, 25 bp, Rattus norvegicus
taacccctttctcagtgtcctgtaa

SEQ ID NO: 540179 - DNA, 25 bp, Rattus norvegicus
taacccctttctgagtgtcctgtaa

SEQ ID NO: 540180 - DNA, 25 bp, Rattus norvegicus
taacccgccacaacttgcaaatgga

SEQ ID NO: 540181 - DNA, 25 bp, Rattus norvegicus
taacccgccacatcttgcaaatgga

SEQ ID NO: 540182 - DNA, 25 bp, Rattus norvegicus
taacccgctgttaagagtggactga

SEQ ID NO: 540183 - DNA, 25 bp, Rattus norvegicus
taacccgctgtttagagtggactga

SEQ ID NO: 540184 - DNA, 25 bp, Rattus norvegicus
taacccgcttggcagtggagccgtc

SEQ ID NO: 540185 - DNA, 25 bp, Rattus norvegicus
taacccgcttgggagtggagccgtc

SEQ ID NO: 540186 - DNA, 25 bp, Rattus norvegicus
taacccgtagggattgttcctcatg

SEQ ID NO: 540187 - DNA, 25 bp, Rattus norvegicus
taacccgtagggtttgttcctcatg

SEQ ID NO: 540188 - DNA, 25 bp, Rattus norvegicus
taaccctaagtgatgcagccagtga

SEQ ID NO: 540189 - DNA, 25 bp, Rattus norvegicus
taaccctaagtgttgcagccagtga

SEQ ID NO: 540190 - DNA, 25 bp, Rattus norvegicus
taaccctaatctatgtccctaagtg

SEQ ID NO: 540191 - DNA, 25 bp, Rattus norvegicus
taaccctaatctttgtccctaagtg

SEQ ID NO: 540192 - DNA, 25 bp, Rattus norvegicus
taaccctatttccagcatcagacat

SEQ ID NO: 540193 - DNA, 25 bp, Rattus norvegicus
taaccctatttcgagcatcagacat

SEQ ID NO: 540194 - DNA, 25 bp, Rattus norvegicus
taaccctcaattagctcaggcgttt

SEQ ID NO: 540195 - DNA, 25 bp, Rattus norvegicus
taaccctcaatttgctcaggcgttt

SEQ ID NO: 540196 - DNA, 25 bp, Rattus norvegicus
taaccctcactgcagcttcatggaa

SEQ ID NO: 540197 - DNA, 25 bp, Rattus norvegicus
taaccctcactggagcttcatggaa

SEQ ID NO: 540198 - DNA, 25 bp, Rattus norvegicus
taaccctcagatatgcagtggctcc

SEQ ID NO: 540199 - DNA, 25 bp, Rattus norvegicus
taaccctcagatttgcagtggctcc

SEQ ID NO: 540200 - DNA, 25 bp, Rattus norvegicus
taaccctcccaaaaagtgccagaat

SEQ ID NO: 540201 - DNA, 25 bp, Rattus norvegicus
taaccctcccaataagtgccagaat

SEQ ID NO: 540202 - DNA, 25 bp, Rattus norvegicus
taaccctccgagagattgcattaat

SEQ ID NO: 540203 - DNA, 25 bp, Rattus norvegicus
taaccctccgagtgattgcattaat

SEQ ID NO: 540204 - DNA, 25 bp, Rattus norvegicus
taaccctcctttcatcacatgggag

SEQ ID NO: 540205 - DNA, 25 bp, Rattus norvegicus
taaccctcctttgatcacatgggag

SEQ ID NO: 540206 - DNA, 25 bp, Rattus norvegicus
taaccctcgattcccggagacagag

SEQ ID NO: 540207 - DNA, 25 bp, Rattus norvegicus
taaccctcgattgccggagacagag

SEQ ID NO: 540208 - DNA, 25 bp, Rattus norvegicus
taaccctctagcacttgcctgtgga

SEQ ID NO: 540209 - DNA, 25 bp, Rattus norvegicus
taaccctctagctcttgcctgtgga

SEQ ID NO: 540210 - DNA, 25 bp, Rattus norvegicus
taaccctgaaaaccacctatggatg

SEQ ID NO: 540211 - DNA, 25 bp, Rattus norvegicus
taaccctgaaaagcacctatggatg

SEQ ID NO: 540212 - DNA, 25 bp, Rattus norvegicus
taaccctgaaatagtctctggcctg

SEQ ID NO: 540213 - DNA, 25 bp, Rattus norvegicus
taaccctgaaattgtctctggcctg

SEQ ID NO: 540214 - DNA, 25 bp, Rattus norvegicus
taaccctgaactctgttaatggtca

SEQ ID NO: 540215 - DNA, 25 bp, Rattus norvegicus
taaccctgaactgtgttaatggtca

SEQ ID NO: 540216 - DNA, 25 bp, Rattus norvegicus
taaccctgaagcaatgtgtctgctg

SEQ ID NO: 540217 - DNA, 25 bp, Rattus norvegicus
taaccctgaagctatgtgtctgctg

SEQ ID NO: 540218 - DNA, 25 bp, Rattus norvegicus
taaccctgactcaccttaggtttgt

SEQ ID NO: 540219 - DNA, 25 bp, Rattus norvegicus
taaccctgactctccttaggtttgt

SEQ ID NO: 540220 - DNA, 25 bp, Rattus norvegicus
taaccctgcctgatagctcgatgta

SEQ ID NO: 540221 - DNA, 25 bp, Rattus norvegicus
taaccctgcctgttagctcgatgta

SEQ ID NO: 540222 - DNA, 25 bp, Rattus norvegicus
taaccctgcgacatgcgtacagtat

SEQ ID NO: 540223 - DNA, 25 bp, Rattus norvegicus
taaccctgcgacttgcgtacagtat

SEQ ID NO: 540224 - DNA, 25 bp, Rattus norvegicus
taaccctggctgaattggaactctt

SEQ ID NO: 540225 - DNA, 25 bp, Rattus norvegicus
taaccctggctgtattggaactctt

SEQ ID NO: 540226 - DNA, 25 bp, Rattus norvegicus
taaccctgggcaatctcatatcaaa

SEQ ID NO: 540227 - DNA, 25 bp, Rattus norvegicus
taaccctgggcattctcatatcaaa

SEQ ID NO: 540228 - DNA, 25 bp, Rattus norvegicus
taaccctgggctactgtggcaaaca

SEQ ID NO: 540229 - DNA, 25 bp, Rattus norvegicus
taaccctgggcttctgtggcaaaca

SEQ ID NO: 540230 - DNA, 25 bp, Rattus norvegicus
taaccctgtagaatgcctcacaagt

SEQ ID NO: 540231 - DNA, 25 bp, Rattus norvegicus
taaccctgtagattgcctcacaagt

SEQ ID NO: 540232 - DNA, 25 bp, Rattus norvegicus
taaccctgtcagagtcagcctgtgt

SEQ ID NO: 540233 - DNA, 25 bp, Rattus norvegicus
taaccctgtcagtgtcagcctgtgt

SEQ ID NO: 540234 - DNA, 25 bp, Rattus norvegicus
taaccctgtgcaaccctgaattcct

SEQ ID NO: 540235 - DNA, 25 bp, Rattus norvegicus
taaccctgtgcatccctgaattcct

SEQ ID NO: 540236 - DNA, 25 bp, Rattus norvegicus
taaccctgtgtaccctctgaagtca

SEQ ID NO: 540237 - DNA, 25 bp, Rattus norvegicus
taaccctgtgtagcctctgaagtca

SEQ ID NO: 540238 - DNA, 25 bp, Rattus norvegicus
taaccctgttgcagcagacgcagat

SEQ ID NO: 540239 - DNA, 25 bp, Rattus norvegicus
taaccctgttgctgcagacgcagat

SEQ ID NO: 540240 - DNA, 25 bp, Rattus norvegicus
taaccctgttttactgttgcagagg

SEQ ID NO: 540241 - DNA, 25 bp, Rattus norvegicus
taaccctgtttttctgttgcagagg

SEQ ID NO: 540242 - DNA, 25 bp, Rattus norvegicus
taacccttacaccaggaagctcact

SEQ ID NO: 540243 - DNA, 25 bp, Rattus norvegicus
taacccttacacgaggaagctcact

SEQ ID NO: 540244 - DNA, 25 bp, Rattus norvegicus
taacccttacctctccgtagttcat

SEQ ID NO: 540245 - DNA, 25 bp, Rattus norvegicus
taacccttacctgtccgtagttcat

SEQ ID NO: 540246 - DNA, 25 bp, Rattus norvegicus
taacccttagaacccactgtggaag

SEQ ID NO: 540247 - DNA, 25 bp, Rattus norvegicus
taacccttagaagccactgtggaag

SEQ ID NO: 540248 - DNA, 25 bp, Rattus norvegicus
taacccttagacctcaacctaggat

SEQ ID NO: 540249 - DNA, 25 bp, Rattus norvegicus
taacccttagacgtcaacctaggat

SEQ ID NO: 540250 - DNA, 25 bp, Rattus norvegicus
taacccttccctcaggtgtgtgtat

SEQ ID NO: 540251 - DNA, 25 bp, Rattus norvegicus
taacccttccctgaggtgtgtgtat

SEQ ID NO: 540252 - DNA, 25 bp, Rattus norvegicus
taacccttctccacatggctattga

SEQ ID NO: 540253 - DNA, 25 bp, Rattus norvegicus
taacccttctcctcatggctattga

SEQ ID NO: 540254 - DNA, 25 bp, Rattus norvegicus
taacccttctctccaggccgaataa

SEQ ID NO: 540255 - DNA, 25 bp, Rattus norvegicus
taacccttctctgcaggccgaataa

SEQ ID NO: 540256 - DNA, 25 bp, Rattus norvegicus
taacccttctgcacatttagcttgt

SEQ ID NO: 540257 - DNA, 25 bp, Rattus norvegicus
taacccttctgctcatttagcttgt

SEQ ID NO: 540258 - DNA, 25 bp, Rattus norvegicus
taacccttgcccaagaactcatttg

SEQ ID NO: 540259 - DNA, 25 bp, Rattus norvegicus
taacccttgcccatgtgacattggt

SEQ ID NO: 540260 - DNA, 25 bp, Rattus norvegicus
taacccttgccctagaactcatttg

SEQ ID NO: 540261 - DNA, 25 bp, Rattus norvegicus
taacccttgcccttgtgacattggt

SEQ ID NO: 540262 - DNA, 25 bp, Rattus norvegicus
taacccttgggaaggagcctcttca

SEQ ID NO: 540263 - DNA, 25 bp, Rattus norvegicus
taacccttgggatggagcctcttca

SEQ ID NO: 540264 - DNA, 25 bp, Rattus norvegicus
taaccctttgaaaactgatttttct

SEQ ID NO: 540265 - DNA, 25 bp, Rattus norvegicus
taaccctttgaatactgatttttct

SEQ ID NO: 540266 - DNA, 25 bp, Rattus norvegicus
taaccgaatagtcgacctgccatcc

SEQ ID NO: 540267 - DNA, 25 bp, Rattus norvegicus
taaccgaatagtggacctgccatcc

SEQ ID NO: 540268 - DNA, 25 bp, Rattus norvegicus
taaccgatacccaaactcgcggatg

SEQ ID NO: 540269 - DNA, 25 bp, Rattus norvegicus
taaccgataccctaactcgcggatg

SEQ ID NO: 540270 - DNA, 25 bp, Rattus norvegicus
taaccgcatcaaaagggagcccaat

SEQ ID NO: 540271 - DNA, 25 bp, Rattus norvegicus
taaccgcatcaatagggagcccaat

SEQ ID NO: 540272 - DNA, 25 bp, Rattus norvegicus
taaccgcatgttctatgtgtgcata

SEQ ID NO: 540273 - DNA, 25 bp, Rattus norvegicus
taaccgcatgttgtatgtgtgcata

SEQ ID NO: 540274 - DNA, 25 bp, Rattus norvegicus
taaccgccacggactgatccgtaaa

SEQ ID NO: 540275 - DNA, 25 bp, Rattus norvegicus
taaccgccacggtctgatccgtaaa

SEQ ID NO: 540276 - DNA, 25 bp, Rattus norvegicus
taaccgccacttcagtgttcaaggt

SEQ ID NO: 540277 - DNA, 25 bp, Rattus norvegicus
taaccgccacttgagtgttcaaggt

SEQ ID NO: 540278 - DNA, 25 bp, Rattus norvegicus
taaccgccctacatgtttgcatcta

SEQ ID NO: 540279 - DNA, 25 bp, Rattus norvegicus
taaccgccctacttgtttgcatcta

SEQ ID NO: 540280 - DNA, 25 bp, Rattus norvegicus
taaccgcggcaaactttcctagcat

SEQ ID NO: 540281 - DNA, 25 bp, Rattus norvegicus
taaccgcggcaatctttcctagcat

SEQ ID NO: 540282 - DNA, 25 bp, Rattus norvegicus
taaccgcgggaaaggctatgaccat

SEQ ID NO: 540283 - DNA, 25 bp, Rattus norvegicus
taaccgcgggaatggctatgaccat

SEQ ID NO: 540284 - DNA, 25 bp, Rattus norvegicus
taaccgctaagtcccacgctaggtg

SEQ ID NO: 540285 - DNA, 25 bp, Rattus norvegicus
taaccgctaagtgccacgctaggtg

SEQ ID NO: 540286 - DNA, 25 bp, Rattus norvegicus
taaccgctggctattagtgggagat

SEQ ID NO: 540287 - DNA, 25 bp, Rattus norvegicus
taaccgctggcttttagtgggagat

SEQ ID NO: 540288 - DNA, 25 bp, Rattus norvegicus
taaccgcttcgtctggtggtggatt

SEQ ID NO: 540289 - DNA, 25 bp, Rattus norvegicus
taaccgcttcgtgtggtggtggatt

SEQ ID NO: 540290 - DNA, 25 bp, Rattus norvegicus
taaccggaaaatcgcagaagcacag

SEQ ID NO: 540291 - DNA, 25 bp, Rattus norvegicus
taaccggaaaatggcagaagcacag

SEQ ID NO: 540292 - DNA, 25 bp, Rattus norvegicus
taaccggagcttaccaatgatgtta

SEQ ID NO: 540293 - DNA, 25 bp, Rattus norvegicus
taaccggagctttccaatgatgtta

SEQ ID NO: 540294 - DNA, 25 bp, Rattus norvegicus
taaccggatcagacatgtgggccca

SEQ ID NO: 540295 - DNA, 25 bp, Rattus norvegicus
taaccggatcagtcatgtgggccca

SEQ ID NO: 540296 - DNA, 25 bp, Rattus norvegicus
taaccggcctacatggtgggtttct

SEQ ID NO: 540297 - DNA, 25 bp, Rattus norvegicus
taaccggcctacttggtgggtttct

SEQ ID NO: 540298 - DNA, 25 bp, Rattus norvegicus
taaccggcgccaaggagtgattaca

SEQ ID NO: 540299 - DNA, 25 bp, Rattus norvegicus
taaccggcgccatggagtgattaca

SEQ ID NO: 540300 - DNA, 25 bp, Rattus norvegicus
taaccggctggtcatgtttgatcct

SEQ ID NO: 540301 - DNA, 25 bp, Rattus norvegicus
taaccggctggtgatgtttgatcct

SEQ ID NO: 540302 - DNA, 25 bp, Rattus norvegicus
taaccggtttgtattcactgtcctg

SEQ ID NO: 540303 - DNA, 25 bp, Rattus norvegicus
taaccggtttgttttcactgtcctg

SEQ ID NO: 540304 - DNA, 25 bp, Rattus norvegicus
taaccgtaaagtaagcagccattgc

SEQ ID NO: 540305 - DNA, 25 bp, Rattus norvegicus
taaccgtaaagttagcagccattgc

SEQ ID NO: 540306 - DNA, 25 bp, Rattus norvegicus
taaccgtcctgaatctaacctaact

SEQ ID NO: 540307 - DNA, 25 bp, Rattus norvegicus
taaccgtcctgattctaacctaact

SEQ ID NO: 540308 - DNA, 25 bp, Rattus norvegicus
taaccgtggtgtattctgactgtcc

SEQ ID NO: 540309 - DNA, 25 bp, Rattus norvegicus
taaccgtggtgttttctgactgtcc

SEQ ID NO: 540310 - DNA, 25 bp, Rattus norvegicus
taaccgttaggtctgggatccatcc

SEQ ID NO: 540311 - DNA, 25 bp, Rattus norvegicus
taaccgttaggtgtgggatccatcc

SEQ ID NO: 540312 - DNA, 25 bp, Rattus norvegicus
taaccgttcgtgacatgggaatgca

SEQ ID NO: 540313 - DNA, 25 bp, Rattus norvegicus
taaccgttcgtgtcatgggaatgca

SEQ ID NO: 540314 - DNA, 25 bp, Rattus norvegicus
taaccgttctctaccctagctgatg

SEQ ID NO: 540315 - DNA, 25 bp, Rattus norvegicus
taaccgttctcttccctagctgatg

SEQ ID NO: 540316 - DNA, 25 bp, Rattus norvegicus
taaccgttgatgctctttaccgtag

SEQ ID NO: 540317 - DNA, 25 bp, Rattus norvegicus
taaccgttgatggtctttaccgtag

SEQ ID NO: 540318 - DNA, 25 bp, Rattus norvegicus
taaccgtttatgagcattttcctta

SEQ ID NO: 540319 - DNA, 25 bp, Rattus norvegicus
taaccgtttatgtgcattttcctta

SEQ ID NO: 540320 - DNA, 25 bp, Rattus norvegicus
taacctaacatccacggacttctgt

SEQ ID NO: 540321 - DNA, 25 bp, Rattus norvegicus
taacctaacatcgacggacttctgt

SEQ ID NO: 540322 - DNA, 25 bp, Rattus norvegicus
taacctaaggcaacagcgtctcaga

SEQ ID NO: 540323 - DNA, 25 bp, Rattus norvegicus
taacctaaggcatcagcgtctcaga

SEQ ID NO: 540324 - DNA, 25 bp, Rattus norvegicus
taacctaagtgcattctcctctgaa

SEQ ID NO: 540325 - DNA, 25 bp, Rattus norvegicus
taacctaagtgctttctcctctgaa

SEQ ID NO: 540326 - DNA, 25 bp, Rattus norvegicus
taacctacatgtcccaggtcagcta

SEQ ID NO: 540327 - DNA, 25 bp, Rattus norvegicus
taacctacatgtgccaggtcagcta

SEQ ID NO: 540328 - DNA, 25 bp, Rattus norvegicus
taacctactattaatcaccagctgt

SEQ ID NO: 540329 - DNA, 25 bp, Rattus norvegicus
taacctactatttatcaccagctgt

SEQ ID NO: 540330 - DNA, 25 bp, Rattus norvegicus
taacctagacttagtgtttcagaga

SEQ ID NO: 540331 - DNA, 25 bp, Rattus norvegicus
taacctagactttgtgtttcagaga

SEQ ID NO: 540332 - DNA, 25 bp, Rattus norvegicus
taacctaggcttactccacttatat

SEQ ID NO: 540333 - DNA, 25 bp, Rattus norvegicus
taacctaggctttctccacttatat

SEQ ID NO: 540334 - DNA, 25 bp, Rattus norvegicus
taacctagtggtcgtcaactccctg

SEQ ID NO: 540335 - DNA, 25 bp, Rattus norvegicus
taacctagtggtggtcaactccctg

SEQ ID NO: 540336 - DNA, 25 bp, Rattus norvegicus
taacctagttctatatctctccttt

SEQ ID NO: 540337 - DNA, 25 bp, Rattus norvegicus
taacctagttctttatctctccttt

SEQ ID NO: 540338 - DNA, 25 bp, Rattus norvegicus
taacctagtttcctaacatcaattt

SEQ ID NO: 540339 - DNA, 25 bp, Rattus norvegicus
taacctagtttcgtaacatcaattt

SEQ ID NO: 540340 - DNA, 25 bp, Rattus norvegicus
taacctatggtcactttgcacaaac

SEQ ID NO: 540341 - DNA, 25 bp, Rattus norvegicus
taacctatggtctctttgcacaaac

SEQ ID NO: 540342 - DNA, 25 bp, Rattus norvegicus
taacctcagactatatcacacagcc

SEQ ID NO: 540343 - DNA, 25 bp, Rattus norvegicus
taacctcagactttatcacacagcc

SEQ ID NO: 540344 - DNA, 25 bp, Rattus norvegicus
taacctcagtacatcaaaggcaggg

SEQ ID NO: 540345 - DNA, 25 bp, Rattus norvegicus
taacctcagtacttcaaaggcaggg

SEQ ID NO: 540346 - DNA, 25 bp, Rattus norvegicus
taacctcatcccagcacaatggcag

SEQ ID NO: 540347 - DNA, 25 bp, Rattus norvegicus
taacctcatccctgcacaatggcag

SEQ ID NO: 540348 - DNA, 25 bp, Rattus norvegicus
taacctcattggagctaaccggctg

SEQ ID NO: 540349 - DNA, 25 bp, Rattus norvegicus
taacctcattggtgctaaccggctg

SEQ ID NO: 540350 - DNA, 25 bp, Rattus norvegicus
taacctcattgtatatggtcatgct

SEQ ID NO: 540351 - DNA, 25 bp, Rattus norvegicus
taacctcattgtttatggtcatgct

SEQ ID NO: 540352 - DNA, 25 bp, Rattus norvegicus
taacctccagcgactcggaatgtga

SEQ ID NO: 540353 - DNA, 25 bp, Rattus norvegicus
taacctccagcgtctcggaatgtga

SEQ ID NO: 540354 - DNA, 25 bp, Rattus norvegicus
taacctccatccaaagtcacagtga

SEQ ID NO: 540355 - DNA, 25 bp, Rattus norvegicus
taacctccatcctaagtcacagtga

SEQ ID NO: 540356 - DNA, 25 bp, Rattus norvegicus
taacctcccctgctgcattttcaat

SEQ ID NO: 540357 - DNA, 25 bp, Rattus norvegicus
taacctcccctggtgcattttcaat

SEQ ID NO: 540358 - DNA, 25 bp, Rattus norvegicus
taacctccctcaacaaggtatacct

SEQ ID NO: 540359 - DNA, 25 bp, Rattus norvegicus
taacctccctcatcaaggtatacct

SEQ ID NO: 540360 - DNA, 25 bp, Rattus norvegicus
taacctcccttgcaaagtcctgaat

SEQ ID NO: 540361 - DNA, 25 bp, Rattus norvegicus
taacctcccttggaaagtcctgaat

SEQ ID NO: 540362 - DNA, 25 bp, Rattus norvegicus
taacctcctactattgctagggtgg

SEQ ID NO: 540363 - DNA, 25 bp, Rattus norvegicus
taacctcctacttttgctagggtgg

SEQ ID NO: 540364 - DNA, 25 bp, Rattus norvegicus
taacctcctgagagcctggcttatt

SEQ ID NO: 540365 - DNA, 25 bp, Rattus norvegicus
taacctcctgagtgcctggcttatt

SEQ ID NO: 540366 - DNA, 25 bp, Rattus norvegicus
taacctcctgcaaagtcccggatgg

SEQ ID NO: 540367 - DNA, 25 bp, Rattus norvegicus
taacctcctgcatagtcccggatgg

SEQ ID NO: 540368 - DNA, 25 bp, Rattus norvegicus
taacctcctgttccctacaaagtga

SEQ ID NO: 540369 - DNA, 25 bp, Rattus norvegicus
taacctcctgttgcctacaaagtga

SEQ ID NO: 540370 - DNA, 25 bp, Rattus norvegicus
taacctccttctatgcctgcatata

SEQ ID NO: 540371 - DNA, 25 bp, Rattus norvegicus
taacctccttctttgcctgcatata

SEQ ID NO: 540372 - DNA, 25 bp, Rattus norvegicus
taacctcctttcctctgagtgtatc

SEQ ID NO: 540373 - DNA, 25 bp, Rattus norvegicus
taacctcctttcgtctgagtgtatc

SEQ ID NO: 540374 - DNA, 25 bp, Rattus norvegicus
taacctctagcaagaagtgaccagt

SEQ ID NO: 540375 - DNA, 25 bp, Rattus norvegicus
taacctctagcatgaagtgaccagt

SEQ ID NO: 540376 - DNA, 25 bp, Rattus norvegicus
taacctctcaaacattgtttccatc

SEQ ID NO: 540377 - DNA, 25 bp, Rattus norvegicus
taacctctcaaagattgtttccatc

SEQ ID NO: 540378 - DNA, 25 bp, Rattus norvegicus
taacctctccagagagagccgttgt

SEQ ID NO: 540379 - DNA, 25 bp, Rattus norvegicus
taacctctccagtgagagccgttgt

SEQ ID NO: 540380 - DNA, 25 bp, Rattus norvegicus
taacctctctgtctcttacatctat

SEQ ID NO: 540381 - DNA, 25 bp, Rattus norvegicus
taacctctctgtgtcttacatctat

SEQ ID NO: 540382 - DNA, 25 bp, Rattus norvegicus
taacctctgcagctggtacaaggac

SEQ ID NO: 540383 - DNA, 25 bp, Rattus norvegicus
taacctctgcaggtggtacaaggac

SEQ ID NO: 540384 - DNA, 25 bp, Rattus norvegicus
taacctctggcaatctgtgcttatt

SEQ ID NO: 540385 - DNA, 25 bp, Rattus norvegicus
taacctctggcattctgtgcttatt

SEQ ID NO: 540386 - DNA, 25 bp, Rattus norvegicus
taacctctgggaataatctctttga

SEQ ID NO: 540387 - DNA, 25 bp, Rattus norvegicus
taacctctgggattaatctctttga

SEQ ID NO: 540388 - DNA, 25 bp, Rattus norvegicus
taacctctgtgacctattcgtccac

SEQ ID NO: 540389 - DNA, 25 bp, Rattus norvegicus
taacctctgtgacctgtaactttgc

SEQ ID NO: 540390 - DNA, 25 bp, Rattus norvegicus
taacctctgtgagctattcgtccac

SEQ ID NO: 540391 - DNA, 25 bp, Rattus norvegicus
taacctctgtgagctgtaactttgc

SEQ ID NO: 540392 - DNA, 25 bp, Rattus norvegicus
taacctctgtgtacctcaagcagga

SEQ ID NO: 540393 - DNA, 25 bp, Rattus norvegicus
taacctctgtgttcctcaagcagga

SEQ ID NO: 540394 - DNA, 25 bp, Rattus norvegicus
taacctcttgttcgcgtgctctaag

SEQ ID NO: 540395 - DNA, 25 bp, Rattus norvegicus
taacctcttgttggcgtgctctaag

SEQ ID NO: 540396 - DNA, 25 bp, Rattus norvegicus
taacctctttcccttcttacctgag

SEQ ID NO: 540397 - DNA, 25 bp, Rattus norvegicus
taacctctttccgttcttacctgag

SEQ ID NO: 540398 - DNA, 25 bp, Rattus norvegicus
taacctgaaatcactggttcaccca

SEQ ID NO: 540399 - DNA, 25 bp, Rattus norvegicus
taacctgaaatctctggttcaccca

SEQ ID NO: 540400 - DNA, 25 bp, Rattus norvegicus
taacctgaagaactccggcatctcc

SEQ ID NO: 540401 - DNA, 25 bp, Rattus norvegicus
taacctgaagaagtccggcatctcc

SEQ ID NO: 540402 - DNA, 25 bp, Rattus norvegicus
taacctgaaggaagttggctacaat

SEQ ID NO: 540403 - DNA, 25 bp, Rattus norvegicus
taacctgaaggatgttggctacaat

SEQ ID NO: 540404 - DNA, 25 bp, Rattus norvegicus
taacctgaccttcgctgggctctga

SEQ ID NO: 540405 - DNA, 25 bp, Rattus norvegicus
taacctgaccttggctgggctctga

SEQ ID NO: 540406 - DNA, 25 bp, Rattus norvegicus
taacctgacggaagcttgtgaacat

SEQ ID NO: 540407 - DNA, 25 bp, Rattus norvegicus
taacctgacggatgcttgtgaacat

SEQ ID NO: 540408 - DNA, 25 bp, Rattus norvegicus
taacctgacttacctggccctggga

SEQ ID NO: 540409 - DNA, 25 bp, Rattus norvegicus
taacctgacttagctggccctggga

SEQ ID NO: 540410 - DNA, 25 bp, Rattus norvegicus
taacctgagaccctgggagctcaca

SEQ ID NO: 540411 - DNA, 25 bp, Rattus norvegicus
taacctgagaccgtgggagctcaca

SEQ ID NO: 540412 - DNA, 25 bp, Rattus norvegicus
taacctgagctaaatctgaagattt

SEQ ID NO: 540413 - DNA, 25 bp, Rattus norvegicus
taacctgagctatatctgaagattt

SEQ ID NO: 540414 - DNA, 25 bp, Rattus norvegicus
taacctgagtgcagtggagcgctat

SEQ ID NO: 540415 - DNA, 25 bp, Rattus norvegicus
taacctgagtgctgtggagcgctat

SEQ ID NO: 540416 - DNA, 25 bp, Rattus norvegicus
taacctgcatgaacccatctgcata

SEQ ID NO: 540417 - DNA, 25 bp, Rattus norvegicus
taacctgcatgatcccatctgcata

SEQ ID NO: 540418 - DNA, 25 bp, Rattus norvegicus
taacctgccaagacatacaatgtca

SEQ ID NO: 540419 - DNA, 25 bp, Rattus norvegicus
taacctgccaagtcatacaatgtca

SEQ ID NO: 540420 - DNA, 25 bp, Rattus norvegicus
taacctgccaatcagatctgtgaaa

SEQ ID NO: 540421 - DNA, 25 bp, Rattus norvegicus
taacctgccaatgagatctgtgaaa

SEQ ID NO: 540422 - DNA, 25 bp, Rattus norvegicus
taacctgccagacttagatgtgaaa

SEQ ID NO: 540423 - DNA, 25 bp, Rattus norvegicus
taacctgccagagttagatgtgaaa

SEQ ID NO: 540424 - DNA, 25 bp, Rattus norvegicus
taacctgcccaaacggttcaatatg

SEQ ID NO: 540425 - DNA, 25 bp, Rattus norvegicus
taacctgcccaatcggttcaatatg

SEQ ID NO: 540426 - DNA, 25 bp, Rattus norvegicus
taacctgcccagcaactctgactag

SEQ ID NO: 540427 - DNA, 25 bp, Rattus norvegicus
taacctgcccaggaactctgactag

SEQ ID NO: 540428 - DNA, 25 bp, Rattus norvegicus
taacctgccgtgatacaatgcttca

SEQ ID NO: 540429 - DNA, 25 bp, Rattus norvegicus
taacctgccgtgttacaatgcttca

SEQ ID NO: 540430 - DNA, 25 bp, Rattus norvegicus
taacctgccttgactttaccagcat

SEQ ID NO: 540431 - DNA, 25 bp, Rattus norvegicus
taacctgccttgtctttaccagcat

SEQ ID NO: 540432 - DNA, 25 bp, Rattus norvegicus
taacctgcgctaccgttgcaatgat

SEQ ID NO: 540433 - DNA, 25 bp, Rattus norvegicus
taacctgcgctagcgttgcaatgat

SEQ ID NO: 540434 - DNA, 25 bp, Rattus norvegicus
taacctgctgttccgagtgaaccac

SEQ ID NO: 540435 - DNA, 25 bp, Rattus norvegicus
taacctgctgttgcgagtgaaccac

SEQ ID NO: 540436 - DNA, 25 bp, Rattus norvegicus
taacctgctttaattcattgggatt

SEQ ID NO: 540437 - DNA, 25 bp, Rattus norvegicus
taacctgctttatttcattgggatt

SEQ ID NO: 540438 - DNA, 25 bp, Rattus norvegicus
taacctggacaaccaaggtccctca

SEQ ID NO: 540439 - DNA, 25 bp, Rattus norvegicus
taacctggacaagcaaggtccctca

SEQ ID NO: 540440 - DNA, 25 bp, Rattus norvegicus
taacctggacatcgtggcgcgtgat

SEQ ID NO: 540441 - DNA, 25 bp, Rattus norvegicus
taacctggacatggtggcgcgtgat

SEQ ID NO: 540442 - DNA, 25 bp, Rattus norvegicus
taacctggaggaataccactccctg

SEQ ID NO: 540443 - DNA, 25 bp, Rattus norvegicus
taacctggaggattaccactccctg

SEQ ID NO: 540444 - DNA, 25 bp, Rattus norvegicus
taacctggcagacccactctgaggt

SEQ ID NO: 540445 - DNA, 25 bp, Rattus norvegicus
taacctggcagagccactctgaggt

SEQ ID NO: 540446 - DNA, 25 bp, Rattus norvegicus
taacctggccgtagactgagcattt

SEQ ID NO: 540447 - DNA, 25 bp, Rattus norvegicus
taacctggccgttgactgagcattt

SEQ ID NO: 540448 - DNA, 25 bp, Rattus norvegicus
taacctggccttaagctgtttagtt

SEQ ID NO: 540449 - DNA, 25 bp, Rattus norvegicus
taacctggcctttagctgtttagtt

SEQ ID NO: 540450 - DNA, 25 bp, Rattus norvegicus
taacctggcttcagtggtatggtgt

SEQ ID NO: 540451 - DNA, 25 bp, Rattus norvegicus
taacctggcttctgtggtatggtgt

SEQ ID NO: 540452 - DNA, 25 bp, Rattus norvegicus
taacctggctttacccatttcaact

SEQ ID NO: 540453 - DNA, 25 bp, Rattus norvegicus
taacctggcttttcccatttcaact

SEQ ID NO: 540454 - DNA, 25 bp, Rattus norvegicus
taacctgggacacttgatacgctgt

SEQ ID NO: 540455 - DNA, 25 bp, Rattus norvegicus
taacctgggacagttgatacgctgt

SEQ ID NO: 540456 - DNA, 25 bp, Rattus norvegicus
taacctgggatacaaaaacgactgt

SEQ ID NO: 540457 - DNA, 25 bp, Rattus norvegicus
taacctgggatagaaaaacgactgt

SEQ ID NO: 540458 - DNA, 25 bp, Rattus norvegicus
taacctggtctaaatgccgactcct

SEQ ID NO: 540459 - DNA, 25 bp, Rattus norvegicus
taacctggtctatatgccgactcct

SEQ ID NO: 540460 - DNA, 25 bp, Rattus norvegicus
taacctggtctcagatgagccctgt

SEQ ID NO: 540461 - DNA, 25 bp, Rattus norvegicus
taacctggtctctgatgagccctgt

SEQ ID NO: 540462 - DNA, 25 bp, Rattus norvegicus
taacctggtcttcacctactgaagg

SEQ ID NO: 540463 - DNA, 25 bp, Rattus norvegicus
taacctggtcttgacctactgaagg

SEQ ID NO: 540464 - DNA, 25 bp, Rattus norvegicus
taacctggtgagaggtgaagcagcc

SEQ ID NO: 540465 - DNA, 25 bp, Rattus norvegicus
taacctggtgagtggtgaagcagcc

SEQ ID NO: 540466 - DNA, 25 bp, Rattus norvegicus
taacctgtccacaaacgcgggtgat

SEQ ID NO: 540467 - DNA, 25 bp, Rattus norvegicus
taacctgtccactaacgcgggtgat

SEQ ID NO: 540468 - DNA, 25 bp, Rattus norvegicus
taacctgtcgccatttctcatttat

SEQ ID NO: 540469 - DNA, 25 bp, Rattus norvegicus
taacctgtcgccttttctcatttat

SEQ ID NO: 540470 - DNA, 25 bp, Rattus norvegicus
taacctgtctacagatggcgaaagc

SEQ ID NO: 540471 - DNA, 25 bp, Rattus norvegicus
taacctgtctactgatggcgaaagc

SEQ ID NO: 540472 - DNA, 25 bp, Rattus norvegicus
taacctgtgaatagtcctcttccat

SEQ ID NO: 540473 - DNA, 25 bp, Rattus norvegicus
taacctgtgaattgtcctcttccat

SEQ ID NO: 540474 - DNA, 25 bp, Rattus norvegicus
taacctgtgatgatgcctagagctg

SEQ ID NO: 540475 - DNA, 25 bp, Rattus norvegicus
taacctgtgatgttgcctagagctg

SEQ ID NO: 540476 - DNA, 25 bp, Rattus norvegicus
taacctgtgtagataccctttcctc

SEQ ID NO: 540477 - DNA, 25 bp, Rattus norvegicus
taacctgtgtagttaccctttcctc

SEQ ID NO: 540478 - DNA, 25 bp, Rattus norvegicus
taacctgtgtctccgaagtcctatg

SEQ ID NO: 540479 - DNA, 25 bp, Rattus norvegicus
taacctgtgtctgcgaagtcctatg

SEQ ID NO: 540480 - DNA, 25 bp, Rattus norvegicus
taacctgtgtttcaaagcttttcct

SEQ ID NO: 540481 - DNA, 25 bp, Rattus norvegicus
taacctgtgtttgaaagcttttcct

SEQ ID NO: 540482 - DNA, 25 bp, Rattus norvegicus
taacctgttctaactgtccctggga

SEQ ID NO: 540483 - DNA, 25 bp, Rattus norvegicus
taacctgttctatctgtccctggga

SEQ ID NO: 540484 - DNA, 25 bp, Rattus norvegicus
taacctgttctgagccaaactggca

SEQ ID NO: 540485 - DNA, 25 bp, Rattus norvegicus
taacctgttctgtgccaaactggca

SEQ ID NO: 540486 - DNA, 25 bp, Rattus norvegicus
taacctgttgttcatatccattgtc

SEQ ID NO: 540487 - DNA, 25 bp, Rattus norvegicus
taacctgttgttgatatccattgtc

SEQ ID NO: 540488 - DNA, 25 bp, Rattus norvegicus
taaccttaaggtcctttgcctggat

SEQ ID NO: 540489 - DNA, 25 bp, Rattus norvegicus
taaccttaaggtgctttgcctggat

SEQ ID NO: 540490 - DNA, 25 bp, Rattus norvegicus
taaccttacgcaccgtgacctattc

SEQ ID NO: 540491 - DNA, 25 bp, Rattus norvegicus
taaccttacgcagcgtgacctattc

SEQ ID NO: 540492 - DNA, 25 bp, Rattus norvegicus
taaccttcaggacaatgtggctact

SEQ ID NO: 540493 - DNA, 25 bp, Rattus norvegicus
taaccttcaggagaatgtggctact

SEQ ID NO: 540494 - DNA, 25 bp, Rattus norvegicus
taaccttccctcataagatctgcaa

SEQ ID NO: 540495 - DNA, 25 bp, Rattus norvegicus
taaccttccctcttaagatctgcaa

SEQ ID NO: 540496 - DNA, 25 bp, Rattus norvegicus
taaccttcggatagggcactgcctg

SEQ ID NO: 540497 - DNA, 25 bp, Rattus norvegicus
taaccttcggattgggcactgcctg

SEQ ID NO: 540498 - DNA, 25 bp, Rattus norvegicus
taaccttctggtaacatggtgtcat

SEQ ID NO: 540499 - DNA, 25 bp, Rattus norvegicus
taaccttctggttacatggtgtcat

SEQ ID NO: 540500 - DNA, 25 bp, Rattus norvegicus
taaccttctgtgacttcgtctgtga

SEQ ID NO: 540501 - DNA, 25 bp, Rattus norvegicus
taaccttctgtgtcttcgtctgtga

SEQ ID NO: 540502 - DNA, 25 bp, Rattus norvegicus
taaccttctgttagttctcttcctg

SEQ ID NO: 540503 - DNA, 25 bp, Rattus norvegicus
taaccttctgtttgttctcttcctg

SEQ ID NO: 540504 - DNA, 25 bp, Rattus norvegicus
taaccttcttagattcctttctatg

SEQ ID NO: 540505 - DNA, 25 bp, Rattus norvegicus
taaccttcttagtttcctttctatg

SEQ ID NO: 540506 - DNA, 25 bp, Rattus norvegicus
taaccttcttttctgcttacctagt

SEQ ID NO: 540507 - DNA, 25 bp, Rattus norvegicus
taaccttcttttgtgcttacctagt

SEQ ID NO: 540508 - DNA, 25 bp, Rattus norvegicus
taaccttgcatgatgtcgcttgctt

SEQ ID NO: 540509 - DNA, 25 bp, Rattus norvegicus
taaccttgcatgttgtcgcttgctt

SEQ ID NO: 540510 - DNA, 25 bp, Rattus norvegicus
taaccttgtgttcagcttgcatgca

SEQ ID NO: 540511 - DNA, 25 bp, Rattus norvegicus
taaccttgtgttgagcttgcatgca

SEQ ID NO: 540512 - DNA, 25 bp, Rattus norvegicus
taaccttgttatctttccctcgact

SEQ ID NO: 540513 - DNA, 25 bp, Rattus norvegicus
taaccttgttatgtttccctcgact

SEQ ID NO: 540514 - DNA, 25 bp, Rattus norvegicus
taaccttgttcaacttcataccttg

SEQ ID NO: 540515 - DNA, 25 bp, Rattus norvegicus
taaccttgttcatcttcataccttg

SEQ ID NO: 540516 - DNA, 25 bp, Rattus norvegicus
taaccttgttctactgcttagtcgt

SEQ ID NO: 540517 - DNA, 25 bp, Rattus norvegicus
taaccttgttcttctgcttagtcgt

SEQ ID NO: 540518 - DNA, 25 bp, Rattus norvegicus
taacctttacttcaatcccagtgat

SEQ ID NO: 540519 - DNA, 25 bp, Rattus norvegicus
taacctttacttgaatcccagtgat

SEQ ID NO: 540520 - DNA, 25 bp, Rattus norvegicus
taacctttagccatcgtgtaaaatg

SEQ ID NO: 540521 - DNA, 25 bp, Rattus norvegicus
taacctttagccttcgtgtaaaatg

SEQ ID NO: 540522 - DNA, 25 bp, Rattus norvegicus
taacctttcaccatcagatctgcaa

SEQ ID NO: 540523 - DNA, 25 bp, Rattus norvegicus
taacctttcaccttcagatctgcaa

SEQ ID NO: 540524 - DNA, 25 bp, Rattus norvegicus
taacctttcccacacaagcaagttt

SEQ ID NO: 540525 - DNA, 25 bp, Rattus norvegicus
taacctttcccagacaagcaagttt

SEQ ID NO: 540526 - DNA, 25 bp, Rattus norvegicus
taacctttctccatagtacttactg

SEQ ID NO: 540527 - DNA, 25 bp, Rattus norvegicus
taacctttctccctatacttattga

SEQ ID NO: 540528 - DNA, 25 bp, Rattus norvegicus
taacctttctccgtatacttattga

SEQ ID NO: 540529 - DNA, 25 bp, Rattus norvegicus
taacctttctccttagtacttactg

SEQ ID NO: 540530 - DNA, 25 bp, Rattus norvegicus
taacctttcttacgcaatctgtgaa

SEQ ID NO: 540531 - DNA, 25 bp, Rattus norvegicus
taacctttcttaggcaatctgtgaa

SEQ ID NO: 540532 - DNA, 25 bp, Rattus norvegicus
taacctttgcttctatgttaccgaa

SEQ ID NO: 540533 - DNA, 25 bp, Rattus norvegicus
taacctttgcttgtatgttaccgaa

SEQ ID NO: 540534 - DNA, 25 bp, Rattus norvegicus
taaccttttcagaggccaccttttg

SEQ ID NO: 540535 - DNA, 25 bp, Rattus norvegicus
taaccttttcagtggccaccttttg

SEQ ID NO: 540536 - DNA, 25 bp, Rattus norvegicus
taaccttttctgctatgtcccacat

SEQ ID NO: 540537 - DNA, 25 bp, Rattus norvegicus
taaccttttctggtatgtcccacat

SEQ ID NO: 540538 - DNA, 25 bp, Rattus norvegicus
taaccttttttcctgtaatcgctcg

SEQ ID NO: 540539 - DNA, 25 bp, Rattus norvegicus
taaccttttttcgtgtaatcgctcg

SEQ ID NO: 540540 - DNA, 25 bp, Rattus norvegicus
taaccttttttgctgcttgccacat

SEQ ID NO: 540541 - DNA, 25 bp, Rattus norvegicus
taaccttttttggtgcttgccacat

SEQ ID NO: 540542 - DNA, 25 bp, Rattus norvegicus
taacgaaacagtagaggctccgtgt

SEQ ID NO: 540543 - DNA, 25 bp, Rattus norvegicus
taacgaaacagttgaggctccgtgt

SEQ ID NO: 540544 - DNA, 25 bp, Rattus norvegicus
taacgaaacgctaccccaagaattg

SEQ ID NO: 540545 - DNA, 25 bp, Rattus norvegicus
taacgaaacgcttccccaagaattg

SEQ ID NO: 540546 - DNA, 25 bp, Rattus norvegicus
taacgaaagcagaagcttctcattt

SEQ ID NO: 540547 - DNA, 25 bp, Rattus norvegicus
taacgaaagcagtagcttctcattt

SEQ ID NO: 540548 - DNA, 25 bp, Rattus norvegicus
taacgaagacagacccgatgggcac

SEQ ID NO: 540549 - DNA, 25 bp, Rattus norvegicus
taacgaagacagtcccgatgggcac

SEQ ID NO: 540550 - DNA, 25 bp, Rattus norvegicus
taacgaagtttcctagctcctgctc

SEQ ID NO: 540551 - DNA, 25 bp, Rattus norvegicus
taacgaagtttcgtagctcctgctc

SEQ ID NO: 540552 - DNA, 25 bp, Rattus norvegicus
taacgaatactgaccttttctaaat

SEQ ID NO: 540553 - DNA, 25 bp, Rattus norvegicus
taacgaatactgtccttttctaaat

SEQ ID NO: 540554 - DNA, 25 bp, Rattus norvegicus
taacgacaataccacggcttactct

SEQ ID NO: 540555 - DNA, 25 bp, Rattus norvegicus
taacgacaatacgacggcttactct

SEQ ID NO: 540556 - DNA, 25 bp, Rattus norvegicus
taacgacacgttaccattcatagaa

SEQ ID NO: 540557 - DNA, 25 bp, Rattus norvegicus
taacgacacgtttccattcatagaa

SEQ ID NO: 540558 - DNA, 25 bp, Rattus norvegicus
taacgaccaatgacttctctgcaag

SEQ ID NO: 540559 - DNA, 25 bp, Rattus norvegicus
taacgaccaatgtcttctctgcaag

SEQ ID NO: 540560 - DNA, 25 bp, Rattus norvegicus
taacgaccagctctgttctctgtca

SEQ ID NO: 540561 - DNA, 25 bp, Rattus norvegicus
taacgaccagctgtgttctctgtca

SEQ ID NO: 540562 - DNA, 25 bp, Rattus norvegicus
taacgaccaggtcggatcctgcttc

SEQ ID NO: 540563 - DNA, 25 bp, Rattus norvegicus
taacgaccaggtgggatcctgcttc

SEQ ID NO: 540564 - DNA, 25 bp, Rattus norvegicus
taacgactcggaagaggttgccagt

SEQ ID NO: 540565 - DNA, 25 bp, Rattus norvegicus
taacgactcggatgaggttgccagt

SEQ ID NO: 540566 - DNA, 25 bp, Rattus norvegicus
taacgacttgttagtttgcctccca

SEQ ID NO: 540567 - DNA, 25 bp, Rattus norvegicus
taacgacttgtttgtttgcctccca

SEQ ID NO: 540568 - DNA, 25 bp, Rattus norvegicus
taacgagagcctccggtatcagcct

SEQ ID NO: 540569 - DNA, 25 bp, Rattus norvegicus
taacgagagcctgcggtatcagcct

SEQ ID NO: 540570 - DNA, 25 bp, Rattus norvegicus
taacgagccctgacattttaagtag

SEQ ID NO: 540571 - DNA, 25 bp, Rattus norvegicus
taacgagccctgtcattttaagtag

SEQ ID NO: 540572 - DNA, 25 bp, Rattus norvegicus
taacgaggacccacagcctgggcag

SEQ ID NO: 540573 - DNA, 25 bp, Rattus norvegicus
taacgaggaccctcagcctgggcag

SEQ ID NO: 540574 - DNA, 25 bp, Rattus norvegicus
taacgagttacccaaagttcagtgg

SEQ ID NO: 540575 - DNA, 25 bp, Rattus norvegicus
taacgagttaccgaaagttcagtgg

SEQ ID NO: 540576 - DNA, 25 bp, Rattus norvegicus
taacgagttcttcactctgtgctca

SEQ ID NO: 540577 - DNA, 25 bp, Rattus norvegicus
taacgagttcttgactctgtgctca

SEQ ID NO: 540578 - DNA, 25 bp, Rattus norvegicus
taacgagtttctcaagtatacttgt

SEQ ID NO: 540579 - DNA, 25 bp, Rattus norvegicus
taacgagtttctgaagtatacttgt

SEQ ID NO: 540580 - DNA, 25 bp, Rattus norvegicus
taacgatatcagaagctccggaaag

SEQ ID NO: 540581 - DNA, 25 bp, Rattus norvegicus
taacgatatcagtagctccggaaag

SEQ ID NO: 540582 - DNA, 25 bp, Rattus norvegicus
taacgatcacggatacgacaacttc

SEQ ID NO: 540583 - DNA, 25 bp, Rattus norvegicus
taacgatcacggttacgacaacttc

SEQ ID NO: 540584 - DNA, 25 bp, Rattus norvegicus
taacgatgaggaatccagctgtagg

SEQ ID NO: 540585 - DNA, 25 bp, Rattus norvegicus
taacgatgaggattccagctgtagg

SEQ ID NO: 540586 - DNA, 25 bp, Rattus norvegicus
taacgatgccgcagactctacggta

SEQ ID NO: 540587 - DNA, 25 bp, Rattus norvegicus
taacgatgccgctgactctacggta

SEQ ID NO: 540588 - DNA, 25 bp, Rattus norvegicus
taacgatgctgccactgtgcatgcc

SEQ ID NO: 540589 - DNA, 25 bp, Rattus norvegicus
taacgatgctgcgactgtgcatgcc

SEQ ID NO: 540590 - DNA, 25 bp, Rattus norvegicus
taacgattggcactcacatggttct

SEQ ID NO: 540591 - DNA, 25 bp, Rattus norvegicus
taacgattggcagtcacatggttct

SEQ ID NO: 540592 - DNA, 25 bp, Rattus norvegicus
taacgattgtttatacgggtgcact

SEQ ID NO: 540593 - DNA, 25 bp, Rattus norvegicus
taacgattgtttttacgggtgcact

SEQ ID NO: 540594 - DNA, 25 bp, Rattus norvegicus
taacgcaaactaatgccacctgcat

SEQ ID NO: 540595 - DNA, 25 bp, Rattus norvegicus
taacgcaaactattgccacctgcat

SEQ ID NO: 540596 - DNA, 25 bp, Rattus norvegicus
taacgcaagttgctttctctcccta

SEQ ID NO: 540597 - DNA, 25 bp, Rattus norvegicus
taacgcaagttggtttctctcccta

SEQ ID NO: 540598 - DNA, 25 bp, Rattus norvegicus
taacgcaatcttcttaacgtcaatt

SEQ ID NO: 540599 - DNA, 25 bp, Rattus norvegicus
taacgcaatcttgttaacgtcaatt

SEQ ID NO: 540600 - DNA, 25 bp, Rattus norvegicus
taacgcacccctcaactgggagact

SEQ ID NO: 540601 - DNA, 25 bp, Rattus norvegicus
taacgcacccctgaactgggagact

SEQ ID NO: 540602 - DNA, 25 bp, Rattus norvegicus
taacgcaccgcaccggaggacatta

SEQ ID NO: 540603 - DNA, 25 bp, Rattus norvegicus
taacgcaccgcagcggaggacatta

SEQ ID NO: 540604 - DNA, 25 bp, Rattus norvegicus
taacgcaggcgacaggacaagccct

SEQ ID NO: 540605 - DNA, 25 bp, Rattus norvegicus
taacgcaggcgagaggacaagccct

SEQ ID NO: 540606 - DNA, 25 bp, Rattus norvegicus
taacgcagggttcgactccccagta

SEQ ID NO: 540607 - DNA, 25 bp, Rattus norvegicus
taacgcagggttggactccccagta

SEQ ID NO: 540608 - DNA, 25 bp, Rattus norvegicus
taacgcagttggcagactcgtcttt

SEQ ID NO: 540609 - DNA, 25 bp, Rattus norvegicus
taacgcagttgggagactcgtcttt

SEQ ID NO: 540610 - DNA, 25 bp, Rattus norvegicus
taacgcatacgtcgctgatggcact

SEQ ID NO: 540611 - DNA, 25 bp, Rattus norvegicus
taacgcatacgtggctgatggcact

SEQ ID NO: 540612 - DNA, 25 bp, Rattus norvegicus
taacgcatctaccatttctaccgat

SEQ ID NO: 540613 - DNA, 25 bp, Rattus norvegicus
taacgcatctacgatttctaccgat

SEQ ID NO: 540614 - DNA, 25 bp, Rattus norvegicus
taacgccaagcaccacgtgtatttt

SEQ ID NO: 540615 - DNA, 25 bp, Rattus norvegicus
taacgccaagcagcacgtgtatttt

SEQ ID NO: 540616 - DNA, 25 bp, Rattus norvegicus
taacgccaatttacggagagggatg

SEQ ID NO: 540617 - DNA, 25 bp, Rattus norvegicus
taacgccaattttcggagagggatg

SEQ ID NO: 540618 - DNA, 25 bp, Rattus norvegicus
taacgccagcgtaagatggagaact

SEQ ID NO: 540619 - DNA, 25 bp, Rattus norvegicus
taacgccagcgttagatggagaact

SEQ ID NO: 540620 - DNA, 25 bp, Rattus norvegicus
taacgccccaaactaacgcaagtct

SEQ ID NO: 540621 - DNA, 25 bp, Rattus norvegicus
taacgccccaaagtaacgcaagtct

SEQ ID NO: 540622 - DNA, 25 bp, Rattus norvegicus
taacgcccctgccaggcatactgga

SEQ ID NO: 540623 - DNA, 25 bp, Rattus norvegicus
taacgcccctgcgaggcatactgga

SEQ ID NO: 540624 - DNA, 25 bp, Rattus norvegicus
taacgccgacctaaaggttcaggat

SEQ ID NO: 540625 - DNA, 25 bp, Rattus norvegicus
taacgccgaccttaaggttcaggat

SEQ ID NO: 540626 - DNA, 25 bp, Rattus norvegicus
taacgcctagatagtcccacttctg

SEQ ID NO: 540627 - DNA, 25 bp, Rattus norvegicus
taacgcctagattgtcccacttctg

SEQ ID NO: 540628 - DNA, 25 bp, Rattus norvegicus
taacgcctgaggctagtcggcaaga

SEQ ID NO: 540629 - DNA, 25 bp, Rattus norvegicus
taacgcctgagggtagtcggcaaga

SEQ ID NO: 540630 - DNA, 25 bp, Rattus norvegicus
taacgccttgctacaactttaactg

SEQ ID NO: 540631 - DNA, 25 bp, Rattus norvegicus
taacgccttgcttcaactttaactg

SEQ ID NO: 540632 - DNA, 25 bp, Rattus norvegicus
taacgcggcgggagccgaactgcta

SEQ ID NO: 540633 - DNA, 25 bp, Rattus norvegicus
taacgcggcgggtgccgaactgcta

SEQ ID NO: 540634 - DNA, 25 bp, Rattus norvegicus
taacgcgtgattctgatgtcctgtc

SEQ ID NO: 540635 - DNA, 25 bp, Rattus norvegicus
taacgcgtgattgtgatgtcctgtc

SEQ ID NO: 540636 - DNA, 25 bp, Rattus norvegicus
taacgctcaccacctgaaagttcta

SEQ ID NO: 540637 - DNA, 25 bp, Rattus norvegicus
taacgctcaccagctgaaagttcta

SEQ ID NO: 540638 - DNA, 25 bp, Rattus norvegicus
taacgctcagctccctataggaatc

SEQ ID NO: 540639 - DNA, 25 bp, Rattus norvegicus
taacgctcagctgcctataggaatc

SEQ ID NO: 540640 - DNA, 25 bp, Rattus norvegicus
taacgctcccaaccaccaatgtttt

SEQ ID NO: 540641 - DNA, 25 bp, Rattus norvegicus
taacgctcccaagcaccaatgtttt

SEQ ID NO: 540642 - DNA, 25 bp, Rattus norvegicus
taacgctcggtgacgacggtctgtg

SEQ ID NO: 540643 - DNA, 25 bp, Rattus norvegicus
taacgctcggtgtcgacggtctgtg

SEQ ID NO: 540644 - DNA, 25 bp, Rattus norvegicus
taacgctctggtccacccggaggtg

SEQ ID NO: 540645 - DNA, 25 bp, Rattus norvegicus
taacgctctggtgcacccggaggtg

SEQ ID NO: 540646 - DNA, 25 bp, Rattus norvegicus
taacgctgacataaatccacaatta

SEQ ID NO: 540647 - DNA, 25 bp, Rattus norvegicus
taacgctgacattaatccacaatta

SEQ ID NO: 540648 - DNA, 25 bp, Rattus norvegicus
taacgctgtactaggcttactgtgg

SEQ ID NO: 540649 - DNA, 25 bp, Rattus norvegicus
taacgctgtacttggcttactgtgg

SEQ ID NO: 540650 - DNA, 25 bp, Rattus norvegicus
taacgcttgtttcaggatagggaca

SEQ ID NO: 540651 - DNA, 25 bp, Rattus norvegicus
taacgcttgtttgaggatagggaca

SEQ ID NO: 540652 - DNA, 25 bp, Rattus norvegicus
taacgctttaatcccttggaatttt

SEQ ID NO: 540653 - DNA, 25 bp, Rattus norvegicus
taacgctttaatgccttggaatttt

SEQ ID NO: 540654 - DNA, 25 bp, Rattus norvegicus
taacggaactgcctcttaaaaggca

SEQ ID NO: 540655 - DNA, 25 bp, Rattus norvegicus
taacggaactgcgtcttaaaaggca

SEQ ID NO: 540656 - DNA, 25 bp, Rattus norvegicus
taacggacaggcaggtgtcggcttc

SEQ ID NO: 540657 - DNA, 25 bp, Rattus norvegicus
taacggacaggctggtgtcggcttc

SEQ ID NO: 540658 - DNA, 25 bp, Rattus norvegicus
taacggacctcgaagagtaactcag

SEQ ID NO: 540659 - DNA, 25 bp, Rattus norvegicus
taacggacctcgtagagtaactcag

SEQ ID NO: 540660 - DNA, 25 bp, Rattus norvegicus
taacggactcgcacttcctgtgggt

SEQ ID NO: 540661 - DNA, 25 bp, Rattus norvegicus
taacggactcgctcttcctgtgggt

SEQ ID NO: 540662 - DNA, 25 bp, Rattus norvegicus
taacggactgaaacctcatgaatgt

SEQ ID NO: 540663 - DNA, 25 bp, Rattus norvegicus
taacggactgaatcctcatgaatgt

SEQ ID NO: 540664 - DNA, 25 bp, Rattus norvegicus
taacggacttcaaactctatgcctc

SEQ ID NO: 540665 - DNA, 25 bp, Rattus norvegicus
taacggacttcatactctatgcctc

SEQ ID NO: 540666 - DNA, 25 bp, Rattus norvegicus
taacggacttccagtggtggaccag

SEQ ID NO: 540667 - DNA, 25 bp, Rattus norvegicus
taacggacttcctgtggtggaccag

SEQ ID NO: 540668 - DNA, 25 bp, Rattus norvegicus
taacggacttgaaggaactgacgga

SEQ ID NO: 540669 - DNA, 25 bp, Rattus norvegicus
taacggacttgatggaactgacgga

SEQ ID NO: 540670 - DNA, 25 bp, Rattus norvegicus
taacggatggttctgactcttagga

SEQ ID NO: 540671 - DNA, 25 bp, Rattus norvegicus
taacggatggttgtgactcttagga

SEQ ID NO: 540672 - DNA, 25 bp, Rattus norvegicus
taacggcagcccattggaggactgt

SEQ ID NO: 540673 - DNA, 25 bp, Rattus norvegicus
taacggcagccctttggaggactgt

SEQ ID NO: 540674 - DNA, 25 bp, Rattus norvegicus
taacggcagctgacctggcggaagt

SEQ ID NO: 540675 - DNA, 25 bp, Rattus norvegicus
taacggcagctgtcctggcggaagt

SEQ ID NO: 540676 - DNA, 25 bp, Rattus norvegicus
taacggctctttaactctgagctgt

SEQ ID NO: 540677 - DNA, 25 bp, Rattus norvegicus
taacggctcttttactctgagctgt

SEQ ID NO: 540678 - DNA, 25 bp, Rattus norvegicus
taacgggacagccagtctctatgac

SEQ ID NO: 540679 - DNA, 25 bp, Rattus norvegicus
taacgggacagcgagtctctatgac

SEQ ID NO: 540680 - DNA, 25 bp, Rattus norvegicus
taacgggaccggagtgcagacccaa

SEQ ID NO: 540681 - DNA, 25 bp, Rattus norvegicus
taacgggaccggtgtgcagacccaa

SEQ ID NO: 540682 - DNA, 25 bp, Rattus norvegicus
taacgggactgtcccatcatctttc

SEQ ID NO: 540683 - DNA, 25 bp, Rattus norvegicus
taacgggactgtgccatcatctttc

SEQ ID NO: 540684 - DNA, 25 bp, Rattus norvegicus
taacgggccaaactaggaccagagg

SEQ ID NO: 540685 - DNA, 25 bp, Rattus norvegicus
taacgggccaaagtaggaccagagg

SEQ ID NO: 540686 - DNA, 25 bp, Rattus norvegicus
taacgggcttatccaagttgtgttt

SEQ ID NO: 540687 - DNA, 25 bp, Rattus norvegicus
taacgggcttatgcaagttgtgttt

SEQ ID NO: 540688 - DNA, 25 bp, Rattus norvegicus
taacgggcttccacgagaacaggca

SEQ ID NO: 540689 - DNA, 25 bp, Rattus norvegicus
taacgggcttcctcgagaacaggca

SEQ ID NO: 540690 - DNA, 25 bp, Rattus norvegicus
taacgtaagttgactctcttctcac

SEQ ID NO: 540691 - DNA, 25 bp, Rattus norvegicus
taacgtaagttgtctctcttctcac

SEQ ID NO: 540692 - DNA, 25 bp, Rattus norvegicus
taacgtaccatcaaggctgccaagc

SEQ ID NO: 540693 - DNA, 25 bp, Rattus norvegicus
taacgtaccatctaggctgccaagc

SEQ ID NO: 540694 - DNA, 25 bp, Rattus norvegicus
taacgtacttgcacaggcgcttatg

SEQ ID NO: 540695 - DNA, 25 bp, Rattus norvegicus
taacgtacttgctcaggcgcttatg

SEQ ID NO: 540696 - DNA, 25 bp, Rattus norvegicus
taacgtagtgtcctctttttgggag

SEQ ID NO: 540697 - DNA, 25 bp, Rattus norvegicus
taacgtagtgtcgtctttttgggag

SEQ ID NO: 540698 - DNA, 25 bp, Rattus norvegicus
taacgtatcatacaccaaacagtaa

SEQ ID NO: 540699 - DNA, 25 bp, Rattus norvegicus
taacgtatcatagaccaaacagtaa

SEQ ID NO: 540700 - DNA, 25 bp, Rattus norvegicus
taacgtatctatcttccaggtggct

SEQ ID NO: 540701 - DNA, 25 bp, Rattus norvegicus
taacgtatctatgttccaggtggct

SEQ ID NO: 540702 - DNA, 25 bp, Rattus norvegicus
taacgtatgtttctgcttgctgtgc

SEQ ID NO: 540703 - DNA, 25 bp, Rattus norvegicus
taacgtatgtttgtgcttgctgtgc

SEQ ID NO: 540704 - DNA, 25 bp, Rattus norvegicus
taacgtattcatcctcagagggcca

SEQ ID NO: 540705 - DNA, 25 bp, Rattus norvegicus
taacgtattcatgctcagagggcca

SEQ ID NO: 540706 - DNA, 25 bp, Rattus norvegicus
taacgtcctggactgaacagccaat

SEQ ID NO: 540707 - DNA, 25 bp, Rattus norvegicus
taacgtcctggagtgaacagccaat

SEQ ID NO: 540708 - DNA, 25 bp, Rattus norvegicus
taacgtcctggcatcttttgttaag

SEQ ID NO: 540709 - DNA, 25 bp, Rattus norvegicus
taacgtcctggcttcttttgttaag

SEQ ID NO: 540710 - DNA, 25 bp, Rattus norvegicus
taacgtcggttcacactgcttctgt

SEQ ID NO: 540711 - DNA, 25 bp, Rattus norvegicus
taacgtcggttctcactgcttctgt

SEQ ID NO: 540712 - DNA, 25 bp, Rattus norvegicus
taacgtctgccgagatagcttgcca

SEQ ID NO: 540713 - DNA, 25 bp, Rattus norvegicus
taacgtctgccgtgatagcttgcca

SEQ ID NO: 540714 - DNA, 25 bp, Rattus norvegicus
taacgtctgtctagttttcctccct

SEQ ID NO: 540715 - DNA, 25 bp, Rattus norvegicus
taacgtctgtcttgttttcctccct

SEQ ID NO: 540716 - DNA, 25 bp, Rattus norvegicus
taacgtctgtgcaccaaccatgaga

SEQ ID NO: 540717 - DNA, 25 bp, Rattus norvegicus
taacgtctgtgctccaaccatgaga

SEQ ID NO: 540718 - DNA, 25 bp, Rattus norvegicus
taacgtcttgacacttacttaatac

SEQ ID NO: 540719 - DNA, 25 bp, Rattus norvegicus
taacgtcttgactcttacttaatac

SEQ ID NO: 540720 - DNA, 25 bp, Rattus norvegicus
taacgtctttaccttcgtcaacttg

SEQ ID NO: 540721 - DNA, 25 bp, Rattus norvegicus
taacgtctttacgttcgtcaacttg

SEQ ID NO: 540722 - DNA, 25 bp, Rattus norvegicus
taacgtgaccatctgggacctccct

SEQ ID NO: 540723 - DNA, 25 bp, Rattus norvegicus
taacgtgaccatgtgggacctccct

SEQ ID NO: 540724 - DNA, 25 bp, Rattus norvegicus
taacgtgaccctcctgattcaagaa

SEQ ID NO: 540725 - DNA, 25 bp, Rattus norvegicus
taacgtgaccctgctgattcaagaa

SEQ ID NO: 540726 - DNA, 25 bp, Rattus norvegicus
taacgtgactggagtccggtgccca

SEQ ID NO: 540727 - DNA, 25 bp, Rattus norvegicus
taacgtgactggtgtccggtgccca

SEQ ID NO: 540728 - DNA, 25 bp, Rattus norvegicus
taacgtgagcctattgttgcctgtc

SEQ ID NO: 540729 - DNA, 25 bp, Rattus norvegicus
taacgtgagccttttgttgcctgtc

SEQ ID NO: 540730 - DNA, 25 bp, Rattus norvegicus
taacgtgatcaacctttaagtgcct

SEQ ID NO: 540731 - DNA, 25 bp, Rattus norvegicus
taacgtgatcaagctttaagtgcct

SEQ ID NO: 540732 - DNA, 25 bp, Rattus norvegicus
taacgtgccttcctgatattggtcc

SEQ ID NO: 540733 - DNA, 25 bp, Rattus norvegicus
taacgtgccttcgtgatattggtcc

SEQ ID NO: 540734 - DNA, 25 bp, Rattus norvegicus
taacgtgggctacctacgagtggat

SEQ ID NO: 540735 - DNA, 25 bp, Rattus norvegicus
taacgtgggctagctacgagtggat

SEQ ID NO: 540736 - DNA, 25 bp, Rattus norvegicus
taacgtgtagcgacttttggtgctt

SEQ ID NO: 540737 - DNA, 25 bp, Rattus norvegicus
taacgtgtagcgtcttttggtgctt

SEQ ID NO: 540738 - DNA, 25 bp, Rattus norvegicus
taacgtgtgaacctctctttagaac

SEQ ID NO: 540739 - DNA, 25 bp, Rattus norvegicus
taacgtgtgaacgtctctttagaac

SEQ ID NO: 540740 - DNA, 25 bp, Rattus norvegicus
taacgtgtgaagaagcccgctgctc

SEQ ID NO: 540741 - DNA, 25 bp, Rattus norvegicus
taacgtgtgaagtagcccgctgctc

SEQ ID NO: 540742 - DNA, 25 bp, Rattus norvegicus
taacgtgtgcatcaagaaacctcgg

SEQ ID NO: 540743 - DNA, 25 bp, Rattus norvegicus
taacgtgtgcatgaagaaacctcgg

SEQ ID NO: 540744 - DNA, 25 bp, Rattus norvegicus
taacgtgtggccctgatcatgaagt

SEQ ID NO: 540745 - DNA, 25 bp, Rattus norvegicus
taacgtgtggccgtgatcatgaagt

SEQ ID NO: 540746 - DNA, 25 bp, Rattus norvegicus
taacgtgttcccaggccgaggatga

SEQ ID NO: 540747 - DNA, 25 bp, Rattus norvegicus
taacgtgttccctggccgaggatga

SEQ ID NO: 540748 - DNA, 25 bp, Rattus norvegicus
taacgtgttttcactaagcttcttt

SEQ ID NO: 540749 - DNA, 25 bp, Rattus norvegicus
taacgtgttttctctaagcttcttt

SEQ ID NO: 540750 - DNA, 25 bp, Rattus norvegicus
taacgtgttttgatcactaccccat

SEQ ID NO: 540751 - DNA, 25 bp, Rattus norvegicus
taacgtgttttgttcactaccccat

SEQ ID NO: 540752 - DNA, 25 bp, Rattus norvegicus
taacgttcgtaccttgctggctgtg

SEQ ID NO: 540753 - DNA, 25 bp, Rattus norvegicus
taacgttcgtacgttgctggctgtg

SEQ ID NO: 540754 - DNA, 25 bp, Rattus norvegicus
taacgttgaatacgccgcaggacca

SEQ ID NO: 540755 - DNA, 25 bp, Rattus norvegicus
taacgttgaataggccgcaggacca

SEQ ID NO: 540756 - DNA, 25 bp, Rattus norvegicus
taacgttgagtaccaatcacgcatt

SEQ ID NO: 540757 - DNA, 25 bp, Rattus norvegicus
taacgttgagtagcaatcacgcatt

SEQ ID NO: 540758 - DNA, 25 bp, Rattus norvegicus
taacgtttatccattgcttcagctt

SEQ ID NO: 540759 - DNA, 25 bp, Rattus norvegicus
taacgtttatcctttgcttcagctt

SEQ ID NO: 540760 - DNA, 25 bp, Rattus norvegicus
taacgtttcctaatcatccagtgtc

SEQ ID NO: 540761 - DNA, 25 bp, Rattus norvegicus
taacgtttcctattcatccagtgtc

SEQ ID NO: 540762 - DNA, 25 bp, Rattus norvegicus
taacgtttcctcagatggacacact

SEQ ID NO: 540763 - DNA, 25 bp, Rattus norvegicus
taacgtttcctctgatggacacact

SEQ ID NO: 540764 - DNA, 25 bp, Rattus norvegicus
taacgtttctgtattctccaatgaa

SEQ ID NO: 540765 - DNA, 25 bp, Rattus norvegicus
taacgtttctgttttctccaatgaa

SEQ ID NO: 540766 - DNA, 25 bp, Rattus norvegicus
taacgtttgccacaagagactaggt

SEQ ID NO: 540767 - DNA, 25 bp, Rattus norvegicus
taacgtttgccagaagagactaggt

SEQ ID NO: 540768 - DNA, 25 bp, Rattus norvegicus
taacgtttgtttccgttccctatct

SEQ ID NO: 540769 - DNA, 25 bp, Rattus norvegicus
taacgtttgtttgcgttccctatct

SEQ ID NO: 540770 - DNA, 25 bp, Rattus norvegicus
taactaaaccatcgctctggctctg

SEQ ID NO: 540771 - DNA, 25 bp, Rattus norvegicus
taactaaaccatggctctggctctg

SEQ ID NO: 540772 - DNA, 25 bp, Rattus norvegicus
taactaaacttgaataaccagctat

SEQ ID NO: 540773 - DNA, 25 bp, Rattus norvegicus
taactaaacttgtataaccagctat

SEQ ID NO: 540774 - DNA, 25 bp, Rattus norvegicus
taactaaattgcagcgttcgctgcc

SEQ ID NO: 540775 - DNA, 25 bp, Rattus norvegicus
taactaaattgctgcgttcgctgcc

SEQ ID NO: 540776 - DNA, 25 bp, Rattus norvegicus
taactaagtggtaggtttcatttct

SEQ ID NO: 540777 - DNA, 25 bp, Rattus norvegicus
taactaagtggttggtttcatttct

SEQ ID NO: 540778 - DNA, 25 bp, Rattus norvegicus
taactaataccacgcgcagcatctt

SEQ ID NO: 540779 - DNA, 25 bp, Rattus norvegicus
taactaataccaggcgcagcatctt

SEQ ID NO: 540780 - DNA, 25 bp, Rattus norvegicus
taactaatgattaccattggaggga

SEQ ID NO: 540781 - DNA, 25 bp, Rattus norvegicus
taactaatgatttccattggaggga

SEQ ID NO: 540782 - DNA, 25 bp, Rattus norvegicus
taactaatgcacatatttttacagt

SEQ ID NO: 540783 - DNA, 25 bp, Rattus norvegicus
taactaatgcacttatttttacagt

SEQ ID NO: 540784 - DNA, 25 bp, Rattus norvegicus
taactacaacctatctacacatgag

SEQ ID NO: 540785 - DNA, 25 bp, Rattus norvegicus
taactacaacctttctacacatgag

SEQ ID NO: 540786 - DNA, 25 bp, Rattus norvegicus
taactacaccccaagcataaggcta

SEQ ID NO: 540787 - DNA, 25 bp, Rattus norvegicus
taactacacccctagcataaggcta

SEQ ID NO: 540788 - DNA, 25 bp, Rattus norvegicus
taactacacttcaaggtacagcagt

SEQ ID NO: 540789 - DNA, 25 bp, Rattus norvegicus
taactacacttctaggtacagcagt

SEQ ID NO: 540790 - DNA, 25 bp, Rattus norvegicus
taactacattctctttgctctttgt

SEQ ID NO: 540791 - DNA, 25 bp, Rattus norvegicus
taactacattctgtttgctctttgt

SEQ ID NO: 540792 - DNA, 25 bp, Rattus norvegicus
taactacctcagactcctgtataat

SEQ ID NO: 540793 - DNA, 25 bp, Rattus norvegicus
taactacctcagatgtggaaaccaa

SEQ ID NO: 540794 - DNA, 25 bp, Rattus norvegicus
taactacctcagtctcctgtataat

SEQ ID NO: 540795 - DNA, 25 bp, Rattus norvegicus
taactacctcagttgtggaaaccaa

SEQ ID NO: 540796 - DNA, 25 bp, Rattus norvegicus
taactacctccactgctgacgaagt

SEQ ID NO: 540797 - DNA, 25 bp, Rattus norvegicus
taactacctccagtgctgacgaagt

SEQ ID NO: 540798 - DNA, 25 bp, Rattus norvegicus
taactacctgccattcattatggaa

SEQ ID NO: 540799 - DNA, 25 bp, Rattus norvegicus
taactacctgcctttcattatggaa

SEQ ID NO: 540800 - DNA, 25 bp, Rattus norvegicus
taactaccttcactacctctggagt

SEQ ID NO: 540801 - DNA, 25 bp, Rattus norvegicus
taactaccttcagtacctctggagt

SEQ ID NO: 540802 - DNA, 25 bp, Rattus norvegicus
taactaccttttcgaaactgagcct

SEQ ID NO: 540803 - DNA, 25 bp, Rattus norvegicus
taactaccttttggaaactgagcct

SEQ ID NO: 540804 - DNA, 25 bp, Rattus norvegicus
taactacgttctcctgtgctagagt

SEQ ID NO: 540805 - DNA, 25 bp, Rattus norvegicus
taactacgttctgctgtgctagagt

SEQ ID NO: 540806 - DNA, 25 bp, Rattus norvegicus
taactactagttatcctcacagcgc

SEQ ID NO: 540807 - DNA, 25 bp, Rattus norvegicus
taactactagttttcctcacagcgc

SEQ ID NO: 540808 - DNA, 25 bp, Rattus norvegicus
taactactcacactatttccagcat

SEQ ID NO: 540809 - DNA, 25 bp, Rattus norvegicus
taactactcacagtatttccagcat

SEQ ID NO: 540810 - DNA, 25 bp, Rattus norvegicus
taactactcccacattttcctgtct

SEQ ID NO: 540811 - DNA, 25 bp, Rattus norvegicus
taactactcccacctttttcatctg

SEQ ID NO: 540812 - DNA, 25 bp, Rattus norvegicus
taactactcccagattttcctgtct

SEQ ID NO: 540813 - DNA, 25 bp, Rattus norvegicus
taactactcccagctttttcatctg

SEQ ID NO: 540814 - DNA, 25 bp, Rattus norvegicus
taactactccggctaccttgatatt

SEQ ID NO: 540815 - DNA, 25 bp, Rattus norvegicus
taactactccgggtaccttgatatt

SEQ ID NO: 540816 - DNA, 25 bp, Rattus norvegicus
taactactctatactccaagggcag

SEQ ID NO: 540817 - DNA, 25 bp, Rattus norvegicus
taactactctattctccaagggcag

SEQ ID NO: 540818 - DNA, 25 bp, Rattus norvegicus
taactactctctactctgatgtgct

SEQ ID NO: 540819 - DNA, 25 bp, Rattus norvegicus
taactactctcttctctgatgtgct

SEQ ID NO: 540820 - DNA, 25 bp, Rattus norvegicus
taactactgctcaacgttctgccag

SEQ ID NO: 540821 - DNA, 25 bp, Rattus norvegicus
taactactgctctacgttctgccag

SEQ ID NO: 540822 - DNA, 25 bp, Rattus norvegicus
taactactgtaccgagaggagcggt

SEQ ID NO: 540823 - DNA, 25 bp, Rattus norvegicus
taactactgtacggagaggagcggt

SEQ ID NO: 540824 - DNA, 25 bp, Rattus norvegicus
taactacttttacatggaaccacaa

SEQ ID NO: 540825 - DNA, 25 bp, Rattus norvegicus
taactacttttagatggaaccacaa

SEQ ID NO: 540826 - DNA, 25 bp, Rattus norvegicus
taactagacagtccagttccttcct

SEQ ID NO: 540827 - DNA, 25 bp, Rattus norvegicus
taactagacagtgcagttccttcct

SEQ ID NO: 540828 - DNA, 25 bp, Rattus norvegicus
taactagacccaccagtgggcctag

SEQ ID NO: 540829 - DNA, 25 bp, Rattus norvegicus
taactagacccagcagtgggcctag

SEQ ID NO: 540830 - DNA, 25 bp, Rattus norvegicus
taactagagattattaaagagactg

SEQ ID NO: 540831 - DNA, 25 bp, Rattus norvegicus
taactagagatttttaaagagactg

SEQ ID NO: 540832 - DNA, 25 bp, Rattus norvegicus
taactagcctgaatgcctgtcacca

SEQ ID NO: 540833 - DNA, 25 bp, Rattus norvegicus
taactagcctgattgcctgtcacca

SEQ ID NO: 540834 - DNA, 25 bp, Rattus norvegicus
taactaggaaaacctgtgctggtaa

SEQ ID NO: 540835 - DNA, 25 bp, Rattus norvegicus
taactaggaaaagctgtgctggtaa

SEQ ID NO: 540836 - DNA, 25 bp, Rattus norvegicus
taactagggcccaatctgctgatgc

SEQ ID NO: 540837 - DNA, 25 bp, Rattus norvegicus
taactagggccctatctgctgatgc

SEQ ID NO: 540838 - DNA, 25 bp, Rattus norvegicus
taactagggcttaaaagctgctcat

SEQ ID NO: 540839 - DNA, 25 bp, Rattus norvegicus
taactagggctttaaagctgctcat

SEQ ID NO: 540840 - DNA, 25 bp, Rattus norvegicus
taactagtatgtacccgtggccatt

SEQ ID NO: 540841 - DNA, 25 bp, Rattus norvegicus
taactagtatgttcccgtggccatt

SEQ ID NO: 540842 - DNA, 25 bp, Rattus norvegicus
taactagtcccgattgtctcttacg

SEQ ID NO: 540843 - DNA, 25 bp, Rattus norvegicus
taactagtcccgtttgtctcttacg

SEQ ID NO: 540844 - DNA, 25 bp, Rattus norvegicus
taactagtccttacttagtgccctt

SEQ ID NO: 540845 - DNA, 25 bp, Rattus norvegicus
taactagtcctttcttagtgccctt

SEQ ID NO: 540846 - DNA, 25 bp, Rattus norvegicus
taactatctccaagatggctcctat

SEQ ID NO: 540847 - DNA, 25 bp, Rattus norvegicus
taactatctccatgatggctcctat

SEQ ID NO: 540848 - DNA, 25 bp, Rattus norvegicus
taactatctggaaccccagctccag

SEQ ID NO: 540849 - DNA, 25 bp, Rattus norvegicus
taactatctggatccccagctccag

SEQ ID NO: 540850 - DNA, 25 bp, Rattus norvegicus
taactattcaaacctgtcctgggaa

SEQ ID NO: 540851 - DNA, 25 bp, Rattus norvegicus
taactattcaaagctgtcctgggaa

SEQ ID NO: 540852 - DNA, 25 bp, Rattus norvegicus
taactattctgactcatggctgagg

SEQ ID NO: 540853 - DNA, 25 bp, Rattus norvegicus
taactattctgagtcatggctgagg

SEQ ID NO: 540854 - DNA, 25 bp, Rattus norvegicus
taactattctgtccgtctccagctt

SEQ ID NO: 540855 - DNA, 25 bp, Rattus norvegicus
taactattctgtgcgtctccagctt

SEQ ID NO: 540856 - DNA, 25 bp, Rattus norvegicus
taactatttattattcccttctgag

SEQ ID NO: 540857 - DNA, 25 bp, Rattus norvegicus
taactatttatttttcccttctgag

SEQ ID NO: 540858 - DNA, 25 bp, Rattus norvegicus
taactcaaagccagtctccactatg

SEQ ID NO: 540859 - DNA, 25 bp, Rattus norvegicus
taactcaaagcctgtctccactatg

SEQ ID NO: 540860 - DNA, 25 bp, Rattus norvegicus
taactcaactctagcctgactgaat

SEQ ID NO: 540861 - DNA, 25 bp, Rattus norvegicus
taactcaactcttgcctgactgaat

SEQ ID NO: 540862 - DNA, 25 bp, Rattus norvegicus
taactcaaggcactgggctctttat

SEQ ID NO: 540863 - DNA, 25 bp, Rattus norvegicus
taactcaaggcagtgggctctttat

SEQ ID NO: 540864 - DNA, 25 bp, Rattus norvegicus
taactcaatatcactgggtaacctc

SEQ ID NO: 540865 - DNA, 25 bp, Rattus norvegicus
taactcaatatctctgggtaacctc

SEQ ID NO: 540866 - DNA, 25 bp, Rattus norvegicus
taactcaatcttacgggtgccaggg

SEQ ID NO: 540867 - DNA, 25 bp, Rattus norvegicus
taactcaatctttcgggtgccaggg

SEQ ID NO: 540868 - DNA, 25 bp, Rattus norvegicus
taactcacactaactgtacacgcca

SEQ ID NO: 540869 - DNA, 25 bp, Rattus norvegicus
taactcacactatctgtacacgcca

SEQ ID NO: 540870 - DNA, 25 bp, Rattus norvegicus
taactcacagtactcatcaaagcaa

SEQ ID NO: 540871 - DNA, 25 bp, Rattus norvegicus
taactcacagtagtcatcaaagcaa

SEQ ID NO: 540872 - DNA, 25 bp, Rattus norvegicus
taactcacattaacgggagcagtgt

SEQ ID NO: 540873 - DNA, 25 bp, Rattus norvegicus
taactcacattatcgggagcagtgt

SEQ ID NO: 540874 - DNA, 25 bp, Rattus norvegicus
taactcacctgccagaagccaagat

SEQ ID NO: 540875 - DNA, 25 bp, Rattus norvegicus
taactcacctgcgagaagccaagat

SEQ ID NO: 540876 - DNA, 25 bp, Rattus norvegicus
taactcacctttatgaactgctcat

SEQ ID NO: 540877 - DNA, 25 bp, Rattus norvegicus
taactcacctttttgaactgctcat

SEQ ID NO: 540878 - DNA, 25 bp, Rattus norvegicus
taactcacgagcactttcctgcatg

SEQ ID NO: 540879 - DNA, 25 bp, Rattus norvegicus
taactcacgagctctttcctgcatg

SEQ ID NO: 540880 - DNA, 25 bp, Rattus norvegicus
taactcacgcttagttctgctgcta

SEQ ID NO: 540881 - DNA, 25 bp, Rattus norvegicus
taactcacgctttgttctgctgcta

SEQ ID NO: 540882 - DNA, 25 bp, Rattus norvegicus
taactcagaacactaccgccaagat

SEQ ID NO: 540883 - DNA, 25 bp, Rattus norvegicus
taactcagaacagtaccgccaagat

SEQ ID NO: 540884 - DNA, 25 bp, Rattus norvegicus
taactcagaggccatcatcccactt

SEQ ID NO: 540885 - DNA, 25 bp, Rattus norvegicus
taactcagaggcgatcatcccactt

SEQ ID NO: 540886 - DNA, 25 bp, Rattus norvegicus
taactcagctagcacgtgaacccag

SEQ ID NO: 540887 - DNA, 25 bp, Rattus norvegicus
taactcagctaggacgtgaacccag

SEQ ID NO: 540888 - DNA, 25 bp, Rattus norvegicus
taactcagtattacgcacacccaag

SEQ ID NO: 540889 - DNA, 25 bp, Rattus norvegicus
taactcagtatttcgcacacccaag

SEQ ID NO: 540890 - DNA, 25 bp, Rattus norvegicus
taactcagtcagctggagttccctg

SEQ ID NO: 540891 - DNA, 25 bp, Rattus norvegicus
taactcagtcaggtggagttccctg

SEQ ID NO: 540892 - DNA, 25 bp, Rattus norvegicus
taactcagtcggaagagtccttgcc

SEQ ID NO: 540893 - DNA, 25 bp, Rattus norvegicus
taactcagtcggtagagtccttgcc

SEQ ID NO: 540894 - DNA, 25 bp, Rattus norvegicus
taactcagttatcccatttacacca

SEQ ID NO: 540895 - DNA, 25 bp, Rattus norvegicus
taactcagttatgccatttacacca

SEQ ID NO: 540896 - DNA, 25 bp, Rattus norvegicus
taactcagttgcctcgggctgggac

SEQ ID NO: 540897 - DNA, 25 bp, Rattus norvegicus
taactcagttgcgtcgggctgggac

SEQ ID NO: 540898 - DNA, 25 bp, Rattus norvegicus
taactcataatcactggctaccagg

SEQ ID NO: 540899 - DNA, 25 bp, Rattus norvegicus
taactcataatctctggctaccagg

SEQ ID NO: 540900 - DNA, 25 bp, Rattus norvegicus
taactcatagagagcttgctggaaa

SEQ ID NO: 540901 - DNA, 25 bp, Rattus norvegicus
taactcatagagtgcttgctggaaa

SEQ ID NO: 540902 - DNA, 25 bp, Rattus norvegicus
taactcatcttaaacccgtgctttt

SEQ ID NO: 540903 - DNA, 25 bp, Rattus norvegicus
taactcatcttatacccgtgctttt

SEQ ID NO: 540904 - DNA, 25 bp, Rattus norvegicus
taactcattcccatagcaagccaaa

SEQ ID NO: 540905 - DNA, 25 bp, Rattus norvegicus
taactcattcccttagcaagccaaa

SEQ ID NO: 540906 - DNA, 25 bp, Rattus norvegicus
taactcattgctaattcctgtcttg

SEQ ID NO: 540907 - DNA, 25 bp, Rattus norvegicus
taactcattgcttattcctgtcttg

SEQ ID NO: 540908 - DNA, 25 bp, Rattus norvegicus
taactcatttccctttcgggacttg

SEQ ID NO: 540909 - DNA, 25 bp, Rattus norvegicus
taactcatttccgtttcgggacttg

SEQ ID NO: 540910 - DNA, 25 bp, Rattus norvegicus
taactccaaggaattgtgtgtcatt

SEQ ID NO: 540911 - DNA, 25 bp, Rattus norvegicus
taactccaaggatttgtgtgtcatt

SEQ ID NO: 540912 - DNA, 25 bp, Rattus norvegicus
taactccaagtgattttcctcaggt

SEQ ID NO: 540913 - DNA, 25 bp, Rattus norvegicus
taactccaagtgtttttcctcaggt

SEQ ID NO: 540914 - DNA, 25 bp, Rattus norvegicus
taactccaccttctggttggtggtt

SEQ ID NO: 540915 - DNA, 25 bp, Rattus norvegicus
taactccaccttgtggttggtggtt

SEQ ID NO: 540916 - DNA, 25 bp, Rattus norvegicus
taactccactgcctgggatggcctc

SEQ ID NO: 540917 - DNA, 25 bp, Rattus norvegicus
taactccactgcgtgggatggcctc

SEQ ID NO: 540918 - DNA, 25 bp, Rattus norvegicus
taactccagacgctatttattttgt

SEQ ID NO: 540919 - DNA, 25 bp, Rattus norvegicus
taactccagacggtatttattttgt

SEQ ID NO: 540920 - DNA, 25 bp, Rattus norvegicus
taactccaggctacaccaaatgtgc

SEQ ID NO: 540921 - DNA, 25 bp, Rattus norvegicus
taactccaggcttcaccaaatgtgc

SEQ ID NO: 540922 - DNA, 25 bp, Rattus norvegicus
taactccagtttagggctgtgccca

SEQ ID NO: 540923 - DNA, 25 bp, Rattus norvegicus
taactccagttttgggctgtgccca

SEQ ID NO: 540924 - DNA, 25 bp, Rattus norvegicus
taactccataggctctgttgtcaca

SEQ ID NO: 540925 - DNA, 25 bp, Rattus norvegicus
taactccatagggtctgttgtcaca

SEQ ID NO: 540926 - DNA, 25 bp, Rattus norvegicus
taactccattcaatcagcactcaag

SEQ ID NO: 540927 - DNA, 25 bp, Rattus norvegicus
taactccattcattcagcactcaag

SEQ ID NO: 540928 - DNA, 25 bp, Rattus norvegicus
taactcccacctagctggagtcttg

SEQ ID NO: 540929 - DNA, 25 bp, Rattus norvegicus
taactcccaccttgctggagtcttg

SEQ ID NO: 540930 - DNA, 25 bp, Rattus norvegicus
taactcccatctcacaggtgacttt

SEQ ID NO: 540931 - DNA, 25 bp, Rattus norvegicus
taactcccatctgacaggtgacttt

SEQ ID NO: 540932 - DNA, 25 bp, Rattus norvegicus
taactcccattccagaggatctggt

SEQ ID NO: 540933 - DNA, 25 bp, Rattus norvegicus
taactcccattcgagaggatctggt

SEQ ID NO: 540934 - DNA, 25 bp, Rattus norvegicus
taactccccttgcaatgcactggat

SEQ ID NO: 540935 - DNA, 25 bp, Rattus norvegicus
taactccccttggaatgcactggat

SEQ ID NO: 540936 - DNA, 25 bp, Rattus norvegicus
taactccctatgatgtgtgctctac

SEQ ID NO: 540937 - DNA, 25 bp, Rattus norvegicus
taactccctatgttgtgtgctctac

SEQ ID NO: 540938 - DNA, 25 bp, Rattus norvegicus
taactccctcatcacgctgaaagga

SEQ ID NO: 540939 - DNA, 25 bp, Rattus norvegicus
taactccctcatgacgctgaaagga

SEQ ID NO: 540940 - DNA, 25 bp, Rattus norvegicus
taactccctgaactctcttaatctc

SEQ ID NO: 540941 - DNA, 25 bp, Rattus norvegicus
taactccctgaagtctcttaatctc

SEQ ID NO: 540942 - DNA, 25 bp, Rattus norvegicus
taactccctgcgctcaggtactgga

SEQ ID NO: 540943 - DNA, 25 bp, Rattus norvegicus
taactccctgcggtcaggtactgga

SEQ ID NO: 540944 - DNA, 25 bp, Rattus norvegicus
taactcccttctcttactgtctaga

SEQ ID NO: 540945 - DNA, 25 bp, Rattus norvegicus
taactcccttctgttactgtctaga

SEQ ID NO: 540946 - DNA, 25 bp, Rattus norvegicus
taactccggttccagagtatctaac

SEQ ID NO: 540947 - DNA, 25 bp, Rattus norvegicus
taactccggttcgagagtatctaac

SEQ ID NO: 540948 - DNA, 25 bp, Rattus norvegicus
taactcctacctcccatagagtgta

SEQ ID NO: 540949 - DNA, 25 bp, Rattus norvegicus
taactcctacctgccatagagtgta

SEQ ID NO: 540950 - DNA, 25 bp, Rattus norvegicus
taactcctcatcataaacatccttc

SEQ ID NO: 540951 - DNA, 25 bp, Rattus norvegicus
taactcctcatcttaaacatccttc

SEQ ID NO: 540952 - DNA, 25 bp, Rattus norvegicus
taactcctgctgataggcaattctc

SEQ ID NO: 540953 - DNA, 25 bp, Rattus norvegicus
taactcctgctgttaggcaattctc

SEQ ID NO: 540954 - DNA, 25 bp, Rattus norvegicus
taactcctggtcagtgctgagtcac

SEQ ID NO: 540955 - DNA, 25 bp, Rattus norvegicus
taactcctggtctgtgctgagtcac

SEQ ID NO: 540956 - DNA, 25 bp, Rattus norvegicus
taactcctgtgtaccgttatccttt

SEQ ID NO: 540957 - DNA, 25 bp, Rattus norvegicus
taactcctgtgttccgttatccttt

SEQ ID NO: 540958 - DNA, 25 bp, Rattus norvegicus
taactccttatcacccgaagtggca

SEQ ID NO: 540959 - DNA, 25 bp, Rattus norvegicus
taactccttatctcccgaagtggca

SEQ ID NO: 540960 - DNA, 25 bp, Rattus norvegicus
taactcctttgcctggcggcagtaa

SEQ ID NO: 540961 - DNA, 25 bp, Rattus norvegicus
taactcctttgcgtggcggcagtaa

SEQ ID NO: 540962 - DNA, 25 bp, Rattus norvegicus
taactcgagatccttaagcctgcat

SEQ ID NO: 540963 - DNA, 25 bp, Rattus norvegicus
taactcgagatcgttaagcctgcat

SEQ ID NO: 540964 - DNA, 25 bp, Rattus norvegicus
taactcgatggcatagcatccctac

SEQ ID NO: 540965 - DNA, 25 bp, Rattus norvegicus
taactcgatggcttagcatccctac

SEQ ID NO: 540966 - DNA, 25 bp, Rattus norvegicus
taactcgccctcagtgatacagttg

SEQ ID NO: 540967 - DNA, 25 bp, Rattus norvegicus
taactcgccctctgtgatacagttg

SEQ ID NO: 540968 - DNA, 25 bp, Rattus norvegicus
taactcgccttgatgtctggcctta

SEQ ID NO: 540969 - DNA, 25 bp, Rattus norvegicus
taactcgccttgttgtctggcctta

SEQ ID NO: 540970 - DNA, 25 bp, Rattus norvegicus
taactcgcctttatatacacctgta

SEQ ID NO: 540971 - DNA, 25 bp, Rattus norvegicus
taactcgcctttttatacacctgta

SEQ ID NO: 540972 - DNA, 25 bp, Rattus norvegicus
taactcgctcttattctcattctaa

SEQ ID NO: 540973 - DNA, 25 bp, Rattus norvegicus
taactcgctctttttctcattctaa

SEQ ID NO: 540974 - DNA, 25 bp, Rattus norvegicus
taactcgctgatattgtggtgctgt

SEQ ID NO: 540975 - DNA, 25 bp, Rattus norvegicus
taactcgctgattttgtggtgctgt

SEQ ID NO: 540976 - DNA, 25 bp, Rattus norvegicus
taactcggaggactctccttggacc

SEQ ID NO: 540977 - DNA, 25 bp, Rattus norvegicus
taactcggaggagtctccttggacc

SEQ ID NO: 540978 - DNA, 25 bp, Rattus norvegicus
taactcggcagcacacgtgcaggaa

SEQ ID NO: 540979 - DNA, 25 bp, Rattus norvegicus
taactcggcagctcacgtgcaggaa

SEQ ID NO: 540980 - DNA, 25 bp, Rattus norvegicus
taactcggcatcatctctggtagtg

SEQ ID NO: 540981 - DNA, 25 bp, Rattus norvegicus
taactcggcatcttctctggtagtg

SEQ ID NO: 540982 - DNA, 25 bp, Rattus norvegicus
taactcgggttcagggcttaggtct

SEQ ID NO: 540983 - DNA, 25 bp, Rattus norvegicus
taactcgggttctgggcttaggtct

SEQ ID NO: 540984 - DNA, 25 bp, Rattus norvegicus
taactcggtgccaactaaaacaaag

SEQ ID NO: 540985 - DNA, 25 bp, Rattus norvegicus
taactcggtgcctactaaaacaaag

SEQ ID NO: 540986 - DNA, 25 bp, Rattus norvegicus
taactcggtttgaagcaccacgcat

SEQ ID NO: 540987 - DNA, 25 bp, Rattus norvegicus
taactcggtttgtagcaccacgcat

SEQ ID NO: 540988 - DNA, 25 bp, Rattus norvegicus
taactctactcaactgctttgtttc

SEQ ID NO: 540989 - DNA, 25 bp, Rattus norvegicus
taactctactcatctgctttgtttc

SEQ ID NO: 540990 - DNA, 25 bp, Rattus norvegicus
taactctactggagcacccatgaag

SEQ ID NO: 540991 - DNA, 25 bp, Rattus norvegicus
taactctactggtgcacccatgaag

SEQ ID NO: 540992 - DNA, 25 bp, Rattus norvegicus
taactctcaggtaccaaagaaagtc

SEQ ID NO: 540993 - DNA, 25 bp, Rattus norvegicus
taactctcaggttccaaagaaagtc

SEQ ID NO: 540994 - DNA, 25 bp, Rattus norvegicus
taactctcagttactctctcaggta

SEQ ID NO: 540995 - DNA, 25 bp, Rattus norvegicus
taactctcagtttctctctcaggta

SEQ ID NO: 540996 - DNA, 25 bp, Rattus norvegicus
taactctcctccactcaaaatagaa

SEQ ID NO: 540997 - DNA, 25 bp, Rattus norvegicus
taactctcctcctctcaaaatagaa

SEQ ID NO: 540998 - DNA, 25 bp, Rattus norvegicus
taactctctgaaaaaggtaagccct

SEQ ID NO: 540999 - DNA, 25 bp, Rattus norvegicus
taactctctgaataaggtaagccct

SEQ ID NO: 541000 - DNA, 25 bp, Rattus norvegicus
taactctctgtaacgggtttcctat

SEQ ID NO: 541001 - DNA, 25 bp, Rattus norvegicus
taactctctgtatcgggtttcctat

SEQ ID NO: 541002 - DNA, 25 bp, Rattus norvegicus
taactctgaagaactaaatagccct

SEQ ID NO: 541003 - DNA, 25 bp, Rattus norvegicus
taactctgaagactgaaggcacatg

SEQ ID NO: 541004 - DNA, 25 bp, Rattus norvegicus
taactctgaagagtgaaggcacatg

SEQ ID NO: 541005 - DNA, 25 bp, Rattus norvegicus
taactctgaagatctaaatagccct

SEQ ID NO: 541006 - DNA, 25 bp, Rattus norvegicus
taactctgagccatcacaccataat

SEQ ID NO: 541007 - DNA, 25 bp, Rattus norvegicus
taactctgagccttcacaccataat

SEQ ID NO: 541008 - DNA, 25 bp, Rattus norvegicus
taactctgcagcacgttgtctggac

SEQ ID NO: 541009 - DNA, 25 bp, Rattus norvegicus
taactctgcagctcgttgtctggac

SEQ ID NO: 541010 - DNA, 25 bp, Rattus norvegicus
taactctggactatgattccccatt

SEQ ID NO: 541011 - DNA, 25 bp, Rattus norvegicus
taactctggactttgattccccatt

SEQ ID NO: 541012 - DNA, 25 bp, Rattus norvegicus
taactctggcccattgacatggcgc

SEQ ID NO: 541013 - DNA, 25 bp, Rattus norvegicus
taactctggccctttgacatggcgc

SEQ ID NO: 541014 - DNA, 25 bp, Rattus norvegicus
taactctggtcaattgtgcctttct

SEQ ID NO: 541015 - DNA, 25 bp, Rattus norvegicus
taactctggtcatttgtgcctttct

SEQ ID NO: 541016 - DNA, 25 bp, Rattus norvegicus
taactctggtttagggacacacaca

SEQ ID NO: 541017 - DNA, 25 bp, Rattus norvegicus
taactctggttttgggacacacaca

SEQ ID NO: 541018 - DNA, 25 bp, Rattus norvegicus
taactctgtgacctcactgttggct

SEQ ID NO: 541019 - DNA, 25 bp, Rattus norvegicus
taactctgtgacgtcactgttggct

SEQ ID NO: 541020 - DNA, 25 bp, Rattus norvegicus
taactctgttgcagtggtcattgga

SEQ ID NO: 541021 - DNA, 25 bp, Rattus norvegicus
taactctgttgctgtggtcattgga

SEQ ID NO: 541022 - DNA, 25 bp, Rattus norvegicus
taactctgttgtaacctttactcag

SEQ ID NO: 541023 - DNA, 25 bp, Rattus norvegicus
taactctgttgttacctttactcag

SEQ ID NO: 541024 - DNA, 25 bp, Rattus norvegicus
taactcttacttaacatctgtgtgc

SEQ ID NO: 541025 - DNA, 25 bp, Rattus norvegicus
taactcttactttacatctgtgtgc

SEQ ID NO: 541026 - DNA, 25 bp, Rattus norvegicus
taactcttaggcagcttcccaaaag

SEQ ID NO: 541027 - DNA, 25 bp, Rattus norvegicus
taactcttaggctgcttcccaaaag

SEQ ID NO: 541028 - DNA, 25 bp, Rattus norvegicus
taactcttatttattgtccacccct

SEQ ID NO: 541029 - DNA, 25 bp, Rattus norvegicus
taactcttattttttgtccacccct

SEQ ID NO: 541030 - DNA, 25 bp, Rattus norvegicus
taactcttcataatctcttgctctg

SEQ ID NO: 541031 - DNA, 25 bp, Rattus norvegicus
taactcttcatattctcttgctctg

SEQ ID NO: 541032 - DNA, 25 bp, Rattus norvegicus
taactcttccctatgctactgtgat

SEQ ID NO: 541033 - DNA, 25 bp, Rattus norvegicus
taactcttccctttgctactgtgat

SEQ ID NO: 541034 - DNA, 25 bp, Rattus norvegicus
taactcttgagcatgcctagccagc

SEQ ID NO: 541035 - DNA, 25 bp, Rattus norvegicus
taactcttgagcttgcctagccagc

SEQ ID NO: 541036 - DNA, 25 bp, Rattus norvegicus
taactcttggaaattagccctctcc

SEQ ID NO: 541037 - DNA, 25 bp, Rattus norvegicus
taactcttggaatttagccctctcc

SEQ ID NO: 541038 - DNA, 25 bp, Rattus norvegicus
taactctttctactctctaaatcct

SEQ ID NO: 541039 - DNA, 25 bp, Rattus norvegicus
taactctttctagtctctaaatcct

SEQ ID NO: 541040 - DNA, 25 bp, Rattus norvegicus
taactctttcttcgaatgggcctgt

SEQ ID NO: 541041 - DNA, 25 bp, Rattus norvegicus
taactctttcttggaatgggcctgt

SEQ ID NO: 541042 - DNA, 25 bp, Rattus norvegicus
taactcttttctactgtacaaaaca

SEQ ID NO: 541043 - DNA, 25 bp, Rattus norvegicus
taactcttttcttctgtacaaaaca

SEQ ID NO: 541044 - DNA, 25 bp, Rattus norvegicus
taactgaaatgccagctcctccatg

SEQ ID NO: 541045 - DNA, 25 bp, Rattus norvegicus
taactgaaatgcgagctcctccatg

SEQ ID NO: 541046 - DNA, 25 bp, Rattus norvegicus
taactgacaactcaggtcctgctcc

SEQ ID NO: 541047 - DNA, 25 bp, Rattus norvegicus
taactgacaactgaggtcctgctcc

SEQ ID NO: 541048 - DNA, 25 bp, Rattus norvegicus
taactgaccaccacttactgcaagt

SEQ ID NO: 541049 - DNA, 25 bp, Rattus norvegicus
taactgaccacctcttactgcaagt

SEQ ID NO: 541050 - DNA, 25 bp, Rattus norvegicus
taactgaccttacgtgccttttgaa

SEQ ID NO: 541051 - DNA, 25 bp, Rattus norvegicus
taactgaccttaggtgccttttgaa

SEQ ID NO: 541052 - DNA, 25 bp, Rattus norvegicus
taactgactgtcctgctgctaaagc

SEQ ID NO: 541053 - DNA, 25 bp, Rattus norvegicus
taactgactgtcgtgctgctaaagc

SEQ ID NO: 541054 - DNA, 25 bp, Rattus norvegicus
taactgactttcaagatgccttaat

SEQ ID NO: 541055 - DNA, 25 bp, Rattus norvegicus
taactgactttctagatgccttaat

SEQ ID NO: 541056 - DNA, 25 bp, Rattus norvegicus
taactgagcctgctgtctgcacctt

SEQ ID NO: 541057 - DNA, 25 bp, Rattus norvegicus
taactgagcctggtgtctgcacctt

SEQ ID NO: 541058 - DNA, 25 bp, Rattus norvegicus
taactgaggccaccatcagagccat

SEQ ID NO: 541059 - DNA, 25 bp, Rattus norvegicus
taactgaggccagcatcagagccat

SEQ ID NO: 541060 - DNA, 25 bp, Rattus norvegicus
taactgagtactatacttccccaac

SEQ ID NO: 541061 - DNA, 25 bp, Rattus norvegicus
taactgagtactttacttccccaac

SEQ ID NO: 541062 - DNA, 25 bp, Rattus norvegicus
taactgatgtatccacagcacaggg

SEQ ID NO: 541063 - DNA, 25 bp, Rattus norvegicus
taactgatgtatgcacagcacaggg

SEQ ID NO: 541064 - DNA, 25 bp, Rattus norvegicus
taactgcaaaccaagaagataattt

SEQ ID NO: 541065 - DNA, 25 bp, Rattus norvegicus
taactgcaaacctagaagataattt

SEQ ID NO: 541066 - DNA, 25 bp, Rattus norvegicus
taactgcaagctattctagaacctg

SEQ ID NO: 541067 - DNA, 25 bp, Rattus norvegicus
taactgcaagcttttctagaacctg

SEQ ID NO: 541068 - DNA, 25 bp, Rattus norvegicus
taactgcaagtcaaggtatttccct

SEQ ID NO: 541069 - DNA, 25 bp, Rattus norvegicus
taactgcaagtctaggtatttccct

SEQ ID NO: 541070 - DNA, 25 bp, Rattus norvegicus
taactgcacatcagataatggacta

SEQ ID NO: 541071 - DNA, 25 bp, Rattus norvegicus
taactgcacatctgataatggacta

SEQ ID NO: 541072 - DNA, 25 bp, Rattus norvegicus
taactgcacccacctttgtgtcttt

SEQ ID NO: 541073 - DNA, 25 bp, Rattus norvegicus
taactgcacccagctttgtgtcttt

SEQ ID NO: 541074 - DNA, 25 bp, Rattus norvegicus
taactgcagacactctctcaaactg

SEQ ID NO: 541075 - DNA, 25 bp, Rattus norvegicus
taactgcagacagtctctcaaactg

SEQ ID NO: 541076 - DNA, 25 bp, Rattus norvegicus
taactgcagctgagatccacacatt

SEQ ID NO: 541077 - DNA, 25 bp, Rattus norvegicus
taactgcagctgtgatccacacatt

SEQ ID NO: 541078 - DNA, 25 bp, Rattus norvegicus
taactgcatggactcttcggtgggc

SEQ ID NO: 541079 - DNA, 25 bp, Rattus norvegicus
taactgcatggagtcttcggtgggc

SEQ ID NO: 541080 - DNA, 25 bp, Rattus norvegicus
taactgcatggtccttaaggcccct

SEQ ID NO: 541081 - DNA, 25 bp, Rattus norvegicus
taactgcatggtgcttaaggcccct

SEQ ID NO: 541082 - DNA, 25 bp, Rattus norvegicus
taactgccatctctgttttgcctga

SEQ ID NO: 541083 - DNA, 25 bp, Rattus norvegicus
taactgccatctgtgttttgcctga

SEQ ID NO: 541084 - DNA, 25 bp, Rattus norvegicus
taactgcccaagacaattctctttg

SEQ ID NO: 541085 - DNA, 25 bp, Rattus norvegicus
taactgcccaagtcaattctctttg

SEQ ID NO: 541086 - DNA, 25 bp, Rattus norvegicus
taactgccccttagtgacagactag

SEQ ID NO: 541087 - DNA, 25 bp, Rattus norvegicus
taactgcccctttgtgacagactag

SEQ ID NO: 541088 - DNA, 25 bp, Rattus norvegicus
taactgccctaactctgaggtcctg

SEQ ID NO: 541089 - DNA, 25 bp, Rattus norvegicus
taactgccctaagtctgaggtcctg

SEQ ID NO: 541090 - DNA, 25 bp, Rattus norvegicus
taactgccctctcacggaaactgga

SEQ ID NO: 541091 - DNA, 25 bp, Rattus norvegicus
taactgccctctgacggaaactgga

SEQ ID NO: 541092 - DNA, 25 bp, Rattus norvegicus
taactgccgcagacatcactggaat

SEQ ID NO: 541093 - DNA, 25 bp, Rattus norvegicus
taactgccgcagtcatcactggaat

SEQ ID NO: 541094 - DNA, 25 bp, Rattus norvegicus
taactgccgttcatcttttactaaa

SEQ ID NO: 541095 - DNA, 25 bp, Rattus norvegicus
taactgccgttcttcttttactaaa

SEQ ID NO: 541096 - DNA, 25 bp, Rattus norvegicus
taactgcctggaatcatcattggat

SEQ ID NO: 541097 - DNA, 25 bp, Rattus norvegicus
taactgcctggattcatcattggat

SEQ ID NO: 541098 - DNA, 25 bp, Rattus norvegicus
taactgcctgttatcccagggattt

SEQ ID NO: 541099 - DNA, 25 bp, Rattus norvegicus
taactgcctgttttcccagggattt

SEQ ID NO: 541100 - DNA, 25 bp, Rattus norvegicus
taactgccttgtctggtagaaacca

SEQ ID NO: 541101 - DNA, 25 bp, Rattus norvegicus
taactgccttgtgtggtagaaacca

SEQ ID NO: 541102 - DNA, 25 bp, Rattus norvegicus
taactgcggagccatttctctagtc

SEQ ID NO: 541103 - DNA, 25 bp, Rattus norvegicus
taactgcggagcgatttctctagtc

SEQ ID NO: 541104 - DNA, 25 bp, Rattus norvegicus
taactgcgggccctctaagggacaa

SEQ ID NO: 541105 - DNA, 25 bp, Rattus norvegicus
taactgcgggccgtctaagggacaa

SEQ ID NO: 541106 - DNA, 25 bp, Rattus norvegicus
taactgcgtgttaatctatatgtaa

SEQ ID NO: 541107 - DNA, 25 bp, Rattus norvegicus
taactgcgtgtttatctatatgtaa

SEQ ID NO: 541108 - DNA, 25 bp, Rattus norvegicus
taactgctcctcctggcagaaggat

SEQ ID NO: 541109 - DNA, 25 bp, Rattus norvegicus
taactgctcctcgtggcagaaggat

SEQ ID NO: 541110 - DNA, 25 bp, Rattus norvegicus
taactgctctctcggacattgtggt

SEQ ID NO: 541111 - DNA, 25 bp, Rattus norvegicus
taactgctctctgggacattgtggt

SEQ ID NO: 541112 - DNA, 25 bp, Rattus norvegicus
taactgctctgtaggccatggctgt

SEQ ID NO: 541113 - DNA, 25 bp, Rattus norvegicus
taactgctctgttggccatggctgt

SEQ ID NO: 541114 - DNA, 25 bp, Rattus norvegicus
taactgctggccattggacccaaat

SEQ ID NO: 541115 - DNA, 25 bp, Rattus norvegicus
taactgctggcctttggacccaaat

SEQ ID NO: 541116 - DNA, 25 bp, Rattus norvegicus
taactggaacggcacctgtgtctca

SEQ ID NO: 541117 - DNA, 25 bp, Rattus norvegicus
taactggaacgggacctgtgtctca

SEQ ID NO: 541118 - DNA, 25 bp, Rattus norvegicus
taactggaactgaacccggacaaca

SEQ ID NO: 541119 - DNA, 25 bp, Rattus norvegicus
taactggaactgtacccggacaaca

SEQ ID NO: 541120 - DNA, 25 bp, Rattus norvegicus
taactggacctccaactttttggtg

SEQ ID NO: 541121 - DNA, 25 bp, Rattus norvegicus
taactggacctcgaactttttggtg

SEQ ID NO: 541122 - DNA, 25 bp, Rattus norvegicus
taactggactctcaaggctgatgca

SEQ ID NO: 541123 - DNA, 25 bp, Rattus norvegicus
taactggactctgaaggctgatgca

SEQ ID NO: 541124 - DNA, 25 bp, Rattus norvegicus
taactggacttcaaagcgctggctg

SEQ ID NO: 541125 - DNA, 25 bp, Rattus norvegicus
taactggacttctaagcgctggctg

SEQ ID NO: 541126 - DNA, 25 bp, Rattus norvegicus
taactggagccactccccttgaatt

SEQ ID NO: 541127 - DNA, 25 bp, Rattus norvegicus
taactggagccagtccccttgaatt

SEQ ID NO: 541128 - DNA, 25 bp, Rattus norvegicus
taactggatagtccatcctgccttg

SEQ ID NO: 541129 - DNA, 25 bp, Rattus norvegicus
taactggatagtgcatcctgccttg

SEQ ID NO: 541130 - DNA, 25 bp, Rattus norvegicus
taactggatctgagtggctctgttc

SEQ ID NO: 541131 - DNA, 25 bp, Rattus norvegicus
taactggatctgtgtggctctgttc

SEQ ID NO: 541132 - DNA, 25 bp, Rattus norvegicus
taactggatcttctgcctagagaaa

SEQ ID NO: 541133 - DNA, 25 bp, Rattus norvegicus
taactggatcttgtgcctagagaaa

SEQ ID NO: 541134 - DNA, 25 bp, Rattus norvegicus
taactggattccacaagtcttcaag

SEQ ID NO: 541135 - DNA, 25 bp, Rattus norvegicus
taactggattcctcaagtcttcaag

SEQ ID NO: 541136 - DNA, 25 bp, Rattus norvegicus
taactggcacggacaatcagggaca

SEQ ID NO: 541137 - DNA, 25 bp, Rattus norvegicus
taactggcacggtcaatcagggaca

SEQ ID NO: 541138 - DNA, 25 bp, Rattus norvegicus
taactggcattgattccccttttat

SEQ ID NO: 541139 - DNA, 25 bp, Rattus norvegicus
taactggcattgtttccccttttat

SEQ ID NO: 541140 - DNA, 25 bp, Rattus norvegicus
taactggccagtagcacccgagaag

SEQ ID NO: 541141 - DNA, 25 bp, Rattus norvegicus
taactggccagttgcacccgagaag

SEQ ID NO: 541142 - DNA, 25 bp, Rattus norvegicus
taactggcccctcgagctcaggaat

SEQ ID NO: 541143 - DNA, 25 bp, Rattus norvegicus
taactggcccctggagctcaggaat

SEQ ID NO: 541144 - DNA, 25 bp, Rattus norvegicus
taactggcctatccaagcgagcggg

SEQ ID NO: 541145 - DNA, 25 bp, Rattus norvegicus
taactggcctatgcaagcgagcggg

SEQ ID NO: 541146 - DNA, 25 bp, Rattus norvegicus
taactggctcgtacacaatgtttga

SEQ ID NO: 541147 - DNA, 25 bp, Rattus norvegicus
taactggctcgttcacaatgtttga

SEQ ID NO: 541148 - DNA, 25 bp, Rattus norvegicus
taactggctgggagctggtatctcc

SEQ ID NO: 541149 - DNA, 25 bp, Rattus norvegicus
taactggctgggtgctggtatctcc

SEQ ID NO: 541150 - DNA, 25 bp, Rattus norvegicus
taactggctgttctcagttactccg

SEQ ID NO: 541151 - DNA, 25 bp, Rattus norvegicus
taactggctgttgtcagttactccg

SEQ ID NO: 541152 - DNA, 25 bp, Rattus norvegicus
taactggcttcaagttctcctggaa

SEQ ID NO: 541153 - DNA, 25 bp, Rattus norvegicus
taactggcttcatgttctcctggaa

SEQ ID NO: 541154 - DNA, 25 bp, Rattus norvegicus
taactggctttactagacggctaat

SEQ ID NO: 541155 - DNA, 25 bp, Rattus norvegicus
taactggctttagtagacggctaat

SEQ ID NO: 541156 - DNA, 25 bp, Rattus norvegicus
taactggcttttcttaactcgtaag

SEQ ID NO: 541157 - DNA, 25 bp, Rattus norvegicus
taactggcttttgttaactcgtaag

SEQ ID NO: 541158 - DNA, 25 bp, Rattus norvegicus
taactgggaaccagagctggcgccc

SEQ ID NO: 541159 - DNA, 25 bp, Rattus norvegicus
taactgggaacctgagctggcgccc

SEQ ID NO: 541160 - DNA, 25 bp, Rattus norvegicus
taactgggaactaaaactctaggtg

SEQ ID NO: 541161 - DNA, 25 bp, Rattus norvegicus
taactgggaacttaaactctaggtg

SEQ ID NO: 541162 - DNA, 25 bp, Rattus norvegicus
taactgggatatattttgcataacc

SEQ ID NO: 541163 - DNA, 25 bp, Rattus norvegicus
taactgggatattttttgcataacc

SEQ ID NO: 541164 - DNA, 25 bp, Rattus norvegicus
taactgggcggacctttatcctgtt

SEQ ID NO: 541165 - DNA, 25 bp, Rattus norvegicus
taactgggcggagctttatcctgtt

SEQ ID NO: 541166 - DNA, 25 bp, Rattus norvegicus
taactgggtgcaccaagcatccaca

SEQ ID NO: 541167 - DNA, 25 bp, Rattus norvegicus
taactgggtgcagcaagcatccaca

SEQ ID NO: 541168 - DNA, 25 bp, Rattus norvegicus
taactgggttgaaggccttggagct

SEQ ID NO: 541169 - DNA, 25 bp, Rattus norvegicus
taactgggttgatggccttggagct

SEQ ID NO: 541170 - DNA, 25 bp, Rattus norvegicus
taactggtattcacctgtgctctga

SEQ ID NO: 541171 - DNA, 25 bp, Rattus norvegicus
taactggtattctcctgtgctctga

SEQ ID NO: 541172 - DNA, 25 bp, Rattus norvegicus
taactggtctggacagccatgcttt

SEQ ID NO: 541173 - DNA, 25 bp, Rattus norvegicus
taactggtctggtcagccatgcttt

SEQ ID NO: 541174 - DNA, 25 bp, Rattus norvegicus
taactggtgcttcggccttgagctg

SEQ ID NO: 541175 - DNA, 25 bp, Rattus norvegicus
taactggtgcttgggccttgagctg

SEQ ID NO: 541176 - DNA, 25 bp, Rattus norvegicus
taactggtgtgactgcctctctgtc

SEQ ID NO: 541177 - DNA, 25 bp, Rattus norvegicus
taactggtgtgagtgcctctctgtc

SEQ ID NO: 541178 - DNA, 25 bp, Rattus norvegicus
taactgtaagctagtccttttaaag

SEQ ID NO: 541179 - DNA, 25 bp, Rattus norvegicus
taactgtaagcttgtccttttaaag

SEQ ID NO: 541180 - DNA, 25 bp, Rattus norvegicus
taactgtaaggccattccctcttaa

SEQ ID NO: 541181 - DNA, 25 bp, Rattus norvegicus
taactgtaaggcgattccctcttaa

SEQ ID NO: 541182 - DNA, 25 bp, Rattus norvegicus
taactgtaatttagcctccactatg

SEQ ID NO: 541183 - DNA, 25 bp, Rattus norvegicus
taactgtaattttgcctccactatg

SEQ ID NO: 541184 - DNA, 25 bp, Rattus norvegicus
taactgtacattattctcgctgttg

SEQ ID NO: 541185 - DNA, 25 bp, Rattus norvegicus
taactgtacatttttctcgctgttg

SEQ ID NO: 541186 - DNA, 25 bp, Rattus norvegicus
taactgtacgagactctttcctatc

SEQ ID NO: 541187 - DNA, 25 bp, Rattus norvegicus
taactgtacgagtctctttcctatc

SEQ ID NO: 541188 - DNA, 25 bp, Rattus norvegicus
taactgtagctacaccctaaagcca

SEQ ID NO: 541189 - DNA, 25 bp, Rattus norvegicus
taactgtagctagaccctaaagcca

SEQ ID NO: 541190 - DNA, 25 bp, Rattus norvegicus
taactgtaggcaaacattttttgca

SEQ ID NO: 541191 - DNA, 25 bp, Rattus norvegicus
taactgtaggcatacattttttgca

SEQ ID NO: 541192 - DNA, 25 bp, Rattus norvegicus
taactgtaggccacatgcgcacatc

SEQ ID NO: 541193 - DNA, 25 bp, Rattus norvegicus
taactgtaggcctcatgcgcacatc

SEQ ID NO: 541194 - DNA, 25 bp, Rattus norvegicus
taactgtatagtacccgtgtccatc

SEQ ID NO: 541195 - DNA, 25 bp, Rattus norvegicus
taactgtatagttcccgtgtccatc

SEQ ID NO: 541196 - DNA, 25 bp, Rattus norvegicus
taactgtatttaatggcggtgtatc

SEQ ID NO: 541197 - DNA, 25 bp, Rattus norvegicus
taactgtatttattggcggtgtatc

SEQ ID NO: 541198 - DNA, 25 bp, Rattus norvegicus
taactgtccctgctgggtggcgaca

SEQ ID NO: 541199 - DNA, 25 bp, Rattus norvegicus
taactgtccctggtgggtggcgaca

SEQ ID NO: 541200 - DNA, 25 bp, Rattus norvegicus
taactgtcgacacgcttgcatgctg

SEQ ID NO: 541201 - DNA, 25 bp, Rattus norvegicus
taactgtcgacaggcttgcatgctg

SEQ ID NO: 541202 - DNA, 25 bp, Rattus norvegicus
taactgtcgcggaccgacagcgagt

SEQ ID NO: 541203 - DNA, 25 bp, Rattus norvegicus
taactgtcgcggtccgacagcgagt

SEQ ID NO: 541204 - DNA, 25 bp, Rattus norvegicus
taactgtctcatacctctgagcttc

SEQ ID NO: 541205 - DNA, 25 bp, Rattus norvegicus
taactgtctcattcctctgagcttc

SEQ ID NO: 541206 - DNA, 25 bp, Rattus norvegicus
taactgtctcgacttttgccctggt

SEQ ID NO: 541207 - DNA, 25 bp, Rattus norvegicus
taactgtctcgagttttgccctggt

SEQ ID NO: 541208 - DNA, 25 bp, Rattus norvegicus
taactgtctctgagctacaactgtc

SEQ ID NO: 541209 - DNA, 25 bp, Rattus norvegicus
taactgtctctgtgctacaactgtc

SEQ ID NO: 541210 - DNA, 25 bp, Rattus norvegicus
taactgtcttcgaattttatcgcca

SEQ ID NO: 541211 - DNA, 25 bp, Rattus norvegicus
taactgtcttcgtattttatcgcca

SEQ ID NO: 541212 - DNA, 25 bp, Rattus norvegicus
taactgtgaacaagggctggtccct

SEQ ID NO: 541213 - DNA, 25 bp, Rattus norvegicus
taactgtgaacatgggctggtccct

SEQ ID NO: 541214 - DNA, 25 bp, Rattus norvegicus
taactgtgacagagctaccttccca

SEQ ID NO: 541215 - DNA, 25 bp, Rattus norvegicus
taactgtgacagtgctaccttccca

SEQ ID NO: 541216 - DNA, 25 bp, Rattus norvegicus
taactgtgacctcctgcactgtgaa

SEQ ID NO: 541217 - DNA, 25 bp, Rattus norvegicus
taactgtgacctgctgcactgtgaa

SEQ ID NO: 541218 - DNA, 25 bp, Rattus norvegicus
taactgtgagctatagagcctgccc

SEQ ID NO: 541219 - DNA, 25 bp, Rattus norvegicus
taactgtgagctttagagcctgccc

SEQ ID NO: 541220 - DNA, 25 bp, Rattus norvegicus
taactgtgccgcctctggtaattcc

SEQ ID NO: 541221 - DNA, 25 bp, Rattus norvegicus
taactgtgccgcgtctggtaattcc

SEQ ID NO: 541222 - DNA, 25 bp, Rattus norvegicus
taactgtggttccaaatcgcccagg

SEQ ID NO: 541223 - DNA, 25 bp, Rattus norvegicus
taactgtggttcgaaatcgcccagg

SEQ ID NO: 541224 - DNA, 25 bp, Rattus norvegicus
taactgttaactccagctggcgaac

SEQ ID NO: 541225 - DNA, 25 bp, Rattus norvegicus
taactgttaactgcagctggcgaac

SEQ ID NO: 541226 - DNA, 25 bp, Rattus norvegicus
taactgttaccccattagtcagcca

SEQ ID NO: 541227 - DNA, 25 bp, Rattus norvegicus
taactgttacccgattagtcagcca

SEQ ID NO: 541228 - DNA, 25 bp, Rattus norvegicus
taactgttatggacgcctcatctct

SEQ ID NO: 541229 - DNA, 25 bp, Rattus norvegicus
taactgttatggtcgcctcatctct

SEQ ID NO: 541230 - DNA, 25 bp, Rattus norvegicus
taactgttctccacagctgggctgg

SEQ ID NO: 541231 - DNA, 25 bp, Rattus norvegicus
taactgttctcctcagctgggctgg

SEQ ID NO: 541232 - DNA, 20 bp, Rattus norvegicus
taactgttgcatgcctacat

SEQ ID NO: 541233 - DNA, 20 bp, Rattus norvegicus
taactgttgcctgcctacat

SEQ ID NO: 541234 - DNA, 20 bp, Rattus norvegicus
taactgttgcgtgcctacat

SEQ ID NO: 541235 - DNA, 20 bp, Rattus norvegicus
taactgttgcttgcctacat

SEQ ID NO: 541236 - DNA, 25 bp, Rattus norvegicus
taactgttggctaagggacatggca

SEQ ID NO: 541237 - DNA, 25 bp, Rattus norvegicus
taactgttggcttagggacatggca

SEQ ID NO: 541238 - DNA, 25 bp, Rattus norvegicus
taactgttttctcgttactgggaag

SEQ ID NO: 541239 - DNA, 25 bp, Rattus norvegicus
taactgttttctggttactgggaag

SEQ ID NO: 541240 - DNA, 25 bp, Rattus norvegicus
taactgttttttcgaccatgccttt

SEQ ID NO: 541241 - DNA, 25 bp, Rattus norvegicus
taactgttttttggaccatgccttt

SEQ ID NO: 541242 - DNA, 25 bp, Rattus norvegicus
taacttaaagtcacctccttgatcc

SEQ ID NO: 541243 - DNA, 25 bp, Rattus norvegicus
taacttaaagtctcctccttgatcc

SEQ ID NO: 541244 - DNA, 25 bp, Rattus norvegicus
taacttaaccgtcttagtgctaaat

SEQ ID NO: 541245 - DNA, 25 bp, Rattus norvegicus
taacttaaccgtgttagtgctaaat

SEQ ID NO: 541246 - DNA, 25 bp, Rattus norvegicus
taacttaacttgacattttcttggt

SEQ ID NO: 541247 - DNA, 25 bp, Rattus norvegicus
taacttaacttgtcattttcttggt

SEQ ID NO: 541248 - DNA, 25 bp, Rattus norvegicus
taacttaatccaaactgcactgttg

SEQ ID NO: 541249 - DNA, 25 bp, Rattus norvegicus
taacttaatccatactgcactgttg

SEQ ID NO: 541250 - DNA, 25 bp, Rattus norvegicus
taacttacacaaatccatcatttat

SEQ ID NO: 541251 - DNA, 25 bp, Rattus norvegicus
taacttacacaattccatcatttat

SEQ ID NO: 541252 - DNA, 25 bp, Rattus norvegicus
taacttaccgacatttgtttgagcc

SEQ ID NO: 541253 - DNA, 25 bp, Rattus norvegicus
taacttaccgacttttgtttgagcc

SEQ ID NO: 541254 - DNA, 25 bp, Rattus norvegicus
taacttacgttacgttcagcccaag

SEQ ID NO: 541255 - DNA, 25 bp, Rattus norvegicus
taacttacgttaggttcagcccaag

SEQ ID NO: 541256 - DNA, 25 bp, Rattus norvegicus
taacttactggaagctccctaaggc

SEQ ID NO: 541257 - DNA, 25 bp, Rattus norvegicus
taacttactggatgctccctaaggc

SEQ ID NO: 541258 - DNA, 25 bp, Rattus norvegicus
taacttactgtaccgtggtcttcct

SEQ ID NO: 541259 - DNA, 25 bp, Rattus norvegicus
taacttactgtagcgtggtcttcct

SEQ ID NO: 541260 - DNA, 25 bp, Rattus norvegicus
taacttagccctaacattgcatacc

SEQ ID NO: 541261 - DNA, 25 bp, Rattus norvegicus
taacttagcccttacattgcatacc

SEQ ID NO: 541262 - DNA, 25 bp, Rattus norvegicus
taacttaggcctctagcaccacttt

SEQ ID NO: 541263 - DNA, 25 bp, Rattus norvegicus
taacttaggcctgtagcaccacttt

SEQ ID NO: 541264 - DNA, 25 bp, Rattus norvegicus
taacttataaagagcacctcgccgc

SEQ ID NO: 541265 - DNA, 25 bp, Rattus norvegicus
taacttataaagtgcacctcgccgc

SEQ ID NO: 541266 - DNA, 25 bp, Rattus norvegicus
taacttataagtatgctgagtgtaa

SEQ ID NO: 541267 - DNA, 25 bp, Rattus norvegicus
taacttataagtttgctgagtgtaa

SEQ ID NO: 541268 - DNA, 25 bp, Rattus norvegicus
taacttatactaaccctcagcaact

SEQ ID NO: 541269 - DNA, 25 bp, Rattus norvegicus
taacttatactatccctcagcaact

SEQ ID NO: 541270 - DNA, 25 bp, Rattus norvegicus
taacttatatttcccttcacgaagg

SEQ ID NO: 541271 - DNA, 25 bp, Rattus norvegicus
taacttatatttgccttcacgaagg

SEQ ID NO: 541272 - DNA, 25 bp, Rattus norvegicus
taacttatccgtcctgaccttgaac

SEQ ID NO: 541273 - DNA, 25 bp, Rattus norvegicus
taacttatccgtgctgaccttgaac

SEQ ID NO: 541274 - DNA, 25 bp, Rattus norvegicus
taacttatcttgatcctatccctgc

SEQ ID NO: 541275 - DNA, 25 bp, Rattus norvegicus
taacttatcttgttcctatccctgc

SEQ ID NO: 541276 - DNA, 25 bp, Rattus norvegicus
taacttattggcattctcctggctt

SEQ ID NO: 541277 - DNA, 25 bp, Rattus norvegicus
taacttattggctttctcctggctt

SEQ ID NO: 541278 - DNA, 25 bp, Rattus norvegicus
taacttattgttaacctgtggcgtg

SEQ ID NO: 541279 - DNA, 25 bp, Rattus norvegicus
taacttattgtttacctgtggcgtg

SEQ ID NO: 541280 - DNA, 25 bp, Rattus norvegicus
taacttcaatataagcacaatcatt

SEQ ID NO: 541281 - DNA, 25 bp, Rattus norvegicus
taacttcaatattagcacaatcatt

SEQ ID NO: 541282 - DNA, 25 bp, Rattus norvegicus
taacttcacagcaggctgacactac

SEQ ID NO: 541283 - DNA, 25 bp, Rattus norvegicus
taacttcacagctggctgacactac

SEQ ID NO: 541284 - DNA, 25 bp, Rattus norvegicus
taacttcagtagctcccacctagga

SEQ ID NO: 541285 - DNA, 25 bp, Rattus norvegicus
taacttcagtaggtcccacctagga

SEQ ID NO: 541286 - DNA, 25 bp, Rattus norvegicus
taacttcagttgatctcctcggtgt

SEQ ID NO: 541287 - DNA, 25 bp, Rattus norvegicus
taacttcagttgttctcctcggtgt

SEQ ID NO: 541288 - DNA, 25 bp, Rattus norvegicus
taacttcagtttacgccattcctaa

SEQ ID NO: 541289 - DNA, 25 bp, Rattus norvegicus
taacttcagttttcgccattcctaa

SEQ ID NO: 541290 - DNA, 25 bp, Rattus norvegicus
taacttcatcaaaggatcagccgtt

SEQ ID NO: 541291 - DNA, 25 bp, Rattus norvegicus
taacttcatcaatggatcagccgtt

SEQ ID NO: 541292 - DNA, 25 bp, Rattus norvegicus
taacttcatggtatttcttgccttc

SEQ ID NO: 541293 - DNA, 25 bp, Rattus norvegicus
taacttcatggtttttcttgccttc

SEQ ID NO: 541294 - DNA, 25 bp, Rattus norvegicus
taacttccaagtctgcacttctatg

SEQ ID NO: 541295 - DNA, 25 bp, Rattus norvegicus
taacttccaagtgtgcacttctatg

SEQ ID NO: 541296 - DNA, 25 bp, Rattus norvegicus
taacttccagtcctcagctatagtt

SEQ ID NO: 541297 - DNA, 25 bp, Rattus norvegicus
taacttccagtcgtcagctatagtt

SEQ ID NO: 541298 - DNA, 25 bp, Rattus norvegicus
taacttcccaagaacacttggaaca

SEQ ID NO: 541299 - DNA, 25 bp, Rattus norvegicus
taacttcccaagtacacttggaaca

SEQ ID NO: 541300 - DNA, 25 bp, Rattus norvegicus
taacttcccactaaactatcaggtc

SEQ ID NO: 541301 - DNA, 25 bp, Rattus norvegicus
taacttcccacttaactatcaggtc

SEQ ID NO: 541302 - DNA, 25 bp, Rattus norvegicus
taacttccccttaactattgtcagc

SEQ ID NO: 541303 - DNA, 25 bp, Rattus norvegicus
taacttcccctttactattgtcagc

SEQ ID NO: 541304 - DNA, 25 bp, Rattus norvegicus
taacttccgattatcatatcccact

SEQ ID NO: 541305 - DNA, 25 bp, Rattus norvegicus
taacttccgattttcatatcccact

SEQ ID NO: 541306 - DNA, 25 bp, Rattus norvegicus
taacttcctactcatttttccctag

SEQ ID NO: 541307 - DNA, 25 bp, Rattus norvegicus
taacttcctactgatttttccctag

SEQ ID NO: 541308 - DNA, 25 bp, Rattus norvegicus
taacttcctgatacatgtcctggtt

SEQ ID NO: 541309 - DNA, 25 bp, Rattus norvegicus
taacttcctgattcatgtcctggtt

SEQ ID NO: 541310 - DNA, 25 bp, Rattus norvegicus
taacttctagccctcaaattctttg

SEQ ID NO: 541311 - DNA, 25 bp, Rattus norvegicus
taacttctagccgtcaaattctttg

SEQ ID NO: 541312 - DNA, 25 bp, Rattus norvegicus
taacttctagttagggcaaaggagt

SEQ ID NO: 541313 - DNA, 25 bp, Rattus norvegicus
taacttctagtttgggcaaaggagt

SEQ ID NO: 541314 - DNA, 25 bp, Rattus norvegicus
taacttctcacaccagtctctggaa

SEQ ID NO: 541315 - DNA, 25 bp, Rattus norvegicus
taacttctcacagcagtctctggaa

SEQ ID NO: 541316 - DNA, 25 bp, Rattus norvegicus
taacttctccacaaacctatttcaa

SEQ ID NO: 541317 - DNA, 25 bp, Rattus norvegicus
taacttctccactaacctatttcaa

SEQ ID NO: 541318 - DNA, 25 bp, Rattus norvegicus
taacttctccggctcttacattttg

SEQ ID NO: 541319 - DNA, 25 bp, Rattus norvegicus
taacttctccgggtcttacattttg

SEQ ID NO: 541320 - DNA, 25 bp, Rattus norvegicus
taacttctctttaacatgctcaatg

SEQ ID NO: 541321 - DNA, 25 bp, Rattus norvegicus
taacttctcttttacatgctcaatg

SEQ ID NO: 541322 - DNA, 25 bp, Rattus norvegicus
taacttctgagacgactgattgctt

SEQ ID NO: 541323 - DNA, 25 bp, Rattus norvegicus
taacttctgagaggactgattgctt

SEQ ID NO: 541324 - DNA, 25 bp, Rattus norvegicus
taacttctgagtacccttcagtact

SEQ ID NO: 541325 - DNA, 25 bp, Rattus norvegicus
taacttctgagttcccttcagtact

SEQ ID NO: 541326 - DNA, 25 bp, Rattus norvegicus
taacttctgcccacagcaagcctga

SEQ ID NO: 541327 - DNA, 25 bp, Rattus norvegicus
taacttctgccctcagcaagcctga

SEQ ID NO: 541328 - DNA, 25 bp, Rattus norvegicus
taacttctgctgattctgtgaccga

SEQ ID NO: 541329 - DNA, 25 bp, Rattus norvegicus
taacttctgctgtttctgtgaccga

SEQ ID NO: 541330 - DNA, 25 bp, Rattus norvegicus
taacttctggataagggtcccactc

SEQ ID NO: 541331 - DNA, 25 bp, Rattus norvegicus
taacttctggattagggtcccactc

SEQ ID NO: 541332 - DNA, 25 bp, Rattus norvegicus
taacttctgtgaactgcgctgtgca

SEQ ID NO: 541333 - DNA, 25 bp, Rattus norvegicus
taacttctgtgatctgcgctgtgca

SEQ ID NO: 541334 - DNA, 25 bp, Rattus norvegicus
taacttctgtgccttctatgactgt

SEQ ID NO: 541335 - DNA, 25 bp, Rattus norvegicus
taacttctgtgcgttctatgactgt

SEQ ID NO: 541336 - DNA, 25 bp, Rattus norvegicus
taacttcttgttacgattcagggaa

SEQ ID NO: 541337 - DNA, 25 bp, Rattus norvegicus
taacttcttgtttcgattcagggaa

SEQ ID NO: 541338 - DNA, 25 bp, Rattus norvegicus
taacttctttaaaaccatgggctat

SEQ ID NO: 541339 - DNA, 25 bp, Rattus norvegicus
taacttctttaataccatgggctat

SEQ ID NO: 541340 - DNA, 25 bp, Rattus norvegicus
taacttcttttaccatccatctttg

SEQ ID NO: 541341 - DNA, 25 bp, Rattus norvegicus
taacttcttttagcatccatctttg

SEQ ID NO: 541342 - DNA, 25 bp, Rattus norvegicus
taacttgaacaccagtgggctccgg

SEQ ID NO: 541343 - DNA, 25 bp, Rattus norvegicus
taacttgaacacgagtgggctccgg

SEQ ID NO: 541344 - DNA, 25 bp, Rattus norvegicus
taacttgaccaaccccatggagcta

SEQ ID NO: 541345 - DNA, 25 bp, Rattus norvegicus
taacttgaccaagcccatggagcta

SEQ ID NO: 541346 - DNA, 25 bp, Rattus norvegicus
taacttgacttaaccgtaccctaca

SEQ ID NO: 541347 - DNA, 25 bp, Rattus norvegicus
taacttgacttatccgtaccctaca

SEQ ID NO: 541348 - DNA, 25 bp, Rattus norvegicus
taacttgagagccacactcatcctg

SEQ ID NO: 541349 - DNA, 25 bp, Rattus norvegicus
taacttgagagcgacactcatcctg

SEQ ID NO: 541350 - DNA, 25 bp, Rattus norvegicus
taacttgagcccacttttcacagct

SEQ ID NO: 541351 - DNA, 25 bp, Rattus norvegicus
taacttgagccctcttttcacagct

SEQ ID NO: 541352 - DNA, 25 bp, Rattus norvegicus
taacttgaggccatagctgtctacc

SEQ ID NO: 541353 - DNA, 25 bp, Rattus norvegicus
taacttgaggccttagctgtctacc

SEQ ID NO: 541354 - DNA, 25 bp, Rattus norvegicus
taacttgagtgtcctgtgtgagaga

SEQ ID NO: 541355 - DNA, 25 bp, Rattus norvegicus
taacttgagtgtgctgtgtgagaga

SEQ ID NO: 541356 - DNA, 25 bp, Rattus norvegicus
taacttgagttcctagcctgggacc

SEQ ID NO: 541357 - DNA, 25 bp, Rattus norvegicus
taacttgagttcgtagcctgggacc

SEQ ID NO: 541358 - DNA, 25 bp, Rattus norvegicus
taacttgatgctctggattgaaccc

SEQ ID NO: 541359 - DNA, 25 bp, Rattus norvegicus
taacttgatgctgtggattgaaccc

SEQ ID NO: 541360 - DNA, 25 bp, Rattus norvegicus
taacttgattaacttctgccctgaa

SEQ ID NO: 541361 - DNA, 25 bp, Rattus norvegicus
taacttgattaagttctgccctgaa

SEQ ID NO: 541362 - DNA, 25 bp, Rattus norvegicus
taacttgattctctgggcctactta

SEQ ID NO: 541363 - DNA, 25 bp, Rattus norvegicus
taacttgattctgtgggcctactta

SEQ ID NO: 541364 - DNA, 25 bp, Rattus norvegicus
taacttgccctcatgttctctcctg

SEQ ID NO: 541365 - DNA, 25 bp, Rattus norvegicus
taacttgccctcttgttctctcctg

SEQ ID NO: 541366 - DNA, 25 bp, Rattus norvegicus
taacttgcctgtcgtgtcacaacta

SEQ ID NO: 541367 - DNA, 25 bp, Rattus norvegicus
taacttgcctgtggtgtcacaacta

SEQ ID NO: 541368 - DNA, 25 bp, Rattus norvegicus
taacttgcgctgagtatttctcctt

SEQ ID NO: 541369 - DNA, 25 bp, Rattus norvegicus
taacttgcgctgtgtatttctcctt

SEQ ID NO: 541370 - DNA, 25 bp, Rattus norvegicus
taacttgctacaaagactcttcttg

SEQ ID NO: 541371 - DNA, 25 bp, Rattus norvegicus
taacttgctacatagactcttcttg

SEQ ID NO: 541372 - DNA, 25 bp, Rattus norvegicus
taacttgctgataagatgacatatg

SEQ ID NO: 541373 - DNA, 25 bp, Rattus norvegicus
taacttgctgattagatgacatatg

SEQ ID NO: 541374 - DNA, 25 bp, Rattus norvegicus
taacttgctgttcttggcacatgtg

SEQ ID NO: 541375 - DNA, 25 bp, Rattus norvegicus
taacttgctgttgttggcacatgtg

SEQ ID NO: 541376 - DNA, 25 bp, Rattus norvegicus
taacttgcttttccatgatgccacc

SEQ ID NO: 541377 - DNA, 25 bp, Rattus norvegicus
taacttgcttttcgtagaaccctct

SEQ ID NO: 541378 - DNA, 25 bp, Rattus norvegicus
taacttgcttttgcatgatgccacc

SEQ ID NO: 541379 - DNA, 25 bp, Rattus norvegicus
taacttgcttttggtagaaccctct

SEQ ID NO: 541380 - DNA, 25 bp, Rattus norvegicus
taacttggagagatgtgtccctcaa

SEQ ID NO: 541381 - DNA, 25 bp, Rattus norvegicus
taacttggagagttgtgtccctcaa

SEQ ID NO: 541382 - DNA, 25 bp, Rattus norvegicus
taacttggatcgaagtcctggcaat

SEQ ID NO: 541383 - DNA, 25 bp, Rattus norvegicus
taacttggatcgtagtcctggcaat

SEQ ID NO: 541384 - DNA, 25 bp, Rattus norvegicus
taacttggccgacatcttggagctg

SEQ ID NO: 541385 - DNA, 25 bp, Rattus norvegicus
taacttggccgagatcttggagctg

SEQ ID NO: 541386 - DNA, 25 bp, Rattus norvegicus
taacttggcgtgacctgagtgttgt

SEQ ID NO: 541387 - DNA, 25 bp, Rattus norvegicus
taacttggcgtgtcctgagtgttgt

SEQ ID NO: 541388 - DNA, 25 bp, Rattus norvegicus
taacttgggcatctaatcttgtcac

SEQ ID NO: 541389 - DNA, 25 bp, Rattus norvegicus
taacttgggcatgtaatcttgtcac

SEQ ID NO: 541390 - DNA, 25 bp, Rattus norvegicus
taacttgggccaactcagaaaggag

SEQ ID NO: 541391 - DNA, 25 bp, Rattus norvegicus
taacttgggccatctcagaaaggag

SEQ ID NO: 541392 - DNA, 25 bp, Rattus norvegicus
taacttgggttaccgctcagctttg

SEQ ID NO: 541393 - DNA, 25 bp, Rattus norvegicus
taacttgggttagcgctcagctttg

SEQ ID NO: 541394 - DNA, 25 bp, Rattus norvegicus
taacttggtaagcacctgcctgtag

SEQ ID NO: 541395 - DNA, 25 bp, Rattus norvegicus
taacttggtaaggacctgcctgtag

SEQ ID NO: 541396 - DNA, 25 bp, Rattus norvegicus
taacttggttctctcacttcatgat

SEQ ID NO: 541397 - DNA, 25 bp, Rattus norvegicus
taacttggttctgtcacttcatgat

SEQ ID NO: 541398 - DNA, 25 bp, Rattus norvegicus
taacttgtatatcccctatgctctg

SEQ ID NO: 541399 - DNA, 25 bp, Rattus norvegicus
taacttgtatatgccctatgctctg

SEQ ID NO: 541400 - DNA, 25 bp, Rattus norvegicus
taacttgtcagtcctacaccacttg

SEQ ID NO: 541401 - DNA, 25 bp, Rattus norvegicus
taacttgtcagtgctacaccacttg

SEQ ID NO: 541402 - DNA, 25 bp, Rattus norvegicus
taacttgtctttatcaccacactag

SEQ ID NO: 541403 - DNA, 25 bp, Rattus norvegicus
taacttgtctttttcaccacactag

SEQ ID NO: 541404 - DNA, 25 bp, Rattus norvegicus
taacttgtggttatgcttgactcgc

SEQ ID NO: 541405 - DNA, 25 bp, Rattus norvegicus
taacttgtggttttgcttgactcgc

SEQ ID NO: 541406 - DNA, 25 bp, Rattus norvegicus
taacttgtgtgacgttcccagcacc

SEQ ID NO: 541407 - DNA, 25 bp, Rattus norvegicus
taacttgtgtgaggttcccagcacc

SEQ ID NO: 541408 - DNA, 25 bp, Rattus norvegicus
taacttgttcccaatcactgacatg

SEQ ID NO: 541409 - DNA, 25 bp, Rattus norvegicus
taacttgttccctatcactgacatg

SEQ ID NO: 541410 - DNA, 25 bp, Rattus norvegicus
taacttgtttttcatgtactgccat

SEQ ID NO: 541411 - DNA, 25 bp, Rattus norvegicus
taacttgtttttgatgtactgccat

SEQ ID NO: 541412 - DNA, 25 bp, Rattus norvegicus
taactttacaccaagcattgcacaa

SEQ ID NO: 541413 - DNA, 25 bp, Rattus norvegicus
taactttacacctagcattgcacaa

SEQ ID NO: 541414 - DNA, 25 bp, Rattus norvegicus
taactttagagaactgaccctgcag

SEQ ID NO: 541415 - DNA, 25 bp, Rattus norvegicus
taactttagagatctgaccctgcag

SEQ ID NO: 541416 - DNA, 25 bp, Rattus norvegicus
taactttcagccagctccttgaagt

SEQ ID NO: 541417 - DNA, 25 bp, Rattus norvegicus
taactttcagcctgctccttgaagt

SEQ ID NO: 541418 - DNA, 25 bp, Rattus norvegicus
taactttcagttattactttagctt

SEQ ID NO: 541419 - DNA, 25 bp, Rattus norvegicus
taactttcagtttttactttagctt

SEQ ID NO: 541420 - DNA, 25 bp, Rattus norvegicus
taactttccactagagtgctgggaa

SEQ ID NO: 541421 - DNA, 25 bp, Rattus norvegicus
taactttccacttgagtgctgggaa

SEQ ID NO: 541422 - DNA, 25 bp, Rattus norvegicus
taactttccattaccttttgtgaat

SEQ ID NO: 541423 - DNA, 25 bp, Rattus norvegicus
taactttccatttccttttgtgaat

SEQ ID NO: 541424 - DNA, 25 bp, Rattus norvegicus
taactttctactagagctgccatcc

SEQ ID NO: 541425 - DNA, 25 bp, Rattus norvegicus
taactttctacttgagctgccatcc

SEQ ID NO: 541426 - DNA, 25 bp, Rattus norvegicus
taactttcttctatttgcttgccaa

SEQ ID NO: 541427 - DNA, 25 bp, Rattus norvegicus
taactttcttctttttgcttgccaa

SEQ ID NO: 541428 - DNA, 25 bp, Rattus norvegicus
taactttgagtacgccttttctcct

SEQ ID NO: 541429 - DNA, 25 bp, Rattus norvegicus
taactttgagtaggccttttctcct

SEQ ID NO: 541430 - DNA, 25 bp, Rattus norvegicus
taactttgagtcaagtcactgtttg

SEQ ID NO: 541431 - DNA, 25 bp, Rattus norvegicus
taactttgagtctagtcactgtttg

SEQ ID NO: 541432 - DNA, 25 bp, Rattus norvegicus
taactttgattaatctctgcctcct

SEQ ID NO: 541433 - DNA, 25 bp, Rattus norvegicus
taactttgattattctctgcctcct

SEQ ID NO: 541434 - DNA, 25 bp, Rattus norvegicus
taactttgcatgctcccaagtggac

SEQ ID NO: 541435 - DNA, 25 bp, Rattus norvegicus
taactttgcatggtcccaagtggac

SEQ ID NO: 541436 - DNA, 25 bp, Rattus norvegicus
taactttgcctcatcaagcctcaag

SEQ ID NO: 541437 - DNA, 25 bp, Rattus norvegicus
taactttgcctcttcaagcctcaag

SEQ ID NO: 541438 - DNA, 25 bp, Rattus norvegicus
taactttgctggatatgtctgtggg

SEQ ID NO: 541439 - DNA, 25 bp, Rattus norvegicus
taactttgctggttatgtctgtggg

SEQ ID NO: 541440 - DNA, 25 bp, Rattus norvegicus
taactttggcaacacgcccgatcta

SEQ ID NO: 541441 - DNA, 25 bp, Rattus norvegicus
taactttggcaagacgcccgatcta

SEQ ID NO: 541442 - DNA, 25 bp, Rattus norvegicus
taactttggctaaatgtcctcctat

SEQ ID NO: 541443 - DNA, 25 bp, Rattus norvegicus
taactttggctatatgtcctcctat

SEQ ID NO: 541444 - DNA, 25 bp, Rattus norvegicus
taactttggtttctcctgtatgttg

SEQ ID NO: 541445 - DNA, 25 bp, Rattus norvegicus
taactttggtttgtcctgtatgttg

SEQ ID NO: 541446 - DNA, 25 bp, Rattus norvegicus
taacttttagccatgtaattcagca

SEQ ID NO: 541447 - DNA, 25 bp, Rattus norvegicus
taacttttagccttgtaattcagca

SEQ ID NO: 541448 - DNA, 25 bp, Rattus norvegicus
taacttttatccaagcctttcccag

SEQ ID NO: 541449 - DNA, 25 bp, Rattus norvegicus
taacttttatcctagcctttcccag

SEQ ID NO: 541450 - DNA, 25 bp, Rattus norvegicus
taacttttcattacacatcgggctg

SEQ ID NO: 541451 - DNA, 25 bp, Rattus norvegicus
taacttttcattcctactcaccaca

SEQ ID NO: 541452 - DNA, 25 bp, Rattus norvegicus
taacttttcattgctactcaccaca

SEQ ID NO: 541453 - DNA, 25 bp, Rattus norvegicus
taacttttcatttcacatcgggctg

SEQ ID NO: 541454 - DNA, 25 bp, Rattus norvegicus
taacttttccatagtggtccccatg

SEQ ID NO: 541455 - DNA, 25 bp, Rattus norvegicus
taacttttccattgtggtccccatg

SEQ ID NO: 541456 - DNA, 25 bp, Rattus norvegicus
taacttttgactcttctgtgcgctt

SEQ ID NO: 541457 - DNA, 25 bp, Rattus norvegicus
taacttttgactgttctgtgcgctt

SEQ ID NO: 541458 - DNA, 25 bp, Rattus norvegicus
taacttttgcaaaacgctgtcgtct

SEQ ID NO: 541459 - DNA, 25 bp, Rattus norvegicus
taacttttgcaatacgctgtcgtct

SEQ ID NO: 541460 - DNA, 25 bp, Rattus norvegicus
taacttttggtacctaggtgctttg

SEQ ID NO: 541461 - DNA, 25 bp, Rattus norvegicus
taacttttggtagctaggtgctttg

SEQ ID NO: 541462 - DNA, 25 bp, Rattus norvegicus
taacttttgtttacctgactttgct

SEQ ID NO: 541463 - DNA, 25 bp, Rattus norvegicus
taacttttgttttcctgactttgct

SEQ ID NO: 541464 - DNA, 25 bp, Rattus norvegicus
taactttttcgaatcctgtgagggc

SEQ ID NO: 541465 - DNA, 25 bp, Rattus norvegicus
taactttttcgattcctgtgagggc

SEQ ID NO: 541466 - DNA, 25 bp, Rattus norvegicus
taactttttgctaaacacttttgct

SEQ ID NO: 541467 - DNA, 25 bp, Rattus norvegicus
taactttttgcttaacacttttgct

SEQ ID NO: 541468 - DNA, 25 bp, Rattus norvegicus
taactttttgtccaggtccaaggca

SEQ ID NO: 541469 - DNA, 25 bp, Rattus norvegicus
taactttttgtcgaggtccaaggca

SEQ ID NO: 541470 - DNA, 25 bp, Rattus norvegicus
taactttttgttcatattactcctt

SEQ ID NO: 541471 - DNA, 25 bp, Rattus norvegicus
taactttttgttgatattactcctt

SEQ ID NO: 541472 - DNA, 25 bp, Rattus norvegicus
taacttttttcaccctgcccaaact

SEQ ID NO: 541473 - DNA, 25 bp, Rattus norvegicus
taacttttttcagcctgcccaaact

SEQ ID NO: 541474 - DNA, 25 bp, Rattus norvegicus
taagaaaaaactcagcccacccagt

SEQ ID NO: 541475 - DNA, 25 bp, Rattus norvegicus
taagaaaaaactgagcccacccagt

SEQ ID NO: 541476 - DNA, 25 bp, Rattus norvegicus
taagaaaaccctcttcctcatccta

SEQ ID NO: 541477 - DNA, 25 bp, Rattus norvegicus
taagaaaaccctgttcctcatccta

SEQ ID NO: 541478 - DNA, 25 bp, Rattus norvegicus
taagaaaagggcacagggcatgcca

SEQ ID NO: 541479 - DNA, 25 bp, Rattus norvegicus
taagaaaagggctcagggcatgcca

SEQ ID NO: 541480 - DNA, 25 bp, Rattus norvegicus
taagaaacatcaccggccgagggca

SEQ ID NO: 541481 - DNA, 25 bp, Rattus norvegicus
taagaaacatcagcggccgagggca

SEQ ID NO: 541482 - DNA, 25 bp, Rattus norvegicus
taagaaacatgcagcctatgcctgg

SEQ ID NO: 541483 - DNA, 25 bp, Rattus norvegicus
taagaaacatgctgcctatgcctgg

SEQ ID NO: 541484 - DNA, 25 bp, Rattus norvegicus
taagaaaccctgcaatctcctgctt

SEQ ID NO: 541485 - DNA, 25 bp, Rattus norvegicus
taagaaaccctggaatctcctgctt

SEQ ID NO: 541486 - DNA, 25 bp, Rattus norvegicus
taagaaactcaactctccctagcgc

SEQ ID NO: 541487 - DNA, 25 bp, Rattus norvegicus
taagaaactcaagtctccctagcgc

SEQ ID NO: 541488 - DNA, 25 bp, Rattus norvegicus
taagaaactctccagtcgccttgct

SEQ ID NO: 541489 - DNA, 25 bp, Rattus norvegicus
taagaaactctcgagtcgccttgct

SEQ ID NO: 541490 - DNA, 25 bp, Rattus norvegicus
taagaaagatcacttcaatctgtcc

SEQ ID NO: 541491 - DNA, 25 bp, Rattus norvegicus
taagaaagatcagttcaatctgtcc

SEQ ID NO: 541492 - DNA, 25 bp, Rattus norvegicus
taagaaagcacaaccggcccagggt

SEQ ID NO: 541493 - DNA, 25 bp, Rattus norvegicus
taagaaagcacatccggcccagggt

SEQ ID NO: 541494 - DNA, 25 bp, Rattus norvegicus
taagaaaggtccagcgcaggctcac

SEQ ID NO: 541495 - DNA, 25 bp, Rattus norvegicus
taagaaaggtcctgcgcaggctcac

SEQ ID NO: 541496 - DNA, 25 bp, Rattus norvegicus
taagaaagtccacaagccgctccgt

SEQ ID NO: 541497 - DNA, 25 bp, Rattus norvegicus
taagaaagtccagaagccgctccgt

SEQ ID NO: 541498 - DNA, 25 bp, Rattus norvegicus
taagaaatcattccccaccatgaat

SEQ ID NO: 541499 - DNA, 25 bp, Rattus norvegicus
taagaaatcattgcccaccatgaat

SEQ ID NO: 541500 - DNA, 25 bp, Rattus norvegicus
taagaaatcgttagcattttgcata

SEQ ID NO: 541501 - DNA, 25 bp, Rattus norvegicus
taagaaatcgtttgcattttgcata

SEQ ID NO: 541502 - DNA, 25 bp, Rattus norvegicus
taagaaatgattaagtcgggattgg

SEQ ID NO: 541503 - DNA, 25 bp, Rattus norvegicus
taagaaatgatttagtcgggattgg

SEQ ID NO: 541504 - DNA, 25 bp, Rattus norvegicus
taagaaatgcacctcgccctggtgg

SEQ ID NO: 541505 - DNA, 25 bp, Rattus norvegicus
taagaaatgcacgtcgccctggtgg

SEQ ID NO: 541506 - DNA, 25 bp, Rattus norvegicus
taagaaatgcggctccccgtttaag

SEQ ID NO: 541507 - DNA, 25 bp, Rattus norvegicus
taagaaatgcgggtccccgtttaag

SEQ ID NO: 541508 - DNA, 25 bp, Rattus norvegicus
taagaaattttgcagctgttcctgg

SEQ ID NO: 541509 - DNA, 25 bp, Rattus norvegicus
taagaaattttggagctgttcctgg

SEQ ID NO: 541510 - DNA, 25 bp, Rattus norvegicus
taagaacaacatcagcacctacgga

SEQ ID NO: 541511 - DNA, 25 bp, Rattus norvegicus
taagaacaacatgagcacctacgga

SEQ ID NO: 541512 - DNA, 25 bp, Rattus norvegicus
taagaacagaagactcctcgtcacc

SEQ ID NO: 541513 - DNA, 25 bp, Rattus norvegicus
taagaacagaagtctcctcgtcacc

SEQ ID NO: 541514 - DNA, 25 bp, Rattus norvegicus
taagaacagcagaggcgccgcccag

SEQ ID NO: 541515 - DNA, 25 bp, Rattus norvegicus
taagaacagcagtggcgccgcccag

SEQ ID NO: 541516 - DNA, 25 bp, Rattus norvegicus
taagaacatcgacaacctctctggt

SEQ ID NO: 541517 - DNA, 25 bp, Rattus norvegicus
taagaacatcgagaacctctctggt

SEQ ID NO: 541518 - DNA, 25 bp, Rattus norvegicus
taagaacattccaattccaaccctg

SEQ ID NO: 541519 - DNA, 25 bp, Rattus norvegicus
taagaacattcctattccaaccctg

SEQ ID NO: 541520 - DNA, 25 bp, Rattus norvegicus
taagaaccaactctaatagccgtga

SEQ ID NO: 541521 - DNA, 25 bp, Rattus norvegicus
taagaaccaactgtaatagccgtga

SEQ ID NO: 541522 - DNA, 25 bp, Rattus norvegicus
taagaaccaagacaaagccccattt

SEQ ID NO: 541523 - DNA, 25 bp, Rattus norvegicus
taagaaccaagagaaagccccattt

SEQ ID NO: 541524 - DNA, 25 bp, Rattus norvegicus
taagaaccacggaaatctcaccccg

SEQ ID NO: 541525 - DNA, 25 bp, Rattus norvegicus
taagaaccacggtaatctcaccccg

SEQ ID NO: 541526 - DNA, 25 bp, Rattus norvegicus
taagaaccagttccccgcagagaga

SEQ ID NO: 541527 - DNA, 25 bp, Rattus norvegicus
taagaaccagttgcccgcagagaga

SEQ ID NO: 541528 - DNA, 25 bp, Rattus norvegicus
taagaaccataactgctgacgtctg

SEQ ID NO: 541529 - DNA, 25 bp, Rattus norvegicus
taagaaccataagtgctgacgtctg

SEQ ID NO: 541530 - DNA, 25 bp, Rattus norvegicus
taagaaccgaatcactgcccacaac

SEQ ID NO: 541531 - DNA, 25 bp, Rattus norvegicus
taagaaccgaatgactgcccacaac

SEQ ID NO: 541532 - DNA, 25 bp, Rattus norvegicus
taagaaccgtgcattgtgcctttta

SEQ ID NO: 541533 - DNA, 25 bp, Rattus norvegicus
taagaaccgtgctttgtgcctttta

SEQ ID NO: 541534 - DNA, 25 bp, Rattus norvegicus
taagaacctctcatttctcgaagca

SEQ ID NO: 541535 - DNA, 25 bp, Rattus norvegicus
taagaacctctcttttctcgaagca

SEQ ID NO: 541536 - DNA, 25 bp, Rattus norvegicus
taagaacctgagatttagaccccag

SEQ ID NO: 541537 - DNA, 25 bp, Rattus norvegicus
taagaacctgagttttagaccccag

SEQ ID NO: 541538 - DNA, 25 bp, Rattus norvegicus
taagaactacttcacatccgcagct

SEQ ID NO: 541539 - DNA, 25 bp, Rattus norvegicus
taagaactacttgacatccgcagct

SEQ ID NO: 541540 - DNA, 25 bp, Rattus norvegicus
taagaactcctgaaaaccttgccgt

SEQ ID NO: 541541 - DNA, 25 bp, Rattus norvegicus
taagaactcctgtaaaccttgccgt

SEQ ID NO: 541542 - DNA, 25 bp, Rattus norvegicus
taagaactgccccttcctagaaagg

SEQ ID NO: 541543 - DNA, 25 bp, Rattus norvegicus
taagaactgcccgttcctagaaagg

SEQ ID NO: 541544 - DNA, 25 bp, Rattus norvegicus
taagaactgcgcctgctaactggat

SEQ ID NO: 541545 - DNA, 25 bp, Rattus norvegicus
taagaactgcgcgtgctaactggat

SEQ ID NO: 541546 - DNA, 25 bp, Rattus norvegicus
taagaactggaaccctggcactttc

SEQ ID NO: 541547 - DNA, 25 bp, Rattus norvegicus
taagaactggaagcctggcactttc

SEQ ID NO: 541548 - DNA, 25 bp, Rattus norvegicus
taagaactggcgcacgatggcactc

SEQ ID NO: 541549 - DNA, 25 bp, Rattus norvegicus
taagaactggcggacgatggcactc

SEQ ID NO: 541550 - DNA, 25 bp, Rattus norvegicus
taagaacttactcatccagttcccc

SEQ ID NO: 541551 - DNA, 25 bp, Rattus norvegicus
taagaacttactgatccagttcccc

SEQ ID NO: 541552 - DNA, 25 bp, Rattus norvegicus
taagaacttcctacctggaccttca

SEQ ID NO: 541553 - DNA, 25 bp, Rattus norvegicus
taagaacttccttcctggaccttca

SEQ ID NO: 541554 - DNA, 25 bp, Rattus norvegicus
taagaagaacctcctccaagaccct

SEQ ID NO: 541555 - DNA, 25 bp, Rattus norvegicus
taagaagaacctgctccaagaccct

SEQ ID NO: 541556 - DNA, 25 bp, Rattus norvegicus
taagaagacatactccttacggagc

SEQ ID NO: 541557 - DNA, 25 bp, Rattus norvegicus
taagaagacatagtccttacggagc

SEQ ID NO: 541558 - DNA, 25 bp, Rattus norvegicus
taagaagaccatcacagagctgcag

SEQ ID NO: 541559 - DNA, 25 bp, Rattus norvegicus
taagaagaccatgacagagctgcag

SEQ ID NO: 541560 - DNA, 25 bp, Rattus norvegicus
taagaagacccacgccttcgtcaga

SEQ ID NO: 541561 - DNA, 25 bp, Rattus norvegicus
taagaagacccaggccttcgtcaga

SEQ ID NO: 541562 - DNA, 25 bp, Rattus norvegicus
taagaagactttccccagcacaagg

SEQ ID NO: 541563 - DNA, 25 bp, Rattus norvegicus
taagaagactttgcccagcacaagg

SEQ ID NO: 541564 - DNA, 25 bp, Rattus norvegicus
taagaagaggaacccggcccaccat

SEQ ID NO: 541565 - DNA, 25 bp, Rattus norvegicus
taagaagaggaagccggcccaccat

SEQ ID NO: 541566 - DNA, 25 bp, Rattus norvegicus
taagaagagggtccccacaggcctg

SEQ ID NO: 541567 - DNA, 25 bp, Rattus norvegicus
taagaagagggtgcccacaggcctg

SEQ ID NO: 541568 - DNA, 25 bp, Rattus norvegicus
taagaagatcctacacacagcctgg

SEQ ID NO: 541569 - DNA, 25 bp, Rattus norvegicus
taagaagatccttcacacagcctgg

SEQ ID NO: 541570 - DNA, 25 bp, Rattus norvegicus
taagaagcacttcccagacttcaag

SEQ ID NO: 541571 - DNA, 25 bp, Rattus norvegicus
taagaagcacttgccagacttcaag

SEQ ID NO: 541572 - DNA, 25 bp, Rattus norvegicus
taagaagcaggactcagtttcccaa

SEQ ID NO: 541573 - DNA, 25 bp, Rattus norvegicus
taagaagcaggagtcagtttcccaa

SEQ ID NO: 541574 - DNA, 25 bp, Rattus norvegicus
taagaagcattcatttgggccctcc

SEQ ID NO: 541575 - DNA, 25 bp, Rattus norvegicus
taagaagcattcttttgggccctcc

SEQ ID NO: 541576 - DNA, 25 bp, Rattus norvegicus
taagaagccgagctcctacgacttt

SEQ ID NO: 541577 - DNA, 25 bp, Rattus norvegicus
taagaagccgaggtcctacgacttt

SEQ ID NO: 541578 - DNA, 25 bp, Rattus norvegicus
taagaagcctgcactgcgtactgct

SEQ ID NO: 541579 - DNA, 25 bp, Rattus norvegicus
taagaagcctgctctgcgtactgct

SEQ ID NO: 541580 - DNA, 25 bp, Rattus norvegicus
taagaagccttccttgcgattgcct

SEQ ID NO: 541581 - DNA, 25 bp, Rattus norvegicus
taagaagccttcgttgcgattgcct

SEQ ID NO: 541582 - DNA, 25 bp, Rattus norvegicus
taagaagcggccatttccctaatca

SEQ ID NO: 541583 - DNA, 25 bp, Rattus norvegicus
taagaagcggccttttccctaatca

SEQ ID NO: 541584 - DNA, 25 bp, Rattus norvegicus
taagaagctcttacgaatcaccgct

SEQ ID NO: 541585 - DNA, 25 bp, Rattus norvegicus
taagaagctctttcgaatcaccgct

SEQ ID NO: 541586 - DNA, 25 bp, Rattus norvegicus
taagaagctgatcaccaagggccgc

SEQ ID NO: 541587 - DNA, 25 bp, Rattus norvegicus
taagaagctgatgaccaagggccgc

SEQ ID NO: 541588 - DNA, 25 bp, Rattus norvegicus
taagaagctggaacattgcctccct

SEQ ID NO: 541589 - DNA, 25 bp, Rattus norvegicus
taagaagctggatcattgcctccct

SEQ ID NO: 541590 - DNA, 25 bp, Rattus norvegicus
taagaagcttggattactgccctaa

SEQ ID NO: 541591 - DNA, 25 bp, Rattus norvegicus
taagaagcttggtttactgccctaa

SEQ ID NO: 541592 - DNA, 25 bp, Rattus norvegicus
taagaagcttttcttctcttgagac

SEQ ID NO: 541593 - DNA, 25 bp, Rattus norvegicus
taagaagcttttgttctcttgagac

SEQ ID NO: 541594 - DNA, 25 bp, Rattus norvegicus
taagaaggacacagcaatccgccgg

SEQ ID NO: 541595 - DNA, 25 bp, Rattus norvegicus
taagaaggacactgcaatccgccgg

SEQ ID NO: 541596 - DNA, 25 bp, Rattus norvegicus
taagaaggagcaccatcatcaccac

SEQ ID NO: 541597 - DNA, 25 bp, Rattus norvegicus
taagaaggagcagcatcatcaccac

SEQ ID NO: 541598 - DNA, 25 bp, Rattus norvegicus
taagaaggatgaacccctctcctac

SEQ ID NO: 541599 - DNA, 25 bp, Rattus norvegicus
taagaaggatgatcccctctcctac

SEQ ID NO: 541600 - DNA, 25 bp, Rattus norvegicus
taagaagggaccaccggcagctggc

SEQ ID NO: 541601 - DNA, 25 bp, Rattus norvegicus
taagaagggacctccggcagctggc

SEQ ID NO: 541602 - DNA, 25 bp, Rattus norvegicus
taagaaggtgcactcctgggtgtct

SEQ ID NO: 541603 - DNA, 25 bp, Rattus norvegicus
taagaaggtgcagtcctgggtgtct

SEQ ID NO: 541604 - DNA, 25 bp, Rattus norvegicus
taagaaggtgccattgtgtgctatg

SEQ ID NO: 541605 - DNA, 25 bp, Rattus norvegicus
taagaaggtgcctttgtgtgctatg

SEQ ID NO: 541606 - DNA, 25 bp, Rattus norvegicus
taagaaggttgtcttccctgactct

SEQ ID NO: 541607 - DNA, 25 bp, Rattus norvegicus
taagaaggttgtgttccctgactct

SEQ ID NO: 541608 - DNA, 25 bp, Rattus norvegicus
taagaagtagataccctttcctcgt

SEQ ID NO: 541609 - DNA, 25 bp, Rattus norvegicus
taagaagtagattccctttcctcgt

SEQ ID NO: 541610 - DNA, 25 bp, Rattus norvegicus
taagaagtatgtcatcagcgatgaa

SEQ ID NO: 541611 - DNA, 25 bp, Rattus norvegicus
taagaagtatgtgatcagcgatgaa

SEQ ID NO: 541612 - DNA, 25 bp, Rattus norvegicus
taagaagtcacccttgaccatctgc

SEQ ID NO: 541613 - DNA, 25 bp, Rattus norvegicus
taagaagtcaccgttgaccatctgc

SEQ ID NO: 541614 - DNA, 25 bp, Rattus norvegicus
taagaagtccacagaagccctggct

SEQ ID NO: 541615 - DNA, 25 bp, Rattus norvegicus
taagaagtccactgaagccctggct

SEQ ID NO: 541616 - DNA, 25 bp, Rattus norvegicus
taagaagtcttcagcccagactgca

SEQ ID NO: 541617 - DNA, 25 bp, Rattus norvegicus
taagaagtcttctgcccagactgca

SEQ ID NO: 541618 - DNA, 25 bp, Rattus norvegicus
taagaagtgcaaagttagtgtcaac

SEQ ID NO: 541619 - DNA, 25 bp, Rattus norvegicus
taagaagtgcaatgttagtgtcaac

SEQ ID NO: 541620 - DNA, 25 bp, Rattus norvegicus
taagaagtgtttcgccagagccctg

SEQ ID NO: 541621 - DNA, 25 bp, Rattus norvegicus
taagaagtgtttggccagagccctg

SEQ ID NO: 541622 - DNA, 25 bp, Rattus norvegicus
taagaagttactaccctctcttggc

SEQ ID NO: 541623 - DNA, 25 bp, Rattus norvegicus
taagaagttacttccctctcttggc

SEQ ID NO: 541624 - DNA, 25 bp, Rattus norvegicus
taagaagttcctccaacctggaagt

SEQ ID NO: 541625 - DNA, 25 bp, Rattus norvegicus
taagaagttcctgcaacctggaagt

SEQ ID NO: 541626 - DNA, 25 bp, Rattus norvegicus
taagaagtttccataccctccactg

SEQ ID NO: 541627 - DNA, 25 bp, Rattus norvegicus
taagaagtttccttaccctccactg

SEQ ID NO: 541628 - DNA, 25 bp, Rattus norvegicus
taagaatacccaccagaaagacaat

SEQ ID NO: 541629 - DNA, 25 bp, Rattus norvegicus
taagaatacccagcagaaagacaat

SEQ ID NO: 541630 - DNA, 25 bp, Rattus norvegicus
taagaatagtgcagggccaccctac

SEQ ID NO: 541631 - DNA, 25 bp, Rattus norvegicus
taagaatagtgctgggccaccctac

SEQ ID NO: 541632 - DNA, 25 bp, Rattus norvegicus
taagaatccttcctgctggtgtgca

SEQ ID NO: 541633 - DNA, 25 bp, Rattus norvegicus
taagaatccttcgtgctggtgtgca

SEQ ID NO: 541634 - DNA, 25 bp, Rattus norvegicus
taagaatcggacctatggccttgct

SEQ ID NO: 541635 - DNA, 25 bp, Rattus norvegicus
taagaatcggacgtatggccttgct

SEQ ID NO: 541636 - DNA, 25 bp, Rattus norvegicus
taagaatcggcacctgacagtcacc

SEQ ID NO: 541637 - DNA, 25 bp, Rattus norvegicus
taagaatcggcagctgacagtcacc

SEQ ID NO: 541638 - DNA, 25 bp, Rattus norvegicus
taagaatgactgacttcccatccca

SEQ ID NO: 541639 - DNA, 25 bp, Rattus norvegicus
taagaatgactgtcttcccatccca

SEQ ID NO: 541640 - DNA, 25 bp, Rattus norvegicus
taagaatgagaaacacctggtgcta

SEQ ID NO: 541641 - DNA, 25 bp, Rattus norvegicus
taagaatgagaatcacctggtgcta

SEQ ID NO: 541642 - DNA, 25 bp, Rattus norvegicus
taagaatgagggatccgagccggat

SEQ ID NO: 541643 - DNA, 25 bp, Rattus norvegicus
taagaatgagggttccgagccggat

SEQ ID NO: 541644 - DNA, 25 bp, Rattus norvegicus
taagaatgcaggataatcagtaagc

SEQ ID NO: 541645 - DNA, 25 bp, Rattus norvegicus
taagaatgcaggttaatcagtaagc

SEQ ID NO: 541646 - DNA, 25 bp, Rattus norvegicus
taagaatgcctacctgaccagcaag

SEQ ID NO: 541647 - DNA, 25 bp, Rattus norvegicus
taagaatgcctagctgaccagcaag

SEQ ID NO: 541648 - DNA, 25 bp, Rattus norvegicus
taagaatgcctgcagccggtagacc

SEQ ID NO: 541649 - DNA, 25 bp, Rattus norvegicus
taagaatgcctggagccggtagacc

SEQ ID NO: 541650 - DNA, 25 bp, Rattus norvegicus
taagaatgctttctagccttcagag

SEQ ID NO: 541651 - DNA, 25 bp, Rattus norvegicus
taagaatgctttgtagccttcagag

SEQ ID NO: 541652 - DNA, 25 bp, Rattus norvegicus
taagaatgtcgtagcacctactgtc

SEQ ID NO: 541653 - DNA, 25 bp, Rattus norvegicus
taagaatgtcgttgcacctactgtc

SEQ ID NO: 541654 - DNA, 25 bp, Rattus norvegicus
taagaattattcacctgtaggctca

SEQ ID NO: 541655 - DNA, 25 bp, Rattus norvegicus
taagaattattctcctgtaggctca

SEQ ID NO: 541656 - DNA, 25 bp, Rattus norvegicus
taagaattctgcctgtctatctctc

SEQ ID NO: 541657 - DNA, 25 bp, Rattus norvegicus
taagaattctgcgtgtctatctctc

SEQ ID NO: 541658 - DNA, 25 bp, Rattus norvegicus
taagaattgcacaggtggtctgcct

SEQ ID NO: 541659 - DNA, 25 bp, Rattus norvegicus
taagaattgcactggtggtctgcct

SEQ ID NO: 541660 - DNA, 25 bp, Rattus norvegicus
taagaatttccacaaccacccaggg

SEQ ID NO: 541661 - DNA, 25 bp, Rattus norvegicus
taagaatttccagaaccacccaggg

SEQ ID NO: 541662 - DNA, 25 bp, Rattus norvegicus
taagaatttcccaactatccccaag

SEQ ID NO: 541663 - DNA, 25 bp, Rattus norvegicus
taagaatttccctactatccccaag

SEQ ID NO: 541664 - DNA, 25 bp, Rattus norvegicus
taagaatttcttagccctgtgcaac

SEQ ID NO: 541665 - DNA, 25 bp, Rattus norvegicus
taagaatttctttgccctgtgcaac

SEQ ID NO: 541666 - DNA, 25 bp, Rattus norvegicus
taagaatttgcactctatttgatat

SEQ ID NO: 541667 - DNA, 25 bp, Rattus norvegicus
taagaatttgcagtctatttgatat

SEQ ID NO: 541668 - DNA, 25 bp, Rattus norvegicus
taagacaaaccaccaaccagttgaa

SEQ ID NO: 541669 - DNA, 25 bp, Rattus norvegicus
taagacaaaccagcaaccagttgaa

SEQ ID NO: 541670 - DNA, 25 bp, Rattus norvegicus
taagacaaacttagccagccactta

SEQ ID NO: 541671 - DNA, 25 bp, Rattus norvegicus
taagacaaactttgccagccactta

SEQ ID NO: 541672 - DNA, 25 bp, Rattus norvegicus
taagacaaagtcacctcttcatcct

SEQ ID NO: 541673 - DNA, 25 bp, Rattus norvegicus
taagacaaagtctcctcttcatcct

SEQ ID NO: 541674 - DNA, 25 bp, Rattus norvegicus
taagacaactctcaggaactccaca

SEQ ID NO: 541675 - DNA, 25 bp, Rattus norvegicus
taagacaactctgaggaactccaca

SEQ ID NO: 541676 - DNA, 25 bp, Rattus norvegicus
taagacaagcttagtcctcttcctt

SEQ ID NO: 541677 - DNA, 25 bp, Rattus norvegicus
taagacaagctttgtcctcttcctt

SEQ ID NO: 541678 - DNA, 25 bp, Rattus norvegicus
taagacaatcaaacccttttgggta

SEQ ID NO: 541679 - DNA, 25 bp, Rattus norvegicus
taagacaatcaactccgataactga

SEQ ID NO: 541680 - DNA, 25 bp, Rattus norvegicus
taagacaatcaagtccgataactga

SEQ ID NO: 541681 - DNA, 25 bp, Rattus norvegicus
taagacaatcaatcccttttgggta

SEQ ID NO: 541682 - DNA, 25 bp, Rattus norvegicus
taagacaatggtacacactcctcac

SEQ ID NO: 541683 - DNA, 25 bp, Rattus norvegicus
taagacaatggttcacactcctcac

SEQ ID NO: 541684 - DNA, 25 bp, Rattus norvegicus
taagacacaaagagccacctacttg

SEQ ID NO: 541685 - DNA, 25 bp, Rattus norvegicus
taagacacaaagtgccacctacttg

SEQ ID NO: 541686 - DNA, 25 bp, Rattus norvegicus
taagacaccgtaactcaacactcag

SEQ ID NO: 541687 - DNA, 25 bp, Rattus norvegicus
taagacaccgtatctcaacactcag

SEQ ID NO: 541688 - DNA, 25 bp, Rattus norvegicus
taagacactacgaggtgggccgcag

SEQ ID NO: 541689 - DNA, 25 bp, Rattus norvegicus
taagacactacgtggtgggccgcag

SEQ ID NO: 541690 - DNA, 25 bp, Rattus norvegicus
taagacactactactgtggcccaac

SEQ ID NO: 541691 - DNA, 25 bp, Rattus norvegicus
taagacactacttctgtggcccaac

SEQ ID NO: 541692 - DNA, 25 bp, Rattus norvegicus
taagacactctgacctagtgaggga

SEQ ID NO: 541693 - DNA, 25 bp, Rattus norvegicus
taagacactctgtcctagtgaggga

SEQ ID NO: 541694 - DNA, 25 bp, Rattus norvegicus
taagacactgtgaggcttgccataa

SEQ ID NO: 541695 - DNA, 25 bp, Rattus norvegicus
taagacactgtgtggcttgccataa

SEQ ID NO: 541696 - DNA, 25 bp, Rattus norvegicus
taagacacttaccttaggccacact

SEQ ID NO: 541697 - DNA, 25 bp, Rattus norvegicus
taagacacttacgttaggccacact

SEQ ID NO: 541698 - DNA, 25 bp, Rattus norvegicus
taagacagacacaagacctacccct

SEQ ID NO: 541699 - DNA, 25 bp, Rattus norvegicus
taagacagacactagacctacccct

SEQ ID NO: 541700 - DNA, 25 bp, Rattus norvegicus
taagacagacgcacagcaggtaagc

SEQ ID NO: 541701 - DNA, 25 bp, Rattus norvegicus
taagacagacgctcagcaggtaagc

SEQ ID NO: 541702 - DNA, 25 bp, Rattus norvegicus
taagacagggtgaccctgtgtaccc

SEQ ID NO: 541703 - DNA, 25 bp, Rattus norvegicus
taagacagggtgtccctgtgtaccc

SEQ ID NO: 541704 - DNA, 25 bp, Rattus norvegicus
taagacatctgcagcgggaggccca

SEQ ID NO: 541705 - DNA, 25 bp, Rattus norvegicus
taagacatctgctgcgggaggccca

SEQ ID NO: 541706 - DNA, 25 bp, Rattus norvegicus
taagacatgaagcacaccccagatc

SEQ ID NO: 541707 - DNA, 25 bp, Rattus norvegicus
taagacatgaaggacaccccagatc

SEQ ID NO: 541708 - DNA, 25 bp, Rattus norvegicus
taagacatgaccactgctgtacctg

SEQ ID NO: 541709 - DNA, 25 bp, Rattus norvegicus
taagacatgacctctgctgtacctg

SEQ ID NO: 541710 - DNA, 25 bp, Rattus norvegicus
taagacatggatcgccctgtgctcc

SEQ ID NO: 541711 - DNA, 25 bp, Rattus norvegicus
taagacatggatggccctgtgctcc

SEQ ID NO: 541712 - DNA, 25 bp, Rattus norvegicus
taagacattactctgctgattggaa

SEQ ID NO: 541713 - DNA, 25 bp, Rattus norvegicus
taagacattactgtgctgattggaa

SEQ ID NO: 541714 - DNA, 25 bp, Rattus norvegicus
taagacatttgtaaacggtcccaat

SEQ ID NO: 541715 - DNA, 25 bp, Rattus norvegicus
taagacatttgttaacggtcccaat

SEQ ID NO: 541716 - DNA, 25 bp, Rattus norvegicus
taagaccaccaacacctgggtattg

SEQ ID NO: 541717 - DNA, 25 bp, Rattus norvegicus
taagaccaccaagacctgggtattg

SEQ ID NO: 541718 - DNA, 25 bp, Rattus norvegicus
taagaccacctccagatttcttgtt

SEQ ID NO: 541719 - DNA, 25 bp, Rattus norvegicus
taagaccacctcgagatttcttgtt

SEQ ID NO: 541720 - DNA, 25 bp, Rattus norvegicus
taagaccacttcagctggcttgcaa

SEQ ID NO: 541721 - DNA, 25 bp, Rattus norvegicus
taagaccacttctgctggcttgcaa

SEQ ID NO: 541722 - DNA, 25 bp, Rattus norvegicus
taagaccagggtcgtacaggagcat

SEQ ID NO: 541723 - DNA, 25 bp, Rattus norvegicus
taagaccagggtggtacaggagcat

SEQ ID NO: 541724 - DNA, 25 bp, Rattus norvegicus
taagaccataagctttcccactggg

SEQ ID NO: 541725 - DNA, 25 bp, Rattus norvegicus
taagaccataaggtttcccactggg

SEQ ID NO: 541726 - DNA, 25 bp, Rattus norvegicus
taagaccattatagatgccagtgtg

SEQ ID NO: 541727 - DNA, 25 bp, Rattus norvegicus
taagaccattattgatgccagtgtg

SEQ ID NO: 541728 - DNA, 25 bp, Rattus norvegicus
taagacccaggtacacttggcatcc

SEQ ID NO: 541729 - DNA, 25 bp, Rattus norvegicus
taagacccaggtagccctttcagaa

SEQ ID NO: 541730 - DNA, 25 bp, Rattus norvegicus
taagacccaggttcacttggcatcc

SEQ ID NO: 541731 - DNA, 25 bp, Rattus norvegicus
taagacccaggttgccctttcagaa

SEQ ID NO: 541732 - DNA, 25 bp, Rattus norvegicus
taagacccatctcatttcgacttcg

SEQ ID NO: 541733 - DNA, 25 bp, Rattus norvegicus
taagacccatctgatttcgacttcg

SEQ ID NO: 541734 - DNA, 25 bp, Rattus norvegicus
taagaccccaggagtcagtgtccct

SEQ ID NO: 541735 - DNA, 25 bp, Rattus norvegicus
taagaccccaggtgtcagtgtccct

SEQ ID NO: 541736 - DNA, 25 bp, Rattus norvegicus
taagacccctttaattttcgctgtg

SEQ ID NO: 541737 - DNA, 25 bp, Rattus norvegicus
taagaccccttttattttcgctgtg

SEQ ID NO: 541738 - DNA, 25 bp, Rattus norvegicus
taagacccttccagtctcagcttgg

SEQ ID NO: 541739 - DNA, 25 bp, Rattus norvegicus
taagacccttcctgtctcagcttgg

SEQ ID NO: 541740 - DNA, 25 bp, Rattus norvegicus
taagacctacggcatcaagcacatg

SEQ ID NO: 541741 - DNA, 25 bp, Rattus norvegicus
taagacctacgggatcaagcacatg

SEQ ID NO: 541742 - DNA, 25 bp, Rattus norvegicus
taagacctataaaagctcccggagc

SEQ ID NO: 541743 - DNA, 25 bp, Rattus norvegicus
taagacctataatagctcccggagc

SEQ ID NO: 541744 - DNA, 25 bp, Rattus norvegicus
taagacctcgtcctagttgccttga

SEQ ID NO: 541745 - DNA, 25 bp, Rattus norvegicus
taagacctcgtcgtagttgccttga

SEQ ID NO: 541746 - DNA, 25 bp, Rattus norvegicus
taagacctgcacaccggactgtaag

SEQ ID NO: 541747 - DNA, 25 bp, Rattus norvegicus
taagacctgcactccggactgtaag

SEQ ID NO: 541748 - DNA, 25 bp, Rattus norvegicus
taagaccttcagacccctgtggaaa

SEQ ID NO: 541749 - DNA, 25 bp, Rattus norvegicus
taagaccttcagtcccctgtggaaa

SEQ ID NO: 541750 - DNA, 25 bp, Rattus norvegicus
taagaccttgcgcaataggctaatt

SEQ ID NO: 541751 - DNA, 25 bp, Rattus norvegicus
taagaccttgcggaataggctaatt

SEQ ID NO: 541752 - DNA, 25 bp, Rattus norvegicus
taagacctttggctcaaggcggaga

SEQ ID NO: 541753 - DNA, 25 bp, Rattus norvegicus
taagacctttgggtcaaggcggaga

SEQ ID NO: 541754 - DNA, 25 bp, Rattus norvegicus
taagacgcaatcaatcgctcgacct

SEQ ID NO: 541755 - DNA, 25 bp, Rattus norvegicus
taagacgcaatctatcgctcgacct

SEQ ID NO: 541756 - DNA, 25 bp, Rattus norvegicus
taagacgctgtcacttctgtgtaca

SEQ ID NO: 541757 - DNA, 25 bp, Rattus norvegicus
taagacgctgtctcttctgtgtaca

SEQ ID NO: 541758 - DNA, 25 bp, Rattus norvegicus
taagacggacttcggtgcagctaca

SEQ ID NO: 541759 - DNA, 25 bp, Rattus norvegicus
taagacggacttgggtgcagctaca

SEQ ID NO: 541760 - DNA, 25 bp, Rattus norvegicus
taagactaatttattcactcaaaat

SEQ ID NO: 541761 - DNA, 25 bp, Rattus norvegicus
taagactaattttttcactcaaaat

SEQ ID NO: 541762 - DNA, 25 bp, Rattus norvegicus
taagactagctgctggagttcctgc

SEQ ID NO: 541763 - DNA, 25 bp, Rattus norvegicus
taagactagctggtggagttcctgc

SEQ ID NO: 541764 - DNA, 25 bp, Rattus norvegicus
taagactcacggagctctcagctaa

SEQ ID NO: 541765 - DNA, 25 bp, Rattus norvegicus
taagactcacggtgctctcagctaa

SEQ ID NO: 541766 - DNA, 25 bp, Rattus norvegicus
taagactcactcagccgatgttgga

SEQ ID NO: 541767 - DNA, 25 bp, Rattus norvegicus
taagactcactctgccgatgttgga

SEQ ID NO: 541768 - DNA, 25 bp, Rattus norvegicus
taagactcagggagatgccctgcct

SEQ ID NO: 541769 - DNA, 25 bp, Rattus norvegicus
taagactcagggtgatgccctgcct

SEQ ID NO: 541770 - DNA, 25 bp, Rattus norvegicus
taagactccacacggttcacatggt

SEQ ID NO: 541771 - DNA, 25 bp, Rattus norvegicus
taagactccacagggttcacatggt

SEQ ID NO: 541772 - DNA, 25 bp, Rattus norvegicus
taagactccagacctttcttggttt

SEQ ID NO: 541773 - DNA, 25 bp, Rattus norvegicus
taagactccagagctttcttggttt

SEQ ID NO: 541774 - DNA, 25 bp, Rattus norvegicus
taagactccagtattgccttaaagg

SEQ ID NO: 541775 - DNA, 25 bp, Rattus norvegicus
taagactccagttttgccttaaagg

SEQ ID NO: 541776 - DNA, 25 bp, Rattus norvegicus
taagactcgagtactgttccagtgg

SEQ ID NO: 541777 - DNA, 25 bp, Rattus norvegicus
taagactcgagttctgttccagtgg

SEQ ID NO: 541778 - DNA, 25 bp, Rattus norvegicus
taagactcgccaaagtaagcccttg

SEQ ID NO: 541779 - DNA, 25 bp, Rattus norvegicus
taagactcgccatagtaagcccttg

SEQ ID NO: 541780 - DNA, 25 bp, Rattus norvegicus
taagactcgggactggccactgcca

SEQ ID NO: 541781 - DNA, 25 bp, Rattus norvegicus
taagactcgggagtggccactgcca

SEQ ID NO: 541782 - DNA, 25 bp, Rattus norvegicus
taagactctgaaacagcccagccaa

SEQ ID NO: 541783 - DNA, 25 bp, Rattus norvegicus
taagactctgaacacctacactagg

SEQ ID NO: 541784 - DNA, 25 bp, Rattus norvegicus
taagactctgaagacctacactagg

SEQ ID NO: 541785 - DNA, 25 bp, Rattus norvegicus
taagactctgaatcagcccagccaa

SEQ ID NO: 541786 - DNA, 25 bp, Rattus norvegicus
taagactctgtactttcctttctgc

SEQ ID NO: 541787 - DNA, 25 bp, Rattus norvegicus
taagactctgtagtttcctttctgc

SEQ ID NO: 541788 - DNA, 25 bp, Rattus norvegicus
taagactcttttacccttgaaacat

SEQ ID NO: 541789 - DNA, 25 bp, Rattus norvegicus
taagactctttttcccttgaaacat

SEQ ID NO: 541790 - DNA, 25 bp, Rattus norvegicus
taagactgcgtcagcatttttctga

SEQ ID NO: 541791 - DNA, 25 bp, Rattus norvegicus
taagactgcgtctgcatttttctga

SEQ ID NO: 541792 - DNA, 25 bp, Rattus norvegicus
taagactggacacacatcccatacc

SEQ ID NO: 541793 - DNA, 25 bp, Rattus norvegicus
taagactggacagacatcccatacc

SEQ ID NO: 541794 - DNA, 25 bp, Rattus norvegicus
taagactggaccaaacctccatggt

SEQ ID NO: 541795 - DNA, 25 bp, Rattus norvegicus
taagactggacctaacctccatggt

SEQ ID NO: 541796 - DNA, 25 bp, Rattus norvegicus
taagactggcgcagctggactagca

SEQ ID NO: 541797 - DNA, 25 bp, Rattus norvegicus
taagactggcgctgctggactagca

SEQ ID NO: 541798 - DNA, 25 bp, Rattus norvegicus
taagactgggacattcgcctccgat

SEQ ID NO: 541799 - DNA, 25 bp, Rattus norvegicus
taagactgggactttcgcctccgat

SEQ ID NO: 541800 - DNA, 25 bp, Rattus norvegicus
taagactggtcacggatgtccactc

SEQ ID NO: 541801 - DNA, 25 bp, Rattus norvegicus
taagactggtcagggatgtccactc

SEQ ID NO: 541802 - DNA, 25 bp, Rattus norvegicus
taagactgtcctcccacgagatcga

SEQ ID NO: 541803 - DNA, 25 bp, Rattus norvegicus
taagactgtcctgccacgagatcga

SEQ ID NO: 541804 - DNA, 25 bp, Rattus norvegicus
taagactgtctcaaagccccaaaac

SEQ ID NO: 541805 - DNA, 25 bp, Rattus norvegicus
taagactgtctctaagccccaaaac

SEQ ID NO: 541806 - DNA, 25 bp, Rattus norvegicus
taagactgtgcgatccaaccatgaa

SEQ ID NO: 541807 - DNA, 25 bp, Rattus norvegicus
taagactgtgcgttccaaccatgaa

SEQ ID NO: 541808 - DNA, 25 bp, Rattus norvegicus
taagactgttaacgccacaggctgg

SEQ ID NO: 541809 - DNA, 25 bp, Rattus norvegicus
taagactgttaaggccacaggctgg

SEQ ID NO: 541810 - DNA, 25 bp, Rattus norvegicus
taagacttccatacggagactgcaa

SEQ ID NO: 541811 - DNA, 25 bp, Rattus norvegicus
taagacttccattcggagactgcaa

SEQ ID NO: 541812 - DNA, 25 bp, Rattus norvegicus
taagacttctatactcacctttttc

SEQ ID NO: 541813 - DNA, 25 bp, Rattus norvegicus
taagacttctattctcacctttttc

SEQ ID NO: 541814 - DNA, 25 bp, Rattus norvegicus
taagacttgccacatcctttttaca

SEQ ID NO: 541815 - DNA, 25 bp, Rattus norvegicus
taagacttgccagatcctttttaca

SEQ ID NO: 541816 - DNA, 25 bp, Rattus norvegicus
taagacttgcctctggtagccatgt

SEQ ID NO: 541817 - DNA, 25 bp, Rattus norvegicus
taagacttgcctgtggtagccatgt

SEQ ID NO: 541818 - DNA, 25 bp, Rattus norvegicus
taagacttgggaaccatataccaaa

SEQ ID NO: 541819 - DNA, 25 bp, Rattus norvegicus
taagacttgggatccatataccaaa

SEQ ID NO: 541820 - DNA, 25 bp, Rattus norvegicus
taagacttggttcctcttgtttcct

SEQ ID NO: 541821 - DNA, 25 bp, Rattus norvegicus
taagacttggttgctcttgtttcct

SEQ ID NO: 541822 - DNA, 25 bp, Rattus norvegicus
taagactttaatactcagactggaa

SEQ ID NO: 541823 - DNA, 25 bp, Rattus norvegicus
taagactttaattctcagactggaa

SEQ ID NO: 541824 - DNA, 25 bp, Rattus norvegicus
taagagacaacaatggtaccaggga

SEQ ID NO: 541825 - DNA, 25 bp, Rattus norvegicus
taagagacaacattggtaccaggga

SEQ ID NO: 541826 - DNA, 25 bp, Rattus norvegicus
taagagacacggacagcaacttgct

SEQ ID NO: 541827 - DNA, 25 bp, Rattus norvegicus
taagagacacggtcagcaacttgct

SEQ ID NO: 541828 - DNA, 25 bp, Rattus norvegicus
taagagacatcaaggcccacgctac

SEQ ID NO: 541829 - DNA, 25 bp, Rattus norvegicus
taagagacatcatggcccacgctac

SEQ ID NO: 541830 - DNA, 25 bp, Rattus norvegicus
taagagaccaggaacgaatcccccg

SEQ ID NO: 541831 - DNA, 25 bp, Rattus norvegicus
taagagaccaggtacgaatcccccg

SEQ ID NO: 541832 - DNA, 25 bp, Rattus norvegicus
taagagacccagaggaagacccaaa

SEQ ID NO: 541833 - DNA, 25 bp, Rattus norvegicus
taagagacccagtggaagacccaaa

SEQ ID NO: 541834 - DNA, 25 bp, Rattus norvegicus
taagagacttttacccattgctggg

SEQ ID NO: 541835 - DNA, 25 bp, Rattus norvegicus
taagagactttttcccattgctggg

SEQ ID NO: 541836 - DNA, 25 bp, Rattus norvegicus
taagagagatccctcgttaccagaa

SEQ ID NO: 541837 - DNA, 25 bp, Rattus norvegicus
taagagagatccgtcgttaccagaa

SEQ ID NO: 541838 - DNA, 25 bp, Rattus norvegicus
taagagagcaatcggcttcctaccc

SEQ ID NO: 541839 - DNA, 25 bp, Rattus norvegicus
taagagagcaatgggcttcctaccc

SEQ ID NO: 541840 - DNA, 25 bp, Rattus norvegicus
taagagagcagtacccgggttaggc

SEQ ID NO: 541841 - DNA, 25 bp, Rattus norvegicus
taagagagcagttcccgggttaggc

SEQ ID NO: 541842 - DNA, 25 bp, Rattus norvegicus
taagagaggcagattagattccact

SEQ ID NO: 541843 - DNA, 25 bp, Rattus norvegicus
taagagaggcagtttagattccact

SEQ ID NO: 541844 - DNA, 25 bp, Rattus norvegicus
taagagagtctgctgatccctccac

SEQ ID NO: 541845 - DNA, 25 bp, Rattus norvegicus
taagagagtctggtgatccctccac

SEQ ID NO: 541846 - DNA, 25 bp, Rattus norvegicus
taagagatgagaagcccctccaggc

SEQ ID NO: 541847 - DNA, 25 bp, Rattus norvegicus
taagagatgagatgcccctccaggc

SEQ ID NO: 541848 - DNA, 25 bp, Rattus norvegicus
taagagatttcacccctggtaactc

SEQ ID NO: 541849 - DNA, 25 bp, Rattus norvegicus
taagagatttcagccctggtaactc

SEQ ID NO: 541850 - DNA, 25 bp, Rattus norvegicus
taagagatttcccaatcctccctga

SEQ ID NO: 541851 - DNA, 25 bp, Rattus norvegicus
taagagatttccgaatcctccctga

SEQ ID NO: 541852 - DNA, 25 bp, Rattus norvegicus
taagagcacacacacaagcctaatg

SEQ ID NO: 541853 - DNA, 25 bp, Rattus norvegicus
taagagcacacagacaagcctaatg

SEQ ID NO: 541854 - DNA, 25 bp, Rattus norvegicus
taagagcattgcatccacgtggtac

SEQ ID NO: 541855 - DNA, 25 bp, Rattus norvegicus
taagagcattgcttccacgtggtac

SEQ ID NO: 541856 - DNA, 25 bp, Rattus norvegicus
taagagccaacaaatagagggtgaa

SEQ ID NO: 541857 - DNA, 25 bp, Rattus norvegicus
taagagccaacatatagagggtgaa

SEQ ID NO: 541858 - DNA, 25 bp, Rattus norvegicus
taagagccacctatgaacttcattt

SEQ ID NO: 541859 - DNA, 25 bp, Rattus norvegicus
taagagccacctttgaacttcattt

SEQ ID NO: 541860 - DNA, 25 bp, Rattus norvegicus
taagagccattcagcttcagccttt

SEQ ID NO: 541861 - DNA, 25 bp, Rattus norvegicus
taagagccattctgcttcagccttt

SEQ ID NO: 541862 - DNA, 25 bp, Rattus norvegicus
taagagcccgcaagatcacaactga

SEQ ID NO: 541863 - DNA, 25 bp, Rattus norvegicus
taagagcccgcatgatcacaactga

SEQ ID NO: 541864 - DNA, 25 bp, Rattus norvegicus
taagagccggcaagcacagctctgt

SEQ ID NO: 541865 - DNA, 25 bp, Rattus norvegicus
taagagccggcatgcacagctctgt

SEQ ID NO: 541866 - DNA, 25 bp, Rattus norvegicus
taagagcctcttccggttgcagagt

SEQ ID NO: 541867 - DNA, 25 bp, Rattus norvegicus
taagagcctcttgcggttgcagagt

SEQ ID NO: 541868 - DNA, 25 bp, Rattus norvegicus
taagagccttgtactgacatttcag

SEQ ID NO: 541869 - DNA, 25 bp, Rattus norvegicus
taagagccttgttctgacatttcag

SEQ ID NO: 541870 - DNA, 25 bp, Rattus norvegicus
taagagcgatgcctcctaacacagt

SEQ ID NO: 541871 - DNA, 25 bp, Rattus norvegicus
taagagcgatgcgtcctaacacagt

SEQ ID NO: 541872 - DNA, 25 bp, Rattus norvegicus
taagagctaacaaacatcaatgtgg

SEQ ID NO: 541873 - DNA, 25 bp, Rattus norvegicus
taagagctaacatacatcaatgtgg

SEQ ID NO: 541874 - DNA, 25 bp, Rattus norvegicus
taagagctaacgactctggccaacc

SEQ ID NO: 541875 - DNA, 25 bp, Rattus norvegicus
taagagctaacgtctctggccaacc

SEQ ID NO: 541876 - DNA, 25 bp, Rattus norvegicus
taagagctacctattcttgaaaatt

SEQ ID NO: 541877 - DNA, 25 bp, Rattus norvegicus
taagagctaccttttcttgaaaatt

SEQ ID NO: 541878 - DNA, 25 bp, Rattus norvegicus
taagagctccgaagaggtccaccag

SEQ ID NO: 541879 - DNA, 25 bp, Rattus norvegicus
taagagctccgatgaggtccaccag

SEQ ID NO: 541880 - DNA, 25 bp, Rattus norvegicus
taagagctcctgcttaccggctgag

SEQ ID NO: 541881 - DNA, 25 bp, Rattus norvegicus
taagagctcctggttaccggctgag

SEQ ID NO: 541882 - DNA, 25 bp, Rattus norvegicus
taagagctctctccagggtcttgaa

SEQ ID NO: 541883 - DNA, 25 bp, Rattus norvegicus
taagagctctctgcagggtcttgaa

SEQ ID NO: 541884 - DNA, 25 bp, Rattus norvegicus
taagagctctgcaggctttgtgctc

SEQ ID NO: 541885 - DNA, 25 bp, Rattus norvegicus
taagagctctgctggctttgtgctc

SEQ ID NO: 541886 - DNA, 25 bp, Rattus norvegicus
taagagctcttgatgggttgggttc

SEQ ID NO: 541887 - DNA, 25 bp, Rattus norvegicus
taagagctcttgttgggttgggttc

SEQ ID NO: 541888 - DNA, 25 bp, Rattus norvegicus
taagagctgcttactggtgaacagt

SEQ ID NO: 541889 - DNA, 25 bp, Rattus norvegicus
taagagctgctttctggtgaacagt

SEQ ID NO: 541890 - DNA, 25 bp, Rattus norvegicus
taagagcttcccaatggccatgcgt

SEQ ID NO: 541891 - DNA, 25 bp, Rattus norvegicus
taagagcttccctatggccatgcgt

SEQ ID NO: 541892 - DNA, 25 bp, Rattus norvegicus
taagaggaggccataccctgcacta

SEQ ID NO: 541893 - DNA, 25 bp, Rattus norvegicus
taagaggaggccttaccctgcacta

SEQ ID NO: 541894 - DNA, 25 bp, Rattus norvegicus
taagaggagtccagtccggttggtc

SEQ ID NO: 541895 - DNA, 25 bp, Rattus norvegicus
taagaggagtcctgtccggttggtc

SEQ ID NO: 541896 - DNA, 25 bp, Rattus norvegicus
taagaggatgagacctcggccagcc

SEQ ID NO: 541897 - DNA, 25 bp, Rattus norvegicus
taagaggatgagtcctcggccagcc

SEQ ID NO: 541898 - DNA, 25 bp, Rattus norvegicus
taagaggccatcattgccccaaatg

SEQ ID NO: 541899 - DNA, 25 bp, Rattus norvegicus
taagaggccatctttgccccaaatg

SEQ ID NO: 541900 - DNA, 25 bp, Rattus norvegicus
taagaggcccacaaggtccatgctg

SEQ ID NO: 541901 - DNA, 25 bp, Rattus norvegicus
taagaggcccactaggtccatgctg

SEQ ID NO: 541902 - DNA, 25 bp, Rattus norvegicus
taagaggccccgatacatagagagt

SEQ ID NO: 541903 - DNA, 25 bp, Rattus norvegicus
taagaggccccgttacatagagagt

SEQ ID NO: 541904 - DNA, 25 bp, Rattus norvegicus
taagaggcgagaactgtcctactcc

SEQ ID NO: 541905 - DNA, 25 bp, Rattus norvegicus
taagaggcgagatctgtcctactcc

SEQ ID NO: 541906 - DNA, 25 bp, Rattus norvegicus
taagaggctaccagccagctagatg

SEQ ID NO: 541907 - DNA, 25 bp, Rattus norvegicus
taagaggctacctgccagctagatg

SEQ ID NO: 541908 - DNA, 25 bp, Rattus norvegicus
taagaggctcacatttgtcctctgg

SEQ ID NO: 541909 - DNA, 25 bp, Rattus norvegicus
taagaggctcacttttgtcctctgg

SEQ ID NO: 541910 - DNA, 25 bp, Rattus norvegicus
taagaggctcccagggctcaggagt

SEQ ID NO: 541911 - DNA, 25 bp, Rattus norvegicus
taagaggctccctgggctcaggagt

SEQ ID NO: 541912 - DNA, 25 bp, Rattus norvegicus
taagaggctcgtagattttagttac

SEQ ID NO: 541913 - DNA, 25 bp, Rattus norvegicus
taagaggctcgttgattttagttac

SEQ ID NO: 541914 - DNA, 25 bp, Rattus norvegicus
taagaggctgcacaccacacggttg

SEQ ID NO: 541915 - DNA, 25 bp, Rattus norvegicus
taagaggctgcagaccacacggttg

SEQ ID NO: 541916 - DNA, 25 bp, Rattus norvegicus
taagaggctgggaggcccactgata

SEQ ID NO: 541917 - DNA, 25 bp, Rattus norvegicus
taagaggctgggtggcccactgata

SEQ ID NO: 541918 - DNA, 25 bp, Rattus norvegicus
taagagggacctcccaccgggctct

SEQ ID NO: 541919 - DNA, 25 bp, Rattus norvegicus
taagagggacctgccaccgggctct

SEQ ID NO: 541920 - DNA, 25 bp, Rattus norvegicus
taagagggatgcctgccaggttctc

SEQ ID NO: 541921 - DNA, 25 bp, Rattus norvegicus
taagagggatgcgtgccaggttctc

SEQ ID NO: 541922 - DNA, 25 bp, Rattus norvegicus
taagagggcccacttagagcttgaa

SEQ ID NO: 541923 - DNA, 25 bp, Rattus norvegicus
taagagggcccagttagagcttgaa

SEQ ID NO: 541924 - DNA, 25 bp, Rattus norvegicus
taagagggccctcgtctttcagcca

SEQ ID NO: 541925 - DNA, 25 bp, Rattus norvegicus
taagagggccctggtctttcagcca

SEQ ID NO: 541926 - DNA, 25 bp, Rattus norvegicus
taagagggtcgcagacttccactgt

SEQ ID NO: 541927 - DNA, 25 bp, Rattus norvegicus
taagagggtcgctgacttccactgt

SEQ ID NO: 541928 - DNA, 25 bp, Rattus norvegicus
taagaggtccaccttgcttgtaggt

SEQ ID NO: 541929 - DNA, 25 bp, Rattus norvegicus
taagaggtccacgttgcttgtaggt

SEQ ID NO: 541930 - DNA, 25 bp, Rattus norvegicus
taagaggttcacactgcagttcctg

SEQ ID NO: 541931 - DNA, 25 bp, Rattus norvegicus
taagaggttcactctgcagttcctg

SEQ ID NO: 541932 - DNA, 25 bp, Rattus norvegicus
taagaggttggtatggcttctgcct

SEQ ID NO: 541933 - DNA, 25 bp, Rattus norvegicus
taagaggttggtttggcttctgcct

SEQ ID NO: 541934 - DNA, 25 bp, Rattus norvegicus
taagagtaaacccattgccctgcct

SEQ ID NO: 541935 - DNA, 25 bp, Rattus norvegicus
taagagtaaaccgattgccctgcct

SEQ ID NO: 541936 - DNA, 25 bp, Rattus norvegicus
taagagtaaagaagccgtccccaaa

SEQ ID NO: 541937 - DNA, 25 bp, Rattus norvegicus
taagagtaaagatgccgtccccaaa

SEQ ID NO: 541938 - DNA, 25 bp, Rattus norvegicus
taagagtaacagctccccagtgtcc

SEQ ID NO: 541939 - DNA, 25 bp, Rattus norvegicus
taagagtaacaggtccccagtgtcc

SEQ ID NO: 541940 - DNA, 25 bp, Rattus norvegicus
taagagtacctcctgttgttccaga

SEQ ID NO: 541941 - DNA, 25 bp, Rattus norvegicus
taagagtacctcgtgttgttccaga

SEQ ID NO: 541942 - DNA, 25 bp, Rattus norvegicus
taagagtactgcatcaccctgaagt

SEQ ID NO: 541943 - DNA, 25 bp, Rattus norvegicus
taagagtactgcttcaccctgaagt

SEQ ID NO: 541944 - DNA, 25 bp, Rattus norvegicus
taagagtagaagaccgaccccacaa

SEQ ID NO: 541945 - DNA, 25 bp, Rattus norvegicus
taagagtagaagtccgaccccacaa

SEQ ID NO: 541946 - DNA, 25 bp, Rattus norvegicus
taagagtatttcctaacatgcccca

SEQ ID NO: 541947 - DNA, 25 bp, Rattus norvegicus
taagagtatttcgtaacatgcccca

SEQ ID NO: 541948 - DNA, 25 bp, Rattus norvegicus
taagagtcagcgaccgtatgcctgg

SEQ ID NO: 541949 - DNA, 25 bp, Rattus norvegicus
taagagtcagcgtccgtatgcctgg

SEQ ID NO: 541950 - DNA, 25 bp, Rattus norvegicus
taagagtctactcggcacaccgatg

SEQ ID NO: 541951 - DNA, 25 bp, Rattus norvegicus
taagagtctactgggcacaccgatg

SEQ ID NO: 541952 - DNA, 25 bp, Rattus norvegicus
taagagtcttcaaagggctgaacat

SEQ ID NO: 541953 - DNA, 25 bp, Rattus norvegicus
taagagtcttcatagggctgaacat

SEQ ID NO: 541954 - DNA, 25 bp, Rattus norvegicus
taagagtgagacctccggaagcctc

SEQ ID NO: 541955 - DNA, 25 bp, Rattus norvegicus
taagagtgagacgtccggaagcctc

SEQ ID NO: 541956 - DNA, 25 bp, Rattus norvegicus
taagagtgctccatggatgggctag

SEQ ID NO: 541957 - DNA, 25 bp, Rattus norvegicus
taagagtgctccttggatgggctag

SEQ ID NO: 541958 - DNA, 25 bp, Rattus norvegicus
taagagttctccatgactccccgga

SEQ ID NO: 541959 - DNA, 25 bp, Rattus norvegicus
taagagttctccttgactccccgga

SEQ ID NO: 541960 - DNA, 25 bp, Rattus norvegicus
taagagttctgaagactttgaagcc

SEQ ID NO: 541961 - DNA, 25 bp, Rattus norvegicus
taagagttctgatgactttgaagcc

SEQ ID NO: 541962 - DNA, 25 bp, Rattus norvegicus
taagagttgatgagctgttgtgtat

SEQ ID NO: 541963 - DNA, 25 bp, Rattus norvegicus
taagagttgatgtgctgttgtgtat

SEQ ID NO: 541964 - DNA, 25 bp, Rattus norvegicus
taagagttgctcacgtttgttcctg

SEQ ID NO: 541965 - DNA, 25 bp, Rattus norvegicus
taagagttgctctcgtttgttcctg

SEQ ID NO: 541966 - DNA, 25 bp, Rattus norvegicus
taagagttttctccggaggtcacct

SEQ ID NO: 541967 - DNA, 25 bp, Rattus norvegicus
taagagttttctgcggaggtcacct

SEQ ID NO: 541968 - DNA, 25 bp, Rattus norvegicus
taagataacttgcaagctgtgtgta

SEQ ID NO: 541969 - DNA, 25 bp, Rattus norvegicus
taagataacttggaagctgtgtgta

SEQ ID NO: 541970 - DNA, 25 bp, Rattus norvegicus
taagatactgttatgttttggctca

SEQ ID NO: 541971 - DNA, 25 bp, Rattus norvegicus
taagatactgttttgttttggctca

SEQ ID NO: 541972 - DNA, 25 bp, Rattus norvegicus
taagatatctctacccaagctctat

SEQ ID NO: 541973 - DNA, 25 bp, Rattus norvegicus
taagatatctcttcccaagctctat

SEQ ID NO: 541974 - DNA, 25 bp, Rattus norvegicus
taagatatgggtcccacagcacaca

SEQ ID NO: 541975 - DNA, 25 bp, Rattus norvegicus
taagatatgggtgccacagcacaca

SEQ ID NO: 541976 - DNA, 25 bp, Rattus norvegicus
taagatcaataacctatccaagaag

SEQ ID NO: 541977 - DNA, 25 bp, Rattus norvegicus
taagatcaataagctatccaagaag

SEQ ID NO: 541978 - DNA, 25 bp, Rattus norvegicus
taagatcagaacatctgcaccagat

SEQ ID NO: 541979 - DNA, 25 bp, Rattus norvegicus
taagatcagaacttctgcaccagat

SEQ ID NO: 541980 - DNA, 25 bp, Rattus norvegicus
taagatcatcgacccagagtactcc

SEQ ID NO: 541981 - DNA, 25 bp, Rattus norvegicus
taagatcatcgagccagagtactcc

SEQ ID NO: 541982 - DNA, 25 bp, Rattus norvegicus
taagatccagctcttgtttttctga

SEQ ID NO: 541983 - DNA, 25 bp, Rattus norvegicus
taagatccagctgttgtttttctga

SEQ ID NO: 541984 - DNA, 25 bp, Rattus norvegicus
taagatcccaacacagtcaggtgtt

SEQ ID NO: 541985 - DNA, 25 bp, Rattus norvegicus
taagatcccaactcagtcaggtgtt

SEQ ID NO: 541986 - DNA, 25 bp, Rattus norvegicus
taagatcccgtcatgagtgactggt

SEQ ID NO: 541987 - DNA, 25 bp, Rattus norvegicus
taagatcccgtcttgagtgactggt

SEQ ID NO: 541988 - DNA, 25 bp, Rattus norvegicus
taagatcctatcagtgggtcaccct

SEQ ID NO: 541989 - DNA, 25 bp, Rattus norvegicus
taagatcctatctgtgggtcaccct

SEQ ID NO: 541990 - DNA, 25 bp, Rattus norvegicus
taagatcggtccactgggtctgtct

SEQ ID NO: 541991 - DNA, 25 bp, Rattus norvegicus
taagatcggtcctctgggtctgtct

SEQ ID NO: 541992 - DNA, 25 bp, Rattus norvegicus
taagatctcatcagccaatacctct

SEQ ID NO: 541993 - DNA, 25 bp, Rattus norvegicus
taagatctcatctgccaatacctct

SEQ ID NO: 541994 - DNA, 25 bp, Rattus norvegicus
taagatctccctccctaagaagtga

SEQ ID NO: 541995 - DNA, 25 bp, Rattus norvegicus
taagatctccctgcctaagaagtga

SEQ ID NO: 541996 - DNA, 25 bp, Rattus norvegicus
taagatctctgtctttactccttac

SEQ ID NO: 541997 - DNA, 25 bp, Rattus norvegicus
taagatctctgtgtttactccttac

SEQ ID NO: 541998 - DNA, 25 bp, Rattus norvegicus
taagatctctttaattcccctgtac

SEQ ID NO: 541999 - DNA, 25 bp, Rattus norvegicus
taagatctcttttattcccctgtac

SEQ ID NO: 542000 - DNA, 25 bp, Rattus norvegicus
taagatctgctactgcttctgcttc

SEQ ID NO: 542001 - DNA, 25 bp, Rattus norvegicus
taagatctgctagtgcttctgcttc

SEQ ID NO: 542002 - DNA, 25 bp, Rattus norvegicus
taagatcttggacaacctgcggctc

SEQ ID NO: 542003 - DNA, 25 bp, Rattus norvegicus
taagatcttggagaacctgcggctc

SEQ ID NO: 542004 - DNA, 25 bp, Rattus norvegicus
taagatgaactgagcttcaggccac

SEQ ID NO: 542005 - DNA, 25 bp, Rattus norvegicus
taagatgaactgtgcttcaggccac

SEQ ID NO: 542006 - DNA, 25 bp, Rattus norvegicus
taagatgaccacatgggcacctctc

SEQ ID NO: 542007 - DNA, 25 bp, Rattus norvegicus
taagatgaccacttgggcacctctc

SEQ ID NO: 542008 - DNA, 25 bp, Rattus norvegicus
taagatgactgtcgctctgcttcaa

SEQ ID NO: 542009 - DNA, 25 bp, Rattus norvegicus
taagatgactgtggctctgcttcaa

SEQ ID NO: 542010 - DNA, 25 bp, Rattus norvegicus
taagatgagcctcccagtccaaata

SEQ ID NO: 542011 - DNA, 25 bp, Rattus norvegicus
taagatgagcctgccagtccaaata

SEQ ID NO: 542012 - DNA, 25 bp, Rattus norvegicus
taagatgcaagtcttcccttgtgcc

SEQ ID NO: 542013 - DNA, 25 bp, Rattus norvegicus
taagatgcaagtgttcccttgtgcc

SEQ ID NO: 542014 - DNA, 25 bp, Rattus norvegicus
taagatgccattccttgagcacata

SEQ ID NO: 542015 - DNA, 25 bp, Rattus norvegicus
taagatgccattgcttgagcacata

SEQ ID NO: 542016 - DNA, 25 bp, Rattus norvegicus
taagatgctctgagtgtccgtgctc

SEQ ID NO: 542017 - DNA, 25 bp, Rattus norvegicus
taagatgctctgtgtgtccgtgctc

SEQ ID NO: 542018 - DNA, 25 bp, Rattus norvegicus
taagatgctgccattgcatccctgt

SEQ ID NO: 542019 - DNA, 25 bp, Rattus norvegicus
taagatgctgcctttgcatccctgt

SEQ ID NO: 542020 - DNA, 25 bp, Rattus norvegicus
taagatgctttgctccagccttaaa

SEQ ID NO: 542021 - DNA, 25 bp, Rattus norvegicus
taagatgctttggtccagccttaaa

SEQ ID NO: 542022 - DNA, 25 bp, Rattus norvegicus
taagatggagatacaacccctggcc

SEQ ID NO: 542023 - DNA, 25 bp, Rattus norvegicus
taagatggagattcaacccctggcc

SEQ ID NO: 542024 - DNA, 25 bp, Rattus norvegicus
taagatggccgcacccaaatgtttg

SEQ ID NO: 542025 - DNA, 25 bp, Rattus norvegicus
taagatggccgctcccaaatgtttg

SEQ ID NO: 542026 - DNA, 25 bp, Rattus norvegicus
taagatggcggacacgggttctcca

SEQ ID NO: 542027 - DNA, 25 bp, Rattus norvegicus
taagatggcggagacgggttctcca

SEQ ID NO: 542028 - DNA, 25 bp, Rattus norvegicus
taagatgggcatcaatggtggcaca

SEQ ID NO: 542029 - DNA, 25 bp, Rattus norvegicus
taagatgggcatgaatggtggcaca

SEQ ID NO: 542030 - DNA, 25 bp, Rattus norvegicus
taagatggtccccttctgggaacat

SEQ ID NO: 542031 - DNA, 25 bp, Rattus norvegicus
taagatggtcccgttctgggaacat

SEQ ID NO: 542032 - DNA, 25 bp, Rattus norvegicus
taagatggtccgcttgttactcgac

SEQ ID NO: 542033 - DNA, 25 bp, Rattus norvegicus
taagatggtccggttgttactcgac

SEQ ID NO: 542034 - DNA, 25 bp, Rattus norvegicus
taagatggtgatctactcggcccac

SEQ ID NO: 542035 - DNA, 25 bp, Rattus norvegicus
taagatggtgatgtactcggcccac

SEQ ID NO: 542036 - DNA, 25 bp, Rattus norvegicus
taagatgtacctctgttggctttca

SEQ ID NO: 542037 - DNA, 25 bp, Rattus norvegicus
taagatgtacctgtgttggctttca

SEQ ID NO: 542038 - DNA, 25 bp, Rattus norvegicus
taagatgtatttccttgcccctttc

SEQ ID NO: 542039 - DNA, 25 bp, Rattus norvegicus
taagatgtatttgcttgcccctttc

SEQ ID NO: 542040 - DNA, 25 bp, Rattus norvegicus
taagatgtcccaagctgtccaccag

SEQ ID NO: 542041 - DNA, 25 bp, Rattus norvegicus
taagatgtcccatgctgtccaccag

SEQ ID NO: 542042 - DNA, 25 bp, Rattus norvegicus
taagatgtcctgaagtgtctccgga

SEQ ID NO: 542043 - DNA, 25 bp, Rattus norvegicus
taagatgtcctgtagtgtctccgga

SEQ ID NO: 542044 - DNA, 25 bp, Rattus norvegicus
taagatgtccttccagcttgtcaca

SEQ ID NO: 542045 - DNA, 25 bp, Rattus norvegicus
taagatgtccttgcagcttgtcaca

SEQ ID NO: 542046 - DNA, 25 bp, Rattus norvegicus
taagatgtctttactccaccaatcc

SEQ ID NO: 542047 - DNA, 25 bp, Rattus norvegicus
taagatgtcttttctccaccaatcc

SEQ ID NO: 542048 - DNA, 25 bp, Rattus norvegicus
taagatgtgccaagtctgactttaa

SEQ ID NO: 542049 - DNA, 25 bp, Rattus norvegicus
taagatgtgccatgtctgactttaa

SEQ ID NO: 542050 - DNA, 25 bp, Rattus norvegicus
taagatgttccaccctaacgtctat

SEQ ID NO: 542051 - DNA, 25 bp, Rattus norvegicus
taagatgttccagcctaacgtctat

SEQ ID NO: 542052 - DNA, 25 bp, Rattus norvegicus
taagatgttcgcattgttccttttg

SEQ ID NO: 542053 - DNA, 25 bp, Rattus norvegicus
taagatgttcgctttgttccttttg

SEQ ID NO: 542054 - DNA, 25 bp, Rattus norvegicus
taagatgttgtaaagtgagtgcccc

SEQ ID NO: 542055 - DNA, 25 bp, Rattus norvegicus
taagatgttgtatagtgagtgcccc

SEQ ID NO: 542056 - DNA, 25 bp, Rattus norvegicus
taagattactgcctgaggcctccaa

SEQ ID NO: 542057 - DNA, 25 bp, Rattus norvegicus
taagattactgcgtgaggcctccaa

SEQ ID NO: 542058 - DNA, 25 bp, Rattus norvegicus
taagattcaccgagtgtcccaagct

SEQ ID NO: 542059 - DNA, 25 bp, Rattus norvegicus
taagattcaccgtgtgtcccaagct

SEQ ID NO: 542060 - DNA, 25 bp, Rattus norvegicus
taagattcaggtcataactcagtga

SEQ ID NO: 542061 - DNA, 25 bp, Rattus norvegicus
taagattcaggtgataactcagtga

SEQ ID NO: 542062 - DNA, 25 bp, Rattus norvegicus
taagattcattcatccaaaggatga

SEQ ID NO: 542063 - DNA, 25 bp, Rattus norvegicus
taagattcattcttccaaaggatga

SEQ ID NO: 542064 - DNA, 25 bp, Rattus norvegicus
taagattccaacatccgtgtgggta

SEQ ID NO: 542065 - DNA, 25 bp, Rattus norvegicus
taagattccaacttccgtgtgggta

SEQ ID NO: 542066 - DNA, 25 bp, Rattus norvegicus
taagattccatgatcctgatcacct

SEQ ID NO: 542067 - DNA, 25 bp, Rattus norvegicus
taagattccatgttcctgatcacct

SEQ ID NO: 542068 - DNA, 25 bp, Rattus norvegicus
taagattccctgctgccaactgtgg

SEQ ID NO: 542069 - DNA, 25 bp, Rattus norvegicus
taagattccctggtgccaactgtgg

SEQ ID NO: 542070 - DNA, 25 bp, Rattus norvegicus
taagattcccttacttcagcaacta

SEQ ID NO: 542071 - DNA, 25 bp, Rattus norvegicus
taagattccctttcttcagcaacta

SEQ ID NO: 542072 - DNA, 25 bp, Rattus norvegicus
taagattccttactggcttgctacc

SEQ ID NO: 542073 - DNA, 25 bp, Rattus norvegicus
taagattccttagtggcttgctacc

SEQ ID NO: 542074 - DNA, 25 bp, Rattus norvegicus
taagattcgttaagtccaggacagc

SEQ ID NO: 542075 - DNA, 25 bp, Rattus norvegicus
taagattcgttatgtccaggacagc

SEQ ID NO: 542076 - DNA, 25 bp, Rattus norvegicus
taagattctagcagcctccagtaag

SEQ ID NO: 542077 - DNA, 25 bp, Rattus norvegicus
taagattctagctgcctccagtaag

SEQ ID NO: 542078 - DNA, 25 bp, Rattus norvegicus
taagattctatcatgggccctcata

SEQ ID NO: 542079 - DNA, 25 bp, Rattus norvegicus
taagattctatcttgggccctcata

SEQ ID NO: 542080 - DNA, 25 bp, Rattus norvegicus
taagattctggtaggcctgaggctc

SEQ ID NO: 542081 - DNA, 25 bp, Rattus norvegicus
taagattctggttggcctgaggctc

SEQ ID NO: 542082 - DNA, 25 bp, Rattus norvegicus
taagattgaattcctagccctgttg

SEQ ID NO: 542083 - DNA, 25 bp, Rattus norvegicus
taagattgaattgctagccctgttg

SEQ ID NO: 542084 - DNA, 25 bp, Rattus norvegicus
taagattgtctgcaattgtaacgca

SEQ ID NO: 542085 - DNA, 25 bp, Rattus norvegicus
taagattgtctggaattgtaacgca

SEQ ID NO: 542086 - DNA, 25 bp, Rattus norvegicus
taagattgttctcaaggctccccat

SEQ ID NO: 542087 - DNA, 25 bp, Rattus norvegicus
taagattgttctgaaggctccccat

SEQ ID NO: 542088 - DNA, 25 bp, Rattus norvegicus
taagatttcactaccggttggtgtg

SEQ ID NO: 542089 - DNA, 25 bp, Rattus norvegicus
taagatttcacttccggttggtgtg

SEQ ID NO: 542090 - DNA, 25 bp, Rattus norvegicus
taagatttccttacaagtttcctga

SEQ ID NO: 542091 - DNA, 25 bp, Rattus norvegicus
taagatttcctttcaagtttcctga

SEQ ID NO: 542092 - DNA, 25 bp, Rattus norvegicus
taagatttctctcaccatagcatcc

SEQ ID NO: 542093 - DNA, 25 bp, Rattus norvegicus
taagatttctctgaccatagcatcc

SEQ ID NO: 542094 - DNA, 25 bp, Rattus norvegicus
taagatttgcatcttggctgactgc

SEQ ID NO: 542095 - DNA, 25 bp, Rattus norvegicus
taagatttgcatgttggctgactgc

SEQ ID NO: 542096 - DNA, 25 bp, Rattus norvegicus
taagatttgggtcggcagctcagta

SEQ ID NO: 542097 - DNA, 25 bp, Rattus norvegicus
taagatttgggtgggcagctcagta

SEQ ID NO: 542098 - DNA, 25 bp, Rattus norvegicus
taagcaaaaccaacccttctgtcag

SEQ ID NO: 542099 - DNA, 25 bp, Rattus norvegicus
taagcaaaaccatcccttctgtcag

SEQ ID NO: 542100 - DNA, 25 bp, Rattus norvegicus
taagcaaaagctccagtcttccccg

SEQ ID NO: 542101 - DNA, 25 bp, Rattus norvegicus
taagcaaaagctgcagtcttccccg

SEQ ID NO: 542102 - DNA, 25 bp, Rattus norvegicus
taagcaaaaggcatccccaaggcct

SEQ ID NO: 542103 - DNA, 25 bp, Rattus norvegicus
taagcaaaaggcttccccaaggcct

SEQ ID NO: 542104 - DNA, 25 bp, Rattus norvegicus
taagcaaacaggaggcctctcactg

SEQ ID NO: 542105 - DNA, 25 bp, Rattus norvegicus
taagcaaacaggtggcctctcactg

SEQ ID NO: 542106 - DNA, 25 bp, Rattus norvegicus
taagcaaagctcagatgttccctct

SEQ ID NO: 542107 - DNA, 25 bp, Rattus norvegicus
taagcaaagctctgatgttccctct

SEQ ID NO: 542108 - DNA, 25 bp, Rattus norvegicus
taagcaacacggcactgccccagaa

SEQ ID NO: 542109 - DNA, 25 bp, Rattus norvegicus
taagcaacacgggactgccccagaa

SEQ ID NO: 542110 - DNA, 25 bp, Rattus norvegicus
taagcaacatcccagcccatgaaat

SEQ ID NO: 542111 - DNA, 25 bp, Rattus norvegicus
taagcaacatccgagcccatgaaat

SEQ ID NO: 542112 - DNA, 25 bp, Rattus norvegicus
taagcaacctaaacctgactcagaa

SEQ ID NO: 542113 - DNA, 25 bp, Rattus norvegicus
taagcaacctaatcctgactcagaa

SEQ ID NO: 542114 - DNA, 25 bp, Rattus norvegicus
taagcaacctgcagtcccaagaaag

SEQ ID NO: 542115 - DNA, 25 bp, Rattus norvegicus
taagcaacctgctgtcccaagaaag

SEQ ID NO: 542116 - DNA, 25 bp, Rattus norvegicus
taagcaactcagacatttccagcct

SEQ ID NO: 542117 - DNA, 25 bp, Rattus norvegicus
taagcaactcagtcatttccagcct

SEQ ID NO: 542118 - DNA, 25 bp, Rattus norvegicus
taagcaactgctcgtctctgtaaag

SEQ ID NO: 542119 - DNA, 25 bp, Rattus norvegicus
taagcaactgctggtctctgtaaag

SEQ ID NO: 542120 - DNA, 25 bp, Rattus norvegicus
taagcaactgggattttctatcttt

SEQ ID NO: 542121 - DNA, 25 bp, Rattus norvegicus
taagcaactgggtttttctatcttt

SEQ ID NO: 542122 - DNA, 25 bp, Rattus norvegicus
taagcaagcaggagcccgcggcaag

SEQ ID NO: 542123 - DNA, 25 bp, Rattus norvegicus
taagcaagcaggtgcccgcggcaag

SEQ ID NO: 542124 - DNA, 25 bp, Rattus norvegicus
taagcaagctatctgaaaaatcatt

SEQ ID NO: 542125 - DNA, 25 bp, Rattus norvegicus
taagcaagctatgtgaaaaatcatt

SEQ ID NO: 542126 - DNA, 25 bp, Rattus norvegicus
taagcaaggccgctacttctgtttt

SEQ ID NO: 542127 - DNA, 25 bp, Rattus norvegicus
taagcaaggccggtacttctgtttt

SEQ ID NO: 542128 - DNA, 25 bp, Rattus norvegicus
taagcaaggtccagtctgctgccag

SEQ ID NO: 542129 - DNA, 25 bp, Rattus norvegicus
taagcaaggtcctgtctgctgccag

SEQ ID NO: 542130 - DNA, 25 bp, Rattus norvegicus
taagcaagtctgataatcccatggt

SEQ ID NO: 542131 - DNA, 25 bp, Rattus norvegicus
taagcaagtctgttaatcccatggt

SEQ ID NO: 542132 - DNA, 25 bp, Rattus norvegicus
taagcaagtgttcctttgtggcctc

SEQ ID NO: 542133 - DNA, 25 bp, Rattus norvegicus
taagcaagtgttgctttgtggcctc

SEQ ID NO: 542134 - DNA, 25 bp, Rattus norvegicus
taagcaagttcacagctatcgccct

SEQ ID NO: 542135 - DNA, 25 bp, Rattus norvegicus
taagcaagttcagagctatcgccct

SEQ ID NO: 542136 - DNA, 25 bp, Rattus norvegicus
taagcaatcccaattgatgcctctg

SEQ ID NO: 542137 - DNA, 25 bp, Rattus norvegicus
taagcaatcccatttgatgcctctg

SEQ ID NO: 542138 - DNA, 25 bp, Rattus norvegicus
taagcaatcttaagtccctccttct

SEQ ID NO: 542139 - DNA, 25 bp, Rattus norvegicus
taagcaatcttatgtccctccttct

SEQ ID NO: 542140 - DNA, 25 bp, Rattus norvegicus
taagcaatgccaccctaatgcccat

SEQ ID NO: 542141 - DNA, 25 bp, Rattus norvegicus
taagcaatgccagcctaatgcccat

SEQ ID NO: 542142 - DNA, 25 bp, Rattus norvegicus
taagcaatgctaactgccctacagt

SEQ ID NO: 542143 - DNA, 25 bp, Rattus norvegicus
taagcaatgctatctgccctacagt

SEQ ID NO: 542144 - DNA, 25 bp, Rattus norvegicus
taagcaatgtggacttgttgaagaa

SEQ ID NO: 542145 - DNA, 25 bp, Rattus norvegicus
taagcaatgtggtcttgttgaagaa

SEQ ID NO: 542146 - DNA, 25 bp, Rattus norvegicus
taagcaattctaagccttcccattc

SEQ ID NO: 542147 - DNA, 25 bp, Rattus norvegicus
taagcaattctatgccttcccattc

SEQ ID NO: 542148 - DNA, 25 bp, Rattus norvegicus
taagcaatttgcaggcccagtcctt

SEQ ID NO: 542149 - DNA, 25 bp, Rattus norvegicus
taagcaatttgctggcccagtcctt

SEQ ID NO: 542150 - DNA, 25 bp, Rattus norvegicus
taagcacaaacacagccgtacccag

SEQ ID NO: 542151 - DNA, 25 bp, Rattus norvegicus
taagcacaaacagagccgtacccag

SEQ ID NO: 542152 - DNA, 25 bp, Rattus norvegicus
taagcacacaaccattggccttcat

SEQ ID NO: 542153 - DNA, 25 bp, Rattus norvegicus
taagcacacaacgattggccttcat

SEQ ID NO: 542154 - DNA, 25 bp, Rattus norvegicus
taagcacacattaaccattcctcat

SEQ ID NO: 542155 - DNA, 25 bp, Rattus norvegicus
taagcacacatttaccattcctcat

SEQ ID NO: 542156 - DNA, 25 bp, Rattus norvegicus
taagcacaccgcaaaatcccggaag

SEQ ID NO: 542157 - DNA, 25 bp, Rattus norvegicus
taagcacaccgctaaatcccggaag

SEQ ID NO: 542158 - DNA, 25 bp, Rattus norvegicus
taagcacacctacacacagcatttg

SEQ ID NO: 542159 - DNA, 25 bp, Rattus norvegicus
taagcacacctagacacagcatttg

SEQ ID NO: 542160 - DNA, 25 bp, Rattus norvegicus
taagcacacctcagactaacacagt

SEQ ID NO: 542161 - DNA, 25 bp, Rattus norvegicus
taagcacacctctgactaacacagt

SEQ ID NO: 542162 - DNA, 25 bp, Rattus norvegicus
taagcacacggaaagaacacataaa

SEQ ID NO: 542163 - DNA, 25 bp, Rattus norvegicus
taagcacacggatagaacacataaa

SEQ ID NO: 542164 - DNA, 25 bp, Rattus norvegicus
taagcacactggctctcatgagagc

SEQ ID NO: 542165 - DNA, 25 bp, Rattus norvegicus
taagcacactgggtctcatgagagc

SEQ ID NO: 542166 - DNA, 25 bp, Rattus norvegicus
taagcacaggcactttccagtctct

SEQ ID NO: 542167 - DNA, 25 bp, Rattus norvegicus
taagcacaggcagtttccagtctct

SEQ ID NO: 542168 - DNA, 25 bp, Rattus norvegicus
taagcacaggccctttttcactttg

SEQ ID NO: 542169 - DNA, 25 bp, Rattus norvegicus
taagcacaggccgtttttcactttg

SEQ ID NO: 542170 - DNA, 25 bp, Rattus norvegicus
taagcacagttgacactgcagtagt

SEQ ID NO: 542171 - DNA, 25 bp, Rattus norvegicus
taagcacagttgtcactgcagtagt

SEQ ID NO: 542172 - DNA, 25 bp, Rattus norvegicus
taagcacatcgtactgttccttgca

SEQ ID NO: 542173 - DNA, 25 bp, Rattus norvegicus
taagcacatcgttctgttccttgca

SEQ ID NO: 542174 - DNA, 25 bp, Rattus norvegicus
taagcacatttcagcacatgccaag

SEQ ID NO: 542175 - DNA, 25 bp, Rattus norvegicus
taagcacatttctgcacatgccaag

SEQ ID NO: 542176 - DNA, 25 bp, Rattus norvegicus
taagcaccaccacgaaccaaggagg

SEQ ID NO: 542177 - DNA, 25 bp, Rattus norvegicus
taagcaccaccaggaaccaaggagg

SEQ ID NO: 542178 - DNA, 25 bp, Rattus norvegicus
taagcaccataaagcctgttctctc

SEQ ID NO: 542179 - DNA, 25 bp, Rattus norvegicus
taagcaccataatgcctgttctctc

SEQ ID NO: 542180 - DNA, 25 bp, Rattus norvegicus
taagcacccatactttgacgacttg

SEQ ID NO: 542181 - DNA, 25 bp, Rattus norvegicus
taagcacccatagtttgacgacttg

SEQ ID NO: 542182 - DNA, 25 bp, Rattus norvegicus
taagcaccctagctaggtgggcgct

SEQ ID NO: 542183 - DNA, 25 bp, Rattus norvegicus
taagcaccctaggtaggtgggcgct

SEQ ID NO: 542184 - DNA, 25 bp, Rattus norvegicus
taagcaccctttcacactgatgtgc

SEQ ID NO: 542185 - DNA, 25 bp, Rattus norvegicus
taagcaccctttgacactgatgtgc

SEQ ID NO: 542186 - DNA, 25 bp, Rattus norvegicus
taagcacctgttaatttcaggtagc

SEQ ID NO: 542187 - DNA, 25 bp, Rattus norvegicus
taagcacctgtttatttcaggtagc

SEQ ID NO: 542188 - DNA, 25 bp, Rattus norvegicus
taagcaccttctagtgggtggcact

SEQ ID NO: 542189 - DNA, 25 bp, Rattus norvegicus
taagcaccttcttgtgggtggcact

SEQ ID NO: 542190 - DNA, 25 bp, Rattus norvegicus
taagcaccttttctacctcagagct

SEQ ID NO: 542191 - DNA, 25 bp, Rattus norvegicus
taagcaccttttgtacctcagagct

SEQ ID NO: 542192 - DNA, 25 bp, Rattus norvegicus
taagcacgacacagtccccttgagc

SEQ ID NO: 542193 - DNA, 25 bp, Rattus norvegicus
taagcacgacactgtccccttgagc

SEQ ID NO: 542194 - DNA, 25 bp, Rattus norvegicus
taagcacgcgttacacctttgacta

SEQ ID NO: 542195 - DNA, 25 bp, Rattus norvegicus
taagcacgcgtttcacctttgacta

SEQ ID NO: 542196 - DNA, 25 bp, Rattus norvegicus
taagcacgcttcctatgacaccagt

SEQ ID NO: 542197 - DNA, 25 bp, Rattus norvegicus
taagcacgcttcgtatgacaccagt

SEQ ID NO: 542198 - DNA, 25 bp, Rattus norvegicus
taagcacgtcttattctgtctctag

SEQ ID NO: 542199 - DNA, 25 bp, Rattus norvegicus
taagcacgtctttttctgtctctag

SEQ ID NO: 542200 - DNA, 25 bp, Rattus norvegicus
taagcactacggcacctctggctgg

SEQ ID NO: 542201 - DNA, 25 bp, Rattus norvegicus
taagcactacgggacctctggctgg

SEQ ID NO: 542202 - DNA, 25 bp, Rattus norvegicus
taagcactaggaccacaggtacaca

SEQ ID NO: 542203 - DNA, 25 bp, Rattus norvegicus
taagcactaggagcacaggtacaca

SEQ ID NO: 542204 - DNA, 25 bp, Rattus norvegicus
taagcactattacccatcagctgag

SEQ ID NO: 542205 - DNA, 25 bp, Rattus norvegicus
taagcactattagccatcagctgag

SEQ ID NO: 542206 - DNA, 25 bp, Rattus norvegicus
taagcactcggaaccaggctgcctg

SEQ ID NO: 542207 - DNA, 25 bp, Rattus norvegicus
taagcactcggatccaggctgcctg

SEQ ID NO: 542208 - DNA, 25 bp, Rattus norvegicus
taagcactctatcagtgggcaacat

SEQ ID NO: 542209 - DNA, 25 bp, Rattus norvegicus
taagcactctatcatatccttggag

SEQ ID NO: 542210 - DNA, 25 bp, Rattus norvegicus
taagcactctatgagtgggcaacat

SEQ ID NO: 542211 - DNA, 25 bp, Rattus norvegicus
taagcactctatgatatccttggag

SEQ ID NO: 542212 - DNA, 25 bp, Rattus norvegicus
taagcactggctaccacgatgtcct

SEQ ID NO: 542213 - DNA, 25 bp, Rattus norvegicus
taagcactggcttccacgatgtcct

SEQ ID NO: 542214 - DNA, 25 bp, Rattus norvegicus
taagcactggtgctctggagtacct

SEQ ID NO: 542215 - DNA, 25 bp, Rattus norvegicus
taagcactggtggtctggagtacct

SEQ ID NO: 542216 - DNA, 25 bp, Rattus norvegicus
taagcactgtataccagaagcccct

SEQ ID NO: 542217 - DNA, 25 bp, Rattus norvegicus
taagcactgtattccagaagcccct

SEQ ID NO: 542218 - DNA, 25 bp, Rattus norvegicus
taagcacttagcaatatggctgaac

SEQ ID NO: 542219 - DNA, 25 bp, Rattus norvegicus
taagcacttagctatatggctgaac

SEQ ID NO: 542220 - DNA, 25 bp, Rattus norvegicus
taagcactttataaagggcgggact

SEQ ID NO: 542221 - DNA, 25 bp, Rattus norvegicus
taagcactttattaagggcgggact

SEQ ID NO: 542222 - DNA, 25 bp, Rattus norvegicus
taagcagaaccacctcttgtgggct

SEQ ID NO: 542223 - DNA, 25 bp, Rattus norvegicus
taagcagaaccagctcttgtgggct

SEQ ID NO: 542224 - DNA, 25 bp, Rattus norvegicus
taagcagacggcacctgtgactgga

SEQ ID NO: 542225 - DNA, 25 bp, Rattus norvegicus
taagcagacggctcctgtgactgga

SEQ ID NO: 542226 - DNA, 25 bp, Rattus norvegicus
taagcagatgacagtctcctcccag

SEQ ID NO: 542227 - DNA, 25 bp, Rattus norvegicus
taagcagatgactgtctcctcccag

SEQ ID NO: 542228 - DNA, 25 bp, Rattus norvegicus
taagcagatgctacgcctcacgtgc

SEQ ID NO: 542229 - DNA, 25 bp, Rattus norvegicus
taagcagatgcttcgcctcacgtgc

SEQ ID NO: 542230 - DNA, 25 bp, Rattus norvegicus
taagcagatgtacttggcctcctct

SEQ ID NO: 542231 - DNA, 25 bp, Rattus norvegicus
taagcagatgtagttggcctcctct

SEQ ID NO: 542232 - DNA, 25 bp, Rattus norvegicus
taagcagcaatcacgtttatatcga

SEQ ID NO: 542233 - DNA, 25 bp, Rattus norvegicus
taagcagcaatctcgtttatatcga

SEQ ID NO: 542234 - DNA, 25 bp, Rattus norvegicus
taagcagcacccagttaatttcagg

SEQ ID NO: 542235 - DNA, 25 bp, Rattus norvegicus
taagcagcaccccttcatgatgtct

SEQ ID NO: 542236 - DNA, 25 bp, Rattus norvegicus
taagcagcacccgttcatgatgtct

SEQ ID NO: 542237 - DNA, 25 bp, Rattus norvegicus
taagcagcaccctgttaatttcagg

SEQ ID NO: 542238 - DNA, 25 bp, Rattus norvegicus
taagcagcagcgatttatgtacagc

SEQ ID NO: 542239 - DNA, 25 bp, Rattus norvegicus
taagcagcagcgttttatgtacagc

SEQ ID NO: 542240 - DNA, 25 bp, Rattus norvegicus
taagcagcagttctggtttaattcc

SEQ ID NO: 542241 - DNA, 25 bp, Rattus norvegicus
taagcagcagttgtggtttaattcc

SEQ ID NO: 542242 - DNA, 25 bp, Rattus norvegicus
taagcagccaggaagctcccatgaa

SEQ ID NO: 542243 - DNA, 25 bp, Rattus norvegicus
taagcagccaggtagctcccatgaa

SEQ ID NO: 542244 - DNA, 25 bp, Rattus norvegicus
taagcagccattatattttcccatg

SEQ ID NO: 542245 - DNA, 25 bp, Rattus norvegicus
taagcagccattttattttcccatg

SEQ ID NO: 542246 - DNA, 25 bp, Rattus norvegicus
taagcagcctctagagcctaatcag

SEQ ID NO: 542247 - DNA, 25 bp, Rattus norvegicus
taagcagcctcttgagcctaatcag

SEQ ID NO: 542248 - DNA, 25 bp, Rattus norvegicus
taagcagccttacttggtctcaaca

SEQ ID NO: 542249 - DNA, 25 bp, Rattus norvegicus
taagcagccttagttggtctcaaca

SEQ ID NO: 542250 - DNA, 25 bp, Rattus norvegicus
taagcagcgggcaccttgagcatgc

SEQ ID NO: 542251 - DNA, 25 bp, Rattus norvegicus
taagcagcgggctccttgagcatgc

SEQ ID NO: 542252 - DNA, 25 bp, Rattus norvegicus
taagcagcgtctccggcaataggtt

SEQ ID NO: 542253 - DNA, 25 bp, Rattus norvegicus
taagcagcgtctgcggcaataggtt

SEQ ID NO: 542254 - DNA, 25 bp, Rattus norvegicus
taagcagctagcagtctgcctgaaa

SEQ ID NO: 542255 - DNA, 25 bp, Rattus norvegicus
taagcagctagctgtctgcctgaaa

SEQ ID NO: 542256 - DNA, 25 bp, Rattus norvegicus
taagcagctaggaaggcctcacact

SEQ ID NO: 542257 - DNA, 25 bp, Rattus norvegicus
taagcagctaggtaggcctcacact

SEQ ID NO: 542258 - DNA, 25 bp, Rattus norvegicus
taagcagctcgtactaatcgccgaa

SEQ ID NO: 542259 - DNA, 25 bp, Rattus norvegicus
taagcagctcgttctaatcgccgaa

SEQ ID NO: 542260 - DNA, 25 bp, Rattus norvegicus
taagcagctgctagcctctctggca

SEQ ID NO: 542261 - DNA, 25 bp, Rattus norvegicus
taagcagctgcttgcctctctggca

SEQ ID NO: 542262 - DNA, 25 bp, Rattus norvegicus
taagcagcttatagcccgggagatt

SEQ ID NO: 542263 - DNA, 25 bp, Rattus norvegicus
taagcagcttattgcccgggagatt

SEQ ID NO: 542264 - DNA, 25 bp, Rattus norvegicus
taagcagctttaccaagggcggcaa

SEQ ID NO: 542265 - DNA, 25 bp, Rattus norvegicus
taagcagctttagcaagggcggcaa

SEQ ID NO: 542266 - DNA, 25 bp, Rattus norvegicus
taagcaggacagacttcccagatcc

SEQ ID NO: 542267 - DNA, 25 bp, Rattus norvegicus
taagcaggacagtcttcccagatcc

SEQ ID NO: 542268 - DNA, 25 bp, Rattus norvegicus
taagcaggcaatagaaaccactaat

SEQ ID NO: 542269 - DNA, 25 bp, Rattus norvegicus
taagcaggcaattgaaaccactaat

SEQ ID NO: 542270 - DNA, 25 bp, Rattus norvegicus
taagcaggcagaccagacagcacac

SEQ ID NO: 542271 - DNA, 25 bp, Rattus norvegicus
taagcaggcagagcagacagcacac

SEQ ID NO: 542272 - DNA, 25 bp, Rattus norvegicus
taagcaggccctctaaagtcctaag

SEQ ID NO: 542273 - DNA, 25 bp, Rattus norvegicus
taagcaggccctgtaaagtcctaag

SEQ ID NO: 542274 - DNA, 25 bp, Rattus norvegicus
taagcaggcctcacgagcctcagag

SEQ ID NO: 542275 - DNA, 25 bp, Rattus norvegicus
taagcaggcctctcgagcctcagag

SEQ ID NO: 542276 - DNA, 25 bp, Rattus norvegicus
taagcaggctctagtatccagcact

SEQ ID NO: 542277 - DNA, 25 bp, Rattus norvegicus
taagcaggctcttgtatccagcact

SEQ ID NO: 542278 - DNA, 25 bp, Rattus norvegicus
taagcagggagccacttgcagtgct

SEQ ID NO: 542279 - DNA, 25 bp, Rattus norvegicus
taagcagggagcgacttgcagtgct

SEQ ID NO: 542280 - DNA, 25 bp, Rattus norvegicus
taagcagggctcacagggtgtaagt

SEQ ID NO: 542281 - DNA, 25 bp, Rattus norvegicus
taagcagggctctcagggtgtaagt

SEQ ID NO: 542282 - DNA, 25 bp, Rattus norvegicus
taagcagggcttaggttacagtccc

SEQ ID NO: 542283 - DNA, 25 bp, Rattus norvegicus
taagcagggctttggttacagtccc

SEQ ID NO: 542284 - DNA, 25 bp, Rattus norvegicus
taagcagggtgtccctttcatggga

SEQ ID NO: 542285 - DNA, 25 bp, Rattus norvegicus
taagcagggtgtgcctttcatggga

SEQ ID NO: 542286 - DNA, 25 bp, Rattus norvegicus
taagcaggtctaatacctttccctc

SEQ ID NO: 542287 - DNA, 25 bp, Rattus norvegicus
taagcaggtctattacctttccctc

SEQ ID NO: 542288 - DNA, 25 bp, Rattus norvegicus
taagcagtactgatttctaaccact

SEQ ID NO: 542289 - DNA, 25 bp, Rattus norvegicus
taagcagtactgttttctaaccact

SEQ ID NO: 542290 - DNA, 25 bp, Rattus norvegicus
taagcagtagacatacggtcggatt

SEQ ID NO: 542291 - DNA, 25 bp, Rattus norvegicus
taagcagtagacttacggtcggatt

SEQ ID NO: 542292 - DNA, 25 bp, Rattus norvegicus
taagcagtcccgaggccccatctat

SEQ ID NO: 542293 - DNA, 25 bp, Rattus norvegicus
taagcagtcccgtggccccatctat

SEQ ID NO: 542294 - DNA, 25 bp, Rattus norvegicus
taagcagtcgccacgaaattcacct

SEQ ID NO: 542295 - DNA, 25 bp, Rattus norvegicus
taagcagtcgcctcgaaattcacct

SEQ ID NO: 542296 - DNA, 25 bp, Rattus norvegicus
taagcagtcggtatcggcaggtccc

SEQ ID NO: 542297 - DNA, 25 bp, Rattus norvegicus
taagcagtcggtttcggcaggtccc

SEQ ID NO: 542298 - DNA, 25 bp, Rattus norvegicus
taagcagtctaaagattgacagcaa

SEQ ID NO: 542299 - DNA, 25 bp, Rattus norvegicus
taagcagtctaatgattgacagcaa

SEQ ID NO: 542300 - DNA, 25 bp, Rattus norvegicus
taagcagtctacctgtggtgagcca

SEQ ID NO: 542301 - DNA, 25 bp, Rattus norvegicus
taagcagtctacgtgtggtgagcca

SEQ ID NO: 542302 - DNA, 25 bp, Rattus norvegicus
taagcagtctgcatcagtcatcctg

SEQ ID NO: 542303 - DNA, 25 bp, Rattus norvegicus
taagcagtctgcttcagtcatcctg

SEQ ID NO: 542304 - DNA, 25 bp, Rattus norvegicus
taagcagtgaccatcctcactttct

SEQ ID NO: 542305 - DNA, 25 bp, Rattus norvegicus
taagcagtgaccttcctcactttct

SEQ ID NO: 542306 - DNA, 25 bp, Rattus norvegicus
taagcagtgcctctactgacgctca

SEQ ID NO: 542307 - DNA, 25 bp, Rattus norvegicus
taagcagtgcctgtactgacgctca

SEQ ID NO: 542308 - DNA, 25 bp, Rattus norvegicus
taagcagtgctgaccatttgtttgt

SEQ ID NO: 542309 - DNA, 25 bp, Rattus norvegicus
taagcagtgctgtccatttgtttgt

SEQ ID NO: 542310 - DNA, 25 bp, Rattus norvegicus
taagcagtggtcatcgtgtgtaaca

SEQ ID NO: 542311 - DNA, 25 bp, Rattus norvegicus
taagcagtggtcttcgtgtgtaaca

SEQ ID NO: 542312 - DNA, 25 bp, Rattus norvegicus
taagcagtgtccatgctgggtcctg

SEQ ID NO: 542313 - DNA, 25 bp, Rattus norvegicus
taagcagtgtccttgctgggtcctg

SEQ ID NO: 542314 - DNA, 25 bp, Rattus norvegicus
taagcagtgtttatctgtttgttct

SEQ ID NO: 542315 - DNA, 25 bp, Rattus norvegicus
taagcagtgtttttctgtttgttct

SEQ ID NO: 542316 - DNA, 25 bp, Rattus norvegicus
taagcagttacaatcagaccctacc

SEQ ID NO: 542317 - DNA, 25 bp, Rattus norvegicus
taagcagttacattcagaccctacc

SEQ ID NO: 542318 - DNA, 25 bp, Rattus norvegicus
taagcagttccccttccggtcaagg

SEQ ID NO: 542319 - DNA, 25 bp, Rattus norvegicus
taagcagttcccgttccggtcaagg

SEQ ID NO: 542320 - DNA, 25 bp, Rattus norvegicus
taagcagttctccaacacagtgtgc

SEQ ID NO: 542321 - DNA, 25 bp, Rattus norvegicus
taagcagttctcgaacacagtgtgc

SEQ ID NO: 542322 - DNA, 25 bp, Rattus norvegicus
taagcagttgacaaggacaggcctc

SEQ ID NO: 542323 - DNA, 25 bp, Rattus norvegicus
taagcagttgactaggacaggcctc

SEQ ID NO: 542324 - DNA, 25 bp, Rattus norvegicus
taagcagtttcacgctcttgtggcc

SEQ ID NO: 542325 - DNA, 25 bp, Rattus norvegicus
taagcagtttcaggctcttgtggcc

SEQ ID NO: 542326 - DNA, 25 bp, Rattus norvegicus
taagcagttttcacgcacagtagat

SEQ ID NO: 542327 - DNA, 25 bp, Rattus norvegicus
taagcagttttctcgcacagtagat

SEQ ID NO: 542328 - DNA, 25 bp, Rattus norvegicus
taagcagtttttcttctcccttgag

SEQ ID NO: 542329 - DNA, 25 bp, Rattus norvegicus
taagcagtttttgttctcccttgag

SEQ ID NO: 542330 - DNA, 25 bp, Rattus norvegicus
taagcatccaagagtctacccgcga

SEQ ID NO: 542331 - DNA, 25 bp, Rattus norvegicus
taagcatccaagtgtctacccgcga

SEQ ID NO: 542332 - DNA, 25 bp, Rattus norvegicus
taagcatccagactcttcataatgt

SEQ ID NO: 542333 - DNA, 25 bp, Rattus norvegicus
taagcatccagagtcttcataatgt

SEQ ID NO: 542334 - DNA, 25 bp, Rattus norvegicus
taagcatcctgacccagagacttct

SEQ ID NO: 542335 - DNA, 25 bp, Rattus norvegicus
taagcatcctgagccagagacttct

SEQ ID NO: 542336 - DNA, 25 bp, Rattus norvegicus
taagcatcctgtaggagcctgctgg

SEQ ID NO: 542337 - DNA, 25 bp, Rattus norvegicus
taagcatcctgttggagcctgctgg

SEQ ID NO: 542338 - DNA, 25 bp, Rattus norvegicus
taagcatcctttcatctttccttag

SEQ ID NO: 542339 - DNA, 25 bp, Rattus norvegicus
taagcatcctttgatctttccttag

SEQ ID NO: 542340 - DNA, 25 bp, Rattus norvegicus
taagcatctctgctttgttcattct

SEQ ID NO: 542341 - DNA, 25 bp, Rattus norvegicus
taagcatctctggtttgttcattct

SEQ ID NO: 542342 - DNA, 25 bp, Rattus norvegicus
taagcatcttggcacattcattctg

SEQ ID NO: 542343 - DNA, 25 bp, Rattus norvegicus
taagcatcttgggacattcattctg

SEQ ID NO: 542344 - DNA, 25 bp, Rattus norvegicus
taagcatgcttacgctgtcattata

SEQ ID NO: 542345 - DNA, 25 bp, Rattus norvegicus
taagcatgcttaggctgtcattata

SEQ ID NO: 542346 - DNA, 25 bp, Rattus norvegicus
taagcatggctgaggttctgtcctc

SEQ ID NO: 542347 - DNA, 25 bp, Rattus norvegicus
taagcatggctgtggttctgtcctc

SEQ ID NO: 542348 - DNA, 25 bp, Rattus norvegicus
taagcatggtttagcacagccggcc

SEQ ID NO: 542349 - DNA, 25 bp, Rattus norvegicus
taagcatggttttgcacagccggcc

SEQ ID NO: 542350 - DNA, 25 bp, Rattus norvegicus
taagcatgtagacctagtgcagcat

SEQ ID NO: 542351 - DNA, 25 bp, Rattus norvegicus
taagcatgtagagctagtgcagcat

SEQ ID NO: 542352 - DNA, 25 bp, Rattus norvegicus
taagcatgtcaaagccagcgcctgt

SEQ ID NO: 542353 - DNA, 25 bp, Rattus norvegicus
taagcatgtcaatgccagcgcctgt

SEQ ID NO: 542354 - DNA, 25 bp, Rattus norvegicus
taagcatgtttgagggctctgccca

SEQ ID NO: 542355 - DNA, 25 bp, Rattus norvegicus
taagcatgtttgtgggctctgccca

SEQ ID NO: 542356 - DNA, 25 bp, Rattus norvegicus
taagcattaccacccagctatgtgg

SEQ ID NO: 542357 - DNA, 25 bp, Rattus norvegicus
taagcattaccagccagctatgtgg

SEQ ID NO: 542358 - DNA, 25 bp, Rattus norvegicus
taagcattcaagctcccaggaatct

SEQ ID NO: 542359 - DNA, 25 bp, Rattus norvegicus
taagcattcaaggtcccaggaatct

SEQ ID NO: 542360 - DNA, 25 bp, Rattus norvegicus
taagcattcgtgctgtctgtgtaga

SEQ ID NO: 542361 - DNA, 25 bp, Rattus norvegicus
taagcattcgtggtgtctgtgtaga

SEQ ID NO: 542362 - DNA, 25 bp, Rattus norvegicus
taagcattgtcaactcctatgtcca

SEQ ID NO: 542363 - DNA, 25 bp, Rattus norvegicus
taagcattgtcatctcctatgtcca

SEQ ID NO: 542364 - DNA, 25 bp, Rattus norvegicus
taagcattgtctaagcccagcctgt

SEQ ID NO: 542365 - DNA, 25 bp, Rattus norvegicus
taagcattgtcttagcccagcctgt

SEQ ID NO: 542366 - DNA, 25 bp, Rattus norvegicus
taagcatttcctagatgaccctgca

SEQ ID NO: 542367 - DNA, 25 bp, Rattus norvegicus
taagcatttccttgatgaccctgca

SEQ ID NO: 542368 - DNA, 25 bp, Rattus norvegicus
taagccaaacccaccttgtgaggat

SEQ ID NO: 542369 - DNA, 25 bp, Rattus norvegicus
taagccaaaccctccttgtgaggat

SEQ ID NO: 542370 - DNA, 25 bp, Rattus norvegicus
taagccaaccgacatactgccgcaa

SEQ ID NO: 542371 - DNA, 25 bp, Rattus norvegicus
taagccaaccgagatactgccgcaa

SEQ ID NO: 542372 - DNA, 25 bp, Rattus norvegicus
taagccaacctcagctgagcaagta

SEQ ID NO: 542373 - DNA, 25 bp, Rattus norvegicus
taagccaacctctgctgagcaagta

SEQ ID NO: 542374 - DNA, 25 bp, Rattus norvegicus
taagccaagtggacgcctaagaatc

SEQ ID NO: 542375 - DNA, 25 bp, Rattus norvegicus
taagccaagtggtcgcctaagaatc

SEQ ID NO: 542376 - DNA, 25 bp, Rattus norvegicus
taagccaatgtgatatgataccaat

SEQ ID NO: 542377 - DNA, 25 bp, Rattus norvegicus
taagccaatgtgttatgataccaat

SEQ ID NO: 542378 - DNA, 25 bp, Rattus norvegicus
taagccaattttactgcactgagca

SEQ ID NO: 542379 - DNA, 25 bp, Rattus norvegicus
taagccaatttttctgcactgagca

SEQ ID NO: 542380 - DNA, 25 bp, Rattus norvegicus
taagccacaaccattcccttcttgt

SEQ ID NO: 542381 - DNA, 25 bp, Rattus norvegicus
taagccacaacctttcccttcttgt

SEQ ID NO: 542382 - DNA, 25 bp, Rattus norvegicus
taagccacactacaaaggtatacat

SEQ ID NO: 542383 - DNA, 25 bp, Rattus norvegicus
taagccacactagaaaggtatacat

SEQ ID NO: 542384 - DNA, 25 bp, Rattus norvegicus
taagccacaggcaaatgtacctcag

SEQ ID NO: 542385 - DNA, 25 bp, Rattus norvegicus
taagccacaggctaatgtacctcag

SEQ ID NO: 542386 - DNA, 25 bp, Rattus norvegicus
taagccacatgtacctttctgacaa

SEQ ID NO: 542387 - DNA, 25 bp, Rattus norvegicus
taagccacatgttcctttctgacaa

SEQ ID NO: 542388 - DNA, 25 bp, Rattus norvegicus
taagccaccctgagatctctgcaga

SEQ ID NO: 542389 - DNA, 25 bp, Rattus norvegicus
taagccaccctgtgatctctgcaga

SEQ ID NO: 542390 - DNA, 25 bp, Rattus norvegicus
taagccaccgagacagcattgagac

SEQ ID NO: 542391 - DNA, 25 bp, Rattus norvegicus
taagccaccgagtcagcattgagac

SEQ ID NO: 542392 - DNA, 25 bp, Rattus norvegicus
taagccacgctgctgtggtcagaac

SEQ ID NO: 542393 - DNA, 25 bp, Rattus norvegicus
taagccacgctggtgtggtcagaac

SEQ ID NO: 542394 - DNA, 25 bp, Rattus norvegicus
taagccactatcatctgaccttggt

SEQ ID NO: 542395 - DNA, 25 bp, Rattus norvegicus
taagccactatcttctgaccttggt

SEQ ID NO: 542396 - DNA, 25 bp, Rattus norvegicus
taagccaggccaccttgaaggccat

SEQ ID NO: 542397 - DNA, 25 bp, Rattus norvegicus
taagccaggccagcttgaaggccat

SEQ ID NO: 542398 - DNA, 25 bp, Rattus norvegicus
taagccaggcctagatgctgatccc

SEQ ID NO: 542399 - DNA, 25 bp, Rattus norvegicus
taagccaggccttgatgctgatccc

SEQ ID NO: 542400 - DNA, 25 bp, Rattus norvegicus
taagccaggcgtcatgacctacact

SEQ ID NO: 542401 - DNA, 25 bp, Rattus norvegicus
taagccaggcgtgatgacctacact

SEQ ID NO: 542402 - DNA, 25 bp, Rattus norvegicus
taagccagggtcactgtctgaacca

SEQ ID NO: 542403 - DNA, 25 bp, Rattus norvegicus
taagccagggtcatgtctggatgac

SEQ ID NO: 542404 - DNA, 25 bp, Rattus norvegicus
taagccagggtctctgtctgaacca

SEQ ID NO: 542405 - DNA, 25 bp, Rattus norvegicus
taagccagggtcttgtctggatgac

SEQ ID NO: 542406 - DNA, 25 bp, Rattus norvegicus
taagccaggtgactgtgtgctctgt

SEQ ID NO: 542407 - DNA, 25 bp, Rattus norvegicus
taagccaggtgagtgtgtgctctgt

SEQ ID NO: 542408 - DNA, 25 bp, Rattus norvegicus
taagccaggtgtatccagctgagat

SEQ ID NO: 542409 - DNA, 25 bp, Rattus norvegicus
taagccaggtgtttccagctgagat

SEQ ID NO: 542410 - DNA, 25 bp, Rattus norvegicus
taagccagtcttcccttaacaaaat

SEQ ID NO: 542411 - DNA, 25 bp, Rattus norvegicus
taagccagtcttgccttaacaaaat

SEQ ID NO: 542412 - DNA, 25 bp, Rattus norvegicus
taagccagtgaaagagtgccagcag

SEQ ID NO: 542413 - DNA, 25 bp, Rattus norvegicus
taagccagtgaatgagtgccagcag

SEQ ID NO: 542414 - DNA, 25 bp, Rattus norvegicus
taagccataacaccctttttctatt

SEQ ID NO: 542415 - DNA, 25 bp, Rattus norvegicus
taagccataacagcctttttctatt

SEQ ID NO: 542416 - DNA, 25 bp, Rattus norvegicus
taagccatacgtccccttgaattcc

SEQ ID NO: 542417 - DNA, 25 bp, Rattus norvegicus
taagccatacgtgcccttgaattcc

SEQ ID NO: 542418 - DNA, 25 bp, Rattus norvegicus
taagccatactacccagcgaacgga

SEQ ID NO: 542419 - DNA, 25 bp, Rattus norvegicus
taagccatactagccagcgaacgga

SEQ ID NO: 542420 - DNA, 25 bp, Rattus norvegicus
taagccatagacctgacgggcgtct

SEQ ID NO: 542421 - DNA, 25 bp, Rattus norvegicus
taagccatagacgtgacgggcgtct

SEQ ID NO: 542422 - DNA, 25 bp, Rattus norvegicus
taagccatagccactggtgagcaag

SEQ ID NO: 542423 - DNA, 25 bp, Rattus norvegicus
taagccatagcctctggtgagcaag

SEQ ID NO: 542424 - DNA, 25 bp, Rattus norvegicus
taagccataggtacactcacacagc

SEQ ID NO: 542425 - DNA, 25 bp, Rattus norvegicus
taagccataggttcactcacacagc

SEQ ID NO: 542426 - DNA, 25 bp, Rattus norvegicus
taagccatataaaccttctcctcaa

SEQ ID NO: 542427 - DNA, 25 bp, Rattus norvegicus
taagccatataatccttctcctcaa

SEQ ID NO: 542428 - DNA, 25 bp, Rattus norvegicus
taagccatcaacctaggtttcccaa

SEQ ID NO: 542429 - DNA, 25 bp, Rattus norvegicus
taagccatcaacgtaggtttcccaa

SEQ ID NO: 542430 - DNA, 25 bp, Rattus norvegicus
taagccatcttcctctacaggtatt

SEQ ID NO: 542431 - DNA, 25 bp, Rattus norvegicus
taagccatcttcgtctacaggtatt

SEQ ID NO: 542432 - DNA, 25 bp, Rattus norvegicus
taagccatgagaccgatttaaccag

SEQ ID NO: 542433 - DNA, 25 bp, Rattus norvegicus
taagccatgagagcgatttaaccag

SEQ ID NO: 542434 - DNA, 25 bp, Rattus norvegicus
taagccatgccgagattaaccctga

SEQ ID NO: 542435 - DNA, 25 bp, Rattus norvegicus
taagccatgccgtgattaaccctga

SEQ ID NO: 542436 - DNA, 25 bp, Rattus norvegicus
taagccatggagctggacaagccta

SEQ ID NO: 542437 - DNA, 25 bp, Rattus norvegicus
taagccatggaggtggacaagccta

SEQ ID NO: 542438 - DNA, 25 bp, Rattus norvegicus
taagccatgtctccagtctgttatg

SEQ ID NO: 542439 - DNA, 25 bp, Rattus norvegicus
taagccatgtctgcagtctgttatg

SEQ ID NO: 542440 - DNA, 25 bp, Rattus norvegicus
taagccatttccatgttctaccagt

SEQ ID NO: 542441 - DNA, 25 bp, Rattus norvegicus
taagccatttccttgttctaccagt

SEQ ID NO: 542442 - DNA, 25 bp, Rattus norvegicus
taagccatttttcgcatgtcagtaa

SEQ ID NO: 542443 - DNA, 25 bp, Rattus norvegicus
taagccatttttggcatgtcagtaa

SEQ ID NO: 542444 - DNA, 25 bp, Rattus norvegicus
taagcccaaccgatatttctacgca

SEQ ID NO: 542445 - DNA, 25 bp, Rattus norvegicus
taagcccaaccgttatttctacgca

SEQ ID NO: 542446 - DNA, 25 bp, Rattus norvegicus
taagcccacatcaactctaacaagt

SEQ ID NO: 542447 - DNA, 25 bp, Rattus norvegicus
taagcccacatctactctaacaagt

SEQ ID NO: 542448 - DNA, 25 bp, Rattus norvegicus
taagcccacggtccagacaggacgg

SEQ ID NO: 542449 - DNA, 25 bp, Rattus norvegicus
taagcccacggtgcagacaggacgg

SEQ ID NO: 542450 - DNA, 25 bp, Rattus norvegicus
taagcccagaagacctcaaggcctg

SEQ ID NO: 542451 - DNA, 25 bp, Rattus norvegicus
taagcccagaagtcctcaaggcctg

SEQ ID NO: 542452 - DNA, 25 bp, Rattus norvegicus
taagcccaggacactagcgtttctc

SEQ ID NO: 542453 - DNA, 25 bp, Rattus norvegicus
taagcccaggactctagcgtttctc

SEQ ID NO: 542454 - DNA, 25 bp, Rattus norvegicus
taagcccagtcaacattaacccagt

SEQ ID NO: 542455 - DNA, 25 bp, Rattus norvegicus
taagcccagtcatcattaacccagt

SEQ ID NO: 542456 - DNA, 25 bp, Rattus norvegicus
taagcccatccacgctagaagtgtg

SEQ ID NO: 542457 - DNA, 25 bp, Rattus norvegicus
taagcccatccaggctagaagtgtg

SEQ ID NO: 542458 - DNA, 25 bp, Rattus norvegicus
taagcccattttatcccagaaatca

SEQ ID NO: 542459 - DNA, 25 bp, Rattus norvegicus
taagcccattttcctgcaccaagtg

SEQ ID NO: 542460 - DNA, 25 bp, Rattus norvegicus
taagcccattttgctgcaccaagtg

SEQ ID NO: 542461 - DNA, 25 bp, Rattus norvegicus
taagcccattttttcccagaaatca

SEQ ID NO: 542462 - DNA, 25 bp, Rattus norvegicus
taagccccaactccttttgtcaaag

SEQ ID NO: 542463 - DNA, 25 bp, Rattus norvegicus
taagccccaactgcttttgtcaaag

SEQ ID NO: 542464 - DNA, 25 bp, Rattus norvegicus
taagccccaagtcgtggtattgcca

SEQ ID NO: 542465 - DNA, 25 bp, Rattus norvegicus
taagccccaagtggtggtattgcca

SEQ ID NO: 542466 - DNA, 25 bp, Rattus norvegicus
taagccccgcacagtattatggtgt

SEQ ID NO: 542467 - DNA, 25 bp, Rattus norvegicus
taagccccgcactgtattatggtgt

SEQ ID NO: 542468 - DNA, 25 bp, Rattus norvegicus
taagcccctagcctgacgtctatat

SEQ ID NO: 542469 - DNA, 25 bp, Rattus norvegicus
taagcccctagcgtgacgtctatat

SEQ ID NO: 542470 - DNA, 25 bp, Rattus norvegicus
taagcccctattcgtgccacaaaag

SEQ ID NO: 542471 - DNA, 25 bp, Rattus norvegicus
taagcccctattggtgccacaaaag

SEQ ID NO: 542472 - DNA, 25 bp, Rattus norvegicus
taagcccctccaatccagtagaaaa

SEQ ID NO: 542473 - DNA, 25 bp, Rattus norvegicus
taagcccctccattccagtagaaaa

SEQ ID NO: 542474 - DNA, 25 bp, Rattus norvegicus
taagcccctgaaaactggcattcta

SEQ ID NO: 542475 - DNA, 25 bp, Rattus norvegicus
taagcccctgaatactggcattcta

SEQ ID NO: 542476 - DNA, 25 bp, Rattus norvegicus
taagcccctttactgcttaatgttt

SEQ ID NO: 542477 - DNA, 25 bp, Rattus norvegicus
taagcccctttagtgcttaatgttt

SEQ ID NO: 542478 - DNA, 25 bp, Rattus norvegicus
taagccccttttaagcaggcacaag

SEQ ID NO: 542479 - DNA, 25 bp, Rattus norvegicus
taagcccctttttagcaggcacaag

SEQ ID NO: 542480 - DNA, 25 bp, Rattus norvegicus
taagcccgcgttccctaagtattaa

SEQ ID NO: 542481 - DNA, 25 bp, Rattus norvegicus
taagcccgcgttgcctaagtattaa

SEQ ID NO: 542482 - DNA, 25 bp, Rattus norvegicus
taagcccgcttactgtaacacatca

SEQ ID NO: 542483 - DNA, 25 bp, Rattus norvegicus
taagcccgcttagtgtaacacatca

SEQ ID NO: 542484 - DNA, 25 bp, Rattus norvegicus
taagccctaccccaggagatggttt

SEQ ID NO: 542485 - DNA, 25 bp, Rattus norvegicus
taagccctacccgaggagatggttt

SEQ ID NO: 542486 - DNA, 25 bp, Rattus norvegicus
taagccctagccagaagctggaggt

SEQ ID NO: 542487 - DNA, 25 bp, Rattus norvegicus
taagccctagcctgaagctggaggt

SEQ ID NO: 542488 - DNA, 25 bp, Rattus norvegicus
taagccctataccagaaccctatta

SEQ ID NO: 542489 - DNA, 25 bp, Rattus norvegicus
taagccctatacgagaaccctatta

SEQ ID NO: 542490 - DNA, 25 bp, Rattus norvegicus
taagccctcattcgtccatgggagc

SEQ ID NO: 542491 - DNA, 25 bp, Rattus norvegicus
taagccctcattggtccatgggagc

SEQ ID NO: 542492 - DNA, 25 bp, Rattus norvegicus
taagccctccagacttctgtcttgt

SEQ ID NO: 542493 - DNA, 25 bp, Rattus norvegicus
taagccctccagtcttctgtcttgt

SEQ ID NO: 542494 - DNA, 25 bp, Rattus norvegicus
taagccctgagcagccgatggccat

SEQ ID NO: 542495 - DNA, 25 bp, Rattus norvegicus
taagccctgagctgccgatggccat

SEQ ID NO: 542496 - DNA, 25 bp, Rattus norvegicus
taagccctgcttaaagtattcacaa

SEQ ID NO: 542497 - DNA, 25 bp, Rattus norvegicus
taagccctgctttaagtattcacaa

SEQ ID NO: 542498 - DNA, 25 bp, Rattus norvegicus
taagccctggctccatgggagactt

SEQ ID NO: 542499 - DNA, 25 bp, Rattus norvegicus
taagccctggctgcatgggagactt

SEQ ID NO: 542500 - DNA, 25 bp, Rattus norvegicus
taagccctgtaaaagtgtcccaaga

SEQ ID NO: 542501 - DNA, 25 bp, Rattus norvegicus
taagccctgtaatagtgtcccaaga

SEQ ID NO: 542502 - DNA, 25 bp, Rattus norvegicus
taagccctgttcattcaacaattta

SEQ ID NO: 542503 - DNA, 25 bp, Rattus norvegicus
taagccctgttctttcaacaattta

SEQ ID NO: 542504 - DNA, 25 bp, Rattus norvegicus
taagcccttagcacttacttggtgg

SEQ ID NO: 542505 - DNA, 25 bp, Rattus norvegicus
taagcccttagctcttacttggtgg

SEQ ID NO: 542506 - DNA, 25 bp, Rattus norvegicus
taagcccttgtaccagcaatccttt

SEQ ID NO: 542507 - DNA, 25 bp, Rattus norvegicus
taagcccttgtagcagcaatccttt

SEQ ID NO: 542508 - DNA, 25 bp, Rattus norvegicus
taagccctttagaggtgttagagac

SEQ ID NO: 542509 - DNA, 25 bp, Rattus norvegicus
taagccctttagtggtgttagagac

SEQ ID NO: 542510 - DNA, 25 bp, Rattus norvegicus
taagccctttgtatcccatctgtat

SEQ ID NO: 542511 - DNA, 25 bp, Rattus norvegicus
taagccctttgtttcccatctgtat

SEQ ID NO: 542512 - DNA, 25 bp, Rattus norvegicus
taagccgaacctagtaatttgtgta

SEQ ID NO: 542513 - DNA, 25 bp, Rattus norvegicus
taagccgaaccttgtaatttgtgta

SEQ ID NO: 542514 - DNA, 25 bp, Rattus norvegicus
taagccgactgccatctttaagaag

SEQ ID NO: 542515 - DNA, 25 bp, Rattus norvegicus
taagccgactgcgatctttaagaag

SEQ ID NO: 542516 - DNA, 25 bp, Rattus norvegicus
taagccgcagtgacgtttatgaaag

SEQ ID NO: 542517 - DNA, 25 bp, Rattus norvegicus
taagccgcagtgtcgtttatgaaag

SEQ ID NO: 542518 - DNA, 25 bp, Rattus norvegicus
taagccgctctgcaaaacggtcctt

SEQ ID NO: 542519 - DNA, 25 bp, Rattus norvegicus
taagccgctctggaaaacggtcctt

SEQ ID NO: 542520 - DNA, 25 bp, Rattus norvegicus
taagccggattacctcgaagttctg

SEQ ID NO: 542521 - DNA, 25 bp, Rattus norvegicus
taagccggattagctcgaagttctg

SEQ ID NO: 542522 - DNA, 25 bp, Rattus norvegicus
taagccgtagacctttaccgagatt

SEQ ID NO: 542523 - DNA, 25 bp, Rattus norvegicus
taagccgtagacgtttaccgagatt

SEQ ID NO: 542524 - DNA, 25 bp, Rattus norvegicus
taagccgttcttcaagtcttctctc

SEQ ID NO: 542525 - DNA, 25 bp, Rattus norvegicus
taagccgttcttgaagtcttctctc

SEQ ID NO: 542526 - DNA, 25 bp, Rattus norvegicus
taagccgtttagattgtcaattgat

SEQ ID NO: 542527 - DNA, 25 bp, Rattus norvegicus
taagccgtttagtttgtcaattgat

SEQ ID NO: 542528 - DNA, 25 bp, Rattus norvegicus
taagcctacaaacgtgctgtcccca

SEQ ID NO: 542529 - DNA, 25 bp, Rattus norvegicus
taagcctacaaaggtgctgtcccca

SEQ ID NO: 542530 - DNA, 25 bp, Rattus norvegicus
taagcctacatgatgtcagcagaag

SEQ ID NO: 542531 - DNA, 25 bp, Rattus norvegicus
taagcctacatgttgtcagcagaag

SEQ ID NO: 542532 - DNA, 25 bp, Rattus norvegicus
taagcctagcgtatgaacctgccag

SEQ ID NO: 542533 - DNA, 25 bp, Rattus norvegicus
taagcctagcgtttgaacctgccag

SEQ ID NO: 542534 - DNA, 25 bp, Rattus norvegicus
taagcctattgtccagctagtccaa

SEQ ID NO: 542535 - DNA, 25 bp, Rattus norvegicus
taagcctattgtgcagctagtccaa

SEQ ID NO: 542536 - DNA, 25 bp, Rattus norvegicus
taagcctcaactaacctgatggcat

SEQ ID NO: 542537 - DNA, 25 bp, Rattus norvegicus
taagcctcaactcttcacctgtgaa

SEQ ID NO: 542538 - DNA, 25 bp, Rattus norvegicus
taagcctcaactgttcacctgtgaa

SEQ ID NO: 542539 - DNA, 25 bp, Rattus norvegicus
taagcctcaacttacctgatggcat

SEQ ID NO: 542540 - DNA, 25 bp, Rattus norvegicus
taagcctcagaaataatccctcaag

SEQ ID NO: 542541 - DNA, 25 bp, Rattus norvegicus
taagcctcagaattaatccctcaag

SEQ ID NO: 542542 - DNA, 25 bp, Rattus norvegicus
taagcctcaggcagtacatttctgt

SEQ ID NO: 542543 - DNA, 25 bp, Rattus norvegicus
taagcctcaggctgtacatttctgt

SEQ ID NO: 542544 - DNA, 25 bp, Rattus norvegicus
taagcctcatcaacatggatctgcc

SEQ ID NO: 542545 - DNA, 25 bp, Rattus norvegicus
taagcctcatcatcatggatctgcc

SEQ ID NO: 542546 - DNA, 25 bp, Rattus norvegicus
taagcctccagacctgaggtaagac

SEQ ID NO: 542547 - DNA, 25 bp, Rattus norvegicus
taagcctccagagctgaggtaagac

SEQ ID NO: 542548 - DNA, 25 bp, Rattus norvegicus
taagcctccagccataggcttgatc

SEQ ID NO: 542549 - DNA, 25 bp, Rattus norvegicus
taagcctccagcgataggcttgatc

SEQ ID NO: 542550 - DNA, 25 bp, Rattus norvegicus
taagcctcccgtcacaggaatatgt

SEQ ID NO: 542551 - DNA, 25 bp, Rattus norvegicus
taagcctcccgtgacaggaatatgt

SEQ ID NO: 542552 - DNA, 25 bp, Rattus norvegicus
taagcctccgagaataaacccgcac

SEQ ID NO: 542553 - DNA, 25 bp, Rattus norvegicus
taagcctccgagtataaacccgcac

SEQ ID NO: 542554 - DNA, 25 bp, Rattus norvegicus
taagcctcggctaccataaaagatc

SEQ ID NO: 542555 - DNA, 25 bp, Rattus norvegicus
taagcctcggcttccataaaagatc

SEQ ID NO: 542556 - DNA, 25 bp, Rattus norvegicus
taagcctcggtacctttgttataat

SEQ ID NO: 542557 - DNA, 25 bp, Rattus norvegicus
taagcctcggtagctttgttataat

SEQ ID NO: 542558 - DNA, 25 bp, Rattus norvegicus
taagcctctattatcgtttcataag

SEQ ID NO: 542559 - DNA, 25 bp, Rattus norvegicus
taagcctctattttcgtttcataag

SEQ ID NO: 542560 - DNA, 25 bp, Rattus norvegicus
taagcctctcttaaagtcagagcat

SEQ ID NO: 542561 - DNA, 25 bp, Rattus norvegicus
taagcctctctttaagtcagagcat

SEQ ID NO: 542562 - DNA, 25 bp, Rattus norvegicus
taagcctctgagatgcctatgctat

SEQ ID NO: 542563 - DNA, 25 bp, Rattus norvegicus
taagcctctgagttgcctatgctat

SEQ ID NO: 542564 - DNA, 25 bp, Rattus norvegicus
taagcctgaagacccaacaacatgt

SEQ ID NO: 542565 - DNA, 25 bp, Rattus norvegicus
taagcctgaagagccaacaacatgt

SEQ ID NO: 542566 - DNA, 25 bp, Rattus norvegicus
taagcctgaagcacttattcctggg

SEQ ID NO: 542567 - DNA, 25 bp, Rattus norvegicus
taagcctgaagctcttattcctggg

SEQ ID NO: 542568 - DNA, 25 bp, Rattus norvegicus
taagcctgccatagctaccctgaag

SEQ ID NO: 542569 - DNA, 25 bp, Rattus norvegicus
taagcctgccatagcttgccagcca

SEQ ID NO: 542570 - DNA, 25 bp, Rattus norvegicus
taagcctgccattgctaccctgaag

SEQ ID NO: 542571 - DNA, 25 bp, Rattus norvegicus
taagcctgccattgcttgccagcca

SEQ ID NO: 542572 - DNA, 25 bp, Rattus norvegicus
taagcctgccctcgatgctgcttct

SEQ ID NO: 542573 - DNA, 25 bp, Rattus norvegicus
taagcctgccctggatgctgcttct

SEQ ID NO: 542574 - DNA, 25 bp, Rattus norvegicus
taagcctgcctcacggtaagccaaa

SEQ ID NO: 542575 - DNA, 25 bp, Rattus norvegicus
taagcctgcctctcggtaagccaaa

SEQ ID NO: 542576 - DNA, 25 bp, Rattus norvegicus
taagcctgccttaggattacactat

SEQ ID NO: 542577 - DNA, 25 bp, Rattus norvegicus
taagcctgccttctggtgtttttca

SEQ ID NO: 542578 - DNA, 25 bp, Rattus norvegicus
taagcctgccttgtggtgtttttca

SEQ ID NO: 542579 - DNA, 25 bp, Rattus norvegicus
taagcctgcctttggattacactat

SEQ ID NO: 542580 - DNA, 25 bp, Rattus norvegicus
taagcctggcttcagcttctgagac

SEQ ID NO: 542581 - DNA, 25 bp, Rattus norvegicus
taagcctggcttcgaccttggcatt

SEQ ID NO: 542582 - DNA, 25 bp, Rattus norvegicus
taagcctggcttgagcttctgagac

SEQ ID NO: 542583 - DNA, 25 bp, Rattus norvegicus
taagcctggcttggaccttggcatt

SEQ ID NO: 542584 - DNA, 25 bp, Rattus norvegicus
taagcctgggttcacgatcatctgt

SEQ ID NO: 542585 - DNA, 25 bp, Rattus norvegicus
taagcctgggttgacgatcatctgt

SEQ ID NO: 542586 - DNA, 25 bp, Rattus norvegicus
taagcctggtgcctatatgtctgcg

SEQ ID NO: 542587 - DNA, 25 bp, Rattus norvegicus
taagcctggtgcgtatatgtctgcg

SEQ ID NO: 542588 - DNA, 25 bp, Rattus norvegicus
taagcctggtggatttgtatgcaat

SEQ ID NO: 542589 - DNA, 25 bp, Rattus norvegicus
taagcctggtggttttgtatgcaat

SEQ ID NO: 542590 - DNA, 25 bp, Rattus norvegicus
taagcctggtgtctatgttcgtgtt

SEQ ID NO: 542591 - DNA, 25 bp, Rattus norvegicus
taagcctggtgtgtatgttcgtgtt

SEQ ID NO: 542592 - DNA, 25 bp, Rattus norvegicus
taagcctgtgccaatgcaagggttt

SEQ ID NO: 542593 - DNA, 25 bp, Rattus norvegicus
taagcctgtgcctatgcaagggttt

SEQ ID NO: 542594 - DNA, 25 bp, Rattus norvegicus
taagcctgttctctcgggcagcctg

SEQ ID NO: 542595 - DNA, 25 bp, Rattus norvegicus
taagcctgttctgtcgggcagcctg

SEQ ID NO: 542596 - DNA, 25 bp, Rattus norvegicus
taagccttaatcatctagtactcaa

SEQ ID NO: 542597 - DNA, 25 bp, Rattus norvegicus
taagccttaatcttctagtactcaa

SEQ ID NO: 542598 - DNA, 25 bp, Rattus norvegicus
taagccttaattactcagctctaaa

SEQ ID NO: 542599 - DNA, 25 bp, Rattus norvegicus
taagccttaatttctcagctctaaa

SEQ ID NO: 542600 - DNA, 25 bp, Rattus norvegicus
taagccttacttccatctctgtggc

SEQ ID NO: 542601 - DNA, 25 bp, Rattus norvegicus
taagccttacttgcatctctgtggc

SEQ ID NO: 542602 - DNA, 25 bp, Rattus norvegicus
taagccttatttcctcttctgtaaa

SEQ ID NO: 542603 - DNA, 25 bp, Rattus norvegicus
taagccttatttgctcttctgtaaa

SEQ ID NO: 542604 - DNA, 25 bp, Rattus norvegicus
taagccttcaccacaataaagcgtc

SEQ ID NO: 542605 - DNA, 25 bp, Rattus norvegicus
taagccttcacctcaataaagcgtc

SEQ ID NO: 542606 - DNA, 25 bp, Rattus norvegicus
taagccttcactcgaattgggacat

SEQ ID NO: 542607 - DNA, 25 bp, Rattus norvegicus
taagccttcactggaattgggacat

SEQ ID NO: 542608 - DNA, 25 bp, Rattus norvegicus
taagccttcggtactgaccactctg

SEQ ID NO: 542609 - DNA, 25 bp, Rattus norvegicus
taagccttcggttctgaccactctg

SEQ ID NO: 542610 - DNA, 25 bp, Rattus norvegicus
taagccttctaactctgactgttgc

SEQ ID NO: 542611 - DNA, 25 bp, Rattus norvegicus
taagccttctaagtctgactgttgc

SEQ ID NO: 542612 - DNA, 25 bp, Rattus norvegicus
taagccttctgtaatggtcaatcct

SEQ ID NO: 542613 - DNA, 25 bp, Rattus norvegicus
taagccttctgttatggtcaatcct

SEQ ID NO: 542614 - DNA, 25 bp, Rattus norvegicus
taagccttgacactggttcaccttc

SEQ ID NO: 542615 - DNA, 25 bp, Rattus norvegicus
taagccttgacagtggttcaccttc

SEQ ID NO: 542616 - DNA, 25 bp, Rattus norvegicus
taagccttgggacccttaagcaggg

SEQ ID NO: 542617 - DNA, 25 bp, Rattus norvegicus
taagccttgggagccttaagcaggg

SEQ ID NO: 542618 - DNA, 25 bp, Rattus norvegicus
taagccttgttcagctcctgtcgtg

SEQ ID NO: 542619 - DNA, 25 bp, Rattus norvegicus
taagccttgttctgctcctgtcgtg

SEQ ID NO: 542620 - DNA, 25 bp, Rattus norvegicus
taagcctttcacaaaaacactgccc

SEQ ID NO: 542621 - DNA, 25 bp, Rattus norvegicus
taagcctttcactaaaacactgccc

SEQ ID NO: 542622 - DNA, 25 bp, Rattus norvegicus
taagcctttccaaaaactaatcaca

SEQ ID NO: 542623 - DNA, 25 bp, Rattus norvegicus
taagcctttccataaactaatcaca

SEQ ID NO: 542624 - DNA, 25 bp, Rattus norvegicus
taagcctttcccatggacatttaag

SEQ ID NO: 542625 - DNA, 25 bp, Rattus norvegicus
taagcctttcccttggacatttaag

SEQ ID NO: 542626 - DNA, 25 bp, Rattus norvegicus
taagccttttctacaagcctgctac

SEQ ID NO: 542627 - DNA, 25 bp, Rattus norvegicus
taagccttttcttcaagcctgctac

SEQ ID NO: 542628 - DNA, 25 bp, Rattus norvegicus
taagcgacagcactcctggcactga

SEQ ID NO: 542629 - DNA, 25 bp, Rattus norvegicus
taagcgacagcagtcctggcactga

SEQ ID NO: 542630 - DNA, 25 bp, Rattus norvegicus
taagcgaccacccaaaaccaagtat

SEQ ID NO: 542631 - DNA, 25 bp, Rattus norvegicus
taagcgaccaccgaaaaccaagtat

SEQ ID NO: 542632 - DNA, 25 bp, Rattus norvegicus
taagcgacctgaaggcacggcgcag

SEQ ID NO: 542633 - DNA, 25 bp, Rattus norvegicus
taagcgacctgatggcacggcgcag

SEQ ID NO: 542634 - DNA, 25 bp, Rattus norvegicus
taagcgataacaaacggctgggaca

SEQ ID NO: 542635 - DNA, 25 bp, Rattus norvegicus
taagcgataacatacggctgggaca

SEQ ID NO: 542636 - DNA, 25 bp, Rattus norvegicus
taagcgatctgtcattggctcatcc

SEQ ID NO: 542637 - DNA, 25 bp, Rattus norvegicus
taagcgatctgtgattggctcatcc

SEQ ID NO: 542638 - DNA, 25 bp, Rattus norvegicus
taagcgatgcagattcatccgcgac

SEQ ID NO: 542639 - DNA, 25 bp, Rattus norvegicus
taagcgatgcagtttcatccgcgac

SEQ ID NO: 542640 - DNA, 25 bp, Rattus norvegicus
taagcgcacggtcctcagtcagttt

SEQ ID NO: 542641 - DNA, 25 bp, Rattus norvegicus
taagcgcacggtgctcagtcagttt

SEQ ID NO: 542642 - DNA, 25 bp, Rattus norvegicus
taagcgcactcacacagcatcttta

SEQ ID NO: 542643 - DNA, 25 bp, Rattus norvegicus
taagcgcactcagacagcatcttta

SEQ ID NO: 542644 - DNA, 25 bp, Rattus norvegicus
taagcgcaggacagattggaagcaa

SEQ ID NO: 542645 - DNA, 25 bp, Rattus norvegicus
taagcgcaggactgattggaagcaa

SEQ ID NO: 542646 - DNA, 25 bp, Rattus norvegicus
taagcgccaccgcaaagtcctgcgc

SEQ ID NO: 542647 - DNA, 25 bp, Rattus norvegicus
taagcgccaccggaaagtcctgcgc

SEQ ID NO: 542648 - DNA, 25 bp, Rattus norvegicus
taagcgcccaagaacccacgagctg

SEQ ID NO: 542649 - DNA, 25 bp, Rattus norvegicus
taagcgcccaagtacccacgagctg

SEQ ID NO: 542650 - DNA, 25 bp, Rattus norvegicus
taagcgccgggcagtttacttacac

SEQ ID NO: 542651 - DNA, 25 bp, Rattus norvegicus
taagcgccgggctgtttacttacac

SEQ ID NO: 542652 - DNA, 25 bp, Rattus norvegicus
taagcgctacaacgccaactactgc

SEQ ID NO: 542653 - DNA, 25 bp, Rattus norvegicus
taagcgctacaaggccaactactgc

SEQ ID NO: 542654 - DNA, 25 bp, Rattus norvegicus
taagcgctcgcaacaatagcattat

SEQ ID NO: 542655 - DNA, 25 bp, Rattus norvegicus
taagcgctcgcatcaatagcattat

SEQ ID NO: 542656 - DNA, 25 bp, Rattus norvegicus
taagcgctctagatgtgggtcctca

SEQ ID NO: 542657 - DNA, 25 bp, Rattus norvegicus
taagcgctctagttgtgggtcctca

SEQ ID NO: 542658 - DNA, 25 bp, Rattus norvegicus
taagcgcttgcccatgtggaattcg

SEQ ID NO: 542659 - DNA, 25 bp, Rattus norvegicus
taagcgcttgccgatgtggaattcg

SEQ ID NO: 542660 - DNA, 25 bp, Rattus norvegicus
taagcgcttgctatctcaggcttta

SEQ ID NO: 542661 - DNA, 25 bp, Rattus norvegicus
taagcgcttgctttctcaggcttta

SEQ ID NO: 542662 - DNA, 25 bp, Rattus norvegicus
taagcggacagcacggtagtcttaa

SEQ ID NO: 542663 - DNA, 25 bp, Rattus norvegicus
taagcggacagctcggtagtcttaa

SEQ ID NO: 542664 - DNA, 25 bp, Rattus norvegicus
taagcggactcgacttccagtgatc

SEQ ID NO: 542665 - DNA, 25 bp, Rattus norvegicus
taagcggactcgtcttccagtgatc

SEQ ID NO: 542666 - DNA, 25 bp, Rattus norvegicus
taagcggcaggaaagaccacccctc

SEQ ID NO: 542667 - DNA, 25 bp, Rattus norvegicus
taagcggcaggatagaccacccctc

SEQ ID NO: 542668 - DNA, 25 bp, Rattus norvegicus
taagcggctggacgagtacacccaa

SEQ ID NO: 542669 - DNA, 25 bp, Rattus norvegicus
taagcggctggaggagtacacccaa

SEQ ID NO: 542670 - DNA, 25 bp, Rattus norvegicus
taagcgggattgcacctcgcagcta

SEQ ID NO: 542671 - DNA, 25 bp, Rattus norvegicus
taagcgggattggacctcgcagcta

SEQ ID NO: 542672 - DNA, 25 bp, Rattus norvegicus
taagcgggtattaggcacgcacacc

SEQ ID NO: 542673 - DNA, 25 bp, Rattus norvegicus
taagcgggtatttggcacgcacacc

SEQ ID NO: 542674 - DNA, 25 bp, Rattus norvegicus
taagcggtaacgactccaattctca

SEQ ID NO: 542675 - DNA, 25 bp, Rattus norvegicus
taagcggtaacgtctccaattctca

SEQ ID NO: 542676 - DNA, 25 bp, Rattus norvegicus
taagcggtccacagggccacagggt

SEQ ID NO: 542677 - DNA, 25 bp, Rattus norvegicus
taagcggtccactgggccacagggt

SEQ ID NO: 542678 - DNA, 25 bp, Rattus norvegicus
taagcggtgggtcgctgatcatctc

SEQ ID NO: 542679 - DNA, 25 bp, Rattus norvegicus
taagcggtgggtggctgatcatctc

SEQ ID NO: 542680 - DNA, 25 bp, Rattus norvegicus
taagcggttgttaaaggcccacaag

SEQ ID NO: 542681 - DNA, 25 bp, Rattus norvegicus
taagcggttgtttaaggcccacaag

SEQ ID NO: 542682 - DNA, 25 bp, Rattus norvegicus
taagcgtataccagctcataataat

SEQ ID NO: 542683 - DNA, 25 bp, Rattus norvegicus
taagcgtatacctgctcataataat

SEQ ID NO: 542684 - DNA, 25 bp, Rattus norvegicus
taagcgtcctggagtctacacagcc

SEQ ID NO: 542685 - DNA, 25 bp, Rattus norvegicus
taagcgtcctggtgtctacacagcc

SEQ ID NO: 542686 - DNA, 25 bp, Rattus norvegicus
taagcgtctaccatcagtcttgaaa

SEQ ID NO: 542687 - DNA, 25 bp, Rattus norvegicus
taagcgtctaccttcagtcttgaaa

SEQ ID NO: 542688 - DNA, 25 bp, Rattus norvegicus
taagcgtctactcggatgctgaagt

SEQ ID NO: 542689 - DNA, 25 bp, Rattus norvegicus
taagcgtctactgggatgctgaagt

SEQ ID NO: 542690 - DNA, 25 bp, Rattus norvegicus
taagcgtgctgcctcattccgtaag

SEQ ID NO: 542691 - DNA, 25 bp, Rattus norvegicus
taagcgtgctgcgtcattccgtaag

SEQ ID NO: 542692 - DNA, 25 bp, Rattus norvegicus
taagcgtgtgggacccagacttggt

SEQ ID NO: 542693 - DNA, 25 bp, Rattus norvegicus
taagcgtgtgggtcccagacttggt

SEQ ID NO: 542694 - DNA, 25 bp, Rattus norvegicus
taagcgtttaggctggagctgccct

SEQ ID NO: 542695 - DNA, 25 bp, Rattus norvegicus
taagcgtttagggtggagctgccct

SEQ ID NO: 542696 - DNA, 25 bp, Rattus norvegicus
taagcgttttctacacagcaagagc

SEQ ID NO: 542697 - DNA, 25 bp, Rattus norvegicus
taagcgttttcttcacagcaagagc

SEQ ID NO: 542698 - DNA, 25 bp, Rattus norvegicus
taagctaacactattaacaatggtt

SEQ ID NO: 542699 - DNA, 25 bp, Rattus norvegicus
taagctaacacttttaacaatggtt

SEQ ID NO: 542700 - DNA, 25 bp, Rattus norvegicus
taagctaactgcactttgatgttca

SEQ ID NO: 542701 - DNA, 25 bp, Rattus norvegicus
taagctaactgctctttgatgttca

SEQ ID NO: 542702 - DNA, 25 bp, Rattus norvegicus
taagctaagtcccaacatcctggtg

SEQ ID NO: 542703 - DNA, 25 bp, Rattus norvegicus
taagctaagtccgaacatcctggtg

SEQ ID NO: 542704 - DNA, 25 bp, Rattus norvegicus
taagctacaactccaccacagaggc

SEQ ID NO: 542705 - DNA, 25 bp, Rattus norvegicus
taagctacaactgcaccacagaggc

SEQ ID NO: 542706 - DNA, 25 bp, Rattus norvegicus
taagctaccgcgaactccaggagaa

SEQ ID NO: 542707 - DNA, 25 bp, Rattus norvegicus
taagctaccgcgtactccaggagaa

SEQ ID NO: 542708 - DNA, 25 bp, Rattus norvegicus
taagctactaagactcgttgagaag

SEQ ID NO: 542709 - DNA, 25 bp, Rattus norvegicus
taagctactaagtctcgttgagaag

SEQ ID NO: 542710 - DNA, 25 bp, Rattus norvegicus
taagctactctgaaccttcaatgaa

SEQ ID NO: 542711 - DNA, 25 bp, Rattus norvegicus
taagctactctgtaccttcaatgaa

SEQ ID NO: 542712 - DNA, 25 bp, Rattus norvegicus
taagctagagcacgtgtccagtgat

SEQ ID NO: 542713 - DNA, 25 bp, Rattus norvegicus
taagctagagcaggtgtccagtgat

SEQ ID NO: 542714 - DNA, 25 bp, Rattus norvegicus
taagctagagtgatggatgttccat

SEQ ID NO: 542715 - DNA, 25 bp, Rattus norvegicus
taagctagagtgttggatgttccat

SEQ ID NO: 542716 - DNA, 25 bp, Rattus norvegicus
taagctagccaaaaatccaccatcc

SEQ ID NO: 542717 - DNA, 25 bp, Rattus norvegicus
taagctagccaataatccaccatcc

SEQ ID NO: 542718 - DNA, 25 bp, Rattus norvegicus
taagctaggtcaccaattggcccct

SEQ ID NO: 542719 - DNA, 25 bp, Rattus norvegicus
taagctaggtcagcaattggcccct

SEQ ID NO: 542720 - DNA, 25 bp, Rattus norvegicus
taagctatagccctagactccaggc

SEQ ID NO: 542721 - DNA, 25 bp, Rattus norvegicus
taagctatagccgtagactccaggc

SEQ ID NO: 542722 - DNA, 25 bp, Rattus norvegicus
taagctatatccacagtctctcaca

SEQ ID NO: 542723 - DNA, 25 bp, Rattus norvegicus
taagctatatcctcagtctctcaca

SEQ ID NO: 542724 - DNA, 25 bp, Rattus norvegicus
taagctatcctcagtttcagactgg

SEQ ID NO: 542725 - DNA, 25 bp, Rattus norvegicus
taagctatcctctgtttcagactgg

SEQ ID NO: 542726 - DNA, 25 bp, Rattus norvegicus
taagctatctctccagaaaggccct

SEQ ID NO: 542727 - DNA, 25 bp, Rattus norvegicus
taagctatctctgcagaaaggccct

SEQ ID NO: 542728 - DNA, 25 bp, Rattus norvegicus
taagctatgagaatcacagaacgtg

SEQ ID NO: 542729 - DNA, 25 bp, Rattus norvegicus
taagctatgagattcacagaacgtg

SEQ ID NO: 542730 - DNA, 25 bp, Rattus norvegicus
taagctatttcacctttcattttga

SEQ ID NO: 542731 - DNA, 25 bp, Rattus norvegicus
taagctatttcagctttcattttga

SEQ ID NO: 542732 - DNA, 25 bp, Rattus norvegicus
taagctcacctaaactcccattttt

SEQ ID NO: 542733 - DNA, 25 bp, Rattus norvegicus
taagctcacctatactcccattttt

SEQ ID NO: 542734 - DNA, 25 bp, Rattus norvegicus
taagctcagcccagaccaaaactgt

SEQ ID NO: 542735 - DNA, 25 bp, Rattus norvegicus
taagctcagccctgaccaaaactgt

SEQ ID NO: 542736 - DNA, 25 bp, Rattus norvegicus
taagctcaggacattataacctctg

SEQ ID NO: 542737 - DNA, 25 bp, Rattus norvegicus
taagctcaggactttataacctctg

SEQ ID NO: 542738 - DNA, 25 bp, Rattus norvegicus
taagctccaagtaaaggtttcttct

SEQ ID NO: 542739 - DNA, 25 bp, Rattus norvegicus
taagctccaagttaaggtttcttct

SEQ ID NO: 542740 - DNA, 25 bp, Rattus norvegicus
taagctccagctatccagttttcta

SEQ ID NO: 542741 - DNA, 25 bp, Rattus norvegicus
taagctccagctttccagttttcta

SEQ ID NO: 542742 - DNA, 25 bp, Rattus norvegicus
taagctccaggaagacctcggctaa

SEQ ID NO: 542743 - DNA, 25 bp, Rattus norvegicus
taagctccaggatgacctcggctaa

SEQ ID NO: 542744 - DNA, 25 bp, Rattus norvegicus
taagctccatgtacaagcctaattg

SEQ ID NO: 542745 - DNA, 25 bp, Rattus norvegicus
taagctccatgttcaagcctaattg

SEQ ID NO: 542746 - DNA, 25 bp, Rattus norvegicus
taagctcccattcacccgtgtttaa

SEQ ID NO: 542747 - DNA, 25 bp, Rattus norvegicus
taagctcccattgacccgtgtttaa

SEQ ID NO: 542748 - DNA, 25 bp, Rattus norvegicus
taagctccctgacaagtccgagtat

SEQ ID NO: 542749 - DNA, 25 bp, Rattus norvegicus
taagctccctgagaagtccgagtat

SEQ ID NO: 542750 - DNA, 25 bp, Rattus norvegicus
taagctcctgccaagagaggctcgg

SEQ ID NO: 542751 - DNA, 25 bp, Rattus norvegicus
taagctcctgcctagagaggctcgg

SEQ ID NO: 542752 - DNA, 25 bp, Rattus norvegicus
taagctcctggaacacacgtgtgta

SEQ ID NO: 542753 - DNA, 25 bp, Rattus norvegicus
taagctcctggatcacacgtgtgta

SEQ ID NO: 542754 - DNA, 25 bp, Rattus norvegicus
taagctccttgtcctcacatgtatg

SEQ ID NO: 542755 - DNA, 25 bp, Rattus norvegicus
taagctccttgtgctcacatgtatg

SEQ ID NO: 542756 - DNA, 25 bp, Rattus norvegicus
taagctcgactgactctgagttcag

SEQ ID NO: 542757 - DNA, 25 bp, Rattus norvegicus
taagctcgactgtctctgagttcag

SEQ ID NO: 542758 - DNA, 25 bp, Rattus norvegicus
taagctcgtttaattcccttctaca

SEQ ID NO: 542759 - DNA, 25 bp, Rattus norvegicus
taagctcgtttatttcccttctaca

SEQ ID NO: 542760 - DNA, 25 bp, Rattus norvegicus
taagctctaagaactgctaaatgct

SEQ ID NO: 542761 - DNA, 25 bp, Rattus norvegicus
taagctctaagatctgctaaatgct

SEQ ID NO: 542762 - DNA, 25 bp, Rattus norvegicus
taagctctaagtatctgcatcccaa

SEQ ID NO: 542763 - DNA, 25 bp, Rattus norvegicus
taagctctaagtttctgcatcccaa

SEQ ID NO: 542764 - DNA, 25 bp, Rattus norvegicus
taagctctagagacacccaggacat

SEQ ID NO: 542765 - DNA, 25 bp, Rattus norvegicus
taagctctagagtcacccaggacat

SEQ ID NO: 542766 - DNA, 25 bp, Rattus norvegicus
taagctctcagaaatggactcattc

SEQ ID NO: 542767 - DNA, 25 bp, Rattus norvegicus
taagctctcagatatggactcattc

SEQ ID NO: 542768 - DNA, 25 bp, Rattus norvegicus
taagctctcgccacagagttcacag

SEQ ID NO: 542769 - DNA, 25 bp, Rattus norvegicus
taagctctcgcctcagagttcacag

SEQ ID NO: 542770 - DNA, 25 bp, Rattus norvegicus
taagctctgagcagtcaacgagacg

SEQ ID NO: 542771 - DNA, 25 bp, Rattus norvegicus
taagctctgagctgtcaacgagacg

SEQ ID NO: 542772 - DNA, 25 bp, Rattus norvegicus
taagctctgggcaggagaatgaaat

SEQ ID NO: 542773 - DNA, 25 bp, Rattus norvegicus
taagctctgggctggagaatgaaat

SEQ ID NO: 542774 - DNA, 25 bp, Rattus norvegicus
taagctcttactagactccagttga

SEQ ID NO: 542775 - DNA, 25 bp, Rattus norvegicus
taagctcttacttgactccagttga

SEQ ID NO: 542776 - DNA, 25 bp, Rattus norvegicus
taagctcttagcatggaccattggg

SEQ ID NO: 542777 - DNA, 25 bp, Rattus norvegicus
taagctcttagcttggaccattggg

SEQ ID NO: 542778 - DNA, 25 bp, Rattus norvegicus
taagctcttccccttgagagagacg

SEQ ID NO: 542779 - DNA, 25 bp, Rattus norvegicus
taagctcttcccgttgagagagacg

SEQ ID NO: 542780 - DNA, 25 bp, Rattus norvegicus
taagctcttggaacgacatttcata

SEQ ID NO: 542781 - DNA, 25 bp, Rattus norvegicus
taagctcttggatcgacatttcata

SEQ ID NO: 542782 - DNA, 25 bp, Rattus norvegicus
taagctctttagagacctttgtttt

SEQ ID NO: 542783 - DNA, 25 bp, Rattus norvegicus
taagctctttagtgacctttgtttt

SEQ ID NO: 542784 - DNA, 25 bp, Rattus norvegicus
taagctctttgacctgtggacctgc

SEQ ID NO: 542785 - DNA, 25 bp, Rattus norvegicus
taagctctttgagctgtggacctgc

SEQ ID NO: 542786 - DNA, 25 bp, Rattus norvegicus
taagctcttttaaagtgggaccact

SEQ ID NO: 542787 - DNA, 25 bp, Rattus norvegicus
taagctcttttatagtgggaccact

SEQ ID NO: 542788 - DNA, 25 bp, Rattus norvegicus
taagctgagatcaaagggacctttt

SEQ ID NO: 542789 - DNA, 25 bp, Rattus norvegicus
taagctgagatctaagggacctttt

SEQ ID NO: 542790 - DNA, 25 bp, Rattus norvegicus
taagctgataataaaccccgtgatt

SEQ ID NO: 542791 - DNA, 25 bp, Rattus norvegicus
taagctgataattaaccccgtgatt

SEQ ID NO: 542792 - DNA, 25 bp, Rattus norvegicus
taagctgatctaaaaatactggagt

SEQ ID NO: 542793 - DNA, 25 bp, Rattus norvegicus
taagctgatctataaatactggagt

SEQ ID NO: 542794 - DNA, 25 bp, Rattus norvegicus
taagctgatgcgctggatccgtaaa

SEQ ID NO: 542795 - DNA, 25 bp, Rattus norvegicus
taagctgatgcggtggatccgtaaa

SEQ ID NO: 542796 - DNA, 25 bp, Rattus norvegicus
taagctgattatatcctcttcataa

SEQ ID NO: 542797 - DNA, 25 bp, Rattus norvegicus
taagctgattatttcctcttcataa

SEQ ID NO: 542798 - DNA, 25 bp, Rattus norvegicus
taagctgattgaagttgtagggcaa

SEQ ID NO: 542799 - DNA, 25 bp, Rattus norvegicus
taagctgattgatgttgtagggcaa

SEQ ID NO: 542800 - DNA, 25 bp, Rattus norvegicus
taagctgcactcatgtattataggt

SEQ ID NO: 542801 - DNA, 25 bp, Rattus norvegicus
taagctgcactcttgtattataggt

SEQ ID NO: 542802 - DNA, 25 bp, Rattus norvegicus
taagctgcagagatcagacctagga

SEQ ID NO: 542803 - DNA, 25 bp, Rattus norvegicus
taagctgcagagttcagacctagga

SEQ ID NO: 542804 - DNA, 25 bp, Rattus norvegicus
taagctgcagtaatggcttcacacg

SEQ ID NO: 542805 - DNA, 25 bp, Rattus norvegicus
taagctgcagtattggcttcacacg

SEQ ID NO: 542806 - DNA, 25 bp, Rattus norvegicus
taagctgcagtgcaatagccatggt

SEQ ID NO: 542807 - DNA, 25 bp, Rattus norvegicus
taagctgcagtggaatagccatggt

SEQ ID NO: 542808 - DNA, 25 bp, Rattus norvegicus
taagctgccaaaagcttcgtgccct

SEQ ID NO: 542809 - DNA, 25 bp, Rattus norvegicus
taagctgccaaatgcttcgtgccct

SEQ ID NO: 542810 - DNA, 25 bp, Rattus norvegicus
taagctgccactcgatcagagggat

SEQ ID NO: 542811 - DNA, 25 bp, Rattus norvegicus
taagctgccactggatcagagggat

SEQ ID NO: 542812 - DNA, 25 bp, Rattus norvegicus
taagctgccatgagtctgtctgtgt

SEQ ID NO: 542813 - DNA, 25 bp, Rattus norvegicus
taagctgccatgtgtctgtctgtgt

SEQ ID NO: 542814 - DNA, 25 bp, Rattus norvegicus
taagctgcccagctctgatgataac

SEQ ID NO: 542815 - DNA, 25 bp, Rattus norvegicus
taagctgcccaggtctgatgataac

SEQ ID NO: 542816 - DNA, 25 bp, Rattus norvegicus
taagctgcccctacgactgcagaag

SEQ ID NO: 542817 - DNA, 25 bp, Rattus norvegicus
taagctgccccttcgactgcagaag

SEQ ID NO: 542818 - DNA, 25 bp, Rattus norvegicus
taagctgcccttactaagctcgtct

SEQ ID NO: 542819 - DNA, 25 bp, Rattus norvegicus
taagctgccctttctaagctcgtct

SEQ ID NO: 542820 - DNA, 25 bp, Rattus norvegicus
taagctgccggacggtctgctgtac

SEQ ID NO: 542821 - DNA, 25 bp, Rattus norvegicus
taagctgccggagggtctgctgtac

SEQ ID NO: 542822 - DNA, 25 bp, Rattus norvegicus
taagctgcctgactaaaccactggg

SEQ ID NO: 542823 - DNA, 25 bp, Rattus norvegicus
taagctgcctgagtaaaccactggg

SEQ ID NO: 542824 - DNA, 25 bp, Rattus norvegicus
taagctgcgttcaacaagccactta

SEQ ID NO: 542825 - DNA, 25 bp, Rattus norvegicus
taagctgcgttctacaagccactta

SEQ ID NO: 542826 - DNA, 25 bp, Rattus norvegicus
taagctgctaatctctgccacgtgt

SEQ ID NO: 542827 - DNA, 25 bp, Rattus norvegicus
taagctgctaatgtctgccacgtgt

SEQ ID NO: 542828 - DNA, 25 bp, Rattus norvegicus
taagctgctaggctatattttctcc

SEQ ID NO: 542829 - DNA, 25 bp, Rattus norvegicus
taagctgctagggtatattttctcc

SEQ ID NO: 542830 - DNA, 25 bp, Rattus norvegicus
taagctgctcttcctcagcatagct

SEQ ID NO: 542831 - DNA, 25 bp, Rattus norvegicus
taagctgctcttgctcagcatagct

SEQ ID NO: 542832 - DNA, 25 bp, Rattus norvegicus
taagctgcttggatatttgttctcc

SEQ ID NO: 542833 - DNA, 25 bp, Rattus norvegicus
taagctgcttggttatttgttctcc

SEQ ID NO: 542834 - DNA, 25 bp, Rattus norvegicus
taagctgcttttccagttggcaaac

SEQ ID NO: 542835 - DNA, 25 bp, Rattus norvegicus
taagctgcttttgcagttggcaaac

SEQ ID NO: 542836 - DNA, 25 bp, Rattus norvegicus
taagctggacttagtcgccactgga

SEQ ID NO: 542837 - DNA, 25 bp, Rattus norvegicus
taagctggactttgtcgccactgga

SEQ ID NO: 542838 - DNA, 25 bp, Rattus norvegicus
taagctggccttcactttgtagacc

SEQ ID NO: 542839 - DNA, 25 bp, Rattus norvegicus
taagctggccttgactttgtagacc

SEQ ID NO: 542840 - DNA, 25 bp, Rattus norvegicus
taagctggctagcaaaccctgtcca

SEQ ID NO: 542841 - DNA, 25 bp, Rattus norvegicus
taagctggctaggaaaccctgtcca

SEQ ID NO: 542842 - DNA, 25 bp, Rattus norvegicus
taagctggctccattgtatcccaag

SEQ ID NO: 542843 - DNA, 25 bp, Rattus norvegicus
taagctggctcctttgtatcccaag

SEQ ID NO: 542844 - DNA, 25 bp, Rattus norvegicus
taagctggctgaacactggagcagt

SEQ ID NO: 542845 - DNA, 25 bp, Rattus norvegicus
taagctggctgatcactggagcagt

SEQ ID NO: 542846 - DNA, 25 bp, Rattus norvegicus
taagctggcttcctagatcgttggt

SEQ ID NO: 542847 - DNA, 25 bp, Rattus norvegicus
taagctggcttcgtagatcgttggt

SEQ ID NO: 542848 - DNA, 25 bp, Rattus norvegicus
taagctgggcttcacttttagttaa

SEQ ID NO: 542849 - DNA, 25 bp, Rattus norvegicus
taagctgggcttgacttttagttaa

SEQ ID NO: 542850 - DNA, 25 bp, Rattus norvegicus
taagctggttctcgatctccttcct

SEQ ID NO: 542851 - DNA, 25 bp, Rattus norvegicus
taagctggttctctgacctgaaggg

SEQ ID NO: 542852 - DNA, 25 bp, Rattus norvegicus
taagctggttctggatctccttcct

SEQ ID NO: 542853 - DNA, 25 bp, Rattus norvegicus
taagctggttctgtgacctgaaggg

SEQ ID NO: 542854 - DNA, 25 bp, Rattus norvegicus
taagctggttgtcggcggtacctca

SEQ ID NO: 542855 - DNA, 25 bp, Rattus norvegicus
taagctggttgtgggcggtacctca

SEQ ID NO: 542856 - DNA, 25 bp, Rattus norvegicus
taagctgtacccaggagccggcaga

SEQ ID NO: 542857 - DNA, 25 bp, Rattus norvegicus
taagctgtaccctggagccggcaga

SEQ ID NO: 542858 - DNA, 25 bp, Rattus norvegicus
taagctgtactacctgactgctacc

SEQ ID NO: 542859 - DNA, 25 bp, Rattus norvegicus
taagctgtactagctgactgctacc

SEQ ID NO: 542860 - DNA, 25 bp, Rattus norvegicus
taagctgtagagatccctggaggga

SEQ ID NO: 542861 - DNA, 25 bp, Rattus norvegicus
taagctgtagagttccctggaggga

SEQ ID NO: 542862 - DNA, 25 bp, Rattus norvegicus
taagctgtatctactattagggcat

SEQ ID NO: 542863 - DNA, 25 bp, Rattus norvegicus
taagctgtatcttctattagggcat

SEQ ID NO: 542864 - DNA, 25 bp, Rattus norvegicus
taagctgtcaacagctagcgtcttg

SEQ ID NO: 542865 - DNA, 25 bp, Rattus norvegicus
taagctgtcaactgctagcgtcttg

SEQ ID NO: 542866 - DNA, 25 bp, Rattus norvegicus
taagctgtcacgaggtgcacatgga

SEQ ID NO: 542867 - DNA, 25 bp, Rattus norvegicus
taagctgtcacgtggtgcacatgga

SEQ ID NO: 542868 - DNA, 25 bp, Rattus norvegicus
taagctgtccttcgcacgtttaact

SEQ ID NO: 542869 - DNA, 25 bp, Rattus norvegicus
taagctgtccttggcacgtttaact

SEQ ID NO: 542870 - DNA, 25 bp, Rattus norvegicus
taagctgtctctctagctcctcagt

SEQ ID NO: 542871 - DNA, 25 bp, Rattus norvegicus
taagctgtctctgtagctcctcagt

SEQ ID NO: 542872 - DNA, 25 bp, Rattus norvegicus
taagctgtcttgaaatacctattta

SEQ ID NO: 542873 - DNA, 25 bp, Rattus norvegicus
taagctgtcttgtaatacctattta

SEQ ID NO: 542874 - DNA, 25 bp, Rattus norvegicus
taagctgtctttagttttcaaaggg

SEQ ID NO: 542875 - DNA, 25 bp, Rattus norvegicus
taagctgtctttcctaaggcccatt

SEQ ID NO: 542876 - DNA, 25 bp, Rattus norvegicus
taagctgtctttgctaaggcccatt

SEQ ID NO: 542877 - DNA, 25 bp, Rattus norvegicus
taagctgtcttttgttttcaaaggg

SEQ ID NO: 542878 - DNA, 25 bp, Rattus norvegicus
taagctgtggctaggctttagcctg

SEQ ID NO: 542879 - DNA, 25 bp, Rattus norvegicus
taagctgtggcttggctttagcctg

SEQ ID NO: 542880 - DNA, 25 bp, Rattus norvegicus
taagctgtgttcactgcgatgccat

SEQ ID NO: 542881 - DNA, 25 bp, Rattus norvegicus
taagctgtgttctctgcgatgccat

SEQ ID NO: 542882 - DNA, 25 bp, Rattus norvegicus
taagctgttcggctgagtcagttta

SEQ ID NO: 542883 - DNA, 25 bp, Rattus norvegicus
taagctgttcgggtgagtcagttta

SEQ ID NO: 542884 - DNA, 25 bp, Rattus norvegicus
taagctgttggcagtagacaccata

SEQ ID NO: 542885 - DNA, 25 bp, Rattus norvegicus
taagctgttggctgtagacaccata

SEQ ID NO: 542886 - DNA, 25 bp, Rattus norvegicus
taagcttacacccacactattgaaa

SEQ ID NO: 542887 - DNA, 25 bp, Rattus norvegicus
taagcttacaccgacactattgaaa

SEQ ID NO: 542888 - DNA, 25 bp, Rattus norvegicus
taagcttacagcagttggcctgaaa

SEQ ID NO: 542889 - DNA, 25 bp, Rattus norvegicus
taagcttacagctgttggcctgaaa

SEQ ID NO: 542890 - DNA, 25 bp, Rattus norvegicus
taagcttacccacatacctcattgt

SEQ ID NO: 542891 - DNA, 25 bp, Rattus norvegicus
taagcttacccagatacctcattgt

SEQ ID NO: 542892 - DNA, 25 bp, Rattus norvegicus
taagcttagtggatgggcacttcct

SEQ ID NO: 542893 - DNA, 25 bp, Rattus norvegicus
taagcttagtggttgggcacttcct

SEQ ID NO: 542894 - DNA, 25 bp, Rattus norvegicus
taagcttatctaactggtacctgag

SEQ ID NO: 542895 - DNA, 25 bp, Rattus norvegicus
taagcttatctatctggtacctgag

SEQ ID NO: 542896 - DNA, 25 bp, Rattus norvegicus
taagcttcatggatctactcctctc

SEQ ID NO: 542897 - DNA, 25 bp, Rattus norvegicus
taagcttcatggttctactcctctc

SEQ ID NO: 542898 - DNA, 25 bp, Rattus norvegicus
taagcttcattaccagccctcagaa

SEQ ID NO: 542899 - DNA, 25 bp, Rattus norvegicus
taagcttcattagcagccctcagaa

SEQ ID NO: 542900 - DNA, 25 bp, Rattus norvegicus
taagcttccaggcttactcgggtat

SEQ ID NO: 542901 - DNA, 25 bp, Rattus norvegicus
taagcttccagggttactcgggtat

SEQ ID NO: 542902 - DNA, 25 bp, Rattus norvegicus
taagcttcccagcatatcgcatcat

SEQ ID NO: 542903 - DNA, 25 bp, Rattus norvegicus
taagcttcccaggatatcgcatcat

SEQ ID NO: 542904 - DNA, 25 bp, Rattus norvegicus
taagcttccccaataatgttgtaaa

SEQ ID NO: 542905 - DNA, 25 bp, Rattus norvegicus
taagcttccccattaatgttgtaaa

SEQ ID NO: 542906 - DNA, 25 bp, Rattus norvegicus
taagcttcgagaatctgctcttcct

SEQ ID NO: 542907 - DNA, 25 bp, Rattus norvegicus
taagcttcgagattctgctcttcct

SEQ ID NO: 542908 - DNA, 25 bp, Rattus norvegicus
taagcttcgcttactgatacgtggc

SEQ ID NO: 542909 - DNA, 25 bp, Rattus norvegicus
taagcttcgctttctgatacgtggc

SEQ ID NO: 542910 - DNA, 25 bp, Rattus norvegicus
taagcttcggacacaggtttgcact

SEQ ID NO: 542911 - DNA, 25 bp, Rattus norvegicus
taagcttcggactcaggtttgcact

SEQ ID NO: 542912 - DNA, 25 bp, Rattus norvegicus
taagcttctaaactagcctcagcct

SEQ ID NO: 542913 - DNA, 25 bp, Rattus norvegicus
taagcttctaaagtagcctcagcct

SEQ ID NO: 542914 - DNA, 25 bp, Rattus norvegicus
taagcttctcatcgagtggtacttg

SEQ ID NO: 542915 - DNA, 25 bp, Rattus norvegicus
taagcttctcatggagtggtacttg

SEQ ID NO: 542916 - DNA, 25 bp, Rattus norvegicus
taagcttctgaactgagggctctgt

SEQ ID NO: 542917 - DNA, 25 bp, Rattus norvegicus
taagcttctgaagtgagggctctgt

SEQ ID NO: 542918 - DNA, 25 bp, Rattus norvegicus
taagcttctgttacaggccatcctg

SEQ ID NO: 542919 - DNA, 25 bp, Rattus norvegicus
taagcttctgtttcaggccatcctg

SEQ ID NO: 542920 - DNA, 25 bp, Rattus norvegicus
taagcttgccagcaaagcacggacg

SEQ ID NO: 542921 - DNA, 25 bp, Rattus norvegicus
taagcttgccaggaaagcacggacg

SEQ ID NO: 542922 - DNA, 25 bp, Rattus norvegicus
taagcttgcctgctcagactaaagg

SEQ ID NO: 542923 - DNA, 25 bp, Rattus norvegicus
taagcttgcctggtcagactaaagg

SEQ ID NO: 542924 - DNA, 25 bp, Rattus norvegicus
taagcttggcttcctgatccaacaa

SEQ ID NO: 542925 - DNA, 25 bp, Rattus norvegicus
taagcttggcttgctgatccaacaa

SEQ ID NO: 542926 - DNA, 25 bp, Rattus norvegicus
taagcttgtgacatatgagcctgaa

SEQ ID NO: 542927 - DNA, 25 bp, Rattus norvegicus
taagcttgtgacttatgagcctgaa

SEQ ID NO: 542928 - DNA, 25 bp, Rattus norvegicus
taagcttgtgccatgacgttgtgga

SEQ ID NO: 542929 - DNA, 25 bp, Rattus norvegicus
taagcttgtgccttgacgttgtgga

SEQ ID NO: 542930 - DNA, 25 bp, Rattus norvegicus
taagcttgtgctctttggccgtgag

SEQ ID NO: 542931 - DNA, 25 bp, Rattus norvegicus
taagcttgtgctgtttggccgtgag

SEQ ID NO: 542932 - DNA, 25 bp, Rattus norvegicus
taagctttacataaccatgctgaac

SEQ ID NO: 542933 - DNA, 25 bp, Rattus norvegicus
taagctttacattaccatgctgaac

SEQ ID NO: 542934 - DNA, 25 bp, Rattus norvegicus
taagctttcctgcaatttcctctat

SEQ ID NO: 542935 - DNA, 25 bp, Rattus norvegicus
taagctttcctggaatttcctctat

SEQ ID NO: 542936 - DNA, 25 bp, Rattus norvegicus
taagctttcgtgattcccttctgta

SEQ ID NO: 542937 - DNA, 25 bp, Rattus norvegicus
taagctttcgtgtttcccttctgta

SEQ ID NO: 542938 - DNA, 25 bp, Rattus norvegicus
taagctttctgaatggcacaggcct

SEQ ID NO: 542939 - DNA, 25 bp, Rattus norvegicus
taagctttctgattggcacaggcct

SEQ ID NO: 542940 - DNA, 25 bp, Rattus norvegicus
taagctttgaagaacacagtaactg

SEQ ID NO: 542941 - DNA, 25 bp, Rattus norvegicus
taagctttgaagtacacagtaactg

SEQ ID NO: 542942 - DNA, 25 bp, Rattus norvegicus
taagctttgcctaacagcctctgca

SEQ ID NO: 542943 - DNA, 25 bp, Rattus norvegicus
taagctttgccttacagcctctgca

SEQ ID NO: 542944 - DNA, 25 bp, Rattus norvegicus
taagctttggtaagtccttctgaag

SEQ ID NO: 542945 - DNA, 25 bp, Rattus norvegicus
taagctttggtatgtccttctgaag

SEQ ID NO: 542946 - DNA, 25 bp, Rattus norvegicus
taagctttgtcacatctctaaacac

SEQ ID NO: 542947 - DNA, 25 bp, Rattus norvegicus
taagctttgtcagatctctaaacac

SEQ ID NO: 542948 - DNA, 25 bp, Rattus norvegicus
taagcttttccacggtgtgcggtta

SEQ ID NO: 542949 - DNA, 25 bp, Rattus norvegicus
taagcttttccagggtgtgcggtta

SEQ ID NO: 542950 - DNA, 25 bp, Rattus norvegicus
taagctttttctccagtggcaatta

SEQ ID NO: 542951 - DNA, 25 bp, Rattus norvegicus
taagctttttctgcagtggcaatta

SEQ ID NO: 542952 - DNA, 25 bp, Rattus norvegicus
taaggaaacattcccctcacctggc

SEQ ID NO: 542953 - DNA, 25 bp, Rattus norvegicus
taaggaaacattgccctcacctggc

SEQ ID NO: 542954 - DNA, 25 bp, Rattus norvegicus
taaggaaaccgcacatctttccctg

SEQ ID NO: 542955 - DNA, 25 bp, Rattus norvegicus
taaggaaaccgctcatctttccctg

SEQ ID NO: 542956 - DNA, 25 bp, Rattus norvegicus
taaggaaagctgagcggactcatgg

SEQ ID NO: 542957 - DNA, 25 bp, Rattus norvegicus
taaggaaagctgtgcggactcatgg

SEQ ID NO: 542958 - DNA, 25 bp, Rattus norvegicus
taaggaaccacacaccacatgtact

SEQ ID NO: 542959 - DNA, 25 bp, Rattus norvegicus
taaggaaccacagaccacatgtact

SEQ ID NO: 542960 - DNA, 25 bp, Rattus norvegicus
taaggaaccgctacctgtgggacag

SEQ ID NO: 542961 - DNA, 25 bp, Rattus norvegicus
taaggaaccgcttcctgtgggacag

SEQ ID NO: 542962 - DNA, 25 bp, Rattus norvegicus
taaggaaccggactccagcaagacc

SEQ ID NO: 542963 - DNA, 25 bp, Rattus norvegicus
taaggaaccggagtccagcaagacc

SEQ ID NO: 542964 - DNA, 25 bp, Rattus norvegicus
taaggaacgagacctctgcagcaaa

SEQ ID NO: 542965 - DNA, 25 bp, Rattus norvegicus
taaggaacgagagctctgcagcaaa

SEQ ID NO: 542966 - DNA, 25 bp, Rattus norvegicus
taaggaactccaatgactgctcagt

SEQ ID NO: 542967 - DNA, 25 bp, Rattus norvegicus
taaggaactccattgactgctcagt

SEQ ID NO: 542968 - DNA, 25 bp, Rattus norvegicus
taaggaactgccacgagtccctgga

SEQ ID NO: 542969 - DNA, 25 bp, Rattus norvegicus
taaggaactgcctcgagtccctgga

SEQ ID NO: 542970 - DNA, 25 bp, Rattus norvegicus
taaggaagacccactcatgcactaa

SEQ ID NO: 542971 - DNA, 25 bp, Rattus norvegicus
taaggaagaccctctcatgcactaa

SEQ ID NO: 542972 - DNA, 25 bp, Rattus norvegicus
taaggaagactgacggccagggctc

SEQ ID NO: 542973 - DNA, 25 bp, Rattus norvegicus
taaggaagactgtcggccagggctc

SEQ ID NO: 542974 - DNA, 25 bp, Rattus norvegicus
taaggaagcaaaccatcccctgagc

SEQ ID NO: 542975 - DNA, 25 bp, Rattus norvegicus
taaggaagcaaagcatcccctgagc

SEQ ID NO: 542976 - DNA, 25 bp, Rattus norvegicus
taaggaagctctctattctatacca

SEQ ID NO: 542977 - DNA, 25 bp, Rattus norvegicus
taaggaagctctgtattctatacca

SEQ ID NO: 542978 - DNA, 25 bp, Rattus norvegicus
taaggaaggccgattgcatcatctt

SEQ ID NO: 542979 - DNA, 25 bp, Rattus norvegicus
taaggaaggccgtttgcatcatctt

SEQ ID NO: 542980 - DNA, 25 bp, Rattus norvegicus
taaggaagggtcactgtcagggtca

SEQ ID NO: 542981 - DNA, 25 bp, Rattus norvegicus
taaggaagggtctctgtcagggtca

SEQ ID NO: 542982 - DNA, 25 bp, Rattus norvegicus
taaggaagttcaactcctgtctgct

SEQ ID NO: 542983 - DNA, 25 bp, Rattus norvegicus
taaggaagttcatctcctgtctgct

SEQ ID NO: 542984 - DNA, 25 bp, Rattus norvegicus
taaggaagttccactgtcttgcagc

SEQ ID NO: 542985 - DNA, 25 bp, Rattus norvegicus
taaggaagttcctctgtcttgcagc

SEQ ID NO: 542986 - DNA, 25 bp, Rattus norvegicus
taaggaatactccacagcctgtgac

SEQ ID NO: 542987 - DNA, 25 bp, Rattus norvegicus
taaggaatactcgacagcctgtgac

SEQ ID NO: 542988 - DNA, 25 bp, Rattus norvegicus
taaggaatcctaactgttcagtgac

SEQ ID NO: 542989 - DNA, 25 bp, Rattus norvegicus
taaggaatcctatctgttcagtgac

SEQ ID NO: 542990 - DNA, 25 bp, Rattus norvegicus
taaggaattaggactgggcggtcaa

SEQ ID NO: 542991 - DNA, 25 bp, Rattus norvegicus
taaggaattaggtctgggcggtcaa

SEQ ID NO: 542992 - DNA, 25 bp, Rattus norvegicus
taaggaattcccaagtcccaacgct

SEQ ID NO: 542993 - DNA, 25 bp, Rattus norvegicus
taaggaattccctagtcccaacgct

SEQ ID NO: 542994 - DNA, 25 bp, Rattus norvegicus
taaggacacaccaccgttattcggt

SEQ ID NO: 542995 - DNA, 25 bp, Rattus norvegicus
taaggacacacctccgttattcggt

SEQ ID NO: 542996 - DNA, 25 bp, Rattus norvegicus
taaggacacagcacaactgccttct

SEQ ID NO: 542997 - DNA, 25 bp, Rattus norvegicus
taaggacacagctcaactgccttct

SEQ ID NO: 542998 - DNA, 25 bp, Rattus norvegicus
taaggacacaggctacatttattgc

SEQ ID NO: 542999 - DNA, 25 bp, Rattus norvegicus
taaggacacagggtacatttattgc

SEQ ID NO: 543000 - DNA, 25 bp, Rattus norvegicus
taaggacacgagatatttcctcttc

SEQ ID NO: 543001 - DNA, 25 bp, Rattus norvegicus
taaggacacgagttatttcctcttc

SEQ ID NO: 543002 - DNA, 25 bp, Rattus norvegicus
taaggacacgttagagccctttggg

SEQ ID NO: 543003 - DNA, 25 bp, Rattus norvegicus
taaggacacgtttgagccctttggg

SEQ ID NO: 543004 - DNA, 25 bp, Rattus norvegicus
taaggacagacaccactcactacac

SEQ ID NO: 543005 - DNA, 25 bp, Rattus norvegicus
taaggacagacagcactcactacac

SEQ ID NO: 543006 - DNA, 25 bp, Rattus norvegicus
taaggacagatcagcactcacaggt

SEQ ID NO: 543007 - DNA, 25 bp, Rattus norvegicus
taaggacagatctgcactcacaggt

SEQ ID NO: 543008 - DNA, 25 bp, Rattus norvegicus
taaggacagcaccaagcgcacctgc

SEQ ID NO: 543009 - DNA, 25 bp, Rattus norvegicus
taaggacagcacgaagcgcacctgc

SEQ ID NO: 543010 - DNA, 25 bp, Rattus norvegicus
taaggacagcttaggagcctatgga

SEQ ID NO: 543011 - DNA, 25 bp, Rattus norvegicus
taaggacagctttggagcctatgga

SEQ ID NO: 543012 - DNA, 25 bp, Rattus norvegicus
taaggacaggcacagctgctcgcaa

SEQ ID NO: 543013 - DNA, 25 bp, Rattus norvegicus
taaggacaggcagagctgctcgcaa

SEQ ID NO: 543014 - DNA, 25 bp, Rattus norvegicus
taaggacagtgcatgcctagggact

SEQ ID NO: 543015 - DNA, 25 bp, Rattus norvegicus
taaggacagtgcttgcctagggact

SEQ ID NO: 543016 - DNA, 25 bp, Rattus norvegicus
taaggacatacacggtgctcctcaa

SEQ ID NO: 543017 - DNA, 25 bp, Rattus norvegicus
taaggacatacagggtgctcctcaa

SEQ ID NO: 543018 - DNA, 25 bp, Rattus norvegicus
taaggacattgaactcactcccaag

SEQ ID NO: 543019 - DNA, 25 bp, Rattus norvegicus
taaggacattgatctcactcccaag

SEQ ID NO: 543020 - DNA, 25 bp, Rattus norvegicus
taaggacatttcatattcagtatat

SEQ ID NO: 543021 - DNA, 25 bp, Rattus norvegicus
taaggacatttcttattcagtatat

SEQ ID NO: 543022 - DNA, 25 bp, Rattus norvegicus
taaggaccaagcctcatggcggttc

SEQ ID NO: 543023 - DNA, 25 bp, Rattus norvegicus
taaggaccaagcgtcatggcggttc

SEQ ID NO: 543024 - DNA, 25 bp, Rattus norvegicus
taaggaccaggacacttgccattgc

SEQ ID NO: 543025 - DNA, 25 bp, Rattus norvegicus
taaggaccaggagacttgccattgc

SEQ ID NO: 543026 - DNA, 25 bp, Rattus norvegicus
taaggacccctcagtgacactgatg

SEQ ID NO: 543027 - DNA, 25 bp, Rattus norvegicus
taaggacccctctgtgacactgatg

SEQ ID NO: 543028 - DNA, 25 bp, Rattus norvegicus
taaggacccgagattgccccagaga

SEQ ID NO: 543029 - DNA, 25 bp, Rattus norvegicus
taaggacccgagtttgccccagaga

SEQ ID NO: 543030 - DNA, 25 bp, Rattus norvegicus
taaggaccctcacttggcctgctgg

SEQ ID NO: 543031 - DNA, 25 bp, Rattus norvegicus
taaggaccctcagttggcctgctgg

SEQ ID NO: 543032 - DNA, 25 bp, Rattus norvegicus
taaggaccgaggatcagccctttgt

SEQ ID NO: 543033 - DNA, 25 bp, Rattus norvegicus
taaggaccgaggttcagccctttgt

SEQ ID NO: 543034 - DNA, 25 bp, Rattus norvegicus
taaggaccgccacactgaacgcttt

SEQ ID NO: 543035 - DNA, 25 bp, Rattus norvegicus
taaggaccgccagactgaacgcttt

SEQ ID NO: 543036 - DNA, 25 bp, Rattus norvegicus
taaggaccgggtccaatacagaaag

SEQ ID NO: 543037 - DNA, 25 bp, Rattus norvegicus
taaggaccgggtgcaatacagaaag

SEQ ID NO: 543038 - DNA, 25 bp, Rattus norvegicus
taaggacctactccgggccacttag

SEQ ID NO: 543039 - DNA, 25 bp, Rattus norvegicus
taaggacctactgcgggccacttag

SEQ ID NO: 543040 - DNA, 25 bp, Rattus norvegicus
taaggacctcaaacttcgtggcttt

SEQ ID NO: 543041 - DNA, 25 bp, Rattus norvegicus
taaggacctcaacaattgtttttct

SEQ ID NO: 543042 - DNA, 25 bp, Rattus norvegicus
taaggacctcaagaattgtttttct

SEQ ID NO: 543043 - DNA, 25 bp, Rattus norvegicus
taaggacctcaatcttcgtggcttt

SEQ ID NO: 543044 - DNA, 25 bp, Rattus norvegicus
taaggacctcctagagtcacttctg

SEQ ID NO: 543045 - DNA, 25 bp, Rattus norvegicus
taaggacctccttgagtcacttctg

SEQ ID NO: 543046 - DNA, 25 bp, Rattus norvegicus
taaggacctttcaactggctcacag

SEQ ID NO: 543047 - DNA, 25 bp, Rattus norvegicus
taaggacctttctactggctcacag

SEQ ID NO: 543048 - DNA, 25 bp, Rattus norvegicus
taaggacgcgcaaagttctcatcta

SEQ ID NO: 543049 - DNA, 25 bp, Rattus norvegicus
taaggacgcgcatagttctcatcta

SEQ ID NO: 543050 - DNA, 25 bp, Rattus norvegicus
taaggactacacattcgtgcgtctg

SEQ ID NO: 543051 - DNA, 25 bp, Rattus norvegicus
taaggactacactttcgtgcgtctg

SEQ ID NO: 543052 - DNA, 25 bp, Rattus norvegicus
taaggactcataacccactgtcagc

SEQ ID NO: 543053 - DNA, 25 bp, Rattus norvegicus
taaggactcatatcccactgtcagc

SEQ ID NO: 543054 - DNA, 25 bp, Rattus norvegicus
taaggactccccagcgtatatggaa

SEQ ID NO: 543055 - DNA, 25 bp, Rattus norvegicus
taaggactcccctgcgtatatggaa

SEQ ID NO: 543056 - DNA, 25 bp, Rattus norvegicus
taaggactcgccctgctggtcttga

SEQ ID NO: 543057 - DNA, 25 bp, Rattus norvegicus
taaggactcgccgtgctggtcttga

SEQ ID NO: 543058 - DNA, 25 bp, Rattus norvegicus
taaggactctgcaagtatgggtcat

SEQ ID NO: 543059 - DNA, 25 bp, Rattus norvegicus
taaggactctgctagtatgggtcat

SEQ ID NO: 543060 - DNA, 25 bp, Rattus norvegicus
taaggactgcgcatgctcacgttgc

SEQ ID NO: 543061 - DNA, 25 bp, Rattus norvegicus
taaggactgcgcttgctcacgttgc

SEQ ID NO: 543062 - DNA, 25 bp, Rattus norvegicus
taaggactgctcacctatcccgggt

SEQ ID NO: 543063 - DNA, 25 bp, Rattus norvegicus
taaggactgctctcctatcccgggt

SEQ ID NO: 543064 - DNA, 25 bp, Rattus norvegicus
taaggactggatcctgcacaccttt

SEQ ID NO: 543065 - DNA, 25 bp, Rattus norvegicus
taaggactggatgctgcacaccttt

SEQ ID NO: 543066 - DNA, 25 bp, Rattus norvegicus
taaggacttcacagttttccctctg

SEQ ID NO: 543067 - DNA, 25 bp, Rattus norvegicus
taaggacttcactgttttccctctg

SEQ ID NO: 543068 - DNA, 25 bp, Rattus norvegicus
taaggacttctgactcctaatttta

SEQ ID NO: 543069 - DNA, 25 bp, Rattus norvegicus
taaggacttctgtctcctaatttta

SEQ ID NO: 543070 - DNA, 25 bp, Rattus norvegicus
taaggacttcttctctgggatgctg

SEQ ID NO: 543071 - DNA, 25 bp, Rattus norvegicus
taaggacttcttgtctgggatgctg

SEQ ID NO: 543072 - DNA, 25 bp, Rattus norvegicus
taaggactttgaccctagcttccca

SEQ ID NO: 543073 - DNA, 25 bp, Rattus norvegicus
taaggactttgagcctagcttccca

SEQ ID NO: 543074 - DNA, 25 bp, Rattus norvegicus
taaggactttttcattattcataga

SEQ ID NO: 543075 - DNA, 25 bp, Rattus norvegicus
taaggactttttgattattcataga

SEQ ID NO: 543076 - DNA, 25 bp, Rattus norvegicus
taaggagaacacacctcctgatgcc

SEQ ID NO: 543077 - DNA, 25 bp, Rattus norvegicus
taaggagaacactcctcctgatgcc

SEQ ID NO: 543078 - DNA, 25 bp, Rattus norvegicus
taaggagaaggaacagggcgcacct

SEQ ID NO: 543079 - DNA, 25 bp, Rattus norvegicus
taaggagaaggatcagggcgcacct

SEQ ID NO: 543080 - DNA, 25 bp, Rattus norvegicus
taaggagaggacaatttttaacact

SEQ ID NO: 543081 - DNA, 25 bp, Rattus norvegicus
taaggagaggactatttttaacact

SEQ ID NO: 543082 - DNA, 25 bp, Rattus norvegicus
taaggagatccgagcagtatgtaag

SEQ ID NO: 543083 - DNA, 25 bp, Rattus norvegicus
taaggagatccgtgcagtatgtaag

SEQ ID NO: 543084 - DNA, 25 bp, Rattus norvegicus
taaggagatgtcagagcttgggcat

SEQ ID NO: 543085 - DNA, 25 bp, Rattus norvegicus
taaggagatgtctgagcttgggcat

SEQ ID NO: 543086 - DNA, 25 bp, Rattus norvegicus
taaggagattcgctcgttcacacca

SEQ ID NO: 543087 - DNA, 25 bp, Rattus norvegicus
taaggagattcggtcgttcacacca

SEQ ID NO: 543088 - DNA, 25 bp, Rattus norvegicus
taaggagcaactcacctgaggacca

SEQ ID NO: 543089 - DNA, 25 bp, Rattus norvegicus
taaggagcaactgacctgaggacca

SEQ ID NO: 543090 - DNA, 25 bp, Rattus norvegicus
taaggagcagggacttttccataaa

SEQ ID NO: 543091 - DNA, 25 bp, Rattus norvegicus
taaggagcagggtcttttccataaa

SEQ ID NO: 543092 - DNA, 25 bp, Rattus norvegicus
taaggagcatcaagctgttccctct

SEQ ID NO: 543093 - DNA, 25 bp, Rattus norvegicus
taaggagcatcatgctgttccctct

SEQ ID NO: 543094 - DNA, 25 bp, Rattus norvegicus
taaggagcatctccagaacttcgca

SEQ ID NO: 543095 - DNA, 25 bp, Rattus norvegicus
taaggagcatctgcagaacttcgca

SEQ ID NO: 543096 - DNA, 25 bp, Rattus norvegicus
taaggagccactctgccagtttctg

SEQ ID NO: 543097 - DNA, 25 bp, Rattus norvegicus
taaggagccactgtgccagtttctg

SEQ ID NO: 543098 - DNA, 25 bp, Rattus norvegicus
taaggagccagcacgcaacagcaca

SEQ ID NO: 543099 - DNA, 25 bp, Rattus norvegicus
taaggagccagctcgcaacagcaca

SEQ ID NO: 543100 - DNA, 25 bp, Rattus norvegicus
taaggagcccctctggtaaatccta

SEQ ID NO: 543101 - DNA, 25 bp, Rattus norvegicus
taaggagcccctgtggtaaatccta

SEQ ID NO: 543102 - DNA, 25 bp, Rattus norvegicus
taaggagccgtacaccataagattc

SEQ ID NO: 543103 - DNA, 25 bp, Rattus norvegicus
taaggagccgtagaccataagattc

SEQ ID NO: 543104 - DNA, 25 bp, Rattus norvegicus
taaggagcctgaccctaggcagaga

SEQ ID NO: 543105 - DNA, 25 bp, Rattus norvegicus
taaggagcctgagcctaggcagaga

SEQ ID NO: 543106 - DNA, 25 bp, Rattus norvegicus
taaggagcctgtcaccgcaagatta

SEQ ID NO: 543107 - DNA, 25 bp, Rattus norvegicus
taaggagcctgtgaccgcaagatta

SEQ ID NO: 543108 - DNA, 25 bp, Rattus norvegicus
taaggagcctttccaacattttagg

SEQ ID NO: 543109 - DNA, 25 bp, Rattus norvegicus
taaggagcctttgcaacattttagg

SEQ ID NO: 543110 - DNA, 25 bp, Rattus norvegicus
taaggagcgattctcacacctgacc

SEQ ID NO: 543111 - DNA, 25 bp, Rattus norvegicus
taaggagcgattgtcacacctgacc

SEQ ID NO: 543112 - DNA, 25 bp, Rattus norvegicus
taaggagcgctcactgttacacggt

SEQ ID NO: 543113 - DNA, 25 bp, Rattus norvegicus
taaggagcgctctctgttacacggt

SEQ ID NO: 543114 - DNA, 25 bp, Rattus norvegicus
taaggagcggttagtggttcacatc

SEQ ID NO: 543115 - DNA, 25 bp, Rattus norvegicus
taaggagcggtttgtggttcacatc

SEQ ID NO: 543116 - DNA, 25 bp, Rattus norvegicus
taaggagctgccacatgagcgtgga

SEQ ID NO: 543117 - DNA, 25 bp, Rattus norvegicus
taaggagctgcctcatgagcgtgga

SEQ ID NO: 543118 - DNA, 25 bp, Rattus norvegicus
taaggagctggtcttcgtgttcatc

SEQ ID NO: 543119 - DNA, 25 bp, Rattus norvegicus
taaggagctggtgttcgtgttcatc

SEQ ID NO: 543120 - DNA, 25 bp, Rattus norvegicus
taaggagcttccacctgaggagagt

SEQ ID NO: 543121 - DNA, 25 bp, Rattus norvegicus
taaggagcttcctcctgaggagagt

SEQ ID NO: 543122 - DNA, 25 bp, Rattus norvegicus
taaggaggacacctgtagccctccc

SEQ ID NO: 543123 - DNA, 25 bp, Rattus norvegicus
taaggaggacacgtgtagccctccc

SEQ ID NO: 543124 - DNA, 25 bp, Rattus norvegicus
taaggaggctcgatcccatgtggaa

SEQ ID NO: 543125 - DNA, 25 bp, Rattus norvegicus
taaggaggctcgttcccatgtggaa

SEQ ID NO: 543126 - DNA, 25 bp, Rattus norvegicus
taaggagggacactcactatacagc

SEQ ID NO: 543127 - DNA, 25 bp, Rattus norvegicus
taaggagggacagtcactatacagc

SEQ ID NO: 543128 - DNA, 25 bp, Rattus norvegicus
taaggagggtttaccagtgtctctt

SEQ ID NO: 543129 - DNA, 25 bp, Rattus norvegicus
taaggagggttttccagtgtctctt

SEQ ID NO: 543130 - DNA, 25 bp, Rattus norvegicus
taaggaggtcttctctccacggtga

SEQ ID NO: 543131 - DNA, 25 bp, Rattus norvegicus
taaggaggtcttgtctccacggtga

SEQ ID NO: 543132 - DNA, 25 bp, Rattus norvegicus
taaggagtaacaactagcattcata

SEQ ID NO: 543133 - DNA, 25 bp, Rattus norvegicus
taaggagtaacatctagcattcata

SEQ ID NO: 543134 - DNA, 25 bp, Rattus norvegicus
taaggagtaatcaccccaaagacca

SEQ ID NO: 543135 - DNA, 25 bp, Rattus norvegicus
taaggagtaatctccccaaagacca

SEQ ID NO: 543136 - DNA, 25 bp, Rattus norvegicus
taaggagtcctcaggtatttgacca

SEQ ID NO: 543137 - DNA, 25 bp, Rattus norvegicus
taaggagtcctctggtatttgacca

SEQ ID NO: 543138 - DNA, 25 bp, Rattus norvegicus
taaggagtctctctttgacctttac

SEQ ID NO: 543139 - DNA, 25 bp, Rattus norvegicus
taaggagtctctgtttgacctttac

SEQ ID NO: 543140 - DNA, 25 bp, Rattus norvegicus
taaggagtctgcagcggttcgcatc

SEQ ID NO: 543141 - DNA, 25 bp, Rattus norvegicus
taaggagtctgctgcggttcgcatc

SEQ ID NO: 543142 - DNA, 25 bp, Rattus norvegicus
taaggagtgagcctttgggcctcca

SEQ ID NO: 543143 - DNA, 25 bp, Rattus norvegicus
taaggagtgagcgtttgggcctcca

SEQ ID NO: 543144 - DNA, 25 bp, Rattus norvegicus
taaggagtgcctcaactctgttccc

SEQ ID NO: 543145 - DNA, 25 bp, Rattus norvegicus
taaggagtgcctgaactctgttccc

SEQ ID NO: 543146 - DNA, 25 bp, Rattus norvegicus
taaggagttagtaggcttctcaaaa

SEQ ID NO: 543147 - DNA, 25 bp, Rattus norvegicus
taaggagttagttggcttctcaaaa

SEQ ID NO: 543148 - DNA, 25 bp, Rattus norvegicus
taaggagttgttcgcagttcctgct

SEQ ID NO: 543149 - DNA, 25 bp, Rattus norvegicus
taaggagttgttggcagttcctgct

SEQ ID NO: 543150 - DNA, 25 bp, Rattus norvegicus
taaggataagaaaggccaagctggg

SEQ ID NO: 543151 - DNA, 25 bp, Rattus norvegicus
taaggataagaatggccaagctggg

SEQ ID NO: 543152 - DNA, 25 bp, Rattus norvegicus
taaggataccccaagagacccgatc

SEQ ID NO: 543153 - DNA, 25 bp, Rattus norvegicus
taaggatacccctagagacccgatc

SEQ ID NO: 543154 - DNA, 25 bp, Rattus norvegicus
taaggatactaaagcagccttgcac

SEQ ID NO: 543155 - DNA, 25 bp, Rattus norvegicus
taaggatactaatgcagccttgcac

SEQ ID NO: 543156 - DNA, 25 bp, Rattus norvegicus
taaggatcacttctgtctttgcttc

SEQ ID NO: 543157 - DNA, 25 bp, Rattus norvegicus
taaggatcacttgtgtctttgcttc

SEQ ID NO: 543158 - DNA, 25 bp, Rattus norvegicus
taaggatcgcttcatagccttcccg

SEQ ID NO: 543159 - DNA, 25 bp, Rattus norvegicus
taaggatcgcttgatagccttcccg

SEQ ID NO: 543160 - DNA, 25 bp, Rattus norvegicus
taaggatctggcaaggttaacaaac

SEQ ID NO: 543161 - DNA, 25 bp, Rattus norvegicus
taaggatctggctaggttaacaaac

SEQ ID NO: 543162 - DNA, 25 bp, Rattus norvegicus
taaggatgactcaggtcagagatac

SEQ ID NO: 543163 - DNA, 25 bp, Rattus norvegicus
taaggatgactctggtcagagatac

SEQ ID NO: 543164 - DNA, 25 bp, Rattus norvegicus
taaggatgagacagagcacaccggt

SEQ ID NO: 543165 - DNA, 25 bp, Rattus norvegicus
taaggatgagactgagcacaccggt

SEQ ID NO: 543166 - DNA, 25 bp, Rattus norvegicus
taaggatgccccaggtcaggaagat

SEQ ID NO: 543167 - DNA, 25 bp, Rattus norvegicus
taaggatgcccctggtcaggaagat

SEQ ID NO: 543168 - DNA, 25 bp, Rattus norvegicus
taaggatgctgcagccaaggccgat

SEQ ID NO: 543169 - DNA, 25 bp, Rattus norvegicus
taaggatgctgctgccaaggccgat

SEQ ID NO: 543170 - DNA, 25 bp, Rattus norvegicus
taaggatgcttactggtcaatgaga

SEQ ID NO: 543171 - DNA, 25 bp, Rattus norvegicus
taaggatgcttagtggtcaatgaga

SEQ ID NO: 543172 - DNA, 25 bp, Rattus norvegicus
taaggatggctacagcctgtccggc

SEQ ID NO: 543173 - DNA, 25 bp, Rattus norvegicus
taaggatggctagagcctgtccggc

SEQ ID NO: 543174 - DNA, 25 bp, Rattus norvegicus
taaggatggtacaggctttctctgt

SEQ ID NO: 543175 - DNA, 25 bp, Rattus norvegicus
taaggatggtactggctttctctgt

SEQ ID NO: 543176 - DNA, 25 bp, Rattus norvegicus
taaggatgtcgaaggacgccctgtc

SEQ ID NO: 543177 - DNA, 25 bp, Rattus norvegicus
taaggatgtcgatggacgccctgtc

SEQ ID NO: 543178 - DNA, 25 bp, Rattus norvegicus
taaggatgtgttatgagtcctcaca

SEQ ID NO: 543179 - DNA, 25 bp, Rattus norvegicus
taaggatgtgttttgagtcctcaca

SEQ ID NO: 543180 - DNA, 25 bp, Rattus norvegicus
taaggatgttgacgctgtgctgcct

SEQ ID NO: 543181 - DNA, 25 bp, Rattus norvegicus
taaggatgttgaggctgtgctgcct

SEQ ID NO: 543182 - DNA, 25 bp, Rattus norvegicus
taaggattcattatggaaaccacat

SEQ ID NO: 543183 - DNA, 25 bp, Rattus norvegicus
taaggattcattttggaaaccacat

SEQ ID NO: 543184 - DNA, 25 bp, Rattus norvegicus
taaggatttattcacctaattagtt

SEQ ID NO: 543185 - DNA, 25 bp, Rattus norvegicus
taaggatttattgacctaattagtt

SEQ ID NO: 543186 - DNA, 25 bp, Rattus norvegicus
taaggatttctgaccttttcccact

SEQ ID NO: 543187 - DNA, 25 bp, Rattus norvegicus
taaggatttctgtccttttcccact

SEQ ID NO: 543188 - DNA, 25 bp, Rattus norvegicus
taaggcaaagttcttgccctccagg

SEQ ID NO: 543189 - DNA, 25 bp, Rattus norvegicus
taaggcaaagttgttgccctccagg

SEQ ID NO: 543190 - DNA, 25 bp, Rattus norvegicus
taaggcaagcttattggttcagaaa

SEQ ID NO: 543191 - DNA, 25 bp, Rattus norvegicus
taaggcaagctttttggttcagaaa

SEQ ID NO: 543192 - DNA, 25 bp, Rattus norvegicus
taaggcacaaatcacccgcctgtgt

SEQ ID NO: 543193 - DNA, 25 bp, Rattus norvegicus
taaggcacaaatgacccgcctgtgt

SEQ ID NO: 543194 - DNA, 25 bp, Rattus norvegicus
taaggcacagtgctgcggagcccac

SEQ ID NO: 543195 - DNA, 25 bp, Rattus norvegicus
taaggcacagtggtgcggagcccac

SEQ ID NO: 543196 - DNA, 25 bp, Rattus norvegicus
taaggcaccttccattgaattaaat

SEQ ID NO: 543197 - DNA, 25 bp, Rattus norvegicus
taaggcaccttcgattgaattaaat

SEQ ID NO: 543198 - DNA, 25 bp, Rattus norvegicus
taaggcacgcctctctgcagcttct

SEQ ID NO: 543199 - DNA, 25 bp, Rattus norvegicus
taaggcacgcctgtctgcagcttct

SEQ ID NO: 543200 - DNA, 25 bp, Rattus norvegicus
taaggcactagaacctgcccaacct

SEQ ID NO: 543201 - DNA, 25 bp, Rattus norvegicus
taaggcactagatcctgcccaacct

SEQ ID NO: 543202 - DNA, 25 bp, Rattus norvegicus
taaggcactctcagcttttgacacc

SEQ ID NO: 543203 - DNA, 25 bp, Rattus norvegicus
taaggcactctctgcttttgacacc

SEQ ID NO: 543204 - DNA, 25 bp, Rattus norvegicus
taaggcactgagctcaagtctctct

SEQ ID NO: 543205 - DNA, 25 bp, Rattus norvegicus
taaggcactgaggtcaagtctctct

SEQ ID NO: 543206 - DNA, 25 bp, Rattus norvegicus
taaggcactgttaccacccacatag

SEQ ID NO: 543207 - DNA, 25 bp, Rattus norvegicus
taaggcactgtttccacccacatag

SEQ ID NO: 543208 - DNA, 25 bp, Rattus norvegicus
taaggcactttgagtcctgacacct

SEQ ID NO: 543209 - DNA, 25 bp, Rattus norvegicus
taaggcactttgtgtcctgacacct

SEQ ID NO: 543210 - DNA, 25 bp, Rattus norvegicus
taaggcagcagtccaggaattccaa

SEQ ID NO: 543211 - DNA, 25 bp, Rattus norvegicus
taaggcagcagtgcaggaattccaa

SEQ ID NO: 543212 - DNA, 25 bp, Rattus norvegicus
taaggcagcccactgttcttgcaga

SEQ ID NO: 543213 - DNA, 25 bp, Rattus norvegicus
taaggcagcccagtgttcttgcaga

SEQ ID NO: 543214 - DNA, 25 bp, Rattus norvegicus
taaggcaggaagcacacagcagtta

SEQ ID NO: 543215 - DNA, 25 bp, Rattus norvegicus
taaggcaggaaggacacagcagtta

SEQ ID NO: 543216 - DNA, 25 bp, Rattus norvegicus
taaggcaggcaaacacttaaagctg

SEQ ID NO: 543217 - DNA, 25 bp, Rattus norvegicus
taaggcaggcaatcacttaaagctg

SEQ ID NO: 543218 - DNA, 25 bp, Rattus norvegicus
taaggcaggttcagctttctcaggg

SEQ ID NO: 543219 - DNA, 25 bp, Rattus norvegicus
taaggcaggttctgctttctcaggg

SEQ ID NO: 543220 - DNA, 25 bp, Rattus norvegicus
taaggcagtgccacagaactcagga

SEQ ID NO: 543221 - DNA, 25 bp, Rattus norvegicus
taaggcagtgcctcagaactcagga

SEQ ID NO: 543222 - DNA, 25 bp, Rattus norvegicus
taaggcatcctgaattagctcactc

SEQ ID NO: 543223 - DNA, 25 bp, Rattus norvegicus
taaggcatcctgtattagctcactc

SEQ ID NO: 543224 - DNA, 25 bp, Rattus norvegicus
taaggcatggaaccagagataacct

SEQ ID NO: 543225 - DNA, 25 bp, Rattus norvegicus
taaggcatggaagcagagataacct

SEQ ID NO: 543226 - DNA, 25 bp, Rattus norvegicus
taaggcatggatctctggagtcaca

SEQ ID NO: 543227 - DNA, 25 bp, Rattus norvegicus
taaggcatggatgtctggagtcaca

SEQ ID NO: 543228 - DNA, 25 bp, Rattus norvegicus
taaggcatggcacctgcagtttccc

SEQ ID NO: 543229 - DNA, 25 bp, Rattus norvegicus
taaggcatggcagctgcagtttccc

SEQ ID NO: 543230 - DNA, 25 bp, Rattus norvegicus
taaggcatgtgccacggcgtatgca

SEQ ID NO: 543231 - DNA, 25 bp, Rattus norvegicus
taaggcatgtgcgacggcgtatgca

SEQ ID NO: 543232 - DNA, 25 bp, Rattus norvegicus
taaggcattcctcgtatctgggctt

SEQ ID NO: 543233 - DNA, 25 bp, Rattus norvegicus
taaggcattcctggtatctgggctt

SEQ ID NO: 543234 - DNA, 25 bp, Rattus norvegicus
taaggccaaaggattaacttgtatg

SEQ ID NO: 543235 - DNA, 25 bp, Rattus norvegicus
taaggccaaaggtttaacttgtatg

SEQ ID NO: 543236 - DNA, 25 bp, Rattus norvegicus
taaggccaagtgcaggtgtcgtcca

SEQ ID NO: 543237 - DNA, 25 bp, Rattus norvegicus
taaggccaagtggaggtgtcgtcca

SEQ ID NO: 543238 - DNA, 25 bp, Rattus norvegicus
taaggccaatggatctctctttcat

SEQ ID NO: 543239 - DNA, 25 bp, Rattus norvegicus
taaggccaatggttctctctttcat

SEQ ID NO: 543240 - DNA, 25 bp, Rattus norvegicus
taaggccaatttattcgaacataag

SEQ ID NO: 543241 - DNA, 25 bp, Rattus norvegicus
taaggccaattttttcgaacataag

SEQ ID NO: 543242 - DNA, 25 bp, Rattus norvegicus
taaggccacacactagggacccgac

SEQ ID NO: 543243 - DNA, 25 bp, Rattus norvegicus
taaggccacacagtagggacccgac

SEQ ID NO: 543244 - DNA, 25 bp, Rattus norvegicus
taaggccaccccaagccaattagag

SEQ ID NO: 543245 - DNA, 25 bp, Rattus norvegicus
taaggccacccctagccaattagag

SEQ ID NO: 543246 - DNA, 25 bp, Rattus norvegicus
taaggccaggccaggttcaactaca

SEQ ID NO: 543247 - DNA, 25 bp, Rattus norvegicus
taaggccaggcctggttcaactaca

SEQ ID NO: 543248 - DNA, 25 bp, Rattus norvegicus
taaggccagggactctatcaggaga

SEQ ID NO: 543249 - DNA, 25 bp, Rattus norvegicus
taaggccagggagtctatcaggaga

SEQ ID NO: 543250 - DNA, 25 bp, Rattus norvegicus
taaggccagtggcaaaattctacca

SEQ ID NO: 543251 - DNA, 25 bp, Rattus norvegicus
taaggccagtgggaaaattctacca

SEQ ID NO: 543252 - DNA, 25 bp, Rattus norvegicus
taaggccagttactctcctgcacac

SEQ ID NO: 543253 - DNA, 25 bp, Rattus norvegicus
taaggccagttagtctcctgcacac

SEQ ID NO: 543254 - DNA, 25 bp, Rattus norvegicus
taaggccatgccagctcctggtcct

SEQ ID NO: 543255 - DNA, 25 bp, Rattus norvegicus
taaggccatgcctgctcctggtcct

SEQ ID NO: 543256 - DNA, 25 bp, Rattus norvegicus
taaggccattgtcggttacaggata

SEQ ID NO: 543257 - DNA, 25 bp, Rattus norvegicus
taaggccattgtgggttacaggata

SEQ ID NO: 543258 - DNA, 25 bp, Rattus norvegicus
taaggcccaaatacaaacttctctg

SEQ ID NO: 543259 - DNA, 25 bp, Rattus norvegicus
taaggcccaaattcaaacttctctg

SEQ ID NO: 543260 - DNA, 25 bp, Rattus norvegicus
taaggcccaaggcttctgtccaatt

SEQ ID NO: 543261 - DNA, 25 bp, Rattus norvegicus
taaggcccaagggttctgtccaatt

SEQ ID NO: 543262 - DNA, 25 bp, Rattus norvegicus
taaggcccagcgaatgtaagacatt

SEQ ID NO: 543263 - DNA, 25 bp, Rattus norvegicus
taaggcccagcgtatgtaagacatt

SEQ ID NO: 543264 - DNA, 25 bp, Rattus norvegicus
taaggcccagctctacggaaccctg

SEQ ID NO: 543265 - DNA, 25 bp, Rattus norvegicus
taaggcccagctgtacggaaccctg

SEQ ID NO: 543266 - DNA, 25 bp, Rattus norvegicus
taaggcccagttcgcatttatcaag

SEQ ID NO: 543267 - DNA, 25 bp, Rattus norvegicus
taaggcccagttctactgctgagaa

SEQ ID NO: 543268 - DNA, 25 bp, Rattus norvegicus
taaggcccagttggcatttatcaag

SEQ ID NO: 543269 - DNA, 25 bp, Rattus norvegicus
taaggcccagttgtactgctgagaa

SEQ ID NO: 543270 - DNA, 25 bp, Rattus norvegicus
taaggcccctggcacaggtacctcg

SEQ ID NO: 543271 - DNA, 25 bp, Rattus norvegicus
taaggcccctgggacaggtacctcg

SEQ ID NO: 543272 - DNA, 25 bp, Rattus norvegicus
taaggcccgtaccagtaatgagcac

SEQ ID NO: 543273 - DNA, 25 bp, Rattus norvegicus
taaggcccgtacgagtaatgagcac

SEQ ID NO: 543274 - DNA, 25 bp, Rattus norvegicus
taaggccctcgaaggtcttcttttt

SEQ ID NO: 543275 - DNA, 25 bp, Rattus norvegicus
taaggccctcgatggtcttcttttt

SEQ ID NO: 543276 - DNA, 25 bp, Rattus norvegicus
taaggccctttactgaagctttcag

SEQ ID NO: 543277 - DNA, 25 bp, Rattus norvegicus
taaggccctttagtgaagctttcag

SEQ ID NO: 543278 - DNA, 25 bp, Rattus norvegicus
taaggccgtttacttgccgacttcg

SEQ ID NO: 543279 - DNA, 25 bp, Rattus norvegicus
taaggccgtttagttgccgacttcg

SEQ ID NO: 543280 - DNA, 25 bp, Rattus norvegicus
taaggcctccctaaatgtacctagg

SEQ ID NO: 543281 - DNA, 25 bp, Rattus norvegicus
taaggcctcccttaatgtacctagg

SEQ ID NO: 543282 - DNA, 25 bp, Rattus norvegicus
taaggcctccttcaaaagtactaga

SEQ ID NO: 543283 - DNA, 25 bp, Rattus norvegicus
taaggcctccttgaaaagtactaga

SEQ ID NO: 543284 - DNA, 25 bp, Rattus norvegicus
taaggcctctctccacatgtgatgt

SEQ ID NO: 543285 - DNA, 25 bp, Rattus norvegicus
taaggcctctctgcacatgtgatgt

SEQ ID NO: 543286 - DNA, 25 bp, Rattus norvegicus
taaggcctgacacaacagttctgag

SEQ ID NO: 543287 - DNA, 25 bp, Rattus norvegicus
taaggcctgacagaacagttctgag

SEQ ID NO: 543288 - DNA, 25 bp, Rattus norvegicus
taaggcctgcaactggagtcatcaa

SEQ ID NO: 543289 - DNA, 25 bp, Rattus norvegicus
taaggcctgcaagtggagtcatcaa

SEQ ID NO: 543290 - DNA, 25 bp, Rattus norvegicus
taaggcctgctaacatttggtggca

SEQ ID NO: 543291 - DNA, 25 bp, Rattus norvegicus
taaggcctgctatcatttggtggca

SEQ ID NO: 543292 - DNA, 25 bp, Rattus norvegicus
taaggcctggaaccaattctttgtg

SEQ ID NO: 543293 - DNA, 25 bp, Rattus norvegicus
taaggcctggaagcaattctttgtg

SEQ ID NO: 543294 - DNA, 25 bp, Rattus norvegicus
taaggcctgggcagtggtcagacat

SEQ ID NO: 543295 - DNA, 25 bp, Rattus norvegicus
taaggcctgggctgtggtcagacat

SEQ ID NO: 543296 - DNA, 25 bp, Rattus norvegicus
taaggcctgtggacactgtgctttg

SEQ ID NO: 543297 - DNA, 25 bp, Rattus norvegicus
taaggcctgtggtcactgtgctttg

SEQ ID NO: 543298 - DNA, 25 bp, Rattus norvegicus
taaggcctgttacctcctttttatt

SEQ ID NO: 543299 - DNA, 25 bp, Rattus norvegicus
taaggcctgttagctcctttttatt

SEQ ID NO: 543300 - DNA, 25 bp, Rattus norvegicus
taaggcctgtttatgtgtgagactg

SEQ ID NO: 543301 - DNA, 25 bp, Rattus norvegicus
taaggcctgtttctagctgttggac

SEQ ID NO: 543302 - DNA, 25 bp, Rattus norvegicus
taaggcctgtttgtagctgttggac

SEQ ID NO: 543303 - DNA, 25 bp, Rattus norvegicus
taaggcctgtttttgtgtgagactg

SEQ ID NO: 543304 - DNA, 25 bp, Rattus norvegicus
taaggccttagccacccttccaaga

SEQ ID NO: 543305 - DNA, 25 bp, Rattus norvegicus
taaggccttagcgacccttccaaga

SEQ ID NO: 543306 - DNA, 25 bp, Rattus norvegicus
taaggccttagtctgtcagctgaaa

SEQ ID NO: 543307 - DNA, 25 bp, Rattus norvegicus
taaggccttagtgtgtcagctgaaa

SEQ ID NO: 543308 - DNA, 25 bp, Rattus norvegicus
taaggccttcagagtcttagatact

SEQ ID NO: 543309 - DNA, 25 bp, Rattus norvegicus
taaggccttcagtgtcttagatact

SEQ ID NO: 543310 - DNA, 25 bp, Rattus norvegicus
taaggcctttctccaaaactccttc

SEQ ID NO: 543311 - DNA, 25 bp, Rattus norvegicus
taaggcctttctgcaaaactccttc

SEQ ID NO: 543312 - DNA, 25 bp, Rattus norvegicus
taaggccttttaaagtctgcaaatg

SEQ ID NO: 543313 - DNA, 25 bp, Rattus norvegicus
taaggccttttatagtctgcaaatg

SEQ ID NO: 543314 - DNA, 25 bp, Rattus norvegicus
taaggcgaggcgatcctactggaga

SEQ ID NO: 543315 - DNA, 25 bp, Rattus norvegicus
taaggcgaggcgttcctactggaga

SEQ ID NO: 543316 - DNA, 25 bp, Rattus norvegicus
taaggcgagtccctttgttcccagt

SEQ ID NO: 543317 - DNA, 25 bp, Rattus norvegicus
taaggcgagtccgtttgttcccagt

SEQ ID NO: 543318 - DNA, 25 bp, Rattus norvegicus
taaggcgcccttccatatgtaatct

SEQ ID NO: 543319 - DNA, 25 bp, Rattus norvegicus
taaggcgcccttgcatatgtaatct

SEQ ID NO: 543320 - DNA, 25 bp, Rattus norvegicus
taaggcgctcttaacatcacagatc

SEQ ID NO: 543321 - DNA, 25 bp, Rattus norvegicus
taaggcgctctttacatcacagatc

SEQ ID NO: 543322 - DNA, 25 bp, Rattus norvegicus
taaggcgctttgacattggcagaga

SEQ ID NO: 543323 - DNA, 25 bp, Rattus norvegicus
taaggcgctttgtcattggcagaga

SEQ ID NO: 543324 - DNA, 25 bp, Rattus norvegicus
taaggcggctccagaccaggatatg

SEQ ID NO: 543325 - DNA, 25 bp, Rattus norvegicus
taaggcggctcctgaccaggatatg

SEQ ID NO: 543326 - DNA, 25 bp, Rattus norvegicus
taaggcgtgaaacatcccagggcag

SEQ ID NO: 543327 - DNA, 25 bp, Rattus norvegicus
taaggcgtgaaagatcccagggcag

SEQ ID NO: 543328 - DNA, 25 bp, Rattus norvegicus
taaggctaatgtcttaacctccctc

SEQ ID NO: 543329 - DNA, 25 bp, Rattus norvegicus
taaggctaatgtgttaacctccctc

SEQ ID NO: 543330 - DNA, 25 bp, Rattus norvegicus
taaggctaccctcaatcgagcccaa

SEQ ID NO: 543331 - DNA, 25 bp, Rattus norvegicus
taaggctaccctgaatcgagcccaa

SEQ ID NO: 543332 - DNA, 25 bp, Rattus norvegicus
taaggctacttcaagtctgggcttg

SEQ ID NO: 543333 - DNA, 25 bp, Rattus norvegicus
taaggctacttctagtctgggcttg

SEQ ID NO: 543334 - DNA, 25 bp, Rattus norvegicus
taaggctagcccaaactacagagtg

SEQ ID NO: 543335 - DNA, 25 bp, Rattus norvegicus
taaggctagccctaactacagagtg

SEQ ID NO: 543336 - DNA, 25 bp, Rattus norvegicus
taaggctatttccatatctcctacc

SEQ ID NO: 543337 - DNA, 25 bp, Rattus norvegicus
taaggctatttcgatatctcctacc

SEQ ID NO: 543338 - DNA, 25 bp, Rattus norvegicus
taaggctcaatcaacatcgtgtgca

SEQ ID NO: 543339 - DNA, 25 bp, Rattus norvegicus
taaggctcaatctacatcgtgtgca

SEQ ID NO: 543340 - DNA, 25 bp, Rattus norvegicus
taaggctccacacacaacttgtttg

SEQ ID NO: 543341 - DNA, 25 bp, Rattus norvegicus
taaggctccacagacaacttgtttg

SEQ ID NO: 543342 - DNA, 25 bp, Rattus norvegicus
taaggctccaggctgtaggtttcct

SEQ ID NO: 543343 - DNA, 25 bp, Rattus norvegicus
taaggctccagggtgtaggtttcct

SEQ ID NO: 543344 - DNA, 25 bp, Rattus norvegicus
taaggctcgagaatgcccgttctga

SEQ ID NO: 543345 - DNA, 25 bp, Rattus norvegicus
taaggctcgagattgcccgttctga

SEQ ID NO: 543346 - DNA, 25 bp, Rattus norvegicus
taaggctcgtaacgtgctgtcctca

SEQ ID NO: 543347 - DNA, 25 bp, Rattus norvegicus
taaggctcgtaaggtgctgtcctca

SEQ ID NO: 543348 - DNA, 25 bp, Rattus norvegicus
taaggctcgttcaccaagcaatgga

SEQ ID NO: 543349 - DNA, 25 bp, Rattus norvegicus
taaggctcgttctccaagcaatgga

SEQ ID NO: 543350 - DNA, 25 bp, Rattus norvegicus
taaggctctcagacacacttgtttc

SEQ ID NO: 543351 - DNA, 25 bp, Rattus norvegicus
taaggctctcagtcacacttgtttc

SEQ ID NO: 543352 - DNA, 25 bp, Rattus norvegicus
taaggctctgcccagttcctgtaag

SEQ ID NO: 543353 - DNA, 25 bp, Rattus norvegicus
taaggctctgccgagttcctgtaag

SEQ ID NO: 543354 - DNA, 25 bp, Rattus norvegicus
taaggctctgtcaacggagtccatc

SEQ ID NO: 543355 - DNA, 25 bp, Rattus norvegicus
taaggctctgtcattgtctagcagg

SEQ ID NO: 543356 - DNA, 25 bp, Rattus norvegicus
taaggctctgtctacggagtccatc

SEQ ID NO: 543357 - DNA, 25 bp, Rattus norvegicus
taaggctctgtctttgtctagcagg

SEQ ID NO: 543358 - DNA, 25 bp, Rattus norvegicus
taaggctgactcagactgctgtcac

SEQ ID NO: 543359 - DNA, 25 bp, Rattus norvegicus
taaggctgactctgactgctgtcac

SEQ ID NO: 543360 - DNA, 25 bp, Rattus norvegicus
taaggctgagaactcaaccccactt

SEQ ID NO: 543361 - DNA, 25 bp, Rattus norvegicus
taaggctgagaagtcaaccccactt

SEQ ID NO: 543362 - DNA, 25 bp, Rattus norvegicus
taaggctgcaggaacttgggcatca

SEQ ID NO: 543363 - DNA, 25 bp, Rattus norvegicus
taaggctgcaggtacttgggcatca

SEQ ID NO: 543364 - DNA, 25 bp, Rattus norvegicus
taaggctgcttgatgattgccactt

SEQ ID NO: 543365 - DNA, 25 bp, Rattus norvegicus
taaggctgcttgttgattgccactt

SEQ ID NO: 543366 - DNA, 25 bp, Rattus norvegicus
taaggctggaaacgacccaactgtc

SEQ ID NO: 543367 - DNA, 25 bp, Rattus norvegicus
taaggctggaaaggacccaactgtc

SEQ ID NO: 543368 - DNA, 25 bp, Rattus norvegicus
taaggctggtgcctgtatctgccct

SEQ ID NO: 543369 - DNA, 25 bp, Rattus norvegicus
taaggctggtgcgtgtatctgccct

SEQ ID NO: 543370 - DNA, 25 bp, Rattus norvegicus
taaggctgtatacagtcctccctgt

SEQ ID NO: 543371 - DNA, 25 bp, Rattus norvegicus
taaggctgtatagagtcctccctgt

SEQ ID NO: 543372 - DNA, 25 bp, Rattus norvegicus
taaggctgtcccatctcattcattt

SEQ ID NO: 543373 - DNA, 25 bp, Rattus norvegicus
taaggctgtcccttctcattcattt

SEQ ID NO: 543374 - DNA, 25 bp, Rattus norvegicus
taaggctgtgctctgagctgagccc

SEQ ID NO: 543375 - DNA, 25 bp, Rattus norvegicus
taaggctgtgctgtgagctgagccc

SEQ ID NO: 543376 - DNA, 25 bp, Rattus norvegicus
taaggctgttagaagcccaaggcct

SEQ ID NO: 543377 - DNA, 25 bp, Rattus norvegicus
taaggctgttagtagcccaaggcct

SEQ ID NO: 543378 - DNA, 25 bp, Rattus norvegicus
taaggctgttcaaaaattctgggtt

SEQ ID NO: 543379 - DNA, 25 bp, Rattus norvegicus
taaggctgttcataaattctgggtt

SEQ ID NO: 543380 - DNA, 25 bp, Rattus norvegicus
taaggcttaggccactaaggctaat

SEQ ID NO: 543381 - DNA, 25 bp, Rattus norvegicus
taaggcttaggcgactaaggctaat

SEQ ID NO: 543382 - DNA, 25 bp, Rattus norvegicus
taaggcttcctccttgtatgcaggc

SEQ ID NO: 543383 - DNA, 25 bp, Rattus norvegicus
taaggcttcctcgttgtatgcaggc

SEQ ID NO: 543384 - DNA, 25 bp, Rattus norvegicus
taaggcttgctcacagtctcaaaag

SEQ ID NO: 543385 - DNA, 25 bp, Rattus norvegicus
taaggcttgctctcagtctcaaaag

SEQ ID NO: 543386 - DNA, 25 bp, Rattus norvegicus
taaggcttgtcccattaccactgta

SEQ ID NO: 543387 - DNA, 25 bp, Rattus norvegicus
taaggcttgtccctgaggcacagaa

SEQ ID NO: 543388 - DNA, 25 bp, Rattus norvegicus
taaggcttgtccgattaccactgta

SEQ ID NO: 543389 - DNA, 25 bp, Rattus norvegicus
taaggcttgtccgtgaggcacagaa

SEQ ID NO: 543390 - DNA, 25 bp, Rattus norvegicus
taaggctttactctgaggaccaccg

SEQ ID NO: 543391 - DNA, 25 bp, Rattus norvegicus
taaggctttactgtgaggaccaccg

SEQ ID NO: 543392 - DNA, 25 bp, Rattus norvegicus
taaggctttcacacacctcactcag

SEQ ID NO: 543393 - DNA, 25 bp, Rattus norvegicus
taaggctttcactcacctcactcag

SEQ ID NO: 543394 - DNA, 25 bp, Rattus norvegicus
taaggctttggaatcttcccacaaa

SEQ ID NO: 543395 - DNA, 25 bp, Rattus norvegicus
taaggctttggattcttcccacaaa

SEQ ID NO: 543396 - DNA, 25 bp, Rattus norvegicus
taagggaaaagcactcagggaactg

SEQ ID NO: 543397 - DNA, 25 bp, Rattus norvegicus
taagggaaaagctctcagggaactg

SEQ ID NO: 543398 - DNA, 25 bp, Rattus norvegicus
taagggaaactgacccctcgtgtca

SEQ ID NO: 543399 - DNA, 25 bp, Rattus norvegicus
taagggaaactgtcccctcgtgtca

SEQ ID NO: 543400 - DNA, 25 bp, Rattus norvegicus
taagggaaagctatgccggacattt

SEQ ID NO: 543401 - DNA, 25 bp, Rattus norvegicus
taagggaaagctttgccggacattt

SEQ ID NO: 543402 - DNA, 25 bp, Rattus norvegicus
taagggaacgctcctttaagatctc

SEQ ID NO: 543403 - DNA, 25 bp, Rattus norvegicus
taagggaacgctgctttaagatctc

SEQ ID NO: 543404 - DNA, 25 bp, Rattus norvegicus
taagggaagccacatagacacacat

SEQ ID NO: 543405 - DNA, 25 bp, Rattus norvegicus
taagggaagccaccttccttctgtc

SEQ ID NO: 543406 - DNA, 25 bp, Rattus norvegicus
taagggaagccagatagacacacat

SEQ ID NO: 543407 - DNA, 25 bp, Rattus norvegicus
taagggaagccagcttccttctgtc

SEQ ID NO: 543408 - DNA, 25 bp, Rattus norvegicus
taagggacacaaaagcaccgggctg

SEQ ID NO: 543409 - DNA, 25 bp, Rattus norvegicus
taagggacacaatagcaccgggctg

SEQ ID NO: 543410 - DNA, 25 bp, Rattus norvegicus
taagggacactaccacgcatctggt

SEQ ID NO: 543411 - DNA, 25 bp, Rattus norvegicus
taagggacactagcacgcatctggt

SEQ ID NO: 543412 - DNA, 25 bp, Rattus norvegicus
taagggacatacactgggtgtatcc

SEQ ID NO: 543413 - DNA, 25 bp, Rattus norvegicus
taagggacatactctgggtgtatcc

SEQ ID NO: 543414 - DNA, 25 bp, Rattus norvegicus
taagggacatccacagaaggctggg

SEQ ID NO: 543415 - DNA, 25 bp, Rattus norvegicus
taagggacatcctcagaaggctggg

SEQ ID NO: 543416 - DNA, 25 bp, Rattus norvegicus
taagggacatctaactgccccatgt

SEQ ID NO: 543417 - DNA, 25 bp, Rattus norvegicus
taagggacatcttactgccccatgt

SEQ ID NO: 543418 - DNA, 25 bp, Rattus norvegicus
taagggaccagccataggacgcagt

SEQ ID NO: 543419 - DNA, 25 bp, Rattus norvegicus
taagggaccagcgataggacgcagt

SEQ ID NO: 543420 - DNA, 25 bp, Rattus norvegicus
taagggactctcctctgtcgtctga

SEQ ID NO: 543421 - DNA, 25 bp, Rattus norvegicus
taagggactctcgtctgtcgtctga

SEQ ID NO: 543422 - DNA, 25 bp, Rattus norvegicus
taagggagtcatacgacggctctgt

SEQ ID NO: 543423 - DNA, 25 bp, Rattus norvegicus
taagggagtcattcgacggctctgt

SEQ ID NO: 543424 - DNA, 25 bp, Rattus norvegicus
taagggagtcccatttgacctctgc

SEQ ID NO: 543425 - DNA, 25 bp, Rattus norvegicus
taagggagtcccttttgacctctgc

SEQ ID NO: 543426 - DNA, 25 bp, Rattus norvegicus
taagggatactgacactgcccatca

SEQ ID NO: 543427 - DNA, 25 bp, Rattus norvegicus
taagggatactgtcactgcccatca

SEQ ID NO: 543428 - DNA, 25 bp, Rattus norvegicus
taagggatgctgaagcccggaacaa

SEQ ID NO: 543429 - DNA, 25 bp, Rattus norvegicus
taagggatgctgtagcccggaacaa

SEQ ID NO: 543430 - DNA, 25 bp, Rattus norvegicus
taagggatggagaatactgggcttt

SEQ ID NO: 543431 - DNA, 25 bp, Rattus norvegicus
taagggatggagtatactgggcttt

SEQ ID NO: 543432 - DNA, 25 bp, Rattus norvegicus
taagggatttgcatctccatagctc

SEQ ID NO: 543433 - DNA, 25 bp, Rattus norvegicus
taagggatttgcttctccatagctc

SEQ ID NO: 543434 - DNA, 25 bp, Rattus norvegicus
taagggcaagatctcattccatagc

SEQ ID NO: 543435 - DNA, 25 bp, Rattus norvegicus
taagggcaagatgtcattccatagc

SEQ ID NO: 543436 - DNA, 25 bp, Rattus norvegicus
taagggcaatccctaagttacactt

SEQ ID NO: 543437 - DNA, 25 bp, Rattus norvegicus
taagggcaatccgtaagttacactt

SEQ ID NO: 543438 - DNA, 25 bp, Rattus norvegicus
taagggcacaagaactggccaccag

SEQ ID NO: 543439 - DNA, 25 bp, Rattus norvegicus
taagggcacaagtactggccaccag

SEQ ID NO: 543440 - DNA, 25 bp, Rattus norvegicus
taagggcacttcattgcctggatgt

SEQ ID NO: 543441 - DNA, 25 bp, Rattus norvegicus
taagggcacttctttgcctggatgt

SEQ ID NO: 543442 - DNA, 25 bp, Rattus norvegicus
taagggcaggtcacggcctctttgc

SEQ ID NO: 543443 - DNA, 25 bp, Rattus norvegicus
taagggcaggtctcggcctctttgc

SEQ ID NO: 543444 - DNA, 25 bp, Rattus norvegicus
taagggcatctcactttcacagaaa

SEQ ID NO: 543445 - DNA, 25 bp, Rattus norvegicus
taagggcatctctctttcacagaaa

SEQ ID NO: 543446 - DNA, 25 bp, Rattus norvegicus
taagggccaagcacactgcatggat

SEQ ID NO: 543447 - DNA, 25 bp, Rattus norvegicus
taagggccaagctcactgcatggat

SEQ ID NO: 543448 - DNA, 25 bp, Rattus norvegicus
taagggccaccacagtaggtgctaa

SEQ ID NO: 543449 - DNA, 25 bp, Rattus norvegicus
taagggccaccagagtaggtgctaa

SEQ ID NO: 543450 - DNA, 25 bp, Rattus norvegicus
taagggccagtaccgacttgcgact

SEQ ID NO: 543451 - DNA, 25 bp, Rattus norvegicus
taagggccagtagcgacttgcgact

SEQ ID NO: 543452 - DNA, 25 bp, Rattus norvegicus
taagggcccaagactgattttacct

SEQ ID NO: 543453 - DNA, 25 bp, Rattus norvegicus
taagggcccaagtctgattttacct

SEQ ID NO: 543454 - DNA, 25 bp, Rattus norvegicus
taagggccccagacagtatatgttg

SEQ ID NO: 543455 - DNA, 25 bp, Rattus norvegicus
taagggccccagtcagtatatgttg

SEQ ID NO: 543456 - DNA, 25 bp, Rattus norvegicus
taagggcccgggagcatgtttaaat

SEQ ID NO: 543457 - DNA, 25 bp, Rattus norvegicus
taagggcccgggtgcatgtttaaat

SEQ ID NO: 543458 - DNA, 25 bp, Rattus norvegicus
taagggccgacaaactggtgttgaa

SEQ ID NO: 543459 - DNA, 25 bp, Rattus norvegicus
taagggccgacatactggtgttgaa

SEQ ID NO: 543460 - DNA, 25 bp, Rattus norvegicus
taagggccggtgatagtattgttga

SEQ ID NO: 543461 - DNA, 25 bp, Rattus norvegicus
taagggccggtgttagtattgttga

SEQ ID NO: 543462 - DNA, 25 bp, Rattus norvegicus
taagggcctctcacagatcaccata

SEQ ID NO: 543463 - DNA, 25 bp, Rattus norvegicus
taagggcctctctcagatcaccata

SEQ ID NO: 543464 - DNA, 25 bp, Rattus norvegicus
taagggcctgtaatcccgtggacgg

SEQ ID NO: 543465 - DNA, 25 bp, Rattus norvegicus
taagggcctgtattcccgtggacgg

SEQ ID NO: 543466 - DNA, 25 bp, Rattus norvegicus
taagggcctgtgaagctgtcatgct

SEQ ID NO: 543467 - DNA, 25 bp, Rattus norvegicus
taagggcctgtgagtatttccccat

SEQ ID NO: 543468 - DNA, 25 bp, Rattus norvegicus
taagggcctgtgtagctgtcatgct

SEQ ID NO: 543469 - DNA, 25 bp, Rattus norvegicus
taagggcctgtgtgtatttccccat

SEQ ID NO: 543470 - DNA, 25 bp, Rattus norvegicus
taagggccttttctctgtaaactag

SEQ ID NO: 543471 - DNA, 25 bp, Rattus norvegicus
taagggccttttgtctgtaaactag

SEQ ID NO: 543472 - DNA, 25 bp, Rattus norvegicus
taagggcgccctaaactccacagta

SEQ ID NO: 543473 - DNA, 25 bp, Rattus norvegicus
taagggcgcccttaactccacagta

SEQ ID NO: 543474 - DNA, 25 bp, Rattus norvegicus
taagggcgtcacatggccaggagct

SEQ ID NO: 543475 - DNA, 25 bp, Rattus norvegicus
taagggcgtcacttggccaggagct

SEQ ID NO: 543476 - DNA, 25 bp, Rattus norvegicus
taagggctacctaagcggcaattat

SEQ ID NO: 543477 - DNA, 25 bp, Rattus norvegicus
taagggctaccttagcggcaattat

SEQ ID NO: 543478 - DNA, 25 bp, Rattus norvegicus
taagggctcaagactttttctacat

SEQ ID NO: 543479 - DNA, 25 bp, Rattus norvegicus
taagggctcaagtctttttctacat

SEQ ID NO: 543480 - DNA, 25 bp, Rattus norvegicus
taagggctcatgacccataggttga

SEQ ID NO: 543481 - DNA, 25 bp, Rattus norvegicus
taagggctcatgtcccataggttga

SEQ ID NO: 543482 - DNA, 25 bp, Rattus norvegicus
taagggctccacagctgactcggca

SEQ ID NO: 543483 - DNA, 25 bp, Rattus norvegicus
taagggctccactgctgactcggca

SEQ ID NO: 543484 - DNA, 25 bp, Rattus norvegicus
taagggctctcgctgcacacagaga

SEQ ID NO: 543485 - DNA, 25 bp, Rattus norvegicus
taagggctctcggtgcacacagaga

SEQ ID NO: 543486 - DNA, 25 bp, Rattus norvegicus
taagggctgcaacacccaccaggaa

SEQ ID NO: 543487 - DNA, 25 bp, Rattus norvegicus
taagggctgcaagacccaccaggaa

SEQ ID NO: 543488 - DNA, 25 bp, Rattus norvegicus
taagggcttaaaatctgtaccaaca

SEQ ID NO: 543489 - DNA, 25 bp, Rattus norvegicus
taagggcttaaattctgtaccaaca

SEQ ID NO: 543490 - DNA, 25 bp, Rattus norvegicus
taagggcttcgtccagatctgggat

SEQ ID NO: 543491 - DNA, 25 bp, Rattus norvegicus
taagggcttcgtgcagatctgggat

SEQ ID NO: 543492 - DNA, 25 bp, Rattus norvegicus
taagggcttgtgagatttccccgtc

SEQ ID NO: 543493 - DNA, 25 bp, Rattus norvegicus
taagggcttgtgtgatttccccgtc

SEQ ID NO: 543494 - DNA, 25 bp, Rattus norvegicus
taagggtacgacctcctttggccat

SEQ ID NO: 543495 - DNA, 25 bp, Rattus norvegicus
taagggtacgacgtcctttggccat

SEQ ID NO: 543496 - DNA, 25 bp, Rattus norvegicus
taagggtagctcagggaccacctac

SEQ ID NO: 543497 - DNA, 25 bp, Rattus norvegicus
taagggtagctctgggaccacctac

SEQ ID NO: 543498 - DNA, 25 bp, Rattus norvegicus
taagggtagttcctgtgccttcttt

SEQ ID NO: 543499 - DNA, 25 bp, Rattus norvegicus
taagggtagttcgtgtgccttcttt

SEQ ID NO: 543500 - DNA, 25 bp, Rattus norvegicus
taagggtatgtgaccatgcgcgtgt

SEQ ID NO: 543501 - DNA, 25 bp, Rattus norvegicus
taagggtatgtgtccatgcgcgtgt

SEQ ID NO: 543502 - DNA, 25 bp, Rattus norvegicus
taagggtcccaaagtgtccatccag

SEQ ID NO: 543503 - DNA, 25 bp, Rattus norvegicus
taagggtcccaatgtgtccatccag

SEQ ID NO: 543504 - DNA, 25 bp, Rattus norvegicus
taagggtccggaattaggttcacag

SEQ ID NO: 543505 - DNA, 25 bp, Rattus norvegicus
taagggtccggatttaggttcacag

SEQ ID NO: 543506 - DNA, 25 bp, Rattus norvegicus
taagggtccttaatgaacccgactg

SEQ ID NO: 543507 - DNA, 25 bp, Rattus norvegicus
taagggtccttattgaacccgactg

SEQ ID NO: 543508 - DNA, 25 bp, Rattus norvegicus
taagggtctgcgacagggtctcagt

SEQ ID NO: 543509 - DNA, 25 bp, Rattus norvegicus
taagggtctgcgtcagggtctcagt

SEQ ID NO: 543510 - DNA, 25 bp, Rattus norvegicus
taagggtctgtcaagtactcagcct

SEQ ID NO: 543511 - DNA, 25 bp, Rattus norvegicus
taagggtctgtctagtactcagcct

SEQ ID NO: 543512 - DNA, 25 bp, Rattus norvegicus
taagggtcttaacccactcaagtgg

SEQ ID NO: 543513 - DNA, 25 bp, Rattus norvegicus
taagggtcttaagccactcaagtgg

SEQ ID NO: 543514 - DNA, 25 bp, Rattus norvegicus
taagggtcttctccggtgggactcc

SEQ ID NO: 543515 - DNA, 25 bp, Rattus norvegicus
taagggtcttctgcggtgggactcc

SEQ ID NO: 543516 - DNA, 25 bp, Rattus norvegicus
taagggtgacctctacttttccact

SEQ ID NO: 543517 - DNA, 25 bp, Rattus norvegicus
taagggtgacctgtacttttccact

SEQ ID NO: 543518 - DNA, 25 bp, Rattus norvegicus
taagggtgacttactcttcagcagt

SEQ ID NO: 543519 - DNA, 25 bp, Rattus norvegicus
taagggtgactttctcttcagcagt

SEQ ID NO: 543520 - DNA, 25 bp, Rattus norvegicus
taagggtgcaacctacggcaagcct

SEQ ID NO: 543521 - DNA, 25 bp, Rattus norvegicus
taagggtgcaacgtacggcaagcct

SEQ ID NO: 543522 - DNA, 25 bp, Rattus norvegicus
taagggttaagcagacaactgtcca

SEQ ID NO: 543523 - DNA, 25 bp, Rattus norvegicus
taagggttaagctgacaactgtcca

SEQ ID NO: 543524 - DNA, 25 bp, Rattus norvegicus
taagggttatgcctttgtccacttc

SEQ ID NO: 543525 - DNA, 25 bp, Rattus norvegicus
taagggttatgcgtttgtccacttc

SEQ ID NO: 543526 - DNA, 25 bp, Rattus norvegicus
taagggttccctacttctaaatctg

SEQ ID NO: 543527 - DNA, 25 bp, Rattus norvegicus
taagggttcccttcttctaaatctg

SEQ ID NO: 543528 - DNA, 25 bp, Rattus norvegicus
taagggttccgcagttgtttctagc

SEQ ID NO: 543529 - DNA, 25 bp, Rattus norvegicus
taagggttccgctgttgtttctagc

SEQ ID NO: 543530 - DNA, 25 bp, Rattus norvegicus
taagggttctacagccctcttctag

SEQ ID NO: 543531 - DNA, 25 bp, Rattus norvegicus
taagggttctactgccctcttctag

SEQ ID NO: 543532 - DNA, 25 bp, Rattus norvegicus
taagggttcttgatattgtccacgg

SEQ ID NO: 543533 - DNA, 25 bp, Rattus norvegicus
taagggttcttgttattgtccacgg

SEQ ID NO: 543534 - DNA, 25 bp, Rattus norvegicus
taagggttgacacatctcatctcac

SEQ ID NO: 543535 - DNA, 25 bp, Rattus norvegicus
taagggttgacagatctcatctcac

SEQ ID NO: 543536 - DNA, 25 bp, Rattus norvegicus
taagggttgcctctgatgtttctct

SEQ ID NO: 543537 - DNA, 25 bp, Rattus norvegicus
taagggttgcctgtgatgtttctct

SEQ ID NO: 543538 - DNA, 25 bp, Rattus norvegicus
taagggttgctactgtttttcctca

SEQ ID NO: 543539 - DNA, 25 bp, Rattus norvegicus
taagggttgctagtgtttttcctca

SEQ ID NO: 543540 - DNA, 25 bp, Rattus norvegicus
taagggtttcctatacaagcgccat

SEQ ID NO: 543541 - DNA, 25 bp, Rattus norvegicus
taagggtttcctttacaagcgccat

SEQ ID NO: 543542 - DNA, 25 bp, Rattus norvegicus
taagggtttgtgacgatctgataat

SEQ ID NO: 543543 - DNA, 25 bp, Rattus norvegicus
taagggtttgtgtcgatctgataat

SEQ ID NO: 543544 - DNA, 25 bp, Rattus norvegicus
taaggtaacttacctcttcccgcct

SEQ ID NO: 543545 - DNA, 25 bp, Rattus norvegicus
taaggtaacttagctcttcccgcct

SEQ ID NO: 543546 - DNA, 25 bp, Rattus norvegicus
taaggtaatcctatgggatcctggg

SEQ ID NO: 543547 - DNA, 25 bp, Rattus norvegicus
taaggtaatcctttgggatcctggg

SEQ ID NO: 543548 - DNA, 25 bp, Rattus norvegicus
taaggtacaagaagctggatcagcg

SEQ ID NO: 543549 - DNA, 25 bp, Rattus norvegicus
taaggtacaagatgctggatcagcg

SEQ ID NO: 543550 - DNA, 25 bp, Rattus norvegicus
taaggtacacttacagcatgctgtc

SEQ ID NO: 543551 - DNA, 25 bp, Rattus norvegicus
taaggtacactttcagcatgctgtc

SEQ ID NO: 543552 - DNA, 25 bp, Rattus norvegicus
taaggtaccatgactatgaattgaa

SEQ ID NO: 543553 - DNA, 25 bp, Rattus norvegicus
taaggtaccatgtctatgaattgaa

SEQ ID NO: 543554 - DNA, 25 bp, Rattus norvegicus
taaggtacccaacttaacagctgac

SEQ ID NO: 543555 - DNA, 25 bp, Rattus norvegicus
taaggtacccaagttaacagctgac

SEQ ID NO: 543556 - DNA, 25 bp, Rattus norvegicus
taaggtacctgaccttgctagctgt

SEQ ID NO: 543557 - DNA, 25 bp, Rattus norvegicus
taaggtacctgagcttgctagctgt

SEQ ID NO: 543558 - DNA, 25 bp, Rattus norvegicus
taaggtacgctgctacgcggttccg

SEQ ID NO: 543559 - DNA, 25 bp, Rattus norvegicus
taaggtacgctggtacgcggttccg

SEQ ID NO: 543560 - DNA, 25 bp, Rattus norvegicus
taaggtactcagaaaaaggccttct

SEQ ID NO: 543561 - DNA, 25 bp, Rattus norvegicus
taaggtactcagtaaaaggccttct

SEQ ID NO: 543562 - DNA, 25 bp, Rattus norvegicus
taaggtactgatatctgacgcgtcc

SEQ ID NO: 543563 - DNA, 25 bp, Rattus norvegicus
taaggtactgatttctgacgcgtcc

SEQ ID NO: 543564 - DNA, 25 bp, Rattus norvegicus
taaggtactggcagttttcctttgt

SEQ ID NO: 543565 - DNA, 25 bp, Rattus norvegicus
taaggtactggctgttttcctttgt

SEQ ID NO: 543566 - DNA, 25 bp, Rattus norvegicus
taaggtactgtgcatgcctgctgag

SEQ ID NO: 543567 - DNA, 25 bp, Rattus norvegicus
taaggtactgtggatgcctgctgag

SEQ ID NO: 543568 - DNA, 25 bp, Rattus norvegicus
taaggtagcacacacacgcctggag

SEQ ID NO: 543569 - DNA, 25 bp, Rattus norvegicus
taaggtagcacagacacgcctggag

SEQ ID NO: 543570 - DNA, 25 bp, Rattus norvegicus
taaggtagggtcaccaggtggctct

SEQ ID NO: 543571 - DNA, 25 bp, Rattus norvegicus
taaggtagggtctccaggtggctct

SEQ ID NO: 543572 - DNA, 25 bp, Rattus norvegicus
taaggtatcgttagttggcggcagc

SEQ ID NO: 543573 - DNA, 25 bp, Rattus norvegicus
taaggtatcgtttgttggcggcagc

SEQ ID NO: 543574 - DNA, 25 bp, Rattus norvegicus
taaggtatcttgctacagtagacac

SEQ ID NO: 543575 - DNA, 25 bp, Rattus norvegicus
taaggtatcttggtacagtagacac

SEQ ID NO: 543576 - DNA, 25 bp, Rattus norvegicus
taaggtatgtctacctcagaggccg

SEQ ID NO: 543577 - DNA, 25 bp, Rattus norvegicus
taaggtatgtcttcctcagaggccg

SEQ ID NO: 543578 - DNA, 25 bp, Rattus norvegicus
taaggtcaaaacactctcgcagatg

SEQ ID NO: 543579 - DNA, 25 bp, Rattus norvegicus
taaggtcaaaactctctcgcagatg

SEQ ID NO: 543580 - DNA, 25 bp, Rattus norvegicus
taaggtcacagtccgagttcccaac

SEQ ID NO: 543581 - DNA, 25 bp, Rattus norvegicus
taaggtcacagtgcgagttcccaac

SEQ ID NO: 543582 - DNA, 25 bp, Rattus norvegicus
taaggtcatatcagtaattcataga

SEQ ID NO: 543583 - DNA, 25 bp, Rattus norvegicus
taaggtcatatctgtaattcataga

SEQ ID NO: 543584 - DNA, 25 bp, Rattus norvegicus
taaggtccatcacagctgccaagta

SEQ ID NO: 543585 - DNA, 25 bp, Rattus norvegicus
taaggtccatcagagctgccaagta

SEQ ID NO: 543586 - DNA, 25 bp, Rattus norvegicus
taaggtccatggatacacaggagca

SEQ ID NO: 543587 - DNA, 25 bp, Rattus norvegicus
taaggtccatggttacacaggagca

SEQ ID NO: 543588 - DNA, 25 bp, Rattus norvegicus
taaggtcccaacagtcttacttgtt

SEQ ID NO: 543589 - DNA, 25 bp, Rattus norvegicus
taaggtcccaactgtcttacttgtt

SEQ ID NO: 543590 - DNA, 25 bp, Rattus norvegicus
taaggtccgaggaagcgagcaagat

SEQ ID NO: 543591 - DNA, 25 bp, Rattus norvegicus
taaggtccgaggtagcgagcaagat

SEQ ID NO: 543592 - DNA, 25 bp, Rattus norvegicus
taaggtcctacacggagcagggacc

SEQ ID NO: 543593 - DNA, 25 bp, Rattus norvegicus
taaggtcctacagggagcagggacc

SEQ ID NO: 543594 - DNA, 25 bp, Rattus norvegicus
taaggtcctggtacctgagaaactg

SEQ ID NO: 543595 - DNA, 25 bp, Rattus norvegicus
taaggtcctggttcctgagaaactg

SEQ ID NO: 543596 - DNA, 25 bp, Rattus norvegicus
taaggtcctgtcagaccaacgtgaa

SEQ ID NO: 543597 - DNA, 25 bp, Rattus norvegicus
taaggtcctgtctgaccaacgtgaa

SEQ ID NO: 543598 - DNA, 25 bp, Rattus norvegicus
taaggtcctgtgactataccctcct

SEQ ID NO: 543599 - DNA, 25 bp, Rattus norvegicus
taaggtcctgtgtctataccctcct

SEQ ID NO: 543600 - DNA, 25 bp, Rattus norvegicus
taaggtcctgttaggttcggcttgg

SEQ ID NO: 543601 - DNA, 25 bp, Rattus norvegicus
taaggtcctgtttggttcggcttgg

SEQ ID NO: 543602 - DNA, 25 bp, Rattus norvegicus
taaggtccttacatcattccgccag

SEQ ID NO: 543603 - DNA, 25 bp, Rattus norvegicus
taaggtccttacttcattccgccag

SEQ ID NO: 543604 - DNA, 25 bp, Rattus norvegicus
taaggtccttgtatggttcatcagt

SEQ ID NO: 543605 - DNA, 25 bp, Rattus norvegicus
taaggtccttgtttggttcatcagt

SEQ ID NO: 543606 - DNA, 25 bp, Rattus norvegicus
taaggtcgcagacctctttgttttg

SEQ ID NO: 543607 - DNA, 25 bp, Rattus norvegicus
taaggtcgcagagctctttgttttg

SEQ ID NO: 543608 - DNA, 25 bp, Rattus norvegicus
taaggtcgtcaacgctggctgacac

SEQ ID NO: 543609 - DNA, 25 bp, Rattus norvegicus
taaggtcgtcaaggctggctgacac

SEQ ID NO: 543610 - DNA, 25 bp, Rattus norvegicus
taaggtcgtctgacggtcacgagtc

SEQ ID NO: 543611 - DNA, 25 bp, Rattus norvegicus
taaggtcgtctgtcggtcacgagtc

SEQ ID NO: 543612 - DNA, 25 bp, Rattus norvegicus
taaggtcgttcaacttggcggctcc

SEQ ID NO: 543613 - DNA, 25 bp, Rattus norvegicus
taaggtcgttcatcttggcggctcc

SEQ ID NO: 543614 - DNA, 25 bp, Rattus norvegicus
taaggtctaatcagggtttccctct

SEQ ID NO: 543615 - DNA, 25 bp, Rattus norvegicus
taaggtctaatctgggtttccctct

SEQ ID NO: 543616 - DNA, 25 bp, Rattus norvegicus
taaggtctaggtagctgccaaagct

SEQ ID NO: 543617 - DNA, 25 bp, Rattus norvegicus
taaggtctaggttgctgccaaagct

SEQ ID NO: 543618 - DNA, 25 bp, Rattus norvegicus
taaggtctatccctattcccaattt

SEQ ID NO: 543619 - DNA, 25 bp, Rattus norvegicus
taaggtctatccgtattcccaattt

SEQ ID NO: 543620 - DNA, 25 bp, Rattus norvegicus
taaggtctctatcaacagctgcctc

SEQ ID NO: 543621 - DNA, 25 bp, Rattus norvegicus
taaggtctctatgaacagctgcctc

SEQ ID NO: 543622 - DNA, 25 bp, Rattus norvegicus
taaggtctctgaagccactggacag

SEQ ID NO: 543623 - DNA, 25 bp, Rattus norvegicus
taaggtctctgatgccactggacag

SEQ ID NO: 543624 - DNA, 25 bp, Rattus norvegicus
taaggtctcttccatctggtttagt

SEQ ID NO: 543625 - DNA, 25 bp, Rattus norvegicus
taaggtctcttcgatctggtttagt

SEQ ID NO: 543626 - DNA, 25 bp, Rattus norvegicus
taaggtctggcaaggtaccccgagg

SEQ ID NO: 543627 - DNA, 25 bp, Rattus norvegicus
taaggtctggcatggtaccccgagg

SEQ ID NO: 543628 - DNA, 25 bp, Rattus norvegicus
taaggtctggtgcattctgagctga

SEQ ID NO: 543629 - DNA, 25 bp, Rattus norvegicus
taaggtctggtggattctgagctga

SEQ ID NO: 543630 - DNA, 25 bp, Rattus norvegicus
taaggtctgtgtcacagcctccgtc

SEQ ID NO: 543631 - DNA, 25 bp, Rattus norvegicus
taaggtctgtgtccgtctgttcatt

SEQ ID NO: 543632 - DNA, 25 bp, Rattus norvegicus
taaggtctgtgtctgtgttttgcct

SEQ ID NO: 543633 - DNA, 25 bp, Rattus norvegicus
taaggtctgtgtgacagcctccgtc

SEQ ID NO: 543634 - DNA, 25 bp, Rattus norvegicus
taaggtctgtgtgcgtctgttcatt

SEQ ID NO: 543635 - DNA, 25 bp, Rattus norvegicus
taaggtctgtgtgtgtgttttgcct

SEQ ID NO: 543636 - DNA, 25 bp, Rattus norvegicus
taaggtcttggacacttccccacaa

SEQ ID NO: 543637 - DNA, 25 bp, Rattus norvegicus
taaggtcttggagacttccccacaa

SEQ ID NO: 543638 - DNA, 25 bp, Rattus norvegicus
taaggtgaaggtccctcttcctaca

SEQ ID NO: 543639 - DNA, 25 bp, Rattus norvegicus
taaggtgaaggtgcctcttcctaca

SEQ ID NO: 543640 - DNA, 25 bp, Rattus norvegicus
taaggtgacatcagcatgagttata

SEQ ID NO: 543641 - DNA, 25 bp, Rattus norvegicus
taaggtgacatctgcatgagttata

SEQ ID NO: 543642 - DNA, 25 bp, Rattus norvegicus
taaggtgatataagactccagcaaa

SEQ ID NO: 543643 - DNA, 25 bp, Rattus norvegicus
taaggtgatatatgactccagcaaa

SEQ ID NO: 543644 - DNA, 25 bp, Rattus norvegicus
taaggtgcaactctgtctccctcag

SEQ ID NO: 543645 - DNA, 25 bp, Rattus norvegicus
taaggtgcaactgtgtctccctcag

SEQ ID NO: 543646 - DNA, 25 bp, Rattus norvegicus
taaggtgcaatcctgccgctatagt

SEQ ID NO: 543647 - DNA, 25 bp, Rattus norvegicus
taaggtgcaatcgtgccgctatagt

SEQ ID NO: 543648 - DNA, 25 bp, Rattus norvegicus
taaggtgcacagagcccacagagaa

SEQ ID NO: 543649 - DNA, 25 bp, Rattus norvegicus
taaggtgcacagtgcccacagagaa

SEQ ID NO: 543650 - DNA, 25 bp, Rattus norvegicus
taaggtgcaccaatgggttccccga

SEQ ID NO: 543651 - DNA, 25 bp, Rattus norvegicus
taaggtgcaccattgggttccccga

SEQ ID NO: 543652 - DNA, 25 bp, Rattus norvegicus
taaggtgcatgcatgtaattcctgc

SEQ ID NO: 543653 - DNA, 25 bp, Rattus norvegicus
taaggtgcatgcttgtaattcctgc

SEQ ID NO: 543654 - DNA, 25 bp, Rattus norvegicus
taaggtgccgtgcaacaggttgttc

SEQ ID NO: 543655 - DNA, 25 bp, Rattus norvegicus
taaggtgccgtggaacaggttgttc

SEQ ID NO: 543656 - DNA, 25 bp, Rattus norvegicus
taaggtgcctcgatttttcttgact

SEQ ID NO: 543657 - DNA, 25 bp, Rattus norvegicus
taaggtgcctcgttttttcttgact

SEQ ID NO: 543658 - DNA, 25 bp, Rattus norvegicus
taaggtgcctggagacgactgtccc

SEQ ID NO: 543659 - DNA, 25 bp, Rattus norvegicus
taaggtgcctggtgacgactgtccc

SEQ ID NO: 543660 - DNA, 25 bp, Rattus norvegicus
taaggtgctcaccaactcctggctt

SEQ ID NO: 543661 - DNA, 25 bp, Rattus norvegicus
taaggtgctcacgaactcctggctt

SEQ ID NO: 543662 - DNA, 25 bp, Rattus norvegicus
taaggtgctcatactggctgatgga

SEQ ID NO: 543663 - DNA, 25 bp, Rattus norvegicus
taaggtgctcattctggctgatgga

SEQ ID NO: 543664 - DNA, 25 bp, Rattus norvegicus
taaggtgctgacatgcatgctgatt

SEQ ID NO: 543665 - DNA, 25 bp, Rattus norvegicus
taaggtgctgacttgcatgctgatt

SEQ ID NO: 543666 - DNA, 25 bp, Rattus norvegicus
taaggtgctgcgcattggcctcctg

SEQ ID NO: 543667 - DNA, 25 bp, Rattus norvegicus
taaggtgctgcggattggcctcctg

SEQ ID NO: 543668 - DNA, 25 bp, Rattus norvegicus
taaggtgctgtcatctagcttgaaa

SEQ ID NO: 543669 - DNA, 25 bp, Rattus norvegicus
taaggtgctgtcctcatctgtgtgc

SEQ ID NO: 543670 - DNA, 25 bp, Rattus norvegicus
taaggtgctgtcgtcatctgtgtgc

SEQ ID NO: 543671 - DNA, 25 bp, Rattus norvegicus
taaggtgctgtcttctagcttgaaa

SEQ ID NO: 543672 - DNA, 25 bp, Rattus norvegicus
taaggtggaccgaggcaggctccct

SEQ ID NO: 543673 - DNA, 25 bp, Rattus norvegicus
taaggtggaccgtggcaggctccct

SEQ ID NO: 543674 - DNA, 25 bp, Rattus norvegicus
taaggtggcccgagtctgtatgatg

SEQ ID NO: 543675 - DNA, 25 bp, Rattus norvegicus
taaggtggcccgtgtctgtatgatg

SEQ ID NO: 543676 - DNA, 25 bp, Rattus norvegicus
taaggtggcctacagaatcctccta

SEQ ID NO: 543677 - DNA, 25 bp, Rattus norvegicus
taaggtggcctagagaatcctccta

SEQ ID NO: 543678 - DNA, 25 bp, Rattus norvegicus
taaggtggcctcagcggtccggttt

SEQ ID NO: 543679 - DNA, 25 bp, Rattus norvegicus
taaggtggcctctgcggtccggttt

SEQ ID NO: 543680 - DNA, 25 bp, Rattus norvegicus
taaggtggctaacggtcagctccca

SEQ ID NO: 543681 - DNA, 25 bp, Rattus norvegicus
taaggtggctaagggtcagctccca

SEQ ID NO: 543682 - DNA, 25 bp, Rattus norvegicus
taaggtggctctagccatacagccc

SEQ ID NO: 543683 - DNA, 25 bp, Rattus norvegicus
taaggtggctcttgccatacagccc

SEQ ID NO: 543684 - DNA, 25 bp, Rattus norvegicus
taaggtgggtacagtgtatacctat

SEQ ID NO: 543685 - DNA, 25 bp, Rattus norvegicus
taaggtgggtactgtgtatacctat

SEQ ID NO: 543686 - DNA, 25 bp, Rattus norvegicus
taaggtggtactccctgggacagcc

SEQ ID NO: 543687 - DNA, 25 bp, Rattus norvegicus
taaggtggtactgcctgggacagcc

SEQ ID NO: 543688 - DNA, 25 bp, Rattus norvegicus
taaggtgtacttcacaaccgccggg

SEQ ID NO: 543689 - DNA, 25 bp, Rattus norvegicus
taaggtgtacttgacaaccgccggg

SEQ ID NO: 543690 - DNA, 25 bp, Rattus norvegicus
taaggtgtctctatccattccattt

SEQ ID NO: 543691 - DNA, 25 bp, Rattus norvegicus
taaggtgtctctttccattccattt

SEQ ID NO: 543692 - DNA, 25 bp, Rattus norvegicus
taaggtgtctggaacctcagcatct

SEQ ID NO: 543693 - DNA, 25 bp, Rattus norvegicus
taaggtgtctggtacctcagcatct

SEQ ID NO: 543694 - DNA, 25 bp, Rattus norvegicus
taaggtgtggatagcctgccattcc

SEQ ID NO: 543695 - DNA, 25 bp, Rattus norvegicus
taaggtgtggattgcctgccattcc

SEQ ID NO: 543696 - DNA, 25 bp, Rattus norvegicus
taaggtgtggtcagtccctccgcag

SEQ ID NO: 543697 - DNA, 25 bp, Rattus norvegicus
taaggtgtggtctgtccctccgcag

SEQ ID NO: 543698 - DNA, 25 bp, Rattus norvegicus
taaggtgtgtatatgaagcgccgac

SEQ ID NO: 543699 - DNA, 25 bp, Rattus norvegicus
taaggtgtgtatttgaagcgccgac

SEQ ID NO: 543700 - DNA, 25 bp, Rattus norvegicus
taaggtgttcctcgtaatgaaggca

SEQ ID NO: 543701 - DNA, 25 bp, Rattus norvegicus
taaggtgttcctggtaatgaaggca

SEQ ID NO: 543702 - DNA, 25 bp, Rattus norvegicus
taaggtgttcttcagggtagcataa

SEQ ID NO: 543703 - DNA, 25 bp, Rattus norvegicus
taaggtgttcttcggagccacactt

SEQ ID NO: 543704 - DNA, 25 bp, Rattus norvegicus
taaggtgttcttgagggtagcataa

SEQ ID NO: 543705 - DNA, 25 bp, Rattus norvegicus
taaggtgttcttgggagccacactt

SEQ ID NO: 543706 - DNA, 25 bp, Rattus norvegicus
taaggtgttgggatccatctctaac

SEQ ID NO: 543707 - DNA, 25 bp, Rattus norvegicus
taaggtgttgggttccatctctaac

SEQ ID NO: 543708 - DNA, 25 bp, Rattus norvegicus
taaggttagaatccggcagctgtga

SEQ ID NO: 543709 - DNA, 25 bp, Rattus norvegicus
taaggttagaatgcggcagctgtga

SEQ ID NO: 543710 - DNA, 25 bp, Rattus norvegicus
taaggttcccagaatatgcaaattg

SEQ ID NO: 543711 - DNA, 25 bp, Rattus norvegicus
taaggttcccagtatatgcaaattg

SEQ ID NO: 543712 - DNA, 25 bp, Rattus norvegicus
taaggttcccttagcctcctggaag

SEQ ID NO: 543713 - DNA, 25 bp, Rattus norvegicus
taaggttccctttgcctcctggaag

SEQ ID NO: 543714 - DNA, 25 bp, Rattus norvegicus
taaggttcctcacagtgggccagga

SEQ ID NO: 543715 - DNA, 25 bp, Rattus norvegicus
taaggttcctcaccactcagtgtta

SEQ ID NO: 543716 - DNA, 25 bp, Rattus norvegicus
taaggttcctcagagtgggccagga

SEQ ID NO: 543717 - DNA, 25 bp, Rattus norvegicus
taaggttcctcagcactcagtgtta

SEQ ID NO: 543718 - DNA, 25 bp, Rattus norvegicus
taaggttcctgtcaatgtgttaaga

SEQ ID NO: 543719 - DNA, 25 bp, Rattus norvegicus
taaggttcctgtgaatgtgttaaga

SEQ ID NO: 543720 - DNA, 25 bp, Rattus norvegicus
taaggttctattaatctctgtctct

SEQ ID NO: 543721 - DNA, 25 bp, Rattus norvegicus
taaggttctatttatctctgtctct

SEQ ID NO: 543722 - DNA, 25 bp, Rattus norvegicus
taaggttctccccagcacgtctgga

SEQ ID NO: 543723 - DNA, 25 bp, Rattus norvegicus
taaggttctcccgagcacgtctgga

SEQ ID NO: 543724 - DNA, 25 bp, Rattus norvegicus
taaggttctctcctgcttacattgt

SEQ ID NO: 543725 - DNA, 25 bp, Rattus norvegicus
taaggttctctcgtgcttacattgt

SEQ ID NO: 543726 - DNA, 25 bp, Rattus norvegicus
taaggttctggactcagttgatgaa

SEQ ID NO: 543727 - DNA, 25 bp, Rattus norvegicus
taaggttctggagtcagttgatgaa

SEQ ID NO: 543728 - DNA, 25 bp, Rattus norvegicus
taaggttctgtgcttgacgagtgcc

SEQ ID NO: 543729 - DNA, 25 bp, Rattus norvegicus
taaggttctgtggttgacgagtgcc

SEQ ID NO: 543730 - DNA, 25 bp, Rattus norvegicus
taaggttcttcgctgcaccaagtga

SEQ ID NO: 543731 - DNA, 25 bp, Rattus norvegicus
taaggttcttcggtgcaccaagtga

SEQ ID NO: 543732 - DNA, 25 bp, Rattus norvegicus
taaggttgaactacatacaagtgaa

SEQ ID NO: 543733 - DNA, 25 bp, Rattus norvegicus
taaggttgaacttcatacaagtgaa

SEQ ID NO: 543734 - DNA, 25 bp, Rattus norvegicus
taaggttgaggcctcacggtcattc

SEQ ID NO: 543735 - DNA, 25 bp, Rattus norvegicus
taaggttgaggcgtcacggtcattc

SEQ ID NO: 543736 - DNA, 25 bp, Rattus norvegicus
taaggttgcaccatcactctgaaca

SEQ ID NO: 543737 - DNA, 25 bp, Rattus norvegicus
taaggttgcaccttcactctgaaca

SEQ ID NO: 543738 - DNA, 25 bp, Rattus norvegicus
taaggttgcactcggttcagctcta

SEQ ID NO: 543739 - DNA, 25 bp, Rattus norvegicus
taaggttgcactgggttcagctcta

SEQ ID NO: 543740 - DNA, 25 bp, Rattus norvegicus
taaggttgcatgatctttgcgttta

SEQ ID NO: 543741 - DNA, 25 bp, Rattus norvegicus
taaggttgcatgttctttgcgttta

SEQ ID NO: 543742 - DNA, 25 bp, Rattus norvegicus
taaggttgcctaccaatgggctcaa

SEQ ID NO: 543743 - DNA, 25 bp, Rattus norvegicus
taaggttgcctagcaatgggctcaa

SEQ ID NO: 543744 - DNA, 25 bp, Rattus norvegicus
taaggttgccttatactcttgaaat

SEQ ID NO: 543745 - DNA, 25 bp, Rattus norvegicus
taaggttgccttttactcttgaaat

SEQ ID NO: 543746 - DNA, 25 bp, Rattus norvegicus
taaggttgtaccataaccccagctc

SEQ ID NO: 543747 - DNA, 25 bp, Rattus norvegicus
taaggttgtaccttaaccccagctc

SEQ ID NO: 543748 - DNA, 25 bp, Rattus norvegicus
taaggttgtctcagtgcaaaatggg

SEQ ID NO: 543749 - DNA, 25 bp, Rattus norvegicus
taaggttgtctctgtgcaaaatggg

SEQ ID NO: 543750 - DNA, 25 bp, Rattus norvegicus
taaggttgtgtcattgctgtctgtc

SEQ ID NO: 543751 - DNA, 25 bp, Rattus norvegicus
taaggttgtgtctttgctgtctgtc

SEQ ID NO: 543752 - DNA, 25 bp, Rattus norvegicus
taaggtttactcagttgcccattgg

SEQ ID NO: 543753 - DNA, 25 bp, Rattus norvegicus
taaggtttactctgttgcccattgg

SEQ ID NO: 543754 - DNA, 25 bp, Rattus norvegicus
taaggtttagctcatggctcaccct

SEQ ID NO: 543755 - DNA, 25 bp, Rattus norvegicus
taaggtttagctgatggctcaccct

SEQ ID NO: 543756 - DNA, 25 bp, Rattus norvegicus
taaggtttattcacctggtaacagt

SEQ ID NO: 543757 - DNA, 25 bp, Rattus norvegicus
taaggtttattctcctggtaacagt

SEQ ID NO: 543758 - DNA, 25 bp, Rattus norvegicus
taaggtttccaaattctccacttct

SEQ ID NO: 543759 - DNA, 25 bp, Rattus norvegicus
taaggtttccaatttctccacttct

SEQ ID NO: 543760 - DNA, 25 bp, Rattus norvegicus
taaggtttccttcacggatcttggg

SEQ ID NO: 543761 - DNA, 25 bp, Rattus norvegicus
taaggtttccttgacggatcttggg

SEQ ID NO: 543762 - DNA, 25 bp, Rattus norvegicus
taaggtttgcttacgagtgcctggt

SEQ ID NO: 543763 - DNA, 25 bp, Rattus norvegicus
taaggtttgcttcttgtgcttcatc

SEQ ID NO: 543764 - DNA, 25 bp, Rattus norvegicus
taaggtttgcttgttgtgcttcatc

SEQ ID NO: 543765 - DNA, 25 bp, Rattus norvegicus
taaggtttgctttcgagtgcctggt

SEQ ID NO: 543766 - DNA, 25 bp, Rattus norvegicus
taaggttttattctactgacttcta

SEQ ID NO: 543767 - DNA, 25 bp, Rattus norvegicus
taaggttttattgtactgacttcta

SEQ ID NO: 543768 - DNA, 25 bp, Rattus norvegicus
taaggttttccactcgggatttcat

SEQ ID NO: 543769 - DNA, 25 bp, Rattus norvegicus
taaggttttccagtcgggatttcat

SEQ ID NO: 543770 - DNA, 25 bp, Rattus norvegicus
taaggttttgataacagccacacgg

SEQ ID NO: 543771 - DNA, 25 bp, Rattus norvegicus
taaggttttgattacagccacacgg

SEQ ID NO: 543772 - DNA, 25 bp, Rattus norvegicus
taaggttttgctacacaatcacggt

SEQ ID NO: 543773 - DNA, 25 bp, Rattus norvegicus
taaggttttgcttcacaatcacggt

SEQ ID NO: 543774 - DNA, 25 bp, Rattus norvegicus
taagtaaaccacattatccccgatg

SEQ ID NO: 543775 - DNA, 25 bp, Rattus norvegicus
taagtaaaccactttatccccgatg

SEQ ID NO: 543776 - DNA, 25 bp, Rattus norvegicus
taagtaaagtctctgtcctcatcct

SEQ ID NO: 543777 - DNA, 25 bp, Rattus norvegicus
taagtaaagtctgtgtcctcatcct

SEQ ID NO: 543778 - DNA, 25 bp, Rattus norvegicus
taagtaaagtttctgctcctggcca

SEQ ID NO: 543779 - DNA, 25 bp, Rattus norvegicus
taagtaaagtttgtgctcctggcca

SEQ ID NO: 543780 - DNA, 25 bp, Rattus norvegicus
taagtaaatagaagctttcggtcaa

SEQ ID NO: 543781 - DNA, 25 bp, Rattus norvegicus
taagtaaatagatgctttcggtcaa

SEQ ID NO: 543782 - DNA, 25 bp, Rattus norvegicus
taagtaaatgagaaccccaggtcca

SEQ ID NO: 543783 - DNA, 25 bp, Rattus norvegicus
taagtaaatgagtaccccaggtcca

SEQ ID NO: 543784 - DNA, 25 bp, Rattus norvegicus
taagtaagacacctacatcacaccc

SEQ ID NO: 543785 - DNA, 25 bp, Rattus norvegicus
taagtaagacacgtacatcacaccc

SEQ ID NO: 543786 - DNA, 25 bp, Rattus norvegicus
taagtaagagtccaccctgttttgc

SEQ ID NO: 543787 - DNA, 25 bp, Rattus norvegicus
taagtaagagtcgaccctgttttgc

SEQ ID NO: 543788 - DNA, 25 bp, Rattus norvegicus
taagtaagggtcatgtcagccggcc

SEQ ID NO: 543789 - DNA, 25 bp, Rattus norvegicus
taagtaagggtcttgtcagccggcc

SEQ ID NO: 543790 - DNA, 25 bp, Rattus norvegicus
taagtaattttcaagctgataggct

SEQ ID NO: 543791 - DNA, 25 bp, Rattus norvegicus
taagtaattttctagctgataggct

SEQ ID NO: 543792 - DNA, 25 bp, Rattus norvegicus
taagtacaaacaactcctgccttga

SEQ ID NO: 543793 - DNA, 25 bp, Rattus norvegicus
taagtacaaacatctcctgccttga

SEQ ID NO: 543794 - DNA, 25 bp, Rattus norvegicus
taagtacaagcacagtaacaaccct

SEQ ID NO: 543795 - DNA, 25 bp, Rattus norvegicus
taagtacaagcagagtaacaaccct

SEQ ID NO: 543796 - DNA, 25 bp, Rattus norvegicus
taagtacaagttcagagcctctcct

SEQ ID NO: 543797 - DNA, 25 bp, Rattus norvegicus
taagtacaagttgagagcctctcct

SEQ ID NO: 543798 - DNA, 25 bp, Rattus norvegicus
taagtacaccacaccctcataggag

SEQ ID NO: 543799 - DNA, 25 bp, Rattus norvegicus
taagtacaccactccctcataggag

SEQ ID NO: 543800 - DNA, 25 bp, Rattus norvegicus
taagtacagcctaggcctctgtgta

SEQ ID NO: 543801 - DNA, 25 bp, Rattus norvegicus
taagtacagccttggcctctgtgta

SEQ ID NO: 543802 - DNA, 25 bp, Rattus norvegicus
taagtaccacaacgtgcttgctcac

SEQ ID NO: 543803 - DNA, 25 bp, Rattus norvegicus
taagtaccacaaggtgcttgctcac

SEQ ID NO: 543804 - DNA, 25 bp, Rattus norvegicus
taagtaccactgagccctttctcta

SEQ ID NO: 543805 - DNA, 25 bp, Rattus norvegicus
taagtaccactgtgccctttctcta

SEQ ID NO: 543806 - DNA, 25 bp, Rattus norvegicus
taagtaccagcgctgccctacggaa

SEQ ID NO: 543807 - DNA, 25 bp, Rattus norvegicus
taagtaccagcggtgccctacggaa

SEQ ID NO: 543808 - DNA, 25 bp, Rattus norvegicus
taagtacccaggagccatgtcagcg

SEQ ID NO: 543809 - DNA, 25 bp, Rattus norvegicus
taagtacccaggtgccatgtcagcg

SEQ ID NO: 543810 - DNA, 25 bp, Rattus norvegicus
taagtacccttccaattctctttct

SEQ ID NO: 543811 - DNA, 25 bp, Rattus norvegicus
taagtacccttcgaattctctttct

SEQ ID NO: 543812 - DNA, 25 bp, Rattus norvegicus
taagtactacacaccagtcccgtgt

SEQ ID NO: 543813 - DNA, 25 bp, Rattus norvegicus
taagtactacactccagtcccgtgt

SEQ ID NO: 543814 - DNA, 25 bp, Rattus norvegicus
taagtactactcattttcaataaat

SEQ ID NO: 543815 - DNA, 25 bp, Rattus norvegicus
taagtactactctttttcaataaat

SEQ ID NO: 543816 - DNA, 25 bp, Rattus norvegicus
taagtactcatgaaatgtctgcatc

SEQ ID NO: 543817 - DNA, 25 bp, Rattus norvegicus
taagtactcatgtaatgtctgcatc

SEQ ID NO: 543818 - DNA, 25 bp, Rattus norvegicus
taagtactgagcatgggtcccctgt

SEQ ID NO: 543819 - DNA, 25 bp, Rattus norvegicus
taagtactgagcttgggtcccctgt

SEQ ID NO: 543820 - DNA, 25 bp, Rattus norvegicus
taagtacttcaaaccagcgtcttgg

SEQ ID NO: 543821 - DNA, 25 bp, Rattus norvegicus
taagtacttcaatccagcgtcttgg

SEQ ID NO: 543822 - DNA, 25 bp, Rattus norvegicus
taagtacttggccagtgacactctc

SEQ ID NO: 543823 - DNA, 25 bp, Rattus norvegicus
taagtacttggcgagtgacactctc

SEQ ID NO: 543824 - DNA, 25 bp, Rattus norvegicus
taagtagaccatccagtcgtcctca

SEQ ID NO: 543825 - DNA, 25 bp, Rattus norvegicus
taagtagaccatgcagtcgtcctca

SEQ ID NO: 543826 - DNA, 25 bp, Rattus norvegicus
taagtagaggaacccgctttgagga

SEQ ID NO: 543827 - DNA, 25 bp, Rattus norvegicus
taagtagaggaagccgctttgagga

SEQ ID NO: 543828 - DNA, 25 bp, Rattus norvegicus
taagtagatggacactggcagcttc

SEQ ID NO: 543829 - DNA, 25 bp, Rattus norvegicus
taagtagatggagactggcagcttc

SEQ ID NO: 543830 - DNA, 25 bp, Rattus norvegicus
taagtagatgtaagccctgaggatt

SEQ ID NO: 543831 - DNA, 25 bp, Rattus norvegicus
taagtagatgtatgccctgaggatt

SEQ ID NO: 543832 - DNA, 25 bp, Rattus norvegicus
taagtagcatttactttctaagcat

SEQ ID NO: 543833 - DNA, 25 bp, Rattus norvegicus
taagtagcattttctttctaagcat

SEQ ID NO: 543834 - DNA, 25 bp, Rattus norvegicus
taagtaggaggcaaacccggtctag

SEQ ID NO: 543835 - DNA, 25 bp, Rattus norvegicus
taagtaggaggctaacccggtctag

SEQ ID NO: 543836 - DNA, 25 bp, Rattus norvegicus
taagtaggcagaccctcctcagaga

SEQ ID NO: 543837 - DNA, 25 bp, Rattus norvegicus
taagtaggcagagcctcctcagaga

SEQ ID NO: 543838 - DNA, 25 bp, Rattus norvegicus
taagtagtctgaccctctacaggga

SEQ ID NO: 543839 - DNA, 25 bp, Rattus norvegicus
taagtagtctgagcctctacaggga

SEQ ID NO: 543840 - DNA, 25 bp, Rattus norvegicus
taagtagttcaaagccagcacctgg

SEQ ID NO: 543841 - DNA, 25 bp, Rattus norvegicus
taagtagttcaatgccagcacctgg

SEQ ID NO: 543842 - DNA, 25 bp, Rattus norvegicus
taagtataccctcgtcactctgcta

SEQ ID NO: 543843 - DNA, 25 bp, Rattus norvegicus
taagtataccctggtcactctgcta

SEQ ID NO: 543844 - DNA, 25 bp, Rattus norvegicus
taagtatcatttctatatttgtaaa

SEQ ID NO: 543845 - DNA, 25 bp, Rattus norvegicus
taagtatcatttgtatatttgtaaa

SEQ ID NO: 543846 - DNA, 25 bp, Rattus norvegicus
taagtatccccgagctgactcggag

SEQ ID NO: 543847 - DNA, 25 bp, Rattus norvegicus
taagtatccccgtgctgactcggag

SEQ ID NO: 543848 - DNA, 25 bp, Rattus norvegicus
taagtatcctagctttggaggacca

SEQ ID NO: 543849 - DNA, 25 bp, Rattus norvegicus
taagtatcctaggtttggaggacca

SEQ ID NO: 543850 - DNA, 25 bp, Rattus norvegicus
taagtatctgtcaccgtaatgcaag

SEQ ID NO: 543851 - DNA, 25 bp, Rattus norvegicus
taagtatctgtctccgtaatgcaag

SEQ ID NO: 543852 - DNA, 25 bp, Rattus norvegicus
taagtatctgttaggcacgtgccat

SEQ ID NO: 543853 - DNA, 25 bp, Rattus norvegicus
taagtatctgtttggcacgtgccat

SEQ ID NO: 543854 - DNA, 25 bp, Rattus norvegicus
taagtatgacatctttcctaagtaa

SEQ ID NO: 543855 - DNA, 25 bp, Rattus norvegicus
taagtatgacatgtttcctaagtaa

SEQ ID NO: 543856 - DNA, 25 bp, Rattus norvegicus
taagtatgacttctgcagctgcctc

SEQ ID NO: 543857 - DNA, 25 bp, Rattus norvegicus
taagtatgacttgtgcagctgcctc

SEQ ID NO: 543858 - DNA, 25 bp, Rattus norvegicus
taagtatgcgtgacctttgcttgta

SEQ ID NO: 543859 - DNA, 25 bp, Rattus norvegicus
taagtatgcgtgtcctttgcttgta

SEQ ID NO: 543860 - DNA, 25 bp, Rattus norvegicus
taagtatgtaccatgcatctgcatt

SEQ ID NO: 543861 - DNA, 25 bp, Rattus norvegicus
taagtatgtaccttgcatctgcatt

SEQ ID NO: 543862 - DNA, 25 bp, Rattus norvegicus
taagtattcaagaccccgcccaagc

SEQ ID NO: 543863 - DNA, 25 bp, Rattus norvegicus
taagtattcaagtccccgcccaagc

SEQ ID NO: 543864 - DNA, 25 bp, Rattus norvegicus
taagtattcccactcagccaagtag

SEQ ID NO: 543865 - DNA, 25 bp, Rattus norvegicus
taagtattcccagtcagccaagtag

SEQ ID NO: 543866 - DNA, 25 bp, Rattus norvegicus
taagtattcccgaaccagacagtgg

SEQ ID NO: 543867 - DNA, 25 bp, Rattus norvegicus
taagtattcccgtaccagacagtgg

SEQ ID NO: 543868 - DNA, 25 bp, Rattus norvegicus
taagtattcttcctgcctgggacag

SEQ ID NO: 543869 - DNA, 25 bp, Rattus norvegicus
taagtattcttcgtgcctgggacag

SEQ ID NO: 543870 - DNA, 25 bp, Rattus norvegicus
taagtattgtggagagctgtttcgg

SEQ ID NO: 543871 - DNA, 25 bp, Rattus norvegicus
taagtattgtggtgagctgtttcgg

SEQ ID NO: 543872 - DNA, 25 bp, Rattus norvegicus
taagtatttacgatcctgagaccaa

SEQ ID NO: 543873 - DNA, 25 bp, Rattus norvegicus
taagtatttacgttcctgagaccaa

SEQ ID NO: 543874 - DNA, 25 bp, Rattus norvegicus
taagtatttcttaacctgacttggt

SEQ ID NO: 543875 - DNA, 25 bp, Rattus norvegicus
taagtatttctttacctgacttggt

SEQ ID NO: 543876 - DNA, 25 bp, Rattus norvegicus
taagtcaacattatgcttcagcgtt

SEQ ID NO: 543877 - DNA, 25 bp, Rattus norvegicus
taagtcaacattttgcttcagcgtt

SEQ ID NO: 543878 - DNA, 25 bp, Rattus norvegicus
taagtcaaccccagatggtagttta

SEQ ID NO: 543879 - DNA, 25 bp, Rattus norvegicus
taagtcaacccctgatggtagttta

SEQ ID NO: 543880 - DNA, 25 bp, Rattus norvegicus
taagtcaagtccagggtggtttctt

SEQ ID NO: 543881 - DNA, 25 bp, Rattus norvegicus
taagtcaagtcctgggtggtttctt

SEQ ID NO: 543882 - DNA, 25 bp, Rattus norvegicus
taagtcaatgtgagttgcacctcac

SEQ ID NO: 543883 - DNA, 25 bp, Rattus norvegicus
taagtcaatgtgtgttgcacctcac

SEQ ID NO: 543884 - DNA, 25 bp, Rattus norvegicus
taagtcacattcctgtggcatctgc

SEQ ID NO: 543885 - DNA, 25 bp, Rattus norvegicus
taagtcacattcgtgtggcatctgc

SEQ ID NO: 543886 - DNA, 25 bp, Rattus norvegicus
taagtcacccaaacaagctggacgt

SEQ ID NO: 543887 - DNA, 25 bp, Rattus norvegicus
taagtcacccaatcaagctggacgt

SEQ ID NO: 543888 - DNA, 25 bp, Rattus norvegicus
taagtcaccctgaaggcatcaccat

SEQ ID NO: 543889 - DNA, 25 bp, Rattus norvegicus
taagtcaccctgtaggcatcaccat

SEQ ID NO: 543890 - DNA, 25 bp, Rattus norvegicus
taagtcactccgctgagaaccgagt

SEQ ID NO: 543891 - DNA, 25 bp, Rattus norvegicus
taagtcactccggtgagaaccgagt

SEQ ID NO: 543892 - DNA, 25 bp, Rattus norvegicus
taagtcactgttatgtttacttgtg

SEQ ID NO: 543893 - DNA, 25 bp, Rattus norvegicus
taagtcactgttttgtttacttgtg

SEQ ID NO: 543894 - DNA, 25 bp, Rattus norvegicus
taagtcacttaacttttcctgaaat

SEQ ID NO: 543895 - DNA, 25 bp, Rattus norvegicus
taagtcacttaagttttcctgaaat

SEQ ID NO: 543896 - DNA, 25 bp, Rattus norvegicus
taagtcagacggacgagacacttgt

SEQ ID NO: 543897 - DNA, 25 bp, Rattus norvegicus
taagtcagacggtcgagacacttgt

SEQ ID NO: 543898 - DNA, 25 bp, Rattus norvegicus
taagtcagagccaatttcacctccc

SEQ ID NO: 543899 - DNA, 25 bp, Rattus norvegicus
taagtcagagcctatttcacctccc

SEQ ID NO: 543900 - DNA, 25 bp, Rattus norvegicus
taagtcagagcgacggcatcttcat

SEQ ID NO: 543901 - DNA, 25 bp, Rattus norvegicus
taagtcagagcgtcggcatcttcat

SEQ ID NO: 543902 - DNA, 25 bp, Rattus norvegicus
taagtcagccttaacagtgcagcca

SEQ ID NO: 543903 - DNA, 25 bp, Rattus norvegicus
taagtcagcctttacagtgcagcca

SEQ ID NO: 543904 - DNA, 25 bp, Rattus norvegicus
taagtcagggagaggccagacagct

SEQ ID NO: 543905 - DNA, 25 bp, Rattus norvegicus
taagtcagggagtggccagacagct

SEQ ID NO: 543906 - DNA, 25 bp, Rattus norvegicus
taagtcagtagcaacgggttctttt

SEQ ID NO: 543907 - DNA, 25 bp, Rattus norvegicus
taagtcagtagctacgggttctttt

SEQ ID NO: 543908 - DNA, 25 bp, Rattus norvegicus
taagtcagtcagacttcaaaccaaa

SEQ ID NO: 543909 - DNA, 25 bp, Rattus norvegicus
taagtcagtcagtcttcaaaccaaa

SEQ ID NO: 543910 - DNA, 25 bp, Rattus norvegicus
taagtcagtctgcagctgctttctc

SEQ ID NO: 543911 - DNA, 25 bp, Rattus norvegicus
taagtcagtctggagctgctttctc

SEQ ID NO: 543912 - DNA, 25 bp, Rattus norvegicus
taagtcagtttgactctgtccatct

SEQ ID NO: 543913 - DNA, 25 bp, Rattus norvegicus
taagtcagtttgtctctgtccatct

SEQ ID NO: 543914 - DNA, 25 bp, Rattus norvegicus
taagtcatagatctgggcctggtgt

SEQ ID NO: 543915 - DNA, 25 bp, Rattus norvegicus
taagtcatagatgtgggcctggtgt

SEQ ID NO: 543916 - DNA, 25 bp, Rattus norvegicus
taagtcatcaagcatttggcctgga

SEQ ID NO: 543917 - DNA, 25 bp, Rattus norvegicus
taagtcatcaaggatttggcctgga

SEQ ID NO: 543918 - DNA, 25 bp, Rattus norvegicus
taagtcatcattcttcatcttcagc

SEQ ID NO: 543919 - DNA, 25 bp, Rattus norvegicus
taagtcatcattgttcatcttcagc

SEQ ID NO: 543920 - DNA, 25 bp, Rattus norvegicus
taagtcattatgctccatgccaact

SEQ ID NO: 543921 - DNA, 25 bp, Rattus norvegicus
taagtcattatggtccatgccaact

SEQ ID NO: 543922 - DNA, 25 bp, Rattus norvegicus
taagtcattcacactcaactcacag

SEQ ID NO: 543923 - DNA, 25 bp, Rattus norvegicus
taagtcattcactctcaactcacag

SEQ ID NO: 543924 - DNA, 25 bp, Rattus norvegicus
taagtcattcccactgcgttttgag

SEQ ID NO: 543925 - DNA, 25 bp, Rattus norvegicus
taagtcattccctctgcgttttgag

SEQ ID NO: 543926 - DNA, 25 bp, Rattus norvegicus
taagtcattcttagtctgtctggtc

SEQ ID NO: 543927 - DNA, 25 bp, Rattus norvegicus
taagtcattctttgtctgtctggtc

SEQ ID NO: 543928 - DNA, 25 bp, Rattus norvegicus
taagtccaagaaaggcggcggagaa

SEQ ID NO: 543929 - DNA, 25 bp, Rattus norvegicus
taagtccaagaatggcggcggagaa

SEQ ID NO: 543930 - DNA, 25 bp, Rattus norvegicus
taagtccaagaccactgggccaaac

SEQ ID NO: 543931 - DNA, 25 bp, Rattus norvegicus
taagtccaagacgactgggccaaac

SEQ ID NO: 543932 - DNA, 25 bp, Rattus norvegicus
taagtccagggccttgcagtctagt

SEQ ID NO: 543933 - DNA, 25 bp, Rattus norvegicus
taagtccagggcgttgcagtctagt

SEQ ID NO: 543934 - DNA, 25 bp, Rattus norvegicus
taagtccattaacccaatgtccaaa

SEQ ID NO: 543935 - DNA, 25 bp, Rattus norvegicus
taagtccattaagccaatgtccaaa

SEQ ID NO: 543936 - DNA, 25 bp, Rattus norvegicus
taagtccattggaccttagggaagt

SEQ ID NO: 543937 - DNA, 25 bp, Rattus norvegicus
taagtccattggtccttagggaagt

SEQ ID NO: 543938 - DNA, 25 bp, Rattus norvegicus
taagtcccacagctgcctcctaatt

SEQ ID NO: 543939 - DNA, 25 bp, Rattus norvegicus
taagtcccacaggtgcctcctaatt

SEQ ID NO: 543940 - DNA, 25 bp, Rattus norvegicus
taagtcccagtgctcagacacggag

SEQ ID NO: 543941 - DNA, 25 bp, Rattus norvegicus
taagtcccagtggtcagacacggag

SEQ ID NO: 543942 - DNA, 25 bp, Rattus norvegicus
taagtccccaggctagagagttctg

SEQ ID NO: 543943 - DNA, 25 bp, Rattus norvegicus
taagtccccagggtagagagttctg

SEQ ID NO: 543944 - DNA, 25 bp, Rattus norvegicus
taagtcccctaaaagctcagcactg

SEQ ID NO: 543945 - DNA, 25 bp, Rattus norvegicus
taagtcccctaatagctcagcactg

SEQ ID NO: 543946 - DNA, 25 bp, Rattus norvegicus
taagtcccctcaccatcacaatgat

SEQ ID NO: 543947 - DNA, 25 bp, Rattus norvegicus
taagtcccctcagcatcacaatgat

SEQ ID NO: 543948 - DNA, 25 bp, Rattus norvegicus
taagtcccgatcaaggtagtatact

SEQ ID NO: 543949 - DNA, 25 bp, Rattus norvegicus
taagtcccgatctaggtagtatact

SEQ ID NO: 543950 - DNA, 25 bp, Rattus norvegicus
taagtcccggttccagcgatttcga

SEQ ID NO: 543951 - DNA, 25 bp, Rattus norvegicus
taagtcccggttgcagcgatttcga

SEQ ID NO: 543952 - DNA, 25 bp, Rattus norvegicus
taagtccctcaactccttctaagga

SEQ ID NO: 543953 - DNA, 25 bp, Rattus norvegicus
taagtccctcaagtccttctaagga

SEQ ID NO: 543954 - DNA, 25 bp, Rattus norvegicus
taagtccctgaacaatctgagcctt

SEQ ID NO: 543955 - DNA, 25 bp, Rattus norvegicus
taagtccctgaagaatctgagcctt

SEQ ID NO: 543956 - DNA, 25 bp, Rattus norvegicus
taagtccgcctacggtgagctgcag

SEQ ID NO: 543957 - DNA, 25 bp, Rattus norvegicus
taagtccgcctagggtgagctgcag

SEQ ID NO: 543958 - DNA, 25 bp, Rattus norvegicus
taagtccggcgccggttaagccgct

SEQ ID NO: 543959 - DNA, 25 bp, Rattus norvegicus
taagtccggcgcgggttaagccgct

SEQ ID NO: 543960 - DNA, 25 bp, Rattus norvegicus
taagtccggtgtcatttccttttct

SEQ ID NO: 543961 - DNA, 25 bp, Rattus norvegicus
taagtccggtgtgatttccttttct

SEQ ID NO: 543962 - DNA, 25 bp, Rattus norvegicus
taagtcctagaaactgtaatcccca

SEQ ID NO: 543963 - DNA, 25 bp, Rattus norvegicus
taagtcctagaatctgtaatcccca

SEQ ID NO: 543964 - DNA, 25 bp, Rattus norvegicus
taagtcctccttcaccgaatgtaga

SEQ ID NO: 543965 - DNA, 25 bp, Rattus norvegicus
taagtcctccttgaccgaatgtaga

SEQ ID NO: 543966 - DNA, 25 bp, Rattus norvegicus
taagtcctctcaccttaaagtctgc

SEQ ID NO: 543967 - DNA, 25 bp, Rattus norvegicus
taagtcctctcagcttaaagtctgc

SEQ ID NO: 543968 - DNA, 25 bp, Rattus norvegicus
taagtcctgacacaagccttttcct

SEQ ID NO: 543969 - DNA, 25 bp, Rattus norvegicus
taagtcctgacagaagccttttcct

SEQ ID NO: 543970 - DNA, 25 bp, Rattus norvegicus
taagtcctgacgaacagtcgctcac

SEQ ID NO: 543971 - DNA, 25 bp, Rattus norvegicus
taagtcctgacgtacagtcgctcac

SEQ ID NO: 543972 - DNA, 25 bp, Rattus norvegicus
taagtcctgagcctgtaagtgccac

SEQ ID NO: 543973 - DNA, 25 bp, Rattus norvegicus
taagtcctgagcgtgtaagtgccac

SEQ ID NO: 543974 - DNA, 25 bp, Rattus norvegicus
taagtccttagcaaccagagattgg

SEQ ID NO: 543975 - DNA, 25 bp, Rattus norvegicus
taagtccttagctaccagagattgg

SEQ ID NO: 543976 - DNA, 25 bp, Rattus norvegicus
taagtccttaggattggcccaggtg

SEQ ID NO: 543977 - DNA, 25 bp, Rattus norvegicus
taagtccttaggtttggcccaggtg

SEQ ID NO: 543978 - DNA, 25 bp, Rattus norvegicus
taagtccttagtccagaccgtcagt

SEQ ID NO: 543979 - DNA, 25 bp, Rattus norvegicus
taagtccttagtgcagaccgtcagt

SEQ ID NO: 543980 - DNA, 25 bp, Rattus norvegicus
taagtccttatcactcagacccgat

SEQ ID NO: 543981 - DNA, 25 bp, Rattus norvegicus
taagtccttatctctcagacccgat

SEQ ID NO: 543982 - DNA, 25 bp, Rattus norvegicus
taagtccttctgctcttcaagaggg

SEQ ID NO: 543983 - DNA, 25 bp, Rattus norvegicus
taagtccttctggtcttcaagaggg

SEQ ID NO: 543984 - DNA, 25 bp, Rattus norvegicus
taagtccttcttaattcaggcccct

SEQ ID NO: 543985 - DNA, 25 bp, Rattus norvegicus
taagtccttctttattcaggcccct

SEQ ID NO: 543986 - DNA, 25 bp, Rattus norvegicus
taagtccttgatctccttcccacaa

SEQ ID NO: 543987 - DNA, 25 bp, Rattus norvegicus
taagtccttgatgtccttcccacaa

SEQ ID NO: 543988 - DNA, 25 bp, Rattus norvegicus
taagtcgaagcactctcctatctct

SEQ ID NO: 543989 - DNA, 25 bp, Rattus norvegicus
taagtcgaagcagtctcctatctct

SEQ ID NO: 543990 - DNA, 25 bp, Rattus norvegicus
taagtcgatgggaccgagagcccgc

SEQ ID NO: 543991 - DNA, 25 bp, Rattus norvegicus
taagtcgatgggtccgagagcccgc

SEQ ID NO: 543992 - DNA, 25 bp, Rattus norvegicus
taagtcgcccgtattgttttgagtg

SEQ ID NO: 543993 - DNA, 25 bp, Rattus norvegicus
taagtcgcccgttttgttttgagtg

SEQ ID NO: 543994 - DNA, 25 bp, Rattus norvegicus
taagtcgcgcagatcttagactctc

SEQ ID NO: 543995 - DNA, 25 bp, Rattus norvegicus
taagtcgcgcagttcttagactctc

SEQ ID NO: 543996 - DNA, 25 bp, Rattus norvegicus
taagtcgcggataaccaagcgcctg

SEQ ID NO: 543997 - DNA, 25 bp, Rattus norvegicus
taagtcgcggattaccaagcgcctg

SEQ ID NO: 543998 - DNA, 25 bp, Rattus norvegicus
taagtcggtccacccgtggccagct

SEQ ID NO: 543999 - DNA, 25 bp, Rattus norvegicus
taagtcggtccagccgtggccagct

SEQ ID NO: 544000 - DNA, 25 bp, Rattus norvegicus
taagtcggtctcattattcctttga

SEQ ID NO: 544001 - DNA, 25 bp, Rattus norvegicus
taagtcggtctctttattcctttga

SEQ ID NO: 544002 - DNA, 25 bp, Rattus norvegicus
taagtcggtggtaactttgttgctt

SEQ ID NO: 544003 - DNA, 25 bp, Rattus norvegicus
taagtcggtggttactttgttgctt

SEQ ID NO: 544004 - DNA, 25 bp, Rattus norvegicus
taagtcgtgccaagaaatggtcaga

SEQ ID NO: 544005 - DNA, 25 bp, Rattus norvegicus
taagtcgtgccatgaaatggtcaga

SEQ ID NO: 544006 - DNA, 25 bp, Rattus norvegicus
taagtcgtgcgaccttagtgtacgg

SEQ ID NO: 544007 - DNA, 25 bp, Rattus norvegicus
taagtcgtgcgagcttagtgtacgg

SEQ ID NO: 544008 - DNA, 25 bp, Rattus norvegicus
taagtcgttggacgcctcgtgacca

SEQ ID NO: 544009 - DNA, 25 bp, Rattus norvegicus
taagtcgttggaggcctcgtgacca

SEQ ID NO: 544010 - DNA, 25 bp, Rattus norvegicus
taagtctaaatcaccatcacctttg

SEQ ID NO: 544011 - DNA, 25 bp, Rattus norvegicus
taagtctaaatctccatcacctttg

SEQ ID NO: 544012 - DNA, 25 bp, Rattus norvegicus
taagtctacccacgacactttttag

SEQ ID NO: 544013 - DNA, 25 bp, Rattus norvegicus
taagtctacccaggacactttttag

SEQ ID NO: 544014 - DNA, 25 bp, Rattus norvegicus
taagtctcaggcagccgcctttaaa

SEQ ID NO: 544015 - DNA, 25 bp, Rattus norvegicus
taagtctcaggctgccgcctttaaa

SEQ ID NO: 544016 - DNA, 25 bp, Rattus norvegicus
taagtctcagtaattttgttttcaa

SEQ ID NO: 544017 - DNA, 25 bp, Rattus norvegicus
taagtctcagtatttttgttttcaa

SEQ ID NO: 544018 - DNA, 25 bp, Rattus norvegicus
taagtctcccgtacgtttgtgaaga

SEQ ID NO: 544019 - DNA, 25 bp, Rattus norvegicus
taagtctcccgttcgtttgtgaaga

SEQ ID NO: 544020 - DNA, 25 bp, Rattus norvegicus
taagtctccgctagaacacacattt

SEQ ID NO: 544021 - DNA, 25 bp, Rattus norvegicus
taagtctccgcttgaacacacattt

SEQ ID NO: 544022 - DNA, 25 bp, Rattus norvegicus
taagtctctccaaaacatagtgcaa

SEQ ID NO: 544023 - DNA, 25 bp, Rattus norvegicus
taagtctctccataacatagtgcaa

SEQ ID NO: 544024 - DNA, 25 bp, Rattus norvegicus
taagtctcttctctataccggaatc

SEQ ID NO: 544025 - DNA, 25 bp, Rattus norvegicus
taagtctcttctgtataccggaatc

SEQ ID NO: 544026 - DNA, 25 bp, Rattus norvegicus
taagtctcttttcttttcgccctca

SEQ ID NO: 544027 - DNA, 25 bp, Rattus norvegicus
taagtctcttttgttttcgccctca

SEQ ID NO: 544028 - DNA, 25 bp, Rattus norvegicus
taagtctgaactctttctcaacctc

SEQ ID NO: 544029 - DNA, 25 bp, Rattus norvegicus
taagtctgaactgtttctcaacctc

SEQ ID NO: 544030 - DNA, 25 bp, Rattus norvegicus
taagtctgccagactctgagatcag

SEQ ID NO: 544031 - DNA, 25 bp, Rattus norvegicus
taagtctgccagtctctgagatcag

SEQ ID NO: 544032 - DNA, 25 bp, Rattus norvegicus
taagtctgtcctcttactacttgac

SEQ ID NO: 544033 - DNA, 25 bp, Rattus norvegicus
taagtctgtcctgttactacttgac

SEQ ID NO: 544034 - DNA, 25 bp, Rattus norvegicus
taagtctgtgctctcctgtgggagt

SEQ ID NO: 544035 - DNA, 25 bp, Rattus norvegicus
taagtctgtgctgtcctgtgggagt

SEQ ID NO: 544036 - DNA, 25 bp, Rattus norvegicus
taagtctgtggcacgcattgccaag

SEQ ID NO: 544037 - DNA, 25 bp, Rattus norvegicus
taagtctgtggctcgcattgccaag

SEQ ID NO: 544038 - DNA, 25 bp, Rattus norvegicus
taagtcttcatacccttgctgtcga

SEQ ID NO: 544039 - DNA, 25 bp, Rattus norvegicus
taagtcttcatagccttgctgtcga

SEQ ID NO: 544040 - DNA, 25 bp, Rattus norvegicus
taagtcttgctgatctggcctgtgt

SEQ ID NO: 544041 - DNA, 25 bp, Rattus norvegicus
taagtcttgctgttctggcctgtgt

SEQ ID NO: 544042 - DNA, 25 bp, Rattus norvegicus
taagtgaaacctactcagataaagt

SEQ ID NO: 544043 - DNA, 25 bp, Rattus norvegicus
taagtgaaaccttctcagataaagt

SEQ ID NO: 544044 - DNA, 25 bp, Rattus norvegicus
taagtgaaacttatgtccctgagag

SEQ ID NO: 544045 - DNA, 25 bp, Rattus norvegicus
taagtgaaacttttgtccctgagag

SEQ ID NO: 544046 - DNA, 25 bp, Rattus norvegicus
taagtgaatggaccctaattccttc

SEQ ID NO: 544047 - DNA, 25 bp, Rattus norvegicus
taagtgaatggagcctaattccttc

SEQ ID NO: 544048 - DNA, 25 bp, Rattus norvegicus
taagtgacaaatcctcattggtgca

SEQ ID NO: 544049 - DNA, 25 bp, Rattus norvegicus
taagtgacaaatgctcattggtgca

SEQ ID NO: 544050 - DNA, 25 bp, Rattus norvegicus
taagtgacatcacggaccttccaac

SEQ ID NO: 544051 - DNA, 25 bp, Rattus norvegicus
taagtgacatcagggaccttccaac

SEQ ID NO: 544052 - DNA, 25 bp, Rattus norvegicus
taagtgaccattaacctctatataa

SEQ ID NO: 544053 - DNA, 25 bp, Rattus norvegicus
taagtgaccatttacctctatataa

SEQ ID NO: 544054 - DNA, 25 bp, Rattus norvegicus
taagtgactgtgcacctggtctgca

SEQ ID NO: 544055 - DNA, 25 bp, Rattus norvegicus
taagtgactgtggacctggtctgca

SEQ ID NO: 544056 - DNA, 25 bp, Rattus norvegicus
taagtgacttagagtcctcctggac

SEQ ID NO: 544057 - DNA, 25 bp, Rattus norvegicus
taagtgacttagtgtcctcctggac

SEQ ID NO: 544058 - DNA, 25 bp, Rattus norvegicus
taagtgacttgacttcatgcctgct

SEQ ID NO: 544059 - DNA, 25 bp, Rattus norvegicus
taagtgacttgagttcatgcctgct

SEQ ID NO: 544060 - DNA, 25 bp, Rattus norvegicus
taagtgagccctaggcctcttcata

SEQ ID NO: 544061 - DNA, 25 bp, Rattus norvegicus
taagtgagcccttggcctcttcata

SEQ ID NO: 544062 - DNA, 25 bp, Rattus norvegicus
taagtgagtggcaccttctggtcat

SEQ ID NO: 544063 - DNA, 25 bp, Rattus norvegicus
taagtgagtggctccttctggtcat

SEQ ID NO: 544064 - DNA, 25 bp, Rattus norvegicus
taagtgatcacccttacctgtggct

SEQ ID NO: 544065 - DNA, 25 bp, Rattus norvegicus
taagtgatcaccgttacctgtggct

SEQ ID NO: 544066 - DNA, 25 bp, Rattus norvegicus
taagtgatcgctcttgctaccatcc

SEQ ID NO: 544067 - DNA, 25 bp, Rattus norvegicus
taagtgatcgctgttgctaccatcc

SEQ ID NO: 544068 - DNA, 25 bp, Rattus norvegicus
taagtgattagaccctgccacacag

SEQ ID NO: 544069 - DNA, 25 bp, Rattus norvegicus
taagtgattagagcctgccacacag

SEQ ID NO: 544070 - DNA, 25 bp, Rattus norvegicus
taagtgattggacgactctcagact

SEQ ID NO: 544071 - DNA, 25 bp, Rattus norvegicus
taagtgattggaggactctcagact

SEQ ID NO: 544072 - DNA, 25 bp, Rattus norvegicus
taagtgcaatgacccgagtcctcca

SEQ ID NO: 544073 - DNA, 25 bp, Rattus norvegicus
taagtgcaatgagccgagtcctcca

SEQ ID NO: 544074 - DNA, 25 bp, Rattus norvegicus
taagtgcaccataggaacggctccc

SEQ ID NO: 544075 - DNA, 25 bp, Rattus norvegicus
taagtgcaccattggaacggctccc

SEQ ID NO: 544076 - DNA, 25 bp, Rattus norvegicus
taagtgcactacacagcaattctat

SEQ ID NO: 544077 - DNA, 25 bp, Rattus norvegicus
taagtgcactactcagcaattctat

SEQ ID NO: 544078 - DNA, 25 bp, Rattus norvegicus
taagtgcaggaccttccagaacctt

SEQ ID NO: 544079 - DNA, 25 bp, Rattus norvegicus
taagtgcaggacgttccagaacctt

SEQ ID NO: 544080 - DNA, 25 bp, Rattus norvegicus
taagtgcatagtactgcctcacagt

SEQ ID NO: 544081 - DNA, 25 bp, Rattus norvegicus
taagtgcatagttctgcctcacagt

SEQ ID NO: 544082 - DNA, 25 bp, Rattus norvegicus
taagtgcatgccatctgttcacaag

SEQ ID NO: 544083 - DNA, 25 bp, Rattus norvegicus
taagtgcatgccttctgttcacaag

SEQ ID NO: 544084 - DNA, 25 bp, Rattus norvegicus
taagtgcccaagacattcactacac

SEQ ID NO: 544085 - DNA, 25 bp, Rattus norvegicus
taagtgcccaagtcattcactacac

SEQ ID NO: 544086 - DNA, 25 bp, Rattus norvegicus
taagtgcccagtatttatttctagt

SEQ ID NO: 544087 - DNA, 25 bp, Rattus norvegicus
taagtgcccagtttttatttctagt

SEQ ID NO: 544088 - DNA, 25 bp, Rattus norvegicus
taagtgccccaactgtactccacaa

SEQ ID NO: 544089 - DNA, 25 bp, Rattus norvegicus
taagtgccccaagtgtactccacaa

SEQ ID NO: 544090 - DNA, 25 bp, Rattus norvegicus
taagtgcccttaccttctgagccat

SEQ ID NO: 544091 - DNA, 25 bp, Rattus norvegicus
taagtgcccttagcttctgagccat

SEQ ID NO: 544092 - DNA, 25 bp, Rattus norvegicus
taagtgccgatgaaccgaggcccag

SEQ ID NO: 544093 - DNA, 25 bp, Rattus norvegicus
taagtgccgatgtaccgaggcccag

SEQ ID NO: 544094 - DNA, 25 bp, Rattus norvegicus
taagtgcctcctactggcagcaagc

SEQ ID NO: 544095 - DNA, 25 bp, Rattus norvegicus
taagtgcctccttctggcagcaagc

SEQ ID NO: 544096 - DNA, 25 bp, Rattus norvegicus
taagtgcctggcagatgaagtgttc

SEQ ID NO: 544097 - DNA, 25 bp, Rattus norvegicus
taagtgcctggctgatgaagtgttc

SEQ ID NO: 544098 - DNA, 25 bp, Rattus norvegicus
taagtgcctgttatgtacaaagaca

SEQ ID NO: 544099 - DNA, 25 bp, Rattus norvegicus
taagtgcctgttttgtacaaagaca

SEQ ID NO: 544100 - DNA, 25 bp, Rattus norvegicus
taagtgccttagacatggcctccct

SEQ ID NO: 544101 - DNA, 25 bp, Rattus norvegicus
taagtgccttagtcatggcctccct

SEQ ID NO: 544102 - DNA, 25 bp, Rattus norvegicus
taagtgcctttgctcgctctcggaa

SEQ ID NO: 544103 - DNA, 25 bp, Rattus norvegicus
taagtgcctttggtcgctctcggaa

SEQ ID NO: 544104 - DNA, 25 bp, Rattus norvegicus
taagtgcgaggcatgctctcatcat

SEQ ID NO: 544105 - DNA, 25 bp, Rattus norvegicus
taagtgcgaggcttgctctcatcat

SEQ ID NO: 544106 - DNA, 25 bp, Rattus norvegicus
taagtgcgatggatcctgcagtgcc

SEQ ID NO: 544107 - DNA, 25 bp, Rattus norvegicus
taagtgcgatggttcctgcagtgcc

SEQ ID NO: 544108 - DNA, 25 bp, Rattus norvegicus
taagtgctatgccatcttccatggt

SEQ ID NO: 544109 - DNA, 25 bp, Rattus norvegicus
taagtgctatgcgatcttccatggt

SEQ ID NO: 544110 - DNA, 25 bp, Rattus norvegicus
taagtgctcccaaccaatttatgaa

SEQ ID NO: 544111 - DNA, 25 bp, Rattus norvegicus
taagtgctcccatccaatttatgaa

SEQ ID NO: 544112 - DNA, 25 bp, Rattus norvegicus
taagtgctctgccatagcctcatgt

SEQ ID NO: 544113 - DNA, 25 bp, Rattus norvegicus
taagtgctctgcgatagcctcatgt

SEQ ID NO: 544114 - DNA, 25 bp, Rattus norvegicus
taagtgctcttcagtatccatgggc

SEQ ID NO: 544115 - DNA, 25 bp, Rattus norvegicus
taagtgctcttctgtatccatgggc

SEQ ID NO: 544116 - DNA, 25 bp, Rattus norvegicus
taagtgctgcgtatttgttctttcc

SEQ ID NO: 544117 - DNA, 25 bp, Rattus norvegicus
taagtgctgcgtttttgttctttcc

SEQ ID NO: 544118 - DNA, 25 bp, Rattus norvegicus
taagtgctgcttactgttcttgctg

SEQ ID NO: 544119 - DNA, 25 bp, Rattus norvegicus
taagtgctgctttctgttcttgctg

SEQ ID NO: 544120 - DNA, 25 bp, Rattus norvegicus
taagtgctgtgaagagccggctccc

SEQ ID NO: 544121 - DNA, 25 bp, Rattus norvegicus
taagtgctgtgatgagccggctccc

SEQ ID NO: 544122 - DNA, 25 bp, Rattus norvegicus
taagtgcttcagagtctctgggaat

SEQ ID NO: 544123 - DNA, 25 bp, Rattus norvegicus
taagtgcttcagtgtctctgggaat

SEQ ID NO: 544124 - DNA, 25 bp, Rattus norvegicus
taagtgcttcatctggactcatcgc

SEQ ID NO: 544125 - DNA, 25 bp, Rattus norvegicus
taagtgcttcatgtggactcatcgc

SEQ ID NO: 544126 - DNA, 25 bp, Rattus norvegicus
taagtgcttccgctacaaacagtcc

SEQ ID NO: 544127 - DNA, 25 bp, Rattus norvegicus
taagtgcttccggtacaaacagtcc

SEQ ID NO: 544128 - DNA, 25 bp, Rattus norvegicus
taagtgcttctgcttgtctttcttc

SEQ ID NO: 544129 - DNA, 25 bp, Rattus norvegicus
taagtgcttctggttgtctttcttc

SEQ ID NO: 544130 - DNA, 25 bp, Rattus norvegicus
taagtggacaaacaccctggtgacc

SEQ ID NO: 544131 - DNA, 25 bp, Rattus norvegicus
taagtggacaaagaccctggtgacc

SEQ ID NO: 544132 - DNA, 25 bp, Rattus norvegicus
taagtggacaggaccctcatgggtt

SEQ ID NO: 544133 - DNA, 25 bp, Rattus norvegicus
taagtggacaggtccctcatgggtt

SEQ ID NO: 544134 - DNA, 25 bp, Rattus norvegicus
taagtggactggaagcacccctgtc

SEQ ID NO: 544135 - DNA, 25 bp, Rattus norvegicus
taagtggactggtagcacccctgtc

SEQ ID NO: 544136 - DNA, 25 bp, Rattus norvegicus
taagtggcatagctgaagcagtcag

SEQ ID NO: 544137 - DNA, 25 bp, Rattus norvegicus
taagtggcataggtgaagcagtcag

SEQ ID NO: 544138 - DNA, 25 bp, Rattus norvegicus
taagtggcctaacagccagcacctt

SEQ ID NO: 544139 - DNA, 25 bp, Rattus norvegicus
taagtggcctaagagccagcacctt

SEQ ID NO: 544140 - DNA, 25 bp, Rattus norvegicus
taagtgggagctatttgtataaact

SEQ ID NO: 544141 - DNA, 25 bp, Rattus norvegicus
taagtgggagctttttgtataaact

SEQ ID NO: 544142 - DNA, 25 bp, Rattus norvegicus
taagtgggatggcttctggcattct

SEQ ID NO: 544143 - DNA, 25 bp, Rattus norvegicus
taagtgggatgggttctggcattct

SEQ ID NO: 544144 - DNA, 25 bp, Rattus norvegicus
taagtgggcacgctagtgcatgcct

SEQ ID NO: 544145 - DNA, 25 bp, Rattus norvegicus
taagtgggcacggtagtgcatgcct

SEQ ID NO: 544146 - DNA, 25 bp, Rattus norvegicus
taagtgggccacatcttggtgtgat

SEQ ID NO: 544147 - DNA, 25 bp, Rattus norvegicus
taagtgggccacttcttggtgtgat

SEQ ID NO: 544148 - DNA, 25 bp, Rattus norvegicus
taagtgggcctcattacaagtgttt

SEQ ID NO: 544149 - DNA, 25 bp, Rattus norvegicus
taagtgggcctctttacaagtgttt

SEQ ID NO: 544150 - DNA, 25 bp, Rattus norvegicus
taagtggtccagattggcctagtaa

SEQ ID NO: 544151 - DNA, 25 bp, Rattus norvegicus
taagtggtccagtttggcctagtaa

SEQ ID NO: 544152 - DNA, 25 bp, Rattus norvegicus
taagtggtgtacaacccagggcctg

SEQ ID NO: 544153 - DNA, 25 bp, Rattus norvegicus
taagtggtgtactacccagggcctg

SEQ ID NO: 544154 - DNA, 25 bp, Rattus norvegicus
taagtgtaatggcttccctttgctg

SEQ ID NO: 544155 - DNA, 25 bp, Rattus norvegicus
taagtgtaatgggttccctttgctg

SEQ ID NO: 544156 - DNA, 25 bp, Rattus norvegicus
taagtgtaccacagacctgtagctc

SEQ ID NO: 544157 - DNA, 25 bp, Rattus norvegicus
taagtgtaccactgacctgtagctc

SEQ ID NO: 544158 - DNA, 25 bp, Rattus norvegicus
taagtgtacgtcattccgtgtgtgt

SEQ ID NO: 544159 - DNA, 25 bp, Rattus norvegicus
taagtgtacgtctttccgtgtgtgt

SEQ ID NO: 544160 - DNA, 25 bp, Rattus norvegicus
taagtgtccaccacacaggttgtgc

SEQ ID NO: 544161 - DNA, 25 bp, Rattus norvegicus
taagtgtccacctcacaggttgtgc

SEQ ID NO: 544162 - DNA, 25 bp, Rattus norvegicus
taagtgtccactctccgccatttaa

SEQ ID NO: 544163 - DNA, 25 bp, Rattus norvegicus
taagtgtccactgtccgccatttaa

SEQ ID NO: 544164 - DNA, 25 bp, Rattus norvegicus
taagtgtccagaacatcagctcagg

SEQ ID NO: 544165 - DNA, 25 bp, Rattus norvegicus
taagtgtccagatcatcagctcagg

SEQ ID NO: 544166 - DNA, 25 bp, Rattus norvegicus
taagtgtcccttatgtcaagagtca

SEQ ID NO: 544167 - DNA, 25 bp, Rattus norvegicus
taagtgtcccttttgtcaagagtca

SEQ ID NO: 544168 - DNA, 25 bp, Rattus norvegicus
taagtgtcctaccttccccagaaca

SEQ ID NO: 544169 - DNA, 25 bp, Rattus norvegicus
taagtgtcctacgttccccagaaca

SEQ ID NO: 544170 - DNA, 25 bp, Rattus norvegicus
taagtgtcctctaccttcatggcaa

SEQ ID NO: 544171 - DNA, 25 bp, Rattus norvegicus
taagtgtcctcttccttcatggcaa

SEQ ID NO: 544172 - DNA, 25 bp, Rattus norvegicus
taagtgtcgtggactccgtactgcc

SEQ ID NO: 544173 - DNA, 25 bp, Rattus norvegicus
taagtgtcgtggtctccgtactgcc

SEQ ID NO: 544174 - DNA, 25 bp, Rattus norvegicus
taagtgtcttcaacttttcagccca

SEQ ID NO: 544175 - DNA, 25 bp, Rattus norvegicus
taagtgtcttcatcttttcagccca

SEQ ID NO: 544176 - DNA, 25 bp, Rattus norvegicus
taagtgtgaaatactccttccccgg

SEQ ID NO: 544177 - DNA, 25 bp, Rattus norvegicus
taagtgtgaaattctccttccccgg

SEQ ID NO: 544178 - DNA, 25 bp, Rattus norvegicus
taagtgtgacctagattgttcacac

SEQ ID NO: 544179 - DNA, 25 bp, Rattus norvegicus
taagtgtgaccttgattgttcacac

SEQ ID NO: 544180 - DNA, 25 bp, Rattus norvegicus
taagtgtgccaaattgtaacatatt

SEQ ID NO: 544181 - DNA, 25 bp, Rattus norvegicus
taagtgtgccaatttgtaacatatt

SEQ ID NO: 544182 - DNA, 25 bp, Rattus norvegicus
taagtgtggctcaacttcccagaag

SEQ ID NO: 544183 - DNA, 25 bp, Rattus norvegicus
taagtgtggctctacttcccagaag

SEQ ID NO: 544184 - DNA, 25 bp, Rattus norvegicus
taagtgtggtggatcctggcacaaa

SEQ ID NO: 544185 - DNA, 25 bp, Rattus norvegicus
taagtgtggtggttcctggcacaaa

SEQ ID NO: 544186 - DNA, 25 bp, Rattus norvegicus
taagtgtgtctcctgtgagcgtgac

SEQ ID NO: 544187 - DNA, 25 bp, Rattus norvegicus
taagtgtgtctcgtgtgagcgtgac

SEQ ID NO: 544188 - DNA, 25 bp, Rattus norvegicus
taagtgttaggacccttgtgtcagc

SEQ ID NO: 544189 - DNA, 25 bp, Rattus norvegicus
taagtgttaggagccttgtgtcagc

SEQ ID NO: 544190 - DNA, 25 bp, Rattus norvegicus
taagtgttaggccatttcttttagg

SEQ ID NO: 544191 - DNA, 25 bp, Rattus norvegicus
taagtgttaggcgatttcttttagg

SEQ ID NO: 544192 - DNA, 25 bp, Rattus norvegicus
taagtgttcggtattgcttctttgt

SEQ ID NO: 544193 - DNA, 25 bp, Rattus norvegicus
taagtgttcggttttgcttctttgt

SEQ ID NO: 544194 - DNA, 25 bp, Rattus norvegicus
taagtgttctgcatgccttgtttca

SEQ ID NO: 544195 - DNA, 25 bp, Rattus norvegicus
taagtgttctgcttgccttgtttca

SEQ ID NO: 544196 - DNA, 25 bp, Rattus norvegicus
taagtgttctgtcacctgttgctag

SEQ ID NO: 544197 - DNA, 25 bp, Rattus norvegicus
taagtgttctgtctctttgcacctg

SEQ ID NO: 544198 - DNA, 25 bp, Rattus norvegicus
taagtgttctgtgacctgttgctag

SEQ ID NO: 544199 - DNA, 25 bp, Rattus norvegicus
taagtgttctgtgtctttgcacctg

SEQ ID NO: 544200 - DNA, 25 bp, Rattus norvegicus
taagtgttgactacctaattcccct

SEQ ID NO: 544201 - DNA, 25 bp, Rattus norvegicus
taagtgttgacttcctaattcccct

SEQ ID NO: 544202 - DNA, 25 bp, Rattus norvegicus
taagtgttgctcactgtggcatttc

SEQ ID NO: 544203 - DNA, 25 bp, Rattus norvegicus
taagtgttgctctctgtggcatttc

SEQ ID NO: 544204 - DNA, 25 bp, Rattus norvegicus
taagtgttgtttctagacctctcct

SEQ ID NO: 544205 - DNA, 25 bp, Rattus norvegicus
taagtgttgtttgtagacctctcct

SEQ ID NO: 544206 - DNA, 25 bp, Rattus norvegicus
taagtgtttcctactaggcttccca

SEQ ID NO: 544207 - DNA, 25 bp, Rattus norvegicus
taagtgtttccttctaggcttccca

SEQ ID NO: 544208 - DNA, 25 bp, Rattus norvegicus
taagtgtttgtgacagggcagtaca

SEQ ID NO: 544209 - DNA, 25 bp, Rattus norvegicus
taagtgtttgtgtcagggcagtaca

SEQ ID NO: 544210 - DNA, 25 bp, Rattus norvegicus
taagttacataacctcttcaccaag

SEQ ID NO: 544211 - DNA, 25 bp, Rattus norvegicus
taagttacataagctcttcaccaag

SEQ ID NO: 544212 - DNA, 25 bp, Rattus norvegicus
taagttaccaagatccggacctcat

SEQ ID NO: 544213 - DNA, 25 bp, Rattus norvegicus
taagttaccaagttccggacctcat

SEQ ID NO: 544214 - DNA, 25 bp, Rattus norvegicus
taagttacctggatacttgccccag

SEQ ID NO: 544215 - DNA, 25 bp, Rattus norvegicus
taagttacctggttacttgccccag

SEQ ID NO: 544216 - DNA, 25 bp, Rattus norvegicus
taagttaccttgacgtgcttcagcc

SEQ ID NO: 544217 - DNA, 25 bp, Rattus norvegicus
taagttaccttgtcgtgcttcagcc

SEQ ID NO: 544218 - DNA, 25 bp, Rattus norvegicus
taagttatcaacacacgctgtgaac

SEQ ID NO: 544219 - DNA, 25 bp, Rattus norvegicus
taagttatcaactcacgctgtgaac

SEQ ID NO: 544220 - DNA, 25 bp, Rattus norvegicus
taagttatctgtcaccaatggccct

SEQ ID NO: 544221 - DNA, 25 bp, Rattus norvegicus
taagttatctgtgaccaatggccct

SEQ ID NO: 544222 - DNA, 25 bp, Rattus norvegicus
taagttatcttcatacctgcaaaat

SEQ ID NO: 544223 - DNA, 25 bp, Rattus norvegicus
taagttatcttcttacctgcaaaat

SEQ ID NO: 544224 - DNA, 25 bp, Rattus norvegicus
taagttatggaccttgggaagaatc

SEQ ID NO: 544225 - DNA, 25 bp, Rattus norvegicus
taagttatggacgttgggaagaatc

SEQ ID NO: 544226 - DNA, 25 bp, Rattus norvegicus
taagttattaccacctctcctgttt

SEQ ID NO: 544227 - DNA, 25 bp, Rattus norvegicus
taagttattacctcctctcctgttt

SEQ ID NO: 544228 - DNA, 25 bp, Rattus norvegicus
taagttattctaccgagacgttccg

SEQ ID NO: 544229 - DNA, 25 bp, Rattus norvegicus
taagttattctagcgagacgttccg

SEQ ID NO: 544230 - DNA, 25 bp, Rattus norvegicus
taagttattgctctcccctgctgtg

SEQ ID NO: 544231 - DNA, 25 bp, Rattus norvegicus
taagttattgctgtcccctgctgtg

SEQ ID NO: 544232 - DNA, 25 bp, Rattus norvegicus
taagttcacataattctctcatatt

SEQ ID NO: 544233 - DNA, 25 bp, Rattus norvegicus
taagttcacatatttctctcatatt

SEQ ID NO: 544234 - DNA, 25 bp, Rattus norvegicus
taagttcaccatacctacagagcct

SEQ ID NO: 544235 - DNA, 25 bp, Rattus norvegicus
taagttcaccattcctacagagcct

SEQ ID NO: 544236 - DNA, 25 bp, Rattus norvegicus
taagttcataagagcccagagtcac

SEQ ID NO: 544237 - DNA, 25 bp, Rattus norvegicus
taagttcataagtgcccagagtcac

SEQ ID NO: 544238 - DNA, 25 bp, Rattus norvegicus
taagttcatgctcccaggcccagga

SEQ ID NO: 544239 - DNA, 25 bp, Rattus norvegicus
taagttcatgctgccaggcccagga

SEQ ID NO: 544240 - DNA, 25 bp, Rattus norvegicus
taagttcatggtattgctctcaagt

SEQ ID NO: 544241 - DNA, 25 bp, Rattus norvegicus
taagttcatggttttgctctcaagt

SEQ ID NO: 544242 - DNA, 25 bp, Rattus norvegicus
taagttcattccaagttactcagag

SEQ ID NO: 544243 - DNA, 25 bp, Rattus norvegicus
taagttcattcctagttactcagag

SEQ ID NO: 544244 - DNA, 25 bp, Rattus norvegicus
taagttccaaggcatcgttcccagt

SEQ ID NO: 544245 - DNA, 25 bp, Rattus norvegicus
taagttccaagggatcgttcccagt

SEQ ID NO: 544246 - DNA, 25 bp, Rattus norvegicus
taagttccaggccaccctttatagc

SEQ ID NO: 544247 - DNA, 25 bp, Rattus norvegicus
taagttccaggcgaccctttatagc

SEQ ID NO: 544248 - DNA, 25 bp, Rattus norvegicus
taagttcccattataacccctgtct

SEQ ID NO: 544249 - DNA, 25 bp, Rattus norvegicus
taagttcccattttaacccctgtct

SEQ ID NO: 544250 - DNA, 25 bp, Rattus norvegicus
taagttcccctgagcatgcatgtgt

SEQ ID NO: 544251 - DNA, 25 bp, Rattus norvegicus
taagttcccctgtgcatgcatgtgt

SEQ ID NO: 544252 - DNA, 25 bp, Rattus norvegicus
taagttcccgtgcaggttggtacca

SEQ ID NO: 544253 - DNA, 25 bp, Rattus norvegicus
taagttcccgtggaggttggtacca

SEQ ID NO: 544254 - DNA, 25 bp, Rattus norvegicus
taagttccgaataatctcagctggg

SEQ ID NO: 544255 - DNA, 25 bp, Rattus norvegicus
taagttccgaattatctcagctggg

SEQ ID NO: 544256 - DNA, 25 bp, Rattus norvegicus
taagttccgtctatgaaactgacaa

SEQ ID NO: 544257 - DNA, 25 bp, Rattus norvegicus
taagttccgtctttgaaactgacaa

SEQ ID NO: 544258 - DNA, 25 bp, Rattus norvegicus
taagttcctcaaccgtaatgcctac

SEQ ID NO: 544259 - DNA, 25 bp, Rattus norvegicus
taagttcctcaagcgtaatgcctac

SEQ ID NO: 544260 - DNA, 25 bp, Rattus norvegicus
taagttccttctatatgtgggccca

SEQ ID NO: 544261 - DNA, 25 bp, Rattus norvegicus
taagttccttctttatgtgggccca

SEQ ID NO: 544262 - DNA, 25 bp, Rattus norvegicus
taagttcgcgtcagagttttttcct

SEQ ID NO: 544263 - DNA, 25 bp, Rattus norvegicus
taagttcgcgtctgagttttttcct

SEQ ID NO: 544264 - DNA, 25 bp, Rattus norvegicus
taagttctaagacagacagcgctac

SEQ ID NO: 544265 - DNA, 25 bp, Rattus norvegicus
taagttctaagagagacagcgctac

SEQ ID NO: 544266 - DNA, 25 bp, Rattus norvegicus
taagttctacttaggtccagtgaaa

SEQ ID NO: 544267 - DNA, 25 bp, Rattus norvegicus
taagttctactttggtccagtgaaa

SEQ ID NO: 544268 - DNA, 25 bp, Rattus norvegicus
taagttctcagaagttggtcctaag

SEQ ID NO: 544269 - DNA, 25 bp, Rattus norvegicus
taagttctcagatgttggtcctaag

SEQ ID NO: 544270 - DNA, 25 bp, Rattus norvegicus
taagttctcaggagctgtctggtcc

SEQ ID NO: 544271 - DNA, 25 bp, Rattus norvegicus
taagttctcaggtgctgtctggtcc

SEQ ID NO: 544272 - DNA, 25 bp, Rattus norvegicus
taagttctcagtctctttactctct

SEQ ID NO: 544273 - DNA, 25 bp, Rattus norvegicus
taagttctcagtgtctttactctct

SEQ ID NO: 544274 - DNA, 25 bp, Rattus norvegicus
taagttctcctaaactgttggtgga

SEQ ID NO: 544275 - DNA, 25 bp, Rattus norvegicus
taagttctcctatactgttggtgga

SEQ ID NO: 544276 - DNA, 25 bp, Rattus norvegicus
taagttctccttatactcctgtcat

SEQ ID NO: 544277 - DNA, 25 bp, Rattus norvegicus
taagttctccttttactcctgtcat

SEQ ID NO: 544278 - DNA, 25 bp, Rattus norvegicus
taagttctctcgaccttcaagacct

SEQ ID NO: 544279 - DNA, 25 bp, Rattus norvegicus
taagttctctcgtccttcaagacct

SEQ ID NO: 544280 - DNA, 25 bp, Rattus norvegicus
taagttctgccaagtggctgctcac

SEQ ID NO: 544281 - DNA, 25 bp, Rattus norvegicus
taagttctgccatgtggctgctcac

SEQ ID NO: 544282 - DNA, 25 bp, Rattus norvegicus
taagttctggccaccagggtcttgc

SEQ ID NO: 544283 - DNA, 25 bp, Rattus norvegicus
taagttctggcctccagggtcttgc

SEQ ID NO: 544284 - DNA, 25 bp, Rattus norvegicus
taagttcttatccttacttccctca

SEQ ID NO: 544285 - DNA, 25 bp, Rattus norvegicus
taagttcttatcgttacttccctca

SEQ ID NO: 544286 - DNA, 25 bp, Rattus norvegicus
taagttcttgacattcttcttaaag

SEQ ID NO: 544287 - DNA, 25 bp, Rattus norvegicus
taagttcttgactttcttcttaaag

SEQ ID NO: 544288 - DNA, 25 bp, Rattus norvegicus
taagttcttgggatgggatcaacta

SEQ ID NO: 544289 - DNA, 25 bp, Rattus norvegicus
taagttcttgggttgggatcaacta

SEQ ID NO: 544290 - DNA, 25 bp, Rattus norvegicus
taagttcttgtccagagtgtcccat

SEQ ID NO: 544291 - DNA, 25 bp, Rattus norvegicus
taagttcttgtccttaggcacccaa

SEQ ID NO: 544292 - DNA, 25 bp, Rattus norvegicus
taagttcttgtcgagagtgtcccat

SEQ ID NO: 544293 - DNA, 25 bp, Rattus norvegicus
taagttcttgtcgttaggcacccaa

SEQ ID NO: 544294 - DNA, 25 bp, Rattus norvegicus
taagttctttctctttcctattctc

SEQ ID NO: 544295 - DNA, 25 bp, Rattus norvegicus
taagttctttctgtttcctattctc

SEQ ID NO: 544296 - DNA, 25 bp, Rattus norvegicus
taagttgatttaagcgcggcccggc

SEQ ID NO: 544297 - DNA, 25 bp, Rattus norvegicus
taagttgatttatgcgcggcccggc

SEQ ID NO: 544298 - DNA, 25 bp, Rattus norvegicus
taagttgcaaaccggggttcactgt

SEQ ID NO: 544299 - DNA, 25 bp, Rattus norvegicus
taagttgcaaacgggggttcactgt

SEQ ID NO: 544300 - DNA, 25 bp, Rattus norvegicus
taagttgcacttactgatgaaaggt

SEQ ID NO: 544301 - DNA, 25 bp, Rattus norvegicus
taagttgcactttctgatgaaaggt

SEQ ID NO: 544302 - DNA, 25 bp, Rattus norvegicus
taagttgccctccatgtccagagac

SEQ ID NO: 544303 - DNA, 25 bp, Rattus norvegicus
taagttgccctcgatgtccagagac

SEQ ID NO: 544304 - DNA, 25 bp, Rattus norvegicus
taagttggctgacagcttccgtatt

SEQ ID NO: 544305 - DNA, 25 bp, Rattus norvegicus
taagttggctgagagcttccgtatt

SEQ ID NO: 544306 - DNA, 25 bp, Rattus norvegicus
taagttggtagactctctgctccag

SEQ ID NO: 544307 - DNA, 25 bp, Rattus norvegicus
taagttggtagagtctctgctccag

SEQ ID NO: 544308 - DNA, 25 bp, Rattus norvegicus
taagttggtgacagttggagctatc

SEQ ID NO: 544309 - DNA, 25 bp, Rattus norvegicus
taagttggtgactgttggagctatc

SEQ ID NO: 544310 - DNA, 25 bp, Rattus norvegicus
taagttgtcattattcacgtctctg

SEQ ID NO: 544311 - DNA, 25 bp, Rattus norvegicus
taagttgtcatttttcacgtctctg

SEQ ID NO: 544312 - DNA, 25 bp, Rattus norvegicus
taagttgtccagctgctcggctcct

SEQ ID NO: 544313 - DNA, 25 bp, Rattus norvegicus
taagttgtccaggtgctcggctcct

SEQ ID NO: 544314 - DNA, 25 bp, Rattus norvegicus
taagttgtctctagtacttcagtga

SEQ ID NO: 544315 - DNA, 25 bp, Rattus norvegicus
taagttgtctcttgtacttcagtga

SEQ ID NO: 544316 - DNA, 25 bp, Rattus norvegicus
taagttgtctgtaccttctgtgact

SEQ ID NO: 544317 - DNA, 25 bp, Rattus norvegicus
taagttgtctgttccttctgtgact

SEQ ID NO: 544318 - DNA, 25 bp, Rattus norvegicus
taagttgtctttaacgggaccagct

SEQ ID NO: 544319 - DNA, 25 bp, Rattus norvegicus
taagttgtcttttacgggaccagct

SEQ ID NO: 544320 - DNA, 25 bp, Rattus norvegicus
taagttgttctcagatttccataca

SEQ ID NO: 544321 - DNA, 25 bp, Rattus norvegicus
taagttgttctctgatttccataca

SEQ ID NO: 544322 - DNA, 25 bp, Rattus norvegicus
taagttgttctgaggcactcccaaa

SEQ ID NO: 544323 - DNA, 25 bp, Rattus norvegicus
taagttgttctgtggcactcccaaa

SEQ ID NO: 544324 - DNA, 25 bp, Rattus norvegicus
taagttgtttgccatccctgatcta

SEQ ID NO: 544325 - DNA, 25 bp, Rattus norvegicus
taagttgtttgcgatccctgatcta

SEQ ID NO: 544326 - DNA, 25 bp, Rattus norvegicus
taagtttacactaggcaagcaggag

SEQ ID NO: 544327 - DNA, 25 bp, Rattus norvegicus
taagtttacacttggcaagcaggag

SEQ ID NO: 544328 - DNA, 25 bp, Rattus norvegicus
taagtttactgcactagtctttttt

SEQ ID NO: 544329 - DNA, 25 bp, Rattus norvegicus
taagtttactgctctagtctttttt

SEQ ID NO: 544330 - DNA, 25 bp, Rattus norvegicus
taagtttacttgaggaccgagtctt

SEQ ID NO: 544331 - DNA, 25 bp, Rattus norvegicus
taagtttacttgtggaccgagtctt

SEQ ID NO: 544332 - DNA, 25 bp, Rattus norvegicus
taagtttactttctctcactctgtg

SEQ ID NO: 544333 - DNA, 25 bp, Rattus norvegicus
taagtttactttgtctcactctgtg

SEQ ID NO: 544334 - DNA, 25 bp, Rattus norvegicus
taagtttagcatccagaggcagagg

SEQ ID NO: 544335 - DNA, 25 bp, Rattus norvegicus
taagtttagcatgcagaggcagagg

SEQ ID NO: 544336 - DNA, 25 bp, Rattus norvegicus
taagtttagccaccttctcaaacca

SEQ ID NO: 544337 - DNA, 25 bp, Rattus norvegicus
taagtttagccagcttctcaaacca

SEQ ID NO: 544338 - DNA, 25 bp, Rattus norvegicus
taagtttagtctcgttccagctgaa

SEQ ID NO: 544339 - DNA, 25 bp, Rattus norvegicus
taagtttagtctggttccagctgaa

SEQ ID NO: 544340 - DNA, 25 bp, Rattus norvegicus
taagtttcaattacggtgcctaaga

SEQ ID NO: 544341 - DNA, 25 bp, Rattus norvegicus
taagtttcaatttcggtgcctaaga

SEQ ID NO: 544342 - DNA, 25 bp, Rattus norvegicus
taagtttcccatctttttgtcagta

SEQ ID NO: 544343 - DNA, 25 bp, Rattus norvegicus
taagtttcccatgtttttgtcagta

SEQ ID NO: 544344 - DNA, 25 bp, Rattus norvegicus
taagtttccctaacaatggaatcag

SEQ ID NO: 544345 - DNA, 25 bp, Rattus norvegicus
taagtttccctatcaatggaatcag

SEQ ID NO: 544346 - DNA, 25 bp, Rattus norvegicus
taagtttcctacacctggaggttgc

SEQ ID NO: 544347 - DNA, 25 bp, Rattus norvegicus
taagtttcctactcctggaggttgc

SEQ ID NO: 544348 - DNA, 25 bp, Rattus norvegicus
taagtttgagtcaccagaggtggct

SEQ ID NO: 544349 - DNA, 25 bp, Rattus norvegicus
taagtttgagtctccagaggtggct

SEQ ID NO: 544350 - DNA, 25 bp, Rattus norvegicus
taagtttgcactacagcacagaagg

SEQ ID NO: 544351 - DNA, 25 bp, Rattus norvegicus
taagtttgcacttcagcacagaagg

SEQ ID NO: 544352 - DNA, 25 bp, Rattus norvegicus
taagtttgccatattagctcagtag

SEQ ID NO: 544353 - DNA, 25 bp, Rattus norvegicus
taagtttgccattttagctcagtag

SEQ ID NO: 544354 - DNA, 25 bp, Rattus norvegicus
taagtttgccgaacacgtcttccgc

SEQ ID NO: 544355 - DNA, 25 bp, Rattus norvegicus
taagtttgccgatcacgtcttccgc

SEQ ID NO: 544356 - DNA, 25 bp, Rattus norvegicus
taagtttgcctgatttttcctccag

SEQ ID NO: 544357 - DNA, 25 bp, Rattus norvegicus
taagtttgcctgttttttcctccag

SEQ ID NO: 544358 - DNA, 25 bp, Rattus norvegicus
taagtttggccacggatgcttccag

SEQ ID NO: 544359 - DNA, 25 bp, Rattus norvegicus
taagtttggccagggatgcttccag

SEQ ID NO: 544360 - DNA, 25 bp, Rattus norvegicus
taagtttggcgtcgctgaaccaaga

SEQ ID NO: 544361 - DNA, 25 bp, Rattus norvegicus
taagtttggcgtggctgaaccaaga

SEQ ID NO: 544362 - DNA, 25 bp, Rattus norvegicus
taagtttggtctatccaccttcagt

SEQ ID NO: 544363 - DNA, 25 bp, Rattus norvegicus
taagtttggtctttccaccttcagt

SEQ ID NO: 544364 - DNA, 25 bp, Rattus norvegicus
taagtttgtcttaggtgtggaggca

SEQ ID NO: 544365 - DNA, 25 bp, Rattus norvegicus
taagtttgtctttggtgtggaggca

SEQ ID NO: 544366 - DNA, 25 bp, Rattus norvegicus
taagtttgttccacatgcattcatg

SEQ ID NO: 544367 - DNA, 25 bp, Rattus norvegicus
taagtttgttcctcatgcattcatg

SEQ ID NO: 544368 - DNA, 25 bp, Rattus norvegicus
taagtttgttgcagtcaaggttttt

SEQ ID NO: 544369 - DNA, 25 bp, Rattus norvegicus
taagtttgttgctgtcaaggttttt

SEQ ID NO: 544370 - DNA, 25 bp, Rattus norvegicus
taagttttacagatcagctccccag

SEQ ID NO: 544371 - DNA, 25 bp, Rattus norvegicus
taagttttacagttcagctccccag

SEQ ID NO: 544372 - DNA, 25 bp, Rattus norvegicus
taagttttatttccgtgtcagcagt

SEQ ID NO: 544373 - DNA, 25 bp, Rattus norvegicus
taagttttatttgcgtgtcagcagt

SEQ ID NO: 544374 - DNA, 25 bp, Rattus norvegicus
taagttttcaagatcatggctttat

SEQ ID NO: 544375 - DNA, 25 bp, Rattus norvegicus
taagttttcaagttcatggctttat

SEQ ID NO: 544376 - DNA, 25 bp, Rattus norvegicus
taagttttcactattcactcctttg

SEQ ID NO: 544377 - DNA, 25 bp, Rattus norvegicus
taagttttcacttttcactcctttg

SEQ ID NO: 544378 - DNA, 25 bp, Rattus norvegicus
taagttttccacacaacacgcagct

SEQ ID NO: 544379 - DNA, 25 bp, Rattus norvegicus
taagttttccactcaacacgcagct

SEQ ID NO: 544380 - DNA, 25 bp, Rattus norvegicus
taagttttcccactgtcttgttcaa

SEQ ID NO: 544381 - DNA, 25 bp, Rattus norvegicus
taagttttcccagtgtcttgttcaa

SEQ ID NO: 544382 - DNA, 25 bp, Rattus norvegicus
taagttttcttcataacccatttgg

SEQ ID NO: 544383 - DNA, 25 bp, Rattus norvegicus
taagttttcttcttaacccatttgg

SEQ ID NO: 544384 - DNA, 25 bp, Rattus norvegicus
taagttttgatgaccccaaggctct

SEQ ID NO: 544385 - DNA, 25 bp, Rattus norvegicus
taagttttgatgtccccaaggctct

SEQ ID NO: 544386 - DNA, 25 bp, Rattus norvegicus
taagttttgtcacagcgagctgcct

SEQ ID NO: 544387 - DNA, 25 bp, Rattus norvegicus
taagttttgtcagagcgagctgcct

SEQ ID NO: 544388 - DNA, 25 bp, Rattus norvegicus
taagtttttattacctgtcgctctg

SEQ ID NO: 544389 - DNA, 25 bp, Rattus norvegicus
taagtttttatttcctgtcgctctg

SEQ ID NO: 544390 - DNA, 25 bp, Rattus norvegicus
taagtttttcttccctttcatgctt

SEQ ID NO: 544391 - DNA, 25 bp, Rattus norvegicus
taagtttttcttgcctttcatgctt

SEQ ID NO: 544392 - DNA, 25 bp, Rattus norvegicus
taataaaagctcagtgtctcgctgt

SEQ ID NO: 544393 - DNA, 25 bp, Rattus norvegicus
taataaaagctctgtgtctcgctgt

SEQ ID NO: 544394 - DNA, 25 bp, Rattus norvegicus
taataaacatcaccctctcgtcatc

SEQ ID NO: 544395 - DNA, 25 bp, Rattus norvegicus
taataaacatcagcctctcgtcatc

SEQ ID NO: 544396 - DNA, 25 bp, Rattus norvegicus
taataaaccgccaagacttctcatc

SEQ ID NO: 544397 - DNA, 25 bp, Rattus norvegicus
taataaaccgcctagacttctcatc

SEQ ID NO: 544398 - DNA, 25 bp, Rattus norvegicus
taataaactcctacatatccctcaa

SEQ ID NO: 544399 - DNA, 25 bp, Rattus norvegicus
taataaactccttcatatccctcaa

SEQ ID NO: 544400 - DNA, 25 bp, Rattus norvegicus
taataaactgttcttgtgcccgggc

SEQ ID NO: 544401 - DNA, 25 bp, Rattus norvegicus
taataaactgttgttgtgcccgggc

SEQ ID NO: 544402 - DNA, 25 bp, Rattus norvegicus
taataaagcatgatccctacctgtc

SEQ ID NO: 544403 - DNA, 25 bp, Rattus norvegicus
taataaagcatgttccctacctgtc

SEQ ID NO: 544404 - DNA, 25 bp, Rattus norvegicus
taataaatctttatgcctaagaact

SEQ ID NO: 544405 - DNA, 25 bp, Rattus norvegicus
taataaatctttttgcctaagaact

SEQ ID NO: 544406 - DNA, 25 bp, Rattus norvegicus
taataaatggctatacctcgcctca

SEQ ID NO: 544407 - DNA, 25 bp, Rattus norvegicus
taataaatggctttacctcgcctca

SEQ ID NO: 544408 - DNA, 25 bp, Rattus norvegicus
taataacagcagcacccctcatttt

SEQ ID NO: 544409 - DNA, 25 bp, Rattus norvegicus
taataacagcaggacccctcatttt

SEQ ID NO: 544410 - DNA, 25 bp, Rattus norvegicus
taataacagggcaggctaggaccat

SEQ ID NO: 544411 - DNA, 25 bp, Rattus norvegicus
taataacagggctggctaggaccat

SEQ ID NO: 544412 - DNA, 25 bp, Rattus norvegicus
taataacatctgcatagcccctctg

SEQ ID NO: 544413 - DNA, 25 bp, Rattus norvegicus
taataacatctggatagcccctctg

SEQ ID NO: 544414 - DNA, 25 bp, Rattus norvegicus
taataaccacctcttactccaactt

SEQ ID NO: 544415 - DNA, 25 bp, Rattus norvegicus
taataaccacctgttactccaactt

SEQ ID NO: 544416 - DNA, 25 bp, Rattus norvegicus
taataaccatgcagtttcctgctgt

SEQ ID NO: 544417 - DNA, 25 bp, Rattus norvegicus
taataaccatgctgtttcctgctgt

SEQ ID NO: 544418 - DNA, 25 bp, Rattus norvegicus
taataacccaagctaggttcctcct

SEQ ID NO: 544419 - DNA, 25 bp, Rattus norvegicus
taataacccaaggtaggttcctcct

SEQ ID NO: 544420 - DNA, 25 bp, Rattus norvegicus
taataaccgccgattcctttctgct

SEQ ID NO: 544421 - DNA, 25 bp, Rattus norvegicus
taataaccgccgtttcctttctgct

SEQ ID NO: 544422 - DNA, 25 bp, Rattus norvegicus
taataacctaagatcccttccttca

SEQ ID NO: 544423 - DNA, 25 bp, Rattus norvegicus
taataacctaagttcccttccttca

SEQ ID NO: 544424 - DNA, 25 bp, Rattus norvegicus
taataacctaccacacagatgtgtg

SEQ ID NO: 544425 - DNA, 25 bp, Rattus norvegicus
taataacctacctcacagatgtgtg

SEQ ID NO: 544426 - DNA, 25 bp, Rattus norvegicus
taataacctgtgagctctggagaca

SEQ ID NO: 544427 - DNA, 25 bp, Rattus norvegicus
taataacctgtgtgctctggagaca

SEQ ID NO: 544428 - DNA, 25 bp, Rattus norvegicus
taataactagtccttaacctgaagt

SEQ ID NO: 544429 - DNA, 25 bp, Rattus norvegicus
taataactagtcgttaacctgaagt

SEQ ID NO: 544430 - DNA, 25 bp, Rattus norvegicus
taataactatgtcgccgtctcctag

SEQ ID NO: 544431 - DNA, 25 bp, Rattus norvegicus
taataactatgtggccgtctcctag

SEQ ID NO: 544432 - DNA, 25 bp, Rattus norvegicus
taataactgtcaaaagggcctcttt

SEQ ID NO: 544433 - DNA, 25 bp, Rattus norvegicus
taataactgtcataagggcctcttt

SEQ ID NO: 544434 - DNA, 25 bp, Rattus norvegicus
taataactgtctcttcttcagctag

SEQ ID NO: 544435 - DNA, 25 bp, Rattus norvegicus
taataactgtctgttcttcagctag

SEQ ID NO: 544436 - DNA, 25 bp, Rattus norvegicus
taataacttccccaggttcagagag

SEQ ID NO: 544437 - DNA, 25 bp, Rattus norvegicus
taataacttcccgaggttcagagag

SEQ ID NO: 544438 - DNA, 25 bp, Rattus norvegicus
taataagaatctctccgccagctcc

SEQ ID NO: 544439 - DNA, 25 bp, Rattus norvegicus
taataagaatctgtccgccagctcc

SEQ ID NO: 544440 - DNA, 25 bp, Rattus norvegicus
taataagacatcagctgcctgctgc

SEQ ID NO: 544441 - DNA, 25 bp, Rattus norvegicus
taataagacatctgctgcctgctgc

SEQ ID NO: 544442 - DNA, 25 bp, Rattus norvegicus
taataagactgccttctccctctat

SEQ ID NO: 544443 - DNA, 25 bp, Rattus norvegicus
taataagactgcgttctccctctat

SEQ ID NO: 544444 - DNA, 25 bp, Rattus norvegicus
taataagcagtcatgtgacgtttat

SEQ ID NO: 544445 - DNA, 25 bp, Rattus norvegicus
taataagcagtcttgtgacgtttat

SEQ ID NO: 544446 - DNA, 25 bp, Rattus norvegicus
taataagccgtgcaagtttaaagac

SEQ ID NO: 544447 - DNA, 25 bp, Rattus norvegicus
taataagccgtggaagtttaaagac

SEQ ID NO: 544448 - DNA, 25 bp, Rattus norvegicus
taataagcgctgagtgcgtcttctc

SEQ ID NO: 544449 - DNA, 25 bp, Rattus norvegicus
taataagcgctgtgtgcgtcttctc

SEQ ID NO: 544450 - DNA, 25 bp, Rattus norvegicus
taataagcgtgcatttccctgaccg

SEQ ID NO: 544451 - DNA, 25 bp, Rattus norvegicus
taataagcgtgcttttccctgaccg

SEQ ID NO: 544452 - DNA, 25 bp, Rattus norvegicus
taataaggcgctcccacttaatgct

SEQ ID NO: 544453 - DNA, 25 bp, Rattus norvegicus
taataaggcgctgccacttaatgct

SEQ ID NO: 544454 - DNA, 25 bp, Rattus norvegicus
taataagggtccacccacagtacct

SEQ ID NO: 544455 - DNA, 25 bp, Rattus norvegicus
taataagggtcctcccacagtacct

SEQ ID NO: 544456 - DNA, 25 bp, Rattus norvegicus
taataatagcccatccatctggcag

SEQ ID NO: 544457 - DNA, 25 bp, Rattus norvegicus
taataatagcccttccatctggcag

SEQ ID NO: 544458 - DNA, 25 bp, Rattus norvegicus
taataatcaacacagctcgctaggc

SEQ ID NO: 544459 - DNA, 25 bp, Rattus norvegicus
taataatcaacagagctcgctaggc

SEQ ID NO: 544460 - DNA, 25 bp, Rattus norvegicus
taataatcagtaagcccagggtaag

SEQ ID NO: 544461 - DNA, 25 bp, Rattus norvegicus
taataatcagtatgcccagggtaag

SEQ ID NO: 544462 - DNA, 25 bp, Rattus norvegicus
taataatcccagactgcaagccgat

SEQ ID NO: 544463 - DNA, 25 bp, Rattus norvegicus
taataatcccagtctgcaagccgat

SEQ ID NO: 544464 - DNA, 25 bp, Rattus norvegicus
taataatctgccactgatgggttcg

SEQ ID NO: 544465 - DNA, 25 bp, Rattus norvegicus
taataatctgcctctgatgggttcg

SEQ ID NO: 544466 - DNA, 25 bp, Rattus norvegicus
taataatcttgcactcagggctggc

SEQ ID NO: 544467 - DNA, 25 bp, Rattus norvegicus
taataatcttgctctcagggctggc

SEQ ID NO: 544468 - DNA, 25 bp, Rattus norvegicus
taataatgactcaaatggcccgtcc

SEQ ID NO: 544469 - DNA, 25 bp, Rattus norvegicus
taataatgactctaatggcccgtcc

SEQ ID NO: 544470 - DNA, 25 bp, Rattus norvegicus
taataatgagtcaaggaatgcccct

SEQ ID NO: 544471 - DNA, 25 bp, Rattus norvegicus
taataatgagtctaggaatgcccct

SEQ ID NO: 544472 - DNA, 25 bp, Rattus norvegicus
taataatgccagacagcaccgacac

SEQ ID NO: 544473 - DNA, 25 bp, Rattus norvegicus
taataatgccagtcagcaccgacac

SEQ ID NO: 544474 - DNA, 25 bp, Rattus norvegicus
taataatggcagagctttccagagc

SEQ ID NO: 544475 - DNA, 25 bp, Rattus norvegicus
taataatggcagtgctttccagagc

SEQ ID NO: 544476 - DNA, 25 bp, Rattus norvegicus
taataatgtcgtatctcctttccat

SEQ ID NO: 544477 - DNA, 25 bp, Rattus norvegicus
taataatgtcgtttctcctttccat

SEQ ID NO: 544478 - DNA, 25 bp, Rattus norvegicus
taataatgtcttagctacccaaggg

SEQ ID NO: 544479 - DNA, 25 bp, Rattus norvegicus
taataatgtctttgctacccaaggg

SEQ ID NO: 544480 - DNA, 25 bp, Rattus norvegicus
taataattattgatactccactaat

SEQ ID NO: 544481 - DNA, 25 bp, Rattus norvegicus
taataattattgttactccactaat

SEQ ID NO: 544482 - DNA, 25 bp, Rattus norvegicus
taataattcaagatcccgctgggcc

SEQ ID NO: 544483 - DNA, 25 bp, Rattus norvegicus
taataattcaagttcccgctgggcc

SEQ ID NO: 544484 - DNA, 25 bp, Rattus norvegicus
taataattggaacatcctgcccctc

SEQ ID NO: 544485 - DNA, 25 bp, Rattus norvegicus
taataattggaagatcctgcccctc

SEQ ID NO: 544486 - DNA, 25 bp, Rattus norvegicus
taatacaacattaccctgtcatgcc

SEQ ID NO: 544487 - DNA, 25 bp, Rattus norvegicus
taatacaacatttccctgtcatgcc

SEQ ID NO: 544488 - DNA, 25 bp, Rattus norvegicus
taatacaatatgctaacccactgag

SEQ ID NO: 544489 - DNA, 25 bp, Rattus norvegicus
taatacaatatggtaacccactgag

SEQ ID NO: 544490 - DNA, 25 bp, Rattus norvegicus
taatacacaccaaatttcctccgaa

SEQ ID NO: 544491 - DNA, 25 bp, Rattus norvegicus
taatacacaccatatttcctccgaa

SEQ ID NO: 544492 - DNA, 25 bp, Rattus norvegicus
taatacacctacatcctatctttgg

SEQ ID NO: 544493 - DNA, 25 bp, Rattus norvegicus
taatacacctacttcctatctttgg

SEQ ID NO: 544494 - DNA, 25 bp, Rattus norvegicus
taatacactctgcaccctttctttg

SEQ ID NO: 544495 - DNA, 25 bp, Rattus norvegicus
taatacactctggaccctttctttg

SEQ ID NO: 544496 - DNA, 25 bp, Rattus norvegicus
taatacagagccacactgtccagca

SEQ ID NO: 544497 - DNA, 25 bp, Rattus norvegicus
taatacagagcctcactgtccagca

SEQ ID NO: 544498 - DNA, 25 bp, Rattus norvegicus
taatacagcatcatatcagccatag

SEQ ID NO: 544499 - DNA, 25 bp, Rattus norvegicus
taatacagcatcttatcagccatag

SEQ ID NO: 544500 - DNA, 25 bp, Rattus norvegicus
taatacatacatcaagccttcccat

SEQ ID NO: 544501 - DNA, 25 bp, Rattus norvegicus
taatacatacatgaagccttcccat

SEQ ID NO: 544502 - DNA, 25 bp, Rattus norvegicus
taatacatagtcatcctcctgggtg

SEQ ID NO: 544503 - DNA, 25 bp, Rattus norvegicus
taatacatagtcttcctcctgggtg

SEQ ID NO: 544504 - DNA, 25 bp, Rattus norvegicus
taatacatgtgcacaacccagtctt

SEQ ID NO: 544505 - DNA, 25 bp, Rattus norvegicus
taatacatgtgctcaacccagtctt

SEQ ID NO: 544506 - DNA, 25 bp, Rattus norvegicus
taatacattactattcctcgtcacg

SEQ ID NO: 544507 - DNA, 25 bp, Rattus norvegicus
taatacattacttttcctcgtcacg

SEQ ID NO: 544508 - DNA, 25 bp, Rattus norvegicus
taataccagacgagagggcttgcct

SEQ ID NO: 544509 - DNA, 25 bp, Rattus norvegicus
taataccagacgtgagggcttgcct

SEQ ID NO: 544510 - DNA, 25 bp, Rattus norvegicus
taataccagggtaactccgggcctg

SEQ ID NO: 544511 - DNA, 25 bp, Rattus norvegicus
taataccagggttactccgggcctg

SEQ ID NO: 544512 - DNA, 25 bp, Rattus norvegicus
taatacccacatcttgagcctgagg

SEQ ID NO: 544513 - DNA, 25 bp, Rattus norvegicus
taatacccacatgttgagcctgagg

SEQ ID NO: 544514 - DNA, 25 bp, Rattus norvegicus
taataccctgttccttcaaagtgtc

SEQ ID NO: 544515 - DNA, 25 bp, Rattus norvegicus
taataccctgttgcttcaaagtgtc

SEQ ID NO: 544516 - DNA, 25 bp, Rattus norvegicus
taataccgataaaaccccacataca

SEQ ID NO: 544517 - DNA, 25 bp, Rattus norvegicus
taataccgataataccccacataca

SEQ ID NO: 544518 - DNA, 25 bp, Rattus norvegicus
taataccgcccacttttaggataca

SEQ ID NO: 544519 - DNA, 25 bp, Rattus norvegicus
taataccgcccagttttaggataca

SEQ ID NO: 544520 - DNA, 25 bp, Rattus norvegicus
taataccgctttccctttctgaata

SEQ ID NO: 544521 - DNA, 25 bp, Rattus norvegicus
taataccgctttgcctttctgaata

SEQ ID NO: 544522 - DNA, 25 bp, Rattus norvegicus
taataccggtttagacataggaaca

SEQ ID NO: 544523 - DNA, 25 bp, Rattus norvegicus
taataccggttttgacataggaaca

SEQ ID NO: 544524 - DNA, 25 bp, Rattus norvegicus
taatacctaactagccaagttccgg

SEQ ID NO: 544525 - DNA, 25 bp, Rattus norvegicus
taatacctaacttgccaagttccgg

SEQ ID NO: 544526 - DNA, 25 bp, Rattus norvegicus
taatacctacacatagcacccaaga

SEQ ID NO: 544527 - DNA, 25 bp, Rattus norvegicus
taatacctacacttagcacccaaga

SEQ ID NO: 544528 - DNA, 25 bp, Rattus norvegicus
taatacctatgtccggagcttcagt

SEQ ID NO: 544529 - DNA, 25 bp, Rattus norvegicus
taatacctatgtgcggagcttcagt

SEQ ID NO: 544530 - DNA, 25 bp, Rattus norvegicus
taatacctccccaaatagagcatcc

SEQ ID NO: 544531 - DNA, 25 bp, Rattus norvegicus
taatacctcccctaatagagcatcc

SEQ ID NO: 544532 - DNA, 25 bp, Rattus norvegicus
taatacctccctaagaaatctgttg

SEQ ID NO: 544533 - DNA, 25 bp, Rattus norvegicus
taatacctcccttagaaatctgttg

SEQ ID NO: 544534 - DNA, 25 bp, Rattus norvegicus
taatacctgcacctttttcttccta

SEQ ID NO: 544535 - DNA, 25 bp, Rattus norvegicus
taatacctgcacgtttttcttccta

SEQ ID NO: 544536 - DNA, 25 bp, Rattus norvegicus
taatacctgcttcgagtttctttgg

SEQ ID NO: 544537 - DNA, 25 bp, Rattus norvegicus
taatacctgcttggagtttctttgg

SEQ ID NO: 544538 - DNA, 25 bp, Rattus norvegicus
taatacctgtgcaggcagggcaact

SEQ ID NO: 544539 - DNA, 25 bp, Rattus norvegicus
taatacctgtgctggcagggcaact

SEQ ID NO: 544540 - DNA, 25 bp, Rattus norvegicus
taataccttatcctgagtcttcctc

SEQ ID NO: 544541 - DNA, 25 bp, Rattus norvegicus
taataccttatcgtgagtcttcctc

SEQ ID NO: 544542 - DNA, 25 bp, Rattus norvegicus
taataccttcaaatttatagccttt

SEQ ID NO: 544543 - DNA, 25 bp, Rattus norvegicus
taataccttcaattttatagccttt

SEQ ID NO: 544544 - DNA, 25 bp, Rattus norvegicus
taataccttgtgctctgttccagaa

SEQ ID NO: 544545 - DNA, 25 bp, Rattus norvegicus
taataccttgtggtctgttccagaa

SEQ ID NO: 544546 - DNA, 25 bp, Rattus norvegicus
taatacctttatctggcagccacta

SEQ ID NO: 544547 - DNA, 25 bp, Rattus norvegicus
taatacctttatgtggcagccacta

SEQ ID NO: 544548 - DNA, 25 bp, Rattus norvegicus
taatacggatttaacttggcaaagg

SEQ ID NO: 544549 - DNA, 25 bp, Rattus norvegicus
taatacggattttacttggcaaagg

SEQ ID NO: 544550 - DNA, 25 bp, Rattus norvegicus
taatacggcttgaactcatgctctg

SEQ ID NO: 544551 - DNA, 25 bp, Rattus norvegicus
taatacggcttgtactcatgctctg

SEQ ID NO: 544552 - DNA, 25 bp, Rattus norvegicus
taatacgtatttctctttgccactc

SEQ ID NO: 544553 - DNA, 25 bp, Rattus norvegicus
taatacgtatttgtctttgccactc

SEQ ID NO: 544554 - DNA, 25 bp, Rattus norvegicus
taatactaattcactgacaggcttt

SEQ ID NO: 544555 - DNA, 25 bp, Rattus norvegicus
taatactaattctctgacaggcttt

SEQ ID NO: 544556 - DNA, 25 bp, Rattus norvegicus
taatactactctcttcttgtcgcac

SEQ ID NO: 544557 - DNA, 25 bp, Rattus norvegicus
taatactactctgttcttgtcgcac

SEQ ID NO: 544558 - DNA, 25 bp, Rattus norvegicus
taatactagcgaaccttcttggctt

SEQ ID NO: 544559 - DNA, 25 bp, Rattus norvegicus
taatactagcgatccttcttggctt

SEQ ID NO: 544560 - DNA, 25 bp, Rattus norvegicus
taatactagtgcacgggctgaggca

SEQ ID NO: 544561 - DNA, 25 bp, Rattus norvegicus
taatactagtgctcgggctgaggca

SEQ ID NO: 544562 - DNA, 25 bp, Rattus norvegicus
taatactcaacacctctttctaatc

SEQ ID NO: 544563 - DNA, 25 bp, Rattus norvegicus
taatactcaacagctctttctaatc

SEQ ID NO: 544564 - DNA, 25 bp, Rattus norvegicus
taatactcggacacgtgttggccac

SEQ ID NO: 544565 - DNA, 25 bp, Rattus norvegicus
taatactcggactcgtgttggccac

SEQ ID NO: 544566 - DNA, 25 bp, Rattus norvegicus
taatactcgtggactcccttctgac

SEQ ID NO: 544567 - DNA, 25 bp, Rattus norvegicus
taatactcgtggtctcccttctgac

SEQ ID NO: 544568 - DNA, 25 bp, Rattus norvegicus
taatactctctgaaaccccagtgta

SEQ ID NO: 544569 - DNA, 25 bp, Rattus norvegicus
taatactctctgtaaccccagtgta

SEQ ID NO: 544570 - DNA, 25 bp, Rattus norvegicus
taatactctgccactaagatccttg

SEQ ID NO: 544571 - DNA, 25 bp, Rattus norvegicus
taatactctgcctctaagatccttg

SEQ ID NO: 544572 - DNA, 25 bp, Rattus norvegicus
taatactgccatctctgcttttaga

SEQ ID NO: 544573 - DNA, 25 bp, Rattus norvegicus
taatactgccatgtctgcttttaga

SEQ ID NO: 544574 - DNA, 25 bp, Rattus norvegicus
taatactgccctctgcgaagtctca

SEQ ID NO: 544575 - DNA, 25 bp, Rattus norvegicus
taatactgccctgtgcgaagtctca

SEQ ID NO: 544576 - DNA, 25 bp, Rattus norvegicus
taatactgctgcctttgtgaaagtg

SEQ ID NO: 544577 - DNA, 25 bp, Rattus norvegicus
taatactgctgcgtttgtgaaagtg

SEQ ID NO: 544578 - DNA, 25 bp, Rattus norvegicus
taatactgtctgacaaacgtttgtt

SEQ ID NO: 544579 - DNA, 25 bp, Rattus norvegicus
taatactgtctgtcaaacgtttgtt

SEQ ID NO: 544580 - DNA, 25 bp, Rattus norvegicus
taatactgttttagtcctgtaaagt

SEQ ID NO: 544581 - DNA, 25 bp, Rattus norvegicus
taatactgtttttgtcctgtaaagt

SEQ ID NO: 544582 - DNA, 25 bp, Rattus norvegicus
taatacttgccacccgtgcgtcttg

SEQ ID NO: 544583 - DNA, 25 bp, Rattus norvegicus
taatacttgccagccgtgcgtcttg

SEQ ID NO: 544584 - DNA, 25 bp, Rattus norvegicus
taatacttgtgtcatttgcttgaac

SEQ ID NO: 544585 - DNA, 25 bp, Rattus norvegicus
taatacttgtgtgatttgcttgaac

SEQ ID NO: 544586 - DNA, 25 bp, Rattus norvegicus
taatagaatcacctgctactggcaa

SEQ ID NO: 544587 - DNA, 25 bp, Rattus norvegicus
taatagaatcacgtgctactggcaa

SEQ ID NO: 544588 - DNA, 25 bp, Rattus norvegicus
taatagaatgttattcccttctccg

SEQ ID NO: 544589 - DNA, 25 bp, Rattus norvegicus
taatagaatgtttttcccttctccg

SEQ ID NO: 544590 - DNA, 25 bp, Rattus norvegicus
taatagacatcgagaaaggagaagt

SEQ ID NO: 544591 - DNA, 25 bp, Rattus norvegicus
taatagacatcgtgaaaggagaagt

SEQ ID NO: 544592 - DNA, 25 bp, Rattus norvegicus
taatagaccttgagtgccttactgg

SEQ ID NO: 544593 - DNA, 25 bp, Rattus norvegicus
taatagaccttgtgtgccttactgg

SEQ ID NO: 544594 - DNA, 25 bp, Rattus norvegicus
taatagacttccagtgccgctaagg

SEQ ID NO: 544595 - DNA, 25 bp, Rattus norvegicus
taatagacttcctgtgccgctaagg

SEQ ID NO: 544596 - DNA, 25 bp, Rattus norvegicus
taatagcaatcccacttagccctgt

SEQ ID NO: 544597 - DNA, 25 bp, Rattus norvegicus
taatagcaatccgacttagccctgt

SEQ ID NO: 544598 - DNA, 25 bp, Rattus norvegicus
taatagcaatctattgtctccgttg

SEQ ID NO: 544599 - DNA, 25 bp, Rattus norvegicus
taatagcaatcttttgtctccgttg

SEQ ID NO: 544600 - DNA, 25 bp, Rattus norvegicus
taatagcacagaatgttagcccagt

SEQ ID NO: 544601 - DNA, 25 bp, Rattus norvegicus
taatagcacagattgttagcccagt

SEQ ID NO: 544602 - DNA, 25 bp, Rattus norvegicus
taatagcagccccactaagtgcacc

SEQ ID NO: 544603 - DNA, 25 bp, Rattus norvegicus
taatagcagcccgactaagtgcacc

SEQ ID NO: 544604 - DNA, 25 bp, Rattus norvegicus
taatagcagtgcctttgggaccctg

SEQ ID NO: 544605 - DNA, 25 bp, Rattus norvegicus
taatagcagtgcgtttgggaccctg

SEQ ID NO: 544606 - DNA, 25 bp, Rattus norvegicus
taatagcattaccaaagacctccag

SEQ ID NO: 544607 - DNA, 25 bp, Rattus norvegicus
taatagcattacgaaagacctccag

SEQ ID NO: 544608 - DNA, 25 bp, Rattus norvegicus
taatagcattagatagtcccctggg

SEQ ID NO: 544609 - DNA, 25 bp, Rattus norvegicus
taatagcattagttagtcccctggg

SEQ ID NO: 544610 - DNA, 25 bp, Rattus norvegicus
taatagccaaaaaccaagccagagg

SEQ ID NO: 544611 - DNA, 25 bp, Rattus norvegicus
taatagccaaaatccaagccagagg

SEQ ID NO: 544612 - DNA, 25 bp, Rattus norvegicus
taatagccctgtcactgttactgca

SEQ ID NO: 544613 - DNA, 25 bp, Rattus norvegicus
taatagccctgtgactgttactgca

SEQ ID NO: 544614 - DNA, 25 bp, Rattus norvegicus
taatagcccttacatcctccatagt

SEQ ID NO: 544615 - DNA, 25 bp, Rattus norvegicus
taatagcccttagatcctccatagt

SEQ ID NO: 544616 - DNA, 25 bp, Rattus norvegicus
taatagccctttacactgaactcca

SEQ ID NO: 544617 - DNA, 25 bp, Rattus norvegicus
taatagcccttttcactgaactcca

SEQ ID NO: 544618 - DNA, 25 bp, Rattus norvegicus
taatagcctcagagtggttcctgcc

SEQ ID NO: 544619 - DNA, 25 bp, Rattus norvegicus
taatagcctcagtgtggttcctgcc

SEQ ID NO: 544620 - DNA, 25 bp, Rattus norvegicus
taatagctaatcatattctgtctcc

SEQ ID NO: 544621 - DNA, 25 bp, Rattus norvegicus
taatagctaatcttattctgtctcc

SEQ ID NO: 544622 - DNA, 25 bp, Rattus norvegicus
taatagctctgtccttaactcgatg

SEQ ID NO: 544623 - DNA, 25 bp, Rattus norvegicus
taatagctctgtgcttaactcgatg

SEQ ID NO: 544624 - DNA, 25 bp, Rattus norvegicus
taatagctgaagagtatggccgagt

SEQ ID NO: 544625 - DNA, 25 bp, Rattus norvegicus
taatagctgaagtgtatggccgagt

SEQ ID NO: 544626 - DNA, 25 bp, Rattus norvegicus
taatagctgttactgtacaggcttc

SEQ ID NO: 544627 - DNA, 25 bp, Rattus norvegicus
taatagctgttagtgtacaggcttc

SEQ ID NO: 544628 - DNA, 25 bp, Rattus norvegicus
taatagcttgctacgggtgttccta

SEQ ID NO: 544629 - DNA, 25 bp, Rattus norvegicus
taatagcttgcttcgggtgttccta

SEQ ID NO: 544630 - DNA, 25 bp, Rattus norvegicus
taatagcttttgatcaatcccaccc

SEQ ID NO: 544631 - DNA, 25 bp, Rattus norvegicus
taatagcttttgttcaatcccaccc

SEQ ID NO: 544632 - DNA, 25 bp, Rattus norvegicus
taataggacctaaagagatggctga

SEQ ID NO: 544633 - DNA, 25 bp, Rattus norvegicus
taataggacctatagagatggctga

SEQ ID NO: 544634 - DNA, 25 bp, Rattus norvegicus
taataggagcccagtctcctagctt

SEQ ID NO: 544635 - DNA, 25 bp, Rattus norvegicus
taataggagccctgtctcctagctt

SEQ ID NO: 544636 - DNA, 25 bp, Rattus norvegicus
taataggatactccgctgtgcacag

SEQ ID NO: 544637 - DNA, 25 bp, Rattus norvegicus
taataggatactgcgctgtgcacag

SEQ ID NO: 544638 - DNA, 25 bp, Rattus norvegicus
taataggcatttcccaccgtactcg

SEQ ID NO: 544639 - DNA, 25 bp, Rattus norvegicus
taataggcatttgccaccgtactcg

SEQ ID NO: 544640 - DNA, 25 bp, Rattus norvegicus
taataggccgccccgcgtgcacagg

SEQ ID NO: 544641 - DNA, 25 bp, Rattus norvegicus
taataggccgccgcgcgtgcacagg

SEQ ID NO: 544642 - DNA, 25 bp, Rattus norvegicus
taataggctaggacaccagtggtgc

SEQ ID NO: 544643 - DNA, 25 bp, Rattus norvegicus
taataggctaggtcaccagtggtgc

SEQ ID NO: 544644 - DNA, 25 bp, Rattus norvegicus
taatagggcctcaggacaagtcagt

SEQ ID NO: 544645 - DNA, 25 bp, Rattus norvegicus
taatagggcctctggacaagtcagt

SEQ ID NO: 544646 - DNA, 25 bp, Rattus norvegicus
taataggtaccacgcagcagattgc

SEQ ID NO: 544647 - DNA, 25 bp, Rattus norvegicus
taataggtaccaggcagcagattgc

SEQ ID NO: 544648 - DNA, 25 bp, Rattus norvegicus
taataggtacctcggagaactccca

SEQ ID NO: 544649 - DNA, 25 bp, Rattus norvegicus
taataggtacctgggagaactccca

SEQ ID NO: 544650 - DNA, 25 bp, Rattus norvegicus
taatagtctctcctctcttctgaaa

SEQ ID NO: 544651 - DNA, 25 bp, Rattus norvegicus
taatagtctctcgtctcttctgaaa

SEQ ID NO: 544652 - DNA, 25 bp, Rattus norvegicus
taatagtgccacactgtgagccagt

SEQ ID NO: 544653 - DNA, 25 bp, Rattus norvegicus
taatagtgccacagtcctcgactga

SEQ ID NO: 544654 - DNA, 25 bp, Rattus norvegicus
taatagtgccactctgtgagccagt

SEQ ID NO: 544655 - DNA, 25 bp, Rattus norvegicus
taatagtgccactgtcctcgactga

SEQ ID NO: 544656 - DNA, 25 bp, Rattus norvegicus
taatagtggattattcctggcaccc

SEQ ID NO: 544657 - DNA, 25 bp, Rattus norvegicus
taatagtggatttttcctggcaccc

SEQ ID NO: 544658 - DNA, 25 bp, Rattus norvegicus
taatagtggctaaatctgtcaaacc

SEQ ID NO: 544659 - DNA, 25 bp, Rattus norvegicus
taatagtggctatatctgtcaaacc

SEQ ID NO: 544660 - DNA, 25 bp, Rattus norvegicus
taatagtgtccaccatggcccatgc

SEQ ID NO: 544661 - DNA, 25 bp, Rattus norvegicus
taatagtgtccagcatggcccatgc

SEQ ID NO: 544662 - DNA, 25 bp, Rattus norvegicus
taatagttattgactggatcctcag

SEQ ID NO: 544663 - DNA, 25 bp, Rattus norvegicus
taatagttattgtctggatcctcag

SEQ ID NO: 544664 - DNA, 25 bp, Rattus norvegicus
taatagttgctaactggctgtcctt

SEQ ID NO: 544665 - DNA, 25 bp, Rattus norvegicus
taatagttgctatctggctgtcctt

SEQ ID NO: 544666 - DNA, 25 bp, Rattus norvegicus
taatagtttcagagggtgagcccat

SEQ ID NO: 544667 - DNA, 25 bp, Rattus norvegicus
taatagtttcagtgggtgagcccat

SEQ ID NO: 544668 - DNA, 25 bp, Rattus norvegicus
taatagtttccacaaagagctgtgg

SEQ ID NO: 544669 - DNA, 25 bp, Rattus norvegicus
taatagtttccagaaagagctgtgg

SEQ ID NO: 544670 - DNA, 25 bp, Rattus norvegicus
taatataaagatcgctacccactcc

SEQ ID NO: 544671 - DNA, 25 bp, Rattus norvegicus
taatataaagatggctacccactcc

SEQ ID NO: 544672 - DNA, 25 bp, Rattus norvegicus
taatatagactgctcccgtggcttg

SEQ ID NO: 544673 - DNA, 25 bp, Rattus norvegicus
taatatagactggtcccgtggcttg

SEQ ID NO: 544674 - DNA, 25 bp, Rattus norvegicus
taatatagtagtagtttcctagaac

SEQ ID NO: 544675 - DNA, 25 bp, Rattus norvegicus
taatatagtagttgtttcctagaac

SEQ ID NO: 544676 - DNA, 25 bp, Rattus norvegicus
taatatagttccacgtgactgacac

SEQ ID NO: 544677 - DNA, 25 bp, Rattus norvegicus
taatatagttcctcgtgactgacac

SEQ ID NO: 544678 - DNA, 25 bp, Rattus norvegicus
taatatattgccacttgtccgtcga

SEQ ID NO: 544679 - DNA, 25 bp, Rattus norvegicus
taatatattgcctcttgtccgtcga

SEQ ID NO: 544680 - DNA, 25 bp, Rattus norvegicus
taatatatttccatgcgaccagcag

SEQ ID NO: 544681 - DNA, 25 bp, Rattus norvegicus
taatatatttccttgcgaccagcag

SEQ ID NO: 544682 - DNA, 25 bp, Rattus norvegicus
taatatcaactgacctgtcatcacc

SEQ ID NO: 544683 - DNA, 25 bp, Rattus norvegicus
taatatcaactgtcctgtcatcacc

SEQ ID NO: 544684 - DNA, 25 bp, Rattus norvegicus
taatatcaccgtacagtagctgccc

SEQ ID NO: 544685 - DNA, 25 bp, Rattus norvegicus
taatatcaccgttcagtagctgccc

SEQ ID NO: 544686 - DNA, 25 bp, Rattus norvegicus
taatatcattgtactccactttctg

SEQ ID NO: 544687 - DNA, 25 bp, Rattus norvegicus
taatatcattgttctccactttctg

SEQ ID NO: 544688 - DNA, 25 bp, Rattus norvegicus
taatatccacgcaaccaatctgatt

SEQ ID NO: 544689 - DNA, 25 bp, Rattus norvegicus
taatatccacgctaccaatctgatt

SEQ ID NO: 544690 - DNA, 25 bp, Rattus norvegicus
taatatccatggataatcctgcaat

SEQ ID NO: 544691 - DNA, 25 bp, Rattus norvegicus
taatatccatggttaatcctgcaat

SEQ ID NO: 544692 - DNA, 25 bp, Rattus norvegicus
taatatcctgtgagaatgacctgca

SEQ ID NO: 544693 - DNA, 25 bp, Rattus norvegicus
taatatcctgtgtgaatgacctgca

SEQ ID NO: 544694 - DNA, 25 bp, Rattus norvegicus
taatatccttttccaagcatctgcc

SEQ ID NO: 544695 - DNA, 25 bp, Rattus norvegicus
taatatccttttgcaagcatctgcc

SEQ ID NO: 544696 - DNA, 25 bp, Rattus norvegicus
taatatctctagatctccatggcac

SEQ ID NO: 544697 - DNA, 25 bp, Rattus norvegicus
taatatctctagttctccatggcac

SEQ ID NO: 544698 - DNA, 25 bp, Rattus norvegicus
taatatcttaagctgatgccccgcc

SEQ ID NO: 544699 - DNA, 25 bp, Rattus norvegicus
taatatcttaaggtgatgccccgcc

SEQ ID NO: 544700 - DNA, 25 bp, Rattus norvegicus
taatatcttggcatactgtcacatt

SEQ ID NO: 544701 - DNA, 25 bp, Rattus norvegicus
taatatcttggcttactgtcacatt

SEQ ID NO: 544702 - DNA, 25 bp, Rattus norvegicus
taatatgcacgtatccacctaagat

SEQ ID NO: 544703 - DNA, 25 bp, Rattus norvegicus
taatatgcacgtttccacctaagat

SEQ ID NO: 544704 - DNA, 25 bp, Rattus norvegicus
taatatgccacacacaagatcccca

SEQ ID NO: 544705 - DNA, 25 bp, Rattus norvegicus
taatatgccacagacaagatcccca

SEQ ID NO: 544706 - DNA, 25 bp, Rattus norvegicus
taatatgcctctactgcacataacc

SEQ ID NO: 544707 - DNA, 25 bp, Rattus norvegicus
taatatgcctcttctgcacataacc

SEQ ID NO: 544708 - DNA, 25 bp, Rattus norvegicus
taatatggcactccctatagacctc

SEQ ID NO: 544709 - DNA, 25 bp, Rattus norvegicus
taatatggcactgcctatagacctc

SEQ ID NO: 544710 - DNA, 25 bp, Rattus norvegicus
taatatggcagtatgttgcttaggc

SEQ ID NO: 544711 - DNA, 25 bp, Rattus norvegicus
taatatggcagtttgttgcttaggc

SEQ ID NO: 544712 - DNA, 25 bp, Rattus norvegicus
taatatggctgcaggccttgctggc

SEQ ID NO: 544713 - DNA, 25 bp, Rattus norvegicus
taatatggctgctggccttgctggc

SEQ ID NO: 544714 - DNA, 25 bp, Rattus norvegicus
taatatgtagaccagctgggccttg

SEQ ID NO: 544715 - DNA, 25 bp, Rattus norvegicus
taatatgtagacgagctgggccttg

SEQ ID NO: 544716 - DNA, 25 bp, Rattus norvegicus
taatatgtgcgaagccctgggttcc

SEQ ID NO: 544717 - DNA, 25 bp, Rattus norvegicus
taatatgtgcgatgccctgggttcc

SEQ ID NO: 544718 - DNA, 25 bp, Rattus norvegicus
taatatgttcatagtgcggacgtca

SEQ ID NO: 544719 - DNA, 25 bp, Rattus norvegicus
taatatgttcattgtgcggacgtca

SEQ ID NO: 544720 - DNA, 25 bp, Rattus norvegicus
taatatgttgtcaatgacccagcca

SEQ ID NO: 544721 - DNA, 25 bp, Rattus norvegicus
taatatgttgtctatgacccagcca

SEQ ID NO: 544722 - DNA, 25 bp, Rattus norvegicus
taatatgtttcacgtgtctcactgg

SEQ ID NO: 544723 - DNA, 25 bp, Rattus norvegicus
taatatgtttcaggtgtctcactgg

SEQ ID NO: 544724 - DNA, 25 bp, Rattus norvegicus
taatatgtttgtagctaatgagttc

SEQ ID NO: 544725 - DNA, 25 bp, Rattus norvegicus
taatatgtttgttgctaatgagttc

SEQ ID NO: 544726 - DNA, 25 bp, Rattus norvegicus
taatattcccttcaggtagcttttt

SEQ ID NO: 544727 - DNA, 25 bp, Rattus norvegicus
taatattcccttgaggtagcttttt

SEQ ID NO: 544728 - DNA, 25 bp, Rattus norvegicus
taatattcgatcaccttgccttttg

SEQ ID NO: 544729 - DNA, 25 bp, Rattus norvegicus
taatattcgatctccttgccttttg

SEQ ID NO: 544730 - DNA, 25 bp, Rattus norvegicus
taatattcggctccttggtcagcat

SEQ ID NO: 544731 - DNA, 25 bp, Rattus norvegicus
taatattcggctgcttggtcagcat

SEQ ID NO: 544732 - DNA, 25 bp, Rattus norvegicus
taatattctattaccagcgtcccca

SEQ ID NO: 544733 - DNA, 25 bp, Rattus norvegicus
taatattctatttccagcgtcccca

SEQ ID NO: 544734 - DNA, 25 bp, Rattus norvegicus
taatattctcaaccccatgaaaagg

SEQ ID NO: 544735 - DNA, 25 bp, Rattus norvegicus
taatattctcaagcccatgaaaagg

SEQ ID NO: 544736 - DNA, 25 bp, Rattus norvegicus
taatattctggtcgttggattttcc

SEQ ID NO: 544737 - DNA, 25 bp, Rattus norvegicus
taatattctggtggttggattttcc

SEQ ID NO: 544738 - DNA, 25 bp, Rattus norvegicus
taatattgccacacaaacccagagt

SEQ ID NO: 544739 - DNA, 25 bp, Rattus norvegicus
taatattgccactcaaacccagagt

SEQ ID NO: 544740 - DNA, 25 bp, Rattus norvegicus
taatattgcctactgacgatgtcac

SEQ ID NO: 544741 - DNA, 25 bp, Rattus norvegicus
taatattgcctagtgacgatgtcac

SEQ ID NO: 544742 - DNA, 25 bp, Rattus norvegicus
taatattggcaaattcccctctttt

SEQ ID NO: 544743 - DNA, 25 bp, Rattus norvegicus
taatattggcaatttcccctctttt

SEQ ID NO: 544744 - DNA, 25 bp, Rattus norvegicus
taatattgtaccacactgtggaagt

SEQ ID NO: 544745 - DNA, 25 bp, Rattus norvegicus
taatattgtacctcactgtggaagt

SEQ ID NO: 544746 - DNA, 25 bp, Rattus norvegicus
taatatttcaagactctgtcaacac

SEQ ID NO: 544747 - DNA, 25 bp, Rattus norvegicus
taatatttcaagtctctgtcaacac

SEQ ID NO: 544748 - DNA, 25 bp, Rattus norvegicus
taatatttggccagtgatactaaca

SEQ ID NO: 544749 - DNA, 25 bp, Rattus norvegicus
taatatttggcctgtgatactaaca

SEQ ID NO: 544750 - DNA, 25 bp, Rattus norvegicus
taatattttggaatggcgggccctg

SEQ ID NO: 544751 - DNA, 25 bp, Rattus norvegicus
taatattttggattggcgggccctg

SEQ ID NO: 544752 - DNA, 25 bp, Rattus norvegicus
taatcaaacgttatcatctctcttg

SEQ ID NO: 544753 - DNA, 25 bp, Rattus norvegicus
taatcaaacgttttcatctctcttg

SEQ ID NO: 544754 - DNA, 25 bp, Rattus norvegicus
taatcaaagcccaaactcctttctt

SEQ ID NO: 544755 - DNA, 25 bp, Rattus norvegicus
taatcaaagccctaactcctttctt

SEQ ID NO: 544756 - DNA, 25 bp, Rattus norvegicus
taatcaaagctccatctggagtggt

SEQ ID NO: 544757 - DNA, 25 bp, Rattus norvegicus
taatcaaagctcgatctggagtggt

SEQ ID NO: 544758 - DNA, 25 bp, Rattus norvegicus
taatcaaagttaactgccactgcaa

SEQ ID NO: 544759 - DNA, 25 bp, Rattus norvegicus
taatcaaagttatctgccactgcaa

SEQ ID NO: 544760 - DNA, 25 bp, Rattus norvegicus
taatcaacacatatcaggctcacat

SEQ ID NO: 544761 - DNA, 25 bp, Rattus norvegicus
taatcaacacatttcaggctcacat

SEQ ID NO: 544762 - DNA, 25 bp, Rattus norvegicus
taatcaaccagcacctaagttaccc

SEQ ID NO: 544763 - DNA, 25 bp, Rattus norvegicus
taatcaaccagctcctaagttaccc

SEQ ID NO: 544764 - DNA, 25 bp, Rattus norvegicus
taatcaacgtgcagctctgtcagca

SEQ ID NO: 544765 - DNA, 25 bp, Rattus norvegicus
taatcaacgtgctgctctgtcagca

SEQ ID NO: 544766 - DNA, 25 bp, Rattus norvegicus
taatcaacttcaaaccacagaacaa

SEQ ID NO: 544767 - DNA, 25 bp, Rattus norvegicus
taatcaacttcataccacagaacaa

SEQ ID NO: 544768 - DNA, 25 bp, Rattus norvegicus
taatcaatacttcctctagtgaagc

SEQ ID NO: 544769 - DNA, 25 bp, Rattus norvegicus
taatcaatacttgctctagtgaagc

SEQ ID NO: 544770 - DNA, 25 bp, Rattus norvegicus
taatcaatttttagacctgtggttt

SEQ ID NO: 544771 - DNA, 25 bp, Rattus norvegicus
taatcaattttttgacctgtggttt

SEQ ID NO: 544772 - DNA, 25 bp, Rattus norvegicus
taatcacaacgtacccaatcttatc

SEQ ID NO: 544773 - DNA, 25 bp, Rattus norvegicus
taatcacaacgttcccaatcttatc

SEQ ID NO: 544774 - DNA, 25 bp, Rattus norvegicus
taatcacatctcaggctaagggcgc

SEQ ID NO: 544775 - DNA, 25 bp, Rattus norvegicus
taatcacatctctggctaagggcgc

SEQ ID NO: 544776 - DNA, 25 bp, Rattus norvegicus
taatcacatgggattcctgctacca

SEQ ID NO: 544777 - DNA, 25 bp, Rattus norvegicus
taatcacatgggtttcctgctacca

SEQ ID NO: 544778 - DNA, 25 bp, Rattus norvegicus
taatcaccaagaccccttaaggagg

SEQ ID NO: 544779 - DNA, 25 bp, Rattus norvegicus
taatcaccaagagcccttaaggagg

SEQ ID NO: 544780 - DNA, 25 bp, Rattus norvegicus
taatcaccacgaccatcacgatgaa

SEQ ID NO: 544781 - DNA, 25 bp, Rattus norvegicus
taatcaccacgagcatcacgatgaa

SEQ ID NO: 544782 - DNA, 25 bp, Rattus norvegicus
taatcaccattccagttcgacgtta

SEQ ID NO: 544783 - DNA, 25 bp, Rattus norvegicus
taatcaccattcgagttcgacgtta

SEQ ID NO: 544784 - DNA, 25 bp, Rattus norvegicus
taatcacccgaaatccagagcgtag

SEQ ID NO: 544785 - DNA, 25 bp, Rattus norvegicus
taatcacccgaattccagagcgtag

SEQ ID NO: 544786 - DNA, 25 bp, Rattus norvegicus
taatcacccggcagtaactctaaac

SEQ ID NO: 544787 - DNA, 25 bp, Rattus norvegicus
taatcacccggctgtaactctaaac

SEQ ID NO: 544788 - DNA, 25 bp, Rattus norvegicus
taatcacctcccatggattccaggg

SEQ ID NO: 544789 - DNA, 25 bp, Rattus norvegicus
taatcacctcccttggattccaggg

SEQ ID NO: 544790 - DNA, 25 bp, Rattus norvegicus
taatcacgcctgcagagatggtcaa

SEQ ID NO: 544791 - DNA, 25 bp, Rattus norvegicus
taatcacgcctggagagatggtcaa

SEQ ID NO: 544792 - DNA, 25 bp, Rattus norvegicus
taatcacgggcacgtccttccaagg

SEQ ID NO: 544793 - DNA, 25 bp, Rattus norvegicus
taatcacgggcaggtccttccaagg

SEQ ID NO: 544794 - DNA, 25 bp, Rattus norvegicus
taatcactatgaaggccagggctaa

SEQ ID NO: 544795 - DNA, 25 bp, Rattus norvegicus
taatcactatgatggccagggctaa

SEQ ID NO: 544796 - DNA, 25 bp, Rattus norvegicus
taatcactgactagagaacgcctct

SEQ ID NO: 544797 - DNA, 25 bp, Rattus norvegicus
taatcactgacttgagaacgcctct

SEQ ID NO: 544798 - DNA, 25 bp, Rattus norvegicus
taatcactgcaacaagaccccactg

SEQ ID NO: 544799 - DNA, 25 bp, Rattus norvegicus
taatcactgcaagaagaccccactg

SEQ ID NO: 544800 - DNA, 25 bp, Rattus norvegicus
taatcactgtcaatgcccttcattc

SEQ ID NO: 544801 - DNA, 25 bp, Rattus norvegicus
taatcactgtcattgcccttcattc

SEQ ID NO: 544802 - DNA, 25 bp, Rattus norvegicus
taatcactgtgacactgcacgctag

SEQ ID NO: 544803 - DNA, 25 bp, Rattus norvegicus
taatcactgtgagactgcacgctag

SEQ ID NO: 544804 - DNA, 25 bp, Rattus norvegicus
taatcactgtttctggaccttggtt

SEQ ID NO: 544805 - DNA, 25 bp, Rattus norvegicus
taatcactgtttgtggaccttggtt

SEQ ID NO: 544806 - DNA, 25 bp, Rattus norvegicus
taatcagaacatccttcccctgtta

SEQ ID NO: 544807 - DNA, 25 bp, Rattus norvegicus
taatcagaacatgcttcccctgtta

SEQ ID NO: 544808 - DNA, 25 bp, Rattus norvegicus
taatcagaatccaggcttccgtttc

SEQ ID NO: 544809 - DNA, 25 bp, Rattus norvegicus
taatcagaatcctggcttccgtttc

SEQ ID NO: 544810 - DNA, 25 bp, Rattus norvegicus
taatcagaatttcttttggctcttg

SEQ ID NO: 544811 - DNA, 25 bp, Rattus norvegicus
taatcagaatttgttttggctcttg

SEQ ID NO: 544812 - DNA, 25 bp, Rattus norvegicus
taatcagacctgcttggctgcgtaa

SEQ ID NO: 544813 - DNA, 25 bp, Rattus norvegicus
taatcagacctggttggctgcgtaa

SEQ ID NO: 544814 - DNA, 25 bp, Rattus norvegicus
taatcagactaactgccagccaagt

SEQ ID NO: 544815 - DNA, 25 bp, Rattus norvegicus
taatcagactaagtgccagccaagt

SEQ ID NO: 544816 - DNA, 25 bp, Rattus norvegicus
taatcagagcttattcgtccctgtg

SEQ ID NO: 544817 - DNA, 25 bp, Rattus norvegicus
taatcagagctttttcgtccctgtg

SEQ ID NO: 544818 - DNA, 25 bp, Rattus norvegicus
taatcagataggacccaaggcaacg

SEQ ID NO: 544819 - DNA, 25 bp, Rattus norvegicus
taatcagataggtcccaaggcaacg

SEQ ID NO: 544820 - DNA, 25 bp, Rattus norvegicus
taatcagattgtctccgtcctcttc

SEQ ID NO: 544821 - DNA, 25 bp, Rattus norvegicus
taatcagattgtgtccgtcctcttc

SEQ ID NO: 544822 - DNA, 25 bp, Rattus norvegicus
taatcagcaagcaggcagaagaatg

SEQ ID NO: 544823 - DNA, 25 bp, Rattus norvegicus
taatcagcaagctggcagaagaatg

SEQ ID NO: 544824 - DNA, 25 bp, Rattus norvegicus
taatcagcagccacgtttaactaaa

SEQ ID NO: 544825 - DNA, 25 bp, Rattus norvegicus
taatcagcagcctcgtttaactaaa

SEQ ID NO: 544826 - DNA, 25 bp, Rattus norvegicus
taatcagcagggagcaccggtggcc

SEQ ID NO: 544827 - DNA, 25 bp, Rattus norvegicus
taatcagcagggtgcaccggtggcc

SEQ ID NO: 544828 - DNA, 25 bp, Rattus norvegicus
taatcagcatttcaaccaggttagc

SEQ ID NO: 544829 - DNA, 25 bp, Rattus norvegicus
taatcagcatttgaaccaggttagc

SEQ ID NO: 544830 - DNA, 25 bp, Rattus norvegicus
taatcagcctttattactggatgta

SEQ ID NO: 544831 - DNA, 25 bp, Rattus norvegicus
taatcagccttttttactggatgta

SEQ ID NO: 544832 - DNA, 25 bp, Rattus norvegicus
taatcagctttgagccagccagcga

SEQ ID NO: 544833 - DNA, 25 bp, Rattus norvegicus
taatcagctttgtgccagccagcga

SEQ ID NO: 544834 - DNA, 25 bp, Rattus norvegicus
taatcaggaaacctttgcccgggca

SEQ ID NO: 544835 - DNA, 25 bp, Rattus norvegicus
taatcaggaaacgtttgcccgggca

SEQ ID NO: 544836 - DNA, 25 bp, Rattus norvegicus
taatcaggacccactgcaaggaacc

SEQ ID NO: 544837 - DNA, 25 bp, Rattus norvegicus
taatcaggaccctctgcaaggaacc

SEQ ID NO: 544838 - DNA, 25 bp, Rattus norvegicus
taatcaggagctacttgcctctttc

SEQ ID NO: 544839 - DNA, 25 bp, Rattus norvegicus
taatcaggagcttcttgcctctttc

SEQ ID NO: 544840 - DNA, 25 bp, Rattus norvegicus
taatcaggaggtaacacaccaccct

SEQ ID NO: 544841 - DNA, 25 bp, Rattus norvegicus
taatcaggaggttacacaccaccct

SEQ ID NO: 544842 - DNA, 25 bp, Rattus norvegicus
taatcaggcctgcagtgggttctct

SEQ ID NO: 544843 - DNA, 25 bp, Rattus norvegicus
taatcaggcctggagtgggttctct

SEQ ID NO: 544844 - DNA, 25 bp, Rattus norvegicus
taatcaggtggtccagagtttcatt

SEQ ID NO: 544845 - DNA, 25 bp, Rattus norvegicus
taatcaggtggtgcagagtttcatt

SEQ ID NO: 544846 - DNA, 25 bp, Rattus norvegicus
taatcagtcactcagacacagcttc

SEQ ID NO: 544847 - DNA, 25 bp, Rattus norvegicus
taatcagtcactgagacacagcttc

SEQ ID NO: 544848 - DNA, 25 bp, Rattus norvegicus
taatcagtgggtaccaggccagtga

SEQ ID NO: 544849 - DNA, 25 bp, Rattus norvegicus
taatcagtgggttccaggccagtga

SEQ ID NO: 544850 - DNA, 25 bp, Rattus norvegicus
taatcagttggtatccttatgtgca

SEQ ID NO: 544851 - DNA, 25 bp, Rattus norvegicus
taatcagttggtcttcgtctcccac

SEQ ID NO: 544852 - DNA, 25 bp, Rattus norvegicus
taatcagttggtgttcgtctcccac

SEQ ID NO: 544853 - DNA, 25 bp, Rattus norvegicus
taatcagttggtttccttatgtgca

SEQ ID NO: 544854 - DNA, 25 bp, Rattus norvegicus
taatcagttttaactttcgaaaggc

SEQ ID NO: 544855 - DNA, 25 bp, Rattus norvegicus
taatcagttttatctttcgaaaggc

SEQ ID NO: 544856 - DNA, 25 bp, Rattus norvegicus
taatcataccttagaactcacacgt

SEQ ID NO: 544857 - DNA, 25 bp, Rattus norvegicus
taatcatacctttgaactcacacgt

SEQ ID NO: 544858 - DNA, 25 bp, Rattus norvegicus
taatcatagactcagagacctgtgc

SEQ ID NO: 544859 - DNA, 25 bp, Rattus norvegicus
taatcatagactgagagacctgtgc

SEQ ID NO: 544860 - DNA, 25 bp, Rattus norvegicus
taatcatatgttacctgtcttgtaa

SEQ ID NO: 544861 - DNA, 25 bp, Rattus norvegicus
taatcatatgtttcctgtcttgtaa

SEQ ID NO: 544862 - DNA, 25 bp, Rattus norvegicus
taatcatcactactgtaccaccttg

SEQ ID NO: 544863 - DNA, 25 bp, Rattus norvegicus
taatcatcactagtgtaccaccttg

SEQ ID NO: 544864 - DNA, 25 bp, Rattus norvegicus
taatcatcattgactgctacaccct

SEQ ID NO: 544865 - DNA, 25 bp, Rattus norvegicus
taatcatcattgtctgctacaccct

SEQ ID NO: 544866 - DNA, 25 bp, Rattus norvegicus
taatcatctcacagtccagtttgct

SEQ ID NO: 544867 - DNA, 25 bp, Rattus norvegicus
taatcatctcactgtccagtttgct

SEQ ID NO: 544868 - DNA, 25 bp, Rattus norvegicus
taatcatgcagacaacaccaccttg

SEQ ID NO: 544869 - DNA, 25 bp, Rattus norvegicus
taatcatgcagagaacaccaccttg

SEQ ID NO: 544870 - DNA, 25 bp, Rattus norvegicus
taatcatgccatagttcagacgttg

SEQ ID NO: 544871 - DNA, 25 bp, Rattus norvegicus
taatcatgccattgttcagacgttg

SEQ ID NO: 544872 - DNA, 25 bp, Rattus norvegicus
taatcatgctggaggccttagtgta

SEQ ID NO: 544873 - DNA, 25 bp, Rattus norvegicus
taatcatgctggtggccttagtgta

SEQ ID NO: 544874 - DNA, 25 bp, Rattus norvegicus
taatcatggactaaccctttgaaac

SEQ ID NO: 544875 - DNA, 25 bp, Rattus norvegicus
taatcatggacttaccctttgaaac

SEQ ID NO: 544876 - DNA, 25 bp, Rattus norvegicus
taatcatgggctagctcagtgggta

SEQ ID NO: 544877 - DNA, 25 bp, Rattus norvegicus
taatcatgggcttgctcagtgggta

SEQ ID NO: 544878 - DNA, 25 bp, Rattus norvegicus
taatcatgttgcatagccttcagag

SEQ ID NO: 544879 - DNA, 25 bp, Rattus norvegicus
taatcatgttgcttagccttcagag

SEQ ID NO: 544880 - DNA, 25 bp, Rattus norvegicus
taatcattactactagccagcctcg

SEQ ID NO: 544881 - DNA, 25 bp, Rattus norvegicus
taatcattactagtagccagcctcg

SEQ ID NO: 544882 - DNA, 25 bp, Rattus norvegicus
taatcattagaccatcttgcccagc

SEQ ID NO: 544883 - DNA, 25 bp, Rattus norvegicus
taatcattagacgatcttgcccagc

SEQ ID NO: 544884 - DNA, 25 bp, Rattus norvegicus
taatcattgactatcctgaccacac

SEQ ID NO: 544885 - DNA, 25 bp, Rattus norvegicus
taatcattgactttcctgaccacac

SEQ ID NO: 544886 - DNA, 25 bp, Rattus norvegicus
taatcattgctcattctactgtctc

SEQ ID NO: 544887 - DNA, 25 bp, Rattus norvegicus
taatcattgctctttctactgtctc

SEQ ID NO: 544888 - DNA, 25 bp, Rattus norvegicus
taatcatttacgctgtttctccctc

SEQ ID NO: 544889 - DNA, 25 bp, Rattus norvegicus
taatcatttacggtgtttctccctc

SEQ ID NO: 544890 - DNA, 25 bp, Rattus norvegicus
taatccaacccaccagttctgatca

SEQ ID NO: 544891 - DNA, 25 bp, Rattus norvegicus
taatccaacccagcagttctgatca

SEQ ID NO: 544892 - DNA, 25 bp, Rattus norvegicus
taatccaaggtgatatttgtctctt

SEQ ID NO: 544893 - DNA, 25 bp, Rattus norvegicus
taatccaaggtgttatttgtctctt

SEQ ID NO: 544894 - DNA, 25 bp, Rattus norvegicus
taatccacaactctcttgcttatgt

SEQ ID NO: 544895 - DNA, 25 bp, Rattus norvegicus
taatccacaactgtcttgcttatgt

SEQ ID NO: 544896 - DNA, 25 bp, Rattus norvegicus
taatccacacaaaccaatagccgtc

SEQ ID NO: 544897 - DNA, 25 bp, Rattus norvegicus
taatccacacaatccaatagccgtc

SEQ ID NO: 544898 - DNA, 25 bp, Rattus norvegicus
taatccacaggcaatttcccaacaa

SEQ ID NO: 544899 - DNA, 25 bp, Rattus norvegicus
taatccacaggctatttcccaacaa

SEQ ID NO: 544900 - DNA, 25 bp, Rattus norvegicus
taatccaccaggacactgtgagcac

SEQ ID NO: 544901 - DNA, 25 bp, Rattus norvegicus
taatccaccaggtcactgtgagcac

SEQ ID NO: 544902 - DNA, 25 bp, Rattus norvegicus
taatccacccagatcaggttgctat

SEQ ID NO: 544903 - DNA, 25 bp, Rattus norvegicus
taatccacccagttcaggttgctat

SEQ ID NO: 544904 - DNA, 25 bp, Rattus norvegicus
taatccaccttcatagattgtccct

SEQ ID NO: 544905 - DNA, 25 bp, Rattus norvegicus
taatccaccttcttagattgtccct

SEQ ID NO: 544906 - DNA, 25 bp, Rattus norvegicus
taatccactctcctgggaggtcggg

SEQ ID NO: 544907 - DNA, 25 bp, Rattus norvegicus
taatccactctcgtgggaggtcggg

SEQ ID NO: 544908 - DNA, 25 bp, Rattus norvegicus
taatccactggacttgcctgaggga

SEQ ID NO: 544909 - DNA, 25 bp, Rattus norvegicus
taatccactggagttgcctgaggga

SEQ ID NO: 544910 - DNA, 25 bp, Rattus norvegicus
taatccagaagcagcccctgaggtg

SEQ ID NO: 544911 - DNA, 25 bp, Rattus norvegicus
taatccagaagctgcccctgaggtg

SEQ ID NO: 544912 - DNA, 25 bp, Rattus norvegicus
taatccagacatcttggctttctct

SEQ ID NO: 544913 - DNA, 25 bp, Rattus norvegicus
taatccagacatgttggctttctct

SEQ ID NO: 544914 - DNA, 25 bp, Rattus norvegicus
taatccagacccatagtgtccacag

SEQ ID NO: 544915 - DNA, 25 bp, Rattus norvegicus
taatccagacccttagtgtccacag

SEQ ID NO: 544916 - DNA, 25 bp, Rattus norvegicus
taatccagccagctttggtggtaca

SEQ ID NO: 544917 - DNA, 25 bp, Rattus norvegicus
taatccagccaggtttggtggtaca

SEQ ID NO: 544918 - DNA, 25 bp, Rattus norvegicus
taatccagcctgaatctcctagttc

SEQ ID NO: 544919 - DNA, 25 bp, Rattus norvegicus
taatccagcctgtatctcctagttc

SEQ ID NO: 544920 - DNA, 25 bp, Rattus norvegicus
taatccagtgttccgtcttacctca

SEQ ID NO: 544921 - DNA, 25 bp, Rattus norvegicus
taatccagtgttgcgtcttacctca

SEQ ID NO: 544922 - DNA, 25 bp, Rattus norvegicus
taatccatagctctcattagtcggc

SEQ ID NO: 544923 - DNA, 25 bp, Rattus norvegicus
taatccatagctgtcattagtcggc

SEQ ID NO: 544924 - DNA, 25 bp, Rattus norvegicus
taatccatcaagctcgggccagtgc

SEQ ID NO: 544925 - DNA, 25 bp, Rattus norvegicus
taatccatcaaggtcgggccagtgc

SEQ ID NO: 544926 - DNA, 25 bp, Rattus norvegicus
taatccatgttgctcaggacccata

SEQ ID NO: 544927 - DNA, 25 bp, Rattus norvegicus
taatccatgttggtcaggacccata

SEQ ID NO: 544928 - DNA, 25 bp, Rattus norvegicus
taatccattaaccatttgctgcctg

SEQ ID NO: 544929 - DNA, 25 bp, Rattus norvegicus
taatccattaacgatttgctgcctg

SEQ ID NO: 544930 - DNA, 25 bp, Rattus norvegicus
taatccattactctgcggaagtcac

SEQ ID NO: 544931 - DNA, 25 bp, Rattus norvegicus
taatccattactgtgcggaagtcac

SEQ ID NO: 544932 - DNA, 25 bp, Rattus norvegicus
taatcccaagccagtcggctggagc

SEQ ID NO: 544933 - DNA, 25 bp, Rattus norvegicus
taatcccaagcctgtcggctggagc

SEQ ID NO: 544934 - DNA, 25 bp, Rattus norvegicus
taatcccaccccacaggaagcaaaa

SEQ ID NO: 544935 - DNA, 25 bp, Rattus norvegicus
taatcccacccctcaggaagcaaaa

SEQ ID NO: 544936 - DNA, 25 bp, Rattus norvegicus
taatcccactaaatcgcctttctta

SEQ ID NO: 544937 - DNA, 25 bp, Rattus norvegicus
taatcccactaattcgcctttctta

SEQ ID NO: 544938 - DNA, 25 bp, Rattus norvegicus
taatcccagaaccataccagagcca

SEQ ID NO: 544939 - DNA, 25 bp, Rattus norvegicus
taatcccagaacgataccagagcca

SEQ ID NO: 544940 - DNA, 25 bp, Rattus norvegicus
taatcccagaatacagcaggttgaa

SEQ ID NO: 544941 - DNA, 25 bp, Rattus norvegicus
taatcccagaattcagcaggttgaa

SEQ ID NO: 544942 - DNA, 25 bp, Rattus norvegicus
taatcccagcagctcagaaggactg

SEQ ID NO: 544943 - DNA, 25 bp, Rattus norvegicus
taatcccagcaggtcagaaggactg

SEQ ID NO: 544944 - DNA, 25 bp, Rattus norvegicus
taatcccagcatatttaagccagag

SEQ ID NO: 544945 - DNA, 25 bp, Rattus norvegicus
taatcccagcatttttaagccagag

SEQ ID NO: 544946 - DNA, 25 bp, Rattus norvegicus
taatcccagcccaaaggaggtaagc

SEQ ID NO: 544947 - DNA, 25 bp, Rattus norvegicus
taatcccagcccatgcaagacagag

SEQ ID NO: 544948 - DNA, 25 bp, Rattus norvegicus
taatcccagccctaaggaggtaagc

SEQ ID NO: 544949 - DNA, 25 bp, Rattus norvegicus
taatcccagcccttgcaagacagag

SEQ ID NO: 544950 - DNA, 25 bp, Rattus norvegicus
taatcccagcgtcgtaactctgtgt

SEQ ID NO: 544951 - DNA, 25 bp, Rattus norvegicus
taatcccagcgtggtaactctgtgt

SEQ ID NO: 544952 - DNA, 25 bp, Rattus norvegicus
taatcccaggtcactttcaacaaaa

SEQ ID NO: 544953 - DNA, 25 bp, Rattus norvegicus
taatcccaggtctctttcaacaaaa

SEQ ID NO: 544954 - DNA, 25 bp, Rattus norvegicus
taatcccagttacacctagtgaagg

SEQ ID NO: 544955 - DNA, 25 bp, Rattus norvegicus
taatcccagttagacctagtgaagg

SEQ ID NO: 544956 - DNA, 25 bp, Rattus norvegicus
taatcccatagaagtcttatgtcag

SEQ ID NO: 544957 - DNA, 25 bp, Rattus norvegicus
taatcccatagatgtcttatgtcag

SEQ ID NO: 544958 - DNA, 25 bp, Rattus norvegicus
taatcccattggagagcgctctgct

SEQ ID NO: 544959 - DNA, 25 bp, Rattus norvegicus
taatcccattggtgagcgctctgct

SEQ ID NO: 544960 - DNA, 25 bp, Rattus norvegicus
taatccccacatatttagagtcaga

SEQ ID NO: 544961 - DNA, 25 bp, Rattus norvegicus
taatccccacatttttagagtcaga

SEQ ID NO: 544962 - DNA, 25 bp, Rattus norvegicus
taatccccagaacgccatgtcagac

SEQ ID NO: 544963 - DNA, 25 bp, Rattus norvegicus
taatccccagaaggccatgtcagac

SEQ ID NO: 544964 - DNA, 25 bp, Rattus norvegicus
taatccccaggaatgttactgtatg

SEQ ID NO: 544965 - DNA, 25 bp, Rattus norvegicus
taatccccaggattgttactgtatg

SEQ ID NO: 544966 - DNA, 25 bp, Rattus norvegicus
taatccccgggaagccattttgcgt

SEQ ID NO: 544967 - DNA, 25 bp, Rattus norvegicus
taatccccgggatgccattttgcgt

SEQ ID NO: 544968 - DNA, 25 bp, Rattus norvegicus
taatcccctgccagttggagactgt

SEQ ID NO: 544969 - DNA, 25 bp, Rattus norvegicus
taatcccctgccatcaagctggatc

SEQ ID NO: 544970 - DNA, 25 bp, Rattus norvegicus
taatcccctgcctgttggagactgt

SEQ ID NO: 544971 - DNA, 25 bp, Rattus norvegicus
taatcccctgccttcaagctggatc

SEQ ID NO: 544972 - DNA, 25 bp, Rattus norvegicus
taatcccgaggcagattcgttccct

SEQ ID NO: 544973 - DNA, 25 bp, Rattus norvegicus
taatcccgaggctgattcgttccct

SEQ ID NO: 544974 - DNA, 25 bp, Rattus norvegicus
taatcccgatcacccagttgtccat

SEQ ID NO: 544975 - DNA, 25 bp, Rattus norvegicus
taatcccgatcagccagttgtccat

SEQ ID NO: 544976 - DNA, 25 bp, Rattus norvegicus
taatcccgatgcacagaaactcaag

SEQ ID NO: 544977 - DNA, 25 bp, Rattus norvegicus
taatcccgatgctcagaaactcaag

SEQ ID NO: 544978 - DNA, 25 bp, Rattus norvegicus
taatcccggaaactgagtcacctaa

SEQ ID NO: 544979 - DNA, 25 bp, Rattus norvegicus
taatcccggaaagtgagtcacctaa

SEQ ID NO: 544980 - DNA, 25 bp, Rattus norvegicus
taatccctaggcatcaaccctgttc

SEQ ID NO: 544981 - DNA, 25 bp, Rattus norvegicus
taatccctaggcttcaaccctgttc

SEQ ID NO: 544982 - DNA, 25 bp, Rattus norvegicus
taatccctcactatacctgatccag

SEQ ID NO: 544983 - DNA, 25 bp, Rattus norvegicus
taatccctcactttacctgatccag

SEQ ID NO: 544984 - DNA, 25 bp, Rattus norvegicus
taatccctcattacaatgtgtgcct

SEQ ID NO: 544985 - DNA, 25 bp, Rattus norvegicus
taatccctcatttcaatgtgtgcct

SEQ ID NO: 544986 - DNA, 25 bp, Rattus norvegicus
taatccctctaaagacttgccccat

SEQ ID NO: 544987 - DNA, 25 bp, Rattus norvegicus
taatccctctaatgacttgccccat

SEQ ID NO: 544988 - DNA, 25 bp, Rattus norvegicus
taatccctctggctggaatatagac

SEQ ID NO: 544989 - DNA, 25 bp, Rattus norvegicus
taatccctctgggtggaatatagac

SEQ ID NO: 544990 - DNA, 25 bp, Rattus norvegicus
taatccctgcacatactcgggagac

SEQ ID NO: 544991 - DNA, 25 bp, Rattus norvegicus
taatccctgcacttactcgggagac

SEQ ID NO: 544992 - DNA, 25 bp, Rattus norvegicus
taatccctggaaaggttatcagtga

SEQ ID NO: 544993 - DNA, 25 bp, Rattus norvegicus
taatccctggaatggttatcagtga

SEQ ID NO: 544994 - DNA, 25 bp, Rattus norvegicus
taatccctgtgcatactttagagac

SEQ ID NO: 544995 - DNA, 25 bp, Rattus norvegicus
taatccctgtgcttactttagagac

SEQ ID NO: 544996 - DNA, 25 bp, Rattus norvegicus
taatccctttacaccagatctggaa

SEQ ID NO: 544997 - DNA, 25 bp, Rattus norvegicus
taatccctttactccagatctggaa

SEQ ID NO: 544998 - DNA, 25 bp, Rattus norvegicus
taatccgaaggtcgcatcgtctctt

SEQ ID NO: 544999 - DNA, 25 bp, Rattus norvegicus
taatccgaaggtggcatcgtctctt

SEQ ID NO: 545000 - DNA, 25 bp, Rattus norvegicus
taatccgatcacagggaccatgctg

SEQ ID NO: 545001 - DNA, 25 bp, Rattus norvegicus
taatccgatcactgggaccatgctg

SEQ ID NO: 545002 - DNA, 25 bp, Rattus norvegicus
taatccggctgtatggtggctggtt

SEQ ID NO: 545003 - DNA, 25 bp, Rattus norvegicus
taatccggctgtttggtggctggtt

SEQ ID NO: 545004 - DNA, 25 bp, Rattus norvegicus
taatccgggcaacgccaatcttaga

SEQ ID NO: 545005 - DNA, 25 bp, Rattus norvegicus
taatccgggcaaggccaatcttaga

SEQ ID NO: 545006 - DNA, 25 bp, Rattus norvegicus
taatccgggtaaaagaattccataa

SEQ ID NO: 545007 - DNA, 25 bp, Rattus norvegicus
taatccgggtaatagaattccataa

SEQ ID NO: 545008 - DNA, 25 bp, Rattus norvegicus
taatccggtgctccagactgtgtgc

SEQ ID NO: 545009 - DNA, 25 bp, Rattus norvegicus
taatccggtgctgcagactgtgtgc

SEQ ID NO: 545010 - DNA, 25 bp, Rattus norvegicus
taatccgtgctcactttattattac

SEQ ID NO: 545011 - DNA, 25 bp, Rattus norvegicus
taatccgtgctctctttattattac

SEQ ID NO: 545012 - DNA, 25 bp, Rattus norvegicus
taatccgtgctgattggttgtcttc

SEQ ID NO: 545013 - DNA, 25 bp, Rattus norvegicus
taatccgtgctgtttggttgtcttc

SEQ ID NO: 545014 - DNA, 25 bp, Rattus norvegicus
taatccgtgtacattgttctgcgtc

SEQ ID NO: 545015 - DNA, 25 bp, Rattus norvegicus
taatccgtgtactttgttctgcgtc

SEQ ID NO: 545016 - DNA, 25 bp, Rattus norvegicus
taatcctagctaaattttagatatt

SEQ ID NO: 545017 - DNA, 25 bp, Rattus norvegicus
taatcctagctatattttagatatt

SEQ ID NO: 545018 - DNA, 25 bp, Rattus norvegicus
taatcctagtgcagaggcaggtgga

SEQ ID NO: 545019 - DNA, 25 bp, Rattus norvegicus
taatcctagtgctgaggcaggtgga

SEQ ID NO: 545020 - DNA, 25 bp, Rattus norvegicus
taatcctatacaaacgtctgtgcaa

SEQ ID NO: 545021 - DNA, 25 bp, Rattus norvegicus
taatcctatacatacgtctgtgcaa

SEQ ID NO: 545022 - DNA, 25 bp, Rattus norvegicus
taatcctcagcgcagctagtctggg

SEQ ID NO: 545023 - DNA, 25 bp, Rattus norvegicus
taatcctcagcggagctagtctggg

SEQ ID NO: 545024 - DNA, 25 bp, Rattus norvegicus
taatcctcaggcctcttcaggttgg

SEQ ID NO: 545025 - DNA, 25 bp, Rattus norvegicus
taatcctcaggcgtcttcaggttgg

SEQ ID NO: 545026 - DNA, 25 bp, Rattus norvegicus
taatcctccctaacgtgttattcct

SEQ ID NO: 545027 - DNA, 25 bp, Rattus norvegicus
taatcctccctatcgtgttattcct

SEQ ID NO: 545028 - DNA, 25 bp, Rattus norvegicus
taatcctccttcattgctcaataaa

SEQ ID NO: 545029 - DNA, 25 bp, Rattus norvegicus
taatcctccttctttgctcaataaa

SEQ ID NO: 545030 - DNA, 25 bp, Rattus norvegicus
taatcctctagcattaaggtgacaa

SEQ ID NO: 545031 - DNA, 25 bp, Rattus norvegicus
taatcctctagctttaaggtgacaa

SEQ ID NO: 545032 - DNA, 25 bp, Rattus norvegicus
taatcctctgaacactccgtatgct

SEQ ID NO: 545033 - DNA, 25 bp, Rattus norvegicus
taatcctctgaagactccgtatgct

SEQ ID NO: 545034 - DNA, 25 bp, Rattus norvegicus
taatcctctgacacacttttatctg

SEQ ID NO: 545035 - DNA, 25 bp, Rattus norvegicus
taatcctctgactcacttttatctg

SEQ ID NO: 545036 - DNA, 25 bp, Rattus norvegicus
taatcctctttgctcgtctctgcag

SEQ ID NO: 545037 - DNA, 25 bp, Rattus norvegicus
taatcctctttggtcgtctctgcag

SEQ ID NO: 545038 - DNA, 25 bp, Rattus norvegicus
taatcctgaactactggtcttgctt

SEQ ID NO: 545039 - DNA, 25 bp, Rattus norvegicus
taatcctgaacttctggtcttgctt

SEQ ID NO: 545040 - DNA, 25 bp, Rattus norvegicus
taatcctgagctaattaggccccag

SEQ ID NO: 545041 - DNA, 25 bp, Rattus norvegicus
taatcctgagcttattaggccccag

SEQ ID NO: 545042 - DNA, 25 bp, Rattus norvegicus
taatcctgcccaacacaagtgaact

SEQ ID NO: 545043 - DNA, 25 bp, Rattus norvegicus
taatcctgcccatcacaagtgaact

SEQ ID NO: 545044 - DNA, 25 bp, Rattus norvegicus
taatcctgcctgacagtatagcctc

SEQ ID NO: 545045 - DNA, 25 bp, Rattus norvegicus
taatcctgcctgtcagtatagcctc

SEQ ID NO: 545046 - DNA, 25 bp, Rattus norvegicus
taatcctgtctgaccttctcaaagg

SEQ ID NO: 545047 - DNA, 25 bp, Rattus norvegicus
taatcctgtctgtccttctcaaagg

SEQ ID NO: 545048 - DNA, 25 bp, Rattus norvegicus
taatcctgtgacatcctttgaactc

SEQ ID NO: 545049 - DNA, 25 bp, Rattus norvegicus
taatcctgtgacttcctttgaactc

SEQ ID NO: 545050 - DNA, 25 bp, Rattus norvegicus
taatcctgtggcataacgactttcc

SEQ ID NO: 545051 - DNA, 25 bp, Rattus norvegicus
taatcctgtggcttaacgactttcc

SEQ ID NO: 545052 - DNA, 25 bp, Rattus norvegicus
taatcctgtgttcatttcctgtcaa

SEQ ID NO: 545053 - DNA, 25 bp, Rattus norvegicus
taatcctgtgttgatttcctgtcaa

SEQ ID NO: 545054 - DNA, 25 bp, Rattus norvegicus
taatccttagtcctcttcacacaga

SEQ ID NO: 545055 - DNA, 25 bp, Rattus norvegicus
taatccttagtcgtcttcacacaga

SEQ ID NO: 545056 - DNA, 25 bp, Rattus norvegicus
taatccttcagcagtaattacaact

SEQ ID NO: 545057 - DNA, 25 bp, Rattus norvegicus
taatccttcagctgtaattacaact

SEQ ID NO: 545058 - DNA, 25 bp, Rattus norvegicus
taatccttggttcgccggttttgtg

SEQ ID NO: 545059 - DNA, 25 bp, Rattus norvegicus
taatccttggttggccggttttgtg

SEQ ID NO: 545060 - DNA, 25 bp, Rattus norvegicus
taatcctttagcagatcatgtctct

SEQ ID NO: 545061 - DNA, 25 bp, Rattus norvegicus
taatcctttagctgatcatgtctct

SEQ ID NO: 545062 - DNA, 25 bp, Rattus norvegicus
taatcctttctcagaaccttggacc

SEQ ID NO: 545063 - DNA, 25 bp, Rattus norvegicus
taatcctttctctgaaccttggacc

SEQ ID NO: 545064 - DNA, 25 bp, Rattus norvegicus
taatccttttcccaatgcttctctt

SEQ ID NO: 545065 - DNA, 25 bp, Rattus norvegicus
taatccttttccgaatgcttctctt

SEQ ID NO: 545066 - DNA, 25 bp, Rattus norvegicus
taatcgaacacacactctttggcct

SEQ ID NO: 545067 - DNA, 25 bp, Rattus norvegicus
taatcgaacacagactctttggcct

SEQ ID NO: 545068 - DNA, 25 bp, Rattus norvegicus
taatcgaatcagctagctttccctc

SEQ ID NO: 545069 - DNA, 25 bp, Rattus norvegicus
taatcgaatcaggtagctttccctc

SEQ ID NO: 545070 - DNA, 25 bp, Rattus norvegicus
taatcgagtagacccatgtggatct

SEQ ID NO: 545071 - DNA, 25 bp, Rattus norvegicus
taatcgagtagagccatgtggatct

SEQ ID NO: 545072 - DNA, 25 bp, Rattus norvegicus
taatcgatcgatacattgtcttcct

SEQ ID NO: 545073 - DNA, 25 bp, Rattus norvegicus
taatcgatcgattcattgtcttcct

SEQ ID NO: 545074 - DNA, 25 bp, Rattus norvegicus
taatcgatgccgagcttgccataat

SEQ ID NO: 545075 - DNA, 25 bp, Rattus norvegicus
taatcgatgccgtgcttgccataat

SEQ ID NO: 545076 - DNA, 25 bp, Rattus norvegicus
taatcgatgtttccggtgtgtcttc

SEQ ID NO: 545077 - DNA, 25 bp, Rattus norvegicus
taatcgatgtttgcggtgtgtcttc

SEQ ID NO: 545078 - DNA, 25 bp, Rattus norvegicus
taatcgcattgcataggtctgtgga

SEQ ID NO: 545079 - DNA, 25 bp, Rattus norvegicus
taatcgcattgcttaggtctgtgga

SEQ ID NO: 545080 - DNA, 25 bp, Rattus norvegicus
taatcgcgttggcaaccgacgccga

SEQ ID NO: 545081 - DNA, 25 bp, Rattus norvegicus
taatcgcgttgggaaccgacgccga

SEQ ID NO: 545082 - DNA, 25 bp, Rattus norvegicus
taatcgctcagcagcccgagtaaca

SEQ ID NO: 545083 - DNA, 25 bp, Rattus norvegicus
taatcgctcagctgcccgagtaaca

SEQ ID NO: 545084 - DNA, 25 bp, Rattus norvegicus
taatcgcttgcacaagatcttcttg

SEQ ID NO: 545085 - DNA, 25 bp, Rattus norvegicus
taatcgcttgcagaagatcttcttg

SEQ ID NO: 545086 - DNA, 25 bp, Rattus norvegicus
taatcggacaacctttcagaacctt

SEQ ID NO: 545087 - DNA, 25 bp, Rattus norvegicus
taatcggacaacgtttcagaacctt

SEQ ID NO: 545088 - DNA, 25 bp, Rattus norvegicus
taatcggagtacagccctacaaggg

SEQ ID NO: 545089 - DNA, 25 bp, Rattus norvegicus
taatcggagtactgccctacaaggg

SEQ ID NO: 545090 - DNA, 25 bp, Rattus norvegicus
taatcggcccgcacagataaggacg

SEQ ID NO: 545091 - DNA, 25 bp, Rattus norvegicus
taatcggcccgctcagataaggacg

SEQ ID NO: 545092 - DNA, 25 bp, Rattus norvegicus
taatcggcttgtagactgggcatgc

SEQ ID NO: 545093 - DNA, 25 bp, Rattus norvegicus
taatcggcttgttgactgggcatgc

SEQ ID NO: 545094 - DNA, 25 bp, Rattus norvegicus
taatcgggaaccattgagtcaacgt

SEQ ID NO: 545095 - DNA, 25 bp, Rattus norvegicus
taatcgggaacctttgagtcaacgt

SEQ ID NO: 545096 - DNA, 25 bp, Rattus norvegicus
taatcgggaatgacaggtaccagtt

SEQ ID NO: 545097 - DNA, 25 bp, Rattus norvegicus
taatcgggaatgtcaggtaccagtt

SEQ ID NO: 545098 - DNA, 25 bp, Rattus norvegicus
taatcggtctatcacactacctatc

SEQ ID NO: 545099 - DNA, 25 bp, Rattus norvegicus
taatcggtctatgacactacctatc

SEQ ID NO: 545100 - DNA, 25 bp, Rattus norvegicus
taatcggtggtgagctgtgtatcaa

SEQ ID NO: 545101 - DNA, 25 bp, Rattus norvegicus
taatcggtggtgtgctgtgtatcaa

SEQ ID NO: 545102 - DNA, 25 bp, Rattus norvegicus
taatcggtttccctgcaactggatg

SEQ ID NO: 545103 - DNA, 25 bp, Rattus norvegicus
taatcggtttccgtgcaactggatg

SEQ ID NO: 545104 - DNA, 25 bp, Rattus norvegicus
taatcggttttcaccttccatcata

SEQ ID NO: 545105 - DNA, 25 bp, Rattus norvegicus
taatcggttttctccttccatcata

SEQ ID NO: 545106 - DNA, 25 bp, Rattus norvegicus
taatcgtcaaatacactagctaaga

SEQ ID NO: 545107 - DNA, 25 bp, Rattus norvegicus
taatcgtcaaattcactagctaaga

SEQ ID NO: 545108 - DNA, 25 bp, Rattus norvegicus
taatcgtctgtgagtttggaactgt

SEQ ID NO: 545109 - DNA, 25 bp, Rattus norvegicus
taatcgtctgtgtgtttggaactgt

SEQ ID NO: 545110 - DNA, 25 bp, Rattus norvegicus
taatcgtggtccagctgccccagtt

SEQ ID NO: 545111 - DNA, 25 bp, Rattus norvegicus
taatcgtggtcctgctgccccagtt

SEQ ID NO: 545112 - DNA, 25 bp, Rattus norvegicus
taatcgttataccacttgctagttc

SEQ ID NO: 545113 - DNA, 25 bp, Rattus norvegicus
taatcgttatacgacttgctagttc

SEQ ID NO: 545114 - DNA, 25 bp, Rattus norvegicus
taatcgttcaacagaggcagctcca

SEQ ID NO: 545115 - DNA, 25 bp, Rattus norvegicus
taatcgttcaactgaggcagctcca

SEQ ID NO: 545116 - DNA, 25 bp, Rattus norvegicus
taatcgtttagtctttcttcccctg

SEQ ID NO: 545117 - DNA, 25 bp, Rattus norvegicus
taatcgtttagtgtttcttcccctg

SEQ ID NO: 545118 - DNA, 25 bp, Rattus norvegicus
taatctaccactcccatctgtggtt

SEQ ID NO: 545119 - DNA, 25 bp, Rattus norvegicus
taatctaccactgccatctgtggtt

SEQ ID NO: 545120 - DNA, 25 bp, Rattus norvegicus
taatctacctagactctggtgccaa

SEQ ID NO: 545121 - DNA, 25 bp, Rattus norvegicus
taatctacctagtctctggtgccaa

SEQ ID NO: 545122 - DNA, 25 bp, Rattus norvegicus
taatctagagcgaccatgtgtgtct

SEQ ID NO: 545123 - DNA, 25 bp, Rattus norvegicus
taatctagagcgtccatgtgtgtct

SEQ ID NO: 545124 - DNA, 25 bp, Rattus norvegicus
taatctagagtgctgtctacagtct

SEQ ID NO: 545125 - DNA, 25 bp, Rattus norvegicus
taatctagagtggtgtctacagtct

SEQ ID NO: 545126 - DNA, 25 bp, Rattus norvegicus
taatctagtatccaggacgcctgcc

SEQ ID NO: 545127 - DNA, 25 bp, Rattus norvegicus
taatctagtatcgaggacgcctgcc

SEQ ID NO: 545128 - DNA, 25 bp, Rattus norvegicus
taatctatacacagcatgctgggat

SEQ ID NO: 545129 - DNA, 25 bp, Rattus norvegicus
taatctatacactgcatgctgggat

SEQ ID NO: 545130 - DNA, 25 bp, Rattus norvegicus
taatctatgcaaccggctgcagccg

SEQ ID NO: 545131 - DNA, 25 bp, Rattus norvegicus
taatctatgcaagcggctgcagccg

SEQ ID NO: 545132 - DNA, 25 bp, Rattus norvegicus
taatctatgtcaatggctctgtgcc

SEQ ID NO: 545133 - DNA, 25 bp, Rattus norvegicus
taatctatgtcattggctctgtgcc

SEQ ID NO: 545134 - DNA, 25 bp, Rattus norvegicus
taatctatttaaccagcctctgtgt

SEQ ID NO: 545135 - DNA, 25 bp, Rattus norvegicus
taatctatttaagcagcctctgtgt

SEQ ID NO: 545136 - DNA, 25 bp, Rattus norvegicus
taatctcaaaacactcatcctggga

SEQ ID NO: 545137 - DNA, 25 bp, Rattus norvegicus
taatctcaaaactctcatcctggga

SEQ ID NO: 545138 - DNA, 25 bp, Rattus norvegicus
taatctcaaatgaatctctcacagg

SEQ ID NO: 545139 - DNA, 25 bp, Rattus norvegicus
taatctcaaatgtatctctcacagg

SEQ ID NO: 545140 - DNA, 25 bp, Rattus norvegicus
taatctcaccatagatgacctttgt

SEQ ID NO: 545141 - DNA, 25 bp, Rattus norvegicus
taatctcaccattgatgacctttgt

SEQ ID NO: 545142 - DNA, 25 bp, Rattus norvegicus
taatctcacgataccagttctcaaa

SEQ ID NO: 545143 - DNA, 25 bp, Rattus norvegicus
taatctcacgattccagttctcaaa

SEQ ID NO: 545144 - DNA, 25 bp, Rattus norvegicus
taatctcagcacactagtgaccaag

SEQ ID NO: 545145 - DNA, 25 bp, Rattus norvegicus
taatctcagcactctagtgaccaag

SEQ ID NO: 545146 - DNA, 25 bp, Rattus norvegicus
taatctcagtggagtttgggcttct

SEQ ID NO: 545147 - DNA, 25 bp, Rattus norvegicus
taatctcagtggtgtttgggcttct

SEQ ID NO: 545148 - DNA, 25 bp, Rattus norvegicus
taatctcattgcaccttgcttcgta

SEQ ID NO: 545149 - DNA, 25 bp, Rattus norvegicus
taatctcattgctccttgcttcgta

SEQ ID NO: 545150 - DNA, 25 bp, Rattus norvegicus
taatctccaaacattgtggcttgtt

SEQ ID NO: 545151 - DNA, 25 bp, Rattus norvegicus
taatctccaaactttgtggcttgtt

SEQ ID NO: 545152 - DNA, 25 bp, Rattus norvegicus
taatctccactcaaaggctgtcaag

SEQ ID NO: 545153 - DNA, 25 bp, Rattus norvegicus
taatctccactctaaggctgtcaag

SEQ ID NO: 545154 - DNA, 25 bp, Rattus norvegicus
taatctccacttccaggcttaatgg

SEQ ID NO: 545155 - DNA, 25 bp, Rattus norvegicus
taatctccacttgcaggcttaatgg

SEQ ID NO: 545156 - DNA, 25 bp, Rattus norvegicus
taatctccagatacaagttgctaag

SEQ ID NO: 545157 - DNA, 25 bp, Rattus norvegicus
taatctccagattcaagttgctaag

SEQ ID NO: 545158 - DNA, 25 bp, Rattus norvegicus
taatctccaggccttaagaactctt

SEQ ID NO: 545159 - DNA, 25 bp, Rattus norvegicus
taatctccaggcgttaagaactctt

SEQ ID NO: 545160 - DNA, 25 bp, Rattus norvegicus
taatctccagtcatagcacagtgtg

SEQ ID NO: 545161 - DNA, 25 bp, Rattus norvegicus
taatctccagtcttagcacagtgtg

SEQ ID NO: 545162 - DNA, 25 bp, Rattus norvegicus
taatctcccactcattcttgaagac

SEQ ID NO: 545163 - DNA, 25 bp, Rattus norvegicus
taatctcccactgattcttgaagac

SEQ ID NO: 545164 - DNA, 25 bp, Rattus norvegicus
taatctcccaggctgatgtgcactc

SEQ ID NO: 545165 - DNA, 25 bp, Rattus norvegicus
taatctcccagggtgatgtgcactc

SEQ ID NO: 545166 - DNA, 25 bp, Rattus norvegicus
taatctcccctccatggacttttta

SEQ ID NO: 545167 - DNA, 25 bp, Rattus norvegicus
taatctcccctcgatggacttttta

SEQ ID NO: 545168 - DNA, 25 bp, Rattus norvegicus
taatctccccttatctgtgcaatgc

SEQ ID NO: 545169 - DNA, 25 bp, Rattus norvegicus
taatctccccttttctgtgcaatgc

SEQ ID NO: 545170 - DNA, 25 bp, Rattus norvegicus
taatctcctgtgctggaaccactac

SEQ ID NO: 545171 - DNA, 25 bp, Rattus norvegicus
taatctcctgtggtggaaccactac

SEQ ID NO: 545172 - DNA, 25 bp, Rattus norvegicus
taatctctaatgagtctgtttgcaa

SEQ ID NO: 545173 - DNA, 25 bp, Rattus norvegicus
taatctctaatgtgtctgtttgcaa

SEQ ID NO: 545174 - DNA, 25 bp, Rattus norvegicus
taatctctccaactcattaagtcag

SEQ ID NO: 545175 - DNA, 25 bp, Rattus norvegicus
taatctctccaagtcattaagtcag

SEQ ID NO: 545176 - DNA, 25 bp, Rattus norvegicus
taatctctccttcacgttctgacta

SEQ ID NO: 545177 - DNA, 25 bp, Rattus norvegicus
taatctctccttgacgttctgacta

SEQ ID NO: 545178 - DNA, 25 bp, Rattus norvegicus
taatctctctccattgttgtacaca

SEQ ID NO: 545179 - DNA, 25 bp, Rattus norvegicus
taatctctctcctttgttgtacaca

SEQ ID NO: 545180 - DNA, 25 bp, Rattus norvegicus
taatctctctgtaaccctggaaacg

SEQ ID NO: 545181 - DNA, 25 bp, Rattus norvegicus
taatctctctgttaccctggaaacg

SEQ ID NO: 545182 - DNA, 25 bp, Rattus norvegicus
taatctctgagaaaggctgccccta

SEQ ID NO: 545183 - DNA, 25 bp, Rattus norvegicus
taatctctgagataggctgccccta

SEQ ID NO: 545184 - DNA, 25 bp, Rattus norvegicus
taatctctggccatcacatacatgt

SEQ ID NO: 545185 - DNA, 25 bp, Rattus norvegicus
taatctctggccttcacatacatgt

SEQ ID NO: 545186 - DNA, 25 bp, Rattus norvegicus
taatctcttcgaacctgctgggatg

SEQ ID NO: 545187 - DNA, 25 bp, Rattus norvegicus
taatctcttcgatcctgctgggatg

SEQ ID NO: 545188 - DNA, 25 bp, Rattus norvegicus
taatctgaaactctcacagtcggcc

SEQ ID NO: 545189 - DNA, 25 bp, Rattus norvegicus
taatctgaaactgtcacagtcggcc

SEQ ID NO: 545190 - DNA, 25 bp, Rattus norvegicus
taatctgaaatgcttgaaaaatcca

SEQ ID NO: 545191 - DNA, 25 bp, Rattus norvegicus
taatctgaaatggttgaaaaatcca

SEQ ID NO: 545192 - DNA, 25 bp, Rattus norvegicus
taatctgaacttatactttggaatg

SEQ ID NO: 545193 - DNA, 25 bp, Rattus norvegicus
taatctgaacttttactttggaatg

SEQ ID NO: 545194 - DNA, 25 bp, Rattus norvegicus
taatctgactttctcagcagtttaa

SEQ ID NO: 545195 - DNA, 25 bp, Rattus norvegicus
taatctgactttgtcagcagtttaa

SEQ ID NO: 545196 - DNA, 25 bp, Rattus norvegicus
taatctgaggctatcttcccgtgag

SEQ ID NO: 545197 - DNA, 25 bp, Rattus norvegicus
taatctgaggctttcttcccgtgag

SEQ ID NO: 545198 - DNA, 25 bp, Rattus norvegicus
taatctgatgtcaccgaagagccat

SEQ ID NO: 545199 - DNA, 25 bp, Rattus norvegicus
taatctgatgtctccgaagagccat

SEQ ID NO: 545200 - DNA, 25 bp, Rattus norvegicus
taatctgcaaccagctgcgtagaca

SEQ ID NO: 545201 - DNA, 25 bp, Rattus norvegicus
taatctgcaacctgctgcgtagaca

SEQ ID NO: 545202 - DNA, 25 bp, Rattus norvegicus
taatctgcacagcttatcttgactt

SEQ ID NO: 545203 - DNA, 25 bp, Rattus norvegicus
taatctgcacaggttatcttgactt

SEQ ID NO: 545204 - DNA, 25 bp, Rattus norvegicus
taatctgcacccacctgtgctgtag

SEQ ID NO: 545205 - DNA, 25 bp, Rattus norvegicus
taatctgcaccctcctgtgctgtag

SEQ ID NO: 545206 - DNA, 25 bp, Rattus norvegicus
taatctgcatgtctgtctccagtga

SEQ ID NO: 545207 - DNA, 25 bp, Rattus norvegicus
taatctgcatgtgtgtctccagtga

SEQ ID NO: 545208 - DNA, 25 bp, Rattus norvegicus
taatctgcatttctgagaagcccca

SEQ ID NO: 545209 - DNA, 25 bp, Rattus norvegicus
taatctgcatttgtgagaagcccca

SEQ ID NO: 545210 - DNA, 25 bp, Rattus norvegicus
taatctggatgcacgtaacttgtat

SEQ ID NO: 545211 - DNA, 25 bp, Rattus norvegicus
taatctggatgctcgtaacttgtat

SEQ ID NO: 545212 - DNA, 25 bp, Rattus norvegicus
taatctgggtttcttctgagtttcc

SEQ ID NO: 545213 - DNA, 25 bp, Rattus norvegicus
taatctgggtttgttctgagtttcc

SEQ ID NO: 545214 - DNA, 25 bp, Rattus norvegicus
taatctggtagcaacatagtagtcc

SEQ ID NO: 545215 - DNA, 25 bp, Rattus norvegicus
taatctggtagctacatagtagtcc

SEQ ID NO: 545216 - DNA, 25 bp, Rattus norvegicus
taatctggtcccagtttgtccagac

SEQ ID NO: 545217 - DNA, 25 bp, Rattus norvegicus
taatctggtccctgtttgtccagac

SEQ ID NO: 545218 - DNA, 25 bp, Rattus norvegicus
taatctggtctaaattgctcctgag

SEQ ID NO: 545219 - DNA, 25 bp, Rattus norvegicus
taatctggtctatattgctcctgag

SEQ ID NO: 545220 - DNA, 25 bp, Rattus norvegicus
taatctgtaatgataccgcttcgga

SEQ ID NO: 545221 - DNA, 25 bp, Rattus norvegicus
taatctgtaatgttaccgcttcgga

SEQ ID NO: 545222 - DNA, 25 bp, Rattus norvegicus
taatctgtcatcctggcccgctttg

SEQ ID NO: 545223 - DNA, 25 bp, Rattus norvegicus
taatctgtcatcgtggcccgctttg

SEQ ID NO: 545224 - DNA, 25 bp, Rattus norvegicus
taatctgtcccaagacacttttctc

SEQ ID NO: 545225 - DNA, 25 bp, Rattus norvegicus
taatctgtcccatgacacttttctc

SEQ ID NO: 545226 - DNA, 25 bp, Rattus norvegicus
taatctgtctgcataagtgtgctca

SEQ ID NO: 545227 - DNA, 25 bp, Rattus norvegicus
taatctgtctgcttaagtgtgctca

SEQ ID NO: 545228 - DNA, 25 bp, Rattus norvegicus
taatctgtgcagctgtctgccagga

SEQ ID NO: 545229 - DNA, 25 bp, Rattus norvegicus
taatctgtgcaggtgtctgccagga

SEQ ID NO: 545230 - DNA, 25 bp, Rattus norvegicus
taatctgtgccgctgctttaaaagt

SEQ ID NO: 545231 - DNA, 25 bp, Rattus norvegicus
taatctgtgccggtgctttaaaagt

SEQ ID NO: 545232 - DNA, 25 bp, Rattus norvegicus
taatctgtggctcgttaagtttgca

SEQ ID NO: 545233 - DNA, 25 bp, Rattus norvegicus
taatctgtggctggttaagtttgca

SEQ ID NO: 545234 - DNA, 25 bp, Rattus norvegicus
taatctgtgttcactgcttgctttt

SEQ ID NO: 545235 - DNA, 25 bp, Rattus norvegicus
taatctgtgttctctgcttgctttt

SEQ ID NO: 545236 - DNA, 25 bp, Rattus norvegicus
taatctgtgtttacgtttcattgaa

SEQ ID NO: 545237 - DNA, 25 bp, Rattus norvegicus
taatctgtgttttcgtttcattgaa

SEQ ID NO: 545238 - DNA, 25 bp, Rattus norvegicus
taatctgttaagagtgtgccgctcc

SEQ ID NO: 545239 - DNA, 25 bp, Rattus norvegicus
taatctgttaagtgtgtgccgctcc

SEQ ID NO: 545240 - DNA, 25 bp, Rattus norvegicus
taatctgttttgagtcttatgtgaa

SEQ ID NO: 545241 - DNA, 25 bp, Rattus norvegicus
taatctgttttgtgtcttatgtgaa

SEQ ID NO: 545242 - DNA, 25 bp, Rattus norvegicus
taatcttaaatgctattcttcacaa

SEQ ID NO: 545243 - DNA, 25 bp, Rattus norvegicus
taatcttaaatggtattcttcacaa

SEQ ID NO: 545244 - DNA, 25 bp, Rattus norvegicus
taatcttaacctcagctcagccgtg

SEQ ID NO: 545245 - DNA, 25 bp, Rattus norvegicus
taatcttaacctgagctcagccgtg

SEQ ID NO: 545246 - DNA, 25 bp, Rattus norvegicus
taatcttaccaactgaccatactgt

SEQ ID NO: 545247 - DNA, 25 bp, Rattus norvegicus
taatcttaccaagtgaccatactgt

SEQ ID NO: 545248 - DNA, 25 bp, Rattus norvegicus
taatcttactgcagttgtgaatcgt

SEQ ID NO: 545249 - DNA, 25 bp, Rattus norvegicus
taatcttactgctgttgtgaatcgt

SEQ ID NO: 545250 - DNA, 25 bp, Rattus norvegicus
taatcttagcacacacccggccaag

SEQ ID NO: 545251 - DNA, 25 bp, Rattus norvegicus
taatcttagcactcacccggccaag

SEQ ID NO: 545252 - DNA, 25 bp, Rattus norvegicus
taatcttatcctcagaagcccctgg

SEQ ID NO: 545253 - DNA, 25 bp, Rattus norvegicus
taatcttatcctgagaagcccctgg

SEQ ID NO: 545254 - DNA, 25 bp, Rattus norvegicus
taatcttattaaacctccactcaac

SEQ ID NO: 545255 - DNA, 25 bp, Rattus norvegicus
taatcttattaatcctccactcaac

SEQ ID NO: 545256 - DNA, 25 bp, Rattus norvegicus
taatcttatttcctttcacccttct

SEQ ID NO: 545257 - DNA, 25 bp, Rattus norvegicus
taatcttatttcgtttcacccttct

SEQ ID NO: 545258 - DNA, 25 bp, Rattus norvegicus
taatcttcattgataactttgctgg

SEQ ID NO: 545259 - DNA, 25 bp, Rattus norvegicus
taatcttcattgattttgcagggac

SEQ ID NO: 545260 - DNA, 25 bp, Rattus norvegicus
taatcttcattgttaactttgctgg

SEQ ID NO: 545261 - DNA, 25 bp, Rattus norvegicus
taatcttcattgtttttgcagggac

SEQ ID NO: 545262 - DNA, 25 bp, Rattus norvegicus
taatcttccaacagataagctggct

SEQ ID NO: 545263 - DNA, 25 bp, Rattus norvegicus
taatcttccaactgataagctggct

SEQ ID NO: 545264 - DNA, 25 bp, Rattus norvegicus
taatcttccagcatacaggagcact

SEQ ID NO: 545265 - DNA, 25 bp, Rattus norvegicus
taatcttccagcttacaggagcact

SEQ ID NO: 545266 - DNA, 25 bp, Rattus norvegicus
taatcttcctgaccaatgacttggc

SEQ ID NO: 545267 - DNA, 25 bp, Rattus norvegicus
taatcttcctgagcaatgacttggc

SEQ ID NO: 545268 - DNA, 25 bp, Rattus norvegicus
taatcttccttgcatctgttgccct

SEQ ID NO: 545269 - DNA, 25 bp, Rattus norvegicus
taatcttccttggatctgttgccct

SEQ ID NO: 545270 - DNA, 25 bp, Rattus norvegicus
taatcttctctgctgtatggtctgc

SEQ ID NO: 545271 - DNA, 25 bp, Rattus norvegicus
taatcttctctggtgtatggtctgc

SEQ ID NO: 545272 - DNA, 25 bp, Rattus norvegicus
taatcttctggcaatcctgtggaga

SEQ ID NO: 545273 - DNA, 25 bp, Rattus norvegicus
taatcttctggctatcctgtggaga

SEQ ID NO: 545274 - DNA, 25 bp, Rattus norvegicus
taatcttgacctcattttagctccc

SEQ ID NO: 545275 - DNA, 25 bp, Rattus norvegicus
taatcttgacctgattttagctccc

SEQ ID NO: 545276 - DNA, 25 bp, Rattus norvegicus
taatcttgcagtcctcttttaggca

SEQ ID NO: 545277 - DNA, 25 bp, Rattus norvegicus
taatcttgcagtgctcttttaggca

SEQ ID NO: 545278 - DNA, 25 bp, Rattus norvegicus
taatcttgctttcgactgttgttct

SEQ ID NO: 545279 - DNA, 25 bp, Rattus norvegicus
taatcttgctttggactgttgttct

SEQ ID NO: 545280 - DNA, 25 bp, Rattus norvegicus
taatcttggcaaacctacacggcat

SEQ ID NO: 545281 - DNA, 25 bp, Rattus norvegicus
taatcttggcaatcctacacggcat

SEQ ID NO: 545282 - DNA, 25 bp, Rattus norvegicus
taatcttggctgagtcctatgtgtc

SEQ ID NO: 545283 - DNA, 25 bp, Rattus norvegicus
taatcttggctgtgtcctatgtgtc

SEQ ID NO: 545284 - DNA, 25 bp, Rattus norvegicus
taatcttggttcctaacatgcctcc

SEQ ID NO: 545285 - DNA, 25 bp, Rattus norvegicus
taatcttggttcgtaacatgcctcc

SEQ ID NO: 545286 - DNA, 25 bp, Rattus norvegicus
taatcttgtaacaatcacgctccac

SEQ ID NO: 545287 - DNA, 25 bp, Rattus norvegicus
taatcttgtaactatcacgctccac

SEQ ID NO: 545288 - DNA, 25 bp, Rattus norvegicus
taatcttgtattctgctgtctggcc

SEQ ID NO: 545289 - DNA, 25 bp, Rattus norvegicus
taatcttgtattgtgctgtctggcc

SEQ ID NO: 545290 - DNA, 25 bp, Rattus norvegicus
taatcttgtcttcccaacttgacac

SEQ ID NO: 545291 - DNA, 25 bp, Rattus norvegicus
taatcttgtcttgccaacttgacac

SEQ ID NO: 545292 - DNA, 25 bp, Rattus norvegicus
taatcttgtgatatccacatcataa

SEQ ID NO: 545293 - DNA, 25 bp, Rattus norvegicus
taatcttgtgatttccacatcataa

SEQ ID NO: 545294 - DNA, 25 bp, Rattus norvegicus
taatcttgtgctatttacatcccag

SEQ ID NO: 545295 - DNA, 25 bp, Rattus norvegicus
taatcttgtgctttttacatcccag

SEQ ID NO: 545296 - DNA, 25 bp, Rattus norvegicus
taatcttgtttcagtcatccgttgt

SEQ ID NO: 545297 - DNA, 25 bp, Rattus norvegicus
taatcttgtttctgtcatccgttgt

SEQ ID NO: 545298 - DNA, 25 bp, Rattus norvegicus
taatctttatgaactctccaactgt

SEQ ID NO: 545299 - DNA, 25 bp, Rattus norvegicus
taatctttatgatctctccaactgt

SEQ ID NO: 545300 - DNA, 25 bp, Rattus norvegicus
taatctttattaccattgttgttgt

SEQ ID NO: 545301 - DNA, 25 bp, Rattus norvegicus
taatctttattagcattgttgttgt

SEQ ID NO: 545302 - DNA, 25 bp, Rattus norvegicus
taatctttccgccagagtggtatct

SEQ ID NO: 545303 - DNA, 25 bp, Rattus norvegicus
taatctttccgcgagagtggtatct

SEQ ID NO: 545304 - DNA, 25 bp, Rattus norvegicus
taatctttgaagactctggtatttc

SEQ ID NO: 545305 - DNA, 25 bp, Rattus norvegicus
taatctttgaagtctctggtatttc

SEQ ID NO: 545306 - DNA, 25 bp, Rattus norvegicus
taatctttggttacatcatcccttt

SEQ ID NO: 545307 - DNA, 25 bp, Rattus norvegicus
taatctttggtttcatcatcccttt

SEQ ID NO: 545308 - DNA, 25 bp, Rattus norvegicus
taatctttgtgtcactaggcctgga

SEQ ID NO: 545309 - DNA, 25 bp, Rattus norvegicus
taatctttgtgtgactaggcctgga

SEQ ID NO: 545310 - DNA, 25 bp, Rattus norvegicus
taatcttttaatcctgccttttagt

SEQ ID NO: 545311 - DNA, 25 bp, Rattus norvegicus
taatcttttaatgctgccttttagt

SEQ ID NO: 545312 - DNA, 25 bp, Rattus norvegicus
taatcttttataatcacggcatggg

SEQ ID NO: 545313 - DNA, 25 bp, Rattus norvegicus
taatcttttatattcacggcatggg

SEQ ID NO: 545314 - DNA, 25 bp, Rattus norvegicus
taatcttttgacatcagctctgcca

SEQ ID NO: 545315 - DNA, 25 bp, Rattus norvegicus
taatcttttgacttcagctctgcca

SEQ ID NO: 545316 - DNA, 25 bp, Rattus norvegicus
taatcttttttaatcctgcaggttt

SEQ ID NO: 545317 - DNA, 25 bp, Rattus norvegicus
taatcttttttattcctgcaggttt

SEQ ID NO: 545318 - DNA, 25 bp, Rattus norvegicus
taatgaaaactcagatccctccttc

SEQ ID NO: 545319 - DNA, 25 bp, Rattus norvegicus
taatgaaaactctgatccctccttc

SEQ ID NO: 545320 - DNA, 25 bp, Rattus norvegicus
taatgaaactgacagcattcggtat

SEQ ID NO: 545321 - DNA, 25 bp, Rattus norvegicus
taatgaaactgagagcattcggtat

SEQ ID NO: 545322 - DNA, 25 bp, Rattus norvegicus
taatgaaactggctgttcaggccca

SEQ ID NO: 545323 - DNA, 25 bp, Rattus norvegicus
taatgaaactgggtgttcaggccca

SEQ ID NO: 545324 - DNA, 25 bp, Rattus norvegicus
taatgaaagccaatgccattcctcc

SEQ ID NO: 545325 - DNA, 25 bp, Rattus norvegicus
taatgaaagccattgccattcctcc

SEQ ID NO: 545326 - DNA, 25 bp, Rattus norvegicus
taatgaaaggagctctaccagttgg

SEQ ID NO: 545327 - DNA, 25 bp, Rattus norvegicus
taatgaaaggaggtctaccagttgg

SEQ ID NO: 545328 - DNA, 25 bp, Rattus norvegicus
taatgaaccttgactgacccagcta

SEQ ID NO: 545329 - DNA, 25 bp, Rattus norvegicus
taatgaaccttgtctgacccagcta

SEQ ID NO: 545330 - DNA, 25 bp, Rattus norvegicus
taatgaacggtacctcatcgctgca

SEQ ID NO: 545331 - DNA, 25 bp, Rattus norvegicus
taatgaacggtagctcatcgctgca

SEQ ID NO: 545332 - DNA, 25 bp, Rattus norvegicus
taatgaacttcccttcaaacagctg

SEQ ID NO: 545333 - DNA, 25 bp, Rattus norvegicus
taatgaacttccgttcaaacagctg

SEQ ID NO: 545334 - DNA, 25 bp, Rattus norvegicus
taatgaactttaactcacctttcga

SEQ ID NO: 545335 - DNA, 25 bp, Rattus norvegicus
taatgaactttatctcacctttcga

SEQ ID NO: 545336 - DNA, 25 bp, Rattus norvegicus
taatgaagaccaagtgagggctgtg

SEQ ID NO: 545337 - DNA, 25 bp, Rattus norvegicus
taatgaagaccatgtgagggctgtg

SEQ ID NO: 545338 - DNA, 25 bp, Rattus norvegicus
taatgaagagctccctgtttctttc

SEQ ID NO: 545339 - DNA, 25 bp, Rattus norvegicus
taatgaagagctgcctgtttctttc

SEQ ID NO: 545340 - DNA, 25 bp, Rattus norvegicus
taatgaagcagtctgctcggccact

SEQ ID NO: 545341 - DNA, 25 bp, Rattus norvegicus
taatgaagcagtgtgctcggccact

SEQ ID NO: 545342 - DNA, 25 bp, Rattus norvegicus
taatgaagccaactcttccttcctc

SEQ ID NO: 545343 - DNA, 25 bp, Rattus norvegicus
taatgaagccaagtcttccttcctc

SEQ ID NO: 545344 - DNA, 25 bp, Rattus norvegicus
taatgaagcctacacctggaccaac

SEQ ID NO: 545345 - DNA, 25 bp, Rattus norvegicus
taatgaagcctagacctggaccaac

SEQ ID NO: 545346 - DNA, 25 bp, Rattus norvegicus
taatgaagctcaacactgtggtagg

SEQ ID NO: 545347 - DNA, 25 bp, Rattus norvegicus
taatgaagctcatcactgtggtagg

SEQ ID NO: 545348 - DNA, 25 bp, Rattus norvegicus
taatgaaggactcttctcccttgtg

SEQ ID NO: 545349 - DNA, 25 bp, Rattus norvegicus
taatgaaggactgttctcccttgtg

SEQ ID NO: 545350 - DNA, 25 bp, Rattus norvegicus
taatgaaggcctcgtcttgccagcc

SEQ ID NO: 545351 - DNA, 25 bp, Rattus norvegicus
taatgaaggcctggtcttgccagcc

SEQ ID NO: 545352 - DNA, 25 bp, Rattus norvegicus
taatgaagtccaactttcctctttc

SEQ ID NO: 545353 - DNA, 25 bp, Rattus norvegicus
taatgaagtccatctttcctctttc

SEQ ID NO: 545354 - DNA, 25 bp, Rattus norvegicus
taatgaagtcctcagctgatccaga

SEQ ID NO: 545355 - DNA, 25 bp, Rattus norvegicus
taatgaagtcctgagctgatccaga

SEQ ID NO: 545356 - DNA, 25 bp, Rattus norvegicus
taatgaagtgccaatgaagtccata

SEQ ID NO: 545357 - DNA, 25 bp, Rattus norvegicus
taatgaagtgcctatgaagtccata

SEQ ID NO: 545358 - DNA, 25 bp, Rattus norvegicus
taatgaatacgcctgcctcaaagcc

SEQ ID NO: 545359 - DNA, 25 bp, Rattus norvegicus
taatgaatacgcgtgcctcaaagcc

SEQ ID NO: 545360 - DNA, 25 bp, Rattus norvegicus
taatgaatccaacgccctggctttc

SEQ ID NO: 545361 - DNA, 25 bp, Rattus norvegicus
taatgaatccaaggccctggctttc

SEQ ID NO: 545362 - DNA, 25 bp, Rattus norvegicus
taatgaattgaactcccctctctgt

SEQ ID NO: 545363 - DNA, 25 bp, Rattus norvegicus
taatgaattgaagtcccctctctgt

SEQ ID NO: 545364 - DNA, 25 bp, Rattus norvegicus
taatgacaaaggaggccctgtggtc

SEQ ID NO: 545365 - DNA, 25 bp, Rattus norvegicus
taatgacaaaggtggccctgtggtc

SEQ ID NO: 545366 - DNA, 25 bp, Rattus norvegicus
taatgacaaagtcccttccaaggct

SEQ ID NO: 545367 - DNA, 25 bp, Rattus norvegicus
taatgacaaagtgccttccaaggct

SEQ ID NO: 545368 - DNA, 25 bp, Rattus norvegicus
taatgacaggatcagtcctcctctg

SEQ ID NO: 545369 - DNA, 25 bp, Rattus norvegicus
taatgacaggatgagtcctcctctg

SEQ ID NO: 545370 - DNA, 25 bp, Rattus norvegicus
taatgacagtacattctccatgaaa

SEQ ID NO: 545371 - DNA, 25 bp, Rattus norvegicus
taatgacagtactttctccatgaaa

SEQ ID NO: 545372 - DNA, 25 bp, Rattus norvegicus
taatgacagtatactccccatcaaa

SEQ ID NO: 545373 - DNA, 25 bp, Rattus norvegicus
taatgacagtattctccccatcaaa

SEQ ID NO: 545374 - DNA, 25 bp, Rattus norvegicus
taatgacatgcgacatcccagcggg

SEQ ID NO: 545375 - DNA, 25 bp, Rattus norvegicus
taatgacatgcgtcatcccagcggg

SEQ ID NO: 545376 - DNA, 25 bp, Rattus norvegicus
taatgacccatactgaggcccgtag

SEQ ID NO: 545377 - DNA, 25 bp, Rattus norvegicus
taatgacccatagtgaggcccgtag

SEQ ID NO: 545378 - DNA, 25 bp, Rattus norvegicus
taatgaccgttcaagttctctccac

SEQ ID NO: 545379 - DNA, 25 bp, Rattus norvegicus
taatgaccgttctagttctctccac

SEQ ID NO: 545380 - DNA, 25 bp, Rattus norvegicus
taatgaccgttgaggttccaacctc

SEQ ID NO: 545381 - DNA, 25 bp, Rattus norvegicus
taatgaccgttgtggttccaacctc

SEQ ID NO: 545382 - DNA, 25 bp, Rattus norvegicus
taatgacgcggtccttttcctaatc

SEQ ID NO: 545383 - DNA, 25 bp, Rattus norvegicus
taatgacgcggtgcttttcctaatc

SEQ ID NO: 545384 - DNA, 25 bp, Rattus norvegicus
taatgactaccaaaccgtacctcat

SEQ ID NO: 545385 - DNA, 25 bp, Rattus norvegicus
taatgactaccataccgtacctcat

SEQ ID NO: 545386 - DNA, 25 bp, Rattus norvegicus
taatgactcactcattcctggttgc

SEQ ID NO: 545387 - DNA, 25 bp, Rattus norvegicus
taatgactcactgattcctggttgc

SEQ ID NO: 545388 - DNA, 25 bp, Rattus norvegicus
taatgactcctgcaagcagtgcccc

SEQ ID NO: 545389 - DNA, 25 bp, Rattus norvegicus
taatgactcctggaagcagtgcccc

SEQ ID NO: 545390 - DNA, 25 bp, Rattus norvegicus
taatgactcggacagtggcagtgat

SEQ ID NO: 545391 - DNA, 25 bp, Rattus norvegicus
taatgactcggagagtggcagtgat

SEQ ID NO: 545392 - DNA, 25 bp, Rattus norvegicus
taatgactgggaatgtcttctggga

SEQ ID NO: 545393 - DNA, 25 bp, Rattus norvegicus
taatgactgggattgtcttctggga

SEQ ID NO: 545394 - DNA, 25 bp, Rattus norvegicus
taatgactgttcacagcatagctga

SEQ ID NO: 545395 - DNA, 25 bp, Rattus norvegicus
taatgactgttctcagcatagctga

SEQ ID NO: 545396 - DNA, 25 bp, Rattus norvegicus
taatgactgtttctcttggtcctca

SEQ ID NO: 545397 - DNA, 25 bp, Rattus norvegicus
taatgactgtttgtcttggtcctca

SEQ ID NO: 545398 - DNA, 25 bp, Rattus norvegicus
taatgacttaaaaacccactctggt

SEQ ID NO: 545399 - DNA, 25 bp, Rattus norvegicus
taatgacttaaatacccactctggt

SEQ ID NO: 545400 - DNA, 25 bp, Rattus norvegicus
taatgagaagatcctgctcctgcag

SEQ ID NO: 545401 - DNA, 25 bp, Rattus norvegicus
taatgagaagatgctgctcctgcag

SEQ ID NO: 545402 - DNA, 25 bp, Rattus norvegicus
taatgagaccagagcagcatccctg

SEQ ID NO: 545403 - DNA, 25 bp, Rattus norvegicus
taatgagaccagtgcagcatccctg

SEQ ID NO: 545404 - DNA, 25 bp, Rattus norvegicus
taatgagaccatcggtccttctccc

SEQ ID NO: 545405 - DNA, 25 bp, Rattus norvegicus
taatgagaccatgggtccttctccc

SEQ ID NO: 545406 - DNA, 25 bp, Rattus norvegicus
taatgagacgtaacccatctgtgtt

SEQ ID NO: 545407 - DNA, 25 bp, Rattus norvegicus
taatgagacgtatcccatctgtgtt

SEQ ID NO: 545408 - DNA, 25 bp, Rattus norvegicus
taatgagactacattgaaccctgtc

SEQ ID NO: 545409 - DNA, 25 bp, Rattus norvegicus
taatgagactactttgaaccctgtc

SEQ ID NO: 545410 - DNA, 25 bp, Rattus norvegicus
taatgagagccaaggtgggtacccg

SEQ ID NO: 545411 - DNA, 25 bp, Rattus norvegicus
taatgagagccatggtgggtacccg

SEQ ID NO: 545412 - DNA, 25 bp, Rattus norvegicus
taatgagagtcaagagccggtcggt

SEQ ID NO: 545413 - DNA, 25 bp, Rattus norvegicus
taatgagagtcatgagccggtcggt

SEQ ID NO: 545414 - DNA, 25 bp, Rattus norvegicus
taatgagatctgagcccgggttaaa

SEQ ID NO: 545415 - DNA, 25 bp, Rattus norvegicus
taatgagatctgtgcccgggttaaa

SEQ ID NO: 545416 - DNA, 25 bp, Rattus norvegicus
taatgagcaaatcacctgccacctg

SEQ ID NO: 545417 - DNA, 25 bp, Rattus norvegicus
taatgagcaaatgacctgccacctg

SEQ ID NO: 545418 - DNA, 25 bp, Rattus norvegicus
taatgagcagagcaccagggtcagc

SEQ ID NO: 545419 - DNA, 25 bp, Rattus norvegicus
taatgagcagaggaccagggtcagc

SEQ ID NO: 545420 - DNA, 25 bp, Rattus norvegicus
taatgagcagccatcagggtctgaa

SEQ ID NO: 545421 - DNA, 25 bp, Rattus norvegicus
taatgagcagccttcagggtctgaa

SEQ ID NO: 545422 - DNA, 25 bp, Rattus norvegicus
taatgagcccagcttacagcgcctt

SEQ ID NO: 545423 - DNA, 25 bp, Rattus norvegicus
taatgagcccaggttacagcgcctt

SEQ ID NO: 545424 - DNA, 25 bp, Rattus norvegicus
taatgagctgtcagttttcctcctt

SEQ ID NO: 545425 - DNA, 25 bp, Rattus norvegicus
taatgagctgtctgttttcctcctt

SEQ ID NO: 545426 - DNA, 25 bp, Rattus norvegicus
taatgagggagtatcagcaccgaat

SEQ ID NO: 545427 - DNA, 25 bp, Rattus norvegicus
taatgagggagtttcagcaccgaat

SEQ ID NO: 545428 - DNA, 25 bp, Rattus norvegicus
taatgaggtgttaccctgactctgg

SEQ ID NO: 545429 - DNA, 25 bp, Rattus norvegicus
taatgaggtgtttccctgactctgg

SEQ ID NO: 545430 - DNA, 25 bp, Rattus norvegicus
taatgagtagaccttctcccttgta

SEQ ID NO: 545431 - DNA, 25 bp, Rattus norvegicus
taatgagtagacgttctcccttgta

SEQ ID NO: 545432 - DNA, 25 bp, Rattus norvegicus
taatgagtgacccagccatgaggct

SEQ ID NO: 545433 - DNA, 25 bp, Rattus norvegicus
taatgagtgaccgagccatgaggct

SEQ ID NO: 545434 - DNA, 25 bp, Rattus norvegicus
taatgagtgactctccatgtcagga

SEQ ID NO: 545435 - DNA, 25 bp, Rattus norvegicus
taatgagtgactgtccatgtcagga

SEQ ID NO: 545436 - DNA, 25 bp, Rattus norvegicus
taatgagtgagccaacaatcttctg

SEQ ID NO: 545437 - DNA, 25 bp, Rattus norvegicus
taatgagtgagcgaacaatcttctg

SEQ ID NO: 545438 - DNA, 25 bp, Rattus norvegicus
taatgagtgtgcactgaccaccagg

SEQ ID NO: 545439 - DNA, 25 bp, Rattus norvegicus
taatgagtgtgctctgaccaccagg

SEQ ID NO: 545440 - DNA, 25 bp, Rattus norvegicus
taatgagttctccatccagaggccg

SEQ ID NO: 545441 - DNA, 25 bp, Rattus norvegicus
taatgagttctcgatccagaggccg

SEQ ID NO: 545442 - DNA, 25 bp, Rattus norvegicus
taatgagttgttatccgtttctctc

SEQ ID NO: 545443 - DNA, 25 bp, Rattus norvegicus
taatgagttgttttccgtttctctc

SEQ ID NO: 545444 - DNA, 25 bp, Rattus norvegicus
taatgatactcaaccacagtgctga

SEQ ID NO: 545445 - DNA, 25 bp, Rattus norvegicus
taatgatactcatccacagtgctga

SEQ ID NO: 545446 - DNA, 25 bp, Rattus norvegicus
taatgatagtggactctgctcacac

SEQ ID NO: 545447 - DNA, 25 bp, Rattus norvegicus
taatgatagtggtctctgctcacac

SEQ ID NO: 545448 - DNA, 25 bp, Rattus norvegicus
taatgatatggcacagtaactaaga

SEQ ID NO: 545449 - DNA, 25 bp, Rattus norvegicus
taatgatatggctcagtaactaaga

SEQ ID NO: 545450 - DNA, 25 bp, Rattus norvegicus
taatgatattctagtatacggcaat

SEQ ID NO: 545451 - DNA, 25 bp, Rattus norvegicus
taatgatattcttgtatacggcaat

SEQ ID NO: 545452 - DNA, 25 bp, Rattus norvegicus
taatgatcatcccagctgcttgcca

SEQ ID NO: 545453 - DNA, 25 bp, Rattus norvegicus
taatgatcatccgagctgcttgcca

SEQ ID NO: 545454 - DNA, 25 bp, Rattus norvegicus
taatgatcattgatctctgcttcct

SEQ ID NO: 545455 - DNA, 25 bp, Rattus norvegicus
taatgatcattgttctctgcttcct

SEQ ID NO: 545456 - DNA, 25 bp, Rattus norvegicus
taatgatcccgactttgcagctttc

SEQ ID NO: 545457 - DNA, 25 bp, Rattus norvegicus
taatgatcccgagtttgcagctttc

SEQ ID NO: 545458 - DNA, 25 bp, Rattus norvegicus
taatgatcgaaaaccgcggacagtt

SEQ ID NO: 545459 - DNA, 25 bp, Rattus norvegicus
taatgatcgaaatccgcggacagtt

SEQ ID NO: 545460 - DNA, 25 bp, Rattus norvegicus
taatgatctcgtcccctcagaacgt

SEQ ID NO: 545461 - DNA, 25 bp, Rattus norvegicus
taatgatctcgtgccctcagaacgt

SEQ ID NO: 545462 - DNA, 25 bp, Rattus norvegicus
taatgatctctcaggccgccgtttg

SEQ ID NO: 545463 - DNA, 25 bp, Rattus norvegicus
taatgatctctctggccgccgtttg

SEQ ID NO: 545464 - DNA, 25 bp, Rattus norvegicus
taatgatcttctcggtcttggcact

SEQ ID NO: 545465 - DNA, 25 bp, Rattus norvegicus
taatgatcttctgggtcttggcact

SEQ ID NO: 545466 - DNA, 25 bp, Rattus norvegicus
taatgatgacctctgctggatttct

SEQ ID NO: 545467 - DNA, 25 bp, Rattus norvegicus
taatgatgacctgtgctggatttct

SEQ ID NO: 545468 - DNA, 25 bp, Rattus norvegicus
taatgatgcatgaggccagccagtc

SEQ ID NO: 545469 - DNA, 25 bp, Rattus norvegicus
taatgatgcatgtggccagccagtc

SEQ ID NO: 545470 - DNA, 25 bp, Rattus norvegicus
taatgatgccatatagcctttgcta

SEQ ID NO: 545471 - DNA, 25 bp, Rattus norvegicus
taatgatgccatttagcctttgcta

SEQ ID NO: 545472 - DNA, 25 bp, Rattus norvegicus
taatgatgcctgctgggacccttat

SEQ ID NO: 545473 - DNA, 25 bp, Rattus norvegicus
taatgatgcctggtgggacccttat

SEQ ID NO: 545474 - DNA, 25 bp, Rattus norvegicus
taatgatggccaaggctcccgattc

SEQ ID NO: 545475 - DNA, 25 bp, Rattus norvegicus
taatgatggccatggctcccgattc

SEQ ID NO: 545476 - DNA, 25 bp, Rattus norvegicus
taatgatgtgcgctaactggcctgc

SEQ ID NO: 545477 - DNA, 25 bp, Rattus norvegicus
taatgatgtgcggtaactggcctgc

SEQ ID NO: 545478 - DNA, 25 bp, Rattus norvegicus
taatgattctgtaacgccactgacc

SEQ ID NO: 545479 - DNA, 25 bp, Rattus norvegicus
taatgattctgttacgccactgacc

SEQ ID NO: 545480 - DNA, 25 bp, Rattus norvegicus
taatgattggtgatttgaatgctgt

SEQ ID NO: 545481 - DNA, 25 bp, Rattus norvegicus
taatgattggtgttttgaatgctgt

SEQ ID NO: 545482 - DNA, 25 bp, Rattus norvegicus
taatgattgtgtctgtctccgtcaa

SEQ ID NO: 545483 - DNA, 25 bp, Rattus norvegicus
taatgattgtgtgtgtctccgtcaa

SEQ ID NO: 545484 - DNA, 25 bp, Rattus norvegicus
taatgatttaccaccagctcacatg

SEQ ID NO: 545485 - DNA, 25 bp, Rattus norvegicus
taatgatttacctccagctcacatg

SEQ ID NO: 545486 - DNA, 25 bp, Rattus norvegicus
taatgatttccactgtcaacaccct

SEQ ID NO: 545487 - DNA, 25 bp, Rattus norvegicus
taatgatttccagtgtcaacaccct

SEQ ID NO: 545488 - DNA, 25 bp, Rattus norvegicus
taatgattttctaccttactaggtg

SEQ ID NO: 545489 - DNA, 25 bp, Rattus norvegicus
taatgattttcttccttactaggtg

SEQ ID NO: 545490 - DNA, 25 bp, Rattus norvegicus
taatgcaaaaagcaccctatacctg

SEQ ID NO: 545491 - DNA, 25 bp, Rattus norvegicus
taatgcaaaaaggaccctatacctg

SEQ ID NO: 545492 - DNA, 25 bp, Rattus norvegicus
taatgcaaacctcccatgtaggagt

SEQ ID NO: 545493 - DNA, 25 bp, Rattus norvegicus
taatgcaaacctgccatgtaggagt

SEQ ID NO: 545494 - DNA, 25 bp, Rattus norvegicus
taatgcaaatccacgggtgctcctg

SEQ ID NO: 545495 - DNA, 25 bp, Rattus norvegicus
taatgcaaatcctcgggtgctcctg

SEQ ID NO: 545496 - DNA, 25 bp, Rattus norvegicus
taatgcaacagtaccttaaagaaca

SEQ ID NO: 545497 - DNA, 25 bp, Rattus norvegicus
taatgcaacagttccttaaagaaca

SEQ ID NO: 545498 - DNA, 25 bp, Rattus norvegicus
taatgcaatggcagtgaccctggtt

SEQ ID NO: 545499 - DNA, 25 bp, Rattus norvegicus
taatgcaatggctgtgaccctggtt

SEQ ID NO: 545500 - DNA, 25 bp, Rattus norvegicus
taatgcaattacatgtctgtctact

SEQ ID NO: 545501 - DNA, 25 bp, Rattus norvegicus
taatgcaattacttgtctgtctact

SEQ ID NO: 545502 - DNA, 25 bp, Rattus norvegicus
taatgcacacacctacatgctccgt

SEQ ID NO: 545503 - DNA, 25 bp, Rattus norvegicus
taatgcacacacgtacatgctccgt

SEQ ID NO: 545504 - DNA, 25 bp, Rattus norvegicus
taatgcacacagaagccgtgctccc

SEQ ID NO: 545505 - DNA, 25 bp, Rattus norvegicus
taatgcacacagtagccgtgctccc

SEQ ID NO: 545506 - DNA, 25 bp, Rattus norvegicus
taatgcacacatagccttcccatat

SEQ ID NO: 545507 - DNA, 25 bp, Rattus norvegicus
taatgcacacattgccttcccatat

SEQ ID NO: 545508 - DNA, 25 bp, Rattus norvegicus
taatgcacagagattctttcccaag

SEQ ID NO: 545509 - DNA, 25 bp, Rattus norvegicus
taatgcacagagtttctttcccaag

SEQ ID NO: 545510 - DNA, 25 bp, Rattus norvegicus
taatgcacggtacagcctgccccag

SEQ ID NO: 545511 - DNA, 25 bp, Rattus norvegicus
taatgcacggtagagcctgccccag

SEQ ID NO: 545512 - DNA, 25 bp, Rattus norvegicus
taatgcactgtgaacgccatatcct

SEQ ID NO: 545513 - DNA, 25 bp, Rattus norvegicus
taatgcactgtgtacgccatatcct

SEQ ID NO: 545514 - DNA, 25 bp, Rattus norvegicus
taatgcactgttctttcaacctagc

SEQ ID NO: 545515 - DNA, 25 bp, Rattus norvegicus
taatgcactgttgtttcaacctagc

SEQ ID NO: 545516 - DNA, 25 bp, Rattus norvegicus
taatgcacttttcaaccacgggtcc

SEQ ID NO: 545517 - DNA, 25 bp, Rattus norvegicus
taatgcacttttgaaccacgggtcc

SEQ ID NO: 545518 - DNA, 25 bp, Rattus norvegicus
taatgcagagagcaacacgtttaat

SEQ ID NO: 545519 - DNA, 25 bp, Rattus norvegicus
taatgcagagaggaacacgtttaat

SEQ ID NO: 545520 - DNA, 25 bp, Rattus norvegicus
taatgcagccctagtggacttggac

SEQ ID NO: 545521 - DNA, 25 bp, Rattus norvegicus
taatgcagcccttgtggacttggac

SEQ ID NO: 545522 - DNA, 25 bp, Rattus norvegicus
taatgcagctgaaacctcttttgcc

SEQ ID NO: 545523 - DNA, 25 bp, Rattus norvegicus
taatgcagctgatacctcttttgcc

SEQ ID NO: 545524 - DNA, 25 bp, Rattus norvegicus
taatgcaggacaatgctgaccagca

SEQ ID NO: 545525 - DNA, 25 bp, Rattus norvegicus
taatgcaggacattgctgaccagca

SEQ ID NO: 545526 - DNA, 25 bp, Rattus norvegicus
taatgcagggtacccattctttcag

SEQ ID NO: 545527 - DNA, 25 bp, Rattus norvegicus
taatgcagggtagccattctttcag

SEQ ID NO: 545528 - DNA, 25 bp, Rattus norvegicus
taatgcagtgtcacctctcaaagaa

SEQ ID NO: 545529 - DNA, 25 bp, Rattus norvegicus
taatgcagtgtctcctctcaaagaa

SEQ ID NO: 545530 - DNA, 25 bp, Rattus norvegicus
taatgcagtgttattcccgggatcc

SEQ ID NO: 545531 - DNA, 25 bp, Rattus norvegicus
taatgcagtgtttttcccgggatcc

SEQ ID NO: 545532 - DNA, 25 bp, Rattus norvegicus
taatgcagtttgacgagccaagtcg

SEQ ID NO: 545533 - DNA, 25 bp, Rattus norvegicus
taatgcagtttgtcgagccaagtcg

SEQ ID NO: 545534 - DNA, 25 bp, Rattus norvegicus
taatgcatatatacagggcttctgg

SEQ ID NO: 545535 - DNA, 25 bp, Rattus norvegicus
taatgcatatattcagggcttctgg

SEQ ID NO: 545536 - DNA, 25 bp, Rattus norvegicus
taatgcatccaaacaaagccctggg

SEQ ID NO: 545537 - DNA, 25 bp, Rattus norvegicus
taatgcatccaatcaaagccctggg

SEQ ID NO: 545538 - DNA, 25 bp, Rattus norvegicus
taatgcatctttatcttcaggattt

SEQ ID NO: 545539 - DNA, 25 bp, Rattus norvegicus
taatgcatctttttcttcaggattt

SEQ ID NO: 545540 - DNA, 25 bp, Rattus norvegicus
taatgcatgctgagtgtttcttgac

SEQ ID NO: 545541 - DNA, 25 bp, Rattus norvegicus
taatgcatgctgtgtgtttcttgac

SEQ ID NO: 545542 - DNA, 25 bp, Rattus norvegicus
taatgcattctgaatttagaccagg

SEQ ID NO: 545543 - DNA, 25 bp, Rattus norvegicus
taatgcattctgtatttagaccagg

SEQ ID NO: 545544 - DNA, 25 bp, Rattus norvegicus
taatgccaaaccacagggatctatg

SEQ ID NO: 545545 - DNA, 25 bp, Rattus norvegicus
taatgccaaacctcagggatctatg

SEQ ID NO: 545546 - DNA, 25 bp, Rattus norvegicus
taatgccaagggactagtgtgttct

SEQ ID NO: 545547 - DNA, 25 bp, Rattus norvegicus
taatgccaagggtctagtgtgttct

SEQ ID NO: 545548 - DNA, 25 bp, Rattus norvegicus
taatgccaccatattcagttgaaaa

SEQ ID NO: 545549 - DNA, 25 bp, Rattus norvegicus
taatgccaccattttcagttgaaaa

SEQ ID NO: 545550 - DNA, 25 bp, Rattus norvegicus
taatgccacctaacaacctgacaag

SEQ ID NO: 545551 - DNA, 25 bp, Rattus norvegicus
taatgccacctatcaacctgacaag

SEQ ID NO: 545552 - DNA, 25 bp, Rattus norvegicus
taatgccacggcaacatcagcggca

SEQ ID NO: 545553 - DNA, 25 bp, Rattus norvegicus
taatgccacggctacatcagcggca

SEQ ID NO: 545554 - DNA, 25 bp, Rattus norvegicus
taatgccagaacataaccgttagac

SEQ ID NO: 545555 - DNA, 25 bp, Rattus norvegicus
taatgccagaacttaaccgttagac

SEQ ID NO: 545556 - DNA, 25 bp, Rattus norvegicus
taatgccatcttcaggcacctgggt

SEQ ID NO: 545557 - DNA, 25 bp, Rattus norvegicus
taatgccatcttgaggcacctgggt

SEQ ID NO: 545558 - DNA, 25 bp, Rattus norvegicus
taatgccatgccatgactcagttgt

SEQ ID NO: 545559 - DNA, 25 bp, Rattus norvegicus
taatgccatgccttgactcagttgt

SEQ ID NO: 545560 - DNA, 25 bp, Rattus norvegicus
taatgcccaaatactagcccgtgtt

SEQ ID NO: 545561 - DNA, 25 bp, Rattus norvegicus
taatgcccaaattctagcccgtgtt

SEQ ID NO: 545562 - DNA, 25 bp, Rattus norvegicus
taatgccccgttacattgctttagg

SEQ ID NO: 545563 - DNA, 25 bp, Rattus norvegicus
taatgccccgtttcattgctttagg

SEQ ID NO: 545564 - DNA, 25 bp, Rattus norvegicus
taatgccctcagagtagcttcttgc

SEQ ID NO: 545565 - DNA, 25 bp, Rattus norvegicus
taatgccctcagtgtagcttcttgc

SEQ ID NO: 545566 - DNA, 25 bp, Rattus norvegicus
taatgccctgaacatcctgctggag

SEQ ID NO: 545567 - DNA, 25 bp, Rattus norvegicus
taatgccctgaagatcctgctggag

SEQ ID NO: 545568 - DNA, 25 bp, Rattus norvegicus
taatgcccttctaatgtgttaccat

SEQ ID NO: 545569 - DNA, 25 bp, Rattus norvegicus
taatgcccttcttatgtgttaccat

SEQ ID NO: 545570 - DNA, 25 bp, Rattus norvegicus
taatgccgggctagatgcagtcagg

SEQ ID NO: 545571 - DNA, 25 bp, Rattus norvegicus
taatgccgggcttgatgcagtcagg

SEQ ID NO: 545572 - DNA, 25 bp, Rattus norvegicus
taatgcctaagtatcccctggaaag

SEQ ID NO: 545573 - DNA, 25 bp, Rattus norvegicus
taatgcctaagtttcccctggaaag

SEQ ID NO: 545574 - DNA, 25 bp, Rattus norvegicus
taatgcctacatcatgatcgccatc

SEQ ID NO: 545575 - DNA, 25 bp, Rattus norvegicus
taatgcctacatgatgatcgccatc

SEQ ID NO: 545576 - DNA, 25 bp, Rattus norvegicus
taatgcctacgacaagacagccttg

SEQ ID NO: 545577 - DNA, 25 bp, Rattus norvegicus
taatgcctacgagaagacagccttg

SEQ ID NO: 545578 - DNA, 25 bp, Rattus norvegicus
taatgcctacttatgaccatgctag

SEQ ID NO: 545579 - DNA, 25 bp, Rattus norvegicus
taatgcctacttcattttttcccaa

SEQ ID NO: 545580 - DNA, 25 bp, Rattus norvegicus
taatgcctacttgattttttcccaa

SEQ ID NO: 545581 - DNA, 25 bp, Rattus norvegicus
taatgcctacttttgaccatgctag

SEQ ID NO: 545582 - DNA, 25 bp, Rattus norvegicus
taatgcctcaaaccaatcagatgtc

SEQ ID NO: 545583 - DNA, 25 bp, Rattus norvegicus
taatgcctcaaagcaatcagatgtc

SEQ ID NO: 545584 - DNA, 25 bp, Rattus norvegicus
taatgcctcagcctagtgcctttgg

SEQ ID NO: 545585 - DNA, 25 bp, Rattus norvegicus
taatgcctcagcgtagtgcctttgg

SEQ ID NO: 545586 - DNA, 25 bp, Rattus norvegicus
taatgcctcattcatcccgggataa

SEQ ID NO: 545587 - DNA, 25 bp, Rattus norvegicus
taatgcctcattgatcccgggataa

SEQ ID NO: 545588 - DNA, 25 bp, Rattus norvegicus
taatgcctctcccattctcatatct

SEQ ID NO: 545589 - DNA, 25 bp, Rattus norvegicus
taatgcctctccgattctcatatct

SEQ ID NO: 545590 - DNA, 25 bp, Rattus norvegicus
taatgcctctttactgtgacaaacc

SEQ ID NO: 545591 - DNA, 25 bp, Rattus norvegicus
taatgcctcttttctgtgacaaacc

SEQ ID NO: 545592 - DNA, 25 bp, Rattus norvegicus
taatgcctgcctcgtttgcagtttt

SEQ ID NO: 545593 - DNA, 25 bp, Rattus norvegicus
taatgcctgcctggtttgcagtttt

SEQ ID NO: 545594 - DNA, 25 bp, Rattus norvegicus
taatgcctgctaactttggaccaga

SEQ ID NO: 545595 - DNA, 25 bp, Rattus norvegicus
taatgcctgctatctttggaccaga

SEQ ID NO: 545596 - DNA, 25 bp, Rattus norvegicus
taatgcctggcacaaattagaggat

SEQ ID NO: 545597 - DNA, 25 bp, Rattus norvegicus
taatgcctggcagaaattagaggat

SEQ ID NO: 545598 - DNA, 25 bp, Rattus norvegicus
taatgcctgtatatggtgtatcact

SEQ ID NO: 545599 - DNA, 25 bp, Rattus norvegicus
taatgcctgtatttggtgtatcact

SEQ ID NO: 545600 - DNA, 25 bp, Rattus norvegicus
taatgcctgtgtagatttaggtcag

SEQ ID NO: 545601 - DNA, 25 bp, Rattus norvegicus
taatgcctgtgtccgactttggcag

SEQ ID NO: 545602 - DNA, 25 bp, Rattus norvegicus
taatgcctgtgtgcgactttggcag

SEQ ID NO: 545603 - DNA, 25 bp, Rattus norvegicus
taatgcctgtgttgatttaggtcag

SEQ ID NO: 545604 - DNA, 25 bp, Rattus norvegicus
taatgccttccaactgaatgtaaaa

SEQ ID NO: 545605 - DNA, 25 bp, Rattus norvegicus
taatgccttccatctgaatgtaaaa

SEQ ID NO: 545606 - DNA, 25 bp, Rattus norvegicus
taatgcctttcaagcattcagccag

SEQ ID NO: 545607 - DNA, 25 bp, Rattus norvegicus
taatgcctttcatgcattcagccag

SEQ ID NO: 545608 - DNA, 25 bp, Rattus norvegicus
taatgcctttgcatctctgacttct

SEQ ID NO: 545609 - DNA, 25 bp, Rattus norvegicus
taatgcctttgcttctctgacttct

SEQ ID NO: 545610 - DNA, 25 bp, Rattus norvegicus
taatgcgaattaccccatccttgac

SEQ ID NO: 545611 - DNA, 25 bp, Rattus norvegicus
taatgcgaattagcccatccttgac

SEQ ID NO: 545612 - DNA, 25 bp, Rattus norvegicus
taatgcggaaaactctgtcaaaggt

SEQ ID NO: 545613 - DNA, 25 bp, Rattus norvegicus
taatgcggaaaagtctgtcaaaggt

SEQ ID NO: 545614 - DNA, 25 bp, Rattus norvegicus
taatgcggagttataccaactttcg

SEQ ID NO: 545615 - DNA, 25 bp, Rattus norvegicus
taatgcggagttttaccaactttcg

SEQ ID NO: 545616 - DNA, 25 bp, Rattus norvegicus
taatgcggtggtacctatctcaggg

SEQ ID NO: 545617 - DNA, 25 bp, Rattus norvegicus
taatgcggtggttcctatctcaggg

SEQ ID NO: 545618 - DNA, 25 bp, Rattus norvegicus
taatgcggtgtcagagtccctgatt

SEQ ID NO: 545619 - DNA, 25 bp, Rattus norvegicus
taatgcggtgtctgagtccctgatt

SEQ ID NO: 545620 - DNA, 25 bp, Rattus norvegicus
taatgcgtgatgacctgagagccct

SEQ ID NO: 545621 - DNA, 25 bp, Rattus norvegicus
taatgcgtgatgtcctgagagccct

SEQ ID NO: 545622 - DNA, 25 bp, Rattus norvegicus
taatgctaacggattgggttgctcc

SEQ ID NO: 545623 - DNA, 25 bp, Rattus norvegicus
taatgctaacggtttgggttgctcc

SEQ ID NO: 545624 - DNA, 25 bp, Rattus norvegicus
taatgctaagtgagggcccctgtgg

SEQ ID NO: 545625 - DNA, 25 bp, Rattus norvegicus
taatgctaagtgtgggcccctgtgg

SEQ ID NO: 545626 - DNA, 25 bp, Rattus norvegicus
taatgctacatacgtgatcaccctc

SEQ ID NO: 545627 - DNA, 25 bp, Rattus norvegicus
taatgctacataggtgatcaccctc

SEQ ID NO: 545628 - DNA, 25 bp, Rattus norvegicus
taatgctaccctaaacaggaccctg

SEQ ID NO: 545629 - DNA, 25 bp, Rattus norvegicus
taatgctacccttaacaggaccctg

SEQ ID NO: 545630 - DNA, 25 bp, Rattus norvegicus
taatgctaccttatgcagagttctc

SEQ ID NO: 545631 - DNA, 25 bp, Rattus norvegicus
taatgctaccttttgcagagttctc

SEQ ID NO: 545632 - DNA, 25 bp, Rattus norvegicus
taatgctagcggattgttcaccaaa

SEQ ID NO: 545633 - DNA, 25 bp, Rattus norvegicus
taatgctagcggtttgttcaccaaa

SEQ ID NO: 545634 - DNA, 25 bp, Rattus norvegicus
taatgctagtggcaaccgatttgtt

SEQ ID NO: 545635 - DNA, 25 bp, Rattus norvegicus
taatgctagtgggaaccgatttgtt

SEQ ID NO: 545636 - DNA, 25 bp, Rattus norvegicus
taatgctattagatcctgacaagta

SEQ ID NO: 545637 - DNA, 25 bp, Rattus norvegicus
taatgctattagttcctgacaagta

SEQ ID NO: 545638 - DNA, 25 bp, Rattus norvegicus
taatgctcacacctgcttgtttcca

SEQ ID NO: 545639 - DNA, 25 bp, Rattus norvegicus
taatgctcacacgtgcttgtttcca

SEQ ID NO: 545640 - DNA, 25 bp, Rattus norvegicus
taatgctcactactctgcagagcaa

SEQ ID NO: 545641 - DNA, 25 bp, Rattus norvegicus
taatgctcactagtctgcagagcaa

SEQ ID NO: 545642 - DNA, 25 bp, Rattus norvegicus
taatgctcaggtctcatagaaaact

SEQ ID NO: 545643 - DNA, 25 bp, Rattus norvegicus
taatgctcaggtgtcatagaaaact

SEQ ID NO: 545644 - DNA, 25 bp, Rattus norvegicus
taatgctcatggaaaacctgggacc

SEQ ID NO: 545645 - DNA, 25 bp, Rattus norvegicus
taatgctcatggtaaacctgggacc

SEQ ID NO: 545646 - DNA, 25 bp, Rattus norvegicus
taatgctccctaataatccctgatt

SEQ ID NO: 545647 - DNA, 25 bp, Rattus norvegicus
taatgctccctattaatccctgatt

SEQ ID NO: 545648 - DNA, 25 bp, Rattus norvegicus
taatgctcctgccttagcttaggat

SEQ ID NO: 545649 - DNA, 25 bp, Rattus norvegicus
taatgctcctgcgttagcttaggat

SEQ ID NO: 545650 - DNA, 25 bp, Rattus norvegicus
taatgctctcttacacatttgtgag

SEQ ID NO: 545651 - DNA, 25 bp, Rattus norvegicus
taatgctctctttcacatttgtgag

SEQ ID NO: 545652 - DNA, 25 bp, Rattus norvegicus
taatgctctgcaagtctcatacact

SEQ ID NO: 545653 - DNA, 25 bp, Rattus norvegicus
taatgctctgcatgtctcatacact

SEQ ID NO: 545654 - DNA, 25 bp, Rattus norvegicus
taatgctgacgtctgcttccatagc

SEQ ID NO: 545655 - DNA, 25 bp, Rattus norvegicus
taatgctgacgtgtgcttccatagc

SEQ ID NO: 545656 - DNA, 25 bp, Rattus norvegicus
taatgctgagcaatggagatcgtta

SEQ ID NO: 545657 - DNA, 25 bp, Rattus norvegicus
taatgctgagcattggagatcgtta

SEQ ID NO: 545658 - DNA, 25 bp, Rattus norvegicus
taatgctggaaacagctcctggcat

SEQ ID NO: 545659 - DNA, 25 bp, Rattus norvegicus
taatgctggaaagagctcctggcat

SEQ ID NO: 545660 - DNA, 25 bp, Rattus norvegicus
taatgctggcacactgctcctctta

SEQ ID NO: 545661 - DNA, 25 bp, Rattus norvegicus
taatgctggcactctgctcctctta

SEQ ID NO: 545662 - DNA, 25 bp, Rattus norvegicus
taatgctggtctcataatgctccca

SEQ ID NO: 545663 - DNA, 25 bp, Rattus norvegicus
taatgctggtctgataatgctccca

SEQ ID NO: 545664 - DNA, 25 bp, Rattus norvegicus
taatgctggtttccggtccctcttg

SEQ ID NO: 545665 - DNA, 25 bp, Rattus norvegicus
taatgctggtttgcggtccctcttg

SEQ ID NO: 545666 - DNA, 25 bp, Rattus norvegicus
taatgctgtgacagccttcagtact

SEQ ID NO: 545667 - DNA, 25 bp, Rattus norvegicus
taatgctgtgactgccttcagtact

SEQ ID NO: 545668 - DNA, 25 bp, Rattus norvegicus
taatgctgtgagagcctggtccctt

SEQ ID NO: 545669 - DNA, 25 bp, Rattus norvegicus
taatgctgtgagtgcctggtccctt

SEQ ID NO: 545670 - DNA, 25 bp, Rattus norvegicus
taatgcttcctaatgtcttccagtc

SEQ ID NO: 545671 - DNA, 25 bp, Rattus norvegicus
taatgcttcctattgtcttccagtc

SEQ ID NO: 545672 - DNA, 25 bp, Rattus norvegicus
taatgcttcttcactggtattcttg

SEQ ID NO: 545673 - DNA, 25 bp, Rattus norvegicus
taatgcttcttctctggtattcttg

SEQ ID NO: 545674 - DNA, 25 bp, Rattus norvegicus
taatgcttgcttactcctagaatgc

SEQ ID NO: 545675 - DNA, 25 bp, Rattus norvegicus
taatgcttgctttctcctagaatgc

SEQ ID NO: 545676 - DNA, 25 bp, Rattus norvegicus
taatgcttgttgaagcctcagtgcc

SEQ ID NO: 545677 - DNA, 25 bp, Rattus norvegicus
taatgcttgttgagtacttgcccca

SEQ ID NO: 545678 - DNA, 25 bp, Rattus norvegicus
taatgcttgttgtagcctcagtgcc

SEQ ID NO: 545679 - DNA, 25 bp, Rattus norvegicus
taatgcttgttgtgtacttgcccca

SEQ ID NO: 545680 - DNA, 25 bp, Rattus norvegicus
taatgcttttggaagtcccaggctt

SEQ ID NO: 545681 - DNA, 25 bp, Rattus norvegicus
taatgcttttggtagtcccaggctt

SEQ ID NO: 545682 - DNA, 25 bp, Rattus norvegicus
taatggaaaacaatccaaggcccgg

SEQ ID NO: 545683 - DNA, 25 bp, Rattus norvegicus
taatggaaaacattccaaggcccgg

SEQ ID NO: 545684 - DNA, 25 bp, Rattus norvegicus
taatggaatcttctttatagacacc

SEQ ID NO: 545685 - DNA, 25 bp, Rattus norvegicus
taatggaatcttgtttatagacacc

SEQ ID NO: 545686 - DNA, 25 bp, Rattus norvegicus
taatggaatgcgctgatatttcggg

SEQ ID NO: 545687 - DNA, 25 bp, Rattus norvegicus
taatggaatgcggtgatatttcggg

SEQ ID NO: 545688 - DNA, 25 bp, Rattus norvegicus
taatggacagttccgaggctacacc

SEQ ID NO: 545689 - DNA, 25 bp, Rattus norvegicus
taatggacagttgcgaggctacacc

SEQ ID NO: 545690 - DNA, 25 bp, Rattus norvegicus
taatggaccagcaaacactgcctgc

SEQ ID NO: 545691 - DNA, 25 bp, Rattus norvegicus
taatggaccagctaacactgcctgc

SEQ ID NO: 545692 - DNA, 25 bp, Rattus norvegicus
taatggacgtcaacactgctctaca

SEQ ID NO: 545693 - DNA, 25 bp, Rattus norvegicus
taatggacgtcatcactgctctaca

SEQ ID NO: 545694 - DNA, 25 bp, Rattus norvegicus
taatggacgtggactttctccgctt

SEQ ID NO: 545695 - DNA, 25 bp, Rattus norvegicus
taatggacgtggtctttctccgctt

SEQ ID NO: 545696 - DNA, 25 bp, Rattus norvegicus
taatggactcatctctgttctggaa

SEQ ID NO: 545697 - DNA, 25 bp, Rattus norvegicus
taatggactcatgtctgttctggaa

SEQ ID NO: 545698 - DNA, 25 bp, Rattus norvegicus
taatggacttgtaagccctacaccc

SEQ ID NO: 545699 - DNA, 25 bp, Rattus norvegicus
taatggacttgttagccctacaccc

SEQ ID NO: 545700 - DNA, 25 bp, Rattus norvegicus
taatggagaatgagccacttggcta

SEQ ID NO: 545701 - DNA, 25 bp, Rattus norvegicus
taatggagaatgtgccacttggcta

SEQ ID NO: 545702 - DNA, 25 bp, Rattus norvegicus
taatggagactaccctttgtccagg

SEQ ID NO: 545703 - DNA, 25 bp, Rattus norvegicus
taatggagactagcctttgtccagg

SEQ ID NO: 545704 - DNA, 25 bp, Rattus norvegicus
taatggagagcaagcccttatcctt

SEQ ID NO: 545705 - DNA, 25 bp, Rattus norvegicus
taatggagagcatgcccttatcctt

SEQ ID NO: 545706 - DNA, 25 bp, Rattus norvegicus
taatggaggcttcagccctgtcact

SEQ ID NO: 545707 - DNA, 25 bp, Rattus norvegicus
taatggaggcttgagccctgtcact

SEQ ID NO: 545708 - DNA, 25 bp, Rattus norvegicus
taatggaggtgtaggctctgcttct

SEQ ID NO: 545709 - DNA, 25 bp, Rattus norvegicus
taatggaggtgttggctctgcttct

SEQ ID NO: 545710 - DNA, 25 bp, Rattus norvegicus
taatggagtctccatgtcctcccta

SEQ ID NO: 545711 - DNA, 25 bp, Rattus norvegicus
taatggagtctcgatgtcctcccta

SEQ ID NO: 545712 - DNA, 25 bp, Rattus norvegicus
taatggagttgtcttcttcccttga

SEQ ID NO: 545713 - DNA, 25 bp, Rattus norvegicus
taatggagttgtgttcttcccttga

SEQ ID NO: 545714 - DNA, 25 bp, Rattus norvegicus
taatggatacatacagaggcccaaa

SEQ ID NO: 545715 - DNA, 25 bp, Rattus norvegicus
taatggatacattcagaggcccaaa

SEQ ID NO: 545716 - DNA, 25 bp, Rattus norvegicus
taatggattccaaggctgactgttt

SEQ ID NO: 545717 - DNA, 25 bp, Rattus norvegicus
taatggattccatggctgactgttt

SEQ ID NO: 545718 - DNA, 25 bp, Rattus norvegicus
taatggatttccatgcggaccgagg

SEQ ID NO: 545719 - DNA, 25 bp, Rattus norvegicus
taatggatttccttgcggaccgagg

SEQ ID NO: 545720 - DNA, 25 bp, Rattus norvegicus
taatggatttggagtgcttcccctt

SEQ ID NO: 545721 - DNA, 25 bp, Rattus norvegicus
taatggatttggtgtgcttcccctt

SEQ ID NO: 545722 - DNA, 25 bp, Rattus norvegicus
taatggatttgtaccgtcctcccat

SEQ ID NO: 545723 - DNA, 25 bp, Rattus norvegicus
taatggatttgttccgtcctcccat

SEQ ID NO: 545724 - DNA, 25 bp, Rattus norvegicus
taatggcaacccacagctctctgta

SEQ ID NO: 545725 - DNA, 25 bp, Rattus norvegicus
taatggcaaccctcagctctctgta

SEQ ID NO: 545726 - DNA, 25 bp, Rattus norvegicus
taatggcacactccaaatggcgctc

SEQ ID NO: 545727 - DNA, 25 bp, Rattus norvegicus
taatggcacactgcaaatggcgctc

SEQ ID NO: 545728 - DNA, 25 bp, Rattus norvegicus
taatggcacagaccgagaggctact

SEQ ID NO: 545729 - DNA, 25 bp, Rattus norvegicus
taatggcacagagcgagaggctact

SEQ ID NO: 545730 - DNA, 25 bp, Rattus norvegicus
taatggcatttcaactgatataagt

SEQ ID NO: 545731 - DNA, 25 bp, Rattus norvegicus
taatggcatttcctgtacacagcag

SEQ ID NO: 545732 - DNA, 25 bp, Rattus norvegicus
taatggcatttcgtgtacacagcag

SEQ ID NO: 545733 - DNA, 25 bp, Rattus norvegicus
taatggcatttctactgatataagt

SEQ ID NO: 545734 - DNA, 25 bp, Rattus norvegicus
taatggccagatcaccggagccagt

SEQ ID NO: 545735 - DNA, 25 bp, Rattus norvegicus
taatggccagatctagtgctcacat

SEQ ID NO: 545736 - DNA, 25 bp, Rattus norvegicus
taatggccagatgaccggagccagt

SEQ ID NO: 545737 - DNA, 25 bp, Rattus norvegicus
taatggccagatgtagtgctcacat

SEQ ID NO: 545738 - DNA, 25 bp, Rattus norvegicus
taatggccatgactacctttacttc

SEQ ID NO: 545739 - DNA, 25 bp, Rattus norvegicus
taatggccatgagtacctttacttc

SEQ ID NO: 545740 - DNA, 25 bp, Rattus norvegicus
taatggccatgcagaccagtaagtc

SEQ ID NO: 545741 - DNA, 25 bp, Rattus norvegicus
taatggccatgctgaccagtaagtc

SEQ ID NO: 545742 - DNA, 25 bp, Rattus norvegicus
taatggccccagcatcccatgctga

SEQ ID NO: 545743 - DNA, 25 bp, Rattus norvegicus
taatggccccaggatcccatgctga

SEQ ID NO: 545744 - DNA, 25 bp, Rattus norvegicus
taatggccgagcaccaggctgtgga

SEQ ID NO: 545745 - DNA, 25 bp, Rattus norvegicus
taatggccgagctccaggctgtgga

SEQ ID NO: 545746 - DNA, 25 bp, Rattus norvegicus
taatggcctacaagacgttgcaggg

SEQ ID NO: 545747 - DNA, 25 bp, Rattus norvegicus
taatggcctacatgacgttgcaggg

SEQ ID NO: 545748 - DNA, 25 bp, Rattus norvegicus
taatggcctacgatcattttcctgt

SEQ ID NO: 545749 - DNA, 25 bp, Rattus norvegicus
taatggcctacgttcattttcctgt

SEQ ID NO: 545750 - DNA, 25 bp, Rattus norvegicus
taatggcctcacatttccctttgaa

SEQ ID NO: 545751 - DNA, 25 bp, Rattus norvegicus
taatggcctcacttttccctttgaa

SEQ ID NO: 545752 - DNA, 25 bp, Rattus norvegicus
taatggcctcatataaaactgtaga

SEQ ID NO: 545753 - DNA, 25 bp, Rattus norvegicus
taatggcctcatttaaaactgtaga

SEQ ID NO: 545754 - DNA, 25 bp, Rattus norvegicus
taatggcctgttcaaacctgtctgc

SEQ ID NO: 545755 - DNA, 25 bp, Rattus norvegicus
taatggcctgttgaaacctgtctgc

SEQ ID NO: 545756 - DNA, 25 bp, Rattus norvegicus
taatggccttggcaatgccttcatt

SEQ ID NO: 545757 - DNA, 25 bp, Rattus norvegicus
taatggccttgggaatgccttcatt

SEQ ID NO: 545758 - DNA, 25 bp, Rattus norvegicus
taatggcgacacacgagagcgattt

SEQ ID NO: 545759 - DNA, 25 bp, Rattus norvegicus
taatggcgacactcgagagcgattt

SEQ ID NO: 545760 - DNA, 25 bp, Rattus norvegicus
taatggcggactcggtcatattgac

SEQ ID NO: 545761 - DNA, 25 bp, Rattus norvegicus
taatggcggactgggtcatattgac

SEQ ID NO: 545762 - DNA, 25 bp, Rattus norvegicus
taatggctaaacagaaccctcagtc

SEQ ID NO: 545763 - DNA, 25 bp, Rattus norvegicus
taatggctaaactgaaccctcagtc

SEQ ID NO: 545764 - DNA, 25 bp, Rattus norvegicus
taatggctaatgcttctgtttccct

SEQ ID NO: 545765 - DNA, 25 bp, Rattus norvegicus
taatggctaatggttctgtttccct

SEQ ID NO: 545766 - DNA, 25 bp, Rattus norvegicus
taatggctcttacaacacttgttct

SEQ ID NO: 545767 - DNA, 25 bp, Rattus norvegicus
taatggctcttagaacacttgttct

SEQ ID NO: 545768 - DNA, 25 bp, Rattus norvegicus
taatggctctttagtactgcggctg

SEQ ID NO: 545769 - DNA, 25 bp, Rattus norvegicus
taatggctcttttgtactgcggctg

SEQ ID NO: 545770 - DNA, 25 bp, Rattus norvegicus
taatggcttaggacagtggtcatat

SEQ ID NO: 545771 - DNA, 25 bp, Rattus norvegicus
taatggcttaggtcagtggtcatat

SEQ ID NO: 545772 - DNA, 25 bp, Rattus norvegicus
taatggcttagtaccttgcactgtc

SEQ ID NO: 545773 - DNA, 25 bp, Rattus norvegicus
taatggcttagttccttgcactgtc

SEQ ID NO: 545774 - DNA, 25 bp, Rattus norvegicus
taatgggacactcctgagactcacg

SEQ ID NO: 545775 - DNA, 25 bp, Rattus norvegicus
taatgggacactgctgagactcacg

SEQ ID NO: 545776 - DNA, 25 bp, Rattus norvegicus
taatgggaccttctctttgagccct

SEQ ID NO: 545777 - DNA, 25 bp, Rattus norvegicus
taatgggaccttgtctttgagccct

SEQ ID NO: 545778 - DNA, 25 bp, Rattus norvegicus
taatgggagaaaacctgtccgagga

SEQ ID NO: 545779 - DNA, 25 bp, Rattus norvegicus
taatgggagaaatcctgtccgagga

SEQ ID NO: 545780 - DNA, 25 bp, Rattus norvegicus
taatgggagcttccctgtgaccttt

SEQ ID NO: 545781 - DNA, 25 bp, Rattus norvegicus
taatgggagcttgcctgtgaccttt

SEQ ID NO: 545782 - DNA, 25 bp, Rattus norvegicus
taatgggatcgtccagccctttctc

SEQ ID NO: 545783 - DNA, 25 bp, Rattus norvegicus
taatgggatcgtgcagccctttctc

SEQ ID NO: 545784 - DNA, 25 bp, Rattus norvegicus
taatgggattttacctttcaccaga

SEQ ID NO: 545785 - DNA, 25 bp, Rattus norvegicus
taatgggatttttcctttcaccaga

SEQ ID NO: 545786 - DNA, 25 bp, Rattus norvegicus
taatgggcatctagtccactgtgct

SEQ ID NO: 545787 - DNA, 25 bp, Rattus norvegicus
taatgggcatcttgtccactgtgct

SEQ ID NO: 545788 - DNA, 25 bp, Rattus norvegicus
taatgggccaggatttctgctgaga

SEQ ID NO: 545789 - DNA, 25 bp, Rattus norvegicus
taatgggccaggttttctgctgaga

SEQ ID NO: 545790 - DNA, 25 bp, Rattus norvegicus
taatgggcccagacggaacttgtaa

SEQ ID NO: 545791 - DNA, 25 bp, Rattus norvegicus
taatgggcccagtcggaacttgtaa

SEQ ID NO: 545792 - DNA, 25 bp, Rattus norvegicus
taatgggccccactagacgaccaga

SEQ ID NO: 545793 - DNA, 25 bp, Rattus norvegicus
taatgggccccagtagacgaccaga

SEQ ID NO: 545794 - DNA, 25 bp, Rattus norvegicus
taatgggctgtcacagggacccctg

SEQ ID NO: 545795 - DNA, 25 bp, Rattus norvegicus
taatgggctgtctcagggacccctg

SEQ ID NO: 545796 - DNA, 25 bp, Rattus norvegicus
taatgggcttcacgcctccactgag

SEQ ID NO: 545797 - DNA, 25 bp, Rattus norvegicus
taatgggcttcaggcctccactgag

SEQ ID NO: 545798 - DNA, 25 bp, Rattus norvegicus
taatgggtccccagtatcaatcact

SEQ ID NO: 545799 - DNA, 25 bp, Rattus norvegicus
taatgggtcccctgtatcaatcact

SEQ ID NO: 545800 - DNA, 25 bp, Rattus norvegicus
taatgggttcttagtcttggcactt

SEQ ID NO: 545801 - DNA, 25 bp, Rattus norvegicus
taatgggttctttgtcttggcactt

SEQ ID NO: 545802 - DNA, 25 bp, Rattus norvegicus
taatgggttgttcagtctccactca

SEQ ID NO: 545803 - DNA, 25 bp, Rattus norvegicus
taatgggttgttgagtctccactca

SEQ ID NO: 545804 - DNA, 25 bp, Rattus norvegicus
taatgggtttctcctgtgacttaga

SEQ ID NO: 545805 - DNA, 25 bp, Rattus norvegicus
taatgggtttctgctgtgacttaga

SEQ ID NO: 545806 - DNA, 25 bp, Rattus norvegicus
taatggtaacccattcctgtctgta

SEQ ID NO: 545807 - DNA, 25 bp, Rattus norvegicus
taatggtaaccctttcctgtctgta

SEQ ID NO: 545808 - DNA, 25 bp, Rattus norvegicus
taatggtacttacacaggagggcgt

SEQ ID NO: 545809 - DNA, 25 bp, Rattus norvegicus
taatggtacttagacaggagggcgt

SEQ ID NO: 545810 - DNA, 25 bp, Rattus norvegicus
taatggtcccagctacgaagcccga

SEQ ID NO: 545811 - DNA, 25 bp, Rattus norvegicus
taatggtcccaggtacgaagcccga

SEQ ID NO: 545812 - DNA, 25 bp, Rattus norvegicus
taatggtcctaccttgtcttcagct

SEQ ID NO: 545813 - DNA, 25 bp, Rattus norvegicus
taatggtcctacgttgtcttcagct

SEQ ID NO: 545814 - DNA, 25 bp, Rattus norvegicus
taatggtcgtgccagctattcccta

SEQ ID NO: 545815 - DNA, 25 bp, Rattus norvegicus
taatggtcgtgcgagctattcccta

SEQ ID NO: 545816 - DNA, 25 bp, Rattus norvegicus
taatggtctccacctgcagtacaaa

SEQ ID NO: 545817 - DNA, 25 bp, Rattus norvegicus
taatggtctccagctgcagtacaaa

SEQ ID NO: 545818 - DNA, 25 bp, Rattus norvegicus
taatggtctcgtatgctttgggatc

SEQ ID NO: 545819 - DNA, 25 bp, Rattus norvegicus
taatggtctcgtttgctttgggatc

SEQ ID NO: 545820 - DNA, 25 bp, Rattus norvegicus
taatggtgacccagtggcgagctct

SEQ ID NO: 545821 - DNA, 25 bp, Rattus norvegicus
taatggtgaccctgtggcgagctct

SEQ ID NO: 545822 - DNA, 25 bp, Rattus norvegicus
taatggtgacctcccattcttgcaa

SEQ ID NO: 545823 - DNA, 25 bp, Rattus norvegicus
taatggtgacctgccattcttgcaa

SEQ ID NO: 545824 - DNA, 25 bp, Rattus norvegicus
taatggtgctgtattcctctccatg

SEQ ID NO: 545825 - DNA, 25 bp, Rattus norvegicus
taatggtgctgttttcctctccatg

SEQ ID NO: 545826 - DNA, 25 bp, Rattus norvegicus
taatggtggcttcttatcctttgtt

SEQ ID NO: 545827 - DNA, 25 bp, Rattus norvegicus
taatggtggcttgttatcctttgtt

SEQ ID NO: 545828 - DNA, 25 bp, Rattus norvegicus
taatggtggtgtctctgcagcctca

SEQ ID NO: 545829 - DNA, 25 bp, Rattus norvegicus
taatggtggtgtgtctgcagcctca

SEQ ID NO: 545830 - DNA, 25 bp, Rattus norvegicus
taatggtgtaccacagcaactgcct

SEQ ID NO: 545831 - DNA, 25 bp, Rattus norvegicus
taatggtgtacctcagcaactgcct

SEQ ID NO: 545832 - DNA, 25 bp, Rattus norvegicus
taatggtgtgatccctggtgactca

SEQ ID NO: 545833 - DNA, 25 bp, Rattus norvegicus
taatggtgtgatgcctggtgactca

SEQ ID NO: 545834 - DNA, 25 bp, Rattus norvegicus
taatggtgttacaccgggtgactgt

SEQ ID NO: 545835 - DNA, 25 bp, Rattus norvegicus
taatggtgttactccgggtgactgt

SEQ ID NO: 545836 - DNA, 25 bp, Rattus norvegicus
taatggttcacaccgtgcgcagcac

SEQ ID NO: 545837 - DNA, 25 bp, Rattus norvegicus
taatggttcacagcgtgcgcagcac

SEQ ID NO: 545838 - DNA, 25 bp, Rattus norvegicus
taatggttcaggatctatattcccc

SEQ ID NO: 545839 - DNA, 25 bp, Rattus norvegicus
taatggttcaggttctatattcccc

SEQ ID NO: 545840 - DNA, 25 bp, Rattus norvegicus
taatggttctgcatgacctagccac

SEQ ID NO: 545841 - DNA, 25 bp, Rattus norvegicus
taatggttctgcttgacctagccac

SEQ ID NO: 545842 - DNA, 25 bp, Rattus norvegicus
taatggttggtccttggcatgcaaa

SEQ ID NO: 545843 - DNA, 25 bp, Rattus norvegicus
taatggttggtcgttggcatgcaaa

SEQ ID NO: 545844 - DNA, 25 bp, Rattus norvegicus
taatggtttcttcagactcatgcag

SEQ ID NO: 545845 - DNA, 25 bp, Rattus norvegicus
taatggtttcttgagactcatgcag

SEQ ID NO: 545846 - DNA, 25 bp, Rattus norvegicus
taatgtaaagttcaaggtccgctgt

SEQ ID NO: 545847 - DNA, 25 bp, Rattus norvegicus
taatgtaaagttgaaggtccgctgt

SEQ ID NO: 545848 - DNA, 25 bp, Rattus norvegicus
taatgtaattgtcacctcctaagcc

SEQ ID NO: 545849 - DNA, 25 bp, Rattus norvegicus
taatgtaattgtgacctcctaagcc

SEQ ID NO: 545850 - DNA, 25 bp, Rattus norvegicus
taatgtacacccatgcatctgcaat

SEQ ID NO: 545851 - DNA, 25 bp, Rattus norvegicus
taatgtacacccttgcatctgcaat

SEQ ID NO: 545852 - DNA, 25 bp, Rattus norvegicus
taatgtaccaaaaacgagggaggcg

SEQ ID NO: 545853 - DNA, 25 bp, Rattus norvegicus
taatgtaccaaaacctgtttatagc

SEQ ID NO: 545854 - DNA, 25 bp, Rattus norvegicus
taatgtaccaaatacgagggaggcg

SEQ ID NO: 545855 - DNA, 25 bp, Rattus norvegicus
taatgtaccaaatcctgtttatagc

SEQ ID NO: 545856 - DNA, 25 bp, Rattus norvegicus
taatgtactgtgctgtgatccctta

SEQ ID NO: 545857 - DNA, 25 bp, Rattus norvegicus
taatgtactgtggtgtgatccctta

SEQ ID NO: 545858 - DNA, 25 bp, Rattus norvegicus
taatgtagagttaaagcacgaggct

SEQ ID NO: 545859 - DNA, 25 bp, Rattus norvegicus
taatgtagagtttaagcacgaggct

SEQ ID NO: 545860 - DNA, 25 bp, Rattus norvegicus
taatgtatccgcaagtggtcatagc

SEQ ID NO: 545861 - DNA, 25 bp, Rattus norvegicus
taatgtatccgctagtggtcatagc

SEQ ID NO: 545862 - DNA, 25 bp, Rattus norvegicus
taatgtatgcctactccagagccaa

SEQ ID NO: 545863 - DNA, 25 bp, Rattus norvegicus
taatgtatgccttctccagagccaa

SEQ ID NO: 545864 - DNA, 25 bp, Rattus norvegicus
taatgtatggagactttgccttgga

SEQ ID NO: 545865 - DNA, 25 bp, Rattus norvegicus
taatgtatggagtctttgccttgga

SEQ ID NO: 545866 - DNA, 25 bp, Rattus norvegicus
taatgtatttccatcaagtctttgg

SEQ ID NO: 545867 - DNA, 25 bp, Rattus norvegicus
taatgtatttccttcaagtctttgg

SEQ ID NO: 545868 - DNA, 25 bp, Rattus norvegicus
taatgtcacatgaaagcgcctttaa

SEQ ID NO: 545869 - DNA, 25 bp, Rattus norvegicus
taatgtcacatgtaagcgcctttaa

SEQ ID NO: 545870 - DNA, 25 bp, Rattus norvegicus
taatgtcaccttagggcaagcttcc

SEQ ID NO: 545871 - DNA, 25 bp, Rattus norvegicus
taatgtcacctttgggcaagcttcc

SEQ ID NO: 545872 - DNA, 25 bp, Rattus norvegicus
taatgtcactctccttccagatgat

SEQ ID NO: 545873 - DNA, 25 bp, Rattus norvegicus
taatgtcactctgcttccagatgat

SEQ ID NO: 545874 - DNA, 25 bp, Rattus norvegicus
taatgtcagcagctcccacctttga

SEQ ID NO: 545875 - DNA, 25 bp, Rattus norvegicus
taatgtcagcaggtcccacctttga

SEQ ID NO: 545876 - DNA, 25 bp, Rattus norvegicus
taatgtcagtctccccaaggccaca

SEQ ID NO: 545877 - DNA, 25 bp, Rattus norvegicus
taatgtcagtctgcccaaggccaca

SEQ ID NO: 545878 - DNA, 25 bp, Rattus norvegicus
taatgtcatcaaatagcctcctctt

SEQ ID NO: 545879 - DNA, 25 bp, Rattus norvegicus
taatgtcatcaattagcctcctctt

SEQ ID NO: 545880 - DNA, 25 bp, Rattus norvegicus
taatgtccaccaccgatagccattt

SEQ ID NO: 545881 - DNA, 25 bp, Rattus norvegicus
taatgtccaccagcgatagccattt

SEQ ID NO: 545882 - DNA, 25 bp, Rattus norvegicus
taatgtccctgtccttagttcagag

SEQ ID NO: 545883 - DNA, 25 bp, Rattus norvegicus
taatgtccctgtctggcttatgccg

SEQ ID NO: 545884 - DNA, 25 bp, Rattus norvegicus
taatgtccctgtgcttagttcagag

SEQ ID NO: 545885 - DNA, 25 bp, Rattus norvegicus
taatgtccctgtgtggcttatgccg

SEQ ID NO: 545886 - DNA, 25 bp, Rattus norvegicus
taatgtcctaacagccgctacaatg

SEQ ID NO: 545887 - DNA, 25 bp, Rattus norvegicus
taatgtcctaactgccgctacaatg

SEQ ID NO: 545888 - DNA, 25 bp, Rattus norvegicus
taatgtcctgttctagccttttcca

SEQ ID NO: 545889 - DNA, 25 bp, Rattus norvegicus
taatgtcctgttgtagccttttcca

SEQ ID NO: 545890 - DNA, 25 bp, Rattus norvegicus
taatgtccttttacttccggaatat

SEQ ID NO: 545891 - DNA, 25 bp, Rattus norvegicus
taatgtcctttttcttccggaatat

SEQ ID NO: 545892 - DNA, 25 bp, Rattus norvegicus
taatgtcgtcttaggatctgagcca

SEQ ID NO: 545893 - DNA, 25 bp, Rattus norvegicus
taatgtcgtctttggatctgagcca

SEQ ID NO: 545894 - DNA, 25 bp, Rattus norvegicus
taatgtcgtgtcagcctcaactttg

SEQ ID NO: 545895 - DNA, 25 bp, Rattus norvegicus
taatgtcgtgtctgcctcaactttg

SEQ ID NO: 545896 - DNA, 25 bp, Rattus norvegicus
taatgtctaaataggcttccgtggc

SEQ ID NO: 545897 - DNA, 25 bp, Rattus norvegicus
taatgtctaaattggcttccgtggc

SEQ ID NO: 545898 - DNA, 25 bp, Rattus norvegicus
taatgtctactccagcaggcatgtg

SEQ ID NO: 545899 - DNA, 25 bp, Rattus norvegicus
taatgtctactcgagcaggcatgtg

SEQ ID NO: 545900 - DNA, 25 bp, Rattus norvegicus
taatgtctacttacaacaccagaat

SEQ ID NO: 545901 - DNA, 25 bp, Rattus norvegicus
taatgtctactttcaacaccagaat

SEQ ID NO: 545902 - DNA, 25 bp, Rattus norvegicus
taatgtctagccattgtcttggcca

SEQ ID NO: 545903 - DNA, 25 bp, Rattus norvegicus
taatgtctagcctttgtcttggcca

SEQ ID NO: 545904 - DNA, 25 bp, Rattus norvegicus
taatgtctatatcaccaggttacct

SEQ ID NO: 545905 - DNA, 25 bp, Rattus norvegicus
taatgtctatatgaccaggttacct

SEQ ID NO: 545906 - DNA, 25 bp, Rattus norvegicus
taatgtctgacaacccaggaagcgc

SEQ ID NO: 545907 - DNA, 25 bp, Rattus norvegicus
taatgtctgacatcccaggaagcgc

SEQ ID NO: 545908 - DNA, 25 bp, Rattus norvegicus
taatgtctgcatactggccagatca

SEQ ID NO: 545909 - DNA, 25 bp, Rattus norvegicus
taatgtctgcattctggccagatca

SEQ ID NO: 545910 - DNA, 25 bp, Rattus norvegicus
taatgtctggacacttggcgctcat

SEQ ID NO: 545911 - DNA, 25 bp, Rattus norvegicus
taatgtctggactcttggcgctcat

SEQ ID NO: 545912 - DNA, 25 bp, Rattus norvegicus
taatgtctggagattactcgtgccg

SEQ ID NO: 545913 - DNA, 25 bp, Rattus norvegicus
taatgtctggagtttactcgtgccg

SEQ ID NO: 545914 - DNA, 25 bp, Rattus norvegicus
taatgtcttccaatttctgtcccac

SEQ ID NO: 545915 - DNA, 25 bp, Rattus norvegicus
taatgtcttccattttctgtcccac

SEQ ID NO: 545916 - DNA, 25 bp, Rattus norvegicus
taatgtctttccacacctcattttt

SEQ ID NO: 545917 - DNA, 25 bp, Rattus norvegicus
taatgtctttcctcacctcattttt

SEQ ID NO: 545918 - DNA, 25 bp, Rattus norvegicus
taatgtgaaaccctaaactctaact

SEQ ID NO: 545919 - DNA, 25 bp, Rattus norvegicus
taatgtgaaaccgtaaactctaact

SEQ ID NO: 545920 - DNA, 25 bp, Rattus norvegicus
taatgtgaaattccctgtgtggacc

SEQ ID NO: 545921 - DNA, 25 bp, Rattus norvegicus
taatgtgaaattgcctgtgtggacc

SEQ ID NO: 545922 - DNA, 25 bp, Rattus norvegicus
taatgtgaactgaagaccccggagc

SEQ ID NO: 545923 - DNA, 25 bp, Rattus norvegicus
taatgtgaactgtagaccccggagc

SEQ ID NO: 545924 - DNA, 25 bp, Rattus norvegicus
taatgtgaataaaacctggtcccaa

SEQ ID NO: 545925 - DNA, 25 bp, Rattus norvegicus
taatgtgaataatacctggtcccaa

SEQ ID NO: 545926 - DNA, 25 bp, Rattus norvegicus
taatgtgaatgtaaataggtctcca

SEQ ID NO: 545927 - DNA, 25 bp, Rattus norvegicus
taatgtgaatgttaataggtctcca

SEQ ID NO: 545928 - DNA, 25 bp, Rattus norvegicus
taatgtgagtgtcggcacttcctcc

SEQ ID NO: 545929 - DNA, 25 bp, Rattus norvegicus
taatgtgagtgtgggcacttcctcc

SEQ ID NO: 545930 - DNA, 25 bp, Rattus norvegicus
taatgtgcatgccatcctccttacc

SEQ ID NO: 545931 - DNA, 25 bp, Rattus norvegicus
taatgtgcatgcgatcctccttacc

SEQ ID NO: 545932 - DNA, 25 bp, Rattus norvegicus
taatgtgcccatctactgcttttat

SEQ ID NO: 545933 - DNA, 25 bp, Rattus norvegicus
taatgtgcccatgtactgcttttat

SEQ ID NO: 545934 - DNA, 25 bp, Rattus norvegicus
taatgtgccctcataagccttgtgg

SEQ ID NO: 545935 - DNA, 25 bp, Rattus norvegicus
taatgtgccctcttaagccttgtgg

SEQ ID NO: 545936 - DNA, 25 bp, Rattus norvegicus
taatgtgccgtcaccaaggatctga

SEQ ID NO: 545937 - DNA, 25 bp, Rattus norvegicus
taatgtgccgtctccaaggatctga

SEQ ID NO: 545938 - DNA, 25 bp, Rattus norvegicus
taatgtgcgattattcaccccgttg

SEQ ID NO: 545939 - DNA, 25 bp, Rattus norvegicus
taatgtgcgatttttcaccccgttg

SEQ ID NO: 545940 - DNA, 25 bp, Rattus norvegicus
taatgtgctagtccatgtggtccct

SEQ ID NO: 545941 - DNA, 25 bp, Rattus norvegicus
taatgtgctagtgcatgtggtccct

SEQ ID NO: 545942 - DNA, 25 bp, Rattus norvegicus
taatgtgctcacctttatgctaaca

SEQ ID NO: 545943 - DNA, 25 bp, Rattus norvegicus
taatgtgctcacgtttatgctaaca

SEQ ID NO: 545944 - DNA, 25 bp, Rattus norvegicus
taatgtgctccacggtctgcatttt

SEQ ID NO: 545945 - DNA, 25 bp, Rattus norvegicus
taatgtgctccagggtctgcatttt

SEQ ID NO: 545946 - DNA, 25 bp, Rattus norvegicus
taatgtgcttaaccatttgcctccg

SEQ ID NO: 545947 - DNA, 25 bp, Rattus norvegicus
taatgtgcttaagcatttgcctccg

SEQ ID NO: 545948 - DNA, 25 bp, Rattus norvegicus
taatgtggaatcctggaaaccttgg

SEQ ID NO: 545949 - DNA, 25 bp, Rattus norvegicus
taatgtggaatcgtggaaaccttgg

SEQ ID NO: 545950 - DNA, 25 bp, Rattus norvegicus
taatgtggcataaagtgacttctta

SEQ ID NO: 545951 - DNA, 25 bp, Rattus norvegicus
taatgtggcatatagtgacttctta

SEQ ID NO: 545952 - DNA, 25 bp, Rattus norvegicus
taatgtggctatctcctgttggtgg

SEQ ID NO: 545953 - DNA, 25 bp, Rattus norvegicus
taatgtggctatgtcctgttggtgg

SEQ ID NO: 545954 - DNA, 25 bp, Rattus norvegicus
taatgtggctctacacaaacctcct

SEQ ID NO: 545955 - DNA, 25 bp, Rattus norvegicus
taatgtggctcttcacaaacctcct

SEQ ID NO: 545956 - DNA, 25 bp, Rattus norvegicus
taatgtggctgcagtaattccccta

SEQ ID NO: 545957 - DNA, 25 bp, Rattus norvegicus
taatgtggctgctgtaattccccta

SEQ ID NO: 545958 - DNA, 25 bp, Rattus norvegicus
taatgtgggaaaccctgctggagtc

SEQ ID NO: 545959 - DNA, 25 bp, Rattus norvegicus
taatgtgggaaagcctgctggagtc

SEQ ID NO: 545960 - DNA, 25 bp, Rattus norvegicus
taatgtgggccactgtcatctggca

SEQ ID NO: 545961 - DNA, 25 bp, Rattus norvegicus
taatgtgggccagtgtcatctggca

SEQ ID NO: 545962 - DNA, 25 bp, Rattus norvegicus
taatgtgggttaactactcttttga

SEQ ID NO: 545963 - DNA, 25 bp, Rattus norvegicus
taatgtgggttatctactcttttga

SEQ ID NO: 545964 - DNA, 25 bp, Rattus norvegicus
taatgtggtcacacctgcagttctg

SEQ ID NO: 545965 - DNA, 25 bp, Rattus norvegicus
taatgtggtcactcctgcagttctg

SEQ ID NO: 545966 - DNA, 25 bp, Rattus norvegicus
taatgtggtgcccattcttcatcac

SEQ ID NO: 545967 - DNA, 25 bp, Rattus norvegicus
taatgtggtgccgattcttcatcac

SEQ ID NO: 545968 - DNA, 25 bp, Rattus norvegicus
taatgtgtagttaagccagtcaaaa

SEQ ID NO: 545969 - DNA, 25 bp, Rattus norvegicus
taatgtgtagtttagccagtcaaaa

SEQ ID NO: 545970 - DNA, 25 bp, Rattus norvegicus
taatgtgtcatccttatcctgcctt

SEQ ID NO: 545971 - DNA, 25 bp, Rattus norvegicus
taatgtgtcatcgttatcctgcctt

SEQ ID NO: 545972 - DNA, 25 bp, Rattus norvegicus
taatgtgtcttcaatcagtcctgga

SEQ ID NO: 545973 - DNA, 25 bp, Rattus norvegicus
taatgtgtcttctatcagtcctgga

SEQ ID NO: 545974 - DNA, 25 bp, Rattus norvegicus
taatgtgtctttacggctgtgtctc

SEQ ID NO: 545975 - DNA, 25 bp, Rattus norvegicus
taatgtgtcttttcggctgtgtctc

SEQ ID NO: 545976 - DNA, 25 bp, Rattus norvegicus
taatgtgtgacccttcacctttgat

SEQ ID NO: 545977 - DNA, 25 bp, Rattus norvegicus
taatgtgtgaccgttcacctttgat

SEQ ID NO: 545978 - DNA, 25 bp, Rattus norvegicus
taatgtgtgctgagctaagcccttc

SEQ ID NO: 545979 - DNA, 25 bp, Rattus norvegicus
taatgtgtgctgtgctaagcccttc

SEQ ID NO: 545980 - DNA, 25 bp, Rattus norvegicus
taatgtgtgcttcggtttctgaggt

SEQ ID NO: 545981 - DNA, 25 bp, Rattus norvegicus
taatgtgtgcttgggtttctgaggt

SEQ ID NO: 545982 - DNA, 25 bp, Rattus norvegicus
taatgtgtggttacaattcagcttg

SEQ ID NO: 545983 - DNA, 25 bp, Rattus norvegicus
taatgtgtggtttcaattcagcttg

SEQ ID NO: 545984 - DNA, 25 bp, Rattus norvegicus
taatgtgtgtgtaactacagtatac

SEQ ID NO: 545985 - DNA, 25 bp, Rattus norvegicus
taatgtgtgtgtcaattcctccacc

SEQ ID NO: 545986 - DNA, 25 bp, Rattus norvegicus
taatgtgtgtgtgaattcctccacc

SEQ ID NO: 545987 - DNA, 25 bp, Rattus norvegicus
taatgtgtgtgttactacagtatac

SEQ ID NO: 545988 - DNA, 25 bp, Rattus norvegicus
taatgtgttactcggtggccaacca

SEQ ID NO: 545989 - DNA, 25 bp, Rattus norvegicus
taatgtgttactgggtggccaacca

SEQ ID NO: 545990 - DNA, 25 bp, Rattus norvegicus
taatgtgttttcacctttggaatat

SEQ ID NO: 545991 - DNA, 25 bp, Rattus norvegicus
taatgtgttttctcctttggaatat

SEQ ID NO: 545992 - DNA, 25 bp, Rattus norvegicus
taatgttaatttcttcccctttcag

SEQ ID NO: 545993 - DNA, 25 bp, Rattus norvegicus
taatgttaatttgttcccctttcag

SEQ ID NO: 545994 - DNA, 25 bp, Rattus norvegicus
taatgttaccagatgggctgcacat

SEQ ID NO: 545995 - DNA, 25 bp, Rattus norvegicus
taatgttaccagttgggctgcacat

SEQ ID NO: 545996 - DNA, 25 bp, Rattus norvegicus
taatgttaggctctggacttcccat

SEQ ID NO: 545997 - DNA, 25 bp, Rattus norvegicus
taatgttaggctgtggacttcccat

SEQ ID NO: 545998 - DNA, 25 bp, Rattus norvegicus
taatgttatgatctgggctaccttc

SEQ ID NO: 545999 - DNA, 25 bp, Rattus norvegicus
taatgttatgatgtgggctaccttc

SEQ ID NO: 546000 - DNA, 25 bp, Rattus norvegicus
taatgttcaatgagttcagtcagca

SEQ ID NO: 546001 - DNA, 25 bp, Rattus norvegicus
taatgttcaatgtgttcagtcagca

SEQ ID NO: 546002 - DNA, 25 bp, Rattus norvegicus
taatgttcacagaagatctttattg

SEQ ID NO: 546003 - DNA, 25 bp, Rattus norvegicus
taatgttcacagtagatctttattg

SEQ ID NO: 546004 - DNA, 25 bp, Rattus norvegicus
taatgttcactgacacactgctcta

SEQ ID NO: 546005 - DNA, 25 bp, Rattus norvegicus
taatgttcactgtcacactgctcta

SEQ ID NO: 546006 - DNA, 25 bp, Rattus norvegicus
taatgttcacttcttttgtttttca

SEQ ID NO: 546007 - DNA, 25 bp, Rattus norvegicus
taatgttcacttgttttgtttttca

SEQ ID NO: 546008 - DNA, 25 bp, Rattus norvegicus
taatgttcctctatctcttagccat

SEQ ID NO: 546009 - DNA, 25 bp, Rattus norvegicus
taatgttcctctttctcttagccat

SEQ ID NO: 546010 - DNA, 25 bp, Rattus norvegicus
taatgttcggtcaatgcccattcga

SEQ ID NO: 546011 - DNA, 25 bp, Rattus norvegicus
taatgttcggtctatgcccattcga

SEQ ID NO: 546012 - DNA, 25 bp, Rattus norvegicus
taatgttcggttaggttaccagatg

SEQ ID NO: 546013 - DNA, 25 bp, Rattus norvegicus
taatgttcggtttggttaccagatg

SEQ ID NO: 546014 - DNA, 25 bp, Rattus norvegicus
taatgttctagcaacccttacctgt

SEQ ID NO: 546015 - DNA, 25 bp, Rattus norvegicus
taatgttctagctacccttacctgt

SEQ ID NO: 546016 - DNA, 25 bp, Rattus norvegicus
taatgttctctgacttaagcagaaa

SEQ ID NO: 546017 - DNA, 25 bp, Rattus norvegicus
taatgttctctgtcttaagcagaaa

SEQ ID NO: 546018 - DNA, 25 bp, Rattus norvegicus
taatgttcttcacgaaatttctgcc

SEQ ID NO: 546019 - DNA, 25 bp, Rattus norvegicus
taatgttcttcaggaaatttctgcc

SEQ ID NO: 546020 - DNA, 25 bp, Rattus norvegicus
taatgttcttggattcctcggtgca

SEQ ID NO: 546021 - DNA, 25 bp, Rattus norvegicus
taatgttcttggtttcctcggtgca

SEQ ID NO: 546022 - DNA, 25 bp, Rattus norvegicus
taatgttgaatcaactgcctgcctc

SEQ ID NO: 546023 - DNA, 25 bp, Rattus norvegicus
taatgttgaatctactgcctgcctc

SEQ ID NO: 546024 - DNA, 25 bp, Rattus norvegicus
taatgttgacgaccaataccaggaa

SEQ ID NO: 546025 - DNA, 25 bp, Rattus norvegicus
taatgttgacgagcaataccaggaa

SEQ ID NO: 546026 - DNA, 25 bp, Rattus norvegicus
taatgttgcccgctattttggaaag

SEQ ID NO: 546027 - DNA, 25 bp, Rattus norvegicus
taatgttgcccggtattttggaaag

SEQ ID NO: 546028 - DNA, 25 bp, Rattus norvegicus
taatgttgccctagtacactgtgtt

SEQ ID NO: 546029 - DNA, 25 bp, Rattus norvegicus
taatgttgcccttgtacactgtgtt

SEQ ID NO: 546030 - DNA, 25 bp, Rattus norvegicus
taatgttggcgcagaggccctgggc

SEQ ID NO: 546031 - DNA, 25 bp, Rattus norvegicus
taatgttggcgctgaggccctgggc

SEQ ID NO: 546032 - DNA, 25 bp, Rattus norvegicus
taatgttggtgcagtctggccacaa

SEQ ID NO: 546033 - DNA, 25 bp, Rattus norvegicus
taatgttggtgctgtctggccacaa

SEQ ID NO: 546034 - DNA, 25 bp, Rattus norvegicus
taatgttgtgacacaatggaaccat

SEQ ID NO: 546035 - DNA, 25 bp, Rattus norvegicus
taatgttgtgactcaatggaaccat

SEQ ID NO: 546036 - DNA, 25 bp, Rattus norvegicus
taatgttgtttgctacttctgtatt

SEQ ID NO: 546037 - DNA, 25 bp, Rattus norvegicus
taatgttgtttggtacttctgtatt

SEQ ID NO: 546038 - DNA, 25 bp, Rattus norvegicus
taatgtttacatagagcactaggtg

SEQ ID NO: 546039 - DNA, 25 bp, Rattus norvegicus
taatgtttacattgagcactaggtg

SEQ ID NO: 546040 - DNA, 25 bp, Rattus norvegicus
taatgtttacccctgatccctaatc

SEQ ID NO: 546041 - DNA, 25 bp, Rattus norvegicus
taatgtttacccgtgatccctaatc

SEQ ID NO: 546042 - DNA, 25 bp, Rattus norvegicus
taatgtttacctacccatgtcatcc

SEQ ID NO: 546043 - DNA, 25 bp, Rattus norvegicus
taatgtttaccttcccatgtcatcc

SEQ ID NO: 546044 - DNA, 25 bp, Rattus norvegicus
taatgtttactaactgggtctccca

SEQ ID NO: 546045 - DNA, 25 bp, Rattus norvegicus
taatgtttactatctgggtctccca

SEQ ID NO: 546046 - DNA, 25 bp, Rattus norvegicus
taatgtttacttcagctagttgagc

SEQ ID NO: 546047 - DNA, 25 bp, Rattus norvegicus
taatgtttacttgagctagttgagc

SEQ ID NO: 546048 - DNA, 25 bp, Rattus norvegicus
taatgtttcactcttttcggtttat

SEQ ID NO: 546049 - DNA, 25 bp, Rattus norvegicus
taatgtttcactgttttcggtttat

SEQ ID NO: 546050 - DNA, 25 bp, Rattus norvegicus
taatgtttccaaagttgttacgcac

SEQ ID NO: 546051 - DNA, 25 bp, Rattus norvegicus
taatgtttccaatgttgttacgcac

SEQ ID NO: 546052 - DNA, 25 bp, Rattus norvegicus
taatgtttcccacctgctcagagtg

SEQ ID NO: 546053 - DNA, 25 bp, Rattus norvegicus
taatgtttcccagctgctcagagtg

SEQ ID NO: 546054 - DNA, 25 bp, Rattus norvegicus
taatgtttcctcagtctacacggac

SEQ ID NO: 546055 - DNA, 25 bp, Rattus norvegicus
taatgtttcctctgtctacacggac

SEQ ID NO: 546056 - DNA, 25 bp, Rattus norvegicus
taatgtttctgacccatcctgctgg

SEQ ID NO: 546057 - DNA, 25 bp, Rattus norvegicus
taatgtttctgagccatcctgctgg

SEQ ID NO: 546058 - DNA, 25 bp, Rattus norvegicus
taatgtttgaggctgtctctccagt

SEQ ID NO: 546059 - DNA, 25 bp, Rattus norvegicus
taatgtttgagggtgtctctccagt

SEQ ID NO: 546060 - DNA, 25 bp, Rattus norvegicus
taatgtttggcgactgtggatgacc

SEQ ID NO: 546061 - DNA, 25 bp, Rattus norvegicus
taatgtttggcgtctgtggatgacc

SEQ ID NO: 546062 - DNA, 25 bp, Rattus norvegicus
taatgtttggctattgagttgcact

SEQ ID NO: 546063 - DNA, 25 bp, Rattus norvegicus
taatgtttggcttttgagttgcact

SEQ ID NO: 546064 - DNA, 25 bp, Rattus norvegicus
taatgttttatcatttctaatggtt

SEQ ID NO: 546065 - DNA, 25 bp, Rattus norvegicus
taatgttttatcttttctaatggtt

SEQ ID NO: 546066 - DNA, 25 bp, Rattus norvegicus
taatgttttctccacagattcctgc

SEQ ID NO: 546067 - DNA, 25 bp, Rattus norvegicus
taatgttttctcgacagattcctgc

SEQ ID NO: 546068 - DNA, 25 bp, Rattus norvegicus
taatgttttgctactcttgtcagac

SEQ ID NO: 546069 - DNA, 25 bp, Rattus norvegicus
taatgttttgcttctcttgtcagac

SEQ ID NO: 546070 - DNA, 25 bp, Rattus norvegicus
taattaaaacggcattaccgtgtct

SEQ ID NO: 546071 - DNA, 25 bp, Rattus norvegicus
taattaaaacgggattaccgtgtct

SEQ ID NO: 546072 - DNA, 25 bp, Rattus norvegicus
taattaactttactccaatgggtgt

SEQ ID NO: 546073 - DNA, 25 bp, Rattus norvegicus
taattaactttagtccaatgggtgt

SEQ ID NO: 546074 - DNA, 25 bp, Rattus norvegicus
taattaactttgaacgtcctctgcc

SEQ ID NO: 546075 - DNA, 25 bp, Rattus norvegicus
taattaactttgtacgtcctctgcc

SEQ ID NO: 546076 - DNA, 25 bp, Rattus norvegicus
taattaaggacacggcacccaaggt

SEQ ID NO: 546077 - DNA, 25 bp, Rattus norvegicus
taattaaggacagggcacccaaggt

SEQ ID NO: 546078 - DNA, 25 bp, Rattus norvegicus
taattaaggcttcggcattctcaag

SEQ ID NO: 546079 - DNA, 25 bp, Rattus norvegicus
taattaaggcttgggcattctcaag

SEQ ID NO: 546080 - DNA, 25 bp, Rattus norvegicus
taattaatgcttccctctgctactg

SEQ ID NO: 546081 - DNA, 25 bp, Rattus norvegicus
taattaatgcttgcctctgctactg

SEQ ID NO: 546082 - DNA, 25 bp, Rattus norvegicus
taattaattgcacggctcaagccac

SEQ ID NO: 546083 - DNA, 25 bp, Rattus norvegicus
taattaattgcagggctcaagccac

SEQ ID NO: 546084 - DNA, 25 bp, Rattus norvegicus
taattacaaaccaggtcttcctcgg

SEQ ID NO: 546085 - DNA, 25 bp, Rattus norvegicus
taattacaaacctggtcttcctcgg

SEQ ID NO: 546086 - DNA, 25 bp, Rattus norvegicus
taattacaaccaccatctcctgttg

SEQ ID NO: 546087 - DNA, 25 bp, Rattus norvegicus
taattacaaccagcatctcctgttg

SEQ ID NO: 546088 - DNA, 25 bp, Rattus norvegicus
taattacagccaaagaagcaggtta

SEQ ID NO: 546089 - DNA, 25 bp, Rattus norvegicus
taattacagccatagaagcaggtta

SEQ ID NO: 546090 - DNA, 25 bp, Rattus norvegicus
taattacatacacccttgcctgtgg

SEQ ID NO: 546091 - DNA, 25 bp, Rattus norvegicus
taattacatacagccttgcctgtgg

SEQ ID NO: 546092 - DNA, 25 bp, Rattus norvegicus
taattacatttacttccttggcctc

SEQ ID NO: 546093 - DNA, 25 bp, Rattus norvegicus
taattacatttagttccttggcctc

SEQ ID NO: 546094 - DNA, 25 bp, Rattus norvegicus
taattaccactgacctgttggccag

SEQ ID NO: 546095 - DNA, 25 bp, Rattus norvegicus
taattaccactgtcctgttggccag

SEQ ID NO: 546096 - DNA, 25 bp, Rattus norvegicus
taattacccgccacttagcaggaag

SEQ ID NO: 546097 - DNA, 25 bp, Rattus norvegicus
taattacccgcctcttagcaggaag

SEQ ID NO: 546098 - DNA, 25 bp, Rattus norvegicus
taattaccgaacctcattgccatga

SEQ ID NO: 546099 - DNA, 25 bp, Rattus norvegicus
taattaccgaacgtcattgccatga

SEQ ID NO: 546100 - DNA, 25 bp, Rattus norvegicus
taattaccgagcacctgcaggcata

SEQ ID NO: 546101 - DNA, 25 bp, Rattus norvegicus
taattaccgagctcctgcaggcata

SEQ ID NO: 546102 - DNA, 25 bp, Rattus norvegicus
taattaccggagcaatccagagcaa

SEQ ID NO: 546103 - DNA, 25 bp, Rattus norvegicus
taattaccggaggaatccagagcaa

SEQ ID NO: 546104 - DNA, 25 bp, Rattus norvegicus
taattaccgttaacagagggagcct

SEQ ID NO: 546105 - DNA, 25 bp, Rattus norvegicus
taattaccgttatcagagggagcct

SEQ ID NO: 546106 - DNA, 25 bp, Rattus norvegicus
taattacctccccagaaggttctgg

SEQ ID NO: 546107 - DNA, 25 bp, Rattus norvegicus
taattacctcccgagaaggttctgg

SEQ ID NO: 546108 - DNA, 25 bp, Rattus norvegicus
taattactacaaaaccccaaggcta

SEQ ID NO: 546109 - DNA, 25 bp, Rattus norvegicus
taattactacaataccccaaggcta

SEQ ID NO: 546110 - DNA, 25 bp, Rattus norvegicus
taattactagctattctttcccact

SEQ ID NO: 546111 - DNA, 25 bp, Rattus norvegicus
taattactagcttttctttcccact

SEQ ID NO: 546112 - DNA, 25 bp, Rattus norvegicus
taattactcctcagaatgtcaccca

SEQ ID NO: 546113 - DNA, 25 bp, Rattus norvegicus
taattactcctctgaatgtcaccca

SEQ ID NO: 546114 - DNA, 25 bp, Rattus norvegicus
taattactctcaaaaggtccttagg

SEQ ID NO: 546115 - DNA, 25 bp, Rattus norvegicus
taattactctcataaggtccttagg

SEQ ID NO: 546116 - DNA, 25 bp, Rattus norvegicus
taattactgcttagtgtcttcccac

SEQ ID NO: 546117 - DNA, 25 bp, Rattus norvegicus
taattactgctttgtgtcttcccac

SEQ ID NO: 546118 - DNA, 25 bp, Rattus norvegicus
taattactggtgagattggtacata

SEQ ID NO: 546119 - DNA, 25 bp, Rattus norvegicus
taattactggtgtgattggtacata

SEQ ID NO: 546120 - DNA, 25 bp, Rattus norvegicus
taattactgtcgattctctgggacc

SEQ ID NO: 546121 - DNA, 25 bp, Rattus norvegicus
taattactgtcgtttctctgggacc

SEQ ID NO: 546122 - DNA, 25 bp, Rattus norvegicus
taattagaatcccttggccactgca

SEQ ID NO: 546123 - DNA, 25 bp, Rattus norvegicus
taattagaatccgttggccactgca

SEQ ID NO: 546124 - DNA, 25 bp, Rattus norvegicus
taattagacccacgcgatagcgatt

SEQ ID NO: 546125 - DNA, 25 bp, Rattus norvegicus
taattagacccaggcgatagcgatt

SEQ ID NO: 546126 - DNA, 25 bp, Rattus norvegicus
taattagcatctatccccgtttcca

SEQ ID NO: 546127 - DNA, 25 bp, Rattus norvegicus
taattagcatctttccccgtttcca

SEQ ID NO: 546128 - DNA, 25 bp, Rattus norvegicus
taattagcattcaggcagcttccaa

SEQ ID NO: 546129 - DNA, 25 bp, Rattus norvegicus
taattagcattctggcagcttccaa

SEQ ID NO: 546130 - DNA, 25 bp, Rattus norvegicus
taattagcccagcaagccgagctgc

SEQ ID NO: 546131 - DNA, 25 bp, Rattus norvegicus
taattagcccaggaagccgagctgc

SEQ ID NO: 546132 - DNA, 25 bp, Rattus norvegicus
taattagccgggagtagcgtctgct

SEQ ID NO: 546133 - DNA, 25 bp, Rattus norvegicus
taattagccgggtgtagcgtctgct

SEQ ID NO: 546134 - DNA, 25 bp, Rattus norvegicus
taattagccggtcccaggagcttgt

SEQ ID NO: 546135 - DNA, 25 bp, Rattus norvegicus
taattagccggtgccaggagcttgt

SEQ ID NO: 546136 - DNA, 25 bp, Rattus norvegicus
taattagccttccaaccaaccaaat

SEQ ID NO: 546137 - DNA, 25 bp, Rattus norvegicus
taattagccttcgaaccaaccaaat

SEQ ID NO: 546138 - DNA, 25 bp, Rattus norvegicus
taattagctgacaccatgctcctga

SEQ ID NO: 546139 - DNA, 25 bp, Rattus norvegicus
taattagctgactccatgctcctga

SEQ ID NO: 546140 - DNA, 25 bp, Rattus norvegicus
taattagctttccttcttggcggaa

SEQ ID NO: 546141 - DNA, 25 bp, Rattus norvegicus
taattagctttcgttcttggcggaa

SEQ ID NO: 546142 - DNA, 25 bp, Rattus norvegicus
taattaggcaagactcagcaagagc

SEQ ID NO: 546143 - DNA, 25 bp, Rattus norvegicus
taattaggcaagtctcagcaagagc

SEQ ID NO: 546144 - DNA, 25 bp, Rattus norvegicus
taattaggctttatgaggtagttct

SEQ ID NO: 546145 - DNA, 25 bp, Rattus norvegicus
taattaggctttttgaggtagttct

SEQ ID NO: 546146 - DNA, 25 bp, Rattus norvegicus
taattagtgatgaccccagtagaaa

SEQ ID NO: 546147 - DNA, 25 bp, Rattus norvegicus
taattagtgatgtccccagtagaaa

SEQ ID NO: 546148 - DNA, 25 bp, Rattus norvegicus
taattatacccgaagtaagccacat

SEQ ID NO: 546149 - DNA, 25 bp, Rattus norvegicus
taattatacccgtagtaagccacat

SEQ ID NO: 546150 - DNA, 25 bp, Rattus norvegicus
taattatagttgacccctggtacca

SEQ ID NO: 546151 - DNA, 25 bp, Rattus norvegicus
taattatagttgtcccctggtacca

SEQ ID NO: 546152 - DNA, 25 bp, Rattus norvegicus
taattatcactgctctctgtcgtat

SEQ ID NO: 546153 - DNA, 25 bp, Rattus norvegicus
taattatcactggtctctgtcgtat

SEQ ID NO: 546154 - DNA, 25 bp, Rattus norvegicus
taattatcctcacgcctattaccgt

SEQ ID NO: 546155 - DNA, 25 bp, Rattus norvegicus
taattatcctcaggcctattaccgt

SEQ ID NO: 546156 - DNA, 25 bp, Rattus norvegicus
taattatcgtgtcaattccctcctc

SEQ ID NO: 546157 - DNA, 25 bp, Rattus norvegicus
taattatcgtgtgaattccctcctc

SEQ ID NO: 546158 - DNA, 25 bp, Rattus norvegicus
taattatgcggaacaaccaggctct

SEQ ID NO: 546159 - DNA, 25 bp, Rattus norvegicus
taattatgcggatcaaccaggctct

SEQ ID NO: 546160 - DNA, 25 bp, Rattus norvegicus
taattatggctgatagtcgactaga

SEQ ID NO: 546161 - DNA, 25 bp, Rattus norvegicus
taattatggctgttagtcgactaga

SEQ ID NO: 546162 - DNA, 25 bp, Rattus norvegicus
taattatgtagacctggccggccta

SEQ ID NO: 546163 - DNA, 25 bp, Rattus norvegicus
taattatgtagagctggccggccta

SEQ ID NO: 546164 - DNA, 25 bp, Rattus norvegicus
taattatgtcctaggtgttctcccc

SEQ ID NO: 546165 - DNA, 25 bp, Rattus norvegicus
taattatgtccttggtgttctcccc

SEQ ID NO: 546166 - DNA, 25 bp, Rattus norvegicus
taattatgttgacacctcagcccca

SEQ ID NO: 546167 - DNA, 25 bp, Rattus norvegicus
taattatgttgagacctcagcccca

SEQ ID NO: 546168 - DNA, 25 bp, Rattus norvegicus
taattattgacaacagtgcctgtgc

SEQ ID NO: 546169 - DNA, 25 bp, Rattus norvegicus
taattattgacatcagtgcctgtgc

SEQ ID NO: 546170 - DNA, 25 bp, Rattus norvegicus
taattatttcccactgttattcaaa

SEQ ID NO: 546171 - DNA, 25 bp, Rattus norvegicus
taattatttcccagtttttagctag

SEQ ID NO: 546172 - DNA, 25 bp, Rattus norvegicus
taattatttccctctgttattcaaa

SEQ ID NO: 546173 - DNA, 25 bp, Rattus norvegicus
taattatttccctgtttttagctag

SEQ ID NO: 546174 - DNA, 25 bp, Rattus norvegicus
taattatttcctcttgtgtcctgct

SEQ ID NO: 546175 - DNA, 25 bp, Rattus norvegicus
taattatttcctgttgtgtcctgct

SEQ ID NO: 546176 - DNA, 25 bp, Rattus norvegicus
taattattttctcttatcaaagcac

SEQ ID NO: 546177 - DNA, 25 bp, Rattus norvegicus
taattattttctgttatcaaagcac

SEQ ID NO: 546178 - DNA, 25 bp, Rattus norvegicus
taattcaagcccagccttcaaaatg

SEQ ID NO: 546179 - DNA, 25 bp, Rattus norvegicus
taattcaagccctgccttcaaaatg

SEQ ID NO: 546180 - DNA, 25 bp, Rattus norvegicus
taattcaagtctcaagctgcctggg

SEQ ID NO: 546181 - DNA, 25 bp, Rattus norvegicus
taattcaagtctgaagctgcctggg

SEQ ID NO: 546182 - DNA, 25 bp, Rattus norvegicus
taattcacctggatttgtcacgcct

SEQ ID NO: 546183 - DNA, 25 bp, Rattus norvegicus
taattcacctggttttgtcacgcct

SEQ ID NO: 546184 - DNA, 25 bp, Rattus norvegicus
taattcactggacagcattagtaac

SEQ ID NO: 546185 - DNA, 25 bp, Rattus norvegicus
taattcactggagagcattagtaac

SEQ ID NO: 546186 - DNA, 25 bp, Rattus norvegicus
taattcacttttctagttcctaaga

SEQ ID NO: 546187 - DNA, 25 bp, Rattus norvegicus
taattcacttttgtagttcctaaga

SEQ ID NO: 546188 - DNA, 25 bp, Rattus norvegicus
taattcagcaaaccctccattggtg

SEQ ID NO: 546189 - DNA, 25 bp, Rattus norvegicus
taattcagcaaagcctccattggtg

SEQ ID NO: 546190 - DNA, 25 bp, Rattus norvegicus
taattcagcaggaaggagtctcaaa

SEQ ID NO: 546191 - DNA, 25 bp, Rattus norvegicus
taattcagcaggtaggagtctcaaa

SEQ ID NO: 546192 - DNA, 25 bp, Rattus norvegicus
taattcagctcgagttttacccttt

SEQ ID NO: 546193 - DNA, 25 bp, Rattus norvegicus
taattcagctcgtgttttacccttt

SEQ ID NO: 546194 - DNA, 25 bp, Rattus norvegicus
taattcaggtacactggcaggctgt

SEQ ID NO: 546195 - DNA, 25 bp, Rattus norvegicus
taattcaggtactctggcaggctgt

SEQ ID NO: 546196 - DNA, 25 bp, Rattus norvegicus
taattcaggtggctgttccttgcca

SEQ ID NO: 546197 - DNA, 25 bp, Rattus norvegicus
taattcaggtgggtgttccttgcca

SEQ ID NO: 546198 - DNA, 25 bp, Rattus norvegicus
taattcatccctctgatccaggaca

SEQ ID NO: 546199 - DNA, 25 bp, Rattus norvegicus
taattcatccctgtgatccaggaca

SEQ ID NO: 546200 - DNA, 25 bp, Rattus norvegicus
taattcatgcctcatttgtatttct

SEQ ID NO: 546201 - DNA, 25 bp, Rattus norvegicus
taattcatgcctgatttgtatttct

SEQ ID NO: 546202 - DNA, 25 bp, Rattus norvegicus
taattcattttaacttccgcacctc

SEQ ID NO: 546203 - DNA, 25 bp, Rattus norvegicus
taattcattttatcttccgcacctc

SEQ ID NO: 546204 - DNA, 25 bp, Rattus norvegicus
taattccacgtgctcctgacaggag

SEQ ID NO: 546205 - DNA, 25 bp, Rattus norvegicus
taattccacgtggtcctgacaggag

SEQ ID NO: 546206 - DNA, 25 bp, Rattus norvegicus
taattccagaataaccagctcacct

SEQ ID NO: 546207 - DNA, 25 bp, Rattus norvegicus
taattccagaattaccagctcacct

SEQ ID NO: 546208 - DNA, 25 bp, Rattus norvegicus
taattccagccccagaggaatccaa

SEQ ID NO: 546209 - DNA, 25 bp, Rattus norvegicus
taattccagcccgagaggaatccaa

SEQ ID NO: 546210 - DNA, 25 bp, Rattus norvegicus
taattccataatagtacactccacc

SEQ ID NO: 546211 - DNA, 25 bp, Rattus norvegicus
taattccataattgtacactccacc

SEQ ID NO: 546212 - DNA, 25 bp, Rattus norvegicus
taattccatcgcagcggtcagcgtc

SEQ ID NO: 546213 - DNA, 25 bp, Rattus norvegicus
taattccatcgctgcggtcagcgtc

SEQ ID NO: 546214 - DNA, 25 bp, Rattus norvegicus
taattcccactcatcctgttgggaa

SEQ ID NO: 546215 - DNA, 25 bp, Rattus norvegicus
taattcccactcttcctgttgggaa

SEQ ID NO: 546216 - DNA, 25 bp, Rattus norvegicus
taattcccaggccttgtcattcaag

SEQ ID NO: 546217 - DNA, 25 bp, Rattus norvegicus
taattcccaggcgttgtcattcaag

SEQ ID NO: 546218 - DNA, 25 bp, Rattus norvegicus
taattccccaatccaacagtgctta

SEQ ID NO: 546219 - DNA, 25 bp, Rattus norvegicus
taattccccaatgcaacagtgctta

SEQ ID NO: 546220 - DNA, 25 bp, Rattus norvegicus
taattccccagtcgatttcacagat

SEQ ID NO: 546221 - DNA, 25 bp, Rattus norvegicus
taattccccagtggatttcacagat

SEQ ID NO: 546222 - DNA, 25 bp, Rattus norvegicus
taattccctgtacctatttggcagc

SEQ ID NO: 546223 - DNA, 25 bp, Rattus norvegicus
taattccctgtagctatttggcagc

SEQ ID NO: 546224 - DNA, 25 bp, Rattus norvegicus
taattcccttgtctacagccatcat

SEQ ID NO: 546225 - DNA, 25 bp, Rattus norvegicus
taattcccttgtgtacagccatcat

SEQ ID NO: 546226 - DNA, 25 bp, Rattus norvegicus
taattcctcacaacccaaatgctgg

SEQ ID NO: 546227 - DNA, 25 bp, Rattus norvegicus
taattcctcacatcccaaatgctgg

SEQ ID NO: 546228 - DNA, 25 bp, Rattus norvegicus
taattcctctttatgggcaactcaa

SEQ ID NO: 546229 - DNA, 25 bp, Rattus norvegicus
taattcctctttttgggcaactcaa

SEQ ID NO: 546230 - DNA, 25 bp, Rattus norvegicus
taattcctgtggatggtcctgatgt

SEQ ID NO: 546231 - DNA, 25 bp, Rattus norvegicus
taattcctgtggttggtcctgatgt

SEQ ID NO: 546232 - DNA, 25 bp, Rattus norvegicus
taattccttgggaacttctttatct

SEQ ID NO: 546233 - DNA, 25 bp, Rattus norvegicus
taattccttgggtacttctttatct

SEQ ID NO: 546234 - DNA, 25 bp, Rattus norvegicus
taattcgatgttatgcttgcactac

SEQ ID NO: 546235 - DNA, 25 bp, Rattus norvegicus
taattcgatgttttgcttgcactac

SEQ ID NO: 546236 - DNA, 25 bp, Rattus norvegicus
taattcgctgtcctttttgtttttg

SEQ ID NO: 546237 - DNA, 25 bp, Rattus norvegicus
taattcgctgtcgtttttgtttttg

SEQ ID NO: 546238 - DNA, 25 bp, Rattus norvegicus
taattctacttcctcgcatcttggt

SEQ ID NO: 546239 - DNA, 25 bp, Rattus norvegicus
taattctacttcgtcgcatcttggt

SEQ ID NO: 546240 - DNA, 25 bp, Rattus norvegicus
taattctaggtgactgtgcactctc

SEQ ID NO: 546241 - DNA, 25 bp, Rattus norvegicus
taattctaggtgtctgtgcactctc

SEQ ID NO: 546242 - DNA, 25 bp, Rattus norvegicus
taattctcaaatattcacaaagatc

SEQ ID NO: 546243 - DNA, 25 bp, Rattus norvegicus
taattctcaaattttcacaaagatc

SEQ ID NO: 546244 - DNA, 25 bp, Rattus norvegicus
taattctcatttatgggatcgccac

SEQ ID NO: 546245 - DNA, 25 bp, Rattus norvegicus
taattctcatttttgggatcgccac

SEQ ID NO: 546246 - DNA, 25 bp, Rattus norvegicus
taattctcccggctctgcacataaa

SEQ ID NO: 546247 - DNA, 25 bp, Rattus norvegicus
taattctcccgggtctgcacataaa

SEQ ID NO: 546248 - DNA, 25 bp, Rattus norvegicus
taattctcggttaccgttccatcac

SEQ ID NO: 546249 - DNA, 25 bp, Rattus norvegicus
taattctcggtttccgttccatcac

SEQ ID NO: 546250 - DNA, 25 bp, Rattus norvegicus
taattctctattaacttctctgtga

SEQ ID NO: 546251 - DNA, 25 bp, Rattus norvegicus
taattctctatttacttctctgtga

SEQ ID NO: 546252 - DNA, 25 bp, Rattus norvegicus
taattctgaaccagattccttccag

SEQ ID NO: 546253 - DNA, 25 bp, Rattus norvegicus
taattctgaacctgattccttccag

SEQ ID NO: 546254 - DNA, 25 bp, Rattus norvegicus
taattctgaactcctgcttcaccag

SEQ ID NO: 546255 - DNA, 25 bp, Rattus norvegicus
taattctgaactgctgcttcaccag

SEQ ID NO: 546256 - DNA, 25 bp, Rattus norvegicus
taattctgacatctcccatctctgt

SEQ ID NO: 546257 - DNA, 25 bp, Rattus norvegicus
taattctgacatgtcccatctctgt

SEQ ID NO: 546258 - DNA, 25 bp, Rattus norvegicus
taattctgaggtcgccccagtcatc

SEQ ID NO: 546259 - DNA, 25 bp, Rattus norvegicus
taattctgaggtggccccagtcatc

SEQ ID NO: 546260 - DNA, 25 bp, Rattus norvegicus
taattctgattgctacccttaaaag

SEQ ID NO: 546261 - DNA, 25 bp, Rattus norvegicus
taattctgattggtacccttaaaag

SEQ ID NO: 546262 - DNA, 25 bp, Rattus norvegicus
taattctgcatgaggactttatcca

SEQ ID NO: 546263 - DNA, 25 bp, Rattus norvegicus
taattctgcatgtggactttatcca

SEQ ID NO: 546264 - DNA, 25 bp, Rattus norvegicus
taattctggcctcgagcttaagcta

SEQ ID NO: 546265 - DNA, 25 bp, Rattus norvegicus
taattctggcctggagcttaagcta

SEQ ID NO: 546266 - DNA, 25 bp, Rattus norvegicus
taattctgtaaccacctgctgattg

SEQ ID NO: 546267 - DNA, 25 bp, Rattus norvegicus
taattctgtaacgacctgctgattg

SEQ ID NO: 546268 - DNA, 25 bp, Rattus norvegicus
taattctgtagcaaagcctctagag

SEQ ID NO: 546269 - DNA, 25 bp, Rattus norvegicus
taattctgtagctaagcctctagag

SEQ ID NO: 546270 - DNA, 25 bp, Rattus norvegicus
taattctgtgtgattcctacccggt

SEQ ID NO: 546271 - DNA, 25 bp, Rattus norvegicus
taattctgtgtgtttcctacccggt

SEQ ID NO: 546272 - DNA, 25 bp, Rattus norvegicus
taattctgttctcagttgcccatga

SEQ ID NO: 546273 - DNA, 25 bp, Rattus norvegicus
taattctgttctgagttgcccatga

SEQ ID NO: 546274 - DNA, 25 bp, Rattus norvegicus
taattcttaatcactctgacttcag

SEQ ID NO: 546275 - DNA, 25 bp, Rattus norvegicus
taattcttaatctctctgacttcag

SEQ ID NO: 546276 - DNA, 25 bp, Rattus norvegicus
taattcttcaagacactgtgtcctt

SEQ ID NO: 546277 - DNA, 25 bp, Rattus norvegicus
taattcttcaagtcactgtgtcctt

SEQ ID NO: 546278 - DNA, 25 bp, Rattus norvegicus
taattcttcaggatgcagcgaggct

SEQ ID NO: 546279 - DNA, 25 bp, Rattus norvegicus
taattcttcaggttgcagcgaggct

SEQ ID NO: 546280 - DNA, 25 bp, Rattus norvegicus
taattcttccacattagcctgcaga

SEQ ID NO: 546281 - DNA, 25 bp, Rattus norvegicus
taattcttccactttagcctgcaga

SEQ ID NO: 546282 - DNA, 25 bp, Rattus norvegicus
taattcttgtgtatggtgttctgta

SEQ ID NO: 546283 - DNA, 25 bp, Rattus norvegicus
taattcttgtgtttggtgttctgta

SEQ ID NO: 546284 - DNA, 25 bp, Rattus norvegicus
taattctttacgatggaggttcact

SEQ ID NO: 546285 - DNA, 25 bp, Rattus norvegicus
taattctttacgttggaggttcact

SEQ ID NO: 546286 - DNA, 25 bp, Rattus norvegicus
taattctttactattgatactgtga

SEQ ID NO: 546287 - DNA, 25 bp, Rattus norvegicus
taattctttacttttgatactgtga

SEQ ID NO: 546288 - DNA, 25 bp, Rattus norvegicus
taattctttcagaagcgggttctac

SEQ ID NO: 546289 - DNA, 25 bp, Rattus norvegicus
taattctttcagtagcgggttctac

SEQ ID NO: 546290 - DNA, 25 bp, Rattus norvegicus
taattctttctcctttgtcaacagc

SEQ ID NO: 546291 - DNA, 25 bp, Rattus norvegicus
taattctttctcgtttgtcaacagc

SEQ ID NO: 546292 - DNA, 25 bp, Rattus norvegicus
taattctttgctcaggaggcctgtt

SEQ ID NO: 546293 - DNA, 25 bp, Rattus norvegicus
taattctttgctgaggaggcctgtt

SEQ ID NO: 546294 - DNA, 25 bp, Rattus norvegicus
taattctttgtaaaggccacctggt

SEQ ID NO: 546295 - DNA, 25 bp, Rattus norvegicus
taattctttgtacactttgcccttc

SEQ ID NO: 546296 - DNA, 25 bp, Rattus norvegicus
taattctttgtagactttgcccttc

SEQ ID NO: 546297 - DNA, 25 bp, Rattus norvegicus
taattctttgtataggccacctggt

SEQ ID NO: 546298 - DNA, 25 bp, Rattus norvegicus
taattgaagatgctcggcacccaca

SEQ ID NO: 546299 - DNA, 25 bp, Rattus norvegicus
taattgaagatggtcggcacccaca

SEQ ID NO: 546300 - DNA, 25 bp, Rattus norvegicus
taattgaattttagtctagacgcca

SEQ ID NO: 546301 - DNA, 25 bp, Rattus norvegicus
taattgaatttttgtctagacgcca

SEQ ID NO: 546302 - DNA, 25 bp, Rattus norvegicus
taattgacaccccatctgccgatgc

SEQ ID NO: 546303 - DNA, 25 bp, Rattus norvegicus
taattgacacccgatctgccgatgc

SEQ ID NO: 546304 - DNA, 25 bp, Rattus norvegicus
taattgactacactttagcagcagt

SEQ ID NO: 546305 - DNA, 25 bp, Rattus norvegicus
taattgactacagtttagcagcagt

SEQ ID NO: 546306 - DNA, 25 bp, Rattus norvegicus
taattgataatgacctctgctgccc

SEQ ID NO: 546307 - DNA, 25 bp, Rattus norvegicus
taattgataatgtcctctgctgccc

SEQ ID NO: 546308 - DNA, 25 bp, Rattus norvegicus
taattgatacatacccctgtgctag

SEQ ID NO: 546309 - DNA, 25 bp, Rattus norvegicus
taattgatacattcccctgtgctag

SEQ ID NO: 546310 - DNA, 25 bp, Rattus norvegicus
taattgattggcatgcattgtgcat

SEQ ID NO: 546311 - DNA, 25 bp, Rattus norvegicus
taattgattggcttgcattgtgcat

SEQ ID NO: 546312 - DNA, 25 bp, Rattus norvegicus
taattgcagcccagtatgtgacacc

SEQ ID NO: 546313 - DNA, 25 bp, Rattus norvegicus
taattgcagccctgtatgtgacacc

SEQ ID NO: 546314 - DNA, 25 bp, Rattus norvegicus
taattgcagtgtcgccctacccgta

SEQ ID NO: 546315 - DNA, 25 bp, Rattus norvegicus
taattgcagtgtggccctacccgta

SEQ ID NO: 546316 - DNA, 25 bp, Rattus norvegicus
taattgcagttgattgctccactgg

SEQ ID NO: 546317 - DNA, 25 bp, Rattus norvegicus
taattgcagttgtttgctccactgg

SEQ ID NO: 546318 - DNA, 25 bp, Rattus norvegicus
taattgcatggtatcgtgagtgtgt

SEQ ID NO: 546319 - DNA, 25 bp, Rattus norvegicus
taattgcatggtttcgtgagtgtgt

SEQ ID NO: 546320 - DNA, 25 bp, Rattus norvegicus
taattgccaagtagagcctcagcct

SEQ ID NO: 546321 - DNA, 25 bp, Rattus norvegicus
taattgccaagtcgacctcctgatg

SEQ ID NO: 546322 - DNA, 25 bp, Rattus norvegicus
taattgccaagtggacctcctgatg

SEQ ID NO: 546323 - DNA, 25 bp, Rattus norvegicus
taattgccaagttgagcctcagcct

SEQ ID NO: 546324 - DNA, 25 bp, Rattus norvegicus
taattgccgaggcagggcttgtttt

SEQ ID NO: 546325 - DNA, 25 bp, Rattus norvegicus
taattgccgagggagggcttgtttt

SEQ ID NO: 546326 - DNA, 25 bp, Rattus norvegicus
taattgcctctgagtgtagctgaac

SEQ ID NO: 546327 - DNA, 25 bp, Rattus norvegicus
taattgcctctgtgtgtagctgaac

SEQ ID NO: 546328 - DNA, 25 bp, Rattus norvegicus
taattgcgacgtctcactctgcatt

SEQ ID NO: 546329 - DNA, 25 bp, Rattus norvegicus
taattgcgacgtgtcactctgcatt

SEQ ID NO: 546330 - DNA, 25 bp, Rattus norvegicus
taattgcgggtgcttcaggactttg

SEQ ID NO: 546331 - DNA, 25 bp, Rattus norvegicus
taattgcgggtggttcaggactttg

SEQ ID NO: 546332 - DNA, 25 bp, Rattus norvegicus
taattgctatccatgttacccattc

SEQ ID NO: 546333 - DNA, 25 bp, Rattus norvegicus
taattgctatccttgttacccattc

SEQ ID NO: 546334 - DNA, 25 bp, Rattus norvegicus
taattgctcgttaccatgtttcttc

SEQ ID NO: 546335 - DNA, 25 bp, Rattus norvegicus
taattgctcgtttccatgtttcttc

SEQ ID NO: 546336 - DNA, 25 bp, Rattus norvegicus
taattgctctgtagtcagtgctctc

SEQ ID NO: 546337 - DNA, 25 bp, Rattus norvegicus
taattgctctgttgtcagtgctctc

SEQ ID NO: 546338 - DNA, 25 bp, Rattus norvegicus
taattgcttctaactctagctccag

SEQ ID NO: 546339 - DNA, 25 bp, Rattus norvegicus
taattgcttctatctctagctccag

SEQ ID NO: 546340 - DNA, 25 bp, Rattus norvegicus
taattgctttcaccctacctatgta

SEQ ID NO: 546341 - DNA, 25 bp, Rattus norvegicus
taattgctttcagcctacctatgta

SEQ ID NO: 546342 - DNA, 25 bp, Rattus norvegicus
taattgcttttgagtttgccacccc

SEQ ID NO: 546343 - DNA, 25 bp, Rattus norvegicus
taattgcttttgtgtttgccacccc

SEQ ID NO: 546344 - DNA, 25 bp, Rattus norvegicus
taattggaacaactctgctcagagc

SEQ ID NO: 546345 - DNA, 25 bp, Rattus norvegicus
taattggaacaagtctgctcagagc

SEQ ID NO: 546346 - DNA, 25 bp, Rattus norvegicus
taattggaatctatctcgcctactg

SEQ ID NO: 546347 - DNA, 25 bp, Rattus norvegicus
taattggaatctttctcgcctactg

SEQ ID NO: 546348 - DNA, 25 bp, Rattus norvegicus
taattggagctcagcgcgaagcgcc

SEQ ID NO: 546349 - DNA, 25 bp, Rattus norvegicus
taattggagctctgcgcgaagcgcc

SEQ ID NO: 546350 - DNA, 25 bp, Rattus norvegicus
taattggcatggaaagactgacttt

SEQ ID NO: 546351 - DNA, 25 bp, Rattus norvegicus
taattggcatggtaagactgacttt

SEQ ID NO: 546352 - DNA, 25 bp, Rattus norvegicus
taattggccctcatagccagcactt

SEQ ID NO: 546353 - DNA, 25 bp, Rattus norvegicus
taattggccctcttagccagcactt

SEQ ID NO: 546354 - DNA, 25 bp, Rattus norvegicus
taattggccgagaggtctgcgaagc

SEQ ID NO: 546355 - DNA, 25 bp, Rattus norvegicus
taattggccgagtggtctgcgaagc

SEQ ID NO: 546356 - DNA, 25 bp, Rattus norvegicus
taattgggctttaacatagttcggg

SEQ ID NO: 546357 - DNA, 25 bp, Rattus norvegicus
taattgggcttttacatagttcggg

SEQ ID NO: 546358 - DNA, 25 bp, Rattus norvegicus
taattggtaattccttgctaagcag

SEQ ID NO: 546359 - DNA, 25 bp, Rattus norvegicus
taattggtaattgcttgctaagcag

SEQ ID NO: 546360 - DNA, 25 bp, Rattus norvegicus
taattggtacagataagtggttctt

SEQ ID NO: 546361 - DNA, 25 bp, Rattus norvegicus
taattggtacagttaagtggttctt

SEQ ID NO: 546362 - DNA, 25 bp, Rattus norvegicus
taattggtactacccagggcagaca

SEQ ID NO: 546363 - DNA, 25 bp, Rattus norvegicus
taattggtactagccagggcagaca

SEQ ID NO: 546364 - DNA, 25 bp, Rattus norvegicus
taattggtcacaagattgcacgatc

SEQ ID NO: 546365 - DNA, 25 bp, Rattus norvegicus
taattggtcacatgattgcacgatc

SEQ ID NO: 546366 - DNA, 25 bp, Rattus norvegicus
taattggtcatactacagtgcctaa

SEQ ID NO: 546367 - DNA, 25 bp, Rattus norvegicus
taattggtcatagtacagtgcctaa

SEQ ID NO: 546368 - DNA, 25 bp, Rattus norvegicus
taattggtggcaactcttgtctttt

SEQ ID NO: 546369 - DNA, 25 bp, Rattus norvegicus
taattggtggcatctcttgtctttt

SEQ ID NO: 546370 - DNA, 25 bp, Rattus norvegicus
taattggttcccagattgctcgctg

SEQ ID NO: 546371 - DNA, 25 bp, Rattus norvegicus
taattggttccctgattgctcgctg

SEQ ID NO: 546372 - DNA, 25 bp, Rattus norvegicus
taattgtagctaaggatttccctgt

SEQ ID NO: 546373 - DNA, 25 bp, Rattus norvegicus
taattgtagctatggatttccctgt

SEQ ID NO: 546374 - DNA, 25 bp, Rattus norvegicus
taattgtagcttcttctcctaccac

SEQ ID NO: 546375 - DNA, 25 bp, Rattus norvegicus
taattgtagcttgttctcctaccac

SEQ ID NO: 546376 - DNA, 25 bp, Rattus norvegicus
taattgtaggagacccactcagccc

SEQ ID NO: 546377 - DNA, 25 bp, Rattus norvegicus
taattgtaggagtcccactcagccc

SEQ ID NO: 546378 - DNA, 25 bp, Rattus norvegicus
taattgtaggctatcactggctgct

SEQ ID NO: 546379 - DNA, 25 bp, Rattus norvegicus
taattgtaggctttcactggctgct

SEQ ID NO: 546380 - DNA, 25 bp, Rattus norvegicus
taattgtattgaccgccctgtaatc

SEQ ID NO: 546381 - DNA, 25 bp, Rattus norvegicus
taattgtattgagcgccctgtaatc

SEQ ID NO: 546382 - DNA, 25 bp, Rattus norvegicus
taattgtcccgtcccatttggaaat

SEQ ID NO: 546383 - DNA, 25 bp, Rattus norvegicus
taattgtcccgtgccatttggaaat

SEQ ID NO: 546384 - DNA, 25 bp, Rattus norvegicus
taattgtctaagcaaggcccctaag

SEQ ID NO: 546385 - DNA, 25 bp, Rattus norvegicus
taattgtctaaggaaggcccctaag

SEQ ID NO: 546386 - DNA, 25 bp, Rattus norvegicus
taattgtctgctcatagtgtccacc

SEQ ID NO: 546387 - DNA, 25 bp, Rattus norvegicus
taattgtctgctgatagtgtccacc

SEQ ID NO: 546388 - DNA, 25 bp, Rattus norvegicus
taattgtgatgcctctttccggagg

SEQ ID NO: 546389 - DNA, 25 bp, Rattus norvegicus
taattgtgatgcgtctttccggagg

SEQ ID NO: 546390 - DNA, 25 bp, Rattus norvegicus
taattgtgcataacttccttctccg

SEQ ID NO: 546391 - DNA, 25 bp, Rattus norvegicus
taattgtgcatatcttccttctccg

SEQ ID NO: 546392 - DNA, 25 bp, Rattus norvegicus
taattgtgtcgcaaaggcttccatt

SEQ ID NO: 546393 - DNA, 25 bp, Rattus norvegicus
taattgtgtcgctaaggcttccatt

SEQ ID NO: 546394 - DNA, 25 bp, Rattus norvegicus
taattgttgtaaatcatgacctcat

SEQ ID NO: 546395 - DNA, 25 bp, Rattus norvegicus
taattgttgtaattcatgacctcat

SEQ ID NO: 546396 - DNA, 25 bp, Rattus norvegicus
taattgtttcccctccattaagttg

SEQ ID NO: 546397 - DNA, 25 bp, Rattus norvegicus
taattgtttcccgtccattaagttg

SEQ ID NO: 546398 - DNA, 25 bp, Rattus norvegicus
taattgttttcaacccatgagcccc

SEQ ID NO: 546399 - DNA, 25 bp, Rattus norvegicus
taattgttttcatcccatgagcccc

SEQ ID NO: 546400 - DNA, 25 bp, Rattus norvegicus
taattgttttgccacccggaatcaa

SEQ ID NO: 546401 - DNA, 25 bp, Rattus norvegicus
taattgttttgcgacccggaatcaa

SEQ ID NO: 546402 - DNA, 25 bp, Rattus norvegicus
taatttaactcgaagctgctctctg

SEQ ID NO: 546403 - DNA, 25 bp, Rattus norvegicus
taatttaactcgtagctgctctctg

SEQ ID NO: 546404 - DNA, 25 bp, Rattus norvegicus
taatttaactttagcctcttcctca

SEQ ID NO: 546405 - DNA, 25 bp, Rattus norvegicus
taatttaacttttgcctcttcctca

SEQ ID NO: 546406 - DNA, 25 bp, Rattus norvegicus
taatttaagaatattatcctggttt

SEQ ID NO: 546407 - DNA, 25 bp, Rattus norvegicus
taatttaagaattttatcctggttt

SEQ ID NO: 546408 - DNA, 25 bp, Rattus norvegicus
taatttaagggaacccagtggctcc

SEQ ID NO: 546409 - DNA, 25 bp, Rattus norvegicus
taatttaagggatcccagtggctcc

SEQ ID NO: 546410 - DNA, 25 bp, Rattus norvegicus
taatttaataaaaccatggacttgg

SEQ ID NO: 546411 - DNA, 25 bp, Rattus norvegicus
taatttaataaatccatggacttgg

SEQ ID NO: 546412 - DNA, 25 bp, Rattus norvegicus
taatttactgccaatttgactctaa

SEQ ID NO: 546413 - DNA, 25 bp, Rattus norvegicus
taatttactgcctatttgactctaa

SEQ ID NO: 546414 - DNA, 25 bp, Rattus norvegicus
taatttactgctatcatcatgaacg

SEQ ID NO: 546415 - DNA, 25 bp, Rattus norvegicus
taatttactgctttcatcatgaacg

SEQ ID NO: 546416 - DNA, 25 bp, Rattus norvegicus
taatttagcaacaaggcagcccttg

SEQ ID NO: 546417 - DNA, 25 bp, Rattus norvegicus
taatttagcaactaggcagcccttg

SEQ ID NO: 546418 - DNA, 25 bp, Rattus norvegicus
taatttaggtttaccagtcgcttct

SEQ ID NO: 546419 - DNA, 25 bp, Rattus norvegicus
taatttaggttttccagtcgcttct

SEQ ID NO: 546420 - DNA, 25 bp, Rattus norvegicus
taatttagtctacctgtctcctgat

SEQ ID NO: 546421 - DNA, 25 bp, Rattus norvegicus
taatttagtctagctgtctcctgat

SEQ ID NO: 546422 - DNA, 25 bp, Rattus norvegicus
taatttagtctccaggtttactcct

SEQ ID NO: 546423 - DNA, 25 bp, Rattus norvegicus
taatttagtctcgaggtttactcct

SEQ ID NO: 546424 - DNA, 25 bp, Rattus norvegicus
taatttagtggtacctacacaactt

SEQ ID NO: 546425 - DNA, 25 bp, Rattus norvegicus
taatttagtggttcctacacaactt

SEQ ID NO: 546426 - DNA, 25 bp, Rattus norvegicus
taatttataatcctgttctgtgtac

SEQ ID NO: 546427 - DNA, 25 bp, Rattus norvegicus
taatttataatcgtgttctgtgtac

SEQ ID NO: 546428 - DNA, 25 bp, Rattus norvegicus
taatttatctacacagtgccctcat

SEQ ID NO: 546429 - DNA, 25 bp, Rattus norvegicus
taatttatctactcagtgccctcat

SEQ ID NO: 546430 - DNA, 25 bp, Rattus norvegicus
taatttatctctctgacctgccagg

SEQ ID NO: 546431 - DNA, 25 bp, Rattus norvegicus
taatttatctctgtgacctgccagg

SEQ ID NO: 546432 - DNA, 25 bp, Rattus norvegicus
taatttatcttcctgcactttcgag

SEQ ID NO: 546433 - DNA, 25 bp, Rattus norvegicus
taatttatcttcgtgcactttcgag

SEQ ID NO: 546434 - DNA, 25 bp, Rattus norvegicus
taatttatgctcaagtggtaccact

SEQ ID NO: 546435 - DNA, 25 bp, Rattus norvegicus
taatttatgctctagtggtaccact

SEQ ID NO: 546436 - DNA, 25 bp, Rattus norvegicus
taatttattgctatccatcctgtgg

SEQ ID NO: 546437 - DNA, 25 bp, Rattus norvegicus
taatttattgctttccatcctgtgg

SEQ ID NO: 546438 - DNA, 25 bp, Rattus norvegicus
taatttattgttcttctgtgtagaa

SEQ ID NO: 546439 - DNA, 25 bp, Rattus norvegicus
taatttattgttgttctgtgtagaa

SEQ ID NO: 546440 - DNA, 25 bp, Rattus norvegicus
taatttatttgaccggtctgtctgt

SEQ ID NO: 546441 - DNA, 25 bp, Rattus norvegicus
taatttatttgagcggtctgtctgt

SEQ ID NO: 546442 - DNA, 25 bp, Rattus norvegicus
taatttcaaaatcccctgggtcaat

SEQ ID NO: 546443 - DNA, 25 bp, Rattus norvegicus
taatttcaaaatgccctgggtcaat

SEQ ID NO: 546444 - DNA, 25 bp, Rattus norvegicus
taatttcaatttacctgctttcgtg

SEQ ID NO: 546445 - DNA, 25 bp, Rattus norvegicus
taatttcaattttcctgctttcgtg

SEQ ID NO: 546446 - DNA, 25 bp, Rattus norvegicus
taatttcaccaaaaaagccttcaaa

SEQ ID NO: 546447 - DNA, 25 bp, Rattus norvegicus
taatttcaccaataaagccttcaaa

SEQ ID NO: 546448 - DNA, 25 bp, Rattus norvegicus
taatttcactgtcccctggaagaca

SEQ ID NO: 546449 - DNA, 25 bp, Rattus norvegicus
taatttcactgtgccctggaagaca

SEQ ID NO: 546450 - DNA, 25 bp, Rattus norvegicus
taatttcactttaaagatccccaga

SEQ ID NO: 546451 - DNA, 25 bp, Rattus norvegicus
taatttcacttttaagatccccaga

SEQ ID NO: 546452 - DNA, 25 bp, Rattus norvegicus
taatttcagaccctaatttcccatc

SEQ ID NO: 546453 - DNA, 25 bp, Rattus norvegicus
taatttcagaccgtaatttcccatc

SEQ ID NO: 546454 - DNA, 25 bp, Rattus norvegicus
taatttcagagaaagcttctcccct

SEQ ID NO: 546455 - DNA, 25 bp, Rattus norvegicus
taatttcagagatagcttctcccct

SEQ ID NO: 546456 - DNA, 25 bp, Rattus norvegicus
taatttcagcccagtttcgttttcg

SEQ ID NO: 546457 - DNA, 25 bp, Rattus norvegicus
taatttcagccctgtttcgttttcg

SEQ ID NO: 546458 - DNA, 25 bp, Rattus norvegicus
taatttcaggttactatgccatgct

SEQ ID NO: 546459 - DNA, 25 bp, Rattus norvegicus
taatttcaggtttctatgccatgct

SEQ ID NO: 546460 - DNA, 25 bp, Rattus norvegicus
taatttccactaagaaatgggccaa

SEQ ID NO: 546461 - DNA, 25 bp, Rattus norvegicus
taatttccactatgaaatgggccaa

SEQ ID NO: 546462 - DNA, 25 bp, Rattus norvegicus
taatttccatacatgtacgtgtagg

SEQ ID NO: 546463 - DNA, 25 bp, Rattus norvegicus
taatttccatacttgtacgtgtagg

SEQ ID NO: 546464 - DNA, 25 bp, Rattus norvegicus
taatttccctctcacatgatgacag

SEQ ID NO: 546465 - DNA, 25 bp, Rattus norvegicus
taatttccctctgacatgatgacag

SEQ ID NO: 546466 - DNA, 25 bp, Rattus norvegicus
taatttccgattccctcctgtactt

SEQ ID NO: 546467 - DNA, 25 bp, Rattus norvegicus
taatttccgattgcctcctgtactt

SEQ ID NO: 546468 - DNA, 25 bp, Rattus norvegicus
taatttcctatgcaagattgtcatg

SEQ ID NO: 546469 - DNA, 25 bp, Rattus norvegicus
taatttcctatggaagattgtcatg

SEQ ID NO: 546470 - DNA, 25 bp, Rattus norvegicus
taatttcctgtgcagtttctaccca

SEQ ID NO: 546471 - DNA, 25 bp, Rattus norvegicus
taatttcctgtggagtttctaccca

SEQ ID NO: 546472 - DNA, 25 bp, Rattus norvegicus
taatttccttatacccgttagcatc

SEQ ID NO: 546473 - DNA, 25 bp, Rattus norvegicus
taatttccttattcccgttagcatc

SEQ ID NO: 546474 - DNA, 25 bp, Rattus norvegicus
taatttccttccatgagttgcacag

SEQ ID NO: 546475 - DNA, 25 bp, Rattus norvegicus
taatttccttccttgagttgcacag

SEQ ID NO: 546476 - DNA, 25 bp, Rattus norvegicus
taatttccttgcaagaatcccacaa

SEQ ID NO: 546477 - DNA, 25 bp, Rattus norvegicus
taatttccttgctagaatcccacaa

SEQ ID NO: 546478 - DNA, 25 bp, Rattus norvegicus
taatttctaacaactagggtcagac

SEQ ID NO: 546479 - DNA, 25 bp, Rattus norvegicus
taatttctaacatctagggtcagac

SEQ ID NO: 546480 - DNA, 25 bp, Rattus norvegicus
taatttctactcaaggtgggccttg

SEQ ID NO: 546481 - DNA, 25 bp, Rattus norvegicus
taatttctactctaggtgggccttg

SEQ ID NO: 546482 - DNA, 20 bp, Rattus norvegicus
taatttctatctcctcaact

SEQ ID NO: 546483 - DNA, 25 bp, Rattus norvegicus
taatttctcagtaccaagtcatcaa

SEQ ID NO: 546484 - DNA, 25 bp, Rattus norvegicus
taatttctcagttccaagtcatcaa

SEQ ID NO: 546485 - DNA, 25 bp, Rattus norvegicus
taatttctcgttcaccacactctaa

SEQ ID NO: 546486 - DNA, 25 bp, Rattus norvegicus
taatttctcgttgaccacactctaa

SEQ ID NO: 546487 - DNA, 25 bp, Rattus norvegicus
taatttctctatctgcctgttcttc

SEQ ID NO: 546488 - DNA, 25 bp, Rattus norvegicus
taatttctctatgtgcctgttcttc

SEQ ID NO: 546489 - DNA, 20 bp, Rattus norvegicus
taatttctctctcctcaact

SEQ ID NO: 546490 - DNA, 25 bp, Rattus norvegicus
taatttctctggacctgcgttctca

SEQ ID NO: 546491 - DNA, 25 bp, Rattus norvegicus
taatttctctggtcctgcgttctca

SEQ ID NO: 546492 - DNA, 25 bp, Rattus norvegicus
taatttctgcagacctgtcacaagt

SEQ ID NO: 546493 - DNA, 25 bp, Rattus norvegicus
taatttctgcagtcctgtcacaagt

SEQ ID NO: 546494 - DNA, 25 bp, Rattus norvegicus
taatttctgctaactctatcctgga

SEQ ID NO: 546495 - DNA, 25 bp, Rattus norvegicus
taatttctgctatctctatcctgga

SEQ ID NO: 546496 - DNA, 25 bp, Rattus norvegicus
taatttctgctcataggtcctcttg

SEQ ID NO: 546497 - DNA, 25 bp, Rattus norvegicus
taatttctgctcttaggtcctcttg

SEQ ID NO: 546498 - DNA, 25 bp, Rattus norvegicus
taatttctggtgagttctctgctac

SEQ ID NO: 546499 - DNA, 25 bp, Rattus norvegicus
taatttctggtgtgttctctgctac

SEQ ID NO: 546500 - DNA, 25 bp, Rattus norvegicus
taatttctgtccattcaacgagcac

SEQ ID NO: 546501 - DNA, 25 bp, Rattus norvegicus
taatttctgtcctttcaacgagcac

SEQ ID NO: 546502 - DNA, 20 bp, Rattus norvegicus
taatttctgtctcctcaact

SEQ ID NO: 546503 - DNA, 25 bp, Rattus norvegicus
taatttcttctaccagaacctcaaa

SEQ ID NO: 546504 - DNA, 25 bp, Rattus norvegicus
taatttcttctagcagaacctcaaa

SEQ ID NO: 546505 - DNA, 25 bp, Rattus norvegicus
taatttcttcttaatcgcaggctcc

SEQ ID NO: 546506 - DNA, 25 bp, Rattus norvegicus
taatttcttctttatcgcaggctcc

SEQ ID NO: 546507 - DNA, 25 bp, Rattus norvegicus
taatttcttggaaagcggctagcga

SEQ ID NO: 546508 - DNA, 25 bp, Rattus norvegicus
taatttcttggatagcggctagcga

SEQ ID NO: 546509 - DNA, 20 bp, Rattus norvegicus
taatttctttctcctcaact

SEQ ID NO: 546510 - DNA, 25 bp, Rattus norvegicus
taatttgaacccatccagagcaaca

SEQ ID NO: 546511 - DNA, 25 bp, Rattus norvegicus
taatttgaacccttccagagcaaca

SEQ ID NO: 546512 - DNA, 25 bp, Rattus norvegicus
taatttgagtggagctcatcctgcc

SEQ ID NO: 546513 - DNA, 25 bp, Rattus norvegicus
taatttgagtggtgctcatcctgcc

SEQ ID NO: 546514 - DNA, 25 bp, Rattus norvegicus
taatttgataggaacccattcttcc

SEQ ID NO: 546515 - DNA, 25 bp, Rattus norvegicus
taatttgataggtacccattcttcc

SEQ ID NO: 546516 - DNA, 25 bp, Rattus norvegicus
taatttgcatccatgcagttggcaa

SEQ ID NO: 546517 - DNA, 25 bp, Rattus norvegicus
taatttgcatccttgcagttggcaa

SEQ ID NO: 546518 - DNA, 25 bp, Rattus norvegicus
taatttgccaggatttcgactacag

SEQ ID NO: 546519 - DNA, 25 bp, Rattus norvegicus
taatttgccaggttttcgactacag

SEQ ID NO: 546520 - DNA, 25 bp, Rattus norvegicus
taatttgccgtcagttaggcacggg

SEQ ID NO: 546521 - DNA, 25 bp, Rattus norvegicus
taatttgccgtctgttaggcacggg

SEQ ID NO: 546522 - DNA, 25 bp, Rattus norvegicus
taatttgcctgtcggtggttagtgt

SEQ ID NO: 546523 - DNA, 25 bp, Rattus norvegicus
taatttgcctgtgggtggttagtgt

SEQ ID NO: 546524 - DNA, 25 bp, Rattus norvegicus
taatttgccttgaggtgtcagttca

SEQ ID NO: 546525 - DNA, 25 bp, Rattus norvegicus
taatttgccttgtggtgtcagttca

SEQ ID NO: 546526 - DNA, 25 bp, Rattus norvegicus
taatttgcctttactctgtttgtaa

SEQ ID NO: 546527 - DNA, 25 bp, Rattus norvegicus
taatttgccttttctctgtttgtaa

SEQ ID NO: 546528 - DNA, 25 bp, Rattus norvegicus
taatttggaaaccttcttccctgtg

SEQ ID NO: 546529 - DNA, 25 bp, Rattus norvegicus
taatttggaaacgttcttccctgtg

SEQ ID NO: 546530 - DNA, 25 bp, Rattus norvegicus
taatttggaattatgcagtgtgcaa

SEQ ID NO: 546531 - DNA, 25 bp, Rattus norvegicus
taatttggaattttgcagtgtgcaa

SEQ ID NO: 546532 - DNA, 25 bp, Rattus norvegicus
taatttggagaaacgtgtgagttac

SEQ ID NO: 546533 - DNA, 25 bp, Rattus norvegicus
taatttggagaatcgtgtgagttac

SEQ ID NO: 546534 - DNA, 25 bp, Rattus norvegicus
taatttggctctaactacagcccca

SEQ ID NO: 546535 - DNA, 25 bp, Rattus norvegicus
taatttggctcttactacagcccca

SEQ ID NO: 546536 - DNA, 25 bp, Rattus norvegicus
taatttgggactagaaactgccttt

SEQ ID NO: 546537 - DNA, 25 bp, Rattus norvegicus
taatttgggacttgaaactgccttt

SEQ ID NO: 546538 - DNA, 25 bp, Rattus norvegicus
taatttgggcatctccatggagtgg

SEQ ID NO: 546539 - DNA, 25 bp, Rattus norvegicus
taatttgggcatgtccatggagtgg

SEQ ID NO: 546540 - DNA, 25 bp, Rattus norvegicus
taatttgtgcttccattttgactga

SEQ ID NO: 546541 - DNA, 25 bp, Rattus norvegicus
taatttgtgcttgcattttgactga

SEQ ID NO: 546542 - DNA, 25 bp, Rattus norvegicus
taatttgttaccacttcacctttga

SEQ ID NO: 546543 - DNA, 25 bp, Rattus norvegicus
taatttgttacctcttcacctttga

SEQ ID NO: 546544 - DNA, 25 bp, Rattus norvegicus
taatttgttgttcaactgctccctc

SEQ ID NO: 546545 - DNA, 25 bp, Rattus norvegicus
taatttgttgttgaactgctccctc

SEQ ID NO: 546546 - DNA, 25 bp, Rattus norvegicus
taatttgtttgtaggtctcgttgtt

SEQ ID NO: 546547 - DNA, 25 bp, Rattus norvegicus
taatttgtttgttggtctcgttgtt

SEQ ID NO: 546548 - DNA, 25 bp, Rattus norvegicus
taattttatcctctttccagtttat

SEQ ID NO: 546549 - DNA, 25 bp, Rattus norvegicus
taattttatcctgtttccagtttat

SEQ ID NO: 546550 - DNA, 25 bp, Rattus norvegicus
taattttatgcaaacagcttccctc

SEQ ID NO: 546551 - DNA, 25 bp, Rattus norvegicus
taattttatgcatacagcttccctc

SEQ ID NO: 546552 - DNA, 25 bp, Rattus norvegicus
taattttatttcatctctgacccca

SEQ ID NO: 546553 - DNA, 25 bp, Rattus norvegicus
taattttatttcttctctgacccca

SEQ ID NO: 546554 - DNA, 25 bp, Rattus norvegicus
taattttcaatgctcagtacccaga

SEQ ID NO: 546555 - DNA, 25 bp, Rattus norvegicus
taattttcaatggtcagtacccaga

SEQ ID NO: 546556 - DNA, 25 bp, Rattus norvegicus
taattttcagttaccaaggcagcca

SEQ ID NO: 546557 - DNA, 25 bp, Rattus norvegicus
taattttcagtttccaaggcagcca

SEQ ID NO: 546558 - DNA, 25 bp, Rattus norvegicus
taattttccacccttgtgtgagtgc

SEQ ID NO: 546559 - DNA, 25 bp, Rattus norvegicus
taattttccaccgttgtgtgagtgc

SEQ ID NO: 546560 - DNA, 25 bp, Rattus norvegicus
taattttcccaaccgtcctgtgaag

SEQ ID NO: 546561 - DNA, 25 bp, Rattus norvegicus
taattttcccaagcgtcctgtgaag

SEQ ID NO: 546562 - DNA, 25 bp, Rattus norvegicus
taattttccttcatctttcatgcaa

SEQ ID NO: 546563 - DNA, 25 bp, Rattus norvegicus
taattttccttcttctttcatgcaa

SEQ ID NO: 546564 - DNA, 25 bp, Rattus norvegicus
taattttctaaacagcagagcaaga

SEQ ID NO: 546565 - DNA, 25 bp, Rattus norvegicus
taattttctaaagagcagagcaaga

SEQ ID NO: 546566 - DNA, 25 bp, Rattus norvegicus
taattttctcacatacgtagttaga

SEQ ID NO: 546567 - DNA, 25 bp, Rattus norvegicus
taattttctcacttacgtagttaga

SEQ ID NO: 546568 - DNA, 25 bp, Rattus norvegicus
taattttctggacctttgggtttct

SEQ ID NO: 546569 - DNA, 25 bp, Rattus norvegicus
taattttctggagctttgggtttct

SEQ ID NO: 546570 - DNA, 25 bp, Rattus norvegicus
taattttcttggctttttgttcata

SEQ ID NO: 546571 - DNA, 25 bp, Rattus norvegicus
taattttcttgggtttttgttcata

SEQ ID NO: 546572 - DNA, 25 bp, Rattus norvegicus
taattttgagataccttttcctgtt

SEQ ID NO: 546573 - DNA, 25 bp, Rattus norvegicus
taattttgagattccttttcctgtt

SEQ ID NO: 546574 - DNA, 25 bp, Rattus norvegicus
taattttgatcaaagcctcacaggg

SEQ ID NO: 546575 - DNA, 25 bp, Rattus norvegicus
taattttgatcatagcctcacaggg

SEQ ID NO: 546576 - DNA, 25 bp, Rattus norvegicus
taattttgccagagcagtgacccca

SEQ ID NO: 546577 - DNA, 25 bp, Rattus norvegicus
taattttgccagtgcagtgacccca

SEQ ID NO: 546578 - DNA, 25 bp, Rattus norvegicus
taattttgctcaatgtttttgggtt

SEQ ID NO: 546579 - DNA, 25 bp, Rattus norvegicus
taattttgctcattgtttttgggtt

SEQ ID NO: 546580 - DNA, 25 bp, Rattus norvegicus
taattttggcatcaaccccttgttc

SEQ ID NO: 546581 - DNA, 25 bp, Rattus norvegicus
taattttggcatgaaccccttgttc

SEQ ID NO: 546582 - DNA, 25 bp, Rattus norvegicus
taattttggtcaacagcctttcaat

SEQ ID NO: 546583 - DNA, 25 bp, Rattus norvegicus
taattttggtcatcagcctttcaat

SEQ ID NO: 546584 - DNA, 25 bp, Rattus norvegicus
taattttgtaacagtctggtggact

SEQ ID NO: 546585 - DNA, 25 bp, Rattus norvegicus
taattttgtaactgtctggtggact

SEQ ID NO: 546586 - DNA, 25 bp, Rattus norvegicus
taattttgtagcattgtccccaagc

SEQ ID NO: 546587 - DNA, 25 bp, Rattus norvegicus
taattttgtagctttgtccccaagc

SEQ ID NO: 546588 - DNA, 25 bp, Rattus norvegicus
taatttttccaactgtcattaccga

SEQ ID NO: 546589 - DNA, 25 bp, Rattus norvegicus
taatttttccaagtgtcattaccga

SEQ ID NO: 546590 - DNA, 25 bp, Rattus norvegicus
taatttttccccagctcgaacaact

SEQ ID NO: 546591 - DNA, 25 bp, Rattus norvegicus
taatttttcccctgctcgaacaact

SEQ ID NO: 546592 - DNA, 25 bp, Rattus norvegicus
taatttttcccgagtagtgctgctg

SEQ ID NO: 546593 - DNA, 25 bp, Rattus norvegicus
taatttttcccgtgtagtgctgctg

SEQ ID NO: 546594 - DNA, 25 bp, Rattus norvegicus
taatttttcctcagtccagaatgga

SEQ ID NO: 546595 - DNA, 25 bp, Rattus norvegicus
taatttttcctctgtccagaatgga

SEQ ID NO: 546596 - DNA, 25 bp, Rattus norvegicus
taatttttcttccttatgcaaagtt

SEQ ID NO: 546597 - DNA, 25 bp, Rattus norvegicus
taatttttcttcgttatgcaaagtt

SEQ ID NO: 546598 - DNA, 25 bp, Rattus norvegicus
taatttttgagtcatttcctccctt

SEQ ID NO: 546599 - DNA, 25 bp, Rattus norvegicus
taatttttgagtgatttcctccctt

SEQ ID NO: 546600 - DNA, 25 bp, Rattus norvegicus
taatttttgtaccagttcctcagct

SEQ ID NO: 546601 - DNA, 25 bp, Rattus norvegicus
taatttttgtacgagttcctcagct

SEQ ID NO: 546602 - DNA, 25 bp, Rattus norvegicus
taatttttgtttctctttactgttg

SEQ ID NO: 546603 - DNA, 25 bp, Rattus norvegicus
taatttttgtttgtctttactgttg

SEQ ID NO: 546604 - DNA, 25 bp, Rattus norvegicus
tacaaaaaccttcagccagatggct

SEQ ID NO: 546605 - DNA, 25 bp, Rattus norvegicus
tacaaaaaccttgagccagatggct

SEQ ID NO: 546606 - DNA, 25 bp, Rattus norvegicus
tacaaaacacgtattgtgcaccatt

SEQ ID NO: 546607 - DNA, 25 bp, Rattus norvegicus
tacaaaacacgttttgtgcaccatt

SEQ ID NO: 546608 - DNA, 25 bp, Rattus norvegicus
tacaaaacccagcttcctactcatt

SEQ ID NO: 546609 - DNA, 25 bp, Rattus norvegicus
tacaaaacccaggttcctactcatt

SEQ ID NO: 546610 - DNA, 25 bp, Rattus norvegicus
tacaaaaccggacacctggacctgc

SEQ ID NO: 546611 - DNA, 25 bp, Rattus norvegicus
tacaaaaccggagacctggacctgc

SEQ ID NO: 546612 - DNA, 25 bp, Rattus norvegicus
tacaaaacgtctctccccaaggttg

SEQ ID NO: 546613 - DNA, 25 bp, Rattus norvegicus
tacaaaacgtctgtccccaaggttg

SEQ ID NO: 546614 - DNA, 25 bp, Rattus norvegicus
tacaaaactcgcaacaccatgtcct

SEQ ID NO: 546615 - DNA, 25 bp, Rattus norvegicus
tacaaaactcgctacaccatgtcct

SEQ ID NO: 546616 - DNA, 25 bp, Rattus norvegicus
tacaaaagaaaaagtgcccgagccc

SEQ ID NO: 546617 - DNA, 25 bp, Rattus norvegicus
tacaaaagaaaatgtgcccgagccc

SEQ ID NO: 546618 - DNA, 25 bp, Rattus norvegicus
tacaaaagagcccttcaggtgcttt

SEQ ID NO: 546619 - DNA, 25 bp, Rattus norvegicus
tacaaaagagccgttcaggtgcttt

SEQ ID NO: 546620 - DNA, 25 bp, Rattus norvegicus
tacaaaagcaagacacgtgagcccc

SEQ ID NO: 546621 - DNA, 25 bp, Rattus norvegicus
tacaaaagcaagtcacgtgagcccc

SEQ ID NO: 546622 - DNA, 25 bp, Rattus norvegicus
tacaaaagtggtctctgtttcccct

SEQ ID NO: 546623 - DNA, 25 bp, Rattus norvegicus
tacaaaagtggtgtctgtttcccct

SEQ ID NO: 546624 - DNA, 25 bp, Rattus norvegicus
tacaaaagtgtcatctgtcctttcc

SEQ ID NO: 546625 - DNA, 25 bp, Rattus norvegicus
tacaaaagtgtcttctgtcctttcc

SEQ ID NO: 546626 - DNA, 25 bp, Rattus norvegicus
tacaaaatccagactacatcaccct

SEQ ID NO: 546627 - DNA, 25 bp, Rattus norvegicus
tacaaaatccagtctacatcaccct

SEQ ID NO: 546628 - DNA, 25 bp, Rattus norvegicus
tacaaaattatcagcacccacacac

SEQ ID NO: 546629 - DNA, 25 bp, Rattus norvegicus
tacaaaattatctgcacccacacac

SEQ ID NO: 546630 - DNA, 25 bp, Rattus norvegicus
tacaaacacttcagacaaacacttg

SEQ ID NO: 546631 - DNA, 25 bp, Rattus norvegicus
tacaaacacttctgacaaacacttg

SEQ ID NO: 546632 - DNA, 25 bp, Rattus norvegicus
tacaaaccaagcacttgtcatccca

SEQ ID NO: 546633 - DNA, 25 bp, Rattus norvegicus
tacaaaccaagctcttgtcatccca

SEQ ID NO: 546634 - DNA, 25 bp, Rattus norvegicus
tacaaacccataccactttacattg

SEQ ID NO: 546635 - DNA, 25 bp, Rattus norvegicus
tacaaacccatagcactttacattg

SEQ ID NO: 546636 - DNA, 25 bp, Rattus norvegicus
tacaaactagcaatccactctttct

SEQ ID NO: 546637 - DNA, 25 bp, Rattus norvegicus
tacaaactagcattccactctttct

SEQ ID NO: 546638 - DNA, 25 bp, Rattus norvegicus
tacaaactattgaccgacagcctgc

SEQ ID NO: 546639 - DNA, 25 bp, Rattus norvegicus
tacaaactattgtccgacagcctgc

SEQ ID NO: 546640 - DNA, 25 bp, Rattus norvegicus
tacaaactctaaaggaacaggacag

SEQ ID NO: 546641 - DNA, 25 bp, Rattus norvegicus
tacaaactctaatggaacaggacag

SEQ ID NO: 546642 - DNA, 25 bp, Rattus norvegicus
tacaaactgacgatgacctagctcg

SEQ ID NO: 546643 - DNA, 25 bp, Rattus norvegicus
tacaaactgacgttgacctagctcg

SEQ ID NO: 546644 - DNA, 25 bp, Rattus norvegicus
tacaaactggtgatctcttctagag

SEQ ID NO: 546645 - DNA, 25 bp, Rattus norvegicus
tacaaactggtgttctcttctagag

SEQ ID NO: 546646 - DNA, 25 bp, Rattus norvegicus
tacaaacttccaaccggtttgacca

SEQ ID NO: 546647 - DNA, 25 bp, Rattus norvegicus
tacaaacttccatccggtttgacca

SEQ ID NO: 546648 - DNA, 25 bp, Rattus norvegicus
tacaaagaacacctcggcctgacat

SEQ ID NO: 546649 - DNA, 25 bp, Rattus norvegicus
tacaaagaacacgtcggcctgacat

SEQ ID NO: 546650 - DNA, 25 bp, Rattus norvegicus
tacaaagaaggaagacccggtcggc

SEQ ID NO: 546651 - DNA, 25 bp, Rattus norvegicus
tacaaagaaggatgacccggtcggc

SEQ ID NO: 546652 - DNA, 25 bp, Rattus norvegicus
tacaaagaatgtagcaccgacctca

SEQ ID NO: 546653 - DNA, 25 bp, Rattus norvegicus
tacaaagaatgttgcaccgacctca

SEQ ID NO: 546654 - DNA, 25 bp, Rattus norvegicus
tacaaagaccttaacccttgaccat

SEQ ID NO: 546655 - DNA, 25 bp, Rattus norvegicus
tacaaagacctttacccttgaccat

SEQ ID NO: 546656 - DNA, 25 bp, Rattus norvegicus
tacaaagagcttcctgggcccaggc

SEQ ID NO: 546657 - DNA, 25 bp, Rattus norvegicus
tacaaagagcttgctgggcccaggc

SEQ ID NO: 546658 - DNA, 25 bp, Rattus norvegicus
tacaaagagggtatccaggacatct

SEQ ID NO: 546659 - DNA, 25 bp, Rattus norvegicus
tacaaagagggtttccaggacatct

SEQ ID NO: 546660 - DNA, 25 bp, Rattus norvegicus
tacaaagaggtcacccagcctgcct

SEQ ID NO: 546661 - DNA, 25 bp, Rattus norvegicus
tacaaagaggtctcccagcctgcct

SEQ ID NO: 546662 - DNA, 25 bp, Rattus norvegicus
tacaaagatgggacgtccgggccaa

SEQ ID NO: 546663 - DNA, 25 bp, Rattus norvegicus
tacaaagatgggtcgtccgggccaa

SEQ ID NO: 546664 - DNA, 25 bp, Rattus norvegicus
tacaaagcaaagagcctgcatagag

SEQ ID NO: 546665 - DNA, 25 bp, Rattus norvegicus
tacaaagcaaagtgcctgcatagag

SEQ ID NO: 546666 - DNA, 25 bp, Rattus norvegicus
tacaaagcacgtactccattgccat

SEQ ID NO: 546667 - DNA, 25 bp, Rattus norvegicus
tacaaagcacgttctccattgccat

SEQ ID NO: 546668 - DNA, 25 bp, Rattus norvegicus
tacaaagcccaccagtgcggtgatg

SEQ ID NO: 546669 - DNA, 25 bp, Rattus norvegicus
tacaaagcccacgagtgcggtgatg

SEQ ID NO: 546670 - DNA, 25 bp, Rattus norvegicus
tacaaagccggcacagagcatgtct

SEQ ID NO: 546671 - DNA, 25 bp, Rattus norvegicus
tacaaagccggctcagagcatgtct

SEQ ID NO: 546672 - DNA, 25 bp, Rattus norvegicus
tacaaagctattccatggcccacag

SEQ ID NO: 546673 - DNA, 25 bp, Rattus norvegicus
tacaaagctattcttttccggccct

SEQ ID NO: 546674 - DNA, 25 bp, Rattus norvegicus
tacaaagctattgcatggcccacag

SEQ ID NO: 546675 - DNA, 25 bp, Rattus norvegicus
tacaaagctattgttttccggccct

SEQ ID NO: 546676 - DNA, 25 bp, Rattus norvegicus
tacaaagctttcataccgggtggtg

SEQ ID NO: 546677 - DNA, 25 bp, Rattus norvegicus
tacaaagctttcttaccgggtggtg

SEQ ID NO: 546678 - DNA, 25 bp, Rattus norvegicus
tacaaaggaactctccacgctgctg

SEQ ID NO: 546679 - DNA, 25 bp, Rattus norvegicus
tacaaaggaactgtccacgctgctg

SEQ ID NO: 546680 - DNA, 25 bp, Rattus norvegicus
tacaaaggagctccacgtgtgtgct

SEQ ID NO: 546681 - DNA, 25 bp, Rattus norvegicus
tacaaaggagctgcacgtgtgtgct

SEQ ID NO: 546682 - DNA, 25 bp, Rattus norvegicus
tacaaaggccatccactgttttaaa

SEQ ID NO: 546683 - DNA, 25 bp, Rattus norvegicus
tacaaaggccatgcactgttttaaa

SEQ ID NO: 546684 - DNA, 25 bp, Rattus norvegicus
tacaaagggttcagtttccacaggg

SEQ ID NO: 546685 - DNA, 25 bp, Rattus norvegicus
tacaaagggttctgtttccacaggg

SEQ ID NO: 546686 - DNA, 25 bp, Rattus norvegicus
tacaaaggttcccatctaggtcagg

SEQ ID NO: 546687 - DNA, 25 bp, Rattus norvegicus
tacaaaggttccgatctaggtcagg

SEQ ID NO: 546688 - DNA, 25 bp, Rattus norvegicus
tacaaagtaaaacgcccagctgcca

SEQ ID NO: 546689 - DNA, 25 bp, Rattus norvegicus
tacaaagtaaaaggcccagctgcca

SEQ ID NO: 546690 - DNA, 25 bp, Rattus norvegicus
tacaaagtaactatcccagcgctgg

SEQ ID NO: 546691 - DNA, 25 bp, Rattus norvegicus
tacaaagtaactttcccagcgctgg

SEQ ID NO: 546692 - DNA, 25 bp, Rattus norvegicus
tacaaagtctgtacccgagtactca

SEQ ID NO: 546693 - DNA, 25 bp, Rattus norvegicus
tacaaagtctgttcccgagtactca

SEQ ID NO: 546694 - DNA, 25 bp, Rattus norvegicus
tacaaagtggacagtgcttgtcaca

SEQ ID NO: 546695 - DNA, 25 bp, Rattus norvegicus
tacaaagtggactgtgcttgtcaca

SEQ ID NO: 546696 - DNA, 25 bp, Rattus norvegicus
tacaaagtggccaacgtgcagctgg

SEQ ID NO: 546697 - DNA, 25 bp, Rattus norvegicus
tacaaagtggcctacgtgcagctgg

SEQ ID NO: 546698 - DNA, 25 bp, Rattus norvegicus
tacaaatctcccattcctttttctg

SEQ ID NO: 546699 - DNA, 25 bp, Rattus norvegicus
tacaaatctccctttcctttttctg

SEQ ID NO: 546700 - DNA, 25 bp, Rattus norvegicus
tacaaatgagaactaggcactgtct

SEQ ID NO: 546701 - DNA, 25 bp, Rattus norvegicus
tacaaatgagaagtaggcactgtct

SEQ ID NO: 546702 - DNA, 25 bp, Rattus norvegicus
tacaaatgcttcatggtgccagctt

SEQ ID NO: 546703 - DNA, 25 bp, Rattus norvegicus
tacaaatgcttcttggtgccagctt

SEQ ID NO: 546704 - DNA, 25 bp, Rattus norvegicus
tacaaatggctactgtccacgtgca

SEQ ID NO: 546705 - DNA, 25 bp, Rattus norvegicus
tacaaatggctagtgtccacgtgca

SEQ ID NO: 546706 - DNA, 25 bp, Rattus norvegicus
tacaaatgggtgacggtgttctccg

SEQ ID NO: 546707 - DNA, 25 bp, Rattus norvegicus
tacaaatgggtgtcggtgttctccg

SEQ ID NO: 546708 - DNA, 25 bp, Rattus norvegicus
tacaaatgtgttccccactctgatg

SEQ ID NO: 546709 - DNA, 25 bp, Rattus norvegicus
tacaaatgtgttgcccactctgatg

SEQ ID NO: 546710 - DNA, 25 bp, Rattus norvegicus
tacaaattgcataacttcccaccgc

SEQ ID NO: 546711 - DNA, 25 bp, Rattus norvegicus
tacaaattgcattacttcccaccgc

SEQ ID NO: 546712 - DNA, 25 bp, Rattus norvegicus
tacaaattgggacctgttccgaccc

SEQ ID NO: 546713 - DNA, 25 bp, Rattus norvegicus
tacaaattgggagctgttccgaccc

SEQ ID NO: 546714 - DNA, 25 bp, Rattus norvegicus
tacaaatttaacatcttctacccgg

SEQ ID NO: 546715 - DNA, 25 bp, Rattus norvegicus
tacaaatttaacttcttctacccgg

SEQ ID NO: 546716 - DNA, 25 bp, Rattus norvegicus
tacaacaacaacaaaacattctatt

SEQ ID NO: 546717 - DNA, 25 bp, Rattus norvegicus
tacaacaacaactaaacattctatt

SEQ ID NO: 546718 - DNA, 25 bp, Rattus norvegicus
tacaacaactcaaggccaacagctg

SEQ ID NO: 546719 - DNA, 25 bp, Rattus norvegicus
tacaacaactcatggccaacagctg

SEQ ID NO: 546720 - DNA, 25 bp, Rattus norvegicus
tacaacaaggacctggagtctgcag

SEQ ID NO: 546721 - DNA, 25 bp, Rattus norvegicus
tacaacaaggacgtggagtctgcag

SEQ ID NO: 546722 - DNA, 25 bp, Rattus norvegicus
tacaacaagttcagtcatgacacat

SEQ ID NO: 546723 - DNA, 25 bp, Rattus norvegicus
tacaacaagttctgtcatgacacat

SEQ ID NO: 546724 - DNA, 25 bp, Rattus norvegicus
tacaacaatatcacttgcgctggcc

SEQ ID NO: 546725 - DNA, 25 bp, Rattus norvegicus
tacaacaatatctcttgcgctggcc

SEQ ID NO: 546726 - DNA, 25 bp, Rattus norvegicus
tacaacaatcccaccaatgtgtctg

SEQ ID NO: 546727 - DNA, 25 bp, Rattus norvegicus
tacaacaatccctccaatgtgtctg

SEQ ID NO: 546728 - DNA, 25 bp, Rattus norvegicus
tacaacaatctaacctgctgctggg

SEQ ID NO: 546729 - DNA, 25 bp, Rattus norvegicus
tacaacaatctactctttgtggatt

SEQ ID NO: 546730 - DNA, 25 bp, Rattus norvegicus
tacaacaatctagtctttgtggatt

SEQ ID NO: 546731 - DNA, 25 bp, Rattus norvegicus
tacaacaatctatcctgctgctggg

SEQ ID NO: 546732 - DNA, 25 bp, Rattus norvegicus
tacaacacactcaaccttcataatt

SEQ ID NO: 546733 - DNA, 25 bp, Rattus norvegicus
tacaacacactctaccttcataatt

SEQ ID NO: 546734 - DNA, 25 bp, Rattus norvegicus
tacaacacgcacagtgctgacacat

SEQ ID NO: 546735 - DNA, 25 bp, Rattus norvegicus
tacaacacgcactgtgctgacacat

SEQ ID NO: 546736 - DNA, 25 bp, Rattus norvegicus
tacaacacgtgtactcagctgcatt

SEQ ID NO: 546737 - DNA, 25 bp, Rattus norvegicus
tacaacacgtgttctcagctgcatt

SEQ ID NO: 546738 - DNA, 25 bp, Rattus norvegicus
tacaacactggtacctttgtggacc

SEQ ID NO: 546739 - DNA, 25 bp, Rattus norvegicus
tacaacactggttcctttgtggacc

SEQ ID NO: 546740 - DNA, 25 bp, Rattus norvegicus
tacaacaggttgagttccctatagc

SEQ ID NO: 546741 - DNA, 25 bp, Rattus norvegicus
tacaacaggttgtgttccctatagc

SEQ ID NO: 546742 - DNA, 25 bp, Rattus norvegicus
tacaacagtcccagagaccatcaga

SEQ ID NO: 546743 - DNA, 25 bp, Rattus norvegicus
tacaacagtccctgagaccatcaga

SEQ ID NO: 546744 - DNA, 25 bp, Rattus norvegicus
tacaacattcaaaaggagtccactc

SEQ ID NO: 546745 - DNA, 25 bp, Rattus norvegicus
tacaacattcaataggagtccactc

SEQ ID NO: 546746 - DNA, 25 bp, Rattus norvegicus
tacaaccaaactctcatccattaaa

SEQ ID NO: 546747 - DNA, 25 bp, Rattus norvegicus
tacaaccaaactgtcatccattaaa

SEQ ID NO: 546748 - DNA, 25 bp, Rattus norvegicus
tacaaccactacatttccctttgag

SEQ ID NO: 546749 - DNA, 25 bp, Rattus norvegicus
tacaaccactacttttccctttgag

SEQ ID NO: 546750 - DNA, 25 bp, Rattus norvegicus
tacaaccactctcgcgactacgaat

SEQ ID NO: 546751 - DNA, 25 bp, Rattus norvegicus
tacaaccactctggcgactacgaat

SEQ ID NO: 546752 - DNA, 25 bp, Rattus norvegicus
tacaaccagggcatcctctaaaaag

SEQ ID NO: 546753 - DNA, 25 bp, Rattus norvegicus
tacaaccagggcttcctctaaaaag

SEQ ID NO: 546754 - DNA, 25 bp, Rattus norvegicus
tacaaccatgtaaactacttccctt

SEQ ID NO: 546755 - DNA, 25 bp, Rattus norvegicus
tacaaccatgtatactacttccctt

SEQ ID NO: 546756 - DNA, 25 bp, Rattus norvegicus
tacaacccagcacagcagatcctag

SEQ ID NO: 546757 - DNA, 25 bp, Rattus norvegicus
tacaacccagcagagcagatcctag

SEQ ID NO: 546758 - DNA, 25 bp, Rattus norvegicus
tacaacccagctctgctcaggaaaa

SEQ ID NO: 546759 - DNA, 25 bp, Rattus norvegicus
tacaacccagctgtgctcaggaaaa

SEQ ID NO: 546760 - DNA, 25 bp, Rattus norvegicus
tacaaccccaatatgttcttcactt

SEQ ID NO: 546761 - DNA, 25 bp, Rattus norvegicus
tacaaccccaatttgttcttcactt

SEQ ID NO: 546762 - DNA, 25 bp, Rattus norvegicus
tacaaccctattattacatgcccaa

SEQ ID NO: 546763 - DNA, 25 bp, Rattus norvegicus
tacaaccctatttttacatgcccaa

SEQ ID NO: 546764 - DNA, 25 bp, Rattus norvegicus
tacaaccctgggagtgatcaccaaa

SEQ ID NO: 546765 - DNA, 25 bp, Rattus norvegicus
tacaaccctgggtgtgatcaccaaa

SEQ ID NO: 546766 - DNA, 25 bp, Rattus norvegicus
tacaaccctgttagcagagttccag

SEQ ID NO: 546767 - DNA, 25 bp, Rattus norvegicus
tacaaccctgtttgcagagttccag

SEQ ID NO: 546768 - DNA, 25 bp, Rattus norvegicus
tacaaccggtgaccctgactgaact

SEQ ID NO: 546769 - DNA, 25 bp, Rattus norvegicus
tacaaccggtgagcctgactgaact

SEQ ID NO: 546770 - DNA, 25 bp, Rattus norvegicus
tacaaccgtaaaaccttggctgaag

SEQ ID NO: 546771 - DNA, 25 bp, Rattus norvegicus
tacaaccgtaaatccttggctgaag

SEQ ID NO: 546772 - DNA, 25 bp, Rattus norvegicus
tacaacctacaaagcctctgtggat

SEQ ID NO: 546773 - DNA, 25 bp, Rattus norvegicus
tacaacctacaatgcctctgtggat

SEQ ID NO: 546774 - DNA, 25 bp, Rattus norvegicus
tacaacctatgcagctaccattatg

SEQ ID NO: 546775 - DNA, 25 bp, Rattus norvegicus
tacaacctatgctgctaccattatg

SEQ ID NO: 546776 - DNA, 25 bp, Rattus norvegicus
tacaacctccttcctgttggttatt

SEQ ID NO: 546777 - DNA, 25 bp, Rattus norvegicus
tacaacctccttgctgttggttatt

SEQ ID NO: 546778 - DNA, 25 bp, Rattus norvegicus
tacaacctgtacagctccctgaaag

SEQ ID NO: 546779 - DNA, 25 bp, Rattus norvegicus
tacaacctgtaccagcaagtcagct

SEQ ID NO: 546780 - DNA, 25 bp, Rattus norvegicus
tacaacctgtacgagcaagtcagct

SEQ ID NO: 546781 - DNA, 25 bp, Rattus norvegicus
tacaacctgtactgctccctgaaag

SEQ ID NO: 546782 - DNA, 25 bp, Rattus norvegicus
tacaacctgtgcatgaccagaccta

SEQ ID NO: 546783 - DNA, 25 bp, Rattus norvegicus
tacaacctgtgcttgaccagaccta

SEQ ID NO: 546784 - DNA, 25 bp, Rattus norvegicus
tacaaccttatccttgcatgttacc

SEQ ID NO: 546785 - DNA, 25 bp, Rattus norvegicus
tacaaccttatcgttgcatgttacc

SEQ ID NO: 546786 - DNA, 25 bp, Rattus norvegicus
tacaaccttcttatgctaattccca

SEQ ID NO: 546787 - DNA, 25 bp, Rattus norvegicus
tacaaccttcttttgctaattccca

SEQ ID NO: 546788 - DNA, 25 bp, Rattus norvegicus
tacaacgccagaatccgacactgat

SEQ ID NO: 546789 - DNA, 25 bp, Rattus norvegicus
tacaacgccagattccgacactgat

SEQ ID NO: 546790 - DNA, 25 bp, Rattus norvegicus
tacaacgtggtgcttttcctggaga

SEQ ID NO: 546791 - DNA, 25 bp, Rattus norvegicus
tacaacgtggtggttttcctggaga

SEQ ID NO: 546792 - DNA, 25 bp, Rattus norvegicus
tacaacgtgtagacagttccctgtt

SEQ ID NO: 546793 - DNA, 25 bp, Rattus norvegicus
tacaacgtgtagtcagttccctgtt

SEQ ID NO: 546794 - DNA, 25 bp, Rattus norvegicus
tacaacgtgtttaaggactctctcc

SEQ ID NO: 546795 - DNA, 25 bp, Rattus norvegicus
tacaacgtgttttaggactctctcc

SEQ ID NO: 546796 - DNA, 25 bp, Rattus norvegicus
tacaactacggcaggtctttttact

SEQ ID NO: 546797 - DNA, 25 bp, Rattus norvegicus
tacaactacggctggtctttttact

SEQ ID NO: 546798 - DNA, 25 bp, Rattus norvegicus
tacaactacggtattttcctgcctt

SEQ ID NO: 546799 - DNA, 25 bp, Rattus norvegicus
tacaactacggttttttcctgcctt

SEQ ID NO: 546800 - DNA, 25 bp, Rattus norvegicus
tacaactactgcattctatcactag

SEQ ID NO: 546801 - DNA, 25 bp, Rattus norvegicus
tacaactactgctttctatcactag

SEQ ID NO: 546802 - DNA, 25 bp, Rattus norvegicus
tacaactcagttatctagaggccaa

SEQ ID NO: 546803 - DNA, 25 bp, Rattus norvegicus
tacaactcagttttctagaggccaa

SEQ ID NO: 546804 - DNA, 25 bp, Rattus norvegicus
tacaactccgtgctgttgtactcct

SEQ ID NO: 546805 - DNA, 25 bp, Rattus norvegicus
tacaactccgtggtgttgtactcct

SEQ ID NO: 546806 - DNA, 25 bp, Rattus norvegicus
tacaactgacggcattacccaaagt

SEQ ID NO: 546807 - DNA, 25 bp, Rattus norvegicus
tacaactgacgggattacccaaagt

SEQ ID NO: 546808 - DNA, 25 bp, Rattus norvegicus
tacaactgatctccaacgtcacggg

SEQ ID NO: 546809 - DNA, 25 bp, Rattus norvegicus
tacaactgatctgcaacgtcacggg

SEQ ID NO: 546810 - DNA, 25 bp, Rattus norvegicus
tacaactgatgacctgaagcaggat

SEQ ID NO: 546811 - DNA, 25 bp, Rattus norvegicus
tacaactgatgagctgaagcaggat

SEQ ID NO: 546812 - DNA, 25 bp, Rattus norvegicus
tacaactgcagtattcacctgaagt

SEQ ID NO: 546813 - DNA, 25 bp, Rattus norvegicus
tacaactgcagttttcacctgaagt

SEQ ID NO: 546814 - DNA, 25 bp, Rattus norvegicus
tacaactgcctcacgagtgacactg

SEQ ID NO: 546815 - DNA, 25 bp, Rattus norvegicus
tacaactgcctctcgagtgacactg

SEQ ID NO: 546816 - DNA, 25 bp, Rattus norvegicus
tacaactgggccaatggcttcggat

SEQ ID NO: 546817 - DNA, 25 bp, Rattus norvegicus
tacaactgggcctatggcttcggat

SEQ ID NO: 546818 - DNA, 25 bp, Rattus norvegicus
tacaactgggtcacatagtggacgt

SEQ ID NO: 546819 - DNA, 25 bp, Rattus norvegicus
tacaactgggtctcatagtggacgt

SEQ ID NO: 546820 - DNA, 25 bp, Rattus norvegicus
tacaactgggtgaggctgggctcct

SEQ ID NO: 546821 - DNA, 25 bp, Rattus norvegicus
tacaactgggtgtggctgggctcct

SEQ ID NO: 546822 - DNA, 25 bp, Rattus norvegicus
tacaactgtgtacctatgatttcat

SEQ ID NO: 546823 - DNA, 25 bp, Rattus norvegicus
tacaactgtgtagctatgatttcat

SEQ ID NO: 546824 - DNA, 25 bp, Rattus norvegicus
tacaacttacgcagaggctgataac

SEQ ID NO: 546825 - DNA, 25 bp, Rattus norvegicus
tacaacttacgctgaggctgataac

SEQ ID NO: 546826 - DNA, 25 bp, Rattus norvegicus
tacaacttccacaacaagatttttt

SEQ ID NO: 546827 - DNA, 25 bp, Rattus norvegicus
tacaacttccactacaagatttttt

SEQ ID NO: 546828 - DNA, 25 bp, Rattus norvegicus
tacaactttcaaacgcctctgggat

SEQ ID NO: 546829 - DNA, 25 bp, Rattus norvegicus
tacaactttcaatcgcctctgggat

SEQ ID NO: 546830 - DNA, 25 bp, Rattus norvegicus
tacaactttgagctctacgacggcc

SEQ ID NO: 546831 - DNA, 25 bp, Rattus norvegicus
tacaactttgaggtctacgacggcc

SEQ ID NO: 546832 - DNA, 25 bp, Rattus norvegicus
tacaagaaaccccatctacctttga

SEQ ID NO: 546833 - DNA, 25 bp, Rattus norvegicus
tacaagaaacccgatctacctttga

SEQ ID NO: 546834 - DNA, 25 bp, Rattus norvegicus
tacaagaacagcaaggctcccacct

SEQ ID NO: 546835 - DNA, 25 bp, Rattus norvegicus
tacaagaacagctaggctcccacct

SEQ ID NO: 546836 - DNA, 25 bp, Rattus norvegicus
tacaagaatctgaaactccccatga

SEQ ID NO: 546837 - DNA, 25 bp, Rattus norvegicus
tacaagaatctgtaactccccatga

SEQ ID NO: 546838 - DNA, 25 bp, Rattus norvegicus
tacaagacacataggctgtcgtcat

SEQ ID NO: 546839 - DNA, 25 bp, Rattus norvegicus
tacaagacacattggctgtcgtcat

SEQ ID NO: 546840 - DNA, 25 bp, Rattus norvegicus
tacaagacactgacaccagccctaa

SEQ ID NO: 546841 - DNA, 25 bp, Rattus norvegicus
tacaagacactgtcaccagccctaa

SEQ ID NO: 546842 - DNA, 25 bp, Rattus norvegicus
tacaagacatggatgccctggaaat

SEQ ID NO: 546843 - DNA, 25 bp, Rattus norvegicus
tacaagacatggttgccctggaaat

SEQ ID NO: 546844 - DNA, 25 bp, Rattus norvegicus
tacaagaccaaacgctctccgttga

SEQ ID NO: 546845 - DNA, 25 bp, Rattus norvegicus
tacaagaccaaaggctctccgttga

SEQ ID NO: 546846 - DNA, 25 bp, Rattus norvegicus
tacaagaccctcagagtccaatgtg

SEQ ID NO: 546847 - DNA, 25 bp, Rattus norvegicus
tacaagaccctctgagtccaatgtg

SEQ ID NO: 546848 - DNA, 25 bp, Rattus norvegicus
tacaagaccttcacccgcgagcagg

SEQ ID NO: 546849 - DNA, 25 bp, Rattus norvegicus
tacaagaccttctcccgcgagcagg

SEQ ID NO: 546850 - DNA, 25 bp, Rattus norvegicus
tacaagactctcacaatttaatagt

SEQ ID NO: 546851 - DNA, 25 bp, Rattus norvegicus
tacaagactctctcaatttaatagt

SEQ ID NO: 546852 - DNA, 25 bp, Rattus norvegicus
tacaagactgcaagcctggcatagg

SEQ ID NO: 546853 - DNA, 25 bp, Rattus norvegicus
tacaagactgcatgcctggcatagg

SEQ ID NO: 546854 - DNA, 25 bp, Rattus norvegicus
tacaagactgcgacacagcctcgaa

SEQ ID NO: 546855 - DNA, 25 bp, Rattus norvegicus
tacaagactgcgtcacagcctcgaa

SEQ ID NO: 546856 - DNA, 25 bp, Rattus norvegicus
tacaagacttgtactcggctacact

SEQ ID NO: 546857 - DNA, 25 bp, Rattus norvegicus
tacaagacttgttctcggctacact

SEQ ID NO: 546858 - DNA, 25 bp, Rattus norvegicus
tacaagagatgtccaccacctgtct

SEQ ID NO: 546859 - DNA, 25 bp, Rattus norvegicus
tacaagagatgtgcaccacctgtct

SEQ ID NO: 546860 - DNA, 25 bp, Rattus norvegicus
tacaagaggatcctccggctggagt

SEQ ID NO: 546861 - DNA, 25 bp, Rattus norvegicus
tacaagaggatcgtccggctggagt

SEQ ID NO: 546862 - DNA, 25 bp, Rattus norvegicus
tacaagagtcctcttgatgtggcca

SEQ ID NO: 546863 - DNA, 25 bp, Rattus norvegicus
tacaagagtcctgttgatgtggcca

SEQ ID NO: 546864 - DNA, 25 bp, Rattus norvegicus
tacaagattccccagttggtacact

SEQ ID NO: 546865 - DNA, 25 bp, Rattus norvegicus
tacaagattcccgagttggtacact

SEQ ID NO: 546866 - DNA, 25 bp, Rattus norvegicus
tacaagattcttaatttcgtaaact

SEQ ID NO: 546867 - DNA, 25 bp, Rattus norvegicus
tacaagattctttatttcgtaaact

SEQ ID NO: 546868 - DNA, 25 bp, Rattus norvegicus
tacaagcacgccaggttctctggga

SEQ ID NO: 546869 - DNA, 25 bp, Rattus norvegicus
tacaagcacgcctggttctctggga

SEQ ID NO: 546870 - DNA, 25 bp, Rattus norvegicus
tacaagcagcatcaggccaatccat

SEQ ID NO: 546871 - DNA, 25 bp, Rattus norvegicus
tacaagcagcatgaggccaatccat

SEQ ID NO: 546872 - DNA, 25 bp, Rattus norvegicus
tacaagcatgtacccaagtccctga

SEQ ID NO: 546873 - DNA, 25 bp, Rattus norvegicus
tacaagcatgtagccaagtccctga

SEQ ID NO: 546874 - DNA, 25 bp, Rattus norvegicus
tacaagcccgtgagtactgaccagg

SEQ ID NO: 546875 - DNA, 25 bp, Rattus norvegicus
tacaagcccgtgtgtactgaccagg

SEQ ID NO: 546876 - DNA, 25 bp, Rattus norvegicus
tacaagccgggccagactgtgttcc

SEQ ID NO: 546877 - DNA, 25 bp, Rattus norvegicus
tacaagccgggcgagactgtgttcc

SEQ ID NO: 546878 - DNA, 25 bp, Rattus norvegicus
tacaagccgtacagatccaagagtt

SEQ ID NO: 546879 - DNA, 25 bp, Rattus norvegicus
tacaagccgtactgatccaagagtt

SEQ ID NO: 546880 - DNA, 25 bp, Rattus norvegicus
tacaagcctattcgccgatcaggaa

SEQ ID NO: 546881 - DNA, 25 bp, Rattus norvegicus
tacaagcctattggccgatcaggaa

SEQ ID NO: 546882 - DNA, 25 bp, Rattus norvegicus
tacaagcctgctagagccacagagt

SEQ ID NO: 546883 - DNA, 25 bp, Rattus norvegicus
tacaagcctgcttgagccacagagt

SEQ ID NO: 546884 - DNA, 25 bp, Rattus norvegicus
tacaagcctgtgaagcacggccggc

SEQ ID NO: 546885 - DNA, 25 bp, Rattus norvegicus
tacaagcctgtgtagcacggccggc

SEQ ID NO: 546886 - DNA, 25 bp, Rattus norvegicus
tacaagctaaccctagatgcggcag

SEQ ID NO: 546887 - DNA, 25 bp, Rattus norvegicus
tacaagctaaccgtagatgcggcag

SEQ ID NO: 546888 - DNA, 25 bp, Rattus norvegicus
tacaagctgcagagcctgtcactat

SEQ ID NO: 546889 - DNA, 25 bp, Rattus norvegicus
tacaagctgcagtgcctgtcactat

SEQ ID NO: 546890 - DNA, 25 bp, Rattus norvegicus
tacaagctggccaggactcaagagg

SEQ ID NO: 546891 - DNA, 25 bp, Rattus norvegicus
tacaagctggcctggactcaagagg

SEQ ID NO: 546892 - DNA, 25 bp, Rattus norvegicus
tacaagctgtaccacagtgccagat

SEQ ID NO: 546893 - DNA, 25 bp, Rattus norvegicus
tacaagctgtacgacagtgccagat

SEQ ID NO: 546894 - DNA, 25 bp, Rattus norvegicus
tacaagcttgtcatctaccctgaaa

SEQ ID NO: 546895 - DNA, 25 bp, Rattus norvegicus
tacaagcttgtcttctaccctgaaa

SEQ ID NO: 546896 - DNA, 25 bp, Rattus norvegicus
tacaaggaatttctctcacccctga

SEQ ID NO: 546897 - DNA, 25 bp, Rattus norvegicus
tacaaggaatttgtctcacccctga

SEQ ID NO: 546898 - DNA, 25 bp, Rattus norvegicus
tacaaggagaacatcatgcgcctct

SEQ ID NO: 546899 - DNA, 25 bp, Rattus norvegicus
tacaaggagaacttcatgcgcctct

SEQ ID NO: 546900 - DNA, 25 bp, Rattus norvegicus
tacaaggagatccacttccgctgca

SEQ ID NO: 546901 - DNA, 25 bp, Rattus norvegicus
tacaaggagatcgacttccgctgca

SEQ ID NO: 546902 - DNA, 25 bp, Rattus norvegicus
tacaaggcaaggctagacgtctgct

SEQ ID NO: 546903 - DNA, 25 bp, Rattus norvegicus
tacaaggcaagggtagacgtctgct

SEQ ID NO: 546904 - DNA, 25 bp, Rattus norvegicus
tacaaggcacctacactcatgtaca

SEQ ID NO: 546905 - DNA, 25 bp, Rattus norvegicus
tacaaggcaccttcactcatgtaca

SEQ ID NO: 546906 - DNA, 25 bp, Rattus norvegicus
tacaaggcccctaggacagagacag

SEQ ID NO: 546907 - DNA, 25 bp, Rattus norvegicus
tacaaggccccttggacagagacag

SEQ ID NO: 546908 - DNA, 25 bp, Rattus norvegicus
tacaaggcctgcagaatttccaaga

SEQ ID NO: 546909 - DNA, 25 bp, Rattus norvegicus
tacaaggcctgctgaatttccaaga

SEQ ID NO: 546910 - DNA, 25 bp, Rattus norvegicus
tacaaggcctttctcatggagacct

SEQ ID NO: 546911 - DNA, 25 bp, Rattus norvegicus
tacaaggcctttgtcatggagacct

SEQ ID NO: 546912 - DNA, 25 bp, Rattus norvegicus
tacaagggatcaactgttttcagag

SEQ ID NO: 546913 - DNA, 25 bp, Rattus norvegicus
tacaagggatcatctgttttcagag

SEQ ID NO: 546914 - DNA, 25 bp, Rattus norvegicus
tacaagggtttccatttcactccac

SEQ ID NO: 546915 - DNA, 25 bp, Rattus norvegicus
tacaagggtttcgatttcactccac

SEQ ID NO: 546916 - DNA, 25 bp, Rattus norvegicus
tacaaggtcatcaaatttacagcag

SEQ ID NO: 546917 - DNA, 25 bp, Rattus norvegicus
tacaaggtcatctaatttacagcag

SEQ ID NO: 546918 - DNA, 25 bp, Rattus norvegicus
tacaaggtctctcagtatgcccgtc

SEQ ID NO: 546919 - DNA, 25 bp, Rattus norvegicus
tacaaggtctctgagtatgcccgtc

SEQ ID NO: 546920 - DNA, 25 bp, Rattus norvegicus
tacaaggtggacaactcacggttcc

SEQ ID NO: 546921 - DNA, 25 bp, Rattus norvegicus
tacaaggtggactactcacggttcc

SEQ ID NO: 546922 - DNA, 25 bp, Rattus norvegicus
tacaaggtttttccccagttcaggt

SEQ ID NO: 546923 - DNA, 25 bp, Rattus norvegicus
tacaaggtttttgcccagttcaggt

SEQ ID NO: 546924 - DNA, 25 bp, Rattus norvegicus
tacaagtacaacacggaccgcaaac

SEQ ID NO: 546925 - DNA, 25 bp, Rattus norvegicus
tacaagtacaactcggaccgcaaac

SEQ ID NO: 546926 - DNA, 25 bp, Rattus norvegicus
tacaagtatgtgatgaagcccacct

SEQ ID NO: 546927 - DNA, 25 bp, Rattus norvegicus
tacaagtatgtgttgaagcccacct

SEQ ID NO: 546928 - DNA, 25 bp, Rattus norvegicus
tacaagtcaaaacatcaggcccctg

SEQ ID NO: 546929 - DNA, 25 bp, Rattus norvegicus
tacaagtcaaaagatcaggcccctg

SEQ ID NO: 546930 - DNA, 25 bp, Rattus norvegicus
tacaagtccaacctcaagatcgcag

SEQ ID NO: 546931 - DNA, 25 bp, Rattus norvegicus
tacaagtccaacgtcaagatcgcag

SEQ ID NO: 546932 - DNA, 25 bp, Rattus norvegicus
tacaagtccccgctgagtgcacagg

SEQ ID NO: 546933 - DNA, 25 bp, Rattus norvegicus
tacaagtccccggtgagtgcacagg

SEQ ID NO: 546934 - DNA, 25 bp, Rattus norvegicus
tacaagtcccttaagtttccacctg

SEQ ID NO: 546935 - DNA, 25 bp, Rattus norvegicus
tacaagtccctttagtttccacctg

SEQ ID NO: 546936 - DNA, 25 bp, Rattus norvegicus
tacaagtctagtcagctccaggtgg

SEQ ID NO: 546937 - DNA, 25 bp, Rattus norvegicus
tacaagtctagtgagctccaggtgg

SEQ ID NO: 546938 - DNA, 25 bp, Rattus norvegicus
tacaagtgaaggaggcaggcctcta

SEQ ID NO: 546939 - DNA, 25 bp, Rattus norvegicus
tacaagtgaaggtggcaggcctcta

SEQ ID NO: 546940 - DNA, 25 bp, Rattus norvegicus
tacaagtgccttcagggtttggcct

SEQ ID NO: 546941 - DNA, 25 bp, Rattus norvegicus
tacaagtgccttgagggtttggcct

SEQ ID NO: 546942 - DNA, 25 bp, Rattus norvegicus
tacaagtgtgcaccctgttgccgca

SEQ ID NO: 546943 - DNA, 25 bp, Rattus norvegicus
tacaagtgtgcagcctgttgccgca

SEQ ID NO: 546944 - DNA, 25 bp, Rattus norvegicus
tacaagtgtgggactggttcggatc

SEQ ID NO: 546945 - DNA, 25 bp, Rattus norvegicus
tacaagtgtgggtctggttcggatc

SEQ ID NO: 546946 - DNA, 25 bp, Rattus norvegicus
tacaagtgtgtaaggccgagcctgt

SEQ ID NO: 546947 - DNA, 25 bp, Rattus norvegicus
tacaagtgtgtatggccgagcctgt

SEQ ID NO: 546948 - DNA, 25 bp, Rattus norvegicus
tacaagttactgcagcctgttctgc

SEQ ID NO: 546949 - DNA, 25 bp, Rattus norvegicus
tacaagttactggagcctgttctgc

SEQ ID NO: 546950 - DNA, 25 bp, Rattus norvegicus
tacaagttcaacagcctaggtatca

SEQ ID NO: 546951 - DNA, 25 bp, Rattus norvegicus
tacaagttcaactgcctaggtatca

SEQ ID NO: 546952 - DNA, 25 bp, Rattus norvegicus
tacaagttgttcactaatccccatt

SEQ ID NO: 546953 - DNA, 25 bp, Rattus norvegicus
tacaagttgttctctaatccccatt

SEQ ID NO: 546954 - DNA, 25 bp, Rattus norvegicus
tacaagttgtttacagtcctgcaca

SEQ ID NO: 546955 - DNA, 25 bp, Rattus norvegicus
tacaagttgttttcagtcctgcaca

SEQ ID NO: 546956 - DNA, 25 bp, Rattus norvegicus
tacaagtttaagctcagccccaggc

SEQ ID NO: 546957 - DNA, 25 bp, Rattus norvegicus
tacaagtttaaggtcagccccaggc

SEQ ID NO: 546958 - DNA, 25 bp, Rattus norvegicus
tacaagtttgcaactggccagtgga

SEQ ID NO: 546959 - DNA, 25 bp, Rattus norvegicus
tacaagtttgcatctggccagtgga

SEQ ID NO: 546960 - DNA, 25 bp, Rattus norvegicus
tacaagttttcacttccctttggtg

SEQ ID NO: 546961 - DNA, 25 bp, Rattus norvegicus
tacaagttttcagttccctttggtg

SEQ ID NO: 546962 - DNA, 25 bp, Rattus norvegicus
tacaataagtctacacgcctctgtg

SEQ ID NO: 546963 - DNA, 25 bp, Rattus norvegicus
tacaataagtcttcacgcctctgtg

SEQ ID NO: 546964 - DNA, 25 bp, Rattus norvegicus
tacaatacacacagaccaagctgtc

SEQ ID NO: 546965 - DNA, 25 bp, Rattus norvegicus
tacaatacacactgaccaagctgtc

SEQ ID NO: 546966 - DNA, 25 bp, Rattus norvegicus
tacaatacagtacaagtagccagag

SEQ ID NO: 546967 - DNA, 25 bp, Rattus norvegicus
tacaatacagtagaagtagccagag

SEQ ID NO: 546968 - DNA, 25 bp, Rattus norvegicus
tacaatagatccatcctgtgtggca

SEQ ID NO: 546969 - DNA, 25 bp, Rattus norvegicus
tacaatagatccttcctgtgtggca

SEQ ID NO: 546970 - DNA, 25 bp, Rattus norvegicus
tacaatagggttatgtccactgccc

SEQ ID NO: 546971 - DNA, 25 bp, Rattus norvegicus
tacaatagggttttgtccactgccc

SEQ ID NO: 546972 - DNA, 25 bp, Rattus norvegicus
tacaatattgttctcttcctgacca

SEQ ID NO: 546973 - DNA, 25 bp, Rattus norvegicus
tacaatattgttgtcttcctgacca

SEQ ID NO: 546974 - DNA, 25 bp, Rattus norvegicus
tacaatcaagtcattctccctttac

SEQ ID NO: 546975 - DNA, 25 bp, Rattus norvegicus
tacaatcaagtctttctccctttac

SEQ ID NO: 546976 - DNA, 25 bp, Rattus norvegicus
tacaatcatcttaacacaactcctc

SEQ ID NO: 546977 - DNA, 25 bp, Rattus norvegicus
tacaatcatctttacacaactcctc

SEQ ID NO: 546978 - DNA, 25 bp, Rattus norvegicus
tacaatccattacacagccctagat

SEQ ID NO: 546979 - DNA, 25 bp, Rattus norvegicus
tacaatccattagacagccctagat

SEQ ID NO: 546980 - DNA, 25 bp, Rattus norvegicus
tacaatcccctgcagtaccaagtgg

SEQ ID NO: 546981 - DNA, 25 bp, Rattus norvegicus
tacaatcccctggagtaccaagtgg

SEQ ID NO: 546982 - DNA, 25 bp, Rattus norvegicus
tacaatcgtttcatcattcggcgtg

SEQ ID NO: 546983 - DNA, 25 bp, Rattus norvegicus
tacaatcgtttcttcattcggcgtg

SEQ ID NO: 546984 - DNA, 25 bp, Rattus norvegicus
tacaatctaggacaatcccttcacc

SEQ ID NO: 546985 - DNA, 25 bp, Rattus norvegicus
tacaatctaggagaatcccttcacc

SEQ ID NO: 546986 - DNA, 25 bp, Rattus norvegicus
tacaatctccccaattgcagaggaa

SEQ ID NO: 546987 - DNA, 25 bp, Rattus norvegicus
tacaatctcccctattgcagaggaa

SEQ ID NO: 546988 - DNA, 25 bp, Rattus norvegicus
tacaatctctagaaacagccctcca

SEQ ID NO: 546989 - DNA, 25 bp, Rattus norvegicus
tacaatctctagtaacagccctcca

SEQ ID NO: 546990 - DNA, 25 bp, Rattus norvegicus
tacaatctggttctgctctcggaca

SEQ ID NO: 546991 - DNA, 25 bp, Rattus norvegicus
tacaatctggttgtgctctcggaca

SEQ ID NO: 546992 - DNA, 25 bp, Rattus norvegicus
tacaatgacggtatcttctggcttc

SEQ ID NO: 546993 - DNA, 25 bp, Rattus norvegicus
tacaatgacggtttcttctggcttc

SEQ ID NO: 546994 - DNA, 25 bp, Rattus norvegicus
tacaatgagatccactggcccatct

SEQ ID NO: 546995 - DNA, 25 bp, Rattus norvegicus
tacaatgagatcgactggcccatct

SEQ ID NO: 546996 - DNA, 25 bp, Rattus norvegicus
tacaatgagctgctactgtttgata

SEQ ID NO: 546997 - DNA, 25 bp, Rattus norvegicus
tacaatgagctggtactgtttgata

SEQ ID NO: 546998 - DNA, 25 bp, Rattus norvegicus
tacaatgagtttcaactcctgatcc

SEQ ID NO: 546999 - DNA, 25 bp, Rattus norvegicus
tacaatgagtttgaactcctgatcc

SEQ ID NO: 547000 - DNA, 25 bp, Rattus norvegicus
tacaatgcccacagaatcataagaa

SEQ ID NO: 547001 - DNA, 25 bp, Rattus norvegicus
tacaatgcccactgaatcataagaa

SEQ ID NO: 547002 - DNA, 25 bp, Rattus norvegicus
tacaatgccctacgctgcagcaggt

SEQ ID NO: 547003 - DNA, 25 bp, Rattus norvegicus
tacaatgccctaggctgcagcaggt

SEQ ID NO: 547004 - DNA, 25 bp, Rattus norvegicus
tacaatgcctaaattacctgaatgg

SEQ ID NO: 547005 - DNA, 25 bp, Rattus norvegicus
tacaatgcctaatttacctgaatgg

SEQ ID NO: 547006 - DNA, 25 bp, Rattus norvegicus
tacaatgcctaccagtcctacgcat

SEQ ID NO: 547007 - DNA, 25 bp, Rattus norvegicus
tacaatgcctacgagtcctacgcat

SEQ ID NO: 547008 - DNA, 25 bp, Rattus norvegicus
tacaatgcgagtcccacattctggc

SEQ ID NO: 547009 - DNA, 25 bp, Rattus norvegicus
tacaatgcgagtgccacattctggc

SEQ ID NO: 547010 - DNA, 25 bp, Rattus norvegicus
tacaatgctcttctggctgtgcaga

SEQ ID NO: 547011 - DNA, 25 bp, Rattus norvegicus
tacaatgctcttgtggctgtgcaga

SEQ ID NO: 547012 - DNA, 25 bp, Rattus norvegicus
tacaatgctgcaacacatcggcttg

SEQ ID NO: 547013 - DNA, 25 bp, Rattus norvegicus
tacaatgctgcatcacatcggcttg

SEQ ID NO: 547014 - DNA, 25 bp, Rattus norvegicus
tacaatgctgctctggtagccaggt

SEQ ID NO: 547015 - DNA, 25 bp, Rattus norvegicus
tacaatgctgctgtggtagccaggt

SEQ ID NO: 547016 - DNA, 25 bp, Rattus norvegicus
tacaatgctgtaatcctgtgagatg

SEQ ID NO: 547017 - DNA, 25 bp, Rattus norvegicus
tacaatgctgtattcctgtgagatg

SEQ ID NO: 547018 - DNA, 25 bp, Rattus norvegicus
tacaatggaagccaagtgaccagaa

SEQ ID NO: 547019 - DNA, 25 bp, Rattus norvegicus
tacaatggaagcgaagtgaccagaa

SEQ ID NO: 547020 - DNA, 25 bp, Rattus norvegicus
tacaatggacagaagtgagggactc

SEQ ID NO: 547021 - DNA, 25 bp, Rattus norvegicus
tacaatggacagtagtgagggactc

SEQ ID NO: 547022 - DNA, 25 bp, Rattus norvegicus
tacaatggccacagtctacggacac

SEQ ID NO: 547023 - DNA, 25 bp, Rattus norvegicus
tacaatggccactgtctacggacac

SEQ ID NO: 547024 - DNA, 25 bp, Rattus norvegicus
tacaatggccagaatatttatgaat

SEQ ID NO: 547025 - DNA, 25 bp, Rattus norvegicus
tacaatggccagtatatttatgaat

SEQ ID NO: 547026 - DNA, 25 bp, Rattus norvegicus
tacaatggccccaaggtagcaggca

SEQ ID NO: 547027 - DNA, 25 bp, Rattus norvegicus
tacaatggcccctaggtagcaggca

SEQ ID NO: 547028 - DNA, 25 bp, Rattus norvegicus
tacaatgggctaagccgccaaactt

SEQ ID NO: 547029 - DNA, 25 bp, Rattus norvegicus
tacaatgggctatgccgccaaactt

SEQ ID NO: 547030 - DNA, 25 bp, Rattus norvegicus
tacaatggtataagctacacccagc

SEQ ID NO: 547031 - DNA, 25 bp, Rattus norvegicus
tacaatggtatatgctacacccagc

SEQ ID NO: 547032 - DNA, 25 bp, Rattus norvegicus
tacaatggtgcccaggtctgtccat

SEQ ID NO: 547033 - DNA, 25 bp, Rattus norvegicus
tacaatggtgccgaggtctgtccat

SEQ ID NO: 547034 - DNA, 25 bp, Rattus norvegicus
tacaatgtacacactgtctgtccaa

SEQ ID NO: 547035 - DNA, 25 bp, Rattus norvegicus
tacaatgtacactctgtctgtccaa

SEQ ID NO: 547036 - DNA, 25 bp, Rattus norvegicus
tacaatgtacagcacctctttcccg

SEQ ID NO: 547037 - DNA, 25 bp, Rattus norvegicus
tacaatgtacaggacctctttcccg

SEQ ID NO: 547038 - DNA, 25 bp, Rattus norvegicus
tacaatgtccataaattctctcgaa

SEQ ID NO: 547039 - DNA, 25 bp, Rattus norvegicus
tacaatgtccattaattctctcgaa

SEQ ID NO: 547040 - DNA, 25 bp, Rattus norvegicus
tacaatgtctgcagtggcgcgcgct

SEQ ID NO: 547041 - DNA, 25 bp, Rattus norvegicus
tacaatgtctgctgtggcgcgcgct

SEQ ID NO: 547042 - DNA, 25 bp, Rattus norvegicus
tacaatgtgcggagaggccttactc

SEQ ID NO: 547043 - DNA, 25 bp, Rattus norvegicus
tacaatgtgcggtgaggccttactc

SEQ ID NO: 547044 - DNA, 25 bp, Rattus norvegicus
tacaatgtgcttcctgtgtgagctt

SEQ ID NO: 547045 - DNA, 25 bp, Rattus norvegicus
tacaatgtgcttgctgtgtgagctt

SEQ ID NO: 547046 - DNA, 25 bp, Rattus norvegicus
tacaatgtggagagactcttacact

SEQ ID NO: 547047 - DNA, 25 bp, Rattus norvegicus
tacaatgtggagtgactcttacact

SEQ ID NO: 547048 - DNA, 25 bp, Rattus norvegicus
tacaatgtggctactgggctgtcct

SEQ ID NO: 547049 - DNA, 25 bp, Rattus norvegicus
tacaatgtggcttctgggctgtcct

SEQ ID NO: 547050 - DNA, 25 bp, Rattus norvegicus
tacaatgtgtcccttcccgtatttt

SEQ ID NO: 547051 - DNA, 25 bp, Rattus norvegicus
tacaatgtgtccgttcccgtatttt

SEQ ID NO: 547052 - DNA, 25 bp, Rattus norvegicus
tacaatgttgtgcttttcctgtctg

SEQ ID NO: 547053 - DNA, 25 bp, Rattus norvegicus
tacaatgttgtggttttcctgtctg

SEQ ID NO: 547054 - DNA, 25 bp, Rattus norvegicus
tacaattactccatccgttgttaat

SEQ ID NO: 547055 - DNA, 25 bp, Rattus norvegicus
tacaattactccttccgttgttaat

SEQ ID NO: 547056 - DNA, 25 bp, Rattus norvegicus
tacaattccatactcttctagcttc

SEQ ID NO: 547057 - DNA, 25 bp, Rattus norvegicus
tacaattccatagtcttctagcttc

SEQ ID NO: 547058 - DNA, 25 bp, Rattus norvegicus
tacaattctccactttgtttcttaa

SEQ ID NO: 547059 - DNA, 25 bp, Rattus norvegicus
tacaattctccagtttgtttcttaa

SEQ ID NO: 547060 - DNA, 25 bp, Rattus norvegicus
tacaattgtccacctccattaaaag

SEQ ID NO: 547061 - DNA, 25 bp, Rattus norvegicus
tacaattgtccagctccattaaaag

SEQ ID NO: 547062 - DNA, 25 bp, Rattus norvegicus
tacaatttatttccaagtgtcctaa

SEQ ID NO: 547063 - DNA, 25 bp, Rattus norvegicus
tacaatttatttgcaagtgtcctaa

SEQ ID NO: 547064 - DNA, 25 bp, Rattus norvegicus
tacaatttcaggcacttatgggctc

SEQ ID NO: 547065 - DNA, 25 bp, Rattus norvegicus
tacaatttcagggacttatgggctc

SEQ ID NO: 547066 - DNA, 25 bp, Rattus norvegicus
tacaatttcataaccttcggtatgg

SEQ ID NO: 547067 - DNA, 25 bp, Rattus norvegicus
tacaatttcatatccttcggtatgg

SEQ ID NO: 547068 - DNA, 25 bp, Rattus norvegicus
tacaatttcgctatctgactaccaa

SEQ ID NO: 547069 - DNA, 25 bp, Rattus norvegicus
tacaatttcgctttctgactaccaa

SEQ ID NO: 547070 - DNA, 25 bp, Rattus norvegicus
tacaattttctccaagttcctaagt

SEQ ID NO: 547071 - DNA, 25 bp, Rattus norvegicus
tacaattttctcgaagttcctaagt

SEQ ID NO: 547072 - DNA, 25 bp, Rattus norvegicus
tacacaaaactcaccctcaaaataa

SEQ ID NO: 547073 - DNA, 25 bp, Rattus norvegicus
tacacaaaactctccctcaaaataa

SEQ ID NO: 547074 - DNA, 25 bp, Rattus norvegicus
tacacaaactacagaacggacccag

SEQ ID NO: 547075 - DNA, 25 bp, Rattus norvegicus
tacacaaactactgaacggacccag

SEQ ID NO: 547076 - DNA, 25 bp, Rattus norvegicus
tacacaaactggacagaggccctga

SEQ ID NO: 547077 - DNA, 25 bp, Rattus norvegicus
tacacaaactggtcagaggccctga

SEQ ID NO: 547078 - DNA, 25 bp, Rattus norvegicus
tacacaaagtaaccgtcttgacagt

SEQ ID NO: 547079 - DNA, 25 bp, Rattus norvegicus
tacacaaagtaagcgtcttgacagt

SEQ ID NO: 547080 - DNA, 25 bp, Rattus norvegicus
tacacaaatgtaatgcgtcctgccc

SEQ ID NO: 547081 - DNA, 25 bp, Rattus norvegicus
tacacaaatgtattgcgtcctgccc

SEQ ID NO: 547082 - DNA, 25 bp, Rattus norvegicus
tacacaacaggtcgctggtgcacac

SEQ ID NO: 547083 - DNA, 25 bp, Rattus norvegicus
tacacaacaggtggctggtgcacac

SEQ ID NO: 547084 - DNA, 25 bp, Rattus norvegicus
tacacaactcctctactctgaggaa

SEQ ID NO: 547085 - DNA, 25 bp, Rattus norvegicus
tacacaactcctgtactctgaggaa

SEQ ID NO: 547086 - DNA, 25 bp, Rattus norvegicus
tacacaacttatccgttacgtactg

SEQ ID NO: 547087 - DNA, 25 bp, Rattus norvegicus
tacacaacttatgcgttacgtactg

SEQ ID NO: 547088 - DNA, 25 bp, Rattus norvegicus
tacacaacttttaggtgccaacagt

SEQ ID NO: 547089 - DNA, 25 bp, Rattus norvegicus
tacacaactttttggtgccaacagt

SEQ ID NO: 547090 - DNA, 25 bp, Rattus norvegicus
tacacaagagcaccatgtccccaag

SEQ ID NO: 547091 - DNA, 25 bp, Rattus norvegicus
tacacaagagcagcatgtccccaag

SEQ ID NO: 547092 - DNA, 25 bp, Rattus norvegicus
tacacaagcactacaccaacagggt

SEQ ID NO: 547093 - DNA, 25 bp, Rattus norvegicus
tacacaagcacttcaccaacagggt

SEQ ID NO: 547094 - DNA, 25 bp, Rattus norvegicus
tacacaagctctacctctaagttaa

SEQ ID NO: 547095 - DNA, 25 bp, Rattus norvegicus
tacacaagctctcatgatggccact

SEQ ID NO: 547096 - DNA, 25 bp, Rattus norvegicus
tacacaagctctgatgatggccact

SEQ ID NO: 547097 - DNA, 25 bp, Rattus norvegicus
tacacaagctcttcctctaagttaa

SEQ ID NO: 547098 - DNA, 25 bp, Rattus norvegicus
tacacaatctctcatggcatcgcac

SEQ ID NO: 547099 - DNA, 25 bp, Rattus norvegicus
tacacaatctctgatggcatcgcac

SEQ ID NO: 547100 - DNA, 25 bp, Rattus norvegicus
tacacaatgccccacagactataaa

SEQ ID NO: 547101 - DNA, 25 bp, Rattus norvegicus
tacacaatgcccgacagactataaa

SEQ ID NO: 547102 - DNA, 25 bp, Rattus norvegicus
tacacaatggtaacagtatgtcact

SEQ ID NO: 547103 - DNA, 25 bp, Rattus norvegicus
tacacaatggtatcagtatgtcact

SEQ ID NO: 547104 - DNA, 25 bp, Rattus norvegicus
tacacacaagcaaagccccacaaga

SEQ ID NO: 547105 - DNA, 25 bp, Rattus norvegicus
tacacacaagcatagccccacaaga

SEQ ID NO: 547106 - DNA, 25 bp, Rattus norvegicus
tacacacacgaaagtttcacacatg

SEQ ID NO: 547107 - DNA, 25 bp, Rattus norvegicus
tacacacacgaatgtttcacacatg

SEQ ID NO: 547108 - DNA, 25 bp, Rattus norvegicus
tacacacacgcgctacccagggatg

SEQ ID NO: 547109 - DNA, 25 bp, Rattus norvegicus
tacacacacgcggtacccagggatg

SEQ ID NO: 547110 - DNA, 25 bp, Rattus norvegicus
tacacacagagcatccagagtcgga

SEQ ID NO: 547111 - DNA, 25 bp, Rattus norvegicus
tacacacagagcttccagagtcgga

SEQ ID NO: 547112 - DNA, 25 bp, Rattus norvegicus
tacacacagcgactcccactggtga

SEQ ID NO: 547113 - DNA, 25 bp, Rattus norvegicus
tacacacagcgagtcccactggtga

SEQ ID NO: 547114 - DNA, 25 bp, Rattus norvegicus
tacacacagcggaaactatctacaa

SEQ ID NO: 547115 - DNA, 25 bp, Rattus norvegicus
tacacacagcggtaactatctacaa

SEQ ID NO: 547116 - DNA, 25 bp, Rattus norvegicus
tacacacagttgattcagccaaagt

SEQ ID NO: 547117 - DNA, 25 bp, Rattus norvegicus
tacacacagttgtttcagccaaagt

SEQ ID NO: 547118 - DNA, 25 bp, Rattus norvegicus
tacacacatgatacgcaaacactcg

SEQ ID NO: 547119 - DNA, 25 bp, Rattus norvegicus
tacacacatgattcgcaaacactcg

SEQ ID NO: 547120 - DNA, 25 bp, Rattus norvegicus
tacacacatgcgcacaaaatactca

SEQ ID NO: 547121 - DNA, 25 bp, Rattus norvegicus
tacacacatgcggacaaaatactca

SEQ ID NO: 547122 - DNA, 25 bp, Rattus norvegicus
tacacacatggcctcattgttcttt

SEQ ID NO: 547123 - DNA, 25 bp, Rattus norvegicus
tacacacatggcgtcattgttcttt

SEQ ID NO: 547124 - DNA, 25 bp, Rattus norvegicus
tacacacattcccatatactccttt

SEQ ID NO: 547125 - DNA, 25 bp, Rattus norvegicus
tacacacattccgatatactccttt

SEQ ID NO: 547126 - DNA, 25 bp, Rattus norvegicus
tacacaccaaatactgcgcttgcat

SEQ ID NO: 547127 - DNA, 25 bp, Rattus norvegicus
tacacaccaaattctgcgcttgcat

SEQ ID NO: 547128 - DNA, 25 bp, Rattus norvegicus
tacacaccagttatatattgccaag

SEQ ID NO: 547129 - DNA, 25 bp, Rattus norvegicus
tacacaccagttttatattgccaag

SEQ ID NO: 547130 - DNA, 25 bp, Rattus norvegicus
tacacacccaatatccacttaaaag

SEQ ID NO: 547131 - DNA, 25 bp, Rattus norvegicus
tacacacccaatttccacttaaaag

SEQ ID NO: 547132 - DNA, 25 bp, Rattus norvegicus
tacacacctcaaacagtgcattgcg

SEQ ID NO: 547133 - DNA, 25 bp, Rattus norvegicus
tacacacctcaatcagtgcattgcg

SEQ ID NO: 547134 - DNA, 25 bp, Rattus norvegicus
tacacaccttgtagacagacagaca

SEQ ID NO: 547135 - DNA, 25 bp, Rattus norvegicus
tacacaccttgttgacagacagaca

SEQ ID NO: 547136 - DNA, 25 bp, Rattus norvegicus
tacacacgagagcatttcttaacag

SEQ ID NO: 547137 - DNA, 25 bp, Rattus norvegicus
tacacacgagaggatttcttaacag

SEQ ID NO: 547138 - DNA, 25 bp, Rattus norvegicus
tacacacgcctgaatgttacatatc

SEQ ID NO: 547139 - DNA, 25 bp, Rattus norvegicus
tacacacgcctgtatgttacatatc

SEQ ID NO: 547140 - DNA, 25 bp, Rattus norvegicus
tacacacggaggatatggcggagtc

SEQ ID NO: 547141 - DNA, 25 bp, Rattus norvegicus
tacacacggaggttatggcggagtc

SEQ ID NO: 547142 - DNA, 25 bp, Rattus norvegicus
tacacacgtgtgacaccttgggata

SEQ ID NO: 547143 - DNA, 25 bp, Rattus norvegicus
tacacacgtgtgtcaccttgggata

SEQ ID NO: 547144 - DNA, 25 bp, Rattus norvegicus
tacacacgttatacagattgacatt

SEQ ID NO: 547145 - DNA, 25 bp, Rattus norvegicus
tacacacgttattcagattgacatt

SEQ ID NO: 547146 - DNA, 25 bp, Rattus norvegicus
tacacactacaaaggatttcaacat

SEQ ID NO: 547147 - DNA, 25 bp, Rattus norvegicus
tacacactacaatggatttcaacat

SEQ ID NO: 547148 - DNA, 25 bp, Rattus norvegicus
tacacactacgtccatgcctggtgc

SEQ ID NO: 547149 - DNA, 25 bp, Rattus norvegicus
tacacactacgtgcatgcctggtgc

SEQ ID NO: 547150 - DNA, 25 bp, Rattus norvegicus
tacacactcaaaacgcaaacttcag

SEQ ID NO: 547151 - DNA, 25 bp, Rattus norvegicus
tacacactcaaatcgcaaacttcag

SEQ ID NO: 547152 - DNA, 25 bp, Rattus norvegicus
tacacactcaagaattgtcccctgt

SEQ ID NO: 547153 - DNA, 25 bp, Rattus norvegicus
tacacactcaagtattgtcccctgt

SEQ ID NO: 547154 - DNA, 25 bp, Rattus norvegicus
tacacactcatcctcaatgctgatc

SEQ ID NO: 547155 - DNA, 25 bp, Rattus norvegicus
tacacactcatcgtcaatgctgatc

SEQ ID NO: 547156 - DNA, 25 bp, Rattus norvegicus
tacacactcgtgctgcccaaggacg

SEQ ID NO: 547157 - DNA, 25 bp, Rattus norvegicus
tacacactcgtggtgcccaaggacg

SEQ ID NO: 547158 - DNA, 25 bp, Rattus norvegicus
tacacactgctgacaccgtttgaga

SEQ ID NO: 547159 - DNA, 25 bp, Rattus norvegicus
tacacactgctgtcaccgtttgaga

SEQ ID NO: 547160 - DNA, 25 bp, Rattus norvegicus
tacacactggagatcgacgggaaga

SEQ ID NO: 547161 - DNA, 25 bp, Rattus norvegicus
tacacactggagttcgacgggaaga

SEQ ID NO: 547162 - DNA, 25 bp, Rattus norvegicus
tacacactggcgaatgcatctgaac

SEQ ID NO: 547163 - DNA, 25 bp, Rattus norvegicus
tacacactggcgtatgcatctgaac

SEQ ID NO: 547164 - DNA, 25 bp, Rattus norvegicus
tacacactgggacaagacgactgct

SEQ ID NO: 547165 - DNA, 25 bp, Rattus norvegicus
tacacactgggagaagacgactgct

SEQ ID NO: 547166 - DNA, 25 bp, Rattus norvegicus
tacacactgtagactcagtactcag

SEQ ID NO: 547167 - DNA, 25 bp, Rattus norvegicus
tacacactgtagtctcagtactcag

SEQ ID NO: 547168 - DNA, 25 bp, Rattus norvegicus
tacacactgtgcctttgttagaagt

SEQ ID NO: 547169 - DNA, 25 bp, Rattus norvegicus
tacacactgtgcgtttgttagaagt

SEQ ID NO: 547170 - DNA, 25 bp, Rattus norvegicus
tacacacttcggacgcaagactttt

SEQ ID NO: 547171 - DNA, 25 bp, Rattus norvegicus
tacacacttcggtcgcaagactttt

SEQ ID NO: 547172 - DNA, 25 bp, Rattus norvegicus
tacacacttggtatcgagagtctcc

SEQ ID NO: 547173 - DNA, 25 bp, Rattus norvegicus
tacacacttggtttcgagagtctcc

SEQ ID NO: 547174 - DNA, 25 bp, Rattus norvegicus
tacacacttttcatcattcaatcag

SEQ ID NO: 547175 - DNA, 25 bp, Rattus norvegicus
tacacacttttcttcattcaatcag

SEQ ID NO: 547176 - DNA, 25 bp, Rattus norvegicus
tacacagaaccacaacagatctcat

SEQ ID NO: 547177 - DNA, 25 bp, Rattus norvegicus
tacacagaaccagaacagatctcat

SEQ ID NO: 547178 - DNA, 25 bp, Rattus norvegicus
tacacagaagatccaaagatactac

SEQ ID NO: 547179 - DNA, 25 bp, Rattus norvegicus
tacacagaagatgcaaagatactac

SEQ ID NO: 547180 - DNA, 25 bp, Rattus norvegicus
tacacagaaggaaacccaggcgctt

SEQ ID NO: 547181 - DNA, 25 bp, Rattus norvegicus
tacacagaaggatacccaggcgctt

SEQ ID NO: 547182 - DNA, 25 bp, Rattus norvegicus
tacacagacaccagaaggagcccca

SEQ ID NO: 547183 - DNA, 25 bp, Rattus norvegicus
tacacagacacctgaaggagcccca

SEQ ID NO: 547184 - DNA, 25 bp, Rattus norvegicus
tacacagacagcatcagggacacag

SEQ ID NO: 547185 - DNA, 25 bp, Rattus norvegicus
tacacagacagcttcagggacacag

SEQ ID NO: 547186 - DNA, 25 bp, Rattus norvegicus
tacacagacatacattgggcaaatg

SEQ ID NO: 547187 - DNA, 25 bp, Rattus norvegicus
tacacagacatagattgggcaaatg

SEQ ID NO: 547188 - DNA, 25 bp, Rattus norvegicus
tacacagacccactgggcacaggac

SEQ ID NO: 547189 - DNA, 25 bp, Rattus norvegicus
tacacagacccagtgggcacaggac

SEQ ID NO: 547190 - DNA, 25 bp, Rattus norvegicus
tacacagacgtgatgctgcttgcct

SEQ ID NO: 547191 - DNA, 25 bp, Rattus norvegicus
tacacagacgtgttgctgcttgcct

SEQ ID NO: 547192 - DNA, 25 bp, Rattus norvegicus
tacacagagagccattccggcgaac

SEQ ID NO: 547193 - DNA, 25 bp, Rattus norvegicus
tacacagagagcgattccggcgaac

SEQ ID NO: 547194 - DNA, 25 bp, Rattus norvegicus
tacacagagaggacctgactccaga

SEQ ID NO: 547195 - DNA, 25 bp, Rattus norvegicus
tacacagagaggtcctgactccaga

SEQ ID NO: 547196 - DNA, 25 bp, Rattus norvegicus
tacacagagtgcattttcactcacg

SEQ ID NO: 547197 - DNA, 25 bp, Rattus norvegicus
tacacagagtgctttttcactcacg

SEQ ID NO: 547198 - DNA, 25 bp, Rattus norvegicus
tacacagatatccatgcctgtttta

SEQ ID NO: 547199 - DNA, 25 bp, Rattus norvegicus
tacacagatatcgatgcctgtttta

SEQ ID NO: 547200 - DNA, 25 bp, Rattus norvegicus
tacacagatttgcactttgactagg

SEQ ID NO: 547201 - DNA, 25 bp, Rattus norvegicus
tacacagatttggactttgactagg

SEQ ID NO: 547202 - DNA, 25 bp, Rattus norvegicus
tacacagcaaggactgcgcggtttt

SEQ ID NO: 547203 - DNA, 25 bp, Rattus norvegicus
tacacagcaaggtctgcgcggtttt

SEQ ID NO: 547204 - DNA, 25 bp, Rattus norvegicus
tacacagcactgagccataggcttc

SEQ ID NO: 547205 - DNA, 25 bp, Rattus norvegicus
tacacagcactgtgccataggcttc

SEQ ID NO: 547206 - DNA, 25 bp, Rattus norvegicus
tacacagcagtgatgatgtcccttg

SEQ ID NO: 547207 - DNA, 25 bp, Rattus norvegicus
tacacagcagtgttgatgtcccttg

SEQ ID NO: 547208 - DNA, 25 bp, Rattus norvegicus
tacacagcagttacatttcacattc

SEQ ID NO: 547209 - DNA, 25 bp, Rattus norvegicus
tacacagcagtttcatttcacattc

SEQ ID NO: 547210 - DNA, 25 bp, Rattus norvegicus
tacacagccgcacacacatatataa

SEQ ID NO: 547211 - DNA, 25 bp, Rattus norvegicus
tacacagccgcagacacatatataa

SEQ ID NO: 547212 - DNA, 25 bp, Rattus norvegicus
tacacagcctgcattacttttacag

SEQ ID NO: 547213 - DNA, 25 bp, Rattus norvegicus
tacacagcctgcctttatactggga

SEQ ID NO: 547214 - DNA, 25 bp, Rattus norvegicus
tacacagcctgcgtttatactggga

SEQ ID NO: 547215 - DNA, 25 bp, Rattus norvegicus
tacacagcctgctttacttttacag

SEQ ID NO: 547216 - DNA, 25 bp, Rattus norvegicus
tacacagcgggtatctcaggagcag

SEQ ID NO: 547217 - DNA, 25 bp, Rattus norvegicus
tacacagcgggtttctcaggagcag

SEQ ID NO: 547218 - DNA, 25 bp, Rattus norvegicus
tacacagcggtgaagtctttgcccc

SEQ ID NO: 547219 - DNA, 25 bp, Rattus norvegicus
tacacagcggtgtagtctttgcccc

SEQ ID NO: 547220 - DNA, 25 bp, Rattus norvegicus
tacacagctcaaatctttgccaggt

SEQ ID NO: 547221 - DNA, 25 bp, Rattus norvegicus
tacacagctcaattctttgccaggt

SEQ ID NO: 547222 - DNA, 25 bp, Rattus norvegicus
tacacagctcttatgacagcctggc

SEQ ID NO: 547223 - DNA, 25 bp, Rattus norvegicus
tacacagctcttttgacagcctggc

SEQ ID NO: 547224 - DNA, 25 bp, Rattus norvegicus
tacacagctgtcatgcttcttccca

SEQ ID NO: 547225 - DNA, 25 bp, Rattus norvegicus
tacacagctgtcttgcttcttccca

SEQ ID NO: 547226 - DNA, 25 bp, Rattus norvegicus
tacacagcttgtctggctaggacgt

SEQ ID NO: 547227 - DNA, 25 bp, Rattus norvegicus
tacacagcttgtgtggctaggacgt

SEQ ID NO: 547228 - DNA, 25 bp, Rattus norvegicus
tacacaggagatcaccatgcaggga

SEQ ID NO: 547229 - DNA, 25 bp, Rattus norvegicus
tacacaggagatgaccatgcaggga

SEQ ID NO: 547230 - DNA, 25 bp, Rattus norvegicus
tacacaggatcccactcagagagtc

SEQ ID NO: 547231 - DNA, 25 bp, Rattus norvegicus
tacacaggatccgactcagagagtc

SEQ ID NO: 547232 - DNA, 25 bp, Rattus norvegicus
tacacaggcgtgatggtagcccttt

SEQ ID NO: 547233 - DNA, 25 bp, Rattus norvegicus
tacacaggcgtgttggtagcccttt

SEQ ID NO: 547234 - DNA, 25 bp, Rattus norvegicus
tacacaggctagacctaggctttcc

SEQ ID NO: 547235 - DNA, 25 bp, Rattus norvegicus
tacacaggctagtcctaggctttcc

SEQ ID NO: 547236 - DNA, 25 bp, Rattus norvegicus
tacacaggctctaccagagccgctt

SEQ ID NO: 547237 - DNA, 25 bp, Rattus norvegicus
tacacaggctcttccagagccgctt

SEQ ID NO: 547238 - DNA, 25 bp, Rattus norvegicus
tacacaggctgcagccctcacggag

SEQ ID NO: 547239 - DNA, 25 bp, Rattus norvegicus
tacacaggctgctgccctcacggag

SEQ ID NO: 547240 - DNA, 25 bp, Rattus norvegicus
tacacaggctgtatacctggcttca

SEQ ID NO: 547241 - DNA, 25 bp, Rattus norvegicus
tacacaggctgtttacctggcttca

SEQ ID NO: 547242 - DNA, 25 bp, Rattus norvegicus
tacacaggcttgcattcccatttct

SEQ ID NO: 547243 - DNA, 25 bp, Rattus norvegicus
tacacaggcttggattcccatttct

SEQ ID NO: 547244 - DNA, 25 bp, Rattus norvegicus
tacacagggccaacttcacaagaac

SEQ ID NO: 547245 - DNA, 25 bp, Rattus norvegicus
tacacagggccatcttcacaagaac

SEQ ID NO: 547246 - DNA, 25 bp, Rattus norvegicus
tacacagggtcgataccaggtccct

SEQ ID NO: 547247 - DNA, 25 bp, Rattus norvegicus
tacacagggtcgttaccaggtccct

SEQ ID NO: 547248 - DNA, 25 bp, Rattus norvegicus
tacacaggtattccagctactggct

SEQ ID NO: 547249 - DNA, 25 bp, Rattus norvegicus
tacacaggtattgcagctactggct

SEQ ID NO: 547250 - DNA, 25 bp, Rattus norvegicus
tacacaggttgaacatcccgaggcc

SEQ ID NO: 547251 - DNA, 25 bp, Rattus norvegicus
tacacaggttgatcatcccgaggcc

SEQ ID NO: 547252 - DNA, 25 bp, Rattus norvegicus
tacacagtacatcagcttcctagca

SEQ ID NO: 547253 - DNA, 25 bp, Rattus norvegicus
tacacagtacatgagcttcctagca

SEQ ID NO: 547254 - DNA, 25 bp, Rattus norvegicus
tacacagtaggacgaggcacgtccc

SEQ ID NO: 547255 - DNA, 25 bp, Rattus norvegicus
tacacagtaggaggaggcacgtccc

SEQ ID NO: 547256 - DNA, 25 bp, Rattus norvegicus
tacacagtccgcatattgaaaggct

SEQ ID NO: 547257 - DNA, 25 bp, Rattus norvegicus
tacacagtccgcttattgaaaggct

SEQ ID NO: 547258 - DNA, 25 bp, Rattus norvegicus
tacacagtctgtattagtatttggg

SEQ ID NO: 547259 - DNA, 25 bp, Rattus norvegicus
tacacagtctgttttagtatttggg

SEQ ID NO: 547260 - DNA, 25 bp, Rattus norvegicus
tacacagtgaatcccaggccaatta

SEQ ID NO: 547261 - DNA, 25 bp, Rattus norvegicus
tacacagtgaatgccaggccaatta

SEQ ID NO: 547262 - DNA, 25 bp, Rattus norvegicus
tacacagtgagcagttccgggagct

SEQ ID NO: 547263 - DNA, 25 bp, Rattus norvegicus
tacacagtgagctgttccgggagct

SEQ ID NO: 547264 - DNA, 25 bp, Rattus norvegicus
tacacagttcagatggactagcagt

SEQ ID NO: 547265 - DNA, 25 bp, Rattus norvegicus
tacacagttcagttggactagcagt

SEQ ID NO: 547266 - DNA, 25 bp, Rattus norvegicus
tacacagtttatacctgaccccaag

SEQ ID NO: 547267 - DNA, 25 bp, Rattus norvegicus
tacacagtttattcctgaccccaag

SEQ ID NO: 547268 - DNA, 25 bp, Rattus norvegicus
tacacagtttggatacaggacttct

SEQ ID NO: 547269 - DNA, 25 bp, Rattus norvegicus
tacacagtttggttacaggacttct

SEQ ID NO: 547270 - DNA, 25 bp, Rattus norvegicus
tacacataagcacctactcttcctg

SEQ ID NO: 547271 - DNA, 25 bp, Rattus norvegicus
tacacataagcagctactcttcctg

SEQ ID NO: 547272 - DNA, 25 bp, Rattus norvegicus
tacacatacggtacttacactggat

SEQ ID NO: 547273 - DNA, 25 bp, Rattus norvegicus
tacacatacggttcttacactggat

SEQ ID NO: 547274 - DNA, 25 bp, Rattus norvegicus
tacacatcagggacgccgatccggg

SEQ ID NO: 547275 - DNA, 25 bp, Rattus norvegicus
tacacatcagggtcgccgatccggg

SEQ ID NO: 547276 - DNA, 25 bp, Rattus norvegicus
tacacatcatgtctattccttctct

SEQ ID NO: 547277 - DNA, 25 bp, Rattus norvegicus
tacacatcatgtgtattccttctct

SEQ ID NO: 547278 - DNA, 25 bp, Rattus norvegicus
tacacatccaccatcttaatactga

SEQ ID NO: 547279 - DNA, 25 bp, Rattus norvegicus
tacacatccaccttcttaatactga

SEQ ID NO: 547280 - DNA, 25 bp, Rattus norvegicus
tacacatccattccttcagctaaat

SEQ ID NO: 547281 - DNA, 25 bp, Rattus norvegicus
tacacatccattgcttcagctaaat

SEQ ID NO: 547282 - DNA, 25 bp, Rattus norvegicus
tacacatccccactgagagactgag

SEQ ID NO: 547283 - DNA, 25 bp, Rattus norvegicus
tacacatccccagtgagagactgag

SEQ ID NO: 547284 - DNA, 25 bp, Rattus norvegicus
tacacatcctaaatcctggcactca

SEQ ID NO: 547285 - DNA, 25 bp, Rattus norvegicus
tacacatcctaattcctggcactca

SEQ ID NO: 547286 - DNA, 25 bp, Rattus norvegicus
tacacatctagcagtcagttcttgt

SEQ ID NO: 547287 - DNA, 25 bp, Rattus norvegicus
tacacatctagctgtcagttcttgt

SEQ ID NO: 547288 - DNA, 25 bp, Rattus norvegicus
tacacatctctgaggctgtgcagat

SEQ ID NO: 547289 - DNA, 25 bp, Rattus norvegicus
tacacatctctgtggctgtgcagat

SEQ ID NO: 547290 - DNA, 25 bp, Rattus norvegicus
tacacatgacacactgaggttgttt

SEQ ID NO: 547291 - DNA, 25 bp, Rattus norvegicus
tacacatgacactctgaggttgttt

SEQ ID NO: 547292 - DNA, 25 bp, Rattus norvegicus
tacacatgagtgcaggtcacctggg

SEQ ID NO: 547293 - DNA, 25 bp, Rattus norvegicus
tacacatgagtggaggtcacctggg

SEQ ID NO: 547294 - DNA, 25 bp, Rattus norvegicus
tacacatgatacagttgacgtttaa

SEQ ID NO: 547295 - DNA, 25 bp, Rattus norvegicus
tacacatgatactgttgacgtttaa

SEQ ID NO: 547296 - DNA, 25 bp, Rattus norvegicus
tacacatgcagacatcaagccctac

SEQ ID NO: 547297 - DNA, 25 bp, Rattus norvegicus
tacacatgcagagatcaagccctac

SEQ ID NO: 547298 - DNA, 25 bp, Rattus norvegicus
tacacatgcatacaaggcccttgat

SEQ ID NO: 547299 - DNA, 25 bp, Rattus norvegicus
tacacatgcatagaaggcccttgat

SEQ ID NO: 547300 - DNA, 25 bp, Rattus norvegicus
tacacatgctgtacctgcgattcta

SEQ ID NO: 547301 - DNA, 25 bp, Rattus norvegicus
tacacatgctgttcctgcgattcta

SEQ ID NO: 547302 - DNA, 25 bp, Rattus norvegicus
tacacatgctttatggagctgcact

SEQ ID NO: 547303 - DNA, 25 bp, Rattus norvegicus
tacacatgctttttggagctgcact

SEQ ID NO: 547304 - DNA, 25 bp, Rattus norvegicus
tacacatggatgctcccttacaaga

SEQ ID NO: 547305 - DNA, 25 bp, Rattus norvegicus
tacacatggatggtcccttacaaga

SEQ ID NO: 547306 - DNA, 25 bp, Rattus norvegicus
tacacatgggcaagggcttggatgc

SEQ ID NO: 547307 - DNA, 25 bp, Rattus norvegicus
tacacatgggcatgggcttggatgc

SEQ ID NO: 547308 - DNA, 25 bp, Rattus norvegicus
tacacatgggctcaccagggctcca

SEQ ID NO: 547309 - DNA, 25 bp, Rattus norvegicus
tacacatgggctgaccagggctcca

SEQ ID NO: 547310 - DNA, 25 bp, Rattus norvegicus
tacacatgtctcagagccatgtttt

SEQ ID NO: 547311 - DNA, 25 bp, Rattus norvegicus
tacacatgtctctgagccatgtttt

SEQ ID NO: 547312 - DNA, 25 bp, Rattus norvegicus
tacacatgtgcacagggttactacc

SEQ ID NO: 547313 - DNA, 25 bp, Rattus norvegicus
tacacatgtgcagagggttactacc

SEQ ID NO: 547314 - DNA, 25 bp, Rattus norvegicus
tacacatgttatcacctgactacct

SEQ ID NO: 547315 - DNA, 25 bp, Rattus norvegicus
tacacatgttatgacctgactacct

SEQ ID NO: 547316 - DNA, 25 bp, Rattus norvegicus
tacacattacacagggttgaacaag

SEQ ID NO: 547317 - DNA, 25 bp, Rattus norvegicus
tacacattacactgggttgaacaag

SEQ ID NO: 547318 - DNA, 25 bp, Rattus norvegicus
tacacattactgacatttccactcg

SEQ ID NO: 547319 - DNA, 25 bp, Rattus norvegicus
tacacattactgtcatttccactcg

SEQ ID NO: 547320 - DNA, 25 bp, Rattus norvegicus
tacacattcccaagagggtcgggct

SEQ ID NO: 547321 - DNA, 25 bp, Rattus norvegicus
tacacattcccatgagggtcgggct

SEQ ID NO: 547322 - DNA, 25 bp, Rattus norvegicus
tacacattcgttctactgagggcag

SEQ ID NO: 547323 - DNA, 25 bp, Rattus norvegicus
tacacattcgttgtactgagggcag

SEQ ID NO: 547324 - DNA, 25 bp, Rattus norvegicus
tacacattggccctggacatgctgg

SEQ ID NO: 547325 - DNA, 25 bp, Rattus norvegicus
tacacattggccgtggacatgctgg

SEQ ID NO: 547326 - DNA, 25 bp, Rattus norvegicus
tacacatttgcaactggttctccag

SEQ ID NO: 547327 - DNA, 25 bp, Rattus norvegicus
tacacatttgcatctggttctccag

SEQ ID NO: 547328 - DNA, 25 bp, Rattus norvegicus
tacacattttatatacatcatcaac

SEQ ID NO: 547329 - DNA, 25 bp, Rattus norvegicus
tacacattttatttacatcatcaac

SEQ ID NO: 547330 - DNA, 25 bp, Rattus norvegicus
tacaccaagagtcgacagcctgctc

SEQ ID NO: 547331 - DNA, 25 bp, Rattus norvegicus
tacaccaagagtggacagcctgctc

SEQ ID NO: 547332 - DNA, 25 bp, Rattus norvegicus
tacaccaagctgaattccaggcctg

SEQ ID NO: 547333 - DNA, 25 bp, Rattus norvegicus
tacaccaagctgtattccaggcctg

SEQ ID NO: 547334 - DNA, 25 bp, Rattus norvegicus
tacaccaagtaccagacgctggaac

SEQ ID NO: 547335 - DNA, 25 bp, Rattus norvegicus
tacaccaagtacgagacgctggaac

SEQ ID NO: 547336 - DNA, 25 bp, Rattus norvegicus
tacaccaatgagacagtctaggcag

SEQ ID NO: 547337 - DNA, 25 bp, Rattus norvegicus
tacaccaatgagtcagtctaggcag

SEQ ID NO: 547338 - DNA, 25 bp, Rattus norvegicus
tacaccacaagtatttaaatttatg

SEQ ID NO: 547339 - DNA, 25 bp, Rattus norvegicus
tacaccacaagtttttaaatttatg

SEQ ID NO: 547340 - DNA, 25 bp, Rattus norvegicus
tacaccaccaacagctttggcgaca

SEQ ID NO: 547341 - DNA, 25 bp, Rattus norvegicus
tacaccaccaactgctttggcgaca

SEQ ID NO: 547342 - DNA, 25 bp, Rattus norvegicus
tacaccaccaagataatagcagccc

SEQ ID NO: 547343 - DNA, 25 bp, Rattus norvegicus
tacaccaccaagttaatagcagccc

SEQ ID NO: 547344 - DNA, 25 bp, Rattus norvegicus
tacaccacttctcctgtcagtcaaa

SEQ ID NO: 547345 - DNA, 25 bp, Rattus norvegicus
tacaccacttctgctgtcagtcaaa

SEQ ID NO: 547346 - DNA, 25 bp, Rattus norvegicus
tacaccagacctatgcaaacccaag

SEQ ID NO: 547347 - DNA, 25 bp, Rattus norvegicus
tacaccagacctttgcaaacccaag

SEQ ID NO: 547348 - DNA, 25 bp, Rattus norvegicus
tacaccagagacagctgcgggcgag

SEQ ID NO: 547349 - DNA, 25 bp, Rattus norvegicus
tacaccagagactgctgcgggcgag

SEQ ID NO: 547350 - DNA, 25 bp, Rattus norvegicus
tacaccagatgcctctgcagacctt

SEQ ID NO: 547351 - DNA, 25 bp, Rattus norvegicus
tacaccagatgcgtctgcagacctt

SEQ ID NO: 547352 - DNA, 25 bp, Rattus norvegicus
tacaccagcactcccagttatctgg

SEQ ID NO: 547353 - DNA, 25 bp, Rattus norvegicus
tacaccagcactgccagttatctgg

SEQ ID NO: 547354 - DNA, 25 bp, Rattus norvegicus
tacaccagcagtatagacaaagcct

SEQ ID NO: 547355 - DNA, 25 bp, Rattus norvegicus
tacaccagcagtttagacaaagcct

SEQ ID NO: 547356 - DNA, 25 bp, Rattus norvegicus
tacaccagcgctaagtaaacttttc

SEQ ID NO: 547357 - DNA, 25 bp, Rattus norvegicus
tacaccagcgcttagtaaacttttc

SEQ ID NO: 547358 - DNA, 25 bp, Rattus norvegicus
tacaccagctacatgctcgggacaa

SEQ ID NO: 547359 - DNA, 25 bp, Rattus norvegicus
tacaccagctacttgctcgggacaa

SEQ ID NO: 547360 - DNA, 25 bp, Rattus norvegicus
tacaccaggtgtattccctttggat

SEQ ID NO: 547361 - DNA, 25 bp, Rattus norvegicus
tacaccaggtgttttccctttggat

SEQ ID NO: 547362 - DNA, 25 bp, Rattus norvegicus
tacaccatactcacctctaggagag

SEQ ID NO: 547363 - DNA, 25 bp, Rattus norvegicus
tacaccatactctcctctaggagag

SEQ ID NO: 547364 - DNA, 25 bp, Rattus norvegicus
tacaccatcagacgtgaccggaaat

SEQ ID NO: 547365 - DNA, 25 bp, Rattus norvegicus
tacaccatcagaggtgaccggaaat

SEQ ID NO: 547366 - DNA, 25 bp, Rattus norvegicus
tacaccatcatgagagaggaagacc

SEQ ID NO: 547367 - DNA, 25 bp, Rattus norvegicus
tacaccatcatgtgagaggaagacc

SEQ ID NO: 547368 - DNA, 25 bp, Rattus norvegicus
tacaccatctttaccggtcttgaag

SEQ ID NO: 547369 - DNA, 25 bp, Rattus norvegicus
tacaccatcttttccggtcttgaag

SEQ ID NO: 547370 - DNA, 25 bp, Rattus norvegicus
tacaccatgagcactttactcacca

SEQ ID NO: 547371 - DNA, 25 bp, Rattus norvegicus
tacaccatgagcatcatgcccatct

SEQ ID NO: 547372 - DNA, 25 bp, Rattus norvegicus
tacaccatgagctctttactcacca

SEQ ID NO: 547373 - DNA, 25 bp, Rattus norvegicus
tacaccatgagcttcatgcccatct

SEQ ID NO: 547374 - DNA, 25 bp, Rattus norvegicus
tacaccatgatacggctctgtcact

SEQ ID NO: 547375 - DNA, 25 bp, Rattus norvegicus
tacaccatgatagggctctgtcact

SEQ ID NO: 547376 - DNA, 25 bp, Rattus norvegicus
tacaccatgggactctcctaggatg

SEQ ID NO: 547377 - DNA, 25 bp, Rattus norvegicus
tacaccatgggagtctcctaggatg

SEQ ID NO: 547378 - DNA, 25 bp, Rattus norvegicus
tacacccaaccaatgtatgtggcaa

SEQ ID NO: 547379 - DNA, 25 bp, Rattus norvegicus
tacacccaaccattgtatgtggcaa

SEQ ID NO: 547380 - DNA, 25 bp, Rattus norvegicus
tacacccaactcatttcagtagtca

SEQ ID NO: 547381 - DNA, 25 bp, Rattus norvegicus
tacacccaactcttttcagtagtca

SEQ ID NO: 547382 - DNA, 25 bp, Rattus norvegicus
tacacccacatgaatccacatacaa

SEQ ID NO: 547383 - DNA, 25 bp, Rattus norvegicus
tacacccacatgtatccacatacaa

SEQ ID NO: 547384 - DNA, 25 bp, Rattus norvegicus
tacacccacctgaatgggaatggct

SEQ ID NO: 547385 - DNA, 25 bp, Rattus norvegicus
tacacccacctgtatgggaatggct

SEQ ID NO: 547386 - DNA, 25 bp, Rattus norvegicus
tacacccactaaaacactcctagta

SEQ ID NO: 547387 - DNA, 25 bp, Rattus norvegicus
tacacccactaatacactcctagta

SEQ ID NO: 547388 - DNA, 25 bp, Rattus norvegicus
tacacccagaggagttcttctcagt

SEQ ID NO: 547389 - DNA, 25 bp, Rattus norvegicus
tacacccagaggtgttcttctcagt

SEQ ID NO: 547390 - DNA, 25 bp, Rattus norvegicus
tacacccatcctattcccttaggta

SEQ ID NO: 547391 - DNA, 25 bp, Rattus norvegicus
tacacccatccttttcccttaggta

SEQ ID NO: 547392 - DNA, 25 bp, Rattus norvegicus
tacaccccagttcaaacctttgcaa

SEQ ID NO: 547393 - DNA, 25 bp, Rattus norvegicus
tacaccccagttgaaacctttgcaa

SEQ ID NO: 547394 - DNA, 25 bp, Rattus norvegicus
tacaccccatatatcgctgaacaag

SEQ ID NO: 547395 - DNA, 25 bp, Rattus norvegicus
tacaccccatatttcgctgaacaag

SEQ ID NO: 547396 - DNA, 25 bp, Rattus norvegicus
tacacccctgctcgagcatgaagac

SEQ ID NO: 547397 - DNA, 25 bp, Rattus norvegicus
tacacccctgctggagcatgaagac

SEQ ID NO: 547398 - DNA, 25 bp, Rattus norvegicus
tacacccctttcatatcacatgaca

SEQ ID NO: 547399 - DNA, 25 bp, Rattus norvegicus
tacacccctttcttatcacatgaca

SEQ ID NO: 547400 - DNA, 25 bp, Rattus norvegicus
tacacccgtctgagccgcaaaagaa

SEQ ID NO: 547401 - DNA, 25 bp, Rattus norvegicus
tacacccgtctgtgccgcaaaagaa

SEQ ID NO: 547402 - DNA, 25 bp, Rattus norvegicus
tacacccgtgtgaccaattatgtgg

SEQ ID NO: 547403 - DNA, 25 bp, Rattus norvegicus
tacacccgtgtgtccaattatgtgg

SEQ ID NO: 547404 - DNA, 25 bp, Rattus norvegicus
tacaccctaagcacataccaatttc

SEQ ID NO: 547405 - DNA, 25 bp, Rattus norvegicus
tacaccctaagctcataccaatttc

SEQ ID NO: 547406 - DNA, 25 bp, Rattus norvegicus
tacaccctagtacctcttagtgatg

SEQ ID NO: 547407 - DNA, 25 bp, Rattus norvegicus
tacaccctagtagctcttagtgatg

SEQ ID NO: 547408 - DNA, 25 bp, Rattus norvegicus
tacaccctgctaattacagacctgg

SEQ ID NO: 547409 - DNA, 25 bp, Rattus norvegicus
tacaccctgctatttacagacctgg

SEQ ID NO: 547410 - DNA, 25 bp, Rattus norvegicus
tacaccctggctagggatcgatggc

SEQ ID NO: 547411 - DNA, 25 bp, Rattus norvegicus
tacaccctggcttgggatcgatggc

SEQ ID NO: 547412 - DNA, 25 bp, Rattus norvegicus
tacaccctggtgcttggctgcagcg

SEQ ID NO: 547413 - DNA, 25 bp, Rattus norvegicus
tacaccctggtggttggctgcagcg

SEQ ID NO: 547414 - DNA, 25 bp, Rattus norvegicus
tacaccctggttatcacagacaagg

SEQ ID NO: 547415 - DNA, 25 bp, Rattus norvegicus
tacaccctggttttcacagacaagg

SEQ ID NO: 547416 - DNA, 25 bp, Rattus norvegicus
tacaccctgtctctagtcacaaaca

SEQ ID NO: 547417 - DNA, 25 bp, Rattus norvegicus
tacaccctgtctgtagtcacaaaca

SEQ ID NO: 547418 - DNA, 25 bp, Rattus norvegicus
tacaccgaacaccagattggcactg

SEQ ID NO: 547419 - DNA, 25 bp, Rattus norvegicus
tacaccgaacacgagattggcactg

SEQ ID NO: 547420 - DNA, 25 bp, Rattus norvegicus
tacaccgaactccccgtcggaggtg

SEQ ID NO: 547421 - DNA, 25 bp, Rattus norvegicus
tacaccgaactcgccgtcggaggtg

SEQ ID NO: 547422 - DNA, 25 bp, Rattus norvegicus
tacaccgactctatggctgcctgga

SEQ ID NO: 547423 - DNA, 25 bp, Rattus norvegicus
tacaccgactctttggctgcctgga

SEQ ID NO: 547424 - DNA, 25 bp, Rattus norvegicus
tacaccgactgtcatcagcccttgt

SEQ ID NO: 547425 - DNA, 25 bp, Rattus norvegicus
tacaccgactgtgatcagcccttgt

SEQ ID NO: 547426 - DNA, 25 bp, Rattus norvegicus
tacaccgatctaaccaccattgaag

SEQ ID NO: 547427 - DNA, 25 bp, Rattus norvegicus
tacaccgatctatccaccattgaag

SEQ ID NO: 547428 - DNA, 25 bp, Rattus norvegicus
tacaccgccattcaagctcctaagg

SEQ ID NO: 547429 - DNA, 25 bp, Rattus norvegicus
tacaccgccattgaagctcctaagg

SEQ ID NO: 547430 - DNA, 25 bp, Rattus norvegicus
tacaccgccctaaacgtggccgtgg

SEQ ID NO: 547431 - DNA, 25 bp, Rattus norvegicus
tacaccgccctatacgtggccgtgg

SEQ ID NO: 547432 - DNA, 25 bp, Rattus norvegicus
tacaccggagctcatggagcttgca

SEQ ID NO: 547433 - DNA, 25 bp, Rattus norvegicus
tacaccggagctgatggagcttgca

SEQ ID NO: 547434 - DNA, 25 bp, Rattus norvegicus
tacaccggtagaaacaccatctgcc

SEQ ID NO: 547435 - DNA, 25 bp, Rattus norvegicus
tacaccggtagatacaccatctgcc

SEQ ID NO: 547436 - DNA, 25 bp, Rattus norvegicus
tacaccgtcttcactggattacagg

SEQ ID NO: 547437 - DNA, 25 bp, Rattus norvegicus
tacaccgtcttctctggattacagg

SEQ ID NO: 547438 - DNA, 25 bp, Rattus norvegicus
tacaccgtgagaatcctacacttgg

SEQ ID NO: 547439 - DNA, 25 bp, Rattus norvegicus
tacaccgtgagattcctacacttgg

SEQ ID NO: 547440 - DNA, 25 bp, Rattus norvegicus
tacaccgttcagctgatgtccacgt

SEQ ID NO: 547441 - DNA, 25 bp, Rattus norvegicus
tacaccgttcaggtgatgtccacgt

SEQ ID NO: 547442 - DNA, 25 bp, Rattus norvegicus
tacacctacgtcattggcagacttg

SEQ ID NO: 547443 - DNA, 25 bp, Rattus norvegicus
tacacctacgtctttggcagacttg

SEQ ID NO: 547444 - DNA, 25 bp, Rattus norvegicus
tacacctactagataccgtcaccta

SEQ ID NO: 547445 - DNA, 25 bp, Rattus norvegicus
tacacctactagttaccgtcaccta

SEQ ID NO: 547446 - DNA, 25 bp, Rattus norvegicus
tacacctacttcagtttggtaaaat

SEQ ID NO: 547447 - DNA, 25 bp, Rattus norvegicus
tacacctacttctgtttggtaaaat

SEQ ID NO: 547448 - DNA, 25 bp, Rattus norvegicus
tacacctatgtactttgaacccttt

SEQ ID NO: 547449 - DNA, 25 bp, Rattus norvegicus
tacacctatgtagtttgaacccttt

SEQ ID NO: 547450 - DNA, 25 bp, Rattus norvegicus
tacacctcagtcagtcaggaacggt

SEQ ID NO: 547451 - DNA, 25 bp, Rattus norvegicus
tacacctcagtctgtcaggaacggt

SEQ ID NO: 547452 - DNA, 25 bp, Rattus norvegicus
tacacctccatcctgtatggcaatg

SEQ ID NO: 547453 - DNA, 25 bp, Rattus norvegicus
tacacctccatcgtgtatggcaatg

SEQ ID NO: 547454 - DNA, 25 bp, Rattus norvegicus
tacacctcccggaagattcatcgga

SEQ ID NO: 547455 - DNA, 25 bp, Rattus norvegicus
tacacctcccggtagattcatcgga

SEQ ID NO: 547456 - DNA, 25 bp, Rattus norvegicus
tacacctcgtgaaactccatagagt

SEQ ID NO: 547457 - DNA, 25 bp, Rattus norvegicus
tacacctcgtgatactccatagagt

SEQ ID NO: 547458 - DNA, 25 bp, Rattus norvegicus
tacacctctgtaatgatgactctgc

SEQ ID NO: 547459 - DNA, 25 bp, Rattus norvegicus
tacacctctgtattgatgactctgc

SEQ ID NO: 547460 - DNA, 25 bp, Rattus norvegicus
tacacctcttgcaaagctcagactg

SEQ ID NO: 547461 - DNA, 25 bp, Rattus norvegicus
tacacctcttgctaagctcagactg

SEQ ID NO: 547462 - DNA, 25 bp, Rattus norvegicus
tacacctctttacgtatatgatgtg

SEQ ID NO: 547463 - DNA, 25 bp, Rattus norvegicus
tacacctctttaggtatatgatgtg

SEQ ID NO: 547464 - DNA, 25 bp, Rattus norvegicus
tacacctgagtgatagctgtaggct

SEQ ID NO: 547465 - DNA, 25 bp, Rattus norvegicus
tacacctgagtgttagctgtaggct

SEQ ID NO: 547466 - DNA, 25 bp, Rattus norvegicus
tacacctgccctaagttaaccatag

SEQ ID NO: 547467 - DNA, 25 bp, Rattus norvegicus
tacacctgcccttagttaaccatag

SEQ ID NO: 547468 - DNA, 25 bp, Rattus norvegicus
tacacctgccttctactgtactaat

SEQ ID NO: 547469 - DNA, 25 bp, Rattus norvegicus
tacacctgccttgtactgtactaat

SEQ ID NO: 547470 - DNA, 25 bp, Rattus norvegicus
tacacctggatgcatgcaaccttga

SEQ ID NO: 547471 - DNA, 25 bp, Rattus norvegicus
tacacctggatggatgcaaccttga

SEQ ID NO: 547472 - DNA, 25 bp, Rattus norvegicus
tacacctggcagatcttttctgaga

SEQ ID NO: 547473 - DNA, 25 bp, Rattus norvegicus
tacacctggcagttcttttctgaga

SEQ ID NO: 547474 - DNA, 25 bp, Rattus norvegicus
tacacctggcttagggaccatttac

SEQ ID NO: 547475 - DNA, 25 bp, Rattus norvegicus
tacacctggctttgggaccatttac

SEQ ID NO: 547476 - DNA, 25 bp, Rattus norvegicus
tacaccttaaaacgcctgctgacat

SEQ ID NO: 547477 - DNA, 25 bp, Rattus norvegicus
tacaccttaaaaggcctgctgacat

SEQ ID NO: 547478 - DNA, 25 bp, Rattus norvegicus
tacaccttaatactggtcagaccag

SEQ ID NO: 547479 - DNA, 25 bp, Rattus norvegicus
tacaccttaatagtggtcagaccag

SEQ ID NO: 547480 - DNA, 25 bp, Rattus norvegicus
tacaccttagaactttggacgcaga

SEQ ID NO: 547481 - DNA, 25 bp, Rattus norvegicus
tacaccttagaagtttggacgcaga

SEQ ID NO: 547482 - DNA, 25 bp, Rattus norvegicus
tacaccttgtagattttccctctag

SEQ ID NO: 547483 - DNA, 25 bp, Rattus norvegicus
tacaccttgtagtttttccctctag

SEQ ID NO: 547484 - DNA, 25 bp, Rattus norvegicus
tacaccttgtgtcagcagcgtgaag

SEQ ID NO: 547485 - DNA, 25 bp, Rattus norvegicus
tacaccttgtgtgagcagcgtgaag

SEQ ID NO: 547486 - DNA, 25 bp, Rattus norvegicus
tacacctttaaaaggagtcaacttt

SEQ ID NO: 547487 - DNA, 25 bp, Rattus norvegicus
tacacctttaaatggagtcaacttt

SEQ ID NO: 547488 - DNA, 25 bp, Rattus norvegicus
tacacctttcaacagaccacagttt

SEQ ID NO: 547489 - DNA, 25 bp, Rattus norvegicus
tacacctttcaagagaccacagttt

SEQ ID NO: 547490 - DNA, 25 bp, Rattus norvegicus
tacacctttcacagcctaggattgg

SEQ ID NO: 547491 - DNA, 25 bp, Rattus norvegicus
tacacctttcactgcctaggattgg

SEQ ID NO: 547492 - DNA, 25 bp, Rattus norvegicus
tacacctttgtgatttaattatatt

SEQ ID NO: 547493 - DNA, 25 bp, Rattus norvegicus
tacacctttgtgttttaattatatt

SEQ ID NO: 547494 - DNA, 25 bp, Rattus norvegicus
tacacgaaagtgctctgatcccgat

SEQ ID NO: 547495 - DNA, 25 bp, Rattus norvegicus
tacacgaaagtggtctgatcccgat

SEQ ID NO: 547496 - DNA, 25 bp, Rattus norvegicus
tacacgaacaagaatggcagctttg

SEQ ID NO: 547497 - DNA, 25 bp, Rattus norvegicus
tacacgaacaagtatggcagctttg

SEQ ID NO: 547498 - DNA, 25 bp, Rattus norvegicus
tacacgaagctgcacatcgcctatg

SEQ ID NO: 547499 - DNA, 25 bp, Rattus norvegicus
tacacgaagctggacatcgcctatg

SEQ ID NO: 547500 - DNA, 25 bp, Rattus norvegicus
tacacgaaggttacctgttgcaata

SEQ ID NO: 547501 - DNA, 25 bp, Rattus norvegicus
tacacgaaggtttcctgttgcaata

SEQ ID NO: 547502 - DNA, 25 bp, Rattus norvegicus
tacacgacactaatacttataacct

SEQ ID NO: 547503 - DNA, 25 bp, Rattus norvegicus
tacacgacactattacttataacct

SEQ ID NO: 547504 - DNA, 25 bp, Rattus norvegicus
tacacgagctgtctggaaataccca

SEQ ID NO: 547505 - DNA, 25 bp, Rattus norvegicus
tacacgagctgtgtggaaataccca

SEQ ID NO: 547506 - DNA, 25 bp, Rattus norvegicus
tacacgaggaggacgcatacactag

SEQ ID NO: 547507 - DNA, 25 bp, Rattus norvegicus
tacacgaggaggtcgcatacactag

SEQ ID NO: 547508 - DNA, 25 bp, Rattus norvegicus
tacacgaggtgtcgaccgtcgtcat

SEQ ID NO: 547509 - DNA, 25 bp, Rattus norvegicus
tacacgaggtgtggaccgtcgtcat

SEQ ID NO: 547510 - DNA, 25 bp, Rattus norvegicus
tacacgaggtttatgcatgagctta

SEQ ID NO: 547511 - DNA, 25 bp, Rattus norvegicus
tacacgaggtttttgcatgagctta

SEQ ID NO: 547512 - DNA, 25 bp, Rattus norvegicus
tacacgatgactaggcttcccttag

SEQ ID NO: 547513 - DNA, 25 bp, Rattus norvegicus
tacacgatgacttggcttcccttag

SEQ ID NO: 547514 - DNA, 25 bp, Rattus norvegicus
tacacgctgcatcaggaccaacaga

SEQ ID NO: 547515 - DNA, 25 bp, Rattus norvegicus
tacacgctgcatgaggaccaacaga

SEQ ID NO: 547516 - DNA, 25 bp, Rattus norvegicus
tacacgcttcgaattttgcctggaa

SEQ ID NO: 547517 - DNA, 25 bp, Rattus norvegicus
tacacgcttcgatttttgcctggaa

SEQ ID NO: 547518 - DNA, 25 bp, Rattus norvegicus
tacacggaacatcctgttgtctcag

SEQ ID NO: 547519 - DNA, 25 bp, Rattus norvegicus
tacacggaacatgctgttgtctcag

SEQ ID NO: 547520 - DNA, 25 bp, Rattus norvegicus
tacacggaacgaattaccacttgtt

SEQ ID NO: 547521 - DNA, 25 bp, Rattus norvegicus
tacacggaacgatttaccacttgtt

SEQ ID NO: 547522 - DNA, 25 bp, Rattus norvegicus
tacacggaccttatcctggaagcaa

SEQ ID NO: 547523 - DNA, 25 bp, Rattus norvegicus
tacacggaccttttcctggaagcaa

SEQ ID NO: 547524 - DNA, 25 bp, Rattus norvegicus
tacacggactccctggttcatgatc

SEQ ID NO: 547525 - DNA, 25 bp, Rattus norvegicus
tacacggactccgtggttcatgatc

SEQ ID NO: 547526 - DNA, 25 bp, Rattus norvegicus
tacacggactgcacatgcgccaagt

SEQ ID NO: 547527 - DNA, 25 bp, Rattus norvegicus
tacacggactgctcatgcgccaagt

SEQ ID NO: 547528 - DNA, 25 bp, Rattus norvegicus
tacacggagttacagcacgggtcac

SEQ ID NO: 547529 - DNA, 25 bp, Rattus norvegicus
tacacggagttagagcacgggtcac

SEQ ID NO: 547530 - DNA, 25 bp, Rattus norvegicus
tacacggatgttctccttgtgactg

SEQ ID NO: 547531 - DNA, 25 bp, Rattus norvegicus
tacacggatgttgtccttgtgactg

SEQ ID NO: 547532 - DNA, 25 bp, Rattus norvegicus
tacacggattgacttaaacccaggg

SEQ ID NO: 547533 - DNA, 25 bp, Rattus norvegicus
tacacggattgagttaaacccaggg

SEQ ID NO: 547534 - DNA, 25 bp, Rattus norvegicus
tacacggcaccacaaattacattaa

SEQ ID NO: 547535 - DNA, 25 bp, Rattus norvegicus
tacacggcaccagaaattacattaa

SEQ ID NO: 547536 - DNA, 25 bp, Rattus norvegicus
tacacggcatgtctgagggctcgtc

SEQ ID NO: 547537 - DNA, 25 bp, Rattus norvegicus
tacacggcatgtgtgagggctcgtc

SEQ ID NO: 547538 - DNA, 25 bp, Rattus norvegicus
tacacggccaccaagcagatttttg

SEQ ID NO: 547539 - DNA, 25 bp, Rattus norvegicus
tacacggccacctagcagatttttg

SEQ ID NO: 547540 - DNA, 25 bp, Rattus norvegicus
tacacggcctgtatactttagtatg

SEQ ID NO: 547541 - DNA, 25 bp, Rattus norvegicus
tacacggcctgtttactttagtatg

SEQ ID NO: 547542 - DNA, 25 bp, Rattus norvegicus
tacacgggatggataattacaggac

SEQ ID NO: 547543 - DNA, 25 bp, Rattus norvegicus
tacacgggatggttaattacaggac

SEQ ID NO: 547544 - DNA, 25 bp, Rattus norvegicus
tacacgggcttactcagcatctcac

SEQ ID NO: 547545 - DNA, 25 bp, Rattus norvegicus
tacacgggcttagtcagcatctcac

SEQ ID NO: 547546 - DNA, 25 bp, Rattus norvegicus
tacacggtataaccagctgtgcctt

SEQ ID NO: 547547 - DNA, 25 bp, Rattus norvegicus
tacacggtataagcagctgtgcctt

SEQ ID NO: 547548 - DNA, 25 bp, Rattus norvegicus
tacacggtgcaccatgtggtctgga

SEQ ID NO: 547549 - DNA, 25 bp, Rattus norvegicus
tacacggtgcacgatgtggtctgga

SEQ ID NO: 547550 - DNA, 25 bp, Rattus norvegicus
tacacggtgcatacaaggatggttg

SEQ ID NO: 547551 - DNA, 25 bp, Rattus norvegicus
tacacggtgcattcaaggatggttg

SEQ ID NO: 547552 - DNA, 25 bp, Rattus norvegicus
tacacggtgtgacttcagccagcta

SEQ ID NO: 547553 - DNA, 25 bp, Rattus norvegicus
tacacggtgtgagttcagccagcta

SEQ ID NO: 547554 - DNA, 25 bp, Rattus norvegicus
tacacgtaggaacctctgcagtcac

SEQ ID NO: 547555 - DNA, 25 bp, Rattus norvegicus
tacacgtaggaagctctgcagtcac

SEQ ID NO: 547556 - DNA, 25 bp, Rattus norvegicus
tacacgtcaaacagccactgctaag

SEQ ID NO: 547557 - DNA, 25 bp, Rattus norvegicus
tacacgtcaaactgccactgctaag

SEQ ID NO: 547558 - DNA, 25 bp, Rattus norvegicus
tacacgtcattaacgcctctgatga

SEQ ID NO: 547559 - DNA, 25 bp, Rattus norvegicus
tacacgtcattatcgcctctgatga

SEQ ID NO: 547560 - DNA, 25 bp, Rattus norvegicus
tacacgtcggaccaaaccgtcctgt

SEQ ID NO: 547561 - DNA, 25 bp, Rattus norvegicus
tacacgtcggacgaaaccgtcctgt

SEQ ID NO: 547562 - DNA, 25 bp, Rattus norvegicus
tacacgtctaatacaacttcagttg

SEQ ID NO: 547563 - DNA, 25 bp, Rattus norvegicus
tacacgtctaattcaacttcagttg

SEQ ID NO: 547564 - DNA, 25 bp, Rattus norvegicus
tacacgtgcgtgagtctgttcggtg

SEQ ID NO: 547565 - DNA, 25 bp, Rattus norvegicus
tacacgtgcgtgtgtctgttcggtg

SEQ ID NO: 547566 - DNA, 25 bp, Rattus norvegicus
tacacgtgggttctagatctgctac

SEQ ID NO: 547567 - DNA, 25 bp, Rattus norvegicus
tacacgtgggttgtagatctgctac

SEQ ID NO: 547568 - DNA, 25 bp, Rattus norvegicus
tacacgttcatacctttgcattcaa

SEQ ID NO: 547569 - DNA, 25 bp, Rattus norvegicus
tacacgttcatagctttgcattcaa

SEQ ID NO: 547570 - DNA, 25 bp, Rattus norvegicus
tacacgttcatgacacatttccttc

SEQ ID NO: 547571 - DNA, 25 bp, Rattus norvegicus
tacacgttcatgtcacatttccttc

SEQ ID NO: 547572 - DNA, 25 bp, Rattus norvegicus
tacacgtttcccaaggacgctgaac

SEQ ID NO: 547573 - DNA, 25 bp, Rattus norvegicus
tacacgtttccctaggacgctgaac

SEQ ID NO: 547574 - DNA, 25 bp, Rattus norvegicus
tacactaatgtaacctcttgattaa

SEQ ID NO: 547575 - DNA, 25 bp, Rattus norvegicus
tacactaatgtatcctcttgattaa

SEQ ID NO: 547576 - DNA, 25 bp, Rattus norvegicus
tacactaattctaggtggctgcccc

SEQ ID NO: 547577 - DNA, 25 bp, Rattus norvegicus
tacactaattcttggtggctgcccc

SEQ ID NO: 547578 - DNA, 25 bp, Rattus norvegicus
tacactacacacagcacaatcgagg

SEQ ID NO: 547579 - DNA, 25 bp, Rattus norvegicus
tacactacacactgcacaatcgagg

SEQ ID NO: 547580 - DNA, 25 bp, Rattus norvegicus
tacactacaggtctctcactgagta

SEQ ID NO: 547581 - DNA, 25 bp, Rattus norvegicus
tacactacaggtgtctcactgagta

SEQ ID NO: 547582 - DNA, 25 bp, Rattus norvegicus
tacactacagtcaaggctgaagcca

SEQ ID NO: 547583 - DNA, 25 bp, Rattus norvegicus
tacactacagtctaggctgaagcca

SEQ ID NO: 547584 - DNA, 25 bp, Rattus norvegicus
tacactacattgctgaccgtctgag

SEQ ID NO: 547585 - DNA, 25 bp, Rattus norvegicus
tacactacattggtgaccgtctgag

SEQ ID NO: 547586 - DNA, 25 bp, Rattus norvegicus
tacactacggttaaagacgttgcct

SEQ ID NO: 547587 - DNA, 25 bp, Rattus norvegicus
tacactacggtttaagacgttgcct

SEQ ID NO: 547588 - DNA, 25 bp, Rattus norvegicus
tacactactgataccacagccgtaa

SEQ ID NO: 547589 - DNA, 25 bp, Rattus norvegicus
tacactactgattccacagccgtaa

SEQ ID NO: 547590 - DNA, 25 bp, Rattus norvegicus
tacactagcctaattgggagtcaac

SEQ ID NO: 547591 - DNA, 25 bp, Rattus norvegicus
tacactagcctatttgggagtcaac

SEQ ID NO: 547592 - DNA, 25 bp, Rattus norvegicus
tacactaggtttcgttttgctcctc

SEQ ID NO: 547593 - DNA, 25 bp, Rattus norvegicus
tacactaggtttggttttgctcctc

SEQ ID NO: 547594 - DNA, 25 bp, Rattus norvegicus
tacactatctaccaacaagcctttt

SEQ ID NO: 547595 - DNA, 25 bp, Rattus norvegicus
tacactatctacgaacaagcctttt

SEQ ID NO: 547596 - DNA, 25 bp, Rattus norvegicus
tacactattcaacttgcaggagggt

SEQ ID NO: 547597 - DNA, 25 bp, Rattus norvegicus
tacactattcaagttgcaggagggt

SEQ ID NO: 547598 - DNA, 25 bp, Rattus norvegicus
tacactcaactacagacatgcttgt

SEQ ID NO: 547599 - DNA, 25 bp, Rattus norvegicus
tacactcaactagagacatgcttgt

SEQ ID NO: 547600 - DNA, 25 bp, Rattus norvegicus
tacactcaaggaccaaaggctggtg

SEQ ID NO: 547601 - DNA, 25 bp, Rattus norvegicus
tacactcaaggagcaaaggctggtg

SEQ ID NO: 547602 - DNA, 25 bp, Rattus norvegicus
tacactcaagttctctttgtgcaat

SEQ ID NO: 547603 - DNA, 25 bp, Rattus norvegicus
tacactcaagttgtctttgtgcaat

SEQ ID NO: 547604 - DNA, 25 bp, Rattus norvegicus
tacactcagctactcgatctgcatg

SEQ ID NO: 547605 - DNA, 25 bp, Rattus norvegicus
tacactcagctagtcgatctgcatg

SEQ ID NO: 547606 - DNA, 25 bp, Rattus norvegicus
tacactcaggagagaatgtgaccct

SEQ ID NO: 547607 - DNA, 25 bp, Rattus norvegicus
tacactcaggagtgaatgtgaccct

SEQ ID NO: 547608 - DNA, 25 bp, Rattus norvegicus
tacactcatccaatcacaggtcaga

SEQ ID NO: 547609 - DNA, 25 bp, Rattus norvegicus
tacactcatccattcacaggtcaga

SEQ ID NO: 547610 - DNA, 25 bp, Rattus norvegicus
tacactcatgtcatatctcttctaa

SEQ ID NO: 547611 - DNA, 25 bp, Rattus norvegicus
tacactcatgtcttatctcttctaa

SEQ ID NO: 547612 - DNA, 25 bp, Rattus norvegicus
tacactcatgttcgacacaggcctg

SEQ ID NO: 547613 - DNA, 25 bp, Rattus norvegicus
tacactcatgttggacacaggcctg

SEQ ID NO: 547614 - DNA, 25 bp, Rattus norvegicus
tacactccacttctcagaagcagct

SEQ ID NO: 547615 - DNA, 25 bp, Rattus norvegicus
tacactccacttgtcagaagcagct

SEQ ID NO: 547616 - DNA, 25 bp, Rattus norvegicus
tacactccaggaattgctcagtcac

SEQ ID NO: 547617 - DNA, 25 bp, Rattus norvegicus
tacactccaggatttgctcagtcac

SEQ ID NO: 547618 - DNA, 25 bp, Rattus norvegicus
tacactcctgtaagatagtatatca

SEQ ID NO: 547619 - DNA, 25 bp, Rattus norvegicus
tacactcctgtatgatagtatatca

SEQ ID NO: 547620 - DNA, 25 bp, Rattus norvegicus
tacactcctgtgatgaagttttatt

SEQ ID NO: 547621 - DNA, 25 bp, Rattus norvegicus
tacactcctgtgttgaagttttatt

SEQ ID NO: 547622 - DNA, 25 bp, Rattus norvegicus
tacactcgcaggaacgcagctttga

SEQ ID NO: 547623 - DNA, 25 bp, Rattus norvegicus
tacactcgcaggtacgcagctttga

SEQ ID NO: 547624 - DNA, 25 bp, Rattus norvegicus
tacactcggaggactggttgtgctg

SEQ ID NO: 547625 - DNA, 25 bp, Rattus norvegicus
tacactcggaggtctggttgtgctg

SEQ ID NO: 547626 - DNA, 25 bp, Rattus norvegicus
tacactcgttttctcttgtcagaaa

SEQ ID NO: 547627 - DNA, 25 bp, Rattus norvegicus
tacactcgttttgtcttgtcagaaa

SEQ ID NO: 547628 - DNA, 25 bp, Rattus norvegicus
tacactctatctatagccatttctc

SEQ ID NO: 547629 - DNA, 25 bp, Rattus norvegicus
tacactctatctttagccatttctc

SEQ ID NO: 547630 - DNA, 25 bp, Rattus norvegicus
tacactctgctcaccaagaactatc

SEQ ID NO: 547631 - DNA, 25 bp, Rattus norvegicus
tacactctgctctccaagaactatc

SEQ ID NO: 547632 - DNA, 25 bp, Rattus norvegicus
tacactctggctctcacatagatga

SEQ ID NO: 547633 - DNA, 25 bp, Rattus norvegicus
tacactctggctgtcacatagatga

SEQ ID NO: 547634 - DNA, 25 bp, Rattus norvegicus
tacactcttaagattcctttttcat

SEQ ID NO: 547635 - DNA, 25 bp, Rattus norvegicus
tacactcttaagctgctccttgggt

SEQ ID NO: 547636 - DNA, 25 bp, Rattus norvegicus
tacactcttaaggtgctccttgggt

SEQ ID NO: 547637 - DNA, 25 bp, Rattus norvegicus
tacactcttaagtttcctttttcat

SEQ ID NO: 547638 - DNA, 25 bp, Rattus norvegicus
tacactcttacacctggcacatgtg

SEQ ID NO: 547639 - DNA, 25 bp, Rattus norvegicus
tacactcttacagctggcacatgtg

SEQ ID NO: 547640 - DNA, 25 bp, Rattus norvegicus
tacactcttggacctgcataactgt

SEQ ID NO: 547641 - DNA, 25 bp, Rattus norvegicus
tacactcttggagctgcataactgt

SEQ ID NO: 547642 - DNA, 25 bp, Rattus norvegicus
tacactcttgtgcacctttaacttt

SEQ ID NO: 547643 - DNA, 25 bp, Rattus norvegicus
tacactcttgtggacctttaacttt

SEQ ID NO: 547644 - DNA, 25 bp, Rattus norvegicus
tacactgacacgctactgttggtta

SEQ ID NO: 547645 - DNA, 25 bp, Rattus norvegicus
tacactgacacggtactgttggtta

SEQ ID NO: 547646 - DNA, 25 bp, Rattus norvegicus
tacactgacgtgattttaggccttt

SEQ ID NO: 547647 - DNA, 25 bp, Rattus norvegicus
tacactgacgtgtttttaggccttt

SEQ ID NO: 547648 - DNA, 25 bp, Rattus norvegicus
tacactgactccacatgcttgaatg

SEQ ID NO: 547649 - DNA, 25 bp, Rattus norvegicus
tacactgactcctcatgcttgaatg

SEQ ID NO: 547650 - DNA, 25 bp, Rattus norvegicus
tacactgactctcactgcactggaa

SEQ ID NO: 547651 - DNA, 25 bp, Rattus norvegicus
tacactgactctgactgcactggaa

SEQ ID NO: 547652 - DNA, 25 bp, Rattus norvegicus
tacactgactgcattttccttctgt

SEQ ID NO: 547653 - DNA, 25 bp, Rattus norvegicus
tacactgactgctttttccttctgt

SEQ ID NO: 547654 - DNA, 25 bp, Rattus norvegicus
tacactgaggccatacatctttctt

SEQ ID NO: 547655 - DNA, 25 bp, Rattus norvegicus
tacactgaggccttacatctttctt

SEQ ID NO: 547656 - DNA, 25 bp, Rattus norvegicus
tacactgatatacccaattcgattt

SEQ ID NO: 547657 - DNA, 25 bp, Rattus norvegicus
tacactgatatagccaattcgattt

SEQ ID NO: 547658 - DNA, 25 bp, Rattus norvegicus
tacactgatgtgcacacaggcctgg

SEQ ID NO: 547659 - DNA, 25 bp, Rattus norvegicus
tacactgatgtggacacaggcctgg

SEQ ID NO: 547660 - DNA, 25 bp, Rattus norvegicus
tacactgcatcaaccaggcgaagaa

SEQ ID NO: 547661 - DNA, 25 bp, Rattus norvegicus
tacactgcatcatccaggcgaagaa

SEQ ID NO: 547662 - DNA, 25 bp, Rattus norvegicus
tacactgccactccaggacgctgat

SEQ ID NO: 547663 - DNA, 25 bp, Rattus norvegicus
tacactgccactgcaggacgctgat

SEQ ID NO: 547664 - DNA, 25 bp, Rattus norvegicus
tacactgcctgaaggtcactttgat

SEQ ID NO: 547665 - DNA, 25 bp, Rattus norvegicus
tacactgcctgatggtcactttgat

SEQ ID NO: 547666 - DNA, 25 bp, Rattus norvegicus
tacactgcctggactgaattgggat

SEQ ID NO: 547667 - DNA, 25 bp, Rattus norvegicus
tacactgcctggtctgaattgggat

SEQ ID NO: 547668 - DNA, 25 bp, Rattus norvegicus
tacactgctagcacttgtcactgat

SEQ ID NO: 547669 - DNA, 25 bp, Rattus norvegicus
tacactgctagctcttgtcactgat

SEQ ID NO: 547670 - DNA, 25 bp, Rattus norvegicus
tacactgctctccagaggactgagt

SEQ ID NO: 547671 - DNA, 25 bp, Rattus norvegicus
tacactgctctcgagaggactgagt

SEQ ID NO: 547672 - DNA, 25 bp, Rattus norvegicus
tacactgctggcaattcaagcttat

SEQ ID NO: 547673 - DNA, 25 bp, Rattus norvegicus
tacactgctggctattcaagcttat

SEQ ID NO: 547674 - DNA, 25 bp, Rattus norvegicus
tacactgctgttcacctccaaagga

SEQ ID NO: 547675 - DNA, 25 bp, Rattus norvegicus
tacactgctgttgacctccaaagga

SEQ ID NO: 547676 - DNA, 25 bp, Rattus norvegicus
tacactgcttgtaacttgtgctccc

SEQ ID NO: 547677 - DNA, 25 bp, Rattus norvegicus
tacactgcttgttacttgtgctccc

SEQ ID NO: 547678 - DNA, 25 bp, Rattus norvegicus
tacactggaggcatctatactgagt

SEQ ID NO: 547679 - DNA, 25 bp, Rattus norvegicus
tacactggaggcttctatactgagt

SEQ ID NO: 547680 - DNA, 25 bp, Rattus norvegicus
tacactggatatccactgagtcctg

SEQ ID NO: 547681 - DNA, 25 bp, Rattus norvegicus
tacactggatatgcactgagtcctg

SEQ ID NO: 547682 - DNA, 25 bp, Rattus norvegicus
tacactggccagcaggctgcagaac

SEQ ID NO: 547683 - DNA, 25 bp, Rattus norvegicus
tacactggccaggaggctgcagaac

SEQ ID NO: 547684 - DNA, 25 bp, Rattus norvegicus
tacactggctatatctctactcgag

SEQ ID NO: 547685 - DNA, 25 bp, Rattus norvegicus
tacactggctatttctctactcgag

SEQ ID NO: 547686 - DNA, 25 bp, Rattus norvegicus
tacactggctggaggatggctagca

SEQ ID NO: 547687 - DNA, 25 bp, Rattus norvegicus
tacactggctggtggatggctagca

SEQ ID NO: 547688 - DNA, 25 bp, Rattus norvegicus
tacactggctgtcggcacggttcag

SEQ ID NO: 547689 - DNA, 25 bp, Rattus norvegicus
tacactggctgtgggcacggttcag

SEQ ID NO: 547690 - DNA, 25 bp, Rattus norvegicus
tacactgggaccattgttaagaatc

SEQ ID NO: 547691 - DNA, 25 bp, Rattus norvegicus
tacactgggacctttgttaagaatc

SEQ ID NO: 547692 - DNA, 25 bp, Rattus norvegicus
tacactgggtacactctggagcagc

SEQ ID NO: 547693 - DNA, 25 bp, Rattus norvegicus
tacactgggtactctctggagcagc

SEQ ID NO: 547694 - DNA, 25 bp, Rattus norvegicus
tacactgggtgtatttgtcttcaaa

SEQ ID NO: 547695 - DNA, 25 bp, Rattus norvegicus
tacactgggtgtttttgtcttcaaa

SEQ ID NO: 547696 - DNA, 25 bp, Rattus norvegicus
tacactggtacaacacggccctgga

SEQ ID NO: 547697 - DNA, 25 bp, Rattus norvegicus
tacactggtacatcacggccctgga

SEQ ID NO: 547698 - DNA, 25 bp, Rattus norvegicus
tacactggtactaaaggcttttgga

SEQ ID NO: 547699 - DNA, 25 bp, Rattus norvegicus
tacactggtacttaaggcttttgga

SEQ ID NO: 547700 - DNA, 25 bp, Rattus norvegicus
tacactgtaattcgttgtctccata

SEQ ID NO: 547701 - DNA, 25 bp, Rattus norvegicus
tacactgtaattggttgtctccata

SEQ ID NO: 547702 - DNA, 25 bp, Rattus norvegicus
tacactgtacggagtgtgcctgaca

SEQ ID NO: 547703 - DNA, 25 bp, Rattus norvegicus
tacactgtacggtgtgtgcctgaca

SEQ ID NO: 547704 - DNA, 25 bp, Rattus norvegicus
tacactgtcactatactgagctctg

SEQ ID NO: 547705 - DNA, 25 bp, Rattus norvegicus
tacactgtcactttactgagctctg

SEQ ID NO: 547706 - DNA, 25 bp, Rattus norvegicus
tacactgtcatgatgtctctttata

SEQ ID NO: 547707 - DNA, 25 bp, Rattus norvegicus
tacactgtcatgttgtctctttata

SEQ ID NO: 547708 - DNA, 25 bp, Rattus norvegicus
tacactgtccttaagcctagttgga

SEQ ID NO: 547709 - DNA, 25 bp, Rattus norvegicus
tacactgtccttctcgatggctgct

SEQ ID NO: 547710 - DNA, 25 bp, Rattus norvegicus
tacactgtccttgtcgatggctgct

SEQ ID NO: 547711 - DNA, 25 bp, Rattus norvegicus
tacactgtcctttagcctagttgga

SEQ ID NO: 547712 - DNA, 25 bp, Rattus norvegicus
tacactgtctacaaagatgaagcac

SEQ ID NO: 547713 - DNA, 25 bp, Rattus norvegicus
tacactgtctactaagatgaagcac

SEQ ID NO: 547714 - DNA, 25 bp, Rattus norvegicus
tacactgtctgtccctaaacatggg

SEQ ID NO: 547715 - DNA, 25 bp, Rattus norvegicus
tacactgtctgtgcctaaacatggg

SEQ ID NO: 547716 - DNA, 25 bp, Rattus norvegicus
tacactgtgcacaagcgctactact

SEQ ID NO: 547717 - DNA, 25 bp, Rattus norvegicus
tacactgtgcactagcgctactact

SEQ ID NO: 547718 - DNA, 25 bp, Rattus norvegicus
tacactgtgcagataggattcaact

SEQ ID NO: 547719 - DNA, 25 bp, Rattus norvegicus
tacactgtgcagttaggattcaact

SEQ ID NO: 547720 - DNA, 25 bp, Rattus norvegicus
tacactgtgccccagagatcgaaaa

SEQ ID NO: 547721 - DNA, 25 bp, Rattus norvegicus
tacactgtgcccgagagatcgaaaa

SEQ ID NO: 547722 - DNA, 25 bp, Rattus norvegicus
tacactgtgcttatgttgtttctaa

SEQ ID NO: 547723 - DNA, 25 bp, Rattus norvegicus
tacactgtgcttcatgagtaggact

SEQ ID NO: 547724 - DNA, 25 bp, Rattus norvegicus
tacactgtgcttcgaactccacaac

SEQ ID NO: 547725 - DNA, 25 bp, Rattus norvegicus
tacactgtgcttgatgagtaggact

SEQ ID NO: 547726 - DNA, 25 bp, Rattus norvegicus
tacactgtgcttggaactccacaac

SEQ ID NO: 547727 - DNA, 25 bp, Rattus norvegicus
tacactgtgcttttgttgtttctaa

SEQ ID NO: 547728 - DNA, 25 bp, Rattus norvegicus
tacactgtggaacgtaccaccccta

SEQ ID NO: 547729 - DNA, 25 bp, Rattus norvegicus
tacactgtggaaggtaccaccccta

SEQ ID NO: 547730 - DNA, 25 bp, Rattus norvegicus
tacactgtgggcaccagcattacta

SEQ ID NO: 547731 - DNA, 25 bp, Rattus norvegicus
tacactgtgggctccagcattacta

SEQ ID NO: 547732 - DNA, 25 bp, Rattus norvegicus
tacactgtggtcataggaggctcct

SEQ ID NO: 547733 - DNA, 25 bp, Rattus norvegicus
tacactgtggtcttaggaggctcct

SEQ ID NO: 547734 - DNA, 25 bp, Rattus norvegicus
tacactgtgtgcaggtgacgaaccc

SEQ ID NO: 547735 - DNA, 25 bp, Rattus norvegicus
tacactgtgtgctggtgacgaaccc

SEQ ID NO: 547736 - DNA, 25 bp, Rattus norvegicus
tacactgttatgatggagtctccaa

SEQ ID NO: 547737 - DNA, 25 bp, Rattus norvegicus
tacactgttatgttggagtctccaa

SEQ ID NO: 547738 - DNA, 25 bp, Rattus norvegicus
tacactgttcttagtcatcgtccca

SEQ ID NO: 547739 - DNA, 25 bp, Rattus norvegicus
tacactgttctttgtcatcgtccca

SEQ ID NO: 547740 - DNA, 25 bp, Rattus norvegicus
tacactgtttctacgctgtacgtaa

SEQ ID NO: 547741 - DNA, 25 bp, Rattus norvegicus
tacactgtttcttcgctgtacgtaa

SEQ ID NO: 547742 - DNA, 25 bp, Rattus norvegicus
tacactgtttgcctgtgtctcagac

SEQ ID NO: 547743 - DNA, 25 bp, Rattus norvegicus
tacactgtttgcgtgtgtctcagac

SEQ ID NO: 547744 - DNA, 25 bp, Rattus norvegicus
tacacttaacccctgcacttgggag

SEQ ID NO: 547745 - DNA, 25 bp, Rattus norvegicus
tacacttaacccgtgcacttgggag

SEQ ID NO: 547746 - DNA, 25 bp, Rattus norvegicus
tacacttactgtcctctgagggcag

SEQ ID NO: 547747 - DNA, 25 bp, Rattus norvegicus
tacacttactgtgctctgagggcag

SEQ ID NO: 547748 - DNA, 25 bp, Rattus norvegicus
tacacttagctaaaggagccttgaa

SEQ ID NO: 547749 - DNA, 25 bp, Rattus norvegicus
tacacttagctataggagccttgaa

SEQ ID NO: 547750 - DNA, 25 bp, Rattus norvegicus
tacacttcatggctagcattgtgat

SEQ ID NO: 547751 - DNA, 25 bp, Rattus norvegicus
tacacttcatgggtagcattgtgat

SEQ ID NO: 547752 - DNA, 25 bp, Rattus norvegicus
tacacttccactaagaccagaggaa

SEQ ID NO: 547753 - DNA, 25 bp, Rattus norvegicus
tacacttccacttagaccagaggaa

SEQ ID NO: 547754 - DNA, 25 bp, Rattus norvegicus
tacacttcctgtccttttgcctact

SEQ ID NO: 547755 - DNA, 25 bp, Rattus norvegicus
tacacttcctgtgcttttgcctact

SEQ ID NO: 547756 - DNA, 25 bp, Rattus norvegicus
tacacttcggagaatgccatctatg

SEQ ID NO: 547757 - DNA, 25 bp, Rattus norvegicus
tacacttcggagtatgccatctatg

SEQ ID NO: 547758 - DNA, 25 bp, Rattus norvegicus
tacacttcggttactttcttgttct

SEQ ID NO: 547759 - DNA, 25 bp, Rattus norvegicus
tacacttcggtttctttcttgttct

SEQ ID NO: 547760 - DNA, 25 bp, Rattus norvegicus
tacacttctagaatctcccaagtca

SEQ ID NO: 547761 - DNA, 25 bp, Rattus norvegicus
tacacttctagattctcccaagtca

SEQ ID NO: 547762 - DNA, 25 bp, Rattus norvegicus
tacacttctcgactgttttcatgca

SEQ ID NO: 547763 - DNA, 25 bp, Rattus norvegicus
tacacttctcgagtgttttcatgca

SEQ ID NO: 547764 - DNA, 25 bp, Rattus norvegicus
tacacttctgctataatgtgaacat

SEQ ID NO: 547765 - DNA, 25 bp, Rattus norvegicus
tacacttctgctttaatgtgaacat

SEQ ID NO: 547766 - DNA, 25 bp, Rattus norvegicus
tacacttctggaaatctaccctatg

SEQ ID NO: 547767 - DNA, 25 bp, Rattus norvegicus
tacacttctggatatctaccctatg

SEQ ID NO: 547768 - DNA, 25 bp, Rattus norvegicus
tacacttctgttcaataccccttac

SEQ ID NO: 547769 - DNA, 25 bp, Rattus norvegicus
tacacttctgttgaataccccttac

SEQ ID NO: 547770 - DNA, 25 bp, Rattus norvegicus
tacacttgagcccattcttcagatt

SEQ ID NO: 547771 - DNA, 25 bp, Rattus norvegicus
tacacttgagccgattcttcagatt

SEQ ID NO: 547772 - DNA, 25 bp, Rattus norvegicus
tacacttgcactctccagaattctt

SEQ ID NO: 547773 - DNA, 25 bp, Rattus norvegicus
tacacttgcactgtccagaattctt

SEQ ID NO: 547774 - DNA, 25 bp, Rattus norvegicus
tacacttggcctaatgtacacagcc

SEQ ID NO: 547775 - DNA, 25 bp, Rattus norvegicus
tacacttggccttatgtacacagcc

SEQ ID NO: 547776 - DNA, 25 bp, Rattus norvegicus
tacacttggtaaagtccttttgaca

SEQ ID NO: 547777 - DNA, 25 bp, Rattus norvegicus
tacacttggtaatgtccttttgaca

SEQ ID NO: 547778 - DNA, 25 bp, Rattus norvegicus
tacacttggtctccatcttggtgag

SEQ ID NO: 547779 - DNA, 25 bp, Rattus norvegicus
tacacttggtctgcatcttggtgag

SEQ ID NO: 547780 - DNA, 25 bp, Rattus norvegicus
tacacttgtcatcagtcctatacag

SEQ ID NO: 547781 - DNA, 25 bp, Rattus norvegicus
tacacttgtcatgagtcctatacag

SEQ ID NO: 547782 - DNA, 25 bp, Rattus norvegicus
tacacttgtgtgctggcttcatagt

SEQ ID NO: 547783 - DNA, 25 bp, Rattus norvegicus
tacacttgtgtggtggcttcatagt

SEQ ID NO: 547784 - DNA, 25 bp, Rattus norvegicus
tacacttgtttaagctgtgagccaa

SEQ ID NO: 547785 - DNA, 25 bp, Rattus norvegicus
tacacttgtttatgctgtgagccaa

SEQ ID NO: 547786 - DNA, 25 bp, Rattus norvegicus
tacacttgttttatcattgcccata

SEQ ID NO: 547787 - DNA, 25 bp, Rattus norvegicus
tacacttgttttttcattgcccata

SEQ ID NO: 547788 - DNA, 25 bp, Rattus norvegicus
tacactttcatgctatttgtggaaa

SEQ ID NO: 547789 - DNA, 25 bp, Rattus norvegicus
tacactttcatggtatttgtggaaa

SEQ ID NO: 547790 - DNA, 25 bp, Rattus norvegicus
tacactttctgccagtttattccca

SEQ ID NO: 547791 - DNA, 25 bp, Rattus norvegicus
tacactttctgcgagtttattccca

SEQ ID NO: 547792 - DNA, 25 bp, Rattus norvegicus
tacacttttgatatttccttccaat

SEQ ID NO: 547793 - DNA, 25 bp, Rattus norvegicus
tacacttttgatttttccttccaat

SEQ ID NO: 547794 - DNA, 25 bp, Rattus norvegicus
tacacttttggaatgactcgtttta

SEQ ID NO: 547795 - DNA, 25 bp, Rattus norvegicus
tacacttttggattgactcgtttta

SEQ ID NO: 547796 - DNA, 25 bp, Rattus norvegicus
tacagaaacatgctggtccgggcct

SEQ ID NO: 547797 - DNA, 25 bp, Rattus norvegicus
tacagaaacatggtggtccgggcct

SEQ ID NO: 547798 - DNA, 25 bp, Rattus norvegicus
tacagaaacttcaagggccacacat

SEQ ID NO: 547799 - DNA, 25 bp, Rattus norvegicus
tacagaaacttctagggccacacat

SEQ ID NO: 547800 - DNA, 25 bp, Rattus norvegicus
tacagaaatgggactctccttccat

SEQ ID NO: 547801 - DNA, 25 bp, Rattus norvegicus
tacagaaatgggtctctccttccat

SEQ ID NO: 547802 - DNA, 25 bp, Rattus norvegicus
tacagaacaaaaactgccacctttt

SEQ ID NO: 547803 - DNA, 25 bp, Rattus norvegicus
tacagaacaaaatctgccacctttt

SEQ ID NO: 547804 - DNA, 25 bp, Rattus norvegicus
tacagaacagctccttgtgctcatc

SEQ ID NO: 547805 - DNA, 25 bp, Rattus norvegicus
tacagaacagctgcttgtgctcatc

SEQ ID NO: 547806 - DNA, 25 bp, Rattus norvegicus
tacagaacatctcctctggccagag

SEQ ID NO: 547807 - DNA, 25 bp, Rattus norvegicus
tacagaacatctgctctggccagag

SEQ ID NO: 547808 - DNA, 25 bp, Rattus norvegicus
tacagaactgtgaccctggcaactc

SEQ ID NO: 547809 - DNA, 25 bp, Rattus norvegicus
tacagaactgtgtccctggcaactc

SEQ ID NO: 547810 - DNA, 25 bp, Rattus norvegicus
tacagaagatctaagcccacagcac

SEQ ID NO: 547811 - DNA, 25 bp, Rattus norvegicus
tacagaagatcttagcccacagcac

SEQ ID NO: 547812 - DNA, 25 bp, Rattus norvegicus
tacagaagcaggaacccaggaggtc

SEQ ID NO: 547813 - DNA, 25 bp, Rattus norvegicus
tacagaagcaggagtggccgcgtcc

SEQ ID NO: 547814 - DNA, 25 bp, Rattus norvegicus
tacagaagcaggtacccaggaggtc

SEQ ID NO: 547815 - DNA, 25 bp, Rattus norvegicus
tacagaagcaggtgtggccgcgtcc

SEQ ID NO: 547816 - DNA, 25 bp, Rattus norvegicus
tacagaagctaacctgggcgtcagt

SEQ ID NO: 547817 - DNA, 25 bp, Rattus norvegicus
tacagaagctaagctgggcgtcagt

SEQ ID NO: 547818 - DNA, 25 bp, Rattus norvegicus
tacagaagctctcacctggttgaag

SEQ ID NO: 547819 - DNA, 25 bp, Rattus norvegicus
tacagaagctctgacctggttgaag

SEQ ID NO: 547820 - DNA, 25 bp, Rattus norvegicus
tacagaaggcagctactccagcaag

SEQ ID NO: 547821 - DNA, 25 bp, Rattus norvegicus
tacagaaggcaggtactccagcaag

SEQ ID NO: 547822 - DNA, 25 bp, Rattus norvegicus
tacagaatgaccaagagccgcctct

SEQ ID NO: 547823 - DNA, 25 bp, Rattus norvegicus
tacagaatgacctagagccgcctct

SEQ ID NO: 547824 - DNA, 25 bp, Rattus norvegicus
tacagaatgttcctgtcccgtggga

SEQ ID NO: 547825 - DNA, 25 bp, Rattus norvegicus
tacagaatgttcgtgtcccgtggga

SEQ ID NO: 547826 - DNA, 25 bp, Rattus norvegicus
tacagaatttttcagccgatacccc

SEQ ID NO: 547827 - DNA, 25 bp, Rattus norvegicus
tacagaatttttgagccgatacccc

SEQ ID NO: 547828 - DNA, 25 bp, Rattus norvegicus
tacagacacttcacatggctcattt

SEQ ID NO: 547829 - DNA, 25 bp, Rattus norvegicus
tacagacacttctcatggctcattt

SEQ ID NO: 547830 - DNA, 25 bp, Rattus norvegicus
tacagacagatgacaccattgatgt

SEQ ID NO: 547831 - DNA, 25 bp, Rattus norvegicus
tacagacagatgtcaccattgatgt

SEQ ID NO: 547832 - DNA, 25 bp, Rattus norvegicus
tacagacagctgaaacttgccaggg

SEQ ID NO: 547833 - DNA, 25 bp, Rattus norvegicus
tacagacagctgagtgtcaggcact

SEQ ID NO: 547834 - DNA, 25 bp, Rattus norvegicus
tacagacagctgtaacttgccaggg

SEQ ID NO: 547835 - DNA, 25 bp, Rattus norvegicus
tacagacagctgtgtgtcaggcact

SEQ ID NO: 547836 - DNA, 25 bp, Rattus norvegicus
tacagacagttgatagccgctagta

SEQ ID NO: 547837 - DNA, 25 bp, Rattus norvegicus
tacagacagttgttagccgctagta

SEQ ID NO: 547838 - DNA, 25 bp, Rattus norvegicus
tacagacattacactatccagaaaa

SEQ ID NO: 547839 - DNA, 25 bp, Rattus norvegicus
tacagacattactctatccagaaaa

SEQ ID NO: 547840 - DNA, 25 bp, Rattus norvegicus
tacagacatttaagtgacccctgcc

SEQ ID NO: 547841 - DNA, 25 bp, Rattus norvegicus
tacagacatttatgtgacccctgcc

SEQ ID NO: 547842 - DNA, 25 bp, Rattus norvegicus
tacagaccagcaaagccagttccta

SEQ ID NO: 547843 - DNA, 25 bp, Rattus norvegicus
tacagaccagcatagccagttccta

SEQ ID NO: 547844 - DNA, 25 bp, Rattus norvegicus
tacagaccaggtagctagactctag

SEQ ID NO: 547845 - DNA, 25 bp, Rattus norvegicus
tacagaccaggttgctagactctag

SEQ ID NO: 547846 - DNA, 25 bp, Rattus norvegicus
tacagaccagtcaggcagggctaca

SEQ ID NO: 547847 - DNA, 25 bp, Rattus norvegicus
tacagaccagtctggcagggctaca

SEQ ID NO: 547848 - DNA, 25 bp, Rattus norvegicus
tacagacccagtaaagccatgagat

SEQ ID NO: 547849 - DNA, 25 bp, Rattus norvegicus
tacagacccagttaagccatgagat

SEQ ID NO: 547850 - DNA, 25 bp, Rattus norvegicus
tacagaccctggacagatgcaggcc

SEQ ID NO: 547851 - DNA, 25 bp, Rattus norvegicus
tacagaccctggtcagatgcaggcc

SEQ ID NO: 547852 - DNA, 25 bp, Rattus norvegicus
tacagacctactacacagggactgc

SEQ ID NO: 547853 - DNA, 25 bp, Rattus norvegicus
tacagacctacttcacagggactgc

SEQ ID NO: 547854 - DNA, 25 bp, Rattus norvegicus
tacagacctctactgcacgtggttt

SEQ ID NO: 547855 - DNA, 25 bp, Rattus norvegicus
tacagacctctagtgcacgtggttt

SEQ ID NO: 547856 - DNA, 25 bp, Rattus norvegicus
tacagacctcttaatgatgtgcaca

SEQ ID NO: 547857 - DNA, 25 bp, Rattus norvegicus
tacagacctctttatgatgtgcaca

SEQ ID NO: 547858 - DNA, 25 bp, Rattus norvegicus
tacagacctgtgctaaggcttacat

SEQ ID NO: 547859 - DNA, 25 bp, Rattus norvegicus
tacagacctgtggtaaggcttacat

SEQ ID NO: 547860 - DNA, 25 bp, Rattus norvegicus
tacagacctgttcggtcgacgacaa

SEQ ID NO: 547861 - DNA, 25 bp, Rattus norvegicus
tacagacctgttgggtcgacgacaa

SEQ ID NO: 547862 - DNA, 25 bp, Rattus norvegicus
tacagacgagtgacccttaagccga

SEQ ID NO: 547863 - DNA, 25 bp, Rattus norvegicus
tacagacgagtgtcccttaagccga

SEQ ID NO: 547864 - DNA, 25 bp, Rattus norvegicus
tacagacgctggcagactttccgct

SEQ ID NO: 547865 - DNA, 25 bp, Rattus norvegicus
tacagacgctgggagactttccgct

SEQ ID NO: 547866 - DNA, 25 bp, Rattus norvegicus
tacagacggagcagccgcaatcatg

SEQ ID NO: 547867 - DNA, 25 bp, Rattus norvegicus
tacagacggagctgccgcaatcatg

SEQ ID NO: 547868 - DNA, 25 bp, Rattus norvegicus
tacagacggtccagcttcagtgttg

SEQ ID NO: 547869 - DNA, 25 bp, Rattus norvegicus
tacagacggtcctgcttcagtgttg

SEQ ID NO: 547870 - DNA, 25 bp, Rattus norvegicus
tacagactaaagagggctgccatgt

SEQ ID NO: 547871 - DNA, 25 bp, Rattus norvegicus
tacagactaaagtgggctgccatgt

SEQ ID NO: 547872 - DNA, 25 bp, Rattus norvegicus
tacagactatgccagctacacacaa

SEQ ID NO: 547873 - DNA, 25 bp, Rattus norvegicus
tacagactatgcgagctacacacaa

SEQ ID NO: 547874 - DNA, 25 bp, Rattus norvegicus
tacagactcttaacaaacctcagga

SEQ ID NO: 547875 - DNA, 25 bp, Rattus norvegicus
tacagactcttatcaaacctcagga

SEQ ID NO: 547876 - DNA, 25 bp, Rattus norvegicus
tacagactgaagattcgcttcggat

SEQ ID NO: 547877 - DNA, 25 bp, Rattus norvegicus
tacagactgaagtttcgcttcggat

SEQ ID NO: 547878 - DNA, 25 bp, Rattus norvegicus
tacagactgcaaacaaaagcaaaca

SEQ ID NO: 547879 - DNA, 25 bp, Rattus norvegicus
tacagactgcaatcaaaagcaaaca

SEQ ID NO: 547880 - DNA, 25 bp, Rattus norvegicus
tacagactgcgtatttacctcgttg

SEQ ID NO: 547881 - DNA, 25 bp, Rattus norvegicus
tacagactgcgtttttacctcgttg

SEQ ID NO: 547882 - DNA, 25 bp, Rattus norvegicus
tacagactgtccatggctcccggag

SEQ ID NO: 547883 - DNA, 25 bp, Rattus norvegicus
tacagactgtccttggctcccggag

SEQ ID NO: 547884 - DNA, 25 bp, Rattus norvegicus
tacagactgtgtactgctgagccct

SEQ ID NO: 547885 - DNA, 25 bp, Rattus norvegicus
tacagactgtgtctgagctaggaat

SEQ ID NO: 547886 - DNA, 25 bp, Rattus norvegicus
tacagactgtgtgtgagctaggaat

SEQ ID NO: 547887 - DNA, 25 bp, Rattus norvegicus
tacagactgtgttctgctgagccct

SEQ ID NO: 547888 - DNA, 25 bp, Rattus norvegicus
tacagacttaaacacccagggcccg

SEQ ID NO: 547889 - DNA, 25 bp, Rattus norvegicus
tacagacttaaagacccagggcccg

SEQ ID NO: 547890 - DNA, 25 bp, Rattus norvegicus
tacagacttaagctcactccaggtt

SEQ ID NO: 547891 - DNA, 25 bp, Rattus norvegicus
tacagacttaaggtcactccaggtt

SEQ ID NO: 547892 - DNA, 25 bp, Rattus norvegicus
tacagacttgccctgacactcagag

SEQ ID NO: 547893 - DNA, 25 bp, Rattus norvegicus
tacagacttgccgtgacactcagag

SEQ ID NO: 547894 - DNA, 25 bp, Rattus norvegicus
tacagacttgtaaacccaggacagg

SEQ ID NO: 547895 - DNA, 25 bp, Rattus norvegicus
tacagacttgtatacccaggacagg

SEQ ID NO: 547896 - DNA, 25 bp, Rattus norvegicus
tacagagaaaccagcttccttcaga

SEQ ID NO: 547897 - DNA, 25 bp, Rattus norvegicus
tacagagaaacctgcttccttcaga

SEQ ID NO: 547898 - DNA, 25 bp, Rattus norvegicus
tacagagaagcacgcgcacacacgc

SEQ ID NO: 547899 - DNA, 25 bp, Rattus norvegicus
tacagagaagcaggcgcacacacgc

SEQ ID NO: 547900 - DNA, 25 bp, Rattus norvegicus
tacagagacttcacctacagaacgg

SEQ ID NO: 547901 - DNA, 25 bp, Rattus norvegicus
tacagagacttctcctacagaacgg

SEQ ID NO: 547902 - DNA, 25 bp, Rattus norvegicus
tacagagagacaacttcacgcccaa

SEQ ID NO: 547903 - DNA, 25 bp, Rattus norvegicus
tacagagagacatcttcacgcccaa

SEQ ID NO: 547904 - DNA, 25 bp, Rattus norvegicus
tacagagagattcccgtccttcaag

SEQ ID NO: 547905 - DNA, 25 bp, Rattus norvegicus
tacagagagattgccgtccttcaag

SEQ ID NO: 547906 - DNA, 25 bp, Rattus norvegicus
tacagagagctgacttcaggcagct

SEQ ID NO: 547907 - DNA, 25 bp, Rattus norvegicus
tacagagagctgtcttcaggcagct

SEQ ID NO: 547908 - DNA, 25 bp, Rattus norvegicus
tacagagatccaagcgtttatttta

SEQ ID NO: 547909 - DNA, 25 bp, Rattus norvegicus
tacagagatccatgcgtttatttta

SEQ ID NO: 547910 - DNA, 25 bp, Rattus norvegicus
tacagagcaagaagtgcccgccaat

SEQ ID NO: 547911 - DNA, 25 bp, Rattus norvegicus
tacagagcaagatgtgcccgccaat

SEQ ID NO: 547912 - DNA, 25 bp, Rattus norvegicus
tacagagccagaaatcactgccctt

SEQ ID NO: 547913 - DNA, 25 bp, Rattus norvegicus
tacagagccagatatcactgccctt

SEQ ID NO: 547914 - DNA, 25 bp, Rattus norvegicus
tacagagccagtcaccgctggtaga

SEQ ID NO: 547915 - DNA, 25 bp, Rattus norvegicus
tacagagccagtcatggagccacat

SEQ ID NO: 547916 - DNA, 25 bp, Rattus norvegicus
tacagagccagtgaccgctggtaga

SEQ ID NO: 547917 - DNA, 25 bp, Rattus norvegicus
tacagagccagtgatggagccacat

SEQ ID NO: 547918 - DNA, 25 bp, Rattus norvegicus
tacagagcccaccttatacacgtct

SEQ ID NO: 547919 - DNA, 25 bp, Rattus norvegicus
tacagagcccacgttatacacgtct

SEQ ID NO: 547920 - DNA, 25 bp, Rattus norvegicus
tacagagccccgaggtgttttggaa

SEQ ID NO: 547921 - DNA, 25 bp, Rattus norvegicus
tacagagccccgtggtgttttggaa

SEQ ID NO: 547922 - DNA, 25 bp, Rattus norvegicus
tacagagctacaagatccttgggtt

SEQ ID NO: 547923 - DNA, 25 bp, Rattus norvegicus
tacagagctacatgatccttgggtt

SEQ ID NO: 547924 - DNA, 25 bp, Rattus norvegicus
tacagagctcggacttcgcattggg

SEQ ID NO: 547925 - DNA, 25 bp, Rattus norvegicus
tacagagctcggtcttcgcattggg

SEQ ID NO: 547926 - DNA, 25 bp, Rattus norvegicus
tacagagctctgaggatgctccctt

SEQ ID NO: 547927 - DNA, 25 bp, Rattus norvegicus
tacagagctctgtggatgctccctt

SEQ ID NO: 547928 - DNA, 25 bp, Rattus norvegicus
tacagagctggcactggtctaatcc

SEQ ID NO: 547929 - DNA, 25 bp, Rattus norvegicus
tacagagctggctctggtctaatcc

SEQ ID NO: 547930 - DNA, 25 bp, Rattus norvegicus
tacagagcttcaccgctgggcagga

SEQ ID NO: 547931 - DNA, 25 bp, Rattus norvegicus
tacagagcttcagcgctgggcagga

SEQ ID NO: 547932 - DNA, 25 bp, Rattus norvegicus
tacagaggaaaaatcttggcctgat

SEQ ID NO: 547933 - DNA, 25 bp, Rattus norvegicus
tacagaggaaaattcttggcctgat

SEQ ID NO: 547934 - DNA, 25 bp, Rattus norvegicus
tacagaggaactcaaggcacagggc

SEQ ID NO: 547935 - DNA, 25 bp, Rattus norvegicus
tacagaggaactgaaggcacagggc

SEQ ID NO: 547936 - DNA, 25 bp, Rattus norvegicus
tacagaggacatcgtgcggcttcga

SEQ ID NO: 547937 - DNA, 25 bp, Rattus norvegicus
tacagaggacatggtgcggcttcga

SEQ ID NO: 547938 - DNA, 25 bp, Rattus norvegicus
tacagaggagagctttcaccccaga

SEQ ID NO: 547939 - DNA, 25 bp, Rattus norvegicus
tacagaggagaggtttcaccccaga

SEQ ID NO: 547940 - DNA, 25 bp, Rattus norvegicus
tacagaggatgtacgctgccttccc

SEQ ID NO: 547941 - DNA, 25 bp, Rattus norvegicus
tacagaggatgttcgctgccttccc

SEQ ID NO: 547942 - DNA, 25 bp, Rattus norvegicus
tacagaggccagacagcccagactc

SEQ ID NO: 547943 - DNA, 25 bp, Rattus norvegicus
tacagaggccagtcagcccagactc

SEQ ID NO: 547944 - DNA, 25 bp, Rattus norvegicus
tacagaggctacattggccacaagc

SEQ ID NO: 547945 - DNA, 25 bp, Rattus norvegicus
tacagaggctactttggccacaagc

SEQ ID NO: 547946 - DNA, 25 bp, Rattus norvegicus
tacagagggatcctttctcggctat

SEQ ID NO: 547947 - DNA, 25 bp, Rattus norvegicus
tacagagggatcgtttctcggctat

SEQ ID NO: 547948 - DNA, 25 bp, Rattus norvegicus
tacagagggtgcaggctctccacta

SEQ ID NO: 547949 - DNA, 25 bp, Rattus norvegicus
tacagagggtgctggctctccacta

SEQ ID NO: 547950 - DNA, 25 bp, Rattus norvegicus
tacagaggtctcagccggctctttc

SEQ ID NO: 547951 - DNA, 25 bp, Rattus norvegicus
tacagaggtctctgccggctctttc

SEQ ID NO: 547952 - DNA, 25 bp, Rattus norvegicus
tacagaggtggaatgccccagggaa

SEQ ID NO: 547953 - DNA, 25 bp, Rattus norvegicus
tacagaggtggattgccccagggaa

SEQ ID NO: 547954 - DNA, 25 bp, Rattus norvegicus
tacagaggtggccattttctctctt

SEQ ID NO: 547955 - DNA, 25 bp, Rattus norvegicus
tacagaggtggcgattttctctctt

SEQ ID NO: 547956 - DNA, 25 bp, Rattus norvegicus
tacagagtaggtcgacagtcattgc

SEQ ID NO: 547957 - DNA, 25 bp, Rattus norvegicus
tacagagtaggtggacagtcattgc

SEQ ID NO: 547958 - DNA, 25 bp, Rattus norvegicus
tacagagtcccgcaactgaacctag

SEQ ID NO: 547959 - DNA, 25 bp, Rattus norvegicus
tacagagtcccggaactgaacctag

SEQ ID NO: 547960 - DNA, 25 bp, Rattus norvegicus
tacagagtcgtaaggcacacaacat

SEQ ID NO: 547961 - DNA, 25 bp, Rattus norvegicus
tacagagtcgtatggcacacaacat

SEQ ID NO: 547962 - DNA, 25 bp, Rattus norvegicus
tacagagtgaacctggccagcagaa

SEQ ID NO: 547963 - DNA, 25 bp, Rattus norvegicus
tacagagtgaacgtggccagcagaa

SEQ ID NO: 547964 - DNA, 25 bp, Rattus norvegicus
tacagagtgagcagcatcccgggct

SEQ ID NO: 547965 - DNA, 25 bp, Rattus norvegicus
tacagagtgagctgcatcccgggct

SEQ ID NO: 547966 - DNA, 25 bp, Rattus norvegicus
tacagagtgagtactgggacagcca

SEQ ID NO: 547967 - DNA, 25 bp, Rattus norvegicus
tacagagtgagttctgggacagcca

SEQ ID NO: 547968 - DNA, 25 bp, Rattus norvegicus
tacagagtgatacagtgcctgcctg

SEQ ID NO: 547969 - DNA, 25 bp, Rattus norvegicus
tacagagtgatagagtgcctgcctg

SEQ ID NO: 547970 - DNA, 25 bp, Rattus norvegicus
tacagagtgcttaggtagcctccat

SEQ ID NO: 547971 - DNA, 25 bp, Rattus norvegicus
tacagagtgctttggtagcctccat

SEQ ID NO: 547972 - DNA, 25 bp, Rattus norvegicus
tacagagttagtactttccgtccac

SEQ ID NO: 547973 - DNA, 25 bp, Rattus norvegicus
tacagagttagttctttccgtccac

SEQ ID NO: 547974 - DNA, 25 bp, Rattus norvegicus
tacagagttgccagtttgcacctgc

SEQ ID NO: 547975 - DNA, 25 bp, Rattus norvegicus
tacagagttgcctgtttgcacctgc

SEQ ID NO: 547976 - DNA, 25 bp, Rattus norvegicus
tacagagtttcacaccagcttggac

SEQ ID NO: 547977 - DNA, 25 bp, Rattus norvegicus
tacagagtttcagaccagcttggac

SEQ ID NO: 547978 - DNA, 25 bp, Rattus norvegicus
tacagagttttaacttccccaggaa

SEQ ID NO: 547979 - DNA, 25 bp, Rattus norvegicus
tacagagttttatcttccccaggaa

SEQ ID NO: 547980 - DNA, 25 bp, Rattus norvegicus
tacagataaactctcaccgtttctg

SEQ ID NO: 547981 - DNA, 25 bp, Rattus norvegicus
tacagataaactgtcaccgtttctg

SEQ ID NO: 547982 - DNA, 25 bp, Rattus norvegicus
tacagatacctgaacgtcagcatcg

SEQ ID NO: 547983 - DNA, 25 bp, Rattus norvegicus
tacagatacctgtacgtcagcatcg

SEQ ID NO: 547984 - DNA, 25 bp, Rattus norvegicus
tacagatatgctcagccagcagcag

SEQ ID NO: 547985 - DNA, 25 bp, Rattus norvegicus
tacagatatgctgagccagcagcag

SEQ ID NO: 547986 - DNA, 25 bp, Rattus norvegicus
tacagatcgctgaagtgccttggac

SEQ ID NO: 547987 - DNA, 25 bp, Rattus norvegicus
tacagatcgctgtagtgccttggac

SEQ ID NO: 547988 - DNA, 25 bp, Rattus norvegicus
tacagatcgcttaatctctaaaaga

SEQ ID NO: 547989 - DNA, 25 bp, Rattus norvegicus
tacagatcgcttagtctctcgtaat

SEQ ID NO: 547990 - DNA, 25 bp, Rattus norvegicus
tacagatcgctttatctctaaaaga

SEQ ID NO: 547991 - DNA, 25 bp, Rattus norvegicus
tacagatcgctttgtctctcgtaat

SEQ ID NO: 547992 - DNA, 25 bp, Rattus norvegicus
tacagatctgctagggcctttgcaa

SEQ ID NO: 547993 - DNA, 25 bp, Rattus norvegicus
tacagatctgcttgggcctttgcaa

SEQ ID NO: 547994 - DNA, 25 bp, Rattus norvegicus
tacagatcttcccactgagcccgga

SEQ ID NO: 547995 - DNA, 25 bp, Rattus norvegicus
tacagatcttccgactgagcccgga

SEQ ID NO: 547996 - DNA, 25 bp, Rattus norvegicus
tacagatgagctagtttccgttgaa

SEQ ID NO: 547997 - DNA, 25 bp, Rattus norvegicus
tacagatgagcttgtttccgttgaa

SEQ ID NO: 547998 - DNA, 25 bp, Rattus norvegicus
tacagatgatcgagaacccaggctt

SEQ ID NO: 547999 - DNA, 25 bp, Rattus norvegicus
tacagatgatcgtgaacccaggctt

SEQ ID NO: 548000 - DNA, 25 bp, Rattus norvegicus
tacagatgattccttgcgtcagctc

SEQ ID NO: 548001 - DNA, 25 bp, Rattus norvegicus
tacagatgattcgttgcgtcagctc

SEQ ID NO: 548002 - DNA, 25 bp, Rattus norvegicus
tacagatgcctgatgtagagcacat

SEQ ID NO: 548003 - DNA, 25 bp, Rattus norvegicus
tacagatgcctgttgtagagcacat

SEQ ID NO: 548004 - DNA, 25 bp, Rattus norvegicus
tacagatgtacaacagcactacatg

SEQ ID NO: 548005 - DNA, 25 bp, Rattus norvegicus
tacagatgtacatcagcactacatg

SEQ ID NO: 548006 - DNA, 25 bp, Rattus norvegicus
tacagatgtagcactcggagggcat

SEQ ID NO: 548007 - DNA, 25 bp, Rattus norvegicus
tacagatgtagctctcggagggcat

SEQ ID NO: 548008 - DNA, 25 bp, Rattus norvegicus
tacagatgtcgaagcccacgaccat

SEQ ID NO: 548009 - DNA, 25 bp, Rattus norvegicus
tacagatgtcgatgcccacgaccat

SEQ ID NO: 548010 - DNA, 25 bp, Rattus norvegicus
tacagatgtctgagatgggctgaga

SEQ ID NO: 548011 - DNA, 25 bp, Rattus norvegicus
tacagatgtctgtgatgggctgaga

SEQ ID NO: 548012 - DNA, 25 bp, Rattus norvegicus
tacagatgtgaacctctgtgcccat

SEQ ID NO: 548013 - DNA, 25 bp, Rattus norvegicus
tacagatgtgaagctctgtgcccat

SEQ ID NO: 548014 - DNA, 25 bp, Rattus norvegicus
tacagatgtgtcatctttccagaac

SEQ ID NO: 548015 - DNA, 25 bp, Rattus norvegicus
tacagatgtgtcttctttccagaac

SEQ ID NO: 548016 - DNA, 25 bp, Rattus norvegicus
tacagattaagacagctccaagctc

SEQ ID NO: 548017 - DNA, 25 bp, Rattus norvegicus
tacagattaagagagctccaagctc

SEQ ID NO: 548018 - DNA, 25 bp, Rattus norvegicus
tacagattctccatttccagcttag

SEQ ID NO: 548019 - DNA, 25 bp, Rattus norvegicus
tacagattctccttttccagcttag

SEQ ID NO: 548020 - DNA, 25 bp, Rattus norvegicus
tacagattctgcacgatggcgctca

SEQ ID NO: 548021 - DNA, 25 bp, Rattus norvegicus
tacagattctgctcgatggcgctca

SEQ ID NO: 548022 - DNA, 25 bp, Rattus norvegicus
tacagattgactcgaggactcttcg

SEQ ID NO: 548023 - DNA, 25 bp, Rattus norvegicus
tacagattgactggaggactcttcg

SEQ ID NO: 548024 - DNA, 25 bp, Rattus norvegicus
tacagattgccgatccagcaggaat

SEQ ID NO: 548025 - DNA, 25 bp, Rattus norvegicus
tacagattgccgttccagcaggaat

SEQ ID NO: 548026 - DNA, 25 bp, Rattus norvegicus
tacagatttgcacctatgtttctag

SEQ ID NO: 548027 - DNA, 25 bp, Rattus norvegicus
tacagatttgcagctatgtttctag

SEQ ID NO: 548028 - DNA, 25 bp, Rattus norvegicus
tacagatttgctatctcctaaacag

SEQ ID NO: 548029 - DNA, 25 bp, Rattus norvegicus
tacagatttgctttctcctaaacag

SEQ ID NO: 548030 - DNA, 25 bp, Rattus norvegicus
tacagcaaacacaaaggaacccttc

SEQ ID NO: 548031 - DNA, 25 bp, Rattus norvegicus
tacagcaaacactaaggaacccttc

SEQ ID NO: 548032 - DNA, 25 bp, Rattus norvegicus
tacagcaaacagacctcacactaga

SEQ ID NO: 548033 - DNA, 25 bp, Rattus norvegicus
tacagcaaacagtcctcacactaga

SEQ ID NO: 548034 - DNA, 25 bp, Rattus norvegicus
tacagcaaagcgctatccttctgat

SEQ ID NO: 548035 - DNA, 25 bp, Rattus norvegicus
tacagcaaagcggtatccttctgat

SEQ ID NO: 548036 - DNA, 25 bp, Rattus norvegicus
tacagcaacgacaacaaccttaatt

SEQ ID NO: 548037 - DNA, 25 bp, Rattus norvegicus
tacagcaacgactacaaccttaatt

SEQ ID NO: 548038 - DNA, 25 bp, Rattus norvegicus
tacagcaagcacattgtacaccaaa

SEQ ID NO: 548039 - DNA, 25 bp, Rattus norvegicus
tacagcaagcactttgtacaccaaa

SEQ ID NO: 548040 - DNA, 25 bp, Rattus norvegicus
tacagcaaggtacattctcatctat

SEQ ID NO: 548041 - DNA, 25 bp, Rattus norvegicus
tacagcaaggtagattctcatctat

SEQ ID NO: 548042 - DNA, 25 bp, Rattus norvegicus
tacagcaataaaaatactttgggta

SEQ ID NO: 548043 - DNA, 25 bp, Rattus norvegicus
tacagcaataaatatactttgggta

SEQ ID NO: 548044 - DNA, 25 bp, Rattus norvegicus
tacagcaatctgcaacgggactatt

SEQ ID NO: 548045 - DNA, 25 bp, Rattus norvegicus
tacagcaatctggaacgggactatt

SEQ ID NO: 548046 - DNA, 25 bp, Rattus norvegicus
tacagcaatgtacttaaacctctct

SEQ ID NO: 548047 - DNA, 25 bp, Rattus norvegicus
tacagcaatgtagttaaacctctct

SEQ ID NO: 548048 - DNA, 25 bp, Rattus norvegicus
tacagcacaatacagagacccaaag

SEQ ID NO: 548049 - DNA, 25 bp, Rattus norvegicus
tacagcacaatagagagacccaaag

SEQ ID NO: 548050 - DNA, 25 bp, Rattus norvegicus
tacagcacagaacgaaccacgacaa

SEQ ID NO: 548051 - DNA, 25 bp, Rattus norvegicus
tacagcacagaaggaaccacgacaa

SEQ ID NO: 548052 - DNA, 25 bp, Rattus norvegicus
tacagcacaggacagtgatgttacg

SEQ ID NO: 548053 - DNA, 25 bp, Rattus norvegicus
tacagcacaggagagtgatgttacg

SEQ ID NO: 548054 - DNA, 25 bp, Rattus norvegicus
tacagcacgtggacggcagccctca

SEQ ID NO: 548055 - DNA, 25 bp, Rattus norvegicus
tacagcacgtggtcggcagccctca

SEQ ID NO: 548056 - DNA, 25 bp, Rattus norvegicus
tacagcactttcagcacgtatgaga

SEQ ID NO: 548057 - DNA, 25 bp, Rattus norvegicus
tacagcactttctgcacgtatgaga

SEQ ID NO: 548058 - DNA, 25 bp, Rattus norvegicus
tacagcagatgaaggctcaggcccg

SEQ ID NO: 548059 - DNA, 25 bp, Rattus norvegicus
tacagcagatgatggctcaggcccg

SEQ ID NO: 548060 - DNA, 25 bp, Rattus norvegicus
tacagcagatgcctcaagtttttaa

SEQ ID NO: 548061 - DNA, 25 bp, Rattus norvegicus
tacagcagatgcgtcaagtttttaa

SEQ ID NO: 548062 - DNA, 25 bp, Rattus norvegicus
tacagcagcaagcaccagaccctgg

SEQ ID NO: 548063 - DNA, 25 bp, Rattus norvegicus
tacagcagcaaggaccagaccctgg

SEQ ID NO: 548064 - DNA, 25 bp, Rattus norvegicus
tacagcagcatacgtcttcggcagc

SEQ ID NO: 548065 - DNA, 25 bp, Rattus norvegicus
tacagcagcataggtcttcggcagc

SEQ ID NO: 548066 - DNA, 25 bp, Rattus norvegicus
tacagcagcatcaccagagagcatt

SEQ ID NO: 548067 - DNA, 25 bp, Rattus norvegicus
tacagcagcatctccagagagcatt

SEQ ID NO: 548068 - DNA, 25 bp, Rattus norvegicus
tacagcagcatgaaccgaactcctc

SEQ ID NO: 548069 - DNA, 25 bp, Rattus norvegicus
tacagcagcatgtaccgaactcctc

SEQ ID NO: 548070 - DNA, 25 bp, Rattus norvegicus
tacagcagcgccaagacccactagg

SEQ ID NO: 548071 - DNA, 25 bp, Rattus norvegicus
tacagcagcgcctagacccactagg

SEQ ID NO: 548072 - DNA, 25 bp, Rattus norvegicus
tacagcagcgctcgagactgggctt

SEQ ID NO: 548073 - DNA, 25 bp, Rattus norvegicus
tacagcagcgctggagactgggctt

SEQ ID NO: 548074 - DNA, 25 bp, Rattus norvegicus
tacagcagctaaatctcagccgaaa

SEQ ID NO: 548075 - DNA, 25 bp, Rattus norvegicus
tacagcagctaattctcagccgaaa

SEQ ID NO: 548076 - DNA, 25 bp, Rattus norvegicus
tacagcagctgtctcatggtgatcg

SEQ ID NO: 548077 - DNA, 25 bp, Rattus norvegicus
tacagcagctgtgtcatggtgatcg

SEQ ID NO: 548078 - DNA, 25 bp, Rattus norvegicus
tacagcaggaaactgtgaacaaagg

SEQ ID NO: 548079 - DNA, 25 bp, Rattus norvegicus
tacagcaggaaagtgtgaacaaagg

SEQ ID NO: 548080 - DNA, 25 bp, Rattus norvegicus
tacagcaggcagacaggatgaggac

SEQ ID NO: 548081 - DNA, 25 bp, Rattus norvegicus
tacagcaggcagtcaggatgaggac

SEQ ID NO: 548082 - DNA, 25 bp, Rattus norvegicus
tacagcagggcccttacgccggttt

SEQ ID NO: 548083 - DNA, 25 bp, Rattus norvegicus
tacagcagggccgttacgccggttt

SEQ ID NO: 548084 - DNA, 25 bp, Rattus norvegicus
tacagcagggtccacagactcttac

SEQ ID NO: 548085 - DNA, 25 bp, Rattus norvegicus
tacagcagggtcgacagactcttac

SEQ ID NO: 548086 - DNA, 25 bp, Rattus norvegicus
tacagcaggtttagcttcaagggct

SEQ ID NO: 548087 - DNA, 25 bp, Rattus norvegicus
tacagcaggtttagggttactttgg

SEQ ID NO: 548088 - DNA, 25 bp, Rattus norvegicus
tacagcaggttttgcttcaagggct

SEQ ID NO: 548089 - DNA, 25 bp, Rattus norvegicus
tacagcaggttttgggttactttgg

SEQ ID NO: 548090 - DNA, 25 bp, Rattus norvegicus
tacagcatagggaattaaatctaca

SEQ ID NO: 548091 - DNA, 25 bp, Rattus norvegicus
tacagcatagggtattaaatctaca

SEQ ID NO: 548092 - DNA, 25 bp, Rattus norvegicus
tacagcatctgtacttggcttgcct

SEQ ID NO: 548093 - DNA, 25 bp, Rattus norvegicus
tacagcatctgttcttggcttgcct

SEQ ID NO: 548094 - DNA, 25 bp, Rattus norvegicus
tacagcatgaagagaatcccagagc

SEQ ID NO: 548095 - DNA, 25 bp, Rattus norvegicus
tacagcatgaagtgaatcccagagc

SEQ ID NO: 548096 - DNA, 25 bp, Rattus norvegicus
tacagcatgcagacgaggtgtttct

SEQ ID NO: 548097 - DNA, 25 bp, Rattus norvegicus
tacagcatgcagtcgaggtgtttct

SEQ ID NO: 548098 - DNA, 25 bp, Rattus norvegicus
tacagcattgtaccccattgttaaa

SEQ ID NO: 548099 - DNA, 25 bp, Rattus norvegicus
tacagcattgtagcccattgttaaa

SEQ ID NO: 548100 - DNA, 25 bp, Rattus norvegicus
tacagccaaatgagctctctggtcc

SEQ ID NO: 548101 - DNA, 25 bp, Rattus norvegicus
tacagccaaatgtgctctctggtcc

SEQ ID NO: 548102 - DNA, 25 bp, Rattus norvegicus
tacagccaactcaaccaggcgtgga

SEQ ID NO: 548103 - DNA, 25 bp, Rattus norvegicus
tacagccaactctaccaggcgtgga

SEQ ID NO: 548104 - DNA, 25 bp, Rattus norvegicus
tacagccacgcactggatgcaacca

SEQ ID NO: 548105 - DNA, 25 bp, Rattus norvegicus
tacagccacgcagtggatgcaacca

SEQ ID NO: 548106 - DNA, 25 bp, Rattus norvegicus
tacagccactgcaccatgagacaaa

SEQ ID NO: 548107 - DNA, 25 bp, Rattus norvegicus
tacagccactgctccatgagacaaa

SEQ ID NO: 548108 - DNA, 25 bp, Rattus norvegicus
tacagccactggacccactgggcag

SEQ ID NO: 548109 - DNA, 25 bp, Rattus norvegicus
tacagccactggtcccactgggcag

SEQ ID NO: 548110 - DNA, 25 bp, Rattus norvegicus
tacagccagcatattcaccaaggac

SEQ ID NO: 548111 - DNA, 25 bp, Rattus norvegicus
tacagccagcattttcaccaaggac

SEQ ID NO: 548112 - DNA, 25 bp, Rattus norvegicus
tacagccagccgacttctttcttta

SEQ ID NO: 548113 - DNA, 25 bp, Rattus norvegicus
tacagccagccgtcttctttcttta

SEQ ID NO: 548114 - DNA, 25 bp, Rattus norvegicus
tacagccatgatcctcaacctatgg

SEQ ID NO: 548115 - DNA, 25 bp, Rattus norvegicus
tacagccatgatgctcaacctatgg

SEQ ID NO: 548116 - DNA, 25 bp, Rattus norvegicus
tacagccatgccacatagcagggaa

SEQ ID NO: 548117 - DNA, 25 bp, Rattus norvegicus
tacagccatgcctcatagcagggaa

SEQ ID NO: 548118 - DNA, 25 bp, Rattus norvegicus
tacagccatggtccagaacagagtc

SEQ ID NO: 548119 - DNA, 25 bp, Rattus norvegicus
tacagccatggtgcagaacagagtc

SEQ ID NO: 548120 - DNA, 25 bp, Rattus norvegicus
tacagccattttcgagactccgtga

SEQ ID NO: 548121 - DNA, 25 bp, Rattus norvegicus
tacagccattttggagactccgtga

SEQ ID NO: 548122 - DNA, 25 bp, Rattus norvegicus
tacagcccagacactgctagggaaa

SEQ ID NO: 548123 - DNA, 25 bp, Rattus norvegicus
tacagcccagactctgctagggaaa

SEQ ID NO: 548124 - DNA, 25 bp, Rattus norvegicus
tacagcccaggtaaacggtgaactc

SEQ ID NO: 548125 - DNA, 25 bp, Rattus norvegicus
tacagcccaggttaacggtgaactc

SEQ ID NO: 548126 - DNA, 25 bp, Rattus norvegicus
tacagcccctttctgcagcctggag

SEQ ID NO: 548127 - DNA, 25 bp, Rattus norvegicus
tacagcccctttgtgcagcctggag

SEQ ID NO: 548128 - DNA, 25 bp, Rattus norvegicus
tacagcccggtgaaatttatttact

SEQ ID NO: 548129 - DNA, 25 bp, Rattus norvegicus
tacagcccggtgtaatttatttact

SEQ ID NO: 548130 - DNA, 25 bp, Rattus norvegicus
tacagccctattacgtaactcacaa

SEQ ID NO: 548131 - DNA, 25 bp, Rattus norvegicus
tacagccctatttcgtaactcacaa

SEQ ID NO: 548132 - DNA, 25 bp, Rattus norvegicus
tacagccctgagaaaaatctttgtt

SEQ ID NO: 548133 - DNA, 25 bp, Rattus norvegicus
tacagccctgagtaaaatctttgtt

SEQ ID NO: 548134 - DNA, 25 bp, Rattus norvegicus
tacagccctgtcatccaaactgaag

SEQ ID NO: 548135 - DNA, 25 bp, Rattus norvegicus
tacagccctgtcttccaaactgaag

SEQ ID NO: 548136 - DNA, 25 bp, Rattus norvegicus
tacagccgcagaaagggtggccctt

SEQ ID NO: 548137 - DNA, 25 bp, Rattus norvegicus
tacagccgcagatagggtggccctt

SEQ ID NO: 548138 - DNA, 25 bp, Rattus norvegicus
tacagccgtataatttcttatgatg

SEQ ID NO: 548139 - DNA, 25 bp, Rattus norvegicus
tacagccgtatattttcttatgatg

SEQ ID NO: 548140 - DNA, 25 bp, Rattus norvegicus
tacagccgtggccacaaacagtagc

SEQ ID NO: 548141 - DNA, 25 bp, Rattus norvegicus
tacagccgtggcgacaaacagtagc

SEQ ID NO: 548142 - DNA, 25 bp, Rattus norvegicus
tacagccgtgtgcacactgagcagt

SEQ ID NO: 548143 - DNA, 25 bp, Rattus norvegicus
tacagccgtgtggacactgagcagt

SEQ ID NO: 548144 - DNA, 25 bp, Rattus norvegicus
tacagcctcagcaggcttggcggtc

SEQ ID NO: 548145 - DNA, 25 bp, Rattus norvegicus
tacagcctcagctggcttggcggtc

SEQ ID NO: 548146 - DNA, 25 bp, Rattus norvegicus
tacagcctcatgattcgacgacttc

SEQ ID NO: 548147 - DNA, 25 bp, Rattus norvegicus
tacagcctcatgtttcgacgacttc

SEQ ID NO: 548148 - DNA, 25 bp, Rattus norvegicus
tacagcctccacaacgagattcttt

SEQ ID NO: 548149 - DNA, 25 bp, Rattus norvegicus
tacagcctccactacgagattcttt

SEQ ID NO: 548150 - DNA, 25 bp, Rattus norvegicus
tacagcctctggattattagttaca

SEQ ID NO: 548151 - DNA, 25 bp, Rattus norvegicus
tacagcctctggtttattagttaca

SEQ ID NO: 548152 - DNA, 25 bp, Rattus norvegicus
tacagcctgaaactccagtctgaag

SEQ ID NO: 548153 - DNA, 25 bp, Rattus norvegicus
tacagcctgaaagtccagtctgaag

SEQ ID NO: 548154 - DNA, 25 bp, Rattus norvegicus
tacagcctgcacaagctaggagctt

SEQ ID NO: 548155 - DNA, 25 bp, Rattus norvegicus
tacagcctgcactagctaggagctt

SEQ ID NO: 548156 - DNA, 25 bp, Rattus norvegicus
tacagcctggacagggttcgtcagt

SEQ ID NO: 548157 - DNA, 25 bp, Rattus norvegicus
tacagcctggactgggttcgtcagt

SEQ ID NO: 548158 - DNA, 25 bp, Rattus norvegicus
tacagcctgggaactgacctcttaa

SEQ ID NO: 548159 - DNA, 25 bp, Rattus norvegicus
tacagcctgggatctgacctcttaa

SEQ ID NO: 548160 - DNA, 25 bp, Rattus norvegicus
tacagccttggaagtccaggcttgc

SEQ ID NO: 548161 - DNA, 25 bp, Rattus norvegicus
tacagccttggatgtccaggcttgc

SEQ ID NO: 548162 - DNA, 25 bp, Rattus norvegicus
tacagcctttgaacatagtatctat

SEQ ID NO: 548163 - DNA, 25 bp, Rattus norvegicus
tacagcctttgatcatagtatctat

SEQ ID NO: 548164 - DNA, 25 bp, Rattus norvegicus
tacagcgaaacaatcttcctgccat

SEQ ID NO: 548165 - DNA, 25 bp, Rattus norvegicus
tacagcgaaacattcttcctgccat

SEQ ID NO: 548166 - DNA, 25 bp, Rattus norvegicus
tacagcgacaggattccctcctaaa

SEQ ID NO: 548167 - DNA, 25 bp, Rattus norvegicus
tacagcgacaggtttccctcctaaa

SEQ ID NO: 548168 - DNA, 25 bp, Rattus norvegicus
tacagcgacgccaggaggatgagct

SEQ ID NO: 548169 - DNA, 25 bp, Rattus norvegicus
tacagcgacgcctggaggatgagct

SEQ ID NO: 548170 - DNA, 25 bp, Rattus norvegicus
tacagcgaggtgatgggccactacc

SEQ ID NO: 548171 - DNA, 25 bp, Rattus norvegicus
tacagcgaggtgttgggccactacc

SEQ ID NO: 548172 - DNA, 25 bp, Rattus norvegicus
tacagcgatctgaaccactctctgg

SEQ ID NO: 548173 - DNA, 25 bp, Rattus norvegicus
tacagcgatctgtaccactctctgg

SEQ ID NO: 548174 - DNA, 25 bp, Rattus norvegicus
tacagcgcagctatgggagccctgg

SEQ ID NO: 548175 - DNA, 25 bp, Rattus norvegicus
tacagcgcagctttgggagccctgg

SEQ ID NO: 548176 - DNA, 25 bp, Rattus norvegicus
tacagcgcattactccttgatgcaa

SEQ ID NO: 548177 - DNA, 25 bp, Rattus norvegicus
tacagcgcattagtccttgatgcaa

SEQ ID NO: 548178 - DNA, 25 bp, Rattus norvegicus
tacagcgccagactgctgacgcctt

SEQ ID NO: 548179 - DNA, 25 bp, Rattus norvegicus
tacagcgccagagtgctgacgcctt

SEQ ID NO: 548180 - DNA, 25 bp, Rattus norvegicus
tacagcgcctagagatttcctggct

SEQ ID NO: 548181 - DNA, 25 bp, Rattus norvegicus
tacagcgcctagtgatttcctggct

SEQ ID NO: 548182 - DNA, 25 bp, Rattus norvegicus
tacagcgcgtgcacagagccctgga

SEQ ID NO: 548183 - DNA, 25 bp, Rattus norvegicus
tacagcgcgtgctcagagccctgga

SEQ ID NO: 548184 - DNA, 25 bp, Rattus norvegicus
tacagcgctcccagggtggcatttc

SEQ ID NO: 548185 - DNA, 25 bp, Rattus norvegicus
tacagcgctccctgggtggcatttc

SEQ ID NO: 548186 - DNA, 25 bp, Rattus norvegicus
tacagcgctctgacatagtttcatg

SEQ ID NO: 548187 - DNA, 25 bp, Rattus norvegicus
tacagcgctctgtcatagtttcatg

SEQ ID NO: 548188 - DNA, 25 bp, Rattus norvegicus
tacagcgcttacagccagacgggat

SEQ ID NO: 548189 - DNA, 25 bp, Rattus norvegicus
tacagcgcttactgccagacgggat

SEQ ID NO: 548190 - DNA, 25 bp, Rattus norvegicus
tacagcgcttgcctggcattcacga

SEQ ID NO: 548191 - DNA, 25 bp, Rattus norvegicus
tacagcgcttgcgtggcattcacga

SEQ ID NO: 548192 - DNA, 25 bp, Rattus norvegicus
tacagcgctttgacaagtgtctgga

SEQ ID NO: 548193 - DNA, 25 bp, Rattus norvegicus
tacagcgctttgtcaagtgtctgga

SEQ ID NO: 548194 - DNA, 25 bp, Rattus norvegicus
tacagcggatcacgtcatggcttcc

SEQ ID NO: 548195 - DNA, 25 bp, Rattus norvegicus
tacagcggatcaggtcatggcttcc

SEQ ID NO: 548196 - DNA, 25 bp, Rattus norvegicus
tacagcggcagtctagccaatggct

SEQ ID NO: 548197 - DNA, 25 bp, Rattus norvegicus
tacagcggcagtgtagccaatggct

SEQ ID NO: 548198 - DNA, 25 bp, Rattus norvegicus
tacagcggccaactgcaaagtgttt

SEQ ID NO: 548199 - DNA, 25 bp, Rattus norvegicus
tacagcggccaagtgcaaagtgttt

SEQ ID NO: 548200 - DNA, 25 bp, Rattus norvegicus
tacagcggctaacgtgtggacttgc

SEQ ID NO: 548201 - DNA, 25 bp, Rattus norvegicus
tacagcggctaaggtgtggacttgc

SEQ ID NO: 548202 - DNA, 25 bp, Rattus norvegicus
tacagcgtatttaaagcccgtccag

SEQ ID NO: 548203 - DNA, 25 bp, Rattus norvegicus
tacagcgtattttaagcccgtccag

SEQ ID NO: 548204 - DNA, 25 bp, Rattus norvegicus
tacagcgtgcttactacaccagagg

SEQ ID NO: 548205 - DNA, 25 bp, Rattus norvegicus
tacagcgtgctttctacaccagagg

SEQ ID NO: 548206 - DNA, 25 bp, Rattus norvegicus
tacagcgtggatatcggcataccct

SEQ ID NO: 548207 - DNA, 25 bp, Rattus norvegicus
tacagcgtggatttcggcataccct

SEQ ID NO: 548208 - DNA, 25 bp, Rattus norvegicus
tacagcgtgtagcagggcagttccc

SEQ ID NO: 548209 - DNA, 25 bp, Rattus norvegicus
tacagcgtgtaggagggcagttccc

SEQ ID NO: 548210 - DNA, 25 bp, Rattus norvegicus
tacagcgtttggattaaccccacca

SEQ ID NO: 548211 - DNA, 25 bp, Rattus norvegicus
tacagcgtttggtttaaccccacca

SEQ ID NO: 548212 - DNA, 25 bp, Rattus norvegicus
tacagctacactcacatgcacgtat

SEQ ID NO: 548213 - DNA, 25 bp, Rattus norvegicus
tacagctacactgacatgcacgtat

SEQ ID NO: 548214 - DNA, 25 bp, Rattus norvegicus
tacagctacgtacggctctggcggt

SEQ ID NO: 548215 - DNA, 25 bp, Rattus norvegicus
tacagctacgtagggctctggcggt

SEQ ID NO: 548216 - DNA, 25 bp, Rattus norvegicus
tacagctagaacaacaggccagtct

SEQ ID NO: 548217 - DNA, 25 bp, Rattus norvegicus
tacagctagaactacaggccagtct

SEQ ID NO: 548218 - DNA, 25 bp, Rattus norvegicus
tacagctagctgagccatgcttgtg

SEQ ID NO: 548219 - DNA, 25 bp, Rattus norvegicus
tacagctagctgtgccatgcttgtg

SEQ ID NO: 548220 - DNA, 25 bp, Rattus norvegicus
tacagctaggcaacaaccttagaag

SEQ ID NO: 548221 - DNA, 25 bp, Rattus norvegicus
tacagctaggcatcaaccttagaag

SEQ ID NO: 548222 - DNA, 25 bp, Rattus norvegicus
tacagctagtcaacgtgttcgccga

SEQ ID NO: 548223 - DNA, 25 bp, Rattus norvegicus
tacagctagtcatcgtgttcgccga

SEQ ID NO: 548224 - DNA, 25 bp, Rattus norvegicus
tacagctatcccaaacaatgcgtct

SEQ ID NO: 548225 - DNA, 25 bp, Rattus norvegicus
tacagctatccctaacaatgcgtct

SEQ ID NO: 548226 - DNA, 25 bp, Rattus norvegicus
tacagctcacgtagatgtgatcccc

SEQ ID NO: 548227 - DNA, 25 bp, Rattus norvegicus
tacagctcacgttgatgtgatcccc

SEQ ID NO: 548228 - DNA, 25 bp, Rattus norvegicus
tacagctccattattgtaactggga

SEQ ID NO: 548229 - DNA, 25 bp, Rattus norvegicus
tacagctccatttttgtaactggga

SEQ ID NO: 548230 - DNA, 25 bp, Rattus norvegicus
tacagctcccaaccgtgggaagttt

SEQ ID NO: 548231 - DNA, 25 bp, Rattus norvegicus
tacagctcccaagcgtgggaagttt

SEQ ID NO: 548232 - DNA, 25 bp, Rattus norvegicus
tacagctccctgatgagacacactg

SEQ ID NO: 548233 - DNA, 25 bp, Rattus norvegicus
tacagctccctgttgagacacactg

SEQ ID NO: 548234 - DNA, 25 bp, Rattus norvegicus
tacagctccgctctgcttcatgttg

SEQ ID NO: 548235 - DNA, 25 bp, Rattus norvegicus
tacagctccgctgtgcttcatgttg

SEQ ID NO: 548236 - DNA, 25 bp, Rattus norvegicus
tacagctccttacagcagatggcag

SEQ ID NO: 548237 - DNA, 25 bp, Rattus norvegicus
tacagctccttagagcagatggcag

SEQ ID NO: 548238 - DNA, 25 bp, Rattus norvegicus
tacagctcctttaatactccacttt

SEQ ID NO: 548239 - DNA, 25 bp, Rattus norvegicus
tacagctccttttatactccacttt

SEQ ID NO: 548240 - DNA, 25 bp, Rattus norvegicus
tacagctctcatcaatggccatttg

SEQ ID NO: 548241 - DNA, 25 bp, Rattus norvegicus
tacagctctcatgaatggccatttg

SEQ ID NO: 548242 - DNA, 25 bp, Rattus norvegicus
tacagctctgcccaattcttggaga

SEQ ID NO: 548243 - DNA, 25 bp, Rattus norvegicus
tacagctctgccgaattcttggaga

SEQ ID NO: 548244 - DNA, 25 bp, Rattus norvegicus
tacagctgaatgacaatgttgccat

SEQ ID NO: 548245 - DNA, 25 bp, Rattus norvegicus
tacagctgaatgtcaatgttgccat

SEQ ID NO: 548246 - DNA, 25 bp, Rattus norvegicus
tacagctgcatgattctccctgtga

SEQ ID NO: 548247 - DNA, 25 bp, Rattus norvegicus
tacagctgcatgtttctccctgtga

SEQ ID NO: 548248 - DNA, 25 bp, Rattus norvegicus
tacagctgccccagtgcttgtggat

SEQ ID NO: 548249 - DNA, 25 bp, Rattus norvegicus
tacagctgcccctgtgcttgtggat

SEQ ID NO: 548250 - DNA, 25 bp, Rattus norvegicus
tacagctgcgtcacaaagaacctag

SEQ ID NO: 548251 - DNA, 25 bp, Rattus norvegicus
tacagctgcgtctcaaagaacctag

SEQ ID NO: 548252 - DNA, 25 bp, Rattus norvegicus
tacagctggcagaagcccctgggaa

SEQ ID NO: 548253 - DNA, 25 bp, Rattus norvegicus
tacagctggcagtagcccctgggaa

SEQ ID NO: 548254 - DNA, 25 bp, Rattus norvegicus
tacagctggctaacaatggtaccga

SEQ ID NO: 548255 - DNA, 25 bp, Rattus norvegicus
tacagctggctatcaatggtaccga

SEQ ID NO: 548256 - DNA, 25 bp, Rattus norvegicus
tacagctgggaactcaagcccactg

SEQ ID NO: 548257 - DNA, 25 bp, Rattus norvegicus
tacagctgggaagtcaagcccactg

SEQ ID NO: 548258 - DNA, 25 bp, Rattus norvegicus
tacagctgggctccaagactcgtac

SEQ ID NO: 548259 - DNA, 25 bp, Rattus norvegicus
tacagctgggctgcaagactcgtac

SEQ ID NO: 548260 - DNA, 25 bp, Rattus norvegicus
tacagctgtacaatgcttgtgggtc

SEQ ID NO: 548261 - DNA, 25 bp, Rattus norvegicus
tacagctgtacattgcttgtgggtc

SEQ ID NO: 548262 - DNA, 25 bp, Rattus norvegicus
tacagctgtattacccttgagcgga

SEQ ID NO: 548263 - DNA, 25 bp, Rattus norvegicus
tacagctgtatttcccttgagcgga

SEQ ID NO: 548264 - DNA, 25 bp, Rattus norvegicus
tacagctgtgtgaatgtcccgcagg

SEQ ID NO: 548265 - DNA, 25 bp, Rattus norvegicus
tacagctgtgtgtatgtcccgcagg

SEQ ID NO: 548266 - DNA, 25 bp, Rattus norvegicus
tacagctgtttgaccactcctatgg

SEQ ID NO: 548267 - DNA, 25 bp, Rattus norvegicus
tacagctgtttgtccactcctatgg

SEQ ID NO: 548268 - DNA, 25 bp, Rattus norvegicus
tacagcttacagactatcatgcaag

SEQ ID NO: 548269 - DNA, 25 bp, Rattus norvegicus
tacagcttacagtctatcatgcaag

SEQ ID NO: 548270 - DNA, 25 bp, Rattus norvegicus
tacagcttatgcacaacctgggcaa

SEQ ID NO: 548271 - DNA, 25 bp, Rattus norvegicus
tacagcttatgctcaacctgggcaa

SEQ ID NO: 548272 - DNA, 25 bp, Rattus norvegicus
tacagcttccaactccaaggagagc

SEQ ID NO: 548273 - DNA, 25 bp, Rattus norvegicus
tacagcttccaagtccaaggagagc

SEQ ID NO: 548274 - DNA, 25 bp, Rattus norvegicus
tacagcttcctgcacgagatggaga

SEQ ID NO: 548275 - DNA, 25 bp, Rattus norvegicus
tacagcttcctggacgagatggaga

SEQ ID NO: 548276 - DNA, 25 bp, Rattus norvegicus
tacagcttctctagtgtgtcaggaa

SEQ ID NO: 548277 - DNA, 25 bp, Rattus norvegicus
tacagcttctctatcacatcaatat

SEQ ID NO: 548278 - DNA, 25 bp, Rattus norvegicus
tacagcttctcttgtgtgtcaggaa

SEQ ID NO: 548279 - DNA, 25 bp, Rattus norvegicus
tacagcttctctttcacatcaatat

SEQ ID NO: 548280 - DNA, 25 bp, Rattus norvegicus
tacagcttcttcctttttcagttag

SEQ ID NO: 548281 - DNA, 25 bp, Rattus norvegicus
tacagcttcttcgtttttcagttag

SEQ ID NO: 548282 - DNA, 25 bp, Rattus norvegicus
tacagcttgcctattgccttaagcg

SEQ ID NO: 548283 - DNA, 25 bp, Rattus norvegicus
tacagcttgccttttgccttaagcg

SEQ ID NO: 548284 - DNA, 25 bp, Rattus norvegicus
tacagcttgtccatgttctcttctt

SEQ ID NO: 548285 - DNA, 25 bp, Rattus norvegicus
tacagcttgtccttgttctcttctt

SEQ ID NO: 548286 - DNA, 25 bp, Rattus norvegicus
tacagctttagcattggttccctgc

SEQ ID NO: 548287 - DNA, 25 bp, Rattus norvegicus
tacagctttagctttggttccctgc

SEQ ID NO: 548288 - DNA, 25 bp, Rattus norvegicus
tacagctttgtgatgctgaggacat

SEQ ID NO: 548289 - DNA, 25 bp, Rattus norvegicus
tacagctttgtgttgctgaggacat

SEQ ID NO: 548290 - DNA, 25 bp, Rattus norvegicus
tacaggaaacctcttacagcaattt

SEQ ID NO: 548291 - DNA, 25 bp, Rattus norvegicus
tacaggaaacctgttacagcaattt

SEQ ID NO: 548292 - DNA, 25 bp, Rattus norvegicus
tacaggaaagctctaaccctcccgg

SEQ ID NO: 548293 - DNA, 25 bp, Rattus norvegicus
tacaggaaagctgtaaccctcccgg

SEQ ID NO: 548294 - DNA, 25 bp, Rattus norvegicus
tacaggaacaaaagcacacctccct

SEQ ID NO: 548295 - DNA, 25 bp, Rattus norvegicus
tacaggaacaaatgcacacctccct

SEQ ID NO: 548296 - DNA, 25 bp, Rattus norvegicus
tacaggaacatgacactgcagcaat

SEQ ID NO: 548297 - DNA, 25 bp, Rattus norvegicus
tacaggaacatgtcactgcagcaat

SEQ ID NO: 548298 - DNA, 25 bp, Rattus norvegicus
tacaggaaccccaactattgttgag

SEQ ID NO: 548299 - DNA, 25 bp, Rattus norvegicus
tacaggaacccctactattgttgag

SEQ ID NO: 548300 - DNA, 25 bp, Rattus norvegicus
tacaggaattgtctttcgggctaca

SEQ ID NO: 548301 - DNA, 25 bp, Rattus norvegicus
tacaggaattgtgtttcgggctaca

SEQ ID NO: 548302 - DNA, 25 bp, Rattus norvegicus
tacaggacaatgctggtgcacatct

SEQ ID NO: 548303 - DNA, 25 bp, Rattus norvegicus
tacaggacaatggtggtgcacatct

SEQ ID NO: 548304 - DNA, 25 bp, Rattus norvegicus
tacaggacagatcactcactagaag

SEQ ID NO: 548305 - DNA, 25 bp, Rattus norvegicus
tacaggacagatgactcactagaag

SEQ ID NO: 548306 - DNA, 25 bp, Rattus norvegicus
tacaggacagctatacagctccacc

SEQ ID NO: 548307 - DNA, 25 bp, Rattus norvegicus
tacaggacagctttacagctccacc

SEQ ID NO: 548308 - DNA, 25 bp, Rattus norvegicus
tacaggaccgcgctggagaaccagc

SEQ ID NO: 548309 - DNA, 25 bp, Rattus norvegicus
tacaggaccgcggtggagaaccagc

SEQ ID NO: 548310 - DNA, 25 bp, Rattus norvegicus
tacaggacctgcattttcaagagaa

SEQ ID NO: 548311 - DNA, 25 bp, Rattus norvegicus
tacaggacctgctttttcaagagaa

SEQ ID NO: 548312 - DNA, 25 bp, Rattus norvegicus
tacaggacgctgatcagagtacacc

SEQ ID NO: 548313 - DNA, 25 bp, Rattus norvegicus
tacaggacgctgttcagagtacacc

SEQ ID NO: 548314 - DNA, 25 bp, Rattus norvegicus
tacaggactcacagcagacagccat

SEQ ID NO: 548315 - DNA, 25 bp, Rattus norvegicus
tacaggactcactgcagacagccat

SEQ ID NO: 548316 - DNA, 25 bp, Rattus norvegicus
tacaggacttttccctttcagttct

SEQ ID NO: 548317 - DNA, 25 bp, Rattus norvegicus
tacaggacttttgcctttcagttct

SEQ ID NO: 548318 - DNA, 25 bp, Rattus norvegicus
tacaggagcagacatcgtgacgaat

SEQ ID NO: 548319 - DNA, 25 bp, Rattus norvegicus
tacaggagcagagatcgtgacgaat

SEQ ID NO: 548320 - DNA, 25 bp, Rattus norvegicus
tacaggagcctaacctggttacagg

SEQ ID NO: 548321 - DNA, 25 bp, Rattus norvegicus
tacaggagcctatcctggttacagg

SEQ ID NO: 548322 - DNA, 25 bp, Rattus norvegicus
tacaggagcctcaaaccacaggaaa

SEQ ID NO: 548323 - DNA, 25 bp, Rattus norvegicus
tacaggagcctctaaccacaggaaa

SEQ ID NO: 548324 - DNA, 25 bp, Rattus norvegicus
tacaggatccggcagttccgccaga

SEQ ID NO: 548325 - DNA, 25 bp, Rattus norvegicus
tacaggatccgggagttccgccaga

SEQ ID NO: 548326 - DNA, 25 bp, Rattus norvegicus
tacaggatctatcaggcctgctcct

SEQ ID NO: 548327 - DNA, 25 bp, Rattus norvegicus
tacaggatctatgaggcctgctcct

SEQ ID NO: 548328 - DNA, 25 bp, Rattus norvegicus
tacaggatgcccctcagcaaagtta

SEQ ID NO: 548329 - DNA, 25 bp, Rattus norvegicus
tacaggatgcccctgcaggagtagc

SEQ ID NO: 548330 - DNA, 25 bp, Rattus norvegicus
tacaggatgcccgtcagcaaagtta

SEQ ID NO: 548331 - DNA, 25 bp, Rattus norvegicus
tacaggatgcccgtgcaggagtagc

SEQ ID NO: 548332 - DNA, 25 bp, Rattus norvegicus
tacaggatggcaccagctcattctc

SEQ ID NO: 548333 - DNA, 25 bp, Rattus norvegicus
tacaggatggcagcagctcattctc

SEQ ID NO: 548334 - DNA, 25 bp, Rattus norvegicus
tacaggatggtgatgcccttatcag

SEQ ID NO: 548335 - DNA, 25 bp, Rattus norvegicus
tacaggatggtgttgcccttatcag

SEQ ID NO: 548336 - DNA, 25 bp, Rattus norvegicus
tacaggattcaaagtcatcccctcc

SEQ ID NO: 548337 - DNA, 25 bp, Rattus norvegicus
tacaggattcaatgtcatcccctcc

SEQ ID NO: 548338 - DNA, 25 bp, Rattus norvegicus
tacaggattcccaaagaagtgcaga

SEQ ID NO: 548339 - DNA, 25 bp, Rattus norvegicus
tacaggattccctaagaagtgcaga

SEQ ID NO: 548340 - DNA, 25 bp, Rattus norvegicus
tacaggattcctaaaggctcccgtt

SEQ ID NO: 548341 - DNA, 25 bp, Rattus norvegicus
tacaggattccttaaggctcccgtt

SEQ ID NO: 548342 - DNA, 25 bp, Rattus norvegicus
tacaggattggcaattactgcaatt

SEQ ID NO: 548343 - DNA, 25 bp, Rattus norvegicus
tacaggattggctattactgcaatt

SEQ ID NO: 548344 - DNA, 25 bp, Rattus norvegicus
tacaggattttgaggcctacaggct

SEQ ID NO: 548345 - DNA, 25 bp, Rattus norvegicus
tacaggattttgtggcctacaggct

SEQ ID NO: 548346 - DNA, 25 bp, Rattus norvegicus
tacaggcaatgaccacccggacaat

SEQ ID NO: 548347 - DNA, 25 bp, Rattus norvegicus
tacaggcaatgagcacccggacaat

SEQ ID NO: 548348 - DNA, 25 bp, Rattus norvegicus
tacaggcacaggaaggtagggccct

SEQ ID NO: 548349 - DNA, 25 bp, Rattus norvegicus
tacaggcacaggtaggtagggccct

SEQ ID NO: 548350 - DNA, 25 bp, Rattus norvegicus
tacaggcacctccatgtcttttggg

SEQ ID NO: 548351 - DNA, 25 bp, Rattus norvegicus
tacaggcacctcgatgtcttttggg

SEQ ID NO: 548352 - DNA, 25 bp, Rattus norvegicus
tacaggcacctgagagctgcagtct

SEQ ID NO: 548353 - DNA, 25 bp, Rattus norvegicus
tacaggcacctgcatgtgtgagctt

SEQ ID NO: 548354 - DNA, 25 bp, Rattus norvegicus
tacaggcacctggatgtgtgagctt

SEQ ID NO: 548355 - DNA, 25 bp, Rattus norvegicus
tacaggcacctgtgagctgcagtct

SEQ ID NO: 548356 - DNA, 25 bp, Rattus norvegicus
tacaggcacgttagcctgctgtttt

SEQ ID NO: 548357 - DNA, 25 bp, Rattus norvegicus
tacaggcacgtttgcctgctgtttt

SEQ ID NO: 548358 - DNA, 25 bp, Rattus norvegicus
tacaggcaggtgctggcattgttgc

SEQ ID NO: 548359 - DNA, 25 bp, Rattus norvegicus
tacaggcaggtggtggcattgttgc

SEQ ID NO: 548360 - DNA, 25 bp, Rattus norvegicus
tacaggcagtttcagtccggtctca

SEQ ID NO: 548361 - DNA, 25 bp, Rattus norvegicus
tacaggcagtttgagtccggtctca

SEQ ID NO: 548362 - DNA, 25 bp, Rattus norvegicus
tacaggcatatgctaccatttctga

SEQ ID NO: 548363 - DNA, 25 bp, Rattus norvegicus
tacaggcatatggtaccatttctga

SEQ ID NO: 548364 - DNA, 25 bp, Rattus norvegicus
tacaggcccgcgcagcccggtgata

SEQ ID NO: 548365 - DNA, 25 bp, Rattus norvegicus
tacaggcccgcggagcccggtgata

SEQ ID NO: 548366 - DNA, 25 bp, Rattus norvegicus
tacaggccctttaactgtctcaggt

SEQ ID NO: 548367 - DNA, 25 bp, Rattus norvegicus
tacaggcccttttactgtctcaggt

SEQ ID NO: 548368 - DNA, 25 bp, Rattus norvegicus
tacaggcctcggagtgtacgtcagt

SEQ ID NO: 548369 - DNA, 25 bp, Rattus norvegicus
tacaggcctcggtgtgtacgtcagt

SEQ ID NO: 548370 - DNA, 25 bp, Rattus norvegicus
tacaggcctctcaaagctataacgt

SEQ ID NO: 548371 - DNA, 25 bp, Rattus norvegicus
tacaggcctctctaagctataacgt

SEQ ID NO: 548372 - DNA, 25 bp, Rattus norvegicus
tacaggcgctctcggctccgcgttg

SEQ ID NO: 548373 - DNA, 25 bp, Rattus norvegicus
tacaggcgctctgggctccgcgttg

SEQ ID NO: 548374 - DNA, 25 bp, Rattus norvegicus
tacaggcggcagcaaaggtaattct

SEQ ID NO: 548375 - DNA, 25 bp, Rattus norvegicus
tacaggcggcaggaaaggtaattct

SEQ ID NO: 548376 - DNA, 25 bp, Rattus norvegicus
tacaggcgtcgccaagcaatatccc

SEQ ID NO: 548377 - DNA, 25 bp, Rattus norvegicus
tacaggcgtcgcgaagcaatatccc

SEQ ID NO: 548378 - DNA, 25 bp, Rattus norvegicus
tacaggctaagcactaactcagtag

SEQ ID NO: 548379 - DNA, 25 bp, Rattus norvegicus
tacaggctaagctctaactcagtag

SEQ ID NO: 548380 - DNA, 25 bp, Rattus norvegicus
tacaggctagctcccaatggtcgca

SEQ ID NO: 548381 - DNA, 25 bp, Rattus norvegicus
tacaggctagctgccaatggtcgca

SEQ ID NO: 548382 - DNA, 25 bp, Rattus norvegicus
tacaggctcaggcttgaagttcatt

SEQ ID NO: 548383 - DNA, 25 bp, Rattus norvegicus
tacaggctcagggttgaagttcatt

SEQ ID NO: 548384 - DNA, 25 bp, Rattus norvegicus
tacaggctccatagaattgcttccc

SEQ ID NO: 548385 - DNA, 25 bp, Rattus norvegicus
tacaggctccattgaattgcttccc

SEQ ID NO: 548386 - DNA, 25 bp, Rattus norvegicus
tacaggctctctcagagctgtaaaa

SEQ ID NO: 548387 - DNA, 25 bp, Rattus norvegicus
tacaggctctctgagagctgtaaaa

SEQ ID NO: 548388 - DNA, 25 bp, Rattus norvegicus
tacaggctctgacacagtgactgct

SEQ ID NO: 548389 - DNA, 25 bp, Rattus norvegicus
tacaggctctgagacagtgactgct

SEQ ID NO: 548390 - DNA, 25 bp, Rattus norvegicus
tacaggctctgcctagttacaggct

SEQ ID NO: 548391 - DNA, 25 bp, Rattus norvegicus
tacaggctctgcgtagttacaggct

SEQ ID NO: 548392 - DNA, 25 bp, Rattus norvegicus
tacaggctctgtcggctgctgcagc

SEQ ID NO: 548393 - DNA, 25 bp, Rattus norvegicus
tacaggctctgtgggctgctgcagc

SEQ ID NO: 548394 - DNA, 25 bp, Rattus norvegicus
tacaggctcttgacagacgtatccg

SEQ ID NO: 548395 - DNA, 25 bp, Rattus norvegicus
tacaggctcttgtcagacgtatccg

SEQ ID NO: 548396 - DNA, 25 bp, Rattus norvegicus
tacaggctgtctccagttggttcac

SEQ ID NO: 548397 - DNA, 25 bp, Rattus norvegicus
tacaggctgtctgcagttggttcac

SEQ ID NO: 548398 - DNA, 25 bp, Rattus norvegicus
tacaggcttattccaaccgttacca

SEQ ID NO: 548399 - DNA, 25 bp, Rattus norvegicus
tacaggcttattgcaaccgttacca

SEQ ID NO: 548400 - DNA, 25 bp, Rattus norvegicus
tacaggcttcagaggatcttctcaa

SEQ ID NO: 548401 - DNA, 25 bp, Rattus norvegicus
tacaggcttcagtggatcttctcaa

SEQ ID NO: 548402 - DNA, 25 bp, Rattus norvegicus
tacaggcttgatatctagccccatt

SEQ ID NO: 548403 - DNA, 25 bp, Rattus norvegicus
tacaggcttgatttctagccccatt

SEQ ID NO: 548404 - DNA, 25 bp, Rattus norvegicus
tacaggcttttgctactgttgggct

SEQ ID NO: 548405 - DNA, 25 bp, Rattus norvegicus
tacaggcttttggtactgttgggct

SEQ ID NO: 548406 - DNA, 25 bp, Rattus norvegicus
tacagggaacccagaggaattctct

SEQ ID NO: 548407 - DNA, 25 bp, Rattus norvegicus
tacagggaaccctgaggaattctct

SEQ ID NO: 548408 - DNA, 25 bp, Rattus norvegicus
tacagggaatgactggtgacctcat

SEQ ID NO: 548409 - DNA, 25 bp, Rattus norvegicus
tacagggaatgagtggtgacctcat

SEQ ID NO: 548410 - DNA, 25 bp, Rattus norvegicus
tacagggaccctaacaagcattaca

SEQ ID NO: 548411 - DNA, 25 bp, Rattus norvegicus
tacagggacccttacaagcattaca

SEQ ID NO: 548412 - DNA, 25 bp, Rattus norvegicus
tacagggacctgcttagatctaaga

SEQ ID NO: 548413 - DNA, 25 bp, Rattus norvegicus
tacagggacctggttagatctaaga

SEQ ID NO: 548414 - DNA, 25 bp, Rattus norvegicus
tacagggactgcatggcttaacaca

SEQ ID NO: 548415 - DNA, 25 bp, Rattus norvegicus
tacagggactgcttggcttaacaca

SEQ ID NO: 548416 - DNA, 25 bp, Rattus norvegicus
tacagggacttgctgtgctcgcaaa

SEQ ID NO: 548417 - DNA, 25 bp, Rattus norvegicus
tacagggacttggtgtgctcgcaaa

SEQ ID NO: 548418 - DNA, 25 bp, Rattus norvegicus
tacagggagcctacctttcctgatc

SEQ ID NO: 548419 - DNA, 25 bp, Rattus norvegicus
tacagggagccttcctttcctgatc

SEQ ID NO: 548420 - DNA, 25 bp, Rattus norvegicus
tacagggaggatcaccctgtcccca

SEQ ID NO: 548421 - DNA, 25 bp, Rattus norvegicus
tacagggaggatgaccctgtcccca

SEQ ID NO: 548422 - DNA, 25 bp, Rattus norvegicus
tacagggatcgtaaagtctgaacaa

SEQ ID NO: 548423 - DNA, 25 bp, Rattus norvegicus
tacagggatcgttaagtctgaacaa

SEQ ID NO: 548424 - DNA, 25 bp, Rattus norvegicus
tacagggatgacctctgactcagtg

SEQ ID NO: 548425 - DNA, 25 bp, Rattus norvegicus
tacagggatgacgtctgactcagtg

SEQ ID NO: 548426 - DNA, 25 bp, Rattus norvegicus
tacagggatgctctttttccattct

SEQ ID NO: 548427 - DNA, 25 bp, Rattus norvegicus
tacagggatgctgtttttccattct

SEQ ID NO: 548428 - DNA, 25 bp, Rattus norvegicus
tacagggcaattagctttttcgggt

SEQ ID NO: 548429 - DNA, 25 bp, Rattus norvegicus
tacagggcaatttgctttttcgggt

SEQ ID NO: 548430 - DNA, 25 bp, Rattus norvegicus
tacagggcacccagatgtcctagag

SEQ ID NO: 548431 - DNA, 25 bp, Rattus norvegicus
tacagggcaccctgatgtcctagag

SEQ ID NO: 548432 - DNA, 25 bp, Rattus norvegicus
tacagggcactgcacattgacctag

SEQ ID NO: 548433 - DNA, 25 bp, Rattus norvegicus
tacagggcactggacattgacctag

SEQ ID NO: 548434 - DNA, 25 bp, Rattus norvegicus
tacagggcagttagtcagacagggc

SEQ ID NO: 548435 - DNA, 25 bp, Rattus norvegicus
tacagggcagtttgtcagacagggc

SEQ ID NO: 548436 - DNA, 25 bp, Rattus norvegicus
tacagggccagactatctgacagac

SEQ ID NO: 548437 - DNA, 25 bp, Rattus norvegicus
tacagggccagagtatctgacagac

SEQ ID NO: 548438 - DNA, 25 bp, Rattus norvegicus
tacagggcccacagatactggacaa

SEQ ID NO: 548439 - DNA, 25 bp, Rattus norvegicus
tacagggcccactgatactggacaa

SEQ ID NO: 548440 - DNA, 25 bp, Rattus norvegicus
tacagggccctaagttgaatttcca

SEQ ID NO: 548441 - DNA, 25 bp, Rattus norvegicus
tacagggccctatgttgaatttcca

SEQ ID NO: 548442 - DNA, 25 bp, Rattus norvegicus
tacagggctctgcaatctgtcacct

SEQ ID NO: 548443 - DNA, 25 bp, Rattus norvegicus
tacagggctctggaatctgtcacct

SEQ ID NO: 548444 - DNA, 25 bp, Rattus norvegicus
tacagggctggcaaaaagtcgaggt

SEQ ID NO: 548445 - DNA, 25 bp, Rattus norvegicus
tacagggctggctaaaagtcgaggt

SEQ ID NO: 548446 - DNA, 25 bp, Rattus norvegicus
tacagggtcatgcaagcttgcatca

SEQ ID NO: 548447 - DNA, 25 bp, Rattus norvegicus
tacagggtcatggaagcttgcatca

SEQ ID NO: 548448 - DNA, 25 bp, Rattus norvegicus
tacagggtccctctctgagtgctaa

SEQ ID NO: 548449 - DNA, 25 bp, Rattus norvegicus
tacagggtccctgtctgagtgctaa

SEQ ID NO: 548450 - DNA, 25 bp, Rattus norvegicus
tacagggtctgcatgtgtacaggat

SEQ ID NO: 548451 - DNA, 25 bp, Rattus norvegicus
tacagggtctgcctacttggccaag

SEQ ID NO: 548452 - DNA, 25 bp, Rattus norvegicus
tacagggtctgcgtacttggccaag

SEQ ID NO: 548453 - DNA, 25 bp, Rattus norvegicus
tacagggtctgcttgtgtacaggat

SEQ ID NO: 548454 - DNA, 25 bp, Rattus norvegicus
tacagggtgatacatctttggcaga

SEQ ID NO: 548455 - DNA, 25 bp, Rattus norvegicus
tacagggtgatagatctttggcaga

SEQ ID NO: 548456 - DNA, 25 bp, Rattus norvegicus
tacagggtggcccaggctttgcata

SEQ ID NO: 548457 - DNA, 25 bp, Rattus norvegicus
tacagggtggccgaggctttgcata

SEQ ID NO: 548458 - DNA, 25 bp, Rattus norvegicus
tacagggtgtttcctccagaagcaa

SEQ ID NO: 548459 - DNA, 25 bp, Rattus norvegicus
tacagggtgtttgctccagaagcaa

SEQ ID NO: 548460 - DNA, 25 bp, Rattus norvegicus
tacaggtcagtcagagtggccacca

SEQ ID NO: 548461 - DNA, 25 bp, Rattus norvegicus
tacaggtcagtctgagtggccacca

SEQ ID NO: 548462 - DNA, 25 bp, Rattus norvegicus
tacaggtcctatatccttttggtct

SEQ ID NO: 548463 - DNA, 25 bp, Rattus norvegicus
tacaggtcctatttccttttggtct

SEQ ID NO: 548464 - DNA, 25 bp, Rattus norvegicus
tacaggtcctccaaagttgtctagc

SEQ ID NO: 548465 - DNA, 25 bp, Rattus norvegicus
tacaggtcctcctaagttgtctagc

SEQ ID NO: 548466 - DNA, 25 bp, Rattus norvegicus
tacaggtccttccaaaattgtcgtc

SEQ ID NO: 548467 - DNA, 25 bp, Rattus norvegicus
tacaggtccttcgaaaattgtcgtc

SEQ ID NO: 548468 - DNA, 25 bp, Rattus norvegicus
tacaggtctctcatcccagataact

SEQ ID NO: 548469 - DNA, 25 bp, Rattus norvegicus
tacaggtctctcttcccagataact

SEQ ID NO: 548470 - DNA, 25 bp, Rattus norvegicus
tacaggtctgcaccatagtcaccac

SEQ ID NO: 548471 - DNA, 25 bp, Rattus norvegicus
tacaggtctgcagcatagtcaccac

SEQ ID NO: 548472 - DNA, 25 bp, Rattus norvegicus
tacaggtctgtgcttggtcctctat

SEQ ID NO: 548473 - DNA, 25 bp, Rattus norvegicus
tacaggtctgtggttggtcctctat

SEQ ID NO: 548474 - DNA, 25 bp, Rattus norvegicus
tacaggtgaacactctccgacgcta

SEQ ID NO: 548475 - DNA, 25 bp, Rattus norvegicus
tacaggtgaacagtctccgacgcta

SEQ ID NO: 548476 - DNA, 25 bp, Rattus norvegicus
tacaggtgcgccaggagcagatccg

SEQ ID NO: 548477 - DNA, 25 bp, Rattus norvegicus
tacaggtgcgcctggagcagatccg

SEQ ID NO: 548478 - DNA, 25 bp, Rattus norvegicus
tacaggtgctggctcagctgacgcc

SEQ ID NO: 548479 - DNA, 25 bp, Rattus norvegicus
tacaggtgctgggtcagctgacgcc

SEQ ID NO: 548480 - DNA, 25 bp, Rattus norvegicus
tacaggtgcttgcatatgcctgtga

SEQ ID NO: 548481 - DNA, 25 bp, Rattus norvegicus
tacaggtgcttggatatgcctgtga

SEQ ID NO: 548482 - DNA, 25 bp, Rattus norvegicus
tacaggtggcatctaccctggctga

SEQ ID NO: 548483 - DNA, 25 bp, Rattus norvegicus
tacaggtggcatgtaccctggctga

SEQ ID NO: 548484 - DNA, 25 bp, Rattus norvegicus
tacaggtggctgatatctggcacat

SEQ ID NO: 548485 - DNA, 25 bp, Rattus norvegicus
tacaggtggctgttatctggcacat

SEQ ID NO: 548486 - DNA, 25 bp, Rattus norvegicus
tacaggttcaccagttcggaaggtt

SEQ ID NO: 548487 - DNA, 25 bp, Rattus norvegicus
tacaggttcacctgttcggaaggtt

SEQ ID NO: 548488 - DNA, 25 bp, Rattus norvegicus
tacaggttcagtcccgatgagtact

SEQ ID NO: 548489 - DNA, 25 bp, Rattus norvegicus
tacaggttcagtgccgatgagtact

SEQ ID NO: 548490 - DNA, 25 bp, Rattus norvegicus
tacaggtttcaaagttcacagggtt

SEQ ID NO: 548491 - DNA, 25 bp, Rattus norvegicus
tacaggtttcaatgttcacagggtt

SEQ ID NO: 548492 - DNA, 25 bp, Rattus norvegicus
tacaggtttctaactggttcacagt

SEQ ID NO: 548493 - DNA, 25 bp, Rattus norvegicus
tacaggtttctatctggttcacagt

SEQ ID NO: 548494 - DNA, 25 bp, Rattus norvegicus
tacaggtttgtacttcattttcaga

SEQ ID NO: 548495 - DNA, 25 bp, Rattus norvegicus
tacaggtttgtagttcattttcaga

SEQ ID NO: 548496 - DNA, 25 bp, Rattus norvegicus
tacaggtttttaaccctcaagcact

SEQ ID NO: 548497 - DNA, 25 bp, Rattus norvegicus
tacaggtttttatccctcaagcact

SEQ ID NO: 548498 - DNA, 25 bp, Rattus norvegicus
tacagtaaccgtcaacagtgccaat

SEQ ID NO: 548499 - DNA, 25 bp, Rattus norvegicus
tacagtaaccgtgaacagtgccaat

SEQ ID NO: 548500 - DNA, 25 bp, Rattus norvegicus
tacagtaacctcagagccttctgca

SEQ ID NO: 548501 - DNA, 25 bp, Rattus norvegicus
tacagtaacctctgagccttctgca

SEQ ID NO: 548502 - DNA, 25 bp, Rattus norvegicus
tacagtaactcaaagttgcctgcaa

SEQ ID NO: 548503 - DNA, 25 bp, Rattus norvegicus
tacagtaactcatagttgcctgcaa

SEQ ID NO: 548504 - DNA, 25 bp, Rattus norvegicus
tacagtaatcacattcccattgttt

SEQ ID NO: 548505 - DNA, 25 bp, Rattus norvegicus
tacagtaatcactttcccattgttt

SEQ ID NO: 548506 - DNA, 25 bp, Rattus norvegicus
tacagtacacatattgtggatcaat

SEQ ID NO: 548507 - DNA, 25 bp, Rattus norvegicus
tacagtacacattttgtggatcaat

SEQ ID NO: 548508 - DNA, 25 bp, Rattus norvegicus
tacagtacagacatgtggtcccatc

SEQ ID NO: 548509 - DNA, 25 bp, Rattus norvegicus
tacagtacagacttgtggtcccatc

SEQ ID NO: 548510 - DNA, 25 bp, Rattus norvegicus
tacagtacagatccctgcttctcag

SEQ ID NO: 548511 - DNA, 25 bp, Rattus norvegicus
tacagtacagatgcctgcttctcag

SEQ ID NO: 548512 - DNA, 25 bp, Rattus norvegicus
tacagtacagttatggcccaatagc

SEQ ID NO: 548513 - DNA, 25 bp, Rattus norvegicus
tacagtacagttttggcccaatagc

SEQ ID NO: 548514 - DNA, 25 bp, Rattus norvegicus
tacagtacatggcatagactttagg

SEQ ID NO: 548515 - DNA, 25 bp, Rattus norvegicus
tacagtacatgggatagactttagg

SEQ ID NO: 548516 - DNA, 25 bp, Rattus norvegicus
tacagtacgtctcattcctttttta

SEQ ID NO: 548517 - DNA, 25 bp, Rattus norvegicus
tacagtacgtctgattcctttttta

SEQ ID NO: 548518 - DNA, 25 bp, Rattus norvegicus
tacagtactcacataaaggcacaat

SEQ ID NO: 548519 - DNA, 25 bp, Rattus norvegicus
tacagtactcacttaaaggcacaat

SEQ ID NO: 548520 - DNA, 25 bp, Rattus norvegicus
tacagtactcttagacgttcagaaa

SEQ ID NO: 548521 - DNA, 25 bp, Rattus norvegicus
tacagtactctttgacgttcagaaa

SEQ ID NO: 548522 - DNA, 25 bp, Rattus norvegicus
tacagtactgtgagttcgacgacca

SEQ ID NO: 548523 - DNA, 25 bp, Rattus norvegicus
tacagtactgtgtgttcgacgacca

SEQ ID NO: 548524 - DNA, 25 bp, Rattus norvegicus
tacagtacttttctttcgtcctatc

SEQ ID NO: 548525 - DNA, 25 bp, Rattus norvegicus
tacagtacttttgtttcgtcctatc

SEQ ID NO: 548526 - DNA, 25 bp, Rattus norvegicus
tacagtagccagctacggcagcaca

SEQ ID NO: 548527 - DNA, 25 bp, Rattus norvegicus
tacagtagccaggtacggcagcaca

SEQ ID NO: 548528 - DNA, 25 bp, Rattus norvegicus
tacagtagctttaaggaaccgtcgg

SEQ ID NO: 548529 - DNA, 25 bp, Rattus norvegicus
tacagtagctttaccccattaattg

SEQ ID NO: 548530 - DNA, 25 bp, Rattus norvegicus
tacagtagcttttaggaaccgtcgg

SEQ ID NO: 548531 - DNA, 25 bp, Rattus norvegicus
tacagtagcttttccccattaattg

SEQ ID NO: 548532 - DNA, 25 bp, Rattus norvegicus
tacagtagggagctatcctgggcct

SEQ ID NO: 548533 - DNA, 25 bp, Rattus norvegicus
tacagtagggaggtatcctgggcct

SEQ ID NO: 548534 - DNA, 25 bp, Rattus norvegicus
tacagtagtcatcaggtgccccaga

SEQ ID NO: 548535 - DNA, 25 bp, Rattus norvegicus
tacagtagtcatgaggtgccccaga

SEQ ID NO: 548536 - DNA, 25 bp, Rattus norvegicus
tacagtagtgctatgaagccagcct

SEQ ID NO: 548537 - DNA, 25 bp, Rattus norvegicus
tacagtagtgctttgaagccagcct

SEQ ID NO: 548538 - DNA, 25 bp, Rattus norvegicus
tacagtattacaacaccacagtggg

SEQ ID NO: 548539 - DNA, 25 bp, Rattus norvegicus
tacagtattacatcaccacagtggg

SEQ ID NO: 548540 - DNA, 25 bp, Rattus norvegicus
tacagtattcctagcttagtcattg

SEQ ID NO: 548541 - DNA, 25 bp, Rattus norvegicus
tacagtattccttgcttagtcattg

SEQ ID NO: 548542 - DNA, 25 bp, Rattus norvegicus
tacagtattcttcctactgctggga

SEQ ID NO: 548543 - DNA, 25 bp, Rattus norvegicus
tacagtattcttgctactgctggga

SEQ ID NO: 548544 - DNA, 25 bp, Rattus norvegicus
tacagtatttgcatcattgtgtggg

SEQ ID NO: 548545 - DNA, 25 bp, Rattus norvegicus
tacagtatttgcttcattgtgtggg

SEQ ID NO: 548546 - DNA, 25 bp, Rattus norvegicus
tacagtcaacgtcgcagatcattct

SEQ ID NO: 548547 - DNA, 25 bp, Rattus norvegicus
tacagtcaacgtggcagatcattct

SEQ ID NO: 548548 - DNA, 25 bp, Rattus norvegicus
tacagtcaatcacagcacatgctac

SEQ ID NO: 548549 - DNA, 25 bp, Rattus norvegicus
tacagtcaatcagagcacatgctac

SEQ ID NO: 548550 - DNA, 25 bp, Rattus norvegicus
tacagtcactctacaatcaaagcat

SEQ ID NO: 548551 - DNA, 25 bp, Rattus norvegicus
tacagtcactcttcaatcaaagcat

SEQ ID NO: 548552 - DNA, 25 bp, Rattus norvegicus
tacagtcagtctaaggtgttaccaa

SEQ ID NO: 548553 - DNA, 25 bp, Rattus norvegicus
tacagtcagtcttaggtgttaccaa

SEQ ID NO: 548554 - DNA, 25 bp, Rattus norvegicus
tacagtcagtgcatacctaggcaga

SEQ ID NO: 548555 - DNA, 25 bp, Rattus norvegicus
tacagtcagtgcttacctaggcaga

SEQ ID NO: 548556 - DNA, 25 bp, Rattus norvegicus
tacagtcattggaggaacaggttta

SEQ ID NO: 548557 - DNA, 25 bp, Rattus norvegicus
tacagtcattggtggaacaggttta

SEQ ID NO: 548558 - DNA, 25 bp, Rattus norvegicus
tacagtccaccacattaacagcttt

SEQ ID NO: 548559 - DNA, 25 bp, Rattus norvegicus
tacagtccaccagattaacagcttt

SEQ ID NO: 548560 - DNA, 25 bp, Rattus norvegicus
tacagtccagccacaagagtttgaa

SEQ ID NO: 548561 - DNA, 25 bp, Rattus norvegicus
tacagtccagcctcaagagtttgaa

SEQ ID NO: 548562 - DNA, 25 bp, Rattus norvegicus
tacagtccaggccttaaggttgaat

SEQ ID NO: 548563 - DNA, 25 bp, Rattus norvegicus
tacagtccaggcgttaaggttgaat

SEQ ID NO: 548564 - DNA, 25 bp, Rattus norvegicus
tacagtccagtgctgatacccagga

SEQ ID NO: 548565 - DNA, 25 bp, Rattus norvegicus
tacagtccagtggtgatacccagga

SEQ ID NO: 548566 - DNA, 25 bp, Rattus norvegicus
tacagtcccaaaccagctaccataa

SEQ ID NO: 548567 - DNA, 25 bp, Rattus norvegicus
tacagtcccaaagcagctaccataa

SEQ ID NO: 548568 - DNA, 25 bp, Rattus norvegicus
tacagtcccatgagcaggtgcctaa

SEQ ID NO: 548569 - DNA, 25 bp, Rattus norvegicus
tacagtcccatgtgcaggtgcctaa

SEQ ID NO: 548570 - DNA, 25 bp, Rattus norvegicus
tacagtcccgagaacgccagcggtg

SEQ ID NO: 548571 - DNA, 25 bp, Rattus norvegicus
tacagtcccgagtacgccagcggtg

SEQ ID NO: 548572 - DNA, 25 bp, Rattus norvegicus
tacagtccgctacagttcaggctca

SEQ ID NO: 548573 - DNA, 25 bp, Rattus norvegicus
tacagtccgctagagttcaggctca

SEQ ID NO: 548574 - DNA, 25 bp, Rattus norvegicus
tacagtccggaccacaacaggtttg

SEQ ID NO: 548575 - DNA, 25 bp, Rattus norvegicus
tacagtccggacgacaacaggtttg

SEQ ID NO: 548576 - DNA, 25 bp, Rattus norvegicus
tacagtcctctgagaaaaccccaag

SEQ ID NO: 548577 - DNA, 25 bp, Rattus norvegicus
tacagtcctctgtgaaaaccccaag

SEQ ID NO: 548578 - DNA, 25 bp, Rattus norvegicus
tacagtcctgggaaaagtttgccaa

SEQ ID NO: 548579 - DNA, 25 bp, Rattus norvegicus
tacagtcctgggtaaagtttgccaa

SEQ ID NO: 548580 - DNA, 25 bp, Rattus norvegicus
tacagtctacacatgtctctaccag

SEQ ID NO: 548581 - DNA, 25 bp, Rattus norvegicus
tacagtctacacttgtctctaccag

SEQ ID NO: 548582 - DNA, 25 bp, Rattus norvegicus
tacagtctcagtcatggccaggcct

SEQ ID NO: 548583 - DNA, 25 bp, Rattus norvegicus
tacagtctcagtgatggccaggcct

SEQ ID NO: 548584 - DNA, 25 bp, Rattus norvegicus
tacagtctcccaatactcaaatctt

SEQ ID NO: 548585 - DNA, 25 bp, Rattus norvegicus
tacagtctcccattactcaaatctt

SEQ ID NO: 548586 - DNA, 25 bp, Rattus norvegicus
tacagtctcgtgacctactagcagg

SEQ ID NO: 548587 - DNA, 25 bp, Rattus norvegicus
tacagtctcgtgtcctactagcagg

SEQ ID NO: 548588 - DNA, 25 bp, Rattus norvegicus
tacagtctctgtcaacttggaacta

SEQ ID NO: 548589 - DNA, 25 bp, Rattus norvegicus
tacagtctctgtgaacttggaacta

SEQ ID NO: 548590 - DNA, 25 bp, Rattus norvegicus
tacagtctgacccaggcagtctctg

SEQ ID NO: 548591 - DNA, 25 bp, Rattus norvegicus
tacagtctgaccgaggcagtctctg

SEQ ID NO: 548592 - DNA, 25 bp, Rattus norvegicus
tacagtctggcccatctacttgaag

SEQ ID NO: 548593 - DNA, 25 bp, Rattus norvegicus
tacagtctggccgatctacttgaag

SEQ ID NO: 548594 - DNA, 25 bp, Rattus norvegicus
tacagtctggcgacattttggagtt

SEQ ID NO: 548595 - DNA, 25 bp, Rattus norvegicus
tacagtctggcgtcattttggagtt

SEQ ID NO: 548596 - DNA, 25 bp, Rattus norvegicus
tacagtcttcccctaaacatggtca

SEQ ID NO: 548597 - DNA, 25 bp, Rattus norvegicus
tacagtcttcccgtaaacatggtca

SEQ ID NO: 548598 - DNA, 25 bp, Rattus norvegicus
tacagtctttaccacatttgctcac

SEQ ID NO: 548599 - DNA, 25 bp, Rattus norvegicus
tacagtctttacgacatttgctcac

SEQ ID NO: 548600 - DNA, 25 bp, Rattus norvegicus
tacagtctttgacccagtgactcag

SEQ ID NO: 548601 - DNA, 25 bp, Rattus norvegicus
tacagtctttgagccagtgactcag

SEQ ID NO: 548602 - DNA, 25 bp, Rattus norvegicus
tacagtgaagctcggctctacgcta

SEQ ID NO: 548603 - DNA, 25 bp, Rattus norvegicus
tacagtgaagctgggctctacgcta

SEQ ID NO: 548604 - DNA, 25 bp, Rattus norvegicus
tacagtgacagccatctttctttgt

SEQ ID NO: 548605 - DNA, 25 bp, Rattus norvegicus
tacagtgacagcgatctttctttgt

SEQ ID NO: 548606 - DNA, 25 bp, Rattus norvegicus
tacagtgaccacctgtttcgtgtcc

SEQ ID NO: 548607 - DNA, 25 bp, Rattus norvegicus
tacagtgaccacgtgtttcgtgtcc

SEQ ID NO: 548608 - DNA, 25 bp, Rattus norvegicus
tacagtgagataacacggattatct

SEQ ID NO: 548609 - DNA, 25 bp, Rattus norvegicus
tacagtgagatatcacggattatct

SEQ ID NO: 548610 - DNA, 25 bp, Rattus norvegicus
tacagtgagcacatcatgccaacac

SEQ ID NO: 548611 - DNA, 25 bp, Rattus norvegicus
tacagtgagcacttcatgccaacac

SEQ ID NO: 548612 - DNA, 25 bp, Rattus norvegicus
tacagtgagcagacactcctcaggg

SEQ ID NO: 548613 - DNA, 25 bp, Rattus norvegicus
tacagtgagcagtcactcctcaggg

SEQ ID NO: 548614 - DNA, 25 bp, Rattus norvegicus
tacagtgagctgcaggccaaccagg

SEQ ID NO: 548615 - DNA, 25 bp, Rattus norvegicus
tacagtgagctggaggccaaccagg

SEQ ID NO: 548616 - DNA, 25 bp, Rattus norvegicus
tacagtgaggcccagcagtgttctt

SEQ ID NO: 548617 - DNA, 25 bp, Rattus norvegicus
tacagtgaggccgagcagtgttctt

SEQ ID NO: 548618 - DNA, 25 bp, Rattus norvegicus
tacagtgagggtcactctgccacac

SEQ ID NO: 548619 - DNA, 25 bp, Rattus norvegicus
tacagtgagggtgactctgccacac

SEQ ID NO: 548620 - DNA, 25 bp, Rattus norvegicus
tacagtgatctgaggcagcggcttc

SEQ ID NO: 548621 - DNA, 25 bp, Rattus norvegicus
tacagtgatctgtggcagcggcttc

SEQ ID NO: 548622 - DNA, 25 bp, Rattus norvegicus
tacagtgcaagtctggactcaccag

SEQ ID NO: 548623 - DNA, 25 bp, Rattus norvegicus
tacagtgcaagtgtggactcaccag

SEQ ID NO: 548624 - DNA, 25 bp, Rattus norvegicus
tacagtgcatgcatagtgccgtgtc

SEQ ID NO: 548625 - DNA, 25 bp, Rattus norvegicus
tacagtgcatgcttagtgccgtgtc

SEQ ID NO: 548626 - DNA, 25 bp, Rattus norvegicus
tacagtgccacaccatcgggaacca

SEQ ID NO: 548627 - DNA, 25 bp, Rattus norvegicus
tacagtgccacagcatcgggaacca

SEQ ID NO: 548628 - DNA, 25 bp, Rattus norvegicus
tacagtgccactcaggaccgataaa

SEQ ID NO: 548629 - DNA, 25 bp, Rattus norvegicus
tacagtgccactgaggaccgataaa

SEQ ID NO: 548630 - DNA, 25 bp, Rattus norvegicus
tacagtgcccagaagacaccaggaa

SEQ ID NO: 548631 - DNA, 25 bp, Rattus norvegicus
tacagtgcccagtagacaccaggaa

SEQ ID NO: 548632 - DNA, 25 bp, Rattus norvegicus
tacagtgccctaaaacggtgttcta

SEQ ID NO: 548633 - DNA, 25 bp, Rattus norvegicus
tacagtgccctataacggtgttcta

SEQ ID NO: 548634 - DNA, 25 bp, Rattus norvegicus
tacagtgcctgaaaaggccagccag

SEQ ID NO: 548635 - DNA, 25 bp, Rattus norvegicus
tacagtgcctgataaggccagccag

SEQ ID NO: 548636 - DNA, 25 bp, Rattus norvegicus
tacagtgcggtccacaacgaccagt

SEQ ID NO: 548637 - DNA, 25 bp, Rattus norvegicus
tacagtgcggtcgacaacgaccagt

SEQ ID NO: 548638 - DNA, 25 bp, Rattus norvegicus
tacagtgctcgaaagatccaggttg

SEQ ID NO: 548639 - DNA, 25 bp, Rattus norvegicus
tacagtgctcgatagatccaggttg

SEQ ID NO: 548640 - DNA, 25 bp, Rattus norvegicus
tacagtgctgtgaacgctgatcagt

SEQ ID NO: 548641 - DNA, 25 bp, Rattus norvegicus
tacagtgctgtgtacgctgatcagt

SEQ ID NO: 548642 - DNA, 25 bp, Rattus norvegicus
tacagtgctgttagaccttttggct

SEQ ID NO: 548643 - DNA, 25 bp, Rattus norvegicus
tacagtgctgtttgaccttttggct

SEQ ID NO: 548644 - DNA, 25 bp, Rattus norvegicus
tacagtggaaagacaaaccccatct

SEQ ID NO: 548645 - DNA, 25 bp, Rattus norvegicus
tacagtggaaagtcaaaccccatct

SEQ ID NO: 548646 - DNA, 25 bp, Rattus norvegicus
tacagtggaagtaacctcaggcatc

SEQ ID NO: 548647 - DNA, 25 bp, Rattus norvegicus
tacagtggaagttacctcaggcatc

SEQ ID NO: 548648 - DNA, 25 bp, Rattus norvegicus
tacagtggatatacaggaacggata

SEQ ID NO: 548649 - DNA, 25 bp, Rattus norvegicus
tacagtggatattcaggaacggata

SEQ ID NO: 548650 - DNA, 25 bp, Rattus norvegicus
tacagtggatccacggagcaggagt

SEQ ID NO: 548651 - DNA, 25 bp, Rattus norvegicus
tacagtggatcctcggagcaggagt

SEQ ID NO: 548652 - DNA, 25 bp, Rattus norvegicus
tacagtggatttcggtcttcatgct

SEQ ID NO: 548653 - DNA, 25 bp, Rattus norvegicus
tacagtggatttgggtcttcatgct

SEQ ID NO: 548654 - DNA, 25 bp, Rattus norvegicus
tacagtggcatacacagtcccaaag

SEQ ID NO: 548655 - DNA, 25 bp, Rattus norvegicus
tacagtggcatagacagtcccaaag

SEQ ID NO: 548656 - DNA, 25 bp, Rattus norvegicus
tacagtggcccaattccattgggat

SEQ ID NO: 548657 - DNA, 25 bp, Rattus norvegicus
tacagtggcccatttccattgggat

SEQ ID NO: 548658 - DNA, 25 bp, Rattus norvegicus
tacagtggccctatggtttgttagt

SEQ ID NO: 548659 - DNA, 25 bp, Rattus norvegicus
tacagtggccctttggtttgttagt

SEQ ID NO: 548660 - DNA, 25 bp, Rattus norvegicus
tacagtggcgctctttgtgtggtcc

SEQ ID NO: 548661 - DNA, 25 bp, Rattus norvegicus
tacagtggcgctgtttgtgtggtcc

SEQ ID NO: 548662 - DNA, 25 bp, Rattus norvegicus
tacagtgggactatcatggacccgc

SEQ ID NO: 548663 - DNA, 25 bp, Rattus norvegicus
tacagtgggactttcatggacccgc

SEQ ID NO: 548664 - DNA, 25 bp, Rattus norvegicus
tacagtgggtgcagacactgcccag

SEQ ID NO: 548665 - DNA, 25 bp, Rattus norvegicus
tacagtgggtgctgacactgcccag

SEQ ID NO: 548666 - DNA, 25 bp, Rattus norvegicus
tacagtgtaagcaccagtctctttg

SEQ ID NO: 548667 - DNA, 25 bp, Rattus norvegicus
tacagtgtaagctccagtctctttg

SEQ ID NO: 548668 - DNA, 25 bp, Rattus norvegicus
tacagtgtacgtctgctcttttctt

SEQ ID NO: 548669 - DNA, 25 bp, Rattus norvegicus
tacagtgtacgtgtgctcttttctt

SEQ ID NO: 548670 - DNA, 25 bp, Rattus norvegicus
tacagtgtactcactctacagtgta

SEQ ID NO: 548671 - DNA, 25 bp, Rattus norvegicus
tacagtgtactctctctacagtgta

SEQ ID NO: 548672 - DNA, 25 bp, Rattus norvegicus
tacagtgtatgcaccactcagtgat

SEQ ID NO: 548673 - DNA, 25 bp, Rattus norvegicus
tacagtgtatgctccactcagtgat

SEQ ID NO: 548674 - DNA, 25 bp, Rattus norvegicus
tacagtgtcaggaacatgtgctctt

SEQ ID NO: 548675 - DNA, 25 bp, Rattus norvegicus
tacagtgtcaggtacatgtgctctt

SEQ ID NO: 548676 - DNA, 25 bp, Rattus norvegicus
tacagtgtcccacagccaggagaga

SEQ ID NO: 548677 - DNA, 25 bp, Rattus norvegicus
tacagtgtcccagagccaggagaga

SEQ ID NO: 548678 - DNA, 25 bp, Rattus norvegicus
tacagtgtctttcctggtttgtcat

SEQ ID NO: 548679 - DNA, 25 bp, Rattus norvegicus
tacagtgtctttgctggtttgtcat

SEQ ID NO: 548680 - DNA, 25 bp, Rattus norvegicus
tacagtgtgaagatcttaagtttaa

SEQ ID NO: 548681 - DNA, 25 bp, Rattus norvegicus
tacagtgtgaagttcttaagtttaa

SEQ ID NO: 548682 - DNA, 25 bp, Rattus norvegicus
tacagtgtgaggctccaccatgagt

SEQ ID NO: 548683 - DNA, 25 bp, Rattus norvegicus
tacagtgtgagggtccaccatgagt

SEQ ID NO: 548684 - DNA, 25 bp, Rattus norvegicus
tacagtgtgcatctcctttgaggtg

SEQ ID NO: 548685 - DNA, 25 bp, Rattus norvegicus
tacagtgtgcatgtcctttgaggtg

SEQ ID NO: 548686 - DNA, 25 bp, Rattus norvegicus
tacagtgtgccccaggccaaggctt

SEQ ID NO: 548687 - DNA, 25 bp, Rattus norvegicus
tacagtgtgcccgaggccaaggctt

SEQ ID NO: 548688 - DNA, 25 bp, Rattus norvegicus
tacagtgtggacatcttgcagcgtg

SEQ ID NO: 548689 - DNA, 25 bp, Rattus norvegicus
tacagtgtggacttcttgcagcgtg

SEQ ID NO: 548690 - DNA, 25 bp, Rattus norvegicus
tacagtgtggtgaacacctctgcac

SEQ ID NO: 548691 - DNA, 25 bp, Rattus norvegicus
tacagtgtggtgtacacctctgcac

SEQ ID NO: 548692 - DNA, 25 bp, Rattus norvegicus
tacagtgtgtttctctgttttgcat

SEQ ID NO: 548693 - DNA, 25 bp, Rattus norvegicus
tacagtgtgtttgtctgttttgcat

SEQ ID NO: 548694 - DNA, 25 bp, Rattus norvegicus
tacagtgtttacatgcaagtgcatt

SEQ ID NO: 548695 - DNA, 25 bp, Rattus norvegicus
tacagtgtttacttgcaagtgcatt

SEQ ID NO: 548696 - DNA, 25 bp, Rattus norvegicus
tacagtgtttgcctaaccctcatga

SEQ ID NO: 548697 - DNA, 25 bp, Rattus norvegicus
tacagtgtttgcgtaaccctcatga

SEQ ID NO: 548698 - DNA, 25 bp, Rattus norvegicus
tacagtgttttgacgcagccattat

SEQ ID NO: 548699 - DNA, 25 bp, Rattus norvegicus
tacagtgttttgtcgcagccattat

SEQ ID NO: 548700 - DNA, 25 bp, Rattus norvegicus
tacagttaacttattgaggattcca

SEQ ID NO: 548701 - DNA, 25 bp, Rattus norvegicus
tacagttaactttttgaggattcca

SEQ ID NO: 548702 - DNA, 25 bp, Rattus norvegicus
tacagttacataccagctctttgag

SEQ ID NO: 548703 - DNA, 25 bp, Rattus norvegicus
tacagttacatagcagctctttgag

SEQ ID NO: 548704 - DNA, 25 bp, Rattus norvegicus
tacagttaccttatgtgacaggact

SEQ ID NO: 548705 - DNA, 25 bp, Rattus norvegicus
tacagttaccttttgtgacaggact

SEQ ID NO: 548706 - DNA, 25 bp, Rattus norvegicus
tacagttactgaagacctgctcaaa

SEQ ID NO: 548707 - DNA, 25 bp, Rattus norvegicus
tacagttactgatgacctgctcaaa

SEQ ID NO: 548708 - DNA, 25 bp, Rattus norvegicus
tacagttcaaccatggctatacagt

SEQ ID NO: 548709 - DNA, 25 bp, Rattus norvegicus
tacagttcaaccttggctatacagt

SEQ ID NO: 548710 - DNA, 25 bp, Rattus norvegicus
tacagttccaaacctactgcagagc

SEQ ID NO: 548711 - DNA, 25 bp, Rattus norvegicus
tacagttccaaagctactgcagagc

SEQ ID NO: 548712 - DNA, 25 bp, Rattus norvegicus
tacagttcccatcacgtaagtcggt

SEQ ID NO: 548713 - DNA, 25 bp, Rattus norvegicus
tacagttcccatgacgtaagtcggt

SEQ ID NO: 548714 - DNA, 25 bp, Rattus norvegicus
tacagttccgacaggcaggccaacc

SEQ ID NO: 548715 - DNA, 25 bp, Rattus norvegicus
tacagttccgactggcaggccaacc

SEQ ID NO: 548716 - DNA, 25 bp, Rattus norvegicus
tacagttccgctatggcacgtttaa

SEQ ID NO: 548717 - DNA, 25 bp, Rattus norvegicus
tacagttccgctttggcacgtttaa

SEQ ID NO: 548718 - DNA, 25 bp, Rattus norvegicus
tacagttcctggcttgctaacgctg

SEQ ID NO: 548719 - DNA, 25 bp, Rattus norvegicus
tacagttcctgggttgctaacgctg

SEQ ID NO: 548720 - DNA, 25 bp, Rattus norvegicus
tacagttccttaccatttagttaaa

SEQ ID NO: 548721 - DNA, 25 bp, Rattus norvegicus
tacagttccttagcatttagttaaa

SEQ ID NO: 548722 - DNA, 25 bp, Rattus norvegicus
tacagttccttgcttcttggagact

SEQ ID NO: 548723 - DNA, 25 bp, Rattus norvegicus
tacagttccttggttcttggagact

SEQ ID NO: 548724 - DNA, 25 bp, Rattus norvegicus
tacagttctgacaagtgttcccgaa

SEQ ID NO: 548725 - DNA, 25 bp, Rattus norvegicus
tacagttctgactagtgttcccgaa

SEQ ID NO: 548726 - DNA, 25 bp, Rattus norvegicus
tacagttctgatcagcagggcctgc

SEQ ID NO: 548727 - DNA, 25 bp, Rattus norvegicus
tacagttctgatgagcagggcctgc

SEQ ID NO: 548728 - DNA, 25 bp, Rattus norvegicus
tacagttctgccatttattgctcct

SEQ ID NO: 548729 - DNA, 25 bp, Rattus norvegicus
tacagttctgccttttattgctcct

SEQ ID NO: 548730 - DNA, 25 bp, Rattus norvegicus
tacagttcttatcccacagagcaga

SEQ ID NO: 548731 - DNA, 25 bp, Rattus norvegicus
tacagttcttatgccacagagcaga

SEQ ID NO: 548732 - DNA, 25 bp, Rattus norvegicus
tacagttgccaaaacattaccacaa

SEQ ID NO: 548733 - DNA, 25 bp, Rattus norvegicus
tacagttgccaatacattaccacaa

SEQ ID NO: 548734 - DNA, 25 bp, Rattus norvegicus
tacagttggccaaggtctgctacag

SEQ ID NO: 548735 - DNA, 25 bp, Rattus norvegicus
tacagttggccatggtctgctacag

SEQ ID NO: 548736 - DNA, 25 bp, Rattus norvegicus
tacagttgtcatacacaaggcgcat

SEQ ID NO: 548737 - DNA, 25 bp, Rattus norvegicus
tacagttgtcattcacaaggcgcat

SEQ ID NO: 548738 - DNA, 25 bp, Rattus norvegicus
tacagtttaacaatcagagccacat

SEQ ID NO: 548739 - DNA, 25 bp, Rattus norvegicus
tacagtttaacattcagagccacat

SEQ ID NO: 548740 - DNA, 25 bp, Rattus norvegicus
tacagtttactgaccatcataaagg

SEQ ID NO: 548741 - DNA, 25 bp, Rattus norvegicus
tacagtttactgtccatcataaagg

SEQ ID NO: 548742 - DNA, 25 bp, Rattus norvegicus
tacagtttcagtcaccagagtggta

SEQ ID NO: 548743 - DNA, 25 bp, Rattus norvegicus
tacagtttcagtgaccagagtggta

SEQ ID NO: 548744 - DNA, 25 bp, Rattus norvegicus
tacagtttcctacaactttgccaga

SEQ ID NO: 548745 - DNA, 25 bp, Rattus norvegicus
tacagtttcctagaactttgccaga

SEQ ID NO: 548746 - DNA, 25 bp, Rattus norvegicus
tacagtttcctgacgtttccttgca

SEQ ID NO: 548747 - DNA, 25 bp, Rattus norvegicus
tacagtttcctgctctagtgaacac

SEQ ID NO: 548748 - DNA, 25 bp, Rattus norvegicus
tacagtttcctggtctagtgaacac

SEQ ID NO: 548749 - DNA, 25 bp, Rattus norvegicus
tacagtttcctgtcgtttccttgca

SEQ ID NO: 548750 - DNA, 25 bp, Rattus norvegicus
tacagtttctggctgacagcattaa

SEQ ID NO: 548751 - DNA, 25 bp, Rattus norvegicus
tacagtttctgggtgacagcattaa

SEQ ID NO: 548752 - DNA, 25 bp, Rattus norvegicus
tacagtttgacgatatcctttaaga

SEQ ID NO: 548753 - DNA, 25 bp, Rattus norvegicus
tacagtttgacgttatcctttaaga

SEQ ID NO: 548754 - DNA, 25 bp, Rattus norvegicus
tacagtttgctacgatcgaaaaaag

SEQ ID NO: 548755 - DNA, 25 bp, Rattus norvegicus
tacagtttgctaggatcgaaaaaag

SEQ ID NO: 548756 - DNA, 25 bp, Rattus norvegicus
tacagtttgctcatggcttagccat

SEQ ID NO: 548757 - DNA, 25 bp, Rattus norvegicus
tacagtttgctcttggcttagccat

SEQ ID NO: 548758 - DNA, 25 bp, Rattus norvegicus
tacagtttgctgagaaccttgctac

SEQ ID NO: 548759 - DNA, 25 bp, Rattus norvegicus
tacagtttgctgtgaaccttgctac

SEQ ID NO: 548760 - DNA, 25 bp, Rattus norvegicus
tacagtttgcttccgctgagagctt

SEQ ID NO: 548761 - DNA, 25 bp, Rattus norvegicus
tacagtttgcttgcgctgagagctt

SEQ ID NO: 548762 - DNA, 25 bp, Rattus norvegicus
tacagtttgtctacctttcttggta

SEQ ID NO: 548763 - DNA, 25 bp, Rattus norvegicus
tacagtttgtcttcctttcttggta

SEQ ID NO: 548764 - DNA, 25 bp, Rattus norvegicus
tacagtttgtgtcctctgacggctc

SEQ ID NO: 548765 - DNA, 25 bp, Rattus norvegicus
tacagtttgtgtgctctgacggctc

SEQ ID NO: 548766 - DNA, 25 bp, Rattus norvegicus
tacagttttaccacagagggactct

SEQ ID NO: 548767 - DNA, 25 bp, Rattus norvegicus
tacagttttacctcagagggactct

SEQ ID NO: 548768 - DNA, 25 bp, Rattus norvegicus
tacagttttagcagttggctcctaa

SEQ ID NO: 548769 - DNA, 25 bp, Rattus norvegicus
tacagttttagctgttggctcctaa

SEQ ID NO: 548770 - DNA, 25 bp, Rattus norvegicus
tacagttttgttacctcagtttact

SEQ ID NO: 548771 - DNA, 25 bp, Rattus norvegicus
tacagttttgtttcctcagtttact

SEQ ID NO: 548772 - DNA, 25 bp, Rattus norvegicus
tacataaaccagaggcgagccaggc

SEQ ID NO: 548773 - DNA, 25 bp, Rattus norvegicus
tacataaaccagtggcgagccaggc

SEQ ID NO: 548774 - DNA, 25 bp, Rattus norvegicus
tacataaaggcgctgggcttccttc

SEQ ID NO: 548775 - DNA, 25 bp, Rattus norvegicus
tacataaaggcggtgggcttccttc

SEQ ID NO: 548776 - DNA, 25 bp, Rattus norvegicus
tacataagcttacacagccgcacac

SEQ ID NO: 548777 - DNA, 25 bp, Rattus norvegicus
tacataagcttagacagccgcacac

SEQ ID NO: 548778 - DNA, 25 bp, Rattus norvegicus
tacataatctgaacaacccctgggc

SEQ ID NO: 548779 - DNA, 25 bp, Rattus norvegicus
tacataatctgatcaacccctgggc

SEQ ID NO: 548780 - DNA, 25 bp, Rattus norvegicus
tacataatctttctccagctacagg

SEQ ID NO: 548781 - DNA, 25 bp, Rattus norvegicus
tacataatctttgtccagctacagg

SEQ ID NO: 548782 - DNA, 25 bp, Rattus norvegicus
tacataatgaccacccctattgcag

SEQ ID NO: 548783 - DNA, 25 bp, Rattus norvegicus
tacataatgacctcccctattgcag

SEQ ID NO: 548784 - DNA, 25 bp, Rattus norvegicus
tacataattcatagcagagctgctt

SEQ ID NO: 548785 - DNA, 25 bp, Rattus norvegicus
tacataattcattgcagagctgctt

SEQ ID NO: 548786 - DNA, 25 bp, Rattus norvegicus
tacataattgtacgagggaagtttt

SEQ ID NO: 548787 - DNA, 25 bp, Rattus norvegicus
tacataattgtaggagggaagtttt

SEQ ID NO: 548788 - DNA, 25 bp, Rattus norvegicus
tacatacaatacacagacgctgggt

SEQ ID NO: 548789 - DNA, 25 bp, Rattus norvegicus
tacatacaatactcagacgctgggt

SEQ ID NO: 548790 - DNA, 25 bp, Rattus norvegicus
tacatacaccacacacccaaagagg

SEQ ID NO: 548791 - DNA, 25 bp, Rattus norvegicus
tacatacaccactcacccaaagagg

SEQ ID NO: 548792 - DNA, 25 bp, Rattus norvegicus
tacatacagctaattttgttgcatt

SEQ ID NO: 548793 - DNA, 25 bp, Rattus norvegicus
tacatacagctatttttgttgcatt

SEQ ID NO: 548794 - DNA, 25 bp, Rattus norvegicus
tacatacagtacatgttgcttgttt

SEQ ID NO: 548795 - DNA, 25 bp, Rattus norvegicus
tacatacagtacttgttgcttgttt

SEQ ID NO: 548796 - DNA, 25 bp, Rattus norvegicus
tacatacagtgtagcttgctgaagc

SEQ ID NO: 548797 - DNA, 25 bp, Rattus norvegicus
tacatacagtgttgcttgctgaagc

SEQ ID NO: 548798 - DNA, 25 bp, Rattus norvegicus
tacatacatggcagtttgtccttcc

SEQ ID NO: 548799 - DNA, 25 bp, Rattus norvegicus
tacatacatggctgtttgtccttcc

SEQ ID NO: 548800 - DNA, 25 bp, Rattus norvegicus
tacataccactgaacccaaagcagg

SEQ ID NO: 548801 - DNA, 25 bp, Rattus norvegicus
tacataccactgtacccaaagcagg

SEQ ID NO: 548802 - DNA, 25 bp, Rattus norvegicus
tacatacccaggagccaacaggaga

SEQ ID NO: 548803 - DNA, 25 bp, Rattus norvegicus
tacatacccaggtgccaacaggaga

SEQ ID NO: 548804 - DNA, 25 bp, Rattus norvegicus
tacatacccgtgctgttcactacag

SEQ ID NO: 548805 - DNA, 25 bp, Rattus norvegicus
tacatacccgtggtgttcactacag

SEQ ID NO: 548806 - DNA, 25 bp, Rattus norvegicus
tacataccgagtcctttctttactg

SEQ ID NO: 548807 - DNA, 25 bp, Rattus norvegicus
tacataccgagtgctttctttactg

SEQ ID NO: 548808 - DNA, 25 bp, Rattus norvegicus
tacatacctatcaggagccatggat

SEQ ID NO: 548809 - DNA, 25 bp, Rattus norvegicus
tacatacctatctggagccatggat

SEQ ID NO: 548810 - DNA, 25 bp, Rattus norvegicus
tacatacggctacactggctagaga

SEQ ID NO: 548811 - DNA, 25 bp, Rattus norvegicus
tacatacggctagactggctagaga

SEQ ID NO: 548812 - DNA, 25 bp, Rattus norvegicus
tacatacgggcaaatgactcccact

SEQ ID NO: 548813 - DNA, 25 bp, Rattus norvegicus
tacatacgggcatatgactcccact

SEQ ID NO: 548814 - DNA, 25 bp, Rattus norvegicus
tacatactcggtactgagccctgtt

SEQ ID NO: 548815 - DNA, 25 bp, Rattus norvegicus
tacatactcggttctgagccctgtt

SEQ ID NO: 548816 - DNA, 25 bp, Rattus norvegicus
tacatacttcatatacaacagggtt

SEQ ID NO: 548817 - DNA, 25 bp, Rattus norvegicus
tacatacttcatttacaacagggtt

SEQ ID NO: 548818 - DNA, 25 bp, Rattus norvegicus
tacatagaagccaccaagcctactg

SEQ ID NO: 548819 - DNA, 25 bp, Rattus norvegicus
tacatagaagcctccaagcctactg

SEQ ID NO: 548820 - DNA, 25 bp, Rattus norvegicus
tacatagaatttaatagtcccagca

SEQ ID NO: 548821 - DNA, 25 bp, Rattus norvegicus
tacatagaattttatagtcccagca

SEQ ID NO: 548822 - DNA, 25 bp, Rattus norvegicus
tacatagaccacactgaacctgctg

SEQ ID NO: 548823 - DNA, 25 bp, Rattus norvegicus
tacatagaccactctgaacctgctg

SEQ ID NO: 548824 - DNA, 25 bp, Rattus norvegicus
tacatagaggttccctccggagtgg

SEQ ID NO: 548825 - DNA, 25 bp, Rattus norvegicus
tacatagaggttgcctccggagtgg

SEQ ID NO: 548826 - DNA, 25 bp, Rattus norvegicus
tacatagattttctcgtgtccgctg

SEQ ID NO: 548827 - DNA, 25 bp, Rattus norvegicus
tacatagattttgtcgtgtccgctg

SEQ ID NO: 548828 - DNA, 25 bp, Rattus norvegicus
tacatagcaatgacacctacaacct

SEQ ID NO: 548829 - DNA, 25 bp, Rattus norvegicus
tacatagcaatgtcacctacaacct

SEQ ID NO: 548830 - DNA, 25 bp, Rattus norvegicus
tacatagcagatcaaccccaacaag

SEQ ID NO: 548831 - DNA, 25 bp, Rattus norvegicus
tacatagcagatgaaccccaacaag

SEQ ID NO: 548832 - DNA, 25 bp, Rattus norvegicus
tacatagccagcacaaggacagcct

SEQ ID NO: 548833 - DNA, 25 bp, Rattus norvegicus
tacatagccagctcaaggacagcct

SEQ ID NO: 548834 - DNA, 25 bp, Rattus norvegicus
tacatagccaggagctgccttacag

SEQ ID NO: 548835 - DNA, 25 bp, Rattus norvegicus
tacatagccaggtgctgccttacag

SEQ ID NO: 548836 - DNA, 25 bp, Rattus norvegicus
tacatagcctgcaagcattcatctc

SEQ ID NO: 548837 - DNA, 25 bp, Rattus norvegicus
tacatagcctgctagcattcatctc

SEQ ID NO: 548838 - DNA, 25 bp, Rattus norvegicus
tacatagctgtaccacaactcgtga

SEQ ID NO: 548839 - DNA, 25 bp, Rattus norvegicus
tacatagctgtagcacaactcgtga

SEQ ID NO: 548840 - DNA, 25 bp, Rattus norvegicus
tacataggatcccagttaggcactg

SEQ ID NO: 548841 - DNA, 25 bp, Rattus norvegicus
tacataggatccgagttaggcactg

SEQ ID NO: 548842 - DNA, 25 bp, Rattus norvegicus
tacataggtcacattgtaggaacaa

SEQ ID NO: 548843 - DNA, 25 bp, Rattus norvegicus
tacataggtcactttgtaggaacaa

SEQ ID NO: 548844 - DNA, 25 bp, Rattus norvegicus
tacataggtgtcagtttgtcctccc

SEQ ID NO: 548845 - DNA, 25 bp, Rattus norvegicus
tacataggtgtctgtttgtcctccc

SEQ ID NO: 548846 - DNA, 25 bp, Rattus norvegicus
tacatagtccggacttttctgagtt

SEQ ID NO: 548847 - DNA, 25 bp, Rattus norvegicus
tacatagtccggtcttttctgagtt

SEQ ID NO: 548848 - DNA, 25 bp, Rattus norvegicus
tacatagtgacgaaccaggcattcg

SEQ ID NO: 548849 - DNA, 25 bp, Rattus norvegicus
tacatagtgacgtaccaggcattcg

SEQ ID NO: 548850 - DNA, 25 bp, Rattus norvegicus
tacatagtgagactggtggcacatt

SEQ ID NO: 548851 - DNA, 25 bp, Rattus norvegicus
tacatagtgagagtggtggcacatt

SEQ ID NO: 548852 - DNA, 25 bp, Rattus norvegicus
tacatagtgagtaccggacacccag

SEQ ID NO: 548853 - DNA, 25 bp, Rattus norvegicus
tacatagtgagttccggacacccag

SEQ ID NO: 548854 - DNA, 25 bp, Rattus norvegicus
tacatagtggcaactgctctctacc

SEQ ID NO: 548855 - DNA, 25 bp, Rattus norvegicus
tacatagtggcatctgctctctacc

SEQ ID NO: 548856 - DNA, 25 bp, Rattus norvegicus
tacatagttcggcttagccaccacg

SEQ ID NO: 548857 - DNA, 25 bp, Rattus norvegicus
tacatagttcgggttagccaccacg

SEQ ID NO: 548858 - DNA, 25 bp, Rattus norvegicus
tacatagttgtcattgccatctgct

SEQ ID NO: 548859 - DNA, 25 bp, Rattus norvegicus
tacatagttgtctttgccatctgct

SEQ ID NO: 548860 - DNA, 25 bp, Rattus norvegicus
tacatataaacactggaggaggccc

SEQ ID NO: 548861 - DNA, 25 bp, Rattus norvegicus
tacatataaacagtggaggaggccc

SEQ ID NO: 548862 - DNA, 25 bp, Rattus norvegicus
tacatatatctaaaggtcctcccct

SEQ ID NO: 548863 - DNA, 25 bp, Rattus norvegicus
tacatatatctataggtcctcccct

SEQ ID NO: 548864 - DNA, 25 bp, Rattus norvegicus
tacatatgccacctccactgggaaa

SEQ ID NO: 548865 - DNA, 25 bp, Rattus norvegicus
tacatatgccacgtccactgggaaa

SEQ ID NO: 548866 - DNA, 25 bp, Rattus norvegicus
tacatatgccatcctgagtctaagc

SEQ ID NO: 548867 - DNA, 25 bp, Rattus norvegicus
tacatatgccatgctgagtctaagc

SEQ ID NO: 548868 - DNA, 25 bp, Rattus norvegicus
tacatatgtcatcagcagtttgctt

SEQ ID NO: 548869 - DNA, 25 bp, Rattus norvegicus
tacatatgtcatgagcagtttgctt

SEQ ID NO: 548870 - DNA, 25 bp, Rattus norvegicus
tacatattgagaatctgtcctgtct

SEQ ID NO: 548871 - DNA, 25 bp, Rattus norvegicus
tacatattgagattctgtcctgtct

SEQ ID NO: 548872 - DNA, 25 bp, Rattus norvegicus
tacatcaacaggcttccaatgctct

SEQ ID NO: 548873 - DNA, 25 bp, Rattus norvegicus
tacatcaacagggttccaatgctct

SEQ ID NO: 548874 - DNA, 25 bp, Rattus norvegicus
tacatcaacttacaggtgtgacctt

SEQ ID NO: 548875 - DNA, 25 bp, Rattus norvegicus
tacatcaacttagaggtgtgacctt

SEQ ID NO: 548876 - DNA, 25 bp, Rattus norvegicus
tacatcaagggcagatccacgtcat

SEQ ID NO: 548877 - DNA, 25 bp, Rattus norvegicus
tacatcaagggctgatccacgtcat

SEQ ID NO: 548878 - DNA, 25 bp, Rattus norvegicus
tacatcaatcacagtcccttatagc

SEQ ID NO: 548879 - DNA, 25 bp, Rattus norvegicus
tacatcaatcactgtcccttatagc

SEQ ID NO: 548880 - DNA, 25 bp, Rattus norvegicus
tacatcaatgatcctgcctttcacc

SEQ ID NO: 548881 - DNA, 25 bp, Rattus norvegicus
tacatcaatgatgctgcctttcacc

SEQ ID NO: 548882 - DNA, 25 bp, Rattus norvegicus
tacatcaccaagagcaggaaccctg

SEQ ID NO: 548883 - DNA, 25 bp, Rattus norvegicus
tacatcaccaagtgcaggaaccctg

SEQ ID NO: 548884 - DNA, 25 bp, Rattus norvegicus
tacatcaccgacagacgtaatctcg

SEQ ID NO: 548885 - DNA, 25 bp, Rattus norvegicus
tacatcaccgactgacgtaatctcg

SEQ ID NO: 548886 - DNA, 25 bp, Rattus norvegicus
tacatcacgagtctacagctcttat

SEQ ID NO: 548887 - DNA, 25 bp, Rattus norvegicus
tacatcacgagtgtacagctcttat

SEQ ID NO: 548888 - DNA, 25 bp, Rattus norvegicus
tacatcagccacagagtggccaaga

SEQ ID NO: 548889 - DNA, 25 bp, Rattus norvegicus
tacatcagccactgagtggccaaga

SEQ ID NO: 548890 - DNA, 25 bp, Rattus norvegicus
tacatcagccggacacagcagtgga

SEQ ID NO: 548891 - DNA, 25 bp, Rattus norvegicus
tacatcagccggtcacagcagtgga

SEQ ID NO: 548892 - DNA, 25 bp, Rattus norvegicus
tacatcagcgccagcgtgaggaaga

SEQ ID NO: 548893 - DNA, 25 bp, Rattus norvegicus
tacatcagcgcctgcgtgaggaaga

SEQ ID NO: 548894 - DNA, 25 bp, Rattus norvegicus
tacatcagcgtcacactggatggtt

SEQ ID NO: 548895 - DNA, 25 bp, Rattus norvegicus
tacatcagcgtctcactggatggtt

SEQ ID NO: 548896 - DNA, 25 bp, Rattus norvegicus
tacatcatctcacactagttcaggc

SEQ ID NO: 548897 - DNA, 25 bp, Rattus norvegicus
tacatcatctcagactagttcaggc

SEQ ID NO: 548898 - DNA, 25 bp, Rattus norvegicus
tacatcatctgtacctgaaccgctg

SEQ ID NO: 548899 - DNA, 25 bp, Rattus norvegicus
tacatcatctgttcctgaaccgctg

SEQ ID NO: 548900 - DNA, 25 bp, Rattus norvegicus
tacatcatgccacgtacactgtgcc

SEQ ID NO: 548901 - DNA, 25 bp, Rattus norvegicus
tacatcatgccaggtacactgtgcc

SEQ ID NO: 548902 - DNA, 25 bp, Rattus norvegicus
tacatcattcgacgtatggcacccc

SEQ ID NO: 548903 - DNA, 25 bp, Rattus norvegicus
tacatcattcgaggtatggcacccc

SEQ ID NO: 548904 - DNA, 25 bp, Rattus norvegicus
tacatcattggccttaactctagaa

SEQ ID NO: 548905 - DNA, 25 bp, Rattus norvegicus
tacatcattggcgttaactctagaa

SEQ ID NO: 548906 - DNA, 25 bp, Rattus norvegicus
tacatccacaggcttttgacacttg

SEQ ID NO: 548907 - DNA, 25 bp, Rattus norvegicus
tacatccacagggttttgacacttg

SEQ ID NO: 548908 - DNA, 25 bp, Rattus norvegicus
tacatccagagtcgggcagacacca

SEQ ID NO: 548909 - DNA, 25 bp, Rattus norvegicus
tacatccagagtggggcagacacca

SEQ ID NO: 548910 - DNA, 25 bp, Rattus norvegicus
tacatccagatcagagtctctcata

SEQ ID NO: 548911 - DNA, 25 bp, Rattus norvegicus
tacatccagatctgagtctctcata

SEQ ID NO: 548912 - DNA, 25 bp, Rattus norvegicus
tacatccagcatcacccacagagga

SEQ ID NO: 548913 - DNA, 25 bp, Rattus norvegicus
tacatccagcatgacccacagagga

SEQ ID NO: 548914 - DNA, 25 bp, Rattus norvegicus
tacatccaggtacacagcccagagt

SEQ ID NO: 548915 - DNA, 25 bp, Rattus norvegicus
tacatccaggtagacagcccagagt

SEQ ID NO: 548916 - DNA, 25 bp, Rattus norvegicus
tacatccattctcgtaatttgcctg

SEQ ID NO: 548917 - DNA, 25 bp, Rattus norvegicus
tacatccattctggtaatttgcctg

SEQ ID NO: 548918 - DNA, 25 bp, Rattus norvegicus
tacatcccaagcctgttggtcctgg

SEQ ID NO: 548919 - DNA, 25 bp, Rattus norvegicus
tacatcccaagcgtgttggtcctgg

SEQ ID NO: 548920 - DNA, 25 bp, Rattus norvegicus
tacatcccagcccaggattctagaa

SEQ ID NO: 548921 - DNA, 25 bp, Rattus norvegicus
tacatcccagccgaggattctagaa

SEQ ID NO: 548922 - DNA, 25 bp, Rattus norvegicus
tacatcccaggcactaaaatgattt

SEQ ID NO: 548923 - DNA, 25 bp, Rattus norvegicus
tacatcccaggctctaaaatgattt

SEQ ID NO: 548924 - DNA, 25 bp, Rattus norvegicus
tacatcccatggcttggtctttgtt

SEQ ID NO: 548925 - DNA, 25 bp, Rattus norvegicus
tacatcccatgggttggtctttgtt

SEQ ID NO: 548926 - DNA, 25 bp, Rattus norvegicus
tacatcccattcaagactgtgccat

SEQ ID NO: 548927 - DNA, 25 bp, Rattus norvegicus
tacatcccattctagactgtgccat

SEQ ID NO: 548928 - DNA, 25 bp, Rattus norvegicus
tacatccccagcatgactctgggaa

SEQ ID NO: 548929 - DNA, 25 bp, Rattus norvegicus
tacatccccagcttgactctgggaa

SEQ ID NO: 548930 - DNA, 25 bp, Rattus norvegicus
tacatcccgaggctcaggttctgtg

SEQ ID NO: 548931 - DNA, 25 bp, Rattus norvegicus
tacatcccgagggtcaggttctgtg

SEQ ID NO: 548932 - DNA, 25 bp, Rattus norvegicus
tacatccctcgcacagcagtagaag

SEQ ID NO: 548933 - DNA, 25 bp, Rattus norvegicus
tacatccctcgctcagcagtagaag

SEQ ID NO: 548934 - DNA, 25 bp, Rattus norvegicus
tacatccgaatgctaactaatactg

SEQ ID NO: 548935 - DNA, 25 bp, Rattus norvegicus
tacatccgaatggtaactaatactg

SEQ ID NO: 548936 - DNA, 25 bp, Rattus norvegicus
tacatccgtataaaagctgtcttag

SEQ ID NO: 548937 - DNA, 25 bp, Rattus norvegicus
tacatccgtatataagctgtcttag

SEQ ID NO: 548938 - DNA, 25 bp, Rattus norvegicus
tacatcctaataacctttccaaagc

SEQ ID NO: 548939 - DNA, 25 bp, Rattus norvegicus
tacatcctaatatcctttccaaagc

SEQ ID NO: 548940 - DNA, 25 bp, Rattus norvegicus
tacatcctcaagaccctggagaagt

SEQ ID NO: 548941 - DNA, 25 bp, Rattus norvegicus
tacatcctcaagtccctggagaagt

SEQ ID NO: 548942 - DNA, 25 bp, Rattus norvegicus
tacatcctcatcattcttactgggc

SEQ ID NO: 548943 - DNA, 25 bp, Rattus norvegicus
tacatcctcatctttcttactgggc

SEQ ID NO: 548944 - DNA, 25 bp, Rattus norvegicus
tacatcctcatgacaaatcagtatg

SEQ ID NO: 548945 - DNA, 25 bp, Rattus norvegicus
tacatcctcatgtcaaatcagtatg

SEQ ID NO: 548946 - DNA, 25 bp, Rattus norvegicus
tacatcctgccgctgtttcacagaa

SEQ ID NO: 548947 - DNA, 25 bp, Rattus norvegicus
tacatcctgccggtgtttcacagaa

SEQ ID NO: 548948 - DNA, 25 bp, Rattus norvegicus
tacatcctggagacacgagcaagca

SEQ ID NO: 548949 - DNA, 25 bp, Rattus norvegicus
tacatcctggagtcacgagcaagca

SEQ ID NO: 548950 - DNA, 25 bp, Rattus norvegicus
tacatcctggctcacactgaattca

SEQ ID NO: 548951 - DNA, 25 bp, Rattus norvegicus
tacatcctggctgacactgaattca

SEQ ID NO: 548952 - DNA, 25 bp, Rattus norvegicus
tacatcctgggcctggagtaatcag

SEQ ID NO: 548953 - DNA, 25 bp, Rattus norvegicus
tacatcctgggcgtggagtaatcag

SEQ ID NO: 548954 - DNA, 25 bp, Rattus norvegicus
tacatcctgggtaccactgtgctgc

SEQ ID NO: 548955 - DNA, 25 bp, Rattus norvegicus
tacatcctgggttccactgtgctgc

SEQ ID NO: 548956 - DNA, 25 bp, Rattus norvegicus
tacatcctgtcccttcaagcagatg

SEQ ID NO: 548957 - DNA, 25 bp, Rattus norvegicus
tacatcctgtccgttcaagcagatg

SEQ ID NO: 548958 - DNA, 25 bp, Rattus norvegicus
tacatccttgtgaagcccatgttga

SEQ ID NO: 548959 - DNA, 25 bp, Rattus norvegicus
tacatccttgtgtagcccatgttga

SEQ ID NO: 548960 - DNA, 25 bp, Rattus norvegicus
tacatccttttcaatcagtctcggg

SEQ ID NO: 548961 - DNA, 25 bp, Rattus norvegicus
tacatccttttctatcagtctcggg

SEQ ID NO: 548962 - DNA, 25 bp, Rattus norvegicus
tacatcgagtgtagtcggccctatc

SEQ ID NO: 548963 - DNA, 25 bp, Rattus norvegicus
tacatcgagtgttgtcggccctatc

SEQ ID NO: 548964 - DNA, 25 bp, Rattus norvegicus
tacatcgagtttcttcttggccaag

SEQ ID NO: 548965 - DNA, 25 bp, Rattus norvegicus
tacatcgagtttgttcttggccaag

SEQ ID NO: 548966 - DNA, 25 bp, Rattus norvegicus
tacatcgatgacaagggccagggat

SEQ ID NO: 548967 - DNA, 25 bp, Rattus norvegicus
tacatcgatgactagggccagggat

SEQ ID NO: 548968 - DNA, 25 bp, Rattus norvegicus
tacatcgccgttagctaagtatgaa

SEQ ID NO: 548969 - DNA, 25 bp, Rattus norvegicus
tacatcgccgtttgctaagtatgaa

SEQ ID NO: 548970 - DNA, 25 bp, Rattus norvegicus
tacatcggagttaccgagacctggt

SEQ ID NO: 548971 - DNA, 25 bp, Rattus norvegicus
tacatcggagtttccgagacctggt

SEQ ID NO: 548972 - DNA, 25 bp, Rattus norvegicus
tacatcgggaggctcttcggcatcg

SEQ ID NO: 548973 - DNA, 25 bp, Rattus norvegicus
tacatcgggagggtcttcggcatcg

SEQ ID NO: 548974 - DNA, 25 bp, Rattus norvegicus
tacatcgggcatattgagttcttca

SEQ ID NO: 548975 - DNA, 25 bp, Rattus norvegicus
tacatcgggcattttgagttcttca

SEQ ID NO: 548976 - DNA, 25 bp, Rattus norvegicus
tacatcgggttcacagtagctgcct

SEQ ID NO: 548977 - DNA, 25 bp, Rattus norvegicus
tacatcgggttctcagtagctgcct

SEQ ID NO: 548978 - DNA, 25 bp, Rattus norvegicus
tacatcgtcagtataaggacttcag

SEQ ID NO: 548979 - DNA, 25 bp, Rattus norvegicus
tacatcgtcagtttaaggacttcag

SEQ ID NO: 548980 - DNA, 25 bp, Rattus norvegicus
tacatcgtcatgcagtttggccggg

SEQ ID NO: 548981 - DNA, 25 bp, Rattus norvegicus
tacatcgtcatggagtttggccggg

SEQ ID NO: 548982 - DNA, 25 bp, Rattus norvegicus
tacatcgtcccaagagtgctgaaca

SEQ ID NO: 548983 - DNA, 25 bp, Rattus norvegicus
tacatcgtcccatgagtgctgaaca

SEQ ID NO: 548984 - DNA, 25 bp, Rattus norvegicus
tacatcgtggatccatagggcccaa

SEQ ID NO: 548985 - DNA, 25 bp, Rattus norvegicus
tacatcgtggatgcatagggcccaa

SEQ ID NO: 548986 - DNA, 25 bp, Rattus norvegicus
tacatcgtgtttactaccgacaaga

SEQ ID NO: 548987 - DNA, 25 bp, Rattus norvegicus
tacatcgtgttttctaccgacaaga

SEQ ID NO: 548988 - DNA, 25 bp, Rattus norvegicus
tacatctaatagaactacccgctag

SEQ ID NO: 548989 - DNA, 25 bp, Rattus norvegicus
tacatctaatagtactacccgctag

SEQ ID NO: 548990 - DNA, 25 bp, Rattus norvegicus
tacatctagattcgtcagggaggca

SEQ ID NO: 548991 - DNA, 25 bp, Rattus norvegicus
tacatctagattggtcagggaggca

SEQ ID NO: 548992 - DNA, 25 bp, Rattus norvegicus
tacatctagccaagaacccattcat

SEQ ID NO: 548993 - DNA, 25 bp, Rattus norvegicus
tacatctagccatgaacccattcat

SEQ ID NO: 548994 - DNA, 25 bp, Rattus norvegicus
tacatctatgtaaagccccatcctg

SEQ ID NO: 548995 - DNA, 25 bp, Rattus norvegicus
tacatctatgtatagccccatcctg

SEQ ID NO: 548996 - DNA, 25 bp, Rattus norvegicus
tacatctctcctcttggtggaggcc

SEQ ID NO: 548997 - DNA, 25 bp, Rattus norvegicus
tacatctctcctgttggtggaggcc

SEQ ID NO: 548998 - DNA, 25 bp, Rattus norvegicus
tacatctcttacaagctggtgccca

SEQ ID NO: 548999 - DNA, 25 bp, Rattus norvegicus
tacatctcttactagctggtgccca

SEQ ID NO: 549000 - DNA, 25 bp, Rattus norvegicus
tacatctcttagcaacagaagaagc

SEQ ID NO: 549001 - DNA, 25 bp, Rattus norvegicus
tacatctcttaggaacagaagaagc

SEQ ID NO: 549002 - DNA, 25 bp, Rattus norvegicus
tacatctcttccagcggcaagaaaa

SEQ ID NO: 549003 - DNA, 25 bp, Rattus norvegicus
tacatctcttcctgcggcaagaaaa

SEQ ID NO: 549004 - DNA, 25 bp, Rattus norvegicus
tacatctgagtgacactgggcctat

SEQ ID NO: 549005 - DNA, 25 bp, Rattus norvegicus
tacatctgagtgtcactgggcctat

SEQ ID NO: 549006 - DNA, 25 bp, Rattus norvegicus
tacatctgctttaatatgacacggg

SEQ ID NO: 549007 - DNA, 25 bp, Rattus norvegicus
tacatctgctttctggctgtgctga

SEQ ID NO: 549008 - DNA, 25 bp, Rattus norvegicus
tacatctgctttgtggctgtgctga

SEQ ID NO: 549009 - DNA, 25 bp, Rattus norvegicus
tacatctgcttttatatgacacggg

SEQ ID NO: 549010 - DNA, 25 bp, Rattus norvegicus
tacatctggcctattctgcttagag

SEQ ID NO: 549011 - DNA, 25 bp, Rattus norvegicus
tacatctggccttttctgcttagag

SEQ ID NO: 549012 - DNA, 25 bp, Rattus norvegicus
tacatctgtcacaagcttttgctgt

SEQ ID NO: 549013 - DNA, 25 bp, Rattus norvegicus
tacatctgtcactagcttttgctgt

SEQ ID NO: 549014 - DNA, 25 bp, Rattus norvegicus
tacatctgtgtgcaactgtacatgt

SEQ ID NO: 549015 - DNA, 25 bp, Rattus norvegicus
tacatctgtgtggaactgtacatgt

SEQ ID NO: 549016 - DNA, 25 bp, Rattus norvegicus
tacatcttcttacggcttcggtggt

SEQ ID NO: 549017 - DNA, 25 bp, Rattus norvegicus
tacatcttcttagggcttcggtggt

SEQ ID NO: 549018 - DNA, 25 bp, Rattus norvegicus
tacatcttgcctaccattgcatgaa

SEQ ID NO: 549019 - DNA, 25 bp, Rattus norvegicus
tacatcttgccttccattgcatgaa

SEQ ID NO: 549020 - DNA, 25 bp, Rattus norvegicus
tacatctttccacaggatgctgcca

SEQ ID NO: 549021 - DNA, 25 bp, Rattus norvegicus
tacatctttccagaggatgctgcca

SEQ ID NO: 549022 - DNA, 25 bp, Rattus norvegicus
tacatctttggactgcttggctgac

SEQ ID NO: 549023 - DNA, 25 bp, Rattus norvegicus
tacatctttggagtgcttggctgac

SEQ ID NO: 549024 - DNA, 25 bp, Rattus norvegicus
tacatctttggcatccattctaaag

SEQ ID NO: 549025 - DNA, 25 bp, Rattus norvegicus
tacatctttggcttccattctaaag

SEQ ID NO: 549026 - DNA, 25 bp, Rattus norvegicus
tacatgaaatgcaccccaactgttt

SEQ ID NO: 549027 - DNA, 25 bp, Rattus norvegicus
tacatgaaatgctccccaactgttt

SEQ ID NO: 549028 - DNA, 25 bp, Rattus norvegicus
tacatgacccacatggcttgctagg

SEQ ID NO: 549029 - DNA, 25 bp, Rattus norvegicus
tacatgacccacttggcttgctagg

SEQ ID NO: 549030 - DNA, 25 bp, Rattus norvegicus
tacatgacgtcaaactcagctgctt

SEQ ID NO: 549031 - DNA, 25 bp, Rattus norvegicus
tacatgacgtcatactcagctgctt

SEQ ID NO: 549032 - DNA, 25 bp, Rattus norvegicus
tacatgactctaacgtcaaagggcg

SEQ ID NO: 549033 - DNA, 25 bp, Rattus norvegicus
tacatgactctatcgtcaaagggcg

SEQ ID NO: 549034 - DNA, 25 bp, Rattus norvegicus
tacatgagctttaacaggacactag

SEQ ID NO: 549035 - DNA, 25 bp, Rattus norvegicus
tacatgagcttttacaggacactag

SEQ ID NO: 549036 - DNA, 25 bp, Rattus norvegicus
tacatgagggcccagctctttacct

SEQ ID NO: 549037 - DNA, 25 bp, Rattus norvegicus
tacatgagggccgagctctttacct

SEQ ID NO: 549038 - DNA, 25 bp, Rattus norvegicus
tacatgagtccaaaggccgggcgca

SEQ ID NO: 549039 - DNA, 25 bp, Rattus norvegicus
tacatgagtccataggccgggcgca

SEQ ID NO: 549040 - DNA, 25 bp, Rattus norvegicus
tacatgatacccaacagttcctttt

SEQ ID NO: 549041 - DNA, 25 bp, Rattus norvegicus
tacatgataccctacagttcctttt

SEQ ID NO: 549042 - DNA, 25 bp, Rattus norvegicus
tacatgatgatgctgattaaaaaga

SEQ ID NO: 549043 - DNA, 25 bp, Rattus norvegicus
tacatgatgatggtgattaaaaaga

SEQ ID NO: 549044 - DNA, 25 bp, Rattus norvegicus
tacatgattataacactggctacaa

SEQ ID NO: 549045 - DNA, 25 bp, Rattus norvegicus
tacatgattatatcactggctacaa

SEQ ID NO: 549046 - DNA, 25 bp, Rattus norvegicus
tacatgcaagagctcgtcatctacg

SEQ ID NO: 549047 - DNA, 25 bp, Rattus norvegicus
tacatgcaagaggtcgtcatctacg

SEQ ID NO: 549048 - DNA, 25 bp, Rattus norvegicus
tacatgcaccagagctgtggtctgt

SEQ ID NO: 549049 - DNA, 25 bp, Rattus norvegicus
tacatgcaccagtgctgtggtctgt

SEQ ID NO: 549050 - DNA, 25 bp, Rattus norvegicus
tacatgcatacaaacactctcacac

SEQ ID NO: 549051 - DNA, 25 bp, Rattus norvegicus
tacatgcatacatacactctcacac

SEQ ID NO: 549052 - DNA, 25 bp, Rattus norvegicus
tacatgcatgcaattagagggtgtt

SEQ ID NO: 549053 - DNA, 25 bp, Rattus norvegicus
tacatgcatgcatttagagggtgtt

SEQ ID NO: 549054 - DNA, 25 bp, Rattus norvegicus
tacatgcatggcaggtgtgcctgca

SEQ ID NO: 549055 - DNA, 25 bp, Rattus norvegicus
tacatgcatggctggtgtgcctgca

SEQ ID NO: 549056 - DNA, 25 bp, Rattus norvegicus
tacatgcatgttccttgcttgctgc

SEQ ID NO: 549057 - DNA, 25 bp, Rattus norvegicus
tacatgcatgttgcttgcttgctgc

SEQ ID NO: 549058 - DNA, 25 bp, Rattus norvegicus
tacatgcatttcctactgtttccag

SEQ ID NO: 549059 - DNA, 25 bp, Rattus norvegicus
tacatgcatttcgtactgtttccag

SEQ ID NO: 549060 - DNA, 25 bp, Rattus norvegicus
tacatgccactaccttttttcttat

SEQ ID NO: 549061 - DNA, 25 bp, Rattus norvegicus
tacatgccactagcttttttcttat

SEQ ID NO: 549062 - DNA, 25 bp, Rattus norvegicus
tacatgccagtaaaaccctcaggtg

SEQ ID NO: 549063 - DNA, 25 bp, Rattus norvegicus
tacatgccagtataaccctcaggtg

SEQ ID NO: 549064 - DNA, 25 bp, Rattus norvegicus
tacatgccattgcactagctgtatg

SEQ ID NO: 549065 - DNA, 25 bp, Rattus norvegicus
tacatgccattggactagctgtatg

SEQ ID NO: 549066 - DNA, 25 bp, Rattus norvegicus
tacatgccccagaaagctgtaatgt

SEQ ID NO: 549067 - DNA, 25 bp, Rattus norvegicus
tacatgccccagtaagctgtaatgt

SEQ ID NO: 549068 - DNA, 25 bp, Rattus norvegicus
tacatgcccttcaggaagccctgaa

SEQ ID NO: 549069 - DNA, 25 bp, Rattus norvegicus
tacatgcccttctggaagccctgaa

SEQ ID NO: 549070 - DNA, 25 bp, Rattus norvegicus
tacatgcctctactcggtccagaac

SEQ ID NO: 549071 - DNA, 25 bp, Rattus norvegicus
tacatgcctctagtcggtccagaac

SEQ ID NO: 549072 - DNA, 25 bp, Rattus norvegicus
tacatgcctggcactgggtttcttt

SEQ ID NO: 549073 - DNA, 25 bp, Rattus norvegicus
tacatgcctggcagttacacctctt

SEQ ID NO: 549074 - DNA, 25 bp, Rattus norvegicus
tacatgcctggctctgggtttcttt

SEQ ID NO: 549075 - DNA, 25 bp, Rattus norvegicus
tacatgcctggctgttacacctctt

SEQ ID NO: 549076 - DNA, 25 bp, Rattus norvegicus
tacatgcctgtcacagatttggctc

SEQ ID NO: 549077 - DNA, 25 bp, Rattus norvegicus
tacatgcctgtcagtctcattgtct

SEQ ID NO: 549078 - DNA, 25 bp, Rattus norvegicus
tacatgcctgtctcagatttggctc

SEQ ID NO: 549079 - DNA, 25 bp, Rattus norvegicus
tacatgcctgtctgtctcattgtct

SEQ ID NO: 549080 - DNA, 25 bp, Rattus norvegicus
tacatgcgacttaatgttttttcaa

SEQ ID NO: 549081 - DNA, 25 bp, Rattus norvegicus
tacatgcgactttatgttttttcaa

SEQ ID NO: 549082 - DNA, 25 bp, Rattus norvegicus
tacatgcggaacacgcgggccatcg

SEQ ID NO: 549083 - DNA, 25 bp, Rattus norvegicus
tacatgcggaactcgcgggccatcg

SEQ ID NO: 549084 - DNA, 25 bp, Rattus norvegicus
tacatgctacttataccaaggtgag

SEQ ID NO: 549085 - DNA, 25 bp, Rattus norvegicus
tacatgctacttttaccaaggtgag

SEQ ID NO: 549086 - DNA, 25 bp, Rattus norvegicus
tacatgctaggtcctgagcctttgt

SEQ ID NO: 549087 - DNA, 25 bp, Rattus norvegicus
tacatgctaggtgctgagcctttgt

SEQ ID NO: 549088 - DNA, 25 bp, Rattus norvegicus
tacatgctatttcggtctgaccgca

SEQ ID NO: 549089 - DNA, 25 bp, Rattus norvegicus
tacatgctatttgggtctgaccgca

SEQ ID NO: 549090 - DNA, 25 bp, Rattus norvegicus
tacatgctcgtgacactcagttcaa

SEQ ID NO: 549091 - DNA, 25 bp, Rattus norvegicus
tacatgctcgtgtcactcagttcaa

SEQ ID NO: 549092 - DNA, 25 bp, Rattus norvegicus
tacatgctgatcatctcgcgcaggt

SEQ ID NO: 549093 - DNA, 25 bp, Rattus norvegicus
tacatgctgatcttctcgcgcaggt

SEQ ID NO: 549094 - DNA, 25 bp, Rattus norvegicus
tacatgctggccaggacgctgtggc

SEQ ID NO: 549095 - DNA, 25 bp, Rattus norvegicus
tacatgctggcctggacgctgtggc

SEQ ID NO: 549096 - DNA, 25 bp, Rattus norvegicus
tacatgctgtaacattcgattgtta

SEQ ID NO: 549097 - DNA, 25 bp, Rattus norvegicus
tacatgctgtaagattcgattgtta

SEQ ID NO: 549098 - DNA, 25 bp, Rattus norvegicus
tacatgctgttaagcccagcaccac

SEQ ID NO: 549099 - DNA, 25 bp, Rattus norvegicus
tacatgctgttatgcccagcaccac

SEQ ID NO: 549100 - DNA, 25 bp, Rattus norvegicus
tacatgcttatgctgcaggattctg

SEQ ID NO: 549101 - DNA, 25 bp, Rattus norvegicus
tacatgcttatggtgcaggattctg

SEQ ID NO: 549102 - DNA, 25 bp, Rattus norvegicus
tacatggaaactcgaggcgccgttc

SEQ ID NO: 549103 - DNA, 25 bp, Rattus norvegicus
tacatggaaactggaggcgccgttc

SEQ ID NO: 549104 - DNA, 25 bp, Rattus norvegicus
tacatggaaccccagaccaaaaacg

SEQ ID NO: 549105 - DNA, 25 bp, Rattus norvegicus
tacatggaacccgagaccaaaaacg

SEQ ID NO: 549106 - DNA, 25 bp, Rattus norvegicus
tacatggaatccagcgtggtccgtc

SEQ ID NO: 549107 - DNA, 25 bp, Rattus norvegicus
tacatggaatcctgcgtggtccgtc

SEQ ID NO: 549108 - DNA, 25 bp, Rattus norvegicus
tacatggaatctacagttgtgctgt

SEQ ID NO: 549109 - DNA, 25 bp, Rattus norvegicus
tacatggaatcttcagttgtgctgt

SEQ ID NO: 549110 - DNA, 25 bp, Rattus norvegicus
tacatggacaggcttccaggcccta

SEQ ID NO: 549111 - DNA, 25 bp, Rattus norvegicus
tacatggacagggttccaggcccta

SEQ ID NO: 549112 - DNA, 25 bp, Rattus norvegicus
tacatggacatcagaggaaccagcc

SEQ ID NO: 549113 - DNA, 25 bp, Rattus norvegicus
tacatggacatctgaggaaccagcc

SEQ ID NO: 549114 - DNA, 25 bp, Rattus norvegicus
tacatggactacctagcagccttgg

SEQ ID NO: 549115 - DNA, 25 bp, Rattus norvegicus
tacatggactacgtagcagccttgg

SEQ ID NO: 549116 - DNA, 25 bp, Rattus norvegicus
tacatggcaagtactgtggctccga

SEQ ID NO: 549117 - DNA, 25 bp, Rattus norvegicus
tacatggcaagttctgtggctccga

SEQ ID NO: 549118 - DNA, 25 bp, Rattus norvegicus
tacatggcagtgatcatcacacaaa

SEQ ID NO: 549119 - DNA, 25 bp, Rattus norvegicus
tacatggcagtgttcatcacacaaa

SEQ ID NO: 549120 - DNA, 25 bp, Rattus norvegicus
tacatggcccctcaagtgcttgatg

SEQ ID NO: 549121 - DNA, 25 bp, Rattus norvegicus
tacatggcccctgaagtgcttgatg

SEQ ID NO: 549122 - DNA, 25 bp, Rattus norvegicus
tacatggtaaagaccaagccagctt

SEQ ID NO: 549123 - DNA, 25 bp, Rattus norvegicus
tacatggtaaagtccaagccagctt

SEQ ID NO: 549124 - DNA, 25 bp, Rattus norvegicus
tacatggtctacaaatggtggcaat

SEQ ID NO: 549125 - DNA, 25 bp, Rattus norvegicus
tacatggtctactaatggtggcaat

SEQ ID NO: 549126 - DNA, 25 bp, Rattus norvegicus
tacatggtctcacttcatattgggt

SEQ ID NO: 549127 - DNA, 25 bp, Rattus norvegicus
tacatggtctcagttcatattgggt

SEQ ID NO: 549128 - DNA, 25 bp, Rattus norvegicus
tacatggtggctcttctgatctcta

SEQ ID NO: 549129 - DNA, 25 bp, Rattus norvegicus
tacatggtggctgttctgatctcta

SEQ ID NO: 549130 - DNA, 25 bp, Rattus norvegicus
tacatggtgggcacctttctgtcaa

SEQ ID NO: 549131 - DNA, 25 bp, Rattus norvegicus
tacatggtgggctcctttctgtcaa

SEQ ID NO: 549132 - DNA, 25 bp, Rattus norvegicus
tacatggttatccttacctgctttc

SEQ ID NO: 549133 - DNA, 25 bp, Rattus norvegicus
tacatggttatcgttacctgctttc

SEQ ID NO: 549134 - DNA, 25 bp, Rattus norvegicus
tacatggttccacctcttacttaaa

SEQ ID NO: 549135 - DNA, 25 bp, Rattus norvegicus
tacatggttccagctcttacttaaa

SEQ ID NO: 549136 - DNA, 25 bp, Rattus norvegicus
tacatggttcttcactgtctgctac

SEQ ID NO: 549137 - DNA, 25 bp, Rattus norvegicus
tacatggttcttgactgtctgctac

SEQ ID NO: 549138 - DNA, 25 bp, Rattus norvegicus
tacatgtaccagctcctagatgatt

SEQ ID NO: 549139 - DNA, 25 bp, Rattus norvegicus
tacatgtaccaggtcctagatgatt

SEQ ID NO: 549140 - DNA, 25 bp, Rattus norvegicus
tacatgtactgtcggtgttcacctc

SEQ ID NO: 549141 - DNA, 25 bp, Rattus norvegicus
tacatgtactgtgggtgttcacctc

SEQ ID NO: 549142 - DNA, 25 bp, Rattus norvegicus
tacatgtatctgaggcagctgttcc

SEQ ID NO: 549143 - DNA, 25 bp, Rattus norvegicus
tacatgtatctgtggcagctgttcc

SEQ ID NO: 549144 - DNA, 25 bp, Rattus norvegicus
tacatgtcacagacgccacacacag

SEQ ID NO: 549145 - DNA, 25 bp, Rattus norvegicus
tacatgtcacagtcgccacacacag

SEQ ID NO: 549146 - DNA, 25 bp, Rattus norvegicus
tacatgtcagttctgtggtttgcat

SEQ ID NO: 549147 - DNA, 25 bp, Rattus norvegicus
tacatgtcagttgtgtggtttgcat

SEQ ID NO: 549148 - DNA, 25 bp, Rattus norvegicus
tacatgtctgtaagggacgctactt

SEQ ID NO: 549149 - DNA, 25 bp, Rattus norvegicus
tacatgtctgtatgggacgctactt

SEQ ID NO: 549150 - DNA, 25 bp, Rattus norvegicus
tacatgtctgttattgtccacaagt

SEQ ID NO: 549151 - DNA, 25 bp, Rattus norvegicus
tacatgtctgtttttgtccacaagt

SEQ ID NO: 549152 - DNA, 25 bp, Rattus norvegicus
tacatgtgcagcattctgttcaact

SEQ ID NO: 549153 - DNA, 25 bp, Rattus norvegicus
tacatgtgcagctttctgttcaact

SEQ ID NO: 549154 - DNA, 25 bp, Rattus norvegicus
tacatgtggatgagcgtctgcctgc

SEQ ID NO: 549155 - DNA, 25 bp, Rattus norvegicus
tacatgtggatgtgcgtctgcctgc

SEQ ID NO: 549156 - DNA, 25 bp, Rattus norvegicus
tacatgtgggcacacactgggaatt

SEQ ID NO: 549157 - DNA, 25 bp, Rattus norvegicus
tacatgtgggcagacactgggaatt

SEQ ID NO: 549158 - DNA, 25 bp, Rattus norvegicus
tacatgtgtaaaaaccctctcaccc

SEQ ID NO: 549159 - DNA, 25 bp, Rattus norvegicus
tacatgtgtaaataccctctcaccc

SEQ ID NO: 549160 - DNA, 25 bp, Rattus norvegicus
tacatgtgtcgcctatggagtacta

SEQ ID NO: 549161 - DNA, 25 bp, Rattus norvegicus
tacatgtgtcgcgtatggagtacta

SEQ ID NO: 549162 - DNA, 25 bp, Rattus norvegicus
tacatgtgttagctgctgcctctcc

SEQ ID NO: 549163 - DNA, 25 bp, Rattus norvegicus
tacatgtgttaggtgctgcctctcc

SEQ ID NO: 549164 - DNA, 25 bp, Rattus norvegicus
tacatgtgttgtcccagaaacccca

SEQ ID NO: 549165 - DNA, 25 bp, Rattus norvegicus
tacatgtgttgtgccagaaacccca

SEQ ID NO: 549166 - DNA, 25 bp, Rattus norvegicus
tacatgttctggcatgtctagccat

SEQ ID NO: 549167 - DNA, 25 bp, Rattus norvegicus
tacatgttctgggatgtctagccat

SEQ ID NO: 549168 - DNA, 25 bp, Rattus norvegicus
tacatgttcttgaatctcagattga

SEQ ID NO: 549169 - DNA, 25 bp, Rattus norvegicus
tacatgttcttgtatctcagattga

SEQ ID NO: 549170 - DNA, 25 bp, Rattus norvegicus
tacatgtttttcactggacgttccc

SEQ ID NO: 549171 - DNA, 25 bp, Rattus norvegicus
tacatgtttttcagtggccatctcc

SEQ ID NO: 549172 - DNA, 25 bp, Rattus norvegicus
tacatgtttttctctggacgttccc

SEQ ID NO: 549173 - DNA, 25 bp, Rattus norvegicus
tacatgtttttctgtggccatctcc

SEQ ID NO: 549174 - DNA, 25 bp, Rattus norvegicus
tacattaaacccattgccctgtgaa

SEQ ID NO: 549175 - DNA, 25 bp, Rattus norvegicus
tacattaaaccctttgccctgtgaa

SEQ ID NO: 549176 - DNA, 25 bp, Rattus norvegicus
tacattaaatacagtgcttggagct

SEQ ID NO: 549177 - DNA, 25 bp, Rattus norvegicus
tacattaaatactgtgcttggagct

SEQ ID NO: 549178 - DNA, 25 bp, Rattus norvegicus
tacattaagcgcaccatcaaagtga

SEQ ID NO: 549179 - DNA, 25 bp, Rattus norvegicus
tacattaagcgctccatcaaagtga

SEQ ID NO: 549180 - DNA, 25 bp, Rattus norvegicus
tacattaagctgatccaggccccgt

SEQ ID NO: 549181 - DNA, 25 bp, Rattus norvegicus
tacattaagctgttccaggccccgt

SEQ ID NO: 549182 - DNA, 25 bp, Rattus norvegicus
tacattacagttacaatagtgcttg

SEQ ID NO: 549183 - DNA, 25 bp, Rattus norvegicus
tacattacagtttcaatagtgcttg

SEQ ID NO: 549184 - DNA, 25 bp, Rattus norvegicus
tacattaccaaaagtgcctctgaca

SEQ ID NO: 549185 - DNA, 25 bp, Rattus norvegicus
tacattaccaaatgtgcctctgaca

SEQ ID NO: 549186 - DNA, 25 bp, Rattus norvegicus
tacattactctcacacgagctgagt

SEQ ID NO: 549187 - DNA, 25 bp, Rattus norvegicus
tacattactctctcacgagctgagt

SEQ ID NO: 549188 - DNA, 25 bp, Rattus norvegicus
tacattagcctcagtagctgacgcg

SEQ ID NO: 549189 - DNA, 25 bp, Rattus norvegicus
tacattagcctcattgcacccaaac

SEQ ID NO: 549190 - DNA, 25 bp, Rattus norvegicus
tacattagcctctgtagctgacgcg

SEQ ID NO: 549191 - DNA, 25 bp, Rattus norvegicus
tacattagcctctttgcacccaaac

SEQ ID NO: 549192 - DNA, 25 bp, Rattus norvegicus
tacattatacaacagtcgaggcctc

SEQ ID NO: 549193 - DNA, 25 bp, Rattus norvegicus
tacattatacaagagtcgaggcctc

SEQ ID NO: 549194 - DNA, 25 bp, Rattus norvegicus
tacattatcatgactacgccttctc

SEQ ID NO: 549195 - DNA, 25 bp, Rattus norvegicus
tacattatcatgtctacgccttctc

SEQ ID NO: 549196 - DNA, 25 bp, Rattus norvegicus
tacattatcgatactaatggcattt

SEQ ID NO: 549197 - DNA, 25 bp, Rattus norvegicus
tacattatcgattctaatggcattt

SEQ ID NO: 549198 - DNA, 25 bp, Rattus norvegicus
tacattatgagcagggacgtcaccc

SEQ ID NO: 549199 - DNA, 25 bp, Rattus norvegicus
tacattatgagctgggacgtcaccc

SEQ ID NO: 549200 - DNA, 25 bp, Rattus norvegicus
tacattatgtttacagatctgctcg

SEQ ID NO: 549201 - DNA, 25 bp, Rattus norvegicus
tacattatgttttcagatctgctcg

SEQ ID NO: 549202 - DNA, 25 bp, Rattus norvegicus
tacattattcttctcttcccaaaag

SEQ ID NO: 549203 - DNA, 25 bp, Rattus norvegicus
tacattattcttgtcttcccaaaag

SEQ ID NO: 549204 - DNA, 25 bp, Rattus norvegicus
tacattcaaaagaactgcggcaagt

SEQ ID NO: 549205 - DNA, 25 bp, Rattus norvegicus
tacattcaaaagtactgcggcaagt

SEQ ID NO: 549206 - DNA, 25 bp, Rattus norvegicus
tacattcaatgcacagtgctgcccg

SEQ ID NO: 549207 - DNA, 25 bp, Rattus norvegicus
tacattcaatgctcagtgctgcccg

SEQ ID NO: 549208 - DNA, 25 bp, Rattus norvegicus
tacattcagtggctatggctttcgt

SEQ ID NO: 549209 - DNA, 25 bp, Rattus norvegicus
tacattcagtgggtatggctttcgt

SEQ ID NO: 549210 - DNA, 25 bp, Rattus norvegicus
tacattcatctactgtgaactcttg

SEQ ID NO: 549211 - DNA, 25 bp, Rattus norvegicus
tacattcatctagtgtgaactcttg

SEQ ID NO: 549212 - DNA, 25 bp, Rattus norvegicus
tacattcattttaccctataagttg

SEQ ID NO: 549213 - DNA, 25 bp, Rattus norvegicus
tacattcatttttccctataagttg

SEQ ID NO: 549214 - DNA, 25 bp, Rattus norvegicus
tacattccacgaccattgccttctt

SEQ ID NO: 549215 - DNA, 25 bp, Rattus norvegicus
tacattccacgagcattgccttctt

SEQ ID NO: 549216 - DNA, 25 bp, Rattus norvegicus
tacattccatatctatctgtcaaat

SEQ ID NO: 549217 - DNA, 25 bp, Rattus norvegicus
tacattccatatgtatctgtcaaat

SEQ ID NO: 549218 - DNA, 25 bp, Rattus norvegicus
tacattccctcgctgtcaattaata

SEQ ID NO: 549219 - DNA, 25 bp, Rattus norvegicus
tacattccctcggtgtcaattaata

SEQ ID NO: 549220 - DNA, 25 bp, Rattus norvegicus
tacattccctgacgctctgacttgg

SEQ ID NO: 549221 - DNA, 25 bp, Rattus norvegicus
tacattccctgaggctctgacttgg

SEQ ID NO: 549222 - DNA, 25 bp, Rattus norvegicus
tacattcctgggacaaatgggatat

SEQ ID NO: 549223 - DNA, 25 bp, Rattus norvegicus
tacattcctgggtcaaatgggatat

SEQ ID NO: 549224 - DNA, 25 bp, Rattus norvegicus
tacattcgcctcacaggtgacactg

SEQ ID NO: 549225 - DNA, 25 bp, Rattus norvegicus
tacattcgcctctcaggtgacactg

SEQ ID NO: 549226 - DNA, 25 bp, Rattus norvegicus
tacattcgtgttcaagcatagtttc

SEQ ID NO: 549227 - DNA, 25 bp, Rattus norvegicus
tacattcgtgttgaagcatagtttc

SEQ ID NO: 549228 - DNA, 25 bp, Rattus norvegicus
tacattctagaacttacactggata

SEQ ID NO: 549229 - DNA, 25 bp, Rattus norvegicus
tacattctagaagttacactggata

SEQ ID NO: 549230 - DNA, 25 bp, Rattus norvegicus
tacattctgactctagcgttgccag

SEQ ID NO: 549231 - DNA, 25 bp, Rattus norvegicus
tacattctgactgtagcgttgccag

SEQ ID NO: 549232 - DNA, 25 bp, Rattus norvegicus
tacattctgctcaagcttgctgtga

SEQ ID NO: 549233 - DNA, 25 bp, Rattus norvegicus
tacattctgctctagcttgctgtga

SEQ ID NO: 549234 - DNA, 25 bp, Rattus norvegicus
tacattctgggaagtttacctggga

SEQ ID NO: 549235 - DNA, 25 bp, Rattus norvegicus
tacattctgggatgtttacctggga

SEQ ID NO: 549236 - DNA, 25 bp, Rattus norvegicus
tacattcttaagcttgtcactgtga

SEQ ID NO: 549237 - DNA, 25 bp, Rattus norvegicus
tacattcttaaggttgtcactgtga

SEQ ID NO: 549238 - DNA, 25 bp, Rattus norvegicus
tacattcttcatatgctgcttcgga

SEQ ID NO: 549239 - DNA, 25 bp, Rattus norvegicus
tacattcttcatttgctgcttcgga

SEQ ID NO: 549240 - DNA, 25 bp, Rattus norvegicus
tacattcttgcactgtcctgtactc

SEQ ID NO: 549241 - DNA, 25 bp, Rattus norvegicus
tacattcttgcagtgtcctgtactc

SEQ ID NO: 549242 - DNA, 25 bp, Rattus norvegicus
tacattctttgtactgtcttcctgc

SEQ ID NO: 549243 - DNA, 25 bp, Rattus norvegicus
tacattctttgtcgacactgtccat

SEQ ID NO: 549244 - DNA, 25 bp, Rattus norvegicus
tacattctttgtggacactgtccat

SEQ ID NO: 549245 - DNA, 25 bp, Rattus norvegicus
tacattctttgttctgtcttcctgc

SEQ ID NO: 549246 - DNA, 25 bp, Rattus norvegicus
tacattgactcgatgcatggcactg

SEQ ID NO: 549247 - DNA, 25 bp, Rattus norvegicus
tacattgactcgttgcatggcactg

SEQ ID NO: 549248 - DNA, 25 bp, Rattus norvegicus
tacattgagcctagtccatggacca

SEQ ID NO: 549249 - DNA, 25 bp, Rattus norvegicus
tacattgagccttgtccatggacca

SEQ ID NO: 549250 - DNA, 25 bp, Rattus norvegicus
tacattgagtctcttcttacacatt

SEQ ID NO: 549251 - DNA, 25 bp, Rattus norvegicus
tacattgagtctgttcttacacatt

SEQ ID NO: 549252 - DNA, 25 bp, Rattus norvegicus
tacattgattcaattccttctttaa

SEQ ID NO: 549253 - DNA, 25 bp, Rattus norvegicus
tacattgattcatttccttctttaa

SEQ ID NO: 549254 - DNA, 25 bp, Rattus norvegicus
tacattgattccatggctgccgtgc

SEQ ID NO: 549255 - DNA, 25 bp, Rattus norvegicus
tacattgattccttggctgccgtgc

SEQ ID NO: 549256 - DNA, 25 bp, Rattus norvegicus
tacattgcagttctgttacccaaat

SEQ ID NO: 549257 - DNA, 25 bp, Rattus norvegicus
tacattgcagttgtgttacccaaat

SEQ ID NO: 549258 - DNA, 25 bp, Rattus norvegicus
tacattgccaggaaagtaccacgta

SEQ ID NO: 549259 - DNA, 25 bp, Rattus norvegicus
tacattgccaggtaagtaccacgta

SEQ ID NO: 549260 - DNA, 25 bp, Rattus norvegicus
tacattgccagtctgaagcagcgtt

SEQ ID NO: 549261 - DNA, 25 bp, Rattus norvegicus
tacattgccagtgtgaagcagcgtt

SEQ ID NO: 549262 - DNA, 25 bp, Rattus norvegicus
tacattgccatcaggttgcatcatg

SEQ ID NO: 549263 - DNA, 25 bp, Rattus norvegicus
tacattgccatctggttgcatcatg

SEQ ID NO: 549264 - DNA, 25 bp, Rattus norvegicus
tacattgcctctccacttgacagat

SEQ ID NO: 549265 - DNA, 25 bp, Rattus norvegicus
tacattgcctctgcacttgacagat

SEQ ID NO: 549266 - DNA, 25 bp, Rattus norvegicus
tacattgcgagtctccatggtccaa

SEQ ID NO: 549267 - DNA, 25 bp, Rattus norvegicus
tacattgcgagtgtccatggtccaa

SEQ ID NO: 549268 - DNA, 25 bp, Rattus norvegicus
tacattgcttttctcagtctctttt

SEQ ID NO: 549269 - DNA, 25 bp, Rattus norvegicus
tacattgcttttgtcagtctctttt

SEQ ID NO: 549270 - DNA, 25 bp, Rattus norvegicus
tacattggaaccaccaactggtctg

SEQ ID NO: 549271 - DNA, 25 bp, Rattus norvegicus
tacattggaacctccaactggtctg

SEQ ID NO: 549272 - DNA, 25 bp, Rattus norvegicus
tacattggtatcattcctgcatata

SEQ ID NO: 549273 - DNA, 25 bp, Rattus norvegicus
tacattggtatctttcctgcatata

SEQ ID NO: 549274 - DNA, 25 bp, Rattus norvegicus
tacattggtgcacccctagttttgg

SEQ ID NO: 549275 - DNA, 25 bp, Rattus norvegicus
tacattggtgcagccctagttttgg

SEQ ID NO: 549276 - DNA, 25 bp, Rattus norvegicus
tacattggtgtgatgtctgaatgtc

SEQ ID NO: 549277 - DNA, 25 bp, Rattus norvegicus
tacattggtgtgttgtctgaatgtc

SEQ ID NO: 549278 - DNA, 25 bp, Rattus norvegicus
tacattggttatctgcatgcaacgc

SEQ ID NO: 549279 - DNA, 25 bp, Rattus norvegicus
tacattggttatgtgcatgcaacgc

SEQ ID NO: 549280 - DNA, 25 bp, Rattus norvegicus
tacattgtaccgctcatcgtgctgg

SEQ ID NO: 549281 - DNA, 25 bp, Rattus norvegicus
tacattgtaccggtcatcgtgctgg

SEQ ID NO: 549282 - DNA, 25 bp, Rattus norvegicus
tacattgtacctatactgtggctaa

SEQ ID NO: 549283 - DNA, 25 bp, Rattus norvegicus
tacattgtacctttactgtggctaa

SEQ ID NO: 549284 - DNA, 25 bp, Rattus norvegicus
tacattgtagatactgtctggaagg

SEQ ID NO: 549285 - DNA, 25 bp, Rattus norvegicus
tacattgtagattctgtctggaagg

SEQ ID NO: 549286 - DNA, 25 bp, Rattus norvegicus
tacattgtcgtccttgtcgtcgtca

SEQ ID NO: 549287 - DNA, 25 bp, Rattus norvegicus
tacattgtcgtcgttgtcgtcgtca

SEQ ID NO: 549288 - DNA, 25 bp, Rattus norvegicus
tacattgtctgtagttcagccctgg

SEQ ID NO: 549289 - DNA, 25 bp, Rattus norvegicus
tacattgtctgtctattgcatttaa

SEQ ID NO: 549290 - DNA, 25 bp, Rattus norvegicus
tacattgtctgtgtattgcatttaa

SEQ ID NO: 549291 - DNA, 25 bp, Rattus norvegicus
tacattgtctgttgttcagccctgg

SEQ ID NO: 549292 - DNA, 25 bp, Rattus norvegicus
tacattgttgcaacagctcaggtct

SEQ ID NO: 549293 - DNA, 25 bp, Rattus norvegicus
tacattgttgcatcagctcaggtct

SEQ ID NO: 549294 - DNA, 25 bp, Rattus norvegicus
tacatttaagctcctgttctgccaa

SEQ ID NO: 549295 - DNA, 25 bp, Rattus norvegicus
tacatttaagctgctgttctgccaa

SEQ ID NO: 549296 - DNA, 25 bp, Rattus norvegicus
tacatttacacaactagcagtcagt

SEQ ID NO: 549297 - DNA, 25 bp, Rattus norvegicus
tacatttacacatctagcagtcagt

SEQ ID NO: 549298 - DNA, 25 bp, Rattus norvegicus
tacatttataaacagttgcgatcag

SEQ ID NO: 549299 - DNA, 25 bp, Rattus norvegicus
tacatttataaagagttgcgatcag

SEQ ID NO: 549300 - DNA, 25 bp, Rattus norvegicus
tacatttattctcatgctgccagca

SEQ ID NO: 549301 - DNA, 25 bp, Rattus norvegicus
tacatttattctgatgctgccagca

SEQ ID NO: 549302 - DNA, 25 bp, Rattus norvegicus
tacatttcagaacatgcccctgtag

SEQ ID NO: 549303 - DNA, 25 bp, Rattus norvegicus
tacatttcagaagatgcccctgtag

SEQ ID NO: 549304 - DNA, 25 bp, Rattus norvegicus
tacatttccaaaccttgtgcatcaa

SEQ ID NO: 549305 - DNA, 25 bp, Rattus norvegicus
tacatttccaaagcttgtgcatcaa

SEQ ID NO: 549306 - DNA, 25 bp, Rattus norvegicus
tacatttccaagcactaatttgaag

SEQ ID NO: 549307 - DNA, 25 bp, Rattus norvegicus
tacatttccaaggactaatttgaag

SEQ ID NO: 549308 - DNA, 25 bp, Rattus norvegicus
tacatttccaggactgacttactcc

SEQ ID NO: 549309 - DNA, 25 bp, Rattus norvegicus
tacatttccaggtctgacttactcc

SEQ ID NO: 549310 - DNA, 25 bp, Rattus norvegicus
tacatttcctacaactcttgcaaga

SEQ ID NO: 549311 - DNA, 25 bp, Rattus norvegicus
tacatttcctactactcttgcaaga

SEQ ID NO: 549312 - DNA, 25 bp, Rattus norvegicus
tacatttctaataacgttcccacaa

SEQ ID NO: 549313 - DNA, 25 bp, Rattus norvegicus
tacatttctaattacgttcccacaa

SEQ ID NO: 549314 - DNA, 25 bp, Rattus norvegicus
tacatttctgtacccttacttttag

SEQ ID NO: 549315 - DNA, 25 bp, Rattus norvegicus
tacatttctgtaccgagaggccttc

SEQ ID NO: 549316 - DNA, 25 bp, Rattus norvegicus
tacatttctgtacctttgtgagaag

SEQ ID NO: 549317 - DNA, 25 bp, Rattus norvegicus
tacatttctgtactgctttctttaa

SEQ ID NO: 549318 - DNA, 25 bp, Rattus norvegicus
tacatttctgtagccttacttttag

SEQ ID NO: 549319 - DNA, 25 bp, Rattus norvegicus
tacatttctgtagcgagaggccttc

SEQ ID NO: 549320 - DNA, 25 bp, Rattus norvegicus
tacatttctgtagctttgtgagaag

SEQ ID NO: 549321 - DNA, 25 bp, Rattus norvegicus
tacatttctgtagtgctttctttaa

SEQ ID NO: 549322 - DNA, 25 bp, Rattus norvegicus
tacatttggaccacttagtctgctc

SEQ ID NO: 549323 - DNA, 25 bp, Rattus norvegicus
tacatttggacctcttagtctgctc

SEQ ID NO: 549324 - DNA, 25 bp, Rattus norvegicus
tacatttgtcttacctcaataaaag

SEQ ID NO: 549325 - DNA, 25 bp, Rattus norvegicus
tacatttgtctttcctcaataaaag

SEQ ID NO: 549326 - DNA, 25 bp, Rattus norvegicus
tacatttgtgttacagtaagcctgt

SEQ ID NO: 549327 - DNA, 25 bp, Rattus norvegicus
tacatttgtgtttcagtaagcctgt

SEQ ID NO: 549328 - DNA, 25 bp, Rattus norvegicus
tacattttacacagatccacagttg

SEQ ID NO: 549329 - DNA, 25 bp, Rattus norvegicus
tacattttacactgatccacagttg

SEQ ID NO: 549330 - DNA, 25 bp, Rattus norvegicus
tacattttagtcaaaaccgagttct

SEQ ID NO: 549331 - DNA, 25 bp, Rattus norvegicus
tacattttagtctaaaccgagttct

SEQ ID NO: 549332 - DNA, 25 bp, Rattus norvegicus
tacattttcattctgttcttcagta

SEQ ID NO: 549333 - DNA, 25 bp, Rattus norvegicus
tacattttcattgtgttcttcagta

SEQ ID NO: 549334 - DNA, 25 bp, Rattus norvegicus
tacattttgaaaagccacatttgcc

SEQ ID NO: 549335 - DNA, 25 bp, Rattus norvegicus
tacattttgaaatgccacatttgcc

SEQ ID NO: 549336 - DNA, 25 bp, Rattus norvegicus
tacattttgcaaatcattccctaga

SEQ ID NO: 549337 - DNA, 25 bp, Rattus norvegicus
tacattttgcaattcattccctaga

SEQ ID NO: 549338 - DNA, 25 bp, Rattus norvegicus
tacattttgcttagactttagggag

SEQ ID NO: 549339 - DNA, 25 bp, Rattus norvegicus
tacattttgctttgactttagggag

SEQ ID NO: 549340 - DNA, 25 bp, Rattus norvegicus
tacatttttccacttgtgttccaat

SEQ ID NO: 549341 - DNA, 25 bp, Rattus norvegicus
tacatttttccagttgtgttccaat

SEQ ID NO: 549342 - DNA, 25 bp, Rattus norvegicus
tacatttttgttaaatacgcttgag

SEQ ID NO: 549343 - DNA, 25 bp, Rattus norvegicus
tacatttttgtttaatacgcttgag

SEQ ID NO: 549344 - DNA, 25 bp, Rattus norvegicus
taccaaaacctcaatcgagcactgt

SEQ ID NO: 549345 - DNA, 25 bp, Rattus norvegicus
taccaaaacctctatcgagcactgt

SEQ ID NO: 549346 - DNA, 25 bp, Rattus norvegicus
taccaaaagcaaacaccatcaaaat

SEQ ID NO: 549347 - DNA, 25 bp, Rattus norvegicus
taccaaaagcaatcaccatcaaaat

SEQ ID NO: 549348 - DNA, 25 bp, Rattus norvegicus
taccaaaccatgctacctatgcagt

SEQ ID NO: 549349 - DNA, 25 bp, Rattus norvegicus
taccaaaccatggtacctatgcagt

SEQ ID NO: 549350 - DNA, 25 bp, Rattus norvegicus
taccaaacgaaacgaccgctctgat

SEQ ID NO: 549351 - DNA, 25 bp, Rattus norvegicus
taccaaacgaaaggaccgctctgat

SEQ ID NO: 549352 - DNA, 25 bp, Rattus norvegicus
taccaaacgcttagtagccacaggc

SEQ ID NO: 549353 - DNA, 25 bp, Rattus norvegicus
taccaaacgctttgtagccacaggc

SEQ ID NO: 549354 - DNA, 25 bp, Rattus norvegicus
taccaaagacacactcaggcgttag

SEQ ID NO: 549355 - DNA, 25 bp, Rattus norvegicus
taccaaagacactctcaggcgttag

SEQ ID NO: 549356 - DNA, 25 bp, Rattus norvegicus
taccaaagccttctgggctgctcag

SEQ ID NO: 549357 - DNA, 25 bp, Rattus norvegicus
taccaaagccttgtgggctgctcag

SEQ ID NO: 549358 - DNA, 25 bp, Rattus norvegicus
taccaaaggacgaggtagggttcag

SEQ ID NO: 549359 - DNA, 25 bp, Rattus norvegicus
taccaaaggacgtggtagggttcag

SEQ ID NO: 549360 - DNA, 25 bp, Rattus norvegicus
taccaaattcggcagcatcagccaa

SEQ ID NO: 549361 - DNA, 25 bp, Rattus norvegicus
taccaaattcgggagcatcagccaa

SEQ ID NO: 549362 - DNA, 25 bp, Rattus norvegicus
taccaaatttggcacatctatccat

SEQ ID NO: 549363 - DNA, 25 bp, Rattus norvegicus
taccaaatttgggacatctatccat

SEQ ID NO: 549364 - DNA, 25 bp, Rattus norvegicus
taccaacacttgacatgctgtatta

SEQ ID NO: 549365 - DNA, 25 bp, Rattus norvegicus
taccaacacttgtcatgctgtatta

SEQ ID NO: 549366 - DNA, 25 bp, Rattus norvegicus
taccaacagtgaactctccattttt

SEQ ID NO: 549367 - DNA, 25 bp, Rattus norvegicus
taccaacagtgatctctccattttt

SEQ ID NO: 549368 - DNA, 25 bp, Rattus norvegicus
taccaacatcagctcctggcaagca

SEQ ID NO: 549369 - DNA, 25 bp, Rattus norvegicus
taccaacatcaggtcctggcaagca

SEQ ID NO: 549370 - DNA, 25 bp, Rattus norvegicus
taccaacattgcctcctagcagaga

SEQ ID NO: 549371 - DNA, 25 bp, Rattus norvegicus
taccaacattgcgtcctagcagaga

SEQ ID NO: 549372 - DNA, 25 bp, Rattus norvegicus
taccaaccatgtcactccagaagag

SEQ ID NO: 549373 - DNA, 25 bp, Rattus norvegicus
taccaaccatgtgactccagaagag

SEQ ID NO: 549374 - DNA, 25 bp, Rattus norvegicus
taccaacctcgacgctcaggtatag

SEQ ID NO: 549375 - DNA, 25 bp, Rattus norvegicus
taccaacctcgaggctcaggtatag

SEQ ID NO: 549376 - DNA, 25 bp, Rattus norvegicus
taccaacgccgacgtgctcaaggtc

SEQ ID NO: 549377 - DNA, 25 bp, Rattus norvegicus
taccaacgccgaggtgctcaaggtc

SEQ ID NO: 549378 - DNA, 25 bp, Rattus norvegicus
taccaacggagtcgcctgggctttg

SEQ ID NO: 549379 - DNA, 25 bp, Rattus norvegicus
taccaacggagtggcctgggctttg

SEQ ID NO: 549380 - DNA, 25 bp, Rattus norvegicus
taccaacggtgtcgtcccagcggga

SEQ ID NO: 549381 - DNA, 25 bp, Rattus norvegicus
taccaacggtgtggtcccagcggga

SEQ ID NO: 549382 - DNA, 25 bp, Rattus norvegicus
taccaactcttgattttctataaag

SEQ ID NO: 549383 - DNA, 25 bp, Rattus norvegicus
taccaactcttgtttttctataaag

SEQ ID NO: 549384 - DNA, 25 bp, Rattus norvegicus
taccaactgagaaatccttggcccc

SEQ ID NO: 549385 - DNA, 25 bp, Rattus norvegicus
taccaactgagatatccttggcccc

SEQ ID NO: 549386 - DNA, 25 bp, Rattus norvegicus
taccaactggaacaggtgaccggaa

SEQ ID NO: 549387 - DNA, 25 bp, Rattus norvegicus
taccaactggaagaggtgaccggaa

SEQ ID NO: 549388 - DNA, 25 bp, Rattus norvegicus
taccaactggccatcaagagggaga

SEQ ID NO: 549389 - DNA, 25 bp, Rattus norvegicus
taccaactggccttcaagagggaga

SEQ ID NO: 549390 - DNA, 25 bp, Rattus norvegicus
taccaacttcagagccttttgtgag

SEQ ID NO: 549391 - DNA, 25 bp, Rattus norvegicus
taccaacttcagtgccttttgtgag

SEQ ID NO: 549392 - DNA, 25 bp, Rattus norvegicus
taccaacttgtaagcactttagaat

SEQ ID NO: 549393 - DNA, 25 bp, Rattus norvegicus
taccaacttgtatgcactttagaat

SEQ ID NO: 549394 - DNA, 25 bp, Rattus norvegicus
taccaagaaggcagctccatctaca

SEQ ID NO: 549395 - DNA, 25 bp, Rattus norvegicus
taccaagaaggctgctccatctaca

SEQ ID NO: 549396 - DNA, 25 bp, Rattus norvegicus
taccaagactatcagcctgaagcct

SEQ ID NO: 549397 - DNA, 25 bp, Rattus norvegicus
taccaagactatgagcctgaagcct

SEQ ID NO: 549398 - DNA, 25 bp, Rattus norvegicus
taccaagcagcacccataccagatg

SEQ ID NO: 549399 - DNA, 25 bp, Rattus norvegicus
taccaagcagcagccataccagatg

SEQ ID NO: 549400 - DNA, 25 bp, Rattus norvegicus
taccaagcatccactgcggctttca

SEQ ID NO: 549401 - DNA, 25 bp, Rattus norvegicus
taccaagcatcctctgcggctttca

SEQ ID NO: 549402 - DNA, 25 bp, Rattus norvegicus
taccaagcctccagtttacagtgaa

SEQ ID NO: 549403 - DNA, 25 bp, Rattus norvegicus
taccaagcctcctgtttacagtgaa

SEQ ID NO: 549404 - DNA, 25 bp, Rattus norvegicus
taccaagcgcagaggccagcagatg

SEQ ID NO: 549405 - DNA, 25 bp, Rattus norvegicus
taccaagcgcagtggccagcagatg

SEQ ID NO: 549406 - DNA, 25 bp, Rattus norvegicus
taccaagcgtggacactcacccatt

SEQ ID NO: 549407 - DNA, 25 bp, Rattus norvegicus
taccaagcgtggtcactcacccatt

SEQ ID NO: 549408 - DNA, 25 bp, Rattus norvegicus
taccaagctcctctatgaatcacga

SEQ ID NO: 549409 - DNA, 25 bp, Rattus norvegicus
taccaagctcctgtatgaatcacga

SEQ ID NO: 549410 - DNA, 25 bp, Rattus norvegicus
taccaagctgccagcactcttggaa

SEQ ID NO: 549411 - DNA, 25 bp, Rattus norvegicus
taccaagctgcctgcactcttggaa

SEQ ID NO: 549412 - DNA, 25 bp, Rattus norvegicus
taccaagctggactttaccgagact

SEQ ID NO: 549413 - DNA, 25 bp, Rattus norvegicus
taccaagctggagtttaccgagact

SEQ ID NO: 549414 - DNA, 25 bp, Rattus norvegicus
taccaaggacctcaggacccagcag

SEQ ID NO: 549415 - DNA, 25 bp, Rattus norvegicus
taccaaggacctgaggacccagcag

SEQ ID NO: 549416 - DNA, 25 bp, Rattus norvegicus
taccaaggctggcaaggcttccgag

SEQ ID NO: 549417 - DNA, 25 bp, Rattus norvegicus
taccaaggctgggaaggcttccgag

SEQ ID NO: 549418 - DNA, 25 bp, Rattus norvegicus
taccaaggtgtgaccttggccattt

SEQ ID NO: 549419 - DNA, 25 bp, Rattus norvegicus
taccaaggtgtgtccttggccattt

SEQ ID NO: 549420 - DNA, 25 bp, Rattus norvegicus
taccaagtagccatctcagagagcg

SEQ ID NO: 549421 - DNA, 25 bp, Rattus norvegicus
taccaagtagccttctcagagagcg

SEQ ID NO: 549422 - DNA, 25 bp, Rattus norvegicus
taccaagtagtcatgatcccagaat

SEQ ID NO: 549423 - DNA, 25 bp, Rattus norvegicus
taccaagtagtcttgatcccagaat

SEQ ID NO: 549424 - DNA, 25 bp, Rattus norvegicus
taccaagtggcacactgtgggcaga

SEQ ID NO: 549425 - DNA, 25 bp, Rattus norvegicus
taccaagtggcagactgtgggcaga

SEQ ID NO: 549426 - DNA, 25 bp, Rattus norvegicus
taccaagttccaatcatcagtgaat

SEQ ID NO: 549427 - DNA, 25 bp, Rattus norvegicus
taccaagttccattcatcagtgaat

SEQ ID NO: 549428 - DNA, 25 bp, Rattus norvegicus
taccaagttggcctctctgtctttc

SEQ ID NO: 549429 - DNA, 25 bp, Rattus norvegicus
taccaagttggcgtctctgtctttc

SEQ ID NO: 549430 - DNA, 25 bp, Rattus norvegicus
taccaatacttcatgcttgcagtgg

SEQ ID NO: 549431 - DNA, 25 bp, Rattus norvegicus
taccaatacttcttgcttgcagtgg

SEQ ID NO: 549432 - DNA, 25 bp, Rattus norvegicus
taccaatcacgtaatcctgtggaat

SEQ ID NO: 549433 - DNA, 25 bp, Rattus norvegicus
taccaatcacgttatcctgtggaat

SEQ ID NO: 549434 - DNA, 25 bp, Rattus norvegicus
taccaatcaggaaggacagtcgcct

SEQ ID NO: 549435 - DNA, 25 bp, Rattus norvegicus
taccaatcaggatggacagtcgcct

SEQ ID NO: 549436 - DNA, 25 bp, Rattus norvegicus
taccaatcgcacaacttctctagtc

SEQ ID NO: 549437 - DNA, 25 bp, Rattus norvegicus
taccaatcgcactacttctctagtc

SEQ ID NO: 549438 - DNA, 25 bp, Rattus norvegicus
taccaatctgtgcatatgacctgtt

SEQ ID NO: 549439 - DNA, 25 bp, Rattus norvegicus
taccaatctgtggatatgacctgtt

SEQ ID NO: 549440 - DNA, 25 bp, Rattus norvegicus
taccaatcttgcattcgctgtcatt

SEQ ID NO: 549441 - DNA, 25 bp, Rattus norvegicus
taccaatcttgctttcgctgtcatt

SEQ ID NO: 549442 - DNA, 25 bp, Rattus norvegicus
taccaatgcctgacctggaattcag

SEQ ID NO: 549443 - DNA, 25 bp, Rattus norvegicus
taccaatgcctgtcctggaattcag

SEQ ID NO: 549444 - DNA, 25 bp, Rattus norvegicus
taccaatgctctaggttctctataa

SEQ ID NO: 549445 - DNA, 25 bp, Rattus norvegicus
taccaatgctcttggttctctataa

SEQ ID NO: 549446 - DNA, 25 bp, Rattus norvegicus
taccaatgtactagtccctcagcca

SEQ ID NO: 549447 - DNA, 25 bp, Rattus norvegicus
taccaatgtacttgtccctcagcca

SEQ ID NO: 549448 - DNA, 25 bp, Rattus norvegicus
taccaattcgtcagggcccgggaca

SEQ ID NO: 549449 - DNA, 25 bp, Rattus norvegicus
taccaattcgtctgggcccgggaca

SEQ ID NO: 549450 - DNA, 25 bp, Rattus norvegicus
taccaattcttacagcttcttcgtt

SEQ ID NO: 549451 - DNA, 25 bp, Rattus norvegicus
taccaattcttacccctttatgtga

SEQ ID NO: 549452 - DNA, 25 bp, Rattus norvegicus
taccaattcttagagcttcttcgtt

SEQ ID NO: 549453 - DNA, 25 bp, Rattus norvegicus
taccaattcttagccctttatgtga

SEQ ID NO: 549454 - DNA, 25 bp, Rattus norvegicus
taccaattggaaaatgaccccttac

SEQ ID NO: 549455 - DNA, 25 bp, Rattus norvegicus
taccaattggaatatgaccccttac

SEQ ID NO: 549456 - DNA, 25 bp, Rattus norvegicus
taccaatttcttagtactaaagagg

SEQ ID NO: 549457 - DNA, 25 bp, Rattus norvegicus
taccaatttctttgtactaaagagg

SEQ ID NO: 549458 - DNA, 25 bp, Rattus norvegicus
taccacaacagaattccaggcatag

SEQ ID NO: 549459 - DNA, 25 bp, Rattus norvegicus
taccacaacagatttccaggcatag

SEQ ID NO: 549460 - DNA, 25 bp, Rattus norvegicus
taccacaactgcagactctggctgg

SEQ ID NO: 549461 - DNA, 25 bp, Rattus norvegicus
taccacaactgctgactctggctgg

SEQ ID NO: 549462 - DNA, 25 bp, Rattus norvegicus
taccacaaggtcaagcttctgttct

SEQ ID NO: 549463 - DNA, 25 bp, Rattus norvegicus
taccacaaggtctagcttctgttct

SEQ ID NO: 549464 - DNA, 25 bp, Rattus norvegicus
taccacacaggcattagctagcaga

SEQ ID NO: 549465 - DNA, 25 bp, Rattus norvegicus
taccacacaggctttagctagcaga

SEQ ID NO: 549466 - DNA, 25 bp, Rattus norvegicus
taccacacccagcaactttctataa

SEQ ID NO: 549467 - DNA, 25 bp, Rattus norvegicus
taccacacccaggaactttctataa

SEQ ID NO: 549468 - DNA, 25 bp, Rattus norvegicus
taccacacgaaccaaggagcactca

SEQ ID NO: 549469 - DNA, 25 bp, Rattus norvegicus
taccacacgaacgaaggagcactca

SEQ ID NO: 549470 - DNA, 25 bp, Rattus norvegicus
taccacacgctgcaagagctgtcgg

SEQ ID NO: 549471 - DNA, 25 bp, Rattus norvegicus
taccacacgctggaagagctgtcgg

SEQ ID NO: 549472 - DNA, 25 bp, Rattus norvegicus
taccacagcggcagtgtcttttcgg

SEQ ID NO: 549473 - DNA, 25 bp, Rattus norvegicus
taccacagcggctgtgtcttttcgg

SEQ ID NO: 549474 - DNA, 25 bp, Rattus norvegicus
taccacaggacacctctgggttttt

SEQ ID NO: 549475 - DNA, 25 bp, Rattus norvegicus
taccacaggacagctctgggttttt

SEQ ID NO: 549476 - DNA, 25 bp, Rattus norvegicus
taccacaggcatattccaggctggg

SEQ ID NO: 549477 - DNA, 25 bp, Rattus norvegicus
taccacaggcattttccaggctggg

SEQ ID NO: 549478 - DNA, 25 bp, Rattus norvegicus
taccacagttcaacctcatcaatga

SEQ ID NO: 549479 - DNA, 25 bp, Rattus norvegicus
taccacagttcatcctcatcaatga

SEQ ID NO: 549480 - DNA, 25 bp, Rattus norvegicus
taccacagtttgaggctgcatatct

SEQ ID NO: 549481 - DNA, 25 bp, Rattus norvegicus
taccacagtttgtggctgcatatct

SEQ ID NO: 549482 - DNA, 25 bp, Rattus norvegicus
taccacatagggaactgagtctatt

SEQ ID NO: 549483 - DNA, 25 bp, Rattus norvegicus
taccacatagggtactgagtctatt

SEQ ID NO: 549484 - DNA, 25 bp, Rattus norvegicus
taccacatccccagtgatgaaactg

SEQ ID NO: 549485 - DNA, 25 bp, Rattus norvegicus
taccacatcccctgtgatgaaactg

SEQ ID NO: 549486 - DNA, 25 bp, Rattus norvegicus
taccacatgctgctgcttacatgaa

SEQ ID NO: 549487 - DNA, 25 bp, Rattus norvegicus
taccacatgctggtgcttacatgaa

SEQ ID NO: 549488 - DNA, 25 bp, Rattus norvegicus
taccacatgggtcctagggactaaa

SEQ ID NO: 549489 - DNA, 25 bp, Rattus norvegicus
taccacatgggtgctagggactaaa

SEQ ID NO: 549490 - DNA, 25 bp, Rattus norvegicus
taccacatgtgcacagagcgagctg

SEQ ID NO: 549491 - DNA, 25 bp, Rattus norvegicus
taccacatgtgctcagagcgagctg

SEQ ID NO: 549492 - DNA, 25 bp, Rattus norvegicus
taccacatgtggctccctttaactg

SEQ ID NO: 549493 - DNA, 25 bp, Rattus norvegicus
taccacatgtgggtccctttaactg

SEQ ID NO: 549494 - DNA, 25 bp, Rattus norvegicus
taccacattgttaatctgatccttc

SEQ ID NO: 549495 - DNA, 25 bp, Rattus norvegicus
taccacattgtttatctgatccttc

SEQ ID NO: 549496 - DNA, 25 bp, Rattus norvegicus
taccaccaaaacatcctgctgagat

SEQ ID NO: 549497 - DNA, 25 bp, Rattus norvegicus
taccaccaaaacttcctgctgagat

SEQ ID NO: 549498 - DNA, 25 bp, Rattus norvegicus
taccaccaaatacctctgatttctg

SEQ ID NO: 549499 - DNA, 25 bp, Rattus norvegicus
taccaccaaatagctctgatttctg

SEQ ID NO: 549500 - DNA, 25 bp, Rattus norvegicus
taccaccaagcccaggttgatattt

SEQ ID NO: 549501 - DNA, 25 bp, Rattus norvegicus
taccaccaagccgaggttgatattt

SEQ ID NO: 549502 - DNA, 25 bp, Rattus norvegicus
taccaccaccttaatcttctgaata

SEQ ID NO: 549503 - DNA, 25 bp, Rattus norvegicus
taccaccacctttatcttctgaata

SEQ ID NO: 549504 - DNA, 25 bp, Rattus norvegicus
taccaccacgggatactgaacatcg

SEQ ID NO: 549505 - DNA, 25 bp, Rattus norvegicus
taccaccacgggttactgaacatcg

SEQ ID NO: 549506 - DNA, 25 bp, Rattus norvegicus
taccaccagatgcaggctgacctga

SEQ ID NO: 549507 - DNA, 25 bp, Rattus norvegicus
taccaccagatggaggctgacctga

SEQ ID NO: 549508 - DNA, 25 bp, Rattus norvegicus
taccaccagcctcctttatgaaagt

SEQ ID NO: 549509 - DNA, 25 bp, Rattus norvegicus
taccaccagcctgctttatgaaagt

SEQ ID NO: 549510 - DNA, 25 bp, Rattus norvegicus
taccaccattcccaagagagcctga

SEQ ID NO: 549511 - DNA, 25 bp, Rattus norvegicus
taccaccattccgaagagagcctga

SEQ ID NO: 549512 - DNA, 25 bp, Rattus norvegicus
taccacccaggcacaaaactcagat

SEQ ID NO: 549513 - DNA, 25 bp, Rattus norvegicus
taccacccaggctcaaaactcagat

SEQ ID NO: 549514 - DNA, 25 bp, Rattus norvegicus
taccacccaggtcaagatgtgtgct

SEQ ID NO: 549515 - DNA, 25 bp, Rattus norvegicus
taccacccaggtgaagatgtgtgct

SEQ ID NO: 549516 - DNA, 25 bp, Rattus norvegicus
taccaccccgatcgcggatttaaat

SEQ ID NO: 549517 - DNA, 25 bp, Rattus norvegicus
taccaccccgatggcggatttaaat

SEQ ID NO: 549518 - DNA, 25 bp, Rattus norvegicus
taccacccggacaatggagagccaa

SEQ ID NO: 549519 - DNA, 25 bp, Rattus norvegicus
taccacccggactatggagagccaa

SEQ ID NO: 549520 - DNA, 25 bp, Rattus norvegicus
taccaccctgtcactgttattctta

SEQ ID NO: 549521 - DNA, 25 bp, Rattus norvegicus
taccaccctgtctctgttattctta

SEQ ID NO: 549522 - DNA, 25 bp, Rattus norvegicus
taccaccgcatcatccatatcaatg

SEQ ID NO: 549523 - DNA, 25 bp, Rattus norvegicus
taccaccgcatcttccatatcaatg

SEQ ID NO: 549524 - DNA, 25 bp, Rattus norvegicus
taccaccgcctgactatgtacataa

SEQ ID NO: 549525 - DNA, 25 bp, Rattus norvegicus
taccaccgcctgtctatgtacataa

SEQ ID NO: 549526 - DNA, 25 bp, Rattus norvegicus
taccacctccatcccacgagggaaa

SEQ ID NO: 549527 - DNA, 25 bp, Rattus norvegicus
taccacctccatgccacgagggaaa

SEQ ID NO: 549528 - DNA, 25 bp, Rattus norvegicus
taccacctctggcatagttacatca

SEQ ID NO: 549529 - DNA, 25 bp, Rattus norvegicus
taccacctctgggatagttacatca

SEQ ID NO: 549530 - DNA, 25 bp, Rattus norvegicus
taccacctcttcatgtcatctgaag

SEQ ID NO: 549531 - DNA, 25 bp, Rattus norvegicus
taccacctcttcttgtcatctgaag

SEQ ID NO: 549532 - DNA, 25 bp, Rattus norvegicus
taccacctggcaacattcagtttgg

SEQ ID NO: 549533 - DNA, 25 bp, Rattus norvegicus
taccacctggcatcattcagtttgg

SEQ ID NO: 549534 - DNA, 25 bp, Rattus norvegicus
taccacctggcgacgtgcagaaaga

SEQ ID NO: 549535 - DNA, 25 bp, Rattus norvegicus
taccacctggcgtcgtgcagaaaga

SEQ ID NO: 549536 - DNA, 25 bp, Rattus norvegicus
taccaccttcacatattgcttctgt

SEQ ID NO: 549537 - DNA, 25 bp, Rattus norvegicus
taccaccttcacttattgcttctgt

SEQ ID NO: 549538 - DNA, 25 bp, Rattus norvegicus
taccaccttcctaagtccagagaaa

SEQ ID NO: 549539 - DNA, 25 bp, Rattus norvegicus
taccaccttccttagtccagagaaa

SEQ ID NO: 549540 - DNA, 25 bp, Rattus norvegicus
taccacctttagctttcttctgaca

SEQ ID NO: 549541 - DNA, 25 bp, Rattus norvegicus
taccacctttaggtttcttctgaca

SEQ ID NO: 549542 - DNA, 25 bp, Rattus norvegicus
taccacgccagccttggaggagact

SEQ ID NO: 549543 - DNA, 25 bp, Rattus norvegicus
taccacgccagcgttggaggagact

SEQ ID NO: 549544 - DNA, 25 bp, Rattus norvegicus
taccacgcggacatagaaatactgt

SEQ ID NO: 549545 - DNA, 25 bp, Rattus norvegicus
taccacgcggacttagaaatactgt

SEQ ID NO: 549546 - DNA, 25 bp, Rattus norvegicus
taccacggatgaactggagggctgc

SEQ ID NO: 549547 - DNA, 25 bp, Rattus norvegicus
taccacggatgatctggagggctgc

SEQ ID NO: 549548 - DNA, 25 bp, Rattus norvegicus
taccacggctatctgccagagaatg

SEQ ID NO: 549549 - DNA, 25 bp, Rattus norvegicus
taccacggctatgtgccagagaatg

SEQ ID NO: 549550 - DNA, 25 bp, Rattus norvegicus
taccacgggtggaagacaggactga

SEQ ID NO: 549551 - DNA, 25 bp, Rattus norvegicus
taccacgggtggtagacaggactga

SEQ ID NO: 549552 - DNA, 25 bp, Rattus norvegicus
taccacgtagtcagtgtgacccagg

SEQ ID NO: 549553 - DNA, 25 bp, Rattus norvegicus
taccacgtagtctgtgtgacccagg

SEQ ID NO: 549554 - DNA, 25 bp, Rattus norvegicus
taccacgtgactatgctgctgctca

SEQ ID NO: 549555 - DNA, 25 bp, Rattus norvegicus
taccacgtgactttgctgctgctca

SEQ ID NO: 549556 - DNA, 25 bp, Rattus norvegicus
taccacgttgacacttgttgttttg

SEQ ID NO: 549557 - DNA, 25 bp, Rattus norvegicus
taccacgttgactcttgttgttttg

SEQ ID NO: 549558 - DNA, 25 bp, Rattus norvegicus
taccactacctgcaaagctgtcagt

SEQ ID NO: 549559 - DNA, 25 bp, Rattus norvegicus
taccactacctggaaagctgtcagt

SEQ ID NO: 549560 - DNA, 25 bp, Rattus norvegicus
taccactactgtaacttttgggagg

SEQ ID NO: 549561 - DNA, 25 bp, Rattus norvegicus
taccactactgttacttttgggagg

SEQ ID NO: 549562 - DNA, 25 bp, Rattus norvegicus
taccactcactcagcaatcattatg

SEQ ID NO: 549563 - DNA, 25 bp, Rattus norvegicus
taccactcactctgcaatcattatg

SEQ ID NO: 549564 - DNA, 25 bp, Rattus norvegicus
taccactcaggtacagccagtattg

SEQ ID NO: 549565 - DNA, 25 bp, Rattus norvegicus
taccactcaggttcagccagtattg

SEQ ID NO: 549566 - DNA, 25 bp, Rattus norvegicus
taccactctggcctttgtgtaaata

SEQ ID NO: 549567 - DNA, 25 bp, Rattus norvegicus
taccactctggcgtttgtgtaaata

SEQ ID NO: 549568 - DNA, 25 bp, Rattus norvegicus
taccactgcacaaacctctgctaag

SEQ ID NO: 549569 - DNA, 25 bp, Rattus norvegicus
taccactgcacatacctctgctaag

SEQ ID NO: 549570 - DNA, 25 bp, Rattus norvegicus
taccactgcgctcagtgtggcaagc

SEQ ID NO: 549571 - DNA, 25 bp, Rattus norvegicus
taccactgcgctgagtgtggcaagc

SEQ ID NO: 549572 - DNA, 25 bp, Rattus norvegicus
taccactggagcaaccacaggactg

SEQ ID NO: 549573 - DNA, 25 bp, Rattus norvegicus
taccactggagctaccacaggactg

SEQ ID NO: 549574 - DNA, 25 bp, Rattus norvegicus
taccactggcttctgctcatctgct

SEQ ID NO: 549575 - DNA, 25 bp, Rattus norvegicus
taccactggcttgtgctcatctgct

SEQ ID NO: 549576 - DNA, 25 bp, Rattus norvegicus
taccactgggtaaaaggcaaaataa

SEQ ID NO: 549577 - DNA, 25 bp, Rattus norvegicus
taccactgggtataaggcaaaataa

SEQ ID NO: 549578 - DNA, 25 bp, Rattus norvegicus
taccactggtgcactgtcatgttga

SEQ ID NO: 549579 - DNA, 25 bp, Rattus norvegicus
taccactggtgctctgtcatgttga

SEQ ID NO: 549580 - DNA, 25 bp, Rattus norvegicus
taccactgtacgcagtgcgaggact

SEQ ID NO: 549581 - DNA, 25 bp, Rattus norvegicus
taccactgtacggagtgcgaggact

SEQ ID NO: 549582 - DNA, 25 bp, Rattus norvegicus
taccactgtcatcgacggttgtgct

SEQ ID NO: 549583 - DNA, 25 bp, Rattus norvegicus
taccactgtcatggacggttgtgct

SEQ ID NO: 549584 - DNA, 25 bp, Rattus norvegicus
taccactgttgcctttaagccttta

SEQ ID NO: 549585 - DNA, 25 bp, Rattus norvegicus
taccactgttgcgtttaagccttta

SEQ ID NO: 549586 - DNA, 25 bp, Rattus norvegicus
taccacttacctaatgtcttctcag

SEQ ID NO: 549587 - DNA, 25 bp, Rattus norvegicus
taccacttaccttatgtcttctcag

SEQ ID NO: 549588 - DNA, 25 bp, Rattus norvegicus
taccacttccagaatctgtcctatt

SEQ ID NO: 549589 - DNA, 25 bp, Rattus norvegicus
taccacttccagtatctgtcctatt

SEQ ID NO: 549590 - DNA, 25 bp, Rattus norvegicus
taccactttaataatgcgggcccct

SEQ ID NO: 549591 - DNA, 25 bp, Rattus norvegicus
taccactttaattatgcgggcccct

SEQ ID NO: 549592 - DNA, 25 bp, Rattus norvegicus
taccactttctccaacttgatgata

SEQ ID NO: 549593 - DNA, 25 bp, Rattus norvegicus
taccactttctcgaacttgatgata

SEQ ID NO: 549594 - DNA, 25 bp, Rattus norvegicus
taccactttgtcacctcccgggaga

SEQ ID NO: 549595 - DNA, 25 bp, Rattus norvegicus
taccactttgtctcctcccgggaga

SEQ ID NO: 549596 - DNA, 25 bp, Rattus norvegicus
taccagaaacttaccccgaagatgg

SEQ ID NO: 549597 - DNA, 25 bp, Rattus norvegicus
taccagaaacttaccttgccaactt

SEQ ID NO: 549598 - DNA, 25 bp, Rattus norvegicus
taccagaaactttccccgaagatgg

SEQ ID NO: 549599 - DNA, 25 bp, Rattus norvegicus
taccagaaactttccttgccaactt

SEQ ID NO: 549600 - DNA, 25 bp, Rattus norvegicus
taccagaaagatcaggcggcgccca

SEQ ID NO: 549601 - DNA, 25 bp, Rattus norvegicus
taccagaaagatgaggcggcgccca

SEQ ID NO: 549602 - DNA, 25 bp, Rattus norvegicus
taccagaacttcctagcaacagaga

SEQ ID NO: 549603 - DNA, 25 bp, Rattus norvegicus
taccagaacttcgtagcaacagaga

SEQ ID NO: 549604 - DNA, 25 bp, Rattus norvegicus
taccagaatcttacggagggccagc

SEQ ID NO: 549605 - DNA, 25 bp, Rattus norvegicus
taccagaatctttcggagggccagc

SEQ ID NO: 549606 - DNA, 25 bp, Rattus norvegicus
taccagacagtcagtgcctgtgttc

SEQ ID NO: 549607 - DNA, 25 bp, Rattus norvegicus
taccagacagtctgtgcctgtgttc

SEQ ID NO: 549608 - DNA, 25 bp, Rattus norvegicus
taccagacctgtctagattagcaca

SEQ ID NO: 549609 - DNA, 25 bp, Rattus norvegicus
taccagacctgtgtagattagcaca

SEQ ID NO: 549610 - DNA, 25 bp, Rattus norvegicus
taccagactgccattgacagtgttt

SEQ ID NO: 549611 - DNA, 25 bp, Rattus norvegicus
taccagactgcctttgacagtgttt

SEQ ID NO: 549612 - DNA, 25 bp, Rattus norvegicus
taccagagaagccaggaccccagtt

SEQ ID NO: 549613 - DNA, 25 bp, Rattus norvegicus
taccagagaagcgaggaccccagtt

SEQ ID NO: 549614 - DNA, 25 bp, Rattus norvegicus
taccagagaagtcctggagaggaaa

SEQ ID NO: 549615 - DNA, 25 bp, Rattus norvegicus
taccagagaagtgctggagaggaaa

SEQ ID NO: 549616 - DNA, 25 bp, Rattus norvegicus
taccagagacagcacactttcagtg

SEQ ID NO: 549617 - DNA, 25 bp, Rattus norvegicus
taccagagacaggacactttcagtg

SEQ ID NO: 549618 - DNA, 25 bp, Rattus norvegicus
taccagagcgtaacaccagagcagg

SEQ ID NO: 549619 - DNA, 25 bp, Rattus norvegicus
taccagagcgtatcaccagagcagg

SEQ ID NO: 549620 - DNA, 25 bp, Rattus norvegicus
taccagagcgttaggttcctttgtc

SEQ ID NO: 549621 - DNA, 25 bp, Rattus norvegicus
taccagagcgtttggttcctttgtc

SEQ ID NO: 549622 - DNA, 25 bp, Rattus norvegicus
taccagagtaagctgaatgcacgct

SEQ ID NO: 549623 - DNA, 25 bp, Rattus norvegicus
taccagagtaaggtgaatgcacgct

SEQ ID NO: 549624 - DNA, 25 bp, Rattus norvegicus
taccagagtacaatattttcccgtg

SEQ ID NO: 549625 - DNA, 25 bp, Rattus norvegicus
taccagagtacattattttcccgtg

SEQ ID NO: 549626 - DNA, 25 bp, Rattus norvegicus
taccagagtctgctcagtgtgctta

SEQ ID NO: 549627 - DNA, 25 bp, Rattus norvegicus
taccagagtctggtcagtgtgctta

SEQ ID NO: 549628 - DNA, 25 bp, Rattus norvegicus
taccagagtgccaagtctaccaggg

SEQ ID NO: 549629 - DNA, 25 bp, Rattus norvegicus
taccagagtgcctagtctaccaggg

SEQ ID NO: 549630 - DNA, 25 bp, Rattus norvegicus
taccagagtggcagcgcaggcatgt

SEQ ID NO: 549631 - DNA, 25 bp, Rattus norvegicus
taccagagtggctgcgcaggcatgt

SEQ ID NO: 549632 - DNA, 25 bp, Rattus norvegicus
taccagataaggcaatcctctgcta

SEQ ID NO: 549633 - DNA, 25 bp, Rattus norvegicus
taccagataagggaatcctctgcta

SEQ ID NO: 549634 - DNA, 25 bp, Rattus norvegicus
taccagatctgaattttacaagcac

SEQ ID NO: 549635 - DNA, 25 bp, Rattus norvegicus
taccagatctgatttttacaagcac

SEQ ID NO: 549636 - DNA, 25 bp, Rattus norvegicus
taccagcaattactagtgtcagcag

SEQ ID NO: 549637 - DNA, 25 bp, Rattus norvegicus
taccagcaattagtagtgtcagcag

SEQ ID NO: 549638 - DNA, 25 bp, Rattus norvegicus
taccagcacgcgattacagaggatg

SEQ ID NO: 549639 - DNA, 25 bp, Rattus norvegicus
taccagcacgcgtttacagaggatg

SEQ ID NO: 549640 - DNA, 25 bp, Rattus norvegicus
taccagcactgtaagcaaccttcag

SEQ ID NO: 549641 - DNA, 25 bp, Rattus norvegicus
taccagcactgttagcaaccttcag

SEQ ID NO: 549642 - DNA, 25 bp, Rattus norvegicus
taccagcatttgacctcttgtgatt

SEQ ID NO: 549643 - DNA, 25 bp, Rattus norvegicus
taccagcatttgtcctcttgtgatt

SEQ ID NO: 549644 - DNA, 25 bp, Rattus norvegicus
taccagccagaaagcagcaagcttt

SEQ ID NO: 549645 - DNA, 25 bp, Rattus norvegicus
taccagccagaatgcagcaagcttt

SEQ ID NO: 549646 - DNA, 25 bp, Rattus norvegicus
taccagcccagaccccgtatgtggg

SEQ ID NO: 549647 - DNA, 25 bp, Rattus norvegicus
taccagcccagagcccgtatgtggg

SEQ ID NO: 549648 - DNA, 25 bp, Rattus norvegicus
taccagccgcatctcattaatcttg

SEQ ID NO: 549649 - DNA, 25 bp, Rattus norvegicus
taccagccgcatgtcattaatcttg

SEQ ID NO: 549650 - DNA, 25 bp, Rattus norvegicus
taccagcctaggctgcttttgtgga

SEQ ID NO: 549651 - DNA, 25 bp, Rattus norvegicus
taccagcctagggtgcttttgtgga

SEQ ID NO: 549652 - DNA, 25 bp, Rattus norvegicus
taccagcctcgtcggactgagcaac

SEQ ID NO: 549653 - DNA, 25 bp, Rattus norvegicus
taccagcctcgtgggactgagcaac

SEQ ID NO: 549654 - DNA, 25 bp, Rattus norvegicus
taccagccttgtaccaggagaatct

SEQ ID NO: 549655 - DNA, 25 bp, Rattus norvegicus
taccagccttgttccaggagaatct

SEQ ID NO: 549656 - DNA, 25 bp, Rattus norvegicus
taccagcgtctgagatggtgtcact

SEQ ID NO: 549657 - DNA, 25 bp, Rattus norvegicus
taccagcgtctgtgatggtgtcact

SEQ ID NO: 549658 - DNA, 25 bp, Rattus norvegicus
taccagctacatactgcactgcaga

SEQ ID NO: 549659 - DNA, 25 bp, Rattus norvegicus
taccagctacattctgcactgcaga

SEQ ID NO: 549660 - DNA, 25 bp, Rattus norvegicus
taccagctaccgcagagctacagcg

SEQ ID NO: 549661 - DNA, 25 bp, Rattus norvegicus
taccagctaccggagagctacagcg

SEQ ID NO: 549662 - DNA, 25 bp, Rattus norvegicus
taccagctctgtccattcaaacgtt

SEQ ID NO: 549663 - DNA, 25 bp, Rattus norvegicus
taccagctctgtgcattcaaacgtt

SEQ ID NO: 549664 - DNA, 25 bp, Rattus norvegicus
taccagctcttcaacttcttcttct

SEQ ID NO: 549665 - DNA, 25 bp, Rattus norvegicus
taccagctcttctacttcttcttct

SEQ ID NO: 549666 - DNA, 25 bp, Rattus norvegicus
taccagctgggacttctgtaaactt

SEQ ID NO: 549667 - DNA, 25 bp, Rattus norvegicus
taccagctgggagttctgtaaactt

SEQ ID NO: 549668 - DNA, 25 bp, Rattus norvegicus
taccagctgtgaatctccactgaaa

SEQ ID NO: 549669 - DNA, 25 bp, Rattus norvegicus
taccagctgtgattctccactgaaa

SEQ ID NO: 549670 - DNA, 25 bp, Rattus norvegicus
taccaggaaatcaggaattccctag

SEQ ID NO: 549671 - DNA, 25 bp, Rattus norvegicus
taccaggaaatctggaattccctag

SEQ ID NO: 549672 - DNA, 25 bp, Rattus norvegicus
taccaggaacatatgtggtgcacag

SEQ ID NO: 549673 - DNA, 25 bp, Rattus norvegicus
taccaggaacatttgtggtgcacag

SEQ ID NO: 549674 - DNA, 25 bp, Rattus norvegicus
taccaggactgtagtggctaagcaa

SEQ ID NO: 549675 - DNA, 25 bp, Rattus norvegicus
taccaggactgttgtggctaagcaa

SEQ ID NO: 549676 - DNA, 25 bp, Rattus norvegicus
taccaggattcaaggagcgggatca

SEQ ID NO: 549677 - DNA, 25 bp, Rattus norvegicus
taccaggattcatggagcgggatca

SEQ ID NO: 549678 - DNA, 25 bp, Rattus norvegicus
taccaggcaaatcatgcttaagatg

SEQ ID NO: 549679 - DNA, 25 bp, Rattus norvegicus
taccaggcaaatgatgcttaagatg

SEQ ID NO: 549680 - DNA, 25 bp, Rattus norvegicus
taccaggcagagcatgggcctgatt

SEQ ID NO: 549681 - DNA, 25 bp, Rattus norvegicus
taccaggcagaggatgggcctgatt

SEQ ID NO: 549682 - DNA, 25 bp, Rattus norvegicus
taccaggctgtactccggagggcaa

SEQ ID NO: 549683 - DNA, 25 bp, Rattus norvegicus
taccaggctgtagtccggagggcaa

SEQ ID NO: 549684 - DNA, 25 bp, Rattus norvegicus
taccaggcttctctgaggcgttcca

SEQ ID NO: 549685 - DNA, 25 bp, Rattus norvegicus
taccaggcttctgtgaggcgttcca

SEQ ID NO: 549686 - DNA, 25 bp, Rattus norvegicus
taccagggactacagaggagactct

SEQ ID NO: 549687 - DNA, 25 bp, Rattus norvegicus
taccagggactagagaggagactct

SEQ ID NO: 549688 - DNA, 25 bp, Rattus norvegicus
taccagggcctgctgaagcacacag

SEQ ID NO: 549689 - DNA, 25 bp, Rattus norvegicus
taccagggcctggtgaagcacacag

SEQ ID NO: 549690 - DNA, 25 bp, Rattus norvegicus
taccagggctgccttctcttgtgac

SEQ ID NO: 549691 - DNA, 25 bp, Rattus norvegicus
taccagggctgcgttctcttgtgac

SEQ ID NO: 549692 - DNA, 25 bp, Rattus norvegicus
taccagggtgcacgaccccgatagg

SEQ ID NO: 549693 - DNA, 25 bp, Rattus norvegicus
taccagggtgcaggaccccgatagg

SEQ ID NO: 549694 - DNA, 25 bp, Rattus norvegicus
taccaggtaggtatagggcctccag

SEQ ID NO: 549695 - DNA, 25 bp, Rattus norvegicus
taccaggtaggtttagggcctccag

SEQ ID NO: 549696 - DNA, 25 bp, Rattus norvegicus
taccaggtccttccaaacgaatcgt

SEQ ID NO: 549697 - DNA, 25 bp, Rattus norvegicus
taccaggtccttgcaaacgaatcgt

SEQ ID NO: 549698 - DNA, 25 bp, Rattus norvegicus
taccaggtggagaacagctacgtcg

SEQ ID NO: 549699 - DNA, 25 bp, Rattus norvegicus
taccaggtggagtacagctacgtcg

SEQ ID NO: 549700 - DNA, 25 bp, Rattus norvegicus
taccagtaatccattcactctttct

SEQ ID NO: 549701 - DNA, 25 bp, Rattus norvegicus
taccagtaatcctttcactctttct

SEQ ID NO: 549702 - DNA, 25 bp, Rattus norvegicus
taccagtaccttagtgtaacatcaa

SEQ ID NO: 549703 - DNA, 25 bp, Rattus norvegicus
taccagtacctttgtgtaacatcaa

SEQ ID NO: 549704 - DNA, 25 bp, Rattus norvegicus
taccagtagtagacagccaaagcct

SEQ ID NO: 549705 - DNA, 25 bp, Rattus norvegicus
taccagtagtagtcagccaaagcct

SEQ ID NO: 549706 - DNA, 25 bp, Rattus norvegicus
taccagtagttgctgtttctcctca

SEQ ID NO: 549707 - DNA, 25 bp, Rattus norvegicus
taccagtagttggtgtttctcctca

SEQ ID NO: 549708 - DNA, 25 bp, Rattus norvegicus
taccagtattccatcccagagttag

SEQ ID NO: 549709 - DNA, 25 bp, Rattus norvegicus
taccagtattccttcccagagttag

SEQ ID NO: 549710 - DNA, 25 bp, Rattus norvegicus
taccagtccatgcagcattgatctc

SEQ ID NO: 549711 - DNA, 25 bp, Rattus norvegicus
taccagtccatggagcattgatctc

SEQ ID NO: 549712 - DNA, 25 bp, Rattus norvegicus
taccagtggctgagctgcgtctcaa

SEQ ID NO: 549713 - DNA, 25 bp, Rattus norvegicus
taccagtggctgtgctgcgtctcaa

SEQ ID NO: 549714 - DNA, 25 bp, Rattus norvegicus
taccagtgtactcagggctttgtcc

SEQ ID NO: 549715 - DNA, 25 bp, Rattus norvegicus
taccagtgtactgagggctttgtcc

SEQ ID NO: 549716 - DNA, 25 bp, Rattus norvegicus
taccagttcactatctcccttggaa

SEQ ID NO: 549717 - DNA, 25 bp, Rattus norvegicus
taccagttcactttctcccttggaa

SEQ ID NO: 549718 - DNA, 25 bp, Rattus norvegicus
taccagttgcatcttcatgagagct

SEQ ID NO: 549719 - DNA, 25 bp, Rattus norvegicus
taccagttgcatgttcatgagagct

SEQ ID NO: 549720 - DNA, 25 bp, Rattus norvegicus
taccagttggccaagtttccctgtt

SEQ ID NO: 549721 - DNA, 25 bp, Rattus norvegicus
taccagttggcctagtttccctgtt

SEQ ID NO: 549722 - DNA, 25 bp, Rattus norvegicus
taccagttttcaatgcacttcactc

SEQ ID NO: 549723 - DNA, 25 bp, Rattus norvegicus
taccagttttcattgcacttcactc

SEQ ID NO: 549724 - DNA, 25 bp, Rattus norvegicus
taccagtttttgcttttcgacttag

SEQ ID NO: 549725 - DNA, 25 bp, Rattus norvegicus
taccagtttttggttttcgacttag

SEQ ID NO: 549726 - DNA, 25 bp, Rattus norvegicus
taccataatgtccttggttttctgt

SEQ ID NO: 549727 - DNA, 25 bp, Rattus norvegicus
taccataatgtcgttggttttctgt

SEQ ID NO: 549728 - DNA, 25 bp, Rattus norvegicus
taccatacagttattatcccctttg

SEQ ID NO: 549729 - DNA, 25 bp, Rattus norvegicus
taccatacagtttttatcccctttg

SEQ ID NO: 549730 - DNA, 25 bp, Rattus norvegicus
taccatagcttccaaggatccaagt

SEQ ID NO: 549731 - DNA, 25 bp, Rattus norvegicus
taccatagcttcgaaggatccaagt

SEQ ID NO: 549732 - DNA, 25 bp, Rattus norvegicus
taccatatatcccactgcactgagg

SEQ ID NO: 549733 - DNA, 25 bp, Rattus norvegicus
taccatatatccgactgcactgagg

SEQ ID NO: 549734 - DNA, 25 bp, Rattus norvegicus
taccatatccagaagattccaaaag

SEQ ID NO: 549735 - DNA, 25 bp, Rattus norvegicus
taccatatccagtagattccaaaag

SEQ ID NO: 549736 - DNA, 25 bp, Rattus norvegicus
taccatattccgcttctttgaacag

SEQ ID NO: 549737 - DNA, 25 bp, Rattus norvegicus
taccatattccggttctttgaacag

SEQ ID NO: 549738 - DNA, 25 bp, Rattus norvegicus
taccatcaaaatactttcctgggac

SEQ ID NO: 549739 - DNA, 25 bp, Rattus norvegicus
taccatcaaaattctttcctgggac

SEQ ID NO: 549740 - DNA, 25 bp, Rattus norvegicus
taccatcaaagcctcctgtgacagg

SEQ ID NO: 549741 - DNA, 25 bp, Rattus norvegicus
taccatcaaagcgtcctgtgacagg

SEQ ID NO: 549742 - DNA, 25 bp, Rattus norvegicus
taccatcacctgctgttttatgaag

SEQ ID NO: 549743 - DNA, 25 bp, Rattus norvegicus
taccatcacctggtgttttatgaag

SEQ ID NO: 549744 - DNA, 25 bp, Rattus norvegicus
taccatcacgccagtgtactgacgg

SEQ ID NO: 549745 - DNA, 25 bp, Rattus norvegicus
taccatcacgcctgtgtactgacgg

SEQ ID NO: 549746 - DNA, 25 bp, Rattus norvegicus
taccatcagtggatctactttgaag

SEQ ID NO: 549747 - DNA, 25 bp, Rattus norvegicus
taccatcagtggctagtttttgtct

SEQ ID NO: 549748 - DNA, 25 bp, Rattus norvegicus
taccatcagtgggtagtttttgtct

SEQ ID NO: 549749 - DNA, 25 bp, Rattus norvegicus
taccatcagtggttctactttgaag

SEQ ID NO: 549750 - DNA, 25 bp, Rattus norvegicus
taccatcatcataacataaattcag

SEQ ID NO: 549751 - DNA, 25 bp, Rattus norvegicus
taccatcatcattacataaattcag

SEQ ID NO: 549752 - DNA, 25 bp, Rattus norvegicus
taccatccagcactggtttgaccag

SEQ ID NO: 549753 - DNA, 25 bp, Rattus norvegicus
taccatccagcagtggtttgaccag

SEQ ID NO: 549754 - DNA, 25 bp, Rattus norvegicus
taccatccagtcacatttaagattg

SEQ ID NO: 549755 - DNA, 25 bp, Rattus norvegicus
taccatccagtctcatttaagattg

SEQ ID NO: 549756 - DNA, 25 bp, Rattus norvegicus
taccatcccatgcactactactggt

SEQ ID NO: 549757 - DNA, 25 bp, Rattus norvegicus
taccatcccatggactactactggt

SEQ ID NO: 549758 - DNA, 25 bp, Rattus norvegicus
taccatcccgagagcttcatgtgta

SEQ ID NO: 549759 - DNA, 25 bp, Rattus norvegicus
taccatcccgagtgcttcatgtgta

SEQ ID NO: 549760 - DNA, 25 bp, Rattus norvegicus
taccatccgcacagagagtatccgg

SEQ ID NO: 549761 - DNA, 25 bp, Rattus norvegicus
taccatccgcactgagagtatccgg

SEQ ID NO: 549762 - DNA, 25 bp, Rattus norvegicus
taccatccgcctcagcatcatggga

SEQ ID NO: 549763 - DNA, 25 bp, Rattus norvegicus
taccatccgcctgagcatcatggga

SEQ ID NO: 549764 - DNA, 25 bp, Rattus norvegicus
taccatcctctcagatcctaagaaa

SEQ ID NO: 549765 - DNA, 25 bp, Rattus norvegicus
taccatcctctctgatcctaagaaa

SEQ ID NO: 549766 - DNA, 25 bp, Rattus norvegicus
taccatccttgcaggtgacatcaag

SEQ ID NO: 549767 - DNA, 25 bp, Rattus norvegicus
taccatccttgctggtgacatcaag

SEQ ID NO: 549768 - DNA, 25 bp, Rattus norvegicus
taccatccttggagattgcctagag

SEQ ID NO: 549769 - DNA, 25 bp, Rattus norvegicus
taccatccttggtgattgcctagag

SEQ ID NO: 549770 - DNA, 25 bp, Rattus norvegicus
taccatcgacatcttagaggacgcc

SEQ ID NO: 549771 - DNA, 25 bp, Rattus norvegicus
taccatcgacatgttagaggacgcc

SEQ ID NO: 549772 - DNA, 25 bp, Rattus norvegicus
taccatctactcatataaacttgaa

SEQ ID NO: 549773 - DNA, 25 bp, Rattus norvegicus
taccatctactcttataaacttgaa

SEQ ID NO: 549774 - DNA, 25 bp, Rattus norvegicus
taccatctgcagctccaactttaag

SEQ ID NO: 549775 - DNA, 25 bp, Rattus norvegicus
taccatctgcaggtccaactttaag

SEQ ID NO: 549776 - DNA, 25 bp, Rattus norvegicus
taccatcttaccagtatccttgaag

SEQ ID NO: 549777 - DNA, 25 bp, Rattus norvegicus
taccatcttacctgtatccttgaag

SEQ ID NO: 549778 - DNA, 25 bp, Rattus norvegicus
taccatcttcaaaagcccaagaagt

SEQ ID NO: 549779 - DNA, 25 bp, Rattus norvegicus
taccatcttcaatagcccaagaagt

SEQ ID NO: 549780 - DNA, 25 bp, Rattus norvegicus
taccatgaactgctgctgaccacaa

SEQ ID NO: 549781 - DNA, 25 bp, Rattus norvegicus
taccatgaactggtgctgaccacaa

SEQ ID NO: 549782 - DNA, 25 bp, Rattus norvegicus
taccatgacatcactctgtacaaag

SEQ ID NO: 549783 - DNA, 25 bp, Rattus norvegicus
taccatgacatcatcagggtggccc

SEQ ID NO: 549784 - DNA, 25 bp, Rattus norvegicus
taccatgacatctctctgtacaaag

SEQ ID NO: 549785 - DNA, 25 bp, Rattus norvegicus
taccatgacatcttcagggtggccc

SEQ ID NO: 549786 - DNA, 25 bp, Rattus norvegicus
taccatgacccacgagctatggctg

SEQ ID NO: 549787 - DNA, 25 bp, Rattus norvegicus
taccatgacccaggagctatggctg

SEQ ID NO: 549788 - DNA, 25 bp, Rattus norvegicus
taccatgactccagtccttggatga

SEQ ID NO: 549789 - DNA, 25 bp, Rattus norvegicus
taccatgactcctgtccttggatga

SEQ ID NO: 549790 - DNA, 25 bp, Rattus norvegicus
taccatgagcatatctcgtctgaag

SEQ ID NO: 549791 - DNA, 25 bp, Rattus norvegicus
taccatgagcatttctcgtctgaag

SEQ ID NO: 549792 - DNA, 25 bp, Rattus norvegicus
taccatgcaatcatctaccttctag

SEQ ID NO: 549793 - DNA, 25 bp, Rattus norvegicus
taccatgcaatcttctaccttctag

SEQ ID NO: 549794 - DNA, 25 bp, Rattus norvegicus
taccatgcagctagatgtattggca

SEQ ID NO: 549795 - DNA, 25 bp, Rattus norvegicus
taccatgcagcttgatgtattggca

SEQ ID NO: 549796 - DNA, 25 bp, Rattus norvegicus
taccatgccttcactatgactacag

SEQ ID NO: 549797 - DNA, 25 bp, Rattus norvegicus
taccatgccttctctatgactacag

SEQ ID NO: 549798 - DNA, 25 bp, Rattus norvegicus
taccatgctctaaactgacagcagc

SEQ ID NO: 549799 - DNA, 25 bp, Rattus norvegicus
taccatgctctatactgacagcagc

SEQ ID NO: 549800 - DNA, 25 bp, Rattus norvegicus
taccatgctgaaccagttcctgggc

SEQ ID NO: 549801 - DNA, 25 bp, Rattus norvegicus
taccatgctgaagcagttcctgggc

SEQ ID NO: 549802 - DNA, 25 bp, Rattus norvegicus
taccatgcttccacagttgtagact

SEQ ID NO: 549803 - DNA, 25 bp, Rattus norvegicus
taccatgcttcctcagttgtagact

SEQ ID NO: 549804 - DNA, 25 bp, Rattus norvegicus
taccatggcaaaaccttgagagtct

SEQ ID NO: 549805 - DNA, 25 bp, Rattus norvegicus
taccatggcaaatccttgagagtct

SEQ ID NO: 549806 - DNA, 25 bp, Rattus norvegicus
taccatggtaggaaactgtgccttc

SEQ ID NO: 549807 - DNA, 25 bp, Rattus norvegicus
taccatggtaggtaactgtgccttc

SEQ ID NO: 549808 - DNA, 25 bp, Rattus norvegicus
taccatggtgatagtgctcacgtct

SEQ ID NO: 549809 - DNA, 25 bp, Rattus norvegicus
taccatggtgattgtgctcacgtct

SEQ ID NO: 549810 - DNA, 25 bp, Rattus norvegicus
taccatgtacatactggcttatgat

SEQ ID NO: 549811 - DNA, 25 bp, Rattus norvegicus
taccatgtacattctggcttatgat

SEQ ID NO: 549812 - DNA, 25 bp, Rattus norvegicus
taccatgtcatcattgcctactgac

SEQ ID NO: 549813 - DNA, 25 bp, Rattus norvegicus
taccatgtcatctttgcctactgac

SEQ ID NO: 549814 - DNA, 25 bp, Rattus norvegicus
taccatgtcattcctgttttacgag

SEQ ID NO: 549815 - DNA, 25 bp, Rattus norvegicus
taccatgtcattgctgttttacgag

SEQ ID NO: 549816 - DNA, 25 bp, Rattus norvegicus
taccatgtcccacgttgatactcca

SEQ ID NO: 549817 - DNA, 25 bp, Rattus norvegicus
taccatgtcccaggttgatactcca

SEQ ID NO: 549818 - DNA, 25 bp, Rattus norvegicus
taccatgtcctcagaagattggcag

SEQ ID NO: 549819 - DNA, 25 bp, Rattus norvegicus
taccatgtcctctgaagattggcag

SEQ ID NO: 549820 - DNA, 25 bp, Rattus norvegicus
taccatgtctctagcttaattcaac

SEQ ID NO: 549821 - DNA, 25 bp, Rattus norvegicus
taccatgtctcttgcttaattcaac

SEQ ID NO: 549822 - DNA, 25 bp, Rattus norvegicus
taccatgtgattatccaagagtttg

SEQ ID NO: 549823 - DNA, 25 bp, Rattus norvegicus
taccatgtgattttccaagagtttg

SEQ ID NO: 549824 - DNA, 25 bp, Rattus norvegicus
taccatgtgggtccaaagatctcta

SEQ ID NO: 549825 - DNA, 25 bp, Rattus norvegicus
taccatgtgggtgcaaagatctcta

SEQ ID NO: 549826 - DNA, 25 bp, Rattus norvegicus
taccatgttgaaagggctgccccta

SEQ ID NO: 549827 - DNA, 25 bp, Rattus norvegicus
taccatgttgaatgggctgccccta

SEQ ID NO: 549828 - DNA, 25 bp, Rattus norvegicus
taccatgtttctactctgtgtctga

SEQ ID NO: 549829 - DNA, 25 bp, Rattus norvegicus
taccatgtttcttctctgtgtctga

SEQ ID NO: 549830 - DNA, 25 bp, Rattus norvegicus
taccatgtttgtccggtacctgtgg

SEQ ID NO: 549831 - DNA, 25 bp, Rattus norvegicus
taccatgtttgtgcggtacctgtgg

SEQ ID NO: 549832 - DNA, 25 bp, Rattus norvegicus
taccattacggaatacttgttttgc

SEQ ID NO: 549833 - DNA, 25 bp, Rattus norvegicus
taccattacggattacttgttttgc

SEQ ID NO: 549834 - DNA, 25 bp, Rattus norvegicus
taccattacgggaacacaggaccag

SEQ ID NO: 549835 - DNA, 25 bp, Rattus norvegicus
taccattacgggtacacaggaccag

SEQ ID NO: 549836 - DNA, 25 bp, Rattus norvegicus
taccattcatggcacctagcatagt

SEQ ID NO: 549837 - DNA, 25 bp, Rattus norvegicus
taccattcatgggacctagcatagt

SEQ ID NO: 549838 - DNA, 25 bp, Rattus norvegicus
taccattctgatagctatccctcaa

SEQ ID NO: 549839 - DNA, 25 bp, Rattus norvegicus
taccattctgattgctatccctcaa

SEQ ID NO: 549840 - DNA, 25 bp, Rattus norvegicus
taccattctgggacattccctttaa

SEQ ID NO: 549841 - DNA, 25 bp, Rattus norvegicus
taccattctgggtcattccctttaa

SEQ ID NO: 549842 - DNA, 25 bp, Rattus norvegicus
taccattgacataattaccaccctc

SEQ ID NO: 549843 - DNA, 25 bp, Rattus norvegicus
taccattgacattattaccaccctc

SEQ ID NO: 549844 - DNA, 25 bp, Rattus norvegicus
taccattgattaacctgtatgtgaa

SEQ ID NO: 549845 - DNA, 25 bp, Rattus norvegicus
taccattgattatcctgtatgtgaa

SEQ ID NO: 549846 - DNA, 25 bp, Rattus norvegicus
taccattgcctaccagagaagacag

SEQ ID NO: 549847 - DNA, 25 bp, Rattus norvegicus
taccattgcctagcagagaagacag

SEQ ID NO: 549848 - DNA, 25 bp, Rattus norvegicus
taccattgggagagtattgcctgaa

SEQ ID NO: 549849 - DNA, 25 bp, Rattus norvegicus
taccattgggagtgtattgcctgaa

SEQ ID NO: 549850 - DNA, 25 bp, Rattus norvegicus
taccattgggccagcttaatgtttt

SEQ ID NO: 549851 - DNA, 25 bp, Rattus norvegicus
taccattgggcctgcttaatgtttt

SEQ ID NO: 549852 - DNA, 25 bp, Rattus norvegicus
taccattggtgcatatgttccagat

SEQ ID NO: 549853 - DNA, 25 bp, Rattus norvegicus
taccattggtgcttatgttccagat

SEQ ID NO: 549854 - DNA, 25 bp, Rattus norvegicus
taccattgtacaattgcacctcttt

SEQ ID NO: 549855 - DNA, 25 bp, Rattus norvegicus
taccattgtacatttgcacctcttt

SEQ ID NO: 549856 - DNA, 25 bp, Rattus norvegicus
taccattgtcagcactgagcgggat

SEQ ID NO: 549857 - DNA, 25 bp, Rattus norvegicus
taccattgtcaggactgagcgggat

SEQ ID NO: 549858 - DNA, 25 bp, Rattus norvegicus
taccatttcattatgcacattctag

SEQ ID NO: 549859 - DNA, 25 bp, Rattus norvegicus
taccatttcattttgcacattctag

SEQ ID NO: 549860 - DNA, 25 bp, Rattus norvegicus
taccatttcccaacatcgacgataa

SEQ ID NO: 549861 - DNA, 25 bp, Rattus norvegicus
taccatttcccatcatcgacgataa

SEQ ID NO: 549862 - DNA, 25 bp, Rattus norvegicus
taccatttcttaaaagtgtactcaa

SEQ ID NO: 549863 - DNA, 25 bp, Rattus norvegicus
taccatttcttataagtgtactcaa

SEQ ID NO: 549864 - DNA, 25 bp, Rattus norvegicus
taccatttgtatacctgaatttatt

SEQ ID NO: 549865 - DNA, 25 bp, Rattus norvegicus
taccatttgtattcctgaatttatt

SEQ ID NO: 549866 - DNA, 25 bp, Rattus norvegicus
taccattttggcagtttagatcctc

SEQ ID NO: 549867 - DNA, 25 bp, Rattus norvegicus
taccattttggctgtttagatcctc

SEQ ID NO: 549868 - DNA, 25 bp, Rattus norvegicus
taccattttttcattatcgactagg

SEQ ID NO: 549869 - DNA, 25 bp, Rattus norvegicus
taccattttttctttatcgactagg

SEQ ID NO: 549870 - DNA, 25 bp, Rattus norvegicus
tacccaaaagggattgattgtctta

SEQ ID NO: 549871 - DNA, 25 bp, Rattus norvegicus
tacccaaaagggtttgattgtctta

SEQ ID NO: 549872 - DNA, 25 bp, Rattus norvegicus
tacccaaaccagagacgtggcgtct

SEQ ID NO: 549873 - DNA, 25 bp, Rattus norvegicus
tacccaaaccagtgacgtggcgtct

SEQ ID NO: 549874 - DNA, 25 bp, Rattus norvegicus
tacccaaactgaccatcttctgaag

SEQ ID NO: 549875 - DNA, 25 bp, Rattus norvegicus
tacccaaactgagcatcttctgaag

SEQ ID NO: 549876 - DNA, 25 bp, Rattus norvegicus
tacccaaagggtagtcctgcttgtt

SEQ ID NO: 549877 - DNA, 25 bp, Rattus norvegicus
tacccaaagggttgtcctgcttgtt

SEQ ID NO: 549878 - DNA, 25 bp, Rattus norvegicus
tacccaaagtggctgctgctgatat

SEQ ID NO: 549879 - DNA, 25 bp, Rattus norvegicus
tacccaaagtgggtgctgctgatat

SEQ ID NO: 549880 - DNA, 25 bp, Rattus norvegicus
tacccaaatgttctgtcacgttctg

SEQ ID NO: 549881 - DNA, 25 bp, Rattus norvegicus
tacccaaatgttgtgtcacgttctg

SEQ ID NO: 549882 - DNA, 25 bp, Rattus norvegicus
tacccaacatgtagttttcacccta

SEQ ID NO: 549883 - DNA, 25 bp, Rattus norvegicus
tacccaacatgttgttttcacccta

SEQ ID NO: 549884 - DNA, 25 bp, Rattus norvegicus
tacccaacctggacctggttatcga

SEQ ID NO: 549885 - DNA, 25 bp, Rattus norvegicus
tacccaacctggtcctggttatcga

SEQ ID NO: 549886 - DNA, 25 bp, Rattus norvegicus
tacccaactctgacatctgtaacaa

SEQ ID NO: 549887 - DNA, 25 bp, Rattus norvegicus
tacccaactctgtcatctgtaacaa

SEQ ID NO: 549888 - DNA, 25 bp, Rattus norvegicus
tacccaagatgcaacaggtctggag

SEQ ID NO: 549889 - DNA, 25 bp, Rattus norvegicus
tacccaagatgctacaggtctggag

SEQ ID NO: 549890 - DNA, 25 bp, Rattus norvegicus
tacccaagcagcacacactgtgaag

SEQ ID NO: 549891 - DNA, 25 bp, Rattus norvegicus
tacccaagcagctcacactgtgaag

SEQ ID NO: 549892 - DNA, 25 bp, Rattus norvegicus
tacccaagcttcaaactcagccaag

SEQ ID NO: 549893 - DNA, 25 bp, Rattus norvegicus
tacccaagcttctaactcagccaag

SEQ ID NO: 549894 - DNA, 25 bp, Rattus norvegicus
tacccaaggagaatctaagtacacg

SEQ ID NO: 549895 - DNA, 25 bp, Rattus norvegicus
tacccaaggagattctaagtacacg

SEQ ID NO: 549896 - DNA, 25 bp, Rattus norvegicus
tacccaaggcctatgccagagtgaa

SEQ ID NO: 549897 - DNA, 25 bp, Rattus norvegicus
tacccaaggcctttgccagagtgaa

SEQ ID NO: 549898 - DNA, 25 bp, Rattus norvegicus
tacccaaggctgaattagaggacat

SEQ ID NO: 549899 - DNA, 25 bp, Rattus norvegicus
tacccaaggctgtattagaggacat

SEQ ID NO: 549900 - DNA, 25 bp, Rattus norvegicus
tacccaagtgttatttgagctgctt

SEQ ID NO: 549901 - DNA, 25 bp, Rattus norvegicus
tacccaagtgttttttgagctgctt

SEQ ID NO: 549902 - DNA, 25 bp, Rattus norvegicus
tacccaataattctgatgtgtttac

SEQ ID NO: 549903 - DNA, 25 bp, Rattus norvegicus
tacccaataattgtgatgtgtttac

SEQ ID NO: 549904 - DNA, 25 bp, Rattus norvegicus
tacccaatgcagctggacctggaat

SEQ ID NO: 549905 - DNA, 25 bp, Rattus norvegicus
tacccaatgcaggtggacctggaat

SEQ ID NO: 549906 - DNA, 25 bp, Rattus norvegicus
tacccacaagtgatctgcttttctt

SEQ ID NO: 549907 - DNA, 25 bp, Rattus norvegicus
tacccacaagtgttctgcttttctt

SEQ ID NO: 549908 - DNA, 25 bp, Rattus norvegicus
tacccacacttaccatatgcgtata

SEQ ID NO: 549909 - DNA, 25 bp, Rattus norvegicus
tacccacacttagcatatgcgtata

SEQ ID NO: 549910 - DNA, 25 bp, Rattus norvegicus
tacccacagccaagttttttccaaa

SEQ ID NO: 549911 - DNA, 25 bp, Rattus norvegicus
tacccacagccatgttttttccaaa

SEQ ID NO: 549912 - DNA, 25 bp, Rattus norvegicus
tacccacagcgtacacaaaggccga

SEQ ID NO: 549913 - DNA, 25 bp, Rattus norvegicus
tacccacagcgttcacaaaggccga

SEQ ID NO: 549914 - DNA, 25 bp, Rattus norvegicus
tacccacagtcccagaaactttata

SEQ ID NO: 549915 - DNA, 25 bp, Rattus norvegicus
tacccacagtccgagaaactttata

SEQ ID NO: 549916 - DNA, 25 bp, Rattus norvegicus
tacccacagtgacatgccagcatct

SEQ ID NO: 549917 - DNA, 25 bp, Rattus norvegicus
tacccacagtgagatgccagcatct

SEQ ID NO: 549918 - DNA, 25 bp, Rattus norvegicus
tacccacattccctcttaagtgttc

SEQ ID NO: 549919 - DNA, 25 bp, Rattus norvegicus
tacccacattccgtcttaagtgttc

SEQ ID NO: 549920 - DNA, 25 bp, Rattus norvegicus
tacccaccaatcacaggctgatgca

SEQ ID NO: 549921 - DNA, 25 bp, Rattus norvegicus
tacccaccaatctcaggctgatgca

SEQ ID NO: 549922 - DNA, 25 bp, Rattus norvegicus
tacccaccctgtctggctataagga

SEQ ID NO: 549923 - DNA, 25 bp, Rattus norvegicus
tacccaccctgtgtggctataagga

SEQ ID NO: 549924 - DNA, 25 bp, Rattus norvegicus
tacccaccgtggatactgcatgatg

SEQ ID NO: 549925 - DNA, 25 bp, Rattus norvegicus
tacccaccgtggttactgcatgatg

SEQ ID NO: 549926 - DNA, 25 bp, Rattus norvegicus
tacccacctataagtttcccatgtt

SEQ ID NO: 549927 - DNA, 25 bp, Rattus norvegicus
tacccacctatatgtttcccatgtt

SEQ ID NO: 549928 - DNA, 25 bp, Rattus norvegicus
tacccacctatcacctttaagattg

SEQ ID NO: 549929 - DNA, 25 bp, Rattus norvegicus
tacccacctatctcctttaagattg

SEQ ID NO: 549930 - DNA, 25 bp, Rattus norvegicus
tacccacggcctatgaatggttcga

SEQ ID NO: 549931 - DNA, 25 bp, Rattus norvegicus
tacccacggcctttgaatggttcga

SEQ ID NO: 549932 - DNA, 25 bp, Rattus norvegicus
tacccacggtcgacacacacaaaga

SEQ ID NO: 549933 - DNA, 25 bp, Rattus norvegicus
tacccacggtcgtcacacacaaaga

SEQ ID NO: 549934 - DNA, 25 bp, Rattus norvegicus
tacccacgtcagatcactaacaaca

SEQ ID NO: 549935 - DNA, 25 bp, Rattus norvegicus
tacccacgtcagttcactaacaaca

SEQ ID NO: 549936 - DNA, 25 bp, Rattus norvegicus
tacccacgtgacaggaaacccattg

SEQ ID NO: 549937 - DNA, 25 bp, Rattus norvegicus
tacccacgtgactggaaacccattg

SEQ ID NO: 549938 - DNA, 25 bp, Rattus norvegicus
tacccactcggtacactgtaggaat

SEQ ID NO: 549939 - DNA, 25 bp, Rattus norvegicus
tacccactcggttcactgtaggaat

SEQ ID NO: 549940 - DNA, 25 bp, Rattus norvegicus
tacccactctccagaggattttttg

SEQ ID NO: 549941 - DNA, 25 bp, Rattus norvegicus
tacccactctcctgaggattttttg

SEQ ID NO: 549942 - DNA, 25 bp, Rattus norvegicus
tacccactgcttattcatgtcagct

SEQ ID NO: 549943 - DNA, 25 bp, Rattus norvegicus
tacccactgctttttcatgtcagct

SEQ ID NO: 549944 - DNA, 25 bp, Rattus norvegicus
tacccactgtacaaacgtgccaagt

SEQ ID NO: 549945 - DNA, 25 bp, Rattus norvegicus
tacccactgtactaacgtgccaagt

SEQ ID NO: 549946 - DNA, 25 bp, Rattus norvegicus
tacccactgttaatttgatagtctg

SEQ ID NO: 549947 - DNA, 25 bp, Rattus norvegicus
tacccactgttattttgatagtctg

SEQ ID NO: 549948 - DNA, 25 bp, Rattus norvegicus
tacccacttattataatgacccata

SEQ ID NO: 549949 - DNA, 25 bp, Rattus norvegicus
tacccacttattttaatgacccata

SEQ ID NO: 549950 - DNA, 25 bp, Rattus norvegicus
tacccacttcctataagctgtacta

SEQ ID NO: 549951 - DNA, 25 bp, Rattus norvegicus
tacccacttcctttaagctgtacta

SEQ ID NO: 549952 - DNA, 25 bp, Rattus norvegicus
tacccacttggcagtcaaactgaat

SEQ ID NO: 549953 - DNA, 25 bp, Rattus norvegicus
tacccacttggctgtcaaactgaat

SEQ ID NO: 549954 - DNA, 25 bp, Rattus norvegicus
tacccagaacctaggtttttcaatg

SEQ ID NO: 549955 - DNA, 25 bp, Rattus norvegicus
tacccagaaccttggtttttcaatg

SEQ ID NO: 549956 - DNA, 25 bp, Rattus norvegicus
tacccagagagtcctatagtagtgt

SEQ ID NO: 549957 - DNA, 25 bp, Rattus norvegicus
tacccagagagtgctatagtagtgt

SEQ ID NO: 549958 - DNA, 25 bp, Rattus norvegicus
tacccagagcatcacacagttcagt

SEQ ID NO: 549959 - DNA, 25 bp, Rattus norvegicus
tacccagagcatgacacagttcagt

SEQ ID NO: 549960 - DNA, 25 bp, Rattus norvegicus
tacccagagccgcaggacggagact

SEQ ID NO: 549961 - DNA, 25 bp, Rattus norvegicus
tacccagagccggaggacggagact

SEQ ID NO: 549962 - DNA, 25 bp, Rattus norvegicus
tacccagatgagaaccctcgagagt

SEQ ID NO: 549963 - DNA, 25 bp, Rattus norvegicus
tacccagatgagtaccctcgagagt

SEQ ID NO: 549964 - DNA, 25 bp, Rattus norvegicus
tacccagcagtaagccaagtctctg

SEQ ID NO: 549965 - DNA, 25 bp, Rattus norvegicus
tacccagcagtatgccaagtctctg

SEQ ID NO: 549966 - DNA, 25 bp, Rattus norvegicus
tacccagccagactcagcagttgtg

SEQ ID NO: 549967 - DNA, 25 bp, Rattus norvegicus
tacccagccagagtcagcagttgtg

SEQ ID NO: 549968 - DNA, 25 bp, Rattus norvegicus
tacccagcccttcaggtgtaacact

SEQ ID NO: 549969 - DNA, 25 bp, Rattus norvegicus
tacccagcccttgaggtgtaacact

SEQ ID NO: 549970 - DNA, 25 bp, Rattus norvegicus
tacccagcctagaacgatcagattt

SEQ ID NO: 549971 - DNA, 25 bp, Rattus norvegicus
tacccagcctagtacgatcagattt

SEQ ID NO: 549972 - DNA, 25 bp, Rattus norvegicus
tacccagcgggcagatcgtcataat

SEQ ID NO: 549973 - DNA, 25 bp, Rattus norvegicus
tacccagcgggctgatcgtcataat

SEQ ID NO: 549974 - DNA, 25 bp, Rattus norvegicus
tacccagctacaacatccttggtga

SEQ ID NO: 549975 - DNA, 25 bp, Rattus norvegicus
tacccagctacatcatccttggtga

SEQ ID NO: 549976 - DNA, 25 bp, Rattus norvegicus
tacccagctcacctgaagagggctc

SEQ ID NO: 549977 - DNA, 25 bp, Rattus norvegicus
tacccagctcacgtgaagagggctc

SEQ ID NO: 549978 - DNA, 25 bp, Rattus norvegicus
tacccagctcctacattttacagaa

SEQ ID NO: 549979 - DNA, 25 bp, Rattus norvegicus
tacccagctccttcattttacagaa

SEQ ID NO: 549980 - DNA, 25 bp, Rattus norvegicus
tacccagctcggcaggacaaggact

SEQ ID NO: 549981 - DNA, 25 bp, Rattus norvegicus
tacccagctcgggaggacaaggact

SEQ ID NO: 549982 - DNA, 25 bp, Rattus norvegicus
tacccagctttcctagttcatgtga

SEQ ID NO: 549983 - DNA, 25 bp, Rattus norvegicus
tacccagctttcgtagttcatgtga

SEQ ID NO: 549984 - DNA, 25 bp, Rattus norvegicus
tacccaggatcgattatcttcacac

SEQ ID NO: 549985 - DNA, 25 bp, Rattus norvegicus
tacccaggatcgtttatcttcacac

SEQ ID NO: 549986 - DNA, 25 bp, Rattus norvegicus
tacccaggccagatgtgagagcaga

SEQ ID NO: 549987 - DNA, 25 bp, Rattus norvegicus
tacccaggccagttgtgagagcaga

SEQ ID NO: 549988 - DNA, 25 bp, Rattus norvegicus
tacccaggctaccaacattgttcat

SEQ ID NO: 549989 - DNA, 25 bp, Rattus norvegicus
tacccaggctacgaacattgttcat

SEQ ID NO: 549990 - DNA, 25 bp, Rattus norvegicus
tacccagggaatccagacagccgta

SEQ ID NO: 549991 - DNA, 25 bp, Rattus norvegicus
tacccagggaatgcagacagccgta

SEQ ID NO: 549992 - DNA, 25 bp, Rattus norvegicus
tacccagggacgcagcagcctttca

SEQ ID NO: 549993 - DNA, 25 bp, Rattus norvegicus
tacccagggacggagcagcctttca

SEQ ID NO: 549994 - DNA, 25 bp, Rattus norvegicus
tacccagggcaaatactgaggtcat

SEQ ID NO: 549995 - DNA, 25 bp, Rattus norvegicus
tacccagggcaattactgaggtcat

SEQ ID NO: 549996 - DNA, 25 bp, Rattus norvegicus
tacccagggccacatgcatgaagaa

SEQ ID NO: 549997 - DNA, 25 bp, Rattus norvegicus
tacccagggccagatgcatgaagaa

SEQ ID NO: 549998 - DNA, 25 bp, Rattus norvegicus
tacccagggtgcaatggagtgagat

SEQ ID NO: 549999 - DNA, 25 bp, Rattus norvegicus
tacccagggtgctatggagtgagat

SEQ ID NO: 550000 - DNA, 25 bp, Rattus norvegicus
tacccagggtggcatatctttgccc

SEQ ID NO: 550001 - DNA, 25 bp, Rattus norvegicus
tacccagggtgggatatctttgccc

SEQ ID NO: 550002 - DNA, 25 bp, Rattus norvegicus
tacccaggtaagcatttgcccggtg

SEQ ID NO: 550003 - DNA, 25 bp, Rattus norvegicus
tacccaggtaaggatttgcccggtg

SEQ ID NO: 550004 - DNA, 25 bp, Rattus norvegicus
tacccaggtcagctctttttacatt

SEQ ID NO: 550005 - DNA, 25 bp, Rattus norvegicus
tacccaggtcaggtctttttacatt

SEQ ID NO: 550006 - DNA, 25 bp, Rattus norvegicus
tacccaggttcaagcagtccgagca

SEQ ID NO: 550007 - DNA, 25 bp, Rattus norvegicus
tacccaggttcatgcagtccgagca

SEQ ID NO: 550008 - DNA, 25 bp, Rattus norvegicus
tacccaggttgccttaccatggtaa

SEQ ID NO: 550009 - DNA, 25 bp, Rattus norvegicus
tacccaggttgcgttaccatggtaa

SEQ ID NO: 550010 - DNA, 25 bp, Rattus norvegicus
tacccagtacaaaaggctgccttta

SEQ ID NO: 550011 - DNA, 25 bp, Rattus norvegicus
tacccagtacaataggctgccttta

SEQ ID NO: 550012 - DNA, 25 bp, Rattus norvegicus
tacccagtacctcagcaggattcag

SEQ ID NO: 550013 - DNA, 25 bp, Rattus norvegicus
tacccagtacctgagcaggattcag

SEQ ID NO: 550014 - DNA, 25 bp, Rattus norvegicus
tacccagtatggacgtttgccgata

SEQ ID NO: 550015 - DNA, 25 bp, Rattus norvegicus
tacccagtatggtcgtttgccgata

SEQ ID NO: 550016 - DNA, 25 bp, Rattus norvegicus
tacccagtattacctttaggctttg

SEQ ID NO: 550017 - DNA, 25 bp, Rattus norvegicus
tacccagtattagctttaggctttg

SEQ ID NO: 550018 - DNA, 25 bp, Rattus norvegicus
tacccagtcaagacctcttgtggag

SEQ ID NO: 550019 - DNA, 25 bp, Rattus norvegicus
tacccagtcaagtcctcttgtggag

SEQ ID NO: 550020 - DNA, 25 bp, Rattus norvegicus
tacccagtgacccagactgctaaga

SEQ ID NO: 550021 - DNA, 25 bp, Rattus norvegicus
tacccagtgaccgagactgctaaga

SEQ ID NO: 550022 - DNA, 25 bp, Rattus norvegicus
tacccagtgctgaagtatcctttta

SEQ ID NO: 550023 - DNA, 25 bp, Rattus norvegicus
tacccagtgctgtagtatcctttta

SEQ ID NO: 550024 - DNA, 25 bp, Rattus norvegicus
tacccagtgggcaagagtctcacat

SEQ ID NO: 550025 - DNA, 25 bp, Rattus norvegicus
tacccagtgggctagagtctcacat

SEQ ID NO: 550026 - DNA, 25 bp, Rattus norvegicus
tacccagtgtccaggttcagcaatg

SEQ ID NO: 550027 - DNA, 25 bp, Rattus norvegicus
tacccagtgtcctggttcagcaatg

SEQ ID NO: 550028 - DNA, 25 bp, Rattus norvegicus
tacccagttactacctagtttacag

SEQ ID NO: 550029 - DNA, 25 bp, Rattus norvegicus
tacccagttacttcctagtttacag

SEQ ID NO: 550030 - DNA, 25 bp, Rattus norvegicus
tacccagttgatccttggactccac

SEQ ID NO: 550031 - DNA, 25 bp, Rattus norvegicus
tacccagttgatgcttggactccac

SEQ ID NO: 550032 - DNA, 25 bp, Rattus norvegicus
tacccatatctaatggctggcatgg

SEQ ID NO: 550033 - DNA, 25 bp, Rattus norvegicus
tacccatatctattggctggcatgg

SEQ ID NO: 550034 - DNA, 25 bp, Rattus norvegicus
tacccatatgagctgctgctggtga

SEQ ID NO: 550035 - DNA, 25 bp, Rattus norvegicus
tacccatatgaggtgctgctggtga

SEQ ID NO: 550036 - DNA, 25 bp, Rattus norvegicus
tacccatcacagctctgagagtcag

SEQ ID NO: 550037 - DNA, 25 bp, Rattus norvegicus
tacccatcacaggtctgagagtcag

SEQ ID NO: 550038 - DNA, 25 bp, Rattus norvegicus
tacccatcatagactgcctggcagg

SEQ ID NO: 550039 - DNA, 25 bp, Rattus norvegicus
tacccatcatagtctgcctggcagg

SEQ ID NO: 550040 - DNA, 25 bp, Rattus norvegicus
tacccatcctgacaacctgagaagg

SEQ ID NO: 550041 - DNA, 25 bp, Rattus norvegicus
tacccatcctgagaacctgagaagg

SEQ ID NO: 550042 - DNA, 25 bp, Rattus norvegicus
tacccatcttccacttaggagctat

SEQ ID NO: 550043 - DNA, 25 bp, Rattus norvegicus
tacccatcttcctcttaggagctat

SEQ ID NO: 550044 - DNA, 25 bp, Rattus norvegicus
tacccatcttgcatgtcctcaggaa

SEQ ID NO: 550045 - DNA, 25 bp, Rattus norvegicus
tacccatcttgcttgtcctcaggaa

SEQ ID NO: 550046 - DNA, 25 bp, Rattus norvegicus
tacccatgactactatcggcgacgt

SEQ ID NO: 550047 - DNA, 25 bp, Rattus norvegicus
tacccatgactagtatcggcgacgt

SEQ ID NO: 550048 - DNA, 25 bp, Rattus norvegicus
tacccatgagtaatgtggagtgtgt

SEQ ID NO: 550049 - DNA, 25 bp, Rattus norvegicus
tacccatgagtattgtggagtgtgt

SEQ ID NO: 550050 - DNA, 25 bp, Rattus norvegicus
tacccatgccatcttgaaagccact

SEQ ID NO: 550051 - DNA, 25 bp, Rattus norvegicus
tacccatgccatgttgaaagccact

SEQ ID NO: 550052 - DNA, 25 bp, Rattus norvegicus
tacccatgcgggactttgtgtgtgc

SEQ ID NO: 550053 - DNA, 25 bp, Rattus norvegicus
tacccatgcgggtctttgtgtgtgc

SEQ ID NO: 550054 - DNA, 25 bp, Rattus norvegicus
tacccatgcgtgcaggccctcagga

SEQ ID NO: 550055 - DNA, 25 bp, Rattus norvegicus
tacccatgcgtggaggccctcagga

SEQ ID NO: 550056 - DNA, 25 bp, Rattus norvegicus
tacccatgctgtagtgtgcaattct

SEQ ID NO: 550057 - DNA, 25 bp, Rattus norvegicus
tacccatgctgttgtgtgcaattct

SEQ ID NO: 550058 - DNA, 25 bp, Rattus norvegicus
tacccatggctacccagtatgttta

SEQ ID NO: 550059 - DNA, 25 bp, Rattus norvegicus
tacccatggctagccagtatgttta

SEQ ID NO: 550060 - DNA, 25 bp, Rattus norvegicus
tacccatgtgcacgcagcgatgaat

SEQ ID NO: 550061 - DNA, 25 bp, Rattus norvegicus
tacccatgtgcaggcagcgatgaat

SEQ ID NO: 550062 - DNA, 25 bp, Rattus norvegicus
tacccatgttgaagactgcagtctc

SEQ ID NO: 550063 - DNA, 25 bp, Rattus norvegicus
tacccatgttgatgactgcagtctc

SEQ ID NO: 550064 - DNA, 25 bp, Rattus norvegicus
tacccattaacacaggactagcaag

SEQ ID NO: 550065 - DNA, 25 bp, Rattus norvegicus
tacccattaacagaggactagcaag

SEQ ID NO: 550066 - DNA, 25 bp, Rattus norvegicus
tacccattcaagaacaactcaatat

SEQ ID NO: 550067 - DNA, 25 bp, Rattus norvegicus
tacccattcaagtacaactcaatat

SEQ ID NO: 550068 - DNA, 25 bp, Rattus norvegicus
tacccattgcaaaagcggcctgtct

SEQ ID NO: 550069 - DNA, 25 bp, Rattus norvegicus
tacccattgcaatagcggcctgtct

SEQ ID NO: 550070 - DNA, 25 bp, Rattus norvegicus
tacccatttctgaatcggaattcca

SEQ ID NO: 550071 - DNA, 25 bp, Rattus norvegicus
tacccatttctgtatcggaattcca

SEQ ID NO: 550072 - DNA, 25 bp, Rattus norvegicus
tacccatttgttcacaagtggatgt

SEQ ID NO: 550073 - DNA, 25 bp, Rattus norvegicus
tacccatttgttgacaagtggatgt

SEQ ID NO: 550074 - DNA, 25 bp, Rattus norvegicus
taccccaaagtacagtggttggctt

SEQ ID NO: 550075 - DNA, 25 bp, Rattus norvegicus
taccccaaagtagagtggttggctt

SEQ ID NO: 550076 - DNA, 25 bp, Rattus norvegicus
taccccaagatacgcactgaactga

SEQ ID NO: 550077 - DNA, 25 bp, Rattus norvegicus
taccccaagataggcactgaactga

SEQ ID NO: 550078 - DNA, 25 bp, Rattus norvegicus
taccccaagctgatcggactttgta

SEQ ID NO: 550079 - DNA, 25 bp, Rattus norvegicus
taccccaagctgttcggactttgta

SEQ ID NO: 550080 - DNA, 25 bp, Rattus norvegicus
taccccaatgcgcagaggagatgac

SEQ ID NO: 550081 - DNA, 25 bp, Rattus norvegicus
taccccaatgcggagaggagatgac

SEQ ID NO: 550082 - DNA, 25 bp, Rattus norvegicus
taccccacaaatcctgagactatag

SEQ ID NO: 550083 - DNA, 25 bp, Rattus norvegicus
taccccacaaatgctgagactatag

SEQ ID NO: 550084 - DNA, 25 bp, Rattus norvegicus
taccccacaatgaaggttcgtgaat

SEQ ID NO: 550085 - DNA, 25 bp, Rattus norvegicus
taccccacaatgtaggttcgtgaat

SEQ ID NO: 550086 - DNA, 25 bp, Rattus norvegicus
taccccacactaaggtgctttgagg

SEQ ID NO: 550087 - DNA, 25 bp, Rattus norvegicus
taccccacactatggtgctttgagg

SEQ ID NO: 550088 - DNA, 25 bp, Rattus norvegicus
taccccacagagatcagctcatgag

SEQ ID NO: 550089 - DNA, 25 bp, Rattus norvegicus
taccccacagagttcagctcatgag

SEQ ID NO: 550090 - DNA, 25 bp, Rattus norvegicus
taccccacaggcatacattctgaaa

SEQ ID NO: 550091 - DNA, 25 bp, Rattus norvegicus
taccccacaggcttacattctgaaa

SEQ ID NO: 550092 - DNA, 25 bp, Rattus norvegicus
taccccaccgagcagcttactaaat

SEQ ID NO: 550093 - DNA, 25 bp, Rattus norvegicus
taccccaccgaggagcttactaaat

SEQ ID NO: 550094 - DNA, 25 bp, Rattus norvegicus
taccccactctcagcgaagtatttg

SEQ ID NO: 550095 - DNA, 25 bp, Rattus norvegicus
taccccactctctgcgaagtatttg

SEQ ID NO: 550096 - DNA, 25 bp, Rattus norvegicus
taccccactgacactgagatagtag

SEQ ID NO: 550097 - DNA, 25 bp, Rattus norvegicus
taccccactgactctgagatagtag

SEQ ID NO: 550098 - DNA, 25 bp, Rattus norvegicus
taccccactgtcacatcagagcagt

SEQ ID NO: 550099 - DNA, 25 bp, Rattus norvegicus
taccccactgtccttttgagataag

SEQ ID NO: 550100 - DNA, 25 bp, Rattus norvegicus
taccccactgtcgttttgagataag

SEQ ID NO: 550101 - DNA, 25 bp, Rattus norvegicus
taccccactgtctcatcagagcagt

SEQ ID NO: 550102 - DNA, 25 bp, Rattus norvegicus
taccccacttagatcggtaactagg

SEQ ID NO: 550103 - DNA, 25 bp, Rattus norvegicus
taccccacttagttcggtaactagg

SEQ ID NO: 550104 - DNA, 25 bp, Rattus norvegicus
taccccagagtacggattgcccagg

SEQ ID NO: 550105 - DNA, 25 bp, Rattus norvegicus
taccccagagtagggattgcccagg

SEQ ID NO: 550106 - DNA, 25 bp, Rattus norvegicus
taccccagcagcaaatctcaatagc

SEQ ID NO: 550107 - DNA, 25 bp, Rattus norvegicus
taccccagcagctaatctcaatagc

SEQ ID NO: 550108 - DNA, 25 bp, Rattus norvegicus
taccccagcccacatggtgtattgg

SEQ ID NO: 550109 - DNA, 25 bp, Rattus norvegicus
taccccagcccagatggtgtattgg

SEQ ID NO: 550110 - DNA, 25 bp, Rattus norvegicus
taccccagcgttattctctaagact

SEQ ID NO: 550111 - DNA, 25 bp, Rattus norvegicus
taccccagcgtttttctctaagact

SEQ ID NO: 550112 - DNA, 25 bp, Rattus norvegicus
taccccagctcaagctgaaggagtg

SEQ ID NO: 550113 - DNA, 25 bp, Rattus norvegicus
taccccagctcatgctgaaggagtg

SEQ ID NO: 550114 - DNA, 25 bp, Rattus norvegicus
taccccagggtgatgtcttccaaag

SEQ ID NO: 550115 - DNA, 25 bp, Rattus norvegicus
taccccagggtgttgtcttccaaag

SEQ ID NO: 550116 - DNA, 25 bp, Rattus norvegicus
taccccagggttcaaggaattgtag

SEQ ID NO: 550117 - DNA, 25 bp, Rattus norvegicus
taccccagggttgaaggaattgtag

SEQ ID NO: 550118 - DNA, 25 bp, Rattus norvegicus
taccccaggtgacacagagctcttt

SEQ ID NO: 550119 - DNA, 25 bp, Rattus norvegicus
taccccaggtgagacagagctcttt

SEQ ID NO: 550120 - DNA, 25 bp, Rattus norvegicus
taccccagtgctaattcagacatct

SEQ ID NO: 550121 - DNA, 25 bp, Rattus norvegicus
taccccagtgctagctcacattgaa

SEQ ID NO: 550122 - DNA, 25 bp, Rattus norvegicus
taccccagtgcttattcagacatct

SEQ ID NO: 550123 - DNA, 25 bp, Rattus norvegicus
taccccagtgcttgctcacattgaa

SEQ ID NO: 550124 - DNA, 25 bp, Rattus norvegicus
taccccatactgatgagtcccaaaa

SEQ ID NO: 550125 - DNA, 25 bp, Rattus norvegicus
taccccatactgttgagtcccaaaa

SEQ ID NO: 550126 - DNA, 25 bp, Rattus norvegicus
taccccatagcacgagtgtttgtga

SEQ ID NO: 550127 - DNA, 25 bp, Rattus norvegicus
taccccatagcaggagtgtttgtga

SEQ ID NO: 550128 - DNA, 25 bp, Rattus norvegicus
taccccatcattcgaggaaacgctt

SEQ ID NO: 550129 - DNA, 25 bp, Rattus norvegicus
taccccatcattggaggaaacgctt

SEQ ID NO: 550130 - DNA, 25 bp, Rattus norvegicus
taccccatcctcagaaactggagtt

SEQ ID NO: 550131 - DNA, 25 bp, Rattus norvegicus
taccccatcctctgaaactggagtt

SEQ ID NO: 550132 - DNA, 25 bp, Rattus norvegicus
taccccatctggagactgtggccaa

SEQ ID NO: 550133 - DNA, 25 bp, Rattus norvegicus
taccccatctggtgactgtggccaa

SEQ ID NO: 550134 - DNA, 25 bp, Rattus norvegicus
taccccatgactctatgtgtggaga

SEQ ID NO: 550135 - DNA, 25 bp, Rattus norvegicus
taccccatgactgtatgtgtggaga

SEQ ID NO: 550136 - DNA, 25 bp, Rattus norvegicus
taccccattactctctttgtggaga

SEQ ID NO: 550137 - DNA, 25 bp, Rattus norvegicus
taccccattactgtctttgtggaga

SEQ ID NO: 550138 - DNA, 25 bp, Rattus norvegicus
taccccattcaaacccagaaagagg

SEQ ID NO: 550139 - DNA, 25 bp, Rattus norvegicus
taccccattcaatcccagaaagagg

SEQ ID NO: 550140 - DNA, 25 bp, Rattus norvegicus
taccccattggtagctctttggaga

SEQ ID NO: 550141 - DNA, 25 bp, Rattus norvegicus
taccccattggttgctctttggaga

SEQ ID NO: 550142 - DNA, 25 bp, Rattus norvegicus
taccccattgttagctgttaggaat

SEQ ID NO: 550143 - DNA, 25 bp, Rattus norvegicus
taccccattgtttgctgttaggaat

SEQ ID NO: 550144 - DNA, 25 bp, Rattus norvegicus
taccccattttgatattctttagct

SEQ ID NO: 550145 - DNA, 25 bp, Rattus norvegicus
taccccattttgttattctttagct

SEQ ID NO: 550146 - DNA, 25 bp, Rattus norvegicus
taccccgaactcattgaacaggaga

SEQ ID NO: 550147 - DNA, 25 bp, Rattus norvegicus
taccccgaactctttgaacaggaga

SEQ ID NO: 550148 - DNA, 25 bp, Rattus norvegicus
taccccgatctaaggactttgagga

SEQ ID NO: 550149 - DNA, 25 bp, Rattus norvegicus
taccccgatctatggactttgagga

SEQ ID NO: 550150 - DNA, 25 bp, Rattus norvegicus
taccccgcatctcttagcttctaaa

SEQ ID NO: 550151 - DNA, 25 bp, Rattus norvegicus
taccccgcatctgttagcttctaaa

SEQ ID NO: 550152 - DNA, 25 bp, Rattus norvegicus
taccccggagacaacttggaggctt

SEQ ID NO: 550153 - DNA, 25 bp, Rattus norvegicus
taccccggagactacttggaggctt

SEQ ID NO: 550154 - DNA, 25 bp, Rattus norvegicus
taccccggcatcacaaagtagtagg

SEQ ID NO: 550155 - DNA, 25 bp, Rattus norvegicus
taccccggcatctcaaagtagtagg

SEQ ID NO: 550156 - DNA, 25 bp, Rattus norvegicus
taccccggttttatgatctggtgcg

SEQ ID NO: 550157 - DNA, 25 bp, Rattus norvegicus
taccccggttttttgatctggtgcg

SEQ ID NO: 550158 - DNA, 25 bp, Rattus norvegicus
taccccgtacacattgacttggtca

SEQ ID NO: 550159 - DNA, 25 bp, Rattus norvegicus
taccccgtacactttgacttggtca

SEQ ID NO: 550160 - DNA, 25 bp, Rattus norvegicus
taccccgtgagcagataggttctct

SEQ ID NO: 550161 - DNA, 25 bp, Rattus norvegicus
taccccgtgagctgataggttctct

SEQ ID NO: 550162 - DNA, 25 bp, Rattus norvegicus
taccccgtgccgagtgggagaaatg

SEQ ID NO: 550163 - DNA, 25 bp, Rattus norvegicus
taccccgtgccgtgtgggagaaatg

SEQ ID NO: 550164 - DNA, 25 bp, Rattus norvegicus
taccccgtttttagatagacagtgt

SEQ ID NO: 550165 - DNA, 25 bp, Rattus norvegicus
taccccgttttttgatagacagtgt

SEQ ID NO: 550166 - DNA, 25 bp, Rattus norvegicus
tacccctacattcctaagtcaatgc

SEQ ID NO: 550167 - DNA, 25 bp, Rattus norvegicus
tacccctacattgctaagtcaatgc

SEQ ID NO: 550168 - DNA, 25 bp, Rattus norvegicus
tacccctaccacaaatcatgcttga

SEQ ID NO: 550169 - DNA, 25 bp, Rattus norvegicus
tacccctaccactaatcatgcttga

SEQ ID NO: 550170 - DNA, 25 bp, Rattus norvegicus
tacccctagccaaaatgggcttgat

SEQ ID NO: 550171 - DNA, 25 bp, Rattus norvegicus
tacccctagccataatgggcttgat

SEQ ID NO: 550172 - DNA, 25 bp, Rattus norvegicus
tacccctattctattctagcatttg

SEQ ID NO: 550173 - DNA, 25 bp, Rattus norvegicus
tacccctattcttttctagcatttg

SEQ ID NO: 550174 - DNA, 25 bp, Rattus norvegicus
tacccctccggtacataaagactat

SEQ ID NO: 550175 - DNA, 25 bp, Rattus norvegicus
tacccctccggttcataaagactat

SEQ ID NO: 550176 - DNA, 25 bp, Rattus norvegicus
tacccctccgtgctttgaatgcatg

SEQ ID NO: 550177 - DNA, 25 bp, Rattus norvegicus
tacccctccgtggtttgaatgcatg

SEQ ID NO: 550178 - DNA, 25 bp, Rattus norvegicus
tacccctcctgaatcctatttcttg

SEQ ID NO: 550179 - DNA, 25 bp, Rattus norvegicus
tacccctcctgattcctatttcttg

SEQ ID NO: 550180 - DNA, 25 bp, Rattus norvegicus
tacccctctgtccagtttggaaaga

SEQ ID NO: 550181 - DNA, 25 bp, Rattus norvegicus
tacccctctgtcgagtttggaaaga

SEQ ID NO: 550182 - DNA, 25 bp, Rattus norvegicus
tacccctgagggacagatcgacatt

SEQ ID NO: 550183 - DNA, 25 bp, Rattus norvegicus
tacccctgagggtcagatcgacatt

SEQ ID NO: 550184 - DNA, 25 bp, Rattus norvegicus
tacccctgcatgcagagctactgag

SEQ ID NO: 550185 - DNA, 25 bp, Rattus norvegicus
tacccctgcatggagagctactgag

SEQ ID NO: 550186 - DNA, 25 bp, Rattus norvegicus
tacccctggaatctcaccattgcag

SEQ ID NO: 550187 - DNA, 25 bp, Rattus norvegicus
tacccctggaatgtcaccattgcag

SEQ ID NO: 550188 - DNA, 25 bp, Rattus norvegicus
tacccctgtcagaactgtggcaaga

SEQ ID NO: 550189 - DNA, 25 bp, Rattus norvegicus
tacccctgtcagtactgtggcaaga

SEQ ID NO: 550190 - DNA, 25 bp, Rattus norvegicus
tacccctgtgtcactctggatggtt

SEQ ID NO: 550191 - DNA, 25 bp, Rattus norvegicus
tacccctgtgtctctctggatggtt

SEQ ID NO: 550192 - DNA, 25 bp, Rattus norvegicus
taccccttcaacatgtgggcagcgt

SEQ ID NO: 550193 - DNA, 25 bp, Rattus norvegicus
taccccttcaacttgtgggcagcgt

SEQ ID NO: 550194 - DNA, 25 bp, Rattus norvegicus
taccccttcaggatagttaaacttg

SEQ ID NO: 550195 - DNA, 25 bp, Rattus norvegicus
taccccttcaggttagttaaacttg

SEQ ID NO: 550196 - DNA, 25 bp, Rattus norvegicus
taccccttctttccattacataata

SEQ ID NO: 550197 - DNA, 25 bp, Rattus norvegicus
taccccttctttgcattacataata

SEQ ID NO: 550198 - DNA, 25 bp, Rattus norvegicus
taccccttgccacggtttgtgtata

SEQ ID NO: 550199 - DNA, 25 bp, Rattus norvegicus
taccccttgccagggtttgtgtata

SEQ ID NO: 550200 - DNA, 25 bp, Rattus norvegicus
taccccttggccagggacagaggga

SEQ ID NO: 550201 - DNA, 25 bp, Rattus norvegicus
taccccttggcctgggacagaggga

SEQ ID NO: 550202 - DNA, 25 bp, Rattus norvegicus
taccccttgtttccttgggtgaatg

SEQ ID NO: 550203 - DNA, 25 bp, Rattus norvegicus
taccccttgtttcttggcttctttg

SEQ ID NO: 550204 - DNA, 25 bp, Rattus norvegicus
taccccttgtttgcttgggtgaatg

SEQ ID NO: 550205 - DNA, 25 bp, Rattus norvegicus
taccccttgtttgttggcttctttg

SEQ ID NO: 550206 - DNA, 25 bp, Rattus norvegicus
tacccctttaagagcaactgtccag

SEQ ID NO: 550207 - DNA, 25 bp, Rattus norvegicus
tacccctttaagtgcaactgtccag

SEQ ID NO: 550208 - DNA, 25 bp, Rattus norvegicus
tacccctttaatcctacctgctttg

SEQ ID NO: 550209 - DNA, 25 bp, Rattus norvegicus
tacccctttaatgctacctgctttg

SEQ ID NO: 550210 - DNA, 25 bp, Rattus norvegicus
tacccctttctcacgggcgtgggtg

SEQ ID NO: 550211 - DNA, 25 bp, Rattus norvegicus
tacccctttctctcgggcgtgggtg

SEQ ID NO: 550212 - DNA, 25 bp, Rattus norvegicus
tacccgaacgtcatcaggcgtggca

SEQ ID NO: 550213 - DNA, 25 bp, Rattus norvegicus
tacccgaacgtcttcaggcgtggca

SEQ ID NO: 550214 - DNA, 25 bp, Rattus norvegicus
tacccgaagtctccacaaattccaa

SEQ ID NO: 550215 - DNA, 25 bp, Rattus norvegicus
tacccgaagtctgcacaaattccaa

SEQ ID NO: 550216 - DNA, 25 bp, Rattus norvegicus
tacccgacactgatctgagagtcgc

SEQ ID NO: 550217 - DNA, 25 bp, Rattus norvegicus
tacccgacactgttctgagagtcgc

SEQ ID NO: 550218 - DNA, 25 bp, Rattus norvegicus
tacccgaccaccaaggcaagataag

SEQ ID NO: 550219 - DNA, 25 bp, Rattus norvegicus
tacccgaccaccattattatttatg

SEQ ID NO: 550220 - DNA, 25 bp, Rattus norvegicus
tacccgaccacctaggcaagataag

SEQ ID NO: 550221 - DNA, 25 bp, Rattus norvegicus
tacccgaccacctttattatttatg

SEQ ID NO: 550222 - DNA, 25 bp, Rattus norvegicus
tacccgactttccagggcatctaac

SEQ ID NO: 550223 - DNA, 25 bp, Rattus norvegicus
tacccgactttcgagggcatctaac

SEQ ID NO: 550224 - DNA, 25 bp, Rattus norvegicus
tacccgacttttagtacagtgcttt

SEQ ID NO: 550225 - DNA, 25 bp, Rattus norvegicus
tacccgactttttgtacagtgcttt

SEQ ID NO: 550226 - DNA, 25 bp, Rattus norvegicus
tacccgatgtcgctgaggcttctaa

SEQ ID NO: 550227 - DNA, 25 bp, Rattus norvegicus
tacccgatgtcggtgaggcttctaa

SEQ ID NO: 550228 - DNA, 25 bp, Rattus norvegicus
tacccgcaaacacacgtgttcttaa

SEQ ID NO: 550229 - DNA, 25 bp, Rattus norvegicus
tacccgcaaacagacgtgttcttaa

SEQ ID NO: 550230 - DNA, 25 bp, Rattus norvegicus
tacccgcacttaacctgagattatc

SEQ ID NO: 550231 - DNA, 25 bp, Rattus norvegicus
tacccgcacttatcctgagattatc

SEQ ID NO: 550232 - DNA, 25 bp, Rattus norvegicus
tacccgcaggcgagtgctccaggag

SEQ ID NO: 550233 - DNA, 25 bp, Rattus norvegicus
tacccgcaggcgtgtgctccaggag

SEQ ID NO: 550234 - DNA, 25 bp, Rattus norvegicus
tacccgcagtttcgatacccctatt

SEQ ID NO: 550235 - DNA, 25 bp, Rattus norvegicus
tacccgcagtttggatacccctatt

SEQ ID NO: 550236 - DNA, 25 bp, Rattus norvegicus
tacccgccaacccagagacttagag

SEQ ID NO: 550237 - DNA, 25 bp, Rattus norvegicus
tacccgccaaccgagagacttagag

SEQ ID NO: 550238 - DNA, 25 bp, Rattus norvegicus
tacccgccccatataggtcaagatg

SEQ ID NO: 550239 - DNA, 25 bp, Rattus norvegicus
tacccgccccatttaggtcaagatg

SEQ ID NO: 550240 - DNA, 25 bp, Rattus norvegicus
tacccgcggcgcctgaatacgaagg

SEQ ID NO: 550241 - DNA, 25 bp, Rattus norvegicus
tacccgcggcgcgtgaatacgaagg

SEQ ID NO: 550242 - DNA, 25 bp, Rattus norvegicus
tacccgctaggactcaaggcatgca

SEQ ID NO: 550243 - DNA, 25 bp, Rattus norvegicus
tacccgctaggagtcaaggcatgca

SEQ ID NO: 550244 - DNA, 25 bp, Rattus norvegicus
tacccgctgcaacctctggtagctt

SEQ ID NO: 550245 - DNA, 25 bp, Rattus norvegicus
tacccgctgcaagctctggtagctt

SEQ ID NO: 550246 - DNA, 25 bp, Rattus norvegicus
tacccgctggatcggcatatcttgt

SEQ ID NO: 550247 - DNA, 25 bp, Rattus norvegicus
tacccgctggatgggcatatcttgt

SEQ ID NO: 550248 - DNA, 25 bp, Rattus norvegicus
tacccggaccctctaaaatcatctg

SEQ ID NO: 550249 - DNA, 25 bp, Rattus norvegicus
tacccggaccctgtaaaatcatctg

SEQ ID NO: 550250 - DNA, 25 bp, Rattus norvegicus
tacccggatacgcattactgacaac

SEQ ID NO: 550251 - DNA, 25 bp, Rattus norvegicus
tacccggatacggattactgacaac

SEQ ID NO: 550252 - DNA, 25 bp, Rattus norvegicus
tacccggatcttcactgagcgagaa

SEQ ID NO: 550253 - DNA, 25 bp, Rattus norvegicus
tacccggatcttgactgagcgagaa

SEQ ID NO: 550254 - DNA, 25 bp, Rattus norvegicus
tacccggctagaaagtgtcactgtt

SEQ ID NO: 550255 - DNA, 25 bp, Rattus norvegicus
tacccggctagatagtgtcactgtt

SEQ ID NO: 550256 - DNA, 25 bp, Rattus norvegicus
tacccggctttgctcattctgtttg

SEQ ID NO: 550257 - DNA, 25 bp, Rattus norvegicus
tacccggctttggtcattctgtttg

SEQ ID NO: 550258 - DNA, 25 bp, Rattus norvegicus
tacccgggtcgcaactatgaaaaag

SEQ ID NO: 550259 - DNA, 25 bp, Rattus norvegicus
tacccgggtcgctactatgaaaaag

SEQ ID NO: 550260 - DNA, 25 bp, Rattus norvegicus
tacccgggtgttcatggctctcaac

SEQ ID NO: 550261 - DNA, 25 bp, Rattus norvegicus
tacccgggtgttgatggctctcaac

SEQ ID NO: 550262 - DNA, 25 bp, Rattus norvegicus
tacccggtgcttcttaaggccagaa

SEQ ID NO: 550263 - DNA, 25 bp, Rattus norvegicus
tacccggtgcttgttaaggccagaa

SEQ ID NO: 550264 - DNA, 25 bp, Rattus norvegicus
tacccggtggtgaaggagcagtccc

SEQ ID NO: 550265 - DNA, 25 bp, Rattus norvegicus
tacccggtggtgtaggagcagtccc

SEQ ID NO: 550266 - DNA, 25 bp, Rattus norvegicus
tacccggtgtacagggctaacactt

SEQ ID NO: 550267 - DNA, 25 bp, Rattus norvegicus
tacccggtgtactgggctaacactt

SEQ ID NO: 550268 - DNA, 25 bp, Rattus norvegicus
tacccggtgtgtatggaggccttgc

SEQ ID NO: 550269 - DNA, 25 bp, Rattus norvegicus
tacccggtgtgtttggaggccttgc

SEQ ID NO: 550270 - DNA, 25 bp, Rattus norvegicus
tacccgtactgaagctggcgaggcc

SEQ ID NO: 550271 - DNA, 25 bp, Rattus norvegicus
tacccgtactgatgctggcgaggcc

SEQ ID NO: 550272 - DNA, 25 bp, Rattus norvegicus
tacccgtagggtctgcagcttttgt

SEQ ID NO: 550273 - DNA, 25 bp, Rattus norvegicus
tacccgtagggtgtgcagcttttgt

SEQ ID NO: 550274 - DNA, 25 bp, Rattus norvegicus
tacccgtcccttacaagttgtgtgg

SEQ ID NO: 550275 - DNA, 25 bp, Rattus norvegicus
tacccgtccctttcaagttgtgtgg

SEQ ID NO: 550276 - DNA, 25 bp, Rattus norvegicus
tacccgtgaggtccatgaagcttgt

SEQ ID NO: 550277 - DNA, 25 bp, Rattus norvegicus
tacccgtgaggtgcatgaagcttgt

SEQ ID NO: 550278 - DNA, 25 bp, Rattus norvegicus
tacccgtgcggtaataatatacaaa

SEQ ID NO: 550279 - DNA, 25 bp, Rattus norvegicus
tacccgtgcggttataatatacaaa

SEQ ID NO: 550280 - DNA, 25 bp, Rattus norvegicus
tacccgtggactataattcagaaca

SEQ ID NO: 550281 - DNA, 25 bp, Rattus norvegicus
tacccgtggactttaattcagaaca

SEQ ID NO: 550282 - DNA, 25 bp, Rattus norvegicus
tacccgtgggtcaactgtggaccaa

SEQ ID NO: 550283 - DNA, 25 bp, Rattus norvegicus
tacccgtgggtctactgtggaccaa

SEQ ID NO: 550284 - DNA, 25 bp, Rattus norvegicus
tacccgtgtatacctctatcccaga

SEQ ID NO: 550285 - DNA, 25 bp, Rattus norvegicus
tacccgtgtatagctctatcccaga

SEQ ID NO: 550286 - DNA, 25 bp, Rattus norvegicus
tacccgttagagatttgtgcatgaa

SEQ ID NO: 550287 - DNA, 25 bp, Rattus norvegicus
tacccgttagagttttgtgcatgaa

SEQ ID NO: 550288 - DNA, 25 bp, Rattus norvegicus
taccctaaactaagatttcctcctg

SEQ ID NO: 550289 - DNA, 25 bp, Rattus norvegicus
taccctaaactatgatttcctcctg

SEQ ID NO: 550290 - DNA, 25 bp, Rattus norvegicus
taccctaatgtgaagccgtgtggac

SEQ ID NO: 550291 - DNA, 25 bp, Rattus norvegicus
taccctaatgtgtagccgtgtggac

SEQ ID NO: 550292 - DNA, 25 bp, Rattus norvegicus
taccctacccagaagtgtgatggca

SEQ ID NO: 550293 - DNA, 25 bp, Rattus norvegicus
taccctacccagtagtgtgatggca

SEQ ID NO: 550294 - DNA, 25 bp, Rattus norvegicus
taccctacccttcaagactctgtat

SEQ ID NO: 550295 - DNA, 25 bp, Rattus norvegicus
taccctacccttgaagactctgtat

SEQ ID NO: 550296 - DNA, 25 bp, Rattus norvegicus
taccctacgtccagctgtttttgct

SEQ ID NO: 550297 - DNA, 25 bp, Rattus norvegicus
taccctacgtcctgctgtttttgct

SEQ ID NO: 550298 - DNA, 25 bp, Rattus norvegicus
taccctagacaaatgttcttgctgg

SEQ ID NO: 550299 - DNA, 25 bp, Rattus norvegicus
taccctagacaattgttcttgctgg

SEQ ID NO: 550300 - DNA, 25 bp, Rattus norvegicus
taccctagatgcactgctctctttg

SEQ ID NO: 550301 - DNA, 25 bp, Rattus norvegicus
taccctagatgctctgctctctttg

SEQ ID NO: 550302 - DNA, 25 bp, Rattus norvegicus
taccctaggaatcctgtctctgact

SEQ ID NO: 550303 - DNA, 25 bp, Rattus norvegicus
taccctaggaatgctgtctctgact

SEQ ID NO: 550304 - DNA, 25 bp, Rattus norvegicus
taccctaggagcatcggttgcaagt

SEQ ID NO: 550305 - DNA, 25 bp, Rattus norvegicus
taccctaggagcttcggttgcaagt

SEQ ID NO: 550306 - DNA, 25 bp, Rattus norvegicus
taccctaggctcatctcagttggga

SEQ ID NO: 550307 - DNA, 25 bp, Rattus norvegicus
taccctaggctcttctcagttggga

SEQ ID NO: 550308 - DNA, 25 bp, Rattus norvegicus
taccctagtaagagtgagaagccat

SEQ ID NO: 550309 - DNA, 25 bp, Rattus norvegicus
taccctagtaagtgtgagaagccat

SEQ ID NO: 550310 - DNA, 25 bp, Rattus norvegicus
taccctagtgccacggtggaaaact

SEQ ID NO: 550311 - DNA, 25 bp, Rattus norvegicus
taccctagtgcctcggtggaaaact

SEQ ID NO: 550312 - DNA, 25 bp, Rattus norvegicus
taccctagttctcctattcttgaat

SEQ ID NO: 550313 - DNA, 25 bp, Rattus norvegicus
taccctagttctgctattcttgaat

SEQ ID NO: 550314 - DNA, 25 bp, Rattus norvegicus
taccctatactgaggcatcaagcct

SEQ ID NO: 550315 - DNA, 25 bp, Rattus norvegicus
taccctatactgtggcatcaagcct

SEQ ID NO: 550316 - DNA, 25 bp, Rattus norvegicus
taccctatgtttatggtgtccctat

SEQ ID NO: 550317 - DNA, 25 bp, Rattus norvegicus
taccctatgtttttggtgtccctat

SEQ ID NO: 550318 - DNA, 25 bp, Rattus norvegicus
taccctattgtgagaacagccttat

SEQ ID NO: 550319 - DNA, 25 bp, Rattus norvegicus
taccctattgtgtgaacagccttat

SEQ ID NO: 550320 - DNA, 25 bp, Rattus norvegicus
taccctcaaagtaatgcttttccaa

SEQ ID NO: 550321 - DNA, 25 bp, Rattus norvegicus
taccctcaaagttatgcttttccaa

SEQ ID NO: 550322 - DNA, 25 bp, Rattus norvegicus
taccctcaccccagtagtgatggcg

SEQ ID NO: 550323 - DNA, 25 bp, Rattus norvegicus
taccctcacccctgtagtgatggcg

SEQ ID NO: 550324 - DNA, 25 bp, Rattus norvegicus
taccctcacctcagaagatatccag

SEQ ID NO: 550325 - DNA, 25 bp, Rattus norvegicus
taccctcacctctgaagatatccag

SEQ ID NO: 550326 - DNA, 25 bp, Rattus norvegicus
taccctcacggaagctggcgaacag

SEQ ID NO: 550327 - DNA, 25 bp, Rattus norvegicus
taccctcacggatgctggcgaacag

SEQ ID NO: 550328 - DNA, 25 bp, Rattus norvegicus
taccctcactcactctctgaaggat

SEQ ID NO: 550329 - DNA, 25 bp, Rattus norvegicus
taccctcactcagtctctgaaggat

SEQ ID NO: 550330 - DNA, 25 bp, Rattus norvegicus
taccctcactgccaatttcatgtgt

SEQ ID NO: 550331 - DNA, 25 bp, Rattus norvegicus
taccctcactgcgaatttcatgtgt

SEQ ID NO: 550332 - DNA, 25 bp, Rattus norvegicus
taccctcagatcacctttgatagca

SEQ ID NO: 550333 - DNA, 25 bp, Rattus norvegicus
taccctcagatctcctttgatagca

SEQ ID NO: 550334 - DNA, 25 bp, Rattus norvegicus
taccctcagtgcctgtagaatcatc

SEQ ID NO: 550335 - DNA, 25 bp, Rattus norvegicus
taccctcagtgcgtgtagaatcatc

SEQ ID NO: 550336 - DNA, 25 bp, Rattus norvegicus
taccctcatctcaagtggctcatga

SEQ ID NO: 550337 - DNA, 25 bp, Rattus norvegicus
taccctcatctctagtggctcatga

SEQ ID NO: 550338 - DNA, 25 bp, Rattus norvegicus
taccctccatgtcagcatcattggg

SEQ ID NO: 550339 - DNA, 25 bp, Rattus norvegicus
taccctccatgtgagcatcattggg

SEQ ID NO: 550340 - DNA, 25 bp, Rattus norvegicus
taccctcccaggaaagtactaattg

SEQ ID NO: 550341 - DNA, 25 bp, Rattus norvegicus
taccctcccaggtaagtactaattg

SEQ ID NO: 550342 - DNA, 25 bp, Rattus norvegicus
taccctcctatcattcaggactgcg

SEQ ID NO: 550343 - DNA, 25 bp, Rattus norvegicus
taccctcctatctttcaggactgcg

SEQ ID NO: 550344 - DNA, 25 bp, Rattus norvegicus
taccctcctgatacttcatgtgtaa

SEQ ID NO: 550345 - DNA, 25 bp, Rattus norvegicus
taccctcctgattcttcatgtgtaa

SEQ ID NO: 550346 - DNA, 25 bp, Rattus norvegicus
taccctcctgctacttttaagatga

SEQ ID NO: 550347 - DNA, 25 bp, Rattus norvegicus
taccctcctgcttcttttaagatga

SEQ ID NO: 550348 - DNA, 25 bp, Rattus norvegicus
taccctcctgtaagcagcactttaa

SEQ ID NO: 550349 - DNA, 25 bp, Rattus norvegicus
taccctcctgtatgcagcactttaa

SEQ ID NO: 550350 - DNA, 25 bp, Rattus norvegicus
taccctcctgtgcatgcttctggaa

SEQ ID NO: 550351 - DNA, 25 bp, Rattus norvegicus
taccctcctgtggatgcttctggaa

SEQ ID NO: 550352 - DNA, 25 bp, Rattus norvegicus
taccctccttgaaggtcctgtggga

SEQ ID NO: 550353 - DNA, 25 bp, Rattus norvegicus
taccctccttgatggtcctgtggga

SEQ ID NO: 550354 - DNA, 25 bp, Rattus norvegicus
taccctcgagttcaagtcacgattg

SEQ ID NO: 550355 - DNA, 25 bp, Rattus norvegicus
taccctcgagttgaagtcacgattg

SEQ ID NO: 550356 - DNA, 25 bp, Rattus norvegicus
taccctcgccatcgtgtagcataat

SEQ ID NO: 550357 - DNA, 25 bp, Rattus norvegicus
taccctcgccatggtgtagcataat

SEQ ID NO: 550358 - DNA, 25 bp, Rattus norvegicus
taccctcggagtaaaaggcagccct

SEQ ID NO: 550359 - DNA, 25 bp, Rattus norvegicus
taccctcggagttaaaggcagccct

SEQ ID NO: 550360 - DNA, 25 bp, Rattus norvegicus
taccctctacataaaactgggttgt

SEQ ID NO: 550361 - DNA, 25 bp, Rattus norvegicus
taccctctacattaaactgggttgt

SEQ ID NO: 550362 - DNA, 25 bp, Rattus norvegicus
taccctctctctcggaatctgaaga

SEQ ID NO: 550363 - DNA, 25 bp, Rattus norvegicus
taccctctctctgggaatctgaaga

SEQ ID NO: 550364 - DNA, 25 bp, Rattus norvegicus
taccctctgattctagcactttcaa

SEQ ID NO: 550365 - DNA, 25 bp, Rattus norvegicus
taccctctgattgtagcactttcaa

SEQ ID NO: 550366 - DNA, 25 bp, Rattus norvegicus
taccctctgcatcatatgcggctga

SEQ ID NO: 550367 - DNA, 25 bp, Rattus norvegicus
taccctctgcatgatatgcggctga

SEQ ID NO: 550368 - DNA, 25 bp, Rattus norvegicus
taccctctgctgagtctgtgatgtt

SEQ ID NO: 550369 - DNA, 25 bp, Rattus norvegicus
taccctctgctgtgtctgtgatgtt

SEQ ID NO: 550370 - DNA, 25 bp, Rattus norvegicus
taccctctgcttagacaatcagctg

SEQ ID NO: 550371 - DNA, 25 bp, Rattus norvegicus
taccctctgctttgacaatcagctg

SEQ ID NO: 550372 - DNA, 25 bp, Rattus norvegicus
taccctcttccaagtagaacaggct

SEQ ID NO: 550373 - DNA, 25 bp, Rattus norvegicus
taccctcttccatgtagaacaggct

SEQ ID NO: 550374 - DNA, 25 bp, Rattus norvegicus
taccctcttccgcatatgtatgtga

SEQ ID NO: 550375 - DNA, 25 bp, Rattus norvegicus
taccctcttccgctctcccagtagg

SEQ ID NO: 550376 - DNA, 25 bp, Rattus norvegicus
taccctcttccggatatgtatgtga

SEQ ID NO: 550377 - DNA, 25 bp, Rattus norvegicus
taccctcttccggtctcccagtagg

SEQ ID NO: 550378 - DNA, 25 bp, Rattus norvegicus
taccctcttgcaaacagctgacaaa

SEQ ID NO: 550379 - DNA, 25 bp, Rattus norvegicus
taccctcttgcatacagctgacaaa

SEQ ID NO: 550380 - DNA, 25 bp, Rattus norvegicus
taccctcttggtagccttatgggca

SEQ ID NO: 550381 - DNA, 25 bp, Rattus norvegicus
taccctcttggttgccttatgggca

SEQ ID NO: 550382 - DNA, 25 bp, Rattus norvegicus
taccctcttgtcacgccaaatgaag

SEQ ID NO: 550383 - DNA, 25 bp, Rattus norvegicus
taccctcttgtctcgccaaatgaag

SEQ ID NO: 550384 - DNA, 25 bp, Rattus norvegicus
taccctcttttacgattcccacaat

SEQ ID NO: 550385 - DNA, 25 bp, Rattus norvegicus
taccctcttttaggattcccacaat

SEQ ID NO: 550386 - DNA, 25 bp, Rattus norvegicus
taccctgaagccattactgttgcct

SEQ ID NO: 550387 - DNA, 25 bp, Rattus norvegicus
taccctgaagcctttactgttgcct

SEQ ID NO: 550388 - DNA, 25 bp, Rattus norvegicus
taccctgacaggaaaggaacccaat

SEQ ID NO: 550389 - DNA, 25 bp, Rattus norvegicus
taccctgacaggtaaggaacccaat

SEQ ID NO: 550390 - DNA, 25 bp, Rattus norvegicus
taccctgagtttaagccctgggagt

SEQ ID NO: 550391 - DNA, 25 bp, Rattus norvegicus
taccctgagttttagccctgggagt

SEQ ID NO: 550392 - DNA, 25 bp, Rattus norvegicus
taccctgatagcaactggtcttggt

SEQ ID NO: 550393 - DNA, 25 bp, Rattus norvegicus
taccctgatagctactggtcttggt

SEQ ID NO: 550394 - DNA, 25 bp, Rattus norvegicus
taccctgatttaaacctggagcttc

SEQ ID NO: 550395 - DNA, 25 bp, Rattus norvegicus
taccctgatttatacctggagcttc

SEQ ID NO: 550396 - DNA, 25 bp, Rattus norvegicus
taccctgcagccatgtttatatgtt

SEQ ID NO: 550397 - DNA, 25 bp, Rattus norvegicus
taccctgcagccttgtttatatgtt

SEQ ID NO: 550398 - DNA, 25 bp, Rattus norvegicus
taccctgcagtgaggttctctctta

SEQ ID NO: 550399 - DNA, 25 bp, Rattus norvegicus
taccctgcagtgtggttctctctta

SEQ ID NO: 550400 - DNA, 25 bp, Rattus norvegicus
taccctgccacaacatacaaaacaa

SEQ ID NO: 550401 - DNA, 25 bp, Rattus norvegicus
taccctgccacatcatacaaaacaa

SEQ ID NO: 550402 - DNA, 25 bp, Rattus norvegicus
taccctgcgtggcattgtcgctgca

SEQ ID NO: 550403 - DNA, 25 bp, Rattus norvegicus
taccctgcgtgggattgtcgctgca

SEQ ID NO: 550404 - DNA, 25 bp, Rattus norvegicus
taccctgctcgaaggaattctagtg

SEQ ID NO: 550405 - DNA, 25 bp, Rattus norvegicus
taccctgctcgatggaattctagtg

SEQ ID NO: 550406 - DNA, 25 bp, Rattus norvegicus
taccctggaaacagcagtaactttt

SEQ ID NO: 550407 - DNA, 25 bp, Rattus norvegicus
taccctggaaactgcagtaactttt

SEQ ID NO: 550408 - DNA, 25 bp, Rattus norvegicus
taccctggacttctgaggctcagtc

SEQ ID NO: 550409 - DNA, 25 bp, Rattus norvegicus
taccctggacttgtgaggctcagtc

SEQ ID NO: 550410 - DNA, 25 bp, Rattus norvegicus
taccctggatttcaggtcggtccat

SEQ ID NO: 550411 - DNA, 25 bp, Rattus norvegicus
taccctggatttgaggtcggtccat

SEQ ID NO: 550412 - DNA, 25 bp, Rattus norvegicus
taccctggcaggaggatcaacgcag

SEQ ID NO: 550413 - DNA, 25 bp, Rattus norvegicus
taccctggcaggtggatcaacgcag

SEQ ID NO: 550414 - DNA, 25 bp, Rattus norvegicus
taccctggccttcagatggccttaa

SEQ ID NO: 550415 - DNA, 25 bp, Rattus norvegicus
taccctggccttgagatggccttaa

SEQ ID NO: 550416 - DNA, 25 bp, Rattus norvegicus
taccctgggagtactttacttggca

SEQ ID NO: 550417 - DNA, 25 bp, Rattus norvegicus
taccctgggagtattacacattgtc

SEQ ID NO: 550418 - DNA, 25 bp, Rattus norvegicus
taccctgggagttctttacttggca

SEQ ID NO: 550419 - DNA, 25 bp, Rattus norvegicus
taccctgggagttttacacattgtc

SEQ ID NO: 550420 - DNA, 25 bp, Rattus norvegicus
taccctgggcctcctatgatggacg

SEQ ID NO: 550421 - DNA, 25 bp, Rattus norvegicus
taccctgggcctgctatgatggacg

SEQ ID NO: 550422 - DNA, 25 bp, Rattus norvegicus
taccctggtgtaagtagactgttct

SEQ ID NO: 550423 - DNA, 25 bp, Rattus norvegicus
taccctggtgtatgtagactgttct

SEQ ID NO: 550424 - DNA, 25 bp, Rattus norvegicus
taccctggttgacagtacacagatt

SEQ ID NO: 550425 - DNA, 25 bp, Rattus norvegicus
taccctggttgagagtacacagatt

SEQ ID NO: 550426 - DNA, 25 bp, Rattus norvegicus
taccctggtttccaagccactgaag

SEQ ID NO: 550427 - DNA, 25 bp, Rattus norvegicus
taccctggtttcgaagccactgaag

SEQ ID NO: 550428 - DNA, 25 bp, Rattus norvegicus
taccctgtaaatatgctgttccaat

SEQ ID NO: 550429 - DNA, 25 bp, Rattus norvegicus
taccctgtaaatttgctgttccaat

SEQ ID NO: 550430 - DNA, 25 bp, Rattus norvegicus
taccctgtacccctatttgattcaa

SEQ ID NO: 550431 - DNA, 25 bp, Rattus norvegicus
taccctgtacccgtatttgattcaa

SEQ ID NO: 550432 - DNA, 25 bp, Rattus norvegicus
taccctgtacttcatgagtgacgct

SEQ ID NO: 550433 - DNA, 25 bp, Rattus norvegicus
taccctgtacttgatgagtgacgct

SEQ ID NO: 550434 - DNA, 25 bp, Rattus norvegicus
taccctgtagtgatttatccctgag

SEQ ID NO: 550435 - DNA, 25 bp, Rattus norvegicus
taccctgtagtgttttatccctgag

SEQ ID NO: 550436 - DNA, 25 bp, Rattus norvegicus
taccctgtcaatatttaccttcctt

SEQ ID NO: 550437 - DNA, 25 bp, Rattus norvegicus
taccctgtcaatttttaccttcctt

SEQ ID NO: 550438 - DNA, 25 bp, Rattus norvegicus
taccctgtctcgagtcattgcttga

SEQ ID NO: 550439 - DNA, 25 bp, Rattus norvegicus
taccctgtctcgtgtcattgcttga

SEQ ID NO: 550440 - DNA, 25 bp, Rattus norvegicus
taccctgtctggacaggagagccat

SEQ ID NO: 550441 - DNA, 25 bp, Rattus norvegicus
taccctgtctggtcaggagagccat

SEQ ID NO: 550442 - DNA, 25 bp, Rattus norvegicus
taccctgtgataccaatcatgctag

SEQ ID NO: 550443 - DNA, 25 bp, Rattus norvegicus
taccctgtgatagcaatcatgctag

SEQ ID NO: 550444 - DNA, 25 bp, Rattus norvegicus
taccctgtgcctcgtatgtgggagt

SEQ ID NO: 550445 - DNA, 25 bp, Rattus norvegicus
taccctgtgcctggtatgtgggagt

SEQ ID NO: 550446 - DNA, 25 bp, Rattus norvegicus
taccctgtgctcagggcacctggct

SEQ ID NO: 550447 - DNA, 25 bp, Rattus norvegicus
taccctgtgctctgggcacctggct

SEQ ID NO: 550448 - DNA, 25 bp, Rattus norvegicus
taccctgtgggcaggctgtccttaa

SEQ ID NO: 550449 - DNA, 25 bp, Rattus norvegicus
taccctgtgggctggctgtccttaa

SEQ ID NO: 550450 - DNA, 25 bp, Rattus norvegicus
taccctgttggtagctttgtagaga

SEQ ID NO: 550451 - DNA, 25 bp, Rattus norvegicus
taccctgttggttgctttgtagaga

SEQ ID NO: 550452 - DNA, 25 bp, Rattus norvegicus
tacccttaactaatcaaccacctag

SEQ ID NO: 550453 - DNA, 25 bp, Rattus norvegicus
tacccttaactattcaaccacctag

SEQ ID NO: 550454 - DNA, 25 bp, Rattus norvegicus
tacccttaaggccacatataacacg

SEQ ID NO: 550455 - DNA, 25 bp, Rattus norvegicus
tacccttaaggcgacatataacacg

SEQ ID NO: 550456 - DNA, 25 bp, Rattus norvegicus
tacccttagggcacactttttattg

SEQ ID NO: 550457 - DNA, 25 bp, Rattus norvegicus
tacccttagggctcactttttattg

SEQ ID NO: 550458 - DNA, 25 bp, Rattus norvegicus
tacccttatactctcaccattgaac

SEQ ID NO: 550459 - DNA, 25 bp, Rattus norvegicus
tacccttatactgtcaccattgaac

SEQ ID NO: 550460 - DNA, 25 bp, Rattus norvegicus
tacccttcaattagctgcactgttt

SEQ ID NO: 550461 - DNA, 25 bp, Rattus norvegicus
tacccttcaatttgctgcactgttt

SEQ ID NO: 550462 - DNA, 25 bp, Rattus norvegicus
tacccttcaccaaagtacactagag

SEQ ID NO: 550463 - DNA, 25 bp, Rattus norvegicus
tacccttcaccatagtacactagag

SEQ ID NO: 550464 - DNA, 25 bp, Rattus norvegicus
tacccttcagccacttgtacaataa

SEQ ID NO: 550465 - DNA, 25 bp, Rattus norvegicus
tacccttcagcctcttgtacaataa

SEQ ID NO: 550466 - DNA, 25 bp, Rattus norvegicus
tacccttcatgtaccgttaaatcca

SEQ ID NO: 550467 - DNA, 25 bp, Rattus norvegicus
tacccttcatgttccgttaaatcca

SEQ ID NO: 550468 - DNA, 25 bp, Rattus norvegicus
tacccttcctacagtcacttgttaa

SEQ ID NO: 550469 - DNA, 25 bp, Rattus norvegicus
tacccttcctactgtcacttgttaa

SEQ ID NO: 550470 - DNA, 25 bp, Rattus norvegicus
tacccttctcagcaccagcagtggg

SEQ ID NO: 550471 - DNA, 25 bp, Rattus norvegicus
tacccttctcaggaccagcagtggg

SEQ ID NO: 550472 - DNA, 25 bp, Rattus norvegicus
tacccttcttagctgactgagagca

SEQ ID NO: 550473 - DNA, 25 bp, Rattus norvegicus
tacccttcttaggtgactgagagca

SEQ ID NO: 550474 - DNA, 25 bp, Rattus norvegicus
tacccttgcagaacacaatggcatg

SEQ ID NO: 550475 - DNA, 25 bp, Rattus norvegicus
tacccttgcagatcacaatggcatg

SEQ ID NO: 550476 - DNA, 25 bp, Rattus norvegicus
tacccttgcaggcaactcgtagttt

SEQ ID NO: 550477 - DNA, 25 bp, Rattus norvegicus
tacccttgcagggaactcgtagttt

SEQ ID NO: 550478 - DNA, 25 bp, Rattus norvegicus
tacccttgccaaatgcctttatgaa

SEQ ID NO: 550479 - DNA, 25 bp, Rattus norvegicus
tacccttgccaactcaacaagtttt

SEQ ID NO: 550480 - DNA, 25 bp, Rattus norvegicus
tacccttgccaagtcaacaagtttt

SEQ ID NO: 550481 - DNA, 25 bp, Rattus norvegicus
tacccttgccaattgcctttatgaa

SEQ ID NO: 550482 - DNA, 25 bp, Rattus norvegicus
tacccttggcagcatgtacctgcag

SEQ ID NO: 550483 - DNA, 25 bp, Rattus norvegicus
tacccttggcaggatgtacctgcag

SEQ ID NO: 550484 - DNA, 25 bp, Rattus norvegicus
tacccttggttgagtgtggacgtca

SEQ ID NO: 550485 - DNA, 25 bp, Rattus norvegicus
tacccttggttgtgtgtggacgtca

SEQ ID NO: 550486 - DNA, 25 bp, Rattus norvegicus
tacccttgtcccaacaggagaggca

SEQ ID NO: 550487 - DNA, 25 bp, Rattus norvegicus
tacccttgtccctacaggagaggca

SEQ ID NO: 550488 - DNA, 25 bp, Rattus norvegicus
tacccttgtgataacccttgggaag

SEQ ID NO: 550489 - DNA, 25 bp, Rattus norvegicus
tacccttgtgattacccttgggaag

SEQ ID NO: 550490 - DNA, 25 bp, Rattus norvegicus
tacccttgtgtaccttttgtgttaa

SEQ ID NO: 550491 - DNA, 25 bp, Rattus norvegicus
tacccttgtgtagcttttgtgttaa

SEQ ID NO: 550492 - DNA, 25 bp, Rattus norvegicus
taccctttaccaacctctgtaattg

SEQ ID NO: 550493 - DNA, 25 bp, Rattus norvegicus
taccctttaccatcctctgtaattg

SEQ ID NO: 550494 - DNA, 25 bp, Rattus norvegicus
taccctttagctacccattgagata

SEQ ID NO: 550495 - DNA, 25 bp, Rattus norvegicus
taccctttagcttcccattgagata

SEQ ID NO: 550496 - DNA, 25 bp, Rattus norvegicus
taccctttatgtattcgccttcaga

SEQ ID NO: 550497 - DNA, 25 bp, Rattus norvegicus
taccctttatgttttcgccttcaga

SEQ ID NO: 550498 - DNA, 25 bp, Rattus norvegicus
taccctttccaaactgttgcacagg

SEQ ID NO: 550499 - DNA, 25 bp, Rattus norvegicus
taccctttccaaatatcgtgctttc

SEQ ID NO: 550500 - DNA, 25 bp, Rattus norvegicus
taccctttccaatctgttgcacagg

SEQ ID NO: 550501 - DNA, 25 bp, Rattus norvegicus
taccctttccaattatcgtgctttc

SEQ ID NO: 550502 - DNA, 25 bp, Rattus norvegicus
taccctttctccatctggaagctaa

SEQ ID NO: 550503 - DNA, 25 bp, Rattus norvegicus
taccctttctccttctggaagctaa

SEQ ID NO: 550504 - DNA, 25 bp, Rattus norvegicus
taccctttgaacactaacaactcat

SEQ ID NO: 550505 - DNA, 25 bp, Rattus norvegicus
taccctttgaactctaacaactcat

SEQ ID NO: 550506 - DNA, 25 bp, Rattus norvegicus
taccctttggctaaaatacgttcag

SEQ ID NO: 550507 - DNA, 25 bp, Rattus norvegicus
taccctttggcttaaatacgttcag

SEQ ID NO: 550508 - DNA, 25 bp, Rattus norvegicus
taccctttgggcactcagaaacaca

SEQ ID NO: 550509 - DNA, 25 bp, Rattus norvegicus
taccctttgggctctcagaaacaca

SEQ ID NO: 550510 - DNA, 25 bp, Rattus norvegicus
tacccttttcgtatactgtgttctg

SEQ ID NO: 550511 - DNA, 25 bp, Rattus norvegicus
tacccttttcgtttactgtgttctg

SEQ ID NO: 550512 - DNA, 25 bp, Rattus norvegicus
tacccttttcttcctaatatactct

SEQ ID NO: 550513 - DNA, 25 bp, Rattus norvegicus
tacccttttcttgctaatatactct

SEQ ID NO: 550514 - DNA, 25 bp, Rattus norvegicus
tacccttttgggagctgaggcaaat

SEQ ID NO: 550515 - DNA, 25 bp, Rattus norvegicus
tacccttttgggtgctgaggcaaat

SEQ ID NO: 550516 - DNA, 25 bp, Rattus norvegicus
tacccttttggtcaagcccttctga

SEQ ID NO: 550517 - DNA, 25 bp, Rattus norvegicus
tacccttttggtgaagcccttctga

SEQ ID NO: 550518 - DNA, 25 bp, Rattus norvegicus
taccgaaaaccaatgcttattactt

SEQ ID NO: 550519 - DNA, 25 bp, Rattus norvegicus
taccgaaaaccattgcttattactt

SEQ ID NO: 550520 - DNA, 25 bp, Rattus norvegicus
taccgaaaccctattggcgtgcata

SEQ ID NO: 550521 - DNA, 25 bp, Rattus norvegicus
taccgaaacccttttggcgtgcata

SEQ ID NO: 550522 - DNA, 25 bp, Rattus norvegicus
taccgaaacttcacagtcctggaca

SEQ ID NO: 550523 - DNA, 25 bp, Rattus norvegicus
taccgaaacttctcagtcctggaca

SEQ ID NO: 550524 - DNA, 25 bp, Rattus norvegicus
taccgaaagacgcaggtctgacaca

SEQ ID NO: 550525 - DNA, 25 bp, Rattus norvegicus
taccgaaagacggaggtctgacaca

SEQ ID NO: 550526 - DNA, 25 bp, Rattus norvegicus
taccgaatgcctattgaacagaatt

SEQ ID NO: 550527 - DNA, 25 bp, Rattus norvegicus
taccgaatgccttttgaacagaatt

SEQ ID NO: 550528 - DNA, 25 bp, Rattus norvegicus
taccgaatgctgacagtttcattag

SEQ ID NO: 550529 - DNA, 25 bp, Rattus norvegicus
taccgaatgctgtcagtttcattag

SEQ ID NO: 550530 - DNA, 25 bp, Rattus norvegicus
taccgaatttgtcacgacaagggaa

SEQ ID NO: 550531 - DNA, 25 bp, Rattus norvegicus
taccgaatttgtgacgacaagggaa

SEQ ID NO: 550532 - DNA, 25 bp, Rattus norvegicus
taccgacagctgaggcatttgggaa

SEQ ID NO: 550533 - DNA, 25 bp, Rattus norvegicus
taccgacagctgtggcatttgggaa

SEQ ID NO: 550534 - DNA, 25 bp, Rattus norvegicus
taccgacatgacaaacaagcagaat

SEQ ID NO: 550535 - DNA, 25 bp, Rattus norvegicus
taccgacatgactaacaagcagaat

SEQ ID NO: 550536 - DNA, 25 bp, Rattus norvegicus
taccgacattccatatacatgacag

SEQ ID NO: 550537 - DNA, 25 bp, Rattus norvegicus
taccgacattccttatacatgacag

SEQ ID NO: 550538 - DNA, 25 bp, Rattus norvegicus
taccgacctaagatgcgattacgct

SEQ ID NO: 550539 - DNA, 25 bp, Rattus norvegicus
taccgacctaagttgcgattacgct

SEQ ID NO: 550540 - DNA, 25 bp, Rattus norvegicus
taccgactctacattctccatggag

SEQ ID NO: 550541 - DNA, 25 bp, Rattus norvegicus
taccgactctactttctccatggag

SEQ ID NO: 550542 - DNA, 25 bp, Rattus norvegicus
taccgactgaagaagtagcacctgc

SEQ ID NO: 550543 - DNA, 25 bp, Rattus norvegicus
taccgactgaagtagtagcacctgc

SEQ ID NO: 550544 - DNA, 25 bp, Rattus norvegicus
taccgactgcggactcaagatgacg

SEQ ID NO: 550545 - DNA, 25 bp, Rattus norvegicus
taccgactgcggtctcaagatgacg

SEQ ID NO: 550546 - DNA, 25 bp, Rattus norvegicus
taccgactgctcacgggacaggaac

SEQ ID NO: 550547 - DNA, 25 bp, Rattus norvegicus
taccgactgctctcgggacaggaac

SEQ ID NO: 550548 - DNA, 25 bp, Rattus norvegicus
taccgagctggccagggcaagcaat

SEQ ID NO: 550549 - DNA, 25 bp, Rattus norvegicus
taccgagctggcgagggcaagcaat

SEQ ID NO: 550550 - DNA, 25 bp, Rattus norvegicus
taccgaggacttattgctcagctca

SEQ ID NO: 550551 - DNA, 25 bp, Rattus norvegicus
taccgaggactttttgctcagctca

SEQ ID NO: 550552 - DNA, 25 bp, Rattus norvegicus
taccgaggccggcagtatctgctga

SEQ ID NO: 550553 - DNA, 25 bp, Rattus norvegicus
taccgaggccgggagtatctgctga

SEQ ID NO: 550554 - DNA, 25 bp, Rattus norvegicus
taccgaggctaccagtatgtcttag

SEQ ID NO: 550555 - DNA, 25 bp, Rattus norvegicus
taccgaggctacgagtatgtcttag

SEQ ID NO: 550556 - DNA, 25 bp, Rattus norvegicus
taccgaggcttcaccgtctgtgttg

SEQ ID NO: 550557 - DNA, 25 bp, Rattus norvegicus
taccgaggcttctccgtctgtgttg

SEQ ID NO: 550558 - DNA, 25 bp, Rattus norvegicus
taccgagtaccccacgctagggaag

SEQ ID NO: 550559 - DNA, 25 bp, Rattus norvegicus
taccgagtacccgacgctagggaag

SEQ ID NO: 550560 - DNA, 25 bp, Rattus norvegicus
taccgagtagctcgccatggagtct

SEQ ID NO: 550561 - DNA, 25 bp, Rattus norvegicus
taccgagtagctggccatggagtct

SEQ ID NO: 550562 - DNA, 25 bp, Rattus norvegicus
taccgagtgttacccagagagcctg

SEQ ID NO: 550563 - DNA, 25 bp, Rattus norvegicus
taccgagtgttagccagagagcctg

SEQ ID NO: 550564 - DNA, 25 bp, Rattus norvegicus
taccgagttcttcgcaaacctgagc

SEQ ID NO: 550565 - DNA, 25 bp, Rattus norvegicus
taccgagttcttggcaaacctgagc

SEQ ID NO: 550566 - DNA, 25 bp, Rattus norvegicus
taccgatccctcaacaaggtgcttg

SEQ ID NO: 550567 - DNA, 25 bp, Rattus norvegicus
taccgatccctctacaaggtgcttg

SEQ ID NO: 550568 - DNA, 25 bp, Rattus norvegicus
taccgatctggcagctggacaagtc

SEQ ID NO: 550569 - DNA, 25 bp, Rattus norvegicus
taccgatctggctgctggacaagtc

SEQ ID NO: 550570 - DNA, 25 bp, Rattus norvegicus
taccgatgggctcttgtgctagcta

SEQ ID NO: 550571 - DNA, 25 bp, Rattus norvegicus
taccgatgggctgttgtgctagcta

SEQ ID NO: 550572 - DNA, 25 bp, Rattus norvegicus
taccgatgtgtaaggtctccttctc

SEQ ID NO: 550573 - DNA, 25 bp, Rattus norvegicus
taccgatgtgtatggtctccttctc

SEQ ID NO: 550574 - DNA, 25 bp, Rattus norvegicus
taccgcaaaccccacaatgcaatta

SEQ ID NO: 550575 - DNA, 25 bp, Rattus norvegicus
taccgcaaacccgacaatgcaatta

SEQ ID NO: 550576 - DNA, 25 bp, Rattus norvegicus
taccgcaactcaaagacccactgga

SEQ ID NO: 550577 - DNA, 25 bp, Rattus norvegicus
taccgcaactcatagacccactgga

SEQ ID NO: 550578 - DNA, 25 bp, Rattus norvegicus
taccgcaacttccataacttctagt

SEQ ID NO: 550579 - DNA, 25 bp, Rattus norvegicus
taccgcaacttcgataacttctagt

SEQ ID NO: 550580 - DNA, 25 bp, Rattus norvegicus
taccgcaaggtcctgcttattgatg

SEQ ID NO: 550581 - DNA, 25 bp, Rattus norvegicus
taccgcaaggtcgtgcttattgatg

SEQ ID NO: 550582 - DNA, 25 bp, Rattus norvegicus
taccgcaagttcagcaccgagagtg

SEQ ID NO: 550583 - DNA, 25 bp, Rattus norvegicus
taccgcaagttctgcaccgagagtg

SEQ ID NO: 550584 - DNA, 25 bp, Rattus norvegicus
taccgcaatactcagccaagtctta

SEQ ID NO: 550585 - DNA, 25 bp, Rattus norvegicus
taccgcaatactgagccaagtctta

SEQ ID NO: 550586 - DNA, 25 bp, Rattus norvegicus
taccgcacctggagctgccctgtgg

SEQ ID NO: 550587 - DNA, 25 bp, Rattus norvegicus
taccgcacctggtgctgccctgtgg

SEQ ID NO: 550588 - DNA, 25 bp, Rattus norvegicus
taccgcacttcaagaattgaggcag

SEQ ID NO: 550589 - DNA, 25 bp, Rattus norvegicus
taccgcacttcatgaattgaggcag

SEQ ID NO: 550590 - DNA, 25 bp, Rattus norvegicus
taccgccaacttaaaacctggattg

SEQ ID NO: 550591 - DNA, 25 bp, Rattus norvegicus
taccgccaactttaaacctggattg

SEQ ID NO: 550592 - DNA, 25 bp, Rattus norvegicus
taccgccaggctccaagcagggtga

SEQ ID NO: 550593 - DNA, 25 bp, Rattus norvegicus
taccgccaggctgcaagcagggtga

SEQ ID NO: 550594 - DNA, 25 bp, Rattus norvegicus
taccgccagtggacggaccggataa

SEQ ID NO: 550595 - DNA, 25 bp, Rattus norvegicus
taccgccagtggtcggaccggataa

SEQ ID NO: 550596 - DNA, 25 bp, Rattus norvegicus
taccgcctccctcatgtgaagcatg

SEQ ID NO: 550597 - DNA, 25 bp, Rattus norvegicus
taccgcctccctgatgtgaagcatg

SEQ ID NO: 550598 - DNA, 25 bp, Rattus norvegicus
taccgcctgagccttctggaggaat

SEQ ID NO: 550599 - DNA, 25 bp, Rattus norvegicus
taccgcctgagcgttctggaggaat

SEQ ID NO: 550600 - DNA, 25 bp, Rattus norvegicus
taccgcctgcatctggatggtggtc

SEQ ID NO: 550601 - DNA, 25 bp, Rattus norvegicus
taccgcctgcatgtggatggtggtc

SEQ ID NO: 550602 - DNA, 25 bp, Rattus norvegicus
taccgcggagtgattgtctctggca

SEQ ID NO: 550603 - DNA, 25 bp, Rattus norvegicus
taccgcggagtgtttgtctctggca

SEQ ID NO: 550604 - DNA, 25 bp, Rattus norvegicus
taccgcggttccacagaaactgagc

SEQ ID NO: 550605 - DNA, 25 bp, Rattus norvegicus
taccgcggttcctcagaaactgagc

SEQ ID NO: 550606 - DNA, 25 bp, Rattus norvegicus
taccgcgtgccacaggacacctggg

SEQ ID NO: 550607 - DNA, 25 bp, Rattus norvegicus
taccgcgtgccagaggacacctggg

SEQ ID NO: 550608 - DNA, 25 bp, Rattus norvegicus
taccgcgtggctattgatgattctg

SEQ ID NO: 550609 - DNA, 25 bp, Rattus norvegicus
taccgcgtggcttttgatgattctg

SEQ ID NO: 550610 - DNA, 25 bp, Rattus norvegicus
taccgcgttcgtcagcacctggaaa

SEQ ID NO: 550611 - DNA, 25 bp, Rattus norvegicus
taccgcgttcgtgagcacctggaaa

SEQ ID NO: 550612 - DNA, 25 bp, Rattus norvegicus
taccgctcaatgcaatggccagttt

SEQ ID NO: 550613 - DNA, 25 bp, Rattus norvegicus
taccgctcaatggaatggccagttt

SEQ ID NO: 550614 - DNA, 25 bp, Rattus norvegicus
taccgctgcgagaatgactttgtca

SEQ ID NO: 550615 - DNA, 25 bp, Rattus norvegicus
taccgctgcgagtatgactttgtca

SEQ ID NO: 550616 - DNA, 25 bp, Rattus norvegicus
taccgctggctgctaaagacaccat

SEQ ID NO: 550617 - DNA, 25 bp, Rattus norvegicus
taccgctggctggtaaagacaccat

SEQ ID NO: 550618 - DNA, 25 bp, Rattus norvegicus
taccgctgggaaaagtgccttttta

SEQ ID NO: 550619 - DNA, 25 bp, Rattus norvegicus
taccgctgggaatagtgccttttta

SEQ ID NO: 550620 - DNA, 25 bp, Rattus norvegicus
taccgctgtgctctccgttttgagt

SEQ ID NO: 550621 - DNA, 25 bp, Rattus norvegicus
taccgctgtgctgtccgttttgagt

SEQ ID NO: 550622 - DNA, 25 bp, Rattus norvegicus
taccgctgtgggaatgtggcagcca

SEQ ID NO: 550623 - DNA, 25 bp, Rattus norvegicus
taccgctgtgggtatgtggcagcca

SEQ ID NO: 550624 - DNA, 25 bp, Rattus norvegicus
taccgctgtggtacggcacatgagg

SEQ ID NO: 550625 - DNA, 25 bp, Rattus norvegicus
taccgctgtggttcggcacatgagg

SEQ ID NO: 550626 - DNA, 25 bp, Rattus norvegicus
taccgcttactgagttctttctgaa

SEQ ID NO: 550627 - DNA, 25 bp, Rattus norvegicus
taccgcttactgtgttctttctgaa

SEQ ID NO: 550628 - DNA, 25 bp, Rattus norvegicus
taccgctttctgaagtcgtcagagg

SEQ ID NO: 550629 - DNA, 25 bp, Rattus norvegicus
taccgctttctgtagtcgtcagagg

SEQ ID NO: 550630 - DNA, 25 bp, Rattus norvegicus
taccggaaaaggcaggtctcttctc

SEQ ID NO: 550631 - DNA, 25 bp, Rattus norvegicus
taccggaaaagggaggtctcttctc

SEQ ID NO: 550632 - DNA, 25 bp, Rattus norvegicus
taccggaaacagagtgccagaacct

SEQ ID NO: 550633 - DNA, 25 bp, Rattus norvegicus
taccggaaacagtgtgccagaacct

SEQ ID NO: 550634 - DNA, 25 bp, Rattus norvegicus
taccggaagggcagtgtgacagtct

SEQ ID NO: 550635 - DNA, 25 bp, Rattus norvegicus
taccggaagggctgtgtgacagtct

SEQ ID NO: 550636 - DNA, 25 bp, Rattus norvegicus
taccggaagggtctgttatcgactc

SEQ ID NO: 550637 - DNA, 25 bp, Rattus norvegicus
taccggaagggtgtgttatcgactc

SEQ ID NO: 550638 - DNA, 25 bp, Rattus norvegicus
taccggaatccgatctctgaaactt

SEQ ID NO: 550639 - DNA, 25 bp, Rattus norvegicus
taccggaatccgttctctgaaactt

SEQ ID NO: 550640 - DNA, 25 bp, Rattus norvegicus
taccggacatccagtttgagcctca

SEQ ID NO: 550641 - DNA, 25 bp, Rattus norvegicus
taccggacatcctgtttgagcctca

SEQ ID NO: 550642 - DNA, 25 bp, Rattus norvegicus
taccggaccatgaacatggcttgca

SEQ ID NO: 550643 - DNA, 25 bp, Rattus norvegicus
taccggaccatgtacatggcttgca

SEQ ID NO: 550644 - DNA, 25 bp, Rattus norvegicus
taccggacggtgacaacatctccaa

SEQ ID NO: 550645 - DNA, 25 bp, Rattus norvegicus
taccggacggtgtcaacatctccaa

SEQ ID NO: 550646 - DNA, 25 bp, Rattus norvegicus
taccggagaatcctgggccaattat

SEQ ID NO: 550647 - DNA, 25 bp, Rattus norvegicus
taccggagaatcgtgggccaattat

SEQ ID NO: 550648 - DNA, 25 bp, Rattus norvegicus
taccggattgccaatcgccatagcc

SEQ ID NO: 550649 - DNA, 25 bp, Rattus norvegicus
taccggattgcctatcgccatagcc

SEQ ID NO: 550650 - DNA, 25 bp, Rattus norvegicus
taccggcaacttaggctttgggatt

SEQ ID NO: 550651 - DNA, 25 bp, Rattus norvegicus
taccggcaactttggctttgggatt

SEQ ID NO: 550652 - DNA, 25 bp, Rattus norvegicus
taccggcattggatgagagcacccc

SEQ ID NO: 550653 - DNA, 25 bp, Rattus norvegicus
taccggcattggttgagagcacccc

SEQ ID NO: 550654 - DNA, 25 bp, Rattus norvegicus
taccggcccagcagtgaggagcagt

SEQ ID NO: 550655 - DNA, 25 bp, Rattus norvegicus
taccggcccagctgtgaggagcagt

SEQ ID NO: 550656 - DNA, 25 bp, Rattus norvegicus
taccggccctgtaagcagtgttgga

SEQ ID NO: 550657 - DNA, 25 bp, Rattus norvegicus
taccggccctgttagcagtgttgga

SEQ ID NO: 550658 - DNA, 25 bp, Rattus norvegicus
taccggcctaacctggagctgtgtc

SEQ ID NO: 550659 - DNA, 25 bp, Rattus norvegicus
taccggcctaacgtggagctgtgtc

SEQ ID NO: 550660 - DNA, 25 bp, Rattus norvegicus
taccggctagagctgtgaattcttt

SEQ ID NO: 550661 - DNA, 25 bp, Rattus norvegicus
taccggctagaggtgtgaattcttt

SEQ ID NO: 550662 - DNA, 25 bp, Rattus norvegicus
taccggctgcccattcgtgaatgag

SEQ ID NO: 550663 - DNA, 25 bp, Rattus norvegicus
taccggctgccctttcgtgaatgag

SEQ ID NO: 550664 - DNA, 25 bp, Rattus norvegicus
taccggctggctctttgtgaatttt

SEQ ID NO: 550665 - DNA, 25 bp, Rattus norvegicus
taccggctggctgtttgtgaatttt

SEQ ID NO: 550666 - DNA, 25 bp, Rattus norvegicus
taccgggaatgtcttcaccatggtt

SEQ ID NO: 550667 - DNA, 25 bp, Rattus norvegicus
taccgggaatgtgttcaccatggtt

SEQ ID NO: 550668 - DNA, 25 bp, Rattus norvegicus
taccgggcccttcgattagttgccg

SEQ ID NO: 550669 - DNA, 25 bp, Rattus norvegicus
taccgggcccttggattagttgccg

SEQ ID NO: 550670 - DNA, 25 bp, Rattus norvegicus
taccgggttctcctcaaacagcagt

SEQ ID NO: 550671 - DNA, 25 bp, Rattus norvegicus
taccgggttctcgtcaaacagcagt

SEQ ID NO: 550672 - DNA, 25 bp, Rattus norvegicus
taccggtatcagattctacccacaa

SEQ ID NO: 550673 - DNA, 25 bp, Rattus norvegicus
taccggtatcagtttctacccacaa

SEQ ID NO: 550674 - DNA, 25 bp, Rattus norvegicus
taccggtccgatccctcaaggcaaa

SEQ ID NO: 550675 - DNA, 25 bp, Rattus norvegicus
taccggtccgatgcctcaaggcaaa

SEQ ID NO: 550676 - DNA, 25 bp, Rattus norvegicus
taccggtccttacttcatcttttat

SEQ ID NO: 550677 - DNA, 25 bp, Rattus norvegicus
taccggtccttagttcatcttttat

SEQ ID NO: 550678 - DNA, 25 bp, Rattus norvegicus
taccggtcgatgcaacgagtgatga

SEQ ID NO: 550679 - DNA, 25 bp, Rattus norvegicus
taccggtcgatggaacgagtgatga

SEQ ID NO: 550680 - DNA, 25 bp, Rattus norvegicus
taccggtgcaagagttaactgtcag

SEQ ID NO: 550681 - DNA, 25 bp, Rattus norvegicus
taccggtgcaagtgttaactgtcag

SEQ ID NO: 550682 - DNA, 25 bp, Rattus norvegicus
taccggtgcctgaaaccattgttac

SEQ ID NO: 550683 - DNA, 25 bp, Rattus norvegicus
taccggtgcctgtaaccattgttac

SEQ ID NO: 550684 - DNA, 25 bp, Rattus norvegicus
taccggttcaagatgactctgtagt

SEQ ID NO: 550685 - DNA, 25 bp, Rattus norvegicus
taccggttcaagttgactctgtagt

SEQ ID NO: 550686 - DNA, 25 bp, Rattus norvegicus
taccggttgaagaacagatctctgc

SEQ ID NO: 550687 - DNA, 25 bp, Rattus norvegicus
taccggttgaagtacagatctctgc

SEQ ID NO: 550688 - DNA, 25 bp, Rattus norvegicus
taccggtttatgatctctctctaaa

SEQ ID NO: 550689 - DNA, 25 bp, Rattus norvegicus
taccggtttatgttctctctctaaa

SEQ ID NO: 550690 - DNA, 25 bp, Rattus norvegicus
taccgtacagcactgctaggttgtt

SEQ ID NO: 550691 - DNA, 25 bp, Rattus norvegicus
taccgtacagcagtgctaggttgtt

SEQ ID NO: 550692 - DNA, 25 bp, Rattus norvegicus
taccgtagaataacactctcacgtg

SEQ ID NO: 550693 - DNA, 25 bp, Rattus norvegicus
taccgtagaatatcactctcacgtg

SEQ ID NO: 550694 - DNA, 25 bp, Rattus norvegicus
taccgtatctatctcactgctaagg

SEQ ID NO: 550695 - DNA, 25 bp, Rattus norvegicus
taccgtatctatgtcactgctaagg

SEQ ID NO: 550696 - DNA, 25 bp, Rattus norvegicus
taccgtatgtatattagctgtctgc

SEQ ID NO: 550697 - DNA, 25 bp, Rattus norvegicus
taccgtatgtattttagctgtctgc

SEQ ID NO: 550698 - DNA, 25 bp, Rattus norvegicus
taccgtcaactgagtggctgctatt

SEQ ID NO: 550699 - DNA, 25 bp, Rattus norvegicus
taccgtcaactgtgtggctgctatt

SEQ ID NO: 550700 - DNA, 25 bp, Rattus norvegicus
taccgtcaagacctggagctgagcc

SEQ ID NO: 550701 - DNA, 25 bp, Rattus norvegicus
taccgtcaagacgtggagctgagcc

SEQ ID NO: 550702 - DNA, 25 bp, Rattus norvegicus
taccgtcacctacttatacaggcat

SEQ ID NO: 550703 - DNA, 25 bp, Rattus norvegicus
taccgtcacctagttatacaggcat

SEQ ID NO: 550704 - DNA, 25 bp, Rattus norvegicus
taccgtcatctgagtaggaatgctg

SEQ ID NO: 550705 - DNA, 25 bp, Rattus norvegicus
taccgtcatctgtgtaggaatgctg

SEQ ID NO: 550706 - DNA, 25 bp, Rattus norvegicus
taccgtccaagtcccaattggcttt

SEQ ID NO: 550707 - DNA, 25 bp, Rattus norvegicus
taccgtccaagtgccaattggcttt

SEQ ID NO: 550708 - DNA, 25 bp, Rattus norvegicus
taccgtcctgctaggaggagctatg

SEQ ID NO: 550709 - DNA, 25 bp, Rattus norvegicus
taccgtcctgcttggaggagctatg

SEQ ID NO: 550710 - DNA, 25 bp, Rattus norvegicus
taccgtctagcgattgtttttgtag

SEQ ID NO: 550711 - DNA, 25 bp, Rattus norvegicus
taccgtctagcgtttgtttttgtag

SEQ ID NO: 550712 - DNA, 25 bp, Rattus norvegicus
taccgtctatttatatccactgtct

SEQ ID NO: 550713 - DNA, 25 bp, Rattus norvegicus
taccgtctatttttatccactgtct

SEQ ID NO: 550714 - DNA, 25 bp, Rattus norvegicus
taccgtctcatactcacagaggcaa

SEQ ID NO: 550715 - DNA, 25 bp, Rattus norvegicus
taccgtctcatagtcacagaggcaa

SEQ ID NO: 550716 - DNA, 25 bp, Rattus norvegicus
taccgtctcctcatctttgataatt

SEQ ID NO: 550717 - DNA, 25 bp, Rattus norvegicus
taccgtctcctcttctttgataatt

SEQ ID NO: 550718 - DNA, 25 bp, Rattus norvegicus
taccgtctgggcaacttccttttca

SEQ ID NO: 550719 - DNA, 25 bp, Rattus norvegicus
taccgtctgggctacttccttttca

SEQ ID NO: 550720 - DNA, 25 bp, Rattus norvegicus
taccgtcttcgtagcagtttggaat

SEQ ID NO: 550721 - DNA, 25 bp, Rattus norvegicus
taccgtcttcgttgcagtttggaat

SEQ ID NO: 550722 - DNA, 25 bp, Rattus norvegicus
taccgtcttcttcgcgggaaagatg

SEQ ID NO: 550723 - DNA, 25 bp, Rattus norvegicus
taccgtcttcttggcgggaaagatg

SEQ ID NO: 550724 - DNA, 25 bp, Rattus norvegicus
taccgtgaaggaagctctgctcagc

SEQ ID NO: 550725 - DNA, 25 bp, Rattus norvegicus
taccgtgaaggatgctctgctcagc

SEQ ID NO: 550726 - DNA, 25 bp, Rattus norvegicus
taccgtgaccagattcgaatgcgtg

SEQ ID NO: 550727 - DNA, 25 bp, Rattus norvegicus
taccgtgaccagtttcgaatgcgtg

SEQ ID NO: 550728 - DNA, 25 bp, Rattus norvegicus
taccgtgacttacttttctgctgat

SEQ ID NO: 550729 - DNA, 25 bp, Rattus norvegicus
taccgtgacttagttttctgctgat

SEQ ID NO: 550730 - DNA, 25 bp, Rattus norvegicus
taccgtgacttgaaggctggaccca

SEQ ID NO: 550731 - DNA, 25 bp, Rattus norvegicus
taccgtgacttgtaggctggaccca

SEQ ID NO: 550732 - DNA, 25 bp, Rattus norvegicus
taccgtgaggtcatgttgtctgtca

SEQ ID NO: 550733 - DNA, 25 bp, Rattus norvegicus
taccgtgaggtcttgttgtctgtca

SEQ ID NO: 550734 - DNA, 25 bp, Rattus norvegicus
taccgtgcagagcaagtggccgaca

SEQ ID NO: 550735 - DNA, 25 bp, Rattus norvegicus
taccgtgcagaggaagtggccgaca

SEQ ID NO: 550736 - DNA, 25 bp, Rattus norvegicus
taccgtgcatgtcattttgggactg

SEQ ID NO: 550737 - DNA, 25 bp, Rattus norvegicus
taccgtgcatgtgattttgggactg

SEQ ID NO: 550738 - DNA, 25 bp, Rattus norvegicus
taccgtgctctacacacttgatgct

SEQ ID NO: 550739 - DNA, 25 bp, Rattus norvegicus
taccgtgctctagacacttgatgct

SEQ ID NO: 550740 - DNA, 25 bp, Rattus norvegicus
taccgtggactgaattgaaaaccaa

SEQ ID NO: 550741 - DNA, 25 bp, Rattus norvegicus
taccgtggactgtattgaaaaccaa

SEQ ID NO: 550742 - DNA, 25 bp, Rattus norvegicus
taccgtggagctcggctcttcaaaa

SEQ ID NO: 550743 - DNA, 25 bp, Rattus norvegicus
taccgtggagctgggctcttcaaaa

SEQ ID NO: 550744 - DNA, 25 bp, Rattus norvegicus
taccgtggctacctgcctaatgtgc

SEQ ID NO: 550745 - DNA, 25 bp, Rattus norvegicus
taccgtggctacgtgcctaatgtgc

SEQ ID NO: 550746 - DNA, 25 bp, Rattus norvegicus
taccgtgggcaacttcctcagaaga

SEQ ID NO: 550747 - DNA, 25 bp, Rattus norvegicus
taccgtgggcaagttcctcagaaga

SEQ ID NO: 550748 - DNA, 25 bp, Rattus norvegicus
taccgtggtctccttacttttaatg

SEQ ID NO: 550749 - DNA, 25 bp, Rattus norvegicus
taccgtggtctcgttacttttaatg

SEQ ID NO: 550750 - DNA, 25 bp, Rattus norvegicus
taccgtgtacccagtgtttgtgaat

SEQ ID NO: 550751 - DNA, 25 bp, Rattus norvegicus
taccgtgtaccctgtgtttgtgaat

SEQ ID NO: 550752 - DNA, 25 bp, Rattus norvegicus
taccgtgtagaacatctagtgcttt

SEQ ID NO: 550753 - DNA, 25 bp, Rattus norvegicus
taccgtgtagaagatctagtgcttt

SEQ ID NO: 550754 - DNA, 25 bp, Rattus norvegicus
taccgtgtcactatgttagactcag

SEQ ID NO: 550755 - DNA, 25 bp, Rattus norvegicus
taccgtgtcactttgttagactcag

SEQ ID NO: 550756 - DNA, 25 bp, Rattus norvegicus
taccgtgtcctaattctatgatgca

SEQ ID NO: 550757 - DNA, 25 bp, Rattus norvegicus
taccgtgtcctatttctatgatgca

SEQ ID NO: 550758 - DNA, 25 bp, Rattus norvegicus
taccgtgtggcactgttacctgtgg

SEQ ID NO: 550759 - DNA, 25 bp, Rattus norvegicus
taccgtgtggcagtgttacctgtgg

SEQ ID NO: 550760 - DNA, 25 bp, Rattus norvegicus
taccgtgttagcattttccatgggc

SEQ ID NO: 550761 - DNA, 25 bp, Rattus norvegicus
taccgtgttagctttttccatgggc

SEQ ID NO: 550762 - DNA, 25 bp, Rattus norvegicus
taccgtgtttccatgatactgtctg

SEQ ID NO: 550763 - DNA, 25 bp, Rattus norvegicus
taccgtgtttccttgatactgtctg

SEQ ID NO: 550764 - DNA, 25 bp, Rattus norvegicus
taccgttaagccacttcctgtcggt

SEQ ID NO: 550765 - DNA, 25 bp, Rattus norvegicus
taccgttaagcctcttcctgtcggt

SEQ ID NO: 550766 - DNA, 25 bp, Rattus norvegicus
taccgttccctcagttcactgataa

SEQ ID NO: 550767 - DNA, 25 bp, Rattus norvegicus
taccgttccctctgttcactgataa

SEQ ID NO: 550768 - DNA, 25 bp, Rattus norvegicus
taccgttctaacatctgcttttctt

SEQ ID NO: 550769 - DNA, 25 bp, Rattus norvegicus
taccgttctaacttctgcttttctt

SEQ ID NO: 550770 - DNA, 25 bp, Rattus norvegicus
taccgttctattcgcataccgtcat

SEQ ID NO: 550771 - DNA, 25 bp, Rattus norvegicus
taccgttctattggcataccgtcat

SEQ ID NO: 550772 - DNA, 25 bp, Rattus norvegicus
taccgttgtcttcccgtggtggact

SEQ ID NO: 550773 - DNA, 25 bp, Rattus norvegicus
taccgttgtcttgccgtggtggact

SEQ ID NO: 550774 - DNA, 25 bp, Rattus norvegicus
tacctaacaacgaagatgctcacct

SEQ ID NO: 550775 - DNA, 25 bp, Rattus norvegicus
tacctaacaacgtagatgctcacct

SEQ ID NO: 550776 - DNA, 25 bp, Rattus norvegicus
tacctaacatccaggcccacaaaga

SEQ ID NO: 550777 - DNA, 25 bp, Rattus norvegicus
tacctaacatcctggcccacaaaga

SEQ ID NO: 550778 - DNA, 25 bp, Rattus norvegicus
tacctaacattgctctgtggcttca

SEQ ID NO: 550779 - DNA, 25 bp, Rattus norvegicus
tacctaacattggtctgtggcttca

SEQ ID NO: 550780 - DNA, 25 bp, Rattus norvegicus
tacctaactacgattggtggtctag

SEQ ID NO: 550781 - DNA, 25 bp, Rattus norvegicus
tacctaactacgtttggtggtctag

SEQ ID NO: 550782 - DNA, 25 bp, Rattus norvegicus
tacctaactctgcttccattatgaa

SEQ ID NO: 550783 - DNA, 25 bp, Rattus norvegicus
tacctaactctggttccattatgaa

SEQ ID NO: 550784 - DNA, 25 bp, Rattus norvegicus
tacctaagataaagcaattaaccat

SEQ ID NO: 550785 - DNA, 25 bp, Rattus norvegicus
tacctaagataatgcaattaaccat

SEQ ID NO: 550786 - DNA, 25 bp, Rattus norvegicus
tacctaatctgcaggatctccaaca

SEQ ID NO: 550787 - DNA, 25 bp, Rattus norvegicus
tacctaatctgctggatctccaaca

SEQ ID NO: 550788 - DNA, 25 bp, Rattus norvegicus
tacctaatggtcatcaggctgctta

SEQ ID NO: 550789 - DNA, 25 bp, Rattus norvegicus
tacctaatggtcttcaggctgctta

SEQ ID NO: 550790 - DNA, 25 bp, Rattus norvegicus
tacctacaatcgacgggccaacgtg

SEQ ID NO: 550791 - DNA, 25 bp, Rattus norvegicus
tacctacaatcgtcgggccaacgtg

SEQ ID NO: 550792 - DNA, 25 bp, Rattus norvegicus
tacctacaccatagtgctccgttaa

SEQ ID NO: 550793 - DNA, 25 bp, Rattus norvegicus
tacctacaccattgtgctccgttaa

SEQ ID NO: 550794 - DNA, 25 bp, Rattus norvegicus
tacctacagtccaacagcaacaact

SEQ ID NO: 550795 - DNA, 25 bp, Rattus norvegicus
tacctacagtcctacagcaacaact

SEQ ID NO: 550796 - DNA, 25 bp, Rattus norvegicus
tacctacattacattctagtctctt

SEQ ID NO: 550797 - DNA, 25 bp, Rattus norvegicus
tacctacattactttctagtctctt

SEQ ID NO: 550798 - DNA, 25 bp, Rattus norvegicus
tacctaccatacacactagagattt

SEQ ID NO: 550799 - DNA, 25 bp, Rattus norvegicus
tacctaccatactcactagagattt

SEQ ID NO: 550800 - DNA, 25 bp, Rattus norvegicus
tacctaccatctctgttttccgcat

SEQ ID NO: 550801 - DNA, 25 bp, Rattus norvegicus
tacctaccatctgtgttttccgcat

SEQ ID NO: 550802 - DNA, 25 bp, Rattus norvegicus
tacctaccattcctgtggatcacag

SEQ ID NO: 550803 - DNA, 25 bp, Rattus norvegicus
tacctaccattcctttcaatcaatt

SEQ ID NO: 550804 - DNA, 25 bp, Rattus norvegicus
tacctaccattcgtgtggatcacag

SEQ ID NO: 550805 - DNA, 25 bp, Rattus norvegicus
tacctaccattcgtttcaatcaatt

SEQ ID NO: 550806 - DNA, 25 bp, Rattus norvegicus
tacctaccggcacatggaacggaca

SEQ ID NO: 550807 - DNA, 25 bp, Rattus norvegicus
tacctaccggcagatggaacggaca

SEQ ID NO: 550808 - DNA, 25 bp, Rattus norvegicus
tacctacctactctggacttggaga

SEQ ID NO: 550809 - DNA, 25 bp, Rattus norvegicus
tacctacctactgtggacttggaga

SEQ ID NO: 550810 - DNA, 25 bp, Rattus norvegicus
tacctacctctgcttgcaaagaatg

SEQ ID NO: 550811 - DNA, 25 bp, Rattus norvegicus
tacctacctctggttgcaaagaatg

SEQ ID NO: 550812 - DNA, 25 bp, Rattus norvegicus
tacctacctgtgacttttctgcacg

SEQ ID NO: 550813 - DNA, 25 bp, Rattus norvegicus
tacctacctgtgtcttttctgcacg

SEQ ID NO: 550814 - DNA, 25 bp, Rattus norvegicus
tacctacgctttcactatggatctg

SEQ ID NO: 550815 - DNA, 25 bp, Rattus norvegicus
tacctacgctttgactatggatctg

SEQ ID NO: 550816 - DNA, 25 bp, Rattus norvegicus
tacctacgtggcagtattctcatga

SEQ ID NO: 550817 - DNA, 25 bp, Rattus norvegicus
tacctacgtggctgtattctcatga

SEQ ID NO: 550818 - DNA, 25 bp, Rattus norvegicus
tacctacgttggacaaacccggcat

SEQ ID NO: 550819 - DNA, 25 bp, Rattus norvegicus
tacctacgttggtcaaacccggcat

SEQ ID NO: 550820 - DNA, 25 bp, Rattus norvegicus
tacctactacacacaatcattgcct

SEQ ID NO: 550821 - DNA, 25 bp, Rattus norvegicus
tacctactacactcaatcattgcct

SEQ ID NO: 550822 - DNA, 25 bp, Rattus norvegicus
tacctactctcccaggacaaaggaa

SEQ ID NO: 550823 - DNA, 25 bp, Rattus norvegicus
tacctactctccgaggacaaaggaa

SEQ ID NO: 550824 - DNA, 25 bp, Rattus norvegicus
tacctactctgacttgcctttagag

SEQ ID NO: 550825 - DNA, 25 bp, Rattus norvegicus
tacctactctgagttgcctttagag

SEQ ID NO: 550826 - DNA, 25 bp, Rattus norvegicus
tacctactgcttccagacatttttg

SEQ ID NO: 550827 - DNA, 25 bp, Rattus norvegicus
tacctactgcttgcagacatttttg

SEQ ID NO: 550828 - DNA, 25 bp, Rattus norvegicus
tacctactggagatcttgctctgga

SEQ ID NO: 550829 - DNA, 25 bp, Rattus norvegicus
tacctactggagttcttgctctgga

SEQ ID NO: 550830 - DNA, 25 bp, Rattus norvegicus
tacctacttctcatcccataaggat

SEQ ID NO: 550831 - DNA, 25 bp, Rattus norvegicus
tacctacttctcttcccataaggat

SEQ ID NO: 550832 - DNA, 25 bp, Rattus norvegicus
tacctacttgaccagagcagtgaag

SEQ ID NO: 550833 - DNA, 25 bp, Rattus norvegicus
tacctacttgacgagagcagtgaag

SEQ ID NO: 550834 - DNA, 25 bp, Rattus norvegicus
tacctagaaaccatgcccagcggag

SEQ ID NO: 550835 - DNA, 25 bp, Rattus norvegicus
tacctagaaaccttgcccagcggag

SEQ ID NO: 550836 - DNA, 25 bp, Rattus norvegicus
tacctagactctccaagtcctcagt

SEQ ID NO: 550837 - DNA, 25 bp, Rattus norvegicus
tacctagactctgcaagtcctcagt

SEQ ID NO: 550838 - DNA, 25 bp, Rattus norvegicus
tacctagcagccagcgggacattta

SEQ ID NO: 550839 - DNA, 25 bp, Rattus norvegicus
tacctagcagcctgcgggacattta

SEQ ID NO: 550840 - DNA, 25 bp, Rattus norvegicus
tacctagccttgatggccctggaac

SEQ ID NO: 550841 - DNA, 25 bp, Rattus norvegicus
tacctagccttgttggccctggaac

SEQ ID NO: 550842 - DNA, 25 bp, Rattus norvegicus
tacctagcctttaacatggaaacct

SEQ ID NO: 550843 - DNA, 25 bp, Rattus norvegicus
tacctagcctttactcttcatatct

SEQ ID NO: 550844 - DNA, 25 bp, Rattus norvegicus
tacctagccttttacatggaaacct

SEQ ID NO: 550845 - DNA, 25 bp, Rattus norvegicus
tacctagccttttctcttcatatct

SEQ ID NO: 550846 - DNA, 25 bp, Rattus norvegicus
tacctagcgtccagtttttaactgt

SEQ ID NO: 550847 - DNA, 25 bp, Rattus norvegicus
tacctagcgtcctgtttttaactgt

SEQ ID NO: 550848 - DNA, 25 bp, Rattus norvegicus
tacctagctggtctagggctggctc

SEQ ID NO: 550849 - DNA, 25 bp, Rattus norvegicus
tacctagctggtgtagggctggctc

SEQ ID NO: 550850 - DNA, 25 bp, Rattus norvegicus
tacctaggacgtagccccggagtca

SEQ ID NO: 550851 - DNA, 25 bp, Rattus norvegicus
tacctaggacgttgccccggagtca

SEQ ID NO: 550852 - DNA, 25 bp, Rattus norvegicus
tacctaggattcactggattctctg

SEQ ID NO: 550853 - DNA, 25 bp, Rattus norvegicus
tacctaggattctctggattctctg

SEQ ID NO: 550854 - DNA, 25 bp, Rattus norvegicus
tacctaggatttaccattggcggcc

SEQ ID NO: 550855 - DNA, 25 bp, Rattus norvegicus
tacctaggattttccattggcggcc

SEQ ID NO: 550856 - DNA, 25 bp, Rattus norvegicus
tacctaggcactcaccggatcacag

SEQ ID NO: 550857 - DNA, 25 bp, Rattus norvegicus
tacctaggcactgaccggatcacag

SEQ ID NO: 550858 - DNA, 25 bp, Rattus norvegicus
tacctagggtctaagagcttgcagc

SEQ ID NO: 550859 - DNA, 25 bp, Rattus norvegicus
tacctagggtcttagagcttgcagc

SEQ ID NO: 550860 - DNA, 25 bp, Rattus norvegicus
tacctaggtctcctgccagagtaat

SEQ ID NO: 550861 - DNA, 25 bp, Rattus norvegicus
tacctaggtctcgtgccagagtaat

SEQ ID NO: 550862 - DNA, 25 bp, Rattus norvegicus
tacctaggttaacaaccctctcgag

SEQ ID NO: 550863 - DNA, 25 bp, Rattus norvegicus
tacctaggttaagaaccctctcgag

SEQ ID NO: 550864 - DNA, 25 bp, Rattus norvegicus
tacctagtcagtctgtgtcagtcag

SEQ ID NO: 550865 - DNA, 25 bp, Rattus norvegicus
tacctagtcagtgtgtgtcagtcag

SEQ ID NO: 550866 - DNA, 25 bp, Rattus norvegicus
tacctagtctcaaccgtcgtgaaaa

SEQ ID NO: 550867 - DNA, 25 bp, Rattus norvegicus
tacctagtctcatccgtcgtgaaaa

SEQ ID NO: 550868 - DNA, 25 bp, Rattus norvegicus
tacctagtgaggacctatctttgcc

SEQ ID NO: 550869 - DNA, 25 bp, Rattus norvegicus
tacctagtgaggcttgtctcagaaa

SEQ ID NO: 550870 - DNA, 25 bp, Rattus norvegicus
tacctagtgagggttgtctcagaaa

SEQ ID NO: 550871 - DNA, 25 bp, Rattus norvegicus
tacctagtgaggtcctatctttgcc

SEQ ID NO: 550872 - DNA, 25 bp, Rattus norvegicus
tacctagtggccctcattaactggc

SEQ ID NO: 550873 - DNA, 25 bp, Rattus norvegicus
tacctagtggccgtcattaactggc

SEQ ID NO: 550874 - DNA, 25 bp, Rattus norvegicus
tacctagtggtgaggaggtccaagc

SEQ ID NO: 550875 - DNA, 25 bp, Rattus norvegicus
tacctagtggtgtggaggtccaagc

SEQ ID NO: 550876 - DNA, 25 bp, Rattus norvegicus
tacctatacagtccccacaagatgt

SEQ ID NO: 550877 - DNA, 25 bp, Rattus norvegicus
tacctatacagtgcccacaagatgt

SEQ ID NO: 550878 - DNA, 25 bp, Rattus norvegicus
tacctatcacggaggaactgctctg

SEQ ID NO: 550879 - DNA, 25 bp, Rattus norvegicus
tacctatcacggtggaactgctctg

SEQ ID NO: 550880 - DNA, 25 bp, Rattus norvegicus
tacctatctcagaatgttgcctttc

SEQ ID NO: 550881 - DNA, 25 bp, Rattus norvegicus
tacctatctcagtatgttgcctttc

SEQ ID NO: 550882 - DNA, 25 bp, Rattus norvegicus
tacctatctcccagagttcctaaag

SEQ ID NO: 550883 - DNA, 25 bp, Rattus norvegicus
tacctatctccctgagttcctaaag

SEQ ID NO: 550884 - DNA, 25 bp, Rattus norvegicus
tacctatgacataacgctggccaac

SEQ ID NO: 550885 - DNA, 25 bp, Rattus norvegicus
tacctatgacattacgctggccaac

SEQ ID NO: 550886 - DNA, 25 bp, Rattus norvegicus
tacctatgggtcaaacgggcaaaca

SEQ ID NO: 550887 - DNA, 25 bp, Rattus norvegicus
tacctatgggtctaacgggcaaaca

SEQ ID NO: 550888 - DNA, 25 bp, Rattus norvegicus
tacctattgcgcacaccgttctatg

SEQ ID NO: 550889 - DNA, 25 bp, Rattus norvegicus
tacctattgcgctcaccgttctatg

SEQ ID NO: 550890 - DNA, 25 bp, Rattus norvegicus
tacctattgtaaccttacctcctgg

SEQ ID NO: 550891 - DNA, 25 bp, Rattus norvegicus
tacctattgtaagcttacctcctgg

SEQ ID NO: 550892 - DNA, 25 bp, Rattus norvegicus
tacctcaaaggtcttccacggtgga

SEQ ID NO: 550893 - DNA, 25 bp, Rattus norvegicus
tacctcaaaggtgttccacggtgga

SEQ ID NO: 550894 - DNA, 25 bp, Rattus norvegicus
tacctcaacaccatgctggagttga

SEQ ID NO: 550895 - DNA, 25 bp, Rattus norvegicus
tacctcaacaccttgctggagttga

SEQ ID NO: 550896 - DNA, 25 bp, Rattus norvegicus
tacctcaacctgagtgactccaaac

SEQ ID NO: 550897 - DNA, 25 bp, Rattus norvegicus
tacctcaacctgtgtgactccaaac

SEQ ID NO: 550898 - DNA, 25 bp, Rattus norvegicus
tacctcaatcccaggtgaggacccg

SEQ ID NO: 550899 - DNA, 25 bp, Rattus norvegicus
tacctcaatccctggtgaggacccg

SEQ ID NO: 550900 - DNA, 25 bp, Rattus norvegicus
tacctcaatcgtattttgtgctgtt

SEQ ID NO: 550901 - DNA, 25 bp, Rattus norvegicus
tacctcaatcgttttttgtgctgtt

SEQ ID NO: 550902 - DNA, 25 bp, Rattus norvegicus
tacctcacagaactgttggctcaga

SEQ ID NO: 550903 - DNA, 25 bp, Rattus norvegicus
tacctcacagaagtgttggctcaga

SEQ ID NO: 550904 - DNA, 25 bp, Rattus norvegicus
tacctcaccatcaacacttggatta

SEQ ID NO: 550905 - DNA, 25 bp, Rattus norvegicus
tacctcaccatctacacttggatta

SEQ ID NO: 550906 - DNA, 25 bp, Rattus norvegicus
tacctcaccctgatcttcaagagtg

SEQ ID NO: 550907 - DNA, 25 bp, Rattus norvegicus
tacctcaccctgttcttcaagagtg

SEQ ID NO: 550908 - DNA, 25 bp, Rattus norvegicus
tacctcacctgaagggaatcacagt

SEQ ID NO: 550909 - DNA, 25 bp, Rattus norvegicus
tacctcacctgaccggttagctgaa

SEQ ID NO: 550910 - DNA, 25 bp, Rattus norvegicus
tacctcacctgagcggttagctgaa

SEQ ID NO: 550911 - DNA, 25 bp, Rattus norvegicus
tacctcacctgatgggaatcacagt

SEQ ID NO: 550912 - DNA, 25 bp, Rattus norvegicus
tacctcacctgtctagtgttgctta

SEQ ID NO: 550913 - DNA, 25 bp, Rattus norvegicus
tacctcacctgtgtagtgttgctta

SEQ ID NO: 550914 - DNA, 25 bp, Rattus norvegicus
tacctcactcaacctgccgatggag

SEQ ID NO: 550915 - DNA, 25 bp, Rattus norvegicus
tacctcactcaagctgccgatggag

SEQ ID NO: 550916 - DNA, 25 bp, Rattus norvegicus
tacctcactctgctcagtaacagga

SEQ ID NO: 550917 - DNA, 25 bp, Rattus norvegicus
tacctcactctggtcagtaacagga

SEQ ID NO: 550918 - DNA, 25 bp, Rattus norvegicus
tacctcactgcaatgcgaaggctat

SEQ ID NO: 550919 - DNA, 25 bp, Rattus norvegicus
tacctcactgcattgcgaaggctat

SEQ ID NO: 550920 - DNA, 25 bp, Rattus norvegicus
tacctcactgtgatctttgaatatg

SEQ ID NO: 550921 - DNA, 25 bp, Rattus norvegicus
tacctcactgtgttctttgaatatg

SEQ ID NO: 550922 - DNA, 25 bp, Rattus norvegicus
tacctcagagataggaacttttcag

SEQ ID NO: 550923 - DNA, 25 bp, Rattus norvegicus
tacctcagagattggaacttttcag

SEQ ID NO: 550924 - DNA, 25 bp, Rattus norvegicus
tacctcagccaaagccagaacagta

SEQ ID NO: 550925 - DNA, 25 bp, Rattus norvegicus
tacctcagccaatgccagaacagta

SEQ ID NO: 550926 - DNA, 25 bp, Rattus norvegicus
tacctcagccggaatgaatgtcctt

SEQ ID NO: 550927 - DNA, 25 bp, Rattus norvegicus
tacctcagccggtatgaatgtcctt

SEQ ID NO: 550928 - DNA, 25 bp, Rattus norvegicus
tacctcagcctcctaagggtgggga

SEQ ID NO: 550929 - DNA, 25 bp, Rattus norvegicus
tacctcagcctcgtaagggtgggga

SEQ ID NO: 550930 - DNA, 25 bp, Rattus norvegicus
tacctcaggaataatctctctctct

SEQ ID NO: 550931 - DNA, 25 bp, Rattus norvegicus
tacctcaggaattatctctctctct

SEQ ID NO: 550932 - DNA, 25 bp, Rattus norvegicus
tacctcaggattcagcttcaaggat

SEQ ID NO: 550933 - DNA, 25 bp, Rattus norvegicus
tacctcaggattgagcttcaaggat

SEQ ID NO: 550934 - DNA, 25 bp, Rattus norvegicus
tacctcagggtaattgcttttgaaa

SEQ ID NO: 550935 - DNA, 25 bp, Rattus norvegicus
tacctcagggtatttgcttttgaaa

SEQ ID NO: 550936 - DNA, 25 bp, Rattus norvegicus
tacctcagggttcgtgctacactgt

SEQ ID NO: 550937 - DNA, 25 bp, Rattus norvegicus
tacctcagggttggtgctacactgt

SEQ ID NO: 550938 - DNA, 25 bp, Rattus norvegicus
tacctcaggttgctgattgctgtgt

SEQ ID NO: 550939 - DNA, 25 bp, Rattus norvegicus
tacctcaggttggtgattgctgtgt

SEQ ID NO: 550940 - DNA, 25 bp, Rattus norvegicus
tacctcagtgagctgagtctttccg

SEQ ID NO: 550941 - DNA, 25 bp, Rattus norvegicus
tacctcagtgaggtgagtctttccg

SEQ ID NO: 550942 - DNA, 25 bp, Rattus norvegicus
tacctcagtggtctaggatgctcct

SEQ ID NO: 550943 - DNA, 25 bp, Rattus norvegicus
tacctcagtggtgtaggatgctcct

SEQ ID NO: 550944 - DNA, 25 bp, Rattus norvegicus
tacctcatcaagattcacgatccag

SEQ ID NO: 550945 - DNA, 25 bp, Rattus norvegicus
tacctcatcaagtttcacgatccag

SEQ ID NO: 550946 - DNA, 25 bp, Rattus norvegicus
tacctcatcaggcatcagacagacc

SEQ ID NO: 550947 - DNA, 25 bp, Rattus norvegicus
tacctcatcagggatcagacagacc

SEQ ID NO: 550948 - DNA, 25 bp, Rattus norvegicus
tacctcatctttatctatttcctgg

SEQ ID NO: 550949 - DNA, 25 bp, Rattus norvegicus
tacctcatctttttctatttcctgg

SEQ ID NO: 550950 - DNA, 25 bp, Rattus norvegicus
tacctcattcaacaccatggcaaag

SEQ ID NO: 550951 - DNA, 25 bp, Rattus norvegicus
tacctcattcaagaccatggcaaag

SEQ ID NO: 550952 - DNA, 25 bp, Rattus norvegicus
tacctcattgagacgtttccgtgtc

SEQ ID NO: 550953 - DNA, 25 bp, Rattus norvegicus
tacctcattgagtcgtttccgtgtc

SEQ ID NO: 550954 - DNA, 25 bp, Rattus norvegicus
tacctccaaagtccccatattacag

SEQ ID NO: 550955 - DNA, 25 bp, Rattus norvegicus
tacctccaaagtgcccatattacag

SEQ ID NO: 550956 - DNA, 25 bp, Rattus norvegicus
tacctccacaccatcatgaagctgg

SEQ ID NO: 550957 - DNA, 25 bp, Rattus norvegicus
tacctccacaccttcatgaagctgg

SEQ ID NO: 550958 - DNA, 25 bp, Rattus norvegicus
tacctccagcttagtttactgtttt

SEQ ID NO: 550959 - DNA, 25 bp, Rattus norvegicus
tacctccagctttgtttactgtttt

SEQ ID NO: 550960 - DNA, 25 bp, Rattus norvegicus
tacctccaggcgaatccagatggga

SEQ ID NO: 550961 - DNA, 25 bp, Rattus norvegicus
tacctccaggcgtatccagatggga

SEQ ID NO: 550962 - DNA, 25 bp, Rattus norvegicus
tacctcccacgcaggtggtataatg

SEQ ID NO: 550963 - DNA, 25 bp, Rattus norvegicus
tacctcccacgctggtggtataatg

SEQ ID NO: 550964 - DNA, 25 bp, Rattus norvegicus
tacctcccagctatgagtttgtgtt

SEQ ID NO: 550965 - DNA, 25 bp, Rattus norvegicus
tacctcccagctttgagtttgtgtt

SEQ ID NO: 550966 - DNA, 25 bp, Rattus norvegicus
tacctccccagtaaaatgtgctttt

SEQ ID NO: 550967 - DNA, 25 bp, Rattus norvegicus
tacctccccagttaaatgtgctttt

SEQ ID NO: 550968 - DNA, 25 bp, Rattus norvegicus
tacctccccgatctgaggagctgaa

SEQ ID NO: 550969 - DNA, 25 bp, Rattus norvegicus
tacctccccgatgtgaggagctgaa

SEQ ID NO: 550970 - DNA, 25 bp, Rattus norvegicus
tacctccccggaactgttagcacaa

SEQ ID NO: 550971 - DNA, 25 bp, Rattus norvegicus
tacctccccggatctgttagcacaa

SEQ ID NO: 550972 - DNA, 25 bp, Rattus norvegicus
tacctcccctgaccaacatgtggaa

SEQ ID NO: 550973 - DNA, 25 bp, Rattus norvegicus
tacctcccctgagcaacatgtggaa

SEQ ID NO: 550974 - DNA, 25 bp, Rattus norvegicus
tacctccccttactttgcataaata

SEQ ID NO: 550975 - DNA, 25 bp, Rattus norvegicus
tacctccccttagtttgcataaata

SEQ ID NO: 550976 - DNA, 25 bp, Rattus norvegicus
tacctccctgcccatgtgtgtcatt

SEQ ID NO: 550977 - DNA, 25 bp, Rattus norvegicus
tacctccctgccgatgtgtgtcatt

SEQ ID NO: 550978 - DNA, 25 bp, Rattus norvegicus
tacctcctcatgaatgtcgtgactc

SEQ ID NO: 550979 - DNA, 25 bp, Rattus norvegicus
tacctcctcatgtatgtcgtgactc

SEQ ID NO: 550980 - DNA, 25 bp, Rattus norvegicus
tacctcctccctagttctaataaag

SEQ ID NO: 550981 - DNA, 25 bp, Rattus norvegicus
tacctcctcccttgttctaataaag

SEQ ID NO: 550982 - DNA, 25 bp, Rattus norvegicus
tacctcctcctgcaatgcattgtga

SEQ ID NO: 550983 - DNA, 25 bp, Rattus norvegicus
tacctcctcctggaatgcattgtga

SEQ ID NO: 550984 - DNA, 25 bp, Rattus norvegicus
tacctcctcgagactaactgtcttc

SEQ ID NO: 550985 - DNA, 25 bp, Rattus norvegicus
tacctcctcgagtctaactgtcttc

SEQ ID NO: 550986 - DNA, 25 bp, Rattus norvegicus
tacctcctctcgatactcaataaag

SEQ ID NO: 550987 - DNA, 25 bp, Rattus norvegicus
tacctcctctcgttactcaataaag

SEQ ID NO: 550988 - DNA, 25 bp, Rattus norvegicus
tacctcctgagtctggacaaagtct

SEQ ID NO: 550989 - DNA, 25 bp, Rattus norvegicus
tacctcctgagtgtggacaaagtct

SEQ ID NO: 550990 - DNA, 25 bp, Rattus norvegicus
tacctcctgctcagtcttctggaat

SEQ ID NO: 550991 - DNA, 25 bp, Rattus norvegicus
tacctcctgctctgtcttctggaat

SEQ ID NO: 550992 - DNA, 25 bp, Rattus norvegicus
tacctcctggtcaatctatgggttt

SEQ ID NO: 550993 - DNA, 25 bp, Rattus norvegicus
tacctcctggtctatctatgggttt

SEQ ID NO: 550994 - DNA, 25 bp, Rattus norvegicus
tacctcctttgtctgggaagtctga

SEQ ID NO: 550995 - DNA, 25 bp, Rattus norvegicus
tacctcctttgtgtgggaagtctga

SEQ ID NO: 550996 - DNA, 25 bp, Rattus norvegicus
tacctcgagacacctgtttccagga

SEQ ID NO: 550997 - DNA, 25 bp, Rattus norvegicus
tacctcgagacagctgtttccagga

SEQ ID NO: 550998 - DNA, 25 bp, Rattus norvegicus
tacctcgagtgcacagccaaataca

SEQ ID NO: 550999 - DNA, 25 bp, Rattus norvegicus
tacctcgagtgctcagccaaataca

SEQ ID NO: 551000 - DNA, 25 bp, Rattus norvegicus
tacctcgcactcacatcattttaaa

SEQ ID NO: 551001 - DNA, 25 bp, Rattus norvegicus
tacctcgcactctcatcattttaaa

SEQ ID NO: 551002 - DNA, 25 bp, Rattus norvegicus
tacctcgcagttagtcttcagggct

SEQ ID NO: 551003 - DNA, 25 bp, Rattus norvegicus
tacctcgcagtttgtcttcagggct

SEQ ID NO: 551004 - DNA, 25 bp, Rattus norvegicus
tacctcgcgaggatgctgtcatggt

SEQ ID NO: 551005 - DNA, 25 bp, Rattus norvegicus
tacctcgcgaggttgctgtcatggt

SEQ ID NO: 551006 - DNA, 25 bp, Rattus norvegicus
tacctcgcgtccagagaggtctcct

SEQ ID NO: 551007 - DNA, 25 bp, Rattus norvegicus
tacctcgcgtcctgagaggtctcct

SEQ ID NO: 551008 - DNA, 25 bp, Rattus norvegicus
tacctcgcttgtactcttgagagat

SEQ ID NO: 551009 - DNA, 25 bp, Rattus norvegicus
tacctcgcttgttctcttgagagat

SEQ ID NO: 551010 - DNA, 25 bp, Rattus norvegicus
tacctcggcgccaaattccgtaaag

SEQ ID NO: 551011 - DNA, 25 bp, Rattus norvegicus
tacctcggcgcctaattccgtaaag

SEQ ID NO: 551012 - DNA, 25 bp, Rattus norvegicus
tacctcgtagtcagtctcttcatgt

SEQ ID NO: 551013 - DNA, 25 bp, Rattus norvegicus
tacctcgtagtctgtctcttcatgt

SEQ ID NO: 551014 - DNA, 25 bp, Rattus norvegicus
tacctcgtggtcagtgtgtgcatag

SEQ ID NO: 551015 - DNA, 25 bp, Rattus norvegicus
tacctcgtggtctgtgtgtgcatag

SEQ ID NO: 551016 - DNA, 25 bp, Rattus norvegicus
tacctctaacacagaggctgcctgt

SEQ ID NO: 551017 - DNA, 25 bp, Rattus norvegicus
tacctctaacactgaggctgcctgt

SEQ ID NO: 551018 - DNA, 25 bp, Rattus norvegicus
tacctctaactcatccacagtttgg

SEQ ID NO: 551019 - DNA, 25 bp, Rattus norvegicus
tacctctaactcttccacagtttgg

SEQ ID NO: 551020 - DNA, 25 bp, Rattus norvegicus
tacctctacaagatctcctttcaga

SEQ ID NO: 551021 - DNA, 25 bp, Rattus norvegicus
tacctctacaagttctcctttcaga

SEQ ID NO: 551022 - DNA, 25 bp, Rattus norvegicus
tacctctacccaacagaacttttta

SEQ ID NO: 551023 - DNA, 25 bp, Rattus norvegicus
tacctctacccatcagaacttttta

SEQ ID NO: 551024 - DNA, 25 bp, Rattus norvegicus
tacctctacctcatcatggagtact

SEQ ID NO: 551025 - DNA, 25 bp, Rattus norvegicus
tacctctacctcttcatggagtact

SEQ ID NO: 551026 - DNA, 25 bp, Rattus norvegicus
tacctctacgagcacagcaacgtgt

SEQ ID NO: 551027 - DNA, 25 bp, Rattus norvegicus
tacctctacgaggacagcaacgtgt

SEQ ID NO: 551028 - DNA, 25 bp, Rattus norvegicus
tacctctactccagctgcattgtca

SEQ ID NO: 551029 - DNA, 25 bp, Rattus norvegicus
tacctctactcctgctgcattgtca

SEQ ID NO: 551030 - DNA, 25 bp, Rattus norvegicus
tacctctcatgcctgttttacctgt

SEQ ID NO: 551031 - DNA, 25 bp, Rattus norvegicus
tacctctcatgcgtgttttacctgt

SEQ ID NO: 551032 - DNA, 25 bp, Rattus norvegicus
tacctctccatgccaaatacctttg

SEQ ID NO: 551033 - DNA, 25 bp, Rattus norvegicus
tacctctccatggcaaatacctttg

SEQ ID NO: 551034 - DNA, 25 bp, Rattus norvegicus
tacctctcggataacagcattgggc

SEQ ID NO: 551035 - DNA, 25 bp, Rattus norvegicus
tacctctcggattacagcattgggc

SEQ ID NO: 551036 - DNA, 25 bp, Rattus norvegicus
tacctctcggtacttttcggacaag

SEQ ID NO: 551037 - DNA, 25 bp, Rattus norvegicus
tacctctcggtagttttcggacaag

SEQ ID NO: 551038 - DNA, 25 bp, Rattus norvegicus
tacctctgaactctcctacattttt

SEQ ID NO: 551039 - DNA, 25 bp, Rattus norvegicus
tacctctgaactgtcctacattttt

SEQ ID NO: 551040 - DNA, 25 bp, Rattus norvegicus
tacctctgactgcttccctgggaga

SEQ ID NO: 551041 - DNA, 25 bp, Rattus norvegicus
tacctctgactggttccctgggaga

SEQ ID NO: 551042 - DNA, 25 bp, Rattus norvegicus
tacctctgagttacagcctaagctt

SEQ ID NO: 551043 - DNA, 25 bp, Rattus norvegicus
tacctctgagtttcagcctaagctt

SEQ ID NO: 551044 - DNA, 25 bp, Rattus norvegicus
tacctctgattgagtggccatttgt

SEQ ID NO: 551045 - DNA, 25 bp, Rattus norvegicus
tacctctgattgtgtggccatttgt

SEQ ID NO: 551046 - DNA, 25 bp, Rattus norvegicus
tacctctgcattatctcactttaag

SEQ ID NO: 551047 - DNA, 25 bp, Rattus norvegicus
tacctctgcattttctcactttaag

SEQ ID NO: 551048 - DNA, 25 bp, Rattus norvegicus
tacctctgccagacactgcaggaag

SEQ ID NO: 551049 - DNA, 25 bp, Rattus norvegicus
tacctctgccagtcactgcaggaag

SEQ ID NO: 551050 - DNA, 25 bp, Rattus norvegicus
tacctctgcctccaaagaatttatt

SEQ ID NO: 551051 - DNA, 25 bp, Rattus norvegicus
tacctctgcctcgaaagaatttatt

SEQ ID NO: 551052 - DNA, 25 bp, Rattus norvegicus
tacctctgctttagtcggtcatgat

SEQ ID NO: 551053 - DNA, 25 bp, Rattus norvegicus
tacctctgcttttgtcggtcatgat

SEQ ID NO: 551054 - DNA, 25 bp, Rattus norvegicus
tacctctgtaagctgtttctcctga

SEQ ID NO: 551055 - DNA, 25 bp, Rattus norvegicus
tacctctgtaaggtgtttctcctga

SEQ ID NO: 551056 - DNA, 25 bp, Rattus norvegicus
tacctctgtatcagcgtgtgtacca

SEQ ID NO: 551057 - DNA, 25 bp, Rattus norvegicus
tacctctgtatctgcgtgtgtacca

SEQ ID NO: 551058 - DNA, 25 bp, Rattus norvegicus
tacctctgtccacttctgaagatga

SEQ ID NO: 551059 - DNA, 25 bp, Rattus norvegicus
tacctctgtccagttctgaagatga

SEQ ID NO: 551060 - DNA, 25 bp, Rattus norvegicus
tacctctgtttgactgtctattggt

SEQ ID NO: 551061 - DNA, 25 bp, Rattus norvegicus
tacctctgtttgtctgtctattggt

SEQ ID NO: 551062 - DNA, 25 bp, Rattus norvegicus
tacctcttcaagactgccgataagg

SEQ ID NO: 551063 - DNA, 25 bp, Rattus norvegicus
tacctcttcaagtctgccgataagg

SEQ ID NO: 551064 - DNA, 25 bp, Rattus norvegicus
tacctcttccaaccagcatggtgtg

SEQ ID NO: 551065 - DNA, 25 bp, Rattus norvegicus
tacctcttccaagcagcatggtgtg

SEQ ID NO: 551066 - DNA, 25 bp, Rattus norvegicus
tacctcttccggaacatcacagtgg

SEQ ID NO: 551067 - DNA, 25 bp, Rattus norvegicus
tacctcttccggtacatcacagtgg

SEQ ID NO: 551068 - DNA, 25 bp, Rattus norvegicus
tacctcttcgctaaacagagcttca

SEQ ID NO: 551069 - DNA, 25 bp, Rattus norvegicus
tacctcttcgcttaacagagcttca

SEQ ID NO: 551070 - DNA, 25 bp, Rattus norvegicus
tacctcttcggtctcttgtgaagga

SEQ ID NO: 551071 - DNA, 25 bp, Rattus norvegicus
tacctcttcggtgtcttgtgaagga

SEQ ID NO: 551072 - DNA, 25 bp, Rattus norvegicus
tacctcttctctctagcctaaggaa

SEQ ID NO: 551073 - DNA, 25 bp, Rattus norvegicus
tacctcttctctgtagcctaaggaa

SEQ ID NO: 551074 - DNA, 25 bp, Rattus norvegicus
tacctcttgagaactctgaataaag

SEQ ID NO: 551075 - DNA, 25 bp, Rattus norvegicus
tacctcttgagatctctgaataaag

SEQ ID NO: 551076 - DNA, 25 bp, Rattus norvegicus
tacctcttgagccttgaactttgac

SEQ ID NO: 551077 - DNA, 25 bp, Rattus norvegicus
tacctcttgagcgttgaactttgac

SEQ ID NO: 551078 - DNA, 25 bp, Rattus norvegicus
tacctcttgtctcttatttatctgc

SEQ ID NO: 551079 - DNA, 25 bp, Rattus norvegicus
tacctcttgtctgttatttatctgc

SEQ ID NO: 551080 - DNA, 25 bp, Rattus norvegicus
tacctcttttggacttggagaccgc

SEQ ID NO: 551081 - DNA, 25 bp, Rattus norvegicus
tacctcttttggtcttggagaccgc

SEQ ID NO: 551082 - DNA, 25 bp, Rattus norvegicus
tacctgaaattccaccaaagcctgg

SEQ ID NO: 551083 - DNA, 25 bp, Rattus norvegicus
tacctgaaattcgaccaaagcctgg

SEQ ID NO: 551084 - DNA, 25 bp, Rattus norvegicus
tacctgaacgggacacacgaacctg

SEQ ID NO: 551085 - DNA, 25 bp, Rattus norvegicus
tacctgaacgggtcacacgaacctg

SEQ ID NO: 551086 - DNA, 25 bp, Rattus norvegicus
tacctgaaggtacacatcttgccca

SEQ ID NO: 551087 - DNA, 25 bp, Rattus norvegicus
tacctgaaggtagacatcttgccca

SEQ ID NO: 551088 - DNA, 25 bp, Rattus norvegicus
tacctgaattccagtggcctcattt

SEQ ID NO: 551089 - DNA, 25 bp, Rattus norvegicus
tacctgaattcctgtggcctcattt

SEQ ID NO: 551090 - DNA, 25 bp, Rattus norvegicus
tacctgacacatctggctgaaacca

SEQ ID NO: 551091 - DNA, 25 bp, Rattus norvegicus
tacctgacacatgtggctgaaacca

SEQ ID NO: 551092 - DNA, 25 bp, Rattus norvegicus
tacctgacaggtagtttcttggctc

SEQ ID NO: 551093 - DNA, 25 bp, Rattus norvegicus
tacctgacaggttgtttcttggctc

SEQ ID NO: 551094 - DNA, 25 bp, Rattus norvegicus
tacctgacagtaattcctcttttta

SEQ ID NO: 551095 - DNA, 25 bp, Rattus norvegicus
tacctgacagtatttcctcttttta

SEQ ID NO: 551096 - DNA, 25 bp, Rattus norvegicus
tacctgacccggaagcccatgacca

SEQ ID NO: 551097 - DNA, 25 bp, Rattus norvegicus
tacctgacccggtagcccatgacca

SEQ ID NO: 551098 - DNA, 25 bp, Rattus norvegicus
tacctgacgttcctctcaaagatta

SEQ ID NO: 551099 - DNA, 25 bp, Rattus norvegicus
tacctgacgttcgtctcaaagatta

SEQ ID NO: 551100 - DNA, 25 bp, Rattus norvegicus
tacctgactcacatgtagaatcctg

SEQ ID NO: 551101 - DNA, 25 bp, Rattus norvegicus
tacctgactcacttgtagaatcctg

SEQ ID NO: 551102 - DNA, 25 bp, Rattus norvegicus
tacctgactgctctgcgcaaagaaa

SEQ ID NO: 551103 - DNA, 25 bp, Rattus norvegicus
tacctgactgctgtgcgcaaagaaa

SEQ ID NO: 551104 - DNA, 25 bp, Rattus norvegicus
tacctgagcaggagggtcacatgca

SEQ ID NO: 551105 - DNA, 25 bp, Rattus norvegicus
tacctgagcaggtgggtcacatgca

SEQ ID NO: 551106 - DNA, 25 bp, Rattus norvegicus
tacctgagcctccttatttattttc

SEQ ID NO: 551107 - DNA, 25 bp, Rattus norvegicus
tacctgagcctcgttatttattttc

SEQ ID NO: 551108 - DNA, 25 bp, Rattus norvegicus
tacctgaggaaaatgtcttacgagc

SEQ ID NO: 551109 - DNA, 25 bp, Rattus norvegicus
tacctgaggaaattgtcttacgagc

SEQ ID NO: 551110 - DNA, 25 bp, Rattus norvegicus
tacctgaggagtctaatgcttgttt

SEQ ID NO: 551111 - DNA, 25 bp, Rattus norvegicus
tacctgaggagtgtaatgcttgttt

SEQ ID NO: 551112 - DNA, 25 bp, Rattus norvegicus
tacctgaggcttattggcaccacag

SEQ ID NO: 551113 - DNA, 25 bp, Rattus norvegicus
tacctgaggctttttggcaccacag

SEQ ID NO: 551114 - DNA, 25 bp, Rattus norvegicus
tacctgagggctaggcccttgaggt

SEQ ID NO: 551115 - DNA, 25 bp, Rattus norvegicus
tacctgagggcttggcccttgaggt

SEQ ID NO: 551116 - DNA, 25 bp, Rattus norvegicus
tacctgaggtatccagttcacacag

SEQ ID NO: 551117 - DNA, 25 bp, Rattus norvegicus
tacctgaggtatgcagttcacacag

SEQ ID NO: 551118 - DNA, 25 bp, Rattus norvegicus
tacctgatacatacctttctgctaa

SEQ ID NO: 551119 - DNA, 25 bp, Rattus norvegicus
tacctgatacattcctttctgctaa

SEQ ID NO: 551120 - DNA, 25 bp, Rattus norvegicus
tacctgatcggtattaacagtttat

SEQ ID NO: 551121 - DNA, 25 bp, Rattus norvegicus
tacctgatcggttttaacagtttat

SEQ ID NO: 551122 - DNA, 25 bp, Rattus norvegicus
tacctgatggttatgtttctcggat

SEQ ID NO: 551123 - DNA, 25 bp, Rattus norvegicus
tacctgatggttttgtttctcggat

SEQ ID NO: 551124 - DNA, 25 bp, Rattus norvegicus
tacctgattgttattcgtggcctga

SEQ ID NO: 551125 - DNA, 25 bp, Rattus norvegicus
tacctgattgtttttcgtggcctga

SEQ ID NO: 551126 - DNA, 25 bp, Rattus norvegicus
tacctgcacaggcactgtggtcatt

SEQ ID NO: 551127 - DNA, 25 bp, Rattus norvegicus
tacctgcacagggactgtggtcatt

SEQ ID NO: 551128 - DNA, 25 bp, Rattus norvegicus
tacctgcaccagcagaacgagcggc

SEQ ID NO: 551129 - DNA, 25 bp, Rattus norvegicus
tacctgcaccaggagaacgagcggc

SEQ ID NO: 551130 - DNA, 25 bp, Rattus norvegicus
tacctgcacctaccgaggtcaagaa

SEQ ID NO: 551131 - DNA, 25 bp, Rattus norvegicus
tacctgcacctagcgaggtcaagaa

SEQ ID NO: 551132 - DNA, 25 bp, Rattus norvegicus
tacctgcagcctcagcacttgagag

SEQ ID NO: 551133 - DNA, 25 bp, Rattus norvegicus
tacctgcagcctgagcacttgagag

SEQ ID NO: 551134 - DNA, 25 bp, Rattus norvegicus
tacctgcagctgcaacctggccagg

SEQ ID NO: 551135 - DNA, 25 bp, Rattus norvegicus
tacctgcagctggaacctggccagg

SEQ ID NO: 551136 - DNA, 25 bp, Rattus norvegicus
tacctgcagtttccctactacaaat

SEQ ID NO: 551137 - DNA, 25 bp, Rattus norvegicus
tacctgcagtttgcctactacaaat

SEQ ID NO: 551138 - DNA, 25 bp, Rattus norvegicus
tacctgcatcagattctcactaata

SEQ ID NO: 551139 - DNA, 25 bp, Rattus norvegicus
tacctgcatcagtttctcactaata

SEQ ID NO: 551140 - DNA, 25 bp, Rattus norvegicus
tacctgcatgctactgatctactac

SEQ ID NO: 551141 - DNA, 25 bp, Rattus norvegicus
tacctgcatgcttctgatctactac

SEQ ID NO: 551142 - DNA, 25 bp, Rattus norvegicus
tacctgccacgaactgtttactgag

SEQ ID NO: 551143 - DNA, 25 bp, Rattus norvegicus
tacctgccacgatctgtttactgag

SEQ ID NO: 551144 - DNA, 25 bp, Rattus norvegicus
tacctgcccaaaccctagtgagaaa

SEQ ID NO: 551145 - DNA, 25 bp, Rattus norvegicus
tacctgcccaaagcctagtgagaaa

SEQ ID NO: 551146 - DNA, 25 bp, Rattus norvegicus
tacctgcccctgattattggcagaa

SEQ ID NO: 551147 - DNA, 25 bp, Rattus norvegicus
tacctgcccctgtttattggcagaa

SEQ ID NO: 551148 - DNA, 25 bp, Rattus norvegicus
tacctgccctctagagtacagggat

SEQ ID NO: 551149 - DNA, 25 bp, Rattus norvegicus
tacctgccctcttgagtacagggat

SEQ ID NO: 551150 - DNA, 25 bp, Rattus norvegicus
tacctgccgaccagactacatagat

SEQ ID NO: 551151 - DNA, 25 bp, Rattus norvegicus
tacctgccgacctgactacatagat

SEQ ID NO: 551152 - DNA, 25 bp, Rattus norvegicus
tacctgccgggcaaaagagctcagc

SEQ ID NO: 551153 - DNA, 25 bp, Rattus norvegicus
tacctgccgggctaaagagctcagc

SEQ ID NO: 551154 - DNA, 25 bp, Rattus norvegicus
tacctgcctaacaggagaagctcaa

SEQ ID NO: 551155 - DNA, 25 bp, Rattus norvegicus
tacctgcctaactggagaagctcaa

SEQ ID NO: 551156 - DNA, 25 bp, Rattus norvegicus
tacctgcctacgacatctacaaatt

SEQ ID NO: 551157 - DNA, 25 bp, Rattus norvegicus
tacctgcctacgtcatctacaaatt

SEQ ID NO: 551158 - DNA, 25 bp, Rattus norvegicus
tacctgcctccgagtttcagtgaga

SEQ ID NO: 551159 - DNA, 25 bp, Rattus norvegicus
tacctgcctccgtgtttcagtgaga

SEQ ID NO: 551160 - DNA, 25 bp, Rattus norvegicus
tacctgcctggaagatttgatgctc

SEQ ID NO: 551161 - DNA, 25 bp, Rattus norvegicus
tacctgcctggatgatttgatgctc

SEQ ID NO: 551162 - DNA, 25 bp, Rattus norvegicus
tacctgcctgtcaatgaatcctttg

SEQ ID NO: 551163 - DNA, 25 bp, Rattus norvegicus
tacctgcctgtctatgaatcctttg

SEQ ID NO: 551164 - DNA, 25 bp, Rattus norvegicus
tacctgccttggagggtgctttgaa

SEQ ID NO: 551165 - DNA, 25 bp, Rattus norvegicus
tacctgccttggtgggtgctttgaa

SEQ ID NO: 551166 - DNA, 25 bp, Rattus norvegicus
tacctgccttttacctctgcaaaag

SEQ ID NO: 551167 - DNA, 25 bp, Rattus norvegicus
tacctgcctttttcctctgcaaaag

SEQ ID NO: 551168 - DNA, 25 bp, Rattus norvegicus
tacctgcgcatgctcacatgtgtat

SEQ ID NO: 551169 - DNA, 25 bp, Rattus norvegicus
tacctgcgcatggtcacatgtgtat

SEQ ID NO: 551170 - DNA, 25 bp, Rattus norvegicus
tacctgctagacctcgagggcatcg

SEQ ID NO: 551171 - DNA, 25 bp, Rattus norvegicus
tacctgctagacgtcgagggcatcg

SEQ ID NO: 551172 - DNA, 25 bp, Rattus norvegicus
tacctgctcagcacatgacacatgc

SEQ ID NO: 551173 - DNA, 25 bp, Rattus norvegicus
tacctgctcagctcatgacacatgc

SEQ ID NO: 551174 - DNA, 25 bp, Rattus norvegicus
tacctgctcatacatacttcttttg

SEQ ID NO: 551175 - DNA, 25 bp, Rattus norvegicus
tacctgctcatagatacttcttttg

SEQ ID NO: 551176 - DNA, 25 bp, Rattus norvegicus
tacctgctccgtcgacttgaaattg

SEQ ID NO: 551177 - DNA, 25 bp, Rattus norvegicus
tacctgctccgtggacttgaaattg

SEQ ID NO: 551178 - DNA, 25 bp, Rattus norvegicus
tacctgctgaggccgggagagtaca

SEQ ID NO: 551179 - DNA, 25 bp, Rattus norvegicus
tacctgctgagggcgggagagtaca

SEQ ID NO: 551180 - DNA, 25 bp, Rattus norvegicus
tacctgctgccgctggccgtggtga

SEQ ID NO: 551181 - DNA, 25 bp, Rattus norvegicus
tacctgctgccggtggccgtggtga

SEQ ID NO: 551182 - DNA, 25 bp, Rattus norvegicus
tacctgctgctaaacctgacttaca

SEQ ID NO: 551183 - DNA, 25 bp, Rattus norvegicus
tacctgctgctatacctgacttaca

SEQ ID NO: 551184 - DNA, 25 bp, Rattus norvegicus
tacctgctgctgacacagtatattc

SEQ ID NO: 551185 - DNA, 25 bp, Rattus norvegicus
tacctgctgctgtcacagtatattc

SEQ ID NO: 551186 - DNA, 25 bp, Rattus norvegicus
tacctgctggttatcatccgtggcg

SEQ ID NO: 551187 - DNA, 25 bp, Rattus norvegicus
tacctgctggttttcatccgtggcg

SEQ ID NO: 551188 - DNA, 25 bp, Rattus norvegicus
tacctgctgtaacacccaccatgaa

SEQ ID NO: 551189 - DNA, 25 bp, Rattus norvegicus
tacctgctgtaagacccaccatgaa

SEQ ID NO: 551190 - DNA, 25 bp, Rattus norvegicus
tacctgctgtgtccagtcctcagag

SEQ ID NO: 551191 - DNA, 25 bp, Rattus norvegicus
tacctgctgtgtgcagtcctcagag

SEQ ID NO: 551192 - DNA, 25 bp, Rattus norvegicus
tacctgctgtttcctacatgtcttc

SEQ ID NO: 551193 - DNA, 25 bp, Rattus norvegicus
tacctgctgtttgctacatgtcttc

SEQ ID NO: 551194 - DNA, 25 bp, Rattus norvegicus
tacctgcttccaattttaacttggg

SEQ ID NO: 551195 - DNA, 25 bp, Rattus norvegicus
tacctgcttccatttttaacttggg

SEQ ID NO: 551196 - DNA, 25 bp, Rattus norvegicus
tacctgcttccccaaactaacaagg

SEQ ID NO: 551197 - DNA, 25 bp, Rattus norvegicus
tacctgcttcccgaaactaacaagg

SEQ ID NO: 551198 - DNA, 25 bp, Rattus norvegicus
tacctgcttgtaatcctgtgactca

SEQ ID NO: 551199 - DNA, 25 bp, Rattus norvegicus
tacctgcttgtattcctgtgactca

SEQ ID NO: 551200 - DNA, 25 bp, Rattus norvegicus
tacctgcttgttatgggccccaggg

SEQ ID NO: 551201 - DNA, 25 bp, Rattus norvegicus
tacctgcttgttttgggccccaggg

SEQ ID NO: 551202 - DNA, 25 bp, Rattus norvegicus
tacctgctttctcttacctactaaa

SEQ ID NO: 551203 - DNA, 25 bp, Rattus norvegicus
tacctgctttctgttacctactaaa

SEQ ID NO: 551204 - DNA, 25 bp, Rattus norvegicus
tacctgcttttcaagtgttgcctta

SEQ ID NO: 551205 - DNA, 25 bp, Rattus norvegicus
tacctgcttttctagtgttgcctta

SEQ ID NO: 551206 - DNA, 25 bp, Rattus norvegicus
tacctggaacttaagtacgtggcgt

SEQ ID NO: 551207 - DNA, 25 bp, Rattus norvegicus
tacctggaactttagtacgtggcgt

SEQ ID NO: 551208 - DNA, 25 bp, Rattus norvegicus
tacctggaatatcagcggagccttt

SEQ ID NO: 551209 - DNA, 25 bp, Rattus norvegicus
tacctggaatatgagcggagccttt

SEQ ID NO: 551210 - DNA, 25 bp, Rattus norvegicus
tacctggacaagagattagactgca

SEQ ID NO: 551211 - DNA, 25 bp, Rattus norvegicus
tacctggacaagtgattagactgca

SEQ ID NO: 551212 - DNA, 25 bp, Rattus norvegicus
tacctggacagcacccttcgtcagt

SEQ ID NO: 551213 - DNA, 25 bp, Rattus norvegicus
tacctggacagctcccttcgtcagt

SEQ ID NO: 551214 - DNA, 25 bp, Rattus norvegicus
tacctggactatcaggctgggcgcc

SEQ ID NO: 551215 - DNA, 25 bp, Rattus norvegicus
tacctggactatgaggctgggcgcc

SEQ ID NO: 551216 - DNA, 25 bp, Rattus norvegicus
tacctggagacacgcttggctgact

SEQ ID NO: 551217 - DNA, 25 bp, Rattus norvegicus
tacctggagacaggcttggctgact

SEQ ID NO: 551218 - DNA, 25 bp, Rattus norvegicus
tacctggagcagagctgagcccttc

SEQ ID NO: 551219 - DNA, 25 bp, Rattus norvegicus
tacctggagcagtgctgagcccttc

SEQ ID NO: 551220 - DNA, 25 bp, Rattus norvegicus
tacctggagcgccagctcggaacga

SEQ ID NO: 551221 - DNA, 25 bp, Rattus norvegicus
tacctggagcgcgagctcggaacga

SEQ ID NO: 551222 - DNA, 25 bp, Rattus norvegicus
tacctggagctgcatgttttataag

SEQ ID NO: 551223 - DNA, 25 bp, Rattus norvegicus
tacctggagctggatgttttataag

SEQ ID NO: 551224 - DNA, 25 bp, Rattus norvegicus
tacctggagggccattctctgggtc

SEQ ID NO: 551225 - DNA, 25 bp, Rattus norvegicus
tacctggagggcgattctctgggtc

SEQ ID NO: 551226 - DNA, 25 bp, Rattus norvegicus
tacctggattttacatttctcacaa

SEQ ID NO: 551227 - DNA, 25 bp, Rattus norvegicus
tacctggatttttcatttctcacaa

SEQ ID NO: 551228 - DNA, 25 bp, Rattus norvegicus
tacctggccactcctgtttggatga

SEQ ID NO: 551229 - DNA, 25 bp, Rattus norvegicus
tacctggccactgctgtttggatga

SEQ ID NO: 551230 - DNA, 25 bp, Rattus norvegicus
tacctggccctcaacaagcagatga

SEQ ID NO: 551231 - DNA, 25 bp, Rattus norvegicus
tacctggccctctacaagcagatga

SEQ ID NO: 551232 - DNA, 25 bp, Rattus norvegicus
tacctggccttcaggaaaacaacaa

SEQ ID NO: 551233 - DNA, 25 bp, Rattus norvegicus
tacctggccttctggaaaacaacaa

SEQ ID NO: 551234 - DNA, 25 bp, Rattus norvegicus
tacctggcctttatggagaatatta

SEQ ID NO: 551235 - DNA, 25 bp, Rattus norvegicus
tacctggcctttttggagaatatta

SEQ ID NO: 551236 - DNA, 25 bp, Rattus norvegicus
tacctggctagacacacttgcacca

SEQ ID NO: 551237 - DNA, 25 bp, Rattus norvegicus
tacctggctagagacacttgcacca

SEQ ID NO: 551238 - DNA, 25 bp, Rattus norvegicus
tacctggctgatattatggagtgtc

SEQ ID NO: 551239 - DNA, 25 bp, Rattus norvegicus
tacctggctgattttatggagtgtc

SEQ ID NO: 551240 - DNA, 25 bp, Rattus norvegicus
tacctggctgcgcaccaagcagaac

SEQ ID NO: 551241 - DNA, 25 bp, Rattus norvegicus
tacctggctgcggaccaagcagaac

SEQ ID NO: 551242 - DNA, 25 bp, Rattus norvegicus
tacctggctgctccaggacatggag

SEQ ID NO: 551243 - DNA, 25 bp, Rattus norvegicus
tacctggctgctgcaggacatggag

SEQ ID NO: 551244 - DNA, 25 bp, Rattus norvegicus
tacctggctggaccctttgccattg

SEQ ID NO: 551245 - DNA, 25 bp, Rattus norvegicus
tacctggctggagcctttgccattg

SEQ ID NO: 551246 - DNA, 25 bp, Rattus norvegicus
tacctggcttacaacccaagtctgt

SEQ ID NO: 551247 - DNA, 25 bp, Rattus norvegicus
tacctggcttactacccaagtctgt

SEQ ID NO: 551248 - DNA, 25 bp, Rattus norvegicus
tacctggcttcactgtttagaacac

SEQ ID NO: 551249 - DNA, 25 bp, Rattus norvegicus
tacctggcttcagtgtttagaacac

SEQ ID NO: 551250 - DNA, 25 bp, Rattus norvegicus
tacctggcttttcaatagactggag

SEQ ID NO: 551251 - DNA, 25 bp, Rattus norvegicus
tacctggcttttgaatagactggag

SEQ ID NO: 551252 - DNA, 25 bp, Rattus norvegicus
tacctgggacacaccatgactggat

SEQ ID NO: 551253 - DNA, 25 bp, Rattus norvegicus
tacctgggacactccatgactggat

SEQ ID NO: 551254 - DNA, 25 bp, Rattus norvegicus
tacctgggactcatacttgcagcaa

SEQ ID NO: 551255 - DNA, 25 bp, Rattus norvegicus
tacctgggactcttacttgcagcaa

SEQ ID NO: 551256 - DNA, 25 bp, Rattus norvegicus
tacctgggagtgactaggcacagct

SEQ ID NO: 551257 - DNA, 25 bp, Rattus norvegicus
tacctgggagtgtctaggcacagct

SEQ ID NO: 551258 - DNA, 25 bp, Rattus norvegicus
tacctgggatgtacgcatcacgaca

SEQ ID NO: 551259 - DNA, 25 bp, Rattus norvegicus
tacctgggatgttcgcatcacgaca

SEQ ID NO: 551260 - DNA, 25 bp, Rattus norvegicus
tacctgggcgctcacctgtcagtga

SEQ ID NO: 551261 - DNA, 25 bp, Rattus norvegicus
tacctgggcgctgacctgtcagtga

SEQ ID NO: 551262 - DNA, 25 bp, Rattus norvegicus
tacctgggtctgctacaggcagagt

SEQ ID NO: 551263 - DNA, 25 bp, Rattus norvegicus
tacctgggtctggtacaggcagagt

SEQ ID NO: 551264 - DNA, 25 bp, Rattus norvegicus
tacctgggtggaactgctctgggca

SEQ ID NO: 551265 - DNA, 25 bp, Rattus norvegicus
tacctgggtggatctgctctgggca

SEQ ID NO: 551266 - DNA, 25 bp, Rattus norvegicus
tacctggtaaggcacaatggatcaa

SEQ ID NO: 551267 - DNA, 25 bp, Rattus norvegicus
tacctggtaagggacaatggatcaa

SEQ ID NO: 551268 - DNA, 25 bp, Rattus norvegicus
tacctggtcaccattacagctgatg

SEQ ID NO: 551269 - DNA, 25 bp, Rattus norvegicus
tacctggtcacctttacagctgatg

SEQ ID NO: 551270 - DNA, 25 bp, Rattus norvegicus
tacctggtcacgatctactgtctgt

SEQ ID NO: 551271 - DNA, 25 bp, Rattus norvegicus
tacctggtcacgttctactgtctgt

SEQ ID NO: 551272 - DNA, 25 bp, Rattus norvegicus
tacctggtccagagctttgacagga

SEQ ID NO: 551273 - DNA, 25 bp, Rattus norvegicus
tacctggtccagtgctttgacagga

SEQ ID NO: 551274 - DNA, 25 bp, Rattus norvegicus
tacctggtccgcaaagggatgccat

SEQ ID NO: 551275 - DNA, 25 bp, Rattus norvegicus
tacctggtccgctaagggatgccat

SEQ ID NO: 551276 - DNA, 25 bp, Rattus norvegicus
tacctggtccttctaactgtgcatt

SEQ ID NO: 551277 - DNA, 25 bp, Rattus norvegicus
tacctggtccttgtaactgtgcatt

SEQ ID NO: 551278 - DNA, 25 bp, Rattus norvegicus
tacctggtcgtgaaggagactcacc

SEQ ID NO: 551279 - DNA, 25 bp, Rattus norvegicus
tacctggtcgtgtaggagactcacc

SEQ ID NO: 551280 - DNA, 25 bp, Rattus norvegicus
tacctggtgctcagctatgtcaatg

SEQ ID NO: 551281 - DNA, 25 bp, Rattus norvegicus
tacctggtgctctgctatgtcaatg

SEQ ID NO: 551282 - DNA, 25 bp, Rattus norvegicus
tacctggtggctcagaagacctccc

SEQ ID NO: 551283 - DNA, 25 bp, Rattus norvegicus
tacctggtggctgagaagacctccc

SEQ ID NO: 551284 - DNA, 25 bp, Rattus norvegicus
tacctggttggtactagactctaaa

SEQ ID NO: 551285 - DNA, 25 bp, Rattus norvegicus
tacctggttggttctagactctaaa

SEQ ID NO: 551286 - DNA, 25 bp, Rattus norvegicus
tacctggtttgtatctgcttttaag

SEQ ID NO: 551287 - DNA, 25 bp, Rattus norvegicus
tacctggtttgtttctgcttttaag

SEQ ID NO: 551288 - DNA, 25 bp, Rattus norvegicus
tacctggttttgctatggctgtaaa

SEQ ID NO: 551289 - DNA, 25 bp, Rattus norvegicus
tacctggttttggtatggctgtaaa

SEQ ID NO: 551290 - DNA, 25 bp, Rattus norvegicus
tacctgtaattccttttcctgcaaa

SEQ ID NO: 551291 - DNA, 25 bp, Rattus norvegicus
tacctgtaattcgttttcctgcaaa

SEQ ID NO: 551292 - DNA, 25 bp, Rattus norvegicus
tacctgtacactaaaacccctgttg

SEQ ID NO: 551293 - DNA, 25 bp, Rattus norvegicus
tacctgtacacttaaacccctgttg

SEQ ID NO: 551294 - DNA, 25 bp, Rattus norvegicus
tacctgtacgcccaggtagctgccg

SEQ ID NO: 551295 - DNA, 25 bp, Rattus norvegicus
tacctgtacgccgaggtagctgccg

SEQ ID NO: 551296 - DNA, 25 bp, Rattus norvegicus
tacctgtacggaaagttattcccag

SEQ ID NO: 551297 - DNA, 25 bp, Rattus norvegicus
tacctgtacggatagttattcccag

SEQ ID NO: 551298 - DNA, 25 bp, Rattus norvegicus
tacctgtcacttacccaggaacaat

SEQ ID NO: 551299 - DNA, 25 bp, Rattus norvegicus
tacctgtcactttcccaggaacaat

SEQ ID NO: 551300 - DNA, 25 bp, Rattus norvegicus
tacctgtcagacctggagctcccta

SEQ ID NO: 551301 - DNA, 25 bp, Rattus norvegicus
tacctgtcagacgtggagctcccta

SEQ ID NO: 551302 - DNA, 25 bp, Rattus norvegicus
tacctgtcctccaggagattctcga

SEQ ID NO: 551303 - DNA, 25 bp, Rattus norvegicus
tacctgtcctcctggagattctcga

SEQ ID NO: 551304 - DNA, 25 bp, Rattus norvegicus
tacctgtcctggaagctgctgtctt

SEQ ID NO: 551305 - DNA, 25 bp, Rattus norvegicus
tacctgtcctggtagctgctgtctt

SEQ ID NO: 551306 - DNA, 25 bp, Rattus norvegicus
tacctgtctaggctggagagttcta

SEQ ID NO: 551307 - DNA, 25 bp, Rattus norvegicus
tacctgtctagggtggagagttcta

SEQ ID NO: 551308 - DNA, 25 bp, Rattus norvegicus
tacctgtctggcaaggtgtggccag

SEQ ID NO: 551309 - DNA, 25 bp, Rattus norvegicus
tacctgtctggctaggtgtggccag

SEQ ID NO: 551310 - DNA, 25 bp, Rattus norvegicus
tacctgtctgtgaagtgtctgaact

SEQ ID NO: 551311 - DNA, 25 bp, Rattus norvegicus
tacctgtctgtgtagtgtctgaact

SEQ ID NO: 551312 - DNA, 25 bp, Rattus norvegicus
tacctgtgacagatgttggcagcta

SEQ ID NO: 551313 - DNA, 25 bp, Rattus norvegicus
tacctgtgacagttgttggcagcta

SEQ ID NO: 551314 - DNA, 25 bp, Rattus norvegicus
tacctgtgacatccttcttctcaaa

SEQ ID NO: 551315 - DNA, 25 bp, Rattus norvegicus
tacctgtgacatgcttcttctcaaa

SEQ ID NO: 551316 - DNA, 25 bp, Rattus norvegicus
tacctgtgctgtatggagtggctca

SEQ ID NO: 551317 - DNA, 25 bp, Rattus norvegicus
tacctgtgctgtttggagtggctca

SEQ ID NO: 551318 - DNA, 25 bp, Rattus norvegicus
tacctgtggaggatattcttattca

SEQ ID NO: 551319 - DNA, 25 bp, Rattus norvegicus
tacctgtggaggttattcttattca

SEQ ID NO: 551320 - DNA, 25 bp, Rattus norvegicus
tacctgtggcacagccattggcggg

SEQ ID NO: 551321 - DNA, 25 bp, Rattus norvegicus
tacctgtggcactgccattggcggg

SEQ ID NO: 551322 - DNA, 25 bp, Rattus norvegicus
tacctgtggccaccaaagggacata

SEQ ID NO: 551323 - DNA, 25 bp, Rattus norvegicus
tacctgtggccagcaaagggacata

SEQ ID NO: 551324 - DNA, 25 bp, Rattus norvegicus
tacctgtggttcattatccccaaat

SEQ ID NO: 551325 - DNA, 25 bp, Rattus norvegicus
tacctgtggttctttatccccaaat

SEQ ID NO: 551326 - DNA, 25 bp, Rattus norvegicus
tacctgtgtattctgtgctctcaaa

SEQ ID NO: 551327 - DNA, 25 bp, Rattus norvegicus
tacctgtgtattgtgtgctctcaaa

SEQ ID NO: 551328 - DNA, 25 bp, Rattus norvegicus
tacctgtgttacatttccatactgc

SEQ ID NO: 551329 - DNA, 25 bp, Rattus norvegicus
tacctgtgttacttttccatactgc

SEQ ID NO: 551330 - DNA, 25 bp, Rattus norvegicus
tacctgttagtacctgatgagagag

SEQ ID NO: 551331 - DNA, 25 bp, Rattus norvegicus
tacctgttagtagctgatgagagag

SEQ ID NO: 551332 - DNA, 25 bp, Rattus norvegicus
tacctgttcacgaccgagttgtacc

SEQ ID NO: 551333 - DNA, 25 bp, Rattus norvegicus
tacctgttcacgtccgagttgtacc

SEQ ID NO: 551334 - DNA, 25 bp, Rattus norvegicus
tacctgttgcctcagcttggtgaga

SEQ ID NO: 551335 - DNA, 25 bp, Rattus norvegicus
tacctgttgcctgagcttggtgaga

SEQ ID NO: 551336 - DNA, 25 bp, Rattus norvegicus
tacctgttgggcagtgcacaagtgg

SEQ ID NO: 551337 - DNA, 25 bp, Rattus norvegicus
tacctgttgggctgtgcacaagtgg

SEQ ID NO: 551338 - DNA, 25 bp, Rattus norvegicus
tacctgttgtcacggagtctcctat

SEQ ID NO: 551339 - DNA, 25 bp, Rattus norvegicus
tacctgttgtcagggagtctcctat

SEQ ID NO: 551340 - DNA, 25 bp, Rattus norvegicus
tacctgttgtttaaagccattgctg

SEQ ID NO: 551341 - DNA, 25 bp, Rattus norvegicus
tacctgttgttttaagccattgctg

SEQ ID NO: 551342 - DNA, 25 bp, Rattus norvegicus
tacctgtttaccagagaaggcccca

SEQ ID NO: 551343 - DNA, 25 bp, Rattus norvegicus
tacctgtttacctgagaaggcccca

SEQ ID NO: 551344 - DNA, 25 bp, Rattus norvegicus
tacctgtttatcatcttctgtgtgt

SEQ ID NO: 551345 - DNA, 25 bp, Rattus norvegicus
tacctgtttatcttcttctgtgtgt

SEQ ID NO: 551346 - DNA, 25 bp, Rattus norvegicus
tacctgtttcatcctcttggatgac

SEQ ID NO: 551347 - DNA, 25 bp, Rattus norvegicus
tacctgtttcatgctcttggatgac

SEQ ID NO: 551348 - DNA, 25 bp, Rattus norvegicus
tacctgtttgatcggtgttaaagct

SEQ ID NO: 551349 - DNA, 25 bp, Rattus norvegicus
tacctgtttgatgggtgttaaagct

SEQ ID NO: 551350 - DNA, 25 bp, Rattus norvegicus
taccttaaatcaattctgtcctccc

SEQ ID NO: 551351 - DNA, 25 bp, Rattus norvegicus
taccttaaatcatttctgtcctccc

SEQ ID NO: 551352 - DNA, 25 bp, Rattus norvegicus
taccttaaggcacttgaaacactgt

SEQ ID NO: 551353 - DNA, 25 bp, Rattus norvegicus
taccttaaggcagttgaaacactgt

SEQ ID NO: 551354 - DNA, 25 bp, Rattus norvegicus
taccttaatcgcattcattctgtgg

SEQ ID NO: 551355 - DNA, 25 bp, Rattus norvegicus
taccttaatcgctttcattctgtgg

SEQ ID NO: 551356 - DNA, 25 bp, Rattus norvegicus
taccttaattctattctctaccctg

SEQ ID NO: 551357 - DNA, 25 bp, Rattus norvegicus
taccttaattcttttctctaccctg

SEQ ID NO: 551358 - DNA, 25 bp, Rattus norvegicus
taccttaattttctcgcccaaagag

SEQ ID NO: 551359 - DNA, 25 bp, Rattus norvegicus
taccttaattttgtcgcccaaagag

SEQ ID NO: 551360 - DNA, 25 bp, Rattus norvegicus
taccttacatatctatgcatgcatt

SEQ ID NO: 551361 - DNA, 25 bp, Rattus norvegicus
taccttacatatgtatgcatgcatt

SEQ ID NO: 551362 - DNA, 25 bp, Rattus norvegicus
taccttacctggcagtcttcaagaa

SEQ ID NO: 551363 - DNA, 25 bp, Rattus norvegicus
taccttacctgggagtcttcaagaa

SEQ ID NO: 551364 - DNA, 25 bp, Rattus norvegicus
taccttacgcacaatgtacttcgct

SEQ ID NO: 551365 - DNA, 25 bp, Rattus norvegicus
taccttacgcactatgtacttcgct

SEQ ID NO: 551366 - DNA, 25 bp, Rattus norvegicus
taccttacggctcgcttcatgataa

SEQ ID NO: 551367 - DNA, 25 bp, Rattus norvegicus
taccttacggctggcttcatgataa

SEQ ID NO: 551368 - DNA, 25 bp, Rattus norvegicus
taccttactggtcttgaggattcct

SEQ ID NO: 551369 - DNA, 25 bp, Rattus norvegicus
taccttactggtgttgaggattcct

SEQ ID NO: 551370 - DNA, 25 bp, Rattus norvegicus
taccttagccgtatacgcagtcagg

SEQ ID NO: 551371 - DNA, 25 bp, Rattus norvegicus
taccttagccgtttacgcagtcagg

SEQ ID NO: 551372 - DNA, 25 bp, Rattus norvegicus
taccttagcgtcatccttttgaact

SEQ ID NO: 551373 - DNA, 25 bp, Rattus norvegicus
taccttagcgtcttccttttgaact

SEQ ID NO: 551374 - DNA, 25 bp, Rattus norvegicus
taccttatccttataaggcctctgg

SEQ ID NO: 551375 - DNA, 25 bp, Rattus norvegicus
taccttatccttttaaggcctctgg

SEQ ID NO: 551376 - DNA, 25 bp, Rattus norvegicus
taccttattctgcaccagcttttac

SEQ ID NO: 551377 - DNA, 25 bp, Rattus norvegicus
taccttattctggaccagcttttac

SEQ ID NO: 551378 - DNA, 25 bp, Rattus norvegicus
taccttatttttctgcatggattgg

SEQ ID NO: 551379 - DNA, 25 bp, Rattus norvegicus
taccttatttttgtgcatggattgg

SEQ ID NO: 551380 - DNA, 25 bp, Rattus norvegicus
taccttcaactcattgtcaacactt

SEQ ID NO: 551381 - DNA, 25 bp, Rattus norvegicus
taccttcaactctttgtcaacactt

SEQ ID NO: 551382 - DNA, 25 bp, Rattus norvegicus
taccttcaagctctttatttcccct

SEQ ID NO: 551383 - DNA, 25 bp, Rattus norvegicus
taccttcaagctgtttatttcccct

SEQ ID NO: 551384 - DNA, 25 bp, Rattus norvegicus
taccttcacttaatgacttgctcct

SEQ ID NO: 551385 - DNA, 25 bp, Rattus norvegicus
taccttcacttattgacttgctcct

SEQ ID NO: 551386 - DNA, 25 bp, Rattus norvegicus
taccttcattttcgacacgagttgc

SEQ ID NO: 551387 - DNA, 25 bp, Rattus norvegicus
taccttcattttggacacgagttgc

SEQ ID NO: 551388 - DNA, 25 bp, Rattus norvegicus
taccttccagccataactcaatggt

SEQ ID NO: 551389 - DNA, 25 bp, Rattus norvegicus
taccttccagccttaactcaatggt

SEQ ID NO: 551390 - DNA, 25 bp, Rattus norvegicus
taccttccattcagcactggtccaa

SEQ ID NO: 551391 - DNA, 25 bp, Rattus norvegicus
taccttccattctgcactggtccaa

SEQ ID NO: 551392 - DNA, 25 bp, Rattus norvegicus
taccttcccaggaggtttgtgtgag

SEQ ID NO: 551393 - DNA, 25 bp, Rattus norvegicus
taccttcccaggtggtttgtgtgag

SEQ ID NO: 551394 - DNA, 25 bp, Rattus norvegicus
taccttcccataaccaaatgcgtgt

SEQ ID NO: 551395 - DNA, 25 bp, Rattus norvegicus
taccttcccatatccaaatgcgtgt

SEQ ID NO: 551396 - DNA, 25 bp, Rattus norvegicus
taccttccccagcacagtagagatt

SEQ ID NO: 551397 - DNA, 25 bp, Rattus norvegicus
taccttccccaggacagtagagatt

SEQ ID NO: 551398 - DNA, 25 bp, Rattus norvegicus
taccttccctccaagctggacaaga

SEQ ID NO: 551399 - DNA, 25 bp, Rattus norvegicus
taccttccctcctagctggacaaga

SEQ ID NO: 551400 - DNA, 25 bp, Rattus norvegicus
taccttcctcctaaagcagactttg

SEQ ID NO: 551401 - DNA, 25 bp, Rattus norvegicus
taccttcctccttaagcagactttg

SEQ ID NO: 551402 - DNA, 25 bp, Rattus norvegicus
taccttcctgacctgagcatattta

SEQ ID NO: 551403 - DNA, 25 bp, Rattus norvegicus
taccttcctgacgtgagcatattta

SEQ ID NO: 551404 - DNA, 25 bp, Rattus norvegicus
taccttcctggacacatgattcgat

SEQ ID NO: 551405 - DNA, 25 bp, Rattus norvegicus
taccttcctggagacatgattcgat

SEQ ID NO: 551406 - DNA, 25 bp, Rattus norvegicus
taccttcgtgacaggaattccgtag

SEQ ID NO: 551407 - DNA, 25 bp, Rattus norvegicus
taccttcgtgactggaattccgtag

SEQ ID NO: 551408 - DNA, 25 bp, Rattus norvegicus
taccttctactgagcggattctgag

SEQ ID NO: 551409 - DNA, 25 bp, Rattus norvegicus
taccttctactgtgcggattctgag

SEQ ID NO: 551410 - DNA, 25 bp, Rattus norvegicus
taccttctctctcaggcacttacaa

SEQ ID NO: 551411 - DNA, 25 bp, Rattus norvegicus
taccttctctctgaggcacttacaa

SEQ ID NO: 551412 - DNA, 25 bp, Rattus norvegicus
taccttctgaagaggacccagtcta

SEQ ID NO: 551413 - DNA, 25 bp, Rattus norvegicus
taccttctgaagtggacccagtcta

SEQ ID NO: 551414 - DNA, 25 bp, Rattus norvegicus
taccttctgtgtccttgtgctgaca

SEQ ID NO: 551415 - DNA, 25 bp, Rattus norvegicus
taccttctgtgtgcttgtgctgaca

SEQ ID NO: 551416 - DNA, 25 bp, Rattus norvegicus
taccttcttcaaccacatgaatgtg

SEQ ID NO: 551417 - DNA, 25 bp, Rattus norvegicus
taccttcttcaagcacatgaatgtg

SEQ ID NO: 551418 - DNA, 25 bp, Rattus norvegicus
taccttcttcgtcggcttcagcaat

SEQ ID NO: 551419 - DNA, 25 bp, Rattus norvegicus
taccttcttcgtgggcttcagcaat

SEQ ID NO: 551420 - DNA, 25 bp, Rattus norvegicus
taccttcttgccagatgtctttttt

SEQ ID NO: 551421 - DNA, 25 bp, Rattus norvegicus
taccttcttgcctgatgtctttttt

SEQ ID NO: 551422 - DNA, 25 bp, Rattus norvegicus
taccttgaacggaaccttagccatg

SEQ ID NO: 551423 - DNA, 25 bp, Rattus norvegicus
taccttgaacggtaccttagccatg

SEQ ID NO: 551424 - DNA, 25 bp, Rattus norvegicus
taccttgaaggtctctactgctgcc

SEQ ID NO: 551425 - DNA, 25 bp, Rattus norvegicus
taccttgaaggtgtctactgctgcc

SEQ ID NO: 551426 - DNA, 25 bp, Rattus norvegicus
taccttgacaaccacttgggcctgt

SEQ ID NO: 551427 - DNA, 25 bp, Rattus norvegicus
taccttgacaacgacttgggcctgt

SEQ ID NO: 551428 - DNA, 25 bp, Rattus norvegicus
taccttgagatcctgccctggcttt

SEQ ID NO: 551429 - DNA, 25 bp, Rattus norvegicus
taccttgagatcgtgccctggcttt

SEQ ID NO: 551430 - DNA, 25 bp, Rattus norvegicus
taccttgatttcatcttccgtgaca

SEQ ID NO: 551431 - DNA, 25 bp, Rattus norvegicus
taccttgatttcttcttccgtgaca

SEQ ID NO: 551432 - DNA, 25 bp, Rattus norvegicus
taccttgatttgcacagactttctg

SEQ ID NO: 551433 - DNA, 25 bp, Rattus norvegicus
taccttgatttggacagactttctg

SEQ ID NO: 551434 - DNA, 25 bp, Rattus norvegicus
taccttgcactcaagggccagacca

SEQ ID NO: 551435 - DNA, 25 bp, Rattus norvegicus
taccttgcactctagggccagacca

SEQ ID NO: 551436 - DNA, 25 bp, Rattus norvegicus
taccttgcagcactcatgtcctcgt

SEQ ID NO: 551437 - DNA, 25 bp, Rattus norvegicus
taccttgcagcagtcatgtcctcgt

SEQ ID NO: 551438 - DNA, 25 bp, Rattus norvegicus
taccttgccgaactctttactaaag

SEQ ID NO: 551439 - DNA, 25 bp, Rattus norvegicus
taccttgccgaagtctttactaaag

SEQ ID NO: 551440 - DNA, 25 bp, Rattus norvegicus
taccttgcgttcctaagattatcaa

SEQ ID NO: 551441 - DNA, 25 bp, Rattus norvegicus
taccttgcgttcgtaagattatcaa

SEQ ID NO: 551442 - DNA, 25 bp, Rattus norvegicus
taccttgctctgagacccaggcaga

SEQ ID NO: 551443 - DNA, 25 bp, Rattus norvegicus
taccttgctctgtgacccaggcaga

SEQ ID NO: 551444 - DNA, 25 bp, Rattus norvegicus
taccttgctggcaaatgccatagct

SEQ ID NO: 551445 - DNA, 25 bp, Rattus norvegicus
taccttgctggcatttctagattct

SEQ ID NO: 551446 - DNA, 25 bp, Rattus norvegicus
taccttgctggctaatgccatagct

SEQ ID NO: 551447 - DNA, 25 bp, Rattus norvegicus
taccttgctggcttttctagattct

SEQ ID NO: 551448 - DNA, 25 bp, Rattus norvegicus
taccttggctgtcgccatggacaca

SEQ ID NO: 551449 - DNA, 25 bp, Rattus norvegicus
taccttggctgtggccatggacaca

SEQ ID NO: 551450 - DNA, 25 bp, Rattus norvegicus
taccttgggtttctgcatgttttct

SEQ ID NO: 551451 - DNA, 25 bp, Rattus norvegicus
taccttgggtttgtgcatgttttct

SEQ ID NO: 551452 - DNA, 25 bp, Rattus norvegicus
taccttggtacgcagctaggacctt

SEQ ID NO: 551453 - DNA, 25 bp, Rattus norvegicus
taccttggtacggagctaggacctt

SEQ ID NO: 551454 - DNA, 25 bp, Rattus norvegicus
taccttggtcttatggtcatcctaa

SEQ ID NO: 551455 - DNA, 25 bp, Rattus norvegicus
taccttggtcttttggtcatcctaa

SEQ ID NO: 551456 - DNA, 25 bp, Rattus norvegicus
taccttggttcacatacagcagctt

SEQ ID NO: 551457 - DNA, 25 bp, Rattus norvegicus
taccttggttcagatacagcagctt

SEQ ID NO: 551458 - DNA, 25 bp, Rattus norvegicus
taccttgtaaagaggatgctgcctt

SEQ ID NO: 551459 - DNA, 25 bp, Rattus norvegicus
taccttgtaaagtggatgctgcctt

SEQ ID NO: 551460 - DNA, 25 bp, Rattus norvegicus
taccttgtacccctggcttttgttg

SEQ ID NO: 551461 - DNA, 25 bp, Rattus norvegicus
taccttgtacccgtggcttttgttg

SEQ ID NO: 551462 - DNA, 25 bp, Rattus norvegicus
taccttgtagatagtactcggcccc

SEQ ID NO: 551463 - DNA, 25 bp, Rattus norvegicus
taccttgtagattgtactcggcccc

SEQ ID NO: 551464 - DNA, 25 bp, Rattus norvegicus
taccttgtagcccagtgctttgagt

SEQ ID NO: 551465 - DNA, 25 bp, Rattus norvegicus
taccttgtagccgagtgctttgagt

SEQ ID NO: 551466 - DNA, 25 bp, Rattus norvegicus
taccttgtaggtaacaggctgaccc

SEQ ID NO: 551467 - DNA, 25 bp, Rattus norvegicus
taccttgtaggttacaggctgaccc

SEQ ID NO: 551468 - DNA, 25 bp, Rattus norvegicus
taccttgtctctccaagttggacag

SEQ ID NO: 551469 - DNA, 25 bp, Rattus norvegicus
taccttgtctctgcaagttggacag

SEQ ID NO: 551470 - DNA, 25 bp, Rattus norvegicus
taccttgtctttccatcgtatggct

SEQ ID NO: 551471 - DNA, 25 bp, Rattus norvegicus
taccttgtctttgcatcgtatggct

SEQ ID NO: 551472 - DNA, 25 bp, Rattus norvegicus
taccttgtgcagagcctgttaggac

SEQ ID NO: 551473 - DNA, 25 bp, Rattus norvegicus
taccttgtgcagtgcctgttaggac

SEQ ID NO: 551474 - DNA, 25 bp, Rattus norvegicus
taccttgtgcatctctgggattgaa

SEQ ID NO: 551475 - DNA, 25 bp, Rattus norvegicus
taccttgtgcatgtctgggattgaa

SEQ ID NO: 551476 - DNA, 25 bp, Rattus norvegicus
taccttgtggtaatggctcctttta

SEQ ID NO: 551477 - DNA, 25 bp, Rattus norvegicus
taccttgtggtattggctcctttta

SEQ ID NO: 551478 - DNA, 25 bp, Rattus norvegicus
taccttgtggtcaacctgcgactgc

SEQ ID NO: 551479 - DNA, 25 bp, Rattus norvegicus
taccttgtggtctacctgcgactgc

SEQ ID NO: 551480 - DNA, 25 bp, Rattus norvegicus
taccttgtggtgaccgattccggca

SEQ ID NO: 551481 - DNA, 25 bp, Rattus norvegicus
taccttgtggtgtccgattccggca

SEQ ID NO: 551482 - DNA, 25 bp, Rattus norvegicus
taccttgtgtaactggctttgtctc

SEQ ID NO: 551483 - DNA, 25 bp, Rattus norvegicus
taccttgtgtaagtggctttgtctc

SEQ ID NO: 551484 - DNA, 25 bp, Rattus norvegicus
taccttgttcccatgttgcttttga

SEQ ID NO: 551485 - DNA, 25 bp, Rattus norvegicus
taccttgttcccttgttgcttttga

SEQ ID NO: 551486 - DNA, 25 bp, Rattus norvegicus
taccttgttcctcgcgctgacatta

SEQ ID NO: 551487 - DNA, 25 bp, Rattus norvegicus
taccttgttcctggcgctgacatta

SEQ ID NO: 551488 - DNA, 25 bp, Rattus norvegicus
taccttgtttaaattgtgcatgcat

SEQ ID NO: 551489 - DNA, 25 bp, Rattus norvegicus
taccttgtttaatttgtgcatgcat

SEQ ID NO: 551490 - DNA, 25 bp, Rattus norvegicus
tacctttaatctagttctgttagaa

SEQ ID NO: 551491 - DNA, 25 bp, Rattus norvegicus
tacctttaatcttgttctgttagaa

SEQ ID NO: 551492 - DNA, 25 bp, Rattus norvegicus
tacctttacaggatgttacaaatgt

SEQ ID NO: 551493 - DNA, 25 bp, Rattus norvegicus
tacctttacaggttgttacaaatgt

SEQ ID NO: 551494 - DNA, 25 bp, Rattus norvegicus
tacctttaggcacattcaagtcaac

SEQ ID NO: 551495 - DNA, 25 bp, Rattus norvegicus
tacctttaggcagattcaagtcaac

SEQ ID NO: 551496 - DNA, 25 bp, Rattus norvegicus
tacctttcaaggaaaggccagtgga

SEQ ID NO: 551497 - DNA, 25 bp, Rattus norvegicus
tacctttcaaggtaaggccagtgga

SEQ ID NO: 551498 - DNA, 25 bp, Rattus norvegicus
tacctttccaggatgtttcaccaat

SEQ ID NO: 551499 - DNA, 25 bp, Rattus norvegicus
tacctttccaggttgtttcaccaat

SEQ ID NO: 551500 - DNA, 25 bp, Rattus norvegicus
tacctttcccttctcaagtttgcta

SEQ ID NO: 551501 - DNA, 25 bp, Rattus norvegicus
tacctttcccttgtcaagtttgcta

SEQ ID NO: 551502 - DNA, 25 bp, Rattus norvegicus
tacctttcctacaactgagctgcag

SEQ ID NO: 551503 - DNA, 25 bp, Rattus norvegicus
tacctttcctactactgagctgcag

SEQ ID NO: 551504 - DNA, 25 bp, Rattus norvegicus
tacctttcggtaatttctatctgtc

SEQ ID NO: 551505 - DNA, 25 bp, Rattus norvegicus
tacctttcggtattttctatctgtc

SEQ ID NO: 551506 - DNA, 25 bp, Rattus norvegicus
tacctttctcaccacagtatctaga

SEQ ID NO: 551507 - DNA, 25 bp, Rattus norvegicus
tacctttctcacgacagtatctaga

SEQ ID NO: 551508 - DNA, 25 bp, Rattus norvegicus
tacctttctgcgacgaccgtgaaga

SEQ ID NO: 551509 - DNA, 25 bp, Rattus norvegicus
tacctttctgcgtcgaccgtgaaga

SEQ ID NO: 551510 - DNA, 25 bp, Rattus norvegicus
tacctttcttgcatgtttttctttg

SEQ ID NO: 551511 - DNA, 25 bp, Rattus norvegicus
tacctttcttgcttgtttttctttg

SEQ ID NO: 551512 - DNA, 25 bp, Rattus norvegicus
tacctttgaacgattaaatacagat

SEQ ID NO: 551513 - DNA, 25 bp, Rattus norvegicus
tacctttgaacgtttaaatacagat

SEQ ID NO: 551514 - DNA, 25 bp, Rattus norvegicus
tacctttgccctaccaggcaaggca

SEQ ID NO: 551515 - DNA, 25 bp, Rattus norvegicus
tacctttgcccttccaggcaaggca

SEQ ID NO: 551516 - DNA, 25 bp, Rattus norvegicus
tacctttgcctgcttttttctggtt

SEQ ID NO: 551517 - DNA, 25 bp, Rattus norvegicus
tacctttgcctggttttttctggtt

SEQ ID NO: 551518 - DNA, 25 bp, Rattus norvegicus
tacctttggccgatttgctaagact

SEQ ID NO: 551519 - DNA, 25 bp, Rattus norvegicus
tacctttggccgttttgctaagact

SEQ ID NO: 551520 - DNA, 25 bp, Rattus norvegicus
tacctttggctgctaaataccctga

SEQ ID NO: 551521 - DNA, 25 bp, Rattus norvegicus
tacctttggctggtaaataccctga

SEQ ID NO: 551522 - DNA, 25 bp, Rattus norvegicus
tacctttgtagaagtcacctgtgcc

SEQ ID NO: 551523 - DNA, 25 bp, Rattus norvegicus
tacctttgtagatgtcacctgtgcc

SEQ ID NO: 551524 - DNA, 25 bp, Rattus norvegicus
tacctttgtgctcgtgggactcaaa

SEQ ID NO: 551525 - DNA, 25 bp, Rattus norvegicus
tacctttgtgctggtgggactcaaa

SEQ ID NO: 551526 - DNA, 25 bp, Rattus norvegicus
tacctttgtggcaagcccgatgtgg

SEQ ID NO: 551527 - DNA, 25 bp, Rattus norvegicus
tacctttgtggctagcccgatgtgg

SEQ ID NO: 551528 - DNA, 25 bp, Rattus norvegicus
taccttttaaccaatacctgcatgc

SEQ ID NO: 551529 - DNA, 25 bp, Rattus norvegicus
taccttttaacctatacctgcatgc

SEQ ID NO: 551530 - DNA, 25 bp, Rattus norvegicus
taccttttacccattcacctaattg

SEQ ID NO: 551531 - DNA, 25 bp, Rattus norvegicus
taccttttaccctttcacctaattg

SEQ ID NO: 551532 - DNA, 25 bp, Rattus norvegicus
taccttttacgtctgcaaactgtcc

SEQ ID NO: 551533 - DNA, 25 bp, Rattus norvegicus
taccttttacgtgtgcaaactgtcc

SEQ ID NO: 551534 - DNA, 25 bp, Rattus norvegicus
taccttttcactaactgcttctaat

SEQ ID NO: 551535 - DNA, 25 bp, Rattus norvegicus
taccttttcacttactgcttctaat

SEQ ID NO: 551536 - DNA, 25 bp, Rattus norvegicus
taccttttccctagtaagtatgaca

SEQ ID NO: 551537 - DNA, 25 bp, Rattus norvegicus
taccttttcccttgtaagtatgaca

SEQ ID NO: 551538 - DNA, 25 bp, Rattus norvegicus
taccttttgctgactcagagtgggt

SEQ ID NO: 551539 - DNA, 25 bp, Rattus norvegicus
taccttttgctgtctcagagtgggt

SEQ ID NO: 551540 - DNA, 25 bp, Rattus norvegicus
taccttttttaaatagttctgacag

SEQ ID NO: 551541 - DNA, 25 bp, Rattus norvegicus
taccttttttaattagttctgacag

SEQ ID NO: 551542 - DNA, 25 bp, Rattus norvegicus
tacgaaaaccaccttcctatgtttg

SEQ ID NO: 551543 - DNA, 25 bp, Rattus norvegicus
tacgaaaaccacgttcctatgtttg

SEQ ID NO: 551544 - DNA, 25 bp, Rattus norvegicus
tacgaaaccacgcaggactgccctt

SEQ ID NO: 551545 - DNA, 25 bp, Rattus norvegicus
tacgaaaccacggaggactgccctt

SEQ ID NO: 551546 - DNA, 25 bp, Rattus norvegicus
tacgaaagaattcaccctgctgctc

SEQ ID NO: 551547 - DNA, 25 bp, Rattus norvegicus
tacgaaagaattgaccctgctgctc

SEQ ID NO: 551548 - DNA, 25 bp, Rattus norvegicus
tacgaaatcaaacttcagccacctg

SEQ ID NO: 551549 - DNA, 25 bp, Rattus norvegicus
tacgaaatcaaagttcagccacctg

SEQ ID NO: 551550 - DNA, 25 bp, Rattus norvegicus
tacgaacaatccaggctcagctaca

SEQ ID NO: 551551 - DNA, 25 bp, Rattus norvegicus
tacgaacaatcctggctcagctaca

SEQ ID NO: 551552 - DNA, 25 bp, Rattus norvegicus
tacgaactttacaaccaagggtatg

SEQ ID NO: 551553 - DNA, 25 bp, Rattus norvegicus
tacgaactttactaccaagggtatg

SEQ ID NO: 551554 - DNA, 25 bp, Rattus norvegicus
tacgaagactccattgtcctccagt

SEQ ID NO: 551555 - DNA, 25 bp, Rattus norvegicus
tacgaagactcctttgtcctccagt

SEQ ID NO: 551556 - DNA, 25 bp, Rattus norvegicus
tacgaagagtacatgtcccggactg

SEQ ID NO: 551557 - DNA, 25 bp, Rattus norvegicus
tacgaagagtacttgtcccggactg

SEQ ID NO: 551558 - DNA, 25 bp, Rattus norvegicus
tacgaagattgccatggcctggaat

SEQ ID NO: 551559 - DNA, 25 bp, Rattus norvegicus
tacgaagattgcgatggcctggaat

SEQ ID NO: 551560 - DNA, 25 bp, Rattus norvegicus
tacgaagcctctacagtgagccttt

SEQ ID NO: 551561 - DNA, 25 bp, Rattus norvegicus
tacgaagcctcttcagtgagccttt

SEQ ID NO: 551562 - DNA, 25 bp, Rattus norvegicus
tacgaagctgaacatggtggtacat

SEQ ID NO: 551563 - DNA, 25 bp, Rattus norvegicus
tacgaagctgaagatggtggtacat

SEQ ID NO: 551564 - DNA, 25 bp, Rattus norvegicus
tacgaaggagtcaatgtggcatttt

SEQ ID NO: 551565 - DNA, 25 bp, Rattus norvegicus
tacgaaggagtctatgtggcatttt

SEQ ID NO: 551566 - DNA, 25 bp, Rattus norvegicus
tacgaaggtggaacttgtgtgtgca

SEQ ID NO: 551567 - DNA, 25 bp, Rattus norvegicus
tacgaaggtggatcttgtgtgtgca

SEQ ID NO: 551568 - DNA, 25 bp, Rattus norvegicus
tacgaagtgacgaccaccattgtcc

SEQ ID NO: 551569 - DNA, 25 bp, Rattus norvegicus
tacgaagtgacgcaggccaacggca

SEQ ID NO: 551570 - DNA, 25 bp, Rattus norvegicus
tacgaagtgacggaggccaacggca

SEQ ID NO: 551571 - DNA, 25 bp, Rattus norvegicus
tacgaagtgacgtccaccattgtcc

SEQ ID NO: 551572 - DNA, 25 bp, Rattus norvegicus
tacgaatcggttaggttagaggcca

SEQ ID NO: 551573 - DNA, 25 bp, Rattus norvegicus
tacgaatcggtttggttagaggcca

SEQ ID NO: 551574 - DNA, 25 bp, Rattus norvegicus
tacgaatgtccacgtctgtgttcct

SEQ ID NO: 551575 - DNA, 25 bp, Rattus norvegicus
tacgaatgtccaggtctgtgttcct

SEQ ID NO: 551576 - DNA, 25 bp, Rattus norvegicus
tacgaattcaaaccggatgccctgt

SEQ ID NO: 551577 - DNA, 25 bp, Rattus norvegicus
tacgaattcaaagcggatgccctgt

SEQ ID NO: 551578 - DNA, 25 bp, Rattus norvegicus
tacgaattctgcaacgaggccctag

SEQ ID NO: 551579 - DNA, 25 bp, Rattus norvegicus
tacgaattctgctacgaggccctag

SEQ ID NO: 551580 - DNA, 25 bp, Rattus norvegicus
tacgaattttgtacgagccgtctcg

SEQ ID NO: 551581 - DNA, 25 bp, Rattus norvegicus
tacgaattttgttcgagccgtctcg

SEQ ID NO: 551582 - DNA, 25 bp, Rattus norvegicus
tacgacagtgatctgcaaggcaaac

SEQ ID NO: 551583 - DNA, 25 bp, Rattus norvegicus
tacgacagtgatgtgcaaggcaaac

SEQ ID NO: 551584 - DNA, 25 bp, Rattus norvegicus
tacgacagtggtactttgactctta

SEQ ID NO: 551585 - DNA, 25 bp, Rattus norvegicus
tacgacagtggttctttgactctta

SEQ ID NO: 551586 - DNA, 25 bp, Rattus norvegicus
tacgacattagcagcgagcgctctt

SEQ ID NO: 551587 - DNA, 25 bp, Rattus norvegicus
tacgacattagctgcgagcgctctt

SEQ ID NO: 551588 - DNA, 25 bp, Rattus norvegicus
tacgaccacttgatcttgagttcat

SEQ ID NO: 551589 - DNA, 25 bp, Rattus norvegicus
tacgaccacttgttcttgagttcat

SEQ ID NO: 551590 - DNA, 25 bp, Rattus norvegicus
tacgaccaggccacgaagtagtgta

SEQ ID NO: 551591 - DNA, 25 bp, Rattus norvegicus
tacgaccaggcctcgaagtagtgta

SEQ ID NO: 551592 - DNA, 25 bp, Rattus norvegicus
tacgaccagggcctgtgccgccaga

SEQ ID NO: 551593 - DNA, 25 bp, Rattus norvegicus
tacgaccagggcgtgtgccgccaga

SEQ ID NO: 551594 - DNA, 25 bp, Rattus norvegicus
tacgacccaaaccactgtttcattg

SEQ ID NO: 551595 - DNA, 25 bp, Rattus norvegicus
tacgacccaaacgactgtttcattg

SEQ ID NO: 551596 - DNA, 25 bp, Rattus norvegicus
tacgaccgactgcatcgcgatttac

SEQ ID NO: 551597 - DNA, 25 bp, Rattus norvegicus
tacgaccgactggatcgcgatttac

SEQ ID NO: 551598 - DNA, 25 bp, Rattus norvegicus
tacgaccgttaacttatccacagac

SEQ ID NO: 551599 - DNA, 25 bp, Rattus norvegicus
tacgaccgttaagttatccacagac

SEQ ID NO: 551600 - DNA, 25 bp, Rattus norvegicus
tacgacctgtgtcatccacttcagc

SEQ ID NO: 551601 - DNA, 25 bp, Rattus norvegicus
tacgacctgtgtgatccacttcagc

SEQ ID NO: 551602 - DNA, 25 bp, Rattus norvegicus
tacgacgactacaatgaggacggtg

SEQ ID NO: 551603 - DNA, 25 bp, Rattus norvegicus
tacgacgactactatgaggacggtg

SEQ ID NO: 551604 - DNA, 25 bp, Rattus norvegicus
tacgacgcacagagccatgacgatg

SEQ ID NO: 551605 - DNA, 25 bp, Rattus norvegicus
tacgacgcacagtgccatgacgatg

SEQ ID NO: 551606 - DNA, 25 bp, Rattus norvegicus
tacgacgcgctacccgcacaggtgg

SEQ ID NO: 551607 - DNA, 25 bp, Rattus norvegicus
tacgacgcgctagccgcacaggtgg

SEQ ID NO: 551608 - DNA, 25 bp, Rattus norvegicus
tacgacggaatacctcttttataat

SEQ ID NO: 551609 - DNA, 25 bp, Rattus norvegicus
tacgacggaatagctcttttataat

SEQ ID NO: 551610 - DNA, 25 bp, Rattus norvegicus
tacgacgtgctgagtgaccctaaga

SEQ ID NO: 551611 - DNA, 25 bp, Rattus norvegicus
tacgacgtgctgtgtgaccctaaga

SEQ ID NO: 551612 - DNA, 25 bp, Rattus norvegicus
tacgactacggacgctactcgggca

SEQ ID NO: 551613 - DNA, 25 bp, Rattus norvegicus
tacgactacggaggctactcgggca

SEQ ID NO: 551614 - DNA, 25 bp, Rattus norvegicus
tacgactactggcaaatggctgata

SEQ ID NO: 551615 - DNA, 25 bp, Rattus norvegicus
tacgactactgggaaatggctgata

SEQ ID NO: 551616 - DNA, 25 bp, Rattus norvegicus
tacgactcaccgattttcagctgtt

SEQ ID NO: 551617 - DNA, 25 bp, Rattus norvegicus
tacgactcaccgtttttcagctgtt

SEQ ID NO: 551618 - DNA, 25 bp, Rattus norvegicus
tacgactcattcatctgattctcca

SEQ ID NO: 551619 - DNA, 25 bp, Rattus norvegicus
tacgactcattcttctgattctcca

SEQ ID NO: 551620 - DNA, 25 bp, Rattus norvegicus
tacgactctcatcctttcagacata

SEQ ID NO: 551621 - DNA, 25 bp, Rattus norvegicus
tacgactctcatgctttcagacata

SEQ ID NO: 551622 - DNA, 25 bp, Rattus norvegicus
tacgacttcgacattgccatgctga

SEQ ID NO: 551623 - DNA, 25 bp, Rattus norvegicus
tacgacttcgactttgccatgctga

SEQ ID NO: 551624 - DNA, 25 bp, Rattus norvegicus
tacgacttttgcctcataccttgaa

SEQ ID NO: 551625 - DNA, 25 bp, Rattus norvegicus
tacgacttttgcgtcataccttgaa

SEQ ID NO: 551626 - DNA, 25 bp, Rattus norvegicus
tacgacttttttccaggaacccgag

SEQ ID NO: 551627 - DNA, 25 bp, Rattus norvegicus
tacgacttttttgcaggaacccgag

SEQ ID NO: 551628 - DNA, 25 bp, Rattus norvegicus
tacgagaaccgcacagtgttcgagt

SEQ ID NO: 551629 - DNA, 25 bp, Rattus norvegicus
tacgagaaccgctcagtgttcgagt

SEQ ID NO: 551630 - DNA, 25 bp, Rattus norvegicus
tacgagaccctgaagctgactgtgt

SEQ ID NO: 551631 - DNA, 25 bp, Rattus norvegicus
tacgagaccctgtagctgactgtgt

SEQ ID NO: 551632 - DNA, 25 bp, Rattus norvegicus
tacgagagctcgctgcacatcggtg

SEQ ID NO: 551633 - DNA, 25 bp, Rattus norvegicus
tacgagagctcggtgcacatcggtg

SEQ ID NO: 551634 - DNA, 25 bp, Rattus norvegicus
tacgagagtctccatatggccatct

SEQ ID NO: 551635 - DNA, 25 bp, Rattus norvegicus
tacgagagtctcgatatggccatct

SEQ ID NO: 551636 - DNA, 25 bp, Rattus norvegicus
tacgagagtgagacctatccacacc

SEQ ID NO: 551637 - DNA, 25 bp, Rattus norvegicus
tacgagagtgagtcctatccacacc

SEQ ID NO: 551638 - DNA, 25 bp, Rattus norvegicus
tacgagataccccagccaaaaatgc

SEQ ID NO: 551639 - DNA, 25 bp, Rattus norvegicus
tacgagatacccgagccaaaaatgc

SEQ ID NO: 551640 - DNA, 25 bp, Rattus norvegicus
tacgagcatgccatgcggtatttgt

SEQ ID NO: 551641 - DNA, 25 bp, Rattus norvegicus
tacgagcatgccttgcggtatttgt

SEQ ID NO: 551642 - DNA, 25 bp, Rattus norvegicus
tacgagcccattaccatggatgcaa

SEQ ID NO: 551643 - DNA, 25 bp, Rattus norvegicus
tacgagcccatttccatggatgcaa

SEQ ID NO: 551644 - DNA, 25 bp, Rattus norvegicus
tacgagcctgggatgcctactgctt

SEQ ID NO: 551645 - DNA, 25 bp, Rattus norvegicus
tacgagcctgggttgcctactgctt

SEQ ID NO: 551646 - DNA, 25 bp, Rattus norvegicus
tacgagctcaaaagccagcctctat

SEQ ID NO: 551647 - DNA, 25 bp, Rattus norvegicus
tacgagctcaaatgccagcctctat

SEQ ID NO: 551648 - DNA, 25 bp, Rattus norvegicus
tacgagctgccactggtgaccgaga

SEQ ID NO: 551649 - DNA, 25 bp, Rattus norvegicus
tacgagctgccagtggtgaccgaga

SEQ ID NO: 551650 - DNA, 25 bp, Rattus norvegicus
tacgagctgtggagcatttctttat

SEQ ID NO: 551651 - DNA, 25 bp, Rattus norvegicus
tacgagctgtggtgcatttctttat

SEQ ID NO: 551652 - DNA, 25 bp, Rattus norvegicus
tacgaggaccggaatactgcctact

SEQ ID NO: 551653 - DNA, 25 bp, Rattus norvegicus
tacgaggaccggtatactgcctact

SEQ ID NO: 551654 - DNA, 25 bp, Rattus norvegicus
tacgaggaccttctcgatggctttc

SEQ ID NO: 551655 - DNA, 25 bp, Rattus norvegicus
tacgaggaccttgtcgatggctttc

SEQ ID NO: 551656 - DNA, 25 bp, Rattus norvegicus
tacgaggaggtgaacccgggctaca

SEQ ID NO: 551657 - DNA, 25 bp, Rattus norvegicus
tacgaggaggtgtacccgggctaca

SEQ ID NO: 551658 - DNA, 25 bp, Rattus norvegicus
tacgagggaacaacctgtgagccag

SEQ ID NO: 551659 - DNA, 25 bp, Rattus norvegicus
tacgagggaacatcctgtgagccag

SEQ ID NO: 551660 - DNA, 25 bp, Rattus norvegicus
tacgaggtcattaagcacaggctgt

SEQ ID NO: 551661 - DNA, 25 bp, Rattus norvegicus
tacgaggtcatttagcacaggctgt

SEQ ID NO: 551662 - DNA, 25 bp, Rattus norvegicus
tacgaggtgaataaaggcagactgc

SEQ ID NO: 551663 - DNA, 25 bp, Rattus norvegicus
tacgaggtgaattaaggcagactgc

SEQ ID NO: 551664 - DNA, 25 bp, Rattus norvegicus
tacgaggtgctcagctttctgctga

SEQ ID NO: 551665 - DNA, 25 bp, Rattus norvegicus
tacgaggtgctctgctttctgctga

SEQ ID NO: 551666 - DNA, 25 bp, Rattus norvegicus
tacgagtccgacctgtacagaggga

SEQ ID NO: 551667 - DNA, 25 bp, Rattus norvegicus
tacgagtccgacgtgtacagaggga

SEQ ID NO: 551668 - DNA, 25 bp, Rattus norvegicus
tacgagtcttctcaggtcgatcctg

SEQ ID NO: 551669 - DNA, 25 bp, Rattus norvegicus
tacgagtcttctgaggtcgatcctg

SEQ ID NO: 551670 - DNA, 25 bp, Rattus norvegicus
tacgagtgctacaaggttccagaat

SEQ ID NO: 551671 - DNA, 25 bp, Rattus norvegicus
tacgagtgctactaggttccagaat

SEQ ID NO: 551672 - DNA, 25 bp, Rattus norvegicus
tacgagtgttcaaaggatgcaatgg

SEQ ID NO: 551673 - DNA, 25 bp, Rattus norvegicus
tacgagtgttcataggatgcaatgg

SEQ ID NO: 551674 - DNA, 25 bp, Rattus norvegicus
tacgagttgaccacggccagccaaa

SEQ ID NO: 551675 - DNA, 25 bp, Rattus norvegicus
tacgagttgacctcggccagccaaa

SEQ ID NO: 551676 - DNA, 25 bp, Rattus norvegicus
tacgatatgccacgcccattcctga

SEQ ID NO: 551677 - DNA, 25 bp, Rattus norvegicus
tacgatatgccaggcccattcctga

SEQ ID NO: 551678 - DNA, 25 bp, Rattus norvegicus
tacgatcaagatcctgggactacag

SEQ ID NO: 551679 - DNA, 25 bp, Rattus norvegicus
tacgatcaagatgctgggactacag

SEQ ID NO: 551680 - DNA, 25 bp, Rattus norvegicus
tacgatcctaacacagctctgtggt

SEQ ID NO: 551681 - DNA, 25 bp, Rattus norvegicus
tacgatcctaactcagctctgtggt

SEQ ID NO: 551682 - DNA, 25 bp, Rattus norvegicus
tacgatcctgacacaagttgcttgc

SEQ ID NO: 551683 - DNA, 25 bp, Rattus norvegicus
tacgatcctgactcaagttgcttgc

SEQ ID NO: 551684 - DNA, 25 bp, Rattus norvegicus
tacgatctgcccatggccatataga

SEQ ID NO: 551685 - DNA, 25 bp, Rattus norvegicus
tacgatctgcccttggccatataga

SEQ ID NO: 551686 - DNA, 25 bp, Rattus norvegicus
tacgatcttcaaactgtacctgtcc

SEQ ID NO: 551687 - DNA, 25 bp, Rattus norvegicus
tacgatcttcaatctgtacctgtcc

SEQ ID NO: 551688 - DNA, 25 bp, Rattus norvegicus
tacgatgagagcctgtggcagccca

SEQ ID NO: 551689 - DNA, 25 bp, Rattus norvegicus
tacgatgagagcgtgtggcagccca

SEQ ID NO: 551690 - DNA, 25 bp, Rattus norvegicus
tacgatgcagcaaaaccactggctt

SEQ ID NO: 551691 - DNA, 25 bp, Rattus norvegicus
tacgatgcagcataaccactggctt

SEQ ID NO: 551692 - DNA, 25 bp, Rattus norvegicus
tacgatggaggtacttcttccagaa

SEQ ID NO: 551693 - DNA, 25 bp, Rattus norvegicus
tacgatggaggttcttcttccagaa

SEQ ID NO: 551694 - DNA, 25 bp, Rattus norvegicus
tacgatggcacccaacccagatact

SEQ ID NO: 551695 - DNA, 25 bp, Rattus norvegicus
tacgatggcaccgaacccagatact

SEQ ID NO: 551696 - DNA, 25 bp, Rattus norvegicus
tacgatggtgctactccgggtcttc

SEQ ID NO: 551697 - DNA, 25 bp, Rattus norvegicus
tacgatggtgcttctccgggtcttc

SEQ ID NO: 551698 - DNA, 25 bp, Rattus norvegicus
tacgatgtcactaagggccctgaaa

SEQ ID NO: 551699 - DNA, 25 bp, Rattus norvegicus
tacgatgtcacttagggccctgaaa

SEQ ID NO: 551700 - DNA, 25 bp, Rattus norvegicus
tacgatgtcatacctttctgctcct

SEQ ID NO: 551701 - DNA, 25 bp, Rattus norvegicus
tacgatgtcatagctttctgctcct

SEQ ID NO: 551702 - DNA, 25 bp, Rattus norvegicus
tacgatgtcttaagtacaccctgct

SEQ ID NO: 551703 - DNA, 25 bp, Rattus norvegicus
tacgatgtcttatgtacaccctgct

SEQ ID NO: 551704 - DNA, 25 bp, Rattus norvegicus
tacgattcagccacacgatgattgt

SEQ ID NO: 551705 - DNA, 25 bp, Rattus norvegicus
tacgattcagcctcacgatgattgt

SEQ ID NO: 551706 - DNA, 25 bp, Rattus norvegicus
tacgattcctgtctccctgtggcag

SEQ ID NO: 551707 - DNA, 25 bp, Rattus norvegicus
tacgattcctgtgtccctgtggcag

SEQ ID NO: 551708 - DNA, 25 bp, Rattus norvegicus
tacgattggtggaggtctcgagcct

SEQ ID NO: 551709 - DNA, 25 bp, Rattus norvegicus
tacgattggtggtggtctcgagcct

SEQ ID NO: 551710 - DNA, 25 bp, Rattus norvegicus
tacgcaacagacactgctccttttg

SEQ ID NO: 551711 - DNA, 25 bp, Rattus norvegicus
tacgcaacagactctgctccttttg

SEQ ID NO: 551712 - DNA, 25 bp, Rattus norvegicus
tacgcaaccagaaccatgtcaagtc

SEQ ID NO: 551713 - DNA, 25 bp, Rattus norvegicus
tacgcaaccagatccatgtcaagtc

SEQ ID NO: 551714 - DNA, 25 bp, Rattus norvegicus
tacgcaaccgaaacttctggatcct

SEQ ID NO: 551715 - DNA, 25 bp, Rattus norvegicus
tacgcaaccgaatcttctggatcct

SEQ ID NO: 551716 - DNA, 25 bp, Rattus norvegicus
tacgcaagcctgctagaccctaagg

SEQ ID NO: 551717 - DNA, 25 bp, Rattus norvegicus
tacgcaagcctggtagaccctaagg

SEQ ID NO: 551718 - DNA, 25 bp, Rattus norvegicus
tacgcaagcgaaatggtccttactt

SEQ ID NO: 551719 - DNA, 25 bp, Rattus norvegicus
tacgcaagcgaattggtccttactt

SEQ ID NO: 551720 - DNA, 25 bp, Rattus norvegicus
tacgcaagcgcacttcctcagaaga

SEQ ID NO: 551721 - DNA, 25 bp, Rattus norvegicus
tacgcaagcgcagttcctcagaaga

SEQ ID NO: 551722 - DNA, 25 bp, Rattus norvegicus
tacgcacagtccacgtgtaaacaag

SEQ ID NO: 551723 - DNA, 25 bp, Rattus norvegicus
tacgcacagtcctcgtgtaaacaag

SEQ ID NO: 551724 - DNA, 25 bp, Rattus norvegicus
tacgcaccagctcggcaggatcagg

SEQ ID NO: 551725 - DNA, 25 bp, Rattus norvegicus
tacgcaccagctgggcaggatcagg

SEQ ID NO: 551726 - DNA, 25 bp, Rattus norvegicus
tacgcacgcacaaacagagatccat

SEQ ID NO: 551727 - DNA, 25 bp, Rattus norvegicus
tacgcacgcacatacagagatccat

SEQ ID NO: 551728 - DNA, 25 bp, Rattus norvegicus
tacgcactcaaacgccagggccgta

SEQ ID NO: 551729 - DNA, 25 bp, Rattus norvegicus
tacgcactcaaaggccagggccgta

SEQ ID NO: 551730 - DNA, 25 bp, Rattus norvegicus
tacgcagaactcacaggctccacga

SEQ ID NO: 551731 - DNA, 25 bp, Rattus norvegicus
tacgcagaactctcaggctccacga

SEQ ID NO: 551732 - DNA, 25 bp, Rattus norvegicus
tacgcagacgacacttttactccag

SEQ ID NO: 551733 - DNA, 25 bp, Rattus norvegicus
tacgcagacgactcttttactccag

SEQ ID NO: 551734 - DNA, 25 bp, Rattus norvegicus
tacgcagaggtgcttttcacagcca

SEQ ID NO: 551735 - DNA, 25 bp, Rattus norvegicus
tacgcagaggtggttttcacagcca

SEQ ID NO: 551736 - DNA, 25 bp, Rattus norvegicus
tacgcagataataaccttggagccg

SEQ ID NO: 551737 - DNA, 25 bp, Rattus norvegicus
tacgcagataattaccttggagccg

SEQ ID NO: 551738 - DNA, 25 bp, Rattus norvegicus
tacgcagcagccagttcgcgcggaa

SEQ ID NO: 551739 - DNA, 25 bp, Rattus norvegicus
tacgcagcagcctgttcgcgcggaa

SEQ ID NO: 551740 - DNA, 25 bp, Rattus norvegicus
tacgcagccaccagatctggacagt

SEQ ID NO: 551741 - DNA, 25 bp, Rattus norvegicus
tacgcagccacctgatctggacagt

SEQ ID NO: 551742 - DNA, 25 bp, Rattus norvegicus
tacgcagccagcagtcgagtgaagc

SEQ ID NO: 551743 - DNA, 25 bp, Rattus norvegicus
tacgcagccagctgtcgagtgaagc

SEQ ID NO: 551744 - DNA, 25 bp, Rattus norvegicus
tacgcagcccagaaaccagggacga

SEQ ID NO: 551745 - DNA, 25 bp, Rattus norvegicus
tacgcagcccagtaaccagggacga

SEQ ID NO: 551746 - DNA, 25 bp, Rattus norvegicus
tacgcagcgtgcctactcaaaggtt

SEQ ID NO: 551747 - DNA, 25 bp, Rattus norvegicus
tacgcagcgtgcgtactcaaaggtt

SEQ ID NO: 551748 - DNA, 25 bp, Rattus norvegicus
tacgcaggactcaagcccatggatt

SEQ ID NO: 551749 - DNA, 25 bp, Rattus norvegicus
tacgcaggactctagcccatggatt

SEQ ID NO: 551750 - DNA, 25 bp, Rattus norvegicus
tacgcaggatgaccccacatttgtg

SEQ ID NO: 551751 - DNA, 25 bp, Rattus norvegicus
tacgcaggatgagcccacatttgtg

SEQ ID NO: 551752 - DNA, 25 bp, Rattus norvegicus
tacgcaggcctcaggagctaagagt

SEQ ID NO: 551753 - DNA, 25 bp, Rattus norvegicus
tacgcaggcctctggagctaagagt

SEQ ID NO: 551754 - DNA, 25 bp, Rattus norvegicus
tacgcaggttatcccctgtggtttc

SEQ ID NO: 551755 - DNA, 25 bp, Rattus norvegicus
tacgcaggttatgccctgtggtttc

SEQ ID NO: 551756 - DNA, 25 bp, Rattus norvegicus
tacgcagtgcgtatgggccgacgtc

SEQ ID NO: 551757 - DNA, 25 bp, Rattus norvegicus
tacgcagtgcgtttgggccgacgtc

SEQ ID NO: 551758 - DNA, 25 bp, Rattus norvegicus
tacgcagttggtcctgagctgtgta

SEQ ID NO: 551759 - DNA, 25 bp, Rattus norvegicus
tacgcagttggtgctgagctgtgta

SEQ ID NO: 551760 - DNA, 25 bp, Rattus norvegicus
tacgcagtttacctagcgaacggac

SEQ ID NO: 551761 - DNA, 25 bp, Rattus norvegicus
tacgcagtttacgtagcgaacggac

SEQ ID NO: 551762 - DNA, 25 bp, Rattus norvegicus
tacgcatcaaacacatcactggtca

SEQ ID NO: 551763 - DNA, 25 bp, Rattus norvegicus
tacgcatcaaactcatcactggtca

SEQ ID NO: 551764 - DNA, 25 bp, Rattus norvegicus
tacgcatccctacgcttgtgtagaa

SEQ ID NO: 551765 - DNA, 25 bp, Rattus norvegicus
tacgcatccctaggcttgtgtagaa

SEQ ID NO: 551766 - DNA, 25 bp, Rattus norvegicus
tacgcatccctgctgagagagccta

SEQ ID NO: 551767 - DNA, 25 bp, Rattus norvegicus
tacgcatccctggtgagagagccta

SEQ ID NO: 551768 - DNA, 25 bp, Rattus norvegicus
tacgcatgactacattacaacgggc

SEQ ID NO: 551769 - DNA, 25 bp, Rattus norvegicus
tacgcatgactagattacaacgggc

SEQ ID NO: 551770 - DNA, 25 bp, Rattus norvegicus
tacgcatgatcaacgagtttccctc

SEQ ID NO: 551771 - DNA, 25 bp, Rattus norvegicus
tacgcatgatcatcgagtttccctc

SEQ ID NO: 551772 - DNA, 25 bp, Rattus norvegicus
tacgcatgcgcaagggcagcactgt

SEQ ID NO: 551773 - DNA, 25 bp, Rattus norvegicus
tacgcatgcgcatgggcagcactgt

SEQ ID NO: 551774 - DNA, 25 bp, Rattus norvegicus
tacgcatgctcactattgggacact

SEQ ID NO: 551775 - DNA, 25 bp, Rattus norvegicus
tacgcatgctcagtattgggacact

SEQ ID NO: 551776 - DNA, 25 bp, Rattus norvegicus
tacgcattgcatagaggtctctact

SEQ ID NO: 551777 - DNA, 25 bp, Rattus norvegicus
tacgcattgcattgaggtctctact

SEQ ID NO: 551778 - DNA, 25 bp, Rattus norvegicus
tacgccaccattctgggctttttta

SEQ ID NO: 551779 - DNA, 25 bp, Rattus norvegicus
tacgccaccattgtgggctttttta

SEQ ID NO: 551780 - DNA, 25 bp, Rattus norvegicus
tacgccactggtctgagtgcctaag

SEQ ID NO: 551781 - DNA, 25 bp, Rattus norvegicus
tacgccactggtgtgagtgcctaag

SEQ ID NO: 551782 - DNA, 25 bp, Rattus norvegicus
tacgccagcactccaacagtttcaa

SEQ ID NO: 551783 - DNA, 25 bp, Rattus norvegicus
tacgccagcactgcaacagtttcaa

SEQ ID NO: 551784 - DNA, 25 bp, Rattus norvegicus
tacgccagctaaccggctaaatgtt

SEQ ID NO: 551785 - DNA, 25 bp, Rattus norvegicus
tacgccagctaagcggctaaatgtt

SEQ ID NO: 551786 - DNA, 25 bp, Rattus norvegicus
tacgccaggacccatgggaaggttt

SEQ ID NO: 551787 - DNA, 25 bp, Rattus norvegicus
tacgccaggaccgatgggaaggttt

SEQ ID NO: 551788 - DNA, 25 bp, Rattus norvegicus
tacgccataccactgcatgctgggt

SEQ ID NO: 551789 - DNA, 25 bp, Rattus norvegicus
tacgccataccagtgcatgctgggt

SEQ ID NO: 551790 - DNA, 25 bp, Rattus norvegicus
tacgccatgacaaacctcaaggcca

SEQ ID NO: 551791 - DNA, 25 bp, Rattus norvegicus
tacgccatgacatacctcaaggcca

SEQ ID NO: 551792 - DNA, 25 bp, Rattus norvegicus
tacgccatggtgctggttctctcca

SEQ ID NO: 551793 - DNA, 25 bp, Rattus norvegicus
tacgccatggtggtggttctctcca

SEQ ID NO: 551794 - DNA, 25 bp, Rattus norvegicus
tacgccattattctctgtgcgttga

SEQ ID NO: 551795 - DNA, 25 bp, Rattus norvegicus
tacgccattattgtctgtgcgttga

SEQ ID NO: 551796 - DNA, 25 bp, Rattus norvegicus
tacgccattccgagcagtagcagaa

SEQ ID NO: 551797 - DNA, 25 bp, Rattus norvegicus
tacgccattccgtgcagtagcagaa

SEQ ID NO: 551798 - DNA, 25 bp, Rattus norvegicus
tacgcccacagacgagctggtgcat

SEQ ID NO: 551799 - DNA, 25 bp, Rattus norvegicus
tacgcccacagaggagctggtgcat

SEQ ID NO: 551800 - DNA, 25 bp, Rattus norvegicus
tacgcccacagtcatttcccacaac

SEQ ID NO: 551801 - DNA, 25 bp, Rattus norvegicus
tacgcccacagtgatttcccacaac

SEQ ID NO: 551802 - DNA, 25 bp, Rattus norvegicus
tacgccccagtaaatgtccgggctt

SEQ ID NO: 551803 - DNA, 25 bp, Rattus norvegicus
tacgccccagtatatgtccgggctt

SEQ ID NO: 551804 - DNA, 25 bp, Rattus norvegicus
tacgccccggcaactgcacgtggga

SEQ ID NO: 551805 - DNA, 25 bp, Rattus norvegicus
tacgccccggcatctgcacgtggga

SEQ ID NO: 551806 - DNA, 25 bp, Rattus norvegicus
tacgcccgtgaacaatttgcccaca

SEQ ID NO: 551807 - DNA, 25 bp, Rattus norvegicus
tacgcccgtgaagaatttgcccaca

SEQ ID NO: 551808 - DNA, 25 bp, Rattus norvegicus
tacgccctgacgctgttggagatat

SEQ ID NO: 551809 - DNA, 25 bp, Rattus norvegicus
tacgccctgacggtgttggagatat

SEQ ID NO: 551810 - DNA, 25 bp, Rattus norvegicus
tacgccctgatcaacgggtacaacg

SEQ ID NO: 551811 - DNA, 25 bp, Rattus norvegicus
tacgccctgatctacgggtacaacg

SEQ ID NO: 551812 - DNA, 25 bp, Rattus norvegicus
tacgccctgcagagcaataacacta

SEQ ID NO: 551813 - DNA, 25 bp, Rattus norvegicus
tacgccctgcagtgcaataacacta

SEQ ID NO: 551814 - DNA, 25 bp, Rattus norvegicus
tacgccgaaccgagtgcgcagccga

SEQ ID NO: 551815 - DNA, 25 bp, Rattus norvegicus
tacgccgaaccgtgtgcgcagccga

SEQ ID NO: 551816 - DNA, 25 bp, Rattus norvegicus
tacgccgaagataaccaccagcaat

SEQ ID NO: 551817 - DNA, 25 bp, Rattus norvegicus
tacgccgaagattaccaccagcaat

SEQ ID NO: 551818 - DNA, 25 bp, Rattus norvegicus
tacgccggccctaaactggcctgag

SEQ ID NO: 551819 - DNA, 25 bp, Rattus norvegicus
tacgccggcccttaactggcctgag

SEQ ID NO: 551820 - DNA, 25 bp, Rattus norvegicus
tacgccggtttaatactttgtaatg

SEQ ID NO: 551821 - DNA, 25 bp, Rattus norvegicus
tacgccggtttattactttgtaatg

SEQ ID NO: 551822 - DNA, 25 bp, Rattus norvegicus
tacgcctcagccatggcatttaaag

SEQ ID NO: 551823 - DNA, 25 bp, Rattus norvegicus
tacgcctcagccttggcatttaaag

SEQ ID NO: 551824 - DNA, 25 bp, Rattus norvegicus
tacgcctccggaagtggctatgttc

SEQ ID NO: 551825 - DNA, 25 bp, Rattus norvegicus
tacgcctccggatgtggctatgttc

SEQ ID NO: 551826 - DNA, 25 bp, Rattus norvegicus
tacgcctcctgcattttatacaaat

SEQ ID NO: 551827 - DNA, 25 bp, Rattus norvegicus
tacgcctcctgctttttatacaaat

SEQ ID NO: 551828 - DNA, 25 bp, Rattus norvegicus
tacgcctcctggataaagtctggcc

SEQ ID NO: 551829 - DNA, 25 bp, Rattus norvegicus
tacgcctcctggttaaagtctggcc

SEQ ID NO: 551830 - DNA, 25 bp, Rattus norvegicus
tacgcctgacctagacctgggttca

SEQ ID NO: 551831 - DNA, 25 bp, Rattus norvegicus
tacgcctgaccttgacctgggttca

SEQ ID NO: 551832 - DNA, 25 bp, Rattus norvegicus
tacgccttctcactcaggttagaac

SEQ ID NO: 551833 - DNA, 25 bp, Rattus norvegicus
tacgccttctcagtcaggttagaac

SEQ ID NO: 551834 - DNA, 25 bp, Rattus norvegicus
tacgcctttgtgatggaggaagaaa

SEQ ID NO: 551835 - DNA, 25 bp, Rattus norvegicus
tacgcctttgtgttggaggaagaaa

SEQ ID NO: 551836 - DNA, 25 bp, Rattus norvegicus
tacgcgctactgagccgggaacgga

SEQ ID NO: 551837 - DNA, 25 bp, Rattus norvegicus
tacgcgctactgtgccgggaacgga

SEQ ID NO: 551838 - DNA, 25 bp, Rattus norvegicus
tacgcgctcaagatctgggctcact

SEQ ID NO: 551839 - DNA, 25 bp, Rattus norvegicus
tacgcgctcaagttctgggctcact

SEQ ID NO: 551840 - DNA, 25 bp, Rattus norvegicus
tacgcggaggtgacagatgcccagc

SEQ ID NO: 551841 - DNA, 25 bp, Rattus norvegicus
tacgcggaggtgtcagatgcccagc

SEQ ID NO: 551842 - DNA, 25 bp, Rattus norvegicus
tacgcggcctctccactttacaggg

SEQ ID NO: 551843 - DNA, 25 bp, Rattus norvegicus
tacgcggcctctgcactttacaggg

SEQ ID NO: 551844 - DNA, 25 bp, Rattus norvegicus
tacgcggcgaggctttccctttgtg

SEQ ID NO: 551845 - DNA, 25 bp, Rattus norvegicus
tacgcggcgagggtttccctttgtg

SEQ ID NO: 551846 - DNA, 25 bp, Rattus norvegicus
tacgcggcgctgcttcgagtcaaga

SEQ ID NO: 551847 - DNA, 25 bp, Rattus norvegicus
tacgcggcgctggttcgagtcaaga

SEQ ID NO: 551848 - DNA, 25 bp, Rattus norvegicus
tacgcggcggccagacacccgagga

SEQ ID NO: 551849 - DNA, 25 bp, Rattus norvegicus
tacgcggcggcctgacacccgagga

SEQ ID NO: 551850 - DNA, 25 bp, Rattus norvegicus
tacgcgggagaaatggttttattgt

SEQ ID NO: 551851 - DNA, 25 bp, Rattus norvegicus
tacgcgggagaattggttttattgt

SEQ ID NO: 551852 - DNA, 25 bp, Rattus norvegicus
tacgcggtcaaccaggtcctggaag

SEQ ID NO: 551853 - DNA, 25 bp, Rattus norvegicus
tacgcggtcaacgaggtcctggaag

SEQ ID NO: 551854 - DNA, 25 bp, Rattus norvegicus
tacgcggtgaagatggtctgcttac

SEQ ID NO: 551855 - DNA, 25 bp, Rattus norvegicus
tacgcggtgaagttggtctgcttac

SEQ ID NO: 551856 - DNA, 25 bp, Rattus norvegicus
tacgcggtggacactgtgcttcgat

SEQ ID NO: 551857 - DNA, 25 bp, Rattus norvegicus
tacgcggtggactctgtgcttcgat

SEQ ID NO: 551858 - DNA, 25 bp, Rattus norvegicus
tacgcgtgagaccaggtgtccatgt

SEQ ID NO: 551859 - DNA, 25 bp, Rattus norvegicus
tacgcgtgagacgaggtgtccatgt

SEQ ID NO: 551860 - DNA, 25 bp, Rattus norvegicus
tacgcgtggccacatggaaccagat

SEQ ID NO: 551861 - DNA, 25 bp, Rattus norvegicus
tacgcgtggccagatggaaccagat

SEQ ID NO: 551862 - DNA, 25 bp, Rattus norvegicus
tacgctaacgcaagaaaccaccaaa

SEQ ID NO: 551863 - DNA, 25 bp, Rattus norvegicus
tacgctaacgcatgaaaccaccaaa

SEQ ID NO: 551864 - DNA, 25 bp, Rattus norvegicus
tacgctacacaaaataccttttctg

SEQ ID NO: 551865 - DNA, 25 bp, Rattus norvegicus
tacgctacacaatataccttttctg

SEQ ID NO: 551866 - DNA, 25 bp, Rattus norvegicus
tacgctagcaccacacgggtacata

SEQ ID NO: 551867 - DNA, 25 bp, Rattus norvegicus
tacgctagcacctcacgggtacata

SEQ ID NO: 551868 - DNA, 25 bp, Rattus norvegicus
tacgctattttaaagttcactgggt

SEQ ID NO: 551869 - DNA, 25 bp, Rattus norvegicus
tacgctattttatagttcactgggt

SEQ ID NO: 551870 - DNA, 25 bp, Rattus norvegicus
tacgctcacacactggtctagcagc

SEQ ID NO: 551871 - DNA, 25 bp, Rattus norvegicus
tacgctcacacagtggtctagcagc

SEQ ID NO: 551872 - DNA, 25 bp, Rattus norvegicus
tacgctcatctgagcctgggctgag

SEQ ID NO: 551873 - DNA, 25 bp, Rattus norvegicus
tacgctcatctgtgcctgggctgag

SEQ ID NO: 551874 - DNA, 25 bp, Rattus norvegicus
tacgctcatcttccttggaggttac

SEQ ID NO: 551875 - DNA, 25 bp, Rattus norvegicus
tacgctcatcttgcttggaggttac

SEQ ID NO: 551876 - DNA, 25 bp, Rattus norvegicus
tacgctcgtacaatgtctttaccat

SEQ ID NO: 551877 - DNA, 25 bp, Rattus norvegicus
tacgctcgtacattgtctttaccat

SEQ ID NO: 551878 - DNA, 25 bp, Rattus norvegicus
tacgctctcttccaggtttttatca

SEQ ID NO: 551879 - DNA, 25 bp, Rattus norvegicus
tacgctctcttcgaggtttttatca

SEQ ID NO: 551880 - DNA, 25 bp, Rattus norvegicus
tacgctctgtgtaggtgttagatct

SEQ ID NO: 551881 - DNA, 25 bp, Rattus norvegicus
tacgctctgtgttggtgttagatct

SEQ ID NO: 551882 - DNA, 25 bp, Rattus norvegicus
tacgctgcctgcatacaaggatttc

SEQ ID NO: 551883 - DNA, 25 bp, Rattus norvegicus
tacgctgcctgcttacaaggatttc

SEQ ID NO: 551884 - DNA, 25 bp, Rattus norvegicus
tacgctggagtgaccgagggcaaat

SEQ ID NO: 551885 - DNA, 25 bp, Rattus norvegicus
tacgctggagtgtccgagggcaaat

SEQ ID NO: 551886 - DNA, 25 bp, Rattus norvegicus
tacgctggatgcaggtatttaccga

SEQ ID NO: 551887 - DNA, 25 bp, Rattus norvegicus
tacgctggatgctggtatttaccga

SEQ ID NO: 551888 - DNA, 25 bp, Rattus norvegicus
tacgctggatggactttggtttgct

SEQ ID NO: 551889 - DNA, 25 bp, Rattus norvegicus
tacgctggatggtctttggtttgct

SEQ ID NO: 551890 - DNA, 25 bp, Rattus norvegicus
tacgctggcattcaggttcccagac

SEQ ID NO: 551891 - DNA, 25 bp, Rattus norvegicus
tacgctggcattgaggttcccagac

SEQ ID NO: 551892 - DNA, 25 bp, Rattus norvegicus
tacgctggctagagtccctgtaggt

SEQ ID NO: 551893 - DNA, 25 bp, Rattus norvegicus
tacgctggctagtgtccctgtaggt

SEQ ID NO: 551894 - DNA, 25 bp, Rattus norvegicus
tacgctgggtatcacaactctgaca

SEQ ID NO: 551895 - DNA, 25 bp, Rattus norvegicus
tacgctgggtatgacaactctgaca

SEQ ID NO: 551896 - DNA, 25 bp, Rattus norvegicus
tacgctgggttaaagcacctggcta

SEQ ID NO: 551897 - DNA, 25 bp, Rattus norvegicus
tacgctgggttatagcacctggcta

SEQ ID NO: 551898 - DNA, 25 bp, Rattus norvegicus
tacgctgtacttagtagacattcat

SEQ ID NO: 551899 - DNA, 25 bp, Rattus norvegicus
tacgctgtactttgtagacattcat

SEQ ID NO: 551900 - DNA, 25 bp, Rattus norvegicus
tacgctgtgccgagtgccaggcatt

SEQ ID NO: 551901 - DNA, 25 bp, Rattus norvegicus
tacgctgtgccgtgtgccaggcatt

SEQ ID NO: 551902 - DNA, 25 bp, Rattus norvegicus
tacgctgttcacacctctgagatag

SEQ ID NO: 551903 - DNA, 25 bp, Rattus norvegicus
tacgctgttcactcctctgagatag

SEQ ID NO: 551904 - DNA, 25 bp, Rattus norvegicus
tacgcttacgaaccttctgacacag

SEQ ID NO: 551905 - DNA, 25 bp, Rattus norvegicus
tacgcttacgaagcttctgacacag

SEQ ID NO: 551906 - DNA, 25 bp, Rattus norvegicus
tacgcttatcctatttattctcagt

SEQ ID NO: 551907 - DNA, 25 bp, Rattus norvegicus
tacgcttatcctttttattctcagt

SEQ ID NO: 551908 - DNA, 25 bp, Rattus norvegicus
tacgcttcagagataccaacgggca

SEQ ID NO: 551909 - DNA, 25 bp, Rattus norvegicus
tacgcttcagagttaccaacgggca

SEQ ID NO: 551910 - DNA, 25 bp, Rattus norvegicus
tacgcttccttcactggtgccttga

SEQ ID NO: 551911 - DNA, 25 bp, Rattus norvegicus
tacgcttccttctctggtgccttga

SEQ ID NO: 551912 - DNA, 25 bp, Rattus norvegicus
tacgcttgagagagacgctttctaa

SEQ ID NO: 551913 - DNA, 25 bp, Rattus norvegicus
tacgcttgagagtgacgctttctaa

SEQ ID NO: 551914 - DNA, 25 bp, Rattus norvegicus
tacgctttcaaactggtgtgctcct

SEQ ID NO: 551915 - DNA, 25 bp, Rattus norvegicus
tacgctttcaaagtggtgtgctcct

SEQ ID NO: 551916 - DNA, 25 bp, Rattus norvegicus
tacggaaaagcaactcacgctgctg

SEQ ID NO: 551917 - DNA, 25 bp, Rattus norvegicus
tacggaaaagcatctcacgctgctg

SEQ ID NO: 551918 - DNA, 25 bp, Rattus norvegicus
tacggaaccccgaaactgaggagat

SEQ ID NO: 551919 - DNA, 25 bp, Rattus norvegicus
tacggaaccccgtaactgaggagat

SEQ ID NO: 551920 - DNA, 25 bp, Rattus norvegicus
tacggaaccctgctcaactgactgc

SEQ ID NO: 551921 - DNA, 25 bp, Rattus norvegicus
tacggaaccctggtcaactgactgc

SEQ ID NO: 551922 - DNA, 25 bp, Rattus norvegicus
tacggaagctgtctggccccaagaa

SEQ ID NO: 551923 - DNA, 25 bp, Rattus norvegicus
tacggaagctgtgtggccccaagaa

SEQ ID NO: 551924 - DNA, 25 bp, Rattus norvegicus
tacggaagtcacagccacaatgcaa

SEQ ID NO: 551925 - DNA, 25 bp, Rattus norvegicus
tacggaagtcactgccacaatgcaa

SEQ ID NO: 551926 - DNA, 25 bp, Rattus norvegicus
tacggaatcctacttccttgtccta

SEQ ID NO: 551927 - DNA, 25 bp, Rattus norvegicus
tacggaatcctagttccttgtccta

SEQ ID NO: 551928 - DNA, 25 bp, Rattus norvegicus
tacggaattaaacccttctcgcgat

SEQ ID NO: 551929 - DNA, 25 bp, Rattus norvegicus
tacggaattaaagccttctcgcgat

SEQ ID NO: 551930 - DNA, 25 bp, Rattus norvegicus
tacggaattcatagctgggcaggaa

SEQ ID NO: 551931 - DNA, 25 bp, Rattus norvegicus
tacggaattcattgctgggcaggaa

SEQ ID NO: 551932 - DNA, 25 bp, Rattus norvegicus
tacggacacgtgacactcatgcggt

SEQ ID NO: 551933 - DNA, 25 bp, Rattus norvegicus
tacggacacgtgtcactcatgcggt

SEQ ID NO: 551934 - DNA, 25 bp, Rattus norvegicus
tacggacagtcgactattcaacttt

SEQ ID NO: 551935 - DNA, 25 bp, Rattus norvegicus
tacggacagtcgtctattcaacttt

SEQ ID NO: 551936 - DNA, 25 bp, Rattus norvegicus
tacggacattttatacctgggttga

SEQ ID NO: 551937 - DNA, 25 bp, Rattus norvegicus
tacggacattttttacctgggttga

SEQ ID NO: 551938 - DNA, 25 bp, Rattus norvegicus
tacggactcagtagccagaattata

SEQ ID NO: 551939 - DNA, 25 bp, Rattus norvegicus
tacggactcagttgccagaattata

SEQ ID NO: 551940 - DNA, 25 bp, Rattus norvegicus
tacggactccaacaaggcagactct

SEQ ID NO: 551941 - DNA, 25 bp, Rattus norvegicus
tacggactccaagaaggcagactct

SEQ ID NO: 551942 - DNA, 25 bp, Rattus norvegicus
tacggagagctgcaacaatgcccaa

SEQ ID NO: 551943 - DNA, 25 bp, Rattus norvegicus
tacggagagctggaacaatgcccaa

SEQ ID NO: 551944 - DNA, 25 bp, Rattus norvegicus
tacggagaggccaggtccagtcagt

SEQ ID NO: 551945 - DNA, 25 bp, Rattus norvegicus
tacggagaggcctggtccagtcagt

SEQ ID NO: 551946 - DNA, 25 bp, Rattus norvegicus
tacggagcactgcactcatactggc

SEQ ID NO: 551947 - DNA, 25 bp, Rattus norvegicus
tacggagcactggactcatactggc

SEQ ID NO: 551948 - DNA, 25 bp, Rattus norvegicus
tacggagcagtgcaccaagcagatt

SEQ ID NO: 551949 - DNA, 25 bp, Rattus norvegicus
tacggagcagtggaccaagcagatt

SEQ ID NO: 551950 - DNA, 25 bp, Rattus norvegicus
tacggagccaaaccttgcccataaa

SEQ ID NO: 551951 - DNA, 25 bp, Rattus norvegicus
tacggagccaaagcttgcccataaa

SEQ ID NO: 551952 - DNA, 25 bp, Rattus norvegicus
tacggagcgatcaaccgcgcgcgag

SEQ ID NO: 551953 - DNA, 25 bp, Rattus norvegicus
tacggagcgatctaccgcgcgcgag

SEQ ID NO: 551954 - DNA, 25 bp, Rattus norvegicus
tacggagctcggacagacatgacta

SEQ ID NO: 551955 - DNA, 25 bp, Rattus norvegicus
tacggagctcggtcagacatgacta

SEQ ID NO: 551956 - DNA, 25 bp, Rattus norvegicus
tacggagctggtaacccggacgatc

SEQ ID NO: 551957 - DNA, 25 bp, Rattus norvegicus
tacggagctggttacccggacgatc

SEQ ID NO: 551958 - DNA, 25 bp, Rattus norvegicus
tacggaggcaaaaggcccagcccag

SEQ ID NO: 551959 - DNA, 25 bp, Rattus norvegicus
tacggaggcaaatggcccagcccag

SEQ ID NO: 551960 - DNA, 25 bp, Rattus norvegicus
tacggaggtaaaccctgcccggtat

SEQ ID NO: 551961 - DNA, 25 bp, Rattus norvegicus
tacggaggtaaagcctgcccggtat

SEQ ID NO: 551962 - DNA, 25 bp, Rattus norvegicus
tacggaggttatagtgaatgaccac

SEQ ID NO: 551963 - DNA, 25 bp, Rattus norvegicus
tacggaggttattgtgaatgaccac

SEQ ID NO: 551964 - DNA, 25 bp, Rattus norvegicus
tacggagtgcggacagaggctctca

SEQ ID NO: 551965 - DNA, 25 bp, Rattus norvegicus
tacggagtgcggtcagaggctctca

SEQ ID NO: 551966 - DNA, 25 bp, Rattus norvegicus
tacggatcccgacacgatacgtgat

SEQ ID NO: 551967 - DNA, 25 bp, Rattus norvegicus
tacggatcccgagacgatacgtgat

SEQ ID NO: 551968 - DNA, 25 bp, Rattus norvegicus
tacggatctgacaggtgggacatga

SEQ ID NO: 551969 - DNA, 25 bp, Rattus norvegicus
tacggatctgactggtgggacatga

SEQ ID NO: 551970 - DNA, 25 bp, Rattus norvegicus
tacggatgacgtactgttttctgtt

SEQ ID NO: 551971 - DNA, 25 bp, Rattus norvegicus
tacggatgacgttctgttttctgtt

SEQ ID NO: 551972 - DNA, 25 bp, Rattus norvegicus
tacggatgtgtgaagatgctgcact

SEQ ID NO: 551973 - DNA, 25 bp, Rattus norvegicus
tacggatgtgtgtagatgctgcact

SEQ ID NO: 551974 - DNA, 25 bp, Rattus norvegicus
tacggattgctcaggaaacttgact

SEQ ID NO: 551975 - DNA, 25 bp, Rattus norvegicus
tacggattgctctggaaacttgact

SEQ ID NO: 551976 - DNA, 25 bp, Rattus norvegicus
tacggatttgctacctcgggagaaa

SEQ ID NO: 551977 - DNA, 25 bp, Rattus norvegicus
tacggatttgctctcccggaaggaa

SEQ ID NO: 551978 - DNA, 25 bp, Rattus norvegicus
tacggatttgctgtcccggaaggaa

SEQ ID NO: 551979 - DNA, 25 bp, Rattus norvegicus
tacggatttgcttcctcgggagaaa

SEQ ID NO: 551980 - DNA, 25 bp, Rattus norvegicus
tacggcaaactgatccctaggatac

SEQ ID NO: 551981 - DNA, 25 bp, Rattus norvegicus
tacggcaaactgttccctaggatac

SEQ ID NO: 551982 - DNA, 25 bp, Rattus norvegicus
tacggcaatgtcaccgggtcagaga

SEQ ID NO: 551983 - DNA, 25 bp, Rattus norvegicus
tacggcaatgtctccgggtcagaga

SEQ ID NO: 551984 - DNA, 25 bp, Rattus norvegicus
tacggcacacggagactacatgcaa

SEQ ID NO: 551985 - DNA, 25 bp, Rattus norvegicus
tacggcacacggtgactacatgcaa

SEQ ID NO: 551986 - DNA, 25 bp, Rattus norvegicus
tacggcaccggcatgaggctctggc

SEQ ID NO: 551987 - DNA, 25 bp, Rattus norvegicus
tacggcaccggcttgaggctctggc

SEQ ID NO: 551988 - DNA, 25 bp, Rattus norvegicus
tacggcacttacaaggtcttcaatg

SEQ ID NO: 551989 - DNA, 25 bp, Rattus norvegicus
tacggcacttactaggtcttcaatg

SEQ ID NO: 551990 - DNA, 25 bp, Rattus norvegicus
tacggcatcctgaagcagcgtccag

SEQ ID NO: 551991 - DNA, 25 bp, Rattus norvegicus
tacggcatcctgtagcagcgtccag

SEQ ID NO: 551992 - DNA, 25 bp, Rattus norvegicus
tacggcatcgaacgccgctatgcaa

SEQ ID NO: 551993 - DNA, 25 bp, Rattus norvegicus
tacggcatcgaaggccgctatgcaa

SEQ ID NO: 551994 - DNA, 25 bp, Rattus norvegicus
tacggcatctacacgaaggtcacgg

SEQ ID NO: 551995 - DNA, 25 bp, Rattus norvegicus
tacggcatctactcgaaggtcacgg

SEQ ID NO: 551996 - DNA, 25 bp, Rattus norvegicus
tacggccactggctattaacataca

SEQ ID NO: 551997 - DNA, 25 bp, Rattus norvegicus
tacggccactgggtattaacataca

SEQ ID NO: 551998 - DNA, 25 bp, Rattus norvegicus
tacggccactgtaagatcaatctgt

SEQ ID NO: 551999 - DNA, 25 bp, Rattus norvegicus
tacggccactgttagatcaatctgt

SEQ ID NO: 552000 - DNA, 25 bp, Rattus norvegicus
tacggccacttacctccacaggtta

SEQ ID NO: 552001 - DNA, 25 bp, Rattus norvegicus
tacggccacttagctccacaggtta

SEQ ID NO: 552002 - DNA, 25 bp, Rattus norvegicus
tacggccagaaacccatcttgtttc

SEQ ID NO: 552003 - DNA, 25 bp, Rattus norvegicus
tacggccagaaagccatcttgtttc

SEQ ID NO: 552004 - DNA, 25 bp, Rattus norvegicus
tacggccagggcacagaaaggaggc

SEQ ID NO: 552005 - DNA, 25 bp, Rattus norvegicus
tacggccagggctcagaaaggaggc

SEQ ID NO: 552006 - DNA, 25 bp, Rattus norvegicus
tacggcccggctcttgttcaagaaa

SEQ ID NO: 552007 - DNA, 25 bp, Rattus norvegicus
tacggcccggctgttgttcaagaaa

SEQ ID NO: 552008 - DNA, 25 bp, Rattus norvegicus
tacggccctgagagatccaagaaat

SEQ ID NO: 552009 - DNA, 25 bp, Rattus norvegicus
tacggccctgagtgatccaagaaat

SEQ ID NO: 552010 - DNA, 25 bp, Rattus norvegicus
tacggcctcatcagcttcaagatct

SEQ ID NO: 552011 - DNA, 25 bp, Rattus norvegicus
tacggcctcatctgcttcaagatct

SEQ ID NO: 552012 - DNA, 25 bp, Rattus norvegicus
tacggcctgatgatcttacgactca

SEQ ID NO: 552013 - DNA, 25 bp, Rattus norvegicus
tacggcctgatgttcttacgactca

SEQ ID NO: 552014 - DNA, 25 bp, Rattus norvegicus
tacggcctggccagggagaagtact

SEQ ID NO: 552015 - DNA, 25 bp, Rattus norvegicus
tacggcctggcctgggagaagtact

SEQ ID NO: 552016 - DNA, 25 bp, Rattus norvegicus
tacggcgggcagactaagcccattt

SEQ ID NO: 552017 - DNA, 25 bp, Rattus norvegicus
tacggcgggcagtctaagcccattt

SEQ ID NO: 552018 - DNA, 25 bp, Rattus norvegicus
tacggcgtacgcatactatagttgt

SEQ ID NO: 552019 - DNA, 25 bp, Rattus norvegicus
tacggcgtacgcttactatagttgt

SEQ ID NO: 552020 - DNA, 25 bp, Rattus norvegicus
tacggcgtccagcaattcagtgatg

SEQ ID NO: 552021 - DNA, 25 bp, Rattus norvegicus
tacggcgtccaggaattcagtgatg

SEQ ID NO: 552022 - DNA, 25 bp, Rattus norvegicus
tacggcgtggtgaatttctgcttcc

SEQ ID NO: 552023 - DNA, 25 bp, Rattus norvegicus
tacggcgtggtgtatttctgcttcc

SEQ ID NO: 552024 - DNA, 25 bp, Rattus norvegicus
tacggctcatctcgaacccgagtgt

SEQ ID NO: 552025 - DNA, 25 bp, Rattus norvegicus
tacggctcatctggaacccgagtgt

SEQ ID NO: 552026 - DNA, 25 bp, Rattus norvegicus
tacggctcctacaaagtgctttcag

SEQ ID NO: 552027 - DNA, 25 bp, Rattus norvegicus
tacggctcctactaagtgctttcag

SEQ ID NO: 552028 - DNA, 25 bp, Rattus norvegicus
tacggctcctcaatctttgtctgtt

SEQ ID NO: 552029 - DNA, 25 bp, Rattus norvegicus
tacggctcctcattctttgtctgtt

SEQ ID NO: 552030 - DNA, 25 bp, Rattus norvegicus
tacggctcggagaccagtgacttca

SEQ ID NO: 552031 - DNA, 25 bp, Rattus norvegicus
tacggctcggagtccagtgacttca

SEQ ID NO: 552032 - DNA, 25 bp, Rattus norvegicus
tacggctctcatagacggcatctgt

SEQ ID NO: 552033 - DNA, 25 bp, Rattus norvegicus
tacggctctcattgacggcatctgt

SEQ ID NO: 552034 - DNA, 25 bp, Rattus norvegicus
tacggcttcgacctctgtgcagaac

SEQ ID NO: 552035 - DNA, 25 bp, Rattus norvegicus
tacggcttcgacgtctgtgcagaac

SEQ ID NO: 552036 - DNA, 25 bp, Rattus norvegicus
tacggctttaggctcatagcgctgt

SEQ ID NO: 552037 - DNA, 25 bp, Rattus norvegicus
tacggctttagggtcatagcgctgt

SEQ ID NO: 552038 - DNA, 25 bp, Rattus norvegicus
tacggctttctcaaacggccttaat

SEQ ID NO: 552039 - DNA, 25 bp, Rattus norvegicus
tacggctttctctaacggccttaat

SEQ ID NO: 552040 - DNA, 25 bp, Rattus norvegicus
tacgggaacatcatcctgaggaagc

SEQ ID NO: 552041 - DNA, 25 bp, Rattus norvegicus
tacgggaacatcttcctgaggaagc

SEQ ID NO: 552042 - DNA, 25 bp, Rattus norvegicus
tacgggaacctaaatctgtatcggt

SEQ ID NO: 552043 - DNA, 25 bp, Rattus norvegicus
tacgggaacctatatctgtatcggt

SEQ ID NO: 552044 - DNA, 25 bp, Rattus norvegicus
tacgggaacctgagcattctgtatg

SEQ ID NO: 552045 - DNA, 25 bp, Rattus norvegicus
tacgggaacctgtgcattctgtatg

SEQ ID NO: 552046 - DNA, 25 bp, Rattus norvegicus
tacgggaagtacacggctgagatca

SEQ ID NO: 552047 - DNA, 25 bp, Rattus norvegicus
tacgggaagtactcggctgagatca

SEQ ID NO: 552048 - DNA, 25 bp, Rattus norvegicus
tacgggaagttcattcgcagctgcc

SEQ ID NO: 552049 - DNA, 25 bp, Rattus norvegicus
tacgggaagttctttcgcagctgcc

SEQ ID NO: 552050 - DNA, 25 bp, Rattus norvegicus
tacgggacactcatggagccttgat

SEQ ID NO: 552051 - DNA, 25 bp, Rattus norvegicus
tacgggacactcttggagccttgat

SEQ ID NO: 552052 - DNA, 25 bp, Rattus norvegicus
tacgggacatcaaggacactacagt

SEQ ID NO: 552053 - DNA, 25 bp, Rattus norvegicus
tacgggacatcatggacactacagt

SEQ ID NO: 552054 - DNA, 25 bp, Rattus norvegicus
tacgggactccactgtgaccgagga

SEQ ID NO: 552055 - DNA, 25 bp, Rattus norvegicus
tacgggactccagtgtgaccgagga

SEQ ID NO: 552056 - DNA, 25 bp, Rattus norvegicus
tacgggactcgcaaccacgtgtcag

SEQ ID NO: 552057 - DNA, 25 bp, Rattus norvegicus
tacgggactcgctaccacgtgtcag

SEQ ID NO: 552058 - DNA, 25 bp, Rattus norvegicus
tacgggatacggctcatataacaat

SEQ ID NO: 552059 - DNA, 25 bp, Rattus norvegicus
tacgggatacgggtcatataacaat

SEQ ID NO: 552060 - DNA, 25 bp, Rattus norvegicus
tacgggatggtacactgactaacac

SEQ ID NO: 552061 - DNA, 25 bp, Rattus norvegicus
tacgggatggtagactgactaacac

SEQ ID NO: 552062 - DNA, 25 bp, Rattus norvegicus
tacgggatgtggatgacctccattg

SEQ ID NO: 552063 - DNA, 25 bp, Rattus norvegicus
tacgggatgtggttgacctccattg

SEQ ID NO: 552064 - DNA, 25 bp, Rattus norvegicus
tacgggattgtcacacttgtggttc

SEQ ID NO: 552065 - DNA, 25 bp, Rattus norvegicus
tacgggattgtctcacttgtggttc

SEQ ID NO: 552066 - DNA, 25 bp, Rattus norvegicus
tacgggcaatcccttatgtaaaggg

SEQ ID NO: 552067 - DNA, 25 bp, Rattus norvegicus
tacgggcaatccgttatgtaaaggg

SEQ ID NO: 552068 - DNA, 25 bp, Rattus norvegicus
tacgggcacgcaaattctagaaggg

SEQ ID NO: 552069 - DNA, 25 bp, Rattus norvegicus
tacgggcacgcatattctagaaggg

SEQ ID NO: 552070 - DNA, 25 bp, Rattus norvegicus
tacgggcagattactgaggagacct

SEQ ID NO: 552071 - DNA, 25 bp, Rattus norvegicus
tacgggcagatttctgaggagacct

SEQ ID NO: 552072 - DNA, 25 bp, Rattus norvegicus
tacgggcatgcgctaccatggtaga

SEQ ID NO: 552073 - DNA, 25 bp, Rattus norvegicus
tacgggcatgcggtaccatggtaga

SEQ ID NO: 552074 - DNA, 25 bp, Rattus norvegicus
tacgggcattatacctgatagcaac

SEQ ID NO: 552075 - DNA, 25 bp, Rattus norvegicus
tacgggcattattcctgatagcaac

SEQ ID NO: 552076 - DNA, 25 bp, Rattus norvegicus
tacgggccggttagaccctggcgct

SEQ ID NO: 552077 - DNA, 25 bp, Rattus norvegicus
tacgggccggtttgaccctggcgct

SEQ ID NO: 552078 - DNA, 25 bp, Rattus norvegicus
tacgggcctgctaagagcaagggcc

SEQ ID NO: 552079 - DNA, 25 bp, Rattus norvegicus
tacgggcctgcttagagcaagggcc

SEQ ID NO: 552080 - DNA, 25 bp, Rattus norvegicus
tacgggctcggcagttgtgtcaaga

SEQ ID NO: 552081 - DNA, 25 bp, Rattus norvegicus
tacgggctcggctgttgtgtcaaga

SEQ ID NO: 552082 - DNA, 25 bp, Rattus norvegicus
tacgggctctacaacttcatctaca

SEQ ID NO: 552083 - DNA, 25 bp, Rattus norvegicus
tacgggctctactacttcatctaca

SEQ ID NO: 552084 - DNA, 25 bp, Rattus norvegicus
tacgggctctccacacatagctgag

SEQ ID NO: 552085 - DNA, 25 bp, Rattus norvegicus
tacgggctctcctcacatagctgag

SEQ ID NO: 552086 - DNA, 25 bp, Rattus norvegicus
tacgggctgcgcacttcagatggct

SEQ ID NO: 552087 - DNA, 25 bp, Rattus norvegicus
tacgggctgcgctcttcagatggct

SEQ ID NO: 552088 - DNA, 25 bp, Rattus norvegicus
tacgggtctgtcagttatccagtac

SEQ ID NO: 552089 - DNA, 25 bp, Rattus norvegicus
tacgggtctgtctgttatccagtac

SEQ ID NO: 552090 - DNA, 25 bp, Rattus norvegicus
tacgggtcttctataaagctccacg

SEQ ID NO: 552091 - DNA, 25 bp, Rattus norvegicus
tacgggtcttctttaaagctccacg

SEQ ID NO: 552092 - DNA, 25 bp, Rattus norvegicus
tacgggtgatggatgctctgtgctc

SEQ ID NO: 552093 - DNA, 25 bp, Rattus norvegicus
tacgggtgatggttgctctgtgctc

SEQ ID NO: 552094 - DNA, 25 bp, Rattus norvegicus
tacggtaatccactcattgcccagg

SEQ ID NO: 552095 - DNA, 25 bp, Rattus norvegicus
tacggtaatccagtcattgcccagg

SEQ ID NO: 552096 - DNA, 25 bp, Rattus norvegicus
tacggtacagttcatttcacgttgt

SEQ ID NO: 552097 - DNA, 25 bp, Rattus norvegicus
tacggtacagttgatttcacgttgt

SEQ ID NO: 552098 - DNA, 25 bp, Rattus norvegicus
tacggtaggtccacggatttgaact

SEQ ID NO: 552099 - DNA, 25 bp, Rattus norvegicus
tacggtaggtcctcggatttgaact

SEQ ID NO: 552100 - DNA, 25 bp, Rattus norvegicus
tacggtatacccacactttaataga

SEQ ID NO: 552101 - DNA, 25 bp, Rattus norvegicus
tacggtataccctcactttaataga

SEQ ID NO: 552102 - DNA, 25 bp, Rattus norvegicus
tacggtcatcgccatcggctgccgg

SEQ ID NO: 552103 - DNA, 25 bp, Rattus norvegicus
tacggtcatcgcgatcggctgccgg

SEQ ID NO: 552104 - DNA, 25 bp, Rattus norvegicus
tacggtccttcaagacttgccatcg

SEQ ID NO: 552105 - DNA, 25 bp, Rattus norvegicus
tacggtccttcatgacttgccatcg

SEQ ID NO: 552106 - DNA, 25 bp, Rattus norvegicus
tacggtctagatcagcatgcctaaa

SEQ ID NO: 552107 - DNA, 25 bp, Rattus norvegicus
tacggtctagatgagcatgcctaaa

SEQ ID NO: 552108 - DNA, 25 bp, Rattus norvegicus
tacggtcttcggatttgatgttcta

SEQ ID NO: 552109 - DNA, 25 bp, Rattus norvegicus
tacggtcttcggttttgatgttcta

SEQ ID NO: 552110 - DNA, 25 bp, Rattus norvegicus
tacggtctttataggctctgggtac

SEQ ID NO: 552111 - DNA, 25 bp, Rattus norvegicus
tacggtctttattggctctgggtac

SEQ ID NO: 552112 - DNA, 25 bp, Rattus norvegicus
tacggtgacagcacactgagccctg

SEQ ID NO: 552113 - DNA, 25 bp, Rattus norvegicus
tacggtgacagctcactgagccctg

SEQ ID NO: 552114 - DNA, 25 bp, Rattus norvegicus
tacggtgatcccaacagtgatgcca

SEQ ID NO: 552115 - DNA, 25 bp, Rattus norvegicus
tacggtgatccctacagtgatgcca

SEQ ID NO: 552116 - DNA, 25 bp, Rattus norvegicus
tacggtgatgaacgacagcgctgaa

SEQ ID NO: 552117 - DNA, 25 bp, Rattus norvegicus
tacggtgatgaaggacagcgctgaa

SEQ ID NO: 552118 - DNA, 25 bp, Rattus norvegicus
tacggtgatggacgacctgcctctg

SEQ ID NO: 552119 - DNA, 25 bp, Rattus norvegicus
tacggtgatggaggacctgcctctg

SEQ ID NO: 552120 - DNA, 25 bp, Rattus norvegicus
tacggtgcagagacccgctgtgaac

SEQ ID NO: 552121 - DNA, 25 bp, Rattus norvegicus
tacggtgcagagtcccgctgtgaac

SEQ ID NO: 552122 - DNA, 25 bp, Rattus norvegicus
tacggtggttctccctgtgatgaat

SEQ ID NO: 552123 - DNA, 25 bp, Rattus norvegicus
tacggtggttctgcctgtgatgaat

SEQ ID NO: 552124 - DNA, 25 bp, Rattus norvegicus
tacggtgtacatactgcaccctgta

SEQ ID NO: 552125 - DNA, 25 bp, Rattus norvegicus
tacggtgtacattctgcaccctgta

SEQ ID NO: 552126 - DNA, 25 bp, Rattus norvegicus
tacggtgtcatactgggtcctttgc

SEQ ID NO: 552127 - DNA, 25 bp, Rattus norvegicus
tacggtgtcatagtgggtcctttgc

SEQ ID NO: 552128 - DNA, 25 bp, Rattus norvegicus
tacggtgtcccaccggcagctcaga

SEQ ID NO: 552129 - DNA, 25 bp, Rattus norvegicus
tacggtgtcccagcggcagctcaga

SEQ ID NO: 552130 - DNA, 25 bp, Rattus norvegicus
tacggtgtccttattcatggtggtt

SEQ ID NO: 552131 - DNA, 25 bp, Rattus norvegicus
tacggtgtcctttttcatggtggtt

SEQ ID NO: 552132 - DNA, 25 bp, Rattus norvegicus
tacggtgtcttgctacctcagttga

SEQ ID NO: 552133 - DNA, 25 bp, Rattus norvegicus
tacggtgtcttggtacctcagttga

SEQ ID NO: 552134 - DNA, 25 bp, Rattus norvegicus
tacggtgtgcctcgctctccggcaa

SEQ ID NO: 552135 - DNA, 25 bp, Rattus norvegicus
tacggtgtgcctggctctccggcaa

SEQ ID NO: 552136 - DNA, 25 bp, Rattus norvegicus
tacggtgtttttactggcctgtctc

SEQ ID NO: 552137 - DNA, 25 bp, Rattus norvegicus
tacggtgttttttctggcctgtctc

SEQ ID NO: 552138 - DNA, 25 bp, Rattus norvegicus
tacggttacaagatgtgcctgcgcc

SEQ ID NO: 552139 - DNA, 25 bp, Rattus norvegicus
tacggttacaagttgtgcctgcgcc

SEQ ID NO: 552140 - DNA, 25 bp, Rattus norvegicus
tacggttcatgcaggttattttagg

SEQ ID NO: 552141 - DNA, 25 bp, Rattus norvegicus
tacggttcatgctggttattttagg

SEQ ID NO: 552142 - DNA, 25 bp, Rattus norvegicus
tacggttctgaactctgccaatgaa

SEQ ID NO: 552143 - DNA, 25 bp, Rattus norvegicus
tacggttctgaagtctgccaatgaa

SEQ ID NO: 552144 - DNA, 25 bp, Rattus norvegicus
tacggttctgtgatctactctgatc

SEQ ID NO: 552145 - DNA, 25 bp, Rattus norvegicus
tacggttctgtgttctactctgatc

SEQ ID NO: 552146 - DNA, 25 bp, Rattus norvegicus
tacggttgatggctgccggcaatca

SEQ ID NO: 552147 - DNA, 25 bp, Rattus norvegicus
tacggttgatgggtgccggcaatca

SEQ ID NO: 552148 - DNA, 25 bp, Rattus norvegicus
tacggttgcaaactgctgaccacgc

SEQ ID NO: 552149 - DNA, 25 bp, Rattus norvegicus
tacggttgcaaagtgctgaccacgc

SEQ ID NO: 552150 - DNA, 25 bp, Rattus norvegicus
tacggttgcacccagagctgtcagg

SEQ ID NO: 552151 - DNA, 25 bp, Rattus norvegicus
tacggttgcaccgagagctgtcagg

SEQ ID NO: 552152 - DNA, 25 bp, Rattus norvegicus
tacggtttagcaagtgtttggttct

SEQ ID NO: 552153 - DNA, 25 bp, Rattus norvegicus
tacggtttagcatgtgtttggttct

SEQ ID NO: 552154 - DNA, 25 bp, Rattus norvegicus
tacggtttgtgcaccacacccaagg

SEQ ID NO: 552155 - DNA, 25 bp, Rattus norvegicus
tacggtttgtgctccacacccaagg

SEQ ID NO: 552156 - DNA, 25 bp, Rattus norvegicus
tacgtaagaccaagtaccgcagctt

SEQ ID NO: 552157 - DNA, 25 bp, Rattus norvegicus
tacgtaagaccatgtaccgcagctt

SEQ ID NO: 552158 - DNA, 25 bp, Rattus norvegicus
tacgtaagttcacctcccagaggtg

SEQ ID NO: 552159 - DNA, 25 bp, Rattus norvegicus
tacgtaagttcagctcccagaggtg

SEQ ID NO: 552160 - DNA, 25 bp, Rattus norvegicus
tacgtaattactcggctctgcggcc

SEQ ID NO: 552161 - DNA, 25 bp, Rattus norvegicus
tacgtaattactgggctctgcggcc

SEQ ID NO: 552162 - DNA, 25 bp, Rattus norvegicus
tacgtaatttcgaccagagccactg

SEQ ID NO: 552163 - DNA, 25 bp, Rattus norvegicus
tacgtaatttcgtccagagccactg

SEQ ID NO: 552164 - DNA, 25 bp, Rattus norvegicus
tacgtacaatatacacaggcccact

SEQ ID NO: 552165 - DNA, 25 bp, Rattus norvegicus
tacgtacaatattcacaggcccact

SEQ ID NO: 552166 - DNA, 25 bp, Rattus norvegicus
tacgtacctacgatttcatgcgtca

SEQ ID NO: 552167 - DNA, 25 bp, Rattus norvegicus
tacgtacctacgttttcatgcgtca

SEQ ID NO: 552168 - DNA, 25 bp, Rattus norvegicus
tacgtactgtttacactggtttctt

SEQ ID NO: 552169 - DNA, 25 bp, Rattus norvegicus
tacgtactgttttcactggtttctt

SEQ ID NO: 552170 - DNA, 25 bp, Rattus norvegicus
tacgtacttttgagacttgcccata

SEQ ID NO: 552171 - DNA, 25 bp, Rattus norvegicus
tacgtacttttgtgacttgcccata

SEQ ID NO: 552172 - DNA, 25 bp, Rattus norvegicus
tacgtagaaaccacttcgtaccgct

SEQ ID NO: 552173 - DNA, 25 bp, Rattus norvegicus
tacgtagaaacctcttcgtaccgct

SEQ ID NO: 552174 - DNA, 25 bp, Rattus norvegicus
tacgtagactaaagtgttcggtgct

SEQ ID NO: 552175 - DNA, 25 bp, Rattus norvegicus
tacgtagactaatgtgttcggtgct

SEQ ID NO: 552176 - DNA, 25 bp, Rattus norvegicus
tacgtagcaaggactgtcttcctgc

SEQ ID NO: 552177 - DNA, 25 bp, Rattus norvegicus
tacgtagcaaggtctgtcttcctgc

SEQ ID NO: 552178 - DNA, 25 bp, Rattus norvegicus
tacgtagcactacggactcggaaat

SEQ ID NO: 552179 - DNA, 25 bp, Rattus norvegicus
tacgtagcactagggactcggaaat

SEQ ID NO: 552180 - DNA, 25 bp, Rattus norvegicus
tacgtagcattcaggacgaggcacc

SEQ ID NO: 552181 - DNA, 25 bp, Rattus norvegicus
tacgtagcattctggacgaggcacc

SEQ ID NO: 552182 - DNA, 25 bp, Rattus norvegicus
tacgtagccgacactggtgacaggt

SEQ ID NO: 552183 - DNA, 25 bp, Rattus norvegicus
tacgtagccgactctggtgacaggt

SEQ ID NO: 552184 - DNA, 25 bp, Rattus norvegicus
tacgtagtactaatcctcagcttca

SEQ ID NO: 552185 - DNA, 25 bp, Rattus norvegicus
tacgtagtactattcctcagcttca

SEQ ID NO: 552186 - DNA, 25 bp, Rattus norvegicus
tacgtagtccgtcggactccgattg

SEQ ID NO: 552187 - DNA, 25 bp, Rattus norvegicus
tacgtagtccgtgggactccgattg

SEQ ID NO: 552188 - DNA, 25 bp, Rattus norvegicus
tacgtagtgctccttttttgtcctg

SEQ ID NO: 552189 - DNA, 25 bp, Rattus norvegicus
tacgtagtgctcgttttttgtcctg

SEQ ID NO: 552190 - DNA, 25 bp, Rattus norvegicus
tacgtatcaagtcctagcactgcca

SEQ ID NO: 552191 - DNA, 25 bp, Rattus norvegicus
tacgtatcaagtgctagcactgcca

SEQ ID NO: 552192 - DNA, 25 bp, Rattus norvegicus
tacgtatctccgagtgcctgggatg

SEQ ID NO: 552193 - DNA, 25 bp, Rattus norvegicus
tacgtatctccgtgtgcctgggatg

SEQ ID NO: 552194 - DNA, 25 bp, Rattus norvegicus
tacgtatgcgggacctcgtgtgtgt

SEQ ID NO: 552195 - DNA, 25 bp, Rattus norvegicus
tacgtatgcgggtcctcgtgtgtgt

SEQ ID NO: 552196 - DNA, 25 bp, Rattus norvegicus
tacgtattcgcgagtgtttttccgc

SEQ ID NO: 552197 - DNA, 25 bp, Rattus norvegicus
tacgtattcgcgtgtgtttttccgc

SEQ ID NO: 552198 - DNA, 25 bp, Rattus norvegicus
tacgtcaaagtgaccctactatgtg

SEQ ID NO: 552199 - DNA, 25 bp, Rattus norvegicus
tacgtcaaagtgtccctactatgtg

SEQ ID NO: 552200 - DNA, 25 bp, Rattus norvegicus
tacgtcacaagcagggcactatcat

SEQ ID NO: 552201 - DNA, 25 bp, Rattus norvegicus
tacgtcacaagctgggcactatcat

SEQ ID NO: 552202 - DNA, 25 bp, Rattus norvegicus
tacgtcacctatcagcctgcagaag

SEQ ID NO: 552203 - DNA, 25 bp, Rattus norvegicus
tacgtcacctatgagcctgcagaag

SEQ ID NO: 552204 - DNA, 25 bp, Rattus norvegicus
tacgtcagggacacgctggacagta

SEQ ID NO: 552205 - DNA, 25 bp, Rattus norvegicus
tacgtcagggactcgctggacagta

SEQ ID NO: 552206 - DNA, 25 bp, Rattus norvegicus
tacgtcagtcggcttaggttactat

SEQ ID NO: 552207 - DNA, 25 bp, Rattus norvegicus
tacgtcagtcgggttaggttactat

SEQ ID NO: 552208 - DNA, 25 bp, Rattus norvegicus
tacgtcagttctcctgtggtccaaa

SEQ ID NO: 552209 - DNA, 25 bp, Rattus norvegicus
tacgtcagttctgctgtggtccaaa

SEQ ID NO: 552210 - DNA, 25 bp, Rattus norvegicus
tacgtcatcctcatcccagtattta

SEQ ID NO: 552211 - DNA, 25 bp, Rattus norvegicus
tacgtcatcctcttcccagtattta

SEQ ID NO: 552212 - DNA, 25 bp, Rattus norvegicus
tacgtcatggctctctcctggagca

SEQ ID NO: 552213 - DNA, 25 bp, Rattus norvegicus
tacgtcatggctgtctcctggagca

SEQ ID NO: 552214 - DNA, 25 bp, Rattus norvegicus
tacgtcattgctctagagatcccca

SEQ ID NO: 552215 - DNA, 25 bp, Rattus norvegicus
tacgtcattgctgtagagatcccca

SEQ ID NO: 552216 - DNA, 25 bp, Rattus norvegicus
tacgtcccaaaaagtgattcccaaa

SEQ ID NO: 552217 - DNA, 25 bp, Rattus norvegicus
tacgtcccaaaatgtgattcccaaa

SEQ ID NO: 552218 - DNA, 25 bp, Rattus norvegicus
tacgtcccatggctgatgtcttgct

SEQ ID NO: 552219 - DNA, 25 bp, Rattus norvegicus
tacgtcccatgggtgatgtcttgct

SEQ ID NO: 552220 - DNA, 25 bp, Rattus norvegicus
tacgtccctaggaggtatggtcctt

SEQ ID NO: 552221 - DNA, 25 bp, Rattus norvegicus
tacgtccctaggtggtatggtcctt

SEQ ID NO: 552222 - DNA, 25 bp, Rattus norvegicus
tacgtccgagcactgacttcagaaa

SEQ ID NO: 552223 - DNA, 25 bp, Rattus norvegicus
tacgtccgagcagtgacttcagaaa

SEQ ID NO: 552224 - DNA, 25 bp, Rattus norvegicus
tacgtcctatttcccagcatgcgtc

SEQ ID NO: 552225 - DNA, 25 bp, Rattus norvegicus
tacgtcctatttgccagcatgcgtc

SEQ ID NO: 552226 - DNA, 25 bp, Rattus norvegicus
tacgtcctgctaattgcagtgtcgc

SEQ ID NO: 552227 - DNA, 25 bp, Rattus norvegicus
tacgtcctgctatttgcagtgtcgc

SEQ ID NO: 552228 - DNA, 25 bp, Rattus norvegicus
tacgtcctggacctcgagatggtca

SEQ ID NO: 552229 - DNA, 25 bp, Rattus norvegicus
tacgtcctggacgtcgagatggtca

SEQ ID NO: 552230 - DNA, 25 bp, Rattus norvegicus
tacgtcgtgcgcaccatactggtct

SEQ ID NO: 552231 - DNA, 25 bp, Rattus norvegicus
tacgtcgtgcgctccatactggtct

SEQ ID NO: 552232 - DNA, 25 bp, Rattus norvegicus
tacgtcgtgtccatctgggtggtgt

SEQ ID NO: 552233 - DNA, 25 bp, Rattus norvegicus
tacgtcgtgtccttctgggtggtgt

SEQ ID NO: 552234 - DNA, 25 bp, Rattus norvegicus
tacgtctaccgcctgatgagcgagc

SEQ ID NO: 552235 - DNA, 25 bp, Rattus norvegicus
tacgtctaccgcgtgatgagcgagc

SEQ ID NO: 552236 - DNA, 25 bp, Rattus norvegicus
tacgtctacgccaaaggtcaaggca

SEQ ID NO: 552237 - DNA, 25 bp, Rattus norvegicus
tacgtctacgcctaaggtcaaggca

SEQ ID NO: 552238 - DNA, 25 bp, Rattus norvegicus
tacgtctacttcagttcggcagtca

SEQ ID NO: 552239 - DNA, 25 bp, Rattus norvegicus
tacgtctacttctgttcggcagtca

SEQ ID NO: 552240 - DNA, 25 bp, Rattus norvegicus
tacgtgaaagccatgcgtttccact

SEQ ID NO: 552241 - DNA, 25 bp, Rattus norvegicus
tacgtgaaagccttgcgtttccact

SEQ ID NO: 552242 - DNA, 25 bp, Rattus norvegicus
tacgtgagcacgaggcattcagatg

SEQ ID NO: 552243 - DNA, 25 bp, Rattus norvegicus
tacgtgagcacgtggcattcagatg

SEQ ID NO: 552244 - DNA, 25 bp, Rattus norvegicus
tacgtgagtttgcaattccttaaat

SEQ ID NO: 552245 - DNA, 25 bp, Rattus norvegicus
tacgtgagtttggaattccttaaat

SEQ ID NO: 552246 - DNA, 25 bp, Rattus norvegicus
tacgtgatatttactccgtgcggtt

SEQ ID NO: 552247 - DNA, 25 bp, Rattus norvegicus
tacgtgatattttctccgtgcggtt

SEQ ID NO: 552248 - DNA, 25 bp, Rattus norvegicus
tacgtgatcaaaccctccgcaggtt

SEQ ID NO: 552249 - DNA, 25 bp, Rattus norvegicus
tacgtgatcaaagcctccgcaggtt

SEQ ID NO: 552250 - DNA, 25 bp, Rattus norvegicus
tacgtgatcatgaggcattcagagt

SEQ ID NO: 552251 - DNA, 25 bp, Rattus norvegicus
tacgtgatcatgtggcattcagagt

SEQ ID NO: 552252 - DNA, 25 bp, Rattus norvegicus
tacgtgatgactatgctggaggaca

SEQ ID NO: 552253 - DNA, 25 bp, Rattus norvegicus
tacgtgatgactttgctggaggaca

SEQ ID NO: 552254 - DNA, 25 bp, Rattus norvegicus
tacgtgcacacgctgccctcagaag

SEQ ID NO: 552255 - DNA, 25 bp, Rattus norvegicus
tacgtgcacacggtgccctcagaag

SEQ ID NO: 552256 - DNA, 25 bp, Rattus norvegicus
tacgtgcagtccaccgcttgcaaga

SEQ ID NO: 552257 - DNA, 25 bp, Rattus norvegicus
tacgtgcagtcctccgcttgcaaga

SEQ ID NO: 552258 - DNA, 25 bp, Rattus norvegicus
tacgtgcagtttaccgagattctta

SEQ ID NO: 552259 - DNA, 25 bp, Rattus norvegicus
tacgtgcagttttccgagattctta

SEQ ID NO: 552260 - DNA, 25 bp, Rattus norvegicus
tacgtgcatcagcttgacccgggag

SEQ ID NO: 552261 - DNA, 25 bp, Rattus norvegicus
tacgtgcatcaggttgacccgggag

SEQ ID NO: 552262 - DNA, 25 bp, Rattus norvegicus
tacgtgcatgctctttgtgtgtttg

SEQ ID NO: 552263 - DNA, 25 bp, Rattus norvegicus
tacgtgcatgctgtttgtgtgtttg

SEQ ID NO: 552264 - DNA, 25 bp, Rattus norvegicus
tacgtgctgcacaggaagatactta

SEQ ID NO: 552265 - DNA, 25 bp, Rattus norvegicus
tacgtgctgcactggaagatactta

SEQ ID NO: 552266 - DNA, 25 bp, Rattus norvegicus
tacgtgctggagagcgatcaccact

SEQ ID NO: 552267 - DNA, 25 bp, Rattus norvegicus
tacgtgctggagtgcgatcaccact

SEQ ID NO: 552268 - DNA, 25 bp, Rattus norvegicus
tacgtgcttgctatctgcctctgca

SEQ ID NO: 552269 - DNA, 25 bp, Rattus norvegicus
tacgtgcttgctttctgcctctgca

SEQ ID NO: 552270 - DNA, 25 bp, Rattus norvegicus
tacgtggacatccacccctttgaga

SEQ ID NO: 552271 - DNA, 25 bp, Rattus norvegicus
tacgtggacatcgacccctttgaga

SEQ ID NO: 552272 - DNA, 25 bp, Rattus norvegicus
tacgtggcaaaaccctgtcaagatg

SEQ ID NO: 552273 - DNA, 25 bp, Rattus norvegicus
tacgtggcaaaagcctgtcaagatg

SEQ ID NO: 552274 - DNA, 25 bp, Rattus norvegicus
tacgtggcagcaagatccggtttct

SEQ ID NO: 552275 - DNA, 25 bp, Rattus norvegicus
tacgtggcagcatgatccggtttct

SEQ ID NO: 552276 - DNA, 25 bp, Rattus norvegicus
tacgtggccttcatgtggacaaacc

SEQ ID NO: 552277 - DNA, 25 bp, Rattus norvegicus
tacgtggccttcttgtggacaaacc

SEQ ID NO: 552278 - DNA, 25 bp, Rattus norvegicus
tacgtggcgtctaacgtggctggca

SEQ ID NO: 552279 - DNA, 25 bp, Rattus norvegicus
tacgtggcgtcttacgtggctggca

SEQ ID NO: 552280 - DNA, 25 bp, Rattus norvegicus
tacgtggcgtgtcacattcctgaac

SEQ ID NO: 552281 - DNA, 25 bp, Rattus norvegicus
tacgtggcgtgtgacattcctgaac

SEQ ID NO: 552282 - DNA, 25 bp, Rattus norvegicus
tacgtggctttcagtaacttgtaga

SEQ ID NO: 552283 - DNA, 25 bp, Rattus norvegicus
tacgtggctttctgtaacttgtaga

SEQ ID NO: 552284 - DNA, 25 bp, Rattus norvegicus
tacgtgggaagtactctacctgctg

SEQ ID NO: 552285 - DNA, 25 bp, Rattus norvegicus
tacgtgggaagttctctacctgctg

SEQ ID NO: 552286 - DNA, 25 bp, Rattus norvegicus
tacgtgggtgtcacacaggatagca

SEQ ID NO: 552287 - DNA, 25 bp, Rattus norvegicus
tacgtgggtgtctcacaggatagca

SEQ ID NO: 552288 - DNA, 25 bp, Rattus norvegicus
tacgtgggttagctcatttgggaaa

SEQ ID NO: 552289 - DNA, 25 bp, Rattus norvegicus
tacgtgggttaggtcatttgggaaa

SEQ ID NO: 552290 - DNA, 25 bp, Rattus norvegicus
tacgtggtcgttagtctgctctgga

SEQ ID NO: 552291 - DNA, 25 bp, Rattus norvegicus
tacgtggtcgtttgtctgctctgga

SEQ ID NO: 552292 - DNA, 25 bp, Rattus norvegicus
tacgtggtgtgtcagccaataaacc

SEQ ID NO: 552293 - DNA, 25 bp, Rattus norvegicus
tacgtggtgtgtgagccaataaacc

SEQ ID NO: 552294 - DNA, 25 bp, Rattus norvegicus
tacgtggtttgaatcctggctacat

SEQ ID NO: 552295 - DNA, 25 bp, Rattus norvegicus
tacgtggtttgattcctggctacat

SEQ ID NO: 552296 - DNA, 25 bp, Rattus norvegicus
tacgtgtacgtcaagtgtcagtatt

SEQ ID NO: 552297 - DNA, 25 bp, Rattus norvegicus
tacgtgtacgtctagtgtcagtatt

SEQ ID NO: 552298 - DNA, 25 bp, Rattus norvegicus
tacgtgtctcccaatatgtctagtc

SEQ ID NO: 552299 - DNA, 25 bp, Rattus norvegicus
tacgtgtctccctatatgtctagtc

SEQ ID NO: 552300 - DNA, 25 bp, Rattus norvegicus
tacgtgtctttgagtagcgtccaca

SEQ ID NO: 552301 - DNA, 25 bp, Rattus norvegicus
tacgtgtctttgtgtagcgtccaca

SEQ ID NO: 552302 - DNA, 25 bp, Rattus norvegicus
tacgtgtgcgcactgacccgagaca

SEQ ID NO: 552303 - DNA, 25 bp, Rattus norvegicus
tacgtgtgcgcagtgacccgagaca

SEQ ID NO: 552304 - DNA, 25 bp, Rattus norvegicus
tacgtgtgtacacccatctcaagag

SEQ ID NO: 552305 - DNA, 25 bp, Rattus norvegicus
tacgtgtgtacagccatctcaagag

SEQ ID NO: 552306 - DNA, 25 bp, Rattus norvegicus
tacgtgtgtggccacacccagctgc

SEQ ID NO: 552307 - DNA, 25 bp, Rattus norvegicus
tacgtgtgtggcgacacccagctgc

SEQ ID NO: 552308 - DNA, 25 bp, Rattus norvegicus
tacgtgtgtttgattcctgttggga

SEQ ID NO: 552309 - DNA, 25 bp, Rattus norvegicus
tacgtgtgtttgtttcctgttggga

SEQ ID NO: 552310 - DNA, 25 bp, Rattus norvegicus
tacgtgtttcgtactgttactccaa

SEQ ID NO: 552311 - DNA, 25 bp, Rattus norvegicus
tacgtgtttcgttctgttactccaa

SEQ ID NO: 552312 - DNA, 25 bp, Rattus norvegicus
tacgtgtttgtgattctgggcctca

SEQ ID NO: 552313 - DNA, 25 bp, Rattus norvegicus
tacgtgtttgtgtttctgggcctca

SEQ ID NO: 552314 - DNA, 25 bp, Rattus norvegicus
tacgtgttttagaagccctggctct

SEQ ID NO: 552315 - DNA, 25 bp, Rattus norvegicus
tacgtgttttagtagccctggctct

SEQ ID NO: 552316 - DNA, 25 bp, Rattus norvegicus
tacgttagtcctagctgacctggag

SEQ ID NO: 552317 - DNA, 25 bp, Rattus norvegicus
tacgttagtccttgctgacctggag

SEQ ID NO: 552318 - DNA, 25 bp, Rattus norvegicus
tacgttatccttcgaagcggaggga

SEQ ID NO: 552319 - DNA, 25 bp, Rattus norvegicus
tacgttatccttggaagcggaggga

SEQ ID NO: 552320 - DNA, 25 bp, Rattus norvegicus
tacgttcatgcactaaacactgttt

SEQ ID NO: 552321 - DNA, 25 bp, Rattus norvegicus
tacgttcatgcagtaaacactgttt

SEQ ID NO: 552322 - DNA, 25 bp, Rattus norvegicus
tacgttccaagacgagctgttccct

SEQ ID NO: 552323 - DNA, 25 bp, Rattus norvegicus
tacgttccaagaggagctgttccct

SEQ ID NO: 552324 - DNA, 25 bp, Rattus norvegicus
tacgttccaggaacagtctctgcag

SEQ ID NO: 552325 - DNA, 25 bp, Rattus norvegicus
tacgttccaggatcagtctctgcag

SEQ ID NO: 552326 - DNA, 25 bp, Rattus norvegicus
tacgttcccaggaattaatctactg

SEQ ID NO: 552327 - DNA, 25 bp, Rattus norvegicus
tacgttcccaggtattaatctactg

SEQ ID NO: 552328 - DNA, 25 bp, Rattus norvegicus
tacgttccctttacttgttgtagat

SEQ ID NO: 552329 - DNA, 25 bp, Rattus norvegicus
tacgttcccttttcttgttgtagat

SEQ ID NO: 552330 - DNA, 25 bp, Rattus norvegicus
tacgttctgtagatagcctgtactt

SEQ ID NO: 552331 - DNA, 25 bp, Rattus norvegicus
tacgttctgtagttagcctgtactt

SEQ ID NO: 552332 - DNA, 25 bp, Rattus norvegicus
tacgttctttggcattctacacact

SEQ ID NO: 552333 - DNA, 25 bp, Rattus norvegicus
tacgttctttgggattctacacact

SEQ ID NO: 552334 - DNA, 25 bp, Rattus norvegicus
tacgttgcagttatccgaccaaaga

SEQ ID NO: 552335 - DNA, 25 bp, Rattus norvegicus
tacgttgcagttttccgaccaaaga

SEQ ID NO: 552336 - DNA, 25 bp, Rattus norvegicus
tacgttgctaccagtggtttctcag

SEQ ID NO: 552337 - DNA, 25 bp, Rattus norvegicus
tacgttgctacctgtggtttctcag

SEQ ID NO: 552338 - DNA, 25 bp, Rattus norvegicus
tacgttgctcctactcacaatagtg

SEQ ID NO: 552339 - DNA, 25 bp, Rattus norvegicus
tacgttgctccttctcacaatagtg

SEQ ID NO: 552340 - DNA, 25 bp, Rattus norvegicus
tacgttggaacgagccccggaatgt

SEQ ID NO: 552341 - DNA, 25 bp, Rattus norvegicus
tacgttggaacgtgccccggaatgt

SEQ ID NO: 552342 - DNA, 25 bp, Rattus norvegicus
tacgttggcaaactcaagtcgtcag

SEQ ID NO: 552343 - DNA, 25 bp, Rattus norvegicus
tacgttggcaaagtcaagtcgtcag

SEQ ID NO: 552344 - DNA, 25 bp, Rattus norvegicus
tacgttggttctcacgccgttaaca

SEQ ID NO: 552345 - DNA, 25 bp, Rattus norvegicus
tacgttggttctgacgccgttaaca

SEQ ID NO: 552346 - DNA, 25 bp, Rattus norvegicus
tacgttgtagctctgatgtcgaccc

SEQ ID NO: 552347 - DNA, 25 bp, Rattus norvegicus
tacgttgtagctgtgatgtcgaccc

SEQ ID NO: 552348 - DNA, 25 bp, Rattus norvegicus
tacgttgtcaaacgcccaagggcta

SEQ ID NO: 552349 - DNA, 25 bp, Rattus norvegicus
tacgttgtcaaaggcccaagggcta

SEQ ID NO: 552350 - DNA, 25 bp, Rattus norvegicus
tacgtttaagtcagtgggttctaca

SEQ ID NO: 552351 - DNA, 25 bp, Rattus norvegicus
tacgtttaagtctgtgggttctaca

SEQ ID NO: 552352 - DNA, 25 bp, Rattus norvegicus
tacgtttccgttatttcaggacatg

SEQ ID NO: 552353 - DNA, 25 bp, Rattus norvegicus
tacgtttccgttttttcaggacatg

SEQ ID NO: 552354 - DNA, 25 bp, Rattus norvegicus
tacgtttcttccagcataactgctt

SEQ ID NO: 552355 - DNA, 25 bp, Rattus norvegicus
tacgtttcttcctgcataactgctt

SEQ ID NO: 552356 - DNA, 25 bp, Rattus norvegicus
tacgtttgggtacagaaatgtgccc

SEQ ID NO: 552357 - DNA, 25 bp, Rattus norvegicus
tacgtttgggtagagaaatgtgccc

SEQ ID NO: 552358 - DNA, 25 bp, Rattus norvegicus
tacgtttgtaatactaaagggctca

SEQ ID NO: 552359 - DNA, 25 bp, Rattus norvegicus
tacgtttgtaattctaaagggctca

SEQ ID NO: 552360 - DNA, 25 bp, Rattus norvegicus
tactaaaaactaccttccaccattg

SEQ ID NO: 552361 - DNA, 25 bp, Rattus norvegicus
tactaaaaactagcttccaccattg

SEQ ID NO: 552362 - DNA, 25 bp, Rattus norvegicus
tactaaaagggaacagctggctgga

SEQ ID NO: 552363 - DNA, 25 bp, Rattus norvegicus
tactaaaagggatcagctggctgga

SEQ ID NO: 552364 - DNA, 25 bp, Rattus norvegicus
tactaaaccaggctcctccggattg

SEQ ID NO: 552365 - DNA, 25 bp, Rattus norvegicus
tactaaaccagggtcctccggattg

SEQ ID NO: 552366 - DNA, 25 bp, Rattus norvegicus
tactaaacttttacttgacggagtg

SEQ ID NO: 552367 - DNA, 25 bp, Rattus norvegicus
tactaaactttttcttgacggagtg

SEQ ID NO: 552368 - DNA, 25 bp, Rattus norvegicus
tactaaagtggcctactccagcttt

SEQ ID NO: 552369 - DNA, 25 bp, Rattus norvegicus
tactaaagtggcgtactccagcttt

SEQ ID NO: 552370 - DNA, 25 bp, Rattus norvegicus
tactaaataggtctgtgaggcccca

SEQ ID NO: 552371 - DNA, 25 bp, Rattus norvegicus
tactaaataggtgtgtgaggcccca

SEQ ID NO: 552372 - DNA, 25 bp, Rattus norvegicus
tactaaatcgagagccgtctccggc

SEQ ID NO: 552373 - DNA, 25 bp, Rattus norvegicus
tactaaatcgagtgccgtctccggc

SEQ ID NO: 552374 - DNA, 25 bp, Rattus norvegicus
tactaaatgaagaagttcctccggt

SEQ ID NO: 552375 - DNA, 25 bp, Rattus norvegicus
tactaaatgaagtagttcctccggt

SEQ ID NO: 552376 - DNA, 25 bp, Rattus norvegicus
tactaaatgcgcctaccgctgttag

SEQ ID NO: 552377 - DNA, 25 bp, Rattus norvegicus
tactaaatgcgcgtaccgctgttag

SEQ ID NO: 552378 - DNA, 25 bp, Rattus norvegicus
tactaaccctgtcaccttgtgcaaa

SEQ ID NO: 552379 - DNA, 25 bp, Rattus norvegicus
tactaaccctgtgaccttgtgcaaa

SEQ ID NO: 552380 - DNA, 25 bp, Rattus norvegicus
tactaactagcacctgttctataga

SEQ ID NO: 552381 - DNA, 25 bp, Rattus norvegicus
tactaactagcagctgttctataga

SEQ ID NO: 552382 - DNA, 25 bp, Rattus norvegicus
tactaactcatgctgccttacaagg

SEQ ID NO: 552383 - DNA, 25 bp, Rattus norvegicus
tactaactcatggtgccttacaagg

SEQ ID NO: 552384 - DNA, 25 bp, Rattus norvegicus
tactaacttagccactttttcctgg

SEQ ID NO: 552385 - DNA, 25 bp, Rattus norvegicus
tactaacttagcgactttttcctgg

SEQ ID NO: 552386 - DNA, 25 bp, Rattus norvegicus
tactaagacacaaggctctgctcct

SEQ ID NO: 552387 - DNA, 25 bp, Rattus norvegicus
tactaagacacatggctctgctcct

SEQ ID NO: 552388 - DNA, 25 bp, Rattus norvegicus
tactaagagtttcagacggcacaca

SEQ ID NO: 552389 - DNA, 25 bp, Rattus norvegicus
tactaagagtttgagacggcacaca

SEQ ID NO: 552390 - DNA, 25 bp, Rattus norvegicus
tactaagatcttcttctccaattgg

SEQ ID NO: 552391 - DNA, 25 bp, Rattus norvegicus
tactaagatcttgttctccaattgg

SEQ ID NO: 552392 - DNA, 25 bp, Rattus norvegicus
tactaagattctaggatccctgaat

SEQ ID NO: 552393 - DNA, 25 bp, Rattus norvegicus
tactaagattcttggatccctgaat

SEQ ID NO: 552394 - DNA, 25 bp, Rattus norvegicus
tactaagcagccctggctagacttc

SEQ ID NO: 552395 - DNA, 25 bp, Rattus norvegicus
tactaagcagccgtggctagacttc

SEQ ID NO: 552396 - DNA, 25 bp, Rattus norvegicus
tactaagcccaacgacccgagtttg

SEQ ID NO: 552397 - DNA, 25 bp, Rattus norvegicus
tactaagcccaaggacccgagtttg

SEQ ID NO: 552398 - DNA, 25 bp, Rattus norvegicus
tactaaggctggacctactgggtgg

SEQ ID NO: 552399 - DNA, 25 bp, Rattus norvegicus
tactaaggctggtcctactgggtgg

SEQ ID NO: 552400 - DNA, 25 bp, Rattus norvegicus
tactaagtactcagtctgtttgttt

SEQ ID NO: 552401 - DNA, 25 bp, Rattus norvegicus
tactaagtactctgtctgtttgttt

SEQ ID NO: 552402 - DNA, 25 bp, Rattus norvegicus
tactaagtcctgcattcccattaaa

SEQ ID NO: 552403 - DNA, 25 bp, Rattus norvegicus
tactaagtcctggattcccattaaa

SEQ ID NO: 552404 - DNA, 25 bp, Rattus norvegicus
tactaagtcttccaggtctctaggg

SEQ ID NO: 552405 - DNA, 25 bp, Rattus norvegicus
tactaagtcttcgaggtctctaggg

SEQ ID NO: 552406 - DNA, 25 bp, Rattus norvegicus
tactaagtgcctagggttgccggct

SEQ ID NO: 552407 - DNA, 25 bp, Rattus norvegicus
tactaagtgccttgggttgccggct

SEQ ID NO: 552408 - DNA, 25 bp, Rattus norvegicus
tactaagtgctgaactaggtagggt

SEQ ID NO: 552409 - DNA, 25 bp, Rattus norvegicus
tactaagtgctgtactaggtagggt

SEQ ID NO: 552410 - DNA, 25 bp, Rattus norvegicus
tactaagttgcactggctgtcccca

SEQ ID NO: 552411 - DNA, 25 bp, Rattus norvegicus
tactaagttgcagtggctgtcccca

SEQ ID NO: 552412 - DNA, 25 bp, Rattus norvegicus
tactaataaattacactccgtgcat

SEQ ID NO: 552413 - DNA, 25 bp, Rattus norvegicus
tactaataaatttcactccgtgcat

SEQ ID NO: 552414 - DNA, 25 bp, Rattus norvegicus
tactaatctcatccgaagacgtcct

SEQ ID NO: 552415 - DNA, 25 bp, Rattus norvegicus
tactaatctcatgcgaagacgtcct

SEQ ID NO: 552416 - DNA, 25 bp, Rattus norvegicus
tactaatggatgcagtgaccgcacc

SEQ ID NO: 552417 - DNA, 25 bp, Rattus norvegicus
tactaatggatggagtgaccgcacc

SEQ ID NO: 552418 - DNA, 25 bp, Rattus norvegicus
tactaatgtgctctgctgtaggaca

SEQ ID NO: 552419 - DNA, 25 bp, Rattus norvegicus
tactaatgtgctgtgctgtaggaca

SEQ ID NO: 552420 - DNA, 25 bp, Rattus norvegicus
tactaattcctacacggcctgtata

SEQ ID NO: 552421 - DNA, 25 bp, Rattus norvegicus
tactaattcctagacggcctgtata

SEQ ID NO: 552422 - DNA, 25 bp, Rattus norvegicus
tactacaactctaggaagcggcgtc

SEQ ID NO: 552423 - DNA, 25 bp, Rattus norvegicus
tactacaactcttggaagcggcgtc

SEQ ID NO: 552424 - DNA, 25 bp, Rattus norvegicus
tactacaagcctatctaggcaacat

SEQ ID NO: 552425 - DNA, 25 bp, Rattus norvegicus
tactacaagcctttctaggcaacat

SEQ ID NO: 552426 - DNA, 25 bp, Rattus norvegicus
tactacaccagacagatgcgctcag

SEQ ID NO: 552427 - DNA, 25 bp, Rattus norvegicus
tactacaccagagagatgcgctcag

SEQ ID NO: 552428 - DNA, 25 bp, Rattus norvegicus
tactacaccggcatactgtgtgagc

SEQ ID NO: 552429 - DNA, 25 bp, Rattus norvegicus
tactacaccggcttactgtgtgagc

SEQ ID NO: 552430 - DNA, 25 bp, Rattus norvegicus
tactacaccgttaaacacagaacag

SEQ ID NO: 552431 - DNA, 25 bp, Rattus norvegicus
tactacaccgtttaacacagaacag

SEQ ID NO: 552432 - DNA, 25 bp, Rattus norvegicus
tactacacctgtcctgtcagacaaa

SEQ ID NO: 552433 - DNA, 25 bp, Rattus norvegicus
tactacacctgtgctgtcagacaaa

SEQ ID NO: 552434 - DNA, 25 bp, Rattus norvegicus
tactacacggccatctgagcagagc

SEQ ID NO: 552435 - DNA, 25 bp, Rattus norvegicus
tactacacggccttctgagcagagc

SEQ ID NO: 552436 - DNA, 25 bp, Rattus norvegicus
tactacactacccttcaggtttggt

SEQ ID NO: 552437 - DNA, 25 bp, Rattus norvegicus
tactacactaccgttcaggtttggt

SEQ ID NO: 552438 - DNA, 25 bp, Rattus norvegicus
tactacacttgcactgtccagaatt

SEQ ID NO: 552439 - DNA, 25 bp, Rattus norvegicus
tactacacttgctctgtccagaatt

SEQ ID NO: 552440 - DNA, 25 bp, Rattus norvegicus
tactacagaactccctgcattcatc

SEQ ID NO: 552441 - DNA, 25 bp, Rattus norvegicus
tactacagaactgcctgcattcatc

SEQ ID NO: 552442 - DNA, 25 bp, Rattus norvegicus
tactacagacctattcctggtagtt

SEQ ID NO: 552443 - DNA, 25 bp, Rattus norvegicus
tactacagaccttttcctggtagtt

SEQ ID NO: 552444 - DNA, 25 bp, Rattus norvegicus
tactacagactgcttcgggagaatc

SEQ ID NO: 552445 - DNA, 25 bp, Rattus norvegicus
tactacagactggttcgggagaatc

SEQ ID NO: 552446 - DNA, 25 bp, Rattus norvegicus
tactacagccccatggtctttaaat

SEQ ID NO: 552447 - DNA, 25 bp, Rattus norvegicus
tactacagccccttggtctttaaat

SEQ ID NO: 552448 - DNA, 25 bp, Rattus norvegicus
tactacagcttccttctgtgagtgg

SEQ ID NO: 552449 - DNA, 25 bp, Rattus norvegicus
tactacagcttcgttctgtgagtgg

SEQ ID NO: 552450 - DNA, 25 bp, Rattus norvegicus
tactacaggactccggcacttctgt

SEQ ID NO: 552451 - DNA, 25 bp, Rattus norvegicus
tactacaggactgcggcacttctgt

SEQ ID NO: 552452 - DNA, 25 bp, Rattus norvegicus
tactacagtctgaagtggccgccat

SEQ ID NO: 552453 - DNA, 25 bp, Rattus norvegicus
tactacagtctgtagtggccgccat

SEQ ID NO: 552454 - DNA, 25 bp, Rattus norvegicus
tactacagtgcacagatcaggagat

SEQ ID NO: 552455 - DNA, 25 bp, Rattus norvegicus
tactacagtgcagagatcaggagat

SEQ ID NO: 552456 - DNA, 25 bp, Rattus norvegicus
tactacatatacaccagcaacagta

SEQ ID NO: 552457 - DNA, 25 bp, Rattus norvegicus
tactacatatactccagcaacagta

SEQ ID NO: 552458 - DNA, 25 bp, Rattus norvegicus
tactacatcaagaaccaccatccaa

SEQ ID NO: 552459 - DNA, 25 bp, Rattus norvegicus
tactacatcaagtaccaccatccaa

SEQ ID NO: 552460 - DNA, 25 bp, Rattus norvegicus
tactacatgtttatgactccagaaa

SEQ ID NO: 552461 - DNA, 25 bp, Rattus norvegicus
tactacatgtttttgactccagaaa

SEQ ID NO: 552462 - DNA, 25 bp, Rattus norvegicus
tactacattgtgctttttccccaat

SEQ ID NO: 552463 - DNA, 25 bp, Rattus norvegicus
tactacattgtggtttttccccaat

SEQ ID NO: 552464 - DNA, 25 bp, Rattus norvegicus
tactaccacaagagactggcaccgg

SEQ ID NO: 552465 - DNA, 25 bp, Rattus norvegicus
tactaccacaagtgactggcaccgg

SEQ ID NO: 552466 - DNA, 25 bp, Rattus norvegicus
tactaccacctgcatgtacatttca

SEQ ID NO: 552467 - DNA, 25 bp, Rattus norvegicus
tactaccacctggatgtacatttca

SEQ ID NO: 552468 - DNA, 25 bp, Rattus norvegicus
tactaccagctacggcgaggcagca

SEQ ID NO: 552469 - DNA, 25 bp, Rattus norvegicus
tactaccagctagggcgaggcagca

SEQ ID NO: 552470 - DNA, 25 bp, Rattus norvegicus
tactaccagggcaggctcaggagac

SEQ ID NO: 552471 - DNA, 25 bp, Rattus norvegicus
tactaccagggctggctcaggagac

SEQ ID NO: 552472 - DNA, 25 bp, Rattus norvegicus
tactacccacttaccaggcattgaa

SEQ ID NO: 552473 - DNA, 25 bp, Rattus norvegicus
tactacccactttccaggcattgaa

SEQ ID NO: 552474 - DNA, 25 bp, Rattus norvegicus
tactacccagggagccttcctgcgg

SEQ ID NO: 552475 - DNA, 25 bp, Rattus norvegicus
tactacccagggtgccttcctgcgg

SEQ ID NO: 552476 - DNA, 25 bp, Rattus norvegicus
tactacccatatcgtctgggctcaa

SEQ ID NO: 552477 - DNA, 25 bp, Rattus norvegicus
tactacccatatggtctgggctcaa

SEQ ID NO: 552478 - DNA, 25 bp, Rattus norvegicus
tactacccatttctacactcaggac

SEQ ID NO: 552479 - DNA, 25 bp, Rattus norvegicus
tactacccatttgtacactcaggac

SEQ ID NO: 552480 - DNA, 25 bp, Rattus norvegicus
tactacccggtgatagcaactgact

SEQ ID NO: 552481 - DNA, 25 bp, Rattus norvegicus
tactacccggtgttagcaactgact

SEQ ID NO: 552482 - DNA, 25 bp, Rattus norvegicus
tactaccctagacttattcctacat

SEQ ID NO: 552483 - DNA, 25 bp, Rattus norvegicus
tactaccctagagttattcctacat

SEQ ID NO: 552484 - DNA, 25 bp, Rattus norvegicus
tactaccctcgtaagtcccaatata

SEQ ID NO: 552485 - DNA, 25 bp, Rattus norvegicus
tactaccctcgttagtcccaatata

SEQ ID NO: 552486 - DNA, 25 bp, Rattus norvegicus
tactaccctttgctgacttctgtgg

SEQ ID NO: 552487 - DNA, 25 bp, Rattus norvegicus
tactaccctttggtgacttctgtgg

SEQ ID NO: 552488 - DNA, 25 bp, Rattus norvegicus
tactaccggcgaccccagggaatat

SEQ ID NO: 552489 - DNA, 25 bp, Rattus norvegicus
tactaccggcgagcccagggaatat

SEQ ID NO: 552490 - DNA, 25 bp, Rattus norvegicus
tactacctctaccaatcttctgtct

SEQ ID NO: 552491 - DNA, 25 bp, Rattus norvegicus
tactacctctacgaatcttctgtct

SEQ ID NO: 552492 - DNA, 25 bp, Rattus norvegicus
tactacctgcggacaaggcctttta

SEQ ID NO: 552493 - DNA, 25 bp, Rattus norvegicus
tactacctgcggtcaaggcctttta

SEQ ID NO: 552494 - DNA, 25 bp, Rattus norvegicus
tactacgttcaacatcccatttaaa

SEQ ID NO: 552495 - DNA, 25 bp, Rattus norvegicus
tactacgttcaagatcccatttaaa

SEQ ID NO: 552496 - DNA, 25 bp, Rattus norvegicus
tactacgttctgctcattatcactg

SEQ ID NO: 552497 - DNA, 25 bp, Rattus norvegicus
tactacgttctggtcattatcactg

SEQ ID NO: 552498 - DNA, 25 bp, Rattus norvegicus
tactactactcaatggattgccggg

SEQ ID NO: 552499 - DNA, 25 bp, Rattus norvegicus
tactactactcattggattgccggg

SEQ ID NO: 552500 - DNA, 25 bp, Rattus norvegicus
tactactacttcattgcccgaaatc

SEQ ID NO: 552501 - DNA, 25 bp, Rattus norvegicus
tactactacttctttgcccgaaatc

SEQ ID NO: 552502 - DNA, 25 bp, Rattus norvegicus
tactactcaaaactccagttctagg

SEQ ID NO: 552503 - DNA, 25 bp, Rattus norvegicus
tactactcaaaagtccagttctagg

SEQ ID NO: 552504 - DNA, 25 bp, Rattus norvegicus
tactactcagttcttctcttacaaa

SEQ ID NO: 552505 - DNA, 25 bp, Rattus norvegicus
tactactcagttgttctcttacaaa

SEQ ID NO: 552506 - DNA, 25 bp, Rattus norvegicus
tactactccatgagggacttcagcc

SEQ ID NO: 552507 - DNA, 25 bp, Rattus norvegicus
tactactccatgtgggacttcagcc

SEQ ID NO: 552508 - DNA, 25 bp, Rattus norvegicus
tactactcttacatcttacttctca

SEQ ID NO: 552509 - DNA, 25 bp, Rattus norvegicus
tactactcttacttcttacttctca

SEQ ID NO: 552510 - DNA, 25 bp, Rattus norvegicus
tactactgacgtacctggccaagca

SEQ ID NO: 552511 - DNA, 25 bp, Rattus norvegicus
tactactgacgttcctggccaagca

SEQ ID NO: 552512 - DNA, 25 bp, Rattus norvegicus
tactactgcatgcactccagggtgg

SEQ ID NO: 552513 - DNA, 25 bp, Rattus norvegicus
tactactgcatggactccagggtgg

SEQ ID NO: 552514 - DNA, 25 bp, Rattus norvegicus
tactactgcattagcgtctgcgaaa

SEQ ID NO: 552515 - DNA, 25 bp, Rattus norvegicus
tactactgcatttgcgtctgcgaaa

SEQ ID NO: 552516 - DNA, 25 bp, Rattus norvegicus
tactactgctagaatgaccactgat

SEQ ID NO: 552517 - DNA, 25 bp, Rattus norvegicus
tactactgctagtatgaccactgat

SEQ ID NO: 552518 - DNA, 25 bp, Rattus norvegicus
tactactgctttcccacaaggtgtg

SEQ ID NO: 552519 - DNA, 25 bp, Rattus norvegicus
tactactgctttgccacaaggtgtg

SEQ ID NO: 552520 - DNA, 25 bp, Rattus norvegicus
tactactgtagacagtggctgtcca

SEQ ID NO: 552521 - DNA, 25 bp, Rattus norvegicus
tactactgtagagagtggctgtcca

SEQ ID NO: 552522 - DNA, 25 bp, Rattus norvegicus
tactactgtcagattaatgtccact

SEQ ID NO: 552523 - DNA, 25 bp, Rattus norvegicus
tactactgtcagtttaatgtccact

SEQ ID NO: 552524 - DNA, 25 bp, Rattus norvegicus
tactactgtgggagttgcatacgct

SEQ ID NO: 552525 - DNA, 25 bp, Rattus norvegicus
tactactgtgggtgttgcatacgct

SEQ ID NO: 552526 - DNA, 25 bp, Rattus norvegicus
tactactgtggtcttctctacttca

SEQ ID NO: 552527 - DNA, 25 bp, Rattus norvegicus
tactactgtggtgttctctacttca

SEQ ID NO: 552528 - DNA, 25 bp, Rattus norvegicus
tactacttccccacaaagaccttag

SEQ ID NO: 552529 - DNA, 25 bp, Rattus norvegicus
tactacttcccctcaaagaccttag

SEQ ID NO: 552530 - DNA, 25 bp, Rattus norvegicus
tactacttcgctatcctgatagaga

SEQ ID NO: 552531 - DNA, 25 bp, Rattus norvegicus
tactacttcgctttcctgatagaga

SEQ ID NO: 552532 - DNA, 25 bp, Rattus norvegicus
tactacttctcacagcttgcgctca

SEQ ID NO: 552533 - DNA, 25 bp, Rattus norvegicus
tactacttctcactgccatgcagtt

SEQ ID NO: 552534 - DNA, 25 bp, Rattus norvegicus
tactacttctcagagcttgcgctca

SEQ ID NO: 552535 - DNA, 25 bp, Rattus norvegicus
tactacttctcagtgccatgcagtt

SEQ ID NO: 552536 - DNA, 25 bp, Rattus norvegicus
tactacttgaatccctctgtgactg

SEQ ID NO: 552537 - DNA, 25 bp, Rattus norvegicus
tactacttgaatgcctctgtgactg

SEQ ID NO: 552538 - DNA, 25 bp, Rattus norvegicus
tactacttgctgagtttcatctggg

SEQ ID NO: 552539 - DNA, 25 bp, Rattus norvegicus
tactacttgctgtgtttcatctggg

SEQ ID NO: 552540 - DNA, 25 bp, Rattus norvegicus
tactactttctgaaggacttgtgcc

SEQ ID NO: 552541 - DNA, 25 bp, Rattus norvegicus
tactactttctgtaggacttgtgcc

SEQ ID NO: 552542 - DNA, 25 bp, Rattus norvegicus
tactactttgacatggttccttgtt

SEQ ID NO: 552543 - DNA, 25 bp, Rattus norvegicus
tactactttgacttggttccttgtt

SEQ ID NO: 552544 - DNA, 25 bp, Rattus norvegicus
tactagaacattctccgggtctacc

SEQ ID NO: 552545 - DNA, 25 bp, Rattus norvegicus
tactagaacattgtccgggtctacc

SEQ ID NO: 552546 - DNA, 25 bp, Rattus norvegicus
tactagaacctacacagctccagat

SEQ ID NO: 552547 - DNA, 25 bp, Rattus norvegicus
tactagaacctagacagctccagat

SEQ ID NO: 552548 - DNA, 25 bp, Rattus norvegicus
tactagacagcgagggcatcgaggc

SEQ ID NO: 552549 - DNA, 25 bp, Rattus norvegicus
tactagacagcgtgggcatcgaggc

SEQ ID NO: 552550 - DNA, 25 bp, Rattus norvegicus
tactagaccctaagcatactgtgtt

SEQ ID NO: 552551 - DNA, 25 bp, Rattus norvegicus
tactagaccctatgcatactgtgtt

SEQ ID NO: 552552 - DNA, 25 bp, Rattus norvegicus
tactagagtccgatactttgtccct

SEQ ID NO: 552553 - DNA, 25 bp, Rattus norvegicus
tactagagtccgttactttgtccct

SEQ ID NO: 552554 - DNA, 25 bp, Rattus norvegicus
tactagcaacccctcagttagaact

SEQ ID NO: 552555 - DNA, 25 bp, Rattus norvegicus
tactagcaacccgtcagttagaact

SEQ ID NO: 552556 - DNA, 25 bp, Rattus norvegicus
tactagcatcaaagagttactatgt

SEQ ID NO: 552557 - DNA, 25 bp, Rattus norvegicus
tactagcatcaatgagttactatgt

SEQ ID NO: 552558 - DNA, 25 bp, Rattus norvegicus
tactagccgagaacgcgtgttccac

SEQ ID NO: 552559 - DNA, 25 bp, Rattus norvegicus
tactagccgagatcgcgtgttccac

SEQ ID NO: 552560 - DNA, 25 bp, Rattus norvegicus
tactagcctattatttatgtgtcag

SEQ ID NO: 552561 - DNA, 25 bp, Rattus norvegicus
tactagcctattttttatgtgtcag

SEQ ID NO: 552562 - DNA, 25 bp, Rattus norvegicus
tactagctcaggcatctctgtttcc

SEQ ID NO: 552563 - DNA, 25 bp, Rattus norvegicus
tactagctcagggatctctgtttcc

SEQ ID NO: 552564 - DNA, 25 bp, Rattus norvegicus
tactaggaggatctctcaggctctg

SEQ ID NO: 552565 - DNA, 25 bp, Rattus norvegicus
tactaggaggatgtctcaggctctg

SEQ ID NO: 552566 - DNA, 25 bp, Rattus norvegicus
tactaggatggtatcccagttactt

SEQ ID NO: 552567 - DNA, 25 bp, Rattus norvegicus
tactaggatggtttcccagttactt

SEQ ID NO: 552568 - DNA, 25 bp, Rattus norvegicus
tactaggcagggatttaagcttgga

SEQ ID NO: 552569 - DNA, 25 bp, Rattus norvegicus
tactaggcagggttttaagcttgga

SEQ ID NO: 552570 - DNA, 25 bp, Rattus norvegicus
tactaggctctaagactgttgcata

SEQ ID NO: 552571 - DNA, 25 bp, Rattus norvegicus
tactaggctctatgactgttgcata

SEQ ID NO: 552572 - DNA, 25 bp, Rattus norvegicus
tactaggctgaaatgccacaagtgt

SEQ ID NO: 552573 - DNA, 25 bp, Rattus norvegicus
tactaggctgaattgccacaagtgt

SEQ ID NO: 552574 - DNA, 25 bp, Rattus norvegicus
tactagggatcgaacctcaggtcat

SEQ ID NO: 552575 - DNA, 25 bp, Rattus norvegicus
tactagggatcgtacctcaggtcat

SEQ ID NO: 552576 - DNA, 25 bp, Rattus norvegicus
tactagggcatgacagcaacactgt

SEQ ID NO: 552577 - DNA, 25 bp, Rattus norvegicus
tactagggcatgtcagcaacactgt

SEQ ID NO: 552578 - DNA, 25 bp, Rattus norvegicus
tactaggtcaggatcacgtagctaa

SEQ ID NO: 552579 - DNA, 25 bp, Rattus norvegicus
tactaggtcaggttcacgtagctaa

SEQ ID NO: 552580 - DNA, 25 bp, Rattus norvegicus
tactaggtgggacttggattttctt

SEQ ID NO: 552581 - DNA, 25 bp, Rattus norvegicus
tactaggtgggagttggattttctt

SEQ ID NO: 552582 - DNA, 25 bp, Rattus norvegicus
tactaggttcctcccgagggttcag

SEQ ID NO: 552583 - DNA, 25 bp, Rattus norvegicus
tactaggttcctgccgagggttcag

SEQ ID NO: 552584 - DNA, 25 bp, Rattus norvegicus
tactaggttcttcgtagcctgaccc

SEQ ID NO: 552585 - DNA, 25 bp, Rattus norvegicus
tactaggttcttggtagcctgaccc

SEQ ID NO: 552586 - DNA, 25 bp, Rattus norvegicus
tactagtatccacaaaactccttct

SEQ ID NO: 552587 - DNA, 25 bp, Rattus norvegicus
tactagtatccagaaaactccttct

SEQ ID NO: 552588 - DNA, 25 bp, Rattus norvegicus
tactagtcactgatagtctctccca

SEQ ID NO: 552589 - DNA, 25 bp, Rattus norvegicus
tactagtcactgttagtctctccca

SEQ ID NO: 552590 - DNA, 25 bp, Rattus norvegicus
tactagtcagttaatccaagccctt

SEQ ID NO: 552591 - DNA, 25 bp, Rattus norvegicus
tactagtcagtttatccaagccctt

SEQ ID NO: 552592 - DNA, 25 bp, Rattus norvegicus
tactagtctttgctgttgtgggcct

SEQ ID NO: 552593 - DNA, 25 bp, Rattus norvegicus
tactagtctttggtgttgtgggcct

SEQ ID NO: 552594 - DNA, 25 bp, Rattus norvegicus
tactagttgactaggagtatgccat

SEQ ID NO: 552595 - DNA, 25 bp, Rattus norvegicus
tactagttgacttggagtatgccat

SEQ ID NO: 552596 - DNA, 25 bp, Rattus norvegicus
tactataaatcactcctcagtccat

SEQ ID NO: 552597 - DNA, 25 bp, Rattus norvegicus
tactataaatcagtcctcagtccat

SEQ ID NO: 552598 - DNA, 25 bp, Rattus norvegicus
tactataaccgacggccttcttcta

SEQ ID NO: 552599 - DNA, 25 bp, Rattus norvegicus
tactataaccgagggccttcttcta

SEQ ID NO: 552600 - DNA, 25 bp, Rattus norvegicus
tactatacaaggctgctggtgcaga

SEQ ID NO: 552601 - DNA, 25 bp, Rattus norvegicus
tactatacaagggtgctggtgcaga

SEQ ID NO: 552602 - DNA, 25 bp, Rattus norvegicus
tactatacacctctgcctttaacca

SEQ ID NO: 552603 - DNA, 25 bp, Rattus norvegicus
tactatacacctgtgcctttaacca

SEQ ID NO: 552604 - DNA, 25 bp, Rattus norvegicus
tactatagactcagagaccctgatc

SEQ ID NO: 552605 - DNA, 25 bp, Rattus norvegicus
tactatagactctgagaccctgatc

SEQ ID NO: 552606 - DNA, 25 bp, Rattus norvegicus
tactatagtcagcattttaacagct

SEQ ID NO: 552607 - DNA, 25 bp, Rattus norvegicus
tactatagtcaggattttaacagct

SEQ ID NO: 552608 - DNA, 25 bp, Rattus norvegicus
tactatatgtggacgtttcccaaag

SEQ ID NO: 552609 - DNA, 25 bp, Rattus norvegicus
tactatatgtggtcgtttcccaaag

SEQ ID NO: 552610 - DNA, 25 bp, Rattus norvegicus
tactatattttgctatccctctacc

SEQ ID NO: 552611 - DNA, 25 bp, Rattus norvegicus
tactatattttggtatccctctacc

SEQ ID NO: 552612 - DNA, 25 bp, Rattus norvegicus
tactatcaagtgctgattgatgccc

SEQ ID NO: 552613 - DNA, 25 bp, Rattus norvegicus
tactatcaagtggtgattgatgccc

SEQ ID NO: 552614 - DNA, 25 bp, Rattus norvegicus
tactatcactttcccttgaggcaaa

SEQ ID NO: 552615 - DNA, 25 bp, Rattus norvegicus
tactatcactttgccttgaggcaaa

SEQ ID NO: 552616 - DNA, 25 bp, Rattus norvegicus
tactatcagctgacaagtccagact

SEQ ID NO: 552617 - DNA, 25 bp, Rattus norvegicus
tactatcagctgtcaagtccagact

SEQ ID NO: 552618 - DNA, 25 bp, Rattus norvegicus
tactatcaggaaccgcaatggcatt

SEQ ID NO: 552619 - DNA, 25 bp, Rattus norvegicus
tactatcaggaagcgcaatggcatt

SEQ ID NO: 552620 - DNA, 25 bp, Rattus norvegicus
tactatccatagctacctgtggctt

SEQ ID NO: 552621 - DNA, 25 bp, Rattus norvegicus
tactatccataggtacctgtggctt

SEQ ID NO: 552622 - DNA, 25 bp, Rattus norvegicus
tactatctcactcacaaaatttgtt

SEQ ID NO: 552623 - DNA, 25 bp, Rattus norvegicus
tactatctcactgacaaaatttgtt

SEQ ID NO: 552624 - DNA, 25 bp, Rattus norvegicus
tactatctctatattctcctttctt

SEQ ID NO: 552625 - DNA, 25 bp, Rattus norvegicus
tactatctctattttctcctttctt

SEQ ID NO: 552626 - DNA, 25 bp, Rattus norvegicus
tactatctgtaaaagctccctcaaa

SEQ ID NO: 552627 - DNA, 25 bp, Rattus norvegicus
tactatctgtaatagctccctcaaa

SEQ ID NO: 552628 - DNA, 25 bp, Rattus norvegicus
tactatcttccaatagtgcctcggg

SEQ ID NO: 552629 - DNA, 25 bp, Rattus norvegicus
tactatcttccattagtgcctcggg

SEQ ID NO: 552630 - DNA, 25 bp, Rattus norvegicus
tactatcttgcaagggctggagaga

SEQ ID NO: 552631 - DNA, 25 bp, Rattus norvegicus
tactatcttgcatgggctggagaga

SEQ ID NO: 552632 - DNA, 25 bp, Rattus norvegicus
tactatgacacaaatcctacccttg

SEQ ID NO: 552633 - DNA, 25 bp, Rattus norvegicus
tactatgacacatatcctacccttg

SEQ ID NO: 552634 - DNA, 25 bp, Rattus norvegicus
tactatgcaattctagctggcctag

SEQ ID NO: 552635 - DNA, 25 bp, Rattus norvegicus
tactatgcaattgtagctggcctag

SEQ ID NO: 552636 - DNA, 25 bp, Rattus norvegicus
tactatgccttcaaccatgctgcct

SEQ ID NO: 552637 - DNA, 25 bp, Rattus norvegicus
tactatgccttctaccatgctgcct

SEQ ID NO: 552638 - DNA, 25 bp, Rattus norvegicus
tactatgcgtttctgagaggcagca

SEQ ID NO: 552639 - DNA, 25 bp, Rattus norvegicus
tactatgcgtttgtgagaggcagca

SEQ ID NO: 552640 - DNA, 25 bp, Rattus norvegicus
tactatggaaatagatgtggctctc

SEQ ID NO: 552641 - DNA, 25 bp, Rattus norvegicus
tactatggaaattgatgtggctctc

SEQ ID NO: 552642 - DNA, 25 bp, Rattus norvegicus
tactatggagcgctcaatgtcagta

SEQ ID NO: 552643 - DNA, 25 bp, Rattus norvegicus
tactatggagcggtcaatgtcagta

SEQ ID NO: 552644 - DNA, 25 bp, Rattus norvegicus
tactatgggaatcccaccatgtctt

SEQ ID NO: 552645 - DNA, 25 bp, Rattus norvegicus
tactatgggaatgccaccatgtctt

SEQ ID NO: 552646 - DNA, 25 bp, Rattus norvegicus
tactatggtggacctcagccactcc

SEQ ID NO: 552647 - DNA, 25 bp, Rattus norvegicus
tactatggtggagctcagccactcc

SEQ ID NO: 552648 - DNA, 25 bp, Rattus norvegicus
tactatgtaaccatggcaggcctca

SEQ ID NO: 552649 - DNA, 25 bp, Rattus norvegicus
tactatgtaaccttggcaggcctca

SEQ ID NO: 552650 - DNA, 25 bp, Rattus norvegicus
tactatgtattacccgtttgttgga

SEQ ID NO: 552651 - DNA, 25 bp, Rattus norvegicus
tactatgtattagccgtttgttgga

SEQ ID NO: 552652 - DNA, 25 bp, Rattus norvegicus
tactatgtctccaaggcaagccaca

SEQ ID NO: 552653 - DNA, 25 bp, Rattus norvegicus
tactatgtctcctaggcaagccaca

SEQ ID NO: 552654 - DNA, 25 bp, Rattus norvegicus
tactatgtggaccagcagtggccct

SEQ ID NO: 552655 - DNA, 25 bp, Rattus norvegicus
tactatgtggacgagcagtggccct

SEQ ID NO: 552656 - DNA, 25 bp, Rattus norvegicus
tactatgttcaaaggctgtatgtat

SEQ ID NO: 552657 - DNA, 25 bp, Rattus norvegicus
tactatgttcaatggctgtatgtat

SEQ ID NO: 552658 - DNA, 25 bp, Rattus norvegicus
tactatgttgacactgctgtgcgcc

SEQ ID NO: 552659 - DNA, 25 bp, Rattus norvegicus
tactatgttgactctgctgtgcgcc

SEQ ID NO: 552660 - DNA, 25 bp, Rattus norvegicus
tactattccagccaatgtggccgtg

SEQ ID NO: 552661 - DNA, 25 bp, Rattus norvegicus
tactattccagcgaatgtggccgtg

SEQ ID NO: 552662 - DNA, 25 bp, Rattus norvegicus
tactattccatacggccacttgatt

SEQ ID NO: 552663 - DNA, 25 bp, Rattus norvegicus
tactattccatagggccacttgatt

SEQ ID NO: 552664 - DNA, 25 bp, Rattus norvegicus
tactattcccatacaccggagagtt

SEQ ID NO: 552665 - DNA, 25 bp, Rattus norvegicus
tactattcccattcaccggagagtt

SEQ ID NO: 552666 - DNA, 25 bp, Rattus norvegicus
tactattctcttcctgattccgagg

SEQ ID NO: 552667 - DNA, 25 bp, Rattus norvegicus
tactattctcttgctgattccgagg

SEQ ID NO: 552668 - DNA, 25 bp, Rattus norvegicus
tactattctgaaatctgggctaaac

SEQ ID NO: 552669 - DNA, 25 bp, Rattus norvegicus
tactattctgaattctgggctaaac

SEQ ID NO: 552670 - DNA, 25 bp, Rattus norvegicus
tactattgactacttcatccctacc

SEQ ID NO: 552671 - DNA, 25 bp, Rattus norvegicus
tactattgactagttcatccctacc

SEQ ID NO: 552672 - DNA, 25 bp, Rattus norvegicus
tactattgcaatagcgtctcttgaa

SEQ ID NO: 552673 - DNA, 25 bp, Rattus norvegicus
tactattgcaattgcgtctcttgaa

SEQ ID NO: 552674 - DNA, 25 bp, Rattus norvegicus
tactattgctctcttgtctttttac

SEQ ID NO: 552675 - DNA, 25 bp, Rattus norvegicus
tactattgctctgttgtctttttac

SEQ ID NO: 552676 - DNA, 25 bp, Rattus norvegicus
tactatttagcactttgaaagtccc

SEQ ID NO: 552677 - DNA, 25 bp, Rattus norvegicus
tactatttagcagtttgaaagtccc

SEQ ID NO: 552678 - DNA, 25 bp, Rattus norvegicus
tactatttccaaacagtgttgcctg

SEQ ID NO: 552679 - DNA, 25 bp, Rattus norvegicus
tactatttccaacaaagggttcaag

SEQ ID NO: 552680 - DNA, 25 bp, Rattus norvegicus
tactatttccaagaaagggttcaag

SEQ ID NO: 552681 - DNA, 25 bp, Rattus norvegicus
tactatttccaatcagtgttgcctg

SEQ ID NO: 552682 - DNA, 25 bp, Rattus norvegicus
tactatttccagcagagtctgcccc

SEQ ID NO: 552683 - DNA, 25 bp, Rattus norvegicus
tactatttccaggagagtctgcccc

SEQ ID NO: 552684 - DNA, 25 bp, Rattus norvegicus
tactatttgatgacatgtgctcaga

SEQ ID NO: 552685 - DNA, 25 bp, Rattus norvegicus
tactatttgatgtcatgtgctcaga

SEQ ID NO: 552686 - DNA, 25 bp, Rattus norvegicus
tactattttggccttaccattccgg

SEQ ID NO: 552687 - DNA, 25 bp, Rattus norvegicus
tactattttggcgttaccattccgg

SEQ ID NO: 552688 - DNA, 25 bp, Rattus norvegicus
tactcaaaagcacctggacttccag

SEQ ID NO: 552689 - DNA, 25 bp, Rattus norvegicus
tactcaaaagcagctggacttccag

SEQ ID NO: 552690 - DNA, 25 bp, Rattus norvegicus
tactcaaaagctaggtcaccccgga

SEQ ID NO: 552691 - DNA, 25 bp, Rattus norvegicus
tactcaaaagcttggtcaccccgga

SEQ ID NO: 552692 - DNA, 25 bp, Rattus norvegicus
tactcaaaggctctggattcatcat

SEQ ID NO: 552693 - DNA, 25 bp, Rattus norvegicus
tactcaaaggctgtggattcatcat

SEQ ID NO: 552694 - DNA, 25 bp, Rattus norvegicus
tactcaacgcaaaggctacaggcta

SEQ ID NO: 552695 - DNA, 25 bp, Rattus norvegicus
tactcaacgcaatggctacaggcta

SEQ ID NO: 552696 - DNA, 25 bp, Rattus norvegicus
tactcaactgtactgttcttggcaa

SEQ ID NO: 552697 - DNA, 25 bp, Rattus norvegicus
tactcaactgtagtgttcttggcaa

SEQ ID NO: 552698 - DNA, 25 bp, Rattus norvegicus
tactcaactttaccctgccatgtga

SEQ ID NO: 552699 - DNA, 25 bp, Rattus norvegicus
tactcaactttagcctgccatgtga

SEQ ID NO: 552700 - DNA, 25 bp, Rattus norvegicus
tactcaagcccccttggagaagtaa

SEQ ID NO: 552701 - DNA, 25 bp, Rattus norvegicus
tactcaagccccgttggagaagtaa

SEQ ID NO: 552702 - DNA, 25 bp, Rattus norvegicus
tactcaagcgtgctggcttatgcct

SEQ ID NO: 552703 - DNA, 25 bp, Rattus norvegicus
tactcaagcgtggtggcttatgcct

SEQ ID NO: 552704 - DNA, 25 bp, Rattus norvegicus
tactcaagctgtaccttccttattg

SEQ ID NO: 552705 - DNA, 25 bp, Rattus norvegicus
tactcaagctgtatctggcttcctg

SEQ ID NO: 552706 - DNA, 25 bp, Rattus norvegicus
tactcaagctgttccttccttattg

SEQ ID NO: 552707 - DNA, 25 bp, Rattus norvegicus
tactcaagctgtttctggcttcctg

SEQ ID NO: 552708 - DNA, 25 bp, Rattus norvegicus
tactcaagtcttcgcttttcataag

SEQ ID NO: 552709 - DNA, 25 bp, Rattus norvegicus
tactcaagtcttggcttttcataag

SEQ ID NO: 552710 - DNA, 25 bp, Rattus norvegicus
tactcaagtgatatctgctgctgcc

SEQ ID NO: 552711 - DNA, 25 bp, Rattus norvegicus
tactcaagtgatttctgctgctgcc

SEQ ID NO: 552712 - DNA, 25 bp, Rattus norvegicus
tactcaattcacatcacccttaaag

SEQ ID NO: 552713 - DNA, 25 bp, Rattus norvegicus
tactcaattcacttcacccttaaag

SEQ ID NO: 552714 - DNA, 25 bp, Rattus norvegicus
tactcaattgcacgtggccatcatt

SEQ ID NO: 552715 - DNA, 25 bp, Rattus norvegicus
tactcaattgcaggtggccatcatt

SEQ ID NO: 552716 - DNA, 25 bp, Rattus norvegicus
tactcaattttcagtttctcccttt

SEQ ID NO: 552717 - DNA, 25 bp, Rattus norvegicus
tactcaattttctgtttctcccttt

SEQ ID NO: 552718 - DNA, 25 bp, Rattus norvegicus
tactcacaaactctatacccaggga

SEQ ID NO: 552719 - DNA, 25 bp, Rattus norvegicus
tactcacaaactgtatacccaggga

SEQ ID NO: 552720 - DNA, 25 bp, Rattus norvegicus
tactcacacagccaacaagcacaag

SEQ ID NO: 552721 - DNA, 25 bp, Rattus norvegicus
tactcacacagcgaacaagcacaag

SEQ ID NO: 552722 - DNA, 25 bp, Rattus norvegicus
tactcacacattagtacaaggccaa

SEQ ID NO: 552723 - DNA, 25 bp, Rattus norvegicus
tactcacacatttgtacaaggccaa

SEQ ID NO: 552724 - DNA, 25 bp, Rattus norvegicus
tactcacaccatcaagtctgttcta

SEQ ID NO: 552725 - DNA, 25 bp, Rattus norvegicus
tactcacaccatgaagtctgttcta

SEQ ID NO: 552726 - DNA, 25 bp, Rattus norvegicus
tactcacaccggcagaagaagaaga

SEQ ID NO: 552727 - DNA, 25 bp, Rattus norvegicus
tactcacaccgggagaagaagaaga

SEQ ID NO: 552728 - DNA, 25 bp, Rattus norvegicus
tactcacaccttctctgggatttta

SEQ ID NO: 552729 - DNA, 25 bp, Rattus norvegicus
tactcacaccttgtctgggatttta

SEQ ID NO: 552730 - DNA, 25 bp, Rattus norvegicus
tactcacacgaacgcgtggtagacg

SEQ ID NO: 552731 - DNA, 25 bp, Rattus norvegicus
tactcacacgaaggcgtggtagacg

SEQ ID NO: 552732 - DNA, 25 bp, Rattus norvegicus
tactcacacgtcagccggtttatct

SEQ ID NO: 552733 - DNA, 25 bp, Rattus norvegicus
tactcacacgtctgccggtttatct

SEQ ID NO: 552734 - DNA, 25 bp, Rattus norvegicus
tactcacactctaaggccatttatg

SEQ ID NO: 552735 - DNA, 25 bp, Rattus norvegicus
tactcacactcttaggccatttatg

SEQ ID NO: 552736 - DNA, 25 bp, Rattus norvegicus
tactcacagatgaaggacggacaca

SEQ ID NO: 552737 - DNA, 25 bp, Rattus norvegicus
tactcacagatgtaggacggacaca

SEQ ID NO: 552738 - DNA, 25 bp, Rattus norvegicus
tactcacatactaatcttgctttct

SEQ ID NO: 552739 - DNA, 25 bp, Rattus norvegicus
tactcacatacttatcttgctttct

SEQ ID NO: 552740 - DNA, 25 bp, Rattus norvegicus
tactcacatgcactcagacacgatt

SEQ ID NO: 552741 - DNA, 25 bp, Rattus norvegicus
tactcacatgcagtcagacacgatt

SEQ ID NO: 552742 - DNA, 25 bp, Rattus norvegicus
tactcacatgtacagcccatctgca

SEQ ID NO: 552743 - DNA, 25 bp, Rattus norvegicus
tactcacatgtagagcccatctgca

SEQ ID NO: 552744 - DNA, 25 bp, Rattus norvegicus
tactcaccactacccagaaattgtt

SEQ ID NO: 552745 - DNA, 25 bp, Rattus norvegicus
tactcaccactagccagaaattgtt

SEQ ID NO: 552746 - DNA, 25 bp, Rattus norvegicus
tactcaccagctcatctttctctgg

SEQ ID NO: 552747 - DNA, 25 bp, Rattus norvegicus
tactcaccagctgatctttctctgg

SEQ ID NO: 552748 - DNA, 25 bp, Rattus norvegicus
tactcaccagtgaactatacgccct

SEQ ID NO: 552749 - DNA, 25 bp, Rattus norvegicus
tactcaccagtgtactatacgccct

SEQ ID NO: 552750 - DNA, 25 bp, Rattus norvegicus
tactcaccccacagactcttttgat

SEQ ID NO: 552751 - DNA, 25 bp, Rattus norvegicus
tactcaccccactgactcttttgat

SEQ ID NO: 552752 - DNA, 25 bp, Rattus norvegicus
tactcaccgttcagttcatacacta

SEQ ID NO: 552753 - DNA, 25 bp, Rattus norvegicus
tactcaccgttctgttcatacacta

SEQ ID NO: 552754 - DNA, 25 bp, Rattus norvegicus
tactcacctatgatttagcaagcag

SEQ ID NO: 552755 - DNA, 25 bp, Rattus norvegicus
tactcacctatgttttagcaagcag

SEQ ID NO: 552756 - DNA, 25 bp, Rattus norvegicus
tactcacctcgtcgctattaaagca

SEQ ID NO: 552757 - DNA, 25 bp, Rattus norvegicus
tactcacctcgtggctattaaagca

SEQ ID NO: 552758 - DNA, 25 bp, Rattus norvegicus
tactcacgggtgatgggcctgcaat

SEQ ID NO: 552759 - DNA, 25 bp, Rattus norvegicus
tactcacgggtgttgggcctgcaat

SEQ ID NO: 552760 - DNA, 25 bp, Rattus norvegicus
tactcactacacactgcggacaaaa

SEQ ID NO: 552761 - DNA, 25 bp, Rattus norvegicus
tactcactacactctgcggacaaaa

SEQ ID NO: 552762 - DNA, 25 bp, Rattus norvegicus
tactcactctgaaagcgcctgggat

SEQ ID NO: 552763 - DNA, 25 bp, Rattus norvegicus
tactcactctgatagcgcctgggat

SEQ ID NO: 552764 - DNA, 25 bp, Rattus norvegicus
tactcactgatgactcccaaaatct

SEQ ID NO: 552765 - DNA, 25 bp, Rattus norvegicus
tactcactgatgtctcccaaaatct

SEQ ID NO: 552766 - DNA, 25 bp, Rattus norvegicus
tactcactgctaacccaagtactgg

SEQ ID NO: 552767 - DNA, 25 bp, Rattus norvegicus
tactcactgctatcccaagtactgg

SEQ ID NO: 552768 - DNA, 25 bp, Rattus norvegicus
tactcactgttgctacctgatggtc

SEQ ID NO: 552769 - DNA, 25 bp, Rattus norvegicus
tactcactgttggtacctgatggtc

SEQ ID NO: 552770 - DNA, 25 bp, Rattus norvegicus
tactcacttactagtcctgctacaa

SEQ ID NO: 552771 - DNA, 25 bp, Rattus norvegicus
tactcacttacttgtcctgctacaa

SEQ ID NO: 552772 - DNA, 25 bp, Rattus norvegicus
tactcacttagaatctccaggtgtg

SEQ ID NO: 552773 - DNA, 25 bp, Rattus norvegicus
tactcacttagattctccaggtgtg

SEQ ID NO: 552774 - DNA, 25 bp, Rattus norvegicus
tactcacttatgaactgtgtataaa

SEQ ID NO: 552775 - DNA, 25 bp, Rattus norvegicus
tactcacttatgtactgtgtataaa

SEQ ID NO: 552776 - DNA, 25 bp, Rattus norvegicus
tactcacttggactaatcaaccaca

SEQ ID NO: 552777 - DNA, 25 bp, Rattus norvegicus
tactcacttggagtaatcaaccaca

SEQ ID NO: 552778 - DNA, 25 bp, Rattus norvegicus
tactcagaccaaagatagtctcttt

SEQ ID NO: 552779 - DNA, 25 bp, Rattus norvegicus
tactcagaccaatgatagtctcttt

SEQ ID NO: 552780 - DNA, 25 bp, Rattus norvegicus
tactcagactcaagcttgggataag

SEQ ID NO: 552781 - DNA, 25 bp, Rattus norvegicus
tactcagactcatgcttgggataag

SEQ ID NO: 552782 - DNA, 25 bp, Rattus norvegicus
tactcagagacgatctgcacgcatt

SEQ ID NO: 552783 - DNA, 25 bp, Rattus norvegicus
tactcagagacgttctgcacgcatt

SEQ ID NO: 552784 - DNA, 25 bp, Rattus norvegicus
tactcagaggcaaaccatagtgggt

SEQ ID NO: 552785 - DNA, 25 bp, Rattus norvegicus
tactcagaggcataccatagtgggt

SEQ ID NO: 552786 - DNA, 25 bp, Rattus norvegicus
tactcagatttacgccttacaaagg

SEQ ID NO: 552787 - DNA, 25 bp, Rattus norvegicus
tactcagatttaggccttacaaagg

SEQ ID NO: 552788 - DNA, 25 bp, Rattus norvegicus
tactcagcaaagagtcttgtgtact

SEQ ID NO: 552789 - DNA, 25 bp, Rattus norvegicus
tactcagcaaagtgtcttgtgtact

SEQ ID NO: 552790 - DNA, 25 bp, Rattus norvegicus
tactcagcacggacgtgtgtgcata

SEQ ID NO: 552791 - DNA, 25 bp, Rattus norvegicus
tactcagcacggtcgtgtgtgcata

SEQ ID NO: 552792 - DNA, 25 bp, Rattus norvegicus
tactcagcccaaagttattttaaac

SEQ ID NO: 552793 - DNA, 25 bp, Rattus norvegicus
tactcagcccaatgttattttaaac

SEQ ID NO: 552794 - DNA, 25 bp, Rattus norvegicus
tactcagcccacacattcatggaaa

SEQ ID NO: 552795 - DNA, 25 bp, Rattus norvegicus
tactcagcccactcattcatggaaa

SEQ ID NO: 552796 - DNA, 25 bp, Rattus norvegicus
tactcagcccagagaaggagccctg

SEQ ID NO: 552797 - DNA, 25 bp, Rattus norvegicus
tactcagcccagtgaaggagccctg

SEQ ID NO: 552798 - DNA, 25 bp, Rattus norvegicus
tactcagccgtgagtgttttgtctg

SEQ ID NO: 552799 - DNA, 25 bp, Rattus norvegicus
tactcagccgtgtgtgttttgtctg

SEQ ID NO: 552800 - DNA, 25 bp, Rattus norvegicus
tactcagcctccaatgtacctgtgt

SEQ ID NO: 552801 - DNA, 25 bp, Rattus norvegicus
tactcagcctcctatgtacctgtgt

SEQ ID NO: 552802 - DNA, 25 bp, Rattus norvegicus
tactcagctactctatttcaggaaa

SEQ ID NO: 552803 - DNA, 25 bp, Rattus norvegicus
tactcagctactgtatttcaggaaa

SEQ ID NO: 552804 - DNA, 25 bp, Rattus norvegicus
tactcagctcgaccctgatgaggac

SEQ ID NO: 552805 - DNA, 25 bp, Rattus norvegicus
tactcagctcgagcctgatgaggac

SEQ ID NO: 552806 - DNA, 25 bp, Rattus norvegicus
tactcagctcttagtgagtgctcag

SEQ ID NO: 552807 - DNA, 25 bp, Rattus norvegicus
tactcagctctttgtgagtgctcag

SEQ ID NO: 552808 - DNA, 25 bp, Rattus norvegicus
tactcagctgtcatgggtcgtgggt

SEQ ID NO: 552809 - DNA, 25 bp, Rattus norvegicus
tactcagctgtcttgggtcgtgggt

SEQ ID NO: 552810 - DNA, 25 bp, Rattus norvegicus
tactcaggatcgcagctgcttgtaa

SEQ ID NO: 552811 - DNA, 25 bp, Rattus norvegicus
tactcaggatcggagctgcttgtaa

SEQ ID NO: 552812 - DNA, 25 bp, Rattus norvegicus
tactcaggatctaggctcggtctaa

SEQ ID NO: 552813 - DNA, 25 bp, Rattus norvegicus
tactcaggatcttggctcggtctaa

SEQ ID NO: 552814 - DNA, 25 bp, Rattus norvegicus
tactcaggctggaacgtgggcttca

SEQ ID NO: 552815 - DNA, 25 bp, Rattus norvegicus
tactcaggctggtacgtgggcttca

SEQ ID NO: 552816 - DNA, 25 bp, Rattus norvegicus
tactcagggaggcaggaagtttcta

SEQ ID NO: 552817 - DNA, 25 bp, Rattus norvegicus
tactcagggagggaggaagtttcta

SEQ ID NO: 552818 - DNA, 25 bp, Rattus norvegicus
tactcagtaaacatcaggccttcct

SEQ ID NO: 552819 - DNA, 25 bp, Rattus norvegicus
tactcagtaaacttcaggccttcct

SEQ ID NO: 552820 - DNA, 25 bp, Rattus norvegicus
tactcagtagatcctatacttgtaa

SEQ ID NO: 552821 - DNA, 25 bp, Rattus norvegicus
tactcagtagatgctatacttgtaa

SEQ ID NO: 552822 - DNA, 25 bp, Rattus norvegicus
tactcagtcagcacagggagacctg

SEQ ID NO: 552823 - DNA, 25 bp, Rattus norvegicus
tactcagtcagctcagggagacctg

SEQ ID NO: 552824 - DNA, 25 bp, Rattus norvegicus
tactcagtccctccaaaggccagaa

SEQ ID NO: 552825 - DNA, 25 bp, Rattus norvegicus
tactcagtccctgcaaaggccagaa

SEQ ID NO: 552826 - DNA, 25 bp, Rattus norvegicus
tactcagtcctgaatcgctcagtaa

SEQ ID NO: 552827 - DNA, 25 bp, Rattus norvegicus
tactcagtcctgtatcgctcagtaa

SEQ ID NO: 552828 - DNA, 25 bp, Rattus norvegicus
tactcagtctaactgggcctctaga

SEQ ID NO: 552829 - DNA, 25 bp, Rattus norvegicus
tactcagtctaagtgggcctctaga

SEQ ID NO: 552830 - DNA, 25 bp, Rattus norvegicus
tactcagtctcacaggtagggcctt

SEQ ID NO: 552831 - DNA, 25 bp, Rattus norvegicus
tactcagtctcagaggtagggcctt

SEQ ID NO: 552832 - DNA, 25 bp, Rattus norvegicus
tactcagtctctctggcttgccaag

SEQ ID NO: 552833 - DNA, 25 bp, Rattus norvegicus
tactcagtctctgtggcttgccaag

SEQ ID NO: 552834 - DNA, 25 bp, Rattus norvegicus
tactcagtgggaaatatcgctctta

SEQ ID NO: 552835 - DNA, 25 bp, Rattus norvegicus
tactcagtgggatatatcgctctta

SEQ ID NO: 552836 - DNA, 25 bp, Rattus norvegicus
tactcagtgggtatggttcctttca

SEQ ID NO: 552837 - DNA, 25 bp, Rattus norvegicus
tactcagtgggtttggttcctttca

SEQ ID NO: 552838 - DNA, 25 bp, Rattus norvegicus
tactcagtggttattgccttgtctt

SEQ ID NO: 552839 - DNA, 25 bp, Rattus norvegicus
tactcagtggtttttgccttgtctt

SEQ ID NO: 552840 - DNA, 25 bp, Rattus norvegicus
tactcagttccaagtgtctttccag

SEQ ID NO: 552841 - DNA, 25 bp, Rattus norvegicus
tactcagttccatgtgtctttccag

SEQ ID NO: 552842 - DNA, 25 bp, Rattus norvegicus
tactcagttctgaagtggcctcttt

SEQ ID NO: 552843 - DNA, 25 bp, Rattus norvegicus
tactcagttctgtagtggcctcttt

SEQ ID NO: 552844 - DNA, 25 bp, Rattus norvegicus
tactcagtttacagccacggcggtg

SEQ ID NO: 552845 - DNA, 25 bp, Rattus norvegicus
tactcagtttactgccacggcggtg

SEQ ID NO: 552846 - DNA, 25 bp, Rattus norvegicus
tactcataagtgaccgtgtgtccag

SEQ ID NO: 552847 - DNA, 25 bp, Rattus norvegicus
tactcataagtgtccgtgtgtccag

SEQ ID NO: 552848 - DNA, 25 bp, Rattus norvegicus
tactcatatatccacctatttaaaa

SEQ ID NO: 552849 - DNA, 25 bp, Rattus norvegicus
tactcatatatcgacctatttaaaa

SEQ ID NO: 552850 - DNA, 25 bp, Rattus norvegicus
tactcatcagtgaaccttacttaac

SEQ ID NO: 552851 - DNA, 25 bp, Rattus norvegicus
tactcatcagtgtaccttacttaac

SEQ ID NO: 552852 - DNA, 25 bp, Rattus norvegicus
tactcatcatctccaactgaactgt

SEQ ID NO: 552853 - DNA, 25 bp, Rattus norvegicus
tactcatcatctgcaactgaactgt

SEQ ID NO: 552854 - DNA, 25 bp, Rattus norvegicus
tactcatccgacactcttgagtgtg

SEQ ID NO: 552855 - DNA, 25 bp, Rattus norvegicus
tactcatccgactctcttgagtgtg

SEQ ID NO: 552856 - DNA, 25 bp, Rattus norvegicus
tactcatctcaactaatccttcctt

SEQ ID NO: 552857 - DNA, 25 bp, Rattus norvegicus
tactcatctcaagtaatccttcctt

SEQ ID NO: 552858 - DNA, 25 bp, Rattus norvegicus
tactcatcttcaagtaggacctatg

SEQ ID NO: 552859 - DNA, 25 bp, Rattus norvegicus
tactcatcttcatgtaggacctatg

SEQ ID NO: 552860 - DNA, 25 bp, Rattus norvegicus
tactcatgaggaagcaccatctcct

SEQ ID NO: 552861 - DNA, 25 bp, Rattus norvegicus
tactcatgaggatgcaccatctcct

SEQ ID NO: 552862 - DNA, 25 bp, Rattus norvegicus
tactcatgagggaacctggagccat

SEQ ID NO: 552863 - DNA, 25 bp, Rattus norvegicus
tactcatgagggtacctggagccat

SEQ ID NO: 552864 - DNA, 25 bp, Rattus norvegicus
tactcatgagtgagacaccatgcac

SEQ ID NO: 552865 - DNA, 25 bp, Rattus norvegicus
tactcatgagtgtgacaccatgcac

SEQ ID NO: 552866 - DNA, 25 bp, Rattus norvegicus
tactcatgtgcacttttccagttct

SEQ ID NO: 552867 - DNA, 25 bp, Rattus norvegicus
tactcatgtgcagttttccagttct

SEQ ID NO: 552868 - DNA, 25 bp, Rattus norvegicus
tactcattgttaattatttcctcac

SEQ ID NO: 552869 - DNA, 25 bp, Rattus norvegicus
tactcattgttatttatttcctcac

SEQ ID NO: 552870 - DNA, 25 bp, Rattus norvegicus
tactcatttcctcccacagaattaa

SEQ ID NO: 552871 - DNA, 25 bp, Rattus norvegicus
tactcatttcctgccacagaattaa

SEQ ID NO: 552872 - DNA, 25 bp, Rattus norvegicus
tactcatttcttatgctactgcttt

SEQ ID NO: 552873 - DNA, 25 bp, Rattus norvegicus
tactcatttcttttgctactgcttt

SEQ ID NO: 552874 - DNA, 25 bp, Rattus norvegicus
tactcatttgagctcccaggtgaac

SEQ ID NO: 552875 - DNA, 25 bp, Rattus norvegicus
tactcatttgaggtcccaggtgaac

SEQ ID NO: 552876 - DNA, 25 bp, Rattus norvegicus
tactccaaatcaagctctgttcagg

SEQ ID NO: 552877 - DNA, 25 bp, Rattus norvegicus
tactccaaatcatgctctgttcagg

SEQ ID NO: 552878 - DNA, 25 bp, Rattus norvegicus
tactccaagaaacacaaaccgctgt

SEQ ID NO: 552879 - DNA, 25 bp, Rattus norvegicus
tactccaagaaagacaaaccgctgt

SEQ ID NO: 552880 - DNA, 25 bp, Rattus norvegicus
tactccaattggaaactcctgcctt

SEQ ID NO: 552881 - DNA, 25 bp, Rattus norvegicus
tactccaattggactttgctttgat

SEQ ID NO: 552882 - DNA, 25 bp, Rattus norvegicus
tactccaattggtaactcctgcctt

SEQ ID NO: 552883 - DNA, 25 bp, Rattus norvegicus
tactccaattggtctttgctttgat

SEQ ID NO: 552884 - DNA, 25 bp, Rattus norvegicus
tactccacagacatggccgctttgt

SEQ ID NO: 552885 - DNA, 25 bp, Rattus norvegicus
tactccacagacttggccgctttgt

SEQ ID NO: 552886 - DNA, 25 bp, Rattus norvegicus
tactccacagatatctgccacgtaa

SEQ ID NO: 552887 - DNA, 25 bp, Rattus norvegicus
tactccacagatttctgccacgtaa

SEQ ID NO: 552888 - DNA, 25 bp, Rattus norvegicus
tactccacctcgaaggaacaacaag

SEQ ID NO: 552889 - DNA, 25 bp, Rattus norvegicus
tactccacctcgtaggaacaacaag

SEQ ID NO: 552890 - DNA, 25 bp, Rattus norvegicus
tactccaccttccaggctagggaaa

SEQ ID NO: 552891 - DNA, 25 bp, Rattus norvegicus
tactccaccttcgaggctagggaaa

SEQ ID NO: 552892 - DNA, 25 bp, Rattus norvegicus
tactccactgccatgtgactgacca

SEQ ID NO: 552893 - DNA, 25 bp, Rattus norvegicus
tactccactgccttgtgactgacca

SEQ ID NO: 552894 - DNA, 25 bp, Rattus norvegicus
tactccagagcaatacgtcccttac

SEQ ID NO: 552895 - DNA, 25 bp, Rattus norvegicus
tactccagagcattacgtcccttac

SEQ ID NO: 552896 - DNA, 25 bp, Rattus norvegicus
tactccagccaccactgtggataat

SEQ ID NO: 552897 - DNA, 25 bp, Rattus norvegicus
tactccagccacgactgtggataat

SEQ ID NO: 552898 - DNA, 25 bp, Rattus norvegicus
tactccaggccgctgctgcaagggt

SEQ ID NO: 552899 - DNA, 25 bp, Rattus norvegicus
tactccaggccggtgctgcaagggt

SEQ ID NO: 552900 - DNA, 25 bp, Rattus norvegicus
tactccagggttaagcgcaagtgca

SEQ ID NO: 552901 - DNA, 25 bp, Rattus norvegicus
tactccagggtttagcgcaagtgca

SEQ ID NO: 552902 - DNA, 25 bp, Rattus norvegicus
tactccagtgccagtaccggaatat

SEQ ID NO: 552903 - DNA, 25 bp, Rattus norvegicus
tactccagtgccagtgtcaaactct

SEQ ID NO: 552904 - DNA, 25 bp, Rattus norvegicus
tactccagtgcctgtaccggaatat

SEQ ID NO: 552905 - DNA, 25 bp, Rattus norvegicus
tactccagtgcctgtgtcaaactct

SEQ ID NO: 552906 - DNA, 25 bp, Rattus norvegicus
tactccagtggcatgaaaaggcttt

SEQ ID NO: 552907 - DNA, 25 bp, Rattus norvegicus
tactccagtggcttgaaaaggcttt

SEQ ID NO: 552908 - DNA, 25 bp, Rattus norvegicus
tactccagttccacagatatcactg

SEQ ID NO: 552909 - DNA, 25 bp, Rattus norvegicus
tactccagttcctcagatatcactg

SEQ ID NO: 552910 - DNA, 25 bp, Rattus norvegicus
tactccatagaactggctggtccct

SEQ ID NO: 552911 - DNA, 25 bp, Rattus norvegicus
tactccatagaagtggctggtccct

SEQ ID NO: 552912 - DNA, 25 bp, Rattus norvegicus
tactccatccttcagtgggcagaag

SEQ ID NO: 552913 - DNA, 25 bp, Rattus norvegicus
tactccatccttgagtgggcagaag

SEQ ID NO: 552914 - DNA, 25 bp, Rattus norvegicus
tactccatctgtcctgtaacacaat

SEQ ID NO: 552915 - DNA, 25 bp, Rattus norvegicus
tactccatctgtgctgtaacacaat

SEQ ID NO: 552916 - DNA, 25 bp, Rattus norvegicus
tactccatcttcacaagttcctttg

SEQ ID NO: 552917 - DNA, 25 bp, Rattus norvegicus
tactccatcttctcaagttcctttg

SEQ ID NO: 552918 - DNA, 25 bp, Rattus norvegicus
tactccatgggacgacactagacag

SEQ ID NO: 552919 - DNA, 25 bp, Rattus norvegicus
tactccatgggaggacactagacag

SEQ ID NO: 552920 - DNA, 25 bp, Rattus norvegicus
tactccattgagaagcaccggtacg

SEQ ID NO: 552921 - DNA, 25 bp, Rattus norvegicus
tactccattgagtagcaccggtacg

SEQ ID NO: 552922 - DNA, 25 bp, Rattus norvegicus
tactcccaagtcactttgcggaaga

SEQ ID NO: 552923 - DNA, 25 bp, Rattus norvegicus
tactcccaagtctctttgcggaaga

SEQ ID NO: 552924 - DNA, 25 bp, Rattus norvegicus
tactcccacatacacacaaaagctt

SEQ ID NO: 552925 - DNA, 25 bp, Rattus norvegicus
tactcccacatagacacaaaagctt

SEQ ID NO: 552926 - DNA, 25 bp, Rattus norvegicus
tactcccaccaacactaaacatttt

SEQ ID NO: 552927 - DNA, 25 bp, Rattus norvegicus
tactcccaccaagactaaacatttt

SEQ ID NO: 552928 - DNA, 25 bp, Rattus norvegicus
tactcccactggagagcatctttgt

SEQ ID NO: 552929 - DNA, 25 bp, Rattus norvegicus
tactcccactggtgagcatctttgt

SEQ ID NO: 552930 - DNA, 25 bp, Rattus norvegicus
tactcccaggctcctgaggtaacta

SEQ ID NO: 552931 - DNA, 25 bp, Rattus norvegicus
tactcccaggctgctgaggtaacta

SEQ ID NO: 552932 - DNA, 25 bp, Rattus norvegicus
tactcccaggtgcagagccatgatt

SEQ ID NO: 552933 - DNA, 25 bp, Rattus norvegicus
tactcccaggtggagagccatgatt

SEQ ID NO: 552934 - DNA, 25 bp, Rattus norvegicus
tactcccatagaccccttttcttct

SEQ ID NO: 552935 - DNA, 25 bp, Rattus norvegicus
tactcccatagagcccttttcttct

SEQ ID NO: 552936 - DNA, 25 bp, Rattus norvegicus
tactcccatagcactgccataggga

SEQ ID NO: 552937 - DNA, 25 bp, Rattus norvegicus
tactcccatagctctgccataggga

SEQ ID NO: 552938 - DNA, 25 bp, Rattus norvegicus
tactccccaaacattaaggcagtat

SEQ ID NO: 552939 - DNA, 25 bp, Rattus norvegicus
tactccccaaacattgcattcattc

SEQ ID NO: 552940 - DNA, 25 bp, Rattus norvegicus
tactccccaaactttaaggcagtat

SEQ ID NO: 552941 - DNA, 25 bp, Rattus norvegicus
tactccccaaactttgcattcattc

SEQ ID NO: 552942 - DNA, 25 bp, Rattus norvegicus
tactccccaaagattgtcactgcta

SEQ ID NO: 552943 - DNA, 25 bp, Rattus norvegicus
tactccccaaagtttgtcactgcta

SEQ ID NO: 552944 - DNA, 25 bp, Rattus norvegicus
tactccccgtttaaacagatcctgg

SEQ ID NO: 552945 - DNA, 25 bp, Rattus norvegicus
tactccccgttttaacagatcctgg

SEQ ID NO: 552946 - DNA, 25 bp, Rattus norvegicus
tactcccctctgcttcttagaaaat

SEQ ID NO: 552947 - DNA, 25 bp, Rattus norvegicus
tactcccctctggttcttagaaaat

SEQ ID NO: 552948 - DNA, 25 bp, Rattus norvegicus
tactcccggaccaacaataaagaag

SEQ ID NO: 552949 - DNA, 25 bp, Rattus norvegicus
tactcccggacctacaataaagaag

SEQ ID NO: 552950 - DNA, 25 bp, Rattus norvegicus
tactcccgggagatagtgtttcctt

SEQ ID NO: 552951 - DNA, 25 bp, Rattus norvegicus
tactcccgggagttagtgtttcctt

SEQ ID NO: 552952 - DNA, 25 bp, Rattus norvegicus
tactccctcagacaaagtgctctgg

SEQ ID NO: 552953 - DNA, 25 bp, Rattus norvegicus
tactccctcagagaaagtgctctgg

SEQ ID NO: 552954 - DNA, 25 bp, Rattus norvegicus
tactccctggccaaagacctagtat

SEQ ID NO: 552955 - DNA, 25 bp, Rattus norvegicus
tactccctggcctaagacctagtat

SEQ ID NO: 552956 - DNA, 25 bp, Rattus norvegicus
tactcccttttaatgcagctttgaa

SEQ ID NO: 552957 - DNA, 25 bp, Rattus norvegicus
tactcccttttattgcagctttgaa

SEQ ID NO: 552958 - DNA, 25 bp, Rattus norvegicus
tactccgaaaaaccaaacccatatg

SEQ ID NO: 552959 - DNA, 25 bp, Rattus norvegicus
tactccgaaaaagcaaacccatatg

SEQ ID NO: 552960 - DNA, 25 bp, Rattus norvegicus
tactccgagcatcctagcggagcct

SEQ ID NO: 552961 - DNA, 25 bp, Rattus norvegicus
tactccgagcatgctagcggagcct

SEQ ID NO: 552962 - DNA, 25 bp, Rattus norvegicus
tactccgatcctaacaatactgctt

SEQ ID NO: 552963 - DNA, 25 bp, Rattus norvegicus
tactccgatccttacaatactgctt

SEQ ID NO: 552964 - DNA, 25 bp, Rattus norvegicus
tactccgccatgattgggcccaaag

SEQ ID NO: 552965 - DNA, 25 bp, Rattus norvegicus
tactccgccatgtttgggcccaaag

SEQ ID NO: 552966 - DNA, 25 bp, Rattus norvegicus
tactccgccctcaagaggatttcaa

SEQ ID NO: 552967 - DNA, 25 bp, Rattus norvegicus
tactccgccctctagaggatttcaa

SEQ ID NO: 552968 - DNA, 25 bp, Rattus norvegicus
tactccgctgtgctcaggtagatat

SEQ ID NO: 552969 - DNA, 25 bp, Rattus norvegicus
tactccgctgtggtcaggtagatat

SEQ ID NO: 552970 - DNA, 25 bp, Rattus norvegicus
tactccggcttcatcaggcggaagt

SEQ ID NO: 552971 - DNA, 25 bp, Rattus norvegicus
tactccggcttcttcaggcggaagt

SEQ ID NO: 552972 - DNA, 25 bp, Rattus norvegicus
tactccgtacagaaaactgccagca

SEQ ID NO: 552973 - DNA, 25 bp, Rattus norvegicus
tactccgtacagtaaactgccagca

SEQ ID NO: 552974 - DNA, 25 bp, Rattus norvegicus
tactccgtacccaacaggttaagct

SEQ ID NO: 552975 - DNA, 25 bp, Rattus norvegicus
tactccgtaccctacaggttaagct

SEQ ID NO: 552976 - DNA, 25 bp, Rattus norvegicus
tactccgtgcttacatacatgctgt

SEQ ID NO: 552977 - DNA, 25 bp, Rattus norvegicus
tactccgtgctttcatacatgctgt

SEQ ID NO: 552978 - DNA, 25 bp, Rattus norvegicus
tactccgtggtcatgttgcctgaaa

SEQ ID NO: 552979 - DNA, 25 bp, Rattus norvegicus
tactccgtggtcttgttgcctgaaa

SEQ ID NO: 552980 - DNA, 25 bp, Rattus norvegicus
tactcctaagtccacttcagagcag

SEQ ID NO: 552981 - DNA, 25 bp, Rattus norvegicus
tactcctaagtcgacttcagagcag

SEQ ID NO: 552982 - DNA, 25 bp, Rattus norvegicus
tactcctagaacctgggaggccagt

SEQ ID NO: 552983 - DNA, 25 bp, Rattus norvegicus
tactcctagaacgtgggaggccagt

SEQ ID NO: 552984 - DNA, 25 bp, Rattus norvegicus
tactcctaggctccactgcagaggc

SEQ ID NO: 552985 - DNA, 25 bp, Rattus norvegicus
tactcctaggctgcactgcagaggc

SEQ ID NO: 552986 - DNA, 25 bp, Rattus norvegicus
tactcctatcccattacttttattc

SEQ ID NO: 552987 - DNA, 25 bp, Rattus norvegicus
tactcctatccctttacttttattc

SEQ ID NO: 552988 - DNA, 25 bp, Rattus norvegicus
tactcctattggatggttgtccctg

SEQ ID NO: 552989 - DNA, 25 bp, Rattus norvegicus
tactcctattggttggttgtccctg

SEQ ID NO: 552990 - DNA, 25 bp, Rattus norvegicus
tactcctcaaaaaccgaccaattgt

SEQ ID NO: 552991 - DNA, 25 bp, Rattus norvegicus
tactcctcaaaatccgaccaattgt

SEQ ID NO: 552992 - DNA, 25 bp, Rattus norvegicus
tactcctcaaccattttctcaaagt

SEQ ID NO: 552993 - DNA, 25 bp, Rattus norvegicus
tactcctcaacctttttctcaaagt

SEQ ID NO: 552994 - DNA, 25 bp, Rattus norvegicus
tactcctcaatcaacatgggtcttg

SEQ ID NO: 552995 - DNA, 25 bp, Rattus norvegicus
tactcctcaatctacatgggtcttg

SEQ ID NO: 552996 - DNA, 25 bp, Rattus norvegicus
tactcctcagacacacttatgcaga

SEQ ID NO: 552997 - DNA, 25 bp, Rattus norvegicus
tactcctcagactcacttatgcaga

SEQ ID NO: 552998 - DNA, 25 bp, Rattus norvegicus
tactcctcagcaagctctggatgga

SEQ ID NO: 552999 - DNA, 25 bp, Rattus norvegicus
tactcctcagcatgctctggatgga

SEQ ID NO: 553000 - DNA, 25 bp, Rattus norvegicus
tactcctcagtgagcctgtagcttc

SEQ ID NO: 553001 - DNA, 25 bp, Rattus norvegicus
tactcctcagtgtgcctgtagcttc

SEQ ID NO: 553002 - DNA, 25 bp, Rattus norvegicus
tactcctcatgactcttctagatgt

SEQ ID NO: 553003 - DNA, 25 bp, Rattus norvegicus
tactcctcatgagtcttctagatgt

SEQ ID NO: 553004 - DNA, 25 bp, Rattus norvegicus
tactcctccctcaaaatactatgtg

SEQ ID NO: 553005 - DNA, 25 bp, Rattus norvegicus
tactcctccctctaaatactatgtg

SEQ ID NO: 553006 - DNA, 25 bp, Rattus norvegicus
tactcctccctgagtagccatgaag

SEQ ID NO: 553007 - DNA, 25 bp, Rattus norvegicus
tactcctccctgtgtagccatgaag

SEQ ID NO: 553008 - DNA, 25 bp, Rattus norvegicus
tactcctcggccaaggtgtgaaact

SEQ ID NO: 553009 - DNA, 25 bp, Rattus norvegicus
tactcctcggcctaggtgtgaaact

SEQ ID NO: 553010 - DNA, 25 bp, Rattus norvegicus
tactcctctacaaggtgtctggtgc

SEQ ID NO: 553011 - DNA, 25 bp, Rattus norvegicus
tactcctctacatggtgtctggtgc

SEQ ID NO: 553012 - DNA, 25 bp, Rattus norvegicus
tactcctctgtacgttgcctgtagg

SEQ ID NO: 553013 - DNA, 25 bp, Rattus norvegicus
tactcctctgtaggttgcctgtagg

SEQ ID NO: 553014 - DNA, 25 bp, Rattus norvegicus
tactcctctgtgcattgtctgtttt

SEQ ID NO: 553015 - DNA, 25 bp, Rattus norvegicus
tactcctctgtggattgtctgtttt

SEQ ID NO: 553016 - DNA, 25 bp, Rattus norvegicus
tactcctgaaatagacggtgcgcca

SEQ ID NO: 553017 - DNA, 25 bp, Rattus norvegicus
tactcctgaaattgacggtgcgcca

SEQ ID NO: 553018 - DNA, 25 bp, Rattus norvegicus
tactcctgacacaagccatttctga

SEQ ID NO: 553019 - DNA, 25 bp, Rattus norvegicus
tactcctgacactagccatttctga

SEQ ID NO: 553020 - DNA, 25 bp, Rattus norvegicus
tactcctgagctcgatgatggtctt

SEQ ID NO: 553021 - DNA, 25 bp, Rattus norvegicus
tactcctgagctggatgatggtctt

SEQ ID NO: 553022 - DNA, 25 bp, Rattus norvegicus
tactcctgcagcatgaaaagctatg

SEQ ID NO: 553023 - DNA, 25 bp, Rattus norvegicus
tactcctgcagcttgaaaagctatg

SEQ ID NO: 553024 - DNA, 25 bp, Rattus norvegicus
tactcctgctgactacagtagctgc

SEQ ID NO: 553025 - DNA, 25 bp, Rattus norvegicus
tactcctgctgagtacagtagctgc

SEQ ID NO: 553026 - DNA, 25 bp, Rattus norvegicus
tactcctggaccatgatgtgcctga

SEQ ID NO: 553027 - DNA, 25 bp, Rattus norvegicus
tactcctggaccttgatgtgcctga

SEQ ID NO: 553028 - DNA, 25 bp, Rattus norvegicus
tactcctgggagattcaatgaatga

SEQ ID NO: 553029 - DNA, 25 bp, Rattus norvegicus
tactcctgggagtttcaatgaatga

SEQ ID NO: 553030 - DNA, 25 bp, Rattus norvegicus
tactcctggttgcagtgactggttt

SEQ ID NO: 553031 - DNA, 25 bp, Rattus norvegicus
tactcctggttggagtgactggttt

SEQ ID NO: 553032 - DNA, 25 bp, Rattus norvegicus
tactcctgtcagaggcttgggcatc

SEQ ID NO: 553033 - DNA, 25 bp, Rattus norvegicus
tactcctgtcagtggcttgggcatc

SEQ ID NO: 553034 - DNA, 25 bp, Rattus norvegicus
tactcctgtcatacaagcattgttt

SEQ ID NO: 553035 - DNA, 25 bp, Rattus norvegicus
tactcctgtcattcaagcattgttt

SEQ ID NO: 553036 - DNA, 25 bp, Rattus norvegicus
tactcctgtctaaacagcacctaca

SEQ ID NO: 553037 - DNA, 25 bp, Rattus norvegicus
tactcctgtctatacagcacctaca

SEQ ID NO: 553038 - DNA, 25 bp, Rattus norvegicus
tactcctgtggaagttaagcccagt

SEQ ID NO: 553039 - DNA, 25 bp, Rattus norvegicus
tactcctgtggatgttaagcccagt

SEQ ID NO: 553040 - DNA, 25 bp, Rattus norvegicus
tactcctgtgtacccagatattgct

SEQ ID NO: 553041 - DNA, 25 bp, Rattus norvegicus
tactcctgtgtagccagatattgct

SEQ ID NO: 553042 - DNA, 25 bp, Rattus norvegicus
tactcctgttcccaatgtcctaaag

SEQ ID NO: 553043 - DNA, 25 bp, Rattus norvegicus
tactcctgttccgaatgtcctaaag

SEQ ID NO: 553044 - DNA, 25 bp, Rattus norvegicus
tactcctgttttcaaaccctgaggt

SEQ ID NO: 553045 - DNA, 25 bp, Rattus norvegicus
tactcctgttttgaaaccctgaggt

SEQ ID NO: 553046 - DNA, 25 bp, Rattus norvegicus
tactccttagttatctctatccaga

SEQ ID NO: 553047 - DNA, 25 bp, Rattus norvegicus
tactccttagttttctctatccaga

SEQ ID NO: 553048 - DNA, 25 bp, Rattus norvegicus
tactccttctgaacgaccaggttgg

SEQ ID NO: 553049 - DNA, 25 bp, Rattus norvegicus
tactccttctgatcgaccaggttgg

SEQ ID NO: 553050 - DNA, 25 bp, Rattus norvegicus
tactccttgagtaccctaagcattt

SEQ ID NO: 553051 - DNA, 25 bp, Rattus norvegicus
tactccttgagttccctaagcattt

SEQ ID NO: 553052 - DNA, 25 bp, Rattus norvegicus
tactccttgcttaggttcccaaaga

SEQ ID NO: 553053 - DNA, 25 bp, Rattus norvegicus
tactccttgctttggttcccaaaga

SEQ ID NO: 553054 - DNA, 25 bp, Rattus norvegicus
tactcctttcttagtacttgcccaa

SEQ ID NO: 553055 - DNA, 25 bp, Rattus norvegicus
tactcctttctttgtacttgcccaa

SEQ ID NO: 553056 - DNA, 25 bp, Rattus norvegicus
tactcctttgaaaacagtctcactg

SEQ ID NO: 553057 - DNA, 25 bp, Rattus norvegicus
tactcctttgaatacagtctcactg

SEQ ID NO: 553058 - DNA, 25 bp, Rattus norvegicus
tactcctttttgatcatgactttca

SEQ ID NO: 553059 - DNA, 25 bp, Rattus norvegicus
tactcctttttgttcatgactttca

SEQ ID NO: 553060 - DNA, 25 bp, Rattus norvegicus
tactcgaaacatattgactatttga

SEQ ID NO: 553061 - DNA, 25 bp, Rattus norvegicus
tactcgaaacattttgactatttga

SEQ ID NO: 553062 - DNA, 25 bp, Rattus norvegicus
tactcgaccaggctcaagacccgaa

SEQ ID NO: 553063 - DNA, 25 bp, Rattus norvegicus
tactcgaccagggtcaagacccgaa

SEQ ID NO: 553064 - DNA, 25 bp, Rattus norvegicus
tactcgactcttatccgtttactag

SEQ ID NO: 553065 - DNA, 25 bp, Rattus norvegicus
tactcgactcttttccgtttactag

SEQ ID NO: 553066 - DNA, 25 bp, Rattus norvegicus
tactcgacttggaaaatgtctctga

SEQ ID NO: 553067 - DNA, 25 bp, Rattus norvegicus
tactcgacttggtaaatgtctctga

SEQ ID NO: 553068 - DNA, 25 bp, Rattus norvegicus
tactcgagcgccctgaactgtgaca

SEQ ID NO: 553069 - DNA, 25 bp, Rattus norvegicus
tactcgagcgccgtgaactgtgaca

SEQ ID NO: 553070 - DNA, 25 bp, Rattus norvegicus
tactcgagggctctttgctgtcctt

SEQ ID NO: 553071 - DNA, 25 bp, Rattus norvegicus
tactcgagggctgtttgctgtcctt

SEQ ID NO: 553072 - DNA, 25 bp, Rattus norvegicus
tactcgcaatcgagcttgccaggga

SEQ ID NO: 553073 - DNA, 25 bp, Rattus norvegicus
tactcgcaatcgtgcttgccaggga

SEQ ID NO: 553074 - DNA, 25 bp, Rattus norvegicus
tactcgcataacattctagccttca

SEQ ID NO: 553075 - DNA, 25 bp, Rattus norvegicus
tactcgcataactttctagccttca

SEQ ID NO: 553076 - DNA, 25 bp, Rattus norvegicus
tactcgctgaggacggcgtgcacaa

SEQ ID NO: 553077 - DNA, 25 bp, Rattus norvegicus
tactcgctgaggtcggcgtgcacaa

SEQ ID NO: 553078 - DNA, 25 bp, Rattus norvegicus
tactcggagctcaggaaaggtctac

SEQ ID NO: 553079 - DNA, 25 bp, Rattus norvegicus
tactcggagctctggaaaggtctac

SEQ ID NO: 553080 - DNA, 25 bp, Rattus norvegicus
tactcggcctgtaattcttttatca

SEQ ID NO: 553081 - DNA, 25 bp, Rattus norvegicus
tactcggcctgttattcttttatca

SEQ ID NO: 553082 - DNA, 25 bp, Rattus norvegicus
tactcgggagctccaggaaggacta

SEQ ID NO: 553083 - DNA, 25 bp, Rattus norvegicus
tactcgggagctgcaggaaggacta

SEQ ID NO: 553084 - DNA, 25 bp, Rattus norvegicus
tactcggtgctcatggagactgctg

SEQ ID NO: 553085 - DNA, 25 bp, Rattus norvegicus
tactcggtgctcttggagactgctg

SEQ ID NO: 553086 - DNA, 25 bp, Rattus norvegicus
tactcggttgaaagcctcggctgta

SEQ ID NO: 553087 - DNA, 25 bp, Rattus norvegicus
tactcggttgaatgcctcggctgta

SEQ ID NO: 553088 - DNA, 25 bp, Rattus norvegicus
tactcgttccaaattcccacgacag

SEQ ID NO: 553089 - DNA, 25 bp, Rattus norvegicus
tactcgttccaatttcccacgacag

SEQ ID NO: 553090 - DNA, 25 bp, Rattus norvegicus
tactctaaaattagcgtcgtcacta

SEQ ID NO: 553091 - DNA, 25 bp, Rattus norvegicus
tactctaaaatttgcgtcgtcacta

SEQ ID NO: 553092 - DNA, 25 bp, Rattus norvegicus
tactctaaactcatctagatgtccc

SEQ ID NO: 553093 - DNA, 25 bp, Rattus norvegicus
tactctaaactcttctagatgtccc

SEQ ID NO: 553094 - DNA, 25 bp, Rattus norvegicus
tactctaaagtgatggaaactgcga

SEQ ID NO: 553095 - DNA, 25 bp, Rattus norvegicus
tactctaaagtgttggaaactgcga

SEQ ID NO: 553096 - DNA, 25 bp, Rattus norvegicus
tactctaaccccacagtgtgtaaag

SEQ ID NO: 553097 - DNA, 25 bp, Rattus norvegicus
tactctaacccctcagtgtgtaaag

SEQ ID NO: 553098 - DNA, 25 bp, Rattus norvegicus
tactctaacggacacactggacaag

SEQ ID NO: 553099 - DNA, 25 bp, Rattus norvegicus
tactctaacggagacactggacaag

SEQ ID NO: 553100 - DNA, 25 bp, Rattus norvegicus
tactctaagaagagtggcgcattac

SEQ ID NO: 553101 - DNA, 25 bp, Rattus norvegicus
tactctaagaagtgtggcgcattac

SEQ ID NO: 553102 - DNA, 25 bp, Rattus norvegicus
tactctaagtagaccaccatccata

SEQ ID NO: 553103 - DNA, 25 bp, Rattus norvegicus
tactctaagtagtccaccatccata

SEQ ID NO: 553104 - DNA, 25 bp, Rattus norvegicus
tactctaatggtaacttgctcgctc

SEQ ID NO: 553105 - DNA, 25 bp, Rattus norvegicus
tactctaatggttacttgctcgctc

SEQ ID NO: 553106 - DNA, 25 bp, Rattus norvegicus
tactctaattggcatcaggaagcaa

SEQ ID NO: 553107 - DNA, 25 bp, Rattus norvegicus
tactctaattgggatcaggaagcaa

SEQ ID NO: 553108 - DNA, 25 bp, Rattus norvegicus
tactctacaactatgttcttttttg

SEQ ID NO: 553109 - DNA, 25 bp, Rattus norvegicus
tactctacaactttgttcttttttg

SEQ ID NO: 553110 - DNA, 25 bp, Rattus norvegicus
tactctacaccactgagctgtctct

SEQ ID NO: 553111 - DNA, 25 bp, Rattus norvegicus
tactctacaccagtgagctgtctct

SEQ ID NO: 553112 - DNA, 25 bp, Rattus norvegicus
tactctacataccacagcagcactg

SEQ ID NO: 553113 - DNA, 25 bp, Rattus norvegicus
tactctacatacgacagcagcactg

SEQ ID NO: 553114 - DNA, 25 bp, Rattus norvegicus
tactctacattaagccctggtcatg

SEQ ID NO: 553115 - DNA, 25 bp, Rattus norvegicus
tactctacattatgccctggtcatg

SEQ ID NO: 553116 - DNA, 25 bp, Rattus norvegicus
tactctactcctcgaccaataaaat

SEQ ID NO: 553117 - DNA, 25 bp, Rattus norvegicus
tactctactcctggaccaataaaat

SEQ ID NO: 553118 - DNA, 25 bp, Rattus norvegicus
tactctagcagcacacttcaatgat

SEQ ID NO: 553119 - DNA, 25 bp, Rattus norvegicus
tactctagcagctcacttcaatgat

SEQ ID NO: 553120 - DNA, 25 bp, Rattus norvegicus
tactctagtcacataacaatgatgg

SEQ ID NO: 553121 - DNA, 25 bp, Rattus norvegicus
tactctagtcacttaacaatgatgg

SEQ ID NO: 553122 - DNA, 25 bp, Rattus norvegicus
tactctagtcagactttttggcatg

SEQ ID NO: 553123 - DNA, 25 bp, Rattus norvegicus
tactctagtcagtctttttggcatg

SEQ ID NO: 553124 - DNA, 25 bp, Rattus norvegicus
tactctagtcccaggagacccagtg

SEQ ID NO: 553125 - DNA, 25 bp, Rattus norvegicus
tactctagtccctggagacccagtg

SEQ ID NO: 553126 - DNA, 25 bp, Rattus norvegicus
tactctagtgttactcgggacctgg

SEQ ID NO: 553127 - DNA, 25 bp, Rattus norvegicus
tactctagtgtttctcgggacctgg

SEQ ID NO: 553128 - DNA, 25 bp, Rattus norvegicus
tactctatacttcccaacgtggaga

SEQ ID NO: 553129 - DNA, 25 bp, Rattus norvegicus
tactctatacttgccaacgtggaga

SEQ ID NO: 553130 - DNA, 25 bp, Rattus norvegicus
tactctatctctctcacacttttga

SEQ ID NO: 553131 - DNA, 25 bp, Rattus norvegicus
tactctatctctgtcacacttttga

SEQ ID NO: 553132 - DNA, 25 bp, Rattus norvegicus
tactctatcttgagtgggctttcgt

SEQ ID NO: 553133 - DNA, 25 bp, Rattus norvegicus
tactctatcttgtgtgggctttcgt

SEQ ID NO: 553134 - DNA, 25 bp, Rattus norvegicus
tactctattgtgagtatcatctaca

SEQ ID NO: 553135 - DNA, 25 bp, Rattus norvegicus
tactctattgtgtgtatcatctaca

SEQ ID NO: 553136 - DNA, 25 bp, Rattus norvegicus
tactctcactgtaacatcgactaag

SEQ ID NO: 553137 - DNA, 25 bp, Rattus norvegicus
tactctcactgttacatcgactaag

SEQ ID NO: 553138 - DNA, 25 bp, Rattus norvegicus
tactctcccttgatatcttcacagg

SEQ ID NO: 553139 - DNA, 25 bp, Rattus norvegicus
tactctcccttgttatcttcacagg

SEQ ID NO: 553140 - DNA, 25 bp, Rattus norvegicus
tactctccggagagcaactcacaat

SEQ ID NO: 553141 - DNA, 25 bp, Rattus norvegicus
tactctccggagtgcaactcacaat

SEQ ID NO: 553142 - DNA, 25 bp, Rattus norvegicus
tactctccttgacccaggcgtgcag

SEQ ID NO: 553143 - DNA, 25 bp, Rattus norvegicus
tactctccttgagccaggcgtgcag

SEQ ID NO: 553144 - DNA, 25 bp, Rattus norvegicus
tactctccttttcgaatcctcaact

SEQ ID NO: 553145 - DNA, 25 bp, Rattus norvegicus
tactctccttttggaatcctcaact

SEQ ID NO: 553146 - DNA, 25 bp, Rattus norvegicus
tactctcgacctcttacatttggag

SEQ ID NO: 553147 - DNA, 25 bp, Rattus norvegicus
tactctcgacctgttacatttggag

SEQ ID NO: 553148 - DNA, 25 bp, Rattus norvegicus
tactctcggttgacattgaagcact

SEQ ID NO: 553149 - DNA, 25 bp, Rattus norvegicus
tactctcggttgtcattgaagcact

SEQ ID NO: 553150 - DNA, 25 bp, Rattus norvegicus
tactctcgtaaaagctcactacatt

SEQ ID NO: 553151 - DNA, 25 bp, Rattus norvegicus
tactctcgtaaatgctcactacatt

SEQ ID NO: 553152 - DNA, 25 bp, Rattus norvegicus
tactctcgttctaacacaccgtgtt

SEQ ID NO: 553153 - DNA, 25 bp, Rattus norvegicus
tactctcgttcttacacaccgtgtt

SEQ ID NO: 553154 - DNA, 25 bp, Rattus norvegicus
tactctctatgcaattggaatctac

SEQ ID NO: 553155 - DNA, 25 bp, Rattus norvegicus
tactctctatgctattggaatctac

SEQ ID NO: 553156 - DNA, 25 bp, Rattus norvegicus
tactctctcagcagtattaaaatga

SEQ ID NO: 553157 - DNA, 25 bp, Rattus norvegicus
tactctctcagctgtattaaaatga

SEQ ID NO: 553158 - DNA, 25 bp, Rattus norvegicus
tactctctcagtcaggctggaaacc

SEQ ID NO: 553159 - DNA, 25 bp, Rattus norvegicus
tactctctcagtgaggctggaaacc

SEQ ID NO: 553160 - DNA, 25 bp, Rattus norvegicus
tactctctgacaacgctgcctttag

SEQ ID NO: 553161 - DNA, 25 bp, Rattus norvegicus
tactctctgacatcgctgcctttag

SEQ ID NO: 553162 - DNA, 25 bp, Rattus norvegicus
tactctctggccagtaagatgcttg

SEQ ID NO: 553163 - DNA, 25 bp, Rattus norvegicus
tactctctggcctgtaagatgcttg

SEQ ID NO: 553164 - DNA, 25 bp, Rattus norvegicus
tactctctgggtactcccaggaggt

SEQ ID NO: 553165 - DNA, 25 bp, Rattus norvegicus
tactctctgggttctcccaggaggt

SEQ ID NO: 553166 - DNA, 25 bp, Rattus norvegicus
tactctctggtcacgtactttggga

SEQ ID NO: 553167 - DNA, 25 bp, Rattus norvegicus
tactctctggtctcgtactttggga

SEQ ID NO: 553168 - DNA, 25 bp, Rattus norvegicus
tactctctggtgcttacctgatgaa

SEQ ID NO: 553169 - DNA, 25 bp, Rattus norvegicus
tactctctggtggttacctgatgaa

SEQ ID NO: 553170 - DNA, 25 bp, Rattus norvegicus
tactctctgtggattgtgcttttca

SEQ ID NO: 553171 - DNA, 25 bp, Rattus norvegicus
tactctctgtggtttgtgcttttca

SEQ ID NO: 553172 - DNA, 25 bp, Rattus norvegicus
tactctcttgtaattgtgcctcaga

SEQ ID NO: 553173 - DNA, 25 bp, Rattus norvegicus
tactctcttgtatttgtgcctcaga

SEQ ID NO: 553174 - DNA, 25 bp, Rattus norvegicus
tactctcttgtgatttctctctttc

SEQ ID NO: 553175 - DNA, 25 bp, Rattus norvegicus
tactctcttgtgttttctctctttc

SEQ ID NO: 553176 - DNA, 25 bp, Rattus norvegicus
tactctctttctctggataaataca

SEQ ID NO: 553177 - DNA, 25 bp, Rattus norvegicus
tactctctttctgtggataaataca

SEQ ID NO: 553178 - DNA, 25 bp, Rattus norvegicus
tactctgaacatcccttacctttaa

SEQ ID NO: 553179 - DNA, 25 bp, Rattus norvegicus
tactctgaacatgccttacctttaa

SEQ ID NO: 553180 - DNA, 25 bp, Rattus norvegicus
tactctgaaccgctcagtaactgct

SEQ ID NO: 553181 - DNA, 25 bp, Rattus norvegicus
tactctgaaccggtcagtaactgct

SEQ ID NO: 553182 - DNA, 25 bp, Rattus norvegicus
tactctgaagcccaaagctcgactt

SEQ ID NO: 553183 - DNA, 25 bp, Rattus norvegicus
tactctgaagcccttgagacacttt

SEQ ID NO: 553184 - DNA, 25 bp, Rattus norvegicus
tactctgaagccgaaagctcgactt

SEQ ID NO: 553185 - DNA, 25 bp, Rattus norvegicus
tactctgaagccgttgagacacttt

SEQ ID NO: 553186 - DNA, 25 bp, Rattus norvegicus
tactctgaagggatgaccgtccaca

SEQ ID NO: 553187 - DNA, 25 bp, Rattus norvegicus
tactctgaagggttgaccgtccaca

SEQ ID NO: 553188 - DNA, 25 bp, Rattus norvegicus
tactctgaccaaaaggcagccgggt

SEQ ID NO: 553189 - DNA, 25 bp, Rattus norvegicus
tactctgaccaataggcagccgggt

SEQ ID NO: 553190 - DNA, 25 bp, Rattus norvegicus
tactctgagtctctgatgtcaccag

SEQ ID NO: 553191 - DNA, 25 bp, Rattus norvegicus
tactctgagtctgtgatgtcaccag

SEQ ID NO: 553192 - DNA, 25 bp, Rattus norvegicus
tactctgatcctattagctgttttc

SEQ ID NO: 553193 - DNA, 25 bp, Rattus norvegicus
tactctgatccttttagctgttttc

SEQ ID NO: 553194 - DNA, 25 bp, Rattus norvegicus
tactctgattctctaacacttctga

SEQ ID NO: 553195 - DNA, 25 bp, Rattus norvegicus
tactctgattctgtaacacttctga

SEQ ID NO: 553196 - DNA, 25 bp, Rattus norvegicus
tactctgcaatcactgaaatcctag

SEQ ID NO: 553197 - DNA, 25 bp, Rattus norvegicus
tactctgcaatctctgaaatcctag

SEQ ID NO: 553198 - DNA, 25 bp, Rattus norvegicus
tactctgcacagatccactgagctt

SEQ ID NO: 553199 - DNA, 25 bp, Rattus norvegicus
tactctgcacagttccactgagctt

SEQ ID NO: 553200 - DNA, 25 bp, Rattus norvegicus
tactctgcactacacagacttctct

SEQ ID NO: 553201 - DNA, 25 bp, Rattus norvegicus
tactctgcactagacagacttctct

SEQ ID NO: 553202 - DNA, 25 bp, Rattus norvegicus
tactctgcagttattgtgtctccaa

SEQ ID NO: 553203 - DNA, 25 bp, Rattus norvegicus
tactctgcagtttttgtgtctccaa

SEQ ID NO: 553204 - DNA, 25 bp, Rattus norvegicus
tactctgccaccagtgttgtagagc

SEQ ID NO: 553205 - DNA, 25 bp, Rattus norvegicus
tactctgccacctgtgttgtagagc

SEQ ID NO: 553206 - DNA, 25 bp, Rattus norvegicus
tactctgcctatctatcaacactgt

SEQ ID NO: 553207 - DNA, 25 bp, Rattus norvegicus
tactctgcctatgtatcaacactgt

SEQ ID NO: 553208 - DNA, 25 bp, Rattus norvegicus
tactctgcctgaagaattacgtttc

SEQ ID NO: 553209 - DNA, 25 bp, Rattus norvegicus
tactctgcctgacactgggctttag

SEQ ID NO: 553210 - DNA, 25 bp, Rattus norvegicus
tactctgcctgagactgggctttag

SEQ ID NO: 553211 - DNA, 25 bp, Rattus norvegicus
tactctgcctgatgaattacgtttc

SEQ ID NO: 553212 - DNA, 25 bp, Rattus norvegicus
tactctgcggctctgattgatcagt

SEQ ID NO: 553213 - DNA, 25 bp, Rattus norvegicus
tactctgcggctgtgattgatcagt

SEQ ID NO: 553214 - DNA, 25 bp, Rattus norvegicus
tactctgcgtatatggttgctgaga

SEQ ID NO: 553215 - DNA, 25 bp, Rattus norvegicus
tactctgcgtatttggttgctgaga

SEQ ID NO: 553216 - DNA, 25 bp, Rattus norvegicus
tactctgctagaatatggactgttg

SEQ ID NO: 553217 - DNA, 25 bp, Rattus norvegicus
tactctgctagattatggactgttg

SEQ ID NO: 553218 - DNA, 25 bp, Rattus norvegicus
tactctgctggcaccctgaggagta

SEQ ID NO: 553219 - DNA, 25 bp, Rattus norvegicus
tactctgctggctccctgaggagta

SEQ ID NO: 553220 - DNA, 25 bp, Rattus norvegicus
tactctgcttcgcactgaaggactt

SEQ ID NO: 553221 - DNA, 25 bp, Rattus norvegicus
tactctgcttcggactgaaggactt

SEQ ID NO: 553222 - DNA, 25 bp, Rattus norvegicus
tactctggactcagtaggctcacag

SEQ ID NO: 553223 - DNA, 25 bp, Rattus norvegicus
tactctggactctgtaggctcacag

SEQ ID NO: 553224 - DNA, 25 bp, Rattus norvegicus
tactctggaggcaataacagctaac

SEQ ID NO: 553225 - DNA, 25 bp, Rattus norvegicus
tactctggaggcattctcatacaga

SEQ ID NO: 553226 - DNA, 25 bp, Rattus norvegicus
tactctggaggctataacagctaac

SEQ ID NO: 553227 - DNA, 25 bp, Rattus norvegicus
tactctggaggctttctcatacaga

SEQ ID NO: 553228 - DNA, 25 bp, Rattus norvegicus
tactctggagttatttccacacgct

SEQ ID NO: 553229 - DNA, 25 bp, Rattus norvegicus
tactctggagttttttccacacgct

SEQ ID NO: 553230 - DNA, 25 bp, Rattus norvegicus
tactctggccctaggactttggaaa

SEQ ID NO: 553231 - DNA, 25 bp, Rattus norvegicus
tactctggcccttggactttggaaa

SEQ ID NO: 553232 - DNA, 25 bp, Rattus norvegicus
tactctgggatgcaaccgacatgtt

SEQ ID NO: 553233 - DNA, 25 bp, Rattus norvegicus
tactctgggatggaaccgacatgtt

SEQ ID NO: 553234 - DNA, 25 bp, Rattus norvegicus
tactctgggcctaggactgctgtga

SEQ ID NO: 553235 - DNA, 25 bp, Rattus norvegicus
tactctgggccttggactgctgtga

SEQ ID NO: 553236 - DNA, 25 bp, Rattus norvegicus
tactctgggctaccagcttcgggaa

SEQ ID NO: 553237 - DNA, 25 bp, Rattus norvegicus
tactctgggctagcagcttcgggaa

SEQ ID NO: 553238 - DNA, 25 bp, Rattus norvegicus
tactctggtatgaagcaaccttcct

SEQ ID NO: 553239 - DNA, 25 bp, Rattus norvegicus
tactctggtatgtagcaaccttcct

SEQ ID NO: 553240 - DNA, 25 bp, Rattus norvegicus
tactctggtctaaacttccctgaga

SEQ ID NO: 553241 - DNA, 25 bp, Rattus norvegicus
tactctggtctatacttccctgaga

SEQ ID NO: 553242 - DNA, 25 bp, Rattus norvegicus
tactctgtacacaggctcttccaga

SEQ ID NO: 553243 - DNA, 25 bp, Rattus norvegicus
tactctgtacactggctcttccaga

SEQ ID NO: 553244 - DNA, 25 bp, Rattus norvegicus
tactctgtagaacccggcttaggaa

SEQ ID NO: 553245 - DNA, 25 bp, Rattus norvegicus
tactctgtagaagccggcttaggaa

SEQ ID NO: 553246 - DNA, 25 bp, Rattus norvegicus
tactctgtagagctggccatggaat

SEQ ID NO: 553247 - DNA, 25 bp, Rattus norvegicus
tactctgtagaggtggccatggaat

SEQ ID NO: 553248 - DNA, 25 bp, Rattus norvegicus
tactctgtagctctggttacactcc

SEQ ID NO: 553249 - DNA, 25 bp, Rattus norvegicus
tactctgtagctgtggttacactcc

SEQ ID NO: 553250 - DNA, 25 bp, Rattus norvegicus
tactctgtagtgctcataggttctg

SEQ ID NO: 553251 - DNA, 25 bp, Rattus norvegicus
tactctgtagtggtcataggttctg

SEQ ID NO: 553252 - DNA, 25 bp, Rattus norvegicus
tactctgtcagccaaaggtttgctt

SEQ ID NO: 553253 - DNA, 25 bp, Rattus norvegicus
tactctgtcagccaacgtgtacaaa

SEQ ID NO: 553254 - DNA, 25 bp, Rattus norvegicus
tactctgtcagcgaaaggtttgctt

SEQ ID NO: 553255 - DNA, 25 bp, Rattus norvegicus
tactctgtcagcgaacgtgtacaaa

SEQ ID NO: 553256 - DNA, 25 bp, Rattus norvegicus
tactctgtcattcgtggaagcggct

SEQ ID NO: 553257 - DNA, 25 bp, Rattus norvegicus
tactctgtcattggtggaagcggct

SEQ ID NO: 553258 - DNA, 25 bp, Rattus norvegicus
tactctgtctgtcttgggcattctg

SEQ ID NO: 553259 - DNA, 25 bp, Rattus norvegicus
tactctgtctgtgttgggcattctg

SEQ ID NO: 553260 - DNA, 25 bp, Rattus norvegicus
tactctgtcttgagtgaggtagaac

SEQ ID NO: 553261 - DNA, 25 bp, Rattus norvegicus
tactctgtcttgtgtgaggtagaac

SEQ ID NO: 553262 - DNA, 25 bp, Rattus norvegicus
tactctgtgagtaccggctggctca

SEQ ID NO: 553263 - DNA, 25 bp, Rattus norvegicus
tactctgtgagttccggctggctca

SEQ ID NO: 553264 - DNA, 25 bp, Rattus norvegicus
tactctgtgcataggatggacctgt

SEQ ID NO: 553265 - DNA, 25 bp, Rattus norvegicus
tactctgtgcattggatggacctgt

SEQ ID NO: 553266 - DNA, 25 bp, Rattus norvegicus
tactctgtgtggattggtggctcta

SEQ ID NO: 553267 - DNA, 25 bp, Rattus norvegicus
tactctgtgtggtttggtggctcta

SEQ ID NO: 553268 - DNA, 25 bp, Rattus norvegicus
tactctgttagtacatagcaaggtt

SEQ ID NO: 553269 - DNA, 25 bp, Rattus norvegicus
tactctgttagttcatagcaaggtt

SEQ ID NO: 553270 - DNA, 25 bp, Rattus norvegicus
tactcttaaagactgcgacctgcca

SEQ ID NO: 553271 - DNA, 25 bp, Rattus norvegicus
tactcttaaagagtgcgacctgcca

SEQ ID NO: 553272 - DNA, 25 bp, Rattus norvegicus
tactcttaaccacaaaatctcttca

SEQ ID NO: 553273 - DNA, 25 bp, Rattus norvegicus
tactcttaaccagaaaatctcttca

SEQ ID NO: 553274 - DNA, 25 bp, Rattus norvegicus
tactcttacatgctacacagaaaat

SEQ ID NO: 553275 - DNA, 25 bp, Rattus norvegicus
tactcttacatggtacacagaaaat

SEQ ID NO: 553276 - DNA, 25 bp, Rattus norvegicus
tactcttacctactttagtccgtga

SEQ ID NO: 553277 - DNA, 25 bp, Rattus norvegicus
tactcttacctagtttagtccgtga

SEQ ID NO: 553278 - DNA, 25 bp, Rattus norvegicus
tactcttacgtgcagttccccattg

SEQ ID NO: 553279 - DNA, 25 bp, Rattus norvegicus
tactcttacgtggagttccccattg

SEQ ID NO: 553280 - DNA, 25 bp, Rattus norvegicus
tactcttattttcttcctttcatgg

SEQ ID NO: 553281 - DNA, 25 bp, Rattus norvegicus
tactcttattttgttcctttcatgg

SEQ ID NO: 553282 - DNA, 25 bp, Rattus norvegicus
tactcttcacaaacccttgaaactt

SEQ ID NO: 553283 - DNA, 25 bp, Rattus norvegicus
tactcttcacaatcccttgaaactt

SEQ ID NO: 553284 - DNA, 25 bp, Rattus norvegicus
tactcttccaacagccaagttactt

SEQ ID NO: 553285 - DNA, 25 bp, Rattus norvegicus
tactcttccaactgccaagttactt

SEQ ID NO: 553286 - DNA, 25 bp, Rattus norvegicus
tactcttccagacgagaagggtagg

SEQ ID NO: 553287 - DNA, 25 bp, Rattus norvegicus
tactcttccagaggagaagggtagg

SEQ ID NO: 553288 - DNA, 25 bp, Rattus norvegicus
tactcttcccagaggtgctatgaaa

SEQ ID NO: 553289 - DNA, 25 bp, Rattus norvegicus
tactcttcccagtggtgctatgaaa

SEQ ID NO: 553290 - DNA, 25 bp, Rattus norvegicus
tactcttcctggcttcatgatgagt

SEQ ID NO: 553291 - DNA, 25 bp, Rattus norvegicus
tactcttcctgggttcatgatgagt

SEQ ID NO: 553292 - DNA, 25 bp, Rattus norvegicus
tactcttcctttcagggtagtgagt

SEQ ID NO: 553293 - DNA, 25 bp, Rattus norvegicus
tactcttcctttgagggtagtgagt

SEQ ID NO: 553294 - DNA, 25 bp, Rattus norvegicus
tactcttcgtttccatgattcgctc

SEQ ID NO: 553295 - DNA, 25 bp, Rattus norvegicus
tactcttcgtttgcatgattcgctc

SEQ ID NO: 553296 - DNA, 25 bp, Rattus norvegicus
tactcttctaatccacttcatctga

SEQ ID NO: 553297 - DNA, 25 bp, Rattus norvegicus
tactcttctaatgcacttcatctga

SEQ ID NO: 553298 - DNA, 25 bp, Rattus norvegicus
tactcttctaccacatccaataatg

SEQ ID NO: 553299 - DNA, 25 bp, Rattus norvegicus
tactcttctacctcatccaataatg

SEQ ID NO: 553300 - DNA, 25 bp, Rattus norvegicus
tactcttctactatggttcctgttg

SEQ ID NO: 553301 - DNA, 25 bp, Rattus norvegicus
tactcttctactttggttcctgttg

SEQ ID NO: 553302 - DNA, 25 bp, Rattus norvegicus
tactcttctattatctgagacaggg

SEQ ID NO: 553303 - DNA, 25 bp, Rattus norvegicus
tactcttctattttctgagacaggg

SEQ ID NO: 553304 - DNA, 25 bp, Rattus norvegicus
tactcttctttcctattatccaatg

SEQ ID NO: 553305 - DNA, 25 bp, Rattus norvegicus
tactcttctttcgtattatccaatg

SEQ ID NO: 553306 - DNA, 25 bp, Rattus norvegicus
tactcttgagtgctatgctcgcctg

SEQ ID NO: 553307 - DNA, 25 bp, Rattus norvegicus
tactcttgagtggtatgctcgcctg

SEQ ID NO: 553308 - DNA, 25 bp, Rattus norvegicus
tactcttgctgtccatctgttacgt

SEQ ID NO: 553309 - DNA, 25 bp, Rattus norvegicus
tactcttgctgtgcatctgttacgt

SEQ ID NO: 553310 - DNA, 25 bp, Rattus norvegicus
tactcttggcgtattctgttctgac

SEQ ID NO: 553311 - DNA, 25 bp, Rattus norvegicus
tactcttggcgttttctgttctgac

SEQ ID NO: 553312 - DNA, 25 bp, Rattus norvegicus
tactcttggtccagaatctctccag

SEQ ID NO: 553313 - DNA, 25 bp, Rattus norvegicus
tactcttggtcctgaatctctccag

SEQ ID NO: 553314 - DNA, 25 bp, Rattus norvegicus
tactcttgtcaacttgacctcaggc

SEQ ID NO: 553315 - DNA, 25 bp, Rattus norvegicus
tactcttgtcaagttgacctcaggc

SEQ ID NO: 553316 - DNA, 25 bp, Rattus norvegicus
tactcttgttccatcgatggcacaa

SEQ ID NO: 553317 - DNA, 25 bp, Rattus norvegicus
tactcttgttccttcgatggcacaa

SEQ ID NO: 553318 - DNA, 25 bp, Rattus norvegicus
tactctttattactggtgcttatga

SEQ ID NO: 553319 - DNA, 25 bp, Rattus norvegicus
tactctttattagtggtgcttatga

SEQ ID NO: 553320 - DNA, 25 bp, Rattus norvegicus
tactctttcctgcaacgtcaaccaa

SEQ ID NO: 553321 - DNA, 25 bp, Rattus norvegicus
tactctttcctggaacgtcaaccaa

SEQ ID NO: 553322 - DNA, 25 bp, Rattus norvegicus
tactctttgctcacctttagtcaag

SEQ ID NO: 553323 - DNA, 25 bp, Rattus norvegicus
tactctttgctctcctttagtcaag

SEQ ID NO: 553324 - DNA, 25 bp, Rattus norvegicus
tactgaaactttaccaggcatctgg

SEQ ID NO: 553325 - DNA, 25 bp, Rattus norvegicus
tactgaaacttttccaggcatctgg

SEQ ID NO: 553326 - DNA, 25 bp, Rattus norvegicus
tactgaaagagcaaagagccgccct

SEQ ID NO: 553327 - DNA, 25 bp, Rattus norvegicus
tactgaaagagctaagagccgccct

SEQ ID NO: 553328 - DNA, 25 bp, Rattus norvegicus
tactgaaagggtctcttcgcttcac

SEQ ID NO: 553329 - DNA, 25 bp, Rattus norvegicus
tactgaaagggtgtcttcgcttcac

SEQ ID NO: 553330 - DNA, 25 bp, Rattus norvegicus
tactgaaatcataccttagttgttt

SEQ ID NO: 553331 - DNA, 25 bp, Rattus norvegicus
tactgaaatcattccttagttgttt

SEQ ID NO: 553332 - DNA, 25 bp, Rattus norvegicus
tactgaaatctacctgttggaggcc

SEQ ID NO: 553333 - DNA, 25 bp, Rattus norvegicus
tactgaaatctagctgttggaggcc

SEQ ID NO: 553334 - DNA, 25 bp, Rattus norvegicus
tactgaaatggactgtggtgacttt

SEQ ID NO: 553335 - DNA, 25 bp, Rattus norvegicus
tactgaaatggagtgtggtgacttt

SEQ ID NO: 553336 - DNA, 25 bp, Rattus norvegicus
tactgaacccgaaatgctctgaaga

SEQ ID NO: 553337 - DNA, 25 bp, Rattus norvegicus
tactgaacccgatatgctctgaaga

SEQ ID NO: 553338 - DNA, 25 bp, Rattus norvegicus
tactgaacgcggagacagatgccct

SEQ ID NO: 553339 - DNA, 25 bp, Rattus norvegicus
tactgaacgcggtgacagatgccct

SEQ ID NO: 553340 - DNA, 25 bp, Rattus norvegicus
tactgaacggtaccactagcacatg

SEQ ID NO: 553341 - DNA, 25 bp, Rattus norvegicus
tactgaacggtagcactagcacatg

SEQ ID NO: 553342 - DNA, 25 bp, Rattus norvegicus
tactgaacgtgcacgatgtcctgaa

SEQ ID NO: 553343 - DNA, 25 bp, Rattus norvegicus
tactgaacgtgctcgatgtcctgaa

SEQ ID NO: 553344 - DNA, 25 bp, Rattus norvegicus
tactgaagagtgagtccttcccttt

SEQ ID NO: 553345 - DNA, 25 bp, Rattus norvegicus
tactgaagagtgtgtccttcccttt

SEQ ID NO: 553346 - DNA, 25 bp, Rattus norvegicus
tactgaagccaacggtacacaagat

SEQ ID NO: 553347 - DNA, 25 bp, Rattus norvegicus
tactgaagccaagggtacacaagat

SEQ ID NO: 553348 - DNA, 25 bp, Rattus norvegicus
tactgaagggagacctagcgggaac

SEQ ID NO: 553349 - DNA, 25 bp, Rattus norvegicus
tactgaagggagtcctagcgggaac

SEQ ID NO: 553350 - DNA, 25 bp, Rattus norvegicus
tactgaagtcagctgccacagcaaa

SEQ ID NO: 553351 - DNA, 25 bp, Rattus norvegicus
tactgaagtcaggtgccacagcaaa

SEQ ID NO: 553352 - DNA, 25 bp, Rattus norvegicus
tactgaagtgacctgagacccctgc

SEQ ID NO: 553353 - DNA, 25 bp, Rattus norvegicus
tactgaagtgacgtgagacccctgc

SEQ ID NO: 553354 - DNA, 25 bp, Rattus norvegicus
tactgaatagttctggcctaggcca

SEQ ID NO: 553355 - DNA, 25 bp, Rattus norvegicus
tactgaatagttgtggcctaggcca

SEQ ID NO: 553356 - DNA, 25 bp, Rattus norvegicus
tactgaattccacactagccagagt

SEQ ID NO: 553357 - DNA, 25 bp, Rattus norvegicus
tactgaattccagactagccagagt

SEQ ID NO: 553358 - DNA, 25 bp, Rattus norvegicus
tactgaattgtaactcaccgggtaa

SEQ ID NO: 553359 - DNA, 25 bp, Rattus norvegicus
tactgaattgtatctcaccgggtaa

SEQ ID NO: 553360 - DNA, 25 bp, Rattus norvegicus
tactgaatttatatgcaactctgaa

SEQ ID NO: 553361 - DNA, 25 bp, Rattus norvegicus
tactgaatttatttgcaactctgaa

SEQ ID NO: 553362 - DNA, 25 bp, Rattus norvegicus
tactgacaatatacctttctgtttg

SEQ ID NO: 553363 - DNA, 25 bp, Rattus norvegicus
tactgacaatattcctttctgtttg

SEQ ID NO: 553364 - DNA, 25 bp, Rattus norvegicus
tactgacagactatccggacaacgc

SEQ ID NO: 553365 - DNA, 25 bp, Rattus norvegicus
tactgacagactttccggacaacgc

SEQ ID NO: 553366 - DNA, 25 bp, Rattus norvegicus
tactgacagccgaagtccatgtaca

SEQ ID NO: 553367 - DNA, 25 bp, Rattus norvegicus
tactgacagccgtagtccatgtaca

SEQ ID NO: 553368 - DNA, 25 bp, Rattus norvegicus
tactgacagcctacattggagatct

SEQ ID NO: 553369 - DNA, 25 bp, Rattus norvegicus
tactgacagccttcattggagatct

SEQ ID NO: 553370 - DNA, 25 bp, Rattus norvegicus
tactgacagctgactcccttttact

SEQ ID NO: 553371 - DNA, 25 bp, Rattus norvegicus
tactgacagctgtctcccttttact

SEQ ID NO: 553372 - DNA, 25 bp, Rattus norvegicus
tactgacagtggaatcttggaaagc

SEQ ID NO: 553373 - DNA, 25 bp, Rattus norvegicus
tactgacagtggtatcttggaaagc

SEQ ID NO: 553374 - DNA, 25 bp, Rattus norvegicus
tactgacatgttagcctgtcggttc

SEQ ID NO: 553375 - DNA, 25 bp, Rattus norvegicus
tactgacatgtttgcctgtcggttc

SEQ ID NO: 553376 - DNA, 25 bp, Rattus norvegicus
tactgaccaaagaaatttcaagggc

SEQ ID NO: 553377 - DNA, 25 bp, Rattus norvegicus
tactgaccaaagtaatttcaagggc

SEQ ID NO: 553378 - DNA, 25 bp, Rattus norvegicus
tactgaccagaaccggcagccattt

SEQ ID NO: 553379 - DNA, 25 bp, Rattus norvegicus
tactgaccagaagcggcagccattt

SEQ ID NO: 553380 - DNA, 25 bp, Rattus norvegicus
tactgaccagggagctgcctagctt

SEQ ID NO: 553381 - DNA, 25 bp, Rattus norvegicus
tactgaccagggtgctgcctagctt

SEQ ID NO: 553382 - DNA, 25 bp, Rattus norvegicus
tactgaccaggtattctcctgagga

SEQ ID NO: 553383 - DNA, 25 bp, Rattus norvegicus
tactgaccaggttttctcctgagga

SEQ ID NO: 553384 - DNA, 25 bp, Rattus norvegicus
tactgaccagtgagttactgcaact

SEQ ID NO: 553385 - DNA, 25 bp, Rattus norvegicus
tactgaccagtgtgttactgcaact

SEQ ID NO: 553386 - DNA, 25 bp, Rattus norvegicus
tactgacccagactcttggagcctc

SEQ ID NO: 553387 - DNA, 25 bp, Rattus norvegicus
tactgacccagagtcttggagcctc

SEQ ID NO: 553388 - DNA, 25 bp, Rattus norvegicus
tactgaccccacagaaagtgcaacc

SEQ ID NO: 553389 - DNA, 25 bp, Rattus norvegicus
tactgaccccactgaaagtgcaacc

SEQ ID NO: 553390 - DNA, 25 bp, Rattus norvegicus
tactgacccgggagccaaggttaga

SEQ ID NO: 553391 - DNA, 25 bp, Rattus norvegicus
tactgacccgggtgccaaggttaga

SEQ ID NO: 553392 - DNA, 25 bp, Rattus norvegicus
tactgacctccacttgtgggtcttt

SEQ ID NO: 553393 - DNA, 25 bp, Rattus norvegicus
tactgacctccagttgtgggtcttt

SEQ ID NO: 553394 - DNA, 25 bp, Rattus norvegicus
tactgacctggaactttcagaggat

SEQ ID NO: 553395 - DNA, 25 bp, Rattus norvegicus
tactgacctggatctttcagaggat

SEQ ID NO: 553396 - DNA, 25 bp, Rattus norvegicus
tactgacctgtaactcaccagcatt

SEQ ID NO: 553397 - DNA, 25 bp, Rattus norvegicus
tactgacctgtatctcaccagcatt

SEQ ID NO: 553398 - DNA, 25 bp, Rattus norvegicus
tactgaccttccatgatgctgtggg

SEQ ID NO: 553399 - DNA, 25 bp, Rattus norvegicus
tactgaccttccttgatgctgtggg

SEQ ID NO: 553400 - DNA, 25 bp, Rattus norvegicus
tactgacggaaaaacttacgccaat

SEQ ID NO: 553401 - DNA, 25 bp, Rattus norvegicus
tactgacggaaatacttacgccaat

SEQ ID NO: 553402 - DNA, 25 bp, Rattus norvegicus
tactgactacttaccttgacttcac

SEQ ID NO: 553403 - DNA, 25 bp, Rattus norvegicus
tactgactactttccttgacttcac

SEQ ID NO: 553404 - DNA, 25 bp, Rattus norvegicus
tactgactattaatctttggcattt

SEQ ID NO: 553405 - DNA, 25 bp, Rattus norvegicus
tactgactattattctttggcattt

SEQ ID NO: 553406 - DNA, 25 bp, Rattus norvegicus
tactgactccaaaaccaggttagta

SEQ ID NO: 553407 - DNA, 25 bp, Rattus norvegicus
tactgactccaataccaggttagta

SEQ ID NO: 553408 - DNA, 25 bp, Rattus norvegicus
tactgactctaacgatggatcccta

SEQ ID NO: 553409 - DNA, 25 bp, Rattus norvegicus
tactgactctaaggatggatcccta

SEQ ID NO: 553410 - DNA, 25 bp, Rattus norvegicus
tactgactgatgaactgcgctgacc

SEQ ID NO: 553411 - DNA, 25 bp, Rattus norvegicus
tactgactgatgagggtgctgccac

SEQ ID NO: 553412 - DNA, 25 bp, Rattus norvegicus
tactgactgatgtactgcgctgacc

SEQ ID NO: 553413 - DNA, 25 bp, Rattus norvegicus
tactgactgatgtgggtgctgccac

SEQ ID NO: 553414 - DNA, 25 bp, Rattus norvegicus
tactgactggctcttttgtggactt

SEQ ID NO: 553415 - DNA, 25 bp, Rattus norvegicus
tactgactggctgttttgtggactt

SEQ ID NO: 553416 - DNA, 25 bp, Rattus norvegicus
tactgactgtcaatcctactttgtg

SEQ ID NO: 553417 - DNA, 25 bp, Rattus norvegicus
tactgactgtcattcctactttgtg

SEQ ID NO: 553418 - DNA, 25 bp, Rattus norvegicus
tactgactgtggagaatatttctga

SEQ ID NO: 553419 - DNA, 25 bp, Rattus norvegicus
tactgactgtggtgaatatttctga

SEQ ID NO: 553420 - DNA, 25 bp, Rattus norvegicus
tactgacttagcaatgtggccttgg

SEQ ID NO: 553421 - DNA, 25 bp, Rattus norvegicus
tactgacttagctatgtggccttgg

SEQ ID NO: 553422 - DNA, 25 bp, Rattus norvegicus
tactgacttgtaccaaacctttgta

SEQ ID NO: 553423 - DNA, 25 bp, Rattus norvegicus
tactgacttgtagcaaacctttgta

SEQ ID NO: 553424 - DNA, 25 bp, Rattus norvegicus
tactgactttagatctcccagcaga

SEQ ID NO: 553425 - DNA, 25 bp, Rattus norvegicus
tactgactttagttctcccagcaga

SEQ ID NO: 553426 - DNA, 25 bp, Rattus norvegicus
tactgactttcgacctggtcaggaa

SEQ ID NO: 553427 - DNA, 25 bp, Rattus norvegicus
tactgactttcgtcctggtcaggaa

SEQ ID NO: 553428 - DNA, 25 bp, Rattus norvegicus
tactgagaataaagacctctgctct

SEQ ID NO: 553429 - DNA, 25 bp, Rattus norvegicus
tactgagaataatgacctctgctct

SEQ ID NO: 553430 - DNA, 25 bp, Rattus norvegicus
tactgagacccacagtgtctcttgg

SEQ ID NO: 553431 - DNA, 25 bp, Rattus norvegicus
tactgagacccagagtgtctcttgg

SEQ ID NO: 553432 - DNA, 25 bp, Rattus norvegicus
tactgagacttcacctaagcgagtt

SEQ ID NO: 553433 - DNA, 25 bp, Rattus norvegicus
tactgagacttctcctaagcgagtt

SEQ ID NO: 553434 - DNA, 25 bp, Rattus norvegicus
tactgagacttgcaacctgtggctt

SEQ ID NO: 553435 - DNA, 25 bp, Rattus norvegicus
tactgagacttggaacctgtggctt

SEQ ID NO: 553436 - DNA, 25 bp, Rattus norvegicus
tactgagatcctaagtcaagacttt

SEQ ID NO: 553437 - DNA, 25 bp, Rattus norvegicus
tactgagatccttagtcaagacttt

SEQ ID NO: 553438 - DNA, 25 bp, Rattus norvegicus
tactgagcagcacccatttaagaca

SEQ ID NO: 553439 - DNA, 25 bp, Rattus norvegicus
tactgagcagcagccatttaagaca

SEQ ID NO: 553440 - DNA, 25 bp, Rattus norvegicus
tactgagccactatctcaaaagtta

SEQ ID NO: 553441 - DNA, 25 bp, Rattus norvegicus
tactgagccactttctcaaaagtta

SEQ ID NO: 553442 - DNA, 25 bp, Rattus norvegicus
tactgagccctcaagttggaccata

SEQ ID NO: 553443 - DNA, 25 bp, Rattus norvegicus
tactgagccctctagttggaccata

SEQ ID NO: 553444 - DNA, 25 bp, Rattus norvegicus
tactgagcgggcacctggcaatgac

SEQ ID NO: 553445 - DNA, 25 bp, Rattus norvegicus
tactgagcgggctcctggcaatgac

SEQ ID NO: 553446 - DNA, 25 bp, Rattus norvegicus
tactgagctatgactgtccttggtc

SEQ ID NO: 553447 - DNA, 25 bp, Rattus norvegicus
tactgagctatgtctgtccttggtc

SEQ ID NO: 553448 - DNA, 25 bp, Rattus norvegicus
tactgagctctgagtctacgtttca

SEQ ID NO: 553449 - DNA, 25 bp, Rattus norvegicus
tactgagctctgtgtctacgtttca

SEQ ID NO: 553450 - DNA, 25 bp, Rattus norvegicus
tactgagctgcgatttacacccttt

SEQ ID NO: 553451 - DNA, 25 bp, Rattus norvegicus
tactgagctgcgttttacacccttt

SEQ ID NO: 553452 - DNA, 25 bp, Rattus norvegicus
tactgaggactgagctatctttact

SEQ ID NO: 553453 - DNA, 25 bp, Rattus norvegicus
tactgaggactgtgctatctttact

SEQ ID NO: 553454 - DNA, 25 bp, Rattus norvegicus
tactgaggatcgagctacccaaagt

SEQ ID NO: 553455 - DNA, 25 bp, Rattus norvegicus
tactgaggatcgtgctacccaaagt

SEQ ID NO: 553456 - DNA, 25 bp, Rattus norvegicus
tactgagggagaacttctcaccttc

SEQ ID NO: 553457 - DNA, 25 bp, Rattus norvegicus
tactgagggagatcttctcaccttc

SEQ ID NO: 553458 - DNA, 25 bp, Rattus norvegicus
tactgagggctaactcctgcctggg

SEQ ID NO: 553459 - DNA, 25 bp, Rattus norvegicus
tactgagggctatctcctgcctggg

SEQ ID NO: 553460 - DNA, 25 bp, Rattus norvegicus
tactgaggttggacagcgccaggtt

SEQ ID NO: 553461 - DNA, 25 bp, Rattus norvegicus
tactgaggttggtcagcgccaggtt

SEQ ID NO: 553462 - DNA, 25 bp, Rattus norvegicus
tactgagtacatccccttccactgg

SEQ ID NO: 553463 - DNA, 25 bp, Rattus norvegicus
tactgagtacatgcccttccactgg

SEQ ID NO: 553464 - DNA, 25 bp, Rattus norvegicus
tactgagtattcatcgtgaccgtaa

SEQ ID NO: 553465 - DNA, 25 bp, Rattus norvegicus
tactgagtattcttcgtgaccgtaa

SEQ ID NO: 553466 - DNA, 25 bp, Rattus norvegicus
tactgagtcctgatgaactggattt

SEQ ID NO: 553467 - DNA, 25 bp, Rattus norvegicus
tactgagtcctgttgaactggattt

SEQ ID NO: 553468 - DNA, 25 bp, Rattus norvegicus
tactgagtctgtaagcctttttaag

SEQ ID NO: 553469 - DNA, 25 bp, Rattus norvegicus
tactgagtctgttagcctttttaag

SEQ ID NO: 553470 - DNA, 25 bp, Rattus norvegicus
tactgagtgactacgccttgcaaag

SEQ ID NO: 553471 - DNA, 25 bp, Rattus norvegicus
tactgagtgacttcgccttgcaaag

SEQ ID NO: 553472 - DNA, 25 bp, Rattus norvegicus
tactgagtgagtacccacaggccca

SEQ ID NO: 553473 - DNA, 25 bp, Rattus norvegicus
tactgagtgagttcccacaggccca

SEQ ID NO: 553474 - DNA, 25 bp, Rattus norvegicus
tactgagtgctgactatacaccagg

SEQ ID NO: 553475 - DNA, 25 bp, Rattus norvegicus
tactgagtgctgtctatacaccagg

SEQ ID NO: 553476 - DNA, 25 bp, Rattus norvegicus
tactgagtggttcttgtggcacaag

SEQ ID NO: 553477 - DNA, 25 bp, Rattus norvegicus
tactgagtggttgttgtggcacaag

SEQ ID NO: 553478 - DNA, 25 bp, Rattus norvegicus
tactgagttggcaacttttggtccc

SEQ ID NO: 553479 - DNA, 25 bp, Rattus norvegicus
tactgagttggctacttttggtccc

SEQ ID NO: 553480 - DNA, 25 bp, Rattus norvegicus
tactgagttttcaaatgtgccatta

SEQ ID NO: 553481 - DNA, 25 bp, Rattus norvegicus
tactgagttttctaatgtgccatta

SEQ ID NO: 553482 - DNA, 25 bp, Rattus norvegicus
tactgagtttttaagagcctgctaa

SEQ ID NO: 553483 - DNA, 25 bp, Rattus norvegicus
tactgagttttttagagcctgctaa

SEQ ID NO: 553484 - DNA, 25 bp, Rattus norvegicus
tactgatccagaaggagccccgatg

SEQ ID NO: 553485 - DNA, 25 bp, Rattus norvegicus
tactgatccagatggagccccgatg

SEQ ID NO: 553486 - DNA, 25 bp, Rattus norvegicus
tactgatcctgacttccctggtgtc

SEQ ID NO: 553487 - DNA, 25 bp, Rattus norvegicus
tactgatcctgagttccctggtgtc

SEQ ID NO: 553488 - DNA, 25 bp, Rattus norvegicus
tactgatcctgtaggttcacccatt

SEQ ID NO: 553489 - DNA, 25 bp, Rattus norvegicus
tactgatcctgttggttcacccatt

SEQ ID NO: 553490 - DNA, 25 bp, Rattus norvegicus
tactgatccttcaatcatactgtcc

SEQ ID NO: 553491 - DNA, 25 bp, Rattus norvegicus
tactgatccttctatcatactgtcc

SEQ ID NO: 553492 - DNA, 25 bp, Rattus norvegicus
tactgatctctgctaccaaggtgga

SEQ ID NO: 553493 - DNA, 25 bp, Rattus norvegicus
tactgatctctggtaccaaggtgga

SEQ ID NO: 553494 - DNA, 25 bp, Rattus norvegicus
tactgatgagtaattttggtgacaa

SEQ ID NO: 553495 - DNA, 25 bp, Rattus norvegicus
tactgatgagtatttttggtgacaa

SEQ ID NO: 553496 - DNA, 25 bp, Rattus norvegicus
tactgatgggaaaggccggcctgtc

SEQ ID NO: 553497 - DNA, 25 bp, Rattus norvegicus
tactgatgggaatggccggcctgtc

SEQ ID NO: 553498 - DNA, 25 bp, Rattus norvegicus
tactgatgtcagcagatcgctcctg

SEQ ID NO: 553499 - DNA, 25 bp, Rattus norvegicus
tactgatgtcaggagatcgctcctg

SEQ ID NO: 553500 - DNA, 25 bp, Rattus norvegicus
tactgatgttgtaatttctctcccc

SEQ ID NO: 553501 - DNA, 25 bp, Rattus norvegicus
tactgatgttgttatttctctcccc

SEQ ID NO: 553502 - DNA, 25 bp, Rattus norvegicus
tactgattacagagggctctctccg

SEQ ID NO: 553503 - DNA, 25 bp, Rattus norvegicus
tactgattacagtgggctctctccg

SEQ ID NO: 553504 - DNA, 25 bp, Rattus norvegicus
tactgattatttatctcgcctctta

SEQ ID NO: 553505 - DNA, 25 bp, Rattus norvegicus
tactgattatttttctcgcctctta

SEQ ID NO: 553506 - DNA, 25 bp, Rattus norvegicus
tactgattccgtccacagctgattg

SEQ ID NO: 553507 - DNA, 25 bp, Rattus norvegicus
tactgattccgtgcacagctgattg

SEQ ID NO: 553508 - DNA, 25 bp, Rattus norvegicus
tactgattggttagctgggtcccag

SEQ ID NO: 553509 - DNA, 25 bp, Rattus norvegicus
tactgattggtttgctgggtcccag

SEQ ID NO: 553510 - DNA, 25 bp, Rattus norvegicus
tactgatttcttactacacctacca

SEQ ID NO: 553511 - DNA, 25 bp, Rattus norvegicus
tactgatttctttctacacctacca

SEQ ID NO: 553512 - DNA, 25 bp, Rattus norvegicus
tactgatttttaaaaacatcccaag

SEQ ID NO: 553513 - DNA, 25 bp, Rattus norvegicus
tactgatttttataaacatcccaag

SEQ ID NO: 553514 - DNA, 25 bp, Rattus norvegicus
tactgatttttcactgttattatga

SEQ ID NO: 553515 - DNA, 25 bp, Rattus norvegicus
tactgatttttctctgttattatga

SEQ ID NO: 553516 - DNA, 25 bp, Rattus norvegicus
tactgatttttgcagatgatcctcc

SEQ ID NO: 553517 - DNA, 25 bp, Rattus norvegicus
tactgatttttggagatgatcctcc

SEQ ID NO: 553518 - DNA, 25 bp, Rattus norvegicus
tactgcaaaatgaagaccctagggc

SEQ ID NO: 553519 - DNA, 25 bp, Rattus norvegicus
tactgcaaaatgcttactgcctcct

SEQ ID NO: 553520 - DNA, 25 bp, Rattus norvegicus
tactgcaaaatggttactgcctcct

SEQ ID NO: 553521 - DNA, 25 bp, Rattus norvegicus
tactgcaaaatgtagaccctagggc

SEQ ID NO: 553522 - DNA, 25 bp, Rattus norvegicus
tactgcaaagctagttagtggtggc

SEQ ID NO: 553523 - DNA, 25 bp, Rattus norvegicus
tactgcaaagcttgttagtggtggc

SEQ ID NO: 553524 - DNA, 25 bp, Rattus norvegicus
tactgcaaagtcatgtgttttcaac

SEQ ID NO: 553525 - DNA, 25 bp, Rattus norvegicus
tactgcaaagtcttgtgttttcaac

SEQ ID NO: 553526 - DNA, 25 bp, Rattus norvegicus
tactgcaactagacctagccggagc

SEQ ID NO: 553527 - DNA, 25 bp, Rattus norvegicus
tactgcaactagtcctagccggagc

SEQ ID NO: 553528 - DNA, 25 bp, Rattus norvegicus
tactgcaagcagaccacttagtgtt

SEQ ID NO: 553529 - DNA, 25 bp, Rattus norvegicus
tactgcaagcagtccacttagtgtt

SEQ ID NO: 553530 - DNA, 25 bp, Rattus norvegicus
tactgcaagcgcagacttccaaaag

SEQ ID NO: 553531 - DNA, 25 bp, Rattus norvegicus
tactgcaagcgctgacttccaaaag

SEQ ID NO: 553532 - DNA, 25 bp, Rattus norvegicus
tactgcaaggacctgctggacattg

SEQ ID NO: 553533 - DNA, 25 bp, Rattus norvegicus
tactgcaaggacgtgctggacattg

SEQ ID NO: 553534 - DNA, 25 bp, Rattus norvegicus
tactgcaaggtgcttctggccactt

SEQ ID NO: 553535 - DNA, 25 bp, Rattus norvegicus
tactgcaaggtggttctggccactt

SEQ ID NO: 553536 - DNA, 25 bp, Rattus norvegicus
tactgcacacacagtctaaattccg

SEQ ID NO: 553537 - DNA, 25 bp, Rattus norvegicus
tactgcacacactgtctaaattccg

SEQ ID NO: 553538 - DNA, 25 bp, Rattus norvegicus
tactgcacagccatccataatcaat

SEQ ID NO: 553539 - DNA, 25 bp, Rattus norvegicus
tactgcacagccttccataatcaat

SEQ ID NO: 553540 - DNA, 25 bp, Rattus norvegicus
tactgcacaggtattgggaaagcca

SEQ ID NO: 553541 - DNA, 25 bp, Rattus norvegicus
tactgcacaggttttgggaaagcca

SEQ ID NO: 553542 - DNA, 25 bp, Rattus norvegicus
tactgcaccgtccaggcacaaagct

SEQ ID NO: 553543 - DNA, 25 bp, Rattus norvegicus
tactgcaccgtcgaggcacaaagct

SEQ ID NO: 553544 - DNA, 25 bp, Rattus norvegicus
tactgcacctgcacagctgggaaag

SEQ ID NO: 553545 - DNA, 25 bp, Rattus norvegicus
tactgcacctgctcagctgggaaag

SEQ ID NO: 553546 - DNA, 25 bp, Rattus norvegicus
tactgcactgtcctttctctgaaat

SEQ ID NO: 553547 - DNA, 25 bp, Rattus norvegicus
tactgcactgtcgtttctctgaaat

SEQ ID NO: 553548 - DNA, 25 bp, Rattus norvegicus
tactgcagcagaacttacaaaagac

SEQ ID NO: 553549 - DNA, 25 bp, Rattus norvegicus
tactgcagcagatcttacaaaagac

SEQ ID NO: 553550 - DNA, 25 bp, Rattus norvegicus
tactgcagggtgcagaatatggtca

SEQ ID NO: 553551 - DNA, 25 bp, Rattus norvegicus
tactgcagggtggagaatatggtca

SEQ ID NO: 553552 - DNA, 25 bp, Rattus norvegicus
tactgcaggtctctttccacagcaa

SEQ ID NO: 553553 - DNA, 25 bp, Rattus norvegicus
tactgcaggtctgtttccacagcaa

SEQ ID NO: 553554 - DNA, 25 bp, Rattus norvegicus
tactgcagtaccaacaggaggagca

SEQ ID NO: 553555 - DNA, 25 bp, Rattus norvegicus
tactgcagtacctacaggaggagca

SEQ ID NO: 553556 - DNA, 25 bp, Rattus norvegicus
tactgcagtgcaacgggaggaaatc

SEQ ID NO: 553557 - DNA, 25 bp, Rattus norvegicus
tactgcagtgcatcgggaggaaatc

SEQ ID NO: 553558 - DNA, 25 bp, Rattus norvegicus
tactgcatctgaccctgtctcagag

SEQ ID NO: 553559 - DNA, 25 bp, Rattus norvegicus
tactgcatctgagcctgtctcagag

SEQ ID NO: 553560 - DNA, 25 bp, Rattus norvegicus
tactgcatgcagaggggtctctcct

SEQ ID NO: 553561 - DNA, 25 bp, Rattus norvegicus
tactgcatgcagtggggtctctcct

SEQ ID NO: 553562 - DNA, 25 bp, Rattus norvegicus
tactgcatggtactttaccgcactt

SEQ ID NO: 553563 - DNA, 25 bp, Rattus norvegicus
tactgcatggtagtttaccgcactt

SEQ ID NO: 553564 - DNA, 25 bp, Rattus norvegicus
tactgcattgatccccgttactatg

SEQ ID NO: 553565 - DNA, 25 bp, Rattus norvegicus
tactgcattgatgcccgttactatg

SEQ ID NO: 553566 - DNA, 25 bp, Rattus norvegicus
tactgcattttcatttgaccctgga

SEQ ID NO: 553567 - DNA, 25 bp, Rattus norvegicus
tactgcattttcttttgaccctgga

SEQ ID NO: 553568 - DNA, 25 bp, Rattus norvegicus
tactgccaaggcacactcattgaaa

SEQ ID NO: 553569 - DNA, 25 bp, Rattus norvegicus
tactgccaaggctcactcattgaaa

SEQ ID NO: 553570 - DNA, 25 bp, Rattus norvegicus
tactgccacataacctgtctggatt

SEQ ID NO: 553571 - DNA, 25 bp, Rattus norvegicus
tactgccacatatcctgtctggatt

SEQ ID NO: 553572 - DNA, 25 bp, Rattus norvegicus
tactgccacatgctgggctctgctg

SEQ ID NO: 553573 - DNA, 25 bp, Rattus norvegicus
tactgccacatggtgggctctgctg

SEQ ID NO: 553574 - DNA, 25 bp, Rattus norvegicus
tactgccaccacaggacgagaattg

SEQ ID NO: 553575 - DNA, 25 bp, Rattus norvegicus
tactgccaccactggacgagaattg

SEQ ID NO: 553576 - DNA, 25 bp, Rattus norvegicus
tactgccaggaacgacttatgtctc

SEQ ID NO: 553577 - DNA, 25 bp, Rattus norvegicus
tactgccaggaaggacttatgtctc

SEQ ID NO: 553578 - DNA, 25 bp, Rattus norvegicus
tactgccaggtcatttctgatacag

SEQ ID NO: 553579 - DNA, 25 bp, Rattus norvegicus
tactgccaggtcttttctgatacag

SEQ ID NO: 553580 - DNA, 25 bp, Rattus norvegicus
tactgccatcatatttatgggtcac

SEQ ID NO: 553581 - DNA, 25 bp, Rattus norvegicus
tactgccatcatttttatgggtcac

SEQ ID NO: 553582 - DNA, 25 bp, Rattus norvegicus
tactgccattgcaaatagggtacaa

SEQ ID NO: 553583 - DNA, 25 bp, Rattus norvegicus
tactgccattgctaatagggtacaa

SEQ ID NO: 553584 - DNA, 25 bp, Rattus norvegicus
tactgcccaggcatggatgtggccc

SEQ ID NO: 553585 - DNA, 25 bp, Rattus norvegicus
tactgcccaggcttggatgtggccc

SEQ ID NO: 553586 - DNA, 25 bp, Rattus norvegicus
tactgccccaacatagccttgagga

SEQ ID NO: 553587 - DNA, 25 bp, Rattus norvegicus
tactgccccaacttagccttgagga

SEQ ID NO: 553588 - DNA, 25 bp, Rattus norvegicus
tactgccccataatataccaggtcg

SEQ ID NO: 553589 - DNA, 25 bp, Rattus norvegicus
tactgccccatattataccaggtcg

SEQ ID NO: 553590 - DNA, 25 bp, Rattus norvegicus
tactgcccggtgaattggccaagca

SEQ ID NO: 553591 - DNA, 25 bp, Rattus norvegicus
tactgcccggtgtattggccaagca

SEQ ID NO: 553592 - DNA, 25 bp, Rattus norvegicus
tactgccctatcataaatcctatat

SEQ ID NO: 553593 - DNA, 25 bp, Rattus norvegicus
tactgccctatcttaaatcctatat

SEQ ID NO: 553594 - DNA, 25 bp, Rattus norvegicus
tactgccctcatctcttgttttaaa

SEQ ID NO: 553595 - DNA, 25 bp, Rattus norvegicus
tactgccctcatgtcttgttttaaa

SEQ ID NO: 553596 - DNA, 25 bp, Rattus norvegicus
tactgcccttggctctggtcaggat

SEQ ID NO: 553597 - DNA, 25 bp, Rattus norvegicus
tactgcccttgggtctggtcaggat

SEQ ID NO: 553598 - DNA, 25 bp, Rattus norvegicus
tactgccgaagtatctggctcgtct

SEQ ID NO: 553599 - DNA, 25 bp, Rattus norvegicus
tactgccgaagtttctggctcgtct

SEQ ID NO: 553600 - DNA, 25 bp, Rattus norvegicus
tactgccgctttatcatgtgcagcc

SEQ ID NO: 553601 - DNA, 25 bp, Rattus norvegicus
tactgccgctttttcatgtgcagcc

SEQ ID NO: 553602 - DNA, 25 bp, Rattus norvegicus
tactgccggtgacgctgaaacgctg

SEQ ID NO: 553603 - DNA, 25 bp, Rattus norvegicus
tactgccggtgaggctgaaacgctg

SEQ ID NO: 553604 - DNA, 25 bp, Rattus norvegicus
tactgcctattgaaatgctaagtgt

SEQ ID NO: 553605 - DNA, 25 bp, Rattus norvegicus
tactgcctattgtaatgctaagtgt

SEQ ID NO: 553606 - DNA, 25 bp, Rattus norvegicus
tactgcctccaaattaagatgctat

SEQ ID NO: 553607 - DNA, 25 bp, Rattus norvegicus
tactgcctccaatttaagatgctat

SEQ ID NO: 553608 - DNA, 25 bp, Rattus norvegicus
tactgcctcctacgtgttcttggct

SEQ ID NO: 553609 - DNA, 25 bp, Rattus norvegicus
tactgcctcctaggtgttcttggct

SEQ ID NO: 553610 - DNA, 25 bp, Rattus norvegicus
tactgcctctgtaactttgtcaaaa

SEQ ID NO: 553611 - DNA, 25 bp, Rattus norvegicus
tactgcctctgttactttgtcaaaa

SEQ ID NO: 553612 - DNA, 25 bp, Rattus norvegicus
tactgcctgtctccatcaaggagtg

SEQ ID NO: 553613 - DNA, 25 bp, Rattus norvegicus
tactgcctgtctgcatcaaggagtg

SEQ ID NO: 553614 - DNA, 25 bp, Rattus norvegicus
tactgcctgtggattaggttcccct

SEQ ID NO: 553615 - DNA, 25 bp, Rattus norvegicus
tactgcctgtggtttaggttcccct

SEQ ID NO: 553616 - DNA, 25 bp, Rattus norvegicus
tactgccttcttctcttctgtacat

SEQ ID NO: 553617 - DNA, 25 bp, Rattus norvegicus
tactgccttcttgtcttctgtacat

SEQ ID NO: 553618 - DNA, 25 bp, Rattus norvegicus
tactgccttgcaaacttggagagtt

SEQ ID NO: 553619 - DNA, 25 bp, Rattus norvegicus
tactgccttgcatacttggagagtt

SEQ ID NO: 553620 - DNA, 25 bp, Rattus norvegicus
tactgcggacttagaatgttttctc

SEQ ID NO: 553621 - DNA, 25 bp, Rattus norvegicus
tactgcggactttgaatgttttctc

SEQ ID NO: 553622 - DNA, 25 bp, Rattus norvegicus
tactgcgggccaccagaatggacta

SEQ ID NO: 553623 - DNA, 25 bp, Rattus norvegicus
tactgcgggccagcagaatggacta

SEQ ID NO: 553624 - DNA, 25 bp, Rattus norvegicus
tactgcgtatggctcccacctgaag

SEQ ID NO: 553625 - DNA, 25 bp, Rattus norvegicus
tactgcgtatgggtcccacctgaag

SEQ ID NO: 553626 - DNA, 25 bp, Rattus norvegicus
tactgctatgccctgtttcagatac

SEQ ID NO: 553627 - DNA, 25 bp, Rattus norvegicus
tactgctatgccgtgtttcagatac

SEQ ID NO: 553628 - DNA, 25 bp, Rattus norvegicus
tactgctcacaaacattctgcttac

SEQ ID NO: 553629 - DNA, 25 bp, Rattus norvegicus
tactgctcacaatcattctgcttac

SEQ ID NO: 553630 - DNA, 25 bp, Rattus norvegicus
tactgctcatgtcttgtttctcttt

SEQ ID NO: 553631 - DNA, 25 bp, Rattus norvegicus
tactgctcatgtgttgtttctcttt

SEQ ID NO: 553632 - DNA, 25 bp, Rattus norvegicus
tactgctcattcagcactggaaaca

SEQ ID NO: 553633 - DNA, 25 bp, Rattus norvegicus
tactgctcattctgcactggaaaca

SEQ ID NO: 553634 - DNA, 25 bp, Rattus norvegicus
tactgctccaccagagtagctgtaa

SEQ ID NO: 553635 - DNA, 25 bp, Rattus norvegicus
tactgctccacctgagtagctgtaa

SEQ ID NO: 553636 - DNA, 25 bp, Rattus norvegicus
tactgctccaggacatcactaagga

SEQ ID NO: 553637 - DNA, 25 bp, Rattus norvegicus
tactgctccaggtcatcactaagga

SEQ ID NO: 553638 - DNA, 25 bp, Rattus norvegicus
tactgctcgtacctttgcttgtgct

SEQ ID NO: 553639 - DNA, 25 bp, Rattus norvegicus
tactgctcgtacgtttgcttgtgct

SEQ ID NO: 553640 - DNA, 25 bp, Rattus norvegicus
tactgctcgtgtctgattggttatt

SEQ ID NO: 553641 - DNA, 25 bp, Rattus norvegicus
tactgctcgtgtgtgattggttatt

SEQ ID NO: 553642 - DNA, 25 bp, Rattus norvegicus
tactgctgaagacacggacactcct

SEQ ID NO: 553643 - DNA, 25 bp, Rattus norvegicus
tactgctgaagagacggacactcct

SEQ ID NO: 553644 - DNA, 25 bp, Rattus norvegicus
tactgctgaccacagcatgggctct

SEQ ID NO: 553645 - DNA, 25 bp, Rattus norvegicus
tactgctgaccagagcatgggctct

SEQ ID NO: 553646 - DNA, 25 bp, Rattus norvegicus
tactgctgacccagacgttgataaa

SEQ ID NO: 553647 - DNA, 25 bp, Rattus norvegicus
tactgctgaccctgacgttgataaa

SEQ ID NO: 553648 - DNA, 25 bp, Rattus norvegicus
tactgctgacctactggacgagttt

SEQ ID NO: 553649 - DNA, 25 bp, Rattus norvegicus
tactgctgaccttctggacgagttt

SEQ ID NO: 553650 - DNA, 25 bp, Rattus norvegicus
tactgctgacgtatctttttggtaa

SEQ ID NO: 553651 - DNA, 25 bp, Rattus norvegicus
tactgctgacgtttctttttggtaa

SEQ ID NO: 553652 - DNA, 25 bp, Rattus norvegicus
tactgctgaggccaggcaccaagct

SEQ ID NO: 553653 - DNA, 25 bp, Rattus norvegicus
tactgctgaggcgaggcaccaagct

SEQ ID NO: 553654 - DNA, 25 bp, Rattus norvegicus
tactgctgcctccattaacgctgta

SEQ ID NO: 553655 - DNA, 25 bp, Rattus norvegicus
tactgctgcctcgattaacgctgta

SEQ ID NO: 553656 - DNA, 25 bp, Rattus norvegicus
tactgctgctgcagtttatgctgtt

SEQ ID NO: 553657 - DNA, 25 bp, Rattus norvegicus
tactgctgctgctgtttatgctgtt

SEQ ID NO: 553658 - DNA, 25 bp, Rattus norvegicus
tactgctgctggcacatctacaaat

SEQ ID NO: 553659 - DNA, 25 bp, Rattus norvegicus
tactgctgctgggacatctacaaat

SEQ ID NO: 553660 - DNA, 25 bp, Rattus norvegicus
tactgctgctgtattgtcttcttga

SEQ ID NO: 553661 - DNA, 25 bp, Rattus norvegicus
tactgctgctgttttgtcttcttga

SEQ ID NO: 553662 - DNA, 25 bp, Rattus norvegicus
tactgctgcttgaactctgccatta

SEQ ID NO: 553663 - DNA, 25 bp, Rattus norvegicus
tactgctgcttgtactctgccatta

SEQ ID NO: 553664 - DNA, 25 bp, Rattus norvegicus
tactgctggatcaaaggcttacacc

SEQ ID NO: 553665 - DNA, 25 bp, Rattus norvegicus
tactgctggatctaaggcttacacc

SEQ ID NO: 553666 - DNA, 25 bp, Rattus norvegicus
tactgctggcatcagctgcacagga

SEQ ID NO: 553667 - DNA, 25 bp, Rattus norvegicus
tactgctggcatgagctgcacagga

SEQ ID NO: 553668 - DNA, 25 bp, Rattus norvegicus
tactgctggcttctgtcattttgat

SEQ ID NO: 553669 - DNA, 25 bp, Rattus norvegicus
tactgctggcttgtgtcattttgat

SEQ ID NO: 553670 - DNA, 25 bp, Rattus norvegicus
tactgctgggaaccatgtgcttctc

SEQ ID NO: 553671 - DNA, 25 bp, Rattus norvegicus
tactgctgggaagcatgtgcttctc

SEQ ID NO: 553672 - DNA, 25 bp, Rattus norvegicus
tactgctgtagcacggaaggcggcc

SEQ ID NO: 553673 - DNA, 25 bp, Rattus norvegicus
tactgctgtagctcggaaggcggcc

SEQ ID NO: 553674 - DNA, 25 bp, Rattus norvegicus
tactgctgtccaccagaccctaaag

SEQ ID NO: 553675 - DNA, 25 bp, Rattus norvegicus
tactgctgtccagcagaccctaaag

SEQ ID NO: 553676 - DNA, 25 bp, Rattus norvegicus
tactgctgttacactttgactagga

SEQ ID NO: 553677 - DNA, 25 bp, Rattus norvegicus
tactgctgttactctttgactagga

SEQ ID NO: 553678 - DNA, 25 bp, Rattus norvegicus
tactgcttaaggcagattctttcga

SEQ ID NO: 553679 - DNA, 25 bp, Rattus norvegicus
tactgcttaagggagattctttcga

SEQ ID NO: 553680 - DNA, 25 bp, Rattus norvegicus
tactgcttacttacacatgctgttt

SEQ ID NO: 553681 - DNA, 25 bp, Rattus norvegicus
tactgcttactttcacatgctgttt

SEQ ID NO: 553682 - DNA, 25 bp, Rattus norvegicus
tactgcttcaacatcaaccattttc

SEQ ID NO: 553683 - DNA, 25 bp, Rattus norvegicus
tactgcttcaacttcaaccattttc

SEQ ID NO: 553684 - DNA, 25 bp, Rattus norvegicus
tactgcttcagcacagtcactggca

SEQ ID NO: 553685 - DNA, 25 bp, Rattus norvegicus
tactgcttcagctcagtcactggca

SEQ ID NO: 553686 - DNA, 25 bp, Rattus norvegicus
tactgcttcatcatcattcacatca

SEQ ID NO: 553687 - DNA, 25 bp, Rattus norvegicus
tactgcttcatcttcattcacatca

SEQ ID NO: 553688 - DNA, 25 bp, Rattus norvegicus
tactgcttcctcaatcaagaggtga

SEQ ID NO: 553689 - DNA, 25 bp, Rattus norvegicus
tactgcttcctctatcaagaggtga

SEQ ID NO: 553690 - DNA, 25 bp, Rattus norvegicus
tactgcttctaaattactgtgtggg

SEQ ID NO: 553691 - DNA, 25 bp, Rattus norvegicus
tactgcttctaatttactgtgtggg

SEQ ID NO: 553692 - DNA, 25 bp, Rattus norvegicus
tactgcttctcaacgactcgggaga

SEQ ID NO: 553693 - DNA, 25 bp, Rattus norvegicus
tactgcttctcatcgactcgggaga

SEQ ID NO: 553694 - DNA, 25 bp, Rattus norvegicus
tactgcttcttcaccaaagacacat

SEQ ID NO: 553695 - DNA, 25 bp, Rattus norvegicus
tactgcttcttctccaaagacacat

SEQ ID NO: 553696 - DNA, 25 bp, Rattus norvegicus
tactgcttgataaagccgttgcttg

SEQ ID NO: 553697 - DNA, 25 bp, Rattus norvegicus
tactgcttgatatagccgttgcttg

SEQ ID NO: 553698 - DNA, 25 bp, Rattus norvegicus
tactgcttgcctcctataggcatga

SEQ ID NO: 553699 - DNA, 25 bp, Rattus norvegicus
tactgcttgcctgctataggcatga

SEQ ID NO: 553700 - DNA, 25 bp, Rattus norvegicus
tactgcttggatcttcattctcttc

SEQ ID NO: 553701 - DNA, 25 bp, Rattus norvegicus
tactgcttggatgttcattctcttc

SEQ ID NO: 553702 - DNA, 25 bp, Rattus norvegicus
tactgcttggttacttggttcctaa

SEQ ID NO: 553703 - DNA, 25 bp, Rattus norvegicus
tactgcttggtttcttggttcctaa

SEQ ID NO: 553704 - DNA, 25 bp, Rattus norvegicus
tactgctttattaagtgacaaatgc

SEQ ID NO: 553705 - DNA, 25 bp, Rattus norvegicus
tactgctttatttagtgacaaatgc

SEQ ID NO: 553706 - DNA, 25 bp, Rattus norvegicus
tactgctttgtaatcctgggtttcc

SEQ ID NO: 553707 - DNA, 25 bp, Rattus norvegicus
tactgctttgtattcctgggtttcc

SEQ ID NO: 553708 - DNA, 25 bp, Rattus norvegicus
tactggaaagtacatcctagtttgt

SEQ ID NO: 553709 - DNA, 25 bp, Rattus norvegicus
tactggaaagtagatcctagtttgt

SEQ ID NO: 553710 - DNA, 25 bp, Rattus norvegicus
tactggaacggtccacagacttcgg

SEQ ID NO: 553711 - DNA, 25 bp, Rattus norvegicus
tactggaacggtgcacagacttcgg

SEQ ID NO: 553712 - DNA, 25 bp, Rattus norvegicus
tactggaaggctcctggtacgtagt

SEQ ID NO: 553713 - DNA, 25 bp, Rattus norvegicus
tactggaaggctgctggtacgtagt

SEQ ID NO: 553714 - DNA, 25 bp, Rattus norvegicus
tactggaatgaaatttctgtacatg

SEQ ID NO: 553715 - DNA, 25 bp, Rattus norvegicus
tactggaatgaattttctgtacatg

SEQ ID NO: 553716 - DNA, 25 bp, Rattus norvegicus
tactggaatgcgaaggctccccaca

SEQ ID NO: 553717 - DNA, 25 bp, Rattus norvegicus
tactggaatgcgtaggctccccaca

SEQ ID NO: 553718 - DNA, 25 bp, Rattus norvegicus
tactggacatatcctggctctctga

SEQ ID NO: 553719 - DNA, 25 bp, Rattus norvegicus
tactggacatatgctggctctctga

SEQ ID NO: 553720 - DNA, 25 bp, Rattus norvegicus
tactggacatgtcagcatcaaccct

SEQ ID NO: 553721 - DNA, 25 bp, Rattus norvegicus
tactggacatgtgagcatcaaccct

SEQ ID NO: 553722 - DNA, 25 bp, Rattus norvegicus
tactggacccataaagctctgctta

SEQ ID NO: 553723 - DNA, 25 bp, Rattus norvegicus
tactggacccattaagctctgctta

SEQ ID NO: 553724 - DNA, 25 bp, Rattus norvegicus
tactggaccgtcatcctagcccaga

SEQ ID NO: 553725 - DNA, 25 bp, Rattus norvegicus
tactggaccgtcttcctagcccaga

SEQ ID NO: 553726 - DNA, 25 bp, Rattus norvegicus
tactggacctacattggctctctga

SEQ ID NO: 553727 - DNA, 25 bp, Rattus norvegicus
tactggacctactttggctctctga

SEQ ID NO: 553728 - DNA, 25 bp, Rattus norvegicus
tactggacgccaagatgttcatcaa

SEQ ID NO: 553729 - DNA, 25 bp, Rattus norvegicus
tactggacgccatgatgttcatcaa

SEQ ID NO: 553730 - DNA, 25 bp, Rattus norvegicus
tactggactcagcaactttcgttgg

SEQ ID NO: 553731 - DNA, 25 bp, Rattus norvegicus
tactggactcaggaactttcgttgg

SEQ ID NO: 553732 - DNA, 25 bp, Rattus norvegicus
tactggagacataggccttctgtgc

SEQ ID NO: 553733 - DNA, 25 bp, Rattus norvegicus
tactggagacattggccttctgtgc

SEQ ID NO: 553734 - DNA, 25 bp, Rattus norvegicus
tactggagagtgatccctactgtcc

SEQ ID NO: 553735 - DNA, 25 bp, Rattus norvegicus
tactggagagtgttccctactgtcc

SEQ ID NO: 553736 - DNA, 25 bp, Rattus norvegicus
tactggagtgggattcctggttgtt

SEQ ID NO: 553737 - DNA, 25 bp, Rattus norvegicus
tactggagtgggtttcctggttgtt

SEQ ID NO: 553738 - DNA, 25 bp, Rattus norvegicus
tactggatccctataacaccatggg

SEQ ID NO: 553739 - DNA, 25 bp, Rattus norvegicus
tactggatccctttaacaccatggg

SEQ ID NO: 553740 - DNA, 25 bp, Rattus norvegicus
tactggatctttcaggtggagctga

SEQ ID NO: 553741 - DNA, 25 bp, Rattus norvegicus
tactggatctttgaggtggagctga

SEQ ID NO: 553742 - DNA, 25 bp, Rattus norvegicus
tactggatgcttccagacactgctt

SEQ ID NO: 553743 - DNA, 25 bp, Rattus norvegicus
tactggatgcttgcagacactgctt

SEQ ID NO: 553744 - DNA, 25 bp, Rattus norvegicus
tactggatgtccagagcgagattaa

SEQ ID NO: 553745 - DNA, 25 bp, Rattus norvegicus
tactggatgtcctgagcgagattaa

SEQ ID NO: 553746 - DNA, 25 bp, Rattus norvegicus
tactggattgctcctattccgtcgg

SEQ ID NO: 553747 - DNA, 25 bp, Rattus norvegicus
tactggattgctgctattccgtcgg

SEQ ID NO: 553748 - DNA, 25 bp, Rattus norvegicus
tactggcaaagtctcgtgtccttga

SEQ ID NO: 553749 - DNA, 25 bp, Rattus norvegicus
tactggcaaagtgtcgtgtccttga

SEQ ID NO: 553750 - DNA, 25 bp, Rattus norvegicus
tactggcaacctctaagactgcagg

SEQ ID NO: 553751 - DNA, 25 bp, Rattus norvegicus
tactggcaacctgtaagactgcagg

SEQ ID NO: 553752 - DNA, 25 bp, Rattus norvegicus
tactggcaatgcatccacagcgtaa

SEQ ID NO: 553753 - DNA, 25 bp, Rattus norvegicus
tactggcaatgcttccacagcgtaa

SEQ ID NO: 553754 - DNA, 25 bp, Rattus norvegicus
tactggcactaacgcaatacttgac

SEQ ID NO: 553755 - DNA, 25 bp, Rattus norvegicus
tactggcactaaggcaatacttgac

SEQ ID NO: 553756 - DNA, 25 bp, Rattus norvegicus
tactggcagcaacccactgcactat

SEQ ID NO: 553757 - DNA, 25 bp, Rattus norvegicus
tactggcagcaagccactgcactat

SEQ ID NO: 553758 - DNA, 25 bp, Rattus norvegicus
tactggcaggtcagggtagtgtccc

SEQ ID NO: 553759 - DNA, 25 bp, Rattus norvegicus
tactggcaggtctgggtagtgtccc

SEQ ID NO: 553760 - DNA, 25 bp, Rattus norvegicus
tactggcatcagacaatgttctgga

SEQ ID NO: 553761 - DNA, 25 bp, Rattus norvegicus
tactggcatcagtcaatgttctgga

SEQ ID NO: 553762 - DNA, 25 bp, Rattus norvegicus
tactggcattctatctagtcatatg

SEQ ID NO: 553763 - DNA, 25 bp, Rattus norvegicus
tactggcattctttctagtcatatg

SEQ ID NO: 553764 - DNA, 25 bp, Rattus norvegicus
tactggccactgatcaccttaattg

SEQ ID NO: 553765 - DNA, 25 bp, Rattus norvegicus
tactggccactgttcaccttaattg

SEQ ID NO: 553766 - DNA, 25 bp, Rattus norvegicus
tactggccattgactgctgacatct

SEQ ID NO: 553767 - DNA, 25 bp, Rattus norvegicus
tactggccattgtctgctgacatct

SEQ ID NO: 553768 - DNA, 25 bp, Rattus norvegicus
tactggcctgtgatgatggagctga

SEQ ID NO: 553769 - DNA, 25 bp, Rattus norvegicus
tactggcctgtgttgatggagctga

SEQ ID NO: 553770 - DNA, 25 bp, Rattus norvegicus
tactggcggtcaagtctacgaggca

SEQ ID NO: 553771 - DNA, 25 bp, Rattus norvegicus
tactggcggtcatgtctacgaggca

SEQ ID NO: 553772 - DNA, 25 bp, Rattus norvegicus
tactggcgtcttcaccaccatggag

SEQ ID NO: 553773 - DNA, 25 bp, Rattus norvegicus
tactggcgtcttgaccaccatggag

SEQ ID NO: 553774 - DNA, 25 bp, Rattus norvegicus
tactggctacggagagaaattcgga

SEQ ID NO: 553775 - DNA, 25 bp, Rattus norvegicus
tactggctacggtgagaaattcgga

SEQ ID NO: 553776 - DNA, 25 bp, Rattus norvegicus
tactggctactaaggctctggaggc

SEQ ID NO: 553777 - DNA, 25 bp, Rattus norvegicus
tactggctactatggctctggaggc

SEQ ID NO: 553778 - DNA, 25 bp, Rattus norvegicus
tactggctcacaccctggattgaaa

SEQ ID NO: 553779 - DNA, 25 bp, Rattus norvegicus
tactggctcacagcctggattgaaa

SEQ ID NO: 553780 - DNA, 25 bp, Rattus norvegicus
tactggctcctgacacatcaatgga

SEQ ID NO: 553781 - DNA, 25 bp, Rattus norvegicus
tactggctcctgtcacatcaatgga

SEQ ID NO: 553782 - DNA, 25 bp, Rattus norvegicus
tactggctcttgcagtatccgcaag

SEQ ID NO: 553783 - DNA, 25 bp, Rattus norvegicus
tactggctcttggagtatccgcaag

SEQ ID NO: 553784 - DNA, 25 bp, Rattus norvegicus
tactggctgagcatgccctacatga

SEQ ID NO: 553785 - DNA, 25 bp, Rattus norvegicus
tactggctgagcttgccctacatga

SEQ ID NO: 553786 - DNA, 25 bp, Rattus norvegicus
tactggctgcagactttgaaattgg

SEQ ID NO: 553787 - DNA, 25 bp, Rattus norvegicus
tactggctgcagtctttgaaattgg

SEQ ID NO: 553788 - DNA, 25 bp, Rattus norvegicus
tactggctggccaatgagaccatca

SEQ ID NO: 553789 - DNA, 25 bp, Rattus norvegicus
tactggctggcctatgagaccatca

SEQ ID NO: 553790 - DNA, 25 bp, Rattus norvegicus
tactggctgtacaatgttaactgag

SEQ ID NO: 553791 - DNA, 25 bp, Rattus norvegicus
tactggctgtactatgttaactgag

SEQ ID NO: 553792 - DNA, 25 bp, Rattus norvegicus
tactggcttctcagcttttcaggat

SEQ ID NO: 553793 - DNA, 25 bp, Rattus norvegicus
tactggcttctctgcttttcaggat

SEQ ID NO: 553794 - DNA, 25 bp, Rattus norvegicus
tactggcttgctaatcagctggaaa

SEQ ID NO: 553795 - DNA, 25 bp, Rattus norvegicus
tactggcttgcttatcagctggaaa

SEQ ID NO: 553796 - DNA, 25 bp, Rattus norvegicus
tactgggaaccaacatctcagggcc

SEQ ID NO: 553797 - DNA, 25 bp, Rattus norvegicus
tactgggaaccatcatctcagggcc

SEQ ID NO: 553798 - DNA, 25 bp, Rattus norvegicus
tactgggaagaacccctgactttat

SEQ ID NO: 553799 - DNA, 25 bp, Rattus norvegicus
tactgggaagaagccctgactttat

SEQ ID NO: 553800 - DNA, 25 bp, Rattus norvegicus
tactgggacatcaacacctgcgtgg

SEQ ID NO: 553801 - DNA, 25 bp, Rattus norvegicus
tactgggacatctacacctgcgtgg

SEQ ID NO: 553802 - DNA, 25 bp, Rattus norvegicus
tactgggaccatatgttctttgacc

SEQ ID NO: 553803 - DNA, 25 bp, Rattus norvegicus
tactgggaccatttgttctttgacc

SEQ ID NO: 553804 - DNA, 25 bp, Rattus norvegicus
tactgggacctactccggaaaggca

SEQ ID NO: 553805 - DNA, 25 bp, Rattus norvegicus
tactgggacctagtccggaaaggca

SEQ ID NO: 553806 - DNA, 25 bp, Rattus norvegicus
tactgggactctaacggtttagcgt

SEQ ID NO: 553807 - DNA, 25 bp, Rattus norvegicus
tactgggactcttacggtttagcgt

SEQ ID NO: 553808 - DNA, 25 bp, Rattus norvegicus
tactgggacttcagagccatgggct

SEQ ID NO: 553809 - DNA, 25 bp, Rattus norvegicus
tactgggacttctgagccatgggct

SEQ ID NO: 553810 - DNA, 25 bp, Rattus norvegicus
tactgggatagtccccatgtgtgct

SEQ ID NO: 553811 - DNA, 25 bp, Rattus norvegicus
tactgggatagtgcccatgtgtgct

SEQ ID NO: 553812 - DNA, 25 bp, Rattus norvegicus
tactgggatggcaagtcagtggtca

SEQ ID NO: 553813 - DNA, 25 bp, Rattus norvegicus
tactgggatggctagtcagtggtca

SEQ ID NO: 553814 - DNA, 25 bp, Rattus norvegicus
tactgggattgaacctttacctggg

SEQ ID NO: 553815 - DNA, 25 bp, Rattus norvegicus
tactgggattgatcctttacctggg

SEQ ID NO: 553816 - DNA, 25 bp, Rattus norvegicus
tactgggcacacacggcggtcctaa

SEQ ID NO: 553817 - DNA, 25 bp, Rattus norvegicus
tactgggcacactcggcggtcctaa

SEQ ID NO: 553818 - DNA, 25 bp, Rattus norvegicus
tactgggcactgaacaagccactca

SEQ ID NO: 553819 - DNA, 25 bp, Rattus norvegicus
tactgggcactgtacaagccactca

SEQ ID NO: 553820 - DNA, 25 bp, Rattus norvegicus
tactgggcctctaattaaactacta

SEQ ID NO: 553821 - DNA, 25 bp, Rattus norvegicus
tactgggcctcttattaaactacta

SEQ ID NO: 553822 - DNA, 25 bp, Rattus norvegicus
tactgggcgaacatcttgatcaatc

SEQ ID NO: 553823 - DNA, 25 bp, Rattus norvegicus
tactgggcgaacttcttgatcaatc

SEQ ID NO: 553824 - DNA, 25 bp, Rattus norvegicus
tactgggctccacctgcaagatggg

SEQ ID NO: 553825 - DNA, 25 bp, Rattus norvegicus
tactgggctccagctgcaagatggg

SEQ ID NO: 553826 - DNA, 25 bp, Rattus norvegicus
tactgggctcgaacaaccgccaagg

SEQ ID NO: 553827 - DNA, 25 bp, Rattus norvegicus
tactgggctcgatcaaccgccaagg

SEQ ID NO: 553828 - DNA, 25 bp, Rattus norvegicus
tactgggctctaacttggtgtcctt

SEQ ID NO: 553829 - DNA, 25 bp, Rattus norvegicus
tactgggctctatcttggtgtcctt

SEQ ID NO: 553830 - DNA, 25 bp, Rattus norvegicus
tactgggcttgcagaggtcccttat

SEQ ID NO: 553831 - DNA, 25 bp, Rattus norvegicus
tactgggcttgctgaggtcccttat

SEQ ID NO: 553832 - DNA, 25 bp, Rattus norvegicus
tactggggaaccatgtctcctcaga

SEQ ID NO: 553833 - DNA, 25 bp, Rattus norvegicus
tactggggaaccttgtctcctcaga

SEQ ID NO: 553834 - DNA, 25 bp, Rattus norvegicus
tactgggtatttccatttctggatg

SEQ ID NO: 553835 - DNA, 25 bp, Rattus norvegicus
tactgggtatttgcatttctggatg

SEQ ID NO: 553836 - DNA, 25 bp, Rattus norvegicus
tactgggtctaaacttgggtcttct

SEQ ID NO: 553837 - DNA, 25 bp, Rattus norvegicus
tactgggtctaatcttgggtcttct

SEQ ID NO: 553838 - DNA, 25 bp, Rattus norvegicus
tactgggtgacgatgtctgcagcct

SEQ ID NO: 553839 - DNA, 25 bp, Rattus norvegicus
tactgggtgacgttgtctgcagcct

SEQ ID NO: 553840 - DNA, 25 bp, Rattus norvegicus
tactgggtgactagtgttcccgtga

SEQ ID NO: 553841 - DNA, 25 bp, Rattus norvegicus
tactgggtgacttgtgttcccgtga

SEQ ID NO: 553842 - DNA, 25 bp, Rattus norvegicus
tactgggtgagaactttgctctctt

SEQ ID NO: 553843 - DNA, 25 bp, Rattus norvegicus
tactgggtgagatctttgctctctt

SEQ ID NO: 553844 - DNA, 25 bp, Rattus norvegicus
tactgggtgatgaggagccctgtta

SEQ ID NO: 553845 - DNA, 25 bp, Rattus norvegicus
tactgggtgatgtggagccctgtta

SEQ ID NO: 553846 - DNA, 25 bp, Rattus norvegicus
tactgggtgtttacatcatctgctg

SEQ ID NO: 553847 - DNA, 25 bp, Rattus norvegicus
tactgggtgtttctggccgttcata

SEQ ID NO: 553848 - DNA, 25 bp, Rattus norvegicus
tactgggtgtttgtggccgttcata

SEQ ID NO: 553849 - DNA, 25 bp, Rattus norvegicus
tactgggtgttttcatcatctgctg

SEQ ID NO: 553850 - DNA, 25 bp, Rattus norvegicus
tactggtaagagacacaccctcgcc

SEQ ID NO: 553851 - DNA, 25 bp, Rattus norvegicus
tactggtaagagtcacaccctcgcc

SEQ ID NO: 553852 - DNA, 25 bp, Rattus norvegicus
tactggtacaatcgactgggagcca

SEQ ID NO: 553853 - DNA, 25 bp, Rattus norvegicus
tactggtacaatggactgggagcca

SEQ ID NO: 553854 - DNA, 25 bp, Rattus norvegicus
tactggtacctactttgccctttat

SEQ ID NO: 553855 - DNA, 25 bp, Rattus norvegicus
tactggtacctagtttgccctttat

SEQ ID NO: 553856 - DNA, 25 bp, Rattus norvegicus
tactggtatctcaagggccttttct

SEQ ID NO: 553857 - DNA, 25 bp, Rattus norvegicus
tactggtatctctagggccttttct

SEQ ID NO: 553858 - DNA, 25 bp, Rattus norvegicus
tactggtcagccaggtcgtgaggca

SEQ ID NO: 553859 - DNA, 25 bp, Rattus norvegicus
tactggtcagcctggtcgtgaggca

SEQ ID NO: 553860 - DNA, 25 bp, Rattus norvegicus
tactggtgagtgataacgctgctgc

SEQ ID NO: 553861 - DNA, 25 bp, Rattus norvegicus
tactggtgagtgttaacgctgctgc

SEQ ID NO: 553862 - DNA, 25 bp, Rattus norvegicus
tactggtgatcgatgccaaaactac

SEQ ID NO: 553863 - DNA, 25 bp, Rattus norvegicus
tactggtgatcgttgccaaaactac

SEQ ID NO: 553864 - DNA, 25 bp, Rattus norvegicus
tactggtgcgctcgtagcaggccaa

SEQ ID NO: 553865 - DNA, 25 bp, Rattus norvegicus
tactggtgcgctggtagcaggccaa

SEQ ID NO: 553866 - DNA, 25 bp, Rattus norvegicus
tactggtggagcaactggcaattgt

SEQ ID NO: 553867 - DNA, 25 bp, Rattus norvegicus
tactggtggagctactggcaattgt

SEQ ID NO: 553868 - DNA, 25 bp, Rattus norvegicus
tactggtgtcaactgctgagctttc

SEQ ID NO: 553869 - DNA, 25 bp, Rattus norvegicus
tactggtgtcaagtgctgagctttc

SEQ ID NO: 553870 - DNA, 25 bp, Rattus norvegicus
tactggtgtcttcgtccttatgttg

SEQ ID NO: 553871 - DNA, 25 bp, Rattus norvegicus
tactggtgtcttggtccttatgttg

SEQ ID NO: 553872 - DNA, 25 bp, Rattus norvegicus
tactggtgtgatcatgggcttccct

SEQ ID NO: 553873 - DNA, 25 bp, Rattus norvegicus
tactggtgtgatgatgggcttccct

SEQ ID NO: 553874 - DNA, 25 bp, Rattus norvegicus
tactggtgtggcatacccggacaga

SEQ ID NO: 553875 - DNA, 25 bp, Rattus norvegicus
tactggtgtggcttacccggacaga

SEQ ID NO: 553876 - DNA, 25 bp, Rattus norvegicus
tactggttaacacccatagatcaag

SEQ ID NO: 553877 - DNA, 25 bp, Rattus norvegicus
tactggttaacagccatagatcaag

SEQ ID NO: 553878 - DNA, 25 bp, Rattus norvegicus
tactggttaagacgatttagctgct

SEQ ID NO: 553879 - DNA, 25 bp, Rattus norvegicus
tactggttaagaggatttagctgct

SEQ ID NO: 553880 - DNA, 25 bp, Rattus norvegicus
tactggttagccattgatccatcct

SEQ ID NO: 553881 - DNA, 25 bp, Rattus norvegicus
tactggttagcctttgatccatcct

SEQ ID NO: 553882 - DNA, 25 bp, Rattus norvegicus
tactggttatgacgaccggtttgca

SEQ ID NO: 553883 - DNA, 25 bp, Rattus norvegicus
tactggttatgaggaccggtttgca

SEQ ID NO: 553884 - DNA, 25 bp, Rattus norvegicus
tactggttcccaatcatgtggtgaa

SEQ ID NO: 553885 - DNA, 25 bp, Rattus norvegicus
tactggttcccattcatgtggtgaa

SEQ ID NO: 553886 - DNA, 25 bp, Rattus norvegicus
tactggttctgacggtgtaccttca

SEQ ID NO: 553887 - DNA, 25 bp, Rattus norvegicus
tactggttctgagggtgtaccttca

SEQ ID NO: 553888 - DNA, 25 bp, Rattus norvegicus
tactggttctgtctttcacgggtca

SEQ ID NO: 553889 - DNA, 25 bp, Rattus norvegicus
tactggttctgtgtttcacgggtca

SEQ ID NO: 553890 - DNA, 25 bp, Rattus norvegicus
tactggttgttaagacctcaatcaa

SEQ ID NO: 553891 - DNA, 25 bp, Rattus norvegicus
tactggttgttatgacctcaatcaa

SEQ ID NO: 553892 - DNA, 25 bp, Rattus norvegicus
tactggtttcatagtagggcccaac

SEQ ID NO: 553893 - DNA, 25 bp, Rattus norvegicus
tactggtttcattgtagggcccaac

SEQ ID NO: 553894 - DNA, 25 bp, Rattus norvegicus
tactggtttcttcttcttagggctt

SEQ ID NO: 553895 - DNA, 25 bp, Rattus norvegicus
tactggtttcttgttcttagggctt

SEQ ID NO: 553896 - DNA, 25 bp, Rattus norvegicus
tactggtttggcagctcatgtacaa

SEQ ID NO: 553897 - DNA, 25 bp, Rattus norvegicus
tactggtttggctgctcatgtacaa

SEQ ID NO: 553898 - DNA, 25 bp, Rattus norvegicus
tactgtaactgaacgcactactgta

SEQ ID NO: 553899 - DNA, 25 bp, Rattus norvegicus
tactgtaactgatcgcactactgta

SEQ ID NO: 553900 - DNA, 25 bp, Rattus norvegicus
tactgtaaggtgcttggtctgaaac

SEQ ID NO: 553901 - DNA, 25 bp, Rattus norvegicus
tactgtaaggtggttggtctgaaac

SEQ ID NO: 553902 - DNA, 25 bp, Rattus norvegicus
tactgtaatattatgccctagctga

SEQ ID NO: 553903 - DNA, 25 bp, Rattus norvegicus
tactgtaatattttgccctagctga

SEQ ID NO: 553904 - DNA, 25 bp, Rattus norvegicus
tactgtaatcccagaaggtagaggc

SEQ ID NO: 553905 - DNA, 25 bp, Rattus norvegicus
tactgtaatccctgaaggtagaggc

SEQ ID NO: 553906 - DNA, 25 bp, Rattus norvegicus
tactgtacacccatgatgcctgtag

SEQ ID NO: 553907 - DNA, 25 bp, Rattus norvegicus
tactgtacacccttgatgcctgtag

SEQ ID NO: 553908 - DNA, 25 bp, Rattus norvegicus
tactgtacacgtcaactgtgagcca

SEQ ID NO: 553909 - DNA, 25 bp, Rattus norvegicus
tactgtacacgtgaactgtgagcca

SEQ ID NO: 553910 - DNA, 25 bp, Rattus norvegicus
tactgtacacttccctcttgagaga

SEQ ID NO: 553911 - DNA, 25 bp, Rattus norvegicus
tactgtacacttgcctcttgagaga

SEQ ID NO: 553912 - DNA, 25 bp, Rattus norvegicus
tactgtacatcactgttctcccagc

SEQ ID NO: 553913 - DNA, 25 bp, Rattus norvegicus
tactgtacatcagtgttctcccagc

SEQ ID NO: 553914 - DNA, 25 bp, Rattus norvegicus
tactgtaccaggctctttggttttt

SEQ ID NO: 553915 - DNA, 25 bp, Rattus norvegicus
tactgtaccagggtctttggttttt

SEQ ID NO: 553916 - DNA, 25 bp, Rattus norvegicus
tactgtacccacctgtacgtaggtg

SEQ ID NO: 553917 - DNA, 25 bp, Rattus norvegicus
tactgtacccacgtgtacgtaggtg

SEQ ID NO: 553918 - DNA, 25 bp, Rattus norvegicus
tactgtacccagataaggcaaccgg

SEQ ID NO: 553919 - DNA, 25 bp, Rattus norvegicus
tactgtacccagttaaggcaaccgg

SEQ ID NO: 553920 - DNA, 25 bp, Rattus norvegicus
tactgtaccccgaactcattgaaca

SEQ ID NO: 553921 - DNA, 25 bp, Rattus norvegicus
tactgtaccccgtactcattgaaca

SEQ ID NO: 553922 - DNA, 25 bp, Rattus norvegicus
tactgtaccgggatgtagcttcctt

SEQ ID NO: 553923 - DNA, 25 bp, Rattus norvegicus
tactgtaccgggttgtagcttcctt

SEQ ID NO: 553924 - DNA, 25 bp, Rattus norvegicus
tactgtacctctccacttgaatgtg

SEQ ID NO: 553925 - DNA, 25 bp, Rattus norvegicus
tactgtacctctgcacttgaatgtg

SEQ ID NO: 553926 - DNA, 25 bp, Rattus norvegicus
tactgtacgacgctgccctttagga

SEQ ID NO: 553927 - DNA, 25 bp, Rattus norvegicus
tactgtacgacggtgccctttagga

SEQ ID NO: 553928 - DNA, 25 bp, Rattus norvegicus
tactgtacggatcttctggaaccac

SEQ ID NO: 553929 - DNA, 25 bp, Rattus norvegicus
tactgtacggatgttctggaaccac

SEQ ID NO: 553930 - DNA, 25 bp, Rattus norvegicus
tactgtactgaaccctttctaggga

SEQ ID NO: 553931 - DNA, 25 bp, Rattus norvegicus
tactgtactgaagcctttctaggga

SEQ ID NO: 553932 - DNA, 25 bp, Rattus norvegicus
tactgtactgttaatcacttgggag

SEQ ID NO: 553933 - DNA, 25 bp, Rattus norvegicus
tactgtactgtttatcacttgggag

SEQ ID NO: 553934 - DNA, 25 bp, Rattus norvegicus
tactgtagcacaaatctaagcatat

SEQ ID NO: 553935 - DNA, 25 bp, Rattus norvegicus
tactgtagcacatatctaagcatat

SEQ ID NO: 553936 - DNA, 25 bp, Rattus norvegicus
tactgtagcgttagttccggttcga

SEQ ID NO: 553937 - DNA, 25 bp, Rattus norvegicus
tactgtagcgtttgttccggttcga

SEQ ID NO: 553938 - DNA, 25 bp, Rattus norvegicus
tactgtagcttgatgcttagccaat

SEQ ID NO: 553939 - DNA, 25 bp, Rattus norvegicus
tactgtagcttgttgcttagccaat

SEQ ID NO: 553940 - DNA, 25 bp, Rattus norvegicus
tactgtagctttaccatcgctgtat

SEQ ID NO: 553941 - DNA, 25 bp, Rattus norvegicus
tactgtagcttttccatcgctgtat

SEQ ID NO: 553942 - DNA, 25 bp, Rattus norvegicus
tactgtagggttaactatggactgt

SEQ ID NO: 553943 - DNA, 25 bp, Rattus norvegicus
tactgtagggtttactatggactgt

SEQ ID NO: 553944 - DNA, 25 bp, Rattus norvegicus
tactgtagttgaagtgtgcgtcgct

SEQ ID NO: 553945 - DNA, 25 bp, Rattus norvegicus
tactgtagttgatgtgtgcgtcgct

SEQ ID NO: 553946 - DNA, 25 bp, Rattus norvegicus
tactgtatagatcttttacctgcat

SEQ ID NO: 553947 - DNA, 25 bp, Rattus norvegicus
tactgtatagatgttttacctgcat

SEQ ID NO: 553948 - DNA, 25 bp, Rattus norvegicus
tactgtatagtgctgtcaccccaat

SEQ ID NO: 553949 - DNA, 25 bp, Rattus norvegicus
tactgtatagtggtgtcaccccaat

SEQ ID NO: 553950 - DNA, 25 bp, Rattus norvegicus
tactgtatcatacctctgtggatgt

SEQ ID NO: 553951 - DNA, 25 bp, Rattus norvegicus
tactgtatcatagctctgtggatgt

SEQ ID NO: 553952 - DNA, 25 bp, Rattus norvegicus
tactgtatctggacactgtgtacac

SEQ ID NO: 553953 - DNA, 25 bp, Rattus norvegicus
tactgtatctggtcactgtgtacac

SEQ ID NO: 553954 - DNA, 25 bp, Rattus norvegicus
tactgtatggctacgaggtgccgcc

SEQ ID NO: 553955 - DNA, 25 bp, Rattus norvegicus
tactgtatggcttcgaggtgccgcc

SEQ ID NO: 553956 - DNA, 25 bp, Rattus norvegicus
tactgtatgttacttacctgttttt

SEQ ID NO: 553957 - DNA, 25 bp, Rattus norvegicus
tactgtatgttagttacctgttttt

SEQ ID NO: 553958 - DNA, 25 bp, Rattus norvegicus
tactgtattctaatggaggcgtcct

SEQ ID NO: 553959 - DNA, 25 bp, Rattus norvegicus
tactgtattctattggaggcgtcct

SEQ ID NO: 553960 - DNA, 25 bp, Rattus norvegicus
tactgtatttacatgcactctttca

SEQ ID NO: 553961 - DNA, 25 bp, Rattus norvegicus
tactgtatttacttgcactctttca

SEQ ID NO: 553962 - DNA, 25 bp, Rattus norvegicus
tactgtatttggcttcttcattaat

SEQ ID NO: 553963 - DNA, 25 bp, Rattus norvegicus
tactgtatttgggttcttcattaat

SEQ ID NO: 553964 - DNA, 25 bp, Rattus norvegicus
tactgtcaaaacacactgtggatat

SEQ ID NO: 553965 - DNA, 25 bp, Rattus norvegicus
tactgtcaaaactcactgtggatat

SEQ ID NO: 553966 - DNA, 25 bp, Rattus norvegicus
tactgtcaactcacagaactgtgtt

SEQ ID NO: 553967 - DNA, 25 bp, Rattus norvegicus
tactgtcaactctcagaactgtgtt

SEQ ID NO: 553968 - DNA, 25 bp, Rattus norvegicus
tactgtcaagttccctgttggtaac

SEQ ID NO: 553969 - DNA, 25 bp, Rattus norvegicus
tactgtcaagttgcctgttggtaac

SEQ ID NO: 553970 - DNA, 25 bp, Rattus norvegicus
tactgtcagagcagagctagtgttt

SEQ ID NO: 553971 - DNA, 25 bp, Rattus norvegicus
tactgtcagagctgagctagtgttt

SEQ ID NO: 553972 - DNA, 25 bp, Rattus norvegicus
tactgtcagcctcctttctaagtga

SEQ ID NO: 553973 - DNA, 25 bp, Rattus norvegicus
tactgtcagcctgctttctaagtga

SEQ ID NO: 553974 - DNA, 25 bp, Rattus norvegicus
tactgtcaggacattaggcatttgt

SEQ ID NO: 553975 - DNA, 25 bp, Rattus norvegicus
tactgtcaggactttaggcatttgt

SEQ ID NO: 553976 - DNA, 25 bp, Rattus norvegicus
tactgtcagggcaattttcaaatca

SEQ ID NO: 553977 - DNA, 25 bp, Rattus norvegicus
tactgtcagggctattttcaaatca

SEQ ID NO: 553978 - DNA, 25 bp, Rattus norvegicus
tactgtcatcagcaactggttccga

SEQ ID NO: 553979 - DNA, 25 bp, Rattus norvegicus
tactgtcatcaggaactggttccga

SEQ ID NO: 553980 - DNA, 25 bp, Rattus norvegicus
tactgtcatgtcagatcagctgcat

SEQ ID NO: 553981 - DNA, 25 bp, Rattus norvegicus
tactgtcatgtctgatcagctgcat

SEQ ID NO: 553982 - DNA, 25 bp, Rattus norvegicus
tactgtccaagtcgacccgagatct

SEQ ID NO: 553983 - DNA, 25 bp, Rattus norvegicus
tactgtccaagtggacccgagatct

SEQ ID NO: 553984 - DNA, 25 bp, Rattus norvegicus
tactgtccaccgactgcaagaagga

SEQ ID NO: 553985 - DNA, 25 bp, Rattus norvegicus
tactgtccaccgtctgcaagaagga

SEQ ID NO: 553986 - DNA, 25 bp, Rattus norvegicus
tactgtccagagcagtcagaccttg

SEQ ID NO: 553987 - DNA, 25 bp, Rattus norvegicus
tactgtccagaggagtcagaccttg

SEQ ID NO: 553988 - DNA, 25 bp, Rattus norvegicus
tactgtccccgcaacaggccgagga

SEQ ID NO: 553989 - DNA, 25 bp, Rattus norvegicus
tactgtccccgctacaggccgagga

SEQ ID NO: 553990 - DNA, 25 bp, Rattus norvegicus
tactgtccctgtagtggatactggt

SEQ ID NO: 553991 - DNA, 25 bp, Rattus norvegicus
tactgtccctgtatgtttccattat

SEQ ID NO: 553992 - DNA, 25 bp, Rattus norvegicus
tactgtccctgttgtggatactggt

SEQ ID NO: 553993 - DNA, 25 bp, Rattus norvegicus
tactgtccctgtttgtttccattat

SEQ ID NO: 553994 - DNA, 25 bp, Rattus norvegicus
tactgtccgggcactatggttggag

SEQ ID NO: 553995 - DNA, 25 bp, Rattus norvegicus
tactgtccgggctctatggttggag

SEQ ID NO: 553996 - DNA, 25 bp, Rattus norvegicus
tactgtcctaagatctgcccaggtg

SEQ ID NO: 553997 - DNA, 25 bp, Rattus norvegicus
tactgtcctaagttctgcccaggtg

SEQ ID NO: 553998 - DNA, 25 bp, Rattus norvegicus
tactgtcctcctcttagcaagatga

SEQ ID NO: 553999 - DNA, 25 bp, Rattus norvegicus
tactgtcctcctgttagcaagatga

SEQ ID NO: 554000 - DNA, 25 bp, Rattus norvegicus
tactgtcctggtccttttccttgaa

SEQ ID NO: 554001 - DNA, 25 bp, Rattus norvegicus
tactgtcctggtgcttttccttgaa

SEQ ID NO: 554002 - DNA, 25 bp, Rattus norvegicus
tactgtcctgtcctgagccttgaag

SEQ ID NO: 554003 - DNA, 25 bp, Rattus norvegicus
tactgtcctgtcgtgagccttgaag

SEQ ID NO: 554004 - DNA, 25 bp, Rattus norvegicus
tactgtcctttcacagggtttccaa

SEQ ID NO: 554005 - DNA, 25 bp, Rattus norvegicus
tactgtcctttctcagggtttccaa

SEQ ID NO: 554006 - DNA, 25 bp, Rattus norvegicus
tactgtctaacaacctgatactaag

SEQ ID NO: 554007 - DNA, 25 bp, Rattus norvegicus
tactgtctaacatcctgatactaag

SEQ ID NO: 554008 - DNA, 25 bp, Rattus norvegicus
tactgtctaattcatctttgtcgag

SEQ ID NO: 554009 - DNA, 25 bp, Rattus norvegicus
tactgtctaattcttcaccctaatg

SEQ ID NO: 554010 - DNA, 25 bp, Rattus norvegicus
tactgtctaattgatctttgtcgag

SEQ ID NO: 554011 - DNA, 25 bp, Rattus norvegicus
tactgtctaattgttcaccctaatg

SEQ ID NO: 554012 - DNA, 25 bp, Rattus norvegicus
tactgtctacagaagcatgcctttg

SEQ ID NO: 554013 - DNA, 25 bp, Rattus norvegicus
tactgtctacagtagcatgcctttg

SEQ ID NO: 554014 - DNA, 25 bp, Rattus norvegicus
tactgtctatgtcgttccctcttct

SEQ ID NO: 554015 - DNA, 25 bp, Rattus norvegicus
tactgtctatgtggttccctcttct

SEQ ID NO: 554016 - DNA, 25 bp, Rattus norvegicus
tactgtctcatgatcttgtacatca

SEQ ID NO: 554017 - DNA, 25 bp, Rattus norvegicus
tactgtctcatgttcttgtacatca

SEQ ID NO: 554018 - DNA, 25 bp, Rattus norvegicus
tactgtctccatatactgttgcaat

SEQ ID NO: 554019 - DNA, 25 bp, Rattus norvegicus
tactgtctccatttactgttgcaat

SEQ ID NO: 554020 - DNA, 25 bp, Rattus norvegicus
tactgtctccctacagtgggcatca

SEQ ID NO: 554021 - DNA, 25 bp, Rattus norvegicus
tactgtctcccttcagtgggcatca

SEQ ID NO: 554022 - DNA, 25 bp, Rattus norvegicus
tactgtctctttcggaagcttccga

SEQ ID NO: 554023 - DNA, 25 bp, Rattus norvegicus
tactgtctctttgggaagcttccga

SEQ ID NO: 554024 - DNA, 25 bp, Rattus norvegicus
tactgtctgcctactgcaggagaca

SEQ ID NO: 554025 - DNA, 25 bp, Rattus norvegicus
tactgtctgccttctgcaggagaca

SEQ ID NO: 554026 - DNA, 25 bp, Rattus norvegicus
tactgtctgtaaatgcatctgccct

SEQ ID NO: 554027 - DNA, 25 bp, Rattus norvegicus
tactgtctgtaattgcatctgccct

SEQ ID NO: 554028 - DNA, 25 bp, Rattus norvegicus
tactgtctgtacattttctgtaatg

SEQ ID NO: 554029 - DNA, 25 bp, Rattus norvegicus
tactgtctgtactttttctgtaatg

SEQ ID NO: 554030 - DNA, 25 bp, Rattus norvegicus
tactgtctgtgaccaccacaagaca

SEQ ID NO: 554031 - DNA, 25 bp, Rattus norvegicus
tactgtctgtgagcaccacaagaca

SEQ ID NO: 554032 - DNA, 25 bp, Rattus norvegicus
tactgtctgttacctgtaatctcta

SEQ ID NO: 554033 - DNA, 25 bp, Rattus norvegicus
tactgtctgttagctgtaatctcta

SEQ ID NO: 554034 - DNA, 25 bp, Rattus norvegicus
tactgtctgtttaggccagggtgca

SEQ ID NO: 554035 - DNA, 25 bp, Rattus norvegicus
tactgtctgtttctgactggctggc

SEQ ID NO: 554036 - DNA, 25 bp, Rattus norvegicus
tactgtctgtttgtgactggctggc

SEQ ID NO: 554037 - DNA, 25 bp, Rattus norvegicus
tactgtctgttttggccagggtgca

SEQ ID NO: 554038 - DNA, 25 bp, Rattus norvegicus
tactgtcttaatccctgcagaacat

SEQ ID NO: 554039 - DNA, 25 bp, Rattus norvegicus
tactgtcttaatgcctgcagaacat

SEQ ID NO: 554040 - DNA, 25 bp, Rattus norvegicus
tactgtcttagtctcaatggcgggt

SEQ ID NO: 554041 - DNA, 25 bp, Rattus norvegicus
tactgtcttagtgtcaatggcgggt

SEQ ID NO: 554042 - DNA, 25 bp, Rattus norvegicus
tactgtgaacagagactcctggtca

SEQ ID NO: 554043 - DNA, 25 bp, Rattus norvegicus
tactgtgaacagtgactcctggtca

SEQ ID NO: 554044 - DNA, 25 bp, Rattus norvegicus
tactgtgaagcaaccgtctcagggc

SEQ ID NO: 554045 - DNA, 25 bp, Rattus norvegicus
tactgtgaagcatccgtctcagggc

SEQ ID NO: 554046 - DNA, 25 bp, Rattus norvegicus
tactgtgaagttaaggaacccctgt

SEQ ID NO: 554047 - DNA, 25 bp, Rattus norvegicus
tactgtgaagtttaggaacccctgt

SEQ ID NO: 554048 - DNA, 25 bp, Rattus norvegicus
tactgtgaatcaattggcctctcca

SEQ ID NO: 554049 - DNA, 25 bp, Rattus norvegicus
tactgtgaatcatttggcctctcca

SEQ ID NO: 554050 - DNA, 25 bp, Rattus norvegicus
tactgtgaatgaccgaagtgacatc

SEQ ID NO: 554051 - DNA, 25 bp, Rattus norvegicus
tactgtgaatgagcgaagtgacatc

SEQ ID NO: 554052 - DNA, 25 bp, Rattus norvegicus
tactgtgaccgcaggcccaacaaac

SEQ ID NO: 554053 - DNA, 25 bp, Rattus norvegicus
tactgtgaccgctggcccaacaaac

SEQ ID NO: 554054 - DNA, 25 bp, Rattus norvegicus
tactgtgaccttcaggagatcatgc

SEQ ID NO: 554055 - DNA, 25 bp, Rattus norvegicus
tactgtgaccttgaggagatcatgc

SEQ ID NO: 554056 - DNA, 25 bp, Rattus norvegicus
tactgtgactgaacgtggagctctc

SEQ ID NO: 554057 - DNA, 25 bp, Rattus norvegicus
tactgtgactgatcgtggagctctc

SEQ ID NO: 554058 - DNA, 25 bp, Rattus norvegicus
tactgtgagaaccagccgatgcttc

SEQ ID NO: 554059 - DNA, 25 bp, Rattus norvegicus
tactgtgagaacgagccgatgcttc

SEQ ID NO: 554060 - DNA, 25 bp, Rattus norvegicus
tactgtgagctcaatcttctcggaa

SEQ ID NO: 554061 - DNA, 25 bp, Rattus norvegicus
tactgtgagctctatcttctcggaa

SEQ ID NO: 554062 - DNA, 25 bp, Rattus norvegicus
tactgtgaggacaggctacactcct

SEQ ID NO: 554063 - DNA, 25 bp, Rattus norvegicus
tactgtgaggactggctacactcct

SEQ ID NO: 554064 - DNA, 25 bp, Rattus norvegicus
tactgtgagtgaacccagtcacctt

SEQ ID NO: 554065 - DNA, 25 bp, Rattus norvegicus
tactgtgagtgatcccagtcacctt

SEQ ID NO: 554066 - DNA, 25 bp, Rattus norvegicus
tactgtgatcctaggctctggctat

SEQ ID NO: 554067 - DNA, 25 bp, Rattus norvegicus
tactgtgatccttggctctggctat

SEQ ID NO: 554068 - DNA, 25 bp, Rattus norvegicus
tactgtgatgttcgacaccacccag

SEQ ID NO: 554069 - DNA, 25 bp, Rattus norvegicus
tactgtgatgttggacaccacccag

SEQ ID NO: 554070 - DNA, 25 bp, Rattus norvegicus
tactgtgatttacacctgaggccgt

SEQ ID NO: 554071 - DNA, 25 bp, Rattus norvegicus
tactgtgatttagacctgaggccgt

SEQ ID NO: 554072 - DNA, 25 bp, Rattus norvegicus
tactgtgcaaaaagacaaggaagca

SEQ ID NO: 554073 - DNA, 25 bp, Rattus norvegicus
tactgtgcaaaatgacaaggaagca

SEQ ID NO: 554074 - DNA, 25 bp, Rattus norvegicus
tactgtgcacataagcaggcccata

SEQ ID NO: 554075 - DNA, 25 bp, Rattus norvegicus
tactgtgcacattagcaggcccata

SEQ ID NO: 554076 - DNA, 25 bp, Rattus norvegicus
tactgtgcacttaaatcattccaaa

SEQ ID NO: 554077 - DNA, 25 bp, Rattus norvegicus
tactgtgcactttaatcattccaaa

SEQ ID NO: 554078 - DNA, 25 bp, Rattus norvegicus
tactgtgcatagctctctgtcacgg

SEQ ID NO: 554079 - DNA, 25 bp, Rattus norvegicus
tactgtgcataggtctctgtcacgg

SEQ ID NO: 554080 - DNA, 25 bp, Rattus norvegicus
tactgtgccagacttggtttatatg

SEQ ID NO: 554081 - DNA, 25 bp, Rattus norvegicus
tactgtgccagagttggtttatatg

SEQ ID NO: 554082 - DNA, 25 bp, Rattus norvegicus
tactgtgccatgagcctggtgcctg

SEQ ID NO: 554083 - DNA, 25 bp, Rattus norvegicus
tactgtgccatgtgcctggtgcctg

SEQ ID NO: 554084 - DNA, 25 bp, Rattus norvegicus
tactgtgccgagaagccgcaatgac

SEQ ID NO: 554085 - DNA, 25 bp, Rattus norvegicus
tactgtgccgagtagccgcaatgac

SEQ ID NO: 554086 - DNA, 25 bp, Rattus norvegicus
tactgtgcctagctcaccgaggaag

SEQ ID NO: 554087 - DNA, 25 bp, Rattus norvegicus
tactgtgcctaggtcaccgaggaag

SEQ ID NO: 554088 - DNA, 25 bp, Rattus norvegicus
tactgtgccttaattgtgaactttt

SEQ ID NO: 554089 - DNA, 25 bp, Rattus norvegicus
tactgtgccttatttgtgaactttt

SEQ ID NO: 554090 - DNA, 25 bp, Rattus norvegicus
tactgtgcgttcaagttctacctaa

SEQ ID NO: 554091 - DNA, 25 bp, Rattus norvegicus
tactgtgcgttctagttctacctaa

SEQ ID NO: 554092 - DNA, 25 bp, Rattus norvegicus
tactgtgctaagacaccacgaccaa

SEQ ID NO: 554093 - DNA, 25 bp, Rattus norvegicus
tactgtgctaagtcaccacgaccaa

SEQ ID NO: 554094 - DNA, 25 bp, Rattus norvegicus
tactgtgctcagatctcttctctcg

SEQ ID NO: 554095 - DNA, 25 bp, Rattus norvegicus
tactgtgctcagttctcttctctcg

SEQ ID NO: 554096 - DNA, 25 bp, Rattus norvegicus
tactgtgctctcctagctactgtag

SEQ ID NO: 554097 - DNA, 25 bp, Rattus norvegicus
tactgtgctctcgtagctactgtag

SEQ ID NO: 554098 - DNA, 25 bp, Rattus norvegicus
tactgtgctcttcgatctcaacgac

SEQ ID NO: 554099 - DNA, 25 bp, Rattus norvegicus
tactgtgctcttggatctcaacgac

SEQ ID NO: 554100 - DNA, 25 bp, Rattus norvegicus
tactgtgctgccattgattttcttt

SEQ ID NO: 554101 - DNA, 25 bp, Rattus norvegicus
tactgtgctgcctttgattttcttt

SEQ ID NO: 554102 - DNA, 25 bp, Rattus norvegicus
tactgtgctgctccgaagcattgga

SEQ ID NO: 554103 - DNA, 25 bp, Rattus norvegicus
tactgtgctgctctctcctgaaaca

SEQ ID NO: 554104 - DNA, 25 bp, Rattus norvegicus
tactgtgctgctgcgaagcattgga

SEQ ID NO: 554105 - DNA, 25 bp, Rattus norvegicus
tactgtgctgctgtctcctgaaaca

SEQ ID NO: 554106 - DNA, 25 bp, Rattus norvegicus
tactgtgctgtaactgtctctgtgt

SEQ ID NO: 554107 - DNA, 25 bp, Rattus norvegicus
tactgtgctgtatctgtctctgtgt

SEQ ID NO: 554108 - DNA, 25 bp, Rattus norvegicus
tactgtgctgtcaaaggactccctg

SEQ ID NO: 554109 - DNA, 25 bp, Rattus norvegicus
tactgtgctgtctaaggactccctg

SEQ ID NO: 554110 - DNA, 25 bp, Rattus norvegicus
tactgtgcttagacattgcctcaag

SEQ ID NO: 554111 - DNA, 25 bp, Rattus norvegicus
tactgtgcttagtcattgcctcaag

SEQ ID NO: 554112 - DNA, 25 bp, Rattus norvegicus
tactgtgcttctaccttgtcacttt

SEQ ID NO: 554113 - DNA, 25 bp, Rattus norvegicus
tactgtgcttcttccttgtcacttt

SEQ ID NO: 554114 - DNA, 25 bp, Rattus norvegicus
tactgtggactcaactctatgccta

SEQ ID NO: 554115 - DNA, 25 bp, Rattus norvegicus
tactgtggactctactctatgccta

SEQ ID NO: 554116 - DNA, 25 bp, Rattus norvegicus
tactgtggatttctttttgccttaa

SEQ ID NO: 554117 - DNA, 25 bp, Rattus norvegicus
tactgtggatttgtttttgccttaa

SEQ ID NO: 554118 - DNA, 25 bp, Rattus norvegicus
tactgtggcagtctcttgttcatgg

SEQ ID NO: 554119 - DNA, 25 bp, Rattus norvegicus
tactgtggcagtgtcttgttcatgg

SEQ ID NO: 554120 - DNA, 25 bp, Rattus norvegicus
tactgtggccaaaaccgaagcttcc

SEQ ID NO: 554121 - DNA, 25 bp, Rattus norvegicus
tactgtggccaataccgaagcttcc

SEQ ID NO: 554122 - DNA, 25 bp, Rattus norvegicus
tactgtggcgagaacctgtggcttg

SEQ ID NO: 554123 - DNA, 25 bp, Rattus norvegicus
tactgtggcgagtacctgtggcttg

SEQ ID NO: 554124 - DNA, 25 bp, Rattus norvegicus
tactgtggcttgaacaatttttcag

SEQ ID NO: 554125 - DNA, 25 bp, Rattus norvegicus
tactgtggcttgtacaatttttcag

SEQ ID NO: 554126 - DNA, 25 bp, Rattus norvegicus
tactgtgggattatggaatacggct

SEQ ID NO: 554127 - DNA, 25 bp, Rattus norvegicus
tactgtgggattttggaatacggct

SEQ ID NO: 554128 - DNA, 25 bp, Rattus norvegicus
tactgtgggtcacttgtgctgcact

SEQ ID NO: 554129 - DNA, 25 bp, Rattus norvegicus
tactgtgggtcagttgtgctgcact

SEQ ID NO: 554130 - DNA, 25 bp, Rattus norvegicus
tactgtggtattccacctagccctg

SEQ ID NO: 554131 - DNA, 25 bp, Rattus norvegicus
tactgtggtattgcacctagccctg

SEQ ID NO: 554132 - DNA, 25 bp, Rattus norvegicus
tactgtggtcatagttaatccgtca

SEQ ID NO: 554133 - DNA, 25 bp, Rattus norvegicus
tactgtggtcattgttaatccgtca

SEQ ID NO: 554134 - DNA, 25 bp, Rattus norvegicus
tactgtggtgtgagcgtatctctcc

SEQ ID NO: 554135 - DNA, 25 bp, Rattus norvegicus
tactgtggtgtgtgcgtatctctcc

SEQ ID NO: 554136 - DNA, 25 bp, Rattus norvegicus
tactgtgtaacaatgctgggcttcc

SEQ ID NO: 554137 - DNA, 25 bp, Rattus norvegicus
tactgtgtaacattgctgggcttcc

SEQ ID NO: 554138 - DNA, 25 bp, Rattus norvegicus
tactgtgtaactactagctgctggt

SEQ ID NO: 554139 - DNA, 25 bp, Rattus norvegicus
tactgtgtaacttctagctgctggt

SEQ ID NO: 554140 - DNA, 25 bp, Rattus norvegicus
tactgtgtaagtatgcctggctcct

SEQ ID NO: 554141 - DNA, 25 bp, Rattus norvegicus
tactgtgtaagtttgcctggctcct

SEQ ID NO: 554142 - DNA, 25 bp, Rattus norvegicus
tactgtgtatatacactcctggaca

SEQ ID NO: 554143 - DNA, 25 bp, Rattus norvegicus
tactgtgtatattcactcctggaca

SEQ ID NO: 554144 - DNA, 25 bp, Rattus norvegicus
tactgtgtatcacagggctccttgc

SEQ ID NO: 554145 - DNA, 25 bp, Rattus norvegicus
tactgtgtatcagagggctccttgc

SEQ ID NO: 554146 - DNA, 25 bp, Rattus norvegicus
tactgtgtattcatttccctcctaa

SEQ ID NO: 554147 - DNA, 25 bp, Rattus norvegicus
tactgtgtattcttttccctcctaa

SEQ ID NO: 554148 - DNA, 25 bp, Rattus norvegicus
tactgtgtatttctcagaaccccac

SEQ ID NO: 554149 - DNA, 25 bp, Rattus norvegicus
tactgtgtatttgtcagaaccccac

SEQ ID NO: 554150 - DNA, 25 bp, Rattus norvegicus
tactgtgtcagaatgcccatctttt

SEQ ID NO: 554151 - DNA, 25 bp, Rattus norvegicus
tactgtgtcagattgcccatctttt

SEQ ID NO: 554152 - DNA, 25 bp, Rattus norvegicus
tactgtgtcagtaaccttcgggaca

SEQ ID NO: 554153 - DNA, 25 bp, Rattus norvegicus
tactgtgtcagttaccttcgggaca

SEQ ID NO: 554154 - DNA, 25 bp, Rattus norvegicus
tactgtgtctccaagtttggcttgg

SEQ ID NO: 554155 - DNA, 25 bp, Rattus norvegicus
tactgtgtctcctagtttggcttgg

SEQ ID NO: 554156 - DNA, 25 bp, Rattus norvegicus
tactgtgtctctaaaaccttttctt

SEQ ID NO: 554157 - DNA, 25 bp, Rattus norvegicus
tactgtgtctcttaaaccttttctt

SEQ ID NO: 554158 - DNA, 25 bp, Rattus norvegicus
tactgtgtgagccagccttctcgac

SEQ ID NO: 554159 - DNA, 25 bp, Rattus norvegicus
tactgtgtgagcgagccttctcgac

SEQ ID NO: 554160 - DNA, 25 bp, Rattus norvegicus
tactgtgtgcaccagacagggccga

SEQ ID NO: 554161 - DNA, 25 bp, Rattus norvegicus
tactgtgtgcacgagacagggccga

SEQ ID NO: 554162 - DNA, 25 bp, Rattus norvegicus
tactgtgtgcccctcatagattggt

SEQ ID NO: 554163 - DNA, 25 bp, Rattus norvegicus
tactgtgtgcccgtcatagattggt

SEQ ID NO: 554164 - DNA, 25 bp, Rattus norvegicus
tactgtgtgtggaccctgttgctga

SEQ ID NO: 554165 - DNA, 25 bp, Rattus norvegicus
tactgtgtgtggcaggagcctcatc

SEQ ID NO: 554166 - DNA, 25 bp, Rattus norvegicus
tactgtgtgtgggaggagcctcatc

SEQ ID NO: 554167 - DNA, 25 bp, Rattus norvegicus
tactgtgtgtggtccctgttgctga

SEQ ID NO: 554168 - DNA, 25 bp, Rattus norvegicus
tactgtgttgaacagctccaccctt

SEQ ID NO: 554169 - DNA, 25 bp, Rattus norvegicus
tactgtgttgaagagctccaccctt

SEQ ID NO: 554170 - DNA, 25 bp, Rattus norvegicus
tactgtgttgagatggcactgtaca

SEQ ID NO: 554171 - DNA, 25 bp, Rattus norvegicus
tactgtgttgagttggcactgtaca

SEQ ID NO: 554172 - DNA, 25 bp, Rattus norvegicus
tactgtgtttacacgaaattttctt

SEQ ID NO: 554173 - DNA, 25 bp, Rattus norvegicus
tactgtgtttactcgaaattttctt

SEQ ID NO: 554174 - DNA, 25 bp, Rattus norvegicus
tactgtgtttccagctctagctaga

SEQ ID NO: 554175 - DNA, 25 bp, Rattus norvegicus
tactgtgtttcctgctctagctaga

SEQ ID NO: 554176 - DNA, 25 bp, Rattus norvegicus
tactgtgtttctagtcctggtatat

SEQ ID NO: 554177 - DNA, 25 bp, Rattus norvegicus
tactgtgtttcttgtcctggtatat

SEQ ID NO: 554178 - DNA, 25 bp, Rattus norvegicus
tactgtgtttttcactgtttctaaa

SEQ ID NO: 554179 - DNA, 25 bp, Rattus norvegicus
tactgtgtttttgactgtttctaaa

SEQ ID NO: 554180 - DNA, 25 bp, Rattus norvegicus
tactgttaaattagcatggcgtttc

SEQ ID NO: 554181 - DNA, 25 bp, Rattus norvegicus
tactgttaaatttgcatggcgtttc

SEQ ID NO: 554182 - DNA, 25 bp, Rattus norvegicus
tactgttaatctaatctctggtgcc

SEQ ID NO: 554183 - DNA, 25 bp, Rattus norvegicus
tactgttaatcttatctctggtgcc

SEQ ID NO: 554184 - DNA, 25 bp, Rattus norvegicus
tactgttaccaccagcactagcaga

SEQ ID NO: 554185 - DNA, 25 bp, Rattus norvegicus
tactgttaccacgagcactagcaga

SEQ ID NO: 554186 - DNA, 25 bp, Rattus norvegicus
tactgttataagactagctgctaaa

SEQ ID NO: 554187 - DNA, 25 bp, Rattus norvegicus
tactgttataagtctagctgctaaa

SEQ ID NO: 554188 - DNA, 25 bp, Rattus norvegicus
tactgttcaaatcgtcgtttccctt

SEQ ID NO: 554189 - DNA, 25 bp, Rattus norvegicus
tactgttcaaatggtcgtttccctt

SEQ ID NO: 554190 - DNA, 25 bp, Rattus norvegicus
tactgttcacagaccaatcatcttg

SEQ ID NO: 554191 - DNA, 25 bp, Rattus norvegicus
tactgttcacagtccaatcatcttg

SEQ ID NO: 554192 - DNA, 25 bp, Rattus norvegicus
tactgttcagcaaaacctggccaaa

SEQ ID NO: 554193 - DNA, 25 bp, Rattus norvegicus
tactgttcagcaagagtcgttatca

SEQ ID NO: 554194 - DNA, 25 bp, Rattus norvegicus
tactgttcagcataacctggccaaa

SEQ ID NO: 554195 - DNA, 25 bp, Rattus norvegicus
tactgttcagcatgagtcgttatca

SEQ ID NO: 554196 - DNA, 25 bp, Rattus norvegicus
tactgttcctccaccagtgaggtca

SEQ ID NO: 554197 - DNA, 25 bp, Rattus norvegicus
tactgttcctcctccagtgaggtca

SEQ ID NO: 554198 - DNA, 25 bp, Rattus norvegicus
tactgttcctgcctgtggtctcact

SEQ ID NO: 554199 - DNA, 25 bp, Rattus norvegicus
tactgttcctgcgtgtggtctcact

SEQ ID NO: 554200 - DNA, 25 bp, Rattus norvegicus
tactgttcgttcagatggctcagcc

SEQ ID NO: 554201 - DNA, 25 bp, Rattus norvegicus
tactgttcgttctgatggctcagcc

SEQ ID NO: 554202 - DNA, 25 bp, Rattus norvegicus
tactgttctcatcctgccctgacaa

SEQ ID NO: 554203 - DNA, 25 bp, Rattus norvegicus
tactgttctcatgctgccctgacaa

SEQ ID NO: 554204 - DNA, 25 bp, Rattus norvegicus
tactgttctctcagtgtgaactcag

SEQ ID NO: 554205 - DNA, 25 bp, Rattus norvegicus
tactgttctctctgtgtgaactcag

SEQ ID NO: 554206 - DNA, 25 bp, Rattus norvegicus
tactgttctggcaagtgagatgaca

SEQ ID NO: 554207 - DNA, 25 bp, Rattus norvegicus
tactgttctggctagtgagatgaca

SEQ ID NO: 554208 - DNA, 25 bp, Rattus norvegicus
tactgttcttgcctgcagatcgacc

SEQ ID NO: 554209 - DNA, 25 bp, Rattus norvegicus
tactgttcttgcgtgcagatcgacc

SEQ ID NO: 554210 - DNA, 25 bp, Rattus norvegicus
tactgttctttgcaagcttgccaca

SEQ ID NO: 554211 - DNA, 25 bp, Rattus norvegicus
tactgttctttggaagcttgccaca

SEQ ID NO: 554212 - DNA, 25 bp, Rattus norvegicus
tactgttgacagaaaggaggtcctc

SEQ ID NO: 554213 - DNA, 25 bp, Rattus norvegicus
tactgttgacagtaaggaggtcctc

SEQ ID NO: 554214 - DNA, 25 bp, Rattus norvegicus
tactgttgcagcattttcgaccttc

SEQ ID NO: 554215 - DNA, 25 bp, Rattus norvegicus
tactgttgcagctttttcgaccttc

SEQ ID NO: 554216 - DNA, 25 bp, Rattus norvegicus
tactgttgcattcactcatttcttg

SEQ ID NO: 554217 - DNA, 25 bp, Rattus norvegicus
tactgttgcattgactcatttcttg

SEQ ID NO: 554218 - DNA, 25 bp, Rattus norvegicus
tactgttgctgtactgctcttgata

SEQ ID NO: 554219 - DNA, 25 bp, Rattus norvegicus
tactgttgctgttctgctcttgata

SEQ ID NO: 554220 - DNA, 25 bp, Rattus norvegicus
tactgttggacacaacgagcagaca

SEQ ID NO: 554221 - DNA, 25 bp, Rattus norvegicus
tactgttggacagaacgagcagaca

SEQ ID NO: 554222 - DNA, 25 bp, Rattus norvegicus
tactgtttaagtctcaggtcctgaa

SEQ ID NO: 554223 - DNA, 25 bp, Rattus norvegicus
tactgtttaagtgtcaggtcctgaa

SEQ ID NO: 554224 - DNA, 25 bp, Rattus norvegicus
tactgtttactgcaattccttctgt

SEQ ID NO: 554225 - DNA, 25 bp, Rattus norvegicus
tactgtttactggaattccttctgt

SEQ ID NO: 554226 - DNA, 25 bp, Rattus norvegicus
tactgtttacttatagcccatagtt

SEQ ID NO: 554227 - DNA, 25 bp, Rattus norvegicus
tactgtttacttttagcccatagtt

SEQ ID NO: 554228 - DNA, 25 bp, Rattus norvegicus
tactgtttagctactacacattgaa

SEQ ID NO: 554229 - DNA, 25 bp, Rattus norvegicus
tactgtttagcttctacacattgaa

SEQ ID NO: 554230 - DNA, 25 bp, Rattus norvegicus
tactgtttcacgctgtgacgttatg

SEQ ID NO: 554231 - DNA, 25 bp, Rattus norvegicus
tactgtttcacggtgtgacgttatg

SEQ ID NO: 554232 - DNA, 25 bp, Rattus norvegicus
tactgtttcatgctgatggtgccat

SEQ ID NO: 554233 - DNA, 25 bp, Rattus norvegicus
tactgtttcatggtgatggtgccat

SEQ ID NO: 554234 - DNA, 25 bp, Rattus norvegicus
tactgtttgactcggtgtggcactc

SEQ ID NO: 554235 - DNA, 25 bp, Rattus norvegicus
tactgtttgactgggtgtggcactc

SEQ ID NO: 554236 - DNA, 25 bp, Rattus norvegicus
tactgtttgctgagtgtttcttcca

SEQ ID NO: 554237 - DNA, 25 bp, Rattus norvegicus
tactgtttgctgtgtgtttcttcca

SEQ ID NO: 554238 - DNA, 25 bp, Rattus norvegicus
tactgttttaataatctgccgtctt

SEQ ID NO: 554239 - DNA, 25 bp, Rattus norvegicus
tactgttttaattatctgccgtctt

SEQ ID NO: 554240 - DNA, 25 bp, Rattus norvegicus
tactgttttactctcctcagagctg

SEQ ID NO: 554241 - DNA, 25 bp, Rattus norvegicus
tactgttttactgtcctcagagctg

SEQ ID NO: 554242 - DNA, 25 bp, Rattus norvegicus
tactgttttatcatcatactttgga

SEQ ID NO: 554243 - DNA, 25 bp, Rattus norvegicus
tactgttttatcttcatactttgga

SEQ ID NO: 554244 - DNA, 25 bp, Rattus norvegicus
tactgttttctgcacctctggtaat

SEQ ID NO: 554245 - DNA, 25 bp, Rattus norvegicus
tactgttttctgcttgctggttaaa

SEQ ID NO: 554246 - DNA, 25 bp, Rattus norvegicus
tactgttttctggacctctggtaat

SEQ ID NO: 554247 - DNA, 25 bp, Rattus norvegicus
tactgttttctggttgctggttaaa

SEQ ID NO: 554248 - DNA, 25 bp, Rattus norvegicus
tactgttttcttccccaacataatt

SEQ ID NO: 554249 - DNA, 25 bp, Rattus norvegicus
tactgttttcttgcccaacataatt

SEQ ID NO: 554250 - DNA, 25 bp, Rattus norvegicus
tacttaacccgtcagggaccaggct

SEQ ID NO: 554251 - DNA, 25 bp, Rattus norvegicus
tacttaacccgtgagggaccaggct

SEQ ID NO: 554252 - DNA, 25 bp, Rattus norvegicus
tacttaacctgcagttccttccaaa

SEQ ID NO: 554253 - DNA, 25 bp, Rattus norvegicus
tacttaacctgctgttccttccaaa

SEQ ID NO: 554254 - DNA, 25 bp, Rattus norvegicus
tacttaaccttaatgcttcaacttg

SEQ ID NO: 554255 - DNA, 25 bp, Rattus norvegicus
tacttaaccttattgcttcaacttg

SEQ ID NO: 554256 - DNA, 25 bp, Rattus norvegicus
tacttaagaaacacgcttcccttca

SEQ ID NO: 554257 - DNA, 25 bp, Rattus norvegicus
tacttaagaaactcgcttcccttca

SEQ ID NO: 554258 - DNA, 25 bp, Rattus norvegicus
tacttaagagtccagcaggtccgat

SEQ ID NO: 554259 - DNA, 25 bp, Rattus norvegicus
tacttaagagtcgagcaggtccgat

SEQ ID NO: 554260 - DNA, 25 bp, Rattus norvegicus
tacttaagagtgagagaggccccaa

SEQ ID NO: 554261 - DNA, 25 bp, Rattus norvegicus
tacttaagagtgtgagaggccccaa

SEQ ID NO: 554262 - DNA, 25 bp, Rattus norvegicus
tacttaatatagatgacgtgttgat

SEQ ID NO: 554263 - DNA, 25 bp, Rattus norvegicus
tacttaatatagttgacgtgttgat

SEQ ID NO: 554264 - DNA, 25 bp, Rattus norvegicus
tacttaatcacgcagggctacccaa

SEQ ID NO: 554265 - DNA, 25 bp, Rattus norvegicus
tacttaatcacggagggctacccaa

SEQ ID NO: 554266 - DNA, 25 bp, Rattus norvegicus
tacttaatccttagtcctcttcaca

SEQ ID NO: 554267 - DNA, 25 bp, Rattus norvegicus
tacttaatcctttgtcctcttcaca

SEQ ID NO: 554268 - DNA, 25 bp, Rattus norvegicus
tacttaatgttccactcctgtataa

SEQ ID NO: 554269 - DNA, 25 bp, Rattus norvegicus
tacttaatgttcgactcctgtataa

SEQ ID NO: 554270 - DNA, 25 bp, Rattus norvegicus
tacttaatttctcgagttcgggcct

SEQ ID NO: 554271 - DNA, 25 bp, Rattus norvegicus
tacttaatttctggagttcgggcct

SEQ ID NO: 554272 - DNA, 25 bp, Rattus norvegicus
tacttacaatcccaacctgttagtc

SEQ ID NO: 554273 - DNA, 25 bp, Rattus norvegicus
tacttacaatccgaacctgttagtc

SEQ ID NO: 554274 - DNA, 25 bp, Rattus norvegicus
tacttacacccaaccattttattga

SEQ ID NO: 554275 - DNA, 25 bp, Rattus norvegicus
tacttacacccaaccgttgaactga

SEQ ID NO: 554276 - DNA, 25 bp, Rattus norvegicus
tacttacacccatccattttattga

SEQ ID NO: 554277 - DNA, 25 bp, Rattus norvegicus
tacttacacccatccgttgaactga

SEQ ID NO: 554278 - DNA, 25 bp, Rattus norvegicus
tacttacattgtacacttgaactgt

SEQ ID NO: 554279 - DNA, 25 bp, Rattus norvegicus
tacttacattgttcacttgaactgt

SEQ ID NO: 554280 - DNA, 25 bp, Rattus norvegicus
tacttaccacgccatcattggaggg

SEQ ID NO: 554281 - DNA, 25 bp, Rattus norvegicus
tacttaccacgcgatcattggaggg

SEQ ID NO: 554282 - DNA, 25 bp, Rattus norvegicus
tacttaccatcaagagcgctagcaa

SEQ ID NO: 554283 - DNA, 25 bp, Rattus norvegicus
tacttaccatcatgagcgctagcaa

SEQ ID NO: 554284 - DNA, 25 bp, Rattus norvegicus
tacttacccactaatgtccggatga

SEQ ID NO: 554285 - DNA, 25 bp, Rattus norvegicus
tacttacccacttatgtccggatga

SEQ ID NO: 554286 - DNA, 25 bp, Rattus norvegicus
tacttacctcgtaagcggttcagaa

SEQ ID NO: 554287 - DNA, 25 bp, Rattus norvegicus
tacttacctcgttagcggttcagaa

SEQ ID NO: 554288 - DNA, 25 bp, Rattus norvegicus
tacttacctgtaattgccactgaaa

SEQ ID NO: 554289 - DNA, 25 bp, Rattus norvegicus
tacttacctgtatttgccactgaaa

SEQ ID NO: 554290 - DNA, 25 bp, Rattus norvegicus
tacttacctttaactgccagcattt

SEQ ID NO: 554291 - DNA, 25 bp, Rattus norvegicus
tacttacctttatctgccagcattt

SEQ ID NO: 554292 - DNA, 25 bp, Rattus norvegicus
tacttactgagtctctgctatgggc

SEQ ID NO: 554293 - DNA, 25 bp, Rattus norvegicus
tacttactgagtgtctgctatgggc

SEQ ID NO: 554294 - DNA, 25 bp, Rattus norvegicus
tacttactgcctctttccactgaaa

SEQ ID NO: 554295 - DNA, 25 bp, Rattus norvegicus
tacttactgcctgtttccactgaaa

SEQ ID NO: 554296 - DNA, 25 bp, Rattus norvegicus
tacttactgtctctggttgcatatg

SEQ ID NO: 554297 - DNA, 25 bp, Rattus norvegicus
tacttactgtctgtggttgcatatg

SEQ ID NO: 554298 - DNA, 25 bp, Rattus norvegicus
tacttactgtgtcccaggcacctgg

SEQ ID NO: 554299 - DNA, 25 bp, Rattus norvegicus
tacttactgtgtgccaggcacctgg

SEQ ID NO: 554300 - DNA, 25 bp, Rattus norvegicus
tacttacttctactggaggctgcgc

SEQ ID NO: 554301 - DNA, 25 bp, Rattus norvegicus
tacttacttctagtggaggctgcgc

SEQ ID NO: 554302 - DNA, 25 bp, Rattus norvegicus
tacttacttctgattgactcgttgc

SEQ ID NO: 554303 - DNA, 25 bp, Rattus norvegicus
tacttacttctgtttgactcgttgc

SEQ ID NO: 554304 - DNA, 25 bp, Rattus norvegicus
tacttagacaatcccttccatccaa

SEQ ID NO: 554305 - DNA, 25 bp, Rattus norvegicus
tacttagacaatgccttccatccaa

SEQ ID NO: 554306 - DNA, 25 bp, Rattus norvegicus
tacttagacatcacggagtccgggc

SEQ ID NO: 554307 - DNA, 25 bp, Rattus norvegicus
tacttagacatctcggagtccgggc

SEQ ID NO: 554308 - DNA, 25 bp, Rattus norvegicus
tacttagagcagcaccaccctaggg

SEQ ID NO: 554309 - DNA, 25 bp, Rattus norvegicus
tacttagagcaggaccaccctaggg

SEQ ID NO: 554310 - DNA, 25 bp, Rattus norvegicus
tacttagcacatatactcgccacag

SEQ ID NO: 554311 - DNA, 25 bp, Rattus norvegicus
tacttagcacatttactcgccacag

SEQ ID NO: 554312 - DNA, 25 bp, Rattus norvegicus
tacttagcatggcacagttgtgggt

SEQ ID NO: 554313 - DNA, 25 bp, Rattus norvegicus
tacttagcatgggacagttgtgggt

SEQ ID NO: 554314 - DNA, 25 bp, Rattus norvegicus
tacttagcccctcagtattaccatg

SEQ ID NO: 554315 - DNA, 25 bp, Rattus norvegicus
tacttagcccctgagtattaccatg

SEQ ID NO: 554316 - DNA, 25 bp, Rattus norvegicus
tacttagccgctcatgaaattcaga

SEQ ID NO: 554317 - DNA, 25 bp, Rattus norvegicus
tacttagccgctgatgaaattcaga

SEQ ID NO: 554318 - DNA, 25 bp, Rattus norvegicus
tacttagcgcaactgacttctgcct

SEQ ID NO: 554319 - DNA, 25 bp, Rattus norvegicus
tacttagcgcaagtgacttctgcct

SEQ ID NO: 554320 - DNA, 25 bp, Rattus norvegicus
tacttaggtcacatggctggtccca

SEQ ID NO: 554321 - DNA, 25 bp, Rattus norvegicus
tacttaggtcacttggctggtccca

SEQ ID NO: 554322 - DNA, 25 bp, Rattus norvegicus
tacttagtaaagcacttatcaagct

SEQ ID NO: 554323 - DNA, 25 bp, Rattus norvegicus
tacttagtaaaggacttatcaagct

SEQ ID NO: 554324 - DNA, 25 bp, Rattus norvegicus
tacttagttttacttccttgtggat

SEQ ID NO: 554325 - DNA, 25 bp, Rattus norvegicus
tacttagttttagttccttgtggat

SEQ ID NO: 554326 - DNA, 25 bp, Rattus norvegicus
tacttatctagtatcttctttgtgt

SEQ ID NO: 554327 - DNA, 25 bp, Rattus norvegicus
tacttatctagtttcttctttgtgt

SEQ ID NO: 554328 - DNA, 25 bp, Rattus norvegicus
tacttatggtagcagagttgtcccc

SEQ ID NO: 554329 - DNA, 25 bp, Rattus norvegicus
tacttatggtaggagagttgtcccc

SEQ ID NO: 554330 - DNA, 25 bp, Rattus norvegicus
tacttatgtgaactcgctcctgcgc

SEQ ID NO: 554331 - DNA, 25 bp, Rattus norvegicus
tacttatgtgaagtcgctcctgcgc

SEQ ID NO: 554332 - DNA, 25 bp, Rattus norvegicus
tacttattcagcagaggacctcgac

SEQ ID NO: 554333 - DNA, 25 bp, Rattus norvegicus
tacttattcagctgaggacctcgac

SEQ ID NO: 554334 - DNA, 25 bp, Rattus norvegicus
tacttatttgtcatgctgtctgccc

SEQ ID NO: 554335 - DNA, 25 bp, Rattus norvegicus
tacttatttgtcttgctgtctgccc

SEQ ID NO: 554336 - DNA, 25 bp, Rattus norvegicus
tacttcaaagtcaccctgtacggaa

SEQ ID NO: 554337 - DNA, 25 bp, Rattus norvegicus
tacttcaaagtctccctgtacggaa

SEQ ID NO: 554338 - DNA, 25 bp, Rattus norvegicus
tacttcaagctgatccagggctatg

SEQ ID NO: 554339 - DNA, 25 bp, Rattus norvegicus
tacttcaagctgttccagggctatg

SEQ ID NO: 554340 - DNA, 25 bp, Rattus norvegicus
tacttcaagtggccggacgggccta

SEQ ID NO: 554341 - DNA, 25 bp, Rattus norvegicus
tacttcaagtgggcggacgggccta

SEQ ID NO: 554342 - DNA, 25 bp, Rattus norvegicus
tacttcacagagacggcaggcacct

SEQ ID NO: 554343 - DNA, 25 bp, Rattus norvegicus
tacttcacagagtcggcaggcacct

SEQ ID NO: 554344 - DNA, 25 bp, Rattus norvegicus
tacttcacatggaaagtccctctgc

SEQ ID NO: 554345 - DNA, 25 bp, Rattus norvegicus
tacttcacatggtaagtccctctgc

SEQ ID NO: 554346 - DNA, 25 bp, Rattus norvegicus
tacttcaccacgctgactgtggaga

SEQ ID NO: 554347 - DNA, 25 bp, Rattus norvegicus
tacttcaccacggtgactgtggaga

SEQ ID NO: 554348 - DNA, 25 bp, Rattus norvegicus
tacttcaccagtcgcctacaggctg

SEQ ID NO: 554349 - DNA, 25 bp, Rattus norvegicus
tacttcaccagtggcctacaggctg

SEQ ID NO: 554350 - DNA, 25 bp, Rattus norvegicus
tacttcacccacaagtcacttgtgt

SEQ ID NO: 554351 - DNA, 25 bp, Rattus norvegicus
tacttcacccactagtcacttgtgt

SEQ ID NO: 554352 - DNA, 25 bp, Rattus norvegicus
tacttcactgtgatgttaacttgga

SEQ ID NO: 554353 - DNA, 25 bp, Rattus norvegicus
tacttcactgtgttgttaacttgga

SEQ ID NO: 554354 - DNA, 25 bp, Rattus norvegicus
tacttcacttcacacacgatccaga

SEQ ID NO: 554355 - DNA, 25 bp, Rattus norvegicus
tacttcacttcagacacgatccaga

SEQ ID NO: 554356 - DNA, 25 bp, Rattus norvegicus
tacttcagaagccataataccccag

SEQ ID NO: 554357 - DNA, 25 bp, Rattus norvegicus
tacttcagaagcgataataccccag

SEQ ID NO: 554358 - DNA, 25 bp, Rattus norvegicus
tacttcagactgctgtggctcttga

SEQ ID NO: 554359 - DNA, 25 bp, Rattus norvegicus
tacttcagactggtgtggctcttga

SEQ ID NO: 554360 - DNA, 25 bp, Rattus norvegicus
tacttcagagacatcatccaggatg

SEQ ID NO: 554361 - DNA, 25 bp, Rattus norvegicus
tacttcagagacttcatccaggatg

SEQ ID NO: 554362 - DNA, 25 bp, Rattus norvegicus
tacttcagcaacagctccagtatcc

SEQ ID NO: 554363 - DNA, 25 bp, Rattus norvegicus
tacttcagcaactgctccagtatcc

SEQ ID NO: 554364 - DNA, 25 bp, Rattus norvegicus
tacttcagcctaagttactcgggag

SEQ ID NO: 554365 - DNA, 25 bp, Rattus norvegicus
tacttcagcctatgttactcgggag

SEQ ID NO: 554366 - DNA, 25 bp, Rattus norvegicus
tacttcagggacatcaggcctttga

SEQ ID NO: 554367 - DNA, 25 bp, Rattus norvegicus
tacttcagggacttcaggcctttga

SEQ ID NO: 554368 - DNA, 25 bp, Rattus norvegicus
tacttcagggctagtagtcctcttg

SEQ ID NO: 554369 - DNA, 25 bp, Rattus norvegicus
tacttcagggcttgtagtcctcttg

SEQ ID NO: 554370 - DNA, 25 bp, Rattus norvegicus
tacttcaggtttcactcctagtgga

SEQ ID NO: 554371 - DNA, 25 bp, Rattus norvegicus
tacttcaggtttgactcctagtgga

SEQ ID NO: 554372 - DNA, 25 bp, Rattus norvegicus
tacttcataccacgcctgtgagacc

SEQ ID NO: 554373 - DNA, 25 bp, Rattus norvegicus
tacttcataccaggcctgtgagacc

SEQ ID NO: 554374 - DNA, 25 bp, Rattus norvegicus
tacttcataggcacactgcactggg

SEQ ID NO: 554375 - DNA, 25 bp, Rattus norvegicus
tacttcataggcctagtgcttacta

SEQ ID NO: 554376 - DNA, 25 bp, Rattus norvegicus
tacttcataggcgtagtgcttacta

SEQ ID NO: 554377 - DNA, 25 bp, Rattus norvegicus
tacttcataggctcactgcactggg

SEQ ID NO: 554378 - DNA, 25 bp, Rattus norvegicus
tacttcatccctattcaaacttcag

SEQ ID NO: 554379 - DNA, 25 bp, Rattus norvegicus
tacttcatcccttttcaaacttcag

SEQ ID NO: 554380 - DNA, 25 bp, Rattus norvegicus
tacttcatgaacatctgtcggattg

SEQ ID NO: 554381 - DNA, 25 bp, Rattus norvegicus
tacttcatgaacttctgtcggattg

SEQ ID NO: 554382 - DNA, 25 bp, Rattus norvegicus
tacttcatggttactcttctgagga

SEQ ID NO: 554383 - DNA, 25 bp, Rattus norvegicus
tacttcatggtttctcttctgagga

SEQ ID NO: 554384 - DNA, 25 bp, Rattus norvegicus
tacttcatgttcactgccctgatgt

SEQ ID NO: 554385 - DNA, 25 bp, Rattus norvegicus
tacttcatgttctctgccctgatgt

SEQ ID NO: 554386 - DNA, 25 bp, Rattus norvegicus
tacttcattatcagactctgctttg

SEQ ID NO: 554387 - DNA, 25 bp, Rattus norvegicus
tacttcattatctgactctgctttg

SEQ ID NO: 554388 - DNA, 25 bp, Rattus norvegicus
tacttcattcttccaaagtttccaa

SEQ ID NO: 554389 - DNA, 25 bp, Rattus norvegicus
tacttcattcttgcaaagtttccaa

SEQ ID NO: 554390 - DNA, 25 bp, Rattus norvegicus
tacttccacagaacgcacgggattt

SEQ ID NO: 554391 - DNA, 25 bp, Rattus norvegicus
tacttccacagatcgcacgggattt

SEQ ID NO: 554392 - DNA, 25 bp, Rattus norvegicus
tacttccacggaacataagccacta

SEQ ID NO: 554393 - DNA, 25 bp, Rattus norvegicus
tacttccacggatcataagccacta

SEQ ID NO: 554394 - DNA, 25 bp, Rattus norvegicus
tacttccactctacgagggctggga

SEQ ID NO: 554395 - DNA, 25 bp, Rattus norvegicus
tacttccactcttcgagggctggga

SEQ ID NO: 554396 - DNA, 25 bp, Rattus norvegicus
tacttccacttcagggtcagcggag

SEQ ID NO: 554397 - DNA, 25 bp, Rattus norvegicus
tacttccacttctgggtcagcggag

SEQ ID NO: 554398 - DNA, 25 bp, Rattus norvegicus
tacttccacttgaacacttgactgt

SEQ ID NO: 554399 - DNA, 25 bp, Rattus norvegicus
tacttccacttgtacacttgactgt

SEQ ID NO: 554400 - DNA, 25 bp, Rattus norvegicus
tacttccagctgctctcaatgctaa

SEQ ID NO: 554401 - DNA, 25 bp, Rattus norvegicus
tacttccagctggtctcaatgctaa

SEQ ID NO: 554402 - DNA, 25 bp, Rattus norvegicus
tacttcccactgactaggcaaggct

SEQ ID NO: 554403 - DNA, 25 bp, Rattus norvegicus
tacttcccactgtctaggcaaggct

SEQ ID NO: 554404 - DNA, 25 bp, Rattus norvegicus
tacttcccacttaagagttgaccgg

SEQ ID NO: 554405 - DNA, 25 bp, Rattus norvegicus
tacttcccacttcataaacagccat

SEQ ID NO: 554406 - DNA, 25 bp, Rattus norvegicus
tacttcccacttgataaacagccat

SEQ ID NO: 554407 - DNA, 25 bp, Rattus norvegicus
tacttcccactttagagttgaccgg

SEQ ID NO: 554408 - DNA, 25 bp, Rattus norvegicus
tacttccccatactaatttacttag

SEQ ID NO: 554409 - DNA, 25 bp, Rattus norvegicus
tacttccccatagtaatttacttag

SEQ ID NO: 554410 - DNA, 25 bp, Rattus norvegicus
tacttcccggatcgtgtttattgcc

SEQ ID NO: 554411 - DNA, 25 bp, Rattus norvegicus
tacttcccggatggtgtttattgcc

SEQ ID NO: 554412 - DNA, 25 bp, Rattus norvegicus
tacttcccgtgaagttcttccaggg

SEQ ID NO: 554413 - DNA, 25 bp, Rattus norvegicus
tacttcccgtgatgttcttccaggg

SEQ ID NO: 554414 - DNA, 25 bp, Rattus norvegicus
tacttccctgccagtaagaaaatgg

SEQ ID NO: 554415 - DNA, 25 bp, Rattus norvegicus
tacttccctgcctgtaagaaaatgg

SEQ ID NO: 554416 - DNA, 25 bp, Rattus norvegicus
tacttccgactaagattttgataat

SEQ ID NO: 554417 - DNA, 25 bp, Rattus norvegicus
tacttccgactatgattttgataat

SEQ ID NO: 554418 - DNA, 25 bp, Rattus norvegicus
tacttccgcaagcacggtcgcaagc

SEQ ID NO: 554419 - DNA, 25 bp, Rattus norvegicus
tacttccgcaaggacggtcgcaagc

SEQ ID NO: 554420 - DNA, 25 bp, Rattus norvegicus
tacttccgggacctttagctgagag

SEQ ID NO: 554421 - DNA, 25 bp, Rattus norvegicus
tacttccgggacgtttagctgagag

SEQ ID NO: 554422 - DNA, 25 bp, Rattus norvegicus
tacttccgtcgcattgagtgtggga

SEQ ID NO: 554423 - DNA, 25 bp, Rattus norvegicus
tacttccgtcgctttgagtgtggga

SEQ ID NO: 554424 - DNA, 25 bp, Rattus norvegicus
tacttccgtgtcactgttcagaggc

SEQ ID NO: 554425 - DNA, 25 bp, Rattus norvegicus
tacttccgtgtctctgttcagaggc

SEQ ID NO: 554426 - DNA, 25 bp, Rattus norvegicus
tacttcctatttcccaactttttga

SEQ ID NO: 554427 - DNA, 25 bp, Rattus norvegicus
tacttcctatttgccaactttttga

SEQ ID NO: 554428 - DNA, 25 bp, Rattus norvegicus
tacttcctcattactgctgacagag

SEQ ID NO: 554429 - DNA, 25 bp, Rattus norvegicus
tacttcctcatttctgctgacagag

SEQ ID NO: 554430 - DNA, 25 bp, Rattus norvegicus
tacttcctccagaccatcaaggaat

SEQ ID NO: 554431 - DNA, 25 bp, Rattus norvegicus
tacttcctccagtccatcaaggaat

SEQ ID NO: 554432 - DNA, 25 bp, Rattus norvegicus
tacttcctctgaagccttgaccaga

SEQ ID NO: 554433 - DNA, 25 bp, Rattus norvegicus
tacttcctctgatgccttgaccaga

SEQ ID NO: 554434 - DNA, 25 bp, Rattus norvegicus
tacttcctcttgcttttgttgttac

SEQ ID NO: 554435 - DNA, 25 bp, Rattus norvegicus
tacttcctcttggttttgttgttac

SEQ ID NO: 554436 - DNA, 25 bp, Rattus norvegicus
tacttcctgaaaactgcctttccat

SEQ ID NO: 554437 - DNA, 25 bp, Rattus norvegicus
tacttcctgaaatctgcctttccat

SEQ ID NO: 554438 - DNA, 25 bp, Rattus norvegicus
tacttcctggttcccaagacaaaag

SEQ ID NO: 554439 - DNA, 25 bp, Rattus norvegicus
tacttcctggttgccaagacaaaag

SEQ ID NO: 554440 - DNA, 25 bp, Rattus norvegicus
tacttcctgtacagccgtggcggta

SEQ ID NO: 554441 - DNA, 25 bp, Rattus norvegicus
tacttcctgtactgccgtggcggta

SEQ ID NO: 554442 - DNA, 25 bp, Rattus norvegicus
tacttcctgttcacccagtgtgcta

SEQ ID NO: 554443 - DNA, 25 bp, Rattus norvegicus
tacttcctgttctcccagtgtgcta

SEQ ID NO: 554444 - DNA, 25 bp, Rattus norvegicus
tacttccttggtagtgtgcttttgc

SEQ ID NO: 554445 - DNA, 25 bp, Rattus norvegicus
tacttccttggttgtgtgcttttgc

SEQ ID NO: 554446 - DNA, 25 bp, Rattus norvegicus
tacttcctttccacatgctattatt

SEQ ID NO: 554447 - DNA, 25 bp, Rattus norvegicus
tacttcctttccagtctcatgtatg

SEQ ID NO: 554448 - DNA, 25 bp, Rattus norvegicus
tacttcctttcctcatgctattatt

SEQ ID NO: 554449 - DNA, 25 bp, Rattus norvegicus
tacttcctttcctgtctcatgtatg

SEQ ID NO: 554450 - DNA, 25 bp, Rattus norvegicus
tacttccttttcataattggctttg

SEQ ID NO: 554451 - DNA, 25 bp, Rattus norvegicus
tacttccttttcttaattggctttg

SEQ ID NO: 554452 - DNA, 25 bp, Rattus norvegicus
tacttcgaagtccttctcaggaagg

SEQ ID NO: 554453 - DNA, 25 bp, Rattus norvegicus
tacttcgaagtcgttctcaggaagg

SEQ ID NO: 554454 - DNA, 25 bp, Rattus norvegicus
tacttcgagcgcagcctgaaatagg

SEQ ID NO: 554455 - DNA, 25 bp, Rattus norvegicus
tacttcgagcgctgcctgaaatagg

SEQ ID NO: 554456 - DNA, 25 bp, Rattus norvegicus
tacttcgatgcaagccccagtcgga

SEQ ID NO: 554457 - DNA, 25 bp, Rattus norvegicus
tacttcgatgcatgccccagtcgga

SEQ ID NO: 554458 - DNA, 25 bp, Rattus norvegicus
tacttcgcatctactgtctgtggag

SEQ ID NO: 554459 - DNA, 25 bp, Rattus norvegicus
tacttcgcatcttctgtctgtggag

SEQ ID NO: 554460 - DNA, 25 bp, Rattus norvegicus
tacttcgcggagaaggcgctttggc

SEQ ID NO: 554461 - DNA, 25 bp, Rattus norvegicus
tacttcgcggagtaggcgctttggc

SEQ ID NO: 554462 - DNA, 25 bp, Rattus norvegicus
tacttcgctgaaagggcggcacccg

SEQ ID NO: 554463 - DNA, 25 bp, Rattus norvegicus
tacttcgctgaatgggcggcacccg

SEQ ID NO: 554464 - DNA, 25 bp, Rattus norvegicus
tacttcggcaaacaattcacagctg

SEQ ID NO: 554465 - DNA, 25 bp, Rattus norvegicus
tacttcggcaaagaattcacagctg

SEQ ID NO: 554466 - DNA, 25 bp, Rattus norvegicus
tacttcgggcctaggacagagctgt

SEQ ID NO: 554467 - DNA, 25 bp, Rattus norvegicus
tacttcgggccttggacagagctgt

SEQ ID NO: 554468 - DNA, 25 bp, Rattus norvegicus
tacttcggttcccaaataatacgcg

SEQ ID NO: 554469 - DNA, 25 bp, Rattus norvegicus
tacttcggttccgaaataatacgcg

SEQ ID NO: 554470 - DNA, 25 bp, Rattus norvegicus
tacttcgtacttctgtttgcttaaa

SEQ ID NO: 554471 - DNA, 25 bp, Rattus norvegicus
tacttcgtacttgtgtttgcttaaa

SEQ ID NO: 554472 - DNA, 25 bp, Rattus norvegicus
tacttcgtagtgcatgtgaaagccc

SEQ ID NO: 554473 - DNA, 25 bp, Rattus norvegicus
tacttcgtagtggatgtgaaagccc

SEQ ID NO: 554474 - DNA, 25 bp, Rattus norvegicus
tacttcgtggtgaattgccatctgc

SEQ ID NO: 554475 - DNA, 25 bp, Rattus norvegicus
tacttcgtggtgtattgccatctgc

SEQ ID NO: 554476 - DNA, 25 bp, Rattus norvegicus
tacttcgtgtcaccgtaggttgtca

SEQ ID NO: 554477 - DNA, 25 bp, Rattus norvegicus
tacttcgtgtcagcgtaggttgtca

SEQ ID NO: 554478 - DNA, 25 bp, Rattus norvegicus
tacttctacggtacgagctacgtgg

SEQ ID NO: 554479 - DNA, 25 bp, Rattus norvegicus
tacttctacggttcgagctacgtgg

SEQ ID NO: 554480 - DNA, 25 bp, Rattus norvegicus
tacttctagccaacatgacagccag

SEQ ID NO: 554481 - DNA, 25 bp, Rattus norvegicus
tacttctagccatcatgacagccag

SEQ ID NO: 554482 - DNA, 25 bp, Rattus norvegicus
tacttctagcccagaacccttgtga

SEQ ID NO: 554483 - DNA, 25 bp, Rattus norvegicus
tacttctagccctgaacccttgtga

SEQ ID NO: 554484 - DNA, 25 bp, Rattus norvegicus
tacttctaggatctcagccgaggaa

SEQ ID NO: 554485 - DNA, 25 bp, Rattus norvegicus
tacttctaggatgtcagccgaggaa

SEQ ID NO: 554486 - DNA, 25 bp, Rattus norvegicus
tacttctagggtcctgagttccaga

SEQ ID NO: 554487 - DNA, 25 bp, Rattus norvegicus
tacttctagggtgctgagttccaga

SEQ ID NO: 554488 - DNA, 25 bp, Rattus norvegicus
tacttctatctcaactacccttaaa

SEQ ID NO: 554489 - DNA, 25 bp, Rattus norvegicus
tacttctatctctactacccttaaa

SEQ ID NO: 554490 - DNA, 25 bp, Rattus norvegicus
tacttctcacttaagagtgcctcag

SEQ ID NO: 554491 - DNA, 25 bp, Rattus norvegicus
tacttctcactttagagtgcctcag

SEQ ID NO: 554492 - DNA, 25 bp, Rattus norvegicus
tacttctcagctaacatatttctaa

SEQ ID NO: 554493 - DNA, 25 bp, Rattus norvegicus
tacttctcagctcagcagtcactta

SEQ ID NO: 554494 - DNA, 25 bp, Rattus norvegicus
tacttctcagctgagcagtcactta

SEQ ID NO: 554495 - DNA, 25 bp, Rattus norvegicus
tacttctcagcttacatatttctaa

SEQ ID NO: 554496 - DNA, 25 bp, Rattus norvegicus
tacttctccctgctattatttgggt

SEQ ID NO: 554497 - DNA, 25 bp, Rattus norvegicus
tacttctccctggtattatttgggt

SEQ ID NO: 554498 - DNA, 25 bp, Rattus norvegicus
tacttctcggtgctttctgattaca

SEQ ID NO: 554499 - DNA, 25 bp, Rattus norvegicus
tacttctcggtggtttctgattaca

SEQ ID NO: 554500 - DNA, 25 bp, Rattus norvegicus
tacttctctcgcacttatttattac

SEQ ID NO: 554501 - DNA, 25 bp, Rattus norvegicus
tacttctctcgctcttatttattac

SEQ ID NO: 554502 - DNA, 25 bp, Rattus norvegicus
tacttctcttgcaagggatgatggt

SEQ ID NO: 554503 - DNA, 25 bp, Rattus norvegicus
tacttctcttgctagggatgatggt

SEQ ID NO: 554504 - DNA, 25 bp, Rattus norvegicus
tacttctctttgatacttgtctgtt

SEQ ID NO: 554505 - DNA, 25 bp, Rattus norvegicus
tacttctctttgttacttgtctgtt

SEQ ID NO: 554506 - DNA, 25 bp, Rattus norvegicus
tacttctgaatcagccctgggcata

SEQ ID NO: 554507 - DNA, 25 bp, Rattus norvegicus
tacttctgaatctgccctgggcata

SEQ ID NO: 554508 - DNA, 25 bp, Rattus norvegicus
tacttctgactcactgtgtgtgcgc

SEQ ID NO: 554509 - DNA, 25 bp, Rattus norvegicus
tacttctgactctctgtgtgtgcgc

SEQ ID NO: 554510 - DNA, 25 bp, Rattus norvegicus
tacttctgattcatcgagaaaggcc

SEQ ID NO: 554511 - DNA, 25 bp, Rattus norvegicus
tacttctgattcttcgagaaaggcc

SEQ ID NO: 554512 - DNA, 25 bp, Rattus norvegicus
tacttctgatttctatttcatggaa

SEQ ID NO: 554513 - DNA, 25 bp, Rattus norvegicus
tacttctgatttgtatttcatggaa

SEQ ID NO: 554514 - DNA, 25 bp, Rattus norvegicus
tacttctgctgcatgaagcgccgct

SEQ ID NO: 554515 - DNA, 25 bp, Rattus norvegicus
tacttctgctgcttgaagcgccgct

SEQ ID NO: 554516 - DNA, 25 bp, Rattus norvegicus
tacttctgcttaagagaccacggct

SEQ ID NO: 554517 - DNA, 25 bp, Rattus norvegicus
tacttctgcttatgagaccacggct

SEQ ID NO: 554518 - DNA, 25 bp, Rattus norvegicus
tacttctggcgcaagaagcggcgct

SEQ ID NO: 554519 - DNA, 25 bp, Rattus norvegicus
tacttctggcgctagaagcggcgct

SEQ ID NO: 554520 - DNA, 25 bp, Rattus norvegicus
tacttctgtctcctgggttcattat

SEQ ID NO: 554521 - DNA, 25 bp, Rattus norvegicus
tacttctgtctcgtgggttcattat

SEQ ID NO: 554522 - DNA, 25 bp, Rattus norvegicus
tacttctgttccattgcccactttg

SEQ ID NO: 554523 - DNA, 25 bp, Rattus norvegicus
tacttctgttcctttgcccactttg

SEQ ID NO: 554524 - DNA, 25 bp, Rattus norvegicus
tacttctgttggagtgtactgtaca

SEQ ID NO: 554525 - DNA, 25 bp, Rattus norvegicus
tacttctgttggtgtgtactgtaca

SEQ ID NO: 554526 - DNA, 25 bp, Rattus norvegicus
tacttcttagacctcctttgacttt

SEQ ID NO: 554527 - DNA, 25 bp, Rattus norvegicus
tacttcttagacgtcctttgacttt

SEQ ID NO: 554528 - DNA, 25 bp, Rattus norvegicus
tacttcttattacttggcatttcct

SEQ ID NO: 554529 - DNA, 25 bp, Rattus norvegicus
tacttcttattagttggcatttcct

SEQ ID NO: 554530 - DNA, 25 bp, Rattus norvegicus
tacttcttccctctcatcggatgga

SEQ ID NO: 554531 - DNA, 25 bp, Rattus norvegicus
tacttcttccctgtcatcggatgga

SEQ ID NO: 554532 - DNA, 25 bp, Rattus norvegicus
tacttcttggttaggcggccctggg

SEQ ID NO: 554533 - DNA, 25 bp, Rattus norvegicus
tacttcttggtttggcggccctggg

SEQ ID NO: 554534 - DNA, 25 bp, Rattus norvegicus
tacttctttagtcgttaggacccat

SEQ ID NO: 554535 - DNA, 25 bp, Rattus norvegicus
tacttctttagtggttaggacccat

SEQ ID NO: 554536 - DNA, 25 bp, Rattus norvegicus
tacttctttgatccggatgtcctga

SEQ ID NO: 554537 - DNA, 25 bp, Rattus norvegicus
tacttctttgatgcggatgtcctga

SEQ ID NO: 554538 - DNA, 25 bp, Rattus norvegicus
tacttgaaccaacgccagtcttatg

SEQ ID NO: 554539 - DNA, 25 bp, Rattus norvegicus
tacttgaaccaaggccagtcttatg

SEQ ID NO: 554540 - DNA, 25 bp, Rattus norvegicus
tacttgacccagaacttggtccttt

SEQ ID NO: 554541 - DNA, 25 bp, Rattus norvegicus
tacttgacccagtacttggtccttt

SEQ ID NO: 554542 - DNA, 25 bp, Rattus norvegicus
tacttgacggtcagatcactttctc

SEQ ID NO: 554543 - DNA, 25 bp, Rattus norvegicus
tacttgacggtctgatcactttctc

SEQ ID NO: 554544 - DNA, 25 bp, Rattus norvegicus
tacttgagcagcagttcctccaggg

SEQ ID NO: 554545 - DNA, 25 bp, Rattus norvegicus
tacttgagcagctgttcctccaggg

SEQ ID NO: 554546 - DNA, 25 bp, Rattus norvegicus
tacttgaggatcaccgttacatgcc

SEQ ID NO: 554547 - DNA, 25 bp, Rattus norvegicus
tacttgaggatctccgttacatgcc

SEQ ID NO: 554548 - DNA, 25 bp, Rattus norvegicus
tacttgaggccgaacgtccagcaac

SEQ ID NO: 554549 - DNA, 25 bp, Rattus norvegicus
tacttgaggccgtacgtccagcaac

SEQ ID NO: 554550 - DNA, 25 bp, Rattus norvegicus
tacttgatacctactccatgagcag

SEQ ID NO: 554551 - DNA, 25 bp, Rattus norvegicus
tacttgataccttctccatgagcag

SEQ ID NO: 554552 - DNA, 25 bp, Rattus norvegicus
tacttgcaatttcttcaacagagag

SEQ ID NO: 554553 - DNA, 25 bp, Rattus norvegicus
tacttgcaatttgttcaacagagag

SEQ ID NO: 554554 - DNA, 25 bp, Rattus norvegicus
tacttgcagatgatggaggtcagct

SEQ ID NO: 554555 - DNA, 25 bp, Rattus norvegicus
tacttgcagatgttggaggtcagct

SEQ ID NO: 554556 - DNA, 25 bp, Rattus norvegicus
tacttgcagtggctttgccagtgtc

SEQ ID NO: 554557 - DNA, 25 bp, Rattus norvegicus
tacttgcagtgggtttgccagtgtc

SEQ ID NO: 554558 - DNA, 25 bp, Rattus norvegicus
tacttgccaagtatccctaggtgaa

SEQ ID NO: 554559 - DNA, 25 bp, Rattus norvegicus
tacttgccaagtttccctaggtgaa

SEQ ID NO: 554560 - DNA, 25 bp, Rattus norvegicus
tacttgccccgactttgttctagaa

SEQ ID NO: 554561 - DNA, 25 bp, Rattus norvegicus
tacttgccccgagtttgttctagaa

SEQ ID NO: 554562 - DNA, 25 bp, Rattus norvegicus
tacttgcccggtcacagtagtacct

SEQ ID NO: 554563 - DNA, 25 bp, Rattus norvegicus
tacttgcccggtgacagtagtacct

SEQ ID NO: 554564 - DNA, 25 bp, Rattus norvegicus
tacttgcctgacatctgtttcacac

SEQ ID NO: 554565 - DNA, 25 bp, Rattus norvegicus
tacttgcctgacttctgtttcacac

SEQ ID NO: 554566 - DNA, 25 bp, Rattus norvegicus
tacttgccttggctgattttttaga

SEQ ID NO: 554567 - DNA, 25 bp, Rattus norvegicus
tacttgccttgggtgattttttaga

SEQ ID NO: 554568 - DNA, 25 bp, Rattus norvegicus
tacttgctaactatctcatccctat

SEQ ID NO: 554569 - DNA, 25 bp, Rattus norvegicus
tacttgctaactttctcatccctat

SEQ ID NO: 554570 - DNA, 25 bp, Rattus norvegicus
tacttgctcttaacagtttctcaga

SEQ ID NO: 554571 - DNA, 25 bp, Rattus norvegicus
tacttgctcttatcagtttctcaga

SEQ ID NO: 554572 - DNA, 25 bp, Rattus norvegicus
tacttgctgcccacattatgagctg

SEQ ID NO: 554573 - DNA, 25 bp, Rattus norvegicus
tacttgctgccctcattatgagctg

SEQ ID NO: 554574 - DNA, 25 bp, Rattus norvegicus
tacttgctgctgatgacattttata

SEQ ID NO: 554575 - DNA, 25 bp, Rattus norvegicus
tacttgctgctgttgacattttata

SEQ ID NO: 554576 - DNA, 25 bp, Rattus norvegicus
tacttgctgtacataaggcttccaa

SEQ ID NO: 554577 - DNA, 25 bp, Rattus norvegicus
tacttgctgtacttaaggcttccaa

SEQ ID NO: 554578 - DNA, 25 bp, Rattus norvegicus
tacttgcttcacattgtgtgtcctt

SEQ ID NO: 554579 - DNA, 25 bp, Rattus norvegicus
tacttgcttcactttgtgtgtcctt

SEQ ID NO: 554580 - DNA, 25 bp, Rattus norvegicus
tacttgcttcatagtaactacacgt

SEQ ID NO: 554581 - DNA, 25 bp, Rattus norvegicus
tacttgcttcattgtaactacacgt

SEQ ID NO: 554582 - DNA, 25 bp, Rattus norvegicus
tacttgcttgcccagcgtgtacagt

SEQ ID NO: 554583 - DNA, 25 bp, Rattus norvegicus
tacttgcttgccgagcgtgtacagt

SEQ ID NO: 554584 - DNA, 25 bp, Rattus norvegicus
tacttggaaatcacctgtccctggc

SEQ ID NO: 554585 - DNA, 25 bp, Rattus norvegicus
tacttggaaatctcctgtccctggc

SEQ ID NO: 554586 - DNA, 25 bp, Rattus norvegicus
tacttggaatttcgtctccccagat

SEQ ID NO: 554587 - DNA, 25 bp, Rattus norvegicus
tacttggaatttggtctccccagat

SEQ ID NO: 554588 - DNA, 25 bp, Rattus norvegicus
tacttggacactccctgggaacaaa

SEQ ID NO: 554589 - DNA, 25 bp, Rattus norvegicus
tacttggacactgcctgggaacaaa

SEQ ID NO: 554590 - DNA, 25 bp, Rattus norvegicus
tacttggacctgaagggatgactcc

SEQ ID NO: 554591 - DNA, 25 bp, Rattus norvegicus
tacttggacctgtagggatgactcc

SEQ ID NO: 554592 - DNA, 25 bp, Rattus norvegicus
tacttggagcttatgcatggcagtt

SEQ ID NO: 554593 - DNA, 25 bp, Rattus norvegicus
tacttggagcttttgcatggcagtt

SEQ ID NO: 554594 - DNA, 25 bp, Rattus norvegicus
tacttggaggatcacgaccctgtcc

SEQ ID NO: 554595 - DNA, 25 bp, Rattus norvegicus
tacttggaggatgacgaccctgtcc

SEQ ID NO: 554596 - DNA, 25 bp, Rattus norvegicus
tacttggatccaccactcattgaga

SEQ ID NO: 554597 - DNA, 25 bp, Rattus norvegicus
tacttggatccagcactcattgaga

SEQ ID NO: 554598 - DNA, 25 bp, Rattus norvegicus
tacttggcagagcaaaacatgtaag

SEQ ID NO: 554599 - DNA, 25 bp, Rattus norvegicus
tacttggcagaggaaaacatgtaag

SEQ ID NO: 554600 - DNA, 25 bp, Rattus norvegicus
tacttggcccatctgttctatgtga

SEQ ID NO: 554601 - DNA, 25 bp, Rattus norvegicus
tacttggcccatgtgttctatgtga

SEQ ID NO: 554602 - DNA, 25 bp, Rattus norvegicus
tacttggcctgtatcatattcttga

SEQ ID NO: 554603 - DNA, 25 bp, Rattus norvegicus
tacttggcctgtttcatattcttga

SEQ ID NO: 554604 - DNA, 25 bp, Rattus norvegicus
tacttggctgttagaggccgcttgc

SEQ ID NO: 554605 - DNA, 25 bp, Rattus norvegicus
tacttggctgtttgaggccgcttgc

SEQ ID NO: 554606 - DNA, 25 bp, Rattus norvegicus
tacttggcttaacccatctagcagg

SEQ ID NO: 554607 - DNA, 25 bp, Rattus norvegicus
tacttggcttaagccatctagcagg

SEQ ID NO: 554608 - DNA, 25 bp, Rattus norvegicus
tacttggcttccaccttttcaagga

SEQ ID NO: 554609 - DNA, 25 bp, Rattus norvegicus
tacttggcttcctccttttcaagga

SEQ ID NO: 554610 - DNA, 25 bp, Rattus norvegicus
tacttggcttctaccagcgaggatg

SEQ ID NO: 554611 - DNA, 25 bp, Rattus norvegicus
tacttggcttcttccagcgaggatg

SEQ ID NO: 554612 - DNA, 25 bp, Rattus norvegicus
tacttgggcacaacgttcgcaggcg

SEQ ID NO: 554613 - DNA, 25 bp, Rattus norvegicus
tacttgggcacatcgttcgcaggcg

SEQ ID NO: 554614 - DNA, 25 bp, Rattus norvegicus
tacttgggcagcctattagggtttt

SEQ ID NO: 554615 - DNA, 25 bp, Rattus norvegicus
tacttgggcagcgtattagggtttt

SEQ ID NO: 554616 - DNA, 25 bp, Rattus norvegicus
tacttgggccaacacctcagctttg

SEQ ID NO: 554617 - DNA, 25 bp, Rattus norvegicus
tacttgggccaagacctcagctttg

SEQ ID NO: 554618 - DNA, 25 bp, Rattus norvegicus
tacttgggcgagaaggtcaggaccc

SEQ ID NO: 554619 - DNA, 25 bp, Rattus norvegicus
tacttgggcgagtaggtcaggaccc

SEQ ID NO: 554620 - DNA, 25 bp, Rattus norvegicus
tacttggtagccaggcagcctgtta

SEQ ID NO: 554621 - DNA, 25 bp, Rattus norvegicus
tacttggtagcctggcagcctgtta

SEQ ID NO: 554622 - DNA, 25 bp, Rattus norvegicus
tacttggtcctaatttctgtttgtc

SEQ ID NO: 554623 - DNA, 25 bp, Rattus norvegicus
tacttggtcctattttctgtttgtc

SEQ ID NO: 554624 - DNA, 25 bp, Rattus norvegicus
tacttggtctgaagattccccgagg

SEQ ID NO: 554625 - DNA, 25 bp, Rattus norvegicus
tacttggtctgatgattccccgagg

SEQ ID NO: 554626 - DNA, 25 bp, Rattus norvegicus
tacttggtcttcatgtatgctgcta

SEQ ID NO: 554627 - DNA, 25 bp, Rattus norvegicus
tacttggtcttcttgtatgctgcta

SEQ ID NO: 554628 - DNA, 25 bp, Rattus norvegicus
tacttggtgaagacctcactcagct

SEQ ID NO: 554629 - DNA, 25 bp, Rattus norvegicus
tacttggtgaagtcctcactcagct

SEQ ID NO: 554630 - DNA, 25 bp, Rattus norvegicus
tacttggtgaccagagcctactgta

SEQ ID NO: 554631 - DNA, 25 bp, Rattus norvegicus
tacttggtgacctgagcctactgta

SEQ ID NO: 554632 - DNA, 25 bp, Rattus norvegicus
tacttggtggctcccaggttacact

SEQ ID NO: 554633 - DNA, 25 bp, Rattus norvegicus
tacttggtggctgccaggttacact

SEQ ID NO: 554634 - DNA, 25 bp, Rattus norvegicus
tacttggtggtcattgtcctataca

SEQ ID NO: 554635 - DNA, 25 bp, Rattus norvegicus
tacttggtggtctttgtcctataca

SEQ ID NO: 554636 - DNA, 25 bp, Rattus norvegicus
tacttggttagcacctgttgtgtca

SEQ ID NO: 554637 - DNA, 25 bp, Rattus norvegicus
tacttggttagctcctgttgtgtca

SEQ ID NO: 554638 - DNA, 25 bp, Rattus norvegicus
tacttggtttggatcttttattcat

SEQ ID NO: 554639 - DNA, 25 bp, Rattus norvegicus
tacttggtttggttcttttattcat

SEQ ID NO: 554640 - DNA, 25 bp, Rattus norvegicus
tacttgtagaccacatcaattccct

SEQ ID NO: 554641 - DNA, 25 bp, Rattus norvegicus
tacttgtagacctcatcaattccct

SEQ ID NO: 554642 - DNA, 25 bp, Rattus norvegicus
tacttgtatgccactgtgtactgtg

SEQ ID NO: 554643 - DNA, 25 bp, Rattus norvegicus
tacttgtatgcctctgtgtactgtg

SEQ ID NO: 554644 - DNA, 25 bp, Rattus norvegicus
tacttgtcattgactgtccagctca

SEQ ID NO: 554645 - DNA, 25 bp, Rattus norvegicus
tacttgtcattgtctgtccagctca

SEQ ID NO: 554646 - DNA, 25 bp, Rattus norvegicus
tacttgtcctgtatgatgcctgttc

SEQ ID NO: 554647 - DNA, 25 bp, Rattus norvegicus
tacttgtcctgtttgatgcctgttc

SEQ ID NO: 554648 - DNA, 25 bp, Rattus norvegicus
tacttgtcgaagagggtatggccat

SEQ ID NO: 554649 - DNA, 25 bp, Rattus norvegicus
tacttgtcgaagtgggtatggccat

SEQ ID NO: 554650 - DNA, 25 bp, Rattus norvegicus
tacttgtgaggcctggccgggtgaa

SEQ ID NO: 554651 - DNA, 25 bp, Rattus norvegicus
tacttgtgaggcgtggccgggtgaa

SEQ ID NO: 554652 - DNA, 25 bp, Rattus norvegicus
tacttgtgatgtaagcttccgtgaa

SEQ ID NO: 554653 - DNA, 25 bp, Rattus norvegicus
tacttgtgatgttagcttccgtgaa

SEQ ID NO: 554654 - DNA, 25 bp, Rattus norvegicus
tacttgtgcaacaccagatcttcag

SEQ ID NO: 554655 - DNA, 25 bp, Rattus norvegicus
tacttgtgcaactccagatcttcag

SEQ ID NO: 554656 - DNA, 25 bp, Rattus norvegicus
tacttgtgcctcagtgtaccattgt

SEQ ID NO: 554657 - DNA, 25 bp, Rattus norvegicus
tacttgtgcctctgtgtaccattgt

SEQ ID NO: 554658 - DNA, 25 bp, Rattus norvegicus
tacttgtgctacagcccactgggaa

SEQ ID NO: 554659 - DNA, 25 bp, Rattus norvegicus
tacttgtgctactgcccactgggaa

SEQ ID NO: 554660 - DNA, 25 bp, Rattus norvegicus
tacttgtgctcccaagtctttttca

SEQ ID NO: 554661 - DNA, 25 bp, Rattus norvegicus
tacttgtgctccgaagtctttttca

SEQ ID NO: 554662 - DNA, 25 bp, Rattus norvegicus
tacttgtgttagctctctgtgcttt

SEQ ID NO: 554663 - DNA, 25 bp, Rattus norvegicus
tacttgtgttaggtctctgtgcttt

SEQ ID NO: 554664 - DNA, 25 bp, Rattus norvegicus
tacttgtgttgcacctagactgagg

SEQ ID NO: 554665 - DNA, 25 bp, Rattus norvegicus
tacttgtgttgctcctagactgagg

SEQ ID NO: 554666 - DNA, 25 bp, Rattus norvegicus
tacttgttcctcagtctcaggtact

SEQ ID NO: 554667 - DNA, 25 bp, Rattus norvegicus
tacttgttcctctgtctcaggtact

SEQ ID NO: 554668 - DNA, 25 bp, Rattus norvegicus
tacttgttgctcattcagacggtct

SEQ ID NO: 554669 - DNA, 25 bp, Rattus norvegicus
tacttgttgctctttcagacggtct

SEQ ID NO: 554670 - DNA, 25 bp, Rattus norvegicus
tacttgtttagcatgaaaaaggcct

SEQ ID NO: 554671 - DNA, 25 bp, Rattus norvegicus
tacttgtttagcttgaaaaaggcct

SEQ ID NO: 554672 - DNA, 25 bp, Rattus norvegicus
tacttgtttagtatgggcaaaggcc

SEQ ID NO: 554673 - DNA, 25 bp, Rattus norvegicus
tacttgtttagtttgggcaaaggcc

SEQ ID NO: 554674 - DNA, 25 bp, Rattus norvegicus
tacttgtttctaatttagcttacca

SEQ ID NO: 554675 - DNA, 25 bp, Rattus norvegicus
tacttgtttctattttagcttacca

SEQ ID NO: 554676 - DNA, 25 bp, Rattus norvegicus
tacttgttttaaactgcctcaggtg

SEQ ID NO: 554677 - DNA, 25 bp, Rattus norvegicus
tacttgttttaatctgcctcaggtg

SEQ ID NO: 554678 - DNA, 25 bp, Rattus norvegicus
tacttgtttttccattgtatgcaca

SEQ ID NO: 554679 - DNA, 25 bp, Rattus norvegicus
tacttgtttttcgattgtatgcaca

SEQ ID NO: 554680 - DNA, 25 bp, Rattus norvegicus
tactttaaaaacaatcctatggact

SEQ ID NO: 554681 - DNA, 25 bp, Rattus norvegicus
tactttaaaaactatcctatggact

SEQ ID NO: 554682 - DNA, 25 bp, Rattus norvegicus
tactttaacttcagaaagcctttct

SEQ ID NO: 554683 - DNA, 25 bp, Rattus norvegicus
tactttaacttctgaaagcctttct

SEQ ID NO: 554684 - DNA, 25 bp, Rattus norvegicus
tactttaccaataacttctaggcgg

SEQ ID NO: 554685 - DNA, 25 bp, Rattus norvegicus
tactttaccaattacttctaggcgg

SEQ ID NO: 554686 - DNA, 25 bp, Rattus norvegicus
tactttacccttcagtttgtggact

SEQ ID NO: 554687 - DNA, 25 bp, Rattus norvegicus
tactttacccttgagtttgtggact

SEQ ID NO: 554688 - DNA, 25 bp, Rattus norvegicus
tactttaccttcctacaaatttgag

SEQ ID NO: 554689 - DNA, 25 bp, Rattus norvegicus
tactttaccttcgtacaaatttgag

SEQ ID NO: 554690 - DNA, 25 bp, Rattus norvegicus
tactttacgtacctgtgacactttc

SEQ ID NO: 554691 - DNA, 25 bp, Rattus norvegicus
tactttacgtacgtgtgacactttc

SEQ ID NO: 554692 - DNA, 25 bp, Rattus norvegicus
tactttagtattcatgctcctccat

SEQ ID NO: 554693 - DNA, 25 bp, Rattus norvegicus
tactttagtattgatgctcctccat

SEQ ID NO: 554694 - DNA, 25 bp, Rattus norvegicus
tactttatgtccctatggccattgc

SEQ ID NO: 554695 - DNA, 25 bp, Rattus norvegicus
tactttatgtccgtatggccattgc

SEQ ID NO: 554696 - DNA, 25 bp, Rattus norvegicus
tactttatgtgtacgggtgctttgc

SEQ ID NO: 554697 - DNA, 25 bp, Rattus norvegicus
tactttatgtgttcgggtgctttgc

SEQ ID NO: 554698 - DNA, 25 bp, Rattus norvegicus
tactttatttggctgttccgtccct

SEQ ID NO: 554699 - DNA, 25 bp, Rattus norvegicus
tactttatttgggtgttccgtccct

SEQ ID NO: 554700 - DNA, 25 bp, Rattus norvegicus
tactttcactgtattttactgagca

SEQ ID NO: 554701 - DNA, 25 bp, Rattus norvegicus
tactttcactgttttttactgagca

SEQ ID NO: 554702 - DNA, 25 bp, Rattus norvegicus
tactttcagataaaacttgcatttg

SEQ ID NO: 554703 - DNA, 25 bp, Rattus norvegicus
tactttcagatataacttgcatttg

SEQ ID NO: 554704 - DNA, 25 bp, Rattus norvegicus
tactttcagttaaatgtcttcctta

SEQ ID NO: 554705 - DNA, 25 bp, Rattus norvegicus
tactttcagttatatgtcttcctta

SEQ ID NO: 554706 - DNA, 25 bp, Rattus norvegicus
tactttcatccacccataggtcaag

SEQ ID NO: 554707 - DNA, 25 bp, Rattus norvegicus
tactttcatccagccataggtcaag

SEQ ID NO: 554708 - DNA, 25 bp, Rattus norvegicus
tactttcccaagctccaggtactag

SEQ ID NO: 554709 - DNA, 25 bp, Rattus norvegicus
tactttcccaaggtccaggtactag

SEQ ID NO: 554710 - DNA, 25 bp, Rattus norvegicus
tactttcccttgagccatttcgctg

SEQ ID NO: 554711 - DNA, 25 bp, Rattus norvegicus
tactttcccttgtgccatttcgctg

SEQ ID NO: 554712 - DNA, 25 bp, Rattus norvegicus
tactttcggtgtaaaccccacagtg

SEQ ID NO: 554713 - DNA, 25 bp, Rattus norvegicus
tactttcggtgttaaccccacagtg

SEQ ID NO: 554714 - DNA, 25 bp, Rattus norvegicus
tactttctatacctgatgtccttgc

SEQ ID NO: 554715 - DNA, 25 bp, Rattus norvegicus
tactttctatacgtgatgtccttgc

SEQ ID NO: 554716 - DNA, 25 bp, Rattus norvegicus
tactttctatatccacctcactaag

SEQ ID NO: 554717 - DNA, 25 bp, Rattus norvegicus
tactttctatatgcacctcactaag

SEQ ID NO: 554718 - DNA, 25 bp, Rattus norvegicus
tactttctatgcagaagcccgagag

SEQ ID NO: 554719 - DNA, 25 bp, Rattus norvegicus
tactttctatgctgaagcccgagag

SEQ ID NO: 554720 - DNA, 25 bp, Rattus norvegicus
tactttctcccaatgctttgtacaa

SEQ ID NO: 554721 - DNA, 25 bp, Rattus norvegicus
tactttctcccattgctttgtacaa

SEQ ID NO: 554722 - DNA, 25 bp, Rattus norvegicus
tactttctctggaagcttactttta

SEQ ID NO: 554723 - DNA, 25 bp, Rattus norvegicus
tactttctctggtagcttactttta

SEQ ID NO: 554724 - DNA, 25 bp, Rattus norvegicus
tactttctgcatagtcttctattga

SEQ ID NO: 554725 - DNA, 25 bp, Rattus norvegicus
tactttctgcattgtcttctattga

SEQ ID NO: 554726 - DNA, 25 bp, Rattus norvegicus
tactttctgccacggttgatagagt

SEQ ID NO: 554727 - DNA, 25 bp, Rattus norvegicus
tactttctgccagggttgatagagt

SEQ ID NO: 554728 - DNA, 25 bp, Rattus norvegicus
tactttctgcgcacatagtggttgt

SEQ ID NO: 554729 - DNA, 25 bp, Rattus norvegicus
tactttctgcgctcatagtggttgt

SEQ ID NO: 554730 - DNA, 25 bp, Rattus norvegicus
tactttctggtgatgagctgtctgg

SEQ ID NO: 554731 - DNA, 25 bp, Rattus norvegicus
tactttctggtgttgagctgtctgg

SEQ ID NO: 554732 - DNA, 25 bp, Rattus norvegicus
tactttctgttcattgagaccaagg

SEQ ID NO: 554733 - DNA, 25 bp, Rattus norvegicus
tactttctgttctttgagaccaagg

SEQ ID NO: 554734 - DNA, 25 bp, Rattus norvegicus
tactttctgttgcaatccttacctg

SEQ ID NO: 554735 - DNA, 25 bp, Rattus norvegicus
tactttctgttggaatccttacctg

SEQ ID NO: 554736 - DNA, 25 bp, Rattus norvegicus
tactttcttcaccaaagccatctga

SEQ ID NO: 554737 - DNA, 25 bp, Rattus norvegicus
tactttcttcacgaaagccatctga

SEQ ID NO: 554738 - DNA, 25 bp, Rattus norvegicus
tactttcttcgaaggctattggaga

SEQ ID NO: 554739 - DNA, 25 bp, Rattus norvegicus
tactttcttcgatggctattggaga

SEQ ID NO: 554740 - DNA, 25 bp, Rattus norvegicus
tactttctttttctgggcttcaacg

SEQ ID NO: 554741 - DNA, 25 bp, Rattus norvegicus
tactttctttttgtgggcttcaacg

SEQ ID NO: 554742 - DNA, 25 bp, Rattus norvegicus
tactttgaaaacagtgctcagagac

SEQ ID NO: 554743 - DNA, 25 bp, Rattus norvegicus
tactttgaaaactgtgctcagagac

SEQ ID NO: 554744 - DNA, 25 bp, Rattus norvegicus
tactttgaagaaagggccctcgtct

SEQ ID NO: 554745 - DNA, 25 bp, Rattus norvegicus
tactttgaagaatgggccctcgtct

SEQ ID NO: 554746 - DNA, 25 bp, Rattus norvegicus
tactttgaatccacactacccatgg

SEQ ID NO: 554747 - DNA, 25 bp, Rattus norvegicus
tactttgaatcctcactacccatgg

SEQ ID NO: 554748 - DNA, 25 bp, Rattus norvegicus
tactttgaatgtctgtttgcctccc

SEQ ID NO: 554749 - DNA, 25 bp, Rattus norvegicus
tactttgaatgtgtgtttgcctccc

SEQ ID NO: 554750 - DNA, 25 bp, Rattus norvegicus
tactttgaattgatgtcttcttgaa

SEQ ID NO: 554751 - DNA, 25 bp, Rattus norvegicus
tactttgaattgttgtcttcttgaa

SEQ ID NO: 554752 - DNA, 25 bp, Rattus norvegicus
tactttgacactacccttagtggtg

SEQ ID NO: 554753 - DNA, 25 bp, Rattus norvegicus
tactttgacacttcccttagtggtg

SEQ ID NO: 554754 - DNA, 25 bp, Rattus norvegicus
tactttgactttagcatagtgccat

SEQ ID NO: 554755 - DNA, 25 bp, Rattus norvegicus
tactttgacttttgcatagtgccat

SEQ ID NO: 554756 - DNA, 25 bp, Rattus norvegicus
tactttgagcagaaggattcagata

SEQ ID NO: 554757 - DNA, 25 bp, Rattus norvegicus
tactttgagcagtaggattcagata

SEQ ID NO: 554758 - DNA, 25 bp, Rattus norvegicus
tactttgagcccctcagtggcaaga

SEQ ID NO: 554759 - DNA, 25 bp, Rattus norvegicus
tactttgagcccgtcagtggcaaga

SEQ ID NO: 554760 - DNA, 25 bp, Rattus norvegicus
tactttgatggcaagctgttccaga

SEQ ID NO: 554761 - DNA, 25 bp, Rattus norvegicus
tactttgatggctagctgttccaga

SEQ ID NO: 554762 - DNA, 25 bp, Rattus norvegicus
tactttgcatgcatgtatgcgcacc

SEQ ID NO: 554763 - DNA, 25 bp, Rattus norvegicus
tactttgcatgcttgtatgcgcacc

SEQ ID NO: 554764 - DNA, 25 bp, Rattus norvegicus
tactttgcattgaacggcctgtcca

SEQ ID NO: 554765 - DNA, 25 bp, Rattus norvegicus
tactttgcattgtacggcctgtcca

SEQ ID NO: 554766 - DNA, 25 bp, Rattus norvegicus
tactttgccttaccttttgtgacac

SEQ ID NO: 554767 - DNA, 25 bp, Rattus norvegicus
tactttgccttagcttttgtgacac

SEQ ID NO: 554768 - DNA, 25 bp, Rattus norvegicus
tactttgcgattattgttttcacaa

SEQ ID NO: 554769 - DNA, 25 bp, Rattus norvegicus
tactttgcgatttttgttttcacaa

SEQ ID NO: 554770 - DNA, 25 bp, Rattus norvegicus
tactttgctttgacacacagaggtg

SEQ ID NO: 554771 - DNA, 25 bp, Rattus norvegicus
tactttgctttgtcacacagaggtg

SEQ ID NO: 554772 - DNA, 25 bp, Rattus norvegicus
tactttggaccgagctcgggccctg

SEQ ID NO: 554773 - DNA, 25 bp, Rattus norvegicus
tactttggaccgtgctcgggccctg

SEQ ID NO: 554774 - DNA, 25 bp, Rattus norvegicus
tactttggagccctgtcgtttattg

SEQ ID NO: 554775 - DNA, 25 bp, Rattus norvegicus
tactttggagccgtgtcgtttattg

SEQ ID NO: 554776 - DNA, 25 bp, Rattus norvegicus
tactttggcagactcttgatttttt

SEQ ID NO: 554777 - DNA, 25 bp, Rattus norvegicus
tactttggcagagtcttgatttttt

SEQ ID NO: 554778 - DNA, 25 bp, Rattus norvegicus
tactttggcagccagttggagctgt

SEQ ID NO: 554779 - DNA, 25 bp, Rattus norvegicus
tactttggcagcgagttggagctgt

SEQ ID NO: 554780 - DNA, 25 bp, Rattus norvegicus
tactttgggaagagcctggatctat

SEQ ID NO: 554781 - DNA, 25 bp, Rattus norvegicus
tactttgggaagtgcctggatctat

SEQ ID NO: 554782 - DNA, 25 bp, Rattus norvegicus
tactttgggtttataacaccgcatg

SEQ ID NO: 554783 - DNA, 25 bp, Rattus norvegicus
tactttgggtttttaacaccgcatg

SEQ ID NO: 554784 - DNA, 25 bp, Rattus norvegicus
tactttggtaacagggcctttctgg

SEQ ID NO: 554785 - DNA, 25 bp, Rattus norvegicus
tactttggtaactgggcctttctgg

SEQ ID NO: 554786 - DNA, 25 bp, Rattus norvegicus
tactttggtaccacctgaggctttc

SEQ ID NO: 554787 - DNA, 25 bp, Rattus norvegicus
tactttggtacctcctgaggctttc

SEQ ID NO: 554788 - DNA, 25 bp, Rattus norvegicus
tactttggtccacaaatgcactttt

SEQ ID NO: 554789 - DNA, 25 bp, Rattus norvegicus
tactttggtccagaaatgcactttt

SEQ ID NO: 554790 - DNA, 25 bp, Rattus norvegicus
tactttggtctgcttgcagcgcaac

SEQ ID NO: 554791 - DNA, 25 bp, Rattus norvegicus
tactttggtctggttgcagcgcaac

SEQ ID NO: 554792 - DNA, 25 bp, Rattus norvegicus
tactttgtaacaatgttggctccaa

SEQ ID NO: 554793 - DNA, 25 bp, Rattus norvegicus
tactttgtaacattgttggctccaa

SEQ ID NO: 554794 - DNA, 25 bp, Rattus norvegicus
tactttgtacaaaaccatcctatgt

SEQ ID NO: 554795 - DNA, 25 bp, Rattus norvegicus
tactttgtacaataccatcctatgt

SEQ ID NO: 554796 - DNA, 25 bp, Rattus norvegicus
tactttgtacataggctgtttagac

SEQ ID NO: 554797 - DNA, 25 bp, Rattus norvegicus
tactttgtacattggctgtttagac

SEQ ID NO: 554798 - DNA, 25 bp, Rattus norvegicus
tactttgtagtcacagtcggtgttg

SEQ ID NO: 554799 - DNA, 25 bp, Rattus norvegicus
tactttgtagtctcagtcggtgttg

SEQ ID NO: 554800 - DNA, 25 bp, Rattus norvegicus
tactttgtagtgagcatggctctgc

SEQ ID NO: 554801 - DNA, 25 bp, Rattus norvegicus
tactttgtagtgtgcatggctctgc

SEQ ID NO: 554802 - DNA, 25 bp, Rattus norvegicus
tactttgtataactacccaccttgc

SEQ ID NO: 554803 - DNA, 25 bp, Rattus norvegicus
tactttgtataagtacccaccttgc

SEQ ID NO: 554804 - DNA, 25 bp, Rattus norvegicus
tactttgtatagctcgccatagggc

SEQ ID NO: 554805 - DNA, 25 bp, Rattus norvegicus
tactttgtataggtcgccatagggc

SEQ ID NO: 554806 - DNA, 25 bp, Rattus norvegicus
tactttgtatttaatgcatgctctg

SEQ ID NO: 554807 - DNA, 25 bp, Rattus norvegicus
tactttgtattttatgcatgctctg

SEQ ID NO: 554808 - DNA, 25 bp, Rattus norvegicus
tactttgtcacactgagcgtgcact

SEQ ID NO: 554809 - DNA, 25 bp, Rattus norvegicus
tactttgtcacagtgagcgtgcact

SEQ ID NO: 554810 - DNA, 25 bp, Rattus norvegicus
tactttgtccctcttgtgtttttat

SEQ ID NO: 554811 - DNA, 25 bp, Rattus norvegicus
tactttgtccctgttgtgtttttat

SEQ ID NO: 554812 - DNA, 25 bp, Rattus norvegicus
tactttgtctccactggtgggacct

SEQ ID NO: 554813 - DNA, 25 bp, Rattus norvegicus
tactttgtctcctctggtgggacct

SEQ ID NO: 554814 - DNA, 25 bp, Rattus norvegicus
tactttgtctcgatcatcttccttt

SEQ ID NO: 554815 - DNA, 25 bp, Rattus norvegicus
tactttgtctcgttcatcttccttt

SEQ ID NO: 554816 - DNA, 25 bp, Rattus norvegicus
tactttgtgctgcatgtttgtaaac

SEQ ID NO: 554817 - DNA, 25 bp, Rattus norvegicus
tactttgtgctggatgtttgtaaac

SEQ ID NO: 554818 - DNA, 25 bp, Rattus norvegicus
tactttgttactcatctatccttcc

SEQ ID NO: 554819 - DNA, 25 bp, Rattus norvegicus
tactttgttactgatctatccttcc

SEQ ID NO: 554820 - DNA, 25 bp, Rattus norvegicus
tactttgttccccacaatggcaaat

SEQ ID NO: 554821 - DNA, 25 bp, Rattus norvegicus
tactttgttcccgacaatggcaaat

SEQ ID NO: 554822 - DNA, 25 bp, Rattus norvegicus
tactttgtttctatccgccattata

SEQ ID NO: 554823 - DNA, 25 bp, Rattus norvegicus
tactttgtttctttccgccattata

SEQ ID NO: 554824 - DNA, 25 bp, Rattus norvegicus
tacttttaaacccagcattcaccag

SEQ ID NO: 554825 - DNA, 25 bp, Rattus norvegicus
tacttttaaaccgagcattcaccag

SEQ ID NO: 554826 - DNA, 25 bp, Rattus norvegicus
tacttttaaatgctgttgtcccgag

SEQ ID NO: 554827 - DNA, 25 bp, Rattus norvegicus
tacttttaaatggtgttgtcccgag

SEQ ID NO: 554828 - DNA, 25 bp, Rattus norvegicus
tacttttactcactgagccttctca

SEQ ID NO: 554829 - DNA, 25 bp, Rattus norvegicus
tacttttactcagtgagccttctca

SEQ ID NO: 554830 - DNA, 25 bp, Rattus norvegicus
tacttttagcttcattctcccatat

SEQ ID NO: 554831 - DNA, 25 bp, Rattus norvegicus
tacttttagcttgattctcccatat

SEQ ID NO: 554832 - DNA, 25 bp, Rattus norvegicus
tacttttagttgaacactctcctcc

SEQ ID NO: 554833 - DNA, 25 bp, Rattus norvegicus
tacttttagttgctggagctgctta

SEQ ID NO: 554834 - DNA, 25 bp, Rattus norvegicus
tacttttagttggtggagctgctta

SEQ ID NO: 554835 - DNA, 25 bp, Rattus norvegicus
tacttttagttgtacactctcctcc

SEQ ID NO: 554836 - DNA, 25 bp, Rattus norvegicus
tacttttcagccaaattctctttcc

SEQ ID NO: 554837 - DNA, 25 bp, Rattus norvegicus
tacttttcagcctaattctctttcc

SEQ ID NO: 554838 - DNA, 25 bp, Rattus norvegicus
tacttttcatagatccacccagtga

SEQ ID NO: 554839 - DNA, 25 bp, Rattus norvegicus
tacttttcatagttccacccagtga

SEQ ID NO: 554840 - DNA, 25 bp, Rattus norvegicus
tacttttcctgtagcactagcaaga

SEQ ID NO: 554841 - DNA, 25 bp, Rattus norvegicus
tacttttcctgttgcactagcaaga

SEQ ID NO: 554842 - DNA, 25 bp, Rattus norvegicus
tacttttcggttaactgtggattca

SEQ ID NO: 554843 - DNA, 25 bp, Rattus norvegicus
tacttttcggtttactgtggattca

SEQ ID NO: 554844 - DNA, 25 bp, Rattus norvegicus
tacttttctaatactggccctgact

SEQ ID NO: 554845 - DNA, 25 bp, Rattus norvegicus
tacttttctaattctggccctgact

SEQ ID NO: 554846 - DNA, 25 bp, Rattus norvegicus
tacttttctgttatgcttctttggc

SEQ ID NO: 554847 - DNA, 25 bp, Rattus norvegicus
tacttttctgttttgcttctttggc

SEQ ID NO: 554848 - DNA, 25 bp, Rattus norvegicus
tacttttcttggaggctgtgtcgga

SEQ ID NO: 554849 - DNA, 25 bp, Rattus norvegicus
tacttttcttggtggctgtgtcgga

SEQ ID NO: 554850 - DNA, 25 bp, Rattus norvegicus
tacttttcttgtaacctgcagggag

SEQ ID NO: 554851 - DNA, 25 bp, Rattus norvegicus
tacttttcttgttacctgcagggag

SEQ ID NO: 554852 - DNA, 25 bp, Rattus norvegicus
tacttttgagtaattgccccgtggc

SEQ ID NO: 554853 - DNA, 25 bp, Rattus norvegicus
tacttttgagtatttgccccgtggc

SEQ ID NO: 554854 - DNA, 25 bp, Rattus norvegicus
tacttttgcatgagactggccgaca

SEQ ID NO: 554855 - DNA, 25 bp, Rattus norvegicus
tacttttgcatgtgactggccgaca

SEQ ID NO: 554856 - DNA, 25 bp, Rattus norvegicus
tacttttgcgtgagtttcacctgga

SEQ ID NO: 554857 - DNA, 25 bp, Rattus norvegicus
tacttttgcgtgtgtttcacctgga

SEQ ID NO: 554858 - DNA, 25 bp, Rattus norvegicus
tacttttgctgcaaccgctgctgct

SEQ ID NO: 554859 - DNA, 25 bp, Rattus norvegicus
tacttttgctgctaccgctgctgct

SEQ ID NO: 554860 - DNA, 25 bp, Rattus norvegicus
tacttttggatgatgcctgtgcagc

SEQ ID NO: 554861 - DNA, 25 bp, Rattus norvegicus
tacttttggatgttgcctgtgcagc

SEQ ID NO: 554862 - DNA, 25 bp, Rattus norvegicus
tacttttggccacagtagcttccag

SEQ ID NO: 554863 - DNA, 25 bp, Rattus norvegicus
tacttttggccagagtagcttccag

SEQ ID NO: 554864 - DNA, 25 bp, Rattus norvegicus
tacttttggctgaagacacctcatt

SEQ ID NO: 554865 - DNA, 25 bp, Rattus norvegicus
tacttttggctgtagacacctcatt

SEQ ID NO: 554866 - DNA, 25 bp, Rattus norvegicus
tacttttgggagacgatgggctgct

SEQ ID NO: 554867 - DNA, 25 bp, Rattus norvegicus
tacttttgggagtcgatgggctgct

SEQ ID NO: 554868 - DNA, 25 bp, Rattus norvegicus
tacttttgttacagagggtcgcctc

SEQ ID NO: 554869 - DNA, 25 bp, Rattus norvegicus
tacttttgttactgagggtcgcctc

SEQ ID NO: 554870 - DNA, 25 bp, Rattus norvegicus
tacttttgttgtcgctgttttctca

SEQ ID NO: 554871 - DNA, 25 bp, Rattus norvegicus
tacttttgttgtggctgttttctca

SEQ ID NO: 554872 - DNA, 25 bp, Rattus norvegicus
tactttttaaataccctgtgacgtg

SEQ ID NO: 554873 - DNA, 25 bp, Rattus norvegicus
tactttttaaattccctgtgacgtg

SEQ ID NO: 554874 - DNA, 25 bp, Rattus norvegicus
tactttttacgcctgtgcttagcca

SEQ ID NO: 554875 - DNA, 25 bp, Rattus norvegicus
tactttttacgcgtgtgcttagcca

SEQ ID NO: 554876 - DNA, 25 bp, Rattus norvegicus
tactttttggaaaagtgcctggaaa

SEQ ID NO: 554877 - DNA, 25 bp, Rattus norvegicus
tactttttggaatagtgcctggaaa

SEQ ID NO: 554878 - DNA, 25 bp, Rattus norvegicus
tactttttgtcaagtttcagtcggg

SEQ ID NO: 554879 - DNA, 25 bp, Rattus norvegicus
tactttttgtcatgtttcagtcggg

SEQ ID NO: 554880 - DNA, 25 bp, Rattus norvegicus
tactttttgtgtatctcctcttcta

SEQ ID NO: 554881 - DNA, 25 bp, Rattus norvegicus
tactttttgtgtttctcctcttcta

SEQ ID NO: 554882 - DNA, 25 bp, Rattus norvegicus
tacttttttacacatatgcttattt

SEQ ID NO: 554883 - DNA, 25 bp, Rattus norvegicus
tacttttttacagatatgcttattt

SEQ ID NO: 554884 - DNA, 25 bp, Rattus norvegicus
tacttttttgcactacttcttaagc

SEQ ID NO: 554885 - DNA, 25 bp, Rattus norvegicus
tacttttttgcagtacttcttaagc

SEQ ID NO: 554886 - DNA, 25 bp, Rattus norvegicus
tacttttttgtaagcctgaaatatt

SEQ ID NO: 554887 - DNA, 25 bp, Rattus norvegicus
tacttttttgtatgcctgaaatatt

SEQ ID NO: 554888 - DNA, 25 bp, Rattus norvegicus
tacttttttgtgacacgcctgcatt

SEQ ID NO: 554889 - DNA, 25 bp, Rattus norvegicus
tacttttttgtgtcacgcctgcatt

SEQ ID NO: 554890 - DNA, 25 bp, Rattus norvegicus
tagaaaaatgctaccgtgggccctg

SEQ ID NO: 554891 - DNA, 25 bp, Rattus norvegicus
tagaaaaatgcttccgtgggccctg

SEQ ID NO: 554892 - DNA, 25 bp, Rattus norvegicus
tagaaaacacgaccttcctcttcct

SEQ ID NO: 554893 - DNA, 25 bp, Rattus norvegicus
tagaaaacacgagcttcctcttcct

SEQ ID NO: 554894 - DNA, 25 bp, Rattus norvegicus
tagaaaacagcccttcagcctagtg

SEQ ID NO: 554895 - DNA, 25 bp, Rattus norvegicus
tagaaaacagccgttcagcctagtg

SEQ ID NO: 554896 - DNA, 25 bp, Rattus norvegicus
tagaaaacatccaattctcccgtcc

SEQ ID NO: 554897 - DNA, 25 bp, Rattus norvegicus
tagaaaacatcctattctcccgtcc

SEQ ID NO: 554898 - DNA, 25 bp, Rattus norvegicus
tagaaaaccacacctcgctgtatgg

SEQ ID NO: 554899 - DNA, 25 bp, Rattus norvegicus
tagaaaaccacagctcgctgtatgg

SEQ ID NO: 554900 - DNA, 25 bp, Rattus norvegicus
tagaaaaccagaacccgagtgccac

SEQ ID NO: 554901 - DNA, 25 bp, Rattus norvegicus
tagaaaaccagatcccgagtgccac

SEQ ID NO: 554902 - DNA, 25 bp, Rattus norvegicus
tagaaaacccaacgcctgagttgca

SEQ ID NO: 554903 - DNA, 25 bp, Rattus norvegicus
tagaaaacccaaggcctgagttgca

SEQ ID NO: 554904 - DNA, 25 bp, Rattus norvegicus
tagaaaaccgccagaactcctttat

SEQ ID NO: 554905 - DNA, 25 bp, Rattus norvegicus
tagaaaaccgcctgaactcctttat

SEQ ID NO: 554906 - DNA, 25 bp, Rattus norvegicus
tagaaaacgcaacctaggaaatgtt

SEQ ID NO: 554907 - DNA, 25 bp, Rattus norvegicus
tagaaaacgcaagctaggaaatgtt

SEQ ID NO: 554908 - DNA, 25 bp, Rattus norvegicus
tagaaaacgcccaggccaggacgcc

SEQ ID NO: 554909 - DNA, 25 bp, Rattus norvegicus
tagaaaacgccctggccaggacgcc

SEQ ID NO: 554910 - DNA, 25 bp, Rattus norvegicus
tagaaaacgtgaccctccaaatggg

SEQ ID NO: 554911 - DNA, 25 bp, Rattus norvegicus
tagaaaacgtgagcctccaaatggg

SEQ ID NO: 554912 - DNA, 25 bp, Rattus norvegicus
tagaaaactctgacttgttttccgt

SEQ ID NO: 554913 - DNA, 25 bp, Rattus norvegicus
tagaaaactctgtcttgttttccgt

SEQ ID NO: 554914 - DNA, 25 bp, Rattus norvegicus
tagaaaacttgaagccatgtctcat

SEQ ID NO: 554915 - DNA, 25 bp, Rattus norvegicus
tagaaaacttgatgccatgtctcat

SEQ ID NO: 554916 - DNA, 25 bp, Rattus norvegicus
tagaaaactttcatgtagctacttt

SEQ ID NO: 554917 - DNA, 25 bp, Rattus norvegicus
tagaaaactttcttgtagctacttt

SEQ ID NO: 554918 - DNA, 25 bp, Rattus norvegicus
tagaaaagccggaagagcccgcagt

SEQ ID NO: 554919 - DNA, 25 bp, Rattus norvegicus
tagaaaagccggtagagcccgcagt

SEQ ID NO: 554920 - DNA, 25 bp, Rattus norvegicus
tagaaaagccgtagcctcttcgtgt

SEQ ID NO: 554921 - DNA, 25 bp, Rattus norvegicus
tagaaaagccgttgcctcttcgtgt

SEQ ID NO: 554922 - DNA, 25 bp, Rattus norvegicus
tagaaaagccttctctgaacccgtg

SEQ ID NO: 554923 - DNA, 25 bp, Rattus norvegicus
tagaaaagccttgtctgaacccgtg

SEQ ID NO: 554924 - DNA, 25 bp, Rattus norvegicus
tagaaaagggtcacccaatagccca

SEQ ID NO: 554925 - DNA, 25 bp, Rattus norvegicus
tagaaaagggtctcccaatagccca

SEQ ID NO: 554926 - DNA, 25 bp, Rattus norvegicus
tagaaaatgcgcatgtctcgcccct

SEQ ID NO: 554927 - DNA, 25 bp, Rattus norvegicus
tagaaaatgcgcttgtctcgcccct

SEQ ID NO: 554928 - DNA, 25 bp, Rattus norvegicus
tagaaaatgtcaacccatcagaatt

SEQ ID NO: 554929 - DNA, 25 bp, Rattus norvegicus
tagaaaatgtcatcccatcagaatt

SEQ ID NO: 554930 - DNA, 25 bp, Rattus norvegicus
tagaaaattaaactgcccttattat

SEQ ID NO: 554931 - DNA, 25 bp, Rattus norvegicus
tagaaaattaaagtgcccttattat

SEQ ID NO: 554932 - DNA, 25 bp, Rattus norvegicus
tagaaaatttatcactgcccaagtg

SEQ ID NO: 554933 - DNA, 25 bp, Rattus norvegicus
tagaaaatttatgactgcccaagtg

SEQ ID NO: 554934 - DNA, 25 bp, Rattus norvegicus
tagaaacagaacatctccccagaag

SEQ ID NO: 554935 - DNA, 25 bp, Rattus norvegicus
tagaaacagaacttctccccagaag

SEQ ID NO: 554936 - DNA, 25 bp, Rattus norvegicus
tagaaacaggcacactggactcagt

SEQ ID NO: 554937 - DNA, 25 bp, Rattus norvegicus
tagaaacaggcagactggactcagt

SEQ ID NO: 554938 - DNA, 25 bp, Rattus norvegicus
tagaaacatccaagagcgtcacccc

SEQ ID NO: 554939 - DNA, 25 bp, Rattus norvegicus
tagaaacatccatgagcgtcacccc

SEQ ID NO: 554940 - DNA, 25 bp, Rattus norvegicus
tagaaaccagccaagccgcagaaca

SEQ ID NO: 554941 - DNA, 25 bp, Rattus norvegicus
tagaaaccagcctagccgcagaaca

SEQ ID NO: 554942 - DNA, 25 bp, Rattus norvegicus
tagaaaccatccagattccagccag

SEQ ID NO: 554943 - DNA, 25 bp, Rattus norvegicus
tagaaaccatcctgattccagccag

SEQ ID NO: 554944 - DNA, 25 bp, Rattus norvegicus
tagaaacccgcacgtgtccttagag

SEQ ID NO: 554945 - DNA, 25 bp, Rattus norvegicus
tagaaacccgcaggtgtccttagag

SEQ ID NO: 554946 - DNA, 25 bp, Rattus norvegicus
tagaaaccgatgcttctctttctca

SEQ ID NO: 554947 - DNA, 25 bp, Rattus norvegicus
tagaaaccgatggttctctttctca

SEQ ID NO: 554948 - DNA, 25 bp, Rattus norvegicus
tagaaacctacgaagaagcatgggc

SEQ ID NO: 554949 - DNA, 25 bp, Rattus norvegicus
tagaaacctacgtagaagcatgggc

SEQ ID NO: 554950 - DNA, 25 bp, Rattus norvegicus
tagaaaccttccctcttagtgtcaa

SEQ ID NO: 554951 - DNA, 25 bp, Rattus norvegicus
tagaaaccttccgtcttagtgtcaa

SEQ ID NO: 554952 - DNA, 25 bp, Rattus norvegicus
tagaaactctccctttattcctaat

SEQ ID NO: 554953 - DNA, 25 bp, Rattus norvegicus
tagaaactctccgtttattcctaat

SEQ ID NO: 554954 - DNA, 25 bp, Rattus norvegicus
tagaaactctctatccaccaaggtc

SEQ ID NO: 554955 - DNA, 25 bp, Rattus norvegicus
tagaaactctctttccaccaaggtc

SEQ ID NO: 554956 - DNA, 25 bp, Rattus norvegicus
tagaaactgaacactgggtccccac

SEQ ID NO: 554957 - DNA, 25 bp, Rattus norvegicus
tagaaactgaactctgggtccccac

SEQ ID NO: 554958 - DNA, 25 bp, Rattus norvegicus
tagaaactgaatatcccaccatcct

SEQ ID NO: 554959 - DNA, 25 bp, Rattus norvegicus
tagaaactgaatttcccaccatcct

SEQ ID NO: 554960 - DNA, 25 bp, Rattus norvegicus
tagaaactgagcatgcgctgcgacg

SEQ ID NO: 554961 - DNA, 25 bp, Rattus norvegicus
tagaaactgagcttgcgctgcgacg

SEQ ID NO: 554962 - DNA, 25 bp, Rattus norvegicus
tagaaagaacttacgtgccccggct

SEQ ID NO: 554963 - DNA, 25 bp, Rattus norvegicus
tagaaagaactttcgtgccccggct

SEQ ID NO: 554964 - DNA, 25 bp, Rattus norvegicus
tagaaagaagacctggccccagtca

SEQ ID NO: 554965 - DNA, 25 bp, Rattus norvegicus
tagaaagaagacgtggccccagtca

SEQ ID NO: 554966 - DNA, 25 bp, Rattus norvegicus
tagaaagaagtcctcacctgggctt

SEQ ID NO: 554967 - DNA, 25 bp, Rattus norvegicus
tagaaagaagtcgtcacctgggctt

SEQ ID NO: 554968 - DNA, 25 bp, Rattus norvegicus
tagaaagaatccctaagcagacctt

SEQ ID NO: 554969 - DNA, 25 bp, Rattus norvegicus
tagaaagaatccgtaagcagacctt

SEQ ID NO: 554970 - DNA, 25 bp, Rattus norvegicus
tagaaagagttcaataccgtgtatt

SEQ ID NO: 554971 - DNA, 25 bp, Rattus norvegicus
tagaaagagttctataccgtgtatt

SEQ ID NO: 554972 - DNA, 25 bp, Rattus norvegicus
tagaaagattgcagccgggctcaga

SEQ ID NO: 554973 - DNA, 25 bp, Rattus norvegicus
tagaaagattgctgccgggctcaga

SEQ ID NO: 554974 - DNA, 25 bp, Rattus norvegicus
tagaaagcacaacctcaccatgctg

SEQ ID NO: 554975 - DNA, 25 bp, Rattus norvegicus
tagaaagcacaagctcaccatgctg

SEQ ID NO: 554976 - DNA, 25 bp, Rattus norvegicus
tagaaagcattacattcccctggaa

SEQ ID NO: 554977 - DNA, 25 bp, Rattus norvegicus
tagaaagcattagattcccctggaa

SEQ ID NO: 554978 - DNA, 25 bp, Rattus norvegicus
tagaaagccactacttccattttcc

SEQ ID NO: 554979 - DNA, 25 bp, Rattus norvegicus
tagaaagccacttcttccattttcc

SEQ ID NO: 554980 - DNA, 25 bp, Rattus norvegicus
tagaaagcccagcacagctcaggcc

SEQ ID NO: 554981 - DNA, 25 bp, Rattus norvegicus
tagaaagcccaggacagctcaggcc

SEQ ID NO: 554982 - DNA, 25 bp, Rattus norvegicus
tagaaagcctctacgggaccctgaa

SEQ ID NO: 554983 - DNA, 25 bp, Rattus norvegicus
tagaaagcctcttcgggaccctgaa

SEQ ID NO: 554984 - DNA, 25 bp, Rattus norvegicus
tagaaagcgtacctcagcccagtgt

SEQ ID NO: 554985 - DNA, 25 bp, Rattus norvegicus
tagaaagcgtacgtcagcccagtgt

SEQ ID NO: 554986 - DNA, 25 bp, Rattus norvegicus
tagaaagctctcattacaccatccc

SEQ ID NO: 554987 - DNA, 25 bp, Rattus norvegicus
tagaaagctctctttacaccatccc

SEQ ID NO: 554988 - DNA, 25 bp, Rattus norvegicus
tagaaaggaccacatgtgccaccct

SEQ ID NO: 554989 - DNA, 25 bp, Rattus norvegicus
tagaaaggaccagatgtgccaccct

SEQ ID NO: 554990 - DNA, 25 bp, Rattus norvegicus
tagaaaggagctccgtcttcctatt

SEQ ID NO: 554991 - DNA, 25 bp, Rattus norvegicus
tagaaaggagctgcgtcttcctatt

SEQ ID NO: 554992 - DNA, 25 bp, Rattus norvegicus
tagaaaggccctaacaacaaagtat

SEQ ID NO: 554993 - DNA, 25 bp, Rattus norvegicus
tagaaaggcccttacaacaaagtat

SEQ ID NO: 554994 - DNA, 25 bp, Rattus norvegicus
tagaaaggctgcacggatccccagt

SEQ ID NO: 554995 - DNA, 25 bp, Rattus norvegicus
tagaaaggctgctcggatccccagt

SEQ ID NO: 554996 - DNA, 25 bp, Rattus norvegicus
tagaaagggtctaccttctcatcac

SEQ ID NO: 554997 - DNA, 25 bp, Rattus norvegicus
tagaaagggtcttccttctcatcac

SEQ ID NO: 554998 - DNA, 25 bp, Rattus norvegicus
tagaaagtacctatgcttctggtcc

SEQ ID NO: 554999 - DNA, 25 bp, Rattus norvegicus
tagaaagtacctttgcttctggtcc

SEQ ID NO: 555000 - DNA, 25 bp, Rattus norvegicus
tagaaagtactgagcctaccctggg

SEQ ID NO: 555001 - DNA, 25 bp, Rattus norvegicus
tagaaagtactgtgcctaccctggg

SEQ ID NO: 555002 - DNA, 25 bp, Rattus norvegicus
tagaaagtcaacatgaaagcgattt

SEQ ID NO: 555003 - DNA, 25 bp, Rattus norvegicus
tagaaagtcaacttgaaagcgattt

SEQ ID NO: 555004 - DNA, 25 bp, Rattus norvegicus
tagaaagtgacccagctgcagggca

SEQ ID NO: 555005 - DNA, 25 bp, Rattus norvegicus
tagaaagtgaccgagctgcagggca

SEQ ID NO: 555006 - DNA, 25 bp, Rattus norvegicus
tagaaagtgcccatcaacggaccct

SEQ ID NO: 555007 - DNA, 25 bp, Rattus norvegicus
tagaaagtgcccttcaacggaccct

SEQ ID NO: 555008 - DNA, 25 bp, Rattus norvegicus
tagaaataacctccgtgttgtctca

SEQ ID NO: 555009 - DNA, 25 bp, Rattus norvegicus
tagaaataacctgcgtgttgtctca

SEQ ID NO: 555010 - DNA, 25 bp, Rattus norvegicus
tagaaatagaatctctgcccccgaa

SEQ ID NO: 555011 - DNA, 25 bp, Rattus norvegicus
tagaaatagaatgtctgcccccgaa

SEQ ID NO: 555012 - DNA, 25 bp, Rattus norvegicus
tagaaatagtcacggcactctgctc

SEQ ID NO: 555013 - DNA, 25 bp, Rattus norvegicus
tagaaatagtcagggcactctgctc

SEQ ID NO: 555014 - DNA, 25 bp, Rattus norvegicus
tagaaatattcgactccctggtctt

SEQ ID NO: 555015 - DNA, 25 bp, Rattus norvegicus
tagaaatattcgtctccctggtctt

SEQ ID NO: 555016 - DNA, 25 bp, Rattus norvegicus
tagaaatcacgtcctgcggctttac

SEQ ID NO: 555017 - DNA, 25 bp, Rattus norvegicus
tagaaatcacgtgctgcggctttac

SEQ ID NO: 555018 - DNA, 25 bp, Rattus norvegicus
tagaaatccgaaaatcctgtcccct

SEQ ID NO: 555019 - DNA, 25 bp, Rattus norvegicus
tagaaatccgaatatcctgtcccct

SEQ ID NO: 555020 - DNA, 25 bp, Rattus norvegicus
tagaaatcctcaaaccagtgtcaga

SEQ ID NO: 555021 - DNA, 25 bp, Rattus norvegicus
tagaaatcctcataccagtgtcaga

SEQ ID NO: 555022 - DNA, 25 bp, Rattus norvegicus
tagaaatcggagctgtggatgctct

SEQ ID NO: 555023 - DNA, 25 bp, Rattus norvegicus
tagaaatcggaggtgtggatgctct

SEQ ID NO: 555024 - DNA, 25 bp, Rattus norvegicus
tagaaatctagtccctcccgacgtc

SEQ ID NO: 555025 - DNA, 25 bp, Rattus norvegicus
tagaaatctagtgcctcccgacgtc

SEQ ID NO: 555026 - DNA, 25 bp, Rattus norvegicus
tagaaatctccacccatttgagctt

SEQ ID NO: 555027 - DNA, 25 bp, Rattus norvegicus
tagaaatctccagccatttgagctt

SEQ ID NO: 555028 - DNA, 25 bp, Rattus norvegicus
tagaaatcttctcctcggcaagtcc

SEQ ID NO: 555029 - DNA, 25 bp, Rattus norvegicus
tagaaatcttctgctcggcaagtcc

SEQ ID NO: 555030 - DNA, 25 bp, Rattus norvegicus
tagaaatgagccctcttacctcttg

SEQ ID NO: 555031 - DNA, 25 bp, Rattus norvegicus
tagaaatgagccgtcttacctcttg

SEQ ID NO: 555032 - DNA, 25 bp, Rattus norvegicus
tagaaatgagtccttcccacatcaa

SEQ ID NO: 555033 - DNA, 25 bp, Rattus norvegicus
tagaaatgagtcgttcccacatcaa

SEQ ID NO: 555034 - DNA, 25 bp, Rattus norvegicus
tagaaatgcactattaccccacaat

SEQ ID NO: 555035 - DNA, 25 bp, Rattus norvegicus
tagaaatgcacttttaccccacaat

SEQ ID NO: 555036 - DNA, 25 bp, Rattus norvegicus
tagaaatgccacagtatccttcctt

SEQ ID NO: 555037 - DNA, 25 bp, Rattus norvegicus
tagaaatgccactgtatccttcctt

SEQ ID NO: 555038 - DNA, 25 bp, Rattus norvegicus
tagaaattcagtagccatcaccaga

SEQ ID NO: 555039 - DNA, 25 bp, Rattus norvegicus
tagaaattcagttgccatcaccaga

SEQ ID NO: 555040 - DNA, 25 bp, Rattus norvegicus
tagaaattccctaattcctttgaag

SEQ ID NO: 555041 - DNA, 25 bp, Rattus norvegicus
tagaaattcccttattcctttgaag

SEQ ID NO: 555042 - DNA, 25 bp, Rattus norvegicus
tagaaattggagagggaaagcccag

SEQ ID NO: 555043 - DNA, 25 bp, Rattus norvegicus
tagaaattggagtgggaaagcccag

SEQ ID NO: 555044 - DNA, 25 bp, Rattus norvegicus
tagaacaaccaactcctgtttgaaa

SEQ ID NO: 555045 - DNA, 25 bp, Rattus norvegicus
tagaacaaccaagtcctgtttgaaa

SEQ ID NO: 555046 - DNA, 25 bp, Rattus norvegicus
tagaacaacctacgctctttctgtc

SEQ ID NO: 555047 - DNA, 25 bp, Rattus norvegicus
tagaacaacctaggctctttctgtc

SEQ ID NO: 555048 - DNA, 25 bp, Rattus norvegicus
tagaacaagccaccagcttcagctc

SEQ ID NO: 555049 - DNA, 25 bp, Rattus norvegicus
tagaacaagccagcagcttcagctc

SEQ ID NO: 555050 - DNA, 25 bp, Rattus norvegicus
tagaacaaggaccacaggaccactc

SEQ ID NO: 555051 - DNA, 25 bp, Rattus norvegicus
tagaacaaggacgacaggaccactc

SEQ ID NO: 555052 - DNA, 25 bp, Rattus norvegicus
tagaacaatgatctccctcacaggg

SEQ ID NO: 555053 - DNA, 25 bp, Rattus norvegicus
tagaacaatgatgtccctcacaggg

SEQ ID NO: 555054 - DNA, 25 bp, Rattus norvegicus
tagaacacaagacctacttcaccgg

SEQ ID NO: 555055 - DNA, 25 bp, Rattus norvegicus
tagaacacaagagctacttcaccgg

SEQ ID NO: 555056 - DNA, 25 bp, Rattus norvegicus
tagaacacacgtctgatgtcaccac

SEQ ID NO: 555057 - DNA, 25 bp, Rattus norvegicus
tagaacacacgtgtgatgtcaccac

SEQ ID NO: 555058 - DNA, 25 bp, Rattus norvegicus
tagaacacagaacccacatcatgat

SEQ ID NO: 555059 - DNA, 25 bp, Rattus norvegicus
tagaacacagaagccacatcatgat

SEQ ID NO: 555060 - DNA, 25 bp, Rattus norvegicus
tagaacacaggccaggtctgacctg

SEQ ID NO: 555061 - DNA, 25 bp, Rattus norvegicus
tagaacacaggcgaggtctgacctg

SEQ ID NO: 555062 - DNA, 25 bp, Rattus norvegicus
tagaacaccagacgatcacgcccag

SEQ ID NO: 555063 - DNA, 25 bp, Rattus norvegicus
tagaacaccagaggatcacgcccag

SEQ ID NO: 555064 - DNA, 25 bp, Rattus norvegicus
tagaacaccaggctcaagacatcct

SEQ ID NO: 555065 - DNA, 25 bp, Rattus norvegicus
tagaacaccagggtcaagacatcct

SEQ ID NO: 555066 - DNA, 25 bp, Rattus norvegicus
tagaacacccaccagaaaatccagt

SEQ ID NO: 555067 - DNA, 25 bp, Rattus norvegicus
tagaacacccacgagaaaatccagt

SEQ ID NO: 555068 - DNA, 25 bp, Rattus norvegicus
tagaacacctagagctgctgtggaa

SEQ ID NO: 555069 - DNA, 25 bp, Rattus norvegicus
tagaacacctagtgctgctgtggaa

SEQ ID NO: 555070 - DNA, 25 bp, Rattus norvegicus
tagaacacttgcctgacaggacaag

SEQ ID NO: 555071 - DNA, 25 bp, Rattus norvegicus
tagaacacttgcgtgacaggacaag

SEQ ID NO: 555072 - DNA, 25 bp, Rattus norvegicus
tagaacagcatgacgtcctgcctgg

SEQ ID NO: 555073 - DNA, 25 bp, Rattus norvegicus
tagaacagcatgtcgtcctgcctgg

SEQ ID NO: 555074 - DNA, 25 bp, Rattus norvegicus
tagaacagcctcagtggtggacctg

SEQ ID NO: 555075 - DNA, 25 bp, Rattus norvegicus
tagaacagcctctgtggtggacctg

SEQ ID NO: 555076 - DNA, 25 bp, Rattus norvegicus
tagaacagcttgagtacgcgcgggt

SEQ ID NO: 555077 - DNA, 25 bp, Rattus norvegicus
tagaacagcttgtgtacgcgcgggt

SEQ ID NO: 555078 - DNA, 25 bp, Rattus norvegicus
tagaacagggctaaggtctcctaga

SEQ ID NO: 555079 - DNA, 25 bp, Rattus norvegicus
tagaacagggcttaggtctcctaga

SEQ ID NO: 555080 - DNA, 25 bp, Rattus norvegicus
tagaacaggtgccacagcagccaac

SEQ ID NO: 555081 - DNA, 25 bp, Rattus norvegicus
tagaacaggtgcgacagcagccaac

SEQ ID NO: 555082 - DNA, 25 bp, Rattus norvegicus
tagaacatagcaatcctccagggct

SEQ ID NO: 555083 - DNA, 25 bp, Rattus norvegicus
tagaacatagcattcctccagggct

SEQ ID NO: 555084 - DNA, 25 bp, Rattus norvegicus
tagaacatatttactgcagggcaat

SEQ ID NO: 555085 - DNA, 25 bp, Rattus norvegicus
tagaacatattttctgcagggcaat

SEQ ID NO: 555086 - DNA, 25 bp, Rattus norvegicus
tagaacattactactcacctagtaa

SEQ ID NO: 555087 - DNA, 25 bp, Rattus norvegicus
tagaacattacttctcacctagtaa

SEQ ID NO: 555088 - DNA, 25 bp, Rattus norvegicus
tagaacattattagccacggtgatc

SEQ ID NO: 555089 - DNA, 25 bp, Rattus norvegicus
tagaacattatttgccacggtgatc

SEQ ID NO: 555090 - DNA, 25 bp, Rattus norvegicus
tagaacattgagctcctttgcatgg

SEQ ID NO: 555091 - DNA, 25 bp, Rattus norvegicus
tagaacattgaggtcctttgcatgg

SEQ ID NO: 555092 - DNA, 25 bp, Rattus norvegicus
tagaacatttccactcattccttag

SEQ ID NO: 555093 - DNA, 25 bp, Rattus norvegicus
tagaacatttcctctcattccttag

SEQ ID NO: 555094 - DNA, 25 bp, Rattus norvegicus
tagaacatttttctgccgttatatt

SEQ ID NO: 555095 - DNA, 25 bp, Rattus norvegicus
tagaacatttttgtgccgttatatt

SEQ ID NO: 555096 - DNA, 25 bp, Rattus norvegicus
tagaaccacgcccttcatataaagc

SEQ ID NO: 555097 - DNA, 25 bp, Rattus norvegicus
tagaaccacgccgttcatataaagc

SEQ ID NO: 555098 - DNA, 25 bp, Rattus norvegicus
tagaaccagtggctgggtactcatg

SEQ ID NO: 555099 - DNA, 25 bp, Rattus norvegicus
tagaaccagtgggtgggtactcatg

SEQ ID NO: 555100 - DNA, 25 bp, Rattus norvegicus
tagaaccagttcatgctggccaaaa

SEQ ID NO: 555101 - DNA, 25 bp, Rattus norvegicus
tagaaccagttcttgctggccaaaa

SEQ ID NO: 555102 - DNA, 25 bp, Rattus norvegicus
tagaacccaccgagtctgtacaaat

SEQ ID NO: 555103 - DNA, 25 bp, Rattus norvegicus
tagaacccaccgtgtctgtacaaat

SEQ ID NO: 555104 - DNA, 25 bp, Rattus norvegicus
tagaaccccaacctccatcaggaaa

SEQ ID NO: 555105 - DNA, 25 bp, Rattus norvegicus
tagaaccccaacgtccatcaggaaa

SEQ ID NO: 555106 - DNA, 25 bp, Rattus norvegicus
tagaaccccacaaattccgtgctaa

SEQ ID NO: 555107 - DNA, 25 bp, Rattus norvegicus
tagaaccccacatattccgtgctaa

SEQ ID NO: 555108 - DNA, 25 bp, Rattus norvegicus
tagaacccctgactctgtgctgtca

SEQ ID NO: 555109 - DNA, 25 bp, Rattus norvegicus
tagaacccctgagtctgtgctgtca

SEQ ID NO: 555110 - DNA, 25 bp, Rattus norvegicus
tagaacccgcagcagtaaccgtcag

SEQ ID NO: 555111 - DNA, 25 bp, Rattus norvegicus
tagaacccgcaggagtaaccgtcag

SEQ ID NO: 555112 - DNA, 25 bp, Rattus norvegicus
tagaacctacatctgttcacctgct

SEQ ID NO: 555113 - DNA, 25 bp, Rattus norvegicus
tagaacctacatgtgttcacctgct

SEQ ID NO: 555114 - DNA, 25 bp, Rattus norvegicus
tagaacctcgcgatctttaaagtgt

SEQ ID NO: 555115 - DNA, 25 bp, Rattus norvegicus
tagaacctcgcgttctttaaagtgt

SEQ ID NO: 555116 - DNA, 25 bp, Rattus norvegicus
tagaacctggatcttgtggagcaaa

SEQ ID NO: 555117 - DNA, 25 bp, Rattus norvegicus
tagaacctggatgttgtggagcaaa

SEQ ID NO: 555118 - DNA, 25 bp, Rattus norvegicus
tagaacctgttgaggctgcatttcc

SEQ ID NO: 555119 - DNA, 25 bp, Rattus norvegicus
tagaacctgttgtggctgcatttcc

SEQ ID NO: 555120 - DNA, 25 bp, Rattus norvegicus
tagaaccttgctatgtagattggaa

SEQ ID NO: 555121 - DNA, 25 bp, Rattus norvegicus
tagaaccttgctttgtagattggaa

SEQ ID NO: 555122 - DNA, 25 bp, Rattus norvegicus
tagaaccttttcacacctcgattag

SEQ ID NO: 555123 - DNA, 25 bp, Rattus norvegicus
tagaaccttttctcacctcgattag

SEQ ID NO: 555124 - DNA, 25 bp, Rattus norvegicus
tagaacctttttcttggtatgtata

SEQ ID NO: 555125 - DNA, 25 bp, Rattus norvegicus
tagaacctttttgttggtatgtata

SEQ ID NO: 555126 - DNA, 25 bp, Rattus norvegicus
tagaacgacacaccgagctgagctg

SEQ ID NO: 555127 - DNA, 25 bp, Rattus norvegicus
tagaacgacacagcgagctgagctg

SEQ ID NO: 555128 - DNA, 25 bp, Rattus norvegicus
tagaacgaggcaacagcgtgttttg

SEQ ID NO: 555129 - DNA, 25 bp, Rattus norvegicus
tagaacgaggcatcagcgtgttttg

SEQ ID NO: 555130 - DNA, 25 bp, Rattus norvegicus
tagaacgctgtcaggatcactgctt

SEQ ID NO: 555131 - DNA, 25 bp, Rattus norvegicus
tagaacgctgtctggatcactgctt

SEQ ID NO: 555132 - DNA, 25 bp, Rattus norvegicus
tagaacggctgaagctctctatgcc

SEQ ID NO: 555133 - DNA, 25 bp, Rattus norvegicus
tagaacggctgatgctctctatgcc

SEQ ID NO: 555134 - DNA, 25 bp, Rattus norvegicus
tagaactaaggcagggagtcccctt

SEQ ID NO: 555135 - DNA, 25 bp, Rattus norvegicus
tagaactaaggctgggagtcccctt

SEQ ID NO: 555136 - DNA, 25 bp, Rattus norvegicus
tagaactagcacacaggaccttcct

SEQ ID NO: 555137 - DNA, 25 bp, Rattus norvegicus
tagaactagcactcaggaccttcct

SEQ ID NO: 555138 - DNA, 25 bp, Rattus norvegicus
tagaactcactaccctgctgatcat

SEQ ID NO: 555139 - DNA, 25 bp, Rattus norvegicus
tagaactcactagcctgctgatcat

SEQ ID NO: 555140 - DNA, 25 bp, Rattus norvegicus
tagaactcagagactaccctgtcgt

SEQ ID NO: 555141 - DNA, 25 bp, Rattus norvegicus
tagaactcagagtctaccctgtcgt

SEQ ID NO: 555142 - DNA, 25 bp, Rattus norvegicus
tagaactcagctctcctgtttacta

SEQ ID NO: 555143 - DNA, 25 bp, Rattus norvegicus
tagaactcagctgtcctgtttacta

SEQ ID NO: 555144 - DNA, 25 bp, Rattus norvegicus
tagaactccaccatggccagaagga

SEQ ID NO: 555145 - DNA, 25 bp, Rattus norvegicus
tagaactccaccttggccagaagga

SEQ ID NO: 555146 - DNA, 25 bp, Rattus norvegicus
tagaactccctcatttgactagact

SEQ ID NO: 555147 - DNA, 25 bp, Rattus norvegicus
tagaactccctcttttgactagact

SEQ ID NO: 555148 - DNA, 25 bp, Rattus norvegicus
tagaactcctatattgactaccggt

SEQ ID NO: 555149 - DNA, 25 bp, Rattus norvegicus
tagaactcctattttgactaccggt

SEQ ID NO: 555150 - DNA, 25 bp, Rattus norvegicus
tagaactctcagcagtgccagtact

SEQ ID NO: 555151 - DNA, 25 bp, Rattus norvegicus
tagaactctcaggagtgccagtact

SEQ ID NO: 555152 - DNA, 25 bp, Rattus norvegicus
tagaactctgtaactgtccataagt

SEQ ID NO: 555153 - DNA, 25 bp, Rattus norvegicus
tagaactctgtatctgtccataagt

SEQ ID NO: 555154 - DNA, 25 bp, Rattus norvegicus
tagaactgaagcacctcagaggaca

SEQ ID NO: 555155 - DNA, 25 bp, Rattus norvegicus
tagaactgaagctcctcagaggaca

SEQ ID NO: 555156 - DNA, 25 bp, Rattus norvegicus
tagaactgacccactgtgacagcct

SEQ ID NO: 555157 - DNA, 25 bp, Rattus norvegicus
tagaactgaccctctgtgacagcct

SEQ ID NO: 555158 - DNA, 25 bp, Rattus norvegicus
tagaactgagaacgatgtgtgcgta

SEQ ID NO: 555159 - DNA, 25 bp, Rattus norvegicus
tagaactgagaaggatgtgtgcgta

SEQ ID NO: 555160 - DNA, 25 bp, Rattus norvegicus
tagaactgcttgcttgtccacaatc

SEQ ID NO: 555161 - DNA, 25 bp, Rattus norvegicus
tagaactgcttggttgtccacaatc

SEQ ID NO: 555162 - DNA, 25 bp, Rattus norvegicus
tagaactggagtcctatatcttttc

SEQ ID NO: 555163 - DNA, 25 bp, Rattus norvegicus
tagaactggagtgctatatcttttc

SEQ ID NO: 555164 - DNA, 25 bp, Rattus norvegicus
tagaactggcttccccttggaaaca

SEQ ID NO: 555165 - DNA, 25 bp, Rattus norvegicus
tagaactggcttgcccttggaaaca

SEQ ID NO: 555166 - DNA, 25 bp, Rattus norvegicus
tagaactgtacaccagacaccccag

SEQ ID NO: 555167 - DNA, 25 bp, Rattus norvegicus
tagaactgtacagcagacaccccag

SEQ ID NO: 555168 - DNA, 25 bp, Rattus norvegicus
tagaactgtcagcagcttgccgatc

SEQ ID NO: 555169 - DNA, 25 bp, Rattus norvegicus
tagaactgtcaggagcttgccgatc

SEQ ID NO: 555170 - DNA, 25 bp, Rattus norvegicus
tagaactgtccaccttcttcctgaa

SEQ ID NO: 555171 - DNA, 25 bp, Rattus norvegicus
tagaactgtccagcttcttcctgaa

SEQ ID NO: 555172 - DNA, 25 bp, Rattus norvegicus
tagaactgtttgacgttacttcctt

SEQ ID NO: 555173 - DNA, 25 bp, Rattus norvegicus
tagaactgtttgtcgttacttcctt

SEQ ID NO: 555174 - DNA, 25 bp, Rattus norvegicus
tagaacttacacattgccgtgcacg

SEQ ID NO: 555175 - DNA, 25 bp, Rattus norvegicus
tagaacttacactttgccgtgcacg

SEQ ID NO: 555176 - DNA, 25 bp, Rattus norvegicus
tagaacttaccaacagcaccacctt

SEQ ID NO: 555177 - DNA, 25 bp, Rattus norvegicus
tagaacttaccatcagcaccacctt

SEQ ID NO: 555178 - DNA, 25 bp, Rattus norvegicus
tagaacttataaaaactactggact

SEQ ID NO: 555179 - DNA, 25 bp, Rattus norvegicus
tagaacttataataactactggact

SEQ ID NO: 555180 - DNA, 25 bp, Rattus norvegicus
tagaacttgcggagtctttcagaat

SEQ ID NO: 555181 - DNA, 25 bp, Rattus norvegicus
tagaacttgcggtgtctttcagaat

SEQ ID NO: 555182 - DNA, 25 bp, Rattus norvegicus
tagaacttgctgacccagatcctgg

SEQ ID NO: 555183 - DNA, 25 bp, Rattus norvegicus
tagaacttgctgtcccagatcctgg

SEQ ID NO: 555184 - DNA, 25 bp, Rattus norvegicus
tagaacttgttgacgctgccagtga

SEQ ID NO: 555185 - DNA, 25 bp, Rattus norvegicus
tagaacttgttgtcgctgccagtga

SEQ ID NO: 555186 - DNA, 25 bp, Rattus norvegicus
tagaactttacacggcaaaatggac

SEQ ID NO: 555187 - DNA, 25 bp, Rattus norvegicus
tagaactttacagggcaaaatggac

SEQ ID NO: 555188 - DNA, 25 bp, Rattus norvegicus
tagaactttgcactgaccctgggaa

SEQ ID NO: 555189 - DNA, 25 bp, Rattus norvegicus
tagaactttgcagtgaccctgggaa

SEQ ID NO: 555190 - DNA, 25 bp, Rattus norvegicus
tagaactttgtcagagccggactct

SEQ ID NO: 555191 - DNA, 25 bp, Rattus norvegicus
tagaactttgtctgagccggactct

SEQ ID NO: 555192 - DNA, 25 bp, Rattus norvegicus
tagaacttttgcctttacttgattt

SEQ ID NO: 555193 - DNA, 25 bp, Rattus norvegicus
tagaacttttgcgtttacttgattt

SEQ ID NO: 555194 - DNA, 25 bp, Rattus norvegicus
tagaacttttgtagaccactctggc

SEQ ID NO: 555195 - DNA, 25 bp, Rattus norvegicus
tagaacttttgttgaccactctggc

SEQ ID NO: 555196 - DNA, 25 bp, Rattus norvegicus
tagaagaaaaacagtgtgccctaca

SEQ ID NO: 555197 - DNA, 25 bp, Rattus norvegicus
tagaagaaaaactgtgtgccctaca

SEQ ID NO: 555198 - DNA, 25 bp, Rattus norvegicus
tagaagaagctgatggccgcatcca

SEQ ID NO: 555199 - DNA, 25 bp, Rattus norvegicus
tagaagaagctgttggccgcatcca

SEQ ID NO: 555200 - DNA, 25 bp, Rattus norvegicus
tagaagaatcagacagctgggttgg

SEQ ID NO: 555201 - DNA, 25 bp, Rattus norvegicus
tagaagaatcagtcagctgggttgg

SEQ ID NO: 555202 - DNA, 25 bp, Rattus norvegicus
tagaagacaaggagcagaacaacac

SEQ ID NO: 555203 - DNA, 25 bp, Rattus norvegicus
tagaagacaaggtgcagaacaacac

SEQ ID NO: 555204 - DNA, 25 bp, Rattus norvegicus
tagaagaccgggactcttcctcatg

SEQ ID NO: 555205 - DNA, 25 bp, Rattus norvegicus
tagaagaccgggtctcttcctcatg

SEQ ID NO: 555206 - DNA, 25 bp, Rattus norvegicus
tagaagacctcacggcggctccgat

SEQ ID NO: 555207 - DNA, 25 bp, Rattus norvegicus
tagaagacctcagggcggctccgat

SEQ ID NO: 555208 - DNA, 25 bp, Rattus norvegicus
tagaagacggccatctgccaggagc

SEQ ID NO: 555209 - DNA, 25 bp, Rattus norvegicus
tagaagacggccttctgccaggagc

SEQ ID NO: 555210 - DNA, 25 bp, Rattus norvegicus
tagaagactccacagccttcatctg

SEQ ID NO: 555211 - DNA, 25 bp, Rattus norvegicus
tagaagactccagagccttcatctg

SEQ ID NO: 555212 - DNA, 25 bp, Rattus norvegicus
tagaagagatgtccctgctgtcgct

SEQ ID NO: 555213 - DNA, 25 bp, Rattus norvegicus
tagaagagatgtgcctgctgtcgct

SEQ ID NO: 555214 - DNA, 25 bp, Rattus norvegicus
tagaagagatttatcaccgggtccc

SEQ ID NO: 555215 - DNA, 25 bp, Rattus norvegicus
tagaagagatttttcaccgggtccc

SEQ ID NO: 555216 - DNA, 25 bp, Rattus norvegicus
tagaagagcgaaactcagaggcaga

SEQ ID NO: 555217 - DNA, 25 bp, Rattus norvegicus
tagaagagcgaatctcagaggcaga

SEQ ID NO: 555218 - DNA, 25 bp, Rattus norvegicus
tagaagagttacctacccgggctgt

SEQ ID NO: 555219 - DNA, 25 bp, Rattus norvegicus
tagaagagttacgtacccgggctgt

SEQ ID NO: 555220 - DNA, 25 bp, Rattus norvegicus
tagaagagttccactcctttccatt

SEQ ID NO: 555221 - DNA, 25 bp, Rattus norvegicus
tagaagagttccctatgccttttgc

SEQ ID NO: 555222 - DNA, 25 bp, Rattus norvegicus
tagaagagttccgtatgccttttgc

SEQ ID NO: 555223 - DNA, 25 bp, Rattus norvegicus
tagaagagttcctctcctttccatt

SEQ ID NO: 555224 - DNA, 25 bp, Rattus norvegicus
tagaagatagcactgcccaaccttt

SEQ ID NO: 555225 - DNA, 25 bp, Rattus norvegicus
tagaagatagcagtgcccaaccttt

SEQ ID NO: 555226 - DNA, 25 bp, Rattus norvegicus
tagaagatgcacatgccccgggtgg

SEQ ID NO: 555227 - DNA, 25 bp, Rattus norvegicus
tagaagatgcacttgccccgggtgg

SEQ ID NO: 555228 - DNA, 25 bp, Rattus norvegicus
tagaagcagcgtcgccaacaggact

SEQ ID NO: 555229 - DNA, 25 bp, Rattus norvegicus
tagaagcagcgtggccaacaggact

SEQ ID NO: 555230 - DNA, 25 bp, Rattus norvegicus
tagaagcagtctcttgtgtcagccc

SEQ ID NO: 555231 - DNA, 25 bp, Rattus norvegicus
tagaagcagtctgttgtgtcagccc

SEQ ID NO: 555232 - DNA, 25 bp, Rattus norvegicus
tagaagcatgtcctttccagacgac

SEQ ID NO: 555233 - DNA, 25 bp, Rattus norvegicus
tagaagcatgtcgtttccagacgac

SEQ ID NO: 555234 - DNA, 25 bp, Rattus norvegicus
tagaagccaagaactcaggagactg

SEQ ID NO: 555235 - DNA, 25 bp, Rattus norvegicus
tagaagccaagatctcaggagactg

SEQ ID NO: 555236 - DNA, 25 bp, Rattus norvegicus
tagaagccaggaaacccgtgaaccc

SEQ ID NO: 555237 - DNA, 25 bp, Rattus norvegicus
tagaagccaggatacccgtgaaccc

SEQ ID NO: 555238 - DNA, 25 bp, Rattus norvegicus
tagaagccaggtcagcaacgagact

SEQ ID NO: 555239 - DNA, 25 bp, Rattus norvegicus
tagaagccaggtgagcaacgagact

SEQ ID NO: 555240 - DNA, 25 bp, Rattus norvegicus
tagaagcctccacggtcacatggta

SEQ ID NO: 555241 - DNA, 25 bp, Rattus norvegicus
tagaagcctccagggtcacatggta

SEQ ID NO: 555242 - DNA, 25 bp, Rattus norvegicus
tagaagcctgctaagtcagccttaa

SEQ ID NO: 555243 - DNA, 25 bp, Rattus norvegicus
tagaagcctgcttagtcagccttaa

SEQ ID NO: 555244 - DNA, 25 bp, Rattus norvegicus
tagaagccttcaccttgctacccat

SEQ ID NO: 555245 - DNA, 25 bp, Rattus norvegicus
tagaagccttcagcttgctacccat

SEQ ID NO: 555246 - DNA, 25 bp, Rattus norvegicus
tagaagcgcatacgcatgactacat

SEQ ID NO: 555247 - DNA, 25 bp, Rattus norvegicus
tagaagcgcataggcatgactacat

SEQ ID NO: 555248 - DNA, 25 bp, Rattus norvegicus
tagaagctcgctactcatgctctgg

SEQ ID NO: 555249 - DNA, 25 bp, Rattus norvegicus
tagaagctcgcttctcatgctctgg

SEQ ID NO: 555250 - DNA, 25 bp, Rattus norvegicus
tagaagctctatacatgcacagaag

SEQ ID NO: 555251 - DNA, 25 bp, Rattus norvegicus
tagaagctctatacttgcccaaaag

SEQ ID NO: 555252 - DNA, 25 bp, Rattus norvegicus
tagaagctctattcatgcacagaag

SEQ ID NO: 555253 - DNA, 25 bp, Rattus norvegicus
tagaagctctattcttgcccaaaag

SEQ ID NO: 555254 - DNA, 25 bp, Rattus norvegicus
tagaagctgcttagtgtgtactctg

SEQ ID NO: 555255 - DNA, 25 bp, Rattus norvegicus
tagaagctgcttcaaataccggttt

SEQ ID NO: 555256 - DNA, 25 bp, Rattus norvegicus
tagaagctgcttgaaataccggttt

SEQ ID NO: 555257 - DNA, 25 bp, Rattus norvegicus
tagaagctgctttgtgtgtactctg

SEQ ID NO: 555258 - DNA, 25 bp, Rattus norvegicus
tagaagctgtggaccctatggagca

SEQ ID NO: 555259 - DNA, 25 bp, Rattus norvegicus
tagaagctgtggtccctatggagca

SEQ ID NO: 555260 - DNA, 25 bp, Rattus norvegicus
tagaagcttccacgtctaggctgac

SEQ ID NO: 555261 - DNA, 25 bp, Rattus norvegicus
tagaagcttccaggtctaggctgac

SEQ ID NO: 555262 - DNA, 25 bp, Rattus norvegicus
tagaagcttttgctctttccgagtt

SEQ ID NO: 555263 - DNA, 25 bp, Rattus norvegicus
tagaagcttttggtctttccgagtt

SEQ ID NO: 555264 - DNA, 25 bp, Rattus norvegicus
tagaaggaactgctccacactgcca

SEQ ID NO: 555265 - DNA, 25 bp, Rattus norvegicus
tagaaggaactggtccacactgcca

SEQ ID NO: 555266 - DNA, 25 bp, Rattus norvegicus
tagaaggacagcctcactgagcaac

SEQ ID NO: 555267 - DNA, 25 bp, Rattus norvegicus
tagaaggacagcgtcactgagcaac

SEQ ID NO: 555268 - DNA, 25 bp, Rattus norvegicus
tagaaggagcgaaggtttttgtttt

SEQ ID NO: 555269 - DNA, 25 bp, Rattus norvegicus
tagaaggagcgatggtttttgtttt

SEQ ID NO: 555270 - DNA, 25 bp, Rattus norvegicus
tagaaggcaactactcgcctctgtc

SEQ ID NO: 555271 - DNA, 25 bp, Rattus norvegicus
tagaaggcaacttctcgcctctgtc

SEQ ID NO: 555272 - DNA, 25 bp, Rattus norvegicus
tagaaggcacccctgatttgctcac

SEQ ID NO: 555273 - DNA, 25 bp, Rattus norvegicus
tagaaggcacccgtgatttgctcac

SEQ ID NO: 555274 - DNA, 25 bp, Rattus norvegicus
tagaaggcactgcttctgcacctgt

SEQ ID NO: 555275 - DNA, 25 bp, Rattus norvegicus
tagaaggcactggttctgcacctgt

SEQ ID NO: 555276 - DNA, 25 bp, Rattus norvegicus
tagaaggcccagaggaagccctcca

SEQ ID NO: 555277 - DNA, 25 bp, Rattus norvegicus
tagaaggcccagtggaagccctcca

SEQ ID NO: 555278 - DNA, 25 bp, Rattus norvegicus
tagaaggcttccaagggtgctctgt

SEQ ID NO: 555279 - DNA, 25 bp, Rattus norvegicus
tagaaggcttcctagggtgctctgt

SEQ ID NO: 555280 - DNA, 25 bp, Rattus norvegicus
tagaagggactcctcttccaagtgt

SEQ ID NO: 555281 - DNA, 25 bp, Rattus norvegicus
tagaagggactcgtcttccaagtgt

SEQ ID NO: 555282 - DNA, 25 bp, Rattus norvegicus
tagaagggccagctccttccagagg

SEQ ID NO: 555283 - DNA, 25 bp, Rattus norvegicus
tagaagggccaggtccttccagagg

SEQ ID NO: 555284 - DNA, 25 bp, Rattus norvegicus
tagaagggtcagctcacaggcatcc

SEQ ID NO: 555285 - DNA, 25 bp, Rattus norvegicus
tagaagggtcaggtcacaggcatcc

SEQ ID NO: 555286 - DNA, 25 bp, Rattus norvegicus
tagaagggttctctttatatggaaa

SEQ ID NO: 555287 - DNA, 25 bp, Rattus norvegicus
tagaagggttctgtttatatggaaa

SEQ ID NO: 555288 - DNA, 25 bp, Rattus norvegicus
tagaaggtagtaccagcaccctggc

SEQ ID NO: 555289 - DNA, 25 bp, Rattus norvegicus
tagaaggtagtagcagcaccctggc

SEQ ID NO: 555290 - DNA, 25 bp, Rattus norvegicus
tagaaggtatcactcccaaagccat

SEQ ID NO: 555291 - DNA, 25 bp, Rattus norvegicus
tagaaggtatcagtcccaaagccat

SEQ ID NO: 555292 - DNA, 25 bp, Rattus norvegicus
tagaaggtctcacgccatcgatcac

SEQ ID NO: 555293 - DNA, 25 bp, Rattus norvegicus
tagaaggtctcaggccatcgatcac

SEQ ID NO: 555294 - DNA, 25 bp, Rattus norvegicus
tagaaggtgactaacggccaggaac

SEQ ID NO: 555295 - DNA, 25 bp, Rattus norvegicus
tagaaggtgacttacggccaggaac

SEQ ID NO: 555296 - DNA, 25 bp, Rattus norvegicus
tagaaggtgctgatctcctggcgca

SEQ ID NO: 555297 - DNA, 25 bp, Rattus norvegicus
tagaaggtgctgttctcctggcgca

SEQ ID NO: 555298 - DNA, 25 bp, Rattus norvegicus
tagaaggtgttgaagctcgtaccct

SEQ ID NO: 555299 - DNA, 25 bp, Rattus norvegicus
tagaaggtgttgtagctcgtaccct

SEQ ID NO: 555300 - DNA, 25 bp, Rattus norvegicus
tagaaggtgtttccccacacacatc

SEQ ID NO: 555301 - DNA, 25 bp, Rattus norvegicus
tagaaggtgtttgcccacacacatc

SEQ ID NO: 555302 - DNA, 25 bp, Rattus norvegicus
tagaaggtttcacccagtactcact

SEQ ID NO: 555303 - DNA, 25 bp, Rattus norvegicus
tagaaggtttcagccagtactcact

SEQ ID NO: 555304 - DNA, 25 bp, Rattus norvegicus
tagaaggttttcaccattcctgctt

SEQ ID NO: 555305 - DNA, 25 bp, Rattus norvegicus
tagaaggttttctccattcctgctt

SEQ ID NO: 555306 - DNA, 25 bp, Rattus norvegicus
tagaagtactgacgctccgtcctgg

SEQ ID NO: 555307 - DNA, 25 bp, Rattus norvegicus
tagaagtactgaggctccgtcctgg

SEQ ID NO: 555308 - DNA, 25 bp, Rattus norvegicus
tagaagtagaccacgggctgctgcc

SEQ ID NO: 555309 - DNA, 25 bp, Rattus norvegicus
tagaagtagacctcgggctgctgcc

SEQ ID NO: 555310 - DNA, 25 bp, Rattus norvegicus
tagaagtagtttcttggcccaagaa

SEQ ID NO: 555311 - DNA, 25 bp, Rattus norvegicus
tagaagtagtttgttggcccaagaa

SEQ ID NO: 555312 - DNA, 25 bp, Rattus norvegicus
tagaagtctaagctgctgcatgtat

SEQ ID NO: 555313 - DNA, 25 bp, Rattus norvegicus
tagaagtctaaggtgctgcatgtat

SEQ ID NO: 555314 - DNA, 25 bp, Rattus norvegicus
tagaagtcttcacttggccaacctc

SEQ ID NO: 555315 - DNA, 25 bp, Rattus norvegicus
tagaagtcttcagttggccaacctc

SEQ ID NO: 555316 - DNA, 25 bp, Rattus norvegicus
tagaagtgacccacagctgtcgctg

SEQ ID NO: 555317 - DNA, 25 bp, Rattus norvegicus
tagaagtgaccctcagctgtcgctg

SEQ ID NO: 555318 - DNA, 25 bp, Rattus norvegicus
tagaagtgacgtcctgtttcctacc

SEQ ID NO: 555319 - DNA, 25 bp, Rattus norvegicus
tagaagtgacgtgctgtttcctacc

SEQ ID NO: 555320 - DNA, 25 bp, Rattus norvegicus
tagaagtgcactaggtccttatcct

SEQ ID NO: 555321 - DNA, 25 bp, Rattus norvegicus
tagaagtgcacttggtccttatcct

SEQ ID NO: 555322 - DNA, 25 bp, Rattus norvegicus
tagaagttacacagcccgggcctgc

SEQ ID NO: 555323 - DNA, 25 bp, Rattus norvegicus
tagaagttacactgcccgggcctgc

SEQ ID NO: 555324 - DNA, 25 bp, Rattus norvegicus
tagaagttcctaaaccttcttcctt

SEQ ID NO: 555325 - DNA, 25 bp, Rattus norvegicus
tagaagttcctataccttcttcctt

SEQ ID NO: 555326 - DNA, 25 bp, Rattus norvegicus
tagaagttctggcttctgttctaac

SEQ ID NO: 555327 - DNA, 25 bp, Rattus norvegicus
tagaagttctgggttctgttctaac

SEQ ID NO: 555328 - DNA, 25 bp, Rattus norvegicus
tagaagttcttcattcgagtgccgc

SEQ ID NO: 555329 - DNA, 25 bp, Rattus norvegicus
tagaagttcttctttcgagtgccgc

SEQ ID NO: 555330 - DNA, 25 bp, Rattus norvegicus
tagaagttgagtacgtggcctgagc

SEQ ID NO: 555331 - DNA, 25 bp, Rattus norvegicus
tagaagttgagttcgtggcctgagc

SEQ ID NO: 555332 - DNA, 25 bp, Rattus norvegicus
tagaataacctgctttatgtctcag

SEQ ID NO: 555333 - DNA, 25 bp, Rattus norvegicus
tagaataacctggtttatgtctcag

SEQ ID NO: 555334 - DNA, 25 bp, Rattus norvegicus
tagaataagattacccagctccctg

SEQ ID NO: 555335 - DNA, 25 bp, Rattus norvegicus
tagaataagatttcccagctccctg

SEQ ID NO: 555336 - DNA, 25 bp, Rattus norvegicus
tagaataattctaccccacatgcct

SEQ ID NO: 555337 - DNA, 25 bp, Rattus norvegicus
tagaataattctcatgtgtctagaa

SEQ ID NO: 555338 - DNA, 25 bp, Rattus norvegicus
tagaataattctgatgtgtctagaa

SEQ ID NO: 555339 - DNA, 25 bp, Rattus norvegicus
tagaataattcttccccacatgcct

SEQ ID NO: 555340 - DNA, 25 bp, Rattus norvegicus
tagaatacagctactgggtccctgg

SEQ ID NO: 555341 - DNA, 25 bp, Rattus norvegicus
tagaatacagcttctgggtccctgg

SEQ ID NO: 555342 - DNA, 25 bp, Rattus norvegicus
tagaatactgtacctgtgctgccgt

SEQ ID NO: 555343 - DNA, 25 bp, Rattus norvegicus
tagaatactgtagctgtgctgccgt

SEQ ID NO: 555344 - DNA, 25 bp, Rattus norvegicus
tagaatagagtcactgtgttggcct

SEQ ID NO: 555345 - DNA, 25 bp, Rattus norvegicus
tagaatagagtctctgtgttggcct

SEQ ID NO: 555346 - DNA, 25 bp, Rattus norvegicus
tagaatagcgacagcctctggatgt

SEQ ID NO: 555347 - DNA, 25 bp, Rattus norvegicus
tagaatagcgactgcctctggatgt

SEQ ID NO: 555348 - DNA, 25 bp, Rattus norvegicus
tagaataggtgtcgccttcttgaag

SEQ ID NO: 555349 - DNA, 25 bp, Rattus norvegicus
tagaataggtgtggccttcttgaag

SEQ ID NO: 555350 - DNA, 25 bp, Rattus norvegicus
tagaatatgtttctttcctaggaga

SEQ ID NO: 555351 - DNA, 25 bp, Rattus norvegicus
tagaatatgtttgtttcctaggaga

SEQ ID NO: 555352 - DNA, 25 bp, Rattus norvegicus
tagaatatttcccagtgtccctcta

SEQ ID NO: 555353 - DNA, 25 bp, Rattus norvegicus
tagaatatttccgagtgtccctcta

SEQ ID NO: 555354 - DNA, 25 bp, Rattus norvegicus
tagaatcacaccagttccaggcagt

SEQ ID NO: 555355 - DNA, 25 bp, Rattus norvegicus
tagaatcacacctgttccaggcagt

SEQ ID NO: 555356 - DNA, 25 bp, Rattus norvegicus
tagaatcacgttatctcgccatctt

SEQ ID NO: 555357 - DNA, 25 bp, Rattus norvegicus
tagaatcacgttttctcgccatctt

SEQ ID NO: 555358 - DNA, 25 bp, Rattus norvegicus
tagaatcagcctacaggccggctaa

SEQ ID NO: 555359 - DNA, 25 bp, Rattus norvegicus
tagaatcagccttcaggccggctaa

SEQ ID NO: 555360 - DNA, 25 bp, Rattus norvegicus
tagaatccaggaccatcagcagcat

SEQ ID NO: 555361 - DNA, 25 bp, Rattus norvegicus
tagaatccaggactacagctttggg

SEQ ID NO: 555362 - DNA, 25 bp, Rattus norvegicus
tagaatccaggagcatcagcagcat

SEQ ID NO: 555363 - DNA, 25 bp, Rattus norvegicus
tagaatccaggagtacagctttggg

SEQ ID NO: 555364 - DNA, 25 bp, Rattus norvegicus
tagaatccaggcatatgacccataa

SEQ ID NO: 555365 - DNA, 25 bp, Rattus norvegicus
tagaatccaggcttatgacccataa

SEQ ID NO: 555366 - DNA, 25 bp, Rattus norvegicus
tagaatccgcatcttttccctgtga

SEQ ID NO: 555367 - DNA, 25 bp, Rattus norvegicus
tagaatccgcatgttttccctgtga

SEQ ID NO: 555368 - DNA, 25 bp, Rattus norvegicus
tagaatcctacgcactatggctctg

SEQ ID NO: 555369 - DNA, 25 bp, Rattus norvegicus
tagaatcctacggactatggctctg

SEQ ID NO: 555370 - DNA, 25 bp, Rattus norvegicus
tagaatcctaggagaccttgcctct

SEQ ID NO: 555371 - DNA, 25 bp, Rattus norvegicus
tagaatcctaggtgaccttgcctct

SEQ ID NO: 555372 - DNA, 25 bp, Rattus norvegicus
tagaatcctcacagtcaaactgtat

SEQ ID NO: 555373 - DNA, 25 bp, Rattus norvegicus
tagaatcctcactgtcaaactgtat

SEQ ID NO: 555374 - DNA, 25 bp, Rattus norvegicus
tagaatcctcttccttcagttcatt

SEQ ID NO: 555375 - DNA, 25 bp, Rattus norvegicus
tagaatcctcttgcttcagttcatt

SEQ ID NO: 555376 - DNA, 25 bp, Rattus norvegicus
tagaatcgttagatccgttgttgat

SEQ ID NO: 555377 - DNA, 25 bp, Rattus norvegicus
tagaatcgttagttccgttgttgat

SEQ ID NO: 555378 - DNA, 25 bp, Rattus norvegicus
tagaatctcgacagttcaaggccag

SEQ ID NO: 555379 - DNA, 25 bp, Rattus norvegicus
tagaatctcgactgttcaaggccag

SEQ ID NO: 555380 - DNA, 25 bp, Rattus norvegicus
tagaatctgaaccagccgtgcaagt

SEQ ID NO: 555381 - DNA, 25 bp, Rattus norvegicus
tagaatctgaacgagccgtgcaagt

SEQ ID NO: 555382 - DNA, 25 bp, Rattus norvegicus
tagaatctgaatatctgccgctctc

SEQ ID NO: 555383 - DNA, 25 bp, Rattus norvegicus
tagaatctgaatttctgccgctctc

SEQ ID NO: 555384 - DNA, 25 bp, Rattus norvegicus
tagaatctgagaagctcccctagac

SEQ ID NO: 555385 - DNA, 25 bp, Rattus norvegicus
tagaatctgagatgctcccctagac

SEQ ID NO: 555386 - DNA, 25 bp, Rattus norvegicus
tagaatctgagcagtctcccacagt

SEQ ID NO: 555387 - DNA, 25 bp, Rattus norvegicus
tagaatctgagctgtctcccacagt

SEQ ID NO: 555388 - DNA, 25 bp, Rattus norvegicus
tagaatctgcaaactggcccttgag

SEQ ID NO: 555389 - DNA, 25 bp, Rattus norvegicus
tagaatctgcaatctggcccttgag

SEQ ID NO: 555390 - DNA, 25 bp, Rattus norvegicus
tagaatctgcctattcctgacaatc

SEQ ID NO: 555391 - DNA, 25 bp, Rattus norvegicus
tagaatctgccttttcctgacaatc

SEQ ID NO: 555392 - DNA, 25 bp, Rattus norvegicus
tagaatctgctacccagtgagctgt

SEQ ID NO: 555393 - DNA, 25 bp, Rattus norvegicus
tagaatctgctagccagtgagctgt

SEQ ID NO: 555394 - DNA, 25 bp, Rattus norvegicus
tagaatctgctgaacctcatggtcg

SEQ ID NO: 555395 - DNA, 25 bp, Rattus norvegicus
tagaatctgctgtacctcatggtcg

SEQ ID NO: 555396 - DNA, 25 bp, Rattus norvegicus
tagaatcttctcaccatctctgtga

SEQ ID NO: 555397 - DNA, 25 bp, Rattus norvegicus
tagaatcttctctccatctctgtga

SEQ ID NO: 555398 - DNA, 25 bp, Rattus norvegicus
tagaatctttggctgaaattcaagc

SEQ ID NO: 555399 - DNA, 25 bp, Rattus norvegicus
tagaatctttgggtgaaattcaagc

SEQ ID NO: 555400 - DNA, 25 bp, Rattus norvegicus
tagaatgacaaaagcctggctgcgt

SEQ ID NO: 555401 - DNA, 25 bp, Rattus norvegicus
tagaatgacaaatgcctggctgcgt

SEQ ID NO: 555402 - DNA, 25 bp, Rattus norvegicus
tagaatgcacaactccttagacgcc

SEQ ID NO: 555403 - DNA, 25 bp, Rattus norvegicus
tagaatgcacaagtccttagacgcc

SEQ ID NO: 555404 - DNA, 25 bp, Rattus norvegicus
tagaatgcacatagtggaaatggac

SEQ ID NO: 555405 - DNA, 25 bp, Rattus norvegicus
tagaatgcacattgtggaaatggac

SEQ ID NO: 555406 - DNA, 25 bp, Rattus norvegicus
tagaatgcctgtaaagtcccgtttt

SEQ ID NO: 555407 - DNA, 25 bp, Rattus norvegicus
tagaatgcctgttaagtcccgtttt

SEQ ID NO: 555408 - DNA, 25 bp, Rattus norvegicus
tagaatggctcacccgaagtgccct

SEQ ID NO: 555409 - DNA, 25 bp, Rattus norvegicus
tagaatggctcagccgaagtgccct

SEQ ID NO: 555410 - DNA, 25 bp, Rattus norvegicus
tagaatgtcccaattgctgtcttta

SEQ ID NO: 555411 - DNA, 25 bp, Rattus norvegicus
tagaatgtcccatttgctgtcttta

SEQ ID NO: 555412 - DNA, 25 bp, Rattus norvegicus
tagaatgtctagatacagtggagcc

SEQ ID NO: 555413 - DNA, 25 bp, Rattus norvegicus
tagaatgtctagttacagtggagcc

SEQ ID NO: 555414 - DNA, 25 bp, Rattus norvegicus
tagaatgtctttccggtttgtccac

SEQ ID NO: 555415 - DNA, 25 bp, Rattus norvegicus
tagaatgtctttgcggtttgtccac

SEQ ID NO: 555416 - DNA, 25 bp, Rattus norvegicus
tagaatgtgctgcaacctactactg

SEQ ID NO: 555417 - DNA, 25 bp, Rattus norvegicus
tagaatgtgctggaacctactactg

SEQ ID NO: 555418 - DNA, 25 bp, Rattus norvegicus
tagaatgtgggcattgtgggtcccc

SEQ ID NO: 555419 - DNA, 25 bp, Rattus norvegicus
tagaatgtgggctttgtgggtcccc

SEQ ID NO: 555420 - DNA, 25 bp, Rattus norvegicus
tagaatgtgtgaacccctggctcaa

SEQ ID NO: 555421 - DNA, 25 bp, Rattus norvegicus
tagaatgtgtgatcccctggctcaa

SEQ ID NO: 555422 - DNA, 25 bp, Rattus norvegicus
tagaatgttattcaccctctgactc

SEQ ID NO: 555423 - DNA, 25 bp, Rattus norvegicus
tagaatgttattgaccctctgactc

SEQ ID NO: 555424 - DNA, 25 bp, Rattus norvegicus
tagaatgtttataacctgagactgg

SEQ ID NO: 555425 - DNA, 25 bp, Rattus norvegicus
tagaatgtttattacctgagactgg

SEQ ID NO: 555426 - DNA, 25 bp, Rattus norvegicus
tagaattaccatctcctgttggccg

SEQ ID NO: 555427 - DNA, 25 bp, Rattus norvegicus
tagaattaccatgtcctgttggccg

SEQ ID NO: 555428 - DNA, 25 bp, Rattus norvegicus
tagaattattacacagctcagcgaa

SEQ ID NO: 555429 - DNA, 25 bp, Rattus norvegicus
tagaattattactcagctcagcgaa

SEQ ID NO: 555430 - DNA, 25 bp, Rattus norvegicus
tagaattcaggcaatcatacctcgc

SEQ ID NO: 555431 - DNA, 25 bp, Rattus norvegicus
tagaattcaggctatcatacctcgc

SEQ ID NO: 555432 - DNA, 25 bp, Rattus norvegicus
tagaattcatcacctcgtgttcctg

SEQ ID NO: 555433 - DNA, 25 bp, Rattus norvegicus
tagaattcatcagctcgtgttcctg

SEQ ID NO: 555434 - DNA, 25 bp, Rattus norvegicus
tagaattcctacatcacagctactc

SEQ ID NO: 555435 - DNA, 25 bp, Rattus norvegicus
tagaattcctacttcacagctactc

SEQ ID NO: 555436 - DNA, 25 bp, Rattus norvegicus
tagaattcctatctgtgttacgaga

SEQ ID NO: 555437 - DNA, 25 bp, Rattus norvegicus
tagaattcctatgtgtgttacgaga

SEQ ID NO: 555438 - DNA, 25 bp, Rattus norvegicus
tagaattctctgacaagctctcacg

SEQ ID NO: 555439 - DNA, 25 bp, Rattus norvegicus
tagaattctctgagtgcttttggcc

SEQ ID NO: 555440 - DNA, 25 bp, Rattus norvegicus
tagaattctctgtcaagctctcacg

SEQ ID NO: 555441 - DNA, 25 bp, Rattus norvegicus
tagaattctctgtgtgcttttggcc

SEQ ID NO: 555442 - DNA, 25 bp, Rattus norvegicus
tagaattctgcgagagcgtgtgccc

SEQ ID NO: 555443 - DNA, 25 bp, Rattus norvegicus
tagaattctgcgtgagcgtgtgccc

SEQ ID NO: 555444 - DNA, 25 bp, Rattus norvegicus
tagaattgctcacgcttggtgctgc

SEQ ID NO: 555445 - DNA, 25 bp, Rattus norvegicus
tagaattgctcaggcttggtgctgc

SEQ ID NO: 555446 - DNA, 25 bp, Rattus norvegicus
tagaattgctttatactcaactgta

SEQ ID NO: 555447 - DNA, 25 bp, Rattus norvegicus
tagaattgctttttactcaactgta

SEQ ID NO: 555448 - DNA, 25 bp, Rattus norvegicus
tagaatttcaggcaacctttgtagt

SEQ ID NO: 555449 - DNA, 25 bp, Rattus norvegicus
tagaatttcagggaacctttgtagt

SEQ ID NO: 555450 - DNA, 25 bp, Rattus norvegicus
tagaatttccttctgtgactcaatc

SEQ ID NO: 555451 - DNA, 25 bp, Rattus norvegicus
tagaatttccttgtgtgactcaatc

SEQ ID NO: 555452 - DNA, 25 bp, Rattus norvegicus
tagaattttagtcccaaacgctgtg

SEQ ID NO: 555453 - DNA, 25 bp, Rattus norvegicus
tagaattttagtgccaaacgctgtg

SEQ ID NO: 555454 - DNA, 25 bp, Rattus norvegicus
tagaattttcccacagacttacttt

SEQ ID NO: 555455 - DNA, 25 bp, Rattus norvegicus
tagaattttcccactggccttaaat

SEQ ID NO: 555456 - DNA, 25 bp, Rattus norvegicus
tagaattttccctcagacttacttt

SEQ ID NO: 555457 - DNA, 25 bp, Rattus norvegicus
tagaattttccctctggccttaaat

SEQ ID NO: 555458 - DNA, 25 bp, Rattus norvegicus
tagaattttcctcgtgtttcaaact

SEQ ID NO: 555459 - DNA, 25 bp, Rattus norvegicus
tagaattttcctggtgtttcaaact

SEQ ID NO: 555460 - DNA, 25 bp, Rattus norvegicus
tagaattttcgacattttccttagg

SEQ ID NO: 555461 - DNA, 25 bp, Rattus norvegicus
tagaattttcgagattttccttagg

SEQ ID NO: 555462 - DNA, 25 bp, Rattus norvegicus
tagaattttcggaagctgctcgtga

SEQ ID NO: 555463 - DNA, 25 bp, Rattus norvegicus
tagaattttcggtagctgctcgtga

SEQ ID NO: 555464 - DNA, 25 bp, Rattus norvegicus
tagaattttctaacagtgcccatga

SEQ ID NO: 555465 - DNA, 25 bp, Rattus norvegicus
tagaattttctatcagtgcccatga

SEQ ID NO: 555466 - DNA, 25 bp, Rattus norvegicus
tagaatttttgactgtccttacctt

SEQ ID NO: 555467 - DNA, 25 bp, Rattus norvegicus
tagaatttttgagtgtccttacctt

SEQ ID NO: 555468 - DNA, 25 bp, Rattus norvegicus
tagacaaagcctcggccagcctgta

SEQ ID NO: 555469 - DNA, 25 bp, Rattus norvegicus
tagacaaagcctgggccagcctgta

SEQ ID NO: 555470 - DNA, 25 bp, Rattus norvegicus
tagacaacaagcagcgtgaggacct

SEQ ID NO: 555471 - DNA, 25 bp, Rattus norvegicus
tagacaacaagctgcgtgaggacct

SEQ ID NO: 555472 - DNA, 25 bp, Rattus norvegicus
tagacaacatctacatcttgcccag

SEQ ID NO: 555473 - DNA, 25 bp, Rattus norvegicus
tagacaacatcttcatcttgcccag

SEQ ID NO: 555474 - DNA, 25 bp, Rattus norvegicus
tagacaacccgtctctgggtcctga

SEQ ID NO: 555475 - DNA, 25 bp, Rattus norvegicus
tagacaacccgtgtctgggtcctga

SEQ ID NO: 555476 - DNA, 25 bp, Rattus norvegicus
tagacaaccgaacgtccgcacagtt

SEQ ID NO: 555477 - DNA, 25 bp, Rattus norvegicus
tagacaaccgaaggtccgcacagtt

SEQ ID NO: 555478 - DNA, 25 bp, Rattus norvegicus
tagacaacctcaagtctgccttggc

SEQ ID NO: 555479 - DNA, 25 bp, Rattus norvegicus
tagacaacctcatgtctgccttggc

SEQ ID NO: 555480 - DNA, 25 bp, Rattus norvegicus
tagacaacggtacctgcgcagttca

SEQ ID NO: 555481 - DNA, 25 bp, Rattus norvegicus
tagacaacggtagctgcgcagttca

SEQ ID NO: 555482 - DNA, 25 bp, Rattus norvegicus
tagacaactggccagtccttcacgg

SEQ ID NO: 555483 - DNA, 25 bp, Rattus norvegicus
tagacaactggcgagtccttcacgg

SEQ ID NO: 555484 - DNA, 25 bp, Rattus norvegicus
tagacaagaattctgctcctctctt

SEQ ID NO: 555485 - DNA, 25 bp, Rattus norvegicus
tagacaagaattgtgctcctctctt

SEQ ID NO: 555486 - DNA, 25 bp, Rattus norvegicus
tagacaagccctacctatcctgtaa

SEQ ID NO: 555487 - DNA, 25 bp, Rattus norvegicus
tagacaagcccttcctatcctgtaa

SEQ ID NO: 555488 - DNA, 25 bp, Rattus norvegicus
tagacaagctgcagagctcgcgttc

SEQ ID NO: 555489 - DNA, 25 bp, Rattus norvegicus
tagacaagctgctgagctcgcgttc

SEQ ID NO: 555490 - DNA, 25 bp, Rattus norvegicus
tagacaaggctacctcacactgaca

SEQ ID NO: 555491 - DNA, 25 bp, Rattus norvegicus
tagacaaggctactaggtttaccct

SEQ ID NO: 555492 - DNA, 25 bp, Rattus norvegicus
tagacaaggctagctcacactgaca

SEQ ID NO: 555493 - DNA, 25 bp, Rattus norvegicus
tagacaaggctagtaggtttaccct

SEQ ID NO: 555494 - DNA, 25 bp, Rattus norvegicus
tagacaatcccaattccactacatt

SEQ ID NO: 555495 - DNA, 25 bp, Rattus norvegicus
tagacaatcccatttccactacatt

SEQ ID NO: 555496 - DNA, 25 bp, Rattus norvegicus
tagacaatgctgctgtcctcattat

SEQ ID NO: 555497 - DNA, 25 bp, Rattus norvegicus
tagacaatgctggtgtcctcattat

SEQ ID NO: 555498 - DNA, 25 bp, Rattus norvegicus
tagacaatggacaggctttcccact

SEQ ID NO: 555499 - DNA, 25 bp, Rattus norvegicus
tagacaatggactggctttcccact

SEQ ID NO: 555500 - DNA, 25 bp, Rattus norvegicus
tagacaatggttatcctgctcgaga

SEQ ID NO: 555501 - DNA, 25 bp, Rattus norvegicus
tagacaatggttttcctgctcgaga

SEQ ID NO: 555502 - DNA, 25 bp, Rattus norvegicus
tagacacaaacacctccagcatatt

SEQ ID NO: 555503 - DNA, 25 bp, Rattus norvegicus
tagacacaaacagctccagcatatt

SEQ ID NO: 555504 - DNA, 25 bp, Rattus norvegicus
tagacacaagcaacacaaagagaat

SEQ ID NO: 555505 - DNA, 25 bp, Rattus norvegicus
tagacacaagcatcacaaagagaat

SEQ ID NO: 555506 - DNA, 25 bp, Rattus norvegicus
tagacacacgcaaacttcactttac

SEQ ID NO: 555507 - DNA, 25 bp, Rattus norvegicus
tagacacacgcatacttcactttac

SEQ ID NO: 555508 - DNA, 25 bp, Rattus norvegicus
tagacacagaacatcctctcctggg

SEQ ID NO: 555509 - DNA, 25 bp, Rattus norvegicus
tagacacagaacttcctctcctggg

SEQ ID NO: 555510 - DNA, 25 bp, Rattus norvegicus
tagacacagaggacttgccgacttt

SEQ ID NO: 555511 - DNA, 25 bp, Rattus norvegicus
tagacacagaggtcttgccgacttt

SEQ ID NO: 555512 - DNA, 25 bp, Rattus norvegicus
tagacacagccgagggtgctggacc

SEQ ID NO: 555513 - DNA, 25 bp, Rattus norvegicus
tagacacagccgtgggtgctggacc

SEQ ID NO: 555514 - DNA, 25 bp, Rattus norvegicus
tagacacagtgcagctacttcctat

SEQ ID NO: 555515 - DNA, 25 bp, Rattus norvegicus
tagacacagtgctgctacttcctat

SEQ ID NO: 555516 - DNA, 25 bp, Rattus norvegicus
tagacaccaagcatcttatactccg

SEQ ID NO: 555517 - DNA, 25 bp, Rattus norvegicus
tagacaccaagcttcttatactccg

SEQ ID NO: 555518 - DNA, 25 bp, Rattus norvegicus
tagacaccaatgacgcatgcactgt

SEQ ID NO: 555519 - DNA, 25 bp, Rattus norvegicus
tagacaccaatgtcgcatgcactgt

SEQ ID NO: 555520 - DNA, 25 bp, Rattus norvegicus
tagacaccacatcctactagacaga

SEQ ID NO: 555521 - DNA, 25 bp, Rattus norvegicus
tagacaccacatgctactagacaga

SEQ ID NO: 555522 - DNA, 25 bp, Rattus norvegicus
tagacaccagtgctctgtgcatgca

SEQ ID NO: 555523 - DNA, 25 bp, Rattus norvegicus
tagacaccagtggtctgtgcatgca

SEQ ID NO: 555524 - DNA, 25 bp, Rattus norvegicus
tagacaccccgtccagctcttagaa

SEQ ID NO: 555525 - DNA, 25 bp, Rattus norvegicus
tagacaccccgtgcagctcttagaa

SEQ ID NO: 555526 - DNA, 25 bp, Rattus norvegicus
tagacacccctgaccagctcgggtg

SEQ ID NO: 555527 - DNA, 25 bp, Rattus norvegicus
tagacacccctgtccagctcgggtg

SEQ ID NO: 555528 - DNA, 25 bp, Rattus norvegicus
tagacacccttacctgctgaataat

SEQ ID NO: 555529 - DNA, 25 bp, Rattus norvegicus
tagacacccttagctgctgaataat

SEQ ID NO: 555530 - DNA, 25 bp, Rattus norvegicus
tagacaccgtccattcttattcggg

SEQ ID NO: 555531 - DNA, 25 bp, Rattus norvegicus
tagacaccgtcctttcttattcggg

SEQ ID NO: 555532 - DNA, 25 bp, Rattus norvegicus
tagacaccgtgaatcctccagtttc

SEQ ID NO: 555533 - DNA, 25 bp, Rattus norvegicus
tagacaccgtgattcctccagtttc

SEQ ID NO: 555534 - DNA, 25 bp, Rattus norvegicus
tagacacctacacctggcctaagga

SEQ ID NO: 555535 - DNA, 25 bp, Rattus norvegicus
tagacacctacagctggcctaagga

SEQ ID NO: 555536 - DNA, 25 bp, Rattus norvegicus
tagacacctctaccttattaaactt

SEQ ID NO: 555537 - DNA, 25 bp, Rattus norvegicus
tagacacctctagcttattaaactt

SEQ ID NO: 555538 - DNA, 25 bp, Rattus norvegicus
tagacaccttagaacaatctggaat

SEQ ID NO: 555539 - DNA, 25 bp, Rattus norvegicus
tagacaccttagtacaatctggaat

SEQ ID NO: 555540 - DNA, 25 bp, Rattus norvegicus
tagacacgccatcttgggtgatgat

SEQ ID NO: 555541 - DNA, 25 bp, Rattus norvegicus
tagacacgccatgttgggtgatgat

SEQ ID NO: 555542 - DNA, 25 bp, Rattus norvegicus
tagacacgctgtccaagatctccga

SEQ ID NO: 555543 - DNA, 25 bp, Rattus norvegicus
tagacacgctgtgcaagatctccga

SEQ ID NO: 555544 - DNA, 25 bp, Rattus norvegicus
tagacacgggacagctacacattcc

SEQ ID NO: 555545 - DNA, 25 bp, Rattus norvegicus
tagacacgggactgctacacattcc

SEQ ID NO: 555546 - DNA, 25 bp, Rattus norvegicus
tagacactactcagacagcagcttc

SEQ ID NO: 555547 - DNA, 25 bp, Rattus norvegicus
tagacactactctgacagcagcttc

SEQ ID NO: 555548 - DNA, 25 bp, Rattus norvegicus
tagacactcagacgcaccacacagg

SEQ ID NO: 555549 - DNA, 25 bp, Rattus norvegicus
tagacactcagaggcaccacacagg

SEQ ID NO: 555550 - DNA, 25 bp, Rattus norvegicus
tagacactctgaagggcactgcaca

SEQ ID NO: 555551 - DNA, 25 bp, Rattus norvegicus
tagacactctgatgggcactgcaca

SEQ ID NO: 555552 - DNA, 25 bp, Rattus norvegicus
tagacactgattacatcgacgagga

SEQ ID NO: 555553 - DNA, 25 bp, Rattus norvegicus
tagacactgatttcatcgacgagga

SEQ ID NO: 555554 - DNA, 25 bp, Rattus norvegicus
tagacactgcatcctgggtccaaat

SEQ ID NO: 555555 - DNA, 25 bp, Rattus norvegicus
tagacactgcatgctgggtccaaat

SEQ ID NO: 555556 - DNA, 25 bp, Rattus norvegicus
tagacacttatcatctctgtctctt

SEQ ID NO: 555557 - DNA, 25 bp, Rattus norvegicus
tagacacttatcttctctgtctctt

SEQ ID NO: 555558 - DNA, 25 bp, Rattus norvegicus
tagacacttggtaagtttagcaaat

SEQ ID NO: 555559 - DNA, 25 bp, Rattus norvegicus
tagacacttggttagtttagcaaat

SEQ ID NO: 555560 - DNA, 25 bp, Rattus norvegicus
tagacacttttacaggttgggttga

SEQ ID NO: 555561 - DNA, 25 bp, Rattus norvegicus
tagacacttttaccctgactttctt

SEQ ID NO: 555562 - DNA, 25 bp, Rattus norvegicus
tagacacttttagaggttgggttga

SEQ ID NO: 555563 - DNA, 25 bp, Rattus norvegicus
tagacacttttagcctgactttctt

SEQ ID NO: 555564 - DNA, 25 bp, Rattus norvegicus
tagacagaatccactcctaagtagg

SEQ ID NO: 555565 - DNA, 25 bp, Rattus norvegicus
tagacagaatcctctcctaagtagg

SEQ ID NO: 555566 - DNA, 25 bp, Rattus norvegicus
tagacagacccaatctcatctaggg

SEQ ID NO: 555567 - DNA, 25 bp, Rattus norvegicus
tagacagacccattctcatctaggg

SEQ ID NO: 555568 - DNA, 25 bp, Rattus norvegicus
tagacagagccacagaatgccaggt

SEQ ID NO: 555569 - DNA, 25 bp, Rattus norvegicus
tagacagagccagagaatgccaggt

SEQ ID NO: 555570 - DNA, 25 bp, Rattus norvegicus
tagacagaggagaccaggccctggc

SEQ ID NO: 555571 - DNA, 25 bp, Rattus norvegicus
tagacagaggagtccaggccctggc

SEQ ID NO: 555572 - DNA, 25 bp, Rattus norvegicus
tagacagatggtcccggatcgtgtt

SEQ ID NO: 555573 - DNA, 25 bp, Rattus norvegicus
tagacagatggtgccggatcgtgtt

SEQ ID NO: 555574 - DNA, 25 bp, Rattus norvegicus
tagacagcaggtagagttaggcccc

SEQ ID NO: 555575 - DNA, 25 bp, Rattus norvegicus
tagacagcaggttgagttaggcccc

SEQ ID NO: 555576 - DNA, 25 bp, Rattus norvegicus
tagacagcatctcccaggacagggt

SEQ ID NO: 555577 - DNA, 25 bp, Rattus norvegicus
tagacagcatctgccaggacagggt

SEQ ID NO: 555578 - DNA, 25 bp, Rattus norvegicus
tagacagcccataacttatcgttaa

SEQ ID NO: 555579 - DNA, 25 bp, Rattus norvegicus
tagacagcccattacttatcgttaa

SEQ ID NO: 555580 - DNA, 25 bp, Rattus norvegicus
tagacagccctgatctttggtaaac

SEQ ID NO: 555581 - DNA, 25 bp, Rattus norvegicus
tagacagccctgttctttggtaaac

SEQ ID NO: 555582 - DNA, 25 bp, Rattus norvegicus
tagacagcctcgaaagacgggtttg

SEQ ID NO: 555583 - DNA, 25 bp, Rattus norvegicus
tagacagcctcgtaagacgggtttg

SEQ ID NO: 555584 - DNA, 25 bp, Rattus norvegicus
tagacagcgacgatgacttgggctt

SEQ ID NO: 555585 - DNA, 25 bp, Rattus norvegicus
tagacagcgacgttgacttgggctt

SEQ ID NO: 555586 - DNA, 25 bp, Rattus norvegicus
tagacagctctcatcatttgcagat

SEQ ID NO: 555587 - DNA, 25 bp, Rattus norvegicus
tagacagctctcttcatttgcagat

SEQ ID NO: 555588 - DNA, 25 bp, Rattus norvegicus
tagacagctctgactggcctgaaac

SEQ ID NO: 555589 - DNA, 25 bp, Rattus norvegicus
tagacagctctgtctggcctgaaac

SEQ ID NO: 555590 - DNA, 25 bp, Rattus norvegicus
tagacagctgtgaggccaagtgtgt

SEQ ID NO: 555591 - DNA, 25 bp, Rattus norvegicus
tagacagctgtgtggccaagtgtgt

SEQ ID NO: 555592 - DNA, 25 bp, Rattus norvegicus
tagacaggaaacaccagccaccata

SEQ ID NO: 555593 - DNA, 25 bp, Rattus norvegicus
tagacaggaaactccagccaccata

SEQ ID NO: 555594 - DNA, 25 bp, Rattus norvegicus
tagacaggccataactgcagtgccc

SEQ ID NO: 555595 - DNA, 25 bp, Rattus norvegicus
tagacaggccattactgcagtgccc

SEQ ID NO: 555596 - DNA, 25 bp, Rattus norvegicus
tagacagggaagctcagtgacactc

SEQ ID NO: 555597 - DNA, 25 bp, Rattus norvegicus
tagacagggaaggtcagtgacactc

SEQ ID NO: 555598 - DNA, 25 bp, Rattus norvegicus
tagacaggtcccatttccccagaga

SEQ ID NO: 555599 - DNA, 25 bp, Rattus norvegicus
tagacaggtcccttttccccagaga

SEQ ID NO: 555600 - DNA, 25 bp, Rattus norvegicus
tagacaggtctgataggcctccaac

SEQ ID NO: 555601 - DNA, 25 bp, Rattus norvegicus
tagacaggtctgttaggcctccaac

SEQ ID NO: 555602 - DNA, 25 bp, Rattus norvegicus
tagacaggtgctcccagactcatga

SEQ ID NO: 555603 - DNA, 25 bp, Rattus norvegicus
tagacaggtgctgccagactcatga

SEQ ID NO: 555604 - DNA, 25 bp, Rattus norvegicus
tagacaggtgtgagctgtggttact

SEQ ID NO: 555605 - DNA, 25 bp, Rattus norvegicus
tagacaggtgtgtgctgtggttact

SEQ ID NO: 555606 - DNA, 25 bp, Rattus norvegicus
tagacagtcacgactactccaacgc

SEQ ID NO: 555607 - DNA, 25 bp, Rattus norvegicus
tagacagtcacgtctactccaacgc

SEQ ID NO: 555608 - DNA, 25 bp, Rattus norvegicus
tagacagtctctccagtgtttctgg

SEQ ID NO: 555609 - DNA, 25 bp, Rattus norvegicus
tagacagtctctgcagtgtttctgg

SEQ ID NO: 555610 - DNA, 25 bp, Rattus norvegicus
tagacagtgattctgcaagagcaca

SEQ ID NO: 555611 - DNA, 25 bp, Rattus norvegicus
tagacagtgattgtgcaagagcaca

SEQ ID NO: 555612 - DNA, 25 bp, Rattus norvegicus
tagacatagcttcccattccataga

SEQ ID NO: 555613 - DNA, 25 bp, Rattus norvegicus
tagacatagcttgccattccataga

SEQ ID NO: 555614 - DNA, 25 bp, Rattus norvegicus
tagacataggctcctccctgttctg

SEQ ID NO: 555615 - DNA, 25 bp, Rattus norvegicus
tagacataggctgctccctgttctg

SEQ ID NO: 555616 - DNA, 25 bp, Rattus norvegicus
tagacatagtttcctctgcttccac

SEQ ID NO: 555617 - DNA, 25 bp, Rattus norvegicus
tagacatagtttgctctgcttccac

SEQ ID NO: 555618 - DNA, 25 bp, Rattus norvegicus
tagacatatgccctgatccagtgac

SEQ ID NO: 555619 - DNA, 25 bp, Rattus norvegicus
tagacatatgccgtgatccagtgac

SEQ ID NO: 555620 - DNA, 25 bp, Rattus norvegicus
tagacatcatctatatcccatgcct

SEQ ID NO: 555621 - DNA, 25 bp, Rattus norvegicus
tagacatcatctttatcccatgcct

SEQ ID NO: 555622 - DNA, 25 bp, Rattus norvegicus
tagacatccctactcactcagctgg

SEQ ID NO: 555623 - DNA, 25 bp, Rattus norvegicus
tagacatccctagtcactcagctgg

SEQ ID NO: 555624 - DNA, 25 bp, Rattus norvegicus
tagacatccgaactgtgtagcccac

SEQ ID NO: 555625 - DNA, 25 bp, Rattus norvegicus
tagacatccgaagtgtgtagcccac

SEQ ID NO: 555626 - DNA, 25 bp, Rattus norvegicus
tagacatcctttcttctgtgcagaa

SEQ ID NO: 555627 - DNA, 25 bp, Rattus norvegicus
tagacatcctttgttctgtgcagaa

SEQ ID NO: 555628 - DNA, 25 bp, Rattus norvegicus
tagacatctcagaccttttttgcca

SEQ ID NO: 555629 - DNA, 25 bp, Rattus norvegicus
tagacatctcagtccttttttgcca

SEQ ID NO: 555630 - DNA, 25 bp, Rattus norvegicus
tagacatctccaatgtctcttccta

SEQ ID NO: 555631 - DNA, 25 bp, Rattus norvegicus
tagacatctccattgtctcttccta

SEQ ID NO: 555632 - DNA, 25 bp, Rattus norvegicus
tagacatcttgcactgaccccatta

SEQ ID NO: 555633 - DNA, 25 bp, Rattus norvegicus
tagacatcttgctctgaccccatta

SEQ ID NO: 555634 - DNA, 25 bp, Rattus norvegicus
tagacatgagctagtggcacccagg

SEQ ID NO: 555635 - DNA, 25 bp, Rattus norvegicus
tagacatgagcttgtggcacccagg

SEQ ID NO: 555636 - DNA, 25 bp, Rattus norvegicus
tagacatgagttcccatcaacatcc

SEQ ID NO: 555637 - DNA, 25 bp, Rattus norvegicus
tagacatgagttgccatcaacatcc

SEQ ID NO: 555638 - DNA, 25 bp, Rattus norvegicus
tagacatgcaccaacacagctgacg

SEQ ID NO: 555639 - DNA, 25 bp, Rattus norvegicus
tagacatgcacctacacagctgacg

SEQ ID NO: 555640 - DNA, 25 bp, Rattus norvegicus
tagacatgcctaccctgaaagcagc

SEQ ID NO: 555641 - DNA, 25 bp, Rattus norvegicus
tagacatgcctagcctgaaagcagc

SEQ ID NO: 555642 - DNA, 25 bp, Rattus norvegicus
tagacatggcccagcaattccacga

SEQ ID NO: 555643 - DNA, 25 bp, Rattus norvegicus
tagacatggccctgcaattccacga

SEQ ID NO: 555644 - DNA, 25 bp, Rattus norvegicus
tagacatggcgcatcttttacagaa

SEQ ID NO: 555645 - DNA, 25 bp, Rattus norvegicus
tagacatggcgcttcttttacagaa

SEQ ID NO: 555646 - DNA, 25 bp, Rattus norvegicus
tagacatggtgtagggctcccacgg

SEQ ID NO: 555647 - DNA, 25 bp, Rattus norvegicus
tagacatggtgttgggctcccacgg

SEQ ID NO: 555648 - DNA, 25 bp, Rattus norvegicus
tagacatgtaggcacccatgcacat

SEQ ID NO: 555649 - DNA, 25 bp, Rattus norvegicus
tagacatgtagggacccatgcacat

SEQ ID NO: 555650 - DNA, 25 bp, Rattus norvegicus
tagacatgtatcattgggtcccgtc

SEQ ID NO: 555651 - DNA, 25 bp, Rattus norvegicus
tagacatgtatctttgggtcccgtc

SEQ ID NO: 555652 - DNA, 25 bp, Rattus norvegicus
tagacatgtccccaagtgtctgggt

SEQ ID NO: 555653 - DNA, 25 bp, Rattus norvegicus
tagacatgtcccgaagtgtctgggt

SEQ ID NO: 555654 - DNA, 25 bp, Rattus norvegicus
tagacatgtcggcagaacaccaatg

SEQ ID NO: 555655 - DNA, 25 bp, Rattus norvegicus
tagacatgtcgggagaacaccaatg

SEQ ID NO: 555656 - DNA, 25 bp, Rattus norvegicus
tagacatgtgtcagtgtggctgaaa

SEQ ID NO: 555657 - DNA, 25 bp, Rattus norvegicus
tagacatgtgtctgtgtggctgaaa

SEQ ID NO: 555658 - DNA, 25 bp, Rattus norvegicus
tagacattcagacctggatcctggg

SEQ ID NO: 555659 - DNA, 25 bp, Rattus norvegicus
tagacattcagagctggatcctggg

SEQ ID NO: 555660 - DNA, 25 bp, Rattus norvegicus
tagacattcataaccttgccatcag

SEQ ID NO: 555661 - DNA, 25 bp, Rattus norvegicus
tagacattcatatccttgccatcag

SEQ ID NO: 555662 - DNA, 25 bp, Rattus norvegicus
tagacattccaaacaccgagttctc

SEQ ID NO: 555663 - DNA, 25 bp, Rattus norvegicus
tagacattccaatcaccgagttctc

SEQ ID NO: 555664 - DNA, 25 bp, Rattus norvegicus
tagacattctggactgatttacgga

SEQ ID NO: 555665 - DNA, 25 bp, Rattus norvegicus
tagacattctggtctgatttacgga

SEQ ID NO: 555666 - DNA, 25 bp, Rattus norvegicus
tagacattctttcttagcacctaag

SEQ ID NO: 555667 - DNA, 25 bp, Rattus norvegicus
tagacattctttgttagcacctaag

SEQ ID NO: 555668 - DNA, 25 bp, Rattus norvegicus
tagacattgcagagctcctcacaac

SEQ ID NO: 555669 - DNA, 25 bp, Rattus norvegicus
tagacattgcagtgctcctcacaac

SEQ ID NO: 555670 - DNA, 25 bp, Rattus norvegicus
tagacattgtgactcagctcatttt

SEQ ID NO: 555671 - DNA, 25 bp, Rattus norvegicus
tagacattgtgagtcagctcatttt

SEQ ID NO: 555672 - DNA, 25 bp, Rattus norvegicus
tagacatttactattattattcaaa

SEQ ID NO: 555673 - DNA, 25 bp, Rattus norvegicus
tagacatttacttttattattcaaa

SEQ ID NO: 555674 - DNA, 25 bp, Rattus norvegicus
tagacatttctacacactcactgag

SEQ ID NO: 555675 - DNA, 25 bp, Rattus norvegicus
tagacatttctagacactcactgag

SEQ ID NO: 555676 - DNA, 25 bp, Rattus norvegicus
tagacatttcttaccgagccccagg

SEQ ID NO: 555677 - DNA, 25 bp, Rattus norvegicus
tagacatttctttccgagccccagg

SEQ ID NO: 555678 - DNA, 25 bp, Rattus norvegicus
tagaccaaagccaggcaaaaccccg

SEQ ID NO: 555679 - DNA, 25 bp, Rattus norvegicus
tagaccaaagcctggcaaaaccccg

SEQ ID NO: 555680 - DNA, 25 bp, Rattus norvegicus
tagaccaactccaagggtgacagtt

SEQ ID NO: 555681 - DNA, 25 bp, Rattus norvegicus
tagaccaactcctagggtgacagtt

SEQ ID NO: 555682 - DNA, 25 bp, Rattus norvegicus
tagaccaagattagggcgggctcgc

SEQ ID NO: 555683 - DNA, 25 bp, Rattus norvegicus
tagaccaagatttgggcgggctcgc

SEQ ID NO: 555684 - DNA, 25 bp, Rattus norvegicus
tagaccaagtctagccctgggcctg

SEQ ID NO: 555685 - DNA, 25 bp, Rattus norvegicus
tagaccaagtcttgccctgggcctg

SEQ ID NO: 555686 - DNA, 25 bp, Rattus norvegicus
tagaccacagagcagttcccaagaa

SEQ ID NO: 555687 - DNA, 25 bp, Rattus norvegicus
tagaccacagaggagttcccaagaa

SEQ ID NO: 555688 - DNA, 25 bp, Rattus norvegicus
tagaccacagtcatctgcaagggta

SEQ ID NO: 555689 - DNA, 25 bp, Rattus norvegicus
tagaccacagtcttctgcaagggta

SEQ ID NO: 555690 - DNA, 25 bp, Rattus norvegicus
tagaccaccctcatctcaaaagcaa

SEQ ID NO: 555691 - DNA, 25 bp, Rattus norvegicus
tagaccaccctcttctcaaaagcaa

SEQ ID NO: 555692 - DNA, 25 bp, Rattus norvegicus
tagaccacttggatggcccagatgg

SEQ ID NO: 555693 - DNA, 25 bp, Rattus norvegicus
tagaccacttggttggcccagatgg

SEQ ID NO: 555694 - DNA, 25 bp, Rattus norvegicus
tagaccagcacaaaggcatccgtgt

SEQ ID NO: 555695 - DNA, 25 bp, Rattus norvegicus
tagaccagcacataggcatccgtgt

SEQ ID NO: 555696 - DNA, 25 bp, Rattus norvegicus
tagaccagcacccatgtctgtctgc

SEQ ID NO: 555697 - DNA, 25 bp, Rattus norvegicus
tagaccagcaccgatgtctgtctgc

SEQ ID NO: 555698 - DNA, 25 bp, Rattus norvegicus
tagaccagcatcctctggcaagcaa

SEQ ID NO: 555699 - DNA, 25 bp, Rattus norvegicus
tagaccagcatcgtctggcaagcaa

SEQ ID NO: 555700 - DNA, 25 bp, Rattus norvegicus
tagaccagccctcggtagaacgcat

SEQ ID NO: 555701 - DNA, 25 bp, Rattus norvegicus
tagaccagccctgggtagaacgcat

SEQ ID NO: 555702 - DNA, 25 bp, Rattus norvegicus
tagaccagcggtatactgtgccctt

SEQ ID NO: 555703 - DNA, 25 bp, Rattus norvegicus
tagaccagcggtttactgtgccctt

SEQ ID NO: 555704 - DNA, 25 bp, Rattus norvegicus
tagaccagctgcatgctacgttctt

SEQ ID NO: 555705 - DNA, 25 bp, Rattus norvegicus
tagaccagctgcttgctacgttctt

SEQ ID NO: 555706 - DNA, 25 bp, Rattus norvegicus
tagaccaggctgagctctgattcat

SEQ ID NO: 555707 - DNA, 25 bp, Rattus norvegicus
tagaccaggctgtgctctgattcat

SEQ ID NO: 555708 - DNA, 25 bp, Rattus norvegicus
tagaccagggttaacttatcgtaag

SEQ ID NO: 555709 - DNA, 25 bp, Rattus norvegicus
tagaccagggtttacttatcgtaag

SEQ ID NO: 555710 - DNA, 25 bp, Rattus norvegicus
tagaccaggttaccctcaaacttgc

SEQ ID NO: 555711 - DNA, 25 bp, Rattus norvegicus
tagaccaggttagcctcaaacttgc

SEQ ID NO: 555712 - DNA, 25 bp, Rattus norvegicus
tagaccaggtttagtagctccgttt

SEQ ID NO: 555713 - DNA, 25 bp, Rattus norvegicus
tagaccaggttttgtagctccgttt

SEQ ID NO: 555714 - DNA, 25 bp, Rattus norvegicus
tagaccagtctgaatcgtgctcaat

SEQ ID NO: 555715 - DNA, 25 bp, Rattus norvegicus
tagaccagtctgtatcgtgctcaat

SEQ ID NO: 555716 - DNA, 25 bp, Rattus norvegicus
tagaccagtttgcatgatctctctc

SEQ ID NO: 555717 - DNA, 25 bp, Rattus norvegicus
tagaccagtttggatgatctctctc

SEQ ID NO: 555718 - DNA, 25 bp, Rattus norvegicus
tagaccagttttctccaaagtacga

SEQ ID NO: 555719 - DNA, 25 bp, Rattus norvegicus
tagaccagttttgtccaaagtacga

SEQ ID NO: 555720 - DNA, 25 bp, Rattus norvegicus
tagaccataattaccatctcctctc

SEQ ID NO: 555721 - DNA, 25 bp, Rattus norvegicus
tagaccataatttccatctcctctc

SEQ ID NO: 555722 - DNA, 25 bp, Rattus norvegicus
tagaccatccccattgttgttaaaa

SEQ ID NO: 555723 - DNA, 25 bp, Rattus norvegicus
tagaccatcccctttgttgttaaaa

SEQ ID NO: 555724 - DNA, 25 bp, Rattus norvegicus
tagaccatcgtcatctgaacaccgt

SEQ ID NO: 555725 - DNA, 25 bp, Rattus norvegicus
tagaccatcgtcttctgaacaccgt

SEQ ID NO: 555726 - DNA, 25 bp, Rattus norvegicus
tagaccatgatgctggcctctagtt

SEQ ID NO: 555727 - DNA, 25 bp, Rattus norvegicus
tagaccatgatggtggcctctagtt

SEQ ID NO: 555728 - DNA, 25 bp, Rattus norvegicus
tagaccatgtcacatcttagctgtt

SEQ ID NO: 555729 - DNA, 25 bp, Rattus norvegicus
tagaccatgtcagatcttagctgtt

SEQ ID NO: 555730 - DNA, 25 bp, Rattus norvegicus
tagaccattataactgctgagcaca

SEQ ID NO: 555731 - DNA, 25 bp, Rattus norvegicus
tagaccattatatctgctgagcaca

SEQ ID NO: 555732 - DNA, 25 bp, Rattus norvegicus
tagacccaaaccactcatactttta

SEQ ID NO: 555733 - DNA, 25 bp, Rattus norvegicus
tagacccaaacctctcatactttta

SEQ ID NO: 555734 - DNA, 25 bp, Rattus norvegicus
tagacccaccagcagattagcaaga

SEQ ID NO: 555735 - DNA, 25 bp, Rattus norvegicus
tagacccaccaggagattagcaaga

SEQ ID NO: 555736 - DNA, 25 bp, Rattus norvegicus
tagacccacttgcaactgtacagag

SEQ ID NO: 555737 - DNA, 25 bp, Rattus norvegicus
tagacccacttggaactgtacagag

SEQ ID NO: 555738 - DNA, 25 bp, Rattus norvegicus
tagacccagctgatgaaggatttat

SEQ ID NO: 555739 - DNA, 25 bp, Rattus norvegicus
tagacccagctgttgaaggatttat

SEQ ID NO: 555740 - DNA, 25 bp, Rattus norvegicus
tagacccatcgtcattcctacacag

SEQ ID NO: 555741 - DNA, 25 bp, Rattus norvegicus
tagacccatcgtgattcctacacag

SEQ ID NO: 555742 - DNA, 25 bp, Rattus norvegicus
tagaccccaaacaccacagttgata

SEQ ID NO: 555743 - DNA, 25 bp, Rattus norvegicus
tagaccccaaactccacagttgata

SEQ ID NO: 555744 - DNA, 25 bp, Rattus norvegicus
tagaccccaaggactatccccttat

SEQ ID NO: 555745 - DNA, 25 bp, Rattus norvegicus
tagaccccaaggtctatccccttat

SEQ ID NO: 555746 - DNA, 25 bp, Rattus norvegicus
tagaccccactacttaagaaataat

SEQ ID NO: 555747 - DNA, 25 bp, Rattus norvegicus
tagaccccactagttaagaaataat

SEQ ID NO: 555748 - DNA, 25 bp, Rattus norvegicus
tagacccccttgacctggagaaatt

SEQ ID NO: 555749 - DNA, 25 bp, Rattus norvegicus
tagacccccttgtcctggagaaatt

SEQ ID NO: 555750 - DNA, 25 bp, Rattus norvegicus
tagaccccgaagatcagtgtccggt

SEQ ID NO: 555751 - DNA, 25 bp, Rattus norvegicus
tagaccccgaagttcagtgtccggt

SEQ ID NO: 555752 - DNA, 25 bp, Rattus norvegicus
tagacccctctcattgaagggtgta

SEQ ID NO: 555753 - DNA, 25 bp, Rattus norvegicus
tagacccctctctttgaagggtgta

SEQ ID NO: 555754 - DNA, 25 bp, Rattus norvegicus
tagacccctttcaccaaggaataag

SEQ ID NO: 555755 - DNA, 25 bp, Rattus norvegicus
tagacccctttctccaaggaataag

SEQ ID NO: 555756 - DNA, 25 bp, Rattus norvegicus
tagaccctaatgacagagctggctc

SEQ ID NO: 555757 - DNA, 25 bp, Rattus norvegicus
tagaccctaatgtcagagctggctc

SEQ ID NO: 555758 - DNA, 25 bp, Rattus norvegicus
tagaccctacttaattttgtcaagt

SEQ ID NO: 555759 - DNA, 25 bp, Rattus norvegicus
tagaccctactttattttgtcaagt

SEQ ID NO: 555760 - DNA, 25 bp, Rattus norvegicus
tagaccctagatcgcagttttcaga

SEQ ID NO: 555761 - DNA, 25 bp, Rattus norvegicus
tagaccctagatggcagttttcaga

SEQ ID NO: 555762 - DNA, 25 bp, Rattus norvegicus
tagaccctcacccagaagcttctgg

SEQ ID NO: 555763 - DNA, 25 bp, Rattus norvegicus
tagaccctcaccgagaagcttctgg

SEQ ID NO: 555764 - DNA, 25 bp, Rattus norvegicus
tagaccctctctacacaggaattgt

SEQ ID NO: 555765 - DNA, 25 bp, Rattus norvegicus
tagaccctctcttcacaggaattgt

SEQ ID NO: 555766 - DNA, 25 bp, Rattus norvegicus
tagaccctgaaaatctccacttcaa

SEQ ID NO: 555767 - DNA, 25 bp, Rattus norvegicus
tagaccctgaaattctccacttcaa

SEQ ID NO: 555768 - DNA, 25 bp, Rattus norvegicus
tagaccctggacagattgctccacc

SEQ ID NO: 555769 - DNA, 25 bp, Rattus norvegicus
tagaccctggactgattgctccacc

SEQ ID NO: 555770 - DNA, 25 bp, Rattus norvegicus
tagaccctggctatggacattccaa

SEQ ID NO: 555771 - DNA, 25 bp, Rattus norvegicus
tagaccctggctttggacattccaa

SEQ ID NO: 555772 - DNA, 25 bp, Rattus norvegicus
tagaccctggtcctctgaagagtgg

SEQ ID NO: 555773 - DNA, 25 bp, Rattus norvegicus
tagaccctggtcgtctgaagagtgg

SEQ ID NO: 555774 - DNA, 25 bp, Rattus norvegicus
tagaccctgtggagttggccgttaa

SEQ ID NO: 555775 - DNA, 25 bp, Rattus norvegicus
tagaccctgtggtgttggccgttaa

SEQ ID NO: 555776 - DNA, 25 bp, Rattus norvegicus
tagacccttatgaacagaactgtgt

SEQ ID NO: 555777 - DNA, 25 bp, Rattus norvegicus
tagacccttatgtacagaactgtgt

SEQ ID NO: 555778 - DNA, 25 bp, Rattus norvegicus
tagaccgcggatactgtggcagctt

SEQ ID NO: 555779 - DNA, 25 bp, Rattus norvegicus
tagaccgcggattctgtggcagctt

SEQ ID NO: 555780 - DNA, 25 bp, Rattus norvegicus
tagaccggcacactggtatcctgca

SEQ ID NO: 555781 - DNA, 25 bp, Rattus norvegicus
tagaccggcacagtggtatcctgca

SEQ ID NO: 555782 - DNA, 25 bp, Rattus norvegicus
tagaccggctgcacattgtgtcaac

SEQ ID NO: 555783 - DNA, 25 bp, Rattus norvegicus
tagaccggctgctcattgtgtcaac

SEQ ID NO: 555784 - DNA, 25 bp, Rattus norvegicus
tagaccgtaaccaggttctgacttc

SEQ ID NO: 555785 - DNA, 25 bp, Rattus norvegicus
tagaccgtaacctggttctgacttc

SEQ ID NO: 555786 - DNA, 25 bp, Rattus norvegicus
tagaccgtcttaaaggagcctctgc

SEQ ID NO: 555787 - DNA, 25 bp, Rattus norvegicus
tagaccgtcttataggagcctctgc

SEQ ID NO: 555788 - DNA, 25 bp, Rattus norvegicus
tagaccgtgttacttacagacgtgt

SEQ ID NO: 555789 - DNA, 25 bp, Rattus norvegicus
tagaccgtgttagttacagacgtgt

SEQ ID NO: 555790 - DNA, 25 bp, Rattus norvegicus
tagaccgttcttcctcataaccaca

SEQ ID NO: 555791 - DNA, 25 bp, Rattus norvegicus
tagaccgttcttgctcataaccaca

SEQ ID NO: 555792 - DNA, 25 bp, Rattus norvegicus
tagacctacttcaaccagctaagtg

SEQ ID NO: 555793 - DNA, 25 bp, Rattus norvegicus
tagacctacttctaccagctaagtg

SEQ ID NO: 555794 - DNA, 25 bp, Rattus norvegicus
tagacctaggctacttcgagtccaa

SEQ ID NO: 555795 - DNA, 25 bp, Rattus norvegicus
tagacctaggcttcttcgagtccaa

SEQ ID NO: 555796 - DNA, 25 bp, Rattus norvegicus
tagacctagtacatggtgcctcacc

SEQ ID NO: 555797 - DNA, 25 bp, Rattus norvegicus
tagacctagtacttggtgcctcacc

SEQ ID NO: 555798 - DNA, 25 bp, Rattus norvegicus
tagacctagtctaccattattcccg

SEQ ID NO: 555799 - DNA, 25 bp, Rattus norvegicus
tagacctagtcttccattattcccg

SEQ ID NO: 555800 - DNA, 25 bp, Rattus norvegicus
tagacctagtttactctctattggt

SEQ ID NO: 555801 - DNA, 25 bp, Rattus norvegicus
tagacctagttttctctctattggt

SEQ ID NO: 555802 - DNA, 25 bp, Rattus norvegicus
tagacctcccggatggtgaccagat

SEQ ID NO: 555803 - DNA, 25 bp, Rattus norvegicus
tagacctcccggttggtgaccagat

SEQ ID NO: 555804 - DNA, 25 bp, Rattus norvegicus
tagacctccctcacatatgtaatag

SEQ ID NO: 555805 - DNA, 25 bp, Rattus norvegicus
tagacctccctctcatatgtaatag

SEQ ID NO: 555806 - DNA, 25 bp, Rattus norvegicus
tagacctccgttattgacacagggc

SEQ ID NO: 555807 - DNA, 25 bp, Rattus norvegicus
tagacctccgtttttgacacagggc

SEQ ID NO: 555808 - DNA, 25 bp, Rattus norvegicus
tagacctcctgcatttcctagggag

SEQ ID NO: 555809 - DNA, 25 bp, Rattus norvegicus
tagacctcctgcttttcctagggag

SEQ ID NO: 555810 - DNA, 25 bp, Rattus norvegicus
tagacctctggtaagcctgacagaa

SEQ ID NO: 555811 - DNA, 25 bp, Rattus norvegicus
tagacctctggttagcctgacagaa

SEQ ID NO: 555812 - DNA, 25 bp, Rattus norvegicus
tagacctcttcacccaattttgttt

SEQ ID NO: 555813 - DNA, 25 bp, Rattus norvegicus
tagacctcttcagccaattttgttt

SEQ ID NO: 555814 - DNA, 25 bp, Rattus norvegicus
tagacctgacctagattcgtgctcg

SEQ ID NO: 555815 - DNA, 25 bp, Rattus norvegicus
tagacctgaccttgattcgtgctcg

SEQ ID NO: 555816 - DNA, 25 bp, Rattus norvegicus
tagacctgatccaggcggagtgctt

SEQ ID NO: 555817 - DNA, 25 bp, Rattus norvegicus
tagacctgatcctggcggagtgctt

SEQ ID NO: 555818 - DNA, 25 bp, Rattus norvegicus
tagacctgcagacttcgtaaccact

SEQ ID NO: 555819 - DNA, 25 bp, Rattus norvegicus
tagacctgcagagttcgtaaccact

SEQ ID NO: 555820 - DNA, 25 bp, Rattus norvegicus
tagacctgcatcattcttctttgta

SEQ ID NO: 555821 - DNA, 25 bp, Rattus norvegicus
tagacctgcatctttcttctttgta

SEQ ID NO: 555822 - DNA, 25 bp, Rattus norvegicus
tagacctgcgccaacgtttaaaagt

SEQ ID NO: 555823 - DNA, 25 bp, Rattus norvegicus
tagacctgcgcctacgtttaaaagt

SEQ ID NO: 555824 - DNA, 25 bp, Rattus norvegicus
tagacctgggatccagcctttcagg

SEQ ID NO: 555825 - DNA, 25 bp, Rattus norvegicus
tagacctgggatgcagcctttcagg

SEQ ID NO: 555826 - DNA, 25 bp, Rattus norvegicus
tagacctgtcggcaaactgttcttc

SEQ ID NO: 555827 - DNA, 25 bp, Rattus norvegicus
tagacctgtcgggaaactgttcttc

SEQ ID NO: 555828 - DNA, 25 bp, Rattus norvegicus
tagacctgttggcttggttcctatt

SEQ ID NO: 555829 - DNA, 25 bp, Rattus norvegicus
tagacctgttgggttggttcctatt

SEQ ID NO: 555830 - DNA, 25 bp, Rattus norvegicus
tagaccttcacccatggcaggatat

SEQ ID NO: 555831 - DNA, 25 bp, Rattus norvegicus
tagaccttcaccgatggcaggatat

SEQ ID NO: 555832 - DNA, 25 bp, Rattus norvegicus
tagaccttcatcacagagttcagag

SEQ ID NO: 555833 - DNA, 25 bp, Rattus norvegicus
tagaccttcatctcagagttcagag

SEQ ID NO: 555834 - DNA, 25 bp, Rattus norvegicus
tagaccttgggacactacaatggcc

SEQ ID NO: 555835 - DNA, 25 bp, Rattus norvegicus
tagaccttgggagactacaatggcc

SEQ ID NO: 555836 - DNA, 25 bp, Rattus norvegicus
tagacctttcgtaatgctggcattc

SEQ ID NO: 555837 - DNA, 25 bp, Rattus norvegicus
tagacctttcgttatgctggcattc

SEQ ID NO: 555838 - DNA, 25 bp, Rattus norvegicus
tagacctttctcctgtagtgttaga

SEQ ID NO: 555839 - DNA, 25 bp, Rattus norvegicus
tagacctttctcgtgtagtgttaga

SEQ ID NO: 555840 - DNA, 25 bp, Rattus norvegicus
tagaccttttccacagtgactatgg

SEQ ID NO: 555841 - DNA, 25 bp, Rattus norvegicus
tagaccttttcctcagtgactatgg

SEQ ID NO: 555842 - DNA, 25 bp, Rattus norvegicus
tagacgaaacctaggtgcacagttc

SEQ ID NO: 555843 - DNA, 25 bp, Rattus norvegicus
tagacgaaaccttggtgcacagttc

SEQ ID NO: 555844 - DNA, 25 bp, Rattus norvegicus
tagacgaattatagcccaagtgtac

SEQ ID NO: 555845 - DNA, 25 bp, Rattus norvegicus
tagacgaattattgcccaagtgtac

SEQ ID NO: 555846 - DNA, 25 bp, Rattus norvegicus
tagacgagggcacctcaatgtgtgt

SEQ ID NO: 555847 - DNA, 25 bp, Rattus norvegicus
tagacgagggcagctcaatgtgtgt

SEQ ID NO: 555848 - DNA, 25 bp, Rattus norvegicus
tagacgcaggcacagggctagcctc

SEQ ID NO: 555849 - DNA, 25 bp, Rattus norvegicus
tagacgcaggcagagggctagcctc

SEQ ID NO: 555850 - DNA, 25 bp, Rattus norvegicus
tagacgcataacacccacaacagtg

SEQ ID NO: 555851 - DNA, 25 bp, Rattus norvegicus
tagacgcataactcccacaacagtg

SEQ ID NO: 555852 - DNA, 25 bp, Rattus norvegicus
tagacgcatctcaggtgtcaatcgc

SEQ ID NO: 555853 - DNA, 25 bp, Rattus norvegicus
tagacgcatctctggtgtcaatcgc

SEQ ID NO: 555854 - DNA, 25 bp, Rattus norvegicus
tagacgccactgacaccgaaggtgg

SEQ ID NO: 555855 - DNA, 25 bp, Rattus norvegicus
tagacgccactgtcaccgaaggtgg

SEQ ID NO: 555856 - DNA, 25 bp, Rattus norvegicus
tagacgccataactggcttcgccta

SEQ ID NO: 555857 - DNA, 25 bp, Rattus norvegicus
tagacgccataagtggcttcgccta

SEQ ID NO: 555858 - DNA, 25 bp, Rattus norvegicus
tagacgccctgaatctctggagtag

SEQ ID NO: 555859 - DNA, 25 bp, Rattus norvegicus
tagacgccctgattctctggagtag

SEQ ID NO: 555860 - DNA, 25 bp, Rattus norvegicus
tagacgccttttccctagattacgt

SEQ ID NO: 555861 - DNA, 25 bp, Rattus norvegicus
tagacgccttttgcctagattacgt

SEQ ID NO: 555862 - DNA, 25 bp, Rattus norvegicus
tagacgctcatgagcgcacgtgcgg

SEQ ID NO: 555863 - DNA, 25 bp, Rattus norvegicus
tagacgctcatgtgcgcacgtgcgg

SEQ ID NO: 555864 - DNA, 25 bp, Rattus norvegicus
tagacgctccccagagatgaagtgg

SEQ ID NO: 555865 - DNA, 25 bp, Rattus norvegicus
tagacgctcccctgagatgaagtgg

SEQ ID NO: 555866 - DNA, 25 bp, Rattus norvegicus
tagacgctgtgccacccaacgttgt

SEQ ID NO: 555867 - DNA, 25 bp, Rattus norvegicus
tagacgctgtgcgacccaacgttgt

SEQ ID NO: 555868 - DNA, 25 bp, Rattus norvegicus
tagacggccgggattaccactttgt

SEQ ID NO: 555869 - DNA, 25 bp, Rattus norvegicus
tagacggccgggtttaccactttgt

SEQ ID NO: 555870 - DNA, 25 bp, Rattus norvegicus
tagacggctgaacgtgtgctgtcat

SEQ ID NO: 555871 - DNA, 25 bp, Rattus norvegicus
tagacggctgaaggtgtgctgtcat

SEQ ID NO: 555872 - DNA, 25 bp, Rattus norvegicus
tagacggctggcacggaagaacccc

SEQ ID NO: 555873 - DNA, 25 bp, Rattus norvegicus
tagacggctggctcggaagaacccc

SEQ ID NO: 555874 - DNA, 25 bp, Rattus norvegicus
tagacgggcgccagtcccctgcgat

SEQ ID NO: 555875 - DNA, 25 bp, Rattus norvegicus
tagacgggcgcctgtcccctgcgat

SEQ ID NO: 555876 - DNA, 25 bp, Rattus norvegicus
tagacgggtagccttacctgctgct

SEQ ID NO: 555877 - DNA, 25 bp, Rattus norvegicus
tagacgggtagcgttacctgctgct

SEQ ID NO: 555878 - DNA, 25 bp, Rattus norvegicus
tagacggtgaatcgacactcccggc

SEQ ID NO: 555879 - DNA, 25 bp, Rattus norvegicus
tagacggtgaatggacactcccggc

SEQ ID NO: 555880 - DNA, 25 bp, Rattus norvegicus
tagacgtcaaacaccattccacaga

SEQ ID NO: 555881 - DNA, 25 bp, Rattus norvegicus
tagacgtcaaactccattccacaga

SEQ ID NO: 555882 - DNA, 25 bp, Rattus norvegicus
tagacgtcgatgcgcacgtgcagca

SEQ ID NO: 555883 - DNA, 25 bp, Rattus norvegicus
tagacgtcgatgggcacgtgcagca

SEQ ID NO: 555884 - DNA, 25 bp, Rattus norvegicus
tagacgtgagcacagtcagacatct

SEQ ID NO: 555885 - DNA, 25 bp, Rattus norvegicus
tagacgtgagcagagtcagacatct

SEQ ID NO: 555886 - DNA, 25 bp, Rattus norvegicus
tagacgttactactgttcgcttttt

SEQ ID NO: 555887 - DNA, 25 bp, Rattus norvegicus
tagacgttactagtgttcgcttttt

SEQ ID NO: 555888 - DNA, 25 bp, Rattus norvegicus
tagacgttagttatcgctccctgtg

SEQ ID NO: 555889 - DNA, 25 bp, Rattus norvegicus
tagacgttagttttcgctccctgtg

SEQ ID NO: 555890 - DNA, 25 bp, Rattus norvegicus
tagactaagttgactcagacccctg

SEQ ID NO: 555891 - DNA, 25 bp, Rattus norvegicus
tagactaagttgtctcagacccctg

SEQ ID NO: 555892 - DNA, 25 bp, Rattus norvegicus
tagactaattggacctccgtttata

SEQ ID NO: 555893 - DNA, 25 bp, Rattus norvegicus
tagactaattggtcctccgtttata

SEQ ID NO: 555894 - DNA, 25 bp, Rattus norvegicus
tagactaatttcagaagccgcgttt

SEQ ID NO: 555895 - DNA, 25 bp, Rattus norvegicus
tagactaatttctgaagccgcgttt

SEQ ID NO: 555896 - DNA, 25 bp, Rattus norvegicus
tagactacactgagcccgagaaggt

SEQ ID NO: 555897 - DNA, 25 bp, Rattus norvegicus
tagactacactgtgcccgagaaggt

SEQ ID NO: 555898 - DNA, 25 bp, Rattus norvegicus
tagactaccaaaaacatttcacatg

SEQ ID NO: 555899 - DNA, 25 bp, Rattus norvegicus
tagactaccaaatacatttcacatg

SEQ ID NO: 555900 - DNA, 25 bp, Rattus norvegicus
tagactactctgcatttaactcata

SEQ ID NO: 555901 - DNA, 25 bp, Rattus norvegicus
tagactactctggatttaactcata

SEQ ID NO: 555902 - DNA, 25 bp, Rattus norvegicus
tagactacttccagggaggactgaa

SEQ ID NO: 555903 - DNA, 25 bp, Rattus norvegicus
tagactacttcctgggaggactgaa

SEQ ID NO: 555904 - DNA, 25 bp, Rattus norvegicus
tagactagccagagtcgtctgtgac

SEQ ID NO: 555905 - DNA, 25 bp, Rattus norvegicus
tagactagccagtgtcgtctgtgac

SEQ ID NO: 555906 - DNA, 25 bp, Rattus norvegicus
tagactagcctgccggtcaataact

SEQ ID NO: 555907 - DNA, 25 bp, Rattus norvegicus
tagactagcctggcggtcaataact

SEQ ID NO: 555908 - DNA, 25 bp, Rattus norvegicus
tagactagtgtcacaggaacttctg

SEQ ID NO: 555909 - DNA, 25 bp, Rattus norvegicus
tagactagtgtctcaggaacttctg

SEQ ID NO: 555910 - DNA, 25 bp, Rattus norvegicus
tagactatggcaaacttcacccttt

SEQ ID NO: 555911 - DNA, 25 bp, Rattus norvegicus
tagactatggcatacttcacccttt

SEQ ID NO: 555912 - DNA, 25 bp, Rattus norvegicus
tagactattatgcaaccagactcac

SEQ ID NO: 555913 - DNA, 25 bp, Rattus norvegicus
tagactattatggaaccagactcac

SEQ ID NO: 555914 - DNA, 25 bp, Rattus norvegicus
tagactattcccaactagatttttt

SEQ ID NO: 555915 - DNA, 25 bp, Rattus norvegicus
tagactattccctactagatttttt

SEQ ID NO: 555916 - DNA, 25 bp, Rattus norvegicus
tagactcacggtctttcctaaagag

SEQ ID NO: 555917 - DNA, 25 bp, Rattus norvegicus
tagactcacggtgtttcctaaagag

SEQ ID NO: 555918 - DNA, 25 bp, Rattus norvegicus
tagactcagccaaccagaggtctgt

SEQ ID NO: 555919 - DNA, 25 bp, Rattus norvegicus
tagactcagccatccagaggtctgt

SEQ ID NO: 555920 - DNA, 25 bp, Rattus norvegicus
tagactcataaaaaccacctgcctg

SEQ ID NO: 555921 - DNA, 25 bp, Rattus norvegicus
tagactcataaataccacctgcctg

SEQ ID NO: 555922 - DNA, 25 bp, Rattus norvegicus
tagactccagatacataatagagtt

SEQ ID NO: 555923 - DNA, 25 bp, Rattus norvegicus
tagactccagattcataatagagtt

SEQ ID NO: 555924 - DNA, 25 bp, Rattus norvegicus
tagactccagctatgctcagtctga

SEQ ID NO: 555925 - DNA, 25 bp, Rattus norvegicus
tagactccagctttgctcagtctga

SEQ ID NO: 555926 - DNA, 25 bp, Rattus norvegicus
tagactccaggaatcatcagcgtga

SEQ ID NO: 555927 - DNA, 25 bp, Rattus norvegicus
tagactccaggattcatcagcgtga

SEQ ID NO: 555928 - DNA, 25 bp, Rattus norvegicus
tagactccattgcatctctctgaat

SEQ ID NO: 555929 - DNA, 25 bp, Rattus norvegicus
tagactccattggatctctctgaat

SEQ ID NO: 555930 - DNA, 25 bp, Rattus norvegicus
tagactcctgcaaacctcaagttgg

SEQ ID NO: 555931 - DNA, 25 bp, Rattus norvegicus
tagactcctgcatacctcaagttgg

SEQ ID NO: 555932 - DNA, 25 bp, Rattus norvegicus
tagactcctggaaagttgtcctggg

SEQ ID NO: 555933 - DNA, 25 bp, Rattus norvegicus
tagactcctggatagttgtcctggg

SEQ ID NO: 555934 - DNA, 25 bp, Rattus norvegicus
tagactcggcgtccagcaacatcaa

SEQ ID NO: 555935 - DNA, 25 bp, Rattus norvegicus
tagactcggcgtgcagcaacatcaa

SEQ ID NO: 555936 - DNA, 25 bp, Rattus norvegicus
tagactcgtgagagacgacccttct

SEQ ID NO: 555937 - DNA, 25 bp, Rattus norvegicus
tagactcgtgagtgacgacccttct

SEQ ID NO: 555938 - DNA, 25 bp, Rattus norvegicus
tagactcgtgtactgtttctgatga

SEQ ID NO: 555939 - DNA, 25 bp, Rattus norvegicus
tagactcgtgtagtgtttctgatga

SEQ ID NO: 555940 - DNA, 25 bp, Rattus norvegicus
tagactctccagcagacttcattta

SEQ ID NO: 555941 - DNA, 25 bp, Rattus norvegicus
tagactctccaggagacttcattta

SEQ ID NO: 555942 - DNA, 25 bp, Rattus norvegicus
tagactctccatcaatacacagctt

SEQ ID NO: 555943 - DNA, 25 bp, Rattus norvegicus
tagactctccatgaatacacagctt

SEQ ID NO: 555944 - DNA, 25 bp, Rattus norvegicus
tagactctgagaccctgatcaatgc

SEQ ID NO: 555945 - DNA, 25 bp, Rattus norvegicus
tagactctgagagcctgatcaatgc

SEQ ID NO: 555946 - DNA, 25 bp, Rattus norvegicus
tagactctggaaattctggcctggc

SEQ ID NO: 555947 - DNA, 25 bp, Rattus norvegicus
tagactctggaatttctggcctggc

SEQ ID NO: 555948 - DNA, 25 bp, Rattus norvegicus
tagactctggcaactggctgggcac

SEQ ID NO: 555949 - DNA, 25 bp, Rattus norvegicus
tagactctggcatctggctgggcac

SEQ ID NO: 555950 - DNA, 25 bp, Rattus norvegicus
tagactctggctctgatgcttgaca

SEQ ID NO: 555951 - DNA, 25 bp, Rattus norvegicus
tagactctggctgtgatgcttgaca

SEQ ID NO: 555952 - DNA, 25 bp, Rattus norvegicus
tagactctgtccaccacgtgtgaga

SEQ ID NO: 555953 - DNA, 25 bp, Rattus norvegicus
tagactctgtcccactttgtgtcac

SEQ ID NO: 555954 - DNA, 25 bp, Rattus norvegicus
tagactctgtccgactttgtgtcac

SEQ ID NO: 555955 - DNA, 25 bp, Rattus norvegicus
tagactctgtcctccacgtgtgaga

SEQ ID NO: 555956 - DNA, 25 bp, Rattus norvegicus
tagactctgttcactctgtcactaa

SEQ ID NO: 555957 - DNA, 25 bp, Rattus norvegicus
tagactctgttctctctgtcactaa

SEQ ID NO: 555958 - DNA, 25 bp, Rattus norvegicus
tagactcttcctaccttgtcacagt

SEQ ID NO: 555959 - DNA, 25 bp, Rattus norvegicus
tagactcttccttccttgtcacagt

SEQ ID NO: 555960 - DNA, 25 bp, Rattus norvegicus
tagactcttctaatggatttcccga

SEQ ID NO: 555961 - DNA, 25 bp, Rattus norvegicus
tagactcttctattggatttcccga

SEQ ID NO: 555962 - DNA, 25 bp, Rattus norvegicus
tagactgactccagagcccttatct

SEQ ID NO: 555963 - DNA, 25 bp, Rattus norvegicus
tagactgactcctgagcccttatct

SEQ ID NO: 555964 - DNA, 25 bp, Rattus norvegicus
tagactgatcgcctggcgtggacta

SEQ ID NO: 555965 - DNA, 25 bp, Rattus norvegicus
tagactgatcgcgtggcgtggacta

SEQ ID NO: 555966 - DNA, 25 bp, Rattus norvegicus
tagactgatggaaggcgtgcagcct

SEQ ID NO: 555967 - DNA, 25 bp, Rattus norvegicus
tagactgatggatggcgtgcagcct

SEQ ID NO: 555968 - DNA, 25 bp, Rattus norvegicus
tagactgcacacaatgtccttttta

SEQ ID NO: 555969 - DNA, 25 bp, Rattus norvegicus
tagactgcacactatgtccttttta

SEQ ID NO: 555970 - DNA, 25 bp, Rattus norvegicus
tagactgccagcctgttcatgatga

SEQ ID NO: 555971 - DNA, 25 bp, Rattus norvegicus
tagactgccagcgtgttcatgatga

SEQ ID NO: 555972 - DNA, 25 bp, Rattus norvegicus
tagactgcctacaggccatatctag

SEQ ID NO: 555973 - DNA, 25 bp, Rattus norvegicus
tagactgcctactggccatatctag

SEQ ID NO: 555974 - DNA, 25 bp, Rattus norvegicus
tagactgcctctctgaactgaaagt

SEQ ID NO: 555975 - DNA, 25 bp, Rattus norvegicus
tagactgcctctgtgaactgaaagt

SEQ ID NO: 555976 - DNA, 25 bp, Rattus norvegicus
tagactgctctccttatctggaggg

SEQ ID NO: 555977 - DNA, 25 bp, Rattus norvegicus
tagactgctctcgttatctggaggg

SEQ ID NO: 555978 - DNA, 25 bp, Rattus norvegicus
tagactgctgttctgaccctattta

SEQ ID NO: 555979 - DNA, 25 bp, Rattus norvegicus
tagactgctgttgtgaccctattta

SEQ ID NO: 555980 - DNA, 25 bp, Rattus norvegicus
tagactgcttccctttgggtagctg

SEQ ID NO: 555981 - DNA, 25 bp, Rattus norvegicus
tagactgcttccgtttgggtagctg

SEQ ID NO: 555982 - DNA, 25 bp, Rattus norvegicus
tagactggctagagagccccaggga

SEQ ID NO: 555983 - DNA, 25 bp, Rattus norvegicus
tagactggctagtgagccccaggga

SEQ ID NO: 555984 - DNA, 25 bp, Rattus norvegicus
tagactggcttgaacttgctagtaa

SEQ ID NO: 555985 - DNA, 25 bp, Rattus norvegicus
tagactggcttgtacttgctagtaa

SEQ ID NO: 555986 - DNA, 25 bp, Rattus norvegicus
tagactggctttagatccggccgtg

SEQ ID NO: 555987 - DNA, 25 bp, Rattus norvegicus
tagactggcttttgatccggccgtg

SEQ ID NO: 555988 - DNA, 25 bp, Rattus norvegicus
tagactgggcttatgacctgggcat

SEQ ID NO: 555989 - DNA, 25 bp, Rattus norvegicus
tagactgggcttttgacctgggcat

SEQ ID NO: 555990 - DNA, 25 bp, Rattus norvegicus
tagactgtaacactacacggtgtac

SEQ ID NO: 555991 - DNA, 25 bp, Rattus norvegicus
tagactgtaacagtacacggtgtac

SEQ ID NO: 555992 - DNA, 25 bp, Rattus norvegicus
tagactgtccatcattctccaggac

SEQ ID NO: 555993 - DNA, 25 bp, Rattus norvegicus
tagactgtccatcctactcgaatta

SEQ ID NO: 555994 - DNA, 25 bp, Rattus norvegicus
tagactgtccatgattctccaggac

SEQ ID NO: 555995 - DNA, 25 bp, Rattus norvegicus
tagactgtccatgctactcgaatta

SEQ ID NO: 555996 - DNA, 25 bp, Rattus norvegicus
tagactgtcctccaggcaaacgtac

SEQ ID NO: 555997 - DNA, 25 bp, Rattus norvegicus
tagactgtcctcgaggcaaacgtac

SEQ ID NO: 555998 - DNA, 25 bp, Rattus norvegicus
tagactgtgagaacgtgagcgccaa

SEQ ID NO: 555999 - DNA, 25 bp, Rattus norvegicus
tagactgtgagatcgtgagcgccaa

SEQ ID NO: 556000 - DNA, 25 bp, Rattus norvegicus
tagactgtggccaggaagctccctt

SEQ ID NO: 556001 - DNA, 25 bp, Rattus norvegicus
tagactgtggcctggaagctccctt

SEQ ID NO: 556002 - DNA, 25 bp, Rattus norvegicus
tagactgtggtcctcagcatcttgc

SEQ ID NO: 556003 - DNA, 25 bp, Rattus norvegicus
tagactgtggtcgtcagcatcttgc

SEQ ID NO: 556004 - DNA, 25 bp, Rattus norvegicus
tagactgtgttaatgcctaccctga

SEQ ID NO: 556005 - DNA, 25 bp, Rattus norvegicus
tagactgtgttattgcctaccctga

SEQ ID NO: 556006 - DNA, 25 bp, Rattus norvegicus
tagactgttctcatgtttgatcaaa

SEQ ID NO: 556007 - DNA, 25 bp, Rattus norvegicus
tagactgttctcttgtttgatcaaa

SEQ ID NO: 556008 - DNA, 25 bp, Rattus norvegicus
tagactgtttttaagggacacccat

SEQ ID NO: 556009 - DNA, 25 bp, Rattus norvegicus
tagactgttttttagggacacccat

SEQ ID NO: 556010 - DNA, 25 bp, Rattus norvegicus
tagacttaaaagatatggcacctta

SEQ ID NO: 556011 - DNA, 25 bp, Rattus norvegicus
tagacttaaaagttatggcacctta

SEQ ID NO: 556012 - DNA, 25 bp, Rattus norvegicus
tagacttaaaggagcttctcgtcat

SEQ ID NO: 556013 - DNA, 25 bp, Rattus norvegicus
tagacttaaaggtgcttctcgtcat

SEQ ID NO: 556014 - DNA, 25 bp, Rattus norvegicus
tagacttaagccatgtgacttccaa

SEQ ID NO: 556015 - DNA, 25 bp, Rattus norvegicus
tagacttaagccttgtgacttccaa

SEQ ID NO: 556016 - DNA, 25 bp, Rattus norvegicus
tagacttacaccactaatacgcaga

SEQ ID NO: 556017 - DNA, 25 bp, Rattus norvegicus
tagacttacacctctaatacgcaga

SEQ ID NO: 556018 - DNA, 25 bp, Rattus norvegicus
tagacttatatgacatctggctaaa

SEQ ID NO: 556019 - DNA, 25 bp, Rattus norvegicus
tagacttatatgtcatctggctaaa

SEQ ID NO: 556020 - DNA, 25 bp, Rattus norvegicus
tagacttcaagcaagttccactctg

SEQ ID NO: 556021 - DNA, 25 bp, Rattus norvegicus
tagacttcaagctagttccactctg

SEQ ID NO: 556022 - DNA, 25 bp, Rattus norvegicus
tagacttcacttccttcacgttttt

SEQ ID NO: 556023 - DNA, 25 bp, Rattus norvegicus
tagacttcacttgcttcacgttttt

SEQ ID NO: 556024 - DNA, 25 bp, Rattus norvegicus
tagacttcagttactttccctgtac

SEQ ID NO: 556025 - DNA, 25 bp, Rattus norvegicus
tagacttcagtttctttccctgtac

SEQ ID NO: 556026 - DNA, 25 bp, Rattus norvegicus
tagacttccgccctgattggtcagt

SEQ ID NO: 556027 - DNA, 25 bp, Rattus norvegicus
tagacttccgccgtgattggtcagt

SEQ ID NO: 556028 - DNA, 25 bp, Rattus norvegicus
tagacttccttcagggcgagctgga

SEQ ID NO: 556029 - DNA, 25 bp, Rattus norvegicus
tagacttccttctgggcgagctgga

SEQ ID NO: 556030 - DNA, 25 bp, Rattus norvegicus
tagacttctcaaacaggcctctgtc

SEQ ID NO: 556031 - DNA, 25 bp, Rattus norvegicus
tagacttctcaatcaggcctctgtc

SEQ ID NO: 556032 - DNA, 25 bp, Rattus norvegicus
tagacttctcatagccaaccttaat

SEQ ID NO: 556033 - DNA, 25 bp, Rattus norvegicus
tagacttctcattgccaaccttaat

SEQ ID NO: 556034 - DNA, 25 bp, Rattus norvegicus
tagacttctgacctagaacttccct

SEQ ID NO: 556035 - DNA, 25 bp, Rattus norvegicus
tagacttctgacgtagaacttccct

SEQ ID NO: 556036 - DNA, 25 bp, Rattus norvegicus
tagacttgaattctttctcccttcc

SEQ ID NO: 556037 - DNA, 25 bp, Rattus norvegicus
tagacttgaattgtttctcccttcc

SEQ ID NO: 556038 - DNA, 25 bp, Rattus norvegicus
tagacttgacataagattttcttta

SEQ ID NO: 556039 - DNA, 25 bp, Rattus norvegicus
tagacttgacattagattttcttta

SEQ ID NO: 556040 - DNA, 25 bp, Rattus norvegicus
tagacttgacctctccactgtcttt

SEQ ID NO: 556041 - DNA, 25 bp, Rattus norvegicus
tagacttgacctgtccactgtcttt

SEQ ID NO: 556042 - DNA, 25 bp, Rattus norvegicus
tagacttgcaacacagggcttctct

SEQ ID NO: 556043 - DNA, 25 bp, Rattus norvegicus
tagacttgcaactcagggcttctct

SEQ ID NO: 556044 - DNA, 25 bp, Rattus norvegicus
tagacttggaggaggtggtcccatt

SEQ ID NO: 556045 - DNA, 25 bp, Rattus norvegicus
tagacttggaggtggtggtcccatt

SEQ ID NO: 556046 - DNA, 25 bp, Rattus norvegicus
tagacttgggctattgtcatttcaa

SEQ ID NO: 556047 - DNA, 25 bp, Rattus norvegicus
tagacttgggcttttgtcatttcaa

SEQ ID NO: 556048 - DNA, 25 bp, Rattus norvegicus
tagacttgggttacatctgagcaga

SEQ ID NO: 556049 - DNA, 25 bp, Rattus norvegicus
tagacttgggtttcatctgagcaga

SEQ ID NO: 556050 - DNA, 25 bp, Rattus norvegicus
tagacttggtggcagcttccgagaa

SEQ ID NO: 556051 - DNA, 25 bp, Rattus norvegicus
tagacttggtgggagcttccgagaa

SEQ ID NO: 556052 - DNA, 25 bp, Rattus norvegicus
tagacttgtgaccaattctgccccg

SEQ ID NO: 556053 - DNA, 25 bp, Rattus norvegicus
tagacttgtgacgaattctgccccg

SEQ ID NO: 556054 - DNA, 25 bp, Rattus norvegicus
tagacttgtgccatcatgctttggg

SEQ ID NO: 556055 - DNA, 25 bp, Rattus norvegicus
tagacttgtgccttcatgctttggg

SEQ ID NO: 556056 - DNA, 25 bp, Rattus norvegicus
tagacttgttctcatgtcgggtcct

SEQ ID NO: 556057 - DNA, 25 bp, Rattus norvegicus
tagacttgttctgatgtcgggtcct

SEQ ID NO: 556058 - DNA, 25 bp, Rattus norvegicus
tagacttgtttgacagtgcgtgcat

SEQ ID NO: 556059 - DNA, 25 bp, Rattus norvegicus
tagacttgtttgtcagtgcgtgcat

SEQ ID NO: 556060 - DNA, 25 bp, Rattus norvegicus
tagactttacttccattctttccct

SEQ ID NO: 556061 - DNA, 25 bp, Rattus norvegicus
tagactttacttgcattctttccct

SEQ ID NO: 556062 - DNA, 25 bp, Rattus norvegicus
tagactttcgctcgcttcaagacaa

SEQ ID NO: 556063 - DNA, 25 bp, Rattus norvegicus
tagactttcgctggcttcaagacaa

SEQ ID NO: 556064 - DNA, 25 bp, Rattus norvegicus
tagactttctctaccccgagaaaat

SEQ ID NO: 556065 - DNA, 25 bp, Rattus norvegicus
tagactttctcttccccgagaaaat

SEQ ID NO: 556066 - DNA, 25 bp, Rattus norvegicus
tagactttctggagactgttcccat

SEQ ID NO: 556067 - DNA, 25 bp, Rattus norvegicus
tagactttctggtgactgttcccat

SEQ ID NO: 556068 - DNA, 25 bp, Rattus norvegicus
tagactttcttcactaagagcacga

SEQ ID NO: 556069 - DNA, 25 bp, Rattus norvegicus
tagactttcttctctaagagcacga

SEQ ID NO: 556070 - DNA, 25 bp, Rattus norvegicus
tagactttgacgattatctccctct

SEQ ID NO: 556071 - DNA, 25 bp, Rattus norvegicus
tagactttgacgtttatctccctct

SEQ ID NO: 556072 - DNA, 25 bp, Rattus norvegicus
tagactttggctctttcttcgtaaa

SEQ ID NO: 556073 - DNA, 25 bp, Rattus norvegicus
tagactttggctgtttcttcgtaaa

SEQ ID NO: 556074 - DNA, 25 bp, Rattus norvegicus
tagactttttatagggcgtcctcgg

SEQ ID NO: 556075 - DNA, 25 bp, Rattus norvegicus
tagactttttattgggcgtcctcgg

SEQ ID NO: 556076 - DNA, 25 bp, Rattus norvegicus
tagagaaacctgagggctctcctgc

SEQ ID NO: 556077 - DNA, 25 bp, Rattus norvegicus
tagagaaacctgtgggctctcctgc

SEQ ID NO: 556078 - DNA, 25 bp, Rattus norvegicus
tagagaaatgaaaccccgttgggca

SEQ ID NO: 556079 - DNA, 25 bp, Rattus norvegicus
tagagaaatgaatccccgttgggca

SEQ ID NO: 556080 - DNA, 25 bp, Rattus norvegicus
tagagaacacatacccttttgcctt

SEQ ID NO: 556081 - DNA, 25 bp, Rattus norvegicus
tagagaacacattcccttttgcctt

SEQ ID NO: 556082 - DNA, 25 bp, Rattus norvegicus
tagagaacactcatttctcctactc

SEQ ID NO: 556083 - DNA, 25 bp, Rattus norvegicus
tagagaacactcttttctcctactc

SEQ ID NO: 556084 - DNA, 25 bp, Rattus norvegicus
tagagaacagcacctccttttcatc

SEQ ID NO: 556085 - DNA, 25 bp, Rattus norvegicus
tagagaacagcactggccctgacag

SEQ ID NO: 556086 - DNA, 25 bp, Rattus norvegicus
tagagaacagcagctccttttcatc

SEQ ID NO: 556087 - DNA, 25 bp, Rattus norvegicus
tagagaacagcagtggccctgacag

SEQ ID NO: 556088 - DNA, 25 bp, Rattus norvegicus
tagagaaccaggatttcagctgtga

SEQ ID NO: 556089 - DNA, 25 bp, Rattus norvegicus
tagagaaccaggttttcagctgtga

SEQ ID NO: 556090 - DNA, 25 bp, Rattus norvegicus
tagagaaccccaagcgacttgcata

SEQ ID NO: 556091 - DNA, 25 bp, Rattus norvegicus
tagagaaccccaagctttttccata

SEQ ID NO: 556092 - DNA, 25 bp, Rattus norvegicus
tagagaaccccatgcgacttgcata

SEQ ID NO: 556093 - DNA, 25 bp, Rattus norvegicus
tagagaaccccatgctttttccata

SEQ ID NO: 556094 - DNA, 25 bp, Rattus norvegicus
tagagaaccccgagcggcctgagga

SEQ ID NO: 556095 - DNA, 25 bp, Rattus norvegicus
tagagaaccccgtgcggcctgagga

SEQ ID NO: 556096 - DNA, 25 bp, Rattus norvegicus
tagagaaccctcaacaacagattat

SEQ ID NO: 556097 - DNA, 25 bp, Rattus norvegicus
tagagaaccctctacaacagattat

SEQ ID NO: 556098 - DNA, 25 bp, Rattus norvegicus
tagagaacgctcagagtcactcatg

SEQ ID NO: 556099 - DNA, 25 bp, Rattus norvegicus
tagagaacgctctgagtcactcatg

SEQ ID NO: 556100 - DNA, 25 bp, Rattus norvegicus
tagagaacggctacgacgtctacct

SEQ ID NO: 556101 - DNA, 25 bp, Rattus norvegicus
tagagaacggcttcgacgtctacct

SEQ ID NO: 556102 - DNA, 25 bp, Rattus norvegicus
tagagaactgcacccatcctctgag

SEQ ID NO: 556103 - DNA, 25 bp, Rattus norvegicus
tagagaactgcagccatcctctgag

SEQ ID NO: 556104 - DNA, 25 bp, Rattus norvegicus
tagagaagacatcaccacagcctgg

SEQ ID NO: 556105 - DNA, 25 bp, Rattus norvegicus
tagagaagacatgaccacagcctgg

SEQ ID NO: 556106 - DNA, 25 bp, Rattus norvegicus
tagagaagaccgaggatcacctggg

SEQ ID NO: 556107 - DNA, 25 bp, Rattus norvegicus
tagagaagaccgtggatcacctggg

SEQ ID NO: 556108 - DNA, 25 bp, Rattus norvegicus
tagagaagagggagcctgtccacgt

SEQ ID NO: 556109 - DNA, 25 bp, Rattus norvegicus
tagagaagagggtgcctgtccacgt

SEQ ID NO: 556110 - DNA, 25 bp, Rattus norvegicus
tagagaagatccaccaggccatggg

SEQ ID NO: 556111 - DNA, 25 bp, Rattus norvegicus
tagagaagatcctccaggccatggg

SEQ ID NO: 556112 - DNA, 25 bp, Rattus norvegicus
tagagaagatctccgctcttcagta

SEQ ID NO: 556113 - DNA, 25 bp, Rattus norvegicus
tagagaagatctgcgctcttcagta

SEQ ID NO: 556114 - DNA, 25 bp, Rattus norvegicus
tagagaagcccaccactcagtgaaa

SEQ ID NO: 556115 - DNA, 25 bp, Rattus norvegicus
tagagaagcccagcactcagtgaaa

SEQ ID NO: 556116 - DNA, 25 bp, Rattus norvegicus
tagagaagcctgctcggaggtcccc

SEQ ID NO: 556117 - DNA, 25 bp, Rattus norvegicus
tagagaagcctggtcggaggtcccc

SEQ ID NO: 556118 - DNA, 25 bp, Rattus norvegicus
tagagaagctcaaccacaaccttta

SEQ ID NO: 556119 - DNA, 25 bp, Rattus norvegicus
tagagaagctcatccacaaccttta

SEQ ID NO: 556120 - DNA, 25 bp, Rattus norvegicus
tagagaagctctatgcacatatgca

SEQ ID NO: 556121 - DNA, 25 bp, Rattus norvegicus
tagagaagctctttgcacatatgca

SEQ ID NO: 556122 - DNA, 25 bp, Rattus norvegicus
tagagaaggataacgcggcccatat

SEQ ID NO: 556123 - DNA, 25 bp, Rattus norvegicus
tagagaaggatatcgcggcccatat

SEQ ID NO: 556124 - DNA, 25 bp, Rattus norvegicus
tagagaaggcttcccagtccatcta

SEQ ID NO: 556125 - DNA, 25 bp, Rattus norvegicus
tagagaaggcttgccagtccatcta

SEQ ID NO: 556126 - DNA, 25 bp, Rattus norvegicus
tagagaagggatcagagatgctact

SEQ ID NO: 556127 - DNA, 25 bp, Rattus norvegicus
tagagaagggatgagagatgctact

SEQ ID NO: 556128 - DNA, 25 bp, Rattus norvegicus
tagagaagtctgcaacccttcagaa

SEQ ID NO: 556129 - DNA, 25 bp, Rattus norvegicus
tagagaagtctggaacccttcagaa

SEQ ID NO: 556130 - DNA, 25 bp, Rattus norvegicus
tagagaatcggtacccaaaagttgt

SEQ ID NO: 556131 - DNA, 25 bp, Rattus norvegicus
tagagaatcggttcccaaaagttgt

SEQ ID NO: 556132 - DNA, 25 bp, Rattus norvegicus
tagagaatctgtcgccattgctcct

SEQ ID NO: 556133 - DNA, 25 bp, Rattus norvegicus
tagagaatctgtggccattgctcct

SEQ ID NO: 556134 - DNA, 25 bp, Rattus norvegicus
tagagaatgcatctctgccccattg

SEQ ID NO: 556135 - DNA, 25 bp, Rattus norvegicus
tagagaatgcatgtctgccccattg

SEQ ID NO: 556136 - DNA, 25 bp, Rattus norvegicus
tagagaatgcgcagcctattcccgt

SEQ ID NO: 556137 - DNA, 25 bp, Rattus norvegicus
tagagaatgcgctgcctattcccgt

SEQ ID NO: 556138 - DNA, 25 bp, Rattus norvegicus
tagagaatgggcctggtcattccct

SEQ ID NO: 556139 - DNA, 25 bp, Rattus norvegicus
tagagaatgggcgtggtcattccct

SEQ ID NO: 556140 - DNA, 25 bp, Rattus norvegicus
tagagaatgtccactgttgccagaa

SEQ ID NO: 556141 - DNA, 25 bp, Rattus norvegicus
tagagaatgtcctctgttgccagaa

SEQ ID NO: 556142 - DNA, 25 bp, Rattus norvegicus
tagagaattcgcaacctctcagagc

SEQ ID NO: 556143 - DNA, 25 bp, Rattus norvegicus
tagagaattcgctacctctcagagc

SEQ ID NO: 556144 - DNA, 25 bp, Rattus norvegicus
tagagaattctaccgattccagatg

SEQ ID NO: 556145 - DNA, 25 bp, Rattus norvegicus
tagagaattctagcgattccagatg

SEQ ID NO: 556146 - DNA, 25 bp, Rattus norvegicus
tagagaatttacaactttagacata

SEQ ID NO: 556147 - DNA, 25 bp, Rattus norvegicus
tagagaatttactactttagacata

SEQ ID NO: 556148 - DNA, 25 bp, Rattus norvegicus
tagagacacactcgctcttctctgg

SEQ ID NO: 556149 - DNA, 25 bp, Rattus norvegicus
tagagacacactggctcttctctgg

SEQ ID NO: 556150 - DNA, 25 bp, Rattus norvegicus
tagagacagaccatcccaagggaca

SEQ ID NO: 556151 - DNA, 25 bp, Rattus norvegicus
tagagacagaccttcccaagggaca

SEQ ID NO: 556152 - DNA, 25 bp, Rattus norvegicus
tagagacagcagctaccaactccat

SEQ ID NO: 556153 - DNA, 25 bp, Rattus norvegicus
tagagacagcaggtaccaactccat

SEQ ID NO: 556154 - DNA, 25 bp, Rattus norvegicus
tagagacataggagagttcaaggcc

SEQ ID NO: 556155 - DNA, 25 bp, Rattus norvegicus
tagagacataggtgagttcaaggcc

SEQ ID NO: 556156 - DNA, 25 bp, Rattus norvegicus
tagagacatcttagtgccgcacaat

SEQ ID NO: 556157 - DNA, 25 bp, Rattus norvegicus
tagagacatctttgtgccgcacaat

SEQ ID NO: 556158 - DNA, 25 bp, Rattus norvegicus
tagagacatgtcatcaggtgtataa

SEQ ID NO: 556159 - DNA, 25 bp, Rattus norvegicus
tagagacatgtcttcaggtgtataa

SEQ ID NO: 556160 - DNA, 25 bp, Rattus norvegicus
tagagacatgtgcttggcaccctgg

SEQ ID NO: 556161 - DNA, 25 bp, Rattus norvegicus
tagagacatgtggttggcaccctgg

SEQ ID NO: 556162 - DNA, 25 bp, Rattus norvegicus
tagagacattaaccccaacagccta

SEQ ID NO: 556163 - DNA, 25 bp, Rattus norvegicus
tagagacattaagcccaacagccta

SEQ ID NO: 556164 - DNA, 25 bp, Rattus norvegicus
tagagaccactgcagggccccagga

SEQ ID NO: 556165 - DNA, 25 bp, Rattus norvegicus
tagagaccactggagggccccagga

SEQ ID NO: 556166 - DNA, 25 bp, Rattus norvegicus
tagagaccaggcagcatgtgagcaa

SEQ ID NO: 556167 - DNA, 25 bp, Rattus norvegicus
tagagaccaggctgcatgtgagcaa

SEQ ID NO: 556168 - DNA, 25 bp, Rattus norvegicus
tagagaccattcagctcttgaactc

SEQ ID NO: 556169 - DNA, 25 bp, Rattus norvegicus
tagagaccattctgctcttgaactc

SEQ ID NO: 556170 - DNA, 25 bp, Rattus norvegicus
tagagacccagacctgcaggcgcag

SEQ ID NO: 556171 - DNA, 25 bp, Rattus norvegicus
tagagacccagagctgcaggcgcag

SEQ ID NO: 556172 - DNA, 25 bp, Rattus norvegicus
tagagaccctttaaaacaggtgaag

SEQ ID NO: 556173 - DNA, 25 bp, Rattus norvegicus
tagagacccttttaaacaggtgaag

SEQ ID NO: 556174 - DNA, 25 bp, Rattus norvegicus
tagagaccgaggaggctggcctcaa

SEQ ID NO: 556175 - DNA, 25 bp, Rattus norvegicus
tagagaccgaggtggctggcctcaa

SEQ ID NO: 556176 - DNA, 25 bp, Rattus norvegicus
tagagaccggttagcccgactcact

SEQ ID NO: 556177 - DNA, 25 bp, Rattus norvegicus
tagagaccggttatcacgtacgacg

SEQ ID NO: 556178 - DNA, 25 bp, Rattus norvegicus
tagagaccggtttgcccgactcact

SEQ ID NO: 556179 - DNA, 25 bp, Rattus norvegicus
tagagaccggttttcacgtacgacg

SEQ ID NO: 556180 - DNA, 25 bp, Rattus norvegicus
tagagacctaaacccatgtctgctc

SEQ ID NO: 556181 - DNA, 25 bp, Rattus norvegicus
tagagacctaaagccatgtctgctc

SEQ ID NO: 556182 - DNA, 25 bp, Rattus norvegicus
tagagacctaggctgttcttttccc

SEQ ID NO: 556183 - DNA, 25 bp, Rattus norvegicus
tagagacctagggtgttcttttccc

SEQ ID NO: 556184 - DNA, 25 bp, Rattus norvegicus
tagagacgatgtcgctttcctgagc

SEQ ID NO: 556185 - DNA, 25 bp, Rattus norvegicus
tagagacgatgtggctttcctgagc

SEQ ID NO: 556186 - DNA, 25 bp, Rattus norvegicus
tagagacgcagaaggcgcgcgtaac

SEQ ID NO: 556187 - DNA, 25 bp, Rattus norvegicus
tagagacgcagatggcgcgcgtaac

SEQ ID NO: 556188 - DNA, 25 bp, Rattus norvegicus
tagagacggacaaccgcggctcttg

SEQ ID NO: 556189 - DNA, 25 bp, Rattus norvegicus
tagagacggacatccgcggctcttg

SEQ ID NO: 556190 - DNA, 25 bp, Rattus norvegicus
tagagactaggactgctcagctgtc

SEQ ID NO: 556191 - DNA, 25 bp, Rattus norvegicus
tagagactaggagtgctcagctgtc

SEQ ID NO: 556192 - DNA, 25 bp, Rattus norvegicus
tagagactccgcctatgacagtgac

SEQ ID NO: 556193 - DNA, 25 bp, Rattus norvegicus
tagagactccgcgtatgacagtgac

SEQ ID NO: 556194 - DNA, 25 bp, Rattus norvegicus
tagagactcctaatttttcaccaat

SEQ ID NO: 556195 - DNA, 25 bp, Rattus norvegicus
tagagactcctattttttcaccaat

SEQ ID NO: 556196 - DNA, 25 bp, Rattus norvegicus
tagagactccttcctgtgtgtacag

SEQ ID NO: 556197 - DNA, 25 bp, Rattus norvegicus
tagagactccttgctgtgtgtacag

SEQ ID NO: 556198 - DNA, 25 bp, Rattus norvegicus
tagagactgagaccagcggccctga

SEQ ID NO: 556199 - DNA, 25 bp, Rattus norvegicus
tagagactgagagcagcggccctga

SEQ ID NO: 556200 - DNA, 25 bp, Rattus norvegicus
tagagactgctacttgaccgtgcca

SEQ ID NO: 556201 - DNA, 25 bp, Rattus norvegicus
tagagactgctagttgaccgtgcca

SEQ ID NO: 556202 - DNA, 25 bp, Rattus norvegicus
tagagactggcccttccgaggttca

SEQ ID NO: 556203 - DNA, 25 bp, Rattus norvegicus
tagagactggccgttccgaggttca

SEQ ID NO: 556204 - DNA, 25 bp, Rattus norvegicus
tagagactgtgaacctcctgagact

SEQ ID NO: 556205 - DNA, 25 bp, Rattus norvegicus
tagagactgtgatcctcctgagact

SEQ ID NO: 556206 - DNA, 25 bp, Rattus norvegicus
tagagactgtttaggcaggccacga

SEQ ID NO: 556207 - DNA, 25 bp, Rattus norvegicus
tagagactgttttggcaggccacga

SEQ ID NO: 556208 - DNA, 25 bp, Rattus norvegicus
tagagacttagacaccctttgtgga

SEQ ID NO: 556209 - DNA, 25 bp, Rattus norvegicus
tagagacttagagaccctttgtgga

SEQ ID NO: 556210 - DNA, 25 bp, Rattus norvegicus
tagagacttgctacaatcctgcaaa

SEQ ID NO: 556211 - DNA, 25 bp, Rattus norvegicus
tagagacttgcttcaatcctgcaaa

SEQ ID NO: 556212 - DNA, 25 bp, Rattus norvegicus
tagagacttgtgaaccagggatttt

SEQ ID NO: 556213 - DNA, 25 bp, Rattus norvegicus
tagagacttgtgagcgttccatcca

SEQ ID NO: 556214 - DNA, 25 bp, Rattus norvegicus
tagagacttgtgtaccagggatttt

SEQ ID NO: 556215 - DNA, 25 bp, Rattus norvegicus
tagagacttgtgtgcgttccatcca

SEQ ID NO: 556216 - DNA, 25 bp, Rattus norvegicus
tagagactttgcctgccatgcacaa

SEQ ID NO: 556217 - DNA, 25 bp, Rattus norvegicus
tagagactttgcgtgccatgcacaa

SEQ ID NO: 556218 - DNA, 25 bp, Rattus norvegicus
tagagagaacgaccagtccagtcct

SEQ ID NO: 556219 - DNA, 25 bp, Rattus norvegicus
tagagagaacgagcagtccagtcct

SEQ ID NO: 556220 - DNA, 25 bp, Rattus norvegicus
tagagagaactacccatgtgccttg

SEQ ID NO: 556221 - DNA, 25 bp, Rattus norvegicus
tagagagaactagccatgtgccttg

SEQ ID NO: 556222 - DNA, 25 bp, Rattus norvegicus
tagagagacactccctccagaaagc

SEQ ID NO: 556223 - DNA, 25 bp, Rattus norvegicus
tagagagacactgcctccagaaagc

SEQ ID NO: 556224 - DNA, 25 bp, Rattus norvegicus
tagagagacccaccaaggcaccaca

SEQ ID NO: 556225 - DNA, 25 bp, Rattus norvegicus
tagagagacccacctactgactgat

SEQ ID NO: 556226 - DNA, 25 bp, Rattus norvegicus
tagagagacccagcaaggcaccaca

SEQ ID NO: 556227 - DNA, 25 bp, Rattus norvegicus
tagagagacccagctactgactgat

SEQ ID NO: 556228 - DNA, 25 bp, Rattus norvegicus
tagagagacctgactctgaggccag

SEQ ID NO: 556229 - DNA, 25 bp, Rattus norvegicus
tagagagacctgtctctgaggccag

SEQ ID NO: 556230 - DNA, 25 bp, Rattus norvegicus
tagagagagccacgcagcagcccag

SEQ ID NO: 556231 - DNA, 25 bp, Rattus norvegicus
tagagagagccaggcagcagcccag

SEQ ID NO: 556232 - DNA, 25 bp, Rattus norvegicus
tagagagagcccagtatctccattt

SEQ ID NO: 556233 - DNA, 25 bp, Rattus norvegicus
tagagagagccctgtatctccattt

SEQ ID NO: 556234 - DNA, 25 bp, Rattus norvegicus
tagagagagtagatggccccaagca

SEQ ID NO: 556235 - DNA, 25 bp, Rattus norvegicus
tagagagagtagttggccccaagca

SEQ ID NO: 556236 - DNA, 25 bp, Rattus norvegicus
tagagagatcccacacgcgaagctt

SEQ ID NO: 556237 - DNA, 25 bp, Rattus norvegicus
tagagagatccctcacgcgaagctt

SEQ ID NO: 556238 - DNA, 25 bp, Rattus norvegicus
tagagagcaagaccctgaaccaccg

SEQ ID NO: 556239 - DNA, 25 bp, Rattus norvegicus
tagagagcaagagcctgaaccaccg

SEQ ID NO: 556240 - DNA, 25 bp, Rattus norvegicus
tagagagcacttcagcccaacacgt

SEQ ID NO: 556241 - DNA, 25 bp, Rattus norvegicus
tagagagcacttgagcccaacacgt

SEQ ID NO: 556242 - DNA, 25 bp, Rattus norvegicus
tagagagcccagctcagtggtgcac

SEQ ID NO: 556243 - DNA, 25 bp, Rattus norvegicus
tagagagcccaggtcagtggtgcac

SEQ ID NO: 556244 - DNA, 25 bp, Rattus norvegicus
tagagagccccaactagccttaaat

SEQ ID NO: 556245 - DNA, 25 bp, Rattus norvegicus
tagagagccccacggacccaagtgt

SEQ ID NO: 556246 - DNA, 25 bp, Rattus norvegicus
tagagagccccagggacccaagtgt

SEQ ID NO: 556247 - DNA, 25 bp, Rattus norvegicus
tagagagccccatctagccttaaat

SEQ ID NO: 556248 - DNA, 25 bp, Rattus norvegicus
tagagagccgtgagaaacctgagaa

SEQ ID NO: 556249 - DNA, 25 bp, Rattus norvegicus
tagagagccgtgtgaaacctgagaa

SEQ ID NO: 556250 - DNA, 25 bp, Rattus norvegicus
tagagagcctttcaccgtcaaggta

SEQ ID NO: 556251 - DNA, 25 bp, Rattus norvegicus
tagagagcctttgaccgtcaaggta

SEQ ID NO: 556252 - DNA, 25 bp, Rattus norvegicus
tagagagcgggacgtctccctaaga

SEQ ID NO: 556253 - DNA, 25 bp, Rattus norvegicus
tagagagcgggaggtctccctaaga

SEQ ID NO: 556254 - DNA, 25 bp, Rattus norvegicus
tagagagctctcaccatcttttatc

SEQ ID NO: 556255 - DNA, 25 bp, Rattus norvegicus
tagagagctctctccatcttttatc

SEQ ID NO: 556256 - DNA, 25 bp, Rattus norvegicus
tagagagctgcgagggcctagccaa

SEQ ID NO: 556257 - DNA, 25 bp, Rattus norvegicus
tagagagctgcgtgggcctagccaa

SEQ ID NO: 556258 - DNA, 25 bp, Rattus norvegicus
tagagaggaccccttgtgctccgtg

SEQ ID NO: 556259 - DNA, 25 bp, Rattus norvegicus
tagagaggacccgttgtgctccgtg

SEQ ID NO: 556260 - DNA, 25 bp, Rattus norvegicus
tagagaggatctacgggcttcctgg

SEQ ID NO: 556261 - DNA, 25 bp, Rattus norvegicus
tagagaggatcttcgggcttcctgg

SEQ ID NO: 556262 - DNA, 25 bp, Rattus norvegicus
tagagaggcaaccatcccggtcaac

SEQ ID NO: 556263 - DNA, 25 bp, Rattus norvegicus
tagagaggcaacgatcccggtcaac

SEQ ID NO: 556264 - DNA, 25 bp, Rattus norvegicus
tagagaggcgctaacaactccaaga

SEQ ID NO: 556265 - DNA, 25 bp, Rattus norvegicus
tagagaggcgcttacaactccaaga

SEQ ID NO: 556266 - DNA, 25 bp, Rattus norvegicus
tagagaggcgtcagtcccaggctga

SEQ ID NO: 556267 - DNA, 25 bp, Rattus norvegicus
tagagaggcgtctgtcccaggctga

SEQ ID NO: 556268 - DNA, 25 bp, Rattus norvegicus
tagagagggagaccctgtccatcct

SEQ ID NO: 556269 - DNA, 25 bp, Rattus norvegicus
tagagagggagagcctgtccatcct

SEQ ID NO: 556270 - DNA, 25 bp, Rattus norvegicus
tagagaggtttcctcaggtcagcgt

SEQ ID NO: 556271 - DNA, 25 bp, Rattus norvegicus
tagagaggtttcgtcaggtcagcgt

SEQ ID NO: 556272 - DNA, 25 bp, Rattus norvegicus
tagagagtaaccacacactgacagt

SEQ ID NO: 556273 - DNA, 25 bp, Rattus norvegicus
tagagagtaacctcacactgacagt

SEQ ID NO: 556274 - DNA, 25 bp, Rattus norvegicus
tagagagtactcacggcgaccccgg

SEQ ID NO: 556275 - DNA, 25 bp, Rattus norvegicus
tagagagtactctcggcgaccccgg

SEQ ID NO: 556276 - DNA, 25 bp, Rattus norvegicus
tagagagtagcccacacagaccgaa

SEQ ID NO: 556277 - DNA, 25 bp, Rattus norvegicus
tagagagtagccgacacagaccgaa

SEQ ID NO: 556278 - DNA, 25 bp, Rattus norvegicus
tagagagtccatccctttagaggtc

SEQ ID NO: 556279 - DNA, 25 bp, Rattus norvegicus
tagagagtccatgcctttagaggtc

SEQ ID NO: 556280 - DNA, 25 bp, Rattus norvegicus
tagagagtcccacaccagtcaggat

SEQ ID NO: 556281 - DNA, 25 bp, Rattus norvegicus
tagagagtcccagaccagtcaggat

SEQ ID NO: 556282 - DNA, 25 bp, Rattus norvegicus
tagagagtcgtgatgctttgttgct

SEQ ID NO: 556283 - DNA, 25 bp, Rattus norvegicus
tagagagtcgtgttgctttgttgct

SEQ ID NO: 556284 - DNA, 25 bp, Rattus norvegicus
tagagagtctctcactgatctggcc

SEQ ID NO: 556285 - DNA, 25 bp, Rattus norvegicus
tagagagtctctgactgatctggcc

SEQ ID NO: 556286 - DNA, 25 bp, Rattus norvegicus
tagagagtgctccagaccctcagtt

SEQ ID NO: 556287 - DNA, 25 bp, Rattus norvegicus
tagagagtgctcgagaccctcagtt

SEQ ID NO: 556288 - DNA, 25 bp, Rattus norvegicus
tagagagtggatcccacaccgggtt

SEQ ID NO: 556289 - DNA, 25 bp, Rattus norvegicus
tagagagtggatgccacaccgggtt

SEQ ID NO: 556290 - DNA, 25 bp, Rattus norvegicus
tagagagtttggaaggatactaacc

SEQ ID NO: 556291 - DNA, 25 bp, Rattus norvegicus
tagagagtttggtaggatactaacc

SEQ ID NO: 556292 - DNA, 25 bp, Rattus norvegicus
tagagatatatgctcccactcgcag

SEQ ID NO: 556293 - DNA, 25 bp, Rattus norvegicus
tagagatatatggtcccactcgcag

SEQ ID NO: 556294 - DNA, 25 bp, Rattus norvegicus
tagagatcccggctgtcaggaagct

SEQ ID NO: 556295 - DNA, 25 bp, Rattus norvegicus
tagagatcccgggtgtcaggaagct

SEQ ID NO: 556296 - DNA, 25 bp, Rattus norvegicus
tagagatccgcaccaaggactccta

SEQ ID NO: 556297 - DNA, 25 bp, Rattus norvegicus
tagagatccgcagcaaggactccta

SEQ ID NO: 556298 - DNA, 25 bp, Rattus norvegicus
tagagatcctctataatgctagaat

SEQ ID NO: 556299 - DNA, 25 bp, Rattus norvegicus
tagagatcctctttaatgctagaat

SEQ ID NO: 556300 - DNA, 25 bp, Rattus norvegicus
tagagatctaatcctctgatcagat

SEQ ID NO: 556301 - DNA, 25 bp, Rattus norvegicus
tagagatctaatgctctgatcagat

SEQ ID NO: 556302 - DNA, 25 bp, Rattus norvegicus
tagagatctaccagtgcttgactct

SEQ ID NO: 556303 - DNA, 25 bp, Rattus norvegicus
tagagatctacctgtgcttgactct

SEQ ID NO: 556304 - DNA, 25 bp, Rattus norvegicus
tagagatctcacaagaacccttcct

SEQ ID NO: 556305 - DNA, 25 bp, Rattus norvegicus
tagagatctcactagaacccttcct

SEQ ID NO: 556306 - DNA, 25 bp, Rattus norvegicus
tagagatctgttacttaaagctaca

SEQ ID NO: 556307 - DNA, 25 bp, Rattus norvegicus
tagagatctgtttcttaaagctaca

SEQ ID NO: 556308 - DNA, 25 bp, Rattus norvegicus
tagagatgagcaccgacacccagca

SEQ ID NO: 556309 - DNA, 25 bp, Rattus norvegicus
tagagatgagcagcgacacccagca

SEQ ID NO: 556310 - DNA, 25 bp, Rattus norvegicus
tagagatgctcaaggtggctgtgaa

SEQ ID NO: 556311 - DNA, 25 bp, Rattus norvegicus
tagagatgctcatggtggctgtgaa

SEQ ID NO: 556312 - DNA, 25 bp, Rattus norvegicus
tagagatgctttactctgcaaccct

SEQ ID NO: 556313 - DNA, 25 bp, Rattus norvegicus
tagagatgcttttctctgcaaccct

SEQ ID NO: 556314 - DNA, 25 bp, Rattus norvegicus
tagagatggagacgtccctttgcct

SEQ ID NO: 556315 - DNA, 25 bp, Rattus norvegicus
tagagatggagaggtccctttgcct

SEQ ID NO: 556316 - DNA, 25 bp, Rattus norvegicus
tagagatgggcgactcccatgttca

SEQ ID NO: 556317 - DNA, 25 bp, Rattus norvegicus
tagagatgggcgtctcccatgttca

SEQ ID NO: 556318 - DNA, 25 bp, Rattus norvegicus
tagagatggtgcacatcggctgcca

SEQ ID NO: 556319 - DNA, 25 bp, Rattus norvegicus
tagagatggtgctcatcggctgcca

SEQ ID NO: 556320 - DNA, 25 bp, Rattus norvegicus
tagagatgtcagacccacacagatg

SEQ ID NO: 556321 - DNA, 25 bp, Rattus norvegicus
tagagatgtcagtcccacacagatg

SEQ ID NO: 556322 - DNA, 25 bp, Rattus norvegicus
tagagattcttcaacttttaccttt

SEQ ID NO: 556323 - DNA, 25 bp, Rattus norvegicus
tagagattcttctacttttaccttt

SEQ ID NO: 556324 - DNA, 25 bp, Rattus norvegicus
tagagatttccaaatacattaccaa

SEQ ID NO: 556325 - DNA, 25 bp, Rattus norvegicus
tagagatttccaccccaaacttagg

SEQ ID NO: 556326 - DNA, 25 bp, Rattus norvegicus
tagagatttccagcccaaacttagg

SEQ ID NO: 556327 - DNA, 25 bp, Rattus norvegicus
tagagatttccatatacattaccaa

SEQ ID NO: 556328 - DNA, 25 bp, Rattus norvegicus
tagagattttgtctacccttcctca

SEQ ID NO: 556329 - DNA, 25 bp, Rattus norvegicus
tagagattttgtgtacccttcctca

SEQ ID NO: 556330 - DNA, 25 bp, Rattus norvegicus
tagagcaaaaccaggcaccttgggc

SEQ ID NO: 556331 - DNA, 25 bp, Rattus norvegicus
tagagcaaaacctggcaccttgggc

SEQ ID NO: 556332 - DNA, 25 bp, Rattus norvegicus
tagagcaaacttccaggtgctgcat

SEQ ID NO: 556333 - DNA, 25 bp, Rattus norvegicus
tagagcaaacttgcaggtgctgcat

SEQ ID NO: 556334 - DNA, 25 bp, Rattus norvegicus
tagagcaaagcacagttggccccac

SEQ ID NO: 556335 - DNA, 25 bp, Rattus norvegicus
tagagcaaagcagagttggccccac

SEQ ID NO: 556336 - DNA, 25 bp, Rattus norvegicus
tagagcaaagtcatccacacccagt

SEQ ID NO: 556337 - DNA, 25 bp, Rattus norvegicus
tagagcaaagtcttccacacccagt

SEQ ID NO: 556338 - DNA, 25 bp, Rattus norvegicus
tagagcaaatgcaagccctaaccac

SEQ ID NO: 556339 - DNA, 25 bp, Rattus norvegicus
tagagcaaatgctagccctaaccac

SEQ ID NO: 556340 - DNA, 25 bp, Rattus norvegicus
tagagcaagactccttcacactgat

SEQ ID NO: 556341 - DNA, 25 bp, Rattus norvegicus
tagagcaagactgcttcacactgat

SEQ ID NO: 556342 - DNA, 25 bp, Rattus norvegicus
tagagcaatgcaccctttcttttag

SEQ ID NO: 556343 - DNA, 25 bp, Rattus norvegicus
tagagcaatgcagcctttcttttag

SEQ ID NO: 556344 - DNA, 25 bp, Rattus norvegicus
tagagcaatttccttgcctgggatc

SEQ ID NO: 556345 - DNA, 25 bp, Rattus norvegicus
tagagcaatttcgttgcctgggatc

SEQ ID NO: 556346 - DNA, 25 bp, Rattus norvegicus
tagagcacacagctctagcaccgtc

SEQ ID NO: 556347 - DNA, 25 bp, Rattus norvegicus
tagagcacacaggtctagcaccgtc

SEQ ID NO: 556348 - DNA, 25 bp, Rattus norvegicus
tagagcacatcccattcctagaata

SEQ ID NO: 556349 - DNA, 25 bp, Rattus norvegicus
tagagcacatccgattcctagaata

SEQ ID NO: 556350 - DNA, 25 bp, Rattus norvegicus
tagagcactatcagttcctatcatg

SEQ ID NO: 556351 - DNA, 25 bp, Rattus norvegicus
tagagcactatctgttcctatcatg

SEQ ID NO: 556352 - DNA, 25 bp, Rattus norvegicus
tagagcactcataccttaaaaggcc

SEQ ID NO: 556353 - DNA, 25 bp, Rattus norvegicus
tagagcactcattccttaaaaggcc

SEQ ID NO: 556354 - DNA, 25 bp, Rattus norvegicus
tagagcactgctcccaaagtggctt

SEQ ID NO: 556355 - DNA, 25 bp, Rattus norvegicus
tagagcactgctgccaaagtggctt

SEQ ID NO: 556356 - DNA, 25 bp, Rattus norvegicus
tagagcactgtgaccaactggcagg

SEQ ID NO: 556357 - DNA, 25 bp, Rattus norvegicus
tagagcactgtgtccaactggcagg

SEQ ID NO: 556358 - DNA, 25 bp, Rattus norvegicus
tagagcacttgccactggttttagt

SEQ ID NO: 556359 - DNA, 25 bp, Rattus norvegicus
tagagcacttgcgactggttttagt

SEQ ID NO: 556360 - DNA, 25 bp, Rattus norvegicus
tagagcagaacccaaggaccacctt

SEQ ID NO: 556361 - DNA, 25 bp, Rattus norvegicus
tagagcagaaccgaaggaccacctt

SEQ ID NO: 556362 - DNA, 25 bp, Rattus norvegicus
tagagcagaagccacaaggtcccca

SEQ ID NO: 556363 - DNA, 25 bp, Rattus norvegicus
tagagcagaagcgacaaggtcccca

SEQ ID NO: 556364 - DNA, 25 bp, Rattus norvegicus
tagagcagaatgaccctgccagtgg

SEQ ID NO: 556365 - DNA, 25 bp, Rattus norvegicus
tagagcagaatgtccctgccagtgg

SEQ ID NO: 556366 - DNA, 25 bp, Rattus norvegicus
tagagcagaggaacaccttcccaaa

SEQ ID NO: 556367 - DNA, 25 bp, Rattus norvegicus
tagagcagaggatcaccttcccaaa

SEQ ID NO: 556368 - DNA, 25 bp, Rattus norvegicus
tagagcagaggcattcttacaccca

SEQ ID NO: 556369 - DNA, 25 bp, Rattus norvegicus
tagagcagaggctttcttacaccca

SEQ ID NO: 556370 - DNA, 25 bp, Rattus norvegicus
tagagcagcccaacctgcttaaaga

SEQ ID NO: 556371 - DNA, 25 bp, Rattus norvegicus
tagagcagcccatcctgcttaaaga

SEQ ID NO: 556372 - DNA, 25 bp, Rattus norvegicus
tagagcagcctaactgggtcctcag

SEQ ID NO: 556373 - DNA, 25 bp, Rattus norvegicus
tagagcagcctatctgggtcctcag

SEQ ID NO: 556374 - DNA, 25 bp, Rattus norvegicus
tagagcagcctgaggtaaacttcca

SEQ ID NO: 556375 - DNA, 25 bp, Rattus norvegicus
tagagcagcctgtggtaaacttcca

SEQ ID NO: 556376 - DNA, 25 bp, Rattus norvegicus
tagagcaggagaatccctctctttg

SEQ ID NO: 556377 - DNA, 25 bp, Rattus norvegicus
tagagcaggagattccctctctttg

SEQ ID NO: 556378 - DNA, 25 bp, Rattus norvegicus
tagagcagggctaaagttacacata

SEQ ID NO: 556379 - DNA, 25 bp, Rattus norvegicus
tagagcagggcttaagttacacata

SEQ ID NO: 556380 - DNA, 25 bp, Rattus norvegicus
tagagcagtagaaaacctgagacag

SEQ ID NO: 556381 - DNA, 25 bp, Rattus norvegicus
tagagcagtagataacctgagacag

SEQ ID NO: 556382 - DNA, 25 bp, Rattus norvegicus
tagagcagtcacactgcggagccac

SEQ ID NO: 556383 - DNA, 25 bp, Rattus norvegicus
tagagcagtcacatagggagccagg

SEQ ID NO: 556384 - DNA, 25 bp, Rattus norvegicus
tagagcagtcactctgcggagccac

SEQ ID NO: 556385 - DNA, 25 bp, Rattus norvegicus
tagagcagtcacttagggagccagg

SEQ ID NO: 556386 - DNA, 25 bp, Rattus norvegicus
tagagcagtgagagcttctcaacct

SEQ ID NO: 556387 - DNA, 25 bp, Rattus norvegicus
tagagcagtgagtgcttctcaacct

SEQ ID NO: 556388 - DNA, 25 bp, Rattus norvegicus
tagagcagtgcacgaatccgcccat

SEQ ID NO: 556389 - DNA, 25 bp, Rattus norvegicus
tagagcagtgcaggaatccgcccat

SEQ ID NO: 556390 - DNA, 25 bp, Rattus norvegicus
tagagcagtggtattcaacttttgc

SEQ ID NO: 556391 - DNA, 25 bp, Rattus norvegicus
tagagcagtggttttcaacttttgc

SEQ ID NO: 556392 - DNA, 25 bp, Rattus norvegicus
tagagcagttggctgcacaggcctc

SEQ ID NO: 556393 - DNA, 25 bp, Rattus norvegicus
tagagcagttgggtgcacaggcctc

SEQ ID NO: 556394 - DNA, 25 bp, Rattus norvegicus
tagagcatccttatgtttctgtggc

SEQ ID NO: 556395 - DNA, 25 bp, Rattus norvegicus
tagagcatccttttgtttctgtggc

SEQ ID NO: 556396 - DNA, 25 bp, Rattus norvegicus
tagagcatctatcctgtttctcacc

SEQ ID NO: 556397 - DNA, 25 bp, Rattus norvegicus
tagagcatctatgctgtttctcacc

SEQ ID NO: 556398 - DNA, 25 bp, Rattus norvegicus
tagagcatgagacaccttagttagg

SEQ ID NO: 556399 - DNA, 25 bp, Rattus norvegicus
tagagcatgagagaccttagttagg

SEQ ID NO: 556400 - DNA, 25 bp, Rattus norvegicus
tagagcatgcagcaccttcgcagtt

SEQ ID NO: 556401 - DNA, 25 bp, Rattus norvegicus
tagagcatgcaggaccttcgcagtt

SEQ ID NO: 556402 - DNA, 25 bp, Rattus norvegicus
tagagcatgctcagcgagggactga

SEQ ID NO: 556403 - DNA, 25 bp, Rattus norvegicus
tagagcatgctctgcgagggactga

SEQ ID NO: 556404 - DNA, 25 bp, Rattus norvegicus
tagagcattcaaagcctggctgtct

SEQ ID NO: 556405 - DNA, 25 bp, Rattus norvegicus
tagagcattcaatgcctggctgtct

SEQ ID NO: 556406 - DNA, 25 bp, Rattus norvegicus
tagagcattctaaaccaggtatttc

SEQ ID NO: 556407 - DNA, 25 bp, Rattus norvegicus
tagagcattctataccaggtatttc

SEQ ID NO: 556408 - DNA, 25 bp, Rattus norvegicus
tagagccaatgcaactttttgaggg

SEQ ID NO: 556409 - DNA, 25 bp, Rattus norvegicus
tagagccaatgctactttttgaggg

SEQ ID NO: 556410 - DNA, 25 bp, Rattus norvegicus
tagagccacacgacaccagttgtga

SEQ ID NO: 556411 - DNA, 25 bp, Rattus norvegicus
tagagccacacgtcaccagttgtga

SEQ ID NO: 556412 - DNA, 25 bp, Rattus norvegicus
tagagccactgaacgtgctgagatt

SEQ ID NO: 556413 - DNA, 25 bp, Rattus norvegicus
tagagccactgatcgtgctgagatt

SEQ ID NO: 556414 - DNA, 25 bp, Rattus norvegicus
tagagccactggaagcctggagcat

SEQ ID NO: 556415 - DNA, 25 bp, Rattus norvegicus
tagagccactggtagcctggagcat

SEQ ID NO: 556416 - DNA, 25 bp, Rattus norvegicus
tagagccagtccctacctactagtc

SEQ ID NO: 556417 - DNA, 25 bp, Rattus norvegicus
tagagccagtccgtacctactagtc

SEQ ID NO: 556418 - DNA, 25 bp, Rattus norvegicus
tagagccatatgcatccgctggtta

SEQ ID NO: 556419 - DNA, 25 bp, Rattus norvegicus
tagagccatatggatccgctggtta

SEQ ID NO: 556420 - DNA, 25 bp, Rattus norvegicus
tagagccatcgtctggacatgccgg

SEQ ID NO: 556421 - DNA, 25 bp, Rattus norvegicus
tagagccatcgtgtggacatgccgg

SEQ ID NO: 556422 - DNA, 25 bp, Rattus norvegicus
tagagccatctccaggtgtaaccat

SEQ ID NO: 556423 - DNA, 25 bp, Rattus norvegicus
tagagccatctcgaggtgtaaccat

SEQ ID NO: 556424 - DNA, 25 bp, Rattus norvegicus
tagagcccaaggaccactgcagatg

SEQ ID NO: 556425 - DNA, 25 bp, Rattus norvegicus
tagagcccaaggtccactgcagatg

SEQ ID NO: 556426 - DNA, 25 bp, Rattus norvegicus
tagagcccacctctgcagagacaaa

SEQ ID NO: 556427 - DNA, 25 bp, Rattus norvegicus
tagagcccacctgtgcagagacaaa

SEQ ID NO: 556428 - DNA, 25 bp, Rattus norvegicus
tagagcccaggcaacttggctgcaa

SEQ ID NO: 556429 - DNA, 25 bp, Rattus norvegicus
tagagcccaggccagagcagactga

SEQ ID NO: 556430 - DNA, 25 bp, Rattus norvegicus
tagagcccaggcgagagcagactga

SEQ ID NO: 556431 - DNA, 25 bp, Rattus norvegicus
tagagcccaggctacttggctgcaa

SEQ ID NO: 556432 - DNA, 25 bp, Rattus norvegicus
tagagcccagggaccgtgtatgtgt

SEQ ID NO: 556433 - DNA, 25 bp, Rattus norvegicus
tagagcccagggtccgtgtatgtgt

SEQ ID NO: 556434 - DNA, 25 bp, Rattus norvegicus
tagagcccagtcataatgtagaaac

SEQ ID NO: 556435 - DNA, 25 bp, Rattus norvegicus
tagagcccagtcttaatgtagaaac

SEQ ID NO: 556436 - DNA, 25 bp, Rattus norvegicus
tagagcccatgaccatcaggatcgg

SEQ ID NO: 556437 - DNA, 25 bp, Rattus norvegicus
tagagcccatgagcatcaggatcgg

SEQ ID NO: 556438 - DNA, 25 bp, Rattus norvegicus
tagagcccctgccacatgtgaatgt

SEQ ID NO: 556439 - DNA, 25 bp, Rattus norvegicus
tagagcccctgcgacatgtgaatgt

SEQ ID NO: 556440 - DNA, 25 bp, Rattus norvegicus
tagagcccctggaaccatgtggatg

SEQ ID NO: 556441 - DNA, 25 bp, Rattus norvegicus
tagagcccctggagcccattgtgtc

SEQ ID NO: 556442 - DNA, 25 bp, Rattus norvegicus
tagagcccctggtaccatgtggatg

SEQ ID NO: 556443 - DNA, 25 bp, Rattus norvegicus
tagagcccctggtgcccattgtgtc

SEQ ID NO: 556444 - DNA, 25 bp, Rattus norvegicus
tagagcccgaccagcagcagcaacg

SEQ ID NO: 556445 - DNA, 25 bp, Rattus norvegicus
tagagcccgacctgcagcagcaacg

SEQ ID NO: 556446 - DNA, 25 bp, Rattus norvegicus
tagagcccgcacaaatctgatccag

SEQ ID NO: 556447 - DNA, 25 bp, Rattus norvegicus
tagagcccgcactaatctgatccag

SEQ ID NO: 556448 - DNA, 25 bp, Rattus norvegicus
tagagcccgcctacaggcaagaagt

SEQ ID NO: 556449 - DNA, 25 bp, Rattus norvegicus
tagagcccgccttcaggcaagaagt

SEQ ID NO: 556450 - DNA, 25 bp, Rattus norvegicus
tagagccctcagaagtgcccttggg

SEQ ID NO: 556451 - DNA, 25 bp, Rattus norvegicus
tagagccctcagtagtgcccttggg

SEQ ID NO: 556452 - DNA, 25 bp, Rattus norvegicus
tagagccctctaacgcagtactgta

SEQ ID NO: 556453 - DNA, 25 bp, Rattus norvegicus
tagagccctctatcgcagtactgta

SEQ ID NO: 556454 - DNA, 25 bp, Rattus norvegicus
tagagccctggtactcgtgtattgg

SEQ ID NO: 556455 - DNA, 25 bp, Rattus norvegicus
tagagccctggttctcgtgtattgg

SEQ ID NO: 556456 - DNA, 25 bp, Rattus norvegicus
tagagccctttgacgtggtggcgca

SEQ ID NO: 556457 - DNA, 25 bp, Rattus norvegicus
tagagccctttgtcgtggtggcgca

SEQ ID NO: 556458 - DNA, 25 bp, Rattus norvegicus
tagagcctaccactgaggagctgtg

SEQ ID NO: 556459 - DNA, 25 bp, Rattus norvegicus
tagagcctaccagtgaggagctgtg

SEQ ID NO: 556460 - DNA, 25 bp, Rattus norvegicus
tagagcctagaacaacgtaccagat

SEQ ID NO: 556461 - DNA, 25 bp, Rattus norvegicus
tagagcctagaaccttctaccaggt

SEQ ID NO: 556462 - DNA, 25 bp, Rattus norvegicus
tagagcctagaagaacgtaccagat

SEQ ID NO: 556463 - DNA, 25 bp, Rattus norvegicus
tagagcctagaagcttctaccaggt

SEQ ID NO: 556464 - DNA, 25 bp, Rattus norvegicus
tagagcctagctcagcacagtgctg

SEQ ID NO: 556465 - DNA, 25 bp, Rattus norvegicus
tagagcctagctgagcacagtgctg

SEQ ID NO: 556466 - DNA, 25 bp, Rattus norvegicus
tagagcctcataactgtcccaacag

SEQ ID NO: 556467 - DNA, 25 bp, Rattus norvegicus
tagagcctcatatctgtcccaacag

SEQ ID NO: 556468 - DNA, 25 bp, Rattus norvegicus
tagagcctccttagtgctcagcgtg

SEQ ID NO: 556469 - DNA, 25 bp, Rattus norvegicus
tagagcctcctttgtgctcagcgtg

SEQ ID NO: 556470 - DNA, 25 bp, Rattus norvegicus
tagagcctgagtctacctagaatag

SEQ ID NO: 556471 - DNA, 25 bp, Rattus norvegicus
tagagcctgagtgtacctagaatag

SEQ ID NO: 556472 - DNA, 25 bp, Rattus norvegicus
tagagcctgctcatgctggttcaga

SEQ ID NO: 556473 - DNA, 25 bp, Rattus norvegicus
tagagcctgctcttgctggttcaga

SEQ ID NO: 556474 - DNA, 25 bp, Rattus norvegicus
tagagcctgctgctaactggagcat

SEQ ID NO: 556475 - DNA, 25 bp, Rattus norvegicus
tagagcctgctggtaactggagcat

SEQ ID NO: 556476 - DNA, 25 bp, Rattus norvegicus
tagagccttatgaacgagaccacgc

SEQ ID NO: 556477 - DNA, 25 bp, Rattus norvegicus
tagagccttatgtacgagaccacgc

SEQ ID NO: 556478 - DNA, 25 bp, Rattus norvegicus
tagagccttctgatgcgtttatggg

SEQ ID NO: 556479 - DNA, 25 bp, Rattus norvegicus
tagagccttctgttgcgtttatggg

SEQ ID NO: 556480 - DNA, 25 bp, Rattus norvegicus
tagagccttttgatggagtcctctc

SEQ ID NO: 556481 - DNA, 25 bp, Rattus norvegicus
tagagccttttgttggagtcctctc

SEQ ID NO: 556482 - DNA, 25 bp, Rattus norvegicus
tagagcgccgcaagcaccagaatga

SEQ ID NO: 556483 - DNA, 25 bp, Rattus norvegicus
tagagcgccgcatgcaccagaatga

SEQ ID NO: 556484 - DNA, 25 bp, Rattus norvegicus
tagagcgccgtgaggtaaaccagct

SEQ ID NO: 556485 - DNA, 25 bp, Rattus norvegicus
tagagcgccgtgtggtaaaccagct

SEQ ID NO: 556486 - DNA, 25 bp, Rattus norvegicus
tagagcgccttccttgtctttacca

SEQ ID NO: 556487 - DNA, 25 bp, Rattus norvegicus
tagagcgccttcgttgtctttacca

SEQ ID NO: 556488 - DNA, 25 bp, Rattus norvegicus
tagagcgcgagcacgtactgcagcg

SEQ ID NO: 556489 - DNA, 25 bp, Rattus norvegicus
tagagcgcgagctcgtactgcagcg

SEQ ID NO: 556490 - DNA, 25 bp, Rattus norvegicus
tagagcgctcgcaccggcagaggat

SEQ ID NO: 556491 - DNA, 25 bp, Rattus norvegicus
tagagcgctcgctccggcagaggat

SEQ ID NO: 556492 - DNA, 25 bp, Rattus norvegicus
tagagcgctgcccttaccctaaggt

SEQ ID NO: 556493 - DNA, 25 bp, Rattus norvegicus
tagagcgctgccgttaccctaaggt

SEQ ID NO: 556494 - DNA, 25 bp, Rattus norvegicus
tagagcggacgccaggctttctttc

SEQ ID NO: 556495 - DNA, 25 bp, Rattus norvegicus
tagagcggacgcgaggctttctttc

SEQ ID NO: 556496 - DNA, 25 bp, Rattus norvegicus
tagagcggccagcactagctgacta

SEQ ID NO: 556497 - DNA, 25 bp, Rattus norvegicus
tagagcggccaggactagctgacta

SEQ ID NO: 556498 - DNA, 25 bp, Rattus norvegicus
tagagcggctttatatttagtttgt

SEQ ID NO: 556499 - DNA, 25 bp, Rattus norvegicus
tagagcggctttttatttagtttgt

SEQ ID NO: 556500 - DNA, 25 bp, Rattus norvegicus
tagagcgtctcccttctggttaact

SEQ ID NO: 556501 - DNA, 25 bp, Rattus norvegicus
tagagcgtctccgttctggttaact

SEQ ID NO: 556502 - DNA, 25 bp, Rattus norvegicus
tagagcgtgctaatcccagtttgag

SEQ ID NO: 556503 - DNA, 25 bp, Rattus norvegicus
tagagcgtgctattcccagtttgag

SEQ ID NO: 556504 - DNA, 25 bp, Rattus norvegicus
tagagcgttatcacagtgctccatt

SEQ ID NO: 556505 - DNA, 25 bp, Rattus norvegicus
tagagcgttatctcagtgctccatt

SEQ ID NO: 556506 - DNA, 25 bp, Rattus norvegicus
tagagctagtagaccactcaccagg

SEQ ID NO: 556507 - DNA, 25 bp, Rattus norvegicus
tagagctagtagtccactcaccagg

SEQ ID NO: 556508 - DNA, 25 bp, Rattus norvegicus
tagagctatgctatgccccgacgaa

SEQ ID NO: 556509 - DNA, 25 bp, Rattus norvegicus
tagagctatgctttgccccgacgaa

SEQ ID NO: 556510 - DNA, 25 bp, Rattus norvegicus
tagagctatgggaggtccttccttc

SEQ ID NO: 556511 - DNA, 25 bp, Rattus norvegicus
tagagctatgggtggtccttccttc

SEQ ID NO: 556512 - DNA, 25 bp, Rattus norvegicus
tagagctattagacctcttcactgc

SEQ ID NO: 556513 - DNA, 25 bp, Rattus norvegicus
tagagctattagtcctcttcactgc

SEQ ID NO: 556514 - DNA, 25 bp, Rattus norvegicus
tagagctcaccaaacatgcagaagt

SEQ ID NO: 556515 - DNA, 25 bp, Rattus norvegicus
tagagctcaccatacatgcagaagt

SEQ ID NO: 556516 - DNA, 25 bp, Rattus norvegicus
tagagctcaggtccggctaaaccac

SEQ ID NO: 556517 - DNA, 25 bp, Rattus norvegicus
tagagctcaggtgcggctaaaccac

SEQ ID NO: 556518 - DNA, 25 bp, Rattus norvegicus
tagagctccacccagctggaaagcc

SEQ ID NO: 556519 - DNA, 25 bp, Rattus norvegicus
tagagctccaccgagctggaaagcc

SEQ ID NO: 556520 - DNA, 25 bp, Rattus norvegicus
tagagctccttcatttttggacaac

SEQ ID NO: 556521 - DNA, 25 bp, Rattus norvegicus
tagagctccttcttttttggacaac

SEQ ID NO: 556522 - DNA, 25 bp, Rattus norvegicus
tagagctctagcagccaagcctgat

SEQ ID NO: 556523 - DNA, 25 bp, Rattus norvegicus
tagagctctagctgccaagcctgat

SEQ ID NO: 556524 - DNA, 25 bp, Rattus norvegicus
tagagctctcataccactgcagaat

SEQ ID NO: 556525 - DNA, 25 bp, Rattus norvegicus
tagagctctcattccactgcagaat

SEQ ID NO: 556526 - DNA, 25 bp, Rattus norvegicus
tagagctctgagcacatagtgtgca

SEQ ID NO: 556527 - DNA, 25 bp, Rattus norvegicus
tagagctctgaggacatagtgtgca

SEQ ID NO: 556528 - DNA, 25 bp, Rattus norvegicus
tagagctctggaagggccaccacct

SEQ ID NO: 556529 - DNA, 25 bp, Rattus norvegicus
tagagctctggatgggccaccacct

SEQ ID NO: 556530 - DNA, 25 bp, Rattus norvegicus
tagagctctttgctggagacccagt

SEQ ID NO: 556531 - DNA, 25 bp, Rattus norvegicus
tagagctctttggtggagacccagt

SEQ ID NO: 556532 - DNA, 25 bp, Rattus norvegicus
tagagctgatccaagacgaatgtgt

SEQ ID NO: 556533 - DNA, 25 bp, Rattus norvegicus
tagagctgatcctagacgaatgtgt

SEQ ID NO: 556534 - DNA, 25 bp, Rattus norvegicus
tagagctgccgtacacgcgggaagt

SEQ ID NO: 556535 - DNA, 25 bp, Rattus norvegicus
tagagctgccgttcacgcgggaagt

SEQ ID NO: 556536 - DNA, 25 bp, Rattus norvegicus
tagagctgcctaaggacaacaagac

SEQ ID NO: 556537 - DNA, 25 bp, Rattus norvegicus
tagagctgcctatggacaacaagac

SEQ ID NO: 556538 - DNA, 25 bp, Rattus norvegicus
tagagctggcctcccagaaagacgg

SEQ ID NO: 556539 - DNA, 25 bp, Rattus norvegicus
tagagctggcctgccagaaagacgg

SEQ ID NO: 556540 - DNA, 25 bp, Rattus norvegicus
tagagctgggccacagaggtttgta

SEQ ID NO: 556541 - DNA, 25 bp, Rattus norvegicus
tagagctgggcctcagaggtttgta

SEQ ID NO: 556542 - DNA, 25 bp, Rattus norvegicus
tagagctgtgctattatgatccaaa

SEQ ID NO: 556543 - DNA, 25 bp, Rattus norvegicus
tagagctgtgcttttatgatccaaa

SEQ ID NO: 556544 - DNA, 25 bp, Rattus norvegicus
tagagcttaataaccaacaaacgtg

SEQ ID NO: 556545 - DNA, 25 bp, Rattus norvegicus
tagagcttaatatccaacaaacgtg

SEQ ID NO: 556546 - DNA, 25 bp, Rattus norvegicus
tagagcttcctaatgccccagaggc

SEQ ID NO: 556547 - DNA, 25 bp, Rattus norvegicus
tagagcttcctactggtagacgccc

SEQ ID NO: 556548 - DNA, 25 bp, Rattus norvegicus
tagagcttcctagtggtagacgccc

SEQ ID NO: 556549 - DNA, 25 bp, Rattus norvegicus
tagagcttcctattgccccagaggc

SEQ ID NO: 556550 - DNA, 25 bp, Rattus norvegicus
tagagcttctcaattaattcaggga

SEQ ID NO: 556551 - DNA, 25 bp, Rattus norvegicus
tagagcttctcatttaattcaggga

SEQ ID NO: 556552 - DNA, 25 bp, Rattus norvegicus
tagagcttgtggattgtcttctctc

SEQ ID NO: 556553 - DNA, 25 bp, Rattus norvegicus
tagagcttgtggtttgtcttctctc

SEQ ID NO: 556554 - DNA, 25 bp, Rattus norvegicus
tagagcttgttcattccgcaggtga

SEQ ID NO: 556555 - DNA, 25 bp, Rattus norvegicus
tagagcttgttctttccgcaggtga

SEQ ID NO: 556556 - DNA, 25 bp, Rattus norvegicus
tagagctttctcaggtgccgattaa

SEQ ID NO: 556557 - DNA, 25 bp, Rattus norvegicus
tagagctttctctggtgccgattaa

SEQ ID NO: 556558 - DNA, 25 bp, Rattus norvegicus
tagagctttcttcttgcttctgcta

SEQ ID NO: 556559 - DNA, 25 bp, Rattus norvegicus
tagagctttcttgttgcttctgcta

SEQ ID NO: 556560 - DNA, 25 bp, Rattus norvegicus
tagagctttgacaagtacctactac

SEQ ID NO: 556561 - DNA, 25 bp, Rattus norvegicus
tagagctttgactagtacctactac

SEQ ID NO: 556562 - DNA, 25 bp, Rattus norvegicus
tagagctttggcatgacgggaaacc

SEQ ID NO: 556563 - DNA, 25 bp, Rattus norvegicus
tagagctttggcttgacgggaaacc

SEQ ID NO: 556564 - DNA, 25 bp, Rattus norvegicus
tagagcttttccattcagcatgtgt

SEQ ID NO: 556565 - DNA, 25 bp, Rattus norvegicus
tagagcttttcctttcagcatgtgt

SEQ ID NO: 556566 - DNA, 25 bp, Rattus norvegicus
tagaggaactgcaatctgacccata

SEQ ID NO: 556567 - DNA, 25 bp, Rattus norvegicus
tagaggaactgctatctgacccata

SEQ ID NO: 556568 - DNA, 25 bp, Rattus norvegicus
tagaggaagtcaacccctcagttgg

SEQ ID NO: 556569 - DNA, 25 bp, Rattus norvegicus
tagaggaagtcatcccctcagttgg

SEQ ID NO: 556570 - DNA, 25 bp, Rattus norvegicus
tagaggaatgccaaaaccccactgc

SEQ ID NO: 556571 - DNA, 25 bp, Rattus norvegicus
tagaggaatgcctaaaccccactgc

SEQ ID NO: 556572 - DNA, 25 bp, Rattus norvegicus
tagaggacaccacgtagggctccaa

SEQ ID NO: 556573 - DNA, 25 bp, Rattus norvegicus
tagaggacaccaggtagggctccaa

SEQ ID NO: 556574 - DNA, 25 bp, Rattus norvegicus
tagaggacacccctaggtgctgtgc

SEQ ID NO: 556575 - DNA, 25 bp, Rattus norvegicus
tagaggacacccgtaggtgctgtgc

SEQ ID NO: 556576 - DNA, 25 bp, Rattus norvegicus
tagaggacagcaacttcttcagcct

SEQ ID NO: 556577 - DNA, 25 bp, Rattus norvegicus
tagaggacagcatcttcttcagcct

SEQ ID NO: 556578 - DNA, 25 bp, Rattus norvegicus
tagaggacatagctgggttttgttt

SEQ ID NO: 556579 - DNA, 25 bp, Rattus norvegicus
tagaggacataggtgggttttgttt

SEQ ID NO: 556580 - DNA, 25 bp, Rattus norvegicus
tagaggacttctcgactcgcagcta

SEQ ID NO: 556581 - DNA, 25 bp, Rattus norvegicus
tagaggacttctggactcgcagcta

SEQ ID NO: 556582 - DNA, 25 bp, Rattus norvegicus
tagaggagacgccaacactctgttc

SEQ ID NO: 556583 - DNA, 25 bp, Rattus norvegicus
tagaggagacgcgaacactctgttc

SEQ ID NO: 556584 - DNA, 25 bp, Rattus norvegicus
tagaggagaggaccctacagccact

SEQ ID NO: 556585 - DNA, 25 bp, Rattus norvegicus
tagaggagaggagcctacagccact

SEQ ID NO: 556586 - DNA, 25 bp, Rattus norvegicus
tagaggaggacacatcccttcctga

SEQ ID NO: 556587 - DNA, 25 bp, Rattus norvegicus
tagaggaggacagatcccttcctga

SEQ ID NO: 556588 - DNA, 25 bp, Rattus norvegicus
tagaggaggtcacttgtcctaccac

SEQ ID NO: 556589 - DNA, 25 bp, Rattus norvegicus
tagaggaggtcagttgtcctaccac

SEQ ID NO: 556590 - DNA, 25 bp, Rattus norvegicus
tagaggaggtcgcaggcggttccgc

SEQ ID NO: 556591 - DNA, 25 bp, Rattus norvegicus
tagaggaggtcggaggcggttccgc

SEQ ID NO: 556592 - DNA, 25 bp, Rattus norvegicus
tagaggatcttgctataggcacccc

SEQ ID NO: 556593 - DNA, 25 bp, Rattus norvegicus
tagaggatcttggtataggcacccc

SEQ ID NO: 556594 - DNA, 25 bp, Rattus norvegicus
tagaggatgcctacagagcctcttt

SEQ ID NO: 556595 - DNA, 25 bp, Rattus norvegicus
tagaggatgccttcagagcctcttt

SEQ ID NO: 556596 - DNA, 25 bp, Rattus norvegicus
tagaggatgttgactctgtccttgt

SEQ ID NO: 556597 - DNA, 25 bp, Rattus norvegicus
tagaggatgttgtctctgtccttgt

SEQ ID NO: 556598 - DNA, 25 bp, Rattus norvegicus
tagaggatgtttaacgcaccgggaa

SEQ ID NO: 556599 - DNA, 25 bp, Rattus norvegicus
tagaggatgttttacgcaccgggaa

SEQ ID NO: 556600 - DNA, 25 bp, Rattus norvegicus
tagaggattactcgacctcaacctc

SEQ ID NO: 556601 - DNA, 25 bp, Rattus norvegicus
tagaggattactggacctcaacctc

SEQ ID NO: 556602 - DNA, 25 bp, Rattus norvegicus
tagaggattgagctctctcctacca

SEQ ID NO: 556603 - DNA, 25 bp, Rattus norvegicus
tagaggattgaggtctctcctacca

SEQ ID NO: 556604 - DNA, 25 bp, Rattus norvegicus
tagaggattttgatttactccaaat

SEQ ID NO: 556605 - DNA, 25 bp, Rattus norvegicus
tagaggattttgttttactccaaat

SEQ ID NO: 556606 - DNA, 25 bp, Rattus norvegicus
tagaggcagctactcattgattttt

SEQ ID NO: 556607 - DNA, 25 bp, Rattus norvegicus
tagaggcagctagtcattgattttt

SEQ ID NO: 556608 - DNA, 25 bp, Rattus norvegicus
tagaggcaggacaggctctgtctct

SEQ ID NO: 556609 - DNA, 25 bp, Rattus norvegicus
tagaggcaggactggctctgtctct

SEQ ID NO: 556610 - DNA, 25 bp, Rattus norvegicus
tagaggcagggcatgtcacagacag

SEQ ID NO: 556611 - DNA, 25 bp, Rattus norvegicus
tagaggcagggcttgtcacagacag

SEQ ID NO: 556612 - DNA, 25 bp, Rattus norvegicus
tagaggccaaacacacagcatttag

SEQ ID NO: 556613 - DNA, 25 bp, Rattus norvegicus
tagaggccaaactcacagcatttag

SEQ ID NO: 556614 - DNA, 25 bp, Rattus norvegicus
tagaggccaacgactgcacatgtga

SEQ ID NO: 556615 - DNA, 25 bp, Rattus norvegicus
tagaggccaacgtctgcacatgtga

SEQ ID NO: 556616 - DNA, 25 bp, Rattus norvegicus
tagaggccaagaagtccctgttcac

SEQ ID NO: 556617 - DNA, 25 bp, Rattus norvegicus
tagaggccaagatgtccctgttcac

SEQ ID NO: 556618 - DNA, 25 bp, Rattus norvegicus
tagaggccacagatgtttgccacat

SEQ ID NO: 556619 - DNA, 25 bp, Rattus norvegicus
tagaggccacagttgtttgccacat

SEQ ID NO: 556620 - DNA, 25 bp, Rattus norvegicus
tagaggccaggcaacttcttgctca

SEQ ID NO: 556621 - DNA, 25 bp, Rattus norvegicus
tagaggccaggctacttcttgctca

SEQ ID NO: 556622 - DNA, 25 bp, Rattus norvegicus
tagaggccagtaagaccattttgtt

SEQ ID NO: 556623 - DNA, 25 bp, Rattus norvegicus
tagaggccagtatgaccattttgtt

SEQ ID NO: 556624 - DNA, 25 bp, Rattus norvegicus
tagaggccatccatacctacattat

SEQ ID NO: 556625 - DNA, 25 bp, Rattus norvegicus
tagaggccatcccagataccgtaaa

SEQ ID NO: 556626 - DNA, 25 bp, Rattus norvegicus
tagaggccatccgagataccgtaaa

SEQ ID NO: 556627 - DNA, 25 bp, Rattus norvegicus
tagaggccatccttacctacattat

SEQ ID NO: 556628 - DNA, 25 bp, Rattus norvegicus
tagaggccattgctcaggacccaaa

SEQ ID NO: 556629 - DNA, 25 bp, Rattus norvegicus
tagaggccattggtcaggacccaaa

SEQ ID NO: 556630 - DNA, 25 bp, Rattus norvegicus
tagaggccggctatagatcacatgt

SEQ ID NO: 556631 - DNA, 25 bp, Rattus norvegicus
tagaggccggctttagatcacatgt

SEQ ID NO: 556632 - DNA, 25 bp, Rattus norvegicus
tagaggcctacacgagagcactgga

SEQ ID NO: 556633 - DNA, 25 bp, Rattus norvegicus
tagaggcctacaggagagcactgga

SEQ ID NO: 556634 - DNA, 25 bp, Rattus norvegicus
tagaggcctggacataagtcattac

SEQ ID NO: 556635 - DNA, 25 bp, Rattus norvegicus
tagaggcctggagataagtcattac

SEQ ID NO: 556636 - DNA, 25 bp, Rattus norvegicus
tagaggccttgcattaccagggtat

SEQ ID NO: 556637 - DNA, 25 bp, Rattus norvegicus
tagaggccttgctttaccagggtat

SEQ ID NO: 556638 - DNA, 25 bp, Rattus norvegicus
tagaggccttgtatatatgtgaata

SEQ ID NO: 556639 - DNA, 25 bp, Rattus norvegicus
tagaggccttgtttatatgtgaata

SEQ ID NO: 556640 - DNA, 25 bp, Rattus norvegicus
tagaggcctttgcagataccccatc

SEQ ID NO: 556641 - DNA, 25 bp, Rattus norvegicus
tagaggcctttggagataccccatc

SEQ ID NO: 556642 - DNA, 25 bp, Rattus norvegicus
tagaggcgactgcagtctgctctca

SEQ ID NO: 556643 - DNA, 25 bp, Rattus norvegicus
tagaggcgactggagtctgctctca

SEQ ID NO: 556644 - DNA, 25 bp, Rattus norvegicus
tagaggcggcgtaagactatcacag

SEQ ID NO: 556645 - DNA, 25 bp, Rattus norvegicus
tagaggcggcgttagactatcacag

SEQ ID NO: 556646 - DNA, 25 bp, Rattus norvegicus
tagaggcggctgatctgagcccagt

SEQ ID NO: 556647 - DNA, 25 bp, Rattus norvegicus
tagaggcggctgttctgagcccagt

SEQ ID NO: 556648 - DNA, 25 bp, Rattus norvegicus
tagaggcggttcatcagctgagtcc

SEQ ID NO: 556649 - DNA, 25 bp, Rattus norvegicus
tagaggcggttcttcagctgagtcc

SEQ ID NO: 556650 - DNA, 25 bp, Rattus norvegicus
tagaggctatgaacccacgtggcgt

SEQ ID NO: 556651 - DNA, 25 bp, Rattus norvegicus
tagaggctatgatcccacgtggcgt

SEQ ID NO: 556652 - DNA, 25 bp, Rattus norvegicus
tagaggctcaggaacactgtctgtt

SEQ ID NO: 556653 - DNA, 25 bp, Rattus norvegicus
tagaggctcaggtacactgtctgtt

SEQ ID NO: 556654 - DNA, 25 bp, Rattus norvegicus
tagaggctcctacatgctggactag

SEQ ID NO: 556655 - DNA, 25 bp, Rattus norvegicus
tagaggctcctagatgctggactag

SEQ ID NO: 556656 - DNA, 25 bp, Rattus norvegicus
tagaggctctgacccactcaaaatc

SEQ ID NO: 556657 - DNA, 25 bp, Rattus norvegicus
tagaggctctgagccactcaaaatc

SEQ ID NO: 556658 - DNA, 25 bp, Rattus norvegicus
tagaggctgacacgccactgtggct

SEQ ID NO: 556659 - DNA, 25 bp, Rattus norvegicus
tagaggctgacaggccactgtggct

SEQ ID NO: 556660 - DNA, 25 bp, Rattus norvegicus
tagaggctgacccaggttctgaaca

SEQ ID NO: 556661 - DNA, 25 bp, Rattus norvegicus
tagaggctgaccgaggttctgaaca

SEQ ID NO: 556662 - DNA, 25 bp, Rattus norvegicus
tagaggctgcctagcctgcgttctc

SEQ ID NO: 556663 - DNA, 25 bp, Rattus norvegicus
tagaggctgccttgcctgcgttctc

SEQ ID NO: 556664 - DNA, 25 bp, Rattus norvegicus
tagaggctgggcattcctcttgcat

SEQ ID NO: 556665 - DNA, 25 bp, Rattus norvegicus
tagaggctgggctttcctcttgcat

SEQ ID NO: 556666 - DNA, 25 bp, Rattus norvegicus
tagaggcttccgagtattcttctcc

SEQ ID NO: 556667 - DNA, 25 bp, Rattus norvegicus
tagaggcttccgtgtattcttctcc

SEQ ID NO: 556668 - DNA, 25 bp, Rattus norvegicus
tagaggcttcggaaaccttcaagat

SEQ ID NO: 556669 - DNA, 25 bp, Rattus norvegicus
tagaggcttcggtaaccttcaagat

SEQ ID NO: 556670 - DNA, 25 bp, Rattus norvegicus
tagaggctttagagtctcggactgg

SEQ ID NO: 556671 - DNA, 25 bp, Rattus norvegicus
tagaggctttagtgtctcggactgg

SEQ ID NO: 556672 - DNA, 25 bp, Rattus norvegicus
tagagggaaacccagccacagcatt

SEQ ID NO: 556673 - DNA, 25 bp, Rattus norvegicus
tagagggaaaccgagccacagcatt

SEQ ID NO: 556674 - DNA, 25 bp, Rattus norvegicus
tagagggaaatcaatgattcttttc

SEQ ID NO: 556675 - DNA, 25 bp, Rattus norvegicus
tagagggaaatctatgattcttttc

SEQ ID NO: 556676 - DNA, 25 bp, Rattus norvegicus
tagagggaacgccactgccatgagt

SEQ ID NO: 556677 - DNA, 25 bp, Rattus norvegicus
tagagggaacgcgactgccatgagt

SEQ ID NO: 556678 - DNA, 25 bp, Rattus norvegicus
tagagggactttagatccgtcctcg

SEQ ID NO: 556679 - DNA, 25 bp, Rattus norvegicus
tagagggacttttgatccgtcctcg

SEQ ID NO: 556680 - DNA, 25 bp, Rattus norvegicus
tagagggagccacagtccttcacac

SEQ ID NO: 556681 - DNA, 25 bp, Rattus norvegicus
tagagggagccagagtccttcacac

SEQ ID NO: 556682 - DNA, 25 bp, Rattus norvegicus
tagagggagtctaccctcccaggaa

SEQ ID NO: 556683 - DNA, 25 bp, Rattus norvegicus
tagagggagtcttccctcccaggaa

SEQ ID NO: 556684 - DNA, 25 bp, Rattus norvegicus
tagagggcacggacagcttcgagtc

SEQ ID NO: 556685 - DNA, 25 bp, Rattus norvegicus
tagagggcacggtcagcttcgagtc

SEQ ID NO: 556686 - DNA, 25 bp, Rattus norvegicus
tagagggcacttagttggactggaa

SEQ ID NO: 556687 - DNA, 25 bp, Rattus norvegicus
tagagggcactttgttggactggaa

SEQ ID NO: 556688 - DNA, 25 bp, Rattus norvegicus
tagagggccagtagtgttcctgtta

SEQ ID NO: 556689 - DNA, 25 bp, Rattus norvegicus
tagagggccagttgtgttcctgtta

SEQ ID NO: 556690 - DNA, 25 bp, Rattus norvegicus
tagagggccatgagctgcccgctga

SEQ ID NO: 556691 - DNA, 25 bp, Rattus norvegicus
tagagggccatgtgctgcccgctga

SEQ ID NO: 556692 - DNA, 25 bp, Rattus norvegicus
tagagggcgcctacttagacactcc

SEQ ID NO: 556693 - DNA, 25 bp, Rattus norvegicus
tagagggcgccttcttagacactcc

SEQ ID NO: 556694 - DNA, 25 bp, Rattus norvegicus
tagagggcgctgacattgtctacca

SEQ ID NO: 556695 - DNA, 25 bp, Rattus norvegicus
tagagggcgctgtcattgtctacca

SEQ ID NO: 556696 - DNA, 25 bp, Rattus norvegicus
tagagggcttccataaaaacatatt

SEQ ID NO: 556697 - DNA, 25 bp, Rattus norvegicus
tagagggcttccttaaaaacatatt

SEQ ID NO: 556698 - DNA, 25 bp, Rattus norvegicus
tagagggtatctaccactaccacca

SEQ ID NO: 556699 - DNA, 25 bp, Rattus norvegicus
tagagggtatcttccactaccacca

SEQ ID NO: 556700 - DNA, 25 bp, Rattus norvegicus
tagagggtccagaattagcaacctg

SEQ ID NO: 556701 - DNA, 25 bp, Rattus norvegicus
tagagggtccagtattagcaacctg

SEQ ID NO: 556702 - DNA, 25 bp, Rattus norvegicus
tagagggttcccacacgtgtgctac

SEQ ID NO: 556703 - DNA, 25 bp, Rattus norvegicus
tagagggttccctcacgtgtgctac

SEQ ID NO: 556704 - DNA, 25 bp, Rattus norvegicus
tagaggtacagcacgtgccaggctt

SEQ ID NO: 556705 - DNA, 25 bp, Rattus norvegicus
tagaggtacagctcgtgccaggctt

SEQ ID NO: 556706 - DNA, 25 bp, Rattus norvegicus
tagaggtactgtacagccaggcctg

SEQ ID NO: 556707 - DNA, 25 bp, Rattus norvegicus
tagaggtactgttcagccaggcctg

SEQ ID NO: 556708 - DNA, 25 bp, Rattus norvegicus
tagaggtcaggaacattcaaggcct

SEQ ID NO: 556709 - DNA, 25 bp, Rattus norvegicus
tagaggtcaggatcattcaaggcct

SEQ ID NO: 556710 - DNA, 25 bp, Rattus norvegicus
tagaggtcccagcactctgggtcat

SEQ ID NO: 556711 - DNA, 25 bp, Rattus norvegicus
tagaggtcccaggactctgggtcat

SEQ ID NO: 556712 - DNA, 25 bp, Rattus norvegicus
tagaggtcctagacacagactgcct

SEQ ID NO: 556713 - DNA, 25 bp, Rattus norvegicus
tagaggtcctagtcacagactgcct

SEQ ID NO: 556714 - DNA, 25 bp, Rattus norvegicus
tagaggtcgcgccagaccctaggct

SEQ ID NO: 556715 - DNA, 25 bp, Rattus norvegicus
tagaggtcgcgcgagaccctaggct

SEQ ID NO: 556716 - DNA, 25 bp, Rattus norvegicus
tagaggtctcctccatggatgcagc

SEQ ID NO: 556717 - DNA, 25 bp, Rattus norvegicus
tagaggtctcctccccacagagaaa

SEQ ID NO: 556718 - DNA, 25 bp, Rattus norvegicus
tagaggtctcctgcatggatgcagc

SEQ ID NO: 556719 - DNA, 25 bp, Rattus norvegicus
tagaggtctcctgcccacagagaaa

SEQ ID NO: 556720 - DNA, 25 bp, Rattus norvegicus
tagaggtgacatatgcacaccctcc

SEQ ID NO: 556721 - DNA, 25 bp, Rattus norvegicus
tagaggtgacatttgcacaccctcc

SEQ ID NO: 556722 - DNA, 25 bp, Rattus norvegicus
tagaggtgcatcacagtcctactca

SEQ ID NO: 556723 - DNA, 25 bp, Rattus norvegicus
tagaggtgcatctcagtcctactca

SEQ ID NO: 556724 - DNA, 25 bp, Rattus norvegicus
tagaggtggcacaagtgaggatcac

SEQ ID NO: 556725 - DNA, 25 bp, Rattus norvegicus
tagaggtggcaccataccctgggtt

SEQ ID NO: 556726 - DNA, 25 bp, Rattus norvegicus
tagaggtggcacgataccctgggtt

SEQ ID NO: 556727 - DNA, 25 bp, Rattus norvegicus
tagaggtggcactagtgaggatcac

SEQ ID NO: 556728 - DNA, 25 bp, Rattus norvegicus
tagaggtggcgtcaacccaacattc

SEQ ID NO: 556729 - DNA, 25 bp, Rattus norvegicus
tagaggtggcgtgaacccaacattc

SEQ ID NO: 556730 - DNA, 25 bp, Rattus norvegicus
tagaggtgggagactcagaagttca

SEQ ID NO: 556731 - DNA, 25 bp, Rattus norvegicus
tagaggtgggagtctcagaagttca

SEQ ID NO: 556732 - DNA, 25 bp, Rattus norvegicus
tagaggtgtcgtctactgctcaagc

SEQ ID NO: 556733 - DNA, 25 bp, Rattus norvegicus
tagaggtgtcgtgtactgctcaagc

SEQ ID NO: 556734 - DNA, 25 bp, Rattus norvegicus
tagaggttcagtcagactcccgtat

SEQ ID NO: 556735 - DNA, 25 bp, Rattus norvegicus
tagaggttcagtgagactcccgtat

SEQ ID NO: 556736 - DNA, 25 bp, Rattus norvegicus
tagaggttccctaccacagtgaaga

SEQ ID NO: 556737 - DNA, 25 bp, Rattus norvegicus
tagaggttcccttccacagtgaaga

SEQ ID NO: 556738 - DNA, 25 bp, Rattus norvegicus
tagaggttctccacgtgatccggga

SEQ ID NO: 556739 - DNA, 25 bp, Rattus norvegicus
tagaggttctcctcgtgatccggga

SEQ ID NO: 556740 - DNA, 25 bp, Rattus norvegicus
tagaggttgccacatgttccctgca

SEQ ID NO: 556741 - DNA, 25 bp, Rattus norvegicus
tagaggttgccagatgttccctgca

SEQ ID NO: 556742 - DNA, 25 bp, Rattus norvegicus
tagaggttgcctcacctcaagttcc

SEQ ID NO: 556743 - DNA, 25 bp, Rattus norvegicus
tagaggttgcctgacctcaagttcc

SEQ ID NO: 556744 - DNA, 25 bp, Rattus norvegicus
tagaggttgctcagacgactgcgct

SEQ ID NO: 556745 - DNA, 25 bp, Rattus norvegicus
tagaggttgctctgacgactgcgct

SEQ ID NO: 556746 - DNA, 25 bp, Rattus norvegicus
tagaggttggacagaaaactttcct

SEQ ID NO: 556747 - DNA, 25 bp, Rattus norvegicus
tagaggttggactgaaaactttcct

SEQ ID NO: 556748 - DNA, 25 bp, Rattus norvegicus
tagaggtttttgcagccttttttca

SEQ ID NO: 556749 - DNA, 25 bp, Rattus norvegicus
tagaggtttttggagccttttttca

SEQ ID NO: 556750 - DNA, 25 bp, Rattus norvegicus
tagagtaaagccatctttgtttgct

SEQ ID NO: 556751 - DNA, 25 bp, Rattus norvegicus
tagagtaaagccttctttgtttgct

SEQ ID NO: 556752 - DNA, 25 bp, Rattus norvegicus
tagagtaacagcactgtggctccat

SEQ ID NO: 556753 - DNA, 25 bp, Rattus norvegicus
tagagtaacagctctgtggctccat

SEQ ID NO: 556754 - DNA, 25 bp, Rattus norvegicus
tagagtaacttcctaccaacaactt

SEQ ID NO: 556755 - DNA, 25 bp, Rattus norvegicus
tagagtaacttcgtaccaacaactt

SEQ ID NO: 556756 - DNA, 25 bp, Rattus norvegicus
tagagtaacttgatttccacgtctc

SEQ ID NO: 556757 - DNA, 25 bp, Rattus norvegicus
tagagtaacttgttttccacgtctc

SEQ ID NO: 556758 - DNA, 25 bp, Rattus norvegicus
tagagtaagagtctggcttctctct

SEQ ID NO: 556759 - DNA, 25 bp, Rattus norvegicus
tagagtaagagtgtggcttctctct

SEQ ID NO: 556760 - DNA, 25 bp, Rattus norvegicus
tagagtaagctgagccaccaccgtt

SEQ ID NO: 556761 - DNA, 25 bp, Rattus norvegicus
tagagtaagctgtgccaccaccgtt

SEQ ID NO: 556762 - DNA, 25 bp, Rattus norvegicus
tagagtacagacatgtcactcccct

SEQ ID NO: 556763 - DNA, 25 bp, Rattus norvegicus
tagagtacagacttgtcactcccct

SEQ ID NO: 556764 - DNA, 25 bp, Rattus norvegicus
tagagtacaggcaaggctgtcttgg

SEQ ID NO: 556765 - DNA, 25 bp, Rattus norvegicus
tagagtacaggctaggctgtcttgg

SEQ ID NO: 556766 - DNA, 25 bp, Rattus norvegicus
tagagtagccgtctctcatgagact

SEQ ID NO: 556767 - DNA, 25 bp, Rattus norvegicus
tagagtagccgtgtctcatgagact

SEQ ID NO: 556768 - DNA, 25 bp, Rattus norvegicus
tagagtaggagcatcctcatggtct

SEQ ID NO: 556769 - DNA, 25 bp, Rattus norvegicus
tagagtaggagcttcctcatggtct

SEQ ID NO: 556770 - DNA, 25 bp, Rattus norvegicus
tagagtatcgacacaagcttcccac

SEQ ID NO: 556771 - DNA, 25 bp, Rattus norvegicus
tagagtatcgactcaagcttcccac

SEQ ID NO: 556772 - DNA, 25 bp, Rattus norvegicus
tagagtatttctcaagcactttaat

SEQ ID NO: 556773 - DNA, 25 bp, Rattus norvegicus
tagagtatttctgaagcactttaat

SEQ ID NO: 556774 - DNA, 25 bp, Rattus norvegicus
tagagtcaagaaccctgtccattgc

SEQ ID NO: 556775 - DNA, 25 bp, Rattus norvegicus
tagagtcaagaagcctgtccattgc

SEQ ID NO: 556776 - DNA, 25 bp, Rattus norvegicus
tagagtcacaaaacaattcgcaata

SEQ ID NO: 556777 - DNA, 25 bp, Rattus norvegicus
tagagtcacaaatcaattcgcaata

SEQ ID NO: 556778 - DNA, 25 bp, Rattus norvegicus
tagagtcacatgctgcagacacctc

SEQ ID NO: 556779 - DNA, 25 bp, Rattus norvegicus
tagagtcacatggtgcagacacctc

SEQ ID NO: 556780 - DNA, 25 bp, Rattus norvegicus
tagagtcagctcactttggcctaat

SEQ ID NO: 556781 - DNA, 25 bp, Rattus norvegicus
tagagtcagctctctttggcctaat

SEQ ID NO: 556782 - DNA, 25 bp, Rattus norvegicus
tagagtcaggcaagcccggtggcat

SEQ ID NO: 556783 - DNA, 25 bp, Rattus norvegicus
tagagtcaggcatgcccggtggcat

SEQ ID NO: 556784 - DNA, 25 bp, Rattus norvegicus
tagagtcaggcgacgagtagcaaga

SEQ ID NO: 556785 - DNA, 25 bp, Rattus norvegicus
tagagtcaggcgtcgagtagcaaga

SEQ ID NO: 556786 - DNA, 25 bp, Rattus norvegicus
tagagtcagtcgctagccagctcag

SEQ ID NO: 556787 - DNA, 25 bp, Rattus norvegicus
tagagtcagtcggtagccagctcag

SEQ ID NO: 556788 - DNA, 25 bp, Rattus norvegicus
tagagtcatcagaaccctagtcagt

SEQ ID NO: 556789 - DNA, 25 bp, Rattus norvegicus
tagagtcatcagtaccctagtcagt

SEQ ID NO: 556790 - DNA, 25 bp, Rattus norvegicus
tagagtcatctacctcacgtaataa

SEQ ID NO: 556791 - DNA, 25 bp, Rattus norvegicus
tagagtcatctagctcacgtaataa

SEQ ID NO: 556792 - DNA, 25 bp, Rattus norvegicus
tagagtccactcagacagggcccat

SEQ ID NO: 556793 - DNA, 25 bp, Rattus norvegicus
tagagtccactctgacagggcccat

SEQ ID NO: 556794 - DNA, 25 bp, Rattus norvegicus
tagagtccagagacatctctcccct

SEQ ID NO: 556795 - DNA, 25 bp, Rattus norvegicus
tagagtccagagtcatctctcccct

SEQ ID NO: 556796 - DNA, 25 bp, Rattus norvegicus
tagagtcccatcatgaattctttct

SEQ ID NO: 556797 - DNA, 25 bp, Rattus norvegicus
tagagtcccatcttgaattctttct

SEQ ID NO: 556798 - DNA, 25 bp, Rattus norvegicus
tagagtcccggcaaaccagtgacag

SEQ ID NO: 556799 - DNA, 25 bp, Rattus norvegicus
tagagtcccggctaaccagtgacag

SEQ ID NO: 556800 - DNA, 25 bp, Rattus norvegicus
tagagtccctggcatccaggccaag

SEQ ID NO: 556801 - DNA, 25 bp, Rattus norvegicus
tagagtccctgggatccaggccaag

SEQ ID NO: 556802 - DNA, 25 bp, Rattus norvegicus
tagagtccgcccagcatagaggctg

SEQ ID NO: 556803 - DNA, 25 bp, Rattus norvegicus
tagagtccgccctgcatagaggctg

SEQ ID NO: 556804 - DNA, 25 bp, Rattus norvegicus
tagagtccgcttaggttcgccacac

SEQ ID NO: 556805 - DNA, 25 bp, Rattus norvegicus
tagagtccgctttggttcgccacac

SEQ ID NO: 556806 - DNA, 25 bp, Rattus norvegicus
tagagtccgttgaggcagaccccaa

SEQ ID NO: 556807 - DNA, 25 bp, Rattus norvegicus
tagagtccgttgtggcagaccccaa

SEQ ID NO: 556808 - DNA, 25 bp, Rattus norvegicus
tagagtcgaagcaccccggtgaagt

SEQ ID NO: 556809 - DNA, 25 bp, Rattus norvegicus
tagagtcgaagctccccggtgaagt

SEQ ID NO: 556810 - DNA, 25 bp, Rattus norvegicus
tagagtcgaggacggccaaccacca

SEQ ID NO: 556811 - DNA, 25 bp, Rattus norvegicus
tagagtcgaggagggccaaccacca

SEQ ID NO: 556812 - DNA, 25 bp, Rattus norvegicus
tagagtctcgacaggccgtgtggca

SEQ ID NO: 556813 - DNA, 25 bp, Rattus norvegicus
tagagtctcgactggccgtgtggca

SEQ ID NO: 556814 - DNA, 25 bp, Rattus norvegicus
tagagtctcgcgagctgtttgtata

SEQ ID NO: 556815 - DNA, 25 bp, Rattus norvegicus
tagagtctcgcgtgctgtttgtata

SEQ ID NO: 556816 - DNA, 25 bp, Rattus norvegicus
tagagtctctagctctccctagaga

SEQ ID NO: 556817 - DNA, 25 bp, Rattus norvegicus
tagagtctctaggtctccctagaga

SEQ ID NO: 556818 - DNA, 25 bp, Rattus norvegicus
tagagtctgcacctgttgcctgaga

SEQ ID NO: 556819 - DNA, 25 bp, Rattus norvegicus
tagagtctgcacgtgttgcctgaga

SEQ ID NO: 556820 - DNA, 25 bp, Rattus norvegicus
tagagtctgcctagaccctgaggag

SEQ ID NO: 556821 - DNA, 25 bp, Rattus norvegicus
tagagtctgccttgaccctgaggag

SEQ ID NO: 556822 - DNA, 25 bp, Rattus norvegicus
tagagtctggatcgactgccctgcc

SEQ ID NO: 556823 - DNA, 25 bp, Rattus norvegicus
tagagtctggatggactgccctgcc

SEQ ID NO: 556824 - DNA, 25 bp, Rattus norvegicus
tagagtctgtccaatggcgtagcat

SEQ ID NO: 556825 - DNA, 25 bp, Rattus norvegicus
tagagtctgtcctatggcgtagcat

SEQ ID NO: 556826 - DNA, 25 bp, Rattus norvegicus
tagagtctgtctactgtacaccaag

SEQ ID NO: 556827 - DNA, 25 bp, Rattus norvegicus
tagagtctgtcttctgtacaccaag

SEQ ID NO: 556828 - DNA, 25 bp, Rattus norvegicus
tagagtctgtgtcggaggatcctac

SEQ ID NO: 556829 - DNA, 25 bp, Rattus norvegicus
tagagtctgtgtgggaggatcctac

SEQ ID NO: 556830 - DNA, 25 bp, Rattus norvegicus
tagagtcttaaactggtggcattcc

SEQ ID NO: 556831 - DNA, 25 bp, Rattus norvegicus
tagagtcttaaagtggtggcattcc

SEQ ID NO: 556832 - DNA, 25 bp, Rattus norvegicus
tagagtcttacacactccctagtaa

SEQ ID NO: 556833 - DNA, 25 bp, Rattus norvegicus
tagagtcttacagactccctagtaa

SEQ ID NO: 556834 - DNA, 25 bp, Rattus norvegicus
tagagtgaaggcactcagcaggaaa

SEQ ID NO: 556835 - DNA, 25 bp, Rattus norvegicus
tagagtgaaggctctcagcaggaaa

SEQ ID NO: 556836 - DNA, 25 bp, Rattus norvegicus
tagagtgacacgcaggccactgttg

SEQ ID NO: 556837 - DNA, 25 bp, Rattus norvegicus
tagagtgacacggaggccactgttg

SEQ ID NO: 556838 - DNA, 25 bp, Rattus norvegicus
tagagtgacatcacttgccttcctc

SEQ ID NO: 556839 - DNA, 25 bp, Rattus norvegicus
tagagtgacatctcttgccttcctc

SEQ ID NO: 556840 - DNA, 25 bp, Rattus norvegicus
tagagtgaccacatctggagggtga

SEQ ID NO: 556841 - DNA, 25 bp, Rattus norvegicus
tagagtgaccacttctggagggtga

SEQ ID NO: 556842 - DNA, 25 bp, Rattus norvegicus
tagagtgaccccatctgttattcca

SEQ ID NO: 556843 - DNA, 25 bp, Rattus norvegicus
tagagtgaccccttctgttattcca

SEQ ID NO: 556844 - DNA, 25 bp, Rattus norvegicus
tagagtgacctgaaagagcttgtga

SEQ ID NO: 556845 - DNA, 25 bp, Rattus norvegicus
tagagtgacctgtaagagcttgtga

SEQ ID NO: 556846 - DNA, 25 bp, Rattus norvegicus
tagagtgagtcgagcatgctgtccc

SEQ ID NO: 556847 - DNA, 25 bp, Rattus norvegicus
tagagtgagtcgtgcatgctgtccc

SEQ ID NO: 556848 - DNA, 25 bp, Rattus norvegicus
tagagtgcaacgagcatacccaggc

SEQ ID NO: 556849 - DNA, 25 bp, Rattus norvegicus
tagagtgcaacgtgcatacccaggc

SEQ ID NO: 556850 - DNA, 25 bp, Rattus norvegicus
tagagtgcacacacctaagtcctca

SEQ ID NO: 556851 - DNA, 25 bp, Rattus norvegicus
tagagtgcacactcctaagtcctca

SEQ ID NO: 556852 - DNA, 25 bp, Rattus norvegicus
tagagtgcaccaatcacacaagccc

SEQ ID NO: 556853 - DNA, 25 bp, Rattus norvegicus
tagagtgcaccattcacacaagccc

SEQ ID NO: 556854 - DNA, 25 bp, Rattus norvegicus
tagagtgcaggaagcccagccattt

SEQ ID NO: 556855 - DNA, 25 bp, Rattus norvegicus
tagagtgcaggatgcccagccattt

SEQ ID NO: 556856 - DNA, 25 bp, Rattus norvegicus
tagagtgccccaaaaagtgtcttta

SEQ ID NO: 556857 - DNA, 25 bp, Rattus norvegicus
tagagtgccccataaagtgtcttta

SEQ ID NO: 556858 - DNA, 25 bp, Rattus norvegicus
tagagtgccctgcaggttgcccaca

SEQ ID NO: 556859 - DNA, 25 bp, Rattus norvegicus
tagagtgccctggaggttgcccaca

SEQ ID NO: 556860 - DNA, 25 bp, Rattus norvegicus
tagagtgcctgtaagcatgcacatg

SEQ ID NO: 556861 - DNA, 25 bp, Rattus norvegicus
tagagtgcctgttagcatgcacatg

SEQ ID NO: 556862 - DNA, 25 bp, Rattus norvegicus
tagagtgcggccaaggattctccca

SEQ ID NO: 556863 - DNA, 25 bp, Rattus norvegicus
tagagtgcggcctaggattctccca

SEQ ID NO: 556864 - DNA, 25 bp, Rattus norvegicus
tagagtgctctacagatccctctct

SEQ ID NO: 556865 - DNA, 25 bp, Rattus norvegicus
tagagtgctctagagatccctctct

SEQ ID NO: 556866 - DNA, 25 bp, Rattus norvegicus
tagagtggcagcacccgtgtctgtg

SEQ ID NO: 556867 - DNA, 25 bp, Rattus norvegicus
tagagtggcagctcccgtgtctgtg

SEQ ID NO: 556868 - DNA, 25 bp, Rattus norvegicus
tagagtggccacatgttcccaaaac

SEQ ID NO: 556869 - DNA, 25 bp, Rattus norvegicus
tagagtggccacttgttcccaaaac

SEQ ID NO: 556870 - DNA, 25 bp, Rattus norvegicus
tagagtggcgctcgcatccgtatac

SEQ ID NO: 556871 - DNA, 25 bp, Rattus norvegicus
tagagtggcgctggcatccgtatac

SEQ ID NO: 556872 - DNA, 25 bp, Rattus norvegicus
tagagtgggatcctggacctcacat

SEQ ID NO: 556873 - DNA, 25 bp, Rattus norvegicus
tagagtgggatcgtggacctcacat

SEQ ID NO: 556874 - DNA, 25 bp, Rattus norvegicus
tagagtgtaaccagcctggctccaa

SEQ ID NO: 556875 - DNA, 25 bp, Rattus norvegicus
tagagtgtaacctgcctggctccaa

SEQ ID NO: 556876 - DNA, 25 bp, Rattus norvegicus
tagagtgtgttcctagaatggccat

SEQ ID NO: 556877 - DNA, 25 bp, Rattus norvegicus
tagagtgtgttcgtagaatggccat

SEQ ID NO: 556878 - DNA, 25 bp, Rattus norvegicus
tagagttacactacggacgcttgct

SEQ ID NO: 556879 - DNA, 25 bp, Rattus norvegicus
tagagttacacttcggacgcttgct

SEQ ID NO: 556880 - DNA, 25 bp, Rattus norvegicus
tagagttactccatggtcagtcttc

SEQ ID NO: 556881 - DNA, 25 bp, Rattus norvegicus
tagagttactccttggtcagtcttc

SEQ ID NO: 556882 - DNA, 25 bp, Rattus norvegicus
tagagttactctctggtttccttgt

SEQ ID NO: 556883 - DNA, 25 bp, Rattus norvegicus
tagagttactctgtggtttccttgt

SEQ ID NO: 556884 - DNA, 25 bp, Rattus norvegicus
tagagttatgttatagtctttggac

SEQ ID NO: 556885 - DNA, 25 bp, Rattus norvegicus
tagagttatgttttagtctttggac

SEQ ID NO: 556886 - DNA, 25 bp, Rattus norvegicus
tagagttcaagcaggtcatcggcca

SEQ ID NO: 556887 - DNA, 25 bp, Rattus norvegicus
tagagttcaagctggtcatcggcca

SEQ ID NO: 556888 - DNA, 25 bp, Rattus norvegicus
tagagttcactgagctcaacttcct

SEQ ID NO: 556889 - DNA, 25 bp, Rattus norvegicus
tagagttcactgtgctcaacttcct

SEQ ID NO: 556890 - DNA, 25 bp, Rattus norvegicus
tagagttcagcaccatcctcgaggg

SEQ ID NO: 556891 - DNA, 25 bp, Rattus norvegicus
tagagttcagcagcatcctcgaggg

SEQ ID NO: 556892 - DNA, 25 bp, Rattus norvegicus
tagagttcagggagctccagtggcc

SEQ ID NO: 556893 - DNA, 25 bp, Rattus norvegicus
tagagttcagggtgctccagtggcc

SEQ ID NO: 556894 - DNA, 25 bp, Rattus norvegicus
tagagttcccataacttggctccaa

SEQ ID NO: 556895 - DNA, 25 bp, Rattus norvegicus
tagagttcccattacttggctccaa

SEQ ID NO: 556896 - DNA, 25 bp, Rattus norvegicus
tagagttcccgaagcaggtgctcat

SEQ ID NO: 556897 - DNA, 25 bp, Rattus norvegicus
tagagttcccgatgcaggtgctcat

SEQ ID NO: 556898 - DNA, 25 bp, Rattus norvegicus
tagagttccggtacagtcctcagag

SEQ ID NO: 556899 - DNA, 25 bp, Rattus norvegicus
tagagttccggttcagtcctcagag

SEQ ID NO: 556900 - DNA, 25 bp, Rattus norvegicus
tagagttctaacaggtctaccctgg

SEQ ID NO: 556901 - DNA, 25 bp, Rattus norvegicus
tagagttctaactggtctaccctgg

SEQ ID NO: 556902 - DNA, 25 bp, Rattus norvegicus
tagagttcttccctgcaacgaatgc

SEQ ID NO: 556903 - DNA, 25 bp, Rattus norvegicus
tagagttcttccgtgcaacgaatgc

SEQ ID NO: 556904 - DNA, 25 bp, Rattus norvegicus
tagagttgacctagactgggccaca

SEQ ID NO: 556905 - DNA, 25 bp, Rattus norvegicus
tagagttgaccttgactgggccaca

SEQ ID NO: 556906 - DNA, 25 bp, Rattus norvegicus
tagagttgagccagtgggacacttc

SEQ ID NO: 556907 - DNA, 25 bp, Rattus norvegicus
tagagttgagcctgtgggacacttc

SEQ ID NO: 556908 - DNA, 25 bp, Rattus norvegicus
tagagttgagtcactctggctgtaa

SEQ ID NO: 556909 - DNA, 25 bp, Rattus norvegicus
tagagttgagtctctctggctgtaa

SEQ ID NO: 556910 - DNA, 25 bp, Rattus norvegicus
tagagtttaatgactcggcagggac

SEQ ID NO: 556911 - DNA, 25 bp, Rattus norvegicus
tagagtttaatgtctcggcagggac

SEQ ID NO: 556912 - DNA, 25 bp, Rattus norvegicus
tagagtttacttactgtcagggaac

SEQ ID NO: 556913 - DNA, 25 bp, Rattus norvegicus
tagagtttactttctgtcagggaac

SEQ ID NO: 556914 - DNA, 25 bp, Rattus norvegicus
tagagtttcaaaacaattcccttaa

SEQ ID NO: 556915 - DNA, 25 bp, Rattus norvegicus
tagagtttcaaatcaattcccttaa

SEQ ID NO: 556916 - DNA, 25 bp, Rattus norvegicus
tagagtttccatccctcattctcat

SEQ ID NO: 556917 - DNA, 25 bp, Rattus norvegicus
tagagtttccatgcctcattctcat

SEQ ID NO: 556918 - DNA, 25 bp, Rattus norvegicus
tagagtttgagcagacccttgcggc

SEQ ID NO: 556919 - DNA, 25 bp, Rattus norvegicus
tagagtttgagctgacccttgcggc

SEQ ID NO: 556920 - DNA, 25 bp, Rattus norvegicus
tagagtttgcatcccagcgcaggac

SEQ ID NO: 556921 - DNA, 25 bp, Rattus norvegicus
tagagtttgcatgccagcgcaggac

SEQ ID NO: 556922 - DNA, 25 bp, Rattus norvegicus
tagagtttggtacccaatccttggc

SEQ ID NO: 556923 - DNA, 25 bp, Rattus norvegicus
tagagtttggtagccaatccttggc

SEQ ID NO: 556924 - DNA, 25 bp, Rattus norvegicus
tagagttttgcaacagagttcttgt

SEQ ID NO: 556925 - DNA, 25 bp, Rattus norvegicus
tagagttttgcatcagagttcttgt

SEQ ID NO: 556926 - DNA, 25 bp, Rattus norvegicus
tagagtttttgtatccaccagtggg

SEQ ID NO: 556927 - DNA, 25 bp, Rattus norvegicus
tagagtttttgtttccaccagtggg

SEQ ID NO: 556928 - DNA, 25 bp, Rattus norvegicus
tagataaccacgcaggagactcccg

SEQ ID NO: 556929 - DNA, 25 bp, Rattus norvegicus
tagataaccacggaggagactcccg

SEQ ID NO: 556930 - DNA, 25 bp, Rattus norvegicus
tagataaccctaactataccactcc

SEQ ID NO: 556931 - DNA, 25 bp, Rattus norvegicus
tagataaccctatctataccactcc

SEQ ID NO: 556932 - DNA, 25 bp, Rattus norvegicus
tagataacgtctaactcccagtcaa

SEQ ID NO: 556933 - DNA, 25 bp, Rattus norvegicus
tagataacgtcttactcccagtcaa

SEQ ID NO: 556934 - DNA, 25 bp, Rattus norvegicus
tagataattgggatcctctggcccc

SEQ ID NO: 556935 - DNA, 25 bp, Rattus norvegicus
tagataattgggttcctctggcccc

SEQ ID NO: 556936 - DNA, 25 bp, Rattus norvegicus
tagatacacggacccttggcagcat

SEQ ID NO: 556937 - DNA, 25 bp, Rattus norvegicus
tagatacacggagccttggcagcat

SEQ ID NO: 556938 - DNA, 25 bp, Rattus norvegicus
tagatacagtcgatctctcactctt

SEQ ID NO: 556939 - DNA, 25 bp, Rattus norvegicus
tagatacagtcgttctctcactctt

SEQ ID NO: 556940 - DNA, 25 bp, Rattus norvegicus
tagatacatctgacaccagtgacag

SEQ ID NO: 556941 - DNA, 25 bp, Rattus norvegicus
tagatacatctgtcaccagtgacag

SEQ ID NO: 556942 - DNA, 25 bp, Rattus norvegicus
tagataccaggcaagtgtgtgcaca

SEQ ID NO: 556943 - DNA, 25 bp, Rattus norvegicus
tagataccaggctagtgtgtgcaca

SEQ ID NO: 556944 - DNA, 25 bp, Rattus norvegicus
tagataccagtcagctgttctccat

SEQ ID NO: 556945 - DNA, 25 bp, Rattus norvegicus
tagataccagtctgctgttctccat

SEQ ID NO: 556946 - DNA, 25 bp, Rattus norvegicus
tagatacccaatccccttcacatgt

SEQ ID NO: 556947 - DNA, 25 bp, Rattus norvegicus
tagatacccaatgcccttcacatgt

SEQ ID NO: 556948 - DNA, 25 bp, Rattus norvegicus
tagatacccacgcttcaccaagctg

SEQ ID NO: 556949 - DNA, 25 bp, Rattus norvegicus
tagatacccacggttcaccaagctg

SEQ ID NO: 556950 - DNA, 25 bp, Rattus norvegicus
tagatacccactattgctgctgcta

SEQ ID NO: 556951 - DNA, 25 bp, Rattus norvegicus
tagatacccacttttgctgctgcta

SEQ ID NO: 556952 - DNA, 25 bp, Rattus norvegicus
tagatacccagcacctgaagtcgtt

SEQ ID NO: 556953 - DNA, 25 bp, Rattus norvegicus
tagatacccagcatctaacctggaa

SEQ ID NO: 556954 - DNA, 25 bp, Rattus norvegicus
tagatacccagctcctgaagtcgtt

SEQ ID NO: 556955 - DNA, 25 bp, Rattus norvegicus
tagatacccagcttctaacctggaa

SEQ ID NO: 556956 - DNA, 25 bp, Rattus norvegicus
tagatacctccgatttctttaagtg

SEQ ID NO: 556957 - DNA, 25 bp, Rattus norvegicus
tagatacctccgttttctttaagtg

SEQ ID NO: 556958 - DNA, 25 bp, Rattus norvegicus
tagatacctgacaaccaactttggg

SEQ ID NO: 556959 - DNA, 25 bp, Rattus norvegicus
tagatacctgactaccaactttggg

SEQ ID NO: 556960 - DNA, 25 bp, Rattus norvegicus
tagatacctggcactgctggagacc

SEQ ID NO: 556961 - DNA, 25 bp, Rattus norvegicus
tagatacctggctctgctggagacc

SEQ ID NO: 556962 - DNA, 25 bp, Rattus norvegicus
tagatacctgtgagactccctggag

SEQ ID NO: 556963 - DNA, 25 bp, Rattus norvegicus
tagatacctgtgtgactccctggag

SEQ ID NO: 556964 - DNA, 25 bp, Rattus norvegicus
tagatactatggagctggccacctt

SEQ ID NO: 556965 - DNA, 25 bp, Rattus norvegicus
tagatactatggtgctggccacctt

SEQ ID NO: 556966 - DNA, 25 bp, Rattus norvegicus
tagatacttgtccttcccaggatag

SEQ ID NO: 556967 - DNA, 25 bp, Rattus norvegicus
tagatacttgtcgttcccaggatag

SEQ ID NO: 556968 - DNA, 25 bp, Rattus norvegicus
tagatagaaggcacctggctggcac

SEQ ID NO: 556969 - DNA, 25 bp, Rattus norvegicus
tagatagaaggctcctggctggcac

SEQ ID NO: 556970 - DNA, 25 bp, Rattus norvegicus
tagatagaccctctgtgctccttta

SEQ ID NO: 556971 - DNA, 25 bp, Rattus norvegicus
tagatagaccctgtgtgctccttta

SEQ ID NO: 556972 - DNA, 25 bp, Rattus norvegicus
tagatagagttcaaatgcatgccat

SEQ ID NO: 556973 - DNA, 25 bp, Rattus norvegicus
tagatagagttctaatgcatgccat

SEQ ID NO: 556974 - DNA, 25 bp, Rattus norvegicus
tagatagcacctactgactttgccc

SEQ ID NO: 556975 - DNA, 25 bp, Rattus norvegicus
tagatagcaccttctgactttgccc

SEQ ID NO: 556976 - DNA, 25 bp, Rattus norvegicus
tagatagcctggagcgtctgtgtgc

SEQ ID NO: 556977 - DNA, 25 bp, Rattus norvegicus
tagatagcctggtgcgtctgtgtgc

SEQ ID NO: 556978 - DNA, 25 bp, Rattus norvegicus
tagatagctggaccggcttggccca

SEQ ID NO: 556979 - DNA, 25 bp, Rattus norvegicus
tagatagctggagcggcttggccca

SEQ ID NO: 556980 - DNA, 25 bp, Rattus norvegicus
tagataggcaccacaacatctagac

SEQ ID NO: 556981 - DNA, 25 bp, Rattus norvegicus
tagataggcacctcaacatctagac

SEQ ID NO: 556982 - DNA, 25 bp, Rattus norvegicus
tagataggccagacatggtcccaca

SEQ ID NO: 556983 - DNA, 25 bp, Rattus norvegicus
tagataggccagtcatggtcccaca

SEQ ID NO: 556984 - DNA, 25 bp, Rattus norvegicus
tagataggctttacctcgttcttag

SEQ ID NO: 556985 - DNA, 25 bp, Rattus norvegicus
tagataggcttttcctcgttcttag

SEQ ID NO: 556986 - DNA, 25 bp, Rattus norvegicus
tagatagggaccagcgcacagggca

SEQ ID NO: 556987 - DNA, 25 bp, Rattus norvegicus
tagatagggacctgcgcacagggca

SEQ ID NO: 556988 - DNA, 25 bp, Rattus norvegicus
tagatagtaactcaatccggtgttg

SEQ ID NO: 556989 - DNA, 25 bp, Rattus norvegicus
tagatagtaactgaatccggtgttg

SEQ ID NO: 556990 - DNA, 25 bp, Rattus norvegicus
tagatagtcacacgcggttttgtaa

SEQ ID NO: 556991 - DNA, 25 bp, Rattus norvegicus
tagatagtcacaggcggttttgtaa

SEQ ID NO: 556992 - DNA, 25 bp, Rattus norvegicus
tagatagtctagacacagtggttca

SEQ ID NO: 556993 - DNA, 25 bp, Rattus norvegicus
tagatagtctagtcacagtggttca

SEQ ID NO: 556994 - DNA, 25 bp, Rattus norvegicus
tagatagtggtgactgccacctgct

SEQ ID NO: 556995 - DNA, 25 bp, Rattus norvegicus
tagatagtggtgtctgccacctgct

SEQ ID NO: 556996 - DNA, 25 bp, Rattus norvegicus
tagatataaaccctgttcctgcgct

SEQ ID NO: 556997 - DNA, 25 bp, Rattus norvegicus
tagatataaaccgtgttcctgcgct

SEQ ID NO: 556998 - DNA, 25 bp, Rattus norvegicus
tagatataagagagacccgccccaa

SEQ ID NO: 556999 - DNA, 25 bp, Rattus norvegicus
tagatataagagtgacccgccccaa

SEQ ID NO: 557000 - DNA, 25 bp, Rattus norvegicus
tagatatacacaaaccatccccatg

SEQ ID NO: 557001 - DNA, 25 bp, Rattus norvegicus
tagatatacacataccatccccatg

SEQ ID NO: 557002 - DNA, 25 bp, Rattus norvegicus
tagatatacataagccaaccccaca

SEQ ID NO: 557003 - DNA, 25 bp, Rattus norvegicus
tagatatacatatgccaaccccaca

SEQ ID NO: 557004 - DNA, 25 bp, Rattus norvegicus
tagatatatcctactgcatctgccc

SEQ ID NO: 557005 - DNA, 25 bp, Rattus norvegicus
tagatatatccttctgcatctgccc

SEQ ID NO: 557006 - DNA, 25 bp, Rattus norvegicus
tagatatctattattcccctgtgga

SEQ ID NO: 557007 - DNA, 25 bp, Rattus norvegicus
tagatatctatttttcccctgtgga

SEQ ID NO: 557008 - DNA, 25 bp, Rattus norvegicus
tagatatgactactgacctacctca

SEQ ID NO: 557009 - DNA, 25 bp, Rattus norvegicus
tagatatgactagtgacctacctca

SEQ ID NO: 557010 - DNA, 25 bp, Rattus norvegicus
tagatatgcaaaccatgctcatgct

SEQ ID NO: 557011 - DNA, 25 bp, Rattus norvegicus
tagatatgcaaagcatgctcatgct

SEQ ID NO: 557012 - DNA, 25 bp, Rattus norvegicus
tagatatgccttcatcttttttggg

SEQ ID NO: 557013 - DNA, 25 bp, Rattus norvegicus
tagatatgccttgatcttttttggg

SEQ ID NO: 557014 - DNA, 25 bp, Rattus norvegicus
tagatatgcgtgacagccttgagat

SEQ ID NO: 557015 - DNA, 25 bp, Rattus norvegicus
tagatatgcgtgtcagccttgagat

SEQ ID NO: 557016 - DNA, 25 bp, Rattus norvegicus
tagatatgctgcagctgttacccaa

SEQ ID NO: 557017 - DNA, 25 bp, Rattus norvegicus
tagatatgctgctgctgttacccaa

SEQ ID NO: 557018 - DNA, 25 bp, Rattus norvegicus
tagatatgctggcaacctgactcac

SEQ ID NO: 557019 - DNA, 25 bp, Rattus norvegicus
tagatatgctgggaacctgactcac

SEQ ID NO: 557020 - DNA, 25 bp, Rattus norvegicus
tagatatggaccactccgttgtcat

SEQ ID NO: 557021 - DNA, 25 bp, Rattus norvegicus
tagatatggacctctccgttgtcat

SEQ ID NO: 557022 - DNA, 25 bp, Rattus norvegicus
tagatattccatccattgccccaga

SEQ ID NO: 557023 - DNA, 25 bp, Rattus norvegicus
tagatattccatgcattgccccaga

SEQ ID NO: 557024 - DNA, 25 bp, Rattus norvegicus
tagatattcttgaacttcctttcgt

SEQ ID NO: 557025 - DNA, 25 bp, Rattus norvegicus
tagatattcttgtacttcctttcgt

SEQ ID NO: 557026 - DNA, 25 bp, Rattus norvegicus
tagatcaacgctatcctgagcttgt

SEQ ID NO: 557027 - DNA, 25 bp, Rattus norvegicus
tagatcaacgctttcctgagcttgt

SEQ ID NO: 557028 - DNA, 25 bp, Rattus norvegicus
tagatcaagatgcttcctctcccaa

SEQ ID NO: 557029 - DNA, 25 bp, Rattus norvegicus
tagatcaagatggttcctctcccaa

SEQ ID NO: 557030 - DNA, 25 bp, Rattus norvegicus
tagatcaaggtcacagatactgccg

SEQ ID NO: 557031 - DNA, 25 bp, Rattus norvegicus
tagatcaaggtctcagatactgccg

SEQ ID NO: 557032 - DNA, 25 bp, Rattus norvegicus
tagatcaatctccttctggttcatc

SEQ ID NO: 557033 - DNA, 25 bp, Rattus norvegicus
tagatcaatctcgttctggttcatc

SEQ ID NO: 557034 - DNA, 25 bp, Rattus norvegicus
tagatcacccaaccaagaattcctc

SEQ ID NO: 557035 - DNA, 25 bp, Rattus norvegicus
tagatcacccaagcaagaattcctc

SEQ ID NO: 557036 - DNA, 25 bp, Rattus norvegicus
tagatcacttccaaagggtgagaga

SEQ ID NO: 557037 - DNA, 25 bp, Rattus norvegicus
tagatcacttcctaagggtgagaga

SEQ ID NO: 557038 - DNA, 25 bp, Rattus norvegicus
tagatcagctctctccaactatgga

SEQ ID NO: 557039 - DNA, 25 bp, Rattus norvegicus
tagatcagctctgtccaactatgga

SEQ ID NO: 557040 - DNA, 25 bp, Rattus norvegicus
tagatcagcttccctcgctggagat

SEQ ID NO: 557041 - DNA, 25 bp, Rattus norvegicus
tagatcagcttcgctcgctggagat

SEQ ID NO: 557042 - DNA, 25 bp, Rattus norvegicus
tagatcaggacgatgccagcgtggt

SEQ ID NO: 557043 - DNA, 25 bp, Rattus norvegicus
tagatcaggacgttgccagcgtggt

SEQ ID NO: 557044 - DNA, 25 bp, Rattus norvegicus
tagatcatactgcaagtccatcttg

SEQ ID NO: 557045 - DNA, 25 bp, Rattus norvegicus
tagatcatactggaagtccatcttg

SEQ ID NO: 557046 - DNA, 25 bp, Rattus norvegicus
tagatccaaggcactcgttttaaaa

SEQ ID NO: 557047 - DNA, 25 bp, Rattus norvegicus
tagatccaaggctctcgttttaaaa

SEQ ID NO: 557048 - DNA, 25 bp, Rattus norvegicus
tagatccaccatctgaatcagctag

SEQ ID NO: 557049 - DNA, 25 bp, Rattus norvegicus
tagatccaccatgtgaatcagctag

SEQ ID NO: 557050 - DNA, 25 bp, Rattus norvegicus
tagatccacgagactgctacaacgg

SEQ ID NO: 557051 - DNA, 25 bp, Rattus norvegicus
tagatccacgagtctgctacaacgg

SEQ ID NO: 557052 - DNA, 25 bp, Rattus norvegicus
tagatccagaccagtttcctttgat

SEQ ID NO: 557053 - DNA, 25 bp, Rattus norvegicus
tagatccagacctgtttcctttgat

SEQ ID NO: 557054 - DNA, 25 bp, Rattus norvegicus
tagatccagataactaggccctcac

SEQ ID NO: 557055 - DNA, 25 bp, Rattus norvegicus
tagatccagatatctaggccctcac

SEQ ID NO: 557056 - DNA, 25 bp, Rattus norvegicus
tagatccatctgaagacctcaaagt

SEQ ID NO: 557057 - DNA, 25 bp, Rattus norvegicus
tagatccatctgagtttcttattaa

SEQ ID NO: 557058 - DNA, 25 bp, Rattus norvegicus
tagatccatctgtagacctcaaagt

SEQ ID NO: 557059 - DNA, 25 bp, Rattus norvegicus
tagatccatctgtgtttcttattaa

SEQ ID NO: 557060 - DNA, 25 bp, Rattus norvegicus
tagatcccacaccttaatcactgtc

SEQ ID NO: 557061 - DNA, 25 bp, Rattus norvegicus
tagatcccacacgttaatcactgtc

SEQ ID NO: 557062 - DNA, 25 bp, Rattus norvegicus
tagatcccacagaatcacagcgaag

SEQ ID NO: 557063 - DNA, 25 bp, Rattus norvegicus
tagatcccacagtatcacagcgaag

SEQ ID NO: 557064 - DNA, 25 bp, Rattus norvegicus
tagatcccactgaggagccctgaga

SEQ ID NO: 557065 - DNA, 25 bp, Rattus norvegicus
tagatcccactgtggagccctgaga

SEQ ID NO: 557066 - DNA, 25 bp, Rattus norvegicus
tagatcccatttcctaaaggttcaa

SEQ ID NO: 557067 - DNA, 25 bp, Rattus norvegicus
tagatcccatttgctaaaggttcaa

SEQ ID NO: 557068 - DNA, 25 bp, Rattus norvegicus
tagatccctcataagtctgtctgtc

SEQ ID NO: 557069 - DNA, 25 bp, Rattus norvegicus
tagatccctcattagtctgtctgtc

SEQ ID NO: 557070 - DNA, 25 bp, Rattus norvegicus
tagatccctgtgcaccataagcaag

SEQ ID NO: 557071 - DNA, 25 bp, Rattus norvegicus
tagatccctgtggaccataagcaag

SEQ ID NO: 557072 - DNA, 25 bp, Rattus norvegicus
tagatcctaaagattaatcctcgga

SEQ ID NO: 557073 - DNA, 25 bp, Rattus norvegicus
tagatcctaaagtttaatcctcgga

SEQ ID NO: 557074 - DNA, 25 bp, Rattus norvegicus
tagatcctctgtagaaccactcatg

SEQ ID NO: 557075 - DNA, 25 bp, Rattus norvegicus
tagatcctctgttgaaccactcatg

SEQ ID NO: 557076 - DNA, 25 bp, Rattus norvegicus
tagatcctgattctgttctgtggtc

SEQ ID NO: 557077 - DNA, 25 bp, Rattus norvegicus
tagatcctgattgtgttctgtggtc

SEQ ID NO: 557078 - DNA, 25 bp, Rattus norvegicus
tagatcctgcgcacctgaaagaaaa

SEQ ID NO: 557079 - DNA, 25 bp, Rattus norvegicus
tagatcctgcgctcctgaaagaaaa

SEQ ID NO: 557080 - DNA, 25 bp, Rattus norvegicus
tagatcctgctgacgcttttgaaag

SEQ ID NO: 557081 - DNA, 25 bp, Rattus norvegicus
tagatcctgctgtcgcttttgaaag

SEQ ID NO: 557082 - DNA, 25 bp, Rattus norvegicus
tagatcctgttaatacacctacttc

SEQ ID NO: 557083 - DNA, 25 bp, Rattus norvegicus
tagatcctgttattacacctacttc

SEQ ID NO: 557084 - DNA, 25 bp, Rattus norvegicus
tagatccttcccaaggtctttaaca

SEQ ID NO: 557085 - DNA, 25 bp, Rattus norvegicus
tagatccttccctaggtctttaaca

SEQ ID NO: 557086 - DNA, 25 bp, Rattus norvegicus
tagatccttgcaatgagccagccgc

SEQ ID NO: 557087 - DNA, 25 bp, Rattus norvegicus
tagatccttgcattgagccagccgc

SEQ ID NO: 557088 - DNA, 25 bp, Rattus norvegicus
tagatccttgttacttgctacattt

SEQ ID NO: 557089 - DNA, 25 bp, Rattus norvegicus
tagatccttgtttcttgctacattt

SEQ ID NO: 557090 - DNA, 25 bp, Rattus norvegicus
tagatctacctcatttcataacctc

SEQ ID NO: 557091 - DNA, 25 bp, Rattus norvegicus
tagatctacctcttttcataacctc

SEQ ID NO: 557092 - DNA, 25 bp, Rattus norvegicus
tagatctcctgacgctcaactgaaa

SEQ ID NO: 557093 - DNA, 25 bp, Rattus norvegicus
tagatctcctgaggctcaactgaaa

SEQ ID NO: 557094 - DNA, 25 bp, Rattus norvegicus
tagatctctatccaggtctcatagc

SEQ ID NO: 557095 - DNA, 25 bp, Rattus norvegicus
tagatctctatcgaggtctcatagc

SEQ ID NO: 557096 - DNA, 25 bp, Rattus norvegicus
tagatctctgctctttctctcaaag

SEQ ID NO: 557097 - DNA, 25 bp, Rattus norvegicus
tagatctctgctgtttctctcaaag

SEQ ID NO: 557098 - DNA, 25 bp, Rattus norvegicus
tagatctctgttaccaagaactggg

SEQ ID NO: 557099 - DNA, 25 bp, Rattus norvegicus
tagatctctgtttccaagaactggg

SEQ ID NO: 557100 - DNA, 25 bp, Rattus norvegicus
tagatctcttccagttaccaacttc

SEQ ID NO: 557101 - DNA, 25 bp, Rattus norvegicus
tagatctcttcctgttaccaacttc

SEQ ID NO: 557102 - DNA, 25 bp, Rattus norvegicus
tagatctgaccactggctgtctgca

SEQ ID NO: 557103 - DNA, 25 bp, Rattus norvegicus
tagatctgaccagtggctgtctgca

SEQ ID NO: 557104 - DNA, 25 bp, Rattus norvegicus
tagatctgatggcaccttggtctaa

SEQ ID NO: 557105 - DNA, 25 bp, Rattus norvegicus
tagatctgatgggaccttggtctaa

SEQ ID NO: 557106 - DNA, 25 bp, Rattus norvegicus
tagatctgcaggatgggaccatacc

SEQ ID NO: 557107 - DNA, 25 bp, Rattus norvegicus
tagatctgcaggttgggaccatacc

SEQ ID NO: 557108 - DNA, 25 bp, Rattus norvegicus
tagatctgcatcattcaaacctcct

SEQ ID NO: 557109 - DNA, 25 bp, Rattus norvegicus
tagatctgcatctttcaaacctcct

SEQ ID NO: 557110 - DNA, 25 bp, Rattus norvegicus
tagatctgccacctgctagtagaaa

SEQ ID NO: 557111 - DNA, 25 bp, Rattus norvegicus
tagatctgccacgtgctagtagaaa

SEQ ID NO: 557112 - DNA, 25 bp, Rattus norvegicus
tagatctgcctgcaatccattgaat

SEQ ID NO: 557113 - DNA, 25 bp, Rattus norvegicus
tagatctgcctggaatccattgaat

SEQ ID NO: 557114 - DNA, 25 bp, Rattus norvegicus
tagatcttagtgaccatgtcaatag

SEQ ID NO: 557115 - DNA, 25 bp, Rattus norvegicus
tagatcttagtgtccatgtcaatag

SEQ ID NO: 557116 - DNA, 25 bp, Rattus norvegicus
tagatctttacacctatgcccctta

SEQ ID NO: 557117 - DNA, 25 bp, Rattus norvegicus
tagatctttacagctatgcccctta

SEQ ID NO: 557118 - DNA, 25 bp, Rattus norvegicus
tagatgaagaacacggtccaccaga

SEQ ID NO: 557119 - DNA, 25 bp, Rattus norvegicus
tagatgaagaactcggtccaccaga

SEQ ID NO: 557120 - DNA, 25 bp, Rattus norvegicus
tagatgacccctactgcagtggtac

SEQ ID NO: 557121 - DNA, 25 bp, Rattus norvegicus
tagatgaccccttctgcagtggtac

SEQ ID NO: 557122 - DNA, 25 bp, Rattus norvegicus
tagatgacgctgactttccattcat

SEQ ID NO: 557123 - DNA, 25 bp, Rattus norvegicus
tagatgacgctgtctttccattcat

SEQ ID NO: 557124 - DNA, 25 bp, Rattus norvegicus
tagatgactcctcggctaccagcag

SEQ ID NO: 557125 - DNA, 25 bp, Rattus norvegicus
tagatgactcctgggctaccagcag

SEQ ID NO: 557126 - DNA, 25 bp, Rattus norvegicus
tagatgagattccttctgcagcggc

SEQ ID NO: 557127 - DNA, 25 bp, Rattus norvegicus
tagatgagattcgttctgcagcggc

SEQ ID NO: 557128 - DNA, 25 bp, Rattus norvegicus
tagatgatatcaaccggcctggctc

SEQ ID NO: 557129 - DNA, 25 bp, Rattus norvegicus
tagatgatatcatccggcctggctc

SEQ ID NO: 557130 - DNA, 25 bp, Rattus norvegicus
tagatgatcacaacaggcacatcaa

SEQ ID NO: 557131 - DNA, 25 bp, Rattus norvegicus
tagatgatcacatcaggcacatcaa

SEQ ID NO: 557132 - DNA, 25 bp, Rattus norvegicus
tagatgatcctacatcctggccttt

SEQ ID NO: 557133 - DNA, 25 bp, Rattus norvegicus
tagatgatcctagatcctggccttt

SEQ ID NO: 557134 - DNA, 25 bp, Rattus norvegicus
tagatgatctccaggactgaatcct

SEQ ID NO: 557135 - DNA, 25 bp, Rattus norvegicus
tagatgatctcctggactgaatcct

SEQ ID NO: 557136 - DNA, 25 bp, Rattus norvegicus
tagatgatgacaatcgccaccaaat

SEQ ID NO: 557137 - DNA, 25 bp, Rattus norvegicus
tagatgatgacattcgccaccaaat

SEQ ID NO: 557138 - DNA, 25 bp, Rattus norvegicus
tagatgatgtccacagtgtggcctc

SEQ ID NO: 557139 - DNA, 25 bp, Rattus norvegicus
tagatgatgtcctcagtgtggcctc

SEQ ID NO: 557140 - DNA, 25 bp, Rattus norvegicus
tagatgcacgaccttggttttccca

SEQ ID NO: 557141 - DNA, 25 bp, Rattus norvegicus
tagatgcacgacgttggttttccca

SEQ ID NO: 557142 - DNA, 25 bp, Rattus norvegicus
tagatgcagcagcttctacacattc

SEQ ID NO: 557143 - DNA, 25 bp, Rattus norvegicus
tagatgcagcaggttctacacattc

SEQ ID NO: 557144 - DNA, 25 bp, Rattus norvegicus
tagatgcaggccatagcgtcttgtt

SEQ ID NO: 557145 - DNA, 25 bp, Rattus norvegicus
tagatgcaggccttagcgtcttgtt

SEQ ID NO: 557146 - DNA, 25 bp, Rattus norvegicus
tagatgcatgcacgctttggggcta

SEQ ID NO: 557147 - DNA, 25 bp, Rattus norvegicus
tagatgcatgcaggctttggggcta

SEQ ID NO: 557148 - DNA, 25 bp, Rattus norvegicus
tagatgcattgactctctctctctc

SEQ ID NO: 557149 - DNA, 25 bp, Rattus norvegicus
tagatgcattgagtctctctctctc

SEQ ID NO: 557150 - DNA, 25 bp, Rattus norvegicus
tagatgccaaagctgtgggctccga

SEQ ID NO: 557151 - DNA, 25 bp, Rattus norvegicus
tagatgccaaaggtgtgggctccga

SEQ ID NO: 557152 - DNA, 25 bp, Rattus norvegicus
tagatgccactgattaaccctgcag

SEQ ID NO: 557153 - DNA, 25 bp, Rattus norvegicus
tagatgccactgtttaaccctgcag

SEQ ID NO: 557154 - DNA, 25 bp, Rattus norvegicus
tagatgcccacacatgcctaatgaa

SEQ ID NO: 557155 - DNA, 25 bp, Rattus norvegicus
tagatgcccacagatgcctaatgaa

SEQ ID NO: 557156 - DNA, 25 bp, Rattus norvegicus
tagatgcccacgcttggaccaaatc

SEQ ID NO: 557157 - DNA, 25 bp, Rattus norvegicus
tagatgcccacggttggaccaaatc

SEQ ID NO: 557158 - DNA, 25 bp, Rattus norvegicus
tagatgcccttaactatgccctacg

SEQ ID NO: 557159 - DNA, 25 bp, Rattus norvegicus
tagatgcccttacacccttggtgtt

SEQ ID NO: 557160 - DNA, 25 bp, Rattus norvegicus
tagatgcccttagacccttggtgtt

SEQ ID NO: 557161 - DNA, 25 bp, Rattus norvegicus
tagatgcccttatctatgccctacg

SEQ ID NO: 557162 - DNA, 25 bp, Rattus norvegicus
tagatgccttagagtggccgtgtct

SEQ ID NO: 557163 - DNA, 25 bp, Rattus norvegicus
tagatgccttagtgtggccgtgtct

SEQ ID NO: 557164 - DNA, 25 bp, Rattus norvegicus
tagatgccttcactgcagagcagga

SEQ ID NO: 557165 - DNA, 25 bp, Rattus norvegicus
tagatgccttcagtgcagagcagga

SEQ ID NO: 557166 - DNA, 25 bp, Rattus norvegicus
tagatgcgaattatgtgcctgctcc

SEQ ID NO: 557167 - DNA, 25 bp, Rattus norvegicus
tagatgcgaattttgtgcctgctcc

SEQ ID NO: 557168 - DNA, 25 bp, Rattus norvegicus
tagatgcgcgccagagacgagccac

SEQ ID NO: 557169 - DNA, 25 bp, Rattus norvegicus
tagatgcgcgcctgagacgagccac

SEQ ID NO: 557170 - DNA, 25 bp, Rattus norvegicus
tagatgctaaacactccatgccttc

SEQ ID NO: 557171 - DNA, 25 bp, Rattus norvegicus
tagatgctaaactctccatgccttc

SEQ ID NO: 557172 - DNA, 25 bp, Rattus norvegicus
tagatgctaagcaccattgggccct

SEQ ID NO: 557173 - DNA, 25 bp, Rattus norvegicus
tagatgctaagctccattgggccct

SEQ ID NO: 557174 - DNA, 25 bp, Rattus norvegicus
tagatgctatctaccttcccaataa

SEQ ID NO: 557175 - DNA, 25 bp, Rattus norvegicus
tagatgctatcttccttcccaataa

SEQ ID NO: 557176 - DNA, 25 bp, Rattus norvegicus
tagatgctgttgctaggctcaacct

SEQ ID NO: 557177 - DNA, 25 bp, Rattus norvegicus
tagatgctgttggtaggctcaacct

SEQ ID NO: 557178 - DNA, 25 bp, Rattus norvegicus
tagatgcttcatctccttttaaaat

SEQ ID NO: 557179 - DNA, 25 bp, Rattus norvegicus
tagatgcttcatgtccttttaaaat

SEQ ID NO: 557180 - DNA, 25 bp, Rattus norvegicus
tagatgcttccgaatgctcaagcgc

SEQ ID NO: 557181 - DNA, 25 bp, Rattus norvegicus
tagatgcttccgtatgctcaagcgc

SEQ ID NO: 557182 - DNA, 25 bp, Rattus norvegicus
tagatggatgatcctccttctagct

SEQ ID NO: 557183 - DNA, 25 bp, Rattus norvegicus
tagatggatgatgctccttctagct

SEQ ID NO: 557184 - DNA, 25 bp, Rattus norvegicus
tagatggcattcaccttcagtttgt

SEQ ID NO: 557185 - DNA, 25 bp, Rattus norvegicus
tagatggcattctccttcagtttgt

SEQ ID NO: 557186 - DNA, 25 bp, Rattus norvegicus
tagatggcatttcccttgctccata

SEQ ID NO: 557187 - DNA, 25 bp, Rattus norvegicus
tagatggcatttgccttgctccata

SEQ ID NO: 557188 - DNA, 25 bp, Rattus norvegicus
tagatggcgtcaatctcccaggagt

SEQ ID NO: 557189 - DNA, 25 bp, Rattus norvegicus
tagatggcgtcattctcccaggagt

SEQ ID NO: 557190 - DNA, 25 bp, Rattus norvegicus
tagatggctaggctttctgtcctgc

SEQ ID NO: 557191 - DNA, 25 bp, Rattus norvegicus
tagatggctagggtttctgtcctgc

SEQ ID NO: 557192 - DNA, 25 bp, Rattus norvegicus
tagatggctcgacggcagaaaaact

SEQ ID NO: 557193 - DNA, 25 bp, Rattus norvegicus
tagatggctcgagggcagaaaaact

SEQ ID NO: 557194 - DNA, 25 bp, Rattus norvegicus
tagatggctgctctgtaatccctac

SEQ ID NO: 557195 - DNA, 25 bp, Rattus norvegicus
tagatggctgctgtgtaatccctac

SEQ ID NO: 557196 - DNA, 25 bp, Rattus norvegicus
tagatgggcaacactgtcctccagc

SEQ ID NO: 557197 - DNA, 25 bp, Rattus norvegicus
tagatgggcaactctgtcctccagc

SEQ ID NO: 557198 - DNA, 25 bp, Rattus norvegicus
tagatgggcagtccctgtgcactca

SEQ ID NO: 557199 - DNA, 25 bp, Rattus norvegicus
tagatgggcagtgcctgtgcactca

SEQ ID NO: 557200 - DNA, 25 bp, Rattus norvegicus
tagatgggcatacacttccccagct

SEQ ID NO: 557201 - DNA, 25 bp, Rattus norvegicus
tagatgggcatagacttccccagct

SEQ ID NO: 557202 - DNA, 25 bp, Rattus norvegicus
tagatgggccgcaggcatcacaccc

SEQ ID NO: 557203 - DNA, 25 bp, Rattus norvegicus
tagatgggccgctggcatcacaccc

SEQ ID NO: 557204 - DNA, 25 bp, Rattus norvegicus
tagatgggtcttactcacctgcaga

SEQ ID NO: 557205 - DNA, 25 bp, Rattus norvegicus
tagatgggtctttctcacctgcaga

SEQ ID NO: 557206 - DNA, 25 bp, Rattus norvegicus
tagatgggttgaacctcctcctcgc

SEQ ID NO: 557207 - DNA, 25 bp, Rattus norvegicus
tagatgggttgatcctcctcctcgc

SEQ ID NO: 557208 - DNA, 25 bp, Rattus norvegicus
tagatggtaatactctctccctagg

SEQ ID NO: 557209 - DNA, 25 bp, Rattus norvegicus
tagatggtaatagtctctccctagg

SEQ ID NO: 557210 - DNA, 25 bp, Rattus norvegicus
tagatggtatctaccaaggccactg

SEQ ID NO: 557211 - DNA, 25 bp, Rattus norvegicus
tagatggtatcttccaaggccactg

SEQ ID NO: 557212 - DNA, 25 bp, Rattus norvegicus
tagatgtaatggcacccaccgtgac

SEQ ID NO: 557213 - DNA, 25 bp, Rattus norvegicus
tagatgtaatgggacccaccgtgac

SEQ ID NO: 557214 - DNA, 25 bp, Rattus norvegicus
tagatgtcactcacaccttaggtca

SEQ ID NO: 557215 - DNA, 25 bp, Rattus norvegicus
tagatgtcactctcaccttaggtca

SEQ ID NO: 557216 - DNA, 25 bp, Rattus norvegicus
tagatgtccagtaggcagacctgac

SEQ ID NO: 557217 - DNA, 25 bp, Rattus norvegicus
tagatgtccagttggcagacctgac

SEQ ID NO: 557218 - DNA, 25 bp, Rattus norvegicus
tagatgtccctacccaggatcagca

SEQ ID NO: 557219 - DNA, 25 bp, Rattus norvegicus
tagatgtccctagccaggatcagca

SEQ ID NO: 557220 - DNA, 25 bp, Rattus norvegicus
tagatgtctaccacttcccaaaggc

SEQ ID NO: 557221 - DNA, 25 bp, Rattus norvegicus
tagatgtctacccaaaacctccatg

SEQ ID NO: 557222 - DNA, 25 bp, Rattus norvegicus
tagatgtctaccgaaaacctccatg

SEQ ID NO: 557223 - DNA, 25 bp, Rattus norvegicus
tagatgtctacctcttcccaaaggc

SEQ ID NO: 557224 - DNA, 25 bp, Rattus norvegicus
tagatgtctctgaagccatgtgtca

SEQ ID NO: 557225 - DNA, 25 bp, Rattus norvegicus
tagatgtctctgtagccatgtgtca

SEQ ID NO: 557226 - DNA, 25 bp, Rattus norvegicus
tagatgtctgcgacccaggataccc

SEQ ID NO: 557227 - DNA, 25 bp, Rattus norvegicus
tagatgtctgcgtcccaggataccc

SEQ ID NO: 557228 - DNA, 25 bp, Rattus norvegicus
tagatgtgactgatccaagaccctc

SEQ ID NO: 557229 - DNA, 25 bp, Rattus norvegicus
tagatgtgactgttccaagaccctc

SEQ ID NO: 557230 - DNA, 25 bp, Rattus norvegicus
tagatgtgcagcatgaccttcatgg

SEQ ID NO: 557231 - DNA, 25 bp, Rattus norvegicus
tagatgtgcagcttgaccttcatgg

SEQ ID NO: 557232 - DNA, 25 bp, Rattus norvegicus
tagatgtgctggcagccatgtcctt

SEQ ID NO: 557233 - DNA, 25 bp, Rattus norvegicus
tagatgtgctgggagccatgtcctt

SEQ ID NO: 557234 - DNA, 25 bp, Rattus norvegicus
tagatgtggcttaggcccacttgca

SEQ ID NO: 557235 - DNA, 25 bp, Rattus norvegicus
tagatgtggctttggcccacttgca

SEQ ID NO: 557236 - DNA, 25 bp, Rattus norvegicus
tagatgtggtcccttctctcatatt

SEQ ID NO: 557237 - DNA, 25 bp, Rattus norvegicus
tagatgtggtccgttctctcatatt

SEQ ID NO: 557238 - DNA, 25 bp, Rattus norvegicus
tagatgtgtgtcaaggcccctaagc

SEQ ID NO: 557239 - DNA, 25 bp, Rattus norvegicus
tagatgtgtgtctaggcccctaagc

SEQ ID NO: 557240 - DNA, 25 bp, Rattus norvegicus
tagatgttccataggctgtctgaaa

SEQ ID NO: 557241 - DNA, 25 bp, Rattus norvegicus
tagatgttccattggctgtctgaaa

SEQ ID NO: 557242 - DNA, 25 bp, Rattus norvegicus
tagatgttctggaatgcgccaccat

SEQ ID NO: 557243 - DNA, 25 bp, Rattus norvegicus
tagatgttctggtatgcgccaccat

SEQ ID NO: 557244 - DNA, 25 bp, Rattus norvegicus
tagatgtttccacatgtgccatggg

SEQ ID NO: 557245 - DNA, 25 bp, Rattus norvegicus
tagatgtttccagatgtgccatggg

SEQ ID NO: 557246 - DNA, 25 bp, Rattus norvegicus
tagatgtttgttccgtgatggccct

SEQ ID NO: 557247 - DNA, 25 bp, Rattus norvegicus
tagatgtttgttgcgtgatggccct

SEQ ID NO: 557248 - DNA, 25 bp, Rattus norvegicus
tagatgttttttcctccggttctca

SEQ ID NO: 557249 - DNA, 25 bp, Rattus norvegicus
tagatgttttttgctccggttctca

SEQ ID NO: 557250 - DNA, 25 bp, Rattus norvegicus
tagattaaacctcaagggctccctt

SEQ ID NO: 557251 - DNA, 25 bp, Rattus norvegicus
tagattaaacctgaagggctccctt

SEQ ID NO: 557252 - DNA, 25 bp, Rattus norvegicus
tagattaagtagctttgttccacca

SEQ ID NO: 557253 - DNA, 25 bp, Rattus norvegicus
tagattaagtaggtttgttccacca

SEQ ID NO: 557254 - DNA, 25 bp, Rattus norvegicus
tagattaatggtagaggcatcgtgt

SEQ ID NO: 557255 - DNA, 25 bp, Rattus norvegicus
tagattaatggttgaggcatcgtgt

SEQ ID NO: 557256 - DNA, 25 bp, Rattus norvegicus
tagattacagcgcagatcagacaat

SEQ ID NO: 557257 - DNA, 25 bp, Rattus norvegicus
tagattacagcggagatcagacaat

SEQ ID NO: 557258 - DNA, 25 bp, Rattus norvegicus
tagattaccattcgcagcgcactgc

SEQ ID NO: 557259 - DNA, 25 bp, Rattus norvegicus
tagattaccattggcagcgcactgc

SEQ ID NO: 557260 - DNA, 25 bp, Rattus norvegicus
tagattactttgaggcagacagctg

SEQ ID NO: 557261 - DNA, 25 bp, Rattus norvegicus
tagattactttgtggcagacagctg

SEQ ID NO: 557262 - DNA, 25 bp, Rattus norvegicus
tagattagacttctcactcctgtgt

SEQ ID NO: 557263 - DNA, 25 bp, Rattus norvegicus
tagattagacttgtcactcctgtgt

SEQ ID NO: 557264 - DNA, 25 bp, Rattus norvegicus
tagattagattgaacgcccaccggg

SEQ ID NO: 557265 - DNA, 25 bp, Rattus norvegicus
tagattagattgtacgcccaccggg

SEQ ID NO: 557266 - DNA, 25 bp, Rattus norvegicus
tagattagggctagggagccccttc

SEQ ID NO: 557267 - DNA, 25 bp, Rattus norvegicus
tagattagggcttgggagccccttc

SEQ ID NO: 557268 - DNA, 25 bp, Rattus norvegicus
tagattagtattccctcatgtgttg

SEQ ID NO: 557269 - DNA, 25 bp, Rattus norvegicus
tagattagtattgcctcatgtgttg

SEQ ID NO: 557270 - DNA, 25 bp, Rattus norvegicus
tagattatacgcaccttgtgggcag

SEQ ID NO: 557271 - DNA, 25 bp, Rattus norvegicus
tagattatacgctccttgtgggcag

SEQ ID NO: 557272 - DNA, 25 bp, Rattus norvegicus
tagattatctgcattactttcccat

SEQ ID NO: 557273 - DNA, 25 bp, Rattus norvegicus
tagattatctgctttactttcccat

SEQ ID NO: 557274 - DNA, 25 bp, Rattus norvegicus
tagattatctggcagccctggacaa

SEQ ID NO: 557275 - DNA, 25 bp, Rattus norvegicus
tagattatctgggagccctggacaa

SEQ ID NO: 557276 - DNA, 25 bp, Rattus norvegicus
tagattatggcacacaccggagcaa

SEQ ID NO: 557277 - DNA, 25 bp, Rattus norvegicus
tagattatggcagacaccggagcaa

SEQ ID NO: 557278 - DNA, 25 bp, Rattus norvegicus
tagattatgtgcatggccactgcct

SEQ ID NO: 557279 - DNA, 25 bp, Rattus norvegicus
tagattatgtgcttggccactgcct

SEQ ID NO: 557280 - DNA, 25 bp, Rattus norvegicus
tagattcaatacagtgtcaactcca

SEQ ID NO: 557281 - DNA, 25 bp, Rattus norvegicus
tagattcaatactgtgtcaactcca

SEQ ID NO: 557282 - DNA, 25 bp, Rattus norvegicus
tagattccagtgagactcagccagc

SEQ ID NO: 557283 - DNA, 25 bp, Rattus norvegicus
tagattccagtgtgactcagccagc

SEQ ID NO: 557284 - DNA, 25 bp, Rattus norvegicus
tagattcccaatcctaggagactgg

SEQ ID NO: 557285 - DNA, 25 bp, Rattus norvegicus
tagattcccaatgctaggagactgg

SEQ ID NO: 557286 - DNA, 25 bp, Rattus norvegicus
tagattcccagcaattcagtgtcga

SEQ ID NO: 557287 - DNA, 25 bp, Rattus norvegicus
tagattcccagctattcagtgtcga

SEQ ID NO: 557288 - DNA, 25 bp, Rattus norvegicus
tagattccccaaagatggttacatt

SEQ ID NO: 557289 - DNA, 25 bp, Rattus norvegicus
tagattccccaatgatggttacatt

SEQ ID NO: 557290 - DNA, 25 bp, Rattus norvegicus
tagattccccttagctctgcagtac

SEQ ID NO: 557291 - DNA, 25 bp, Rattus norvegicus
tagattcccctttgctctgcagtac

SEQ ID NO: 557292 - DNA, 25 bp, Rattus norvegicus
tagattccctgacacccattgtaag

SEQ ID NO: 557293 - DNA, 25 bp, Rattus norvegicus
tagattccctgagacccattgtaag

SEQ ID NO: 557294 - DNA, 25 bp, Rattus norvegicus
tagattccgagaccctgattaatgc

SEQ ID NO: 557295 - DNA, 25 bp, Rattus norvegicus
tagattccgagagcctgattaatgc

SEQ ID NO: 557296 - DNA, 25 bp, Rattus norvegicus
tagattccgctgagactggtccaat

SEQ ID NO: 557297 - DNA, 25 bp, Rattus norvegicus
tagattccgctgtgactggtccaat

SEQ ID NO: 557298 - DNA, 25 bp, Rattus norvegicus
tagattccttctctgacagcaggga

SEQ ID NO: 557299 - DNA, 25 bp, Rattus norvegicus
tagattccttctgtgacagcaggga

SEQ ID NO: 557300 - DNA, 25 bp, Rattus norvegicus
tagattcctttgaccttgtgtgaga

SEQ ID NO: 557301 - DNA, 25 bp, Rattus norvegicus
tagattcctttgtccttgtgtgaga

SEQ ID NO: 557302 - DNA, 25 bp, Rattus norvegicus
tagattctaaggatcaaggccagac

SEQ ID NO: 557303 - DNA, 25 bp, Rattus norvegicus
tagattctaaggttcaaggccagac

SEQ ID NO: 557304 - DNA, 25 bp, Rattus norvegicus
tagattctacatccttgacctttgc

SEQ ID NO: 557305 - DNA, 25 bp, Rattus norvegicus
tagattctacatgcttgacctttgc

SEQ ID NO: 557306 - DNA, 25 bp, Rattus norvegicus
tagattctcattctcctagccaact

SEQ ID NO: 557307 - DNA, 25 bp, Rattus norvegicus
tagattctcattgtcctagccaact

SEQ ID NO: 557308 - DNA, 25 bp, Rattus norvegicus
tagattctgagtctttccttaccac

SEQ ID NO: 557309 - DNA, 25 bp, Rattus norvegicus
tagattctgagtgtttccttaccac

SEQ ID NO: 557310 - DNA, 25 bp, Rattus norvegicus
tagattctgtgtcttcctctgagga

SEQ ID NO: 557311 - DNA, 25 bp, Rattus norvegicus
tagattctgtgtgttcctctgagga

SEQ ID NO: 557312 - DNA, 25 bp, Rattus norvegicus
tagattcttattacggtatttgtcc

SEQ ID NO: 557313 - DNA, 25 bp, Rattus norvegicus
tagattcttatttcggtatttgtcc

SEQ ID NO: 557314 - DNA, 25 bp, Rattus norvegicus
tagattcttcagagtcacaccggga

SEQ ID NO: 557315 - DNA, 25 bp, Rattus norvegicus
tagattcttcagtgtcacaccggga

SEQ ID NO: 557316 - DNA, 25 bp, Rattus norvegicus
tagattcttctacctctttctgccg

SEQ ID NO: 557317 - DNA, 25 bp, Rattus norvegicus
tagattcttctagctctttctgccg

SEQ ID NO: 557318 - DNA, 25 bp, Rattus norvegicus
tagattcttttcacacttgagcctt

SEQ ID NO: 557319 - DNA, 25 bp, Rattus norvegicus
tagattcttttctcacttgagcctt

SEQ ID NO: 557320 - DNA, 25 bp, Rattus norvegicus
tagattgaccctctcagccaaactg

SEQ ID NO: 557321 - DNA, 25 bp, Rattus norvegicus
tagattgaccctgtcagccaaactg

SEQ ID NO: 557322 - DNA, 25 bp, Rattus norvegicus
tagattgactccaaattcctgctgg

SEQ ID NO: 557323 - DNA, 25 bp, Rattus norvegicus
tagattgactcctaattcctgctgg

SEQ ID NO: 557324 - DNA, 25 bp, Rattus norvegicus
tagattgaggtcagtgccagcacct

SEQ ID NO: 557325 - DNA, 25 bp, Rattus norvegicus
tagattgaggtctgtgccagcacct

SEQ ID NO: 557326 - DNA, 25 bp, Rattus norvegicus
tagattgcacctacagcatccacgt

SEQ ID NO: 557327 - DNA, 25 bp, Rattus norvegicus
tagattgcaccttcagcatccacgt

SEQ ID NO: 557328 - DNA, 25 bp, Rattus norvegicus
tagattgcagggatcagcctagctc

SEQ ID NO: 557329 - DNA, 25 bp, Rattus norvegicus
tagattgcagggttcagcctagctc

SEQ ID NO: 557330 - DNA, 25 bp, Rattus norvegicus
tagattgcggatcaactcccctggc

SEQ ID NO: 557331 - DNA, 25 bp, Rattus norvegicus
tagattgcggatgaactcccctggc

SEQ ID NO: 557332 - DNA, 25 bp, Rattus norvegicus
tagattgcggcaagtgtccctggcc

SEQ ID NO: 557333 - DNA, 25 bp, Rattus norvegicus
tagattgcggcatgtgtccctggcc

SEQ ID NO: 557334 - DNA, 25 bp, Rattus norvegicus
tagattgctaatcccactcattcag

SEQ ID NO: 557335 - DNA, 25 bp, Rattus norvegicus
tagattgctaatgccactcattcag

SEQ ID NO: 557336 - DNA, 25 bp, Rattus norvegicus
tagattgcttttataccctgcctgg

SEQ ID NO: 557337 - DNA, 25 bp, Rattus norvegicus
tagattgcttttttaccctgcctgg

SEQ ID NO: 557338 - DNA, 25 bp, Rattus norvegicus
tagattgtaagcagtgccggctggc

SEQ ID NO: 557339 - DNA, 25 bp, Rattus norvegicus
tagattgtaagctgtgccggctggc

SEQ ID NO: 557340 - DNA, 25 bp, Rattus norvegicus
tagattgtccgacgactgtatcact

SEQ ID NO: 557341 - DNA, 25 bp, Rattus norvegicus
tagattgtccgaggactgtatcact

SEQ ID NO: 557342 - DNA, 25 bp, Rattus norvegicus
tagattgtgaacacaggctaaggta

SEQ ID NO: 557343 - DNA, 25 bp, Rattus norvegicus
tagattgtgaactcaggctaaggta

SEQ ID NO: 557344 - DNA, 25 bp, Rattus norvegicus
tagattgtttgaatgctggctcctc

SEQ ID NO: 557345 - DNA, 25 bp, Rattus norvegicus
tagattgtttgattgctggctcctc

SEQ ID NO: 557346 - DNA, 25 bp, Rattus norvegicus
tagatttaataaccaaacggcaggg

SEQ ID NO: 557347 - DNA, 25 bp, Rattus norvegicus
tagatttaataagcaaacggcaggg

SEQ ID NO: 557348 - DNA, 25 bp, Rattus norvegicus
tagatttacttcacagttttccctt

SEQ ID NO: 557349 - DNA, 25 bp, Rattus norvegicus
tagatttacttctcagttttccctt

SEQ ID NO: 557350 - DNA, 25 bp, Rattus norvegicus
tagatttatggtcgacgtggccgca

SEQ ID NO: 557351 - DNA, 25 bp, Rattus norvegicus
tagatttatggtggacgtggccgca

SEQ ID NO: 557352 - DNA, 25 bp, Rattus norvegicus
tagatttcagtgaatacatcttggc

SEQ ID NO: 557353 - DNA, 25 bp, Rattus norvegicus
tagatttcagtgtatacatcttggc

SEQ ID NO: 557354 - DNA, 25 bp, Rattus norvegicus
tagatttccttaactgtccaccaca

SEQ ID NO: 557355 - DNA, 25 bp, Rattus norvegicus
tagatttccttatctgtccaccaca

SEQ ID NO: 557356 - DNA, 25 bp, Rattus norvegicus
tagatttctagacaggcagcctcct

SEQ ID NO: 557357 - DNA, 25 bp, Rattus norvegicus
tagatttctagagaggcagcctcct

SEQ ID NO: 557358 - DNA, 25 bp, Rattus norvegicus
tagatttctcaccatgctaaaggga

SEQ ID NO: 557359 - DNA, 25 bp, Rattus norvegicus
tagatttctcacgatgctaaaggga

SEQ ID NO: 557360 - DNA, 25 bp, Rattus norvegicus
tagatttctgccctgactcgtttaa

SEQ ID NO: 557361 - DNA, 25 bp, Rattus norvegicus
tagatttctgccgtgactcgtttaa

SEQ ID NO: 557362 - DNA, 25 bp, Rattus norvegicus
tagatttgagttcttccacctccaa

SEQ ID NO: 557363 - DNA, 25 bp, Rattus norvegicus
tagatttgagttgttccacctccaa

SEQ ID NO: 557364 - DNA, 25 bp, Rattus norvegicus
tagatttgcactaatgttcccctgg

SEQ ID NO: 557365 - DNA, 25 bp, Rattus norvegicus
tagatttgcacttatgttcccctgg

SEQ ID NO: 557366 - DNA, 25 bp, Rattus norvegicus
tagatttgccaaactgcccacagtg

SEQ ID NO: 557367 - DNA, 25 bp, Rattus norvegicus
tagatttgccaatctgcccacagtg

SEQ ID NO: 557368 - DNA, 25 bp, Rattus norvegicus
tagatttgccctaaactgtttgact

SEQ ID NO: 557369 - DNA, 25 bp, Rattus norvegicus
tagatttgcccttaactgtttgact

SEQ ID NO: 557370 - DNA, 25 bp, Rattus norvegicus
tagatttgctgtagttagccgttga

SEQ ID NO: 557371 - DNA, 25 bp, Rattus norvegicus
tagatttgctgttgttagccgttga

SEQ ID NO: 557372 - DNA, 25 bp, Rattus norvegicus
tagatttggattctccagctcctgt

SEQ ID NO: 557373 - DNA, 25 bp, Rattus norvegicus
tagatttggattgtccagctcctgt

SEQ ID NO: 557374 - DNA, 25 bp, Rattus norvegicus
tagatttgtcaacgtggaacttaaa

SEQ ID NO: 557375 - DNA, 25 bp, Rattus norvegicus
tagatttgtcaaggtggaacttaaa

SEQ ID NO: 557376 - DNA, 25 bp, Rattus norvegicus
tagatttgtgtcacttgcacgttct

SEQ ID NO: 557377 - DNA, 25 bp, Rattus norvegicus
tagatttgtgtctcttgcacgttct

SEQ ID NO: 557378 - DNA, 25 bp, Rattus norvegicus
tagatttgttctctgtttgactgcc

SEQ ID NO: 557379 - DNA, 25 bp, Rattus norvegicus
tagatttgttctgtgtttgactgcc

SEQ ID NO: 557380 - DNA, 25 bp, Rattus norvegicus
tagattttaaatcgccaatgtgaat

SEQ ID NO: 557381 - DNA, 25 bp, Rattus norvegicus
tagattttaaatggccaatgtgaat

SEQ ID NO: 557382 - DNA, 25 bp, Rattus norvegicus
tagattttaagacctctgccatgga

SEQ ID NO: 557383 - DNA, 25 bp, Rattus norvegicus
tagattttaagagctctgccatgga

SEQ ID NO: 557384 - DNA, 25 bp, Rattus norvegicus
tagattttcctgcaacaccttcaaa

SEQ ID NO: 557385 - DNA, 25 bp, Rattus norvegicus
tagattttcctggaacaccttcaaa

SEQ ID NO: 557386 - DNA, 25 bp, Rattus norvegicus
tagcaaaaccgacctgaaactcacc

SEQ ID NO: 557387 - DNA, 25 bp, Rattus norvegicus
tagcaaaaccgagctgaaactcacc

SEQ ID NO: 557388 - DNA, 25 bp, Rattus norvegicus
tagcaaaagcagagagtgagaccgt

SEQ ID NO: 557389 - DNA, 25 bp, Rattus norvegicus
tagcaaaagcagtgagtgagaccgt

SEQ ID NO: 557390 - DNA, 25 bp, Rattus norvegicus
tagcaaacacctcttcgtgcacatc

SEQ ID NO: 557391 - DNA, 25 bp, Rattus norvegicus
tagcaaacacctgttcgtgcacatc

SEQ ID NO: 557392 - DNA, 25 bp, Rattus norvegicus
tagcaaaccagacagccttccagaa

SEQ ID NO: 557393 - DNA, 25 bp, Rattus norvegicus
tagcaaaccagagagccttccagaa

SEQ ID NO: 557394 - DNA, 25 bp, Rattus norvegicus
tagcaaacccgtcttgtctgataca

SEQ ID NO: 557395 - DNA, 25 bp, Rattus norvegicus
tagcaaacccgtgttgtctgataca

SEQ ID NO: 557396 - DNA, 25 bp, Rattus norvegicus
tagcaaaccctaacccagagtaact

SEQ ID NO: 557397 - DNA, 25 bp, Rattus norvegicus
tagcaaaccctatcccagagtaact

SEQ ID NO: 557398 - DNA, 25 bp, Rattus norvegicus
tagcaaactctgattttgtgtgttt

SEQ ID NO: 557399 - DNA, 25 bp, Rattus norvegicus
tagcaaactctgtttttgtgtgttt

SEQ ID NO: 557400 - DNA, 25 bp, Rattus norvegicus
tagcaaagactgatttccttggctc

SEQ ID NO: 557401 - DNA, 25 bp, Rattus norvegicus
tagcaaagactgttttccttggctc

SEQ ID NO: 557402 - DNA, 25 bp, Rattus norvegicus
tagcaaagagccacggaccacgcac

SEQ ID NO: 557403 - DNA, 25 bp, Rattus norvegicus
tagcaaagagcctcggaccacgcac

SEQ ID NO: 557404 - DNA, 25 bp, Rattus norvegicus
tagcaaagccacatgacccagagat

SEQ ID NO: 557405 - DNA, 25 bp, Rattus norvegicus
tagcaaagccacttgacccagagat

SEQ ID NO: 557406 - DNA, 25 bp, Rattus norvegicus
tagcaaatgtctctgctctagtcct

SEQ ID NO: 557407 - DNA, 25 bp, Rattus norvegicus
tagcaaatgtctgtgctctagtcct

SEQ ID NO: 557408 - DNA, 25 bp, Rattus norvegicus
tagcaaattatccagaccacgtctt

SEQ ID NO: 557409 - DNA, 25 bp, Rattus norvegicus
tagcaaattatcgagaccacgtctt

SEQ ID NO: 557410 - DNA, 25 bp, Rattus norvegicus
tagcaacaagaaccttctcttcacc

SEQ ID NO: 557411 - DNA, 25 bp, Rattus norvegicus
tagcaacaagaacgcttcgttcatg

SEQ ID NO: 557412 - DNA, 25 bp, Rattus norvegicus
tagcaacaagaagcttctcttcacc

SEQ ID NO: 557413 - DNA, 25 bp, Rattus norvegicus
tagcaacaagaaggcttcgttcatg

SEQ ID NO: 557414 - DNA, 25 bp, Rattus norvegicus
tagcaacagaagctttgcccgcaca

SEQ ID NO: 557415 - DNA, 25 bp, Rattus norvegicus
tagcaacagaaggtttgcccgcaca

SEQ ID NO: 557416 - DNA, 25 bp, Rattus norvegicus
tagcaaccctggcacgaactgaagg

SEQ ID NO: 557417 - DNA, 25 bp, Rattus norvegicus
tagcaaccctgggacgaactgaagg

SEQ ID NO: 557418 - DNA, 25 bp, Rattus norvegicus
tagcaaccttctcttttctgtcaca

SEQ ID NO: 557419 - DNA, 25 bp, Rattus norvegicus
tagcaaccttctgttttctgtcaca

SEQ ID NO: 557420 - DNA, 25 bp, Rattus norvegicus
tagcaactccttaccattagcaaaa

SEQ ID NO: 557421 - DNA, 25 bp, Rattus norvegicus
tagcaactcctttccattagcaaaa

SEQ ID NO: 557422 - DNA, 25 bp, Rattus norvegicus
tagcaactctccaatacctacaaag

SEQ ID NO: 557423 - DNA, 25 bp, Rattus norvegicus
tagcaactctcctatacctacaaag

SEQ ID NO: 557424 - DNA, 25 bp, Rattus norvegicus
tagcaactgtacctttcctctctga

SEQ ID NO: 557425 - DNA, 25 bp, Rattus norvegicus
tagcaactgtacgtttcctctctga

SEQ ID NO: 557426 - DNA, 25 bp, Rattus norvegicus
tagcaactgtctagcctgctggagc

SEQ ID NO: 557427 - DNA, 25 bp, Rattus norvegicus
tagcaactgtcttgcctgctggagc

SEQ ID NO: 557428 - DNA, 25 bp, Rattus norvegicus
tagcaagaactgattctggccccag

SEQ ID NO: 557429 - DNA, 25 bp, Rattus norvegicus
tagcaagaactgtttctggccccag

SEQ ID NO: 557430 - DNA, 25 bp, Rattus norvegicus
tagcaagacagccatcaccagatca

SEQ ID NO: 557431 - DNA, 25 bp, Rattus norvegicus
tagcaagacagcgatcaccagatca

SEQ ID NO: 557432 - DNA, 25 bp, Rattus norvegicus
tagcaagaggtcagccagcagcgaa

SEQ ID NO: 557433 - DNA, 25 bp, Rattus norvegicus
tagcaagaggtctgccagcagcgaa

SEQ ID NO: 557434 - DNA, 25 bp, Rattus norvegicus
tagcaagagtttctcttccaaaaaa

SEQ ID NO: 557435 - DNA, 25 bp, Rattus norvegicus
tagcaagagtttgtcttccaaaaaa

SEQ ID NO: 557436 - DNA, 25 bp, Rattus norvegicus
tagcaagatccacacgctcaagctg

SEQ ID NO: 557437 - DNA, 25 bp, Rattus norvegicus
tagcaagatccagacgctcaagctg

SEQ ID NO: 557438 - DNA, 25 bp, Rattus norvegicus
tagcaagatgacctcaaccctgatg

SEQ ID NO: 557439 - DNA, 25 bp, Rattus norvegicus
tagcaagatgacgtcaaccctgatg

SEQ ID NO: 557440 - DNA, 25 bp, Rattus norvegicus
tagcaagattctctgtgagctctgc

SEQ ID NO: 557441 - DNA, 25 bp, Rattus norvegicus
tagcaagattctgtgtgagctctgc

SEQ ID NO: 557442 - DNA, 25 bp, Rattus norvegicus
tagcaagattgcacatcaactgaat

SEQ ID NO: 557443 - DNA, 25 bp, Rattus norvegicus
tagcaagattgctcatcaactgaat

SEQ ID NO: 557444 - DNA, 25 bp, Rattus norvegicus
tagcaagccattatccctttaggag

SEQ ID NO: 557445 - DNA, 25 bp, Rattus norvegicus
tagcaagccattttccctttaggag

SEQ ID NO: 557446 - DNA, 25 bp, Rattus norvegicus
tagcaagcctggatctgtgccagtt

SEQ ID NO: 557447 - DNA, 25 bp, Rattus norvegicus
tagcaagcctggttctgtgccagtt

SEQ ID NO: 557448 - DNA, 25 bp, Rattus norvegicus
tagcaagccttcctatttctggaaa

SEQ ID NO: 557449 - DNA, 25 bp, Rattus norvegicus
tagcaagccttcgtatttctggaaa

SEQ ID NO: 557450 - DNA, 25 bp, Rattus norvegicus
tagcaagctgctatcaaccaaactt

SEQ ID NO: 557451 - DNA, 25 bp, Rattus norvegicus
tagcaagctgctttcaaccaaactt

SEQ ID NO: 557452 - DNA, 25 bp, Rattus norvegicus
tagcaaggcatccacgatcctctgg

SEQ ID NO: 557453 - DNA, 25 bp, Rattus norvegicus
tagcaaggcatcgacgatcctctgg

SEQ ID NO: 557454 - DNA, 25 bp, Rattus norvegicus
tagcaaggcctgaggttgagtctgt

SEQ ID NO: 557455 - DNA, 25 bp, Rattus norvegicus
tagcaaggcctgtggttgagtctgt

SEQ ID NO: 557456 - DNA, 25 bp, Rattus norvegicus
tagcaagggctgagcgacctgtgac

SEQ ID NO: 557457 - DNA, 25 bp, Rattus norvegicus
tagcaagggctgtgcgacctgtgac

SEQ ID NO: 557458 - DNA, 25 bp, Rattus norvegicus
tagcaagggtcaccgtgtttctcag

SEQ ID NO: 557459 - DNA, 25 bp, Rattus norvegicus
tagcaagggtcagcgtgtttctcag

SEQ ID NO: 557460 - DNA, 25 bp, Rattus norvegicus
tagcaagtactgagactcttcctgt

SEQ ID NO: 557461 - DNA, 25 bp, Rattus norvegicus
tagcaagtactgtgactcttcctgt

SEQ ID NO: 557462 - DNA, 25 bp, Rattus norvegicus
tagcaagtaggaactcagctgtctt

SEQ ID NO: 557463 - DNA, 25 bp, Rattus norvegicus
tagcaagtaggatctcagctgtctt

SEQ ID NO: 557464 - DNA, 25 bp, Rattus norvegicus
tagcaagtcctcagcagccatcagg

SEQ ID NO: 557465 - DNA, 25 bp, Rattus norvegicus
tagcaagtcctctgcagccatcagg

SEQ ID NO: 557466 - DNA, 25 bp, Rattus norvegicus
tagcaagtgcttatctttaggaccc

SEQ ID NO: 557467 - DNA, 25 bp, Rattus norvegicus
tagcaagtgcttttctttaggaccc

SEQ ID NO: 557468 - DNA, 25 bp, Rattus norvegicus
tagcaagtgggtctctggtttttac

SEQ ID NO: 557469 - DNA, 25 bp, Rattus norvegicus
tagcaagtgggtgtctggtttttac

SEQ ID NO: 557470 - DNA, 25 bp, Rattus norvegicus
tagcaagttaccacccagggaaggc

SEQ ID NO: 557471 - DNA, 25 bp, Rattus norvegicus
tagcaagttacctcccagggaaggc

SEQ ID NO: 557472 - DNA, 25 bp, Rattus norvegicus
tagcaagttagtctcgcccaggctt

SEQ ID NO: 557473 - DNA, 25 bp, Rattus norvegicus
tagcaagttagtgtcgcccaggctt

SEQ ID NO: 557474 - DNA, 25 bp, Rattus norvegicus
tagcaagttccacacttcccagggc

SEQ ID NO: 557475 - DNA, 25 bp, Rattus norvegicus
tagcaagttccagacttcccagggc

SEQ ID NO: 557476 - DNA, 25 bp, Rattus norvegicus
tagcaagttctgctccaaactcagg

SEQ ID NO: 557477 - DNA, 25 bp, Rattus norvegicus
tagcaagttctggtccaaactcagg

SEQ ID NO: 557478 - DNA, 25 bp, Rattus norvegicus
tagcaatactagatccgactcccat

SEQ ID NO: 557479 - DNA, 25 bp, Rattus norvegicus
tagcaatactagttccgactcccat

SEQ ID NO: 557480 - DNA, 25 bp, Rattus norvegicus
tagcaatagccacagttttacccca

SEQ ID NO: 557481 - DNA, 25 bp, Rattus norvegicus
tagcaatagccagagttttacccca

SEQ ID NO: 557482 - DNA, 25 bp, Rattus norvegicus
tagcaatccttgattgttagtcatc

SEQ ID NO: 557483 - DNA, 25 bp, Rattus norvegicus
tagcaatccttgtttgttagtcatc

SEQ ID NO: 557484 - DNA, 25 bp, Rattus norvegicus
tagcaatggagcagcgaggtgccct

SEQ ID NO: 557485 - DNA, 25 bp, Rattus norvegicus
tagcaatggagctgcgaggtgccct

SEQ ID NO: 557486 - DNA, 25 bp, Rattus norvegicus
tagcaatggatcagggtaaatactt

SEQ ID NO: 557487 - DNA, 25 bp, Rattus norvegicus
tagcaatggatctgggtaaatactt

SEQ ID NO: 557488 - DNA, 25 bp, Rattus norvegicus
tagcaatggcctaggaaacttcctt

SEQ ID NO: 557489 - DNA, 25 bp, Rattus norvegicus
tagcaatggccttggaaacttcctt

SEQ ID NO: 557490 - DNA, 25 bp, Rattus norvegicus
tagcaatgggctacctcttgtcaga

SEQ ID NO: 557491 - DNA, 25 bp, Rattus norvegicus
tagcaatgggcttcctcttgtcaga

SEQ ID NO: 557492 - DNA, 25 bp, Rattus norvegicus
tagcaattatttctagccccatttc

SEQ ID NO: 557493 - DNA, 25 bp, Rattus norvegicus
tagcaattatttgtagccccatttc

SEQ ID NO: 557494 - DNA, 25 bp, Rattus norvegicus
tagcaattcctgaatggccttcctt

SEQ ID NO: 557495 - DNA, 25 bp, Rattus norvegicus
tagcaattcctgtatggccttcctt

SEQ ID NO: 557496 - DNA, 25 bp, Rattus norvegicus
tagcaatttggaccgcactgggcat

SEQ ID NO: 557497 - DNA, 25 bp, Rattus norvegicus
tagcaatttggagcgcactgggcat

SEQ ID NO: 557498 - DNA, 25 bp, Rattus norvegicus
tagcaatttgttcactcgccacagt

SEQ ID NO: 557499 - DNA, 25 bp, Rattus norvegicus
tagcaatttgttgactcgccacagt

SEQ ID NO: 557500 - DNA, 25 bp, Rattus norvegicus
tagcacacacagcagtcttcaactt

SEQ ID NO: 557501 - DNA, 25 bp, Rattus norvegicus
tagcacacacaggagtcttcaactt

SEQ ID NO: 557502 - DNA, 25 bp, Rattus norvegicus
tagcacaccaaactttcacaatttt

SEQ ID NO: 557503 - DNA, 25 bp, Rattus norvegicus
tagcacaccaaagtttcacaatttt

SEQ ID NO: 557504 - DNA, 25 bp, Rattus norvegicus
tagcacaccaggctgtctttgaact

SEQ ID NO: 557505 - DNA, 25 bp, Rattus norvegicus
tagcacaccagggtgtctttgaact

SEQ ID NO: 557506 - DNA, 25 bp, Rattus norvegicus
tagcacacccagactgatctgcaga

SEQ ID NO: 557507 - DNA, 25 bp, Rattus norvegicus
tagcacacccagtctgatctgcaga

SEQ ID NO: 557508 - DNA, 25 bp, Rattus norvegicus
tagcacaccctcagggaaagaggaa

SEQ ID NO: 557509 - DNA, 25 bp, Rattus norvegicus
tagcacaccctctgggaaagaggaa

SEQ ID NO: 557510 - DNA, 25 bp, Rattus norvegicus
tagcacacgagacaggactcctgct

SEQ ID NO: 557511 - DNA, 25 bp, Rattus norvegicus
tagcacacgagagaggactcctgct

SEQ ID NO: 557512 - DNA, 25 bp, Rattus norvegicus
tagcacactgatattctcgagtcct

SEQ ID NO: 557513 - DNA, 25 bp, Rattus norvegicus
tagcacactgattttctcgagtcct

SEQ ID NO: 557514 - DNA, 25 bp, Rattus norvegicus
tagcacactgttcaattctcttaag

SEQ ID NO: 557515 - DNA, 25 bp, Rattus norvegicus
tagcacactgttgaattctcttaag

SEQ ID NO: 557516 - DNA, 25 bp, Rattus norvegicus
tagcacactttcacggtggactcat

SEQ ID NO: 557517 - DNA, 25 bp, Rattus norvegicus
tagcacactttctcggtggactcat

SEQ ID NO: 557518 - DNA, 25 bp, Rattus norvegicus
tagcacaggcttcagctccgatgta

SEQ ID NO: 557519 - DNA, 25 bp, Rattus norvegicus
tagcacaggcttgagctccgatgta

SEQ ID NO: 557520 - DNA, 25 bp, Rattus norvegicus
tagcacagtttgacactctggcctg

SEQ ID NO: 557521 - DNA, 25 bp, Rattus norvegicus
tagcacagtttgtcactctggcctg

SEQ ID NO: 557522 - DNA, 25 bp, Rattus norvegicus
tagcacatatgtatggtcccagcac

SEQ ID NO: 557523 - DNA, 25 bp, Rattus norvegicus
tagcacatatgtttggtcccagcac

SEQ ID NO: 557524 - DNA, 25 bp, Rattus norvegicus
tagcacatcaaaaggcttatgctct

SEQ ID NO: 557525 - DNA, 25 bp, Rattus norvegicus
tagcacatcaaatggcttatgctct

SEQ ID NO: 557526 - DNA, 25 bp, Rattus norvegicus
tagcacatcctgatgctgcacagca

SEQ ID NO: 557527 - DNA, 25 bp, Rattus norvegicus
tagcacatcctgttgctgcacagca

SEQ ID NO: 557528 - DNA, 25 bp, Rattus norvegicus
tagcacatctggctttttctggtaa

SEQ ID NO: 557529 - DNA, 25 bp, Rattus norvegicus
tagcacatctgggtttttctggtaa

SEQ ID NO: 557530 - DNA, 25 bp, Rattus norvegicus
tagcacatctgtctgttggtcccat

SEQ ID NO: 557531 - DNA, 25 bp, Rattus norvegicus
tagcacatctgtgtgttggtcccat

SEQ ID NO: 557532 - DNA, 25 bp, Rattus norvegicus
tagcacatgaaacgtaacacctgag

SEQ ID NO: 557533 - DNA, 25 bp, Rattus norvegicus
tagcacatgaaaggtaacacctgag

SEQ ID NO: 557534 - DNA, 25 bp, Rattus norvegicus
tagcacatgagccttgcccaagtgt

SEQ ID NO: 557535 - DNA, 25 bp, Rattus norvegicus
tagcacatgagcgttgcccaagtgt

SEQ ID NO: 557536 - DNA, 25 bp, Rattus norvegicus
tagcacatgtgcaaaggtcagagga

SEQ ID NO: 557537 - DNA, 25 bp, Rattus norvegicus
tagcacatgtgctaaggtcagagga

SEQ ID NO: 557538 - DNA, 25 bp, Rattus norvegicus
tagcaccaaaaacccaaatcatcca

SEQ ID NO: 557539 - DNA, 25 bp, Rattus norvegicus
tagcaccaaaaagccaaatcatcca

SEQ ID NO: 557540 - DNA, 25 bp, Rattus norvegicus
tagcaccaaccccaggagacaaaag

SEQ ID NO: 557541 - DNA, 25 bp, Rattus norvegicus
tagcaccaacccgaggagacaaaag

SEQ ID NO: 557542 - DNA, 25 bp, Rattus norvegicus
tagcaccaaggtatagtcacctctc

SEQ ID NO: 557543 - DNA, 25 bp, Rattus norvegicus
tagcaccaaggtttagtcacctctc

SEQ ID NO: 557544 - DNA, 25 bp, Rattus norvegicus
tagcaccaataactcctgctgctct

SEQ ID NO: 557545 - DNA, 25 bp, Rattus norvegicus
tagcaccaataagtcctgctgctct

SEQ ID NO: 557546 - DNA, 25 bp, Rattus norvegicus
tagcaccagaagcatatgccgcatt

SEQ ID NO: 557547 - DNA, 25 bp, Rattus norvegicus
tagcaccagaaggatatgccgcatt

SEQ ID NO: 557548 - DNA, 25 bp, Rattus norvegicus
tagcacccaacccagctaagattgg

SEQ ID NO: 557549 - DNA, 25 bp, Rattus norvegicus
tagcacccaaccgagctaagattgg

SEQ ID NO: 557550 - DNA, 25 bp, Rattus norvegicus
tagcacccacatcagatggtttcta

SEQ ID NO: 557551 - DNA, 25 bp, Rattus norvegicus
tagcacccacatgagatggtttcta

SEQ ID NO: 557552 - DNA, 25 bp, Rattus norvegicus
tagcacccactaagtagaccagctt

SEQ ID NO: 557553 - DNA, 25 bp, Rattus norvegicus
tagcacccactatgtagaccagctt

SEQ ID NO: 557554 - DNA, 25 bp, Rattus norvegicus
tagcacccatgtaaaatccaagcgt

SEQ ID NO: 557555 - DNA, 25 bp, Rattus norvegicus
tagcacccatgttaaatccaagcgt

SEQ ID NO: 557556 - DNA, 25 bp, Rattus norvegicus
tagcacccgagtaccgggagcggat

SEQ ID NO: 557557 - DNA, 25 bp, Rattus norvegicus
tagcacccgagttccgggagcggat

SEQ ID NO: 557558 - DNA, 25 bp, Rattus norvegicus
tagcaccctcctctggactgacaag

SEQ ID NO: 557559 - DNA, 25 bp, Rattus norvegicus
tagcaccctcctgtggactgacaag

SEQ ID NO: 557560 - DNA, 25 bp, Rattus norvegicus
tagcaccctcggcaactttgtaggg

SEQ ID NO: 557561 - DNA, 25 bp, Rattus norvegicus
tagcaccctcgggaactttgtaggg

SEQ ID NO: 557562 - DNA, 25 bp, Rattus norvegicus
tagcaccctcttctgaatgcctggg

SEQ ID NO: 557563 - DNA, 25 bp, Rattus norvegicus
tagcaccctcttgtgaatgcctggg

SEQ ID NO: 557564 - DNA, 25 bp, Rattus norvegicus
tagcaccctgcgcatgttcgtatca

SEQ ID NO: 557565 - DNA, 25 bp, Rattus norvegicus
tagcaccctgcggatgttcgtatca

SEQ ID NO: 557566 - DNA, 25 bp, Rattus norvegicus
tagcaccctgggaaatggccacata

SEQ ID NO: 557567 - DNA, 25 bp, Rattus norvegicus
tagcaccctgggtaatggccacata

SEQ ID NO: 557568 - DNA, 25 bp, Rattus norvegicus
tagcacccttgtcagatgactctga

SEQ ID NO: 557569 - DNA, 25 bp, Rattus norvegicus
tagcacccttgtgagatgactctga

SEQ ID NO: 557570 - DNA, 25 bp, Rattus norvegicus
tagcaccgtcctagttttcagctca

SEQ ID NO: 557571 - DNA, 25 bp, Rattus norvegicus
tagcaccgtccttgttttcagctca

SEQ ID NO: 557572 - DNA, 25 bp, Rattus norvegicus
tagcacctacgcacacaggtttggg

SEQ ID NO: 557573 - DNA, 25 bp, Rattus norvegicus
tagcacctacgctcacaggtttggg

SEQ ID NO: 557574 - DNA, 25 bp, Rattus norvegicus
tagcacctagaccacatacttgatc

SEQ ID NO: 557575 - DNA, 25 bp, Rattus norvegicus
tagcacctagacgacatacttgatc

SEQ ID NO: 557576 - DNA, 25 bp, Rattus norvegicus
tagcacctgagaagccctagccggt

SEQ ID NO: 557577 - DNA, 25 bp, Rattus norvegicus
tagcacctgagatgccctagccggt

SEQ ID NO: 557578 - DNA, 25 bp, Rattus norvegicus
tagcacctggtgattttgctcctga

SEQ ID NO: 557579 - DNA, 25 bp, Rattus norvegicus
tagcacctggtgtttttgctcctga

SEQ ID NO: 557580 - DNA, 25 bp, Rattus norvegicus
tagcacctgtatcttactagagccc

SEQ ID NO: 557581 - DNA, 25 bp, Rattus norvegicus
tagcacctgtatgttactagagccc

SEQ ID NO: 557582 - DNA, 25 bp, Rattus norvegicus
tagcacgaagccattctgttatcca

SEQ ID NO: 557583 - DNA, 25 bp, Rattus norvegicus
tagcacgaagcctttctgttatcca

SEQ ID NO: 557584 - DNA, 25 bp, Rattus norvegicus
tagcacgaaggtcctcttggccgag

SEQ ID NO: 557585 - DNA, 25 bp, Rattus norvegicus
tagcacgaaggtgctcttggccgag

SEQ ID NO: 557586 - DNA, 25 bp, Rattus norvegicus
tagcacgacccgcttgtaagactga

SEQ ID NO: 557587 - DNA, 25 bp, Rattus norvegicus
tagcacgacccggttgtaagactga

SEQ ID NO: 557588 - DNA, 25 bp, Rattus norvegicus
tagcacgcacccatgagagcagaga

SEQ ID NO: 557589 - DNA, 25 bp, Rattus norvegicus
tagcacgcacccttgagagcagaga

SEQ ID NO: 557590 - DNA, 25 bp, Rattus norvegicus
tagcacgccgtgactgtgggcaagc

SEQ ID NO: 557591 - DNA, 25 bp, Rattus norvegicus
tagcacgccgtgtctgtgggcaagc

SEQ ID NO: 557592 - DNA, 25 bp, Rattus norvegicus
tagcacgcttcacctgtttacagat

SEQ ID NO: 557593 - DNA, 25 bp, Rattus norvegicus
tagcacgcttcactgctgagccgag

SEQ ID NO: 557594 - DNA, 25 bp, Rattus norvegicus
tagcacgcttcagctgtttacagat

SEQ ID NO: 557595 - DNA, 25 bp, Rattus norvegicus
tagcacgcttcagtgctgagccgag

SEQ ID NO: 557596 - DNA, 25 bp, Rattus norvegicus
tagcacggagctctaaccaactggt

SEQ ID NO: 557597 - DNA, 25 bp, Rattus norvegicus
tagcacggagctgtaaccaactggt

SEQ ID NO: 557598 - DNA, 25 bp, Rattus norvegicus
tagcacggaggcatgctcagatcct

SEQ ID NO: 557599 - DNA, 25 bp, Rattus norvegicus
tagcacggaggcttgctcagatcct

SEQ ID NO: 557600 - DNA, 25 bp, Rattus norvegicus
tagcacggtctcagactccaaggat

SEQ ID NO: 557601 - DNA, 25 bp, Rattus norvegicus
tagcacggtctctgactccaaggat

SEQ ID NO: 557602 - DNA, 25 bp, Rattus norvegicus
tagcacgtaaccaggtggcagccga

SEQ ID NO: 557603 - DNA, 25 bp, Rattus norvegicus
tagcacgtaacctggtggcagccga

SEQ ID NO: 557604 - DNA, 25 bp, Rattus norvegicus
tagcacgtgtggaccacctaatgaa

SEQ ID NO: 557605 - DNA, 25 bp, Rattus norvegicus
tagcacgtgtggattccctgtggca

SEQ ID NO: 557606 - DNA, 25 bp, Rattus norvegicus
tagcacgtgtggtccacctaatgaa

SEQ ID NO: 557607 - DNA, 25 bp, Rattus norvegicus
tagcacgtgtggtttccctgtggca

SEQ ID NO: 557608 - DNA, 25 bp, Rattus norvegicus
tagcactaactcacttcagcaaagg

SEQ ID NO: 557609 - DNA, 25 bp, Rattus norvegicus
tagcactaactctcttcagcaaagg

SEQ ID NO: 557610 - DNA, 25 bp, Rattus norvegicus
tagcactacaaacctctgagttcag

SEQ ID NO: 557611 - DNA, 25 bp, Rattus norvegicus
tagcactacaaagctctgagttcag

SEQ ID NO: 557612 - DNA, 25 bp, Rattus norvegicus
tagcactaggctcaggcgttaacct

SEQ ID NO: 557613 - DNA, 25 bp, Rattus norvegicus
tagcactaggctgaggcgttaacct

SEQ ID NO: 557614 - DNA, 25 bp, Rattus norvegicus
tagcactaggtcagtatcctccagt

SEQ ID NO: 557615 - DNA, 25 bp, Rattus norvegicus
tagcactaggtctgtatcctccagt

SEQ ID NO: 557616 - DNA, 25 bp, Rattus norvegicus
tagcactaggttcacagccctctgc

SEQ ID NO: 557617 - DNA, 25 bp, Rattus norvegicus
tagcactaggttgacagccctctgc

SEQ ID NO: 557618 - DNA, 25 bp, Rattus norvegicus
tagcactcaaatcgcggcttgcaac

SEQ ID NO: 557619 - DNA, 25 bp, Rattus norvegicus
tagcactcaaatggcggcttgcaac

SEQ ID NO: 557620 - DNA, 25 bp, Rattus norvegicus
tagcactcacagaacaaacccagct

SEQ ID NO: 557621 - DNA, 25 bp, Rattus norvegicus
tagcactcacagtacaaacccagct

SEQ ID NO: 557622 - DNA, 25 bp, Rattus norvegicus
tagcactcagtgaggtagtcccctg

SEQ ID NO: 557623 - DNA, 25 bp, Rattus norvegicus
tagcactcagtgtggtagtcccctg

SEQ ID NO: 557624 - DNA, 25 bp, Rattus norvegicus
tagcactccaagaaagcagcctcgg

SEQ ID NO: 557625 - DNA, 25 bp, Rattus norvegicus
tagcactccaagtaagcagcctcgg

SEQ ID NO: 557626 - DNA, 25 bp, Rattus norvegicus
tagcactccaggcaagccaggctgc

SEQ ID NO: 557627 - DNA, 25 bp, Rattus norvegicus
tagcactccagggaagccaggctgc

SEQ ID NO: 557628 - DNA, 25 bp, Rattus norvegicus
tagcactcgaggctgtacgttcatc

SEQ ID NO: 557629 - DNA, 25 bp, Rattus norvegicus
tagcactcgagggtgtacgttcatc

SEQ ID NO: 557630 - DNA, 25 bp, Rattus norvegicus
tagcactgacagattcctatccaag

SEQ ID NO: 557631 - DNA, 25 bp, Rattus norvegicus
tagcactgacagtttcctatccaag

SEQ ID NO: 557632 - DNA, 25 bp, Rattus norvegicus
tagcactgaggaagcttgtcccctt

SEQ ID NO: 557633 - DNA, 25 bp, Rattus norvegicus
tagcactgaggatgcttgtcccctt

SEQ ID NO: 557634 - DNA, 25 bp, Rattus norvegicus
tagcactgatttattcggtcccttt

SEQ ID NO: 557635 - DNA, 25 bp, Rattus norvegicus
tagcactgattttttcggtcccttt

SEQ ID NO: 557636 - DNA, 25 bp, Rattus norvegicus
tagcactgcaggaaagaaaccacaa

SEQ ID NO: 557637 - DNA, 25 bp, Rattus norvegicus
tagcactgcaggtaagaaaccacaa

SEQ ID NO: 557638 - DNA, 25 bp, Rattus norvegicus
tagcactgcgagatgcacttctgaa

SEQ ID NO: 557639 - DNA, 25 bp, Rattus norvegicus
tagcactgcgagttgcacttctgaa

SEQ ID NO: 557640 - DNA, 25 bp, Rattus norvegicus
tagcactgctaaacaaagtacggag

SEQ ID NO: 557641 - DNA, 25 bp, Rattus norvegicus
tagcactgctaatcaaagtacggag

SEQ ID NO: 557642 - DNA, 25 bp, Rattus norvegicus
tagcactggctcagctttaactgtc

SEQ ID NO: 557643 - DNA, 25 bp, Rattus norvegicus
tagcactggctctgctttaactgtc

SEQ ID NO: 557644 - DNA, 25 bp, Rattus norvegicus
tagcactgggtacgcagagacactt

SEQ ID NO: 557645 - DNA, 25 bp, Rattus norvegicus
tagcactgggtaggcagagacactt

SEQ ID NO: 557646 - DNA, 25 bp, Rattus norvegicus
tagcactgtggtcaccagggtaccc

SEQ ID NO: 557647 - DNA, 25 bp, Rattus norvegicus
tagcactgtggtgaccagggtaccc

SEQ ID NO: 557648 - DNA, 25 bp, Rattus norvegicus
tagcactgtgtaagccatcccagac

SEQ ID NO: 557649 - DNA, 25 bp, Rattus norvegicus
tagcactgtgtatgccatcccagac

SEQ ID NO: 557650 - DNA, 25 bp, Rattus norvegicus
tagcactgtgtccaaaactactctt

SEQ ID NO: 557651 - DNA, 25 bp, Rattus norvegicus
tagcactgtgtcgaaaactactctt

SEQ ID NO: 557652 - DNA, 25 bp, Rattus norvegicus
tagcactgttggaatttgtttcctt

SEQ ID NO: 557653 - DNA, 25 bp, Rattus norvegicus
tagcactgttggtatttgtttcctt

SEQ ID NO: 557654 - DNA, 25 bp, Rattus norvegicus
tagcacttacccagggcagctcaca

SEQ ID NO: 557655 - DNA, 25 bp, Rattus norvegicus
tagcacttaccctgggcagctcaca

SEQ ID NO: 557656 - DNA, 25 bp, Rattus norvegicus
tagcacttactgaaggtgtcatctt

SEQ ID NO: 557657 - DNA, 25 bp, Rattus norvegicus
tagcacttactgtaggtgtcatctt

SEQ ID NO: 557658 - DNA, 25 bp, Rattus norvegicus
tagcacttagtaaccacctggctgg

SEQ ID NO: 557659 - DNA, 25 bp, Rattus norvegicus
tagcacttagtatccacctggctgg

SEQ ID NO: 557660 - DNA, 25 bp, Rattus norvegicus
tagcacttcactctccaggctgcag

SEQ ID NO: 557661 - DNA, 25 bp, Rattus norvegicus
tagcacttcactgtccaggctgcag

SEQ ID NO: 557662 - DNA, 25 bp, Rattus norvegicus
tagcacttctaaatgtacatccatg

SEQ ID NO: 557663 - DNA, 25 bp, Rattus norvegicus
tagcacttctaattgtacatccatg

SEQ ID NO: 557664 - DNA, 25 bp, Rattus norvegicus
tagcacttctgcactaaagacctgg

SEQ ID NO: 557665 - DNA, 25 bp, Rattus norvegicus
tagcacttctgctctaaagacctgg

SEQ ID NO: 557666 - DNA, 25 bp, Rattus norvegicus
tagcacttctttcttctctaattgt

SEQ ID NO: 557667 - DNA, 25 bp, Rattus norvegicus
tagcacttctttgttctctaattgt

SEQ ID NO: 557668 - DNA, 25 bp, Rattus norvegicus
tagcacttgatgcaggactgcctct

SEQ ID NO: 557669 - DNA, 25 bp, Rattus norvegicus
tagcacttgatggaggactgcctct

SEQ ID NO: 557670 - DNA, 25 bp, Rattus norvegicus
tagcactttctactccttggcctag

SEQ ID NO: 557671 - DNA, 25 bp, Rattus norvegicus
tagcactttctagtccttggcctag

SEQ ID NO: 557672 - DNA, 25 bp, Rattus norvegicus
tagcagaagtacagccaggcccaat

SEQ ID NO: 557673 - DNA, 25 bp, Rattus norvegicus
tagcagaagtactgccaggcccaat

SEQ ID NO: 557674 - DNA, 25 bp, Rattus norvegicus
tagcagacactcaaatttcatcatc

SEQ ID NO: 557675 - DNA, 25 bp, Rattus norvegicus
tagcagacactctaatttcatcatc

SEQ ID NO: 557676 - DNA, 25 bp, Rattus norvegicus
tagcagacactgacctttgaaggag

SEQ ID NO: 557677 - DNA, 25 bp, Rattus norvegicus
tagcagacactgtcctttgaaggag

SEQ ID NO: 557678 - DNA, 25 bp, Rattus norvegicus
tagcagacagccagaaagaccagaa

SEQ ID NO: 557679 - DNA, 25 bp, Rattus norvegicus
tagcagacagcctgaaagaccagaa

SEQ ID NO: 557680 - DNA, 25 bp, Rattus norvegicus
tagcagaccagaactctcagcagtt

SEQ ID NO: 557681 - DNA, 25 bp, Rattus norvegicus
tagcagaccagatctctcagcagtt

SEQ ID NO: 557682 - DNA, 25 bp, Rattus norvegicus
tagcagaccaggagcatcccttttt

SEQ ID NO: 557683 - DNA, 25 bp, Rattus norvegicus
tagcagaccaggtgcatcccttttt

SEQ ID NO: 557684 - DNA, 25 bp, Rattus norvegicus
tagcagacgttcaagtcctgtggcc

SEQ ID NO: 557685 - DNA, 25 bp, Rattus norvegicus
tagcagacgttctagtcctgtggcc

SEQ ID NO: 557686 - DNA, 25 bp, Rattus norvegicus
tagcagactgcacatgcttcacctg

SEQ ID NO: 557687 - DNA, 25 bp, Rattus norvegicus
tagcagactgcagatgcttcacctg

SEQ ID NO: 557688 - DNA, 25 bp, Rattus norvegicus
tagcagactggcacactgctgttcc

SEQ ID NO: 557689 - DNA, 25 bp, Rattus norvegicus
tagcagactggctcactgctgttcc

SEQ ID NO: 557690 - DNA, 25 bp, Rattus norvegicus
tagcagaggcccattggcttcttac

SEQ ID NO: 557691 - DNA, 25 bp, Rattus norvegicus
tagcagaggccctttggcttcttac

SEQ ID NO: 557692 - DNA, 25 bp, Rattus norvegicus
tagcagagtccacaccaaggtgcgt

SEQ ID NO: 557693 - DNA, 25 bp, Rattus norvegicus
tagcagagtccagaccaaggtgcgt

SEQ ID NO: 557694 - DNA, 25 bp, Rattus norvegicus
tagcagataacaccctgctgcttgt

SEQ ID NO: 557695 - DNA, 25 bp, Rattus norvegicus
tagcagataacagcctgctgcttgt

SEQ ID NO: 557696 - DNA, 25 bp, Rattus norvegicus
tagcagatcctaaagcaaaccttat

SEQ ID NO: 557697 - DNA, 25 bp, Rattus norvegicus
tagcagatcctatagcaaaccttat

SEQ ID NO: 557698 - DNA, 25 bp, Rattus norvegicus
tagcagatggctactttccctaata

SEQ ID NO: 557699 - DNA, 25 bp, Rattus norvegicus
tagcagatggcttctttccctaata

SEQ ID NO: 557700 - DNA, 25 bp, Rattus norvegicus
tagcagattatgatgtctccaatta

SEQ ID NO: 557701 - DNA, 25 bp, Rattus norvegicus
tagcagattatgttgtctccaatta

SEQ ID NO: 557702 - DNA, 25 bp, Rattus norvegicus
tagcagattcttacactccagtggc

SEQ ID NO: 557703 - DNA, 25 bp, Rattus norvegicus
tagcagattctttcactccagtggc

SEQ ID NO: 557704 - DNA, 25 bp, Rattus norvegicus
tagcagattgcccatgccagagtct

SEQ ID NO: 557705 - DNA, 25 bp, Rattus norvegicus
tagcagattgccgatgccagagtct

SEQ ID NO: 557706 - DNA, 25 bp, Rattus norvegicus
tagcagattggaactcttctcccat

SEQ ID NO: 557707 - DNA, 25 bp, Rattus norvegicus
tagcagattggatctcttctcccat

SEQ ID NO: 557708 - DNA, 25 bp, Rattus norvegicus
tagcagcaagtgctccctttggagt

SEQ ID NO: 557709 - DNA, 25 bp, Rattus norvegicus
tagcagcaagtggtccctttggagt

SEQ ID NO: 557710 - DNA, 25 bp, Rattus norvegicus
tagcagcaatatatcagcgtcttcc

SEQ ID NO: 557711 - DNA, 25 bp, Rattus norvegicus
tagcagcaatatttcagcgtcttcc

SEQ ID NO: 557712 - DNA, 25 bp, Rattus norvegicus
tagcagcaattcagactggaccgtc

SEQ ID NO: 557713 - DNA, 25 bp, Rattus norvegicus
tagcagcaattctgactggaccgtc

SEQ ID NO: 557714 - DNA, 25 bp, Rattus norvegicus
tagcagcaccagcatctctgatgtt

SEQ ID NO: 557715 - DNA, 25 bp, Rattus norvegicus
tagcagcaccaggatctctgatgtt

SEQ ID NO: 557716 - DNA, 25 bp, Rattus norvegicus
tagcagcaccatccggttcttcaag

SEQ ID NO: 557717 - DNA, 25 bp, Rattus norvegicus
tagcagcaccatgcggttcttcaag

SEQ ID NO: 557718 - DNA, 25 bp, Rattus norvegicus
tagcagcaccctcttgacatgagtg

SEQ ID NO: 557719 - DNA, 25 bp, Rattus norvegicus
tagcagcaccctgttgacatgagtg

SEQ ID NO: 557720 - DNA, 25 bp, Rattus norvegicus
tagcagcactagagctgtgccccag

SEQ ID NO: 557721 - DNA, 25 bp, Rattus norvegicus
tagcagcactagtgctgtgccccag

SEQ ID NO: 557722 - DNA, 25 bp, Rattus norvegicus
tagcagcagagcaggctgagggctc

SEQ ID NO: 557723 - DNA, 25 bp, Rattus norvegicus
tagcagcagagctggctgagggctc

SEQ ID NO: 557724 - DNA, 25 bp, Rattus norvegicus
tagcagcaggagacttggatcacat

SEQ ID NO: 557725 - DNA, 25 bp, Rattus norvegicus
tagcagcaggagtcttggatcacat

SEQ ID NO: 557726 - DNA, 25 bp, Rattus norvegicus
tagcagcagtggagggtggcccagc

SEQ ID NO: 557727 - DNA, 25 bp, Rattus norvegicus
tagcagcagtggtgggtggcccagc

SEQ ID NO: 557728 - DNA, 25 bp, Rattus norvegicus
tagcagccacagcatccaagacctc

SEQ ID NO: 557729 - DNA, 25 bp, Rattus norvegicus
tagcagccacaggatccaagacctc

SEQ ID NO: 557730 - DNA, 25 bp, Rattus norvegicus
tagcagccagccctctggagaatag

SEQ ID NO: 557731 - DNA, 25 bp, Rattus norvegicus
tagcagccagccgtctggagaatag

SEQ ID NO: 557732 - DNA, 25 bp, Rattus norvegicus
tagcagccagctccaggccttggag

SEQ ID NO: 557733 - DNA, 25 bp, Rattus norvegicus
tagcagccagctgcaggccttggag

SEQ ID NO: 557734 - DNA, 25 bp, Rattus norvegicus
tagcagccatgcaggcttagggaaa

SEQ ID NO: 557735 - DNA, 25 bp, Rattus norvegicus
tagcagccatgctggcttagggaaa

SEQ ID NO: 557736 - DNA, 25 bp, Rattus norvegicus
tagcagccattcacctgaggtaaga

SEQ ID NO: 557737 - DNA, 25 bp, Rattus norvegicus
tagcagccattctcctgaggtaaga

SEQ ID NO: 557738 - DNA, 25 bp, Rattus norvegicus
tagcagccgcccactgaggatgcca

SEQ ID NO: 557739 - DNA, 25 bp, Rattus norvegicus
tagcagccgccctctgaggatgcca

SEQ ID NO: 557740 - DNA, 25 bp, Rattus norvegicus
tagcagccgctaaagaagtcctctc

SEQ ID NO: 557741 - DNA, 25 bp, Rattus norvegicus
tagcagccgctatagaagtcctctc

SEQ ID NO: 557742 - DNA, 25 bp, Rattus norvegicus
tagcagcctccactagcaagacaaa

SEQ ID NO: 557743 - DNA, 25 bp, Rattus norvegicus
tagcagcctccagtagcaagacaaa

SEQ ID NO: 557744 - DNA, 25 bp, Rattus norvegicus
tagcagcctgcactgttagccagct

SEQ ID NO: 557745 - DNA, 25 bp, Rattus norvegicus
tagcagcctgcagtgttagccagct

SEQ ID NO: 557746 - DNA, 25 bp, Rattus norvegicus
tagcagcctggtattggagtatagc

SEQ ID NO: 557747 - DNA, 25 bp, Rattus norvegicus
tagcagcctggttttggagtatagc

SEQ ID NO: 557748 - DNA, 25 bp, Rattus norvegicus
tagcagcgcgcacaaggtggtgggc

SEQ ID NO: 557749 - DNA, 25 bp, Rattus norvegicus
tagcagcgcgcagaaggtggtgggc

SEQ ID NO: 557750 - DNA, 25 bp, Rattus norvegicus
tagcagcggcagatacattttggaa

SEQ ID NO: 557751 - DNA, 25 bp, Rattus norvegicus
tagcagcggcagttacattttggaa

SEQ ID NO: 557752 - DNA, 25 bp, Rattus norvegicus
tagcagcgtattaatttttgctgtg

SEQ ID NO: 557753 - DNA, 25 bp, Rattus norvegicus
tagcagcgtatttatttttgctgtg

SEQ ID NO: 557754 - DNA, 25 bp, Rattus norvegicus
tagcagcgtcggcacacgaagtcgc

SEQ ID NO: 557755 - DNA, 25 bp, Rattus norvegicus
tagcagcgtcgggacacgaagtcgc

SEQ ID NO: 557756 - DNA, 25 bp, Rattus norvegicus
tagcagctcctacgatggcagtgac

SEQ ID NO: 557757 - DNA, 25 bp, Rattus norvegicus
tagcagctcctaggatggcagtgac

SEQ ID NO: 557758 - DNA, 25 bp, Rattus norvegicus
tagcagctctggctggtcaactcaa

SEQ ID NO: 557759 - DNA, 25 bp, Rattus norvegicus
tagcagctctgggtggtcaactcaa

SEQ ID NO: 557760 - DNA, 25 bp, Rattus norvegicus
tagcagctctgtcacaaaccctctt

SEQ ID NO: 557761 - DNA, 25 bp, Rattus norvegicus
tagcagctctgtgacaaaccctctt

SEQ ID NO: 557762 - DNA, 25 bp, Rattus norvegicus
tagcagctgaggctggcttgcccct

SEQ ID NO: 557763 - DNA, 25 bp, Rattus norvegicus
tagcagctgagggtggcttgcccct

SEQ ID NO: 557764 - DNA, 25 bp, Rattus norvegicus
tagcagctgctcatactgcagtcaa

SEQ ID NO: 557765 - DNA, 25 bp, Rattus norvegicus
tagcagctgctcttactgcagtcaa

SEQ ID NO: 557766 - DNA, 25 bp, Rattus norvegicus
tagcagctgctgacataccaatgtg

SEQ ID NO: 557767 - DNA, 25 bp, Rattus norvegicus
tagcagctgctgtcataccaatgtg

SEQ ID NO: 557768 - DNA, 25 bp, Rattus norvegicus
tagcagctggttctctaatgccctg

SEQ ID NO: 557769 - DNA, 25 bp, Rattus norvegicus
tagcagctggttgtctaatgccctg

SEQ ID NO: 557770 - DNA, 25 bp, Rattus norvegicus
tagcagctgtgtagccagcagagct

SEQ ID NO: 557771 - DNA, 25 bp, Rattus norvegicus
tagcagctgtgttgccagcagagct

SEQ ID NO: 557772 - DNA, 25 bp, Rattus norvegicus
tagcagcttcagagagcctcgcagt

SEQ ID NO: 557773 - DNA, 25 bp, Rattus norvegicus
tagcagcttcagtgagcctcgcagt

SEQ ID NO: 557774 - DNA, 25 bp, Rattus norvegicus
tagcagcttcctcagtgtactactg

SEQ ID NO: 557775 - DNA, 25 bp, Rattus norvegicus
tagcagcttcctgagtgtactactg

SEQ ID NO: 557776 - DNA, 25 bp, Rattus norvegicus
tagcagcttgcgcaaacagaacctt

SEQ ID NO: 557777 - DNA, 25 bp, Rattus norvegicus
tagcagcttgcggaaacagaacctt

SEQ ID NO: 557778 - DNA, 25 bp, Rattus norvegicus
tagcaggaagagcttctctgcgtct

SEQ ID NO: 557779 - DNA, 25 bp, Rattus norvegicus
tagcaggaagaggttctctgcgtct

SEQ ID NO: 557780 - DNA, 25 bp, Rattus norvegicus
tagcaggaagcgcagtcggcatctc

SEQ ID NO: 557781 - DNA, 25 bp, Rattus norvegicus
tagcaggaagcggagtcggcatctc

SEQ ID NO: 557782 - DNA, 25 bp, Rattus norvegicus
tagcaggagaaacacatacagatgg

SEQ ID NO: 557783 - DNA, 25 bp, Rattus norvegicus
tagcaggagaaagacatacagatgg

SEQ ID NO: 557784 - DNA, 25 bp, Rattus norvegicus
tagcaggagagaagctccccactga

SEQ ID NO: 557785 - DNA, 25 bp, Rattus norvegicus
tagcaggagagatgctccccactga

SEQ ID NO: 557786 - DNA, 25 bp, Rattus norvegicus
tagcaggagagtcatctagatccat

SEQ ID NO: 557787 - DNA, 25 bp, Rattus norvegicus
tagcaggagagtgatctagatccat

SEQ ID NO: 557788 - DNA, 25 bp, Rattus norvegicus
tagcaggaggcacttgtcatgatga

SEQ ID NO: 557789 - DNA, 25 bp, Rattus norvegicus
tagcaggaggcagttgtcatgatga

SEQ ID NO: 557790 - DNA, 25 bp, Rattus norvegicus
tagcaggatctgctctctctagacc

SEQ ID NO: 557791 - DNA, 25 bp, Rattus norvegicus
tagcaggatctggtctctctagacc

SEQ ID NO: 557792 - DNA, 25 bp, Rattus norvegicus
tagcaggcaaatacccatcagaacc

SEQ ID NO: 557793 - DNA, 25 bp, Rattus norvegicus
tagcaggcaaattcccatcagaacc

SEQ ID NO: 557794 - DNA, 25 bp, Rattus norvegicus
tagcaggcacctctgttctttattc

SEQ ID NO: 557795 - DNA, 25 bp, Rattus norvegicus
tagcaggcacctgtgttctttattc

SEQ ID NO: 557796 - DNA, 25 bp, Rattus norvegicus
tagcaggcagcccagtaatgtgatc

SEQ ID NO: 557797 - DNA, 25 bp, Rattus norvegicus
tagcaggcagccgagtaatgtgatc

SEQ ID NO: 557798 - DNA, 25 bp, Rattus norvegicus
tagcaggccctaaagcagatcttaa

SEQ ID NO: 557799 - DNA, 25 bp, Rattus norvegicus
tagcaggccctatagcagatcttaa

SEQ ID NO: 557800 - DNA, 25 bp, Rattus norvegicus
tagcaggccttaacgtttatatatc

SEQ ID NO: 557801 - DNA, 25 bp, Rattus norvegicus
tagcaggccttatcgtttatatatc

SEQ ID NO: 557802 - DNA, 25 bp, Rattus norvegicus
tagcaggcgcccaagaggacttgga

SEQ ID NO: 557803 - DNA, 25 bp, Rattus norvegicus
tagcaggcgccctagaggacttgga

SEQ ID NO: 557804 - DNA, 25 bp, Rattus norvegicus
tagcaggcgtgcagatccaggcatc

SEQ ID NO: 557805 - DNA, 25 bp, Rattus norvegicus
tagcaggcgtgctgatccaggcatc

SEQ ID NO: 557806 - DNA, 25 bp, Rattus norvegicus
tagcaggctctcaggtatataaact

SEQ ID NO: 557807 - DNA, 25 bp, Rattus norvegicus
tagcaggctctctggtatataaact

SEQ ID NO: 557808 - DNA, 25 bp, Rattus norvegicus
tagcaggctgacaagagaacaccca

SEQ ID NO: 557809 - DNA, 25 bp, Rattus norvegicus
tagcaggctgactagagaacaccca

SEQ ID NO: 557810 - DNA, 25 bp, Rattus norvegicus
tagcaggctgccattttagaaatca

SEQ ID NO: 557811 - DNA, 25 bp, Rattus norvegicus
tagcaggctgcctttttagaaatca

SEQ ID NO: 557812 - DNA, 25 bp, Rattus norvegicus
tagcagggccaactctgaggcaccc

SEQ ID NO: 557813 - DNA, 25 bp, Rattus norvegicus
tagcagggccaagtctgaggcaccc

SEQ ID NO: 557814 - DNA, 25 bp, Rattus norvegicus
tagcagggcctgacctggcagcacc

SEQ ID NO: 557815 - DNA, 25 bp, Rattus norvegicus
tagcagggcctgtcctggcagcacc

SEQ ID NO: 557816 - DNA, 25 bp, Rattus norvegicus
tagcagggccttcggtccagcagta

SEQ ID NO: 557817 - DNA, 25 bp, Rattus norvegicus
tagcagggccttgggtccagcagta

SEQ ID NO: 557818 - DNA, 25 bp, Rattus norvegicus
tagcaggtatttccgatgccctgtt

SEQ ID NO: 557819 - DNA, 25 bp, Rattus norvegicus
tagcaggtatttgcgatgccctgtt

SEQ ID NO: 557820 - DNA, 25 bp, Rattus norvegicus
tagcaggtcatcacagccaaaggcc

SEQ ID NO: 557821 - DNA, 25 bp, Rattus norvegicus
tagcaggtcatctcagccaaaggcc

SEQ ID NO: 557822 - DNA, 25 bp, Rattus norvegicus
tagcaggtccagctcgagttcccag

SEQ ID NO: 557823 - DNA, 25 bp, Rattus norvegicus
tagcaggtccaggtcgagttcccag

SEQ ID NO: 557824 - DNA, 25 bp, Rattus norvegicus
tagcaggtcctgaagagccttgcaa

SEQ ID NO: 557825 - DNA, 25 bp, Rattus norvegicus
tagcaggtcctgtagagccttgcaa

SEQ ID NO: 557826 - DNA, 25 bp, Rattus norvegicus
tagcaggtctgtcttctataccctt

SEQ ID NO: 557827 - DNA, 25 bp, Rattus norvegicus
tagcaggtctgtgttctataccctt

SEQ ID NO: 557828 - DNA, 25 bp, Rattus norvegicus
tagcaggtcttgaaagttttggtac

SEQ ID NO: 557829 - DNA, 25 bp, Rattus norvegicus
tagcaggtcttgtaagttttggtac

SEQ ID NO: 557830 - DNA, 25 bp, Rattus norvegicus
tagcagtacctccagttctatgcat

SEQ ID NO: 557831 - DNA, 25 bp, Rattus norvegicus
tagcagtacctcgagttctatgcat

SEQ ID NO: 557832 - DNA, 25 bp, Rattus norvegicus
tagcagtacctgaacgcccaggtag

SEQ ID NO: 557833 - DNA, 25 bp, Rattus norvegicus
tagcagtacctgacgggaatttcca

SEQ ID NO: 557834 - DNA, 25 bp, Rattus norvegicus
tagcagtacctgtacgcccaggtag

SEQ ID NO: 557835 - DNA, 25 bp, Rattus norvegicus
tagcagtacctgtcgggaatttcca

SEQ ID NO: 557836 - DNA, 25 bp, Rattus norvegicus
tagcagtagatacgccgtttctctc

SEQ ID NO: 557837 - DNA, 25 bp, Rattus norvegicus
tagcagtagataggccgtttctctc

SEQ ID NO: 557838 - DNA, 25 bp, Rattus norvegicus
tagcagtattgtacgttctgatatg

SEQ ID NO: 557839 - DNA, 25 bp, Rattus norvegicus
tagcagtattgttcgttctgatatg

SEQ ID NO: 557840 - DNA, 25 bp, Rattus norvegicus
tagcagtcacctcagcaaggcaact

SEQ ID NO: 557841 - DNA, 25 bp, Rattus norvegicus
tagcagtcacctgagcaaggcaact

SEQ ID NO: 557842 - DNA, 25 bp, Rattus norvegicus
tagcagtcagtacgtggtcattctc

SEQ ID NO: 557843 - DNA, 25 bp, Rattus norvegicus
tagcagtcagtaggtggtcattctc

SEQ ID NO: 557844 - DNA, 25 bp, Rattus norvegicus
tagcagtcatttacactggcacaag

SEQ ID NO: 557845 - DNA, 25 bp, Rattus norvegicus
tagcagtcattttcactggcacaag

SEQ ID NO: 557846 - DNA, 25 bp, Rattus norvegicus
tagcagtcctcccaagagtccaaga

SEQ ID NO: 557847 - DNA, 25 bp, Rattus norvegicus
tagcagtcctccgaagagtccaaga

SEQ ID NO: 557848 - DNA, 25 bp, Rattus norvegicus
tagcagtcctgaaccctattttgtt

SEQ ID NO: 557849 - DNA, 25 bp, Rattus norvegicus
tagcagtcctgatccctattttgtt

SEQ ID NO: 557850 - DNA, 25 bp, Rattus norvegicus
tagcagtctagcctgttgggtaccc

SEQ ID NO: 557851 - DNA, 25 bp, Rattus norvegicus
tagcagtctagcgtgttgggtaccc

SEQ ID NO: 557852 - DNA, 25 bp, Rattus norvegicus
tagcagtctatgattgtgaccgccc

SEQ ID NO: 557853 - DNA, 25 bp, Rattus norvegicus
tagcagtctatgtttgtgaccgccc

SEQ ID NO: 557854 - DNA, 25 bp, Rattus norvegicus
tagcagtctgctaacttgtttaccc

SEQ ID NO: 557855 - DNA, 25 bp, Rattus norvegicus
tagcagtctgcttacttgtttaccc

SEQ ID NO: 557856 - DNA, 25 bp, Rattus norvegicus
tagcagtgatgcagcctttcgaact

SEQ ID NO: 557857 - DNA, 25 bp, Rattus norvegicus
tagcagtgatgctgcctttcgaact

SEQ ID NO: 557858 - DNA, 25 bp, Rattus norvegicus
tagcagtgcacactccatgctgact

SEQ ID NO: 557859 - DNA, 25 bp, Rattus norvegicus
tagcagtgcacagtccatgctgact

SEQ ID NO: 557860 - DNA, 25 bp, Rattus norvegicus
tagcagtgtcaaccccatcatttat

SEQ ID NO: 557861 - DNA, 25 bp, Rattus norvegicus
tagcagtgtcaagcccatcatttat

SEQ ID NO: 557862 - DNA, 25 bp, Rattus norvegicus
tagcagtgtgtaacgctccaagcat

SEQ ID NO: 557863 - DNA, 25 bp, Rattus norvegicus
tagcagtgtgtatcgctccaagcat

SEQ ID NO: 557864 - DNA, 25 bp, Rattus norvegicus
tagcagtgtgtgacctgtgattcat

SEQ ID NO: 557865 - DNA, 25 bp, Rattus norvegicus
tagcagtgtgtgtcctgtgattcat

SEQ ID NO: 557866 - DNA, 25 bp, Rattus norvegicus
tagcagttagctatgatgatctcac

SEQ ID NO: 557867 - DNA, 25 bp, Rattus norvegicus
tagcagttagctttgatgatctcac

SEQ ID NO: 557868 - DNA, 25 bp, Rattus norvegicus
tagcagttcaacatctgtgactcca

SEQ ID NO: 557869 - DNA, 25 bp, Rattus norvegicus
tagcagttcaacttctgtgactcca

SEQ ID NO: 557870 - DNA, 25 bp, Rattus norvegicus
tagcagttccctatctcagaaacat

SEQ ID NO: 557871 - DNA, 25 bp, Rattus norvegicus
tagcagttccctttctcagaaacat

SEQ ID NO: 557872 - DNA, 25 bp, Rattus norvegicus
tagcagttcctaagcatcccagttg

SEQ ID NO: 557873 - DNA, 25 bp, Rattus norvegicus
tagcagttcctatgcatcccagttg

SEQ ID NO: 557874 - DNA, 25 bp, Rattus norvegicus
tagcagttggctatccccgtgactc

SEQ ID NO: 557875 - DNA, 25 bp, Rattus norvegicus
tagcagttggctttccccgtgactc

SEQ ID NO: 557876 - DNA, 25 bp, Rattus norvegicus
tagcagttgtgcacagaggcctaaa

SEQ ID NO: 557877 - DNA, 25 bp, Rattus norvegicus
tagcagttgtgctcagaggcctaaa

SEQ ID NO: 557878 - DNA, 25 bp, Rattus norvegicus
tagcagtttcaacccagttctcatg

SEQ ID NO: 557879 - DNA, 25 bp, Rattus norvegicus
tagcagtttcaagccagttctcatg

SEQ ID NO: 557880 - DNA, 25 bp, Rattus norvegicus
tagcagtttctcaccaacttgcgat

SEQ ID NO: 557881 - DNA, 25 bp, Rattus norvegicus
tagcagtttctctccaacttgcgat

SEQ ID NO: 557882 - DNA, 25 bp, Rattus norvegicus
tagcatacacacagttttggtaaag

SEQ ID NO: 557883 - DNA, 25 bp, Rattus norvegicus
tagcatacacactgttttggtaaag

SEQ ID NO: 557884 - DNA, 25 bp, Rattus norvegicus
tagcatacaggtccaggaatcggct

SEQ ID NO: 557885 - DNA, 25 bp, Rattus norvegicus
tagcatacaggtgcaggaatcggct

SEQ ID NO: 557886 - DNA, 25 bp, Rattus norvegicus
tagcatagacagcatctgcggctgg

SEQ ID NO: 557887 - DNA, 25 bp, Rattus norvegicus
tagcatagacaggatctgcggctgg

SEQ ID NO: 557888 - DNA, 25 bp, Rattus norvegicus
tagcatagcacacccctgaggtgac

SEQ ID NO: 557889 - DNA, 25 bp, Rattus norvegicus
tagcatagcacagccctgaggtgac

SEQ ID NO: 557890 - DNA, 25 bp, Rattus norvegicus
tagcatagccccatcacatgtgtaa

SEQ ID NO: 557891 - DNA, 25 bp, Rattus norvegicus
tagcatagccccttcacatgtgtaa

SEQ ID NO: 557892 - DNA, 25 bp, Rattus norvegicus
tagcatagcctaatgccatctgctc

SEQ ID NO: 557893 - DNA, 25 bp, Rattus norvegicus
tagcatagcctattgccatctgctc

SEQ ID NO: 557894 - DNA, 25 bp, Rattus norvegicus
tagcatagggttaacatttttactg

SEQ ID NO: 557895 - DNA, 25 bp, Rattus norvegicus
tagcatagggtttacatttttactg

SEQ ID NO: 557896 - DNA, 25 bp, Rattus norvegicus
tagcatataagcacacctcacctat

SEQ ID NO: 557897 - DNA, 25 bp, Rattus norvegicus
tagcatataagctcacctcacctat

SEQ ID NO: 557898 - DNA, 25 bp, Rattus norvegicus
tagcatatatttatcctctctgggt

SEQ ID NO: 557899 - DNA, 25 bp, Rattus norvegicus
tagcatatatttttcctctctgggt

SEQ ID NO: 557900 - DNA, 25 bp, Rattus norvegicus
tagcatatccccacgagtccaggag

SEQ ID NO: 557901 - DNA, 25 bp, Rattus norvegicus
tagcatatcccctcgagtccaggag

SEQ ID NO: 557902 - DNA, 25 bp, Rattus norvegicus
tagcatatctttattcttgaggtgt

SEQ ID NO: 557903 - DNA, 25 bp, Rattus norvegicus
tagcatatcttttttcttgaggtgt

SEQ ID NO: 557904 - DNA, 25 bp, Rattus norvegicus
tagcatattggcagtaacacgttat

SEQ ID NO: 557905 - DNA, 25 bp, Rattus norvegicus
tagcatattggctgtaacacgttat

SEQ ID NO: 557906 - DNA, 25 bp, Rattus norvegicus
tagcatattggtccacacccctaat

SEQ ID NO: 557907 - DNA, 25 bp, Rattus norvegicus
tagcatattggtgcacacccctaat

SEQ ID NO: 557908 - DNA, 25 bp, Rattus norvegicus
tagcatatttcaacctccatggctt

SEQ ID NO: 557909 - DNA, 25 bp, Rattus norvegicus
tagcatatttcatcctccatggctt

SEQ ID NO: 557910 - DNA, 25 bp, Rattus norvegicus
tagcatatttttcccttggagcacc

SEQ ID NO: 557911 - DNA, 25 bp, Rattus norvegicus
tagcatatttttgccttggagcacc

SEQ ID NO: 557912 - DNA, 25 bp, Rattus norvegicus
tagcatcaatgccagctcatggtgg

SEQ ID NO: 557913 - DNA, 25 bp, Rattus norvegicus
tagcatcaatgcgagctcatggtgg

SEQ ID NO: 557914 - DNA, 25 bp, Rattus norvegicus
tagcatcacagaaccctgcattcgc

SEQ ID NO: 557915 - DNA, 25 bp, Rattus norvegicus
tagcatcacagatccctgcattcgc

SEQ ID NO: 557916 - DNA, 25 bp, Rattus norvegicus
tagcatcagtcaccgggagctgcgc

SEQ ID NO: 557917 - DNA, 25 bp, Rattus norvegicus
tagcatcagtcagcgggagctgcgc

SEQ ID NO: 557918 - DNA, 25 bp, Rattus norvegicus
tagcatcatcagctgcgacagtgtt

SEQ ID NO: 557919 - DNA, 25 bp, Rattus norvegicus
tagcatcatcaggtgcgacagtgtt

SEQ ID NO: 557920 - DNA, 25 bp, Rattus norvegicus
tagcatcatctacaagtcactgttt

SEQ ID NO: 557921 - DNA, 25 bp, Rattus norvegicus
tagcatcatctagaagtcactgttt

SEQ ID NO: 557922 - DNA, 25 bp, Rattus norvegicus
tagcatccagtgaagccagccagca

SEQ ID NO: 557923 - DNA, 25 bp, Rattus norvegicus
tagcatccagtgtagccagccagca

SEQ ID NO: 557924 - DNA, 25 bp, Rattus norvegicus
tagcatcccaatcgacagtgagtgt

SEQ ID NO: 557925 - DNA, 25 bp, Rattus norvegicus
tagcatcccaatggacagtgagtgt

SEQ ID NO: 557926 - DNA, 25 bp, Rattus norvegicus
tagcatcccacacaactaggcataa

SEQ ID NO: 557927 - DNA, 25 bp, Rattus norvegicus
tagcatcccacagaactaggcataa

SEQ ID NO: 557928 - DNA, 25 bp, Rattus norvegicus
tagcatccccttagaaacagtcttt

SEQ ID NO: 557929 - DNA, 25 bp, Rattus norvegicus
tagcatcccctttgaaacagtcttt

SEQ ID NO: 557930 - DNA, 25 bp, Rattus norvegicus
tagcatcccgcactttgaaaactgt

SEQ ID NO: 557931 - DNA, 25 bp, Rattus norvegicus
tagcatcccgcagtttgaaaactgt

SEQ ID NO: 557932 - DNA, 25 bp, Rattus norvegicus
tagcatccggtgctgtaagccctta

SEQ ID NO: 557933 - DNA, 25 bp, Rattus norvegicus
tagcatccggtggtgtaagccctta

SEQ ID NO: 557934 - DNA, 25 bp, Rattus norvegicus
tagcatcctggtaccagttctataa

SEQ ID NO: 557935 - DNA, 25 bp, Rattus norvegicus
tagcatcctggttccagttctataa

SEQ ID NO: 557936 - DNA, 25 bp, Rattus norvegicus
tagcatcgcccaaagtggccggaag

SEQ ID NO: 557937 - DNA, 25 bp, Rattus norvegicus
tagcatcgcccatagtggccggaag

SEQ ID NO: 557938 - DNA, 25 bp, Rattus norvegicus
tagcatcgcttcagagtgctttctc

SEQ ID NO: 557939 - DNA, 25 bp, Rattus norvegicus
tagcatcgcttctgagtgctttctc

SEQ ID NO: 557940 - DNA, 25 bp, Rattus norvegicus
tagcatcgtcacagactcggagagc

SEQ ID NO: 557941 - DNA, 25 bp, Rattus norvegicus
tagcatcgtcactgactcggagagc

SEQ ID NO: 557942 - DNA, 25 bp, Rattus norvegicus
tagcatcgtcatagccttggcaggg

SEQ ID NO: 557943 - DNA, 25 bp, Rattus norvegicus
tagcatcgtcattgccttggcaggg

SEQ ID NO: 557944 - DNA, 25 bp, Rattus norvegicus
tagcatctcatcaagtcttcatcag

SEQ ID NO: 557945 - DNA, 25 bp, Rattus norvegicus
tagcatctcatctagtcttcatcag

SEQ ID NO: 557946 - DNA, 25 bp, Rattus norvegicus
tagcatctccaaaagactcttccta

SEQ ID NO: 557947 - DNA, 25 bp, Rattus norvegicus
tagcatctccaatagactcttccta

SEQ ID NO: 557948 - DNA, 25 bp, Rattus norvegicus
tagcatctccgtatccgtcaatgga

SEQ ID NO: 557949 - DNA, 25 bp, Rattus norvegicus
tagcatctccgtttccgtcaatgga

SEQ ID NO: 557950 - DNA, 25 bp, Rattus norvegicus
tagcatctcgctataaccgttaggt

SEQ ID NO: 557951 - DNA, 25 bp, Rattus norvegicus
tagcatctcgctttaaccgttaggt

SEQ ID NO: 557952 - DNA, 25 bp, Rattus norvegicus
tagcatctgcaaatttctgagctat

SEQ ID NO: 557953 - DNA, 25 bp, Rattus norvegicus
tagcatctgcaattttctgagctat

SEQ ID NO: 557954 - DNA, 25 bp, Rattus norvegicus
tagcatctgcctaggtagctgcttt

SEQ ID NO: 557955 - DNA, 25 bp, Rattus norvegicus
tagcatctgccttggtagctgcttt

SEQ ID NO: 557956 - DNA, 25 bp, Rattus norvegicus
tagcatctggtacgtagaagcacaa

SEQ ID NO: 557957 - DNA, 25 bp, Rattus norvegicus
tagcatctggtaggtagaagcacaa

SEQ ID NO: 557958 - DNA, 25 bp, Rattus norvegicus
tagcatctgtatattggttaggaaa

SEQ ID NO: 557959 - DNA, 25 bp, Rattus norvegicus
tagcatctgtattttggttaggaaa

SEQ ID NO: 557960 - DNA, 25 bp, Rattus norvegicus
tagcatctgtgtcaggtggccttta

SEQ ID NO: 557961 - DNA, 25 bp, Rattus norvegicus
tagcatctgtgtgaggtggccttta

SEQ ID NO: 557962 - DNA, 25 bp, Rattus norvegicus
tagcatctgttacgccatatcttgt

SEQ ID NO: 557963 - DNA, 25 bp, Rattus norvegicus
tagcatctgttaggccatatcttgt

SEQ ID NO: 557964 - DNA, 25 bp, Rattus norvegicus
tagcatcttggacctttaggaatgg

SEQ ID NO: 557965 - DNA, 25 bp, Rattus norvegicus
tagcatcttggagctttaggaatgg

SEQ ID NO: 557966 - DNA, 25 bp, Rattus norvegicus
tagcatgactacagagcagggacgt

SEQ ID NO: 557967 - DNA, 25 bp, Rattus norvegicus
tagcatgactactgagcagggacgt

SEQ ID NO: 557968 - DNA, 25 bp, Rattus norvegicus
tagcatgagatgacggtccctggca

SEQ ID NO: 557969 - DNA, 25 bp, Rattus norvegicus
tagcatgagatgtcggtccctggca

SEQ ID NO: 557970 - DNA, 25 bp, Rattus norvegicus
tagcatgagattaccacaccaagat

SEQ ID NO: 557971 - DNA, 25 bp, Rattus norvegicus
tagcatgagatttccacaccaagat

SEQ ID NO: 557972 - DNA, 25 bp, Rattus norvegicus
tagcatgagtgacgtcccgggttca

SEQ ID NO: 557973 - DNA, 25 bp, Rattus norvegicus
tagcatgagtgaggtcccgggttca

SEQ ID NO: 557974 - DNA, 25 bp, Rattus norvegicus
tagcatgattgcctttccgggtaca

SEQ ID NO: 557975 - DNA, 25 bp, Rattus norvegicus
tagcatgattgcgtttccgggtaca

SEQ ID NO: 557976 - DNA, 25 bp, Rattus norvegicus
tagcatgcactacgctgggttccca

SEQ ID NO: 557977 - DNA, 25 bp, Rattus norvegicus
tagcatgcactaggctgggttccca

SEQ ID NO: 557978 - DNA, 25 bp, Rattus norvegicus
tagcatgcagctagagcctaaggcg

SEQ ID NO: 557979 - DNA, 25 bp, Rattus norvegicus
tagcatgcagcttgagcctaaggcg

SEQ ID NO: 557980 - DNA, 25 bp, Rattus norvegicus
tagcatgcaggtctgccctttaagg

SEQ ID NO: 557981 - DNA, 25 bp, Rattus norvegicus
tagcatgcaggtgtgccctttaagg

SEQ ID NO: 557982 - DNA, 25 bp, Rattus norvegicus
tagcatgcatttaccagacttccga

SEQ ID NO: 557983 - DNA, 25 bp, Rattus norvegicus
tagcatgcattttccagacttccga

SEQ ID NO: 557984 - DNA, 25 bp, Rattus norvegicus
tagcatgccatgagctgcacaagat

SEQ ID NO: 557985 - DNA, 25 bp, Rattus norvegicus
tagcatgccatgtgctgcacaagat

SEQ ID NO: 557986 - DNA, 25 bp, Rattus norvegicus
tagcatgcccgcagtcattcaatga

SEQ ID NO: 557987 - DNA, 25 bp, Rattus norvegicus
tagcatgcccgctgtcattcaatga

SEQ ID NO: 557988 - DNA, 25 bp, Rattus norvegicus
tagcatggaactatggtcttcacaa

SEQ ID NO: 557989 - DNA, 25 bp, Rattus norvegicus
tagcatggaactttggtcttcacaa

SEQ ID NO: 557990 - DNA, 25 bp, Rattus norvegicus
tagcatggacctattgcctggagga

SEQ ID NO: 557991 - DNA, 25 bp, Rattus norvegicus
tagcatggaccttttgcctggagga

SEQ ID NO: 557992 - DNA, 25 bp, Rattus norvegicus
tagcatggagctactggtcatccag

SEQ ID NO: 557993 - DNA, 25 bp, Rattus norvegicus
tagcatggagctcgcgtgcacacca

SEQ ID NO: 557994 - DNA, 25 bp, Rattus norvegicus
tagcatggagctggcgtgcacacca

SEQ ID NO: 557995 - DNA, 25 bp, Rattus norvegicus
tagcatggagcttctggtcatccag

SEQ ID NO: 557996 - DNA, 25 bp, Rattus norvegicus
tagcatggaggtcccttaccgccac

SEQ ID NO: 557997 - DNA, 25 bp, Rattus norvegicus
tagcatggaggtgccttaccgccac

SEQ ID NO: 557998 - DNA, 25 bp, Rattus norvegicus
tagcatggtaatcatggtgtcacac

SEQ ID NO: 557999 - DNA, 25 bp, Rattus norvegicus
tagcatggtaatgatggtgtcacac

SEQ ID NO: 558000 - DNA, 25 bp, Rattus norvegicus
tagcatggtcaacgctcggacccag

SEQ ID NO: 558001 - DNA, 25 bp, Rattus norvegicus
tagcatggtcaaggctcggacccag

SEQ ID NO: 558002 - DNA, 25 bp, Rattus norvegicus
tagcatgtcactaaagcgggccttt

SEQ ID NO: 558003 - DNA, 25 bp, Rattus norvegicus
tagcatgtcacttaagcgggccttt

SEQ ID NO: 558004 - DNA, 25 bp, Rattus norvegicus
tagcatgtgtccattgaacaaagtg

SEQ ID NO: 558005 - DNA, 25 bp, Rattus norvegicus
tagcatgtgtcctttgaacaaagtg

SEQ ID NO: 558006 - DNA, 25 bp, Rattus norvegicus
tagcatgtgtggactttcacttctg

SEQ ID NO: 558007 - DNA, 25 bp, Rattus norvegicus
tagcatgtgtggtctttcacttctg

SEQ ID NO: 558008 - DNA, 25 bp, Rattus norvegicus
tagcatgttcttatcaaagctccac

SEQ ID NO: 558009 - DNA, 25 bp, Rattus norvegicus
tagcatgttcttttcaaagctccac

SEQ ID NO: 558010 - DNA, 25 bp, Rattus norvegicus
tagcatgttggaatcctcttcgggc

SEQ ID NO: 558011 - DNA, 25 bp, Rattus norvegicus
tagcatgttggattcctcttcgggc

SEQ ID NO: 558012 - DNA, 25 bp, Rattus norvegicus
tagcattaattgctttcgcctcggg

SEQ ID NO: 558013 - DNA, 25 bp, Rattus norvegicus
tagcattaattggtttcgcctcggg

SEQ ID NO: 558014 - DNA, 25 bp, Rattus norvegicus
tagcattaccaaagacctccaggga

SEQ ID NO: 558015 - DNA, 25 bp, Rattus norvegicus
tagcattaccaatgacctccaggga

SEQ ID NO: 558016 - DNA, 25 bp, Rattus norvegicus
tagcattagaagctactcagctgtt

SEQ ID NO: 558017 - DNA, 25 bp, Rattus norvegicus
tagcattagaaggtactcagctgtt

SEQ ID NO: 558018 - DNA, 25 bp, Rattus norvegicus
tagcattaggctatgatgtgatgtg

SEQ ID NO: 558019 - DNA, 25 bp, Rattus norvegicus
tagcattaggctttgatgtgatgtg

SEQ ID NO: 558020 - DNA, 25 bp, Rattus norvegicus
tagcattagtcaaaagccccaaagt

SEQ ID NO: 558021 - DNA, 25 bp, Rattus norvegicus
tagcattagtcataagccccaaagt

SEQ ID NO: 558022 - DNA, 25 bp, Rattus norvegicus
tagcattataatccatacccaaggg

SEQ ID NO: 558023 - DNA, 25 bp, Rattus norvegicus
tagcattataatgcatacccaaggg

SEQ ID NO: 558024 - DNA, 25 bp, Rattus norvegicus
tagcattatcctacctcgagatcta

SEQ ID NO: 558025 - DNA, 25 bp, Rattus norvegicus
tagcattatccttcctcgagatcta

SEQ ID NO: 558026 - DNA, 25 bp, Rattus norvegicus
tagcattcagtacgccagctggcct

SEQ ID NO: 558027 - DNA, 25 bp, Rattus norvegicus
tagcattcagtaggccagctggcct

SEQ ID NO: 558028 - DNA, 25 bp, Rattus norvegicus
tagcattcagttcttgctgtcccca

SEQ ID NO: 558029 - DNA, 25 bp, Rattus norvegicus
tagcattcagttgttgctgtcccca

SEQ ID NO: 558030 - DNA, 25 bp, Rattus norvegicus
tagcattcataaagccccagcacct

SEQ ID NO: 558031 - DNA, 25 bp, Rattus norvegicus
tagcattcataatgccccagcacct

SEQ ID NO: 558032 - DNA, 25 bp, Rattus norvegicus
tagcattcccaactcacacaggata

SEQ ID NO: 558033 - DNA, 25 bp, Rattus norvegicus
tagcattcccaagtcacacaggata

SEQ ID NO: 558034 - DNA, 25 bp, Rattus norvegicus
tagcattcctgcacatcaaccagaa

SEQ ID NO: 558035 - DNA, 25 bp, Rattus norvegicus
tagcattcctgctcatcaaccagaa

SEQ ID NO: 558036 - DNA, 25 bp, Rattus norvegicus
tagcattcctggatctctgtgttca

SEQ ID NO: 558037 - DNA, 25 bp, Rattus norvegicus
tagcattcctggttctctgtgttca

SEQ ID NO: 558038 - DNA, 25 bp, Rattus norvegicus
tagcattgacagaacttgtgaaccg

SEQ ID NO: 558039 - DNA, 25 bp, Rattus norvegicus
tagcattgacagtacttgtgaaccg

SEQ ID NO: 558040 - DNA, 25 bp, Rattus norvegicus
tagcattgagcactacactctgtct

SEQ ID NO: 558041 - DNA, 25 bp, Rattus norvegicus
tagcattgagcagtacactctgtct

SEQ ID NO: 558042 - DNA, 25 bp, Rattus norvegicus
tagcattgagcccttttgagaacag

SEQ ID NO: 558043 - DNA, 25 bp, Rattus norvegicus
tagcattgagccgttttgagaacag

SEQ ID NO: 558044 - DNA, 25 bp, Rattus norvegicus
tagcattgcctaacttgtctttctc

SEQ ID NO: 558045 - DNA, 25 bp, Rattus norvegicus
tagcattgcctatcttgtctttctc

SEQ ID NO: 558046 - DNA, 25 bp, Rattus norvegicus
tagcattgcctcaggaaatagagat

SEQ ID NO: 558047 - DNA, 25 bp, Rattus norvegicus
tagcattgcctcctttgtgaactgg

SEQ ID NO: 558048 - DNA, 25 bp, Rattus norvegicus
tagcattgcctcgtttgtgaactgg

SEQ ID NO: 558049 - DNA, 25 bp, Rattus norvegicus
tagcattgcctctggaaatagagat

SEQ ID NO: 558050 - DNA, 25 bp, Rattus norvegicus
tagcattgtgatagtctacctctct

SEQ ID NO: 558051 - DNA, 25 bp, Rattus norvegicus
tagcattgtgattgtctacctctct

SEQ ID NO: 558052 - DNA, 25 bp, Rattus norvegicus
tagcattgttaaccagctgctgcag

SEQ ID NO: 558053 - DNA, 25 bp, Rattus norvegicus
tagcattgttaagcagctgctgcag

SEQ ID NO: 558054 - DNA, 25 bp, Rattus norvegicus
tagcatttagtgactctcccttgta

SEQ ID NO: 558055 - DNA, 25 bp, Rattus norvegicus
tagcatttagtgtctctcccttgta

SEQ ID NO: 558056 - DNA, 25 bp, Rattus norvegicus
tagcatttcattcagagttttcttc

SEQ ID NO: 558057 - DNA, 25 bp, Rattus norvegicus
tagcatttcattgagagttttcttc

SEQ ID NO: 558058 - DNA, 25 bp, Rattus norvegicus
tagcatttccttcacctttctcatg

SEQ ID NO: 558059 - DNA, 25 bp, Rattus norvegicus
tagcatttccttgacctttctcatg

SEQ ID NO: 558060 - DNA, 25 bp, Rattus norvegicus
tagcatttctgtccttttgccccaa

SEQ ID NO: 558061 - DNA, 25 bp, Rattus norvegicus
tagcatttctgtgcttttgccccaa

SEQ ID NO: 558062 - DNA, 25 bp, Rattus norvegicus
tagcatttgaacacagcctaactat

SEQ ID NO: 558063 - DNA, 25 bp, Rattus norvegicus
tagcatttgaactcagcctaactat

SEQ ID NO: 558064 - DNA, 25 bp, Rattus norvegicus
tagcatttgatcaaccacagccagg

SEQ ID NO: 558065 - DNA, 25 bp, Rattus norvegicus
tagcatttgatctaccacagccagg

SEQ ID NO: 558066 - DNA, 25 bp, Rattus norvegicus
tagcattttctacctggccctagag

SEQ ID NO: 558067 - DNA, 25 bp, Rattus norvegicus
tagcattttctagctggccctagag

SEQ ID NO: 558068 - DNA, 25 bp, Rattus norvegicus
tagccaaaagccatccgggaacttc

SEQ ID NO: 558069 - DNA, 25 bp, Rattus norvegicus
tagccaaaagccttccgggaacttc

SEQ ID NO: 558070 - DNA, 25 bp, Rattus norvegicus
tagccaaaaggcacctaccatggtc

SEQ ID NO: 558071 - DNA, 25 bp, Rattus norvegicus
tagccaaaaggctcctaccatggtc

SEQ ID NO: 558072 - DNA, 25 bp, Rattus norvegicus
tagccaaacattctgtccttcctac

SEQ ID NO: 558073 - DNA, 25 bp, Rattus norvegicus
tagccaaacattgtgtccttcctac

SEQ ID NO: 558074 - DNA, 25 bp, Rattus norvegicus
tagccaaataaacgccacgcgtttt

SEQ ID NO: 558075 - DNA, 25 bp, Rattus norvegicus
tagccaaataaaggccacgcgtttt

SEQ ID NO: 558076 - DNA, 25 bp, Rattus norvegicus
tagccaaatgacagaaagcactgat

SEQ ID NO: 558077 - DNA, 25 bp, Rattus norvegicus
tagccaaatgactgaaagcactgat

SEQ ID NO: 558078 - DNA, 25 bp, Rattus norvegicus
tagccaaatggcagtgcttgtcctg

SEQ ID NO: 558079 - DNA, 25 bp, Rattus norvegicus
tagccaaatggctgtgcttgtcctg

SEQ ID NO: 558080 - DNA, 25 bp, Rattus norvegicus
tagccaaatgtgagaccccactcag

SEQ ID NO: 558081 - DNA, 25 bp, Rattus norvegicus
tagccaaatgtgtgaccccactcag

SEQ ID NO: 558082 - DNA, 25 bp, Rattus norvegicus
tagccaacagtcagagcaaggaaac

SEQ ID NO: 558083 - DNA, 25 bp, Rattus norvegicus
tagccaacagtctgagcaaggaaac

SEQ ID NO: 558084 - DNA, 25 bp, Rattus norvegicus
tagccaacatgcactcctgggaaga

SEQ ID NO: 558085 - DNA, 25 bp, Rattus norvegicus
tagccaacatgctctcctgggaaga

SEQ ID NO: 558086 - DNA, 25 bp, Rattus norvegicus
tagccaacccctagactatcaagaa

SEQ ID NO: 558087 - DNA, 25 bp, Rattus norvegicus
tagccaaccccttgactatcaagaa

SEQ ID NO: 558088 - DNA, 25 bp, Rattus norvegicus
tagccaacccggcatgaacctgcag

SEQ ID NO: 558089 - DNA, 25 bp, Rattus norvegicus
tagccaacccgggatgaacctgcag

SEQ ID NO: 558090 - DNA, 25 bp, Rattus norvegicus
tagccaaccgtgcttctcagaacat

SEQ ID NO: 558091 - DNA, 25 bp, Rattus norvegicus
tagccaaccgtggttctcagaacat

SEQ ID NO: 558092 - DNA, 25 bp, Rattus norvegicus
tagccaacctttattgatctctgca

SEQ ID NO: 558093 - DNA, 25 bp, Rattus norvegicus
tagccaaccttttttgatctctgca

SEQ ID NO: 558094 - DNA, 25 bp, Rattus norvegicus
tagccaacgtgcagtttgcccggga

SEQ ID NO: 558095 - DNA, 25 bp, Rattus norvegicus
tagccaacgtgctgtttgcccggga

SEQ ID NO: 558096 - DNA, 25 bp, Rattus norvegicus
tagccaactagtatcctgtcagaac

SEQ ID NO: 558097 - DNA, 25 bp, Rattus norvegicus
tagccaactagtttcctgtcagaac

SEQ ID NO: 558098 - DNA, 25 bp, Rattus norvegicus
tagccaactctgattacaaataaag

SEQ ID NO: 558099 - DNA, 25 bp, Rattus norvegicus
tagccaactctgtttacaaataaag

SEQ ID NO: 558100 - DNA, 25 bp, Rattus norvegicus
tagccaacttgacgcagaccctgga

SEQ ID NO: 558101 - DNA, 25 bp, Rattus norvegicus
tagccaacttgaggcagaccctgga

SEQ ID NO: 558102 - DNA, 25 bp, Rattus norvegicus
tagccaagaactcaagggtcagtat

SEQ ID NO: 558103 - DNA, 25 bp, Rattus norvegicus
tagccaagaactgaagggtcagtat

SEQ ID NO: 558104 - DNA, 25 bp, Rattus norvegicus
tagccaagaagcagttattcacaca

SEQ ID NO: 558105 - DNA, 25 bp, Rattus norvegicus
tagccaagaagctgttattcacaca

SEQ ID NO: 558106 - DNA, 25 bp, Rattus norvegicus
tagccaagagcaacttccctgtgga

SEQ ID NO: 558107 - DNA, 25 bp, Rattus norvegicus
tagccaagagcatcttccctgtgga

SEQ ID NO: 558108 - DNA, 25 bp, Rattus norvegicus
tagccaagctccatctcctaggaga

SEQ ID NO: 558109 - DNA, 25 bp, Rattus norvegicus
tagccaagctccttctcctaggaga

SEQ ID NO: 558110 - DNA, 25 bp, Rattus norvegicus
tagccaaggaatccagcacctgtcg

SEQ ID NO: 558111 - DNA, 25 bp, Rattus norvegicus
tagccaaggaatgcagcacctgtcg

SEQ ID NO: 558112 - DNA, 25 bp, Rattus norvegicus
tagccaaggtgcctctgtaactcca

SEQ ID NO: 558113 - DNA, 25 bp, Rattus norvegicus
tagccaaggtgcgtctgtaactcca

SEQ ID NO: 558114 - DNA, 25 bp, Rattus norvegicus
tagccaagtagcctgccctgggaag

SEQ ID NO: 558115 - DNA, 25 bp, Rattus norvegicus
tagccaagtagcgtgccctgggaag

SEQ ID NO: 558116 - DNA, 25 bp, Rattus norvegicus
tagccaatcactaaggtggccctga

SEQ ID NO: 558117 - DNA, 25 bp, Rattus norvegicus
tagccaatcacttaggtggccctga

SEQ ID NO: 558118 - DNA, 25 bp, Rattus norvegicus
tagccaatgaatcgccgcccctggg

SEQ ID NO: 558119 - DNA, 25 bp, Rattus norvegicus
tagccaatgaatggccgcccctggg

SEQ ID NO: 558120 - DNA, 25 bp, Rattus norvegicus
tagccacacggcaatctagtagcag

SEQ ID NO: 558121 - DNA, 25 bp, Rattus norvegicus
tagccacacggctatctagtagcag

SEQ ID NO: 558122 - DNA, 25 bp, Rattus norvegicus
tagccacagaggatacagcactgac

SEQ ID NO: 558123 - DNA, 25 bp, Rattus norvegicus
tagccacagaggttacagcactgac

SEQ ID NO: 558124 - DNA, 25 bp, Rattus norvegicus
tagccacagcgaatgatggttgtca

SEQ ID NO: 558125 - DNA, 25 bp, Rattus norvegicus
tagccacagcgattgatggttgtca

SEQ ID NO: 558126 - DNA, 25 bp, Rattus norvegicus
tagccacaggaacattaaaagacat

SEQ ID NO: 558127 - DNA, 25 bp, Rattus norvegicus
tagccacaggaagattaaaagacat

SEQ ID NO: 558128 - DNA, 25 bp, Rattus norvegicus
tagccacagtctcggtttcggagag

SEQ ID NO: 558129 - DNA, 25 bp, Rattus norvegicus
tagccacagtctgggtttcggagag

SEQ ID NO: 558130 - DNA, 25 bp, Rattus norvegicus
tagccacatacccttagccaaaata

SEQ ID NO: 558131 - DNA, 25 bp, Rattus norvegicus
tagccacataccgttagccaaaata

SEQ ID NO: 558132 - DNA, 25 bp, Rattus norvegicus
tagccacatttcacgtgactcaact

SEQ ID NO: 558133 - DNA, 25 bp, Rattus norvegicus
tagccacatttctcgtgactcaact

SEQ ID NO: 558134 - DNA, 25 bp, Rattus norvegicus
tagccaccaagacactaataaagac

SEQ ID NO: 558135 - DNA, 25 bp, Rattus norvegicus
tagccaccaagagactaataaagac

SEQ ID NO: 558136 - DNA, 25 bp, Rattus norvegicus
tagccaccacacaactgagtttatg

SEQ ID NO: 558137 - DNA, 25 bp, Rattus norvegicus
tagccaccacactactgagtttatg

SEQ ID NO: 558138 - DNA, 25 bp, Rattus norvegicus
tagccaccaccaacatcaataacaa

SEQ ID NO: 558139 - DNA, 25 bp, Rattus norvegicus
tagccaccaccatcatcaataacaa

SEQ ID NO: 558140 - DNA, 25 bp, Rattus norvegicus
tagccaccagcaagagggaatgttt

SEQ ID NO: 558141 - DNA, 25 bp, Rattus norvegicus
tagccaccagcatgagggaatgttt

SEQ ID NO: 558142 - DNA, 25 bp, Rattus norvegicus
tagccaccatgcatatgactaattg

SEQ ID NO: 558143 - DNA, 25 bp, Rattus norvegicus
tagccaccatgcttatgactaattg

SEQ ID NO: 558144 - DNA, 25 bp, Rattus norvegicus
tagccacccatcagtaagagctgaa

SEQ ID NO: 558145 - DNA, 25 bp, Rattus norvegicus
tagccacccatctgtaagagctgaa

SEQ ID NO: 558146 - DNA, 25 bp, Rattus norvegicus
tagccacgccctcagattgaggcaa

SEQ ID NO: 558147 - DNA, 25 bp, Rattus norvegicus
tagccacgccctgagattgaggcaa

SEQ ID NO: 558148 - DNA, 25 bp, Rattus norvegicus
tagccacgtgcaagtcttttctaga

SEQ ID NO: 558149 - DNA, 25 bp, Rattus norvegicus
tagccacgtgcatgtcttttctaga

SEQ ID NO: 558150 - DNA, 25 bp, Rattus norvegicus
tagccactcagccagtaaacgggtc

SEQ ID NO: 558151 - DNA, 25 bp, Rattus norvegicus
tagccactcagcgagtaaacgggtc

SEQ ID NO: 558152 - DNA, 25 bp, Rattus norvegicus
tagccactcccgctttaaagaatcc

SEQ ID NO: 558153 - DNA, 25 bp, Rattus norvegicus
tagccactcccggtttaaagaatcc

SEQ ID NO: 558154 - DNA, 25 bp, Rattus norvegicus
tagccactgaacaatctttccaacg

SEQ ID NO: 558155 - DNA, 25 bp, Rattus norvegicus
tagccactgaactatctttccaacg

SEQ ID NO: 558156 - DNA, 25 bp, Rattus norvegicus
tagccactgcggacacaaaagcctg

SEQ ID NO: 558157 - DNA, 25 bp, Rattus norvegicus
tagccactgcggtcacaaaagcctg

SEQ ID NO: 558158 - DNA, 25 bp, Rattus norvegicus
tagccactggcaacatgttgaccga

SEQ ID NO: 558159 - DNA, 25 bp, Rattus norvegicus
tagccactggcatcatgttgaccga

SEQ ID NO: 558160 - DNA, 25 bp, Rattus norvegicus
tagccactgtctatgctcattgctt

SEQ ID NO: 558161 - DNA, 25 bp, Rattus norvegicus
tagccactgtctttgctcattgctt

SEQ ID NO: 558162 - DNA, 25 bp, Rattus norvegicus
tagccactgtgaacttgatgacaag

SEQ ID NO: 558163 - DNA, 25 bp, Rattus norvegicus
tagccactgtgatcttgatgacaag

SEQ ID NO: 558164 - DNA, 25 bp, Rattus norvegicus
tagccactgttcagtgttagtccca

SEQ ID NO: 558165 - DNA, 25 bp, Rattus norvegicus
tagccactgttcataggtgccaagt

SEQ ID NO: 558166 - DNA, 25 bp, Rattus norvegicus
tagccactgttctgtgttagtccca

SEQ ID NO: 558167 - DNA, 25 bp, Rattus norvegicus
tagccactgttcttaggtgccaagt

SEQ ID NO: 558168 - DNA, 25 bp, Rattus norvegicus
tagccacttactatttgcaaccttg

SEQ ID NO: 558169 - DNA, 25 bp, Rattus norvegicus
tagccacttactttttgcaaccttg

SEQ ID NO: 558170 - DNA, 25 bp, Rattus norvegicus
tagccacttcagaaatacaccttcc

SEQ ID NO: 558171 - DNA, 25 bp, Rattus norvegicus
tagccacttcagtaatacaccttcc

SEQ ID NO: 558172 - DNA, 25 bp, Rattus norvegicus
tagccacttgtaccgctagcttgta

SEQ ID NO: 558173 - DNA, 25 bp, Rattus norvegicus
tagccacttgtagcgctagcttgta

SEQ ID NO: 558174 - DNA, 25 bp, Rattus norvegicus
tagccacttttacgtcaattttttg

SEQ ID NO: 558175 - DNA, 25 bp, Rattus norvegicus
tagccacttttaggtcaattttttg

SEQ ID NO: 558176 - DNA, 25 bp, Rattus norvegicus
tagccagacatgagtatacattcag

SEQ ID NO: 558177 - DNA, 25 bp, Rattus norvegicus
tagccagacatgtgtatacattcag

SEQ ID NO: 558178 - DNA, 25 bp, Rattus norvegicus
tagccagactttcctactttttggg

SEQ ID NO: 558179 - DNA, 25 bp, Rattus norvegicus
tagccagactttgctactttttggg

SEQ ID NO: 558180 - DNA, 25 bp, Rattus norvegicus
tagccagagcccatgtgatagagac

SEQ ID NO: 558181 - DNA, 25 bp, Rattus norvegicus
tagccagagcccttgtgatagagac

SEQ ID NO: 558182 - DNA, 25 bp, Rattus norvegicus
tagccagatagaactttactgaaat

SEQ ID NO: 558183 - DNA, 25 bp, Rattus norvegicus
tagccagatagatctttactgaaat

SEQ ID NO: 558184 - DNA, 25 bp, Rattus norvegicus
tagccagatggacaggcgcctgcct

SEQ ID NO: 558185 - DNA, 25 bp, Rattus norvegicus
tagccagatggagaggcgcctgcct

SEQ ID NO: 558186 - DNA, 25 bp, Rattus norvegicus
tagccagatggtaacccttccagga

SEQ ID NO: 558187 - DNA, 25 bp, Rattus norvegicus
tagccagatggttacccttccagga

SEQ ID NO: 558188 - DNA, 25 bp, Rattus norvegicus
tagccagatttacagtgagcaacat

SEQ ID NO: 558189 - DNA, 25 bp, Rattus norvegicus
tagccagatttagagtgagcaacat

SEQ ID NO: 558190 - DNA, 25 bp, Rattus norvegicus
tagccagcattacaacttgtagaga

SEQ ID NO: 558191 - DNA, 25 bp, Rattus norvegicus
tagccagcattagaacttgtagaga

SEQ ID NO: 558192 - DNA, 25 bp, Rattus norvegicus
tagccagccagcagaaccagtcagg

SEQ ID NO: 558193 - DNA, 25 bp, Rattus norvegicus
tagccagccagctgaaccagtcagg

SEQ ID NO: 558194 - DNA, 25 bp, Rattus norvegicus
tagccagccagtatttacccattgt

SEQ ID NO: 558195 - DNA, 25 bp, Rattus norvegicus
tagccagccagtttttacccattgt

SEQ ID NO: 558196 - DNA, 25 bp, Rattus norvegicus
tagccagccattcccattggtctag

SEQ ID NO: 558197 - DNA, 25 bp, Rattus norvegicus
tagccagccattgccattggtctag

SEQ ID NO: 558198 - DNA, 25 bp, Rattus norvegicus
tagccagcggctattgaaacagtaa

SEQ ID NO: 558199 - DNA, 25 bp, Rattus norvegicus
tagccagcggcttttgaaacagtaa

SEQ ID NO: 558200 - DNA, 25 bp, Rattus norvegicus
tagccagctcctagatccggcagaa

SEQ ID NO: 558201 - DNA, 25 bp, Rattus norvegicus
tagccagctccttgatccggcagaa

SEQ ID NO: 558202 - DNA, 25 bp, Rattus norvegicus
tagccagctgctaaagagattctta

SEQ ID NO: 558203 - DNA, 25 bp, Rattus norvegicus
tagccagctgcttaagagattctta

SEQ ID NO: 558204 - DNA, 25 bp, Rattus norvegicus
tagccagctggtatcaggcatatac

SEQ ID NO: 558205 - DNA, 25 bp, Rattus norvegicus
tagccagctggtttcaggcatatac

SEQ ID NO: 558206 - DNA, 25 bp, Rattus norvegicus
tagccagctgtgcaaagcctctcag

SEQ ID NO: 558207 - DNA, 25 bp, Rattus norvegicus
tagccagctgtggaaagcctctcag

SEQ ID NO: 558208 - DNA, 25 bp, Rattus norvegicus
tagccaggagctcaccttcgttttc

SEQ ID NO: 558209 - DNA, 25 bp, Rattus norvegicus
tagccaggagctgaccttcgttttc

SEQ ID NO: 558210 - DNA, 25 bp, Rattus norvegicus
tagccaggagtaccccatctgcatc

SEQ ID NO: 558211 - DNA, 25 bp, Rattus norvegicus
tagccaggagtagcccatctgcatc

SEQ ID NO: 558212 - DNA, 25 bp, Rattus norvegicus
tagccaggctagaactcttgaattc

SEQ ID NO: 558213 - DNA, 25 bp, Rattus norvegicus
tagccaggctagtactcttgaattc

SEQ ID NO: 558214 - DNA, 25 bp, Rattus norvegicus
tagccaggctgtccaggcccgtgga

SEQ ID NO: 558215 - DNA, 25 bp, Rattus norvegicus
tagccaggctgtcctgaaaagggac

SEQ ID NO: 558216 - DNA, 25 bp, Rattus norvegicus
tagccaggctgtgcaggcccgtgga

SEQ ID NO: 558217 - DNA, 25 bp, Rattus norvegicus
tagccaggctgtgctgaaaagggac

SEQ ID NO: 558218 - DNA, 25 bp, Rattus norvegicus
tagccagggctgactttgaactgca

SEQ ID NO: 558219 - DNA, 25 bp, Rattus norvegicus
tagccagggctgtctttgaactgca

SEQ ID NO: 558220 - DNA, 25 bp, Rattus norvegicus
tagccaggttgacggtgtccgccaa

SEQ ID NO: 558221 - DNA, 25 bp, Rattus norvegicus
tagccaggttgagggtgtccgccaa

SEQ ID NO: 558222 - DNA, 25 bp, Rattus norvegicus
tagccagtacccagaggactcagtt

SEQ ID NO: 558223 - DNA, 25 bp, Rattus norvegicus
tagccagtaccctgaggactcagtt

SEQ ID NO: 558224 - DNA, 25 bp, Rattus norvegicus
tagccagtaggcactgtgaggtgta

SEQ ID NO: 558225 - DNA, 25 bp, Rattus norvegicus
tagccagtaggctctgtgaggtgta

SEQ ID NO: 558226 - DNA, 25 bp, Rattus norvegicus
tagccagtatataggtctttttaag

SEQ ID NO: 558227 - DNA, 25 bp, Rattus norvegicus
tagccagtatattggtctttttaag

SEQ ID NO: 558228 - DNA, 25 bp, Rattus norvegicus
tagccagtcagcagcgggttggtca

SEQ ID NO: 558229 - DNA, 25 bp, Rattus norvegicus
tagccagtcagctgcgggttggtca

SEQ ID NO: 558230 - DNA, 25 bp, Rattus norvegicus
tagccagtccagaacattctgcaga

SEQ ID NO: 558231 - DNA, 25 bp, Rattus norvegicus
tagccagtccagtacattctgcaga

SEQ ID NO: 558232 - DNA, 25 bp, Rattus norvegicus
tagccagtggccctgccagagcagc

SEQ ID NO: 558233 - DNA, 25 bp, Rattus norvegicus
tagccagtggccgtgccagagcagc

SEQ ID NO: 558234 - DNA, 25 bp, Rattus norvegicus
tagccagtggctcatgtctcctgtc

SEQ ID NO: 558235 - DNA, 25 bp, Rattus norvegicus
tagccagtggctgatgtctcctgtc

SEQ ID NO: 558236 - DNA, 25 bp, Rattus norvegicus
tagccagtggtgaacttatgtagca

SEQ ID NO: 558237 - DNA, 25 bp, Rattus norvegicus
tagccagtggtgtacttatgtagca

SEQ ID NO: 558238 - DNA, 25 bp, Rattus norvegicus
tagccagttctgacactcaggtaga

SEQ ID NO: 558239 - DNA, 25 bp, Rattus norvegicus
tagccagttctgtcactcaggtaga

SEQ ID NO: 558240 - DNA, 25 bp, Rattus norvegicus
tagccagttggtattatgataatgc

SEQ ID NO: 558241 - DNA, 25 bp, Rattus norvegicus
tagccagttggttttatgataatgc

SEQ ID NO: 558242 - DNA, 25 bp, Rattus norvegicus
tagccagttttacttattttgttct

SEQ ID NO: 558243 - DNA, 25 bp, Rattus norvegicus
tagccagttttagttattttgttct

SEQ ID NO: 558244 - DNA, 25 bp, Rattus norvegicus
tagccataccgaccaatcacctttt

SEQ ID NO: 558245 - DNA, 25 bp, Rattus norvegicus
tagccataccgagcaatcacctttt

SEQ ID NO: 558246 - DNA, 25 bp, Rattus norvegicus
tagccatagccgcagctcatcaagg

SEQ ID NO: 558247 - DNA, 25 bp, Rattus norvegicus
tagccatagccggagctcatcaagg

SEQ ID NO: 558248 - DNA, 25 bp, Rattus norvegicus
tagccatatgtcactcacccttgga

SEQ ID NO: 558249 - DNA, 25 bp, Rattus norvegicus
tagccatatgtctctcacccttgga

SEQ ID NO: 558250 - DNA, 25 bp, Rattus norvegicus
tagccatccttgacctctgaaatga

SEQ ID NO: 558251 - DNA, 25 bp, Rattus norvegicus
tagccatccttgtcctctgaaatga

SEQ ID NO: 558252 - DNA, 25 bp, Rattus norvegicus
tagccatcgatgctggctttagact

SEQ ID NO: 558253 - DNA, 25 bp, Rattus norvegicus
tagccatcgatggtggctttagact

SEQ ID NO: 558254 - DNA, 25 bp, Rattus norvegicus
tagccatctgtccttgtggaaagcc

SEQ ID NO: 558255 - DNA, 25 bp, Rattus norvegicus
tagccatctgtcgttgtggaaagcc

SEQ ID NO: 558256 - DNA, 25 bp, Rattus norvegicus
tagccatgacacattgtaccacgcc

SEQ ID NO: 558257 - DNA, 25 bp, Rattus norvegicus
tagccatgacactttgtaccacgcc

SEQ ID NO: 558258 - DNA, 25 bp, Rattus norvegicus
tagccatgaccgctgacctcattgg

SEQ ID NO: 558259 - DNA, 25 bp, Rattus norvegicus
tagccatgaccggtgacctcattgg

SEQ ID NO: 558260 - DNA, 25 bp, Rattus norvegicus
tagccatgagttctgctcgaagctc

SEQ ID NO: 558261 - DNA, 25 bp, Rattus norvegicus
tagccatgagttgtgctcgaagctc

SEQ ID NO: 558262 - DNA, 25 bp, Rattus norvegicus
tagccatgcatacgcctggcaggcg

SEQ ID NO: 558263 - DNA, 25 bp, Rattus norvegicus
tagccatgcataggcctggcaggcg

SEQ ID NO: 558264 - DNA, 25 bp, Rattus norvegicus
tagccatgcctgagggagccaagct

SEQ ID NO: 558265 - DNA, 25 bp, Rattus norvegicus
tagccatgcctgtgggagccaagct

SEQ ID NO: 558266 - DNA, 25 bp, Rattus norvegicus
tagccatgccttaataattcctgcc

SEQ ID NO: 558267 - DNA, 25 bp, Rattus norvegicus
tagccatgcctttataattcctgcc

SEQ ID NO: 558268 - DNA, 25 bp, Rattus norvegicus
tagccatgcgaaactcagtccggta

SEQ ID NO: 558269 - DNA, 25 bp, Rattus norvegicus
tagccatgcgaatctcagtccggta

SEQ ID NO: 558270 - DNA, 25 bp, Rattus norvegicus
tagccatgcgggagctgtcattcac

SEQ ID NO: 558271 - DNA, 25 bp, Rattus norvegicus
tagccatgcgggtgctgtcattcac

SEQ ID NO: 558272 - DNA, 25 bp, Rattus norvegicus
tagccatggactcctcctgtgatca

SEQ ID NO: 558273 - DNA, 25 bp, Rattus norvegicus
tagccatggactgctcctgtgatca

SEQ ID NO: 558274 - DNA, 25 bp, Rattus norvegicus
tagccatggccacagctcctaagta

SEQ ID NO: 558275 - DNA, 25 bp, Rattus norvegicus
tagccatggccactcctgcataaga

SEQ ID NO: 558276 - DNA, 25 bp, Rattus norvegicus
tagccatggccagagctcctaagta

SEQ ID NO: 558277 - DNA, 25 bp, Rattus norvegicus
tagccatggccagtcctgcataaga

SEQ ID NO: 558278 - DNA, 25 bp, Rattus norvegicus
tagccatggcctcagaacgtacaac

SEQ ID NO: 558279 - DNA, 25 bp, Rattus norvegicus
tagccatggcctgagaacgtacaac

SEQ ID NO: 558280 - DNA, 25 bp, Rattus norvegicus
tagccatggctacttctgacgtgaa

SEQ ID NO: 558281 - DNA, 25 bp, Rattus norvegicus
tagccatggctagttctgacgtgaa

SEQ ID NO: 558282 - DNA, 25 bp, Rattus norvegicus
tagccattcaacatttaccccaagt

SEQ ID NO: 558283 - DNA, 25 bp, Rattus norvegicus
tagccattcaacttttaccccaagt

SEQ ID NO: 558284 - DNA, 25 bp, Rattus norvegicus
tagccattcagaccaatagggcctg

SEQ ID NO: 558285 - DNA, 25 bp, Rattus norvegicus
tagccattcagagcaatagggcctg

SEQ ID NO: 558286 - DNA, 25 bp, Rattus norvegicus
tagccattccgaagctctgggccat

SEQ ID NO: 558287 - DNA, 25 bp, Rattus norvegicus
tagccattccgatgctctgggccat

SEQ ID NO: 558288 - DNA, 25 bp, Rattus norvegicus
tagccattgcttagaaatgtaccat

SEQ ID NO: 558289 - DNA, 25 bp, Rattus norvegicus
tagccattgctttgaaatgtaccat

SEQ ID NO: 558290 - DNA, 25 bp, Rattus norvegicus
tagccatttctcaatgggctgtcca

SEQ ID NO: 558291 - DNA, 25 bp, Rattus norvegicus
tagccatttctctatgggctgtcca

SEQ ID NO: 558292 - DNA, 25 bp, Rattus norvegicus
tagccatttggtattccctattatg

SEQ ID NO: 558293 - DNA, 25 bp, Rattus norvegicus
tagccatttggttttccctattatg

SEQ ID NO: 558294 - DNA, 25 bp, Rattus norvegicus
tagccatttgtaccttcttctttaa

SEQ ID NO: 558295 - DNA, 25 bp, Rattus norvegicus
tagccatttgtagcttcttctttaa

SEQ ID NO: 558296 - DNA, 25 bp, Rattus norvegicus
tagcccaaaattctgcaggacagca

SEQ ID NO: 558297 - DNA, 25 bp, Rattus norvegicus
tagcccaaaattgtgcaggacagca

SEQ ID NO: 558298 - DNA, 25 bp, Rattus norvegicus
tagcccaaacagctcttgccaagtt

SEQ ID NO: 558299 - DNA, 25 bp, Rattus norvegicus
tagcccaaacaggtcttgccaagtt

SEQ ID NO: 558300 - DNA, 25 bp, Rattus norvegicus
tagcccaaacctctgtcgtgattga

SEQ ID NO: 558301 - DNA, 25 bp, Rattus norvegicus
tagcccaaacctgtgtcgtgattga

SEQ ID NO: 558302 - DNA, 25 bp, Rattus norvegicus
tagcccaaacgtatgcagccagaat

SEQ ID NO: 558303 - DNA, 25 bp, Rattus norvegicus
tagcccaaacgtttgcagccagaat

SEQ ID NO: 558304 - DNA, 25 bp, Rattus norvegicus
tagcccaagctaccatgcacttagt

SEQ ID NO: 558305 - DNA, 25 bp, Rattus norvegicus
tagcccaagctagcatgcacttagt

SEQ ID NO: 558306 - DNA, 25 bp, Rattus norvegicus
tagcccaagctgaatgagaccctgt

SEQ ID NO: 558307 - DNA, 25 bp, Rattus norvegicus
tagcccaagctgtatgagaccctgt

SEQ ID NO: 558308 - DNA, 25 bp, Rattus norvegicus
tagcccaagcttacattcttcctct

SEQ ID NO: 558309 - DNA, 25 bp, Rattus norvegicus
tagcccaagctttcattcttcctct

SEQ ID NO: 558310 - DNA, 25 bp, Rattus norvegicus
tagcccaaggccaagttactaacag

SEQ ID NO: 558311 - DNA, 25 bp, Rattus norvegicus
tagcccaaggcctagttactaacag

SEQ ID NO: 558312 - DNA, 25 bp, Rattus norvegicus
tagcccaaggctctaactgttcata

SEQ ID NO: 558313 - DNA, 25 bp, Rattus norvegicus
tagcccaaggctgtaactgttcata

SEQ ID NO: 558314 - DNA, 25 bp, Rattus norvegicus
tagcccacaaaccacaaacttgcat

SEQ ID NO: 558315 - DNA, 25 bp, Rattus norvegicus
tagcccacaaacgacaaacttgcat

SEQ ID NO: 558316 - DNA, 25 bp, Rattus norvegicus
tagcccacattaagtgtcctttcct

SEQ ID NO: 558317 - DNA, 25 bp, Rattus norvegicus
tagcccacattatgtgtcctttcct

SEQ ID NO: 558318 - DNA, 25 bp, Rattus norvegicus
tagcccaccagtccacaacagttag

SEQ ID NO: 558319 - DNA, 25 bp, Rattus norvegicus
tagcccaccagtgcacaacagttag

SEQ ID NO: 558320 - DNA, 25 bp, Rattus norvegicus
tagcccaccgttaactgtggcttat

SEQ ID NO: 558321 - DNA, 25 bp, Rattus norvegicus
tagcccaccgtttactgtggcttat

SEQ ID NO: 558322 - DNA, 25 bp, Rattus norvegicus
tagcccacgattcccagtcggagga

SEQ ID NO: 558323 - DNA, 25 bp, Rattus norvegicus
tagcccacgattgccagtcggagga

SEQ ID NO: 558324 - DNA, 25 bp, Rattus norvegicus
tagcccagaacgaccaggtaactcg

SEQ ID NO: 558325 - DNA, 25 bp, Rattus norvegicus
tagcccagaacgtccaggtaactcg

SEQ ID NO: 558326 - DNA, 25 bp, Rattus norvegicus
tagcccagacttattgacaggtccc

SEQ ID NO: 558327 - DNA, 25 bp, Rattus norvegicus
tagcccagactttttgacaggtccc

SEQ ID NO: 558328 - DNA, 25 bp, Rattus norvegicus
tagcccagcccaacataagaacagg

SEQ ID NO: 558329 - DNA, 25 bp, Rattus norvegicus
tagcccagcccatcataagaacagg

SEQ ID NO: 558330 - DNA, 25 bp, Rattus norvegicus
tagcccagccgtagacatgcgcgta

SEQ ID NO: 558331 - DNA, 25 bp, Rattus norvegicus
tagcccagccgttgacatgcgcgta

SEQ ID NO: 558332 - DNA, 25 bp, Rattus norvegicus
tagcccagctcccagcaggaaagga

SEQ ID NO: 558333 - DNA, 25 bp, Rattus norvegicus
tagcccagctccgagcaggaaagga

SEQ ID NO: 558334 - DNA, 25 bp, Rattus norvegicus
tagcccaggaggcactgcactcaga

SEQ ID NO: 558335 - DNA, 25 bp, Rattus norvegicus
tagcccaggagggactgcactcaga

SEQ ID NO: 558336 - DNA, 25 bp, Rattus norvegicus
tagcccaggatgacacagaacttct

SEQ ID NO: 558337 - DNA, 25 bp, Rattus norvegicus
tagcccaggatgtcacagaacttct

SEQ ID NO: 558338 - DNA, 25 bp, Rattus norvegicus
tagcccaggctaaccatgagctcat

SEQ ID NO: 558339 - DNA, 25 bp, Rattus norvegicus
tagcccaggctatccatgagctcat

SEQ ID NO: 558340 - DNA, 25 bp, Rattus norvegicus
tagcccagggtacagctgtgttcta

SEQ ID NO: 558341 - DNA, 25 bp, Rattus norvegicus
tagcccagggtagagctgtgttcta

SEQ ID NO: 558342 - DNA, 25 bp, Rattus norvegicus
tagcccaggttaacccaaacttgtg

SEQ ID NO: 558343 - DNA, 25 bp, Rattus norvegicus
tagcccaggttatcccaaacttgtg

SEQ ID NO: 558344 - DNA, 25 bp, Rattus norvegicus
tagcccagtggtcagtcatggcatg

SEQ ID NO: 558345 - DNA, 25 bp, Rattus norvegicus
tagcccagtggtgagtcatggcatg

SEQ ID NO: 558346 - DNA, 25 bp, Rattus norvegicus
tagcccagtgtacctcaggaaatgg

SEQ ID NO: 558347 - DNA, 25 bp, Rattus norvegicus
tagcccagtgtagctcaggaaatgg

SEQ ID NO: 558348 - DNA, 25 bp, Rattus norvegicus
tagcccatcacacttgtccagcatt

SEQ ID NO: 558349 - DNA, 25 bp, Rattus norvegicus
tagcccatcacagttgtccagcatt

SEQ ID NO: 558350 - DNA, 25 bp, Rattus norvegicus
tagcccatctgcacgccatacagaa

SEQ ID NO: 558351 - DNA, 25 bp, Rattus norvegicus
tagcccatctgctcgccatacagaa

SEQ ID NO: 558352 - DNA, 25 bp, Rattus norvegicus
tagcccatggagctgactgagtgca

SEQ ID NO: 558353 - DNA, 25 bp, Rattus norvegicus
tagcccatggaggtgactgagtgca

SEQ ID NO: 558354 - DNA, 25 bp, Rattus norvegicus
tagcccattctcaacctgagtgttt

SEQ ID NO: 558355 - DNA, 25 bp, Rattus norvegicus
tagcccattctcagactcttaagtg

SEQ ID NO: 558356 - DNA, 25 bp, Rattus norvegicus
tagcccattctctacctgagtgttt

SEQ ID NO: 558357 - DNA, 25 bp, Rattus norvegicus
tagcccattctctgactcttaagtg

SEQ ID NO: 558358 - DNA, 25 bp, Rattus norvegicus
tagcccatttcgaaagcctttttag

SEQ ID NO: 558359 - DNA, 25 bp, Rattus norvegicus
tagcccatttcgtaagcctttttag

SEQ ID NO: 558360 - DNA, 25 bp, Rattus norvegicus
tagccccaaactacttgctgtaagg

SEQ ID NO: 558361 - DNA, 25 bp, Rattus norvegicus
tagccccaaacttcttgctgtaagg

SEQ ID NO: 558362 - DNA, 25 bp, Rattus norvegicus
tagccccaaagtcatgtctccatag

SEQ ID NO: 558363 - DNA, 25 bp, Rattus norvegicus
tagccccaaagtgatgtctccatag

SEQ ID NO: 558364 - DNA, 25 bp, Rattus norvegicus
tagccccacatccacttagagatga

SEQ ID NO: 558365 - DNA, 25 bp, Rattus norvegicus
tagccccacatcgacttagagatga

SEQ ID NO: 558366 - DNA, 25 bp, Rattus norvegicus
tagccccactcaatgtttatagcag

SEQ ID NO: 558367 - DNA, 25 bp, Rattus norvegicus
tagccccactcattgtttatagcag

SEQ ID NO: 558368 - DNA, 25 bp, Rattus norvegicus
tagccccacttcctggagggatttc

SEQ ID NO: 558369 - DNA, 25 bp, Rattus norvegicus
tagccccacttcgtggagggatttc

SEQ ID NO: 558370 - DNA, 25 bp, Rattus norvegicus
tagccccagcttctgcttcatcttg

SEQ ID NO: 558371 - DNA, 25 bp, Rattus norvegicus
tagccccagcttgtgcttcatcttg

SEQ ID NO: 558372 - DNA, 25 bp, Rattus norvegicus
tagccccaggagactttgattcaga

SEQ ID NO: 558373 - DNA, 25 bp, Rattus norvegicus
tagccccaggagtctttgattcaga

SEQ ID NO: 558374 - DNA, 25 bp, Rattus norvegicus
tagccccaggataggtttagcacat

SEQ ID NO: 558375 - DNA, 25 bp, Rattus norvegicus
tagccccaggattggtttagcacat

SEQ ID NO: 558376 - DNA, 25 bp, Rattus norvegicus
tagccccagtcccacggattatgtg

SEQ ID NO: 558377 - DNA, 25 bp, Rattus norvegicus
tagccccagtccgacggattatgtg

SEQ ID NO: 558378 - DNA, 25 bp, Rattus norvegicus
tagccccagttgaccgactaatgca

SEQ ID NO: 558379 - DNA, 25 bp, Rattus norvegicus
tagccccagttgtccgactaatgca

SEQ ID NO: 558380 - DNA, 25 bp, Rattus norvegicus
tagccccatttcatggagatgtcat

SEQ ID NO: 558381 - DNA, 25 bp, Rattus norvegicus
tagccccatttcttggagatgtcat

SEQ ID NO: 558382 - DNA, 25 bp, Rattus norvegicus
tagccccgagcgacacacgagaagt

SEQ ID NO: 558383 - DNA, 25 bp, Rattus norvegicus
tagccccgagcgtcacacgagaagt

SEQ ID NO: 558384 - DNA, 25 bp, Rattus norvegicus
tagccccgagtaagctcagtctcta

SEQ ID NO: 558385 - DNA, 25 bp, Rattus norvegicus
tagccccgagtatgctcagtctcta

SEQ ID NO: 558386 - DNA, 25 bp, Rattus norvegicus
tagccccggctacaactggatattt

SEQ ID NO: 558387 - DNA, 25 bp, Rattus norvegicus
tagccccggctagaactggatattt

SEQ ID NO: 558388 - DNA, 25 bp, Rattus norvegicus
tagcccctcatcacaggttctaaaa

SEQ ID NO: 558389 - DNA, 25 bp, Rattus norvegicus
tagcccctcatctcaggttctaaaa

SEQ ID NO: 558390 - DNA, 25 bp, Rattus norvegicus
tagcccctcggcaaatgtgagaatt

SEQ ID NO: 558391 - DNA, 25 bp, Rattus norvegicus
tagcccctcggctaatgtgagaatt

SEQ ID NO: 558392 - DNA, 25 bp, Rattus norvegicus
tagcccctcttcagcttagagaagg

SEQ ID NO: 558393 - DNA, 25 bp, Rattus norvegicus
tagcccctcttctgcttagagaagg

SEQ ID NO: 558394 - DNA, 25 bp, Rattus norvegicus
tagcccctggccaaaccttgcagcc

SEQ ID NO: 558395 - DNA, 25 bp, Rattus norvegicus
tagcccctggcctaaccttgcagcc

SEQ ID NO: 558396 - DNA, 25 bp, Rattus norvegicus
tagccccttacccatattcttataa

SEQ ID NO: 558397 - DNA, 25 bp, Rattus norvegicus
tagccccttaccgatattcttataa

SEQ ID NO: 558398 - DNA, 25 bp, Rattus norvegicus
tagccccttctcacaggcattctgg

SEQ ID NO: 558399 - DNA, 25 bp, Rattus norvegicus
tagccccttctctcaggcattctgg

SEQ ID NO: 558400 - DNA, 25 bp, Rattus norvegicus
tagcccctttggacaactgtcgctg

SEQ ID NO: 558401 - DNA, 25 bp, Rattus norvegicus
tagcccctttggtcaactgtcgctg

SEQ ID NO: 558402 - DNA, 25 bp, Rattus norvegicus
tagcccgagcatctcatcatgttaa

SEQ ID NO: 558403 - DNA, 25 bp, Rattus norvegicus
tagcccgagcatgtcatcatgttaa

SEQ ID NO: 558404 - DNA, 25 bp, Rattus norvegicus
tagcccgcatctctaggttaatagc

SEQ ID NO: 558405 - DNA, 25 bp, Rattus norvegicus
tagcccgcatctgtaggttaatagc

SEQ ID NO: 558406 - DNA, 25 bp, Rattus norvegicus
tagcccgcctagcatgtatctctac

SEQ ID NO: 558407 - DNA, 25 bp, Rattus norvegicus
tagcccgcctaggatgtatctctac

SEQ ID NO: 558408 - DNA, 25 bp, Rattus norvegicus
tagcccgcctctagtccagggaaaa

SEQ ID NO: 558409 - DNA, 25 bp, Rattus norvegicus
tagcccgcctcttgtccagggaaaa

SEQ ID NO: 558410 - DNA, 25 bp, Rattus norvegicus
tagcccgcttgactgttactgtagt

SEQ ID NO: 558411 - DNA, 25 bp, Rattus norvegicus
tagcccgcttgagtgttactgtagt

SEQ ID NO: 558412 - DNA, 25 bp, Rattus norvegicus
tagcccgggatgacttcatcatctc

SEQ ID NO: 558413 - DNA, 25 bp, Rattus norvegicus
tagcccgggatgctcccagagctgc

SEQ ID NO: 558414 - DNA, 25 bp, Rattus norvegicus
tagcccgggatggtcccagagctgc

SEQ ID NO: 558415 - DNA, 25 bp, Rattus norvegicus
tagcccgggatgtcttcatcatctc

SEQ ID NO: 558416 - DNA, 25 bp, Rattus norvegicus
tagcccggtcataggcacattattt

SEQ ID NO: 558417 - DNA, 25 bp, Rattus norvegicus
tagcccggtcattggcacattattt

SEQ ID NO: 558418 - DNA, 25 bp, Rattus norvegicus
tagcccggttgccaaagagcaccaa

SEQ ID NO: 558419 - DNA, 25 bp, Rattus norvegicus
tagcccggttgcgaaagagcaccaa

SEQ ID NO: 558420 - DNA, 25 bp, Rattus norvegicus
tagcccgtgaccattttgctgcaga

SEQ ID NO: 558421 - DNA, 25 bp, Rattus norvegicus
tagcccgtgacctttttgctgcaga

SEQ ID NO: 558422 - DNA, 25 bp, Rattus norvegicus
tagccctaaacactgtgctgatgcc

SEQ ID NO: 558423 - DNA, 25 bp, Rattus norvegicus
tagccctaaacagtgtgctgatgcc

SEQ ID NO: 558424 - DNA, 25 bp, Rattus norvegicus
tagccctaactgctagttttttcct

SEQ ID NO: 558425 - DNA, 25 bp, Rattus norvegicus
tagccctaactggtagttttttcct

SEQ ID NO: 558426 - DNA, 25 bp, Rattus norvegicus
tagccctacaccctttgtccaaaga

SEQ ID NO: 558427 - DNA, 25 bp, Rattus norvegicus
tagccctacaccgtttgtccaaaga

SEQ ID NO: 558428 - DNA, 25 bp, Rattus norvegicus
tagccctacctaacagcactgaaaa

SEQ ID NO: 558429 - DNA, 25 bp, Rattus norvegicus
tagccctacctatcagcactgaaaa

SEQ ID NO: 558430 - DNA, 25 bp, Rattus norvegicus
tagccctagccacttgacgctgaag

SEQ ID NO: 558431 - DNA, 25 bp, Rattus norvegicus
tagccctagccagttgacgctgaag

SEQ ID NO: 558432 - DNA, 25 bp, Rattus norvegicus
tagccctagctgacgtggtgtacca

SEQ ID NO: 558433 - DNA, 25 bp, Rattus norvegicus
tagccctagctgtcgtggtgtacca

SEQ ID NO: 558434 - DNA, 25 bp, Rattus norvegicus
tagccctatgagatattaaaattgc

SEQ ID NO: 558435 - DNA, 25 bp, Rattus norvegicus
tagccctatgagttattaaaattgc

SEQ ID NO: 558436 - DNA, 25 bp, Rattus norvegicus
tagccctcagttccagctttggcaa

SEQ ID NO: 558437 - DNA, 25 bp, Rattus norvegicus
tagccctcagttgcagctttggcaa

SEQ ID NO: 558438 - DNA, 25 bp, Rattus norvegicus
tagccctcattccttcatgtgaaag

SEQ ID NO: 558439 - DNA, 25 bp, Rattus norvegicus
tagccctcattcgttcatgtgaaag

SEQ ID NO: 558440 - DNA, 25 bp, Rattus norvegicus
tagccctccttcatgaaagtacaga

SEQ ID NO: 558441 - DNA, 25 bp, Rattus norvegicus
tagccctccttcttgaaagtacaga

SEQ ID NO: 558442 - DNA, 25 bp, Rattus norvegicus
tagccctcgtgtcttgtgtatatac

SEQ ID NO: 558443 - DNA, 25 bp, Rattus norvegicus
tagccctcgtgtgttgtgtatatac

SEQ ID NO: 558444 - DNA, 25 bp, Rattus norvegicus
tagccctctcaccagttaaaggctg

SEQ ID NO: 558445 - DNA, 25 bp, Rattus norvegicus
tagccctctcacgagttaaaggctg

SEQ ID NO: 558446 - DNA, 25 bp, Rattus norvegicus
tagccctctcagacctgcgatacag

SEQ ID NO: 558447 - DNA, 25 bp, Rattus norvegicus
tagccctctcagtcctgcgatacag

SEQ ID NO: 558448 - DNA, 25 bp, Rattus norvegicus
tagccctctcctctcctaggaaaag

SEQ ID NO: 558449 - DNA, 25 bp, Rattus norvegicus
tagccctctcctgtcctaggaaaag

SEQ ID NO: 558450 - DNA, 25 bp, Rattus norvegicus
tagccctcttttacagccaggatgt

SEQ ID NO: 558451 - DNA, 25 bp, Rattus norvegicus
tagccctctttttcagccaggatgt

SEQ ID NO: 558452 - DNA, 25 bp, Rattus norvegicus
tagccctgaacacctcttcttttat

SEQ ID NO: 558453 - DNA, 25 bp, Rattus norvegicus
tagccctgaacagctcttcttttat

SEQ ID NO: 558454 - DNA, 25 bp, Rattus norvegicus
tagccctgaagtatgtgatcctgac

SEQ ID NO: 558455 - DNA, 25 bp, Rattus norvegicus
tagccctgaagtttgtgatcctgac

SEQ ID NO: 558456 - DNA, 25 bp, Rattus norvegicus
tagccctgacagagccagagtgtaa

SEQ ID NO: 558457 - DNA, 25 bp, Rattus norvegicus
tagccctgacagtgccagagtgtaa

SEQ ID NO: 558458 - DNA, 25 bp, Rattus norvegicus
tagccctgaggccacttactccaat

SEQ ID NO: 558459 - DNA, 25 bp, Rattus norvegicus
tagccctgaggcgacttactccaat

SEQ ID NO: 558460 - DNA, 25 bp, Rattus norvegicus
tagccctgagggagctggaacatga

SEQ ID NO: 558461 - DNA, 25 bp, Rattus norvegicus
tagccctgagggtgctggaacatga

SEQ ID NO: 558462 - DNA, 25 bp, Rattus norvegicus
tagccctgatggaacctatcgttta

SEQ ID NO: 558463 - DNA, 25 bp, Rattus norvegicus
tagccctgatggtacctatcgttta

SEQ ID NO: 558464 - DNA, 25 bp, Rattus norvegicus
tagccctgatgtacatatctgcctg

SEQ ID NO: 558465 - DNA, 25 bp, Rattus norvegicus
tagccctgatgttcatatctgcctg

SEQ ID NO: 558466 - DNA, 25 bp, Rattus norvegicus
tagccctgcattcctcagtcaataa

SEQ ID NO: 558467 - DNA, 25 bp, Rattus norvegicus
tagccctgcattgctcagtcaataa

SEQ ID NO: 558468 - DNA, 25 bp, Rattus norvegicus
tagccctgccaacggcggtccagct

SEQ ID NO: 558469 - DNA, 25 bp, Rattus norvegicus
tagccctgccaagggcggtccagct

SEQ ID NO: 558470 - DNA, 25 bp, Rattus norvegicus
tagccctgccttaggttttgaatga

SEQ ID NO: 558471 - DNA, 25 bp, Rattus norvegicus
tagccctgcctttggttttgaatga

SEQ ID NO: 558472 - DNA, 25 bp, Rattus norvegicus
tagccctgcggaaggtgaggccttt

SEQ ID NO: 558473 - DNA, 25 bp, Rattus norvegicus
tagccctgcggacttagcattacag

SEQ ID NO: 558474 - DNA, 25 bp, Rattus norvegicus
tagccctgcggagttagcattacag

SEQ ID NO: 558475 - DNA, 25 bp, Rattus norvegicus
tagccctgcggatggtgaggccttt

SEQ ID NO: 558476 - DNA, 25 bp, Rattus norvegicus
tagccctgcggcatgtggaattacc

SEQ ID NO: 558477 - DNA, 25 bp, Rattus norvegicus
tagccctgcggcttgtggaattacc

SEQ ID NO: 558478 - DNA, 25 bp, Rattus norvegicus
tagccctgctctctttatatttctc

SEQ ID NO: 558479 - DNA, 25 bp, Rattus norvegicus
tagccctgctctgtttatatttctc

SEQ ID NO: 558480 - DNA, 25 bp, Rattus norvegicus
tagccctgctgaaccatgtgcagag

SEQ ID NO: 558481 - DNA, 25 bp, Rattus norvegicus
tagccctgctgatccatgtgcagag

SEQ ID NO: 558482 - DNA, 25 bp, Rattus norvegicus
tagccctgctggatattacaacctc

SEQ ID NO: 558483 - DNA, 25 bp, Rattus norvegicus
tagccctgctggttattacaacctc

SEQ ID NO: 558484 - DNA, 25 bp, Rattus norvegicus
tagccctggaaacatggcatctatt

SEQ ID NO: 558485 - DNA, 25 bp, Rattus norvegicus
tagccctggaaagatggcatctatt

SEQ ID NO: 558486 - DNA, 25 bp, Rattus norvegicus
tagccctggcttatgttttgtttct

SEQ ID NO: 558487 - DNA, 25 bp, Rattus norvegicus
tagccctggcttttgttttgtttct

SEQ ID NO: 558488 - DNA, 25 bp, Rattus norvegicus
tagccctggttgagaaatcccatcg

SEQ ID NO: 558489 - DNA, 25 bp, Rattus norvegicus
tagccctggttgtgaaatcccatcg

SEQ ID NO: 558490 - DNA, 25 bp, Rattus norvegicus
tagccctgtctcattgtttcataaa

SEQ ID NO: 558491 - DNA, 25 bp, Rattus norvegicus
tagccctgtctctttgtttcataaa

SEQ ID NO: 558492 - DNA, 25 bp, Rattus norvegicus
tagccctgtggtcttcacgacacac

SEQ ID NO: 558493 - DNA, 25 bp, Rattus norvegicus
tagccctgtggtgttcacgacacac

SEQ ID NO: 558494 - DNA, 25 bp, Rattus norvegicus
tagccctgttgcacatggtatcgaa

SEQ ID NO: 558495 - DNA, 25 bp, Rattus norvegicus
tagccctgttgctcatggtatcgaa

SEQ ID NO: 558496 - DNA, 25 bp, Rattus norvegicus
tagcccttacatagcatacctgata

SEQ ID NO: 558497 - DNA, 25 bp, Rattus norvegicus
tagcccttacattgcatacctgata

SEQ ID NO: 558498 - DNA, 25 bp, Rattus norvegicus
tagcccttcatcaggaatttcatgg

SEQ ID NO: 558499 - DNA, 25 bp, Rattus norvegicus
tagcccttcatctggaatttcatgg

SEQ ID NO: 558500 - DNA, 25 bp, Rattus norvegicus
tagcccttctctacagtaatgcatg

SEQ ID NO: 558501 - DNA, 25 bp, Rattus norvegicus
tagcccttctcttcagtaatgcatg

SEQ ID NO: 558502 - DNA, 25 bp, Rattus norvegicus
tagcccttgacccatgtgactgcat

SEQ ID NO: 558503 - DNA, 25 bp, Rattus norvegicus
tagcccttgaccgatgtgactgcat

SEQ ID NO: 558504 - DNA, 25 bp, Rattus norvegicus
tagcccttgctgctgtatttaagat

SEQ ID NO: 558505 - DNA, 25 bp, Rattus norvegicus
tagcccttgctggtgtatttaagat

SEQ ID NO: 558506 - DNA, 25 bp, Rattus norvegicus
tagcccttggatcagtacgggaacc

SEQ ID NO: 558507 - DNA, 25 bp, Rattus norvegicus
tagcccttggatgagtacgggaacc

SEQ ID NO: 558508 - DNA, 25 bp, Rattus norvegicus
tagcccttggccaagcaatgcacat

SEQ ID NO: 558509 - DNA, 25 bp, Rattus norvegicus
tagcccttggcctagcaatgcacat

SEQ ID NO: 558510 - DNA, 25 bp, Rattus norvegicus
tagccctttccaacccagtgtggaa

SEQ ID NO: 558511 - DNA, 25 bp, Rattus norvegicus
tagccctttccatcccagtgtggaa

SEQ ID NO: 558512 - DNA, 25 bp, Rattus norvegicus
tagccctttgccagaactctgagta

SEQ ID NO: 558513 - DNA, 25 bp, Rattus norvegicus
tagccctttgcctgaactctgagta

SEQ ID NO: 558514 - DNA, 25 bp, Rattus norvegicus
tagccctttggccaggtttcagagt

SEQ ID NO: 558515 - DNA, 25 bp, Rattus norvegicus
tagccctttggcgaggtttcagagt

SEQ ID NO: 558516 - DNA, 25 bp, Rattus norvegicus
tagccgaagacgaacatgccccgcg

SEQ ID NO: 558517 - DNA, 25 bp, Rattus norvegicus
tagccgaagacgtacatgccccgcg

SEQ ID NO: 558518 - DNA, 25 bp, Rattus norvegicus
tagccgacaatacgcctagtgttga

SEQ ID NO: 558519 - DNA, 25 bp, Rattus norvegicus
tagccgacaataggcctagtgttga

SEQ ID NO: 558520 - DNA, 25 bp, Rattus norvegicus
tagccgagggcccacctctatggtt

SEQ ID NO: 558521 - DNA, 25 bp, Rattus norvegicus
tagccgagggccgacctctatggtt

SEQ ID NO: 558522 - DNA, 25 bp, Rattus norvegicus
tagccgagggctaccgtgtgattga

SEQ ID NO: 558523 - DNA, 25 bp, Rattus norvegicus
tagccgagggcttccgtgtgattga

SEQ ID NO: 558524 - DNA, 25 bp, Rattus norvegicus
tagccgagtgctcttaagatgtcca

SEQ ID NO: 558525 - DNA, 25 bp, Rattus norvegicus
tagccgagtgctgttaagatgtcca

SEQ ID NO: 558526 - DNA, 25 bp, Rattus norvegicus
tagccgattgctatggttctccatt

SEQ ID NO: 558527 - DNA, 25 bp, Rattus norvegicus
tagccgattgctttggttctccatt

SEQ ID NO: 558528 - DNA, 25 bp, Rattus norvegicus
tagccgcgggcgactgtaggcaacc

SEQ ID NO: 558529 - DNA, 25 bp, Rattus norvegicus
tagccgcgggcgtctgtaggcaacc

SEQ ID NO: 558530 - DNA, 25 bp, Rattus norvegicus
tagccgctccttctatcatggaaga

SEQ ID NO: 558531 - DNA, 25 bp, Rattus norvegicus
tagccgctccttgtatcatggaaga

SEQ ID NO: 558532 - DNA, 25 bp, Rattus norvegicus
tagccgcttggacaccaagaactaa

SEQ ID NO: 558533 - DNA, 25 bp, Rattus norvegicus
tagccgcttggagaccaagaactaa

SEQ ID NO: 558534 - DNA, 25 bp, Rattus norvegicus
tagccgcttggtatgcagtaacttg

SEQ ID NO: 558535 - DNA, 25 bp, Rattus norvegicus
tagccgcttggtttgcagtaacttg

SEQ ID NO: 558536 - DNA, 25 bp, Rattus norvegicus
tagccgctttggaatcaggcagaat

SEQ ID NO: 558537 - DNA, 25 bp, Rattus norvegicus
tagccgctttggtatcaggcagaat

SEQ ID NO: 558538 - DNA, 25 bp, Rattus norvegicus
tagccggaatcaccgtgcatgggac

SEQ ID NO: 558539 - DNA, 25 bp, Rattus norvegicus
tagccggaatcagcgtgcatgggac

SEQ ID NO: 558540 - DNA, 25 bp, Rattus norvegicus
tagccggactctcattggtattcat

SEQ ID NO: 558541 - DNA, 25 bp, Rattus norvegicus
tagccggactctgattggtattcat

SEQ ID NO: 558542 - DNA, 25 bp, Rattus norvegicus
tagccggcagctaggcatggcagtt

SEQ ID NO: 558543 - DNA, 25 bp, Rattus norvegicus
tagccggcagcttggcatggcagtt

SEQ ID NO: 558544 - DNA, 25 bp, Rattus norvegicus
tagccggcaggaaagcagactcaat

SEQ ID NO: 558545 - DNA, 25 bp, Rattus norvegicus
tagccggcaggatagcagactcaat

SEQ ID NO: 558546 - DNA, 25 bp, Rattus norvegicus
tagccggcgggccaaaagaaccaag

SEQ ID NO: 558547 - DNA, 25 bp, Rattus norvegicus
tagccggcgggcgaaaagaaccaag

SEQ ID NO: 558548 - DNA, 25 bp, Rattus norvegicus
tagccgggagtgactcattccttca

SEQ ID NO: 558549 - DNA, 25 bp, Rattus norvegicus
tagccgggagtgtctcattccttca

SEQ ID NO: 558550 - DNA, 25 bp, Rattus norvegicus
tagccgtcattacaactgttgtgag

SEQ ID NO: 558551 - DNA, 25 bp, Rattus norvegicus
tagccgtcattagaactgttgtgag

SEQ ID NO: 558552 - DNA, 25 bp, Rattus norvegicus
tagccgtcttgaaccttgagagcaa

SEQ ID NO: 558553 - DNA, 25 bp, Rattus norvegicus
tagccgtcttgatccttgagagcaa

SEQ ID NO: 558554 - DNA, 25 bp, Rattus norvegicus
tagccgtgatctcctcccaggaaga

SEQ ID NO: 558555 - DNA, 25 bp, Rattus norvegicus
tagccgtgatctgctcccaggaaga

SEQ ID NO: 558556 - DNA, 25 bp, Rattus norvegicus
tagccgttatttaccaactttcaag

SEQ ID NO: 558557 - DNA, 25 bp, Rattus norvegicus
tagccgttattttccaactttcaag

SEQ ID NO: 558558 - DNA, 25 bp, Rattus norvegicus
tagccgttcttaacatcaccgtgtg

SEQ ID NO: 558559 - DNA, 25 bp, Rattus norvegicus
tagccgttcttatcatcaccgtgtg

SEQ ID NO: 558560 - DNA, 25 bp, Rattus norvegicus
tagccgttgagtatattcgtttagc

SEQ ID NO: 558561 - DNA, 25 bp, Rattus norvegicus
tagccgttgagtttattcgtttagc

SEQ ID NO: 558562 - DNA, 25 bp, Rattus norvegicus
tagccgttgatcactgtttggatac

SEQ ID NO: 558563 - DNA, 25 bp, Rattus norvegicus
tagccgttgatctctgtttggatac

SEQ ID NO: 558564 - DNA, 25 bp, Rattus norvegicus
tagccgtttatcatatgtgcagcca

SEQ ID NO: 558565 - DNA, 25 bp, Rattus norvegicus
tagccgtttatcttatgtgcagcca

SEQ ID NO: 558566 - DNA, 25 bp, Rattus norvegicus
tagcctaaaacacatgaggccttag

SEQ ID NO: 558567 - DNA, 25 bp, Rattus norvegicus
tagcctaaaacagatgaggccttag

SEQ ID NO: 558568 - DNA, 25 bp, Rattus norvegicus
tagcctaaaggcacagggcacccat

SEQ ID NO: 558569 - DNA, 25 bp, Rattus norvegicus
tagcctaaaggctcagggcacccat

SEQ ID NO: 558570 - DNA, 25 bp, Rattus norvegicus
tagcctaacagtactggtcttccag

SEQ ID NO: 558571 - DNA, 25 bp, Rattus norvegicus
tagcctaacagttctggtcttccag

SEQ ID NO: 558572 - DNA, 25 bp, Rattus norvegicus
tagcctaagcctatagcgagtctgg

SEQ ID NO: 558573 - DNA, 25 bp, Rattus norvegicus
tagcctaagcctttagcgagtctgg

SEQ ID NO: 558574 - DNA, 25 bp, Rattus norvegicus
tagcctaagctgctctgggatacac

SEQ ID NO: 558575 - DNA, 25 bp, Rattus norvegicus
tagcctaagctggtctgggatacac

SEQ ID NO: 558576 - DNA, 25 bp, Rattus norvegicus
tagcctaataccagtgattgtctag

SEQ ID NO: 558577 - DNA, 25 bp, Rattus norvegicus
tagcctaatacctgtgattgtctag

SEQ ID NO: 558578 - DNA, 25 bp, Rattus norvegicus
tagcctaatttaaccgtaagtcagc

SEQ ID NO: 558579 - DNA, 25 bp, Rattus norvegicus
tagcctaatttatccgtaagtcagc

SEQ ID NO: 558580 - DNA, 25 bp, Rattus norvegicus
tagcctaccgcaatagcccaagaga

SEQ ID NO: 558581 - DNA, 25 bp, Rattus norvegicus
tagcctaccgcattagcccaagaga

SEQ ID NO: 558582 - DNA, 25 bp, Rattus norvegicus
tagcctacctagagagttcctgtca

SEQ ID NO: 558583 - DNA, 25 bp, Rattus norvegicus
tagcctacctagatttctcatgacg

SEQ ID NO: 558584 - DNA, 25 bp, Rattus norvegicus
tagcctacctagtgagttcctgtca

SEQ ID NO: 558585 - DNA, 25 bp, Rattus norvegicus
tagcctacctagttttctcatgacg

SEQ ID NO: 558586 - DNA, 25 bp, Rattus norvegicus
tagcctacgtggagctgtgtcctct

SEQ ID NO: 558587 - DNA, 25 bp, Rattus norvegicus
tagcctacgtggtgctgtgtcctct

SEQ ID NO: 558588 - DNA, 25 bp, Rattus norvegicus
tagcctactcccaagtaagagcaga

SEQ ID NO: 558589 - DNA, 25 bp, Rattus norvegicus
tagcctactccctagtaagagcaga

SEQ ID NO: 558590 - DNA, 25 bp, Rattus norvegicus
tagcctagactacgtaagaccttgt

SEQ ID NO: 558591 - DNA, 25 bp, Rattus norvegicus
tagcctagactaggtaagaccttgt

SEQ ID NO: 558592 - DNA, 25 bp, Rattus norvegicus
tagcctagcaccaatgtactaccga

SEQ ID NO: 558593 - DNA, 25 bp, Rattus norvegicus
tagcctagcacctatgtactaccga

SEQ ID NO: 558594 - DNA, 25 bp, Rattus norvegicus
tagcctagcttcctgctgttgaaca

SEQ ID NO: 558595 - DNA, 25 bp, Rattus norvegicus
tagcctagcttcgtgctgttgaaca

SEQ ID NO: 558596 - DNA, 25 bp, Rattus norvegicus
tagcctaggctgattcactacccaa

SEQ ID NO: 558597 - DNA, 25 bp, Rattus norvegicus
tagcctaggctgtttcactacccaa

SEQ ID NO: 558598 - DNA, 25 bp, Rattus norvegicus
tagcctagggctacgacattgcatg

SEQ ID NO: 558599 - DNA, 25 bp, Rattus norvegicus
tagcctagggcttcgacattgcatg

SEQ ID NO: 558600 - DNA, 25 bp, Rattus norvegicus
tagcctagtgatcttgagttcctga

SEQ ID NO: 558601 - DNA, 25 bp, Rattus norvegicus
tagcctagtgatgttgagttcctga

SEQ ID NO: 558602 - DNA, 25 bp, Rattus norvegicus
tagcctatcatccaccagaggtagt

SEQ ID NO: 558603 - DNA, 25 bp, Rattus norvegicus
tagcctatcatcgaccagaggtagt

SEQ ID NO: 558604 - DNA, 25 bp, Rattus norvegicus
tagcctatcccgaaaggtggttgtc

SEQ ID NO: 558605 - DNA, 25 bp, Rattus norvegicus
tagcctatcccgtaaggtggttgtc

SEQ ID NO: 558606 - DNA, 25 bp, Rattus norvegicus
tagcctatttttctgcttaagatac

SEQ ID NO: 558607 - DNA, 25 bp, Rattus norvegicus
tagcctatttttgtgcttaagatac

SEQ ID NO: 558608 - DNA, 25 bp, Rattus norvegicus
tagcctcaaccaaccatttttcttt

SEQ ID NO: 558609 - DNA, 25 bp, Rattus norvegicus
tagcctcaaccatccatttttcttt

SEQ ID NO: 558610 - DNA, 25 bp, Rattus norvegicus
tagcctcaacttccagtggcaaatg

SEQ ID NO: 558611 - DNA, 25 bp, Rattus norvegicus
tagcctcaacttgcagtggcaaatg

SEQ ID NO: 558612 - DNA, 25 bp, Rattus norvegicus
tagcctcaagagagattccttgccc

SEQ ID NO: 558613 - DNA, 25 bp, Rattus norvegicus
tagcctcaagagtgattccttgccc

SEQ ID NO: 558614 - DNA, 25 bp, Rattus norvegicus
tagcctcaggcacatttccaaagct

SEQ ID NO: 558615 - DNA, 25 bp, Rattus norvegicus
tagcctcaggcagatttccaaagct

SEQ ID NO: 558616 - DNA, 25 bp, Rattus norvegicus
tagcctcaggctctgggaattgcag

SEQ ID NO: 558617 - DNA, 25 bp, Rattus norvegicus
tagcctcaggctgtgggaattgcag

SEQ ID NO: 558618 - DNA, 25 bp, Rattus norvegicus
tagcctcagtccatatgtccttgat

SEQ ID NO: 558619 - DNA, 25 bp, Rattus norvegicus
tagcctcagtccttatgtccttgat

SEQ ID NO: 558620 - DNA, 25 bp, Rattus norvegicus
tagcctcatcacaccaagccggctc

SEQ ID NO: 558621 - DNA, 25 bp, Rattus norvegicus
tagcctcatcactccaagccggctc

SEQ ID NO: 558622 - DNA, 25 bp, Rattus norvegicus
tagcctccactgagttcacctgtaa

SEQ ID NO: 558623 - DNA, 25 bp, Rattus norvegicus
tagcctccactgtgttcacctgtaa

SEQ ID NO: 558624 - DNA, 25 bp, Rattus norvegicus
tagcctccaggtatgtttatatagc

SEQ ID NO: 558625 - DNA, 25 bp, Rattus norvegicus
tagcctccaggtttgtttatatagc

SEQ ID NO: 558626 - DNA, 25 bp, Rattus norvegicus
tagcctccctcaacctaggaaaagg

SEQ ID NO: 558627 - DNA, 25 bp, Rattus norvegicus
tagcctccctcatcctaggaaaagg

SEQ ID NO: 558628 - DNA, 25 bp, Rattus norvegicus
tagcctccctctactggattgagaa

SEQ ID NO: 558629 - DNA, 25 bp, Rattus norvegicus
tagcctccctcttctggattgagaa

SEQ ID NO: 558630 - DNA, 25 bp, Rattus norvegicus
tagcctcccttacccatttaaacag

SEQ ID NO: 558631 - DNA, 25 bp, Rattus norvegicus
tagcctcccttagccatttaaacag

SEQ ID NO: 558632 - DNA, 25 bp, Rattus norvegicus
tagcctccgctaaattgaccacgtg

SEQ ID NO: 558633 - DNA, 25 bp, Rattus norvegicus
tagcctccgctatattgaccacgtg

SEQ ID NO: 558634 - DNA, 25 bp, Rattus norvegicus
tagcctcctcacatacagtattcag

SEQ ID NO: 558635 - DNA, 25 bp, Rattus norvegicus
tagcctcctcacttacagtattcag

SEQ ID NO: 558636 - DNA, 25 bp, Rattus norvegicus
tagcctcgtgttagagcctgctgaa

SEQ ID NO: 558637 - DNA, 25 bp, Rattus norvegicus
tagcctcgtgtttgagcctgctgaa

SEQ ID NO: 558638 - DNA, 25 bp, Rattus norvegicus
tagcctctacatctagtgacataca

SEQ ID NO: 558639 - DNA, 25 bp, Rattus norvegicus
tagcctctacatgtagtgacataca

SEQ ID NO: 558640 - DNA, 25 bp, Rattus norvegicus
tagcctctagtcagacggtcacggg

SEQ ID NO: 558641 - DNA, 25 bp, Rattus norvegicus
tagcctctagtctgacggtcacggg

SEQ ID NO: 558642 - DNA, 25 bp, Rattus norvegicus
tagcctctatccctggagtgcaagc

SEQ ID NO: 558643 - DNA, 25 bp, Rattus norvegicus
tagcctctatccgtggagtgcaagc

SEQ ID NO: 558644 - DNA, 25 bp, Rattus norvegicus
tagcctctatggaccctgatcaaaa

SEQ ID NO: 558645 - DNA, 25 bp, Rattus norvegicus
tagcctctatggtccctgatcaaaa

SEQ ID NO: 558646 - DNA, 25 bp, Rattus norvegicus
tagcctctatttcccataatacctt

SEQ ID NO: 558647 - DNA, 25 bp, Rattus norvegicus
tagcctctatttgccataatacctt

SEQ ID NO: 558648 - DNA, 25 bp, Rattus norvegicus
tagcctctcagaatcttatcaagaa

SEQ ID NO: 558649 - DNA, 25 bp, Rattus norvegicus
tagcctctcagattcttatcaagaa

SEQ ID NO: 558650 - DNA, 25 bp, Rattus norvegicus
tagcctctccaaatgtcaacagtat

SEQ ID NO: 558651 - DNA, 25 bp, Rattus norvegicus
tagcctctccaattgtcaacagtat

SEQ ID NO: 558652 - DNA, 25 bp, Rattus norvegicus
tagcctctctggacagatgcagtcc

SEQ ID NO: 558653 - DNA, 25 bp, Rattus norvegicus
tagcctctctggtcagatgcagtcc

SEQ ID NO: 558654 - DNA, 25 bp, Rattus norvegicus
tagcctctctttagcactgctggtt

SEQ ID NO: 558655 - DNA, 25 bp, Rattus norvegicus
tagcctctcttttgcactgctggtt

SEQ ID NO: 558656 - DNA, 25 bp, Rattus norvegicus
tagcctctgcctcaatgcttctgga

SEQ ID NO: 558657 - DNA, 25 bp, Rattus norvegicus
tagcctctgcctgaatgcttctgga

SEQ ID NO: 558658 - DNA, 25 bp, Rattus norvegicus
tagcctctgctacttctagaaggtc

SEQ ID NO: 558659 - DNA, 25 bp, Rattus norvegicus
tagcctctgctagttctagaaggtc

SEQ ID NO: 558660 - DNA, 25 bp, Rattus norvegicus
tagcctctgctgacaccaagcatac

SEQ ID NO: 558661 - DNA, 25 bp, Rattus norvegicus
tagcctctgctgtcaccaagcatac

SEQ ID NO: 558662 - DNA, 25 bp, Rattus norvegicus
tagcctctgggtccacacatgcata

SEQ ID NO: 558663 - DNA, 25 bp, Rattus norvegicus
tagcctctgggtgcacacatgcata

SEQ ID NO: 558664 - DNA, 25 bp, Rattus norvegicus
tagcctctggtcacatctcattatt

SEQ ID NO: 558665 - DNA, 25 bp, Rattus norvegicus
tagcctctggtctcatctcattatt

SEQ ID NO: 558666 - DNA, 25 bp, Rattus norvegicus
tagcctctgtacatagtttcgcatg

SEQ ID NO: 558667 - DNA, 25 bp, Rattus norvegicus
tagcctctgtacttagtttcgcatg

SEQ ID NO: 558668 - DNA, 25 bp, Rattus norvegicus
tagcctctgtagcttattccttcag

SEQ ID NO: 558669 - DNA, 25 bp, Rattus norvegicus
tagcctctgtaggttattccttcag

SEQ ID NO: 558670 - DNA, 25 bp, Rattus norvegicus
tagcctctgtatagttcctttttta

SEQ ID NO: 558671 - DNA, 25 bp, Rattus norvegicus
tagcctctgtattgttcctttttta

SEQ ID NO: 558672 - DNA, 25 bp, Rattus norvegicus
tagcctcttgtcaagattgtgtcat

SEQ ID NO: 558673 - DNA, 25 bp, Rattus norvegicus
tagcctcttgtctagattgtgtcat

SEQ ID NO: 558674 - DNA, 25 bp, Rattus norvegicus
tagcctgaaagaccccctcgcagaa

SEQ ID NO: 558675 - DNA, 25 bp, Rattus norvegicus
tagcctgaaagagcccctcgcagaa

SEQ ID NO: 558676 - DNA, 25 bp, Rattus norvegicus
tagcctgacatcaagcaccttttaa

SEQ ID NO: 558677 - DNA, 25 bp, Rattus norvegicus
tagcctgacatctagcaccttttaa

SEQ ID NO: 558678 - DNA, 25 bp, Rattus norvegicus
tagcctgacctacagatcgagttcc

SEQ ID NO: 558679 - DNA, 25 bp, Rattus norvegicus
tagcctgacctagagatcgagttcc

SEQ ID NO: 558680 - DNA, 25 bp, Rattus norvegicus
tagcctgactccagaagttctggaa

SEQ ID NO: 558681 - DNA, 25 bp, Rattus norvegicus
tagcctgactcctgaagttctggaa

SEQ ID NO: 558682 - DNA, 25 bp, Rattus norvegicus
tagcctgagtatatgatgagatcca

SEQ ID NO: 558683 - DNA, 25 bp, Rattus norvegicus
tagcctgagtatttgatgagatcca

SEQ ID NO: 558684 - DNA, 25 bp, Rattus norvegicus
tagcctgattggagtgccctctagt

SEQ ID NO: 558685 - DNA, 25 bp, Rattus norvegicus
tagcctgattggtgtgccctctagt

SEQ ID NO: 558686 - DNA, 25 bp, Rattus norvegicus
tagcctgcagagagaaataccaatt

SEQ ID NO: 558687 - DNA, 25 bp, Rattus norvegicus
tagcctgcagagtgaaataccaatt

SEQ ID NO: 558688 - DNA, 25 bp, Rattus norvegicus
tagcctgcagccatgtcagaatggc

SEQ ID NO: 558689 - DNA, 25 bp, Rattus norvegicus
tagcctgcagccttgtcagaatggc

SEQ ID NO: 558690 - DNA, 25 bp, Rattus norvegicus
tagcctgccaccaactttatagagt

SEQ ID NO: 558691 - DNA, 25 bp, Rattus norvegicus
tagcctgccacctactttatagagt

SEQ ID NO: 558692 - DNA, 25 bp, Rattus norvegicus
tagcctgccagaacctagacctcaa

SEQ ID NO: 558693 - DNA, 25 bp, Rattus norvegicus
tagcctgccagatcctagacctcaa

SEQ ID NO: 558694 - DNA, 25 bp, Rattus norvegicus
tagcctgccattacatgtcataggg

SEQ ID NO: 558695 - DNA, 25 bp, Rattus norvegicus
tagcctgccatttcatgtcataggg

SEQ ID NO: 558696 - DNA, 25 bp, Rattus norvegicus
tagcctgcctgtccaaaagaacccc

SEQ ID NO: 558697 - DNA, 25 bp, Rattus norvegicus
tagcctgcctgtgcaaaagaacccc

SEQ ID NO: 558698 - DNA, 25 bp, Rattus norvegicus
tagcctgcgtttcacttttggcaaa

SEQ ID NO: 558699 - DNA, 25 bp, Rattus norvegicus
tagcctgcgtttgacttttggcaaa

SEQ ID NO: 558700 - DNA, 25 bp, Rattus norvegicus
tagcctgcttttcctccaatgaatg

SEQ ID NO: 558701 - DNA, 25 bp, Rattus norvegicus
tagcctgcttttgctccaatgaatg

SEQ ID NO: 558702 - DNA, 25 bp, Rattus norvegicus
tagcctggaacaactcctgattttc

SEQ ID NO: 558703 - DNA, 25 bp, Rattus norvegicus
tagcctggaacatctcctgattttc

SEQ ID NO: 558704 - DNA, 25 bp, Rattus norvegicus
tagcctggactgctacacagttaga

SEQ ID NO: 558705 - DNA, 25 bp, Rattus norvegicus
tagcctggactgctgccttttgtaa

SEQ ID NO: 558706 - DNA, 25 bp, Rattus norvegicus
tagcctggactggtacacagttaga

SEQ ID NO: 558707 - DNA, 25 bp, Rattus norvegicus
tagcctggactggtgccttttgtaa

SEQ ID NO: 558708 - DNA, 25 bp, Rattus norvegicus
tagcctggagctatcacgggagtct

SEQ ID NO: 558709 - DNA, 25 bp, Rattus norvegicus
tagcctggagctcctagactggaca

SEQ ID NO: 558710 - DNA, 25 bp, Rattus norvegicus
tagcctggagctgctagactggaca

SEQ ID NO: 558711 - DNA, 25 bp, Rattus norvegicus
tagcctggagctttcacgggagtct

SEQ ID NO: 558712 - DNA, 25 bp, Rattus norvegicus
tagcctggatctcgcctcagctgaa

SEQ ID NO: 558713 - DNA, 25 bp, Rattus norvegicus
tagcctggatctggcctcagctgaa

SEQ ID NO: 558714 - DNA, 25 bp, Rattus norvegicus
tagcctggccaaaacggcgtttgat

SEQ ID NO: 558715 - DNA, 25 bp, Rattus norvegicus
tagcctggccaatacggcgtttgat

SEQ ID NO: 558716 - DNA, 25 bp, Rattus norvegicus
tagcctggccgtatacatacagctt

SEQ ID NO: 558717 - DNA, 25 bp, Rattus norvegicus
tagcctggccgtttacatacagctt

SEQ ID NO: 558718 - DNA, 25 bp, Rattus norvegicus
tagcctggctccagttggttgcaac

SEQ ID NO: 558719 - DNA, 25 bp, Rattus norvegicus
tagcctggctcctgttggttgcaac

SEQ ID NO: 558720 - DNA, 25 bp, Rattus norvegicus
tagcctgggatgacggttctgcaat

SEQ ID NO: 558721 - DNA, 25 bp, Rattus norvegicus
tagcctgggatgtcggttctgcaat

SEQ ID NO: 558722 - DNA, 25 bp, Rattus norvegicus
tagcctgggcagagagtgaaaatca

SEQ ID NO: 558723 - DNA, 25 bp, Rattus norvegicus
tagcctgggcagtgagtgaaaatca

SEQ ID NO: 558724 - DNA, 25 bp, Rattus norvegicus
tagcctgggtgtaactggtctgtta

SEQ ID NO: 558725 - DNA, 25 bp, Rattus norvegicus
tagcctgggtgtccaatatgcctca

SEQ ID NO: 558726 - DNA, 25 bp, Rattus norvegicus
tagcctgggtgtgcaatatgcctca

SEQ ID NO: 558727 - DNA, 25 bp, Rattus norvegicus
tagcctgggtgttactggtctgtta

SEQ ID NO: 558728 - DNA, 25 bp, Rattus norvegicus
tagcctggtatgatccaactgggat

SEQ ID NO: 558729 - DNA, 25 bp, Rattus norvegicus
tagcctggtatgttccaactgggat

SEQ ID NO: 558730 - DNA, 25 bp, Rattus norvegicus
tagcctggtctacagttagtttctg

SEQ ID NO: 558731 - DNA, 25 bp, Rattus norvegicus
tagcctggtctacggccgaagcagt

SEQ ID NO: 558732 - DNA, 25 bp, Rattus norvegicus
tagcctggtctagagttagtttctg

SEQ ID NO: 558733 - DNA, 25 bp, Rattus norvegicus
tagcctggtctagggccgaagcagt

SEQ ID NO: 558734 - DNA, 25 bp, Rattus norvegicus
tagcctggtcttagatttcctcgag

SEQ ID NO: 558735 - DNA, 25 bp, Rattus norvegicus
tagcctggtctttgatttcctcgag

SEQ ID NO: 558736 - DNA, 25 bp, Rattus norvegicus
tagcctggtgacctgctgatggata

SEQ ID NO: 558737 - DNA, 25 bp, Rattus norvegicus
tagcctggtgacgtgctgatggata

SEQ ID NO: 558738 - DNA, 25 bp, Rattus norvegicus
tagcctggttctctttctcagcaat

SEQ ID NO: 558739 - DNA, 25 bp, Rattus norvegicus
tagcctggttctgtttctcagcaat

SEQ ID NO: 558740 - DNA, 25 bp, Rattus norvegicus
tagcctgtatgtattctttgagatc

SEQ ID NO: 558741 - DNA, 25 bp, Rattus norvegicus
tagcctgtatgttttctttgagatc

SEQ ID NO: 558742 - DNA, 25 bp, Rattus norvegicus
tagcctgtcattaatattcatggtg

SEQ ID NO: 558743 - DNA, 25 bp, Rattus norvegicus
tagcctgtcatttatattcatggtg

SEQ ID NO: 558744 - DNA, 25 bp, Rattus norvegicus
tagcctgtccgcatggaagtcagtt

SEQ ID NO: 558745 - DNA, 25 bp, Rattus norvegicus
tagcctgtccgcttggaagtcagtt

SEQ ID NO: 558746 - DNA, 25 bp, Rattus norvegicus
tagcctgtcctcaagtccaattttg

SEQ ID NO: 558747 - DNA, 25 bp, Rattus norvegicus
tagcctgtcctcaatacagtgtctt

SEQ ID NO: 558748 - DNA, 25 bp, Rattus norvegicus
tagcctgtcctctagtccaattttg

SEQ ID NO: 558749 - DNA, 25 bp, Rattus norvegicus
tagcctgtcctctatacagtgtctt

SEQ ID NO: 558750 - DNA, 25 bp, Rattus norvegicus
tagcctgtcgcgattgtgtttctta

SEQ ID NO: 558751 - DNA, 25 bp, Rattus norvegicus
tagcctgtcgcgtttgtgtttctta

SEQ ID NO: 558752 - DNA, 25 bp, Rattus norvegicus
tagcctgtctctagtggttgcaaac

SEQ ID NO: 558753 - DNA, 25 bp, Rattus norvegicus
tagcctgtctcttgtggttgcaaac

SEQ ID NO: 558754 - DNA, 25 bp, Rattus norvegicus
tagcctgtctggatgattgtgcatg

SEQ ID NO: 558755 - DNA, 25 bp, Rattus norvegicus
tagcctgtctggttgattgtgcatg

SEQ ID NO: 558756 - DNA, 25 bp, Rattus norvegicus
tagcctgtgcatccactgtcataaa

SEQ ID NO: 558757 - DNA, 25 bp, Rattus norvegicus
tagcctgtgcatgcactgtcataaa

SEQ ID NO: 558758 - DNA, 25 bp, Rattus norvegicus
tagcctgtgctcagcgagggtccaa

SEQ ID NO: 558759 - DNA, 25 bp, Rattus norvegicus
tagcctgtgctctgcgagggtccaa

SEQ ID NO: 558760 - DNA, 25 bp, Rattus norvegicus
tagcctgtgtccaatgagtgtccat

SEQ ID NO: 558761 - DNA, 25 bp, Rattus norvegicus
tagcctgtgtcctatgagtgtccat

SEQ ID NO: 558762 - DNA, 25 bp, Rattus norvegicus
tagcctgttagcatttgcggtcacc

SEQ ID NO: 558763 - DNA, 25 bp, Rattus norvegicus
tagcctgttagcttttgcggtcacc

SEQ ID NO: 558764 - DNA, 25 bp, Rattus norvegicus
tagcctgttgctcccagaggacatg

SEQ ID NO: 558765 - DNA, 25 bp, Rattus norvegicus
tagcctgttgctgccagaggacatg

SEQ ID NO: 558766 - DNA, 25 bp, Rattus norvegicus
tagccttaaagtccctcagtgtttt

SEQ ID NO: 558767 - DNA, 25 bp, Rattus norvegicus
tagccttaaagtgcctcagtgtttt

SEQ ID NO: 558768 - DNA, 25 bp, Rattus norvegicus
tagccttaaattctcagcagtcctc

SEQ ID NO: 558769 - DNA, 25 bp, Rattus norvegicus
tagccttaaattgtcagcagtcctc

SEQ ID NO: 558770 - DNA, 25 bp, Rattus norvegicus
tagccttagcttattggacagcgtt

SEQ ID NO: 558771 - DNA, 25 bp, Rattus norvegicus
tagccttagctttttggacagcgtt

SEQ ID NO: 558772 - DNA, 25 bp, Rattus norvegicus
tagccttattgcctctgactcttag

SEQ ID NO: 558773 - DNA, 25 bp, Rattus norvegicus
tagccttattgcgtctgactcttag

SEQ ID NO: 558774 - DNA, 25 bp, Rattus norvegicus
tagccttcagagataacgtccacgt

SEQ ID NO: 558775 - DNA, 25 bp, Rattus norvegicus
tagccttcagagttaacgtccacgt

SEQ ID NO: 558776 - DNA, 25 bp, Rattus norvegicus
tagccttcagcactagattggtact

SEQ ID NO: 558777 - DNA, 25 bp, Rattus norvegicus
tagccttcagcagtagattggtact

SEQ ID NO: 558778 - DNA, 25 bp, Rattus norvegicus
tagccttccagtatatgtatataga

SEQ ID NO: 558779 - DNA, 25 bp, Rattus norvegicus
tagccttccagtttatgtatataga

SEQ ID NO: 558780 - DNA, 25 bp, Rattus norvegicus
tagccttccctgaatgtgtgcatgc

SEQ ID NO: 558781 - DNA, 25 bp, Rattus norvegicus
tagccttccctgtatgtgtgcatgc

SEQ ID NO: 558782 - DNA, 25 bp, Rattus norvegicus
tagccttcccttagacatgaacgta

SEQ ID NO: 558783 - DNA, 25 bp, Rattus norvegicus
tagccttccctttgacatgaacgta

SEQ ID NO: 558784 - DNA, 25 bp, Rattus norvegicus
tagccttcctgcagagttcattgtg

SEQ ID NO: 558785 - DNA, 25 bp, Rattus norvegicus
tagccttcctgctgagttcattgtg

SEQ ID NO: 558786 - DNA, 25 bp, Rattus norvegicus
tagccttccttgcaaccagagtatt

SEQ ID NO: 558787 - DNA, 25 bp, Rattus norvegicus
tagccttccttggaaccagagtatt

SEQ ID NO: 558788 - DNA, 25 bp, Rattus norvegicus
tagccttctagcagtgaccctggaa

SEQ ID NO: 558789 - DNA, 25 bp, Rattus norvegicus
tagccttctagctgtgaccctggaa

SEQ ID NO: 558790 - DNA, 25 bp, Rattus norvegicus
tagccttgaagacctggaagccgcc

SEQ ID NO: 558791 - DNA, 25 bp, Rattus norvegicus
tagccttgaagagctggaagccgcc

SEQ ID NO: 558792 - DNA, 25 bp, Rattus norvegicus
tagccttgacaaccatcctgtaatg

SEQ ID NO: 558793 - DNA, 25 bp, Rattus norvegicus
tagccttgacaagcatcctgtaatg

SEQ ID NO: 558794 - DNA, 25 bp, Rattus norvegicus
tagccttgatatactttgtaatttc

SEQ ID NO: 558795 - DNA, 25 bp, Rattus norvegicus
tagccttgatattctttgtaatttc

SEQ ID NO: 558796 - DNA, 25 bp, Rattus norvegicus
tagccttgatggatctggagctcgc

SEQ ID NO: 558797 - DNA, 25 bp, Rattus norvegicus
tagccttgatggttctggagctcgc

SEQ ID NO: 558798 - DNA, 25 bp, Rattus norvegicus
tagccttgcatcaatccttttcttc

SEQ ID NO: 558799 - DNA, 25 bp, Rattus norvegicus
tagccttgcatctatccttttcttc

SEQ ID NO: 558800 - DNA, 25 bp, Rattus norvegicus
tagccttgccagctgttgggcccaa

SEQ ID NO: 558801 - DNA, 25 bp, Rattus norvegicus
tagccttgccaggtgttgggcccaa

SEQ ID NO: 558802 - DNA, 25 bp, Rattus norvegicus
tagccttgcggaagaagcagcagct

SEQ ID NO: 558803 - DNA, 25 bp, Rattus norvegicus
tagccttgcggatgaagcagcagct

SEQ ID NO: 558804 - DNA, 25 bp, Rattus norvegicus
tagccttgctctagacccataactt

SEQ ID NO: 558805 - DNA, 25 bp, Rattus norvegicus
tagccttgctcttgacccataactt

SEQ ID NO: 558806 - DNA, 25 bp, Rattus norvegicus
tagccttggctactgactgtgactg

SEQ ID NO: 558807 - DNA, 25 bp, Rattus norvegicus
tagccttggctagtgactgtgactg

SEQ ID NO: 558808 - DNA, 25 bp, Rattus norvegicus
tagccttgggacctttttgtggagt

SEQ ID NO: 558809 - DNA, 25 bp, Rattus norvegicus
tagccttgggacgtttttgtggagt

SEQ ID NO: 558810 - DNA, 25 bp, Rattus norvegicus
tagccttggtgcacagtgatctcca

SEQ ID NO: 558811 - DNA, 25 bp, Rattus norvegicus
tagccttggtgctcagtgatctcca

SEQ ID NO: 558812 - DNA, 25 bp, Rattus norvegicus
tagccttggttcatttgcctaaact

SEQ ID NO: 558813 - DNA, 25 bp, Rattus norvegicus
tagccttggttcttttgcctaaact

SEQ ID NO: 558814 - DNA, 25 bp, Rattus norvegicus
tagccttgtgtcatcttctcactct

SEQ ID NO: 558815 - DNA, 25 bp, Rattus norvegicus
tagccttgtgtcttcttctcactct

SEQ ID NO: 558816 - DNA, 25 bp, Rattus norvegicus
tagcctttagtacggcaagaggatc

SEQ ID NO: 558817 - DNA, 25 bp, Rattus norvegicus
tagcctttagtagggcaagaggatc

SEQ ID NO: 558818 - DNA, 25 bp, Rattus norvegicus
tagcctttagtcatggcatgtaatg

SEQ ID NO: 558819 - DNA, 25 bp, Rattus norvegicus
tagcctttagtcttggcatgtaatg

SEQ ID NO: 558820 - DNA, 25 bp, Rattus norvegicus
tagcctttcagaagtggatacccca

SEQ ID NO: 558821 - DNA, 25 bp, Rattus norvegicus
tagcctttcagatgtggatacccca

SEQ ID NO: 558822 - DNA, 25 bp, Rattus norvegicus
tagcctttcctcagagactatctag

SEQ ID NO: 558823 - DNA, 25 bp, Rattus norvegicus
tagcctttcctctgagactatctag

SEQ ID NO: 558824 - DNA, 25 bp, Rattus norvegicus
tagcctttccttctggtgcatctgt

SEQ ID NO: 558825 - DNA, 25 bp, Rattus norvegicus
tagcctttccttgtggtgcatctgt

SEQ ID NO: 558826 - DNA, 25 bp, Rattus norvegicus
tagcctttctggcttcctttttgat

SEQ ID NO: 558827 - DNA, 25 bp, Rattus norvegicus
tagcctttctgggttcctttttgat

SEQ ID NO: 558828 - DNA, 25 bp, Rattus norvegicus
tagcctttcttacgctgcaccaaag

SEQ ID NO: 558829 - DNA, 25 bp, Rattus norvegicus
tagcctttcttaggctgcaccaaag

SEQ ID NO: 558830 - DNA, 25 bp, Rattus norvegicus
tagcctttcttcatgtgtcaggatg

SEQ ID NO: 558831 - DNA, 25 bp, Rattus norvegicus
tagcctttcttcttgtgtcaggatg

SEQ ID NO: 558832 - DNA, 25 bp, Rattus norvegicus
tagcctttgacacctgagccatttc

SEQ ID NO: 558833 - DNA, 25 bp, Rattus norvegicus
tagcctttgacagctgagccatttc

SEQ ID NO: 558834 - DNA, 25 bp, Rattus norvegicus
tagcctttgctcatggctttacctg

SEQ ID NO: 558835 - DNA, 25 bp, Rattus norvegicus
tagcctttgctcttggctttacctg

SEQ ID NO: 558836 - DNA, 25 bp, Rattus norvegicus
tagcctttggcgacctaggttcaac

SEQ ID NO: 558837 - DNA, 25 bp, Rattus norvegicus
tagcctttggcgtcctaggttcaac

SEQ ID NO: 558838 - DNA, 25 bp, Rattus norvegicus
tagcctttgggcacttgaaagcttt

SEQ ID NO: 558839 - DNA, 25 bp, Rattus norvegicus
tagcctttgggctcttgaaagcttt

SEQ ID NO: 558840 - DNA, 25 bp, Rattus norvegicus
tagcctttgtgtatgtatgccattt

SEQ ID NO: 558841 - DNA, 25 bp, Rattus norvegicus
tagcctttgtgtttgtatgccattt

SEQ ID NO: 558842 - DNA, 25 bp, Rattus norvegicus
tagccttttaccactagtatcctta

SEQ ID NO: 558843 - DNA, 25 bp, Rattus norvegicus
tagccttttacctctagtatcctta

SEQ ID NO: 558844 - DNA, 25 bp, Rattus norvegicus
tagccttttattaaccttaagatgg

SEQ ID NO: 558845 - DNA, 25 bp, Rattus norvegicus
tagccttttatttaccttaagatgg

SEQ ID NO: 558846 - DNA, 25 bp, Rattus norvegicus
tagccttttgtacttttgcccaaag

SEQ ID NO: 558847 - DNA, 25 bp, Rattus norvegicus
tagccttttgtagttttgcccaaag

SEQ ID NO: 558848 - DNA, 25 bp, Rattus norvegicus
tagccttttgtgctggtgtgttaaa

SEQ ID NO: 558849 - DNA, 25 bp, Rattus norvegicus
tagccttttgtggtggtgtgttaaa

SEQ ID NO: 558850 - DNA, 25 bp, Rattus norvegicus
tagcctttttcaatctggctgaaag

SEQ ID NO: 558851 - DNA, 25 bp, Rattus norvegicus
tagcctttttcattctggctgaaag

SEQ ID NO: 558852 - DNA, 25 bp, Rattus norvegicus
tagcctttttccaggctggctgagg

SEQ ID NO: 558853 - DNA, 25 bp, Rattus norvegicus
tagcctttttcctggctggctgagg

SEQ ID NO: 558854 - DNA, 25 bp, Rattus norvegicus
tagcgaaaaagtaagctgctgctga

SEQ ID NO: 558855 - DNA, 25 bp, Rattus norvegicus
tagcgaaaaagttagctgctgctga

SEQ ID NO: 558856 - DNA, 25 bp, Rattus norvegicus
tagcgaacatttctggtttagggtt

SEQ ID NO: 558857 - DNA, 25 bp, Rattus norvegicus
tagcgaacatttgtggtttagggtt

SEQ ID NO: 558858 - DNA, 25 bp, Rattus norvegicus
tagcgaataaacctgctccgggcag

SEQ ID NO: 558859 - DNA, 25 bp, Rattus norvegicus
tagcgaataaacgtgctccgggcag

SEQ ID NO: 558860 - DNA, 25 bp, Rattus norvegicus
tagcgacctctacgacagtttccta

SEQ ID NO: 558861 - DNA, 25 bp, Rattus norvegicus
tagcgacctctaggacagtttccta

SEQ ID NO: 558862 - DNA, 25 bp, Rattus norvegicus
tagcgactgagcatgggctcctgca

SEQ ID NO: 558863 - DNA, 25 bp, Rattus norvegicus
tagcgactgagcttgggctcctgca

SEQ ID NO: 558864 - DNA, 25 bp, Rattus norvegicus
tagcgacttcctcgtcccaaacggg

SEQ ID NO: 558865 - DNA, 25 bp, Rattus norvegicus
tagcgacttcctggtcccaaacggg

SEQ ID NO: 558866 - DNA, 25 bp, Rattus norvegicus
tagcgacttgtacagcagcgcactg

SEQ ID NO: 558867 - DNA, 25 bp, Rattus norvegicus
tagcgacttgtagagcagcgcactg

SEQ ID NO: 558868 - DNA, 25 bp, Rattus norvegicus
tagcgacttttacagctgtcacttt

SEQ ID NO: 558869 - DNA, 25 bp, Rattus norvegicus
tagcgacttttagagctgtcacttt

SEQ ID NO: 558870 - DNA, 25 bp, Rattus norvegicus
tagcgagccgtgatttgtctcccta

SEQ ID NO: 558871 - DNA, 25 bp, Rattus norvegicus
tagcgagccgtgttttgtctcccta

SEQ ID NO: 558872 - DNA, 25 bp, Rattus norvegicus
tagcgagctctgattcagggctcag

SEQ ID NO: 558873 - DNA, 25 bp, Rattus norvegicus
tagcgagctctgtttcagggctcag

SEQ ID NO: 558874 - DNA, 25 bp, Rattus norvegicus
tagcgaggaggcatatatcccgcct

SEQ ID NO: 558875 - DNA, 25 bp, Rattus norvegicus
tagcgaggaggcttatatcccgcct

SEQ ID NO: 558876 - DNA, 25 bp, Rattus norvegicus
tagcgaggtctcatgccaatatcag

SEQ ID NO: 558877 - DNA, 25 bp, Rattus norvegicus
tagcgaggtctcttgccaatatcag

SEQ ID NO: 558878 - DNA, 25 bp, Rattus norvegicus
tagcgagtcttgacctggtttctca

SEQ ID NO: 558879 - DNA, 25 bp, Rattus norvegicus
tagcgagtcttgtcctggtttctca

SEQ ID NO: 558880 - DNA, 25 bp, Rattus norvegicus
tagcgatatctgcaatggcttcctc

SEQ ID NO: 558881 - DNA, 25 bp, Rattus norvegicus
tagcgatatctggaatggcttcctc

SEQ ID NO: 558882 - DNA, 25 bp, Rattus norvegicus
tagcgatcagggaatagtcacacaa

SEQ ID NO: 558883 - DNA, 25 bp, Rattus norvegicus
tagcgatcagggtatagtcacacaa

SEQ ID NO: 558884 - DNA, 25 bp, Rattus norvegicus
tagcgatccacgagacaaaaccctg

SEQ ID NO: 558885 - DNA, 25 bp, Rattus norvegicus
tagcgatccacgtgacaaaaccctg

SEQ ID NO: 558886 - DNA, 25 bp, Rattus norvegicus
tagcgatctcccaaagctggattca

SEQ ID NO: 558887 - DNA, 25 bp, Rattus norvegicus
tagcgatctccctaagctggattca

SEQ ID NO: 558888 - DNA, 25 bp, Rattus norvegicus
tagcgatctctcatgttgtctgtat

SEQ ID NO: 558889 - DNA, 25 bp, Rattus norvegicus
tagcgatctctcttgttgtctgtat

SEQ ID NO: 558890 - DNA, 25 bp, Rattus norvegicus
tagcgatcttgaagcagtgctgttt

SEQ ID NO: 558891 - DNA, 25 bp, Rattus norvegicus
tagcgatcttgatgcagtgctgttt

SEQ ID NO: 558892 - DNA, 25 bp, Rattus norvegicus
tagcgatgacttctattggccacca

SEQ ID NO: 558893 - DNA, 25 bp, Rattus norvegicus
tagcgatgacttgtattggccacca

SEQ ID NO: 558894 - DNA, 25 bp, Rattus norvegicus
tagcgcaaatgaccaggacttttcc

SEQ ID NO: 558895 - DNA, 25 bp, Rattus norvegicus
tagcgcaaatgagcaggacttttcc

SEQ ID NO: 558896 - DNA, 25 bp, Rattus norvegicus
tagcgcaatctccatgttgtaccta

SEQ ID NO: 558897 - DNA, 25 bp, Rattus norvegicus
tagcgcaatctcgatgttgtaccta

SEQ ID NO: 558898 - DNA, 25 bp, Rattus norvegicus
tagcgcacagttaccatctgatcac

SEQ ID NO: 558899 - DNA, 25 bp, Rattus norvegicus
tagcgcacagtttccatctgatcac

SEQ ID NO: 558900 - DNA, 25 bp, Rattus norvegicus
tagcgcagatgaccctggtgtgcaa

SEQ ID NO: 558901 - DNA, 25 bp, Rattus norvegicus
tagcgcagatgagcctggtgtgcaa

SEQ ID NO: 558902 - DNA, 25 bp, Rattus norvegicus
tagcgcagcaaacgcacagtgacat

SEQ ID NO: 558903 - DNA, 25 bp, Rattus norvegicus
tagcgcagcaaaggcacagtgacat

SEQ ID NO: 558904 - DNA, 25 bp, Rattus norvegicus
tagcgcatgcttacctcaaattcaa

SEQ ID NO: 558905 - DNA, 25 bp, Rattus norvegicus
tagcgcatgctttcctcaaattcaa

SEQ ID NO: 558906 - DNA, 25 bp, Rattus norvegicus
tagcgcatggatccttcttccagaa

SEQ ID NO: 558907 - DNA, 25 bp, Rattus norvegicus
tagcgcatggatgcttcttccagaa

SEQ ID NO: 558908 - DNA, 25 bp, Rattus norvegicus
tagcgccaaaggctgtgaatcatgc

SEQ ID NO: 558909 - DNA, 25 bp, Rattus norvegicus
tagcgccaaagggtgtgaatcatgc

SEQ ID NO: 558910 - DNA, 25 bp, Rattus norvegicus
tagcgccatttcactaaggaacctt

SEQ ID NO: 558911 - DNA, 25 bp, Rattus norvegicus
tagcgccatttctctaaggaacctt

SEQ ID NO: 558912 - DNA, 25 bp, Rattus norvegicus
tagcgcccggagcaaccatggtgac

SEQ ID NO: 558913 - DNA, 25 bp, Rattus norvegicus
tagcgcccggaggaaccatggtgac

SEQ ID NO: 558914 - DNA, 25 bp, Rattus norvegicus
tagcgcccttataattcagactttg

SEQ ID NO: 558915 - DNA, 25 bp, Rattus norvegicus
tagcgcccttattattcagactttg

SEQ ID NO: 558916 - DNA, 25 bp, Rattus norvegicus
tagcgccctttaaccctggccatat

SEQ ID NO: 558917 - DNA, 25 bp, Rattus norvegicus
tagcgccctttatccctggccatat

SEQ ID NO: 558918 - DNA, 25 bp, Rattus norvegicus
tagcgcctagctattttggatttgt

SEQ ID NO: 558919 - DNA, 25 bp, Rattus norvegicus
tagcgcctagcttttttggatttgt

SEQ ID NO: 558920 - DNA, 25 bp, Rattus norvegicus
tagcgcctccttacgcaaagctgaa

SEQ ID NO: 558921 - DNA, 25 bp, Rattus norvegicus
tagcgcctcctttcgcaaagctgaa

SEQ ID NO: 558922 - DNA, 25 bp, Rattus norvegicus
tagcgcctggcactgagccttttaa

SEQ ID NO: 558923 - DNA, 25 bp, Rattus norvegicus
tagcgcctggcagtgagccttttaa

SEQ ID NO: 558924 - DNA, 25 bp, Rattus norvegicus
tagcgcctgtgaatggacagtggaa

SEQ ID NO: 558925 - DNA, 25 bp, Rattus norvegicus
tagcgcctgtgattggacagtggaa

SEQ ID NO: 558926 - DNA, 25 bp, Rattus norvegicus
tagcgcgggctcaaaaggtacctta

SEQ ID NO: 558927 - DNA, 25 bp, Rattus norvegicus
tagcgcgggctctaaaggtacctta

SEQ ID NO: 558928 - DNA, 25 bp, Rattus norvegicus
tagcgcgtatccctggcacgtgtgt

SEQ ID NO: 558929 - DNA, 25 bp, Rattus norvegicus
tagcgcgtatccgtggcacgtgtgt

SEQ ID NO: 558930 - DNA, 25 bp, Rattus norvegicus
tagcgcgtggttagtccagacttac

SEQ ID NO: 558931 - DNA, 25 bp, Rattus norvegicus
tagcgcgtggtttgtccagacttac

SEQ ID NO: 558932 - DNA, 25 bp, Rattus norvegicus
tagcgctaacgtatgcatataaggg

SEQ ID NO: 558933 - DNA, 25 bp, Rattus norvegicus
tagcgctaacgtttgcatataaggg

SEQ ID NO: 558934 - DNA, 25 bp, Rattus norvegicus
tagcgctcatgacgcgtgaattcca

SEQ ID NO: 558935 - DNA, 25 bp, Rattus norvegicus
tagcgctcatgaggcgtgaattcca

SEQ ID NO: 558936 - DNA, 25 bp, Rattus norvegicus
tagcgctctctacctcagtgggtaa

SEQ ID NO: 558937 - DNA, 25 bp, Rattus norvegicus
tagcgctctctagctcagtgggtaa

SEQ ID NO: 558938 - DNA, 25 bp, Rattus norvegicus
tagcgctgccaaatagtgtcactgt

SEQ ID NO: 558939 - DNA, 25 bp, Rattus norvegicus
tagcgctgccaattagtgtcactgt

SEQ ID NO: 558940 - DNA, 25 bp, Rattus norvegicus
tagcgctgcgtaacgggctgaccga

SEQ ID NO: 558941 - DNA, 25 bp, Rattus norvegicus
tagcgctgcgtatcgggctgaccga

SEQ ID NO: 558942 - DNA, 25 bp, Rattus norvegicus
tagcggaacctcacagggctctaat

SEQ ID NO: 558943 - DNA, 25 bp, Rattus norvegicus
tagcggaacctctcagggctctaat

SEQ ID NO: 558944 - DNA, 25 bp, Rattus norvegicus
tagcggaaggctcaaacttctcaga

SEQ ID NO: 558945 - DNA, 25 bp, Rattus norvegicus
tagcggaaggctgaaacttctcaga

SEQ ID NO: 558946 - DNA, 25 bp, Rattus norvegicus
tagcggagcagtacctcaggacaca

SEQ ID NO: 558947 - DNA, 25 bp, Rattus norvegicus
tagcggagcagttcctcaggacaca

SEQ ID NO: 558948 - DNA, 25 bp, Rattus norvegicus
tagcggatatcgctttctgaccggt

SEQ ID NO: 558949 - DNA, 25 bp, Rattus norvegicus
tagcggatatcggtttctgaccggt

SEQ ID NO: 558950 - DNA, 25 bp, Rattus norvegicus
tagcggattctaatccatcttccca

SEQ ID NO: 558951 - DNA, 25 bp, Rattus norvegicus
tagcggattctattccatcttccca

SEQ ID NO: 558952 - DNA, 25 bp, Rattus norvegicus
tagcggccagcgctctcagtacctg

SEQ ID NO: 558953 - DNA, 25 bp, Rattus norvegicus
tagcggccagcggtctcagtacctg

SEQ ID NO: 558954 - DNA, 25 bp, Rattus norvegicus
tagcggccccttagctggaaaaagt

SEQ ID NO: 558955 - DNA, 25 bp, Rattus norvegicus
tagcggcccctttgctggaaaaagt

SEQ ID NO: 558956 - DNA, 25 bp, Rattus norvegicus
tagcggcgcaccaggcggtccagca

SEQ ID NO: 558957 - DNA, 25 bp, Rattus norvegicus
tagcggcgcacctggcggtccagca

SEQ ID NO: 558958 - DNA, 25 bp, Rattus norvegicus
tagcggcggtatcgttcctccatgg

SEQ ID NO: 558959 - DNA, 25 bp, Rattus norvegicus
tagcggcggtatggttcctccatgg

SEQ ID NO: 558960 - DNA, 25 bp, Rattus norvegicus
tagcggcttacgctactcaggtcac

SEQ ID NO: 558961 - DNA, 25 bp, Rattus norvegicus
tagcggcttacggtactcaggtcac

SEQ ID NO: 558962 - DNA, 25 bp, Rattus norvegicus
tagcgggaaggtcgccctctaaata

SEQ ID NO: 558963 - DNA, 25 bp, Rattus norvegicus
tagcgggaaggtggccctctaaata

SEQ ID NO: 558964 - DNA, 25 bp, Rattus norvegicus
tagcgggcagaaacagagccacact

SEQ ID NO: 558965 - DNA, 25 bp, Rattus norvegicus
tagcgggcagaatcagagccacact

SEQ ID NO: 558966 - DNA, 25 bp, Rattus norvegicus
tagcgggcatgtcactgggaatcca

SEQ ID NO: 558967 - DNA, 25 bp, Rattus norvegicus
tagcgggcatgtgactgggaatcca

SEQ ID NO: 558968 - DNA, 25 bp, Rattus norvegicus
tagcgggccagtccgaagtcattgc

SEQ ID NO: 558969 - DNA, 25 bp, Rattus norvegicus
tagcgggccagtgcgaagtcattgc

SEQ ID NO: 558970 - DNA, 25 bp, Rattus norvegicus
tagcgggcccggacgccaaggccat

SEQ ID NO: 558971 - DNA, 25 bp, Rattus norvegicus
tagcgggcccggcagaactactcct

SEQ ID NO: 558972 - DNA, 25 bp, Rattus norvegicus
tagcgggcccgggagaactactcct

SEQ ID NO: 558973 - DNA, 25 bp, Rattus norvegicus
tagcgggcccggtcgccaaggccat

SEQ ID NO: 558974 - DNA, 25 bp, Rattus norvegicus
tagcgggctctgacctggtcacgcg

SEQ ID NO: 558975 - DNA, 25 bp, Rattus norvegicus
tagcgggctctgtcctggtcacgcg

SEQ ID NO: 558976 - DNA, 25 bp, Rattus norvegicus
tagcgggtcccactgatatccaact

SEQ ID NO: 558977 - DNA, 25 bp, Rattus norvegicus
tagcgggtcccagtgatatccaact

SEQ ID NO: 558978 - DNA, 25 bp, Rattus norvegicus
tagcggtacctgcatgccaccataa

SEQ ID NO: 558979 - DNA, 25 bp, Rattus norvegicus
tagcggtacctggatgccaccataa

SEQ ID NO: 558980 - DNA, 25 bp, Rattus norvegicus
tagcggtcagtccacacgttagagt

SEQ ID NO: 558981 - DNA, 25 bp, Rattus norvegicus
tagcggtcagtcgacacgttagagt

SEQ ID NO: 558982 - DNA, 25 bp, Rattus norvegicus
tagcggttgcagatgatgtactccc

SEQ ID NO: 558983 - DNA, 25 bp, Rattus norvegicus
tagcggttgcagttgatgtactccc

SEQ ID NO: 558984 - DNA, 25 bp, Rattus norvegicus
tagcggttgttcactgacagagagg

SEQ ID NO: 558985 - DNA, 25 bp, Rattus norvegicus
tagcggttgttctctgacagagagg

SEQ ID NO: 558986 - DNA, 25 bp, Rattus norvegicus
tagcgtactggtcggtctctcctta

SEQ ID NO: 558987 - DNA, 25 bp, Rattus norvegicus
tagcgtactggtgggtctctcctta

SEQ ID NO: 558988 - DNA, 25 bp, Rattus norvegicus
tagcgtagagctacactggttagtc

SEQ ID NO: 558989 - DNA, 25 bp, Rattus norvegicus
tagcgtagagcttcactggttagtc

SEQ ID NO: 558990 - DNA, 25 bp, Rattus norvegicus
tagcgtcccagaccacaatggtcac

SEQ ID NO: 558991 - DNA, 25 bp, Rattus norvegicus
tagcgtcccagagcacaatggtcac

SEQ ID NO: 558992 - DNA, 25 bp, Rattus norvegicus
tagcgtcctggtaccggatggctcg

SEQ ID NO: 558993 - DNA, 25 bp, Rattus norvegicus
tagcgtcctggttccggatggctcg

SEQ ID NO: 558994 - DNA, 25 bp, Rattus norvegicus
tagcgtctctttcttttgaactgtg

SEQ ID NO: 558995 - DNA, 25 bp, Rattus norvegicus
tagcgtctctttgttttgaactgtg

SEQ ID NO: 558996 - DNA, 25 bp, Rattus norvegicus
tagcgtgaagagcttttctcattag

SEQ ID NO: 558997 - DNA, 25 bp, Rattus norvegicus
tagcgtgaagaggttttctcattag

SEQ ID NO: 558998 - DNA, 25 bp, Rattus norvegicus
tagcgtgaagggatttgcgtccgcc

SEQ ID NO: 558999 - DNA, 25 bp, Rattus norvegicus
tagcgtgaagggttttgcgtccgcc

SEQ ID NO: 559000 - DNA, 25 bp, Rattus norvegicus
tagcgtgagatgaggctgcagcctt

SEQ ID NO: 559001 - DNA, 25 bp, Rattus norvegicus
tagcgtgagatgtggctgcagcctt

SEQ ID NO: 559002 - DNA, 25 bp, Rattus norvegicus
tagcgtgatgtcagttttgttgaaa

SEQ ID NO: 559003 - DNA, 25 bp, Rattus norvegicus
tagcgtgatgtctgttttgttgaaa

SEQ ID NO: 559004 - DNA, 25 bp, Rattus norvegicus
tagcgtgcaaccatatctctcttaa

SEQ ID NO: 559005 - DNA, 25 bp, Rattus norvegicus
tagcgtgcaaccttatctctcttaa

SEQ ID NO: 559006 - DNA, 25 bp, Rattus norvegicus
tagcgtgcacaaaaccttgggttcc

SEQ ID NO: 559007 - DNA, 25 bp, Rattus norvegicus
tagcgtgcacaataccttgggttcc

SEQ ID NO: 559008 - DNA, 25 bp, Rattus norvegicus
tagcgtgcatatctgttgtcccgga

SEQ ID NO: 559009 - DNA, 25 bp, Rattus norvegicus
tagcgtgcatatgtgttgtcccgga

SEQ ID NO: 559010 - DNA, 25 bp, Rattus norvegicus
tagcgtgccggcctagcatgcataa

SEQ ID NO: 559011 - DNA, 25 bp, Rattus norvegicus
tagcgtgccggcgtagcatgcataa

SEQ ID NO: 559012 - DNA, 25 bp, Rattus norvegicus
tagcgtgctctaaggaaaggccatc

SEQ ID NO: 559013 - DNA, 25 bp, Rattus norvegicus
tagcgtgctctatggaaaggccatc

SEQ ID NO: 559014 - DNA, 25 bp, Rattus norvegicus
tagcgtgggacccaaggagacatca

SEQ ID NO: 559015 - DNA, 25 bp, Rattus norvegicus
tagcgtgggaccgaaggagacatca

SEQ ID NO: 559016 - DNA, 25 bp, Rattus norvegicus
tagcgtgtccgacacctggaaggcc

SEQ ID NO: 559017 - DNA, 25 bp, Rattus norvegicus
tagcgtgtccgagacctggaaggcc

SEQ ID NO: 559018 - DNA, 25 bp, Rattus norvegicus
tagcgtgtctccctgttggtgaaaa

SEQ ID NO: 559019 - DNA, 25 bp, Rattus norvegicus
tagcgtgtctccgtgttggtgaaaa

SEQ ID NO: 559020 - DNA, 25 bp, Rattus norvegicus
tagcgtgtggctagcagggtctcca

SEQ ID NO: 559021 - DNA, 25 bp, Rattus norvegicus
tagcgtgtggcttgcagggtctcca

SEQ ID NO: 559022 - DNA, 25 bp, Rattus norvegicus
tagcgttaaactaccctaggcctag

SEQ ID NO: 559023 - DNA, 25 bp, Rattus norvegicus
tagcgttaaacttccctaggcctag

SEQ ID NO: 559024 - DNA, 25 bp, Rattus norvegicus
tagcgttaagcgaagttgcccaaac

SEQ ID NO: 559025 - DNA, 25 bp, Rattus norvegicus
tagcgttaagcgtagttgcccaaac

SEQ ID NO: 559026 - DNA, 25 bp, Rattus norvegicus
tagcgttaatcaagtcagtgggcac

SEQ ID NO: 559027 - DNA, 25 bp, Rattus norvegicus
tagcgttaatcatgtcagtgggcac

SEQ ID NO: 559028 - DNA, 25 bp, Rattus norvegicus
tagcgttcacaaagcctcaggtcag

SEQ ID NO: 559029 - DNA, 25 bp, Rattus norvegicus
tagcgttcacaatgcctcaggtcag

SEQ ID NO: 559030 - DNA, 25 bp, Rattus norvegicus
tagcgttgttttccttgctgagtcc

SEQ ID NO: 559031 - DNA, 25 bp, Rattus norvegicus
tagcgttgttttgcttgctgagtcc

SEQ ID NO: 559032 - DNA, 25 bp, Rattus norvegicus
tagcgtttagaacaccctgggttca

SEQ ID NO: 559033 - DNA, 25 bp, Rattus norvegicus
tagcgtttagaagaccctgggttca

SEQ ID NO: 559034 - DNA, 25 bp, Rattus norvegicus
tagcgtttaggtaaagccatgtcaa

SEQ ID NO: 559035 - DNA, 25 bp, Rattus norvegicus
tagcgtttaggttaagccatgtcaa

SEQ ID NO: 559036 - DNA, 25 bp, Rattus norvegicus
tagcgtttgcccattgtacaaagca

SEQ ID NO: 559037 - DNA, 25 bp, Rattus norvegicus
tagcgtttgccctttgtacaaagca

SEQ ID NO: 559038 - DNA, 25 bp, Rattus norvegicus
tagcgtttgctaatgtttgcctcat

SEQ ID NO: 559039 - DNA, 25 bp, Rattus norvegicus
tagcgtttgctattgtttgcctcat

SEQ ID NO: 559040 - DNA, 25 bp, Rattus norvegicus
tagcgtttgctcacctggattgcag

SEQ ID NO: 559041 - DNA, 25 bp, Rattus norvegicus
tagcgtttgctctcctggattgcag

SEQ ID NO: 559042 - DNA, 25 bp, Rattus norvegicus
tagctaaacatgactgcgtcccagc

SEQ ID NO: 559043 - DNA, 25 bp, Rattus norvegicus
tagctaaacatgtctgcgtcccagc

SEQ ID NO: 559044 - DNA, 25 bp, Rattus norvegicus
tagctaaactgtaacgttaattaag

SEQ ID NO: 559045 - DNA, 25 bp, Rattus norvegicus
tagctaaactgttacgttaattaag

SEQ ID NO: 559046 - DNA, 25 bp, Rattus norvegicus
tagctaacacccagcatgtgagcaa

SEQ ID NO: 559047 - DNA, 25 bp, Rattus norvegicus
tagctaacaccctgcatgtgagcaa

SEQ ID NO: 559048 - DNA, 25 bp, Rattus norvegicus
tagctaacacgtctaagaccctgag

SEQ ID NO: 559049 - DNA, 25 bp, Rattus norvegicus
tagctaacacgtgtaagaccctgag

SEQ ID NO: 559050 - DNA, 25 bp, Rattus norvegicus
tagctaacctttaagcctgtttcca

SEQ ID NO: 559051 - DNA, 25 bp, Rattus norvegicus
tagctaaccttttagcctgtttcca

SEQ ID NO: 559052 - DNA, 25 bp, Rattus norvegicus
tagctaacgtacatgccctttctgt

SEQ ID NO: 559053 - DNA, 25 bp, Rattus norvegicus
tagctaacgtacttgccctttctgt

SEQ ID NO: 559054 - DNA, 25 bp, Rattus norvegicus
tagctaactgctcagggctccggga

SEQ ID NO: 559055 - DNA, 25 bp, Rattus norvegicus
tagctaactgctgagggctccggga

SEQ ID NO: 559056 - DNA, 25 bp, Rattus norvegicus
tagctaagcgacacccagtgcctga

SEQ ID NO: 559057 - DNA, 25 bp, Rattus norvegicus
tagctaagcgactcccagtgcctga

SEQ ID NO: 559058 - DNA, 25 bp, Rattus norvegicus
tagctacaacatcccgtactttgag

SEQ ID NO: 559059 - DNA, 25 bp, Rattus norvegicus
tagctacaacatgccgtactttgag

SEQ ID NO: 559060 - DNA, 25 bp, Rattus norvegicus
tagctacacaaaagcagcctgctga

SEQ ID NO: 559061 - DNA, 25 bp, Rattus norvegicus
tagctacacaaatgcagcctgctga

SEQ ID NO: 559062 - DNA, 25 bp, Rattus norvegicus
tagctacacataacagacctccgga

SEQ ID NO: 559063 - DNA, 25 bp, Rattus norvegicus
tagctacacatatcagacctccgga

SEQ ID NO: 559064 - DNA, 25 bp, Rattus norvegicus
tagctacactgtccagatgtaccac

SEQ ID NO: 559065 - DNA, 25 bp, Rattus norvegicus
tagctacactgtgcagatgtaccac

SEQ ID NO: 559066 - DNA, 25 bp, Rattus norvegicus
tagctacacttcaaggcttttccac

SEQ ID NO: 559067 - DNA, 25 bp, Rattus norvegicus
tagctacacttctaggcttttccac

SEQ ID NO: 559068 - DNA, 25 bp, Rattus norvegicus
tagctacagagcaggcattgttcaa

SEQ ID NO: 559069 - DNA, 25 bp, Rattus norvegicus
tagctacagagctggcattgttcaa

SEQ ID NO: 559070 - DNA, 25 bp, Rattus norvegicus
tagctacagcacaaacagtttgaag

SEQ ID NO: 559071 - DNA, 25 bp, Rattus norvegicus
tagctacagcactaacagtttgaag

SEQ ID NO: 559072 - DNA, 25 bp, Rattus norvegicus
tagctacagccacttctgggtggat

SEQ ID NO: 559073 - DNA, 25 bp, Rattus norvegicus
tagctacagccagttctgggtggat

SEQ ID NO: 559074 - DNA, 25 bp, Rattus norvegicus
tagctaccagccaggaaacagcctt

SEQ ID NO: 559075 - DNA, 25 bp, Rattus norvegicus
tagctaccagcctggaaacagcctt

SEQ ID NO: 559076 - DNA, 25 bp, Rattus norvegicus
tagctaccatcaccagagtgcgagt

SEQ ID NO: 559077 - DNA, 25 bp, Rattus norvegicus
tagctaccatcagcagagtgcgagt

SEQ ID NO: 559078 - DNA, 25 bp, Rattus norvegicus
tagctacttcaaacacagcacggat

SEQ ID NO: 559079 - DNA, 25 bp, Rattus norvegicus
tagctacttcaatcacagcacggat

SEQ ID NO: 559080 - DNA, 25 bp, Rattus norvegicus
tagctacttcctagcaatcagagat

SEQ ID NO: 559081 - DNA, 25 bp, Rattus norvegicus
tagctacttccttgcaatcagagat

SEQ ID NO: 559082 - DNA, 25 bp, Rattus norvegicus
tagctagaacaacttcctactccat

SEQ ID NO: 559083 - DNA, 25 bp, Rattus norvegicus
tagctagaacaagttcctactccat

SEQ ID NO: 559084 - DNA, 25 bp, Rattus norvegicus
tagctagacatcaagactcacacaa

SEQ ID NO: 559085 - DNA, 25 bp, Rattus norvegicus
tagctagacatctagactcacacaa

SEQ ID NO: 559086 - DNA, 25 bp, Rattus norvegicus
tagctagatcgtcaggtgtccgtct

SEQ ID NO: 559087 - DNA, 25 bp, Rattus norvegicus
tagctagatcgtgaggtgtccgtct

SEQ ID NO: 559088 - DNA, 25 bp, Rattus norvegicus
tagctagcagagaaccaacccttgg

SEQ ID NO: 559089 - DNA, 25 bp, Rattus norvegicus
tagctagcagagtaccaacccttgg

SEQ ID NO: 559090 - DNA, 25 bp, Rattus norvegicus
tagctagcccttagggactgctaaa

SEQ ID NO: 559091 - DNA, 25 bp, Rattus norvegicus
tagctagccctttgggactgctaaa

SEQ ID NO: 559092 - DNA, 25 bp, Rattus norvegicus
tagctagggcctaacatcaagtcta

SEQ ID NO: 559093 - DNA, 25 bp, Rattus norvegicus
tagctagggccttacatcaagtcta

SEQ ID NO: 559094 - DNA, 25 bp, Rattus norvegicus
tagctaggtctcacttcaaacatgt

SEQ ID NO: 559095 - DNA, 25 bp, Rattus norvegicus
tagctaggtctctcttcaaacatgt

SEQ ID NO: 559096 - DNA, 25 bp, Rattus norvegicus
tagctaggttggatcttgccctgaa

SEQ ID NO: 559097 - DNA, 25 bp, Rattus norvegicus
tagctaggttggttcttgccctgaa

SEQ ID NO: 559098 - DNA, 25 bp, Rattus norvegicus
tagctagtagctacagcaccgtggt

SEQ ID NO: 559099 - DNA, 25 bp, Rattus norvegicus
tagctagtagctcgtaaggtcttca

SEQ ID NO: 559100 - DNA, 25 bp, Rattus norvegicus
tagctagtagctggtaaggtcttca

SEQ ID NO: 559101 - DNA, 25 bp, Rattus norvegicus
tagctagtagcttcagcaccgtggt

SEQ ID NO: 559102 - DNA, 25 bp, Rattus norvegicus
tagctagtccttagtacatcataat

SEQ ID NO: 559103 - DNA, 25 bp, Rattus norvegicus
tagctagtcctttgtacatcataat

SEQ ID NO: 559104 - DNA, 25 bp, Rattus norvegicus
tagctagtgacccaaatgcttttct

SEQ ID NO: 559105 - DNA, 25 bp, Rattus norvegicus
tagctagtgaccgaaatgcttttct

SEQ ID NO: 559106 - DNA, 25 bp, Rattus norvegicus
tagctagttctcctggtaattctga

SEQ ID NO: 559107 - DNA, 25 bp, Rattus norvegicus
tagctagttctcgtggtaattctga

SEQ ID NO: 559108 - DNA, 25 bp, Rattus norvegicus
tagctataactgctgccgttgtctt

SEQ ID NO: 559109 - DNA, 25 bp, Rattus norvegicus
tagctataactggtgccgttgtctt

SEQ ID NO: 559110 - DNA, 25 bp, Rattus norvegicus
tagctataacttctggtggtcctcc

SEQ ID NO: 559111 - DNA, 25 bp, Rattus norvegicus
tagctataacttgtggtggtcctcc

SEQ ID NO: 559112 - DNA, 25 bp, Rattus norvegicus
tagctatagtctaggcctccgatat

SEQ ID NO: 559113 - DNA, 25 bp, Rattus norvegicus
tagctatagtcttggcctccgatat

SEQ ID NO: 559114 - DNA, 25 bp, Rattus norvegicus
tagctatcactgacatgacgaacgt

SEQ ID NO: 559115 - DNA, 25 bp, Rattus norvegicus
tagctatcactgtcatgacgaacgt

SEQ ID NO: 559116 - DNA, 25 bp, Rattus norvegicus
tagctatccaatcctgcacacacgt

SEQ ID NO: 559117 - DNA, 25 bp, Rattus norvegicus
tagctatccaatgctgcacacacgt

SEQ ID NO: 559118 - DNA, 25 bp, Rattus norvegicus
tagctatccgtacttcctgcagtct

SEQ ID NO: 559119 - DNA, 25 bp, Rattus norvegicus
tagctatccgtagttcctgcagtct

SEQ ID NO: 559120 - DNA, 25 bp, Rattus norvegicus
tagctatctgttagtctctatcgcc

SEQ ID NO: 559121 - DNA, 25 bp, Rattus norvegicus
tagctatctgtttgtctctatcgcc

SEQ ID NO: 559122 - DNA, 25 bp, Rattus norvegicus
tagctatggctaccagttcccaggc

SEQ ID NO: 559123 - DNA, 25 bp, Rattus norvegicus
tagctatggctagcagttcccaggc

SEQ ID NO: 559124 - DNA, 25 bp, Rattus norvegicus
tagctatggctgcattccccaagaa

SEQ ID NO: 559125 - DNA, 25 bp, Rattus norvegicus
tagctatggctggattccccaagaa

SEQ ID NO: 559126 - DNA, 25 bp, Rattus norvegicus
tagctattaagccattttaccagaa

SEQ ID NO: 559127 - DNA, 25 bp, Rattus norvegicus
tagctattaagcgattttaccagaa

SEQ ID NO: 559128 - DNA, 25 bp, Rattus norvegicus
tagctattacgtacttgaaaaatgg

SEQ ID NO: 559129 - DNA, 25 bp, Rattus norvegicus
tagctattacgttcttgaaaaatgg

SEQ ID NO: 559130 - DNA, 25 bp, Rattus norvegicus
tagctattacttctgcattgccttg

SEQ ID NO: 559131 - DNA, 25 bp, Rattus norvegicus
tagctattacttgtgcattgccttg

SEQ ID NO: 559132 - DNA, 25 bp, Rattus norvegicus
tagctattatccattcgacaacacc

SEQ ID NO: 559133 - DNA, 25 bp, Rattus norvegicus
tagctattatcctttcgacaacacc

SEQ ID NO: 559134 - DNA, 25 bp, Rattus norvegicus
tagctattccctacttcacgagcat

SEQ ID NO: 559135 - DNA, 25 bp, Rattus norvegicus
tagctattcccttcttcacgagcat

SEQ ID NO: 559136 - DNA, 25 bp, Rattus norvegicus
tagctattcctgaacttgtggccac

SEQ ID NO: 559137 - DNA, 25 bp, Rattus norvegicus
tagctattcctgtacttgtggccac

SEQ ID NO: 559138 - DNA, 25 bp, Rattus norvegicus
tagctattctgcctgccaaacagtg

SEQ ID NO: 559139 - DNA, 25 bp, Rattus norvegicus
tagctattctgcgtgccaaacagtg

SEQ ID NO: 559140 - DNA, 25 bp, Rattus norvegicus
tagctatttctcagtccatttagac

SEQ ID NO: 559141 - DNA, 25 bp, Rattus norvegicus
tagctatttctctgtccatttagac

SEQ ID NO: 559142 - DNA, 25 bp, Rattus norvegicus
tagctatttgacactcctaggtttc

SEQ ID NO: 559143 - DNA, 25 bp, Rattus norvegicus
tagctatttgactctcctaggtttc

SEQ ID NO: 559144 - DNA, 25 bp, Rattus norvegicus
tagctcaaaatgacagctgtttcct

SEQ ID NO: 559145 - DNA, 25 bp, Rattus norvegicus
tagctcaaaatgtcagctgtttcct

SEQ ID NO: 559146 - DNA, 25 bp, Rattus norvegicus
tagctcaaagcaacaggactccaag

SEQ ID NO: 559147 - DNA, 25 bp, Rattus norvegicus
tagctcaaagcatcaggactccaag

SEQ ID NO: 559148 - DNA, 25 bp, Rattus norvegicus
tagctcaagccgcttcggagactcc

SEQ ID NO: 559149 - DNA, 25 bp, Rattus norvegicus
tagctcaagccggttcggagactcc

SEQ ID NO: 559150 - DNA, 25 bp, Rattus norvegicus
tagctcaccaccacctcatgaaaag

SEQ ID NO: 559151 - DNA, 25 bp, Rattus norvegicus
tagctcaccacctcctcatgaaaag

SEQ ID NO: 559152 - DNA, 25 bp, Rattus norvegicus
tagctcactctccattaacttttca

SEQ ID NO: 559153 - DNA, 25 bp, Rattus norvegicus
tagctcactctcgattaacttttca

SEQ ID NO: 559154 - DNA, 25 bp, Rattus norvegicus
tagctcagaggccaggctctcaaat

SEQ ID NO: 559155 - DNA, 25 bp, Rattus norvegicus
tagctcagaggcgaggctctcaaat

SEQ ID NO: 559156 - DNA, 25 bp, Rattus norvegicus
tagctcagcatcaagttctgtttaa

SEQ ID NO: 559157 - DNA, 25 bp, Rattus norvegicus
tagctcagcatctagttctgtttaa

SEQ ID NO: 559158 - DNA, 25 bp, Rattus norvegicus
tagctcagccatcagccactgtcag

SEQ ID NO: 559159 - DNA, 25 bp, Rattus norvegicus
tagctcagccatgagccactgtcag

SEQ ID NO: 559160 - DNA, 25 bp, Rattus norvegicus
tagctcagctgcagggaatgaagat

SEQ ID NO: 559161 - DNA, 25 bp, Rattus norvegicus
tagctcagctgctgggaatgaagat

SEQ ID NO: 559162 - DNA, 25 bp, Rattus norvegicus
tagctcaggcagaccacgggtatat

SEQ ID NO: 559163 - DNA, 25 bp, Rattus norvegicus
tagctcaggcagtccacgggtatat

SEQ ID NO: 559164 - DNA, 25 bp, Rattus norvegicus
tagctcagggcgactggactggact

SEQ ID NO: 559165 - DNA, 25 bp, Rattus norvegicus
tagctcagggcgtctggactggact

SEQ ID NO: 559166 - DNA, 25 bp, Rattus norvegicus
tagctcagtggtagatcatctgcga

SEQ ID NO: 559167 - DNA, 25 bp, Rattus norvegicus
tagctcagtggttgatcatctgcga

SEQ ID NO: 559168 - DNA, 25 bp, Rattus norvegicus
tagctcagtgtgaaggcctccttag

SEQ ID NO: 559169 - DNA, 25 bp, Rattus norvegicus
tagctcagtgtgtaggcctccttag

SEQ ID NO: 559170 - DNA, 25 bp, Rattus norvegicus
tagctcagttctcgtccactaagag

SEQ ID NO: 559171 - DNA, 25 bp, Rattus norvegicus
tagctcagttctggtccactaagag

SEQ ID NO: 559172 - DNA, 25 bp, Rattus norvegicus
tagctcagttggaagcattctcagc

SEQ ID NO: 559173 - DNA, 25 bp, Rattus norvegicus
tagctcagttggtagcattctcagc

SEQ ID NO: 559174 - DNA, 25 bp, Rattus norvegicus
tagctcataccaaagcgggaagttc

SEQ ID NO: 559175 - DNA, 25 bp, Rattus norvegicus
tagctcataccatagcgggaagttc

SEQ ID NO: 559176 - DNA, 25 bp, Rattus norvegicus
tagctcatctgaattgttgcaacta

SEQ ID NO: 559177 - DNA, 25 bp, Rattus norvegicus
tagctcatctgatttgttgcaacta

SEQ ID NO: 559178 - DNA, 25 bp, Rattus norvegicus
tagctcatgataacaccggccattt

SEQ ID NO: 559179 - DNA, 25 bp, Rattus norvegicus
tagctcatgatatcaccggccattt

SEQ ID NO: 559180 - DNA, 25 bp, Rattus norvegicus
tagctcatgcaactggagtcccagg

SEQ ID NO: 559181 - DNA, 25 bp, Rattus norvegicus
tagctcatgcaagtggagtcccagg

SEQ ID NO: 559182 - DNA, 25 bp, Rattus norvegicus
tagctcatggatcaaggcaggtctt

SEQ ID NO: 559183 - DNA, 25 bp, Rattus norvegicus
tagctcatggatgaaggcaggtctt

SEQ ID NO: 559184 - DNA, 25 bp, Rattus norvegicus
tagctcattctgactcactgattag

SEQ ID NO: 559185 - DNA, 25 bp, Rattus norvegicus
tagctcattctgtctcactgattag

SEQ ID NO: 559186 - DNA, 25 bp, Rattus norvegicus
tagctcattcttcaacttcaggttc

SEQ ID NO: 559187 - DNA, 25 bp, Rattus norvegicus
tagctcattcttgaacttcaggttc

SEQ ID NO: 559188 - DNA, 25 bp, Rattus norvegicus
tagctcattgtcaggtatgcggcgc

SEQ ID NO: 559189 - DNA, 25 bp, Rattus norvegicus
tagctcattgtctggtatgcggcgc

SEQ ID NO: 559190 - DNA, 25 bp, Rattus norvegicus
tagctccaaagcagttcattcccag

SEQ ID NO: 559191 - DNA, 25 bp, Rattus norvegicus
tagctccaaagctgttcattcccag

SEQ ID NO: 559192 - DNA, 25 bp, Rattus norvegicus
tagctccaattaacagtttctcctc

SEQ ID NO: 559193 - DNA, 25 bp, Rattus norvegicus
tagctccaattatcagtttctcctc

SEQ ID NO: 559194 - DNA, 25 bp, Rattus norvegicus
tagctccagagaaacctgcatgtct

SEQ ID NO: 559195 - DNA, 25 bp, Rattus norvegicus
tagctccagagatacctgcatgtct

SEQ ID NO: 559196 - DNA, 25 bp, Rattus norvegicus
tagctccagcctatgtctgactgca

SEQ ID NO: 559197 - DNA, 25 bp, Rattus norvegicus
tagctccagcctttgtctgactgca

SEQ ID NO: 559198 - DNA, 25 bp, Rattus norvegicus
tagctccatgctagacaacggcctg

SEQ ID NO: 559199 - DNA, 25 bp, Rattus norvegicus
tagctccatgcttgacaacggcctg

SEQ ID NO: 559200 - DNA, 25 bp, Rattus norvegicus
tagctccatgtcatacaccttctag

SEQ ID NO: 559201 - DNA, 25 bp, Rattus norvegicus
tagctccatgtcttacaccttctag

SEQ ID NO: 559202 - DNA, 25 bp, Rattus norvegicus
tagctccatttgacccacttgttta

SEQ ID NO: 559203 - DNA, 25 bp, Rattus norvegicus
tagctccatttgtcccacttgttta

SEQ ID NO: 559204 - DNA, 25 bp, Rattus norvegicus
tagctcccaaagctcaatcctgtgc

SEQ ID NO: 559205 - DNA, 25 bp, Rattus norvegicus
tagctcccaaaggtcaatcctgtgc

SEQ ID NO: 559206 - DNA, 25 bp, Rattus norvegicus
tagctcccaaatcatactgtcctgc

SEQ ID NO: 559207 - DNA, 25 bp, Rattus norvegicus
tagctcccaaatgatactgtcctgc

SEQ ID NO: 559208 - DNA, 25 bp, Rattus norvegicus
tagctcccaaggagtaggccgctgt

SEQ ID NO: 559209 - DNA, 25 bp, Rattus norvegicus
tagctcccaaggtgtaggccgctgt

SEQ ID NO: 559210 - DNA, 25 bp, Rattus norvegicus
tagctcccatgtacctgagttttct

SEQ ID NO: 559211 - DNA, 25 bp, Rattus norvegicus
tagctcccatgttcctgagttttct

SEQ ID NO: 559212 - DNA, 25 bp, Rattus norvegicus
tagctccccaaacaaagatcaccgt

SEQ ID NO: 559213 - DNA, 25 bp, Rattus norvegicus
tagctccccaaagaaagatcaccgt

SEQ ID NO: 559214 - DNA, 25 bp, Rattus norvegicus
tagctccccactctgtgtagataaa

SEQ ID NO: 559215 - DNA, 25 bp, Rattus norvegicus
tagctccccactgtgtgtagataaa

SEQ ID NO: 559216 - DNA, 25 bp, Rattus norvegicus
tagctcccctaaatcacacattagc

SEQ ID NO: 559217 - DNA, 25 bp, Rattus norvegicus
tagctcccctaattcacacattagc

SEQ ID NO: 559218 - DNA, 25 bp, Rattus norvegicus
tagctcccctggctcggacaagaag

SEQ ID NO: 559219 - DNA, 25 bp, Rattus norvegicus
tagctcccctgggtcggacaagaag

SEQ ID NO: 559220 - DNA, 25 bp, Rattus norvegicus
tagctcccgctgacaatgctgtggc

SEQ ID NO: 559221 - DNA, 25 bp, Rattus norvegicus
tagctcccgctgtcaatgctgtggc

SEQ ID NO: 559222 - DNA, 25 bp, Rattus norvegicus
tagctccctgtcaagagtactcatt

SEQ ID NO: 559223 - DNA, 25 bp, Rattus norvegicus
tagctccctgtcaagctctacttgt

SEQ ID NO: 559224 - DNA, 25 bp, Rattus norvegicus
tagctccctgtctagagtactcatt

SEQ ID NO: 559225 - DNA, 25 bp, Rattus norvegicus
tagctccctgtctagctctacttgt

SEQ ID NO: 559226 - DNA, 25 bp, Rattus norvegicus
tagctccctttcatcctgaaataat

SEQ ID NO: 559227 - DNA, 25 bp, Rattus norvegicus
tagctccctttcttcctgaaataat

SEQ ID NO: 559228 - DNA, 25 bp, Rattus norvegicus
tagctccgaggcacgcccgaggaga

SEQ ID NO: 559229 - DNA, 25 bp, Rattus norvegicus
tagctccgaggctcgcccgaggaga

SEQ ID NO: 559230 - DNA, 25 bp, Rattus norvegicus
tagctccgagggatctgactccttg

SEQ ID NO: 559231 - DNA, 25 bp, Rattus norvegicus
tagctccgagggttctgactccttg

SEQ ID NO: 559232 - DNA, 25 bp, Rattus norvegicus
tagctccggatccagcctagaagga

SEQ ID NO: 559233 - DNA, 25 bp, Rattus norvegicus
tagctccggatcgagcctagaagga

SEQ ID NO: 559234 - DNA, 25 bp, Rattus norvegicus
tagctccgtgttcctgaagttccag

SEQ ID NO: 559235 - DNA, 25 bp, Rattus norvegicus
tagctccgtgttgctgaagttccag

SEQ ID NO: 559236 - DNA, 25 bp, Rattus norvegicus
tagctccgttttctcagttttctac

SEQ ID NO: 559237 - DNA, 25 bp, Rattus norvegicus
tagctccgttttgtcagttttctac

SEQ ID NO: 559238 - DNA, 25 bp, Rattus norvegicus
tagctcctacccctcaggtctgtgg

SEQ ID NO: 559239 - DNA, 25 bp, Rattus norvegicus
tagctcctacccgtcaggtctgtgg

SEQ ID NO: 559240 - DNA, 25 bp, Rattus norvegicus
tagctcctactcagggaacgtccgt

SEQ ID NO: 559241 - DNA, 25 bp, Rattus norvegicus
tagctcctactctgggaacgtccgt

SEQ ID NO: 559242 - DNA, 25 bp, Rattus norvegicus
tagctcctccctcgtgaagatacag

SEQ ID NO: 559243 - DNA, 25 bp, Rattus norvegicus
tagctcctccctggtgaagatacag

SEQ ID NO: 559244 - DNA, 25 bp, Rattus norvegicus
tagctcctcggtctactgctaggaa

SEQ ID NO: 559245 - DNA, 25 bp, Rattus norvegicus
tagctcctcggtgtactgctaggaa

SEQ ID NO: 559246 - DNA, 25 bp, Rattus norvegicus
tagctcctcttactttatctctcgt

SEQ ID NO: 559247 - DNA, 25 bp, Rattus norvegicus
tagctcctcttagtttatctctcgt

SEQ ID NO: 559248 - DNA, 25 bp, Rattus norvegicus
tagctcctgaatctgatctccatca

SEQ ID NO: 559249 - DNA, 25 bp, Rattus norvegicus
tagctcctgaatgtgatctccatca

SEQ ID NO: 559250 - DNA, 25 bp, Rattus norvegicus
tagctcctgactccttatttgtaat

SEQ ID NO: 559251 - DNA, 25 bp, Rattus norvegicus
tagctcctgactgcttatttgtaat

SEQ ID NO: 559252 - DNA, 25 bp, Rattus norvegicus
tagctcctggaactcacaccaagaa

SEQ ID NO: 559253 - DNA, 25 bp, Rattus norvegicus
tagctcctggaagtcacaccaagaa

SEQ ID NO: 559254 - DNA, 25 bp, Rattus norvegicus
tagctcctgtttactaacctttgtt

SEQ ID NO: 559255 - DNA, 25 bp, Rattus norvegicus
tagctcctgtttcagatttctgtgt

SEQ ID NO: 559256 - DNA, 25 bp, Rattus norvegicus
tagctcctgtttgagatttctgtgt

SEQ ID NO: 559257 - DNA, 25 bp, Rattus norvegicus
tagctcctgttttctaacctttgtt

SEQ ID NO: 559258 - DNA, 25 bp, Rattus norvegicus
tagctccttatgactaactctcgtg

SEQ ID NO: 559259 - DNA, 25 bp, Rattus norvegicus
tagctccttatgtctaactctcgtg

SEQ ID NO: 559260 - DNA, 25 bp, Rattus norvegicus
tagctccttcccattgactctgagt

SEQ ID NO: 559261 - DNA, 25 bp, Rattus norvegicus
tagctccttccctttgactctgagt

SEQ ID NO: 559262 - DNA, 25 bp, Rattus norvegicus
tagctccttcctcggaagtggagca

SEQ ID NO: 559263 - DNA, 25 bp, Rattus norvegicus
tagctccttcctgggaagtggagca

SEQ ID NO: 559264 - DNA, 25 bp, Rattus norvegicus
tagctcctttaaacattctcctaac

SEQ ID NO: 559265 - DNA, 25 bp, Rattus norvegicus
tagctcctttaatcattctcctaac

SEQ ID NO: 559266 - DNA, 25 bp, Rattus norvegicus
tagctcgagagtaaccctgtgtgaa

SEQ ID NO: 559267 - DNA, 25 bp, Rattus norvegicus
tagctcgagagttaccctgtgtgaa

SEQ ID NO: 559268 - DNA, 25 bp, Rattus norvegicus
tagctcgcaactatagtggaggcat

SEQ ID NO: 559269 - DNA, 25 bp, Rattus norvegicus
tagctcgcaactttagtggaggcat

SEQ ID NO: 559270 - DNA, 25 bp, Rattus norvegicus
tagctcgcactaaatatatactgat

SEQ ID NO: 559271 - DNA, 25 bp, Rattus norvegicus
tagctcgcactatatatatactgat

SEQ ID NO: 559272 - DNA, 25 bp, Rattus norvegicus
tagctcgcgggcaaccatgtgaaat

SEQ ID NO: 559273 - DNA, 25 bp, Rattus norvegicus
tagctcgcgggctaccatgtgaaat

SEQ ID NO: 559274 - DNA, 25 bp, Rattus norvegicus
tagctcgctctcagtgagcagttga

SEQ ID NO: 559275 - DNA, 25 bp, Rattus norvegicus
tagctcgctctctgtgagcagttga

SEQ ID NO: 559276 - DNA, 25 bp, Rattus norvegicus
tagctcgctggtatagtacttgttt

SEQ ID NO: 559277 - DNA, 25 bp, Rattus norvegicus
tagctcgctggtttagtacttgttt

SEQ ID NO: 559278 - DNA, 25 bp, Rattus norvegicus
tagctcggacacagagccagcgcga

SEQ ID NO: 559279 - DNA, 25 bp, Rattus norvegicus
tagctcggacactgagccagcgcga

SEQ ID NO: 559280 - DNA, 25 bp, Rattus norvegicus
tagctcgggctcagattcttacaaa

SEQ ID NO: 559281 - DNA, 25 bp, Rattus norvegicus
tagctcgggctctgattcttacaaa

SEQ ID NO: 559282 - DNA, 25 bp, Rattus norvegicus
tagctcgtgctacgcagctctgtaa

SEQ ID NO: 559283 - DNA, 25 bp, Rattus norvegicus
tagctcgtgctaggcagctctgtaa

SEQ ID NO: 559284 - DNA, 25 bp, Rattus norvegicus
tagctctaactacccctggagtgta

SEQ ID NO: 559285 - DNA, 25 bp, Rattus norvegicus
tagctctaactagccctggagtgta

SEQ ID NO: 559286 - DNA, 25 bp, Rattus norvegicus
tagctctaccatactgcatacagta

SEQ ID NO: 559287 - DNA, 25 bp, Rattus norvegicus
tagctctaccattctgcatacagta

SEQ ID NO: 559288 - DNA, 25 bp, Rattus norvegicus
tagctctaccctcccttcttagtaa

SEQ ID NO: 559289 - DNA, 25 bp, Rattus norvegicus
tagctctaccctgccttcttagtaa

SEQ ID NO: 559290 - DNA, 25 bp, Rattus norvegicus
tagctctacctacaagtccaagaat

SEQ ID NO: 559291 - DNA, 25 bp, Rattus norvegicus
tagctctacctagaagtccaagaat

SEQ ID NO: 559292 - DNA, 25 bp, Rattus norvegicus
tagctctcaagcataagatcattaa

SEQ ID NO: 559293 - DNA, 25 bp, Rattus norvegicus
tagctctcaagcttaagatcattaa

SEQ ID NO: 559294 - DNA, 25 bp, Rattus norvegicus
tagctctcaatacctggaggcggga

SEQ ID NO: 559295 - DNA, 25 bp, Rattus norvegicus
tagctctcaatagctggaggcggga

SEQ ID NO: 559296 - DNA, 25 bp, Rattus norvegicus
tagctctcacttagacacgattctg

SEQ ID NO: 559297 - DNA, 25 bp, Rattus norvegicus
tagctctcactttgacacgattctg

SEQ ID NO: 559298 - DNA, 25 bp, Rattus norvegicus
tagctctcgcacatggcgctcgtgg

SEQ ID NO: 559299 - DNA, 25 bp, Rattus norvegicus
tagctctcgcacttggcgctcgtgg

SEQ ID NO: 559300 - DNA, 25 bp, Rattus norvegicus
tagctctctgcaatcctgcataaaa

SEQ ID NO: 559301 - DNA, 25 bp, Rattus norvegicus
tagctctctgcattcctgcataaaa

SEQ ID NO: 559302 - DNA, 25 bp, Rattus norvegicus
tagctctgaagtcagtctcccagac

SEQ ID NO: 559303 - DNA, 25 bp, Rattus norvegicus
tagctctgaagtgagtctcccagac

SEQ ID NO: 559304 - DNA, 25 bp, Rattus norvegicus
tagctctgacctatgcgcagtcttt

SEQ ID NO: 559305 - DNA, 25 bp, Rattus norvegicus
tagctctgacctttgcgcagtcttt

SEQ ID NO: 559306 - DNA, 25 bp, Rattus norvegicus
tagctctgaggtagatgtgcacaca

SEQ ID NO: 559307 - DNA, 25 bp, Rattus norvegicus
tagctctgaggtatactgcgtattt

SEQ ID NO: 559308 - DNA, 25 bp, Rattus norvegicus
tagctctgaggttgatgtgcacaca

SEQ ID NO: 559309 - DNA, 25 bp, Rattus norvegicus
tagctctgaggtttactgcgtattt

SEQ ID NO: 559310 - DNA, 25 bp, Rattus norvegicus
tagctctgatacaccacttgtcaag

SEQ ID NO: 559311 - DNA, 25 bp, Rattus norvegicus
tagctctgatactccacttgtcaag

SEQ ID NO: 559312 - DNA, 25 bp, Rattus norvegicus
tagctctgatcacatttcccaagaa

SEQ ID NO: 559313 - DNA, 25 bp, Rattus norvegicus
tagctctgatcagatttcccaagaa

SEQ ID NO: 559314 - DNA, 25 bp, Rattus norvegicus
tagctctgctctaggcactattgat

SEQ ID NO: 559315 - DNA, 25 bp, Rattus norvegicus
tagctctgctcttggcactattgat

SEQ ID NO: 559316 - DNA, 25 bp, Rattus norvegicus
tagctctgggcaaattctttggtct

SEQ ID NO: 559317 - DNA, 25 bp, Rattus norvegicus
tagctctgggcatattctttggtct

SEQ ID NO: 559318 - DNA, 25 bp, Rattus norvegicus
tagctctggtctcgttttgactaga

SEQ ID NO: 559319 - DNA, 25 bp, Rattus norvegicus
tagctctggtctggttttgactaga

SEQ ID NO: 559320 - DNA, 25 bp, Rattus norvegicus
tagctctgtactagcatggtgctgt

SEQ ID NO: 559321 - DNA, 25 bp, Rattus norvegicus
tagctctgtacttgcatggtgctgt

SEQ ID NO: 559322 - DNA, 25 bp, Rattus norvegicus
tagctctgtcctatccttattaaga

SEQ ID NO: 559323 - DNA, 25 bp, Rattus norvegicus
tagctctgtcctttccttattaaga

SEQ ID NO: 559324 - DNA, 25 bp, Rattus norvegicus
tagctctgtcttcctcaggtcagtg

SEQ ID NO: 559325 - DNA, 25 bp, Rattus norvegicus
tagctctgtcttgctcaggtcagtg

SEQ ID NO: 559326 - DNA, 25 bp, Rattus norvegicus
tagctcttacccatgctgttcagca

SEQ ID NO: 559327 - DNA, 25 bp, Rattus norvegicus
tagctcttacccttgctgttcagca

SEQ ID NO: 559328 - DNA, 25 bp, Rattus norvegicus
tagctcttactgaatctagcaggtg

SEQ ID NO: 559329 - DNA, 25 bp, Rattus norvegicus
tagctcttactgtatctagcaggtg

SEQ ID NO: 559330 - DNA, 25 bp, Rattus norvegicus
tagctcttaggcacttgtttttaca

SEQ ID NO: 559331 - DNA, 25 bp, Rattus norvegicus
tagctcttaggctcttgtttttaca

SEQ ID NO: 559332 - DNA, 25 bp, Rattus norvegicus
tagctcttcagcacataaatccctc

SEQ ID NO: 559333 - DNA, 25 bp, Rattus norvegicus
tagctcttcagctcataaatccctc

SEQ ID NO: 559334 - DNA, 25 bp, Rattus norvegicus
tagctcttcagtcgtttcctttctg

SEQ ID NO: 559335 - DNA, 25 bp, Rattus norvegicus
tagctcttcagtggtttcctttctg

SEQ ID NO: 559336 - DNA, 25 bp, Rattus norvegicus
tagctcttctccacaactctcggtg

SEQ ID NO: 559337 - DNA, 25 bp, Rattus norvegicus
tagctcttctcctcaactctcggtg

SEQ ID NO: 559338 - DNA, 25 bp, Rattus norvegicus
tagctcttctttctacctatatgtc

SEQ ID NO: 559339 - DNA, 25 bp, Rattus norvegicus
tagctcttctttgtacctatatgtc

SEQ ID NO: 559340 - DNA, 25 bp, Rattus norvegicus
tagctcttgggccatgtcttgactt

SEQ ID NO: 559341 - DNA, 25 bp, Rattus norvegicus
tagctcttgggcgatgtcttgactt

SEQ ID NO: 559342 - DNA, 25 bp, Rattus norvegicus
tagctctttaacatgtagccagcca

SEQ ID NO: 559343 - DNA, 25 bp, Rattus norvegicus
tagctctttaacttgtagccagcca

SEQ ID NO: 559344 - DNA, 25 bp, Rattus norvegicus
tagctctttaatctgttctcagtgt

SEQ ID NO: 559345 - DNA, 25 bp, Rattus norvegicus
tagctctttaatgtgttctcagtgt

SEQ ID NO: 559346 - DNA, 25 bp, Rattus norvegicus
tagctctttagtaacccatatgcac

SEQ ID NO: 559347 - DNA, 25 bp, Rattus norvegicus
tagctctttagttacccatatgcac

SEQ ID NO: 559348 - DNA, 25 bp, Rattus norvegicus
tagctctttcagacttacacatctt

SEQ ID NO: 559349 - DNA, 25 bp, Rattus norvegicus
tagctctttcagtcttacacatctt

SEQ ID NO: 559350 - DNA, 25 bp, Rattus norvegicus
tagctctttgtactgttgcgttcag

SEQ ID NO: 559351 - DNA, 25 bp, Rattus norvegicus
tagctctttgtagtgttgcgttcag

SEQ ID NO: 559352 - DNA, 25 bp, Rattus norvegicus
tagctgaactcaaactctcggaagg

SEQ ID NO: 559353 - DNA, 25 bp, Rattus norvegicus
tagctgaactcatactctcggaagg

SEQ ID NO: 559354 - DNA, 25 bp, Rattus norvegicus
tagctgaatctaaagtgtaatactc

SEQ ID NO: 559355 - DNA, 25 bp, Rattus norvegicus
tagctgaatctatagtgtaatactc

SEQ ID NO: 559356 - DNA, 25 bp, Rattus norvegicus
tagctgaatttgactgcctttgtct

SEQ ID NO: 559357 - DNA, 25 bp, Rattus norvegicus
tagctgaatttgtctgcctttgtct

SEQ ID NO: 559358 - DNA, 25 bp, Rattus norvegicus
tagctgacaaaccttaaattcctta

SEQ ID NO: 559359 - DNA, 25 bp, Rattus norvegicus
tagctgacaaacgttaaattcctta

SEQ ID NO: 559360 - DNA, 25 bp, Rattus norvegicus
tagctgacctcaacgggtgcaatac

SEQ ID NO: 559361 - DNA, 25 bp, Rattus norvegicus
tagctgacctcatcgggtgcaatac

SEQ ID NO: 559362 - DNA, 25 bp, Rattus norvegicus
tagctgacttacatggcaggtatat

SEQ ID NO: 559363 - DNA, 25 bp, Rattus norvegicus
tagctgacttacttggcaggtatat

SEQ ID NO: 559364 - DNA, 25 bp, Rattus norvegicus
tagctgagctccagggcgacttcga

SEQ ID NO: 559365 - DNA, 25 bp, Rattus norvegicus
tagctgagctcctgggcgacttcga

SEQ ID NO: 559366 - DNA, 25 bp, Rattus norvegicus
tagctgagctggctctgaaggccac

SEQ ID NO: 559367 - DNA, 25 bp, Rattus norvegicus
tagctgagctggctgccatgaacat

SEQ ID NO: 559368 - DNA, 25 bp, Rattus norvegicus
tagctgagctgggtctgaaggccac

SEQ ID NO: 559369 - DNA, 25 bp, Rattus norvegicus
tagctgagctgggtgccatgaacat

SEQ ID NO: 559370 - DNA, 25 bp, Rattus norvegicus
tagctgaggtgaccgagagcaccaa

SEQ ID NO: 559371 - DNA, 25 bp, Rattus norvegicus
tagctgaggtgagcgagagcaccaa

SEQ ID NO: 559372 - DNA, 25 bp, Rattus norvegicus
tagctgagtctcagtagtatacaaa

SEQ ID NO: 559373 - DNA, 25 bp, Rattus norvegicus
tagctgagtctctgtagtatacaaa

SEQ ID NO: 559374 - DNA, 25 bp, Rattus norvegicus
tagctgagtgctagaccaggaggca

SEQ ID NO: 559375 - DNA, 25 bp, Rattus norvegicus
tagctgagtgctcgagttctgccta

SEQ ID NO: 559376 - DNA, 25 bp, Rattus norvegicus
tagctgagtgctcttttctgtgtct

SEQ ID NO: 559377 - DNA, 25 bp, Rattus norvegicus
tagctgagtgctggagttctgccta

SEQ ID NO: 559378 - DNA, 25 bp, Rattus norvegicus
tagctgagtgctgttttctgtgtct

SEQ ID NO: 559379 - DNA, 25 bp, Rattus norvegicus
tagctgagtgcttgaccaggaggca

SEQ ID NO: 559380 - DNA, 25 bp, Rattus norvegicus
tagctgagttgccaaggttgacctc

SEQ ID NO: 559381 - DNA, 25 bp, Rattus norvegicus
tagctgagttgcgaaggttgacctc

SEQ ID NO: 559382 - DNA, 25 bp, Rattus norvegicus
tagctgatctgtcatggcatccctc

SEQ ID NO: 559383 - DNA, 25 bp, Rattus norvegicus
tagctgatctgtgatggcatccctc

SEQ ID NO: 559384 - DNA, 25 bp, Rattus norvegicus
tagctgatgatccgaataactacct

SEQ ID NO: 559385 - DNA, 25 bp, Rattus norvegicus
tagctgatgatcggaataactacct

SEQ ID NO: 559386 - DNA, 25 bp, Rattus norvegicus
tagctgatgatgctgaggccctgtc

SEQ ID NO: 559387 - DNA, 25 bp, Rattus norvegicus
tagctgatgatggtgaggccctgtc

SEQ ID NO: 559388 - DNA, 25 bp, Rattus norvegicus
tagctgatgcacaggagcctgtcca

SEQ ID NO: 559389 - DNA, 25 bp, Rattus norvegicus
tagctgatgcactggagcctgtcca

SEQ ID NO: 559390 - DNA, 25 bp, Rattus norvegicus
tagctgatttaaacgagagcacaat

SEQ ID NO: 559391 - DNA, 25 bp, Rattus norvegicus
tagctgatttaatcgagagcacaat

SEQ ID NO: 559392 - DNA, 25 bp, Rattus norvegicus
tagctgatttcaagttaccaacctg

SEQ ID NO: 559393 - DNA, 25 bp, Rattus norvegicus
tagctgatttcatgttaccaacctg

SEQ ID NO: 559394 - DNA, 25 bp, Rattus norvegicus
tagctgcaagcgattctccttttaa

SEQ ID NO: 559395 - DNA, 25 bp, Rattus norvegicus
tagctgcaagcgtttctccttttaa

SEQ ID NO: 559396 - DNA, 25 bp, Rattus norvegicus
tagctgcacagcctccgtcatttat

SEQ ID NO: 559397 - DNA, 25 bp, Rattus norvegicus
tagctgcacagcgtccgtcatttat

SEQ ID NO: 559398 - DNA, 25 bp, Rattus norvegicus
tagctgcacatccaccagaagagca

SEQ ID NO: 559399 - DNA, 25 bp, Rattus norvegicus
tagctgcacatcgaccagaagagca

SEQ ID NO: 559400 - DNA, 25 bp, Rattus norvegicus
tagctgcagcaaacatctggccagt

SEQ ID NO: 559401 - DNA, 25 bp, Rattus norvegicus
tagctgcagcaatcatctggccagt

SEQ ID NO: 559402 - DNA, 25 bp, Rattus norvegicus
tagctgcagcccatcagtcacataa

SEQ ID NO: 559403 - DNA, 25 bp, Rattus norvegicus
tagctgcagcccttcagtcacataa

SEQ ID NO: 559404 - DNA, 25 bp, Rattus norvegicus
tagctgcatcctacatgtgacggat

SEQ ID NO: 559405 - DNA, 25 bp, Rattus norvegicus
tagctgcatccttcatgtgacggat

SEQ ID NO: 559406 - DNA, 25 bp, Rattus norvegicus
tagctgcatgacatgtgcctttgaa

SEQ ID NO: 559407 - DNA, 25 bp, Rattus norvegicus
tagctgcatgacttgtgcctttgaa

SEQ ID NO: 559408 - DNA, 25 bp, Rattus norvegicus
tagctgcatggtcttttctgatctt

SEQ ID NO: 559409 - DNA, 25 bp, Rattus norvegicus
tagctgcatggtgttttctgatctt

SEQ ID NO: 559410 - DNA, 25 bp, Rattus norvegicus
tagctgccatttaccaggtgtgcat

SEQ ID NO: 559411 - DNA, 25 bp, Rattus norvegicus
tagctgccattttccaggtgtgcat

SEQ ID NO: 559412 - DNA, 25 bp, Rattus norvegicus
tagctgcccagaaattcatctcaga

SEQ ID NO: 559413 - DNA, 25 bp, Rattus norvegicus
tagctgcccagatattcatctcaga

SEQ ID NO: 559414 - DNA, 25 bp, Rattus norvegicus
tagctgccctgacgccttatatgat

SEQ ID NO: 559415 - DNA, 25 bp, Rattus norvegicus
tagctgccctgaggccttatatgat

SEQ ID NO: 559416 - DNA, 25 bp, Rattus norvegicus
tagctgcctaaccaagttcggtgtt

SEQ ID NO: 559417 - DNA, 25 bp, Rattus norvegicus
tagctgcctaacgaagttcggtgtt

SEQ ID NO: 559418 - DNA, 25 bp, Rattus norvegicus
tagctgcctcttatcccattgttat

SEQ ID NO: 559419 - DNA, 25 bp, Rattus norvegicus
tagctgcctcttttcccattgttat

SEQ ID NO: 559420 - DNA, 25 bp, Rattus norvegicus
tagctgcctgcaagtcatgctgtga

SEQ ID NO: 559421 - DNA, 25 bp, Rattus norvegicus
tagctgcctgcatgtcatgctgtga

SEQ ID NO: 559422 - DNA, 25 bp, Rattus norvegicus
tagctgcggacacaattgctggcct

SEQ ID NO: 559423 - DNA, 25 bp, Rattus norvegicus
tagctgcggacagaattgctggcct

SEQ ID NO: 559424 - DNA, 25 bp, Rattus norvegicus
tagctgcggttccacctgtgctgag

SEQ ID NO: 559425 - DNA, 25 bp, Rattus norvegicus
tagctgcggttcgacctgtgctgag

SEQ ID NO: 559426 - DNA, 25 bp, Rattus norvegicus
tagctgctaaataacaagccactgg

SEQ ID NO: 559427 - DNA, 25 bp, Rattus norvegicus
tagctgctaaattacaagccactgg

SEQ ID NO: 559428 - DNA, 25 bp, Rattus norvegicus
tagctgctagggaagaatctccatt

SEQ ID NO: 559429 - DNA, 25 bp, Rattus norvegicus
tagctgctagggtagaatctccatt

SEQ ID NO: 559430 - DNA, 25 bp, Rattus norvegicus
tagctgctagtacacaccttgactg

SEQ ID NO: 559431 - DNA, 25 bp, Rattus norvegicus
tagctgctagtagacaccttgactg

SEQ ID NO: 559432 - DNA, 25 bp, Rattus norvegicus
tagctgctcagcctttgtaaccttg

SEQ ID NO: 559433 - DNA, 25 bp, Rattus norvegicus
tagctgctcagcgtttgtaaccttg

SEQ ID NO: 559434 - DNA, 25 bp, Rattus norvegicus
tagctgctcagtcttctgtcataac

SEQ ID NO: 559435 - DNA, 25 bp, Rattus norvegicus
tagctgctcagtgttctgtcataac

SEQ ID NO: 559436 - DNA, 25 bp, Rattus norvegicus
tagctgctccgaaggttgttcagga

SEQ ID NO: 559437 - DNA, 25 bp, Rattus norvegicus
tagctgctccgatggttgttcagga

SEQ ID NO: 559438 - DNA, 25 bp, Rattus norvegicus
tagctgctcgacagctgctggcatg

SEQ ID NO: 559439 - DNA, 25 bp, Rattus norvegicus
tagctgctcgactgctgctggcatg

SEQ ID NO: 559440 - DNA, 25 bp, Rattus norvegicus
tagctgctcgtgacggaggatctga

SEQ ID NO: 559441 - DNA, 25 bp, Rattus norvegicus
tagctgctcgtgtcggaggatctga

SEQ ID NO: 559442 - DNA, 25 bp, Rattus norvegicus
tagctgctcttgaatttctgtgttc

SEQ ID NO: 559443 - DNA, 25 bp, Rattus norvegicus
tagctgctcttgtatttctgtgttc

SEQ ID NO: 559444 - DNA, 25 bp, Rattus norvegicus
tagctgctgcgccttatgaagaagg

SEQ ID NO: 559445 - DNA, 25 bp, Rattus norvegicus
tagctgctgcgcgttatgaagaagg

SEQ ID NO: 559446 - DNA, 25 bp, Rattus norvegicus
tagctgctgctacttatggtccatt

SEQ ID NO: 559447 - DNA, 25 bp, Rattus norvegicus
tagctgctgctagttatggtccatt

SEQ ID NO: 559448 - DNA, 25 bp, Rattus norvegicus
tagctgctgtagaactgtttgttca

SEQ ID NO: 559449 - DNA, 25 bp, Rattus norvegicus
tagctgctgtagtactgtttgttca

SEQ ID NO: 559450 - DNA, 25 bp, Rattus norvegicus
tagctgcttatacaatttcctgaaa

SEQ ID NO: 559451 - DNA, 25 bp, Rattus norvegicus
tagctgcttatagaatttcctgaaa

SEQ ID NO: 559452 - DNA, 25 bp, Rattus norvegicus
tagctgcttcatattcagttccttc

SEQ ID NO: 559453 - DNA, 25 bp, Rattus norvegicus
tagctgcttcattttcagttccttc

SEQ ID NO: 559454 - DNA, 25 bp, Rattus norvegicus
tagctgcttgctagacttaactcct

SEQ ID NO: 559455 - DNA, 25 bp, Rattus norvegicus
tagctgcttgcttgacttaactcct

SEQ ID NO: 559456 - DNA, 25 bp, Rattus norvegicus
tagctggaattaaggactgtggcac

SEQ ID NO: 559457 - DNA, 25 bp, Rattus norvegicus
tagctggaattatggactgtggcac

SEQ ID NO: 559458 - DNA, 25 bp, Rattus norvegicus
tagctggaccttatcacccatggaa

SEQ ID NO: 559459 - DNA, 25 bp, Rattus norvegicus
tagctggaccttttcacccatggaa

SEQ ID NO: 559460 - DNA, 25 bp, Rattus norvegicus
tagctggactaaacggcttgccgtc

SEQ ID NO: 559461 - DNA, 25 bp, Rattus norvegicus
tagctggactaatcggcttgccgtc

SEQ ID NO: 559462 - DNA, 25 bp, Rattus norvegicus
tagctggagctcaaacctcatgcag

SEQ ID NO: 559463 - DNA, 25 bp, Rattus norvegicus
tagctggagctctaacctcatgcag

SEQ ID NO: 559464 - DNA, 25 bp, Rattus norvegicus
tagctggataccaaccatgtcagaa

SEQ ID NO: 559465 - DNA, 25 bp, Rattus norvegicus
tagctggatacctaccatgtcagaa

SEQ ID NO: 559466 - DNA, 25 bp, Rattus norvegicus
tagctggatcccattactcattaat

SEQ ID NO: 559467 - DNA, 25 bp, Rattus norvegicus
tagctggatccctttactcattaat

SEQ ID NO: 559468 - DNA, 25 bp, Rattus norvegicus
tagctggcagacacccaaggcagtg

SEQ ID NO: 559469 - DNA, 25 bp, Rattus norvegicus
tagctggcagactcccaaggcagtg

SEQ ID NO: 559470 - DNA, 25 bp, Rattus norvegicus
tagctggcagtgacaaacgcttggt

SEQ ID NO: 559471 - DNA, 25 bp, Rattus norvegicus
tagctggcagtgtcaaacgcttggt

SEQ ID NO: 559472 - DNA, 25 bp, Rattus norvegicus
tagctggcatgtaggcacgggacca

SEQ ID NO: 559473 - DNA, 25 bp, Rattus norvegicus
tagctggcatgttggcacgggacca

SEQ ID NO: 559474 - DNA, 25 bp, Rattus norvegicus
tagctggccccacaagagaagacat

SEQ ID NO: 559475 - DNA, 25 bp, Rattus norvegicus
tagctggccccagaagagaagacat

SEQ ID NO: 559476 - DNA, 25 bp, Rattus norvegicus
tagctggccctaaacttctagaatt

SEQ ID NO: 559477 - DNA, 25 bp, Rattus norvegicus
tagctggccctatacttctagaatt

SEQ ID NO: 559478 - DNA, 25 bp, Rattus norvegicus
tagctggctgaacgatcactgtaac

SEQ ID NO: 559479 - DNA, 25 bp, Rattus norvegicus
tagctggctgaaggatcactgtaac

SEQ ID NO: 559480 - DNA, 25 bp, Rattus norvegicus
tagctggctgccagtattgtcagga

SEQ ID NO: 559481 - DNA, 25 bp, Rattus norvegicus
tagctggctgcctgtattgtcagga

SEQ ID NO: 559482 - DNA, 25 bp, Rattus norvegicus
tagctggctgtcatgtcaaggtttc

SEQ ID NO: 559483 - DNA, 25 bp, Rattus norvegicus
tagctggctgtcttgtcaaggtttc

SEQ ID NO: 559484 - DNA, 25 bp, Rattus norvegicus
tagctggctgtgaaggtgacctgta

SEQ ID NO: 559485 - DNA, 25 bp, Rattus norvegicus
tagctggctgtgtaggtgacctgta

SEQ ID NO: 559486 - DNA, 25 bp, Rattus norvegicus
tagctggctgttacctttgcataaa

SEQ ID NO: 559487 - DNA, 25 bp, Rattus norvegicus
tagctggctgtttcctttgcataaa

SEQ ID NO: 559488 - DNA, 25 bp, Rattus norvegicus
tagctgggaagactctgatgataca

SEQ ID NO: 559489 - DNA, 25 bp, Rattus norvegicus
tagctgggaagagtctgatgataca

SEQ ID NO: 559490 - DNA, 25 bp, Rattus norvegicus
tagctgggcatacgtggatacactt

SEQ ID NO: 559491 - DNA, 25 bp, Rattus norvegicus
tagctgggcataggtggatacactt

SEQ ID NO: 559492 - DNA, 25 bp, Rattus norvegicus
tagctgggctccagtgaggtctcag

SEQ ID NO: 559493 - DNA, 25 bp, Rattus norvegicus
tagctgggctcctgtgaggtctcag

SEQ ID NO: 559494 - DNA, 25 bp, Rattus norvegicus
tagctgggttagattgcattctcac

SEQ ID NO: 559495 - DNA, 25 bp, Rattus norvegicus
tagctgggttagtttgcattctcac

SEQ ID NO: 559496 - DNA, 25 bp, Rattus norvegicus
tagctggtagacacttcctgtagat

SEQ ID NO: 559497 - DNA, 25 bp, Rattus norvegicus
tagctggtagactcttcctgtagat

SEQ ID NO: 559498 - DNA, 25 bp, Rattus norvegicus
tagctggtagggagtcgtgtcctca

SEQ ID NO: 559499 - DNA, 25 bp, Rattus norvegicus
tagctggtagggtgtcgtgtcctca

SEQ ID NO: 559500 - DNA, 25 bp, Rattus norvegicus
tagctggtcagaaggtcctttctaa

SEQ ID NO: 559501 - DNA, 25 bp, Rattus norvegicus
tagctggtcagatggtcctttctaa

SEQ ID NO: 559502 - DNA, 25 bp, Rattus norvegicus
tagctggtcgggacctcactgacta

SEQ ID NO: 559503 - DNA, 25 bp, Rattus norvegicus
tagctggtcgggtcctcactgacta

SEQ ID NO: 559504 - DNA, 25 bp, Rattus norvegicus
tagctggtctggaaaggtgttcact

SEQ ID NO: 559505 - DNA, 25 bp, Rattus norvegicus
tagctggtctggtaaggtgttcact

SEQ ID NO: 559506 - DNA, 25 bp, Rattus norvegicus
tagctggttctcagtggatgtctca

SEQ ID NO: 559507 - DNA, 25 bp, Rattus norvegicus
tagctggttctctgtggatgtctca

SEQ ID NO: 559508 - DNA, 25 bp, Rattus norvegicus
tagctggttggcaagctggcatctc

SEQ ID NO: 559509 - DNA, 25 bp, Rattus norvegicus
tagctggttggctagctggcatctc

SEQ ID NO: 559510 - DNA, 25 bp, Rattus norvegicus
tagctggtttgcactaacttagttc

SEQ ID NO: 559511 - DNA, 25 bp, Rattus norvegicus
tagctggtttgctctaacttagttc

SEQ ID NO: 559512 - DNA, 25 bp, Rattus norvegicus
tagctgtagtacagtgacccgaggg

SEQ ID NO: 559513 - DNA, 25 bp, Rattus norvegicus
tagctgtagtactgtgacccgaggg

SEQ ID NO: 559514 - DNA, 25 bp, Rattus norvegicus
tagctgtatggaatatgcctaaacc

SEQ ID NO: 559515 - DNA, 25 bp, Rattus norvegicus
tagctgtatggattatgcctaaacc

SEQ ID NO: 559516 - DNA, 25 bp, Rattus norvegicus
tagctgtcacagctgccaattcaat

SEQ ID NO: 559517 - DNA, 25 bp, Rattus norvegicus
tagctgtcacaggtgccaattcaat

SEQ ID NO: 559518 - DNA, 25 bp, Rattus norvegicus
tagctgtcatctctacatgctccca

SEQ ID NO: 559519 - DNA, 25 bp, Rattus norvegicus
tagctgtcatctgtacatgctccca

SEQ ID NO: 559520 - DNA, 25 bp, Rattus norvegicus
tagctgtcatgcatgcgtcttccat

SEQ ID NO: 559521 - DNA, 25 bp, Rattus norvegicus
tagctgtcatgcttgcgtcttccat

SEQ ID NO: 559522 - DNA, 25 bp, Rattus norvegicus
tagctgtccaggaagccttgatctt

SEQ ID NO: 559523 - DNA, 25 bp, Rattus norvegicus
tagctgtccaggtagccttgatctt

SEQ ID NO: 559524 - DNA, 25 bp, Rattus norvegicus
tagctgtcctgaacatttcactgga

SEQ ID NO: 559525 - DNA, 25 bp, Rattus norvegicus
tagctgtcctgatcatttcactgga

SEQ ID NO: 559526 - DNA, 25 bp, Rattus norvegicus
tagctgtcgaataaagtggtcctta

SEQ ID NO: 559527 - DNA, 25 bp, Rattus norvegicus
tagctgtcgaattaagtggtcctta

SEQ ID NO: 559528 - DNA, 25 bp, Rattus norvegicus
tagctgtcgtgcacgtcccgcaggc

SEQ ID NO: 559529 - DNA, 25 bp, Rattus norvegicus
tagctgtcgtgctcgtcccgcaggc

SEQ ID NO: 559530 - DNA, 25 bp, Rattus norvegicus
tagctgtcgttaaaagtacttggat

SEQ ID NO: 559531 - DNA, 25 bp, Rattus norvegicus
tagctgtcgttataagtacttggat

SEQ ID NO: 559532 - DNA, 25 bp, Rattus norvegicus
tagctgtctaccaccagaggaccta

SEQ ID NO: 559533 - DNA, 25 bp, Rattus norvegicus
tagctgtctacctccagaggaccta

SEQ ID NO: 559534 - DNA, 25 bp, Rattus norvegicus
tagctgtctcctaggtagtacacac

SEQ ID NO: 559535 - DNA, 25 bp, Rattus norvegicus
tagctgtctcctcattcctgattct

SEQ ID NO: 559536 - DNA, 25 bp, Rattus norvegicus
tagctgtctcctgattcctgattct

SEQ ID NO: 559537 - DNA, 25 bp, Rattus norvegicus
tagctgtctccttggtagtacacac

SEQ ID NO: 559538 - DNA, 25 bp, Rattus norvegicus
tagctgtgctccaacaatgatctca

SEQ ID NO: 559539 - DNA, 25 bp, Rattus norvegicus
tagctgtgctcctacaatgatctca

SEQ ID NO: 559540 - DNA, 25 bp, Rattus norvegicus
tagctgtgctgcaagacatcgaaca

SEQ ID NO: 559541 - DNA, 25 bp, Rattus norvegicus
tagctgtgctgctagacatcgaaca

SEQ ID NO: 559542 - DNA, 25 bp, Rattus norvegicus
tagctgtgcttgagcccgtgctgat

SEQ ID NO: 559543 - DNA, 25 bp, Rattus norvegicus
tagctgtgcttgtgcccgtgctgat

SEQ ID NO: 559544 - DNA, 25 bp, Rattus norvegicus
tagctgtggctgagcctgatcctga

SEQ ID NO: 559545 - DNA, 25 bp, Rattus norvegicus
tagctgtggctgtgcctgatcctga

SEQ ID NO: 559546 - DNA, 25 bp, Rattus norvegicus
tagctgtggcttatgaccgctgctc

SEQ ID NO: 559547 - DNA, 25 bp, Rattus norvegicus
tagctgtggcttttgaccgctgctc

SEQ ID NO: 559548 - DNA, 25 bp, Rattus norvegicus
tagctgtgtccccatggcgggtcat

SEQ ID NO: 559549 - DNA, 25 bp, Rattus norvegicus
tagctgtgtcccgatggcgggtcat

SEQ ID NO: 559550 - DNA, 25 bp, Rattus norvegicus
tagctgtgtctgatccgtgtttgtg

SEQ ID NO: 559551 - DNA, 25 bp, Rattus norvegicus
tagctgtgtctgttccgtgtttgtg

SEQ ID NO: 559552 - DNA, 25 bp, Rattus norvegicus
tagctgttattccagtatgcatttt

SEQ ID NO: 559553 - DNA, 25 bp, Rattus norvegicus
tagctgttattcgagtatgcatttt

SEQ ID NO: 559554 - DNA, 25 bp, Rattus norvegicus
tagctgttcatcaaagctgagtgac

SEQ ID NO: 559555 - DNA, 25 bp, Rattus norvegicus
tagctgttcatctaagctgagtgac

SEQ ID NO: 559556 - DNA, 25 bp, Rattus norvegicus
tagctgttgcagatggtttttaccc

SEQ ID NO: 559557 - DNA, 25 bp, Rattus norvegicus
tagctgttgcagttggtttttaccc

SEQ ID NO: 559558 - DNA, 25 bp, Rattus norvegicus
tagctgttggctagatcacggtaaa

SEQ ID NO: 559559 - DNA, 25 bp, Rattus norvegicus
tagctgttggcttgatcacggtaaa

SEQ ID NO: 559560 - DNA, 25 bp, Rattus norvegicus
tagctgtttttaatctgttctgcaa

SEQ ID NO: 559561 - DNA, 25 bp, Rattus norvegicus
tagctgtttttattctgttctgcaa

SEQ ID NO: 559562 - DNA, 25 bp, Rattus norvegicus
tagcttaaccttattaatcccagca

SEQ ID NO: 559563 - DNA, 25 bp, Rattus norvegicus
tagcttaacctttttaatcccagca

SEQ ID NO: 559564 - DNA, 25 bp, Rattus norvegicus
tagcttaactctactgacatctgat

SEQ ID NO: 559565 - DNA, 25 bp, Rattus norvegicus
tagcttaactcttctgacatctgat

SEQ ID NO: 559566 - DNA, 25 bp, Rattus norvegicus
tagcttacagcgatggttcgtttgc

SEQ ID NO: 559567 - DNA, 25 bp, Rattus norvegicus
tagcttacagcgttggttcgtttgc

SEQ ID NO: 559568 - DNA, 25 bp, Rattus norvegicus
tagcttacattaatccctgtgcagg

SEQ ID NO: 559569 - DNA, 25 bp, Rattus norvegicus
tagcttacattattccctgtgcagg

SEQ ID NO: 559570 - DNA, 25 bp, Rattus norvegicus
tagcttaccaaacgtttgttcattt

SEQ ID NO: 559571 - DNA, 25 bp, Rattus norvegicus
tagcttaccaaaggtttgttcattt

SEQ ID NO: 559572 - DNA, 25 bp, Rattus norvegicus
tagcttactaatacacacacctgga

SEQ ID NO: 559573 - DNA, 25 bp, Rattus norvegicus
tagcttactaattcacacacctgga

SEQ ID NO: 559574 - DNA, 25 bp, Rattus norvegicus
tagcttactacgcttactgagaagg

SEQ ID NO: 559575 - DNA, 25 bp, Rattus norvegicus
tagcttactacggttactgagaagg

SEQ ID NO: 559576 - DNA, 25 bp, Rattus norvegicus
tagcttacttggctgattctgggcc

SEQ ID NO: 559577 - DNA, 25 bp, Rattus norvegicus
tagcttacttgggtgattctgggcc

SEQ ID NO: 559578 - DNA, 25 bp, Rattus norvegicus
tagcttatacccatgtgcactgtga

SEQ ID NO: 559579 - DNA, 25 bp, Rattus norvegicus
tagcttatacccttgtgcactgtga

SEQ ID NO: 559580 - DNA, 25 bp, Rattus norvegicus
tagcttatccttctcttgttttacc

SEQ ID NO: 559581 - DNA, 25 bp, Rattus norvegicus
tagcttatccttgtcttgttttacc

SEQ ID NO: 559582 - DNA, 25 bp, Rattus norvegicus
tagcttatctgtcttctgcagtgtc

SEQ ID NO: 559583 - DNA, 25 bp, Rattus norvegicus
tagcttatctgtgttctgcagtgtc

SEQ ID NO: 559584 - DNA, 25 bp, Rattus norvegicus
tagcttatcttcattcacctattaa

SEQ ID NO: 559585 - DNA, 25 bp, Rattus norvegicus
tagcttatcttctttcacctattaa

SEQ ID NO: 559586 - DNA, 25 bp, Rattus norvegicus
tagcttatgtttagccccgctatgc

SEQ ID NO: 559587 - DNA, 25 bp, Rattus norvegicus
tagcttatgttttgccccgctatgc

SEQ ID NO: 559588 - DNA, 25 bp, Rattus norvegicus
tagcttcaacgaacgcgtttgtccc

SEQ ID NO: 559589 - DNA, 25 bp, Rattus norvegicus
tagcttcaacgatcgcgtttgtccc

SEQ ID NO: 559590 - DNA, 25 bp, Rattus norvegicus
tagcttcaacgtcgctgttcgtaag

SEQ ID NO: 559591 - DNA, 25 bp, Rattus norvegicus
tagcttcaacgtggctgttcgtaag

SEQ ID NO: 559592 - DNA, 25 bp, Rattus norvegicus
tagcttcacctgagtagcgtgcggg

SEQ ID NO: 559593 - DNA, 25 bp, Rattus norvegicus
tagcttcacctgtgtagcgtgcggg

SEQ ID NO: 559594 - DNA, 25 bp, Rattus norvegicus
tagcttcactgtctggcttacacat

SEQ ID NO: 559595 - DNA, 25 bp, Rattus norvegicus
tagcttcactgtgtggcttacacat

SEQ ID NO: 559596 - DNA, 25 bp, Rattus norvegicus
tagcttcagctgattatggtgatgc

SEQ ID NO: 559597 - DNA, 25 bp, Rattus norvegicus
tagcttcagctgtttatggtgatgc

SEQ ID NO: 559598 - DNA, 25 bp, Rattus norvegicus
tagcttcaggcgatgcagtcagcat

SEQ ID NO: 559599 - DNA, 25 bp, Rattus norvegicus
tagcttcaggcgttgcagtcagcat

SEQ ID NO: 559600 - DNA, 25 bp, Rattus norvegicus
tagcttcatcatacagaaaacctgt

SEQ ID NO: 559601 - DNA, 25 bp, Rattus norvegicus
tagcttcatcattcagaaaacctgt

SEQ ID NO: 559602 - DNA, 25 bp, Rattus norvegicus
tagcttcatcgccattgctggtcct

SEQ ID NO: 559603 - DNA, 25 bp, Rattus norvegicus
tagcttcatcgcgattgctggtcct

SEQ ID NO: 559604 - DNA, 25 bp, Rattus norvegicus
tagcttccaagtatcagttcctttc

SEQ ID NO: 559605 - DNA, 25 bp, Rattus norvegicus
tagcttccaagtttcagttcctttc

SEQ ID NO: 559606 - DNA, 25 bp, Rattus norvegicus
tagcttccacttacctcattttgaa

SEQ ID NO: 559607 - DNA, 25 bp, Rattus norvegicus
tagcttccactttcctcattttgaa

SEQ ID NO: 559608 - DNA, 25 bp, Rattus norvegicus
tagcttccagtgagcccaacttgaa

SEQ ID NO: 559609 - DNA, 25 bp, Rattus norvegicus
tagcttccagtgtgcccaacttgaa

SEQ ID NO: 559610 - DNA, 25 bp, Rattus norvegicus
tagcttccatctctttgtcgtcttt

SEQ ID NO: 559611 - DNA, 25 bp, Rattus norvegicus
tagcttccatctgtttgtcgtcttt

SEQ ID NO: 559612 - DNA, 25 bp, Rattus norvegicus
tagcttccgtgaaaccgttttctag

SEQ ID NO: 559613 - DNA, 25 bp, Rattus norvegicus
tagcttccgtgataccgttttctag

SEQ ID NO: 559614 - DNA, 25 bp, Rattus norvegicus
tagcttcctatcacctcatgaagga

SEQ ID NO: 559615 - DNA, 25 bp, Rattus norvegicus
tagcttcctatctcctcatgaagga

SEQ ID NO: 559616 - DNA, 25 bp, Rattus norvegicus
tagcttcctgctcacctagaagaga

SEQ ID NO: 559617 - DNA, 25 bp, Rattus norvegicus
tagcttcctgctgacctagaagaga

SEQ ID NO: 559618 - DNA, 25 bp, Rattus norvegicus
tagcttcctgtacctctgtggtcaa

SEQ ID NO: 559619 - DNA, 25 bp, Rattus norvegicus
tagcttcctgtagctctgtggtcaa

SEQ ID NO: 559620 - DNA, 25 bp, Rattus norvegicus
tagcttcctgtcctgcctaagtttc

SEQ ID NO: 559621 - DNA, 25 bp, Rattus norvegicus
tagcttcctgtcgtgcctaagtttc

SEQ ID NO: 559622 - DNA, 25 bp, Rattus norvegicus
tagcttcgagctcatcctcttacta

SEQ ID NO: 559623 - DNA, 25 bp, Rattus norvegicus
tagcttcgagctgatcctcttacta

SEQ ID NO: 559624 - DNA, 25 bp, Rattus norvegicus
tagcttcgattcaacaggattttgt

SEQ ID NO: 559625 - DNA, 25 bp, Rattus norvegicus
tagcttcgattctacaggattttgt

SEQ ID NO: 559626 - DNA, 25 bp, Rattus norvegicus
tagcttctcattacagtactcagta

SEQ ID NO: 559627 - DNA, 25 bp, Rattus norvegicus
tagcttctcatttcagtactcagta

SEQ ID NO: 559628 - DNA, 25 bp, Rattus norvegicus
tagcttctccacagcatggcagtga

SEQ ID NO: 559629 - DNA, 25 bp, Rattus norvegicus
tagcttctccactgcatggcagtga

SEQ ID NO: 559630 - DNA, 25 bp, Rattus norvegicus
tagcttctccttctgttttgttctg

SEQ ID NO: 559631 - DNA, 25 bp, Rattus norvegicus
tagcttctccttgtgttttgttctg

SEQ ID NO: 559632 - DNA, 25 bp, Rattus norvegicus
tagcttctgattacagctctacctt

SEQ ID NO: 559633 - DNA, 25 bp, Rattus norvegicus
tagcttctgatttcagctctacctt

SEQ ID NO: 559634 - DNA, 25 bp, Rattus norvegicus
tagcttctggaaacatcactgtctt

SEQ ID NO: 559635 - DNA, 25 bp, Rattus norvegicus
tagcttctggaatcatcactgtctt

SEQ ID NO: 559636 - DNA, 25 bp, Rattus norvegicus
tagcttctgggtccctgctatgaat

SEQ ID NO: 559637 - DNA, 25 bp, Rattus norvegicus
tagcttctgggtgcctgctatgaat

SEQ ID NO: 559638 - DNA, 25 bp, Rattus norvegicus
tagcttcttcttatacctccggaga

SEQ ID NO: 559639 - DNA, 25 bp, Rattus norvegicus
tagcttcttcttttacctccggaga

SEQ ID NO: 559640 - DNA, 25 bp, Rattus norvegicus
tagcttgaccacaggctcgctgtgt

SEQ ID NO: 559641 - DNA, 25 bp, Rattus norvegicus
tagcttgaccactggctcgctgtgt

SEQ ID NO: 559642 - DNA, 25 bp, Rattus norvegicus
tagcttgactcactgtctttaccca

SEQ ID NO: 559643 - DNA, 25 bp, Rattus norvegicus
tagcttgactcagtgtctttaccca

SEQ ID NO: 559644 - DNA, 25 bp, Rattus norvegicus
tagcttgatctgcaactagccgaaa

SEQ ID NO: 559645 - DNA, 25 bp, Rattus norvegicus
tagcttgatctggaactagccgaaa

SEQ ID NO: 559646 - DNA, 25 bp, Rattus norvegicus
tagcttgatgttactgcttagcaga

SEQ ID NO: 559647 - DNA, 25 bp, Rattus norvegicus
tagcttgatgtttctgcttagcaga

SEQ ID NO: 559648 - DNA, 25 bp, Rattus norvegicus
tagcttgcacaacgattcttcctgt

SEQ ID NO: 559649 - DNA, 25 bp, Rattus norvegicus
tagcttgcacaaggattcttcctgt

SEQ ID NO: 559650 - DNA, 25 bp, Rattus norvegicus
tagcttgcactgcttcctttgtaaa

SEQ ID NO: 559651 - DNA, 25 bp, Rattus norvegicus
tagcttgcactggttcctttgtaaa

SEQ ID NO: 559652 - DNA, 25 bp, Rattus norvegicus
tagcttgccacgctggaacgcaata

SEQ ID NO: 559653 - DNA, 25 bp, Rattus norvegicus
tagcttgccacggtggaacgcaata

SEQ ID NO: 559654 - DNA, 25 bp, Rattus norvegicus
tagcttgcccgaacaggagtcctta

SEQ ID NO: 559655 - DNA, 25 bp, Rattus norvegicus
tagcttgcccgatcaggagtcctta

SEQ ID NO: 559656 - DNA, 25 bp, Rattus norvegicus
tagcttgcctatcagttctatccat

SEQ ID NO: 559657 - DNA, 25 bp, Rattus norvegicus
tagcttgcctatgagttctatccat

SEQ ID NO: 559658 - DNA, 25 bp, Rattus norvegicus
tagcttgctaggctctttcttgtct

SEQ ID NO: 559659 - DNA, 25 bp, Rattus norvegicus
tagcttgctagggtctttcttgtct

SEQ ID NO: 559660 - DNA, 25 bp, Rattus norvegicus
tagcttgctcacctccagcaggaag

SEQ ID NO: 559661 - DNA, 25 bp, Rattus norvegicus
tagcttgctcacgtccagcaggaag

SEQ ID NO: 559662 - DNA, 25 bp, Rattus norvegicus
tagcttgctcttatgtgcttgtgag

SEQ ID NO: 559663 - DNA, 25 bp, Rattus norvegicus
tagcttgctcttttgtgcttgtgag

SEQ ID NO: 559664 - DNA, 25 bp, Rattus norvegicus
tagcttgctgttcgcctcagttgag

SEQ ID NO: 559665 - DNA, 25 bp, Rattus norvegicus
tagcttgctgttggcctcagttgag

SEQ ID NO: 559666 - DNA, 25 bp, Rattus norvegicus
tagcttggcctacatgccctggaaa

SEQ ID NO: 559667 - DNA, 25 bp, Rattus norvegicus
tagcttggcctagatgccctggaaa

SEQ ID NO: 559668 - DNA, 25 bp, Rattus norvegicus
tagcttggtgtcctctgctgactgc

SEQ ID NO: 559669 - DNA, 25 bp, Rattus norvegicus
tagcttggtgtcgtctgctgactgc

SEQ ID NO: 559670 - DNA, 25 bp, Rattus norvegicus
tagcttgtaccgctggttcagtgct

SEQ ID NO: 559671 - DNA, 25 bp, Rattus norvegicus
tagcttgtaccggtggttcagtgct

SEQ ID NO: 559672 - DNA, 25 bp, Rattus norvegicus
tagcttgtattgattgagggacctg

SEQ ID NO: 559673 - DNA, 25 bp, Rattus norvegicus
tagcttgtattgtttgagggacctg

SEQ ID NO: 559674 - DNA, 25 bp, Rattus norvegicus
tagcttgtccacattgtatctcaat

SEQ ID NO: 559675 - DNA, 25 bp, Rattus norvegicus
tagcttgtccactttgtatctcaat

SEQ ID NO: 559676 - DNA, 25 bp, Rattus norvegicus
tagcttgtccttcccagtgatgctg

SEQ ID NO: 559677 - DNA, 25 bp, Rattus norvegicus
tagcttgtccttgccagtgatgctg

SEQ ID NO: 559678 - DNA, 25 bp, Rattus norvegicus
tagcttgtctcacaacaattcagtg

SEQ ID NO: 559679 - DNA, 25 bp, Rattus norvegicus
tagcttgtctcagaacaattcagtg

SEQ ID NO: 559680 - DNA, 25 bp, Rattus norvegicus
tagcttgtgggtcacggtcgccaac

SEQ ID NO: 559681 - DNA, 25 bp, Rattus norvegicus
tagcttgtgggtgacggtcgccaac

SEQ ID NO: 559682 - DNA, 25 bp, Rattus norvegicus
tagcttgtttttagcaatgccggcc

SEQ ID NO: 559683 - DNA, 25 bp, Rattus norvegicus
tagcttgttttttgcaatgccggcc

SEQ ID NO: 559684 - DNA, 25 bp, Rattus norvegicus
tagctttaactcacatatccccatt

SEQ ID NO: 559685 - DNA, 25 bp, Rattus norvegicus
tagctttaactctcatatccccatt

SEQ ID NO: 559686 - DNA, 25 bp, Rattus norvegicus
tagctttaacttatcccatcattcc

SEQ ID NO: 559687 - DNA, 25 bp, Rattus norvegicus
tagctttaacttttcccatcattcc

SEQ ID NO: 559688 - DNA, 25 bp, Rattus norvegicus
tagctttaatatatctttccctcgt

SEQ ID NO: 559689 - DNA, 25 bp, Rattus norvegicus
tagctttaatatttctttccctcgt

SEQ ID NO: 559690 - DNA, 25 bp, Rattus norvegicus
tagctttcaccaaccaatacttaca

SEQ ID NO: 559691 - DNA, 25 bp, Rattus norvegicus
tagctttcaccatccaatacttaca

SEQ ID NO: 559692 - DNA, 25 bp, Rattus norvegicus
tagctttcagccattagaaactctt

SEQ ID NO: 559693 - DNA, 25 bp, Rattus norvegicus
tagctttcagcctttagaaactctt

SEQ ID NO: 559694 - DNA, 25 bp, Rattus norvegicus
tagctttcccaccattggagcagag

SEQ ID NO: 559695 - DNA, 25 bp, Rattus norvegicus
tagctttcccacgattggagcagag

SEQ ID NO: 559696 - DNA, 25 bp, Rattus norvegicus
tagctttcccctatggtctgactta

SEQ ID NO: 559697 - DNA, 25 bp, Rattus norvegicus
tagctttcccctttggtctgactta

SEQ ID NO: 559698 - DNA, 25 bp, Rattus norvegicus
tagctttcctctaacaccagactta

SEQ ID NO: 559699 - DNA, 25 bp, Rattus norvegicus
tagctttcctcttacaccagactta

SEQ ID NO: 559700 - DNA, 25 bp, Rattus norvegicus
tagctttccttcacttgtaccagaa

SEQ ID NO: 559701 - DNA, 25 bp, Rattus norvegicus
tagctttccttctcttgtaccagaa

SEQ ID NO: 559702 - DNA, 25 bp, Rattus norvegicus
tagctttcctttatgccggggacat

SEQ ID NO: 559703 - DNA, 25 bp, Rattus norvegicus
tagctttcctttttgccggggacat

SEQ ID NO: 559704 - DNA, 25 bp, Rattus norvegicus
tagctttctcatcctaaccctgaaa

SEQ ID NO: 559705 - DNA, 25 bp, Rattus norvegicus
tagctttctcatgctaaccctgaaa

SEQ ID NO: 559706 - DNA, 25 bp, Rattus norvegicus
tagctttctgtcctgcaactggcaa

SEQ ID NO: 559707 - DNA, 25 bp, Rattus norvegicus
tagctttctgtcgtgcaactggcaa

SEQ ID NO: 559708 - DNA, 25 bp, Rattus norvegicus
tagctttctttgagtttcagtgcaa

SEQ ID NO: 559709 - DNA, 25 bp, Rattus norvegicus
tagctttctttgtgtttcagtgcaa

SEQ ID NO: 559710 - DNA, 25 bp, Rattus norvegicus
tagctttgactaagcaagacagtgc

SEQ ID NO: 559711 - DNA, 25 bp, Rattus norvegicus
tagctttgactatgcaagacagtgc

SEQ ID NO: 559712 - DNA, 25 bp, Rattus norvegicus
tagctttgcctcaactctgggcaat

SEQ ID NO: 559713 - DNA, 25 bp, Rattus norvegicus
tagctttgcctctactctgggcaat

SEQ ID NO: 559714 - DNA, 25 bp, Rattus norvegicus
tagctttgctggcaaccatgctctg

SEQ ID NO: 559715 - DNA, 25 bp, Rattus norvegicus
tagctttgctgggaaccatgctctg

SEQ ID NO: 559716 - DNA, 25 bp, Rattus norvegicus
tagctttgcttgaggaccgtctaaa

SEQ ID NO: 559717 - DNA, 25 bp, Rattus norvegicus
tagctttgcttgtggaccgtctaaa

SEQ ID NO: 559718 - DNA, 25 bp, Rattus norvegicus
tagctttggccaaaactccgcaaat

SEQ ID NO: 559719 - DNA, 25 bp, Rattus norvegicus
tagctttggccataactccgcaaat

SEQ ID NO: 559720 - DNA, 25 bp, Rattus norvegicus
tagctttggctgacgtggaactagg

SEQ ID NO: 559721 - DNA, 25 bp, Rattus norvegicus
tagctttggctgtcgtggaactagg

SEQ ID NO: 559722 - DNA, 25 bp, Rattus norvegicus
tagctttggggtctcctgggctccc

SEQ ID NO: 559723 - DNA, 25 bp, Rattus norvegicus
tagctttggggtgtcctgggctccc

SEQ ID NO: 559724 - DNA, 25 bp, Rattus norvegicus
tagctttggtggacctttagcgaaa

SEQ ID NO: 559725 - DNA, 25 bp, Rattus norvegicus
tagctttggtggtcctttagcgaaa

SEQ ID NO: 559726 - DNA, 25 bp, Rattus norvegicus
tagctttgtaaactcctacctagga

SEQ ID NO: 559727 - DNA, 25 bp, Rattus norvegicus
tagctttgtaaagtcctacctagga

SEQ ID NO: 559728 - DNA, 25 bp, Rattus norvegicus
tagctttgtagcagtggttagcgta

SEQ ID NO: 559729 - DNA, 25 bp, Rattus norvegicus
tagctttgtagctgtggttagcgta

SEQ ID NO: 559730 - DNA, 25 bp, Rattus norvegicus
tagctttgtatcatgcaggttttgc

SEQ ID NO: 559731 - DNA, 25 bp, Rattus norvegicus
tagctttgtatcttgcaggttttgc

SEQ ID NO: 559732 - DNA, 25 bp, Rattus norvegicus
tagctttgtgtaatcatgcctctct

SEQ ID NO: 559733 - DNA, 25 bp, Rattus norvegicus
tagctttgtgtattcatgcctctct

SEQ ID NO: 559734 - DNA, 25 bp, Rattus norvegicus
tagcttttagagaccaggtctggtt

SEQ ID NO: 559735 - DNA, 25 bp, Rattus norvegicus
tagcttttagagtccaggtctggtt

SEQ ID NO: 559736 - DNA, 25 bp, Rattus norvegicus
tagcttttagcaaacttgggccaaa

SEQ ID NO: 559737 - DNA, 25 bp, Rattus norvegicus
tagcttttagcatacttgggccaaa

SEQ ID NO: 559738 - DNA, 25 bp, Rattus norvegicus
tagcttttagctctcttctccgtca

SEQ ID NO: 559739 - DNA, 25 bp, Rattus norvegicus
tagcttttagctgtcttctccgtca

SEQ ID NO: 559740 - DNA, 25 bp, Rattus norvegicus
tagcttttatctcaagtgccttaag

SEQ ID NO: 559741 - DNA, 25 bp, Rattus norvegicus
tagcttttatctgaagtgccttaag

SEQ ID NO: 559742 - DNA, 25 bp, Rattus norvegicus
tagcttttattcaagaggatcttaa

SEQ ID NO: 559743 - DNA, 25 bp, Rattus norvegicus
tagcttttattctagaggatcttaa

SEQ ID NO: 559744 - DNA, 25 bp, Rattus norvegicus
tagcttttccagagtcctgttacaa

SEQ ID NO: 559745 - DNA, 25 bp, Rattus norvegicus
tagcttttccagtgtcctgttacaa

SEQ ID NO: 559746 - DNA, 25 bp, Rattus norvegicus
tagcttttcctaacatcacacacac

SEQ ID NO: 559747 - DNA, 25 bp, Rattus norvegicus
tagcttttcctatcatcacacacac

SEQ ID NO: 559748 - DNA, 25 bp, Rattus norvegicus
tagcttttcgctccattgtgaacac

SEQ ID NO: 559749 - DNA, 25 bp, Rattus norvegicus
tagcttttcgctgcattgtgaacac

SEQ ID NO: 559750 - DNA, 25 bp, Rattus norvegicus
tagcttttctgcaggaaggacttcc

SEQ ID NO: 559751 - DNA, 25 bp, Rattus norvegicus
tagcttttctgctggaaggacttcc

SEQ ID NO: 559752 - DNA, 25 bp, Rattus norvegicus
tagcttttgccacttaccgtaggtc

SEQ ID NO: 559753 - DNA, 25 bp, Rattus norvegicus
tagcttttgccagttaccgtaggtc

SEQ ID NO: 559754 - DNA, 25 bp, Rattus norvegicus
tagcttttggataatgctccctaat

SEQ ID NO: 559755 - DNA, 25 bp, Rattus norvegicus
tagcttttggattatgctccctaat

SEQ ID NO: 559756 - DNA, 25 bp, Rattus norvegicus
tagcttttgttgatcttccctgtta

SEQ ID NO: 559757 - DNA, 25 bp, Rattus norvegicus
tagcttttgttgttcttccctgtta

SEQ ID NO: 559758 - DNA, 25 bp, Rattus norvegicus
tagcttttgtttacaccctggaatg

SEQ ID NO: 559759 - DNA, 25 bp, Rattus norvegicus
tagcttttgttttcaccctggaatg

SEQ ID NO: 559760 - DNA, 25 bp, Rattus norvegicus
tagctttttaccatttctggcccag

SEQ ID NO: 559761 - DNA, 25 bp, Rattus norvegicus
tagctttttaccttttctggcccag

SEQ ID NO: 559762 - DNA, 25 bp, Rattus norvegicus
tagctttttcaactgcaggctgcag

SEQ ID NO: 559763 - DNA, 25 bp, Rattus norvegicus
tagctttttcaagtgcaggctgcag

SEQ ID NO: 559764 - DNA, 25 bp, Rattus norvegicus
taggaaaagccaccctgtatgctgt

SEQ ID NO: 559765 - DNA, 25 bp, Rattus norvegicus
taggaaaagccagcctgtatgctgt

SEQ ID NO: 559766 - DNA, 25 bp, Rattus norvegicus
taggaaacccgtagtacctggccat

SEQ ID NO: 559767 - DNA, 25 bp, Rattus norvegicus
taggaaacccgttgtacctggccat

SEQ ID NO: 559768 - DNA, 25 bp, Rattus norvegicus
taggaaacgggaactccactaccac

SEQ ID NO: 559769 - DNA, 25 bp, Rattus norvegicus
taggaaacgggatctccactaccac

SEQ ID NO: 559770 - DNA, 25 bp, Rattus norvegicus
taggaaactgggattgccctttcta

SEQ ID NO: 559771 - DNA, 25 bp, Rattus norvegicus
taggaaactgggtttgccctttcta

SEQ ID NO: 559772 - DNA, 25 bp, Rattus norvegicus
taggaaagacatccttgtggacttt

SEQ ID NO: 559773 - DNA, 25 bp, Rattus norvegicus
taggaaagacatgcttgtggacttt

SEQ ID NO: 559774 - DNA, 25 bp, Rattus norvegicus
taggaaagactcacccgtaaagctt

SEQ ID NO: 559775 - DNA, 25 bp, Rattus norvegicus
taggaaagactctcccgtaaagctt

SEQ ID NO: 559776 - DNA, 25 bp, Rattus norvegicus
taggaaagcctgactctgcggctag

SEQ ID NO: 559777 - DNA, 25 bp, Rattus norvegicus
taggaaagcctgtctctgcggctag

SEQ ID NO: 559778 - DNA, 25 bp, Rattus norvegicus
taggaaagcgcaagcgcgtccgatc

SEQ ID NO: 559779 - DNA, 25 bp, Rattus norvegicus
taggaaagcgcatgcgcgtccgatc

SEQ ID NO: 559780 - DNA, 25 bp, Rattus norvegicus
taggaaagcgggactcttcctctgc

SEQ ID NO: 559781 - DNA, 25 bp, Rattus norvegicus
taggaaagcgggtctcttcctctgc

SEQ ID NO: 559782 - DNA, 25 bp, Rattus norvegicus
taggaaaggcatcgtggactcacac

SEQ ID NO: 559783 - DNA, 25 bp, Rattus norvegicus
taggaaaggcatggtggactcacac

SEQ ID NO: 559784 - DNA, 25 bp, Rattus norvegicus
taggaaatccacacattccggaaga

SEQ ID NO: 559785 - DNA, 25 bp, Rattus norvegicus
taggaaatccactcattccggaaga

SEQ ID NO: 559786 - DNA, 25 bp, Rattus norvegicus
taggaaatcgcaagcccgggaagct

SEQ ID NO: 559787 - DNA, 25 bp, Rattus norvegicus
taggaaatcgcatgcccgggaagct

SEQ ID NO: 559788 - DNA, 25 bp, Rattus norvegicus
taggaaatgaagctcgagcccctgc

SEQ ID NO: 559789 - DNA, 25 bp, Rattus norvegicus
taggaaatgaaggtcgagcccctgc

SEQ ID NO: 559790 - DNA, 25 bp, Rattus norvegicus
taggaaatgctcaccttattttgtc

SEQ ID NO: 559791 - DNA, 25 bp, Rattus norvegicus
taggaaatgctctccttattttgtc

SEQ ID NO: 559792 - DNA, 25 bp, Rattus norvegicus
taggaaatgtccaacctcctgggaa

SEQ ID NO: 559793 - DNA, 25 bp, Rattus norvegicus
taggaaatgtcctacctcctgggaa

SEQ ID NO: 559794 - DNA, 25 bp, Rattus norvegicus
taggaaattcctccgggtctgggca

SEQ ID NO: 559795 - DNA, 25 bp, Rattus norvegicus
taggaaattcctgcgggtctgggca

SEQ ID NO: 559796 - DNA, 25 bp, Rattus norvegicus
taggaaattgctcgttgcctgtccc

SEQ ID NO: 559797 - DNA, 25 bp, Rattus norvegicus
taggaaattgctggttgcctgtccc

SEQ ID NO: 559798 - DNA, 25 bp, Rattus norvegicus
taggaacaattcacttctcctgacc

SEQ ID NO: 559799 - DNA, 25 bp, Rattus norvegicus
taggaacaattctcttctcctgacc

SEQ ID NO: 559800 - DNA, 25 bp, Rattus norvegicus
taggaacaccagactacctggttcc

SEQ ID NO: 559801 - DNA, 25 bp, Rattus norvegicus
taggaacaccagtctacctggttcc

SEQ ID NO: 559802 - DNA, 25 bp, Rattus norvegicus
taggaacactgcatgactcccttgc

SEQ ID NO: 559803 - DNA, 25 bp, Rattus norvegicus
taggaacactgcttgactcccttgc

SEQ ID NO: 559804 - DNA, 25 bp, Rattus norvegicus
taggaacacttccaggtctctgaag

SEQ ID NO: 559805 - DNA, 25 bp, Rattus norvegicus
taggaacacttcgaggtctctgaag

SEQ ID NO: 559806 - DNA, 25 bp, Rattus norvegicus
taggaacacttgctgccctgatctt

SEQ ID NO: 559807 - DNA, 25 bp, Rattus norvegicus
taggaacacttggtgccctgatctt

SEQ ID NO: 559808 - DNA, 25 bp, Rattus norvegicus
taggaacagtccaggttcaaaccct

SEQ ID NO: 559809 - DNA, 25 bp, Rattus norvegicus
taggaacagtcctggttcaaaccct

SEQ ID NO: 559810 - DNA, 25 bp, Rattus norvegicus
taggaacattcgcttgcgtactctc

SEQ ID NO: 559811 - DNA, 25 bp, Rattus norvegicus
taggaacattcggttgcgtactctc

SEQ ID NO: 559812 - DNA, 25 bp, Rattus norvegicus
taggaacccattctgcttctttgta

SEQ ID NO: 559813 - DNA, 25 bp, Rattus norvegicus
taggaacccattgtgcttctttgta

SEQ ID NO: 559814 - DNA, 25 bp, Rattus norvegicus
taggaaccctgcatcaccagataaa

SEQ ID NO: 559815 - DNA, 25 bp, Rattus norvegicus
taggaaccctgcctttttctatctt

SEQ ID NO: 559816 - DNA, 25 bp, Rattus norvegicus
taggaaccctgcgtttttctatctt

SEQ ID NO: 559817 - DNA, 25 bp, Rattus norvegicus
taggaaccctgcttcaccagataaa

SEQ ID NO: 559818 - DNA, 25 bp, Rattus norvegicus
taggaacctgccaagagggacccac

SEQ ID NO: 559819 - DNA, 25 bp, Rattus norvegicus
taggaacctgcctagagggacccac

SEQ ID NO: 559820 - DNA, 25 bp, Rattus norvegicus
taggaacctggaagagtggctaccc

SEQ ID NO: 559821 - DNA, 25 bp, Rattus norvegicus
taggaacctggatgagtggctaccc

SEQ ID NO: 559822 - DNA, 25 bp, Rattus norvegicus
taggaactacatagctgtcccatgt

SEQ ID NO: 559823 - DNA, 25 bp, Rattus norvegicus
taggaactacattgctgtcccatgt

SEQ ID NO: 559824 - DNA, 25 bp, Rattus norvegicus
taggaactatcgcaccatgaagtta

SEQ ID NO: 559825 - DNA, 25 bp, Rattus norvegicus
taggaactatcggaccatgaagtta

SEQ ID NO: 559826 - DNA, 25 bp, Rattus norvegicus
taggaactattcaagacagtaaata

SEQ ID NO: 559827 - DNA, 25 bp, Rattus norvegicus
taggaactattcacaaagccattga

SEQ ID NO: 559828 - DNA, 25 bp, Rattus norvegicus
taggaactattctagacagtaaata

SEQ ID NO: 559829 - DNA, 25 bp, Rattus norvegicus
taggaactattctcaaagccattga

SEQ ID NO: 559830 - DNA, 25 bp, Rattus norvegicus
taggaactcagccaaagccttctgt

SEQ ID NO: 559831 - DNA, 25 bp, Rattus norvegicus
taggaactcagcgaaagccttctgt

SEQ ID NO: 559832 - DNA, 25 bp, Rattus norvegicus
taggaactccctcttgtgtttgttt

SEQ ID NO: 559833 - DNA, 25 bp, Rattus norvegicus
taggaactccctgttgtgtttgttt

SEQ ID NO: 559834 - DNA, 25 bp, Rattus norvegicus
taggaactccgaccaggctgagcaa

SEQ ID NO: 559835 - DNA, 25 bp, Rattus norvegicus
taggaactccgagcaggctgagcaa

SEQ ID NO: 559836 - DNA, 25 bp, Rattus norvegicus
taggaactccttacgtttacctgtg

SEQ ID NO: 559837 - DNA, 25 bp, Rattus norvegicus
taggaactcctttcgtttacctgtg

SEQ ID NO: 559838 - DNA, 25 bp, Rattus norvegicus
taggaactgaaacgccttcttctgt

SEQ ID NO: 559839 - DNA, 25 bp, Rattus norvegicus
taggaactgaaaggccttcttctgt

SEQ ID NO: 559840 - DNA, 25 bp, Rattus norvegicus
taggaactgagacccaccattgtcc

SEQ ID NO: 559841 - DNA, 25 bp, Rattus norvegicus
taggaactgagagccaccattgtcc

SEQ ID NO: 559842 - DNA, 25 bp, Rattus norvegicus
taggaactgcctatttatgctcatt

SEQ ID NO: 559843 - DNA, 25 bp, Rattus norvegicus
taggaactgcctttttatgctcatt

SEQ ID NO: 559844 - DNA, 25 bp, Rattus norvegicus
taggaactggctattctggtccttc

SEQ ID NO: 559845 - DNA, 25 bp, Rattus norvegicus
taggaactggcttttctggtccttc

SEQ ID NO: 559846 - DNA, 25 bp, Rattus norvegicus
taggaacttacaactttggtgccaa

SEQ ID NO: 559847 - DNA, 25 bp, Rattus norvegicus
taggaacttacatctttggtgccaa

SEQ ID NO: 559848 - DNA, 25 bp, Rattus norvegicus
taggaacttagactcccagctaggg

SEQ ID NO: 559849 - DNA, 25 bp, Rattus norvegicus
taggaacttagagtcccagctaggg

SEQ ID NO: 559850 - DNA, 25 bp, Rattus norvegicus
taggaacttcaccttgagtcttggg

SEQ ID NO: 559851 - DNA, 25 bp, Rattus norvegicus
taggaacttcacgttgagtcttggg

SEQ ID NO: 559852 - DNA, 25 bp, Rattus norvegicus
taggaacttcctccttatctcatgt

SEQ ID NO: 559853 - DNA, 25 bp, Rattus norvegicus
taggaacttcctgcttatctcatgt

SEQ ID NO: 559854 - DNA, 25 bp, Rattus norvegicus
taggaagaagccactggtcccttca

SEQ ID NO: 559855 - DNA, 25 bp, Rattus norvegicus
taggaagaagcctctggtcccttca

SEQ ID NO: 559856 - DNA, 25 bp, Rattus norvegicus
taggaagaatctcgcccaacctttt

SEQ ID NO: 559857 - DNA, 25 bp, Rattus norvegicus
taggaagaatctggcccaacctttt

SEQ ID NO: 559858 - DNA, 25 bp, Rattus norvegicus
taggaagacagtacctggcaacaga

SEQ ID NO: 559859 - DNA, 25 bp, Rattus norvegicus
taggaagacagttcctggcaacaga

SEQ ID NO: 559860 - DNA, 25 bp, Rattus norvegicus
taggaagagctgagtaggtaaacac

SEQ ID NO: 559861 - DNA, 25 bp, Rattus norvegicus
taggaagagctgtgtaggtaaacac

SEQ ID NO: 559862 - DNA, 25 bp, Rattus norvegicus
taggaagatcacactttctgtcccc

SEQ ID NO: 559863 - DNA, 25 bp, Rattus norvegicus
taggaagatcactctttctgtcccc

SEQ ID NO: 559864 - DNA, 25 bp, Rattus norvegicus
taggaagccatcagactaatgtctc

SEQ ID NO: 559865 - DNA, 25 bp, Rattus norvegicus
taggaagccatctgactaatgtctc

SEQ ID NO: 559866 - DNA, 25 bp, Rattus norvegicus
taggaagccattcccatttgcagca

SEQ ID NO: 559867 - DNA, 25 bp, Rattus norvegicus
taggaagccattgccatttgcagca

SEQ ID NO: 559868 - DNA, 25 bp, Rattus norvegicus
taggaagccgatcttctgtggtgaa

SEQ ID NO: 559869 - DNA, 25 bp, Rattus norvegicus
taggaagccgatgttctgtggtgaa

SEQ ID NO: 559870 - DNA, 25 bp, Rattus norvegicus
taggaagcctccacttatccatgtg

SEQ ID NO: 559871 - DNA, 25 bp, Rattus norvegicus
taggaagcctcctcttatccatgtg

SEQ ID NO: 559872 - DNA, 25 bp, Rattus norvegicus
taggaagcctgaaggatctagacat

SEQ ID NO: 559873 - DNA, 25 bp, Rattus norvegicus
taggaagcctgatggatctagacat

SEQ ID NO: 559874 - DNA, 25 bp, Rattus norvegicus
taggaagcgctcacccatgaggtgg

SEQ ID NO: 559875 - DNA, 25 bp, Rattus norvegicus
taggaagcgctctcccatgaggtgg

SEQ ID NO: 559876 - DNA, 25 bp, Rattus norvegicus
taggaagctccaccgggtccttagg

SEQ ID NO: 559877 - DNA, 25 bp, Rattus norvegicus
taggaagctccagcgggtccttagg

SEQ ID NO: 559878 - DNA, 25 bp, Rattus norvegicus
taggaagctcgtcagaccctttatc

SEQ ID NO: 559879 - DNA, 25 bp, Rattus norvegicus
taggaagctcgtgagaccctttatc

SEQ ID NO: 559880 - DNA, 25 bp, Rattus norvegicus
taggaaggcctcacactcccaagtg

SEQ ID NO: 559881 - DNA, 25 bp, Rattus norvegicus
taggaaggcctctcactcccaagtg

SEQ ID NO: 559882 - DNA, 25 bp, Rattus norvegicus
taggaagggactactcgatgccgat

SEQ ID NO: 559883 - DNA, 25 bp, Rattus norvegicus
taggaagggacttctcgatgccgat

SEQ ID NO: 559884 - DNA, 25 bp, Rattus norvegicus
taggaagggcacactctcacactag

SEQ ID NO: 559885 - DNA, 25 bp, Rattus norvegicus
taggaagggcactctctcacactag

SEQ ID NO: 559886 - DNA, 25 bp, Rattus norvegicus
taggaagggcttctttgcacacttc

SEQ ID NO: 559887 - DNA, 25 bp, Rattus norvegicus
taggaagggcttgtttgcacacttc

SEQ ID NO: 559888 - DNA, 25 bp, Rattus norvegicus
taggaaggtcctattctggtgaaga

SEQ ID NO: 559889 - DNA, 25 bp, Rattus norvegicus
taggaaggtccttttctggtgaaga

SEQ ID NO: 559890 - DNA, 25 bp, Rattus norvegicus
taggaaggtcttcggcttctgttca

SEQ ID NO: 559891 - DNA, 25 bp, Rattus norvegicus
taggaaggtcttgggcttctgttca

SEQ ID NO: 559892 - DNA, 25 bp, Rattus norvegicus
taggaaggttgtattcagcccgact

SEQ ID NO: 559893 - DNA, 25 bp, Rattus norvegicus
taggaaggttgttttcagcccgact

SEQ ID NO: 559894 - DNA, 25 bp, Rattus norvegicus
taggaagtcgcaagcggttccgcgt

SEQ ID NO: 559895 - DNA, 25 bp, Rattus norvegicus
taggaagtcgcaaggtccctgggtt

SEQ ID NO: 559896 - DNA, 25 bp, Rattus norvegicus
taggaagtcgcatgcggttccgcgt

SEQ ID NO: 559897 - DNA, 25 bp, Rattus norvegicus
taggaagtcgcatggtccctgggtt

SEQ ID NO: 559898 - DNA, 25 bp, Rattus norvegicus
taggaagtgctgcttcggtgtttta

SEQ ID NO: 559899 - DNA, 25 bp, Rattus norvegicus
taggaagtgctggttcggtgtttta

SEQ ID NO: 559900 - DNA, 25 bp, Rattus norvegicus
taggaagttcagagtcacccttctt

SEQ ID NO: 559901 - DNA, 25 bp, Rattus norvegicus
taggaagttcagtgtcacccttctt

SEQ ID NO: 559902 - DNA, 25 bp, Rattus norvegicus
taggaagttgagatgtagtacatga

SEQ ID NO: 559903 - DNA, 25 bp, Rattus norvegicus
taggaagttgagttgtagtacatga

SEQ ID NO: 559904 - DNA, 25 bp, Rattus norvegicus
taggaagttgatatcgtctccaccc

SEQ ID NO: 559905 - DNA, 25 bp, Rattus norvegicus
taggaagttgatttcgtctccaccc

SEQ ID NO: 559906 - DNA, 25 bp, Rattus norvegicus
taggaatacttgctgcgcctgtaga

SEQ ID NO: 559907 - DNA, 25 bp, Rattus norvegicus
taggaatacttggtgcgcctgtaga

SEQ ID NO: 559908 - DNA, 25 bp, Rattus norvegicus
taggaatagtaaagccctgccctca

SEQ ID NO: 559909 - DNA, 25 bp, Rattus norvegicus
taggaatagtaatgccctgccctca

SEQ ID NO: 559910 - DNA, 25 bp, Rattus norvegicus
taggaatatctacgtgtgcacacat

SEQ ID NO: 559911 - DNA, 25 bp, Rattus norvegicus
taggaatatctaggtgtgcacacat

SEQ ID NO: 559912 - DNA, 25 bp, Rattus norvegicus
taggaatatcttaattagccaagca

SEQ ID NO: 559913 - DNA, 25 bp, Rattus norvegicus
taggaatatctttattagccaagca

SEQ ID NO: 559914 - DNA, 25 bp, Rattus norvegicus
taggaatccaagaagtaacttttct

SEQ ID NO: 559915 - DNA, 25 bp, Rattus norvegicus
taggaatccaagtagtaacttttct

SEQ ID NO: 559916 - DNA, 25 bp, Rattus norvegicus
taggaatccactctgtgactgcgcc

SEQ ID NO: 559917 - DNA, 25 bp, Rattus norvegicus
taggaatccactgtgtgactgcgcc

SEQ ID NO: 559918 - DNA, 25 bp, Rattus norvegicus
taggaatccccacggttgtgccaga

SEQ ID NO: 559919 - DNA, 25 bp, Rattus norvegicus
taggaatccccagggttgtgccaga

SEQ ID NO: 559920 - DNA, 25 bp, Rattus norvegicus
taggaatcctcactcacttgtatag

SEQ ID NO: 559921 - DNA, 25 bp, Rattus norvegicus
taggaatcctcagtcacttgtatag

SEQ ID NO: 559922 - DNA, 25 bp, Rattus norvegicus
taggaatctccgactgtttctccaa

SEQ ID NO: 559923 - DNA, 25 bp, Rattus norvegicus
taggaatctccgtctgtttctccaa

SEQ ID NO: 559924 - DNA, 25 bp, Rattus norvegicus
taggaatgacctccagagtctgagc

SEQ ID NO: 559925 - DNA, 25 bp, Rattus norvegicus
taggaatgacctgcagagtctgagc

SEQ ID NO: 559926 - DNA, 25 bp, Rattus norvegicus
taggaatgactgatgctatcgcaca

SEQ ID NO: 559927 - DNA, 25 bp, Rattus norvegicus
taggaatgactgttgctatcgcaca

SEQ ID NO: 559928 - DNA, 25 bp, Rattus norvegicus
taggaatgccttacttctctaactc

SEQ ID NO: 559929 - DNA, 25 bp, Rattus norvegicus
taggaatgcctttcttctctaactc

SEQ ID NO: 559930 - DNA, 25 bp, Rattus norvegicus
taggaatgctgcctgagcccttgca

SEQ ID NO: 559931 - DNA, 25 bp, Rattus norvegicus
taggaatgctgcgtgagcccttgca

SEQ ID NO: 559932 - DNA, 25 bp, Rattus norvegicus
taggaatgcttgcttaactatatgc

SEQ ID NO: 559933 - DNA, 25 bp, Rattus norvegicus
taggaatgcttggttaactatatgc

SEQ ID NO: 559934 - DNA, 25 bp, Rattus norvegicus
taggaatggcacacggtacctcacc

SEQ ID NO: 559935 - DNA, 25 bp, Rattus norvegicus
taggaatggcactcggtacctcacc

SEQ ID NO: 559936 - DNA, 25 bp, Rattus norvegicus
taggaatggctgagtctcgctgtgc

SEQ ID NO: 559937 - DNA, 25 bp, Rattus norvegicus
taggaatggctgtgtctcgctgtgc

SEQ ID NO: 559938 - DNA, 25 bp, Rattus norvegicus
taggaattgtgtctgccacccgctg

SEQ ID NO: 559939 - DNA, 25 bp, Rattus norvegicus
taggaattgtgtgtgccacccgctg

SEQ ID NO: 559940 - DNA, 25 bp, Rattus norvegicus
taggaatttcctcacagacttgccc

SEQ ID NO: 559941 - DNA, 25 bp, Rattus norvegicus
taggaatttcctgacagacttgccc

SEQ ID NO: 559942 - DNA, 25 bp, Rattus norvegicus
taggaatttgtgatttggtgtaagc

SEQ ID NO: 559943 - DNA, 25 bp, Rattus norvegicus
taggaatttgtgttttggtgtaagc

SEQ ID NO: 559944 - DNA, 25 bp, Rattus norvegicus
taggaattttttcacctgtaatatg

SEQ ID NO: 559945 - DNA, 25 bp, Rattus norvegicus
taggaattttttgacctgtaatatg

SEQ ID NO: 559946 - DNA, 25 bp, Rattus norvegicus
taggacaacgtcatcaatacccagt

SEQ ID NO: 559947 - DNA, 25 bp, Rattus norvegicus
taggacaacgtcttcaatacccagt

SEQ ID NO: 559948 - DNA, 25 bp, Rattus norvegicus
taggacaagcctagagacataactc

SEQ ID NO: 559949 - DNA, 25 bp, Rattus norvegicus
taggacaagccttgagacataactc

SEQ ID NO: 559950 - DNA, 25 bp, Rattus norvegicus
taggacaattgcaggcccaggcagg

SEQ ID NO: 559951 - DNA, 25 bp, Rattus norvegicus
taggacaattgctggcccaggcagg

SEQ ID NO: 559952 - DNA, 25 bp, Rattus norvegicus
taggacacacggactcaacagaggc

SEQ ID NO: 559953 - DNA, 25 bp, Rattus norvegicus
taggacacacggtctcaacagaggc

SEQ ID NO: 559954 - DNA, 25 bp, Rattus norvegicus
taggacacagatattcaaggcacat

SEQ ID NO: 559955 - DNA, 25 bp, Rattus norvegicus
taggacacagattttcaaggcacat

SEQ ID NO: 559956 - DNA, 25 bp, Rattus norvegicus
taggacacagtcctggtttcccatc

SEQ ID NO: 559957 - DNA, 25 bp, Rattus norvegicus
taggacacagtcgtggtttcccatc

SEQ ID NO: 559958 - DNA, 25 bp, Rattus norvegicus
taggacacatttatccagacatcat

SEQ ID NO: 559959 - DNA, 25 bp, Rattus norvegicus
taggacacatttttccagacatcat

SEQ ID NO: 559960 - DNA, 25 bp, Rattus norvegicus
taggacaccaacactttctacaggt

SEQ ID NO: 559961 - DNA, 25 bp, Rattus norvegicus
taggacaccaactctttctacaggt

SEQ ID NO: 559962 - DNA, 25 bp, Rattus norvegicus
taggacaccacgcatgcatgacagg

SEQ ID NO: 559963 - DNA, 25 bp, Rattus norvegicus
taggacaccacggatgcatgacagg

SEQ ID NO: 559964 - DNA, 25 bp, Rattus norvegicus
taggacacctcgactcataaagaga

SEQ ID NO: 559965 - DNA, 25 bp, Rattus norvegicus
taggacacctcgtctcataaagaga

SEQ ID NO: 559966 - DNA, 25 bp, Rattus norvegicus
taggacacgtccctgaatgccagtc

SEQ ID NO: 559967 - DNA, 25 bp, Rattus norvegicus
taggacacgtccgtgaatgccagtc

SEQ ID NO: 559968 - DNA, 25 bp, Rattus norvegicus
taggacacgtgacactggctctgca

SEQ ID NO: 559969 - DNA, 25 bp, Rattus norvegicus
taggacacgtgagactggctctgca

SEQ ID NO: 559970 - DNA, 25 bp, Rattus norvegicus
taggacactacaagtgatctgcctg

SEQ ID NO: 559971 - DNA, 25 bp, Rattus norvegicus
taggacactacatgtgatctgcctg

SEQ ID NO: 559972 - DNA, 25 bp, Rattus norvegicus
taggacactcaacgcctcttggact

SEQ ID NO: 559973 - DNA, 25 bp, Rattus norvegicus
taggacactcaaggcctcttggact

SEQ ID NO: 559974 - DNA, 25 bp, Rattus norvegicus
taggacactcctcccatgaaaacag

SEQ ID NO: 559975 - DNA, 25 bp, Rattus norvegicus
taggacactcctgccatgaaaacag

SEQ ID NO: 559976 - DNA, 25 bp, Rattus norvegicus
taggacagaaagagcccctgctaca

SEQ ID NO: 559977 - DNA, 25 bp, Rattus norvegicus
taggacagaaagtgcccctgctaca

SEQ ID NO: 559978 - DNA, 25 bp, Rattus norvegicus
taggacagaggcctcttgacctgca

SEQ ID NO: 559979 - DNA, 25 bp, Rattus norvegicus
taggacagaggcgtcttgacctgca

SEQ ID NO: 559980 - DNA, 25 bp, Rattus norvegicus
taggacagcaggatggctaccctca

SEQ ID NO: 559981 - DNA, 25 bp, Rattus norvegicus
taggacagcaggttggctaccctca

SEQ ID NO: 559982 - DNA, 25 bp, Rattus norvegicus
taggacagcccgaaggtagcgactc

SEQ ID NO: 559983 - DNA, 25 bp, Rattus norvegicus
taggacagcccgtaggtagcgactc

SEQ ID NO: 559984 - DNA, 25 bp, Rattus norvegicus
taggacatacagatcctgtgcccag

SEQ ID NO: 559985 - DNA, 25 bp, Rattus norvegicus
taggacatacagttcctgtgcccag

SEQ ID NO: 559986 - DNA, 25 bp, Rattus norvegicus
taggacatcaaactaggctctacga

SEQ ID NO: 559987 - DNA, 25 bp, Rattus norvegicus
taggacatcaaagtaggctctacga

SEQ ID NO: 559988 - DNA, 25 bp, Rattus norvegicus
taggacatccgtacagttgtgtagc

SEQ ID NO: 559989 - DNA, 25 bp, Rattus norvegicus
taggacatccgttcagttgtgtagc

SEQ ID NO: 559990 - DNA, 25 bp, Rattus norvegicus
taggacatgtcaccaaagcagccca

SEQ ID NO: 559991 - DNA, 25 bp, Rattus norvegicus
taggacatgtcagcaaagcagccca

SEQ ID NO: 559992 - DNA, 25 bp, Rattus norvegicus
taggacattaacaccttcgttcggt

SEQ ID NO: 559993 - DNA, 25 bp, Rattus norvegicus
taggacattaactccttcgttcggt

SEQ ID NO: 559994 - DNA, 25 bp, Rattus norvegicus
taggacatttgtcggcgcatacgtt

SEQ ID NO: 559995 - DNA, 25 bp, Rattus norvegicus
taggacatttgtgggcgcatacgtt

SEQ ID NO: 559996 - DNA, 25 bp, Rattus norvegicus
taggaccaaaggacagaggccctgt

SEQ ID NO: 559997 - DNA, 25 bp, Rattus norvegicus
taggaccaaaggtcagaggccctgt

SEQ ID NO: 559998 - DNA, 25 bp, Rattus norvegicus
taggaccacaaacagcttcagcttc

SEQ ID NO: 559999 - DNA, 25 bp, Rattus norvegicus
taggaccacaaagagcttcagcttc

SEQ ID NO: 560000 - DNA, 25 bp, Rattus norvegicus
taggaccacactctacaccaaatgc

SEQ ID NO: 560001 - DNA, 25 bp, Rattus norvegicus
taggaccacactgtacaccaaatgc

SEQ ID NO: 560002 - DNA, 25 bp, Rattus norvegicus
taggaccagattagattagcagcat

SEQ ID NO: 560003 - DNA, 25 bp, Rattus norvegicus
taggaccagatttgattagcagcat

SEQ ID NO: 560004 - DNA, 25 bp, Rattus norvegicus
taggaccagcggacagacaacattg

SEQ ID NO: 560005 - DNA, 25 bp, Rattus norvegicus
taggaccagcggtcagacaacattg

SEQ ID NO: 560006 - DNA, 25 bp, Rattus norvegicus
taggaccaggttaacagagctttat

SEQ ID NO: 560007 - DNA, 25 bp, Rattus norvegicus
taggaccaggtttacagagctttat

SEQ ID NO: 560008 - DNA, 25 bp, Rattus norvegicus
taggaccatggtacacgtgacaata

SEQ ID NO: 560009 - DNA, 25 bp, Rattus norvegicus
taggaccatggttcacgtgacaata

SEQ ID NO: 560010 - DNA, 25 bp, Rattus norvegicus
taggacccacaaatagttatcgatt

SEQ ID NO: 560011 - DNA, 25 bp, Rattus norvegicus
taggacccacaattagttatcgatt

SEQ ID NO: 560012 - DNA, 25 bp, Rattus norvegicus
taggacccagtgattactacagtgt

SEQ ID NO: 560013 - DNA, 25 bp, Rattus norvegicus
taggacccagtgtttactacagtgt

SEQ ID NO: 560014 - DNA, 25 bp, Rattus norvegicus
taggacccatttatgcttatcccca

SEQ ID NO: 560015 - DNA, 25 bp, Rattus norvegicus
taggacccatttttgcttatcccca

SEQ ID NO: 560016 - DNA, 25 bp, Rattus norvegicus
taggaccccaatcgttgcctccagg

SEQ ID NO: 560017 - DNA, 25 bp, Rattus norvegicus
taggaccccaatggttgcctccagg

SEQ ID NO: 560018 - DNA, 25 bp, Rattus norvegicus
taggacccctgtcttagaaggaaag

SEQ ID NO: 560019 - DNA, 25 bp, Rattus norvegicus
taggacccctgtgttagaaggaaag

SEQ ID NO: 560020 - DNA, 25 bp, Rattus norvegicus
taggacccgaagctcaagctgcttg

SEQ ID NO: 560021 - DNA, 25 bp, Rattus norvegicus
taggacccgaaggtcaagctgcttg

SEQ ID NO: 560022 - DNA, 25 bp, Rattus norvegicus
taggacccgtggcagttcctctagg

SEQ ID NO: 560023 - DNA, 25 bp, Rattus norvegicus
taggacccgtgggagttcctctagg

SEQ ID NO: 560024 - DNA, 25 bp, Rattus norvegicus
taggaccctaagaagccagccaatt

SEQ ID NO: 560025 - DNA, 25 bp, Rattus norvegicus
taggaccctaagtagccagccaatt

SEQ ID NO: 560026 - DNA, 25 bp, Rattus norvegicus
taggaccctctcaggatggactaag

SEQ ID NO: 560027 - DNA, 25 bp, Rattus norvegicus
taggaccctctctggatggactaag

SEQ ID NO: 560028 - DNA, 25 bp, Rattus norvegicus
taggaccctggtcttactaaaactg

SEQ ID NO: 560029 - DNA, 25 bp, Rattus norvegicus
taggaccctggtgttactaaaactg

SEQ ID NO: 560030 - DNA, 25 bp, Rattus norvegicus
taggaccctttcagtggacacatgc

SEQ ID NO: 560031 - DNA, 25 bp, Rattus norvegicus
taggaccctttctgtggacacatgc

SEQ ID NO: 560032 - DNA, 25 bp, Rattus norvegicus
taggaccgaagacctgaccaggccc

SEQ ID NO: 560033 - DNA, 25 bp, Rattus norvegicus
taggaccgaagagctgaccaggccc

SEQ ID NO: 560034 - DNA, 25 bp, Rattus norvegicus
taggaccgagtgatggactagctat

SEQ ID NO: 560035 - DNA, 25 bp, Rattus norvegicus
taggaccgagtgttggactagctat

SEQ ID NO: 560036 - DNA, 25 bp, Rattus norvegicus
taggaccgtgatcgcactaacttca

SEQ ID NO: 560037 - DNA, 25 bp, Rattus norvegicus
taggaccgtgatggcactaacttca

SEQ ID NO: 560038 - DNA, 25 bp, Rattus norvegicus
taggacctacccaatggtctggaaa

SEQ ID NO: 560039 - DNA, 25 bp, Rattus norvegicus
taggacctaccctatggtctggaaa

SEQ ID NO: 560040 - DNA, 25 bp, Rattus norvegicus
taggacctaggcagaccccactaga

SEQ ID NO: 560041 - DNA, 25 bp, Rattus norvegicus
taggacctaggctgaccccactaga

SEQ ID NO: 560042 - DNA, 25 bp, Rattus norvegicus
taggacctatcacggcctttaaata

SEQ ID NO: 560043 - DNA, 25 bp, Rattus norvegicus
taggacctatcagggcctttaaata

SEQ ID NO: 560044 - DNA, 25 bp, Rattus norvegicus
taggacctcagtcaggttcctgcca

SEQ ID NO: 560045 - DNA, 25 bp, Rattus norvegicus
taggacctcagtgaggttcctgcca

SEQ ID NO: 560046 - DNA, 25 bp, Rattus norvegicus
taggacctgacaatgctcaaccaca

SEQ ID NO: 560047 - DNA, 25 bp, Rattus norvegicus
taggacctgacattgctcaaccaca

SEQ ID NO: 560048 - DNA, 25 bp, Rattus norvegicus
taggacctgcccatctcttcaggat

SEQ ID NO: 560049 - DNA, 25 bp, Rattus norvegicus
taggacctgcccttctcttcaggat

SEQ ID NO: 560050 - DNA, 25 bp, Rattus norvegicus
taggacctgtccacaggaggccaga

SEQ ID NO: 560051 - DNA, 25 bp, Rattus norvegicus
taggacctgtcctcaggaggccaga

SEQ ID NO: 560052 - DNA, 25 bp, Rattus norvegicus
taggaccttttcaggagaatgccca

SEQ ID NO: 560053 - DNA, 25 bp, Rattus norvegicus
taggaccttttctggagaatgccca

SEQ ID NO: 560054 - DNA, 25 bp, Rattus norvegicus
taggacgacagaagcttcatcccgg

SEQ ID NO: 560055 - DNA, 25 bp, Rattus norvegicus
taggacgacagatgcttcatcccgg

SEQ ID NO: 560056 - DNA, 25 bp, Rattus norvegicus
taggacgattccagagagctgacgt

SEQ ID NO: 560057 - DNA, 25 bp, Rattus norvegicus
taggacgattcctgagagctgacgt

SEQ ID NO: 560058 - DNA, 25 bp, Rattus norvegicus
taggacgcaatgataaatttgttaa

SEQ ID NO: 560059 - DNA, 25 bp, Rattus norvegicus
taggacgcaatgttaaatttgttaa

SEQ ID NO: 560060 - DNA, 25 bp, Rattus norvegicus
taggacgcagttctatctctccatc

SEQ ID NO: 560061 - DNA, 25 bp, Rattus norvegicus
taggacgcagttgtatctctccatc

SEQ ID NO: 560062 - DNA, 25 bp, Rattus norvegicus
taggacgcctccacctaattttgaa

SEQ ID NO: 560063 - DNA, 25 bp, Rattus norvegicus
taggacgcctcctcctaattttgaa

SEQ ID NO: 560064 - DNA, 25 bp, Rattus norvegicus
taggacgctaccctcgtgctcaact

SEQ ID NO: 560065 - DNA, 25 bp, Rattus norvegicus
taggacgctaccgtcgtgctcaact

SEQ ID NO: 560066 - DNA, 25 bp, Rattus norvegicus
taggacgctactaccgcacaggagt

SEQ ID NO: 560067 - DNA, 25 bp, Rattus norvegicus
taggacgctacttccgcacaggagt

SEQ ID NO: 560068 - DNA, 25 bp, Rattus norvegicus
taggacggtgacactgactggaatt

SEQ ID NO: 560069 - DNA, 25 bp, Rattus norvegicus
taggacggtgactctgactggaatt

SEQ ID NO: 560070 - DNA, 25 bp, Rattus norvegicus
taggacgtctgaccatggtacctgc

SEQ ID NO: 560071 - DNA, 25 bp, Rattus norvegicus
taggacgtctgagcatggtacctgc

SEQ ID NO: 560072 - DNA, 25 bp, Rattus norvegicus
taggacgttgaacaccagcctgtgt

SEQ ID NO: 560073 - DNA, 25 bp, Rattus norvegicus
taggacgttgaagaccagcctgtgt

SEQ ID NO: 560074 - DNA, 25 bp, Rattus norvegicus
taggactaatgaccacagccctctc

SEQ ID NO: 560075 - DNA, 25 bp, Rattus norvegicus
taggactaatgagcacagccctctc

SEQ ID NO: 560076 - DNA, 25 bp, Rattus norvegicus
taggactacacgataaccctccaag

SEQ ID NO: 560077 - DNA, 25 bp, Rattus norvegicus
taggactacacgttaaccctccaag

SEQ ID NO: 560078 - DNA, 25 bp, Rattus norvegicus
taggactagagccatggtcccttgg

SEQ ID NO: 560079 - DNA, 25 bp, Rattus norvegicus
taggactagagcgatggtcccttgg

SEQ ID NO: 560080 - DNA, 25 bp, Rattus norvegicus
taggactatgtccaagcgtttcgac

SEQ ID NO: 560081 - DNA, 25 bp, Rattus norvegicus
taggactatgtcgaagcgtttcgac

SEQ ID NO: 560082 - DNA, 25 bp, Rattus norvegicus
taggactcacatccaactctttagt

SEQ ID NO: 560083 - DNA, 25 bp, Rattus norvegicus
taggactcacatgcaactctttagt

SEQ ID NO: 560084 - DNA, 25 bp, Rattus norvegicus
taggactcagctatgagctcatgtc

SEQ ID NO: 560085 - DNA, 25 bp, Rattus norvegicus
taggactcagctttgagctcatgtc

SEQ ID NO: 560086 - DNA, 25 bp, Rattus norvegicus
taggactcagggaagtttccactat

SEQ ID NO: 560087 - DNA, 25 bp, Rattus norvegicus
taggactcagggtagtttccactat

SEQ ID NO: 560088 - DNA, 25 bp, Rattus norvegicus
taggactcagtgcttcagaaggctc

SEQ ID NO: 560089 - DNA, 25 bp, Rattus norvegicus
taggactcagtggttcagaaggctc

SEQ ID NO: 560090 - DNA, 25 bp, Rattus norvegicus
taggactcatataggacagcagcgt

SEQ ID NO: 560091 - DNA, 25 bp, Rattus norvegicus
taggactcatattggacagcagcgt

SEQ ID NO: 560092 - DNA, 25 bp, Rattus norvegicus
taggactccagcctacagcctgtag

SEQ ID NO: 560093 - DNA, 25 bp, Rattus norvegicus
taggactccagcgtacagcctgtag

SEQ ID NO: 560094 - DNA, 25 bp, Rattus norvegicus
taggactccaggatgctaggcagat

SEQ ID NO: 560095 - DNA, 25 bp, Rattus norvegicus
taggactccaggttgctaggcagat

SEQ ID NO: 560096 - DNA, 25 bp, Rattus norvegicus
taggactcccacctgcactgagatg

SEQ ID NO: 560097 - DNA, 25 bp, Rattus norvegicus
taggactcccacgtgcactgagatg

SEQ ID NO: 560098 - DNA, 25 bp, Rattus norvegicus
taggactctcagcaagacatattct

SEQ ID NO: 560099 - DNA, 25 bp, Rattus norvegicus
taggactctcaggaagacatattct

SEQ ID NO: 560100 - DNA, 25 bp, Rattus norvegicus
taggactctgacctggagcagcaaa

SEQ ID NO: 560101 - DNA, 25 bp, Rattus norvegicus
taggactctgacgtggagcagcaaa

SEQ ID NO: 560102 - DNA, 25 bp, Rattus norvegicus
taggactggaacagccctgggaatt

SEQ ID NO: 560103 - DNA, 25 bp, Rattus norvegicus
taggactggaactgccctgggaatt

SEQ ID NO: 560104 - DNA, 25 bp, Rattus norvegicus
taggactggcgcatgtggctataaa

SEQ ID NO: 560105 - DNA, 25 bp, Rattus norvegicus
taggactggcgcttgtggctataaa

SEQ ID NO: 560106 - DNA, 25 bp, Rattus norvegicus
taggactggtaacccaacagggact

SEQ ID NO: 560107 - DNA, 25 bp, Rattus norvegicus
taggactggtaagccaacagggact

SEQ ID NO: 560108 - DNA, 25 bp, Rattus norvegicus
taggactgtctgcagctgaacgcac

SEQ ID NO: 560109 - DNA, 25 bp, Rattus norvegicus
taggactgtctggagctgaacgcac

SEQ ID NO: 560110 - DNA, 25 bp, Rattus norvegicus
taggactgtgtgagtgacttctgca

SEQ ID NO: 560111 - DNA, 25 bp, Rattus norvegicus
taggactgtgtgtgtgacttctgca

SEQ ID NO: 560112 - DNA, 25 bp, Rattus norvegicus
taggacttccttaccacaagtgggt

SEQ ID NO: 560113 - DNA, 25 bp, Rattus norvegicus
taggacttcctttccacaagtgggt

SEQ ID NO: 560114 - DNA, 25 bp, Rattus norvegicus
taggacttctacatcctttgctttt

SEQ ID NO: 560115 - DNA, 25 bp, Rattus norvegicus
taggacttctacttcctttgctttt

SEQ ID NO: 560116 - DNA, 25 bp, Rattus norvegicus
taggacttgccaaaccagctatcag

SEQ ID NO: 560117 - DNA, 25 bp, Rattus norvegicus
taggacttgccataccagctatcag

SEQ ID NO: 560118 - DNA, 25 bp, Rattus norvegicus
taggacttggccacagcttgttggt

SEQ ID NO: 560119 - DNA, 25 bp, Rattus norvegicus
taggacttggcctcagcttgttggt

SEQ ID NO: 560120 - DNA, 25 bp, Rattus norvegicus
taggacttgtttcactgtgctctgt

SEQ ID NO: 560121 - DNA, 25 bp, Rattus norvegicus
taggacttgtttgactgtgctctgt

SEQ ID NO: 560122 - DNA, 25 bp, Rattus norvegicus
taggactttgtcagtgccacaggca

SEQ ID NO: 560123 - DNA, 25 bp, Rattus norvegicus
taggactttgtctgtgccacaggca

SEQ ID NO: 560124 - DNA, 25 bp, Rattus norvegicus
taggagaacctcctctactgggcaa

SEQ ID NO: 560125 - DNA, 25 bp, Rattus norvegicus
taggagaacctcgtctactgggcaa

SEQ ID NO: 560126 - DNA, 25 bp, Rattus norvegicus
taggagaagcacatctccctgcagg

SEQ ID NO: 560127 - DNA, 25 bp, Rattus norvegicus
taggagaagcacttctccctgcagg

SEQ ID NO: 560128 - DNA, 25 bp, Rattus norvegicus
taggagaaggccacccacatggtga

SEQ ID NO: 560129 - DNA, 25 bp, Rattus norvegicus
taggagaaggcctcccacatggtga

SEQ ID NO: 560130 - DNA, 25 bp, Rattus norvegicus
taggagaatatgagggcaccagcaa

SEQ ID NO: 560131 - DNA, 25 bp, Rattus norvegicus
taggagaatatgtgggcaccagcaa

SEQ ID NO: 560132 - DNA, 25 bp, Rattus norvegicus
taggagacacctacgcctttatcgc

SEQ ID NO: 560133 - DNA, 25 bp, Rattus norvegicus
taggagacaccttcgcctttatcgc

SEQ ID NO: 560134 - DNA, 25 bp, Rattus norvegicus
taggagaccccaaaggcacagctct

SEQ ID NO: 560135 - DNA, 25 bp, Rattus norvegicus
taggagaccccataggcacagctct

SEQ ID NO: 560136 - DNA, 25 bp, Rattus norvegicus
taggagacgccacagggacagccca

SEQ ID NO: 560137 - DNA, 25 bp, Rattus norvegicus
taggagacgccagagggacagccca

SEQ ID NO: 560138 - DNA, 25 bp, Rattus norvegicus
taggagactcgccttaaatgccctc

SEQ ID NO: 560139 - DNA, 25 bp, Rattus norvegicus
taggagactcgcgttaaatgccctc

SEQ ID NO: 560140 - DNA, 25 bp, Rattus norvegicus
taggagagactaaccctctgtttcc

SEQ ID NO: 560141 - DNA, 25 bp, Rattus norvegicus
taggagagactatccctctgtttcc

SEQ ID NO: 560142 - DNA, 25 bp, Rattus norvegicus
taggagagcactatacccagctggt

SEQ ID NO: 560143 - DNA, 25 bp, Rattus norvegicus
taggagagcactttacccagctggt

SEQ ID NO: 560144 - DNA, 25 bp, Rattus norvegicus
taggagaggtctatgtcattcacac

SEQ ID NO: 560145 - DNA, 25 bp, Rattus norvegicus
taggagaggtctttgtcattcacac

SEQ ID NO: 560146 - DNA, 25 bp, Rattus norvegicus
taggagagtgttattactgtcatat

SEQ ID NO: 560147 - DNA, 25 bp, Rattus norvegicus
taggagagtgtttttactgtcatat

SEQ ID NO: 560148 - DNA, 25 bp, Rattus norvegicus
taggagatccagcaccctcacatag

SEQ ID NO: 560149 - DNA, 25 bp, Rattus norvegicus
taggagatccaggaccctcacatag

SEQ ID NO: 560150 - DNA, 25 bp, Rattus norvegicus
taggagatccgcactggccaaggaa

SEQ ID NO: 560151 - DNA, 25 bp, Rattus norvegicus
taggagatccgctctggccaaggaa

SEQ ID NO: 560152 - DNA, 25 bp, Rattus norvegicus
taggagatgcccagtcccgggtaga

SEQ ID NO: 560153 - DNA, 25 bp, Rattus norvegicus
taggagatgccctgtcccgggtaga

SEQ ID NO: 560154 - DNA, 25 bp, Rattus norvegicus
taggagatggctccacacccatgag

SEQ ID NO: 560155 - DNA, 25 bp, Rattus norvegicus
taggagatggctgcacacccatgag

SEQ ID NO: 560156 - DNA, 25 bp, Rattus norvegicus
taggagatgggaatattgtgctttc

SEQ ID NO: 560157 - DNA, 25 bp, Rattus norvegicus
taggagatgggattattgtgctttc

SEQ ID NO: 560158 - DNA, 25 bp, Rattus norvegicus
taggagatgtagagccagcatcccc

SEQ ID NO: 560159 - DNA, 25 bp, Rattus norvegicus
taggagatgtagtgccagcatcccc

SEQ ID NO: 560160 - DNA, 25 bp, Rattus norvegicus
taggagcacacactagcccactggt

SEQ ID NO: 560161 - DNA, 25 bp, Rattus norvegicus
taggagcacacagtagcccactggt

SEQ ID NO: 560162 - DNA, 25 bp, Rattus norvegicus
taggagcacgccaggcttgattcca

SEQ ID NO: 560163 - DNA, 25 bp, Rattus norvegicus
taggagcacgcctggcttgattcca

SEQ ID NO: 560164 - DNA, 25 bp, Rattus norvegicus
taggagcactggctacccttcttga

SEQ ID NO: 560165 - DNA, 25 bp, Rattus norvegicus
taggagcactgggtacccttcttga

SEQ ID NO: 560166 - DNA, 25 bp, Rattus norvegicus
taggagcagagtagcaaaagaggct

SEQ ID NO: 560167 - DNA, 25 bp, Rattus norvegicus
taggagcagagttgcaaaagaggct

SEQ ID NO: 560168 - DNA, 25 bp, Rattus norvegicus
taggagcagattatggcactcaaat

SEQ ID NO: 560169 - DNA, 25 bp, Rattus norvegicus
taggagcagattttggcactcaaat

SEQ ID NO: 560170 - DNA, 25 bp, Rattus norvegicus
taggagccatacatgcttcaaccgc

SEQ ID NO: 560171 - DNA, 25 bp, Rattus norvegicus
taggagccatacttgcttcaaccgc

SEQ ID NO: 560172 - DNA, 25 bp, Rattus norvegicus
taggagccccttctctctggagaca

SEQ ID NO: 560173 - DNA, 25 bp, Rattus norvegicus
taggagccccttgtctctggagaca

SEQ ID NO: 560174 - DNA, 25 bp, Rattus norvegicus
taggagcccggtaaccactgtgcca

SEQ ID NO: 560175 - DNA, 25 bp, Rattus norvegicus
taggagcccggttaccactgtgcca

SEQ ID NO: 560176 - DNA, 25 bp, Rattus norvegicus
taggagccctgaatcaggcctttct

SEQ ID NO: 560177 - DNA, 25 bp, Rattus norvegicus
taggagccctgattcaggcctttct

SEQ ID NO: 560178 - DNA, 25 bp, Rattus norvegicus
taggagccgagcaggcaagctgcat

SEQ ID NO: 560179 - DNA, 25 bp, Rattus norvegicus
taggagccgagctggcaagctgcat

SEQ ID NO: 560180 - DNA, 25 bp, Rattus norvegicus
taggagccgcccaggacagataagc

SEQ ID NO: 560181 - DNA, 25 bp, Rattus norvegicus
taggagccgccctggacagataagc

SEQ ID NO: 560182 - DNA, 25 bp, Rattus norvegicus
taggagcctaggactgtccactggg

SEQ ID NO: 560183 - DNA, 25 bp, Rattus norvegicus
taggagcctaggtctgtccactggg

SEQ ID NO: 560184 - DNA, 25 bp, Rattus norvegicus
taggagcctctaccagactcctgag

SEQ ID NO: 560185 - DNA, 25 bp, Rattus norvegicus
taggagcctctagcagactcctgag

SEQ ID NO: 560186 - DNA, 25 bp, Rattus norvegicus
taggagcctgagagaaacccttgct

SEQ ID NO: 560187 - DNA, 25 bp, Rattus norvegicus
taggagcctgagtgaaacccttgct

SEQ ID NO: 560188 - DNA, 25 bp, Rattus norvegicus
taggagccttccatctcttggtgtc

SEQ ID NO: 560189 - DNA, 25 bp, Rattus norvegicus
taggagccttccttctcttggtgtc

SEQ ID NO: 560190 - DNA, 25 bp, Rattus norvegicus
taggagcgaactacaactcccgacg

SEQ ID NO: 560191 - DNA, 25 bp, Rattus norvegicus
taggagcgaacttcaactcccgacg

SEQ ID NO: 560192 - DNA, 25 bp, Rattus norvegicus
taggagcgctgcaacctgggtataa

SEQ ID NO: 560193 - DNA, 25 bp, Rattus norvegicus
taggagcgctgctacctgggtataa

SEQ ID NO: 560194 - DNA, 25 bp, Rattus norvegicus
taggagcgtccacccaagcaggaaa

SEQ ID NO: 560195 - DNA, 25 bp, Rattus norvegicus
taggagcgtccagccaagcaggaaa

SEQ ID NO: 560196 - DNA, 25 bp, Rattus norvegicus
taggagcgtggactactcatgcaga

SEQ ID NO: 560197 - DNA, 25 bp, Rattus norvegicus
taggagcgtggagtactcatgcaga

SEQ ID NO: 560198 - DNA, 25 bp, Rattus norvegicus
taggagctagttacttctcgtcgcg

SEQ ID NO: 560199 - DNA, 25 bp, Rattus norvegicus
taggagctagtttcttctcgtcgcg

SEQ ID NO: 560200 - DNA, 25 bp, Rattus norvegicus
taggagctccatattgcaactgact

SEQ ID NO: 560201 - DNA, 25 bp, Rattus norvegicus
taggagctccattttgcaactgact

SEQ ID NO: 560202 - DNA, 25 bp, Rattus norvegicus
taggagctcccgacaccaggttcac

SEQ ID NO: 560203 - DNA, 25 bp, Rattus norvegicus
taggagctcccgtcaccaggttcac

SEQ ID NO: 560204 - DNA, 25 bp, Rattus norvegicus
taggagctgacacgcctttcatcag

SEQ ID NO: 560205 - DNA, 25 bp, Rattus norvegicus
taggagctgacaggcctttcatcag

SEQ ID NO: 560206 - DNA, 25 bp, Rattus norvegicus
taggagctgagcagagccacccctg

SEQ ID NO: 560207 - DNA, 25 bp, Rattus norvegicus
taggagctgagctgagccacccctg

SEQ ID NO: 560208 - DNA, 25 bp, Rattus norvegicus
taggagctgccgcagcctcagaagt

SEQ ID NO: 560209 - DNA, 25 bp, Rattus norvegicus
taggagctgccggagcctcagaagt

SEQ ID NO: 560210 - DNA, 25 bp, Rattus norvegicus
taggagctgtgacctgtcccggcca

SEQ ID NO: 560211 - DNA, 25 bp, Rattus norvegicus
taggagctgtgagctgtcccggcca

SEQ ID NO: 560212 - DNA, 25 bp, Rattus norvegicus
taggagcttccacagtgcacctagc

SEQ ID NO: 560213 - DNA, 25 bp, Rattus norvegicus
taggagcttccactgactgcttgac

SEQ ID NO: 560214 - DNA, 25 bp, Rattus norvegicus
taggagcttccagagtgcacctagc

SEQ ID NO: 560215 - DNA, 25 bp, Rattus norvegicus
taggagcttccagtgactgcttgac

SEQ ID NO: 560216 - DNA, 25 bp, Rattus norvegicus
taggagcttcttaacttagagggat

SEQ ID NO: 560217 - DNA, 25 bp, Rattus norvegicus
taggagcttctttacttagagggat

SEQ ID NO: 560218 - DNA, 25 bp, Rattus norvegicus
taggaggacctgagccttcacggtt

SEQ ID NO: 560219 - DNA, 25 bp, Rattus norvegicus
taggaggacctgtgccttcacggtt

SEQ ID NO: 560220 - DNA, 25 bp, Rattus norvegicus
taggaggactgccatcctggaaaaa

SEQ ID NO: 560221 - DNA, 25 bp, Rattus norvegicus
taggaggactgcgatcctggaaaaa

SEQ ID NO: 560222 - DNA, 25 bp, Rattus norvegicus
taggaggagcgtcgcccatgacaca

SEQ ID NO: 560223 - DNA, 25 bp, Rattus norvegicus
taggaggagcgtggcccatgacaca

SEQ ID NO: 560224 - DNA, 25 bp, Rattus norvegicus
taggaggaggagacagcattttttc

SEQ ID NO: 560225 - DNA, 25 bp, Rattus norvegicus
taggaggaggagtcagcattttttc

SEQ ID NO: 560226 - DNA, 25 bp, Rattus norvegicus
taggaggagtcccaggaaacacagt

SEQ ID NO: 560227 - DNA, 25 bp, Rattus norvegicus
taggaggagtccgaggaaacacagt

SEQ ID NO: 560228 - DNA, 25 bp, Rattus norvegicus
taggaggattttacttctccccatg

SEQ ID NO: 560229 - DNA, 25 bp, Rattus norvegicus
taggaggatttttcttctccccatg

SEQ ID NO: 560230 - DNA, 25 bp, Rattus norvegicus
taggaggcctagaccctggacagat

SEQ ID NO: 560231 - DNA, 25 bp, Rattus norvegicus
taggaggcctagtccctggacagat

SEQ ID NO: 560232 - DNA, 25 bp, Rattus norvegicus
taggaggcctcacaccttttatttt

SEQ ID NO: 560233 - DNA, 25 bp, Rattus norvegicus
taggaggcctcagaccttttatttt

SEQ ID NO: 560234 - DNA, 25 bp, Rattus norvegicus
taggaggctgatatagggacgcaca

SEQ ID NO: 560235 - DNA, 25 bp, Rattus norvegicus
taggaggctgatttagggacgcaca

SEQ ID NO: 560236 - DNA, 25 bp, Rattus norvegicus
taggagggatcaaaagaccccgtat

SEQ ID NO: 560237 - DNA, 25 bp, Rattus norvegicus
taggagggatcataagaccccgtat

SEQ ID NO: 560238 - DNA, 25 bp, Rattus norvegicus
taggagggccaacctcagcagtgca

SEQ ID NO: 560239 - DNA, 25 bp, Rattus norvegicus
taggagggccaagctcagcagtgca

SEQ ID NO: 560240 - DNA, 25 bp, Rattus norvegicus
taggagggctgcacctgaccttgga

SEQ ID NO: 560241 - DNA, 25 bp, Rattus norvegicus
taggagggctgctcctgaccttgga

SEQ ID NO: 560242 - DNA, 25 bp, Rattus norvegicus
taggagggtccaacccattgtgggt

SEQ ID NO: 560243 - DNA, 25 bp, Rattus norvegicus
taggagggtccatcccattgtgggt

SEQ ID NO: 560244 - DNA, 25 bp, Rattus norvegicus
taggaggtatgtcctgggcacccct

SEQ ID NO: 560245 - DNA, 25 bp, Rattus norvegicus
taggaggtatgtgctgggcacccct

SEQ ID NO: 560246 - DNA, 25 bp, Rattus norvegicus
taggaggtcaaaacggagcagacaa

SEQ ID NO: 560247 - DNA, 25 bp, Rattus norvegicus
taggaggtcaaatcggagcagacaa

SEQ ID NO: 560248 - DNA, 25 bp, Rattus norvegicus
taggaggtcaccagttttcagtcct

SEQ ID NO: 560249 - DNA, 25 bp, Rattus norvegicus
taggaggtcacctgttttcagtcct

SEQ ID NO: 560250 - DNA, 25 bp, Rattus norvegicus
taggaggttcctaggccctgggcat

SEQ ID NO: 560251 - DNA, 25 bp, Rattus norvegicus
taggaggttccttggccctgggcat

SEQ ID NO: 560252 - DNA, 25 bp, Rattus norvegicus
taggagtaagcccatctgctggcaa

SEQ ID NO: 560253 - DNA, 25 bp, Rattus norvegicus
taggagtaagccgatctgctggcaa

SEQ ID NO: 560254 - DNA, 25 bp, Rattus norvegicus
taggagtaagttagccgacgtcgtt

SEQ ID NO: 560255 - DNA, 25 bp, Rattus norvegicus
taggagtaagtttgccgacgtcgtt

SEQ ID NO: 560256 - DNA, 25 bp, Rattus norvegicus
taggagtaatggagtgcaccaccac

SEQ ID NO: 560257 - DNA, 25 bp, Rattus norvegicus
taggagtaatggtgtgcaccaccac

SEQ ID NO: 560258 - DNA, 25 bp, Rattus norvegicus
taggagtagactagctagccacaga

SEQ ID NO: 560259 - DNA, 25 bp, Rattus norvegicus
taggagtagacttgctagccacaga

SEQ ID NO: 560260 - DNA, 25 bp, Rattus norvegicus
taggagtcaagcacgaattctctgt

SEQ ID NO: 560261 - DNA, 25 bp, Rattus norvegicus
taggagtcaagctcgaattctctgt

SEQ ID NO: 560262 - DNA, 25 bp, Rattus norvegicus
taggagtcagagatcctgccctgtg

SEQ ID NO: 560263 - DNA, 25 bp, Rattus norvegicus
taggagtcagagttcctgccctgtg

SEQ ID NO: 560264 - DNA, 25 bp, Rattus norvegicus
taggagtctgggatcctccacattc

SEQ ID NO: 560265 - DNA, 25 bp, Rattus norvegicus
taggagtctgggttcctccacattc

SEQ ID NO: 560266 - DNA, 25 bp, Rattus norvegicus
taggagtcttgcctagctagctggc

SEQ ID NO: 560267 - DNA, 25 bp, Rattus norvegicus
taggagtcttgcgtagctagctggc

SEQ ID NO: 560268 - DNA, 25 bp, Rattus norvegicus
taggagtgagccacagtgtcctctt

SEQ ID NO: 560269 - DNA, 25 bp, Rattus norvegicus
taggagtgagcctcagtgtcctctt

SEQ ID NO: 560270 - DNA, 25 bp, Rattus norvegicus
taggagtggaaaaccctgccttctg

SEQ ID NO: 560271 - DNA, 25 bp, Rattus norvegicus
taggagtggaaatccctgccttctg

SEQ ID NO: 560272 - DNA, 25 bp, Rattus norvegicus
taggagtggagacctgagtaccctc

SEQ ID NO: 560273 - DNA, 25 bp, Rattus norvegicus
taggagtggagagctgagtaccctc

SEQ ID NO: 560274 - DNA, 25 bp, Rattus norvegicus
taggagtgggtcacgtggtcaccac

SEQ ID NO: 560275 - DNA, 25 bp, Rattus norvegicus
taggagtgggtctcgtggtcaccac

SEQ ID NO: 560276 - DNA, 25 bp, Rattus norvegicus
taggagttcatcaaaaccataggaa

SEQ ID NO: 560277 - DNA, 25 bp, Rattus norvegicus
taggagttcatctaaaccataggaa

SEQ ID NO: 560278 - DNA, 25 bp, Rattus norvegicus
taggagttccttctaatttctttat

SEQ ID NO: 560279 - DNA, 25 bp, Rattus norvegicus
taggagttccttgtaatttctttat

SEQ ID NO: 560280 - DNA, 25 bp, Rattus norvegicus
taggagttcgttcgcatacctcact

SEQ ID NO: 560281 - DNA, 25 bp, Rattus norvegicus
taggagttcgttggcatacctcact

SEQ ID NO: 560282 - DNA, 25 bp, Rattus norvegicus
taggatacacagctgaccaccaaat

SEQ ID NO: 560283 - DNA, 25 bp, Rattus norvegicus
taggatacacaggtgaccaccaaat

SEQ ID NO: 560284 - DNA, 25 bp, Rattus norvegicus
taggatacatctagacctgtccatc

SEQ ID NO: 560285 - DNA, 25 bp, Rattus norvegicus
taggatacatctatctgcttcaaat

SEQ ID NO: 560286 - DNA, 25 bp, Rattus norvegicus
taggatacatcttgacctgtccatc

SEQ ID NO: 560287 - DNA, 25 bp, Rattus norvegicus
taggatacatctttctgcttcaaat

SEQ ID NO: 560288 - DNA, 25 bp, Rattus norvegicus
taggataccgaaaccatggcaacga

SEQ ID NO: 560289 - DNA, 25 bp, Rattus norvegicus
taggataccgaatccatggcaacga

SEQ ID NO: 560290 - DNA, 25 bp, Rattus norvegicus
taggatagccagattctcacccagg

SEQ ID NO: 560291 - DNA, 25 bp, Rattus norvegicus
taggatagccagtttctcacccagg

SEQ ID NO: 560292 - DNA, 25 bp, Rattus norvegicus
taggatagcctcagtaccgtaaacc

SEQ ID NO: 560293 - DNA, 25 bp, Rattus norvegicus
taggatagcctctgtaccgtaaacc

SEQ ID NO: 560294 - DNA, 25 bp, Rattus norvegicus
taggatagcgctcatggtccctcat

SEQ ID NO: 560295 - DNA, 25 bp, Rattus norvegicus
taggatagcgctgatggtccctcat

SEQ ID NO: 560296 - DNA, 25 bp, Rattus norvegicus
taggatatgcttaactctcaggaga

SEQ ID NO: 560297 - DNA, 25 bp, Rattus norvegicus
taggatatgctttactctcaggaga

SEQ ID NO: 560298 - DNA, 25 bp, Rattus norvegicus
taggatattttcctgtctcctcatc

SEQ ID NO: 560299 - DNA, 25 bp, Rattus norvegicus
taggatattttcgtgtctcctcatc

SEQ ID NO: 560300 - DNA, 25 bp, Rattus norvegicus
taggatcacaccagaaagctctaga

SEQ ID NO: 560301 - DNA, 25 bp, Rattus norvegicus
taggatcacacctgaaagctctaga

SEQ ID NO: 560302 - DNA, 25 bp, Rattus norvegicus
taggatcacatcacatattcccaca

SEQ ID NO: 560303 - DNA, 25 bp, Rattus norvegicus
taggatcacatctcatattcccaca

SEQ ID NO: 560304 - DNA, 25 bp, Rattus norvegicus
taggatcacctgagctatctagcct

SEQ ID NO: 560305 - DNA, 25 bp, Rattus norvegicus
taggatcacctgtgctatctagcct

SEQ ID NO: 560306 - DNA, 25 bp, Rattus norvegicus
taggatccatgccagacagtttgtc

SEQ ID NO: 560307 - DNA, 25 bp, Rattus norvegicus
taggatccatgcgagacagtttgtc

SEQ ID NO: 560308 - DNA, 25 bp, Rattus norvegicus
taggatcccagactgctaactgtga

SEQ ID NO: 560309 - DNA, 25 bp, Rattus norvegicus
taggatcccagagtgctaactgtga

SEQ ID NO: 560310 - DNA, 25 bp, Rattus norvegicus
taggatccccttctgtttacagcgt

SEQ ID NO: 560311 - DNA, 25 bp, Rattus norvegicus
taggatccccttgtgtttacagcgt

SEQ ID NO: 560312 - DNA, 25 bp, Rattus norvegicus
taggatccctcacacaagtgctgga

SEQ ID NO: 560313 - DNA, 25 bp, Rattus norvegicus
taggatccctcagacaagtgctgga

SEQ ID NO: 560314 - DNA, 25 bp, Rattus norvegicus
taggatcctacacctcggagcagtg

SEQ ID NO: 560315 - DNA, 25 bp, Rattus norvegicus
taggatcctacagctcggagcagtg

SEQ ID NO: 560316 - DNA, 25 bp, Rattus norvegicus
taggatcctccaacttcacaagcag

SEQ ID NO: 560317 - DNA, 25 bp, Rattus norvegicus
taggatcctccatcttcacaagcag

SEQ ID NO: 560318 - DNA, 25 bp, Rattus norvegicus
taggatctaaacacacagctccctc

SEQ ID NO: 560319 - DNA, 25 bp, Rattus norvegicus
taggatctaaactcacagctccctc

SEQ ID NO: 560320 - DNA, 25 bp, Rattus norvegicus
taggatctatccagccaattggagg

SEQ ID NO: 560321 - DNA, 25 bp, Rattus norvegicus
taggatctatcctgccaattggagg

SEQ ID NO: 560322 - DNA, 25 bp, Rattus norvegicus
taggatctcttgctgtcttctggtc

SEQ ID NO: 560323 - DNA, 25 bp, Rattus norvegicus
taggatctcttggtgtcttctggtc

SEQ ID NO: 560324 - DNA, 25 bp, Rattus norvegicus
taggatctggcacatggagccctgc

SEQ ID NO: 560325 - DNA, 25 bp, Rattus norvegicus
taggatctggcagatggagccctgc

SEQ ID NO: 560326 - DNA, 25 bp, Rattus norvegicus
taggatctgtcacgcttactgtcac

SEQ ID NO: 560327 - DNA, 25 bp, Rattus norvegicus
taggatctgtcaggcttactgtcac

SEQ ID NO: 560328 - DNA, 25 bp, Rattus norvegicus
taggatctgtctctcgccagggttt

SEQ ID NO: 560329 - DNA, 25 bp, Rattus norvegicus
taggatctgtctgtcgccagggttt

SEQ ID NO: 560330 - DNA, 25 bp, Rattus norvegicus
taggatcttctaattcatactcaga

SEQ ID NO: 560331 - DNA, 25 bp, Rattus norvegicus
taggatcttctatttcatactcaga

SEQ ID NO: 560332 - DNA, 25 bp, Rattus norvegicus
taggatgaaactaagcttggccaaa

SEQ ID NO: 560333 - DNA, 25 bp, Rattus norvegicus
taggatgaaacttagcttggccaaa

SEQ ID NO: 560334 - DNA, 25 bp, Rattus norvegicus
taggatgaacctaagcagccctggt

SEQ ID NO: 560335 - DNA, 25 bp, Rattus norvegicus
taggatgaaccttagcagccctggt

SEQ ID NO: 560336 - DNA, 25 bp, Rattus norvegicus
taggatgaacttccttggtagcccc

SEQ ID NO: 560337 - DNA, 25 bp, Rattus norvegicus
taggatgaacttgcttggtagcccc

SEQ ID NO: 560338 - DNA, 25 bp, Rattus norvegicus
taggatgaagctagccactcggcca

SEQ ID NO: 560339 - DNA, 25 bp, Rattus norvegicus
taggatgaagcttgccactcggcca

SEQ ID NO: 560340 - DNA, 25 bp, Rattus norvegicus
taggatgacagactccttctgtggt

SEQ ID NO: 560341 - DNA, 25 bp, Rattus norvegicus
taggatgacagagtccttctgtggt

SEQ ID NO: 560342 - DNA, 25 bp, Rattus norvegicus
taggatgactccattcagcgctatt

SEQ ID NO: 560343 - DNA, 25 bp, Rattus norvegicus
taggatgactcctttcagcgctatt

SEQ ID NO: 560344 - DNA, 25 bp, Rattus norvegicus
taggatgatgctctaccaccgtgta

SEQ ID NO: 560345 - DNA, 25 bp, Rattus norvegicus
taggatgatgctctcatgtcccagg

SEQ ID NO: 560346 - DNA, 25 bp, Rattus norvegicus
taggatgatgctgtaccaccgtgta

SEQ ID NO: 560347 - DNA, 25 bp, Rattus norvegicus
taggatgatgctgtcatgtcccagg

SEQ ID NO: 560348 - DNA, 25 bp, Rattus norvegicus
taggatgcctaacgtcctgggttca

SEQ ID NO: 560349 - DNA, 25 bp, Rattus norvegicus
taggatgcctaaggtcctgggttca

SEQ ID NO: 560350 - DNA, 25 bp, Rattus norvegicus
taggatgctcaaatgtcggtcgtgt

SEQ ID NO: 560351 - DNA, 25 bp, Rattus norvegicus
taggatgctcaattgtcggtcgtgt

SEQ ID NO: 560352 - DNA, 25 bp, Rattus norvegicus
taggatgctcttaggatctgctgat

SEQ ID NO: 560353 - DNA, 25 bp, Rattus norvegicus
taggatgctctttggatctgctgat

SEQ ID NO: 560354 - DNA, 25 bp, Rattus norvegicus
taggatgcttacctctgaatgccca

SEQ ID NO: 560355 - DNA, 25 bp, Rattus norvegicus
taggatgcttacgtctgaatgccca

SEQ ID NO: 560356 - DNA, 25 bp, Rattus norvegicus
taggatggccaaatctgctctgtga

SEQ ID NO: 560357 - DNA, 25 bp, Rattus norvegicus
taggatggccaaccctttcattgtc

SEQ ID NO: 560358 - DNA, 25 bp, Rattus norvegicus
taggatggccaagcctttcattgtc

SEQ ID NO: 560359 - DNA, 25 bp, Rattus norvegicus
taggatggccaattctgctctgtga

SEQ ID NO: 560360 - DNA, 25 bp, Rattus norvegicus
taggatgggagtacagttaccccgt

SEQ ID NO: 560361 - DNA, 25 bp, Rattus norvegicus
taggatgggagttcagttaccccgt

SEQ ID NO: 560362 - DNA, 25 bp, Rattus norvegicus
taggatgggctgaccttcaactact

SEQ ID NO: 560363 - DNA, 25 bp, Rattus norvegicus
taggatgggctgtccttcaactact

SEQ ID NO: 560364 - DNA, 25 bp, Rattus norvegicus
taggatgggcttactttcctcctct

SEQ ID NO: 560365 - DNA, 25 bp, Rattus norvegicus
taggatgggctttctttcctcctct

SEQ ID NO: 560366 - DNA, 25 bp, Rattus norvegicus
taggatggggccagtcattgaacga

SEQ ID NO: 560367 - DNA, 25 bp, Rattus norvegicus
taggatggggcctgtcattgaacga

SEQ ID NO: 560368 - DNA, 25 bp, Rattus norvegicus
taggatggtccgacgccctctacag

SEQ ID NO: 560369 - DNA, 25 bp, Rattus norvegicus
taggatggtccgtcgccctctacag

SEQ ID NO: 560370 - DNA, 25 bp, Rattus norvegicus
taggatggtcttcgctcagcctaca

SEQ ID NO: 560371 - DNA, 25 bp, Rattus norvegicus
taggatggtcttggctcagcctaca

SEQ ID NO: 560372 - DNA, 25 bp, Rattus norvegicus
taggatgtaaagatcacccctcctc

SEQ ID NO: 560373 - DNA, 25 bp, Rattus norvegicus
taggatgtaaagttcacccctcctc

SEQ ID NO: 560374 - DNA, 25 bp, Rattus norvegicus
taggatgtccccactctgagagcag

SEQ ID NO: 560375 - DNA, 25 bp, Rattus norvegicus
taggatgtcccctctctgagagcag

SEQ ID NO: 560376 - DNA, 25 bp, Rattus norvegicus
taggatgtccttaatggagctaatt

SEQ ID NO: 560377 - DNA, 25 bp, Rattus norvegicus
taggatgtcctttatggagctaatt

SEQ ID NO: 560378 - DNA, 25 bp, Rattus norvegicus
taggatgtgatgcttctgcccggaa

SEQ ID NO: 560379 - DNA, 25 bp, Rattus norvegicus
taggatgtgatggttctgcccggaa

SEQ ID NO: 560380 - DNA, 25 bp, Rattus norvegicus
taggatgttacaccaggctctgcac

SEQ ID NO: 560381 - DNA, 25 bp, Rattus norvegicus
taggatgttacagcaggctctgcac

SEQ ID NO: 560382 - DNA, 25 bp, Rattus norvegicus
taggattacaggcttcctcgaggca

SEQ ID NO: 560383 - DNA, 25 bp, Rattus norvegicus
taggattacagggttcctcgaggca

SEQ ID NO: 560384 - DNA, 25 bp, Rattus norvegicus
taggattacttcattcttccaaagt

SEQ ID NO: 560385 - DNA, 25 bp, Rattus norvegicus
taggattacttctttcttccaaagt

SEQ ID NO: 560386 - DNA, 25 bp, Rattus norvegicus
taggattcagcacgttggaccaact

SEQ ID NO: 560387 - DNA, 25 bp, Rattus norvegicus
taggattcagcaggttggaccaact

SEQ ID NO: 560388 - DNA, 25 bp, Rattus norvegicus
taggattccgtcattcctcggtggt

SEQ ID NO: 560389 - DNA, 25 bp, Rattus norvegicus
taggattccgtctttcctcggtggt

SEQ ID NO: 560390 - DNA, 25 bp, Rattus norvegicus
taggattccttgctactcgctggtc

SEQ ID NO: 560391 - DNA, 25 bp, Rattus norvegicus
taggattccttggtactcgctggtc

SEQ ID NO: 560392 - DNA, 25 bp, Rattus norvegicus
taggattcggttaccatccttttgt

SEQ ID NO: 560393 - DNA, 25 bp, Rattus norvegicus
taggattcggtttccatccttttgt

SEQ ID NO: 560394 - DNA, 25 bp, Rattus norvegicus
taggattcttgaccctcagctgaaa

SEQ ID NO: 560395 - DNA, 25 bp, Rattus norvegicus
taggattcttgagcctcagctgaaa

SEQ ID NO: 560396 - DNA, 25 bp, Rattus norvegicus
taggattcttggaccccgcggttca

SEQ ID NO: 560397 - DNA, 25 bp, Rattus norvegicus
taggattcttggtccccgcggttca

SEQ ID NO: 560398 - DNA, 25 bp, Rattus norvegicus
taggattgagttatcagcctccggt

SEQ ID NO: 560399 - DNA, 25 bp, Rattus norvegicus
taggattgagttttcagcctccggt

SEQ ID NO: 560400 - DNA, 25 bp, Rattus norvegicus
taggattgcttcaatggcctgttcc

SEQ ID NO: 560401 - DNA, 25 bp, Rattus norvegicus
taggattgcttctatggcctgttcc

SEQ ID NO: 560402 - DNA, 25 bp, Rattus norvegicus
taggattggctgacctggtgcctgc

SEQ ID NO: 560403 - DNA, 25 bp, Rattus norvegicus
taggattggctgagagttcttggta

SEQ ID NO: 560404 - DNA, 25 bp, Rattus norvegicus
taggattggctgtcctggtgcctgc

SEQ ID NO: 560405 - DNA, 25 bp, Rattus norvegicus
taggattggctgtgagttcttggta

SEQ ID NO: 560406 - DNA, 25 bp, Rattus norvegicus
taggatttactacctgcttcccaaa

SEQ ID NO: 560407 - DNA, 25 bp, Rattus norvegicus
taggatttactagctgcttcccaaa

SEQ ID NO: 560408 - DNA, 25 bp, Rattus norvegicus
taggatttctaacggcatgccgacc

SEQ ID NO: 560409 - DNA, 25 bp, Rattus norvegicus
taggatttctaagggcatgccgacc

SEQ ID NO: 560410 - DNA, 25 bp, Rattus norvegicus
taggatttctctcgtgtcttggctc

SEQ ID NO: 560411 - DNA, 25 bp, Rattus norvegicus
taggatttctctggtgtcttggctc

SEQ ID NO: 560412 - DNA, 25 bp, Rattus norvegicus
taggatttcttcacaccacaaacaa

SEQ ID NO: 560413 - DNA, 25 bp, Rattus norvegicus
taggatttcttctcaccacaaacaa

SEQ ID NO: 560414 - DNA, 25 bp, Rattus norvegicus
taggatttgaacactcaacgctgca

SEQ ID NO: 560415 - DNA, 25 bp, Rattus norvegicus
taggatttgaactctcaacgctgca

SEQ ID NO: 560416 - DNA, 25 bp, Rattus norvegicus
taggatttgcctactgtctctgaat

SEQ ID NO: 560417 - DNA, 25 bp, Rattus norvegicus
taggatttgccttctgtctctgaat

SEQ ID NO: 560418 - DNA, 25 bp, Rattus norvegicus
taggattttttcacgtactttgata

SEQ ID NO: 560419 - DNA, 25 bp, Rattus norvegicus
taggattttttctcgtactttgata

SEQ ID NO: 560420 - DNA, 25 bp, Rattus norvegicus
taggcaaaactcagccactgtgctt

SEQ ID NO: 560421 - DNA, 25 bp, Rattus norvegicus
taggcaaaactctgccactgtgctt

SEQ ID NO: 560422 - DNA, 25 bp, Rattus norvegicus
taggcaaacctcacatacacatcaa

SEQ ID NO: 560423 - DNA, 25 bp, Rattus norvegicus
taggcaaacctctcatacacatcaa

SEQ ID NO: 560424 - DNA, 25 bp, Rattus norvegicus
taggcaaagctgctgaggagccaca

SEQ ID NO: 560425 - DNA, 25 bp, Rattus norvegicus
taggcaaagctggtgaggagccaca

SEQ ID NO: 560426 - DNA, 25 bp, Rattus norvegicus
taggcaaaggccacagtttttcgtt

SEQ ID NO: 560427 - DNA, 25 bp, Rattus norvegicus
taggcaaaggcctcagtttttcgtt

SEQ ID NO: 560428 - DNA, 25 bp, Rattus norvegicus
taggcaaagtcaacccagagctcaa

SEQ ID NO: 560429 - DNA, 25 bp, Rattus norvegicus
taggcaaagtcatcccagagctcaa

SEQ ID NO: 560430 - DNA, 25 bp, Rattus norvegicus
taggcaaagtctcagctccaactta

SEQ ID NO: 560431 - DNA, 25 bp, Rattus norvegicus
taggcaaagtctgagctccaactta

SEQ ID NO: 560432 - DNA, 25 bp, Rattus norvegicus
taggcaaatcccagagagccacctg

SEQ ID NO: 560433 - DNA, 25 bp, Rattus norvegicus
taggcaaatccctgagagccacctg

SEQ ID NO: 560434 - DNA, 25 bp, Rattus norvegicus
taggcaacagagctcagccttccgt

SEQ ID NO: 560435 - DNA, 25 bp, Rattus norvegicus
taggcaacagaggtcagccttccgt

SEQ ID NO: 560436 - DNA, 25 bp, Rattus norvegicus
taggcaaccacacgaggctctagct

SEQ ID NO: 560437 - DNA, 25 bp, Rattus norvegicus
taggcaaccacaggaggctctagct

SEQ ID NO: 560438 - DNA, 25 bp, Rattus norvegicus
taggcaaccatacttcttgaatagc

SEQ ID NO: 560439 - DNA, 25 bp, Rattus norvegicus
taggcaaccatagttcttgaatagc

SEQ ID NO: 560440 - DNA, 25 bp, Rattus norvegicus
taggcaacccctcaaagcagaccag

SEQ ID NO: 560441 - DNA, 25 bp, Rattus norvegicus
taggcaacccctgaaagcagaccag

SEQ ID NO: 560442 - DNA, 25 bp, Rattus norvegicus
taggcaactagaacaatgtcccttg

SEQ ID NO: 560443 - DNA, 25 bp, Rattus norvegicus
taggcaactagatcaatgtcccttg

SEQ ID NO: 560444 - DNA, 25 bp, Rattus norvegicus
taggcaactcctctggtagcgacgt

SEQ ID NO: 560445 - DNA, 25 bp, Rattus norvegicus
taggcaactcctgtggtagcgacgt

SEQ ID NO: 560446 - DNA, 25 bp, Rattus norvegicus
taggcaactgatctgccattggaaa

SEQ ID NO: 560447 - DNA, 25 bp, Rattus norvegicus
taggcaactgatgtgccattggaaa

SEQ ID NO: 560448 - DNA, 25 bp, Rattus norvegicus
taggcaactgctcgaggttttaccc

SEQ ID NO: 560449 - DNA, 25 bp, Rattus norvegicus
taggcaactgctggaggttttaccc

SEQ ID NO: 560450 - DNA, 25 bp, Rattus norvegicus
taggcaagagagagtgctcctcctt

SEQ ID NO: 560451 - DNA, 25 bp, Rattus norvegicus
taggcaagagagtgtgctcctcctt

SEQ ID NO: 560452 - DNA, 25 bp, Rattus norvegicus
taggcaagcaccaagagccccagga

SEQ ID NO: 560453 - DNA, 25 bp, Rattus norvegicus
taggcaagcacctagagccccagga

SEQ ID NO: 560454 - DNA, 25 bp, Rattus norvegicus
taggcaagccctacagacactgcat

SEQ ID NO: 560455 - DNA, 25 bp, Rattus norvegicus
taggcaagcccttcagacactgcat

SEQ ID NO: 560456 - DNA, 25 bp, Rattus norvegicus
taggcaagccttccacttgcactag

SEQ ID NO: 560457 - DNA, 25 bp, Rattus norvegicus
taggcaagccttgcacttgcactag

SEQ ID NO: 560458 - DNA, 25 bp, Rattus norvegicus
taggcaaggactcctcacgaatgca

SEQ ID NO: 560459 - DNA, 25 bp, Rattus norvegicus
taggcaaggactgctcacgaatgca

SEQ ID NO: 560460 - DNA, 25 bp, Rattus norvegicus
taggcaaggcctatatcactgacac

SEQ ID NO: 560461 - DNA, 25 bp, Rattus norvegicus
taggcaaggcctttatcactgacac

SEQ ID NO: 560462 - DNA, 25 bp, Rattus norvegicus
taggcaagtggcatcagtctccaga

SEQ ID NO: 560463 - DNA, 25 bp, Rattus norvegicus
taggcaagtggcttcagtctccaga

SEQ ID NO: 560464 - DNA, 25 bp, Rattus norvegicus
taggcaatatagagcgtcccagtct

SEQ ID NO: 560465 - DNA, 25 bp, Rattus norvegicus
taggcaatatagtgcgtcccagtct

SEQ ID NO: 560466 - DNA, 25 bp, Rattus norvegicus
taggcaatcatacaactgtcccaca

SEQ ID NO: 560467 - DNA, 25 bp, Rattus norvegicus
taggcaatcatagaactgtcccaca

SEQ ID NO: 560468 - DNA, 25 bp, Rattus norvegicus
taggcaattattatcccatcccact

SEQ ID NO: 560469 - DNA, 25 bp, Rattus norvegicus
taggcaattattttcccatcccact

SEQ ID NO: 560470 - DNA, 25 bp, Rattus norvegicus
taggcacaaacccacattcagacac

SEQ ID NO: 560471 - DNA, 25 bp, Rattus norvegicus
taggcacaaaccgacattcagacac

SEQ ID NO: 560472 - DNA, 25 bp, Rattus norvegicus
taggcacaccaaaagactcatcaat

SEQ ID NO: 560473 - DNA, 25 bp, Rattus norvegicus
taggcacaccaatagactcatcaat

SEQ ID NO: 560474 - DNA, 25 bp, Rattus norvegicus
taggcacactttcagattcagtcgt

SEQ ID NO: 560475 - DNA, 25 bp, Rattus norvegicus
taggcacactttgagattcagtcgt

SEQ ID NO: 560476 - DNA, 25 bp, Rattus norvegicus
taggcacaggaaacagatccagcat

SEQ ID NO: 560477 - DNA, 25 bp, Rattus norvegicus
taggcacaggaatcagatccagcat

SEQ ID NO: 560478 - DNA, 25 bp, Rattus norvegicus
taggcacaggcgcactgtctgacat

SEQ ID NO: 560479 - DNA, 25 bp, Rattus norvegicus
taggcacaggcggactgtctgacat

SEQ ID NO: 560480 - DNA, 25 bp, Rattus norvegicus
taggcacagtagagagcccttgtca

SEQ ID NO: 560481 - DNA, 25 bp, Rattus norvegicus
taggcacagtagtgagcccttgtca

SEQ ID NO: 560482 - DNA, 25 bp, Rattus norvegicus
taggcaccacctcaatgtccaacaa

SEQ ID NO: 560483 - DNA, 25 bp, Rattus norvegicus
taggcaccacctgaatgtccaacaa

SEQ ID NO: 560484 - DNA, 25 bp, Rattus norvegicus
taggcacccaatcaagaccctggtt

SEQ ID NO: 560485 - DNA, 25 bp, Rattus norvegicus
taggcacccaatgaagaccctggtt

SEQ ID NO: 560486 - DNA, 25 bp, Rattus norvegicus
taggcacccacacaccttagaaaag

SEQ ID NO: 560487 - DNA, 25 bp, Rattus norvegicus
taggcacccacagaccttagaaaag

SEQ ID NO: 560488 - DNA, 25 bp, Rattus norvegicus
taggcacccagtctaaccagaactg

SEQ ID NO: 560489 - DNA, 25 bp, Rattus norvegicus
taggcacccagtgtaaccagaactg

SEQ ID NO: 560490 - DNA, 25 bp, Rattus norvegicus
taggcaccccttaatgctaactgtg

SEQ ID NO: 560491 - DNA, 25 bp, Rattus norvegicus
taggcacccctttatgctaactgtg

SEQ ID NO: 560492 - DNA, 25 bp, Rattus norvegicus
taggcacctcctcggtatgggctgc

SEQ ID NO: 560493 - DNA, 25 bp, Rattus norvegicus
taggcacctcctgggtatgggctgc

SEQ ID NO: 560494 - DNA, 25 bp, Rattus norvegicus
taggcacctgcgagtacctgtggag

SEQ ID NO: 560495 - DNA, 25 bp, Rattus norvegicus
taggcacctgcgtgtacctgtggag

SEQ ID NO: 560496 - DNA, 25 bp, Rattus norvegicus
taggcacctgtccaaggcacagata

SEQ ID NO: 560497 - DNA, 25 bp, Rattus norvegicus
taggcacctgtcgaaggcacagata

SEQ ID NO: 560498 - DNA, 25 bp, Rattus norvegicus
taggcaccttaactggagactggag

SEQ ID NO: 560499 - DNA, 25 bp, Rattus norvegicus
taggcaccttaagtggagactggag

SEQ ID NO: 560500 - DNA, 25 bp, Rattus norvegicus
taggcacggatcatctcttggacaa

SEQ ID NO: 560501 - DNA, 25 bp, Rattus norvegicus
taggcacggatcttctcttggacaa

SEQ ID NO: 560502 - DNA, 25 bp, Rattus norvegicus
taggcacggcacagagcccataaat

SEQ ID NO: 560503 - DNA, 25 bp, Rattus norvegicus
taggcacggcactgagcccataaat

SEQ ID NO: 560504 - DNA, 25 bp, Rattus norvegicus
taggcacgggacatttcctgttgta

SEQ ID NO: 560505 - DNA, 25 bp, Rattus norvegicus
taggcacgggacttttcctgttgta

SEQ ID NO: 560506 - DNA, 25 bp, Rattus norvegicus
taggcacgggtacagagtcacactc

SEQ ID NO: 560507 - DNA, 25 bp, Rattus norvegicus
taggcacgggtagagagtcacactc

SEQ ID NO: 560508 - DNA, 25 bp, Rattus norvegicus
taggcacggtggcacacgacgttaa

SEQ ID NO: 560509 - DNA, 25 bp, Rattus norvegicus
taggcacggtgggacacgacgttaa

SEQ ID NO: 560510 - DNA, 25 bp, Rattus norvegicus
taggcactaattaagcacgttggca

SEQ ID NO: 560511 - DNA, 25 bp, Rattus norvegicus
taggcactaatttagcacgttggca

SEQ ID NO: 560512 - DNA, 25 bp, Rattus norvegicus
taggcactactgagatctagcgatg

SEQ ID NO: 560513 - DNA, 25 bp, Rattus norvegicus
taggcactactgatctctctggctc

SEQ ID NO: 560514 - DNA, 25 bp, Rattus norvegicus
taggcactactgtgatctagcgatg

SEQ ID NO: 560515 - DNA, 25 bp, Rattus norvegicus
taggcactactgttctctctggctc

SEQ ID NO: 560516 - DNA, 25 bp, Rattus norvegicus
taggcactcctgagaggactttgat

SEQ ID NO: 560517 - DNA, 25 bp, Rattus norvegicus
taggcactcctgtgaggactttgat

SEQ ID NO: 560518 - DNA, 25 bp, Rattus norvegicus
taggcactgagcagggtctcaaaca

SEQ ID NO: 560519 - DNA, 25 bp, Rattus norvegicus
taggcactgagctgggtctcaaaca

SEQ ID NO: 560520 - DNA, 25 bp, Rattus norvegicus
taggcactgcggctgaagctcttgc

SEQ ID NO: 560521 - DNA, 25 bp, Rattus norvegicus
taggcactgcgggtgaagctcttgc

SEQ ID NO: 560522 - DNA, 25 bp, Rattus norvegicus
taggcactggaacacagctcacctt

SEQ ID NO: 560523 - DNA, 25 bp, Rattus norvegicus
taggcactggaagacagctcacctt

SEQ ID NO: 560524 - DNA, 25 bp, Rattus norvegicus
taggcacttaacatcaaaactcaaa

SEQ ID NO: 560525 - DNA, 25 bp, Rattus norvegicus
taggcacttaacttcaaaactcaaa

SEQ ID NO: 560526 - DNA, 25 bp, Rattus norvegicus
taggcacttaagagcccctggatat

SEQ ID NO: 560527 - DNA, 25 bp, Rattus norvegicus
taggcacttaagtgcccctggatat

SEQ ID NO: 560528 - DNA, 25 bp, Rattus norvegicus
taggcacttgtgctttgttccatgc

SEQ ID NO: 560529 - DNA, 25 bp, Rattus norvegicus
taggcacttgtggtttgttccatgc

SEQ ID NO: 560530 - DNA, 25 bp, Rattus norvegicus
taggcagaaccccaaggagtcctct

SEQ ID NO: 560531 - DNA, 25 bp, Rattus norvegicus
taggcagaacccgaaggagtcctct

SEQ ID NO: 560532 - DNA, 25 bp, Rattus norvegicus
taggcagaagccatcaaatcagaaa

SEQ ID NO: 560533 - DNA, 25 bp, Rattus norvegicus
taggcagaagccttcaaatcagaaa

SEQ ID NO: 560534 - DNA, 25 bp, Rattus norvegicus
taggcagaagtgacagttcccacag

SEQ ID NO: 560535 - DNA, 25 bp, Rattus norvegicus
taggcagaagtgtcagttcccacag

SEQ ID NO: 560536 - DNA, 25 bp, Rattus norvegicus
taggcagaccccagcttgtcacatg

SEQ ID NO: 560537 - DNA, 25 bp, Rattus norvegicus
taggcagacccctgcttgtcacatg

SEQ ID NO: 560538 - DNA, 25 bp, Rattus norvegicus
taggcagacctcatcctactggaat

SEQ ID NO: 560539 - DNA, 25 bp, Rattus norvegicus
taggcagacctcttcctactggaat

SEQ ID NO: 560540 - DNA, 25 bp, Rattus norvegicus
taggcagagctaaatgtgagaccct

SEQ ID NO: 560541 - DNA, 25 bp, Rattus norvegicus
taggcagagctatatgtgagaccct

SEQ ID NO: 560542 - DNA, 25 bp, Rattus norvegicus
taggcagatagtcggttttcggaat

SEQ ID NO: 560543 - DNA, 25 bp, Rattus norvegicus
taggcagatagtgggttttcggaat

SEQ ID NO: 560544 - DNA, 25 bp, Rattus norvegicus
taggcagatatcactgtctgacccc

SEQ ID NO: 560545 - DNA, 25 bp, Rattus norvegicus
taggcagatatctctgtctgacccc

SEQ ID NO: 560546 - DNA, 25 bp, Rattus norvegicus
taggcagatgagcagccacctgtca

SEQ ID NO: 560547 - DNA, 25 bp, Rattus norvegicus
taggcagatgaggagccacctgtca

SEQ ID NO: 560548 - DNA, 25 bp, Rattus norvegicus
taggcagcacatacagttgtcattg

SEQ ID NO: 560549 - DNA, 25 bp, Rattus norvegicus
taggcagcacattcagttgtcattg

SEQ ID NO: 560550 - DNA, 25 bp, Rattus norvegicus
taggcagcagacacagacgttgacc

SEQ ID NO: 560551 - DNA, 25 bp, Rattus norvegicus
taggcagcagactcagacgttgacc

SEQ ID NO: 560552 - DNA, 25 bp, Rattus norvegicus
taggcagccataataaactcaacag

SEQ ID NO: 560553 - DNA, 25 bp, Rattus norvegicus
taggcagccatattaaactcaacag

SEQ ID NO: 560554 - DNA, 25 bp, Rattus norvegicus
taggcagccatgagctgtagacagt

SEQ ID NO: 560555 - DNA, 25 bp, Rattus norvegicus
taggcagccatgatgttgagctttc

SEQ ID NO: 560556 - DNA, 25 bp, Rattus norvegicus
taggcagccatgtgctgtagacagt

SEQ ID NO: 560557 - DNA, 25 bp, Rattus norvegicus
taggcagccatgttgttgagctttc

SEQ ID NO: 560558 - DNA, 25 bp, Rattus norvegicus
taggcagcctctagtcatagttaca

SEQ ID NO: 560559 - DNA, 25 bp, Rattus norvegicus
taggcagcctcttgtcatagttaca

SEQ ID NO: 560560 - DNA, 25 bp, Rattus norvegicus
taggcagcctggaatgactgtcacc

SEQ ID NO: 560561 - DNA, 25 bp, Rattus norvegicus
taggcagcctggatctaagtgtaac

SEQ ID NO: 560562 - DNA, 25 bp, Rattus norvegicus
taggcagcctggtatgactgtcacc

SEQ ID NO: 560563 - DNA, 25 bp, Rattus norvegicus
taggcagcctggttctaagtgtaac

SEQ ID NO: 560564 - DNA, 25 bp, Rattus norvegicus
taggcagccttgcatgcttctggga

SEQ ID NO: 560565 - DNA, 25 bp, Rattus norvegicus
taggcagccttggatgcttctggga

SEQ ID NO: 560566 - DNA, 25 bp, Rattus norvegicus
taggcagcgccgagtctgtatcagt

SEQ ID NO: 560567 - DNA, 25 bp, Rattus norvegicus
taggcagcgccgtgtctgtatcagt

SEQ ID NO: 560568 - DNA, 25 bp, Rattus norvegicus
taggcagcgctaagggattcagtga

SEQ ID NO: 560569 - DNA, 25 bp, Rattus norvegicus
taggcagcgctatgggattcagtga

SEQ ID NO: 560570 - DNA, 25 bp, Rattus norvegicus
taggcagcggagaccatgtctgtct

SEQ ID NO: 560571 - DNA, 25 bp, Rattus norvegicus
taggcagcggagtccatgtctgtct

SEQ ID NO: 560572 - DNA, 25 bp, Rattus norvegicus
taggcagctactactagaacttaac

SEQ ID NO: 560573 - DNA, 25 bp, Rattus norvegicus
taggcagctacttctagaacttaac

SEQ ID NO: 560574 - DNA, 25 bp, Rattus norvegicus
taggcagcttcgctttgtttgtttt

SEQ ID NO: 560575 - DNA, 25 bp, Rattus norvegicus
taggcagcttcggtttgtttgtttt

SEQ ID NO: 560576 - DNA, 25 bp, Rattus norvegicus
taggcagcttgcactatgtaataaa

SEQ ID NO: 560577 - DNA, 25 bp, Rattus norvegicus
taggcagcttgctctatgtaataaa

SEQ ID NO: 560578 - DNA, 25 bp, Rattus norvegicus
taggcaggaatgctcttacctttta

SEQ ID NO: 560579 - DNA, 25 bp, Rattus norvegicus
taggcaggaatggtcttacctttta

SEQ ID NO: 560580 - DNA, 25 bp, Rattus norvegicus
taggcaggacctcccatcacagggt

SEQ ID NO: 560581 - DNA, 25 bp, Rattus norvegicus
taggcaggacctctggccaagttct

SEQ ID NO: 560582 - DNA, 25 bp, Rattus norvegicus
taggcaggacctgccatcacagggt

SEQ ID NO: 560583 - DNA, 25 bp, Rattus norvegicus
taggcaggacctgtggccaagttct

SEQ ID NO: 560584 - DNA, 25 bp, Rattus norvegicus
taggcaggcaaaaggttctgtggtt

SEQ ID NO: 560585 - DNA, 25 bp, Rattus norvegicus
taggcaggcaaatggttctgtggtt

SEQ ID NO: 560586 - DNA, 25 bp, Rattus norvegicus
taggcaggctagcaacctgtcctcc

SEQ ID NO: 560587 - DNA, 25 bp, Rattus norvegicus
taggcaggctaggaacctgtcctcc

SEQ ID NO: 560588 - DNA, 25 bp, Rattus norvegicus
taggcaggtgaccactgactggctt

SEQ ID NO: 560589 - DNA, 25 bp, Rattus norvegicus
taggcaggtgacgactgactggctt

SEQ ID NO: 560590 - DNA, 25 bp, Rattus norvegicus
taggcaggtgttccagacagtttgt

SEQ ID NO: 560591 - DNA, 25 bp, Rattus norvegicus
taggcaggtgttgcagacagtttgt

SEQ ID NO: 560592 - DNA, 25 bp, Rattus norvegicus
taggcagtccttcctccaggacttt

SEQ ID NO: 560593 - DNA, 25 bp, Rattus norvegicus
taggcagtccttgctccaggacttt

SEQ ID NO: 560594 - DNA, 25 bp, Rattus norvegicus
taggcagtcgcaacatggcgccagg

SEQ ID NO: 560595 - DNA, 25 bp, Rattus norvegicus
taggcagtcgcatcatggcgccagg

SEQ ID NO: 560596 - DNA, 25 bp, Rattus norvegicus
taggcagtctctatcaacttgcatg

SEQ ID NO: 560597 - DNA, 25 bp, Rattus norvegicus
taggcagtctctttcaacttgcatg

SEQ ID NO: 560598 - DNA, 25 bp, Rattus norvegicus
taggcagtgactacctagaggccaa

SEQ ID NO: 560599 - DNA, 25 bp, Rattus norvegicus
taggcagtgactacttcgacacgac

SEQ ID NO: 560600 - DNA, 25 bp, Rattus norvegicus
taggcagtgacttcctagaggccaa

SEQ ID NO: 560601 - DNA, 25 bp, Rattus norvegicus
taggcagtgacttcttcgacacgac

SEQ ID NO: 560602 - DNA, 25 bp, Rattus norvegicus
taggcagtgggtccagatcctgcca

SEQ ID NO: 560603 - DNA, 25 bp, Rattus norvegicus
taggcagtgggtgcagatcctgcca

SEQ ID NO: 560604 - DNA, 25 bp, Rattus norvegicus
taggcagtggttattccgggacact

SEQ ID NO: 560605 - DNA, 25 bp, Rattus norvegicus
taggcagtggtttttccgggacact

SEQ ID NO: 560606 - DNA, 25 bp, Rattus norvegicus
taggcagttcagagcgtatgtttac

SEQ ID NO: 560607 - DNA, 25 bp, Rattus norvegicus
taggcagttcagtgcgtatgtttac

SEQ ID NO: 560608 - DNA, 25 bp, Rattus norvegicus
taggcagttcttataccaaggttca

SEQ ID NO: 560609 - DNA, 25 bp, Rattus norvegicus
taggcagttcttttaccaaggttca

SEQ ID NO: 560610 - DNA, 25 bp, Rattus norvegicus
taggcagtttctcctggtggacaca

SEQ ID NO: 560611 - DNA, 25 bp, Rattus norvegicus
taggcagtttctgctggtggacaca

SEQ ID NO: 560612 - DNA, 25 bp, Rattus norvegicus
taggcataactccactgcatagtgt

SEQ ID NO: 560613 - DNA, 25 bp, Rattus norvegicus
taggcataactcgactgcatagtgt

SEQ ID NO: 560614 - DNA, 25 bp, Rattus norvegicus
taggcatactacatacagctttgaa

SEQ ID NO: 560615 - DNA, 25 bp, Rattus norvegicus
taggcatactacttacagctttgaa

SEQ ID NO: 560616 - DNA, 25 bp, Rattus norvegicus
taggcatagaaaccagtctctctgg

SEQ ID NO: 560617 - DNA, 25 bp, Rattus norvegicus
taggcatagaaagcagtctctctgg

SEQ ID NO: 560618 - DNA, 25 bp, Rattus norvegicus
taggcataggcaaactctcacactg

SEQ ID NO: 560619 - DNA, 25 bp, Rattus norvegicus
taggcataggcatactctcacactg

SEQ ID NO: 560620 - DNA, 25 bp, Rattus norvegicus
taggcatcacgcatttgtctgcata

SEQ ID NO: 560621 - DNA, 25 bp, Rattus norvegicus
taggcatcacgcttttgtctgcata

SEQ ID NO: 560622 - DNA, 25 bp, Rattus norvegicus
taggcatcctgcatctcagagcgct

SEQ ID NO: 560623 - DNA, 25 bp, Rattus norvegicus
taggcatcctgcttctcagagcgct

SEQ ID NO: 560624 - DNA, 25 bp, Rattus norvegicus
taggcatcgcatctaaaaggcagag

SEQ ID NO: 560625 - DNA, 25 bp, Rattus norvegicus
taggcatcgcatgtaaaaggcagag

SEQ ID NO: 560626 - DNA, 25 bp, Rattus norvegicus
taggcatcgtcgacgggattgtgct

SEQ ID NO: 560627 - DNA, 25 bp, Rattus norvegicus
taggcatcgtcgtcgggattgtgct

SEQ ID NO: 560628 - DNA, 25 bp, Rattus norvegicus
taggcatctgacactttgaaccaaa

SEQ ID NO: 560629 - DNA, 25 bp, Rattus norvegicus
taggcatctgactctttgaaccaaa

SEQ ID NO: 560630 - DNA, 25 bp, Rattus norvegicus
taggcatctgggaagaaacagtgct

SEQ ID NO: 560631 - DNA, 25 bp, Rattus norvegicus
taggcatctgggtagaaacagtgct

SEQ ID NO: 560632 - DNA, 25 bp, Rattus norvegicus
taggcatgaaccacagtggtccagc

SEQ ID NO: 560633 - DNA, 25 bp, Rattus norvegicus
taggcatgaacctcagtggtccagc

SEQ ID NO: 560634 - DNA, 25 bp, Rattus norvegicus
taggcatggccaacctttggtggat

SEQ ID NO: 560635 - DNA, 25 bp, Rattus norvegicus
taggcatggccatcctttggtggat

SEQ ID NO: 560636 - DNA, 25 bp, Rattus norvegicus
taggcatggctgaccacacctttaa

SEQ ID NO: 560637 - DNA, 25 bp, Rattus norvegicus
taggcatggctgtccacacctttaa

SEQ ID NO: 560638 - DNA, 25 bp, Rattus norvegicus
taggcatgggacacagaggccctct

SEQ ID NO: 560639 - DNA, 25 bp, Rattus norvegicus
taggcatgggacatgtaccacactt

SEQ ID NO: 560640 - DNA, 25 bp, Rattus norvegicus
taggcatgggactcagaggccctct

SEQ ID NO: 560641 - DNA, 25 bp, Rattus norvegicus
taggcatgggacttgtaccacactt

SEQ ID NO: 560642 - DNA, 25 bp, Rattus norvegicus
taggcatggtgtagttcgcgtcgca

SEQ ID NO: 560643 - DNA, 25 bp, Rattus norvegicus
taggcatggtgttgttcgcgtcgca

SEQ ID NO: 560644 - DNA, 25 bp, Rattus norvegicus
taggcattacctatcttagcagact

SEQ ID NO: 560645 - DNA, 25 bp, Rattus norvegicus
taggcattacctttcttagcagact

SEQ ID NO: 560646 - DNA, 25 bp, Rattus norvegicus
taggcattaggcacggcacaggacg

SEQ ID NO: 560647 - DNA, 25 bp, Rattus norvegicus
taggcattaggctcggcacaggacg

SEQ ID NO: 560648 - DNA, 25 bp, Rattus norvegicus
taggcattcaagcacctagcctgga

SEQ ID NO: 560649 - DNA, 25 bp, Rattus norvegicus
taggcattcaaggacctagcctgga

SEQ ID NO: 560650 - DNA, 25 bp, Rattus norvegicus
taggcattcagcaaaggttctcccc

SEQ ID NO: 560651 - DNA, 25 bp, Rattus norvegicus
taggcattcagctaaggttctcccc

SEQ ID NO: 560652 - DNA, 25 bp, Rattus norvegicus
taggcattccacatccagtttagac

SEQ ID NO: 560653 - DNA, 25 bp, Rattus norvegicus
taggcattccacttccagtttagac

SEQ ID NO: 560654 - DNA, 25 bp, Rattus norvegicus
taggcattctttctatccgcatggt

SEQ ID NO: 560655 - DNA, 25 bp, Rattus norvegicus
taggcattctttgtatccgcatggt

SEQ ID NO: 560656 - DNA, 25 bp, Rattus norvegicus
taggcattgtggctcatgcctgcag

SEQ ID NO: 560657 - DNA, 25 bp, Rattus norvegicus
taggcattgtgggtcatgcctgcag

SEQ ID NO: 560658 - DNA, 25 bp, Rattus norvegicus
taggcattgttgaatcctgagcaaa

SEQ ID NO: 560659 - DNA, 25 bp, Rattus norvegicus
taggcattgttgtatcctgagcaaa

SEQ ID NO: 560660 - DNA, 25 bp, Rattus norvegicus
taggcatttagacgccagtccgggc

SEQ ID NO: 560661 - DNA, 25 bp, Rattus norvegicus
taggcatttagaggccagtccgggc

SEQ ID NO: 560662 - DNA, 25 bp, Rattus norvegicus
taggcatttccaactgatgggtcag

SEQ ID NO: 560663 - DNA, 25 bp, Rattus norvegicus
taggcatttccatctgatgggtcag

SEQ ID NO: 560664 - DNA, 25 bp, Rattus norvegicus
taggcatttcctccgagtgctggag

SEQ ID NO: 560665 - DNA, 25 bp, Rattus norvegicus
taggcatttcctgcgagtgctggag

SEQ ID NO: 560666 - DNA, 25 bp, Rattus norvegicus
taggcattttctaacttttattaca

SEQ ID NO: 560667 - DNA, 25 bp, Rattus norvegicus
taggcattttcttacttttattaca

SEQ ID NO: 560668 - DNA, 25 bp, Rattus norvegicus
taggccaaggtcatgtctgtggctc

SEQ ID NO: 560669 - DNA, 25 bp, Rattus norvegicus
taggccaaggtcttgtctgtggctc

SEQ ID NO: 560670 - DNA, 25 bp, Rattus norvegicus
taggccacactcaagacgagacagc

SEQ ID NO: 560671 - DNA, 25 bp, Rattus norvegicus
taggccacactctagacgagacagc

SEQ ID NO: 560672 - DNA, 25 bp, Rattus norvegicus
taggccaccagaagggctcctgaga

SEQ ID NO: 560673 - DNA, 25 bp, Rattus norvegicus
taggccaccagatgggctcctgaga

SEQ ID NO: 560674 - DNA, 25 bp, Rattus norvegicus
taggccaccaggaccttcaaaggat

SEQ ID NO: 560675 - DNA, 25 bp, Rattus norvegicus
taggccaccaggtccttcaaaggat

SEQ ID NO: 560676 - DNA, 25 bp, Rattus norvegicus
taggccaccatgacttccggtatat

SEQ ID NO: 560677 - DNA, 25 bp, Rattus norvegicus
taggccaccatgtcttccggtatat

SEQ ID NO: 560678 - DNA, 25 bp, Rattus norvegicus
taggccacctagaaagatcccatct

SEQ ID NO: 560679 - DNA, 25 bp, Rattus norvegicus
taggccacctagtaagatcccatct

SEQ ID NO: 560680 - DNA, 25 bp, Rattus norvegicus
taggccacgtggcacttagtactta

SEQ ID NO: 560681 - DNA, 25 bp, Rattus norvegicus
taggccacgtgggacttagtactta

SEQ ID NO: 560682 - DNA, 25 bp, Rattus norvegicus
taggccactctcaaactgctctgaa

SEQ ID NO: 560683 - DNA, 25 bp, Rattus norvegicus
taggccactctctaactgctctgaa

SEQ ID NO: 560684 - DNA, 25 bp, Rattus norvegicus
taggccactgccacctgggatggaa

SEQ ID NO: 560685 - DNA, 25 bp, Rattus norvegicus
taggccactgcctcctgggatggaa

SEQ ID NO: 560686 - DNA, 25 bp, Rattus norvegicus
taggccactggtctaccctttttag

SEQ ID NO: 560687 - DNA, 25 bp, Rattus norvegicus
taggccactggtgtaccctttttag

SEQ ID NO: 560688 - DNA, 25 bp, Rattus norvegicus
taggccactgtgctcccagggagtt

SEQ ID NO: 560689 - DNA, 25 bp, Rattus norvegicus
taggccactgtggtcccagggagtt

SEQ ID NO: 560690 - DNA, 25 bp, Rattus norvegicus
taggccagaaagaacacctgcctcc

SEQ ID NO: 560691 - DNA, 25 bp, Rattus norvegicus
taggccagaaagtacacctgcctcc

SEQ ID NO: 560692 - DNA, 25 bp, Rattus norvegicus
taggccagataaatcttccagggtt

SEQ ID NO: 560693 - DNA, 25 bp, Rattus norvegicus
taggccagataattcttccagggtt

SEQ ID NO: 560694 - DNA, 25 bp, Rattus norvegicus
taggccagccttaactgagactcca

SEQ ID NO: 560695 - DNA, 25 bp, Rattus norvegicus
taggccagcctttactgagactcca

SEQ ID NO: 560696 - DNA, 25 bp, Rattus norvegicus
taggccaggagccacccagagccat

SEQ ID NO: 560697 - DNA, 25 bp, Rattus norvegicus
taggccaggagcgacccagagccat

SEQ ID NO: 560698 - DNA, 25 bp, Rattus norvegicus
taggccaggccaagtggctacagca

SEQ ID NO: 560699 - DNA, 25 bp, Rattus norvegicus
taggccaggccatgtggctacagca

SEQ ID NO: 560700 - DNA, 25 bp, Rattus norvegicus
taggccaggcctagttccgggtccg

SEQ ID NO: 560701 - DNA, 25 bp, Rattus norvegicus
taggccaggccttgttccgggtccg

SEQ ID NO: 560702 - DNA, 25 bp, Rattus norvegicus
taggccaggtttacctagactcctc

SEQ ID NO: 560703 - DNA, 25 bp, Rattus norvegicus
taggccaggttttcctagactcctc

SEQ ID NO: 560704 - DNA, 25 bp, Rattus norvegicus
taggccagtcgtagattgctatctc

SEQ ID NO: 560705 - DNA, 25 bp, Rattus norvegicus
taggccagtcgttgattgctatctc

SEQ ID NO: 560706 - DNA, 25 bp, Rattus norvegicus
taggccatccagcactatatataag

SEQ ID NO: 560707 - DNA, 25 bp, Rattus norvegicus
taggccatccaggactatatataag

SEQ ID NO: 560708 - DNA, 25 bp, Rattus norvegicus
taggccatcgaaagaactgctgctg

SEQ ID NO: 560709 - DNA, 25 bp, Rattus norvegicus
taggccatcgaatgaactgctgctg

SEQ ID NO: 560710 - DNA, 25 bp, Rattus norvegicus
taggccatggctctggcatgacatg

SEQ ID NO: 560711 - DNA, 25 bp, Rattus norvegicus
taggccatggctgtggcatgacatg

SEQ ID NO: 560712 - DNA, 25 bp, Rattus norvegicus
taggccatgtgaagcccaccaagta

SEQ ID NO: 560713 - DNA, 25 bp, Rattus norvegicus
taggccatgtgatgcccaccaagta

SEQ ID NO: 560714 - DNA, 25 bp, Rattus norvegicus
taggccattgttactacataccaaa

SEQ ID NO: 560715 - DNA, 25 bp, Rattus norvegicus
taggccattgtttctacataccaaa

SEQ ID NO: 560716 - DNA, 25 bp, Rattus norvegicus
taggcccacctgaagagctccaagt

SEQ ID NO: 560717 - DNA, 25 bp, Rattus norvegicus
taggcccacctgtagagctccaagt

SEQ ID NO: 560718 - DNA, 25 bp, Rattus norvegicus
taggcccagaccaatgtctacacat

SEQ ID NO: 560719 - DNA, 25 bp, Rattus norvegicus
taggcccagacctatgtctacacat

SEQ ID NO: 560720 - DNA, 25 bp, Rattus norvegicus
taggcccagcttatcggcagactgg

SEQ ID NO: 560721 - DNA, 25 bp, Rattus norvegicus
taggcccagcttttcggcagactgg

SEQ ID NO: 560722 - DNA, 25 bp, Rattus norvegicus
taggcccagggaccttgacaatcat

SEQ ID NO: 560723 - DNA, 25 bp, Rattus norvegicus
taggcccagggagcttgacaatcat

SEQ ID NO: 560724 - DNA, 25 bp, Rattus norvegicus
taggcccatcctatatcgtcaggtg

SEQ ID NO: 560725 - DNA, 25 bp, Rattus norvegicus
taggcccatcctttatcgtcaggtg

SEQ ID NO: 560726 - DNA, 25 bp, Rattus norvegicus
taggccccaagaaaagttcctcgtg

SEQ ID NO: 560727 - DNA, 25 bp, Rattus norvegicus
taggccccaagaaagtcaccctgag

SEQ ID NO: 560728 - DNA, 25 bp, Rattus norvegicus
taggccccaagataagttcctcgtg

SEQ ID NO: 560729 - DNA, 25 bp, Rattus norvegicus
taggccccaagatagtcaccctgag

SEQ ID NO: 560730 - DNA, 25 bp, Rattus norvegicus
taggccccagcaccttatgatgatg

SEQ ID NO: 560731 - DNA, 25 bp, Rattus norvegicus
taggccccagcagcttatgatgatg

SEQ ID NO: 560732 - DNA, 25 bp, Rattus norvegicus
taggccccagtcagcaaaagcaagg

SEQ ID NO: 560733 - DNA, 25 bp, Rattus norvegicus
taggccccagtctgcaaaagcaagg

SEQ ID NO: 560734 - DNA, 25 bp, Rattus norvegicus
taggccccatttaggttctgacagt

SEQ ID NO: 560735 - DNA, 25 bp, Rattus norvegicus
taggccccattttggttctgacagt

SEQ ID NO: 560736 - DNA, 25 bp, Rattus norvegicus
taggcccctatgagatcaacgtgac

SEQ ID NO: 560737 - DNA, 25 bp, Rattus norvegicus
taggcccctatgtgatcaacgtgac

SEQ ID NO: 560738 - DNA, 25 bp, Rattus norvegicus
taggcccctggcctgacaaaggaaa

SEQ ID NO: 560739 - DNA, 25 bp, Rattus norvegicus
taggcccctggcgtgacaaaggaaa

SEQ ID NO: 560740 - DNA, 25 bp, Rattus norvegicus
taggcccctgtgaagtagtgcatag

SEQ ID NO: 560741 - DNA, 25 bp, Rattus norvegicus
taggcccctgtgtagtagtgcatag

SEQ ID NO: 560742 - DNA, 25 bp, Rattus norvegicus
taggcccggcaacttgtcctctagg

SEQ ID NO: 560743 - DNA, 25 bp, Rattus norvegicus
taggcccggcaagttgtcctctagg

SEQ ID NO: 560744 - DNA, 25 bp, Rattus norvegicus
taggcccgtatcaagcccagtcgtg

SEQ ID NO: 560745 - DNA, 25 bp, Rattus norvegicus
taggcccgtatctagcccagtcgtg

SEQ ID NO: 560746 - DNA, 25 bp, Rattus norvegicus
taggccctacagcaatgaacatggt

SEQ ID NO: 560747 - DNA, 25 bp, Rattus norvegicus
taggccctacaggaatgaacatggt

SEQ ID NO: 560748 - DNA, 25 bp, Rattus norvegicus
taggccctatttagaattccagaac

SEQ ID NO: 560749 - DNA, 25 bp, Rattus norvegicus
taggccctattttgaattccagaac

SEQ ID NO: 560750 - DNA, 25 bp, Rattus norvegicus
taggccctgcgaacgagctaacgag

SEQ ID NO: 560751 - DNA, 25 bp, Rattus norvegicus
taggccctgcgatcgagctaacgag

SEQ ID NO: 560752 - DNA, 25 bp, Rattus norvegicus
taggccctggctcaaggactttgca

SEQ ID NO: 560753 - DNA, 25 bp, Rattus norvegicus
taggccctggctgaaggactttgca

SEQ ID NO: 560754 - DNA, 25 bp, Rattus norvegicus
taggccctggtcacatgggcaactt

SEQ ID NO: 560755 - DNA, 25 bp, Rattus norvegicus
taggccctggtctcatgggcaactt

SEQ ID NO: 560756 - DNA, 25 bp, Rattus norvegicus
taggccctgtgtctttatgcaaaaa

SEQ ID NO: 560757 - DNA, 25 bp, Rattus norvegicus
taggccctgtgtgtttatgcaaaaa

SEQ ID NO: 560758 - DNA, 25 bp, Rattus norvegicus
taggcccttaagctcctacaggtag

SEQ ID NO: 560759 - DNA, 25 bp, Rattus norvegicus
taggcccttaaggtcctacaggtag

SEQ ID NO: 560760 - DNA, 25 bp, Rattus norvegicus
taggcccttaggacacgtggaaact

SEQ ID NO: 560761 - DNA, 25 bp, Rattus norvegicus
taggcccttaggtcacgtggaaact

SEQ ID NO: 560762 - DNA, 25 bp, Rattus norvegicus
taggccctttcaagctagatacagt

SEQ ID NO: 560763 - DNA, 25 bp, Rattus norvegicus
taggccctttcatgctagatacagt

SEQ ID NO: 560764 - DNA, 25 bp, Rattus norvegicus
taggccgataaaaaaccaagagcat

SEQ ID NO: 560765 - DNA, 25 bp, Rattus norvegicus
taggccgataaataaccaagagcat

SEQ ID NO: 560766 - DNA, 25 bp, Rattus norvegicus
taggccgcagatccaggtggcacct

SEQ ID NO: 560767 - DNA, 25 bp, Rattus norvegicus
taggccgcagatgcaggtggcacct

SEQ ID NO: 560768 - DNA, 25 bp, Rattus norvegicus
taggccgccaacagtgtgacagaca

SEQ ID NO: 560769 - DNA, 25 bp, Rattus norvegicus
taggccgccaactgtgtgacagaca

SEQ ID NO: 560770 - DNA, 25 bp, Rattus norvegicus
taggccgcgacgatgaagtcgccct

SEQ ID NO: 560771 - DNA, 25 bp, Rattus norvegicus
taggccgcgacgttgaagtcgccct

SEQ ID NO: 560772 - DNA, 25 bp, Rattus norvegicus
taggccgcgggaacctgcaacgcgc

SEQ ID NO: 560773 - DNA, 25 bp, Rattus norvegicus
taggccgcgggatcctgcaacgcgc

SEQ ID NO: 560774 - DNA, 25 bp, Rattus norvegicus
taggccgctctacagaagtcagtat

SEQ ID NO: 560775 - DNA, 25 bp, Rattus norvegicus
taggccgctctagagaagtcagtat

SEQ ID NO: 560776 - DNA, 25 bp, Rattus norvegicus
taggccgggactacagcccgactgg

SEQ ID NO: 560777 - DNA, 25 bp, Rattus norvegicus
taggccgggacttcagcccgactgg

SEQ ID NO: 560778 - DNA, 25 bp, Rattus norvegicus
taggccgggcaaaggacactgctct

SEQ ID NO: 560779 - DNA, 25 bp, Rattus norvegicus
taggccgggcaatggacactgctct

SEQ ID NO: 560780 - DNA, 25 bp, Rattus norvegicus
taggccggtgggacttccgctccat

SEQ ID NO: 560781 - DNA, 25 bp, Rattus norvegicus
taggccggtgggtcttccgctccat

SEQ ID NO: 560782 - DNA, 25 bp, Rattus norvegicus
taggccgtacggcagcagccactct

SEQ ID NO: 560783 - DNA, 25 bp, Rattus norvegicus
taggccgtacgggagcagccactct

SEQ ID NO: 560784 - DNA, 25 bp, Rattus norvegicus
taggccgttgccactgttcagggac

SEQ ID NO: 560785 - DNA, 25 bp, Rattus norvegicus
taggccgttgcctctgttcagggac

SEQ ID NO: 560786 - DNA, 25 bp, Rattus norvegicus
taggcctagtccatcgagtggctag

SEQ ID NO: 560787 - DNA, 25 bp, Rattus norvegicus
taggcctagtccttcgagtggctag

SEQ ID NO: 560788 - DNA, 25 bp, Rattus norvegicus
taggcctatttccatgtaagggtga

SEQ ID NO: 560789 - DNA, 25 bp, Rattus norvegicus
taggcctatttcgatgtaagggtga

SEQ ID NO: 560790 - DNA, 25 bp, Rattus norvegicus
taggcctcacatcctgcctgagtca

SEQ ID NO: 560791 - DNA, 25 bp, Rattus norvegicus
taggcctcacatgctgcctgagtca

SEQ ID NO: 560792 - DNA, 25 bp, Rattus norvegicus
taggcctcagtaaggagtggtcgtc

SEQ ID NO: 560793 - DNA, 25 bp, Rattus norvegicus
taggcctcagtatggagtggtcgtc

SEQ ID NO: 560794 - DNA, 25 bp, Rattus norvegicus
taggcctcagtgctagggattgaac

SEQ ID NO: 560795 - DNA, 25 bp, Rattus norvegicus
taggcctcagtggtagggattgaac

SEQ ID NO: 560796 - DNA, 25 bp, Rattus norvegicus
taggcctcagttatctctagtagac

SEQ ID NO: 560797 - DNA, 25 bp, Rattus norvegicus
taggcctcagttttctctagtagac

SEQ ID NO: 560798 - DNA, 25 bp, Rattus norvegicus
taggcctcatgcagttgttctctga

SEQ ID NO: 560799 - DNA, 25 bp, Rattus norvegicus
taggcctcatgctgttgttctctga

SEQ ID NO: 560800 - DNA, 25 bp, Rattus norvegicus
taggcctccagcaacattgagagaa

SEQ ID NO: 560801 - DNA, 25 bp, Rattus norvegicus
taggcctccagctacattgagagaa

SEQ ID NO: 560802 - DNA, 25 bp, Rattus norvegicus
taggcctccattaccaattgacaca

SEQ ID NO: 560803 - DNA, 25 bp, Rattus norvegicus
taggcctccatttccaattgacaca

SEQ ID NO: 560804 - DNA, 25 bp, Rattus norvegicus
taggcctcccagcacatttgtagcg

SEQ ID NO: 560805 - DNA, 25 bp, Rattus norvegicus
taggcctcccaggacatttgtagcg

SEQ ID NO: 560806 - DNA, 25 bp, Rattus norvegicus
taggcctccctcaagagactgactg

SEQ ID NO: 560807 - DNA, 25 bp, Rattus norvegicus
taggcctccctctagagactgactg

SEQ ID NO: 560808 - DNA, 25 bp, Rattus norvegicus
taggcctcccttataacaggtgatt

SEQ ID NO: 560809 - DNA, 25 bp, Rattus norvegicus
taggcctcccttttaacaggtgatt

SEQ ID NO: 560810 - DNA, 25 bp, Rattus norvegicus
taggcctccgatataaagacgcttc

SEQ ID NO: 560811 - DNA, 25 bp, Rattus norvegicus
taggcctccgatttaaagacgcttc

SEQ ID NO: 560812 - DNA, 25 bp, Rattus norvegicus
taggcctcctacagggaaagtgttt

SEQ ID NO: 560813 - DNA, 25 bp, Rattus norvegicus
taggcctcctactgggaaagtgttt

SEQ ID NO: 560814 - DNA, 25 bp, Rattus norvegicus
taggcctcctcccaatatgatctgt

SEQ ID NO: 560815 - DNA, 25 bp, Rattus norvegicus
taggcctcctccgaatatgatctgt

SEQ ID NO: 560816 - DNA, 25 bp, Rattus norvegicus
taggcctcgtgaccttctgcttcta

SEQ ID NO: 560817 - DNA, 25 bp, Rattus norvegicus
taggcctcgtgagcttctgcttcta

SEQ ID NO: 560818 - DNA, 25 bp, Rattus norvegicus
taggcctctaagcttccattacttt

SEQ ID NO: 560819 - DNA, 25 bp, Rattus norvegicus
taggcctctaaggttccattacttt

SEQ ID NO: 560820 - DNA, 25 bp, Rattus norvegicus
taggcctctaatcccttgcttttgt

SEQ ID NO: 560821 - DNA, 25 bp, Rattus norvegicus
taggcctctaatgccttgcttttgt

SEQ ID NO: 560822 - DNA, 25 bp, Rattus norvegicus
taggcctctcctatacagtattaaa

SEQ ID NO: 560823 - DNA, 25 bp, Rattus norvegicus
taggcctctcctttacagtattaaa

SEQ ID NO: 560824 - DNA, 25 bp, Rattus norvegicus
taggcctcttgcaccttggagttgt

SEQ ID NO: 560825 - DNA, 25 bp, Rattus norvegicus
taggcctcttgctccttggagttgt

SEQ ID NO: 560826 - DNA, 25 bp, Rattus norvegicus
taggcctgagagactggttgccagc

SEQ ID NO: 560827 - DNA, 25 bp, Rattus norvegicus
taggcctgagagtctggttgccagc

SEQ ID NO: 560828 - DNA, 25 bp, Rattus norvegicus
taggcctgcagacactgttttaaaa

SEQ ID NO: 560829 - DNA, 25 bp, Rattus norvegicus
taggcctgcagagactgttttaaaa

SEQ ID NO: 560830 - DNA, 25 bp, Rattus norvegicus
taggcctgccttaaattttagtgtt

SEQ ID NO: 560831 - DNA, 25 bp, Rattus norvegicus
taggcctgcctttaattttagtgtt

SEQ ID NO: 560832 - DNA, 25 bp, Rattus norvegicus
taggcctggagccacattgtgttgt

SEQ ID NO: 560833 - DNA, 25 bp, Rattus norvegicus
taggcctggagcgacattgtgttgt

SEQ ID NO: 560834 - DNA, 25 bp, Rattus norvegicus
taggcctggcatcttctctcatgga

SEQ ID NO: 560835 - DNA, 25 bp, Rattus norvegicus
taggcctggcatgttctctcatgga

SEQ ID NO: 560836 - DNA, 25 bp, Rattus norvegicus
taggcctgggaacttctcagacctg

SEQ ID NO: 560837 - DNA, 25 bp, Rattus norvegicus
taggcctgggaagttctcagacctg

SEQ ID NO: 560838 - DNA, 25 bp, Rattus norvegicus
taggcctgtcacatctgttttcaca

SEQ ID NO: 560839 - DNA, 25 bp, Rattus norvegicus
taggcctgtcacttctgttttcaca

SEQ ID NO: 560840 - DNA, 25 bp, Rattus norvegicus
taggccttaaggacagctgagagac

SEQ ID NO: 560841 - DNA, 25 bp, Rattus norvegicus
taggccttaaggtcagctgagagac

SEQ ID NO: 560842 - DNA, 25 bp, Rattus norvegicus
taggccttactgaaagccgctgagg

SEQ ID NO: 560843 - DNA, 25 bp, Rattus norvegicus
taggccttactgtaagccgctgagg

SEQ ID NO: 560844 - DNA, 25 bp, Rattus norvegicus
taggccttcagactcggactctaag

SEQ ID NO: 560845 - DNA, 25 bp, Rattus norvegicus
taggccttcagagtcggactctaag

SEQ ID NO: 560846 - DNA, 25 bp, Rattus norvegicus
taggccttcatgagcgaccacgtgg

SEQ ID NO: 560847 - DNA, 25 bp, Rattus norvegicus
taggccttcatgtgcgaccacgtgg

SEQ ID NO: 560848 - DNA, 25 bp, Rattus norvegicus
taggccttctcgctaatccagggca

SEQ ID NO: 560849 - DNA, 25 bp, Rattus norvegicus
taggccttctcggtaatccagggca

SEQ ID NO: 560850 - DNA, 25 bp, Rattus norvegicus
taggccttcttgcttgcagacattc

SEQ ID NO: 560851 - DNA, 25 bp, Rattus norvegicus
taggccttcttggttgcagacattc

SEQ ID NO: 560852 - DNA, 25 bp, Rattus norvegicus
taggccttgagtaagcatggacccc

SEQ ID NO: 560853 - DNA, 25 bp, Rattus norvegicus
taggccttgagttagcatggacccc

SEQ ID NO: 560854 - DNA, 25 bp, Rattus norvegicus
taggccttgcttcagtgtccaggag

SEQ ID NO: 560855 - DNA, 25 bp, Rattus norvegicus
taggccttgcttgagtgtccaggag

SEQ ID NO: 560856 - DNA, 25 bp, Rattus norvegicus
taggccttggccagaagacactcag

SEQ ID NO: 560857 - DNA, 25 bp, Rattus norvegicus
taggccttggcctgaagacactcag

SEQ ID NO: 560858 - DNA, 25 bp, Rattus norvegicus
taggccttgtagagttgcccatgca

SEQ ID NO: 560859 - DNA, 25 bp, Rattus norvegicus
taggccttgtagtgttgcccatgca

SEQ ID NO: 560860 - DNA, 25 bp, Rattus norvegicus
taggcctttgacagtgaactcacgc

SEQ ID NO: 560861 - DNA, 25 bp, Rattus norvegicus
taggcctttgactgtgaactcacgc

SEQ ID NO: 560862 - DNA, 25 bp, Rattus norvegicus
taggcctttgagaagctaagcttgc

SEQ ID NO: 560863 - DNA, 25 bp, Rattus norvegicus
taggcctttgagtagctaagcttgc

SEQ ID NO: 560864 - DNA, 25 bp, Rattus norvegicus
taggccttttccattcataagttgg

SEQ ID NO: 560865 - DNA, 25 bp, Rattus norvegicus
taggccttttcctttcataagttgg

SEQ ID NO: 560866 - DNA, 25 bp, Rattus norvegicus
taggcgaagaccaccctgggtccta

SEQ ID NO: 560867 - DNA, 25 bp, Rattus norvegicus
taggcgaagacctccctgggtccta

SEQ ID NO: 560868 - DNA, 25 bp, Rattus norvegicus
taggcgacagcgagagcactcccaa

SEQ ID NO: 560869 - DNA, 25 bp, Rattus norvegicus
taggcgacagcgtgagcactcccaa

SEQ ID NO: 560870 - DNA, 25 bp, Rattus norvegicus
taggcgactatcagcagcccaagta

SEQ ID NO: 560871 - DNA, 25 bp, Rattus norvegicus
taggcgactatctgcagcccaagta

SEQ ID NO: 560872 - DNA, 25 bp, Rattus norvegicus
taggcgagccttattcccaagagga

SEQ ID NO: 560873 - DNA, 25 bp, Rattus norvegicus
taggcgagcctttttcccaagagga

SEQ ID NO: 560874 - DNA, 25 bp, Rattus norvegicus
taggcgaggagactctaccccaaca

SEQ ID NO: 560875 - DNA, 25 bp, Rattus norvegicus
taggcgaggagagtctaccccaaca

SEQ ID NO: 560876 - DNA, 25 bp, Rattus norvegicus
taggcgatacctcctttaattacaa

SEQ ID NO: 560877 - DNA, 25 bp, Rattus norvegicus
taggcgatacctgctttaattacaa

SEQ ID NO: 560878 - DNA, 25 bp, Rattus norvegicus
taggcgatagtgacgtcctgaagca

SEQ ID NO: 560879 - DNA, 25 bp, Rattus norvegicus
taggcgatagtgtcgtcctgaagca

SEQ ID NO: 560880 - DNA, 25 bp, Rattus norvegicus
taggcgcacgccctacgaagccgga

SEQ ID NO: 560881 - DNA, 25 bp, Rattus norvegicus
taggcgcacgccgtacgaagccgga

SEQ ID NO: 560882 - DNA, 25 bp, Rattus norvegicus
taggcgccaccacttgaagatgctc

SEQ ID NO: 560883 - DNA, 25 bp, Rattus norvegicus
taggcgccaccagttgaagatgctc

SEQ ID NO: 560884 - DNA, 25 bp, Rattus norvegicus
taggcgcggcagagtgcatctctga

SEQ ID NO: 560885 - DNA, 25 bp, Rattus norvegicus
taggcgcggcagtgtgcatctctga

SEQ ID NO: 560886 - DNA, 25 bp, Rattus norvegicus
taggcgctatggctctgcagccctc

SEQ ID NO: 560887 - DNA, 25 bp, Rattus norvegicus
taggcgctatgggtctgcagccctc

SEQ ID NO: 560888 - DNA, 25 bp, Rattus norvegicus
taggcgctcgccacaggccatgcta

SEQ ID NO: 560889 - DNA, 25 bp, Rattus norvegicus
taggcgctcgcctcaggccatgcta

SEQ ID NO: 560890 - DNA, 25 bp, Rattus norvegicus
taggcggccgacaggcattttgaag

SEQ ID NO: 560891 - DNA, 25 bp, Rattus norvegicus
taggcggccgactggcattttgaag

SEQ ID NO: 560892 - DNA, 25 bp, Rattus norvegicus
taggcggctgcaacctgtggcgcaa

SEQ ID NO: 560893 - DNA, 25 bp, Rattus norvegicus
taggcggctgcatcctgtggcgcaa

SEQ ID NO: 560894 - DNA, 25 bp, Rattus norvegicus
taggcgggaccgcaagaaccggccg

SEQ ID NO: 560895 - DNA, 25 bp, Rattus norvegicus
taggcgggaccggaagaaccggccg

SEQ ID NO: 560896 - DNA, 25 bp, Rattus norvegicus
taggcggtatttacagtgcaaccaa

SEQ ID NO: 560897 - DNA, 25 bp, Rattus norvegicus
taggcggtattttcagtgcaaccaa

SEQ ID NO: 560898 - DNA, 25 bp, Rattus norvegicus
taggcggtgcagaacggccttacca

SEQ ID NO: 560899 - DNA, 25 bp, Rattus norvegicus
taggcggtgcagtacggccttacca

SEQ ID NO: 560900 - DNA, 25 bp, Rattus norvegicus
taggcggttcctcataggttcttaa

SEQ ID NO: 560901 - DNA, 25 bp, Rattus norvegicus
taggcggttcctgataggttcttaa

SEQ ID NO: 560902 - DNA, 25 bp, Rattus norvegicus
taggcgtaagccaccacatttcatt

SEQ ID NO: 560903 - DNA, 25 bp, Rattus norvegicus
taggcgtaagcctccacatttcatt

SEQ ID NO: 560904 - DNA, 25 bp, Rattus norvegicus
taggcgtcagtaatatttgctctct

SEQ ID NO: 560905 - DNA, 25 bp, Rattus norvegicus
taggcgtcagtattatttgctctct

SEQ ID NO: 560906 - DNA, 25 bp, Rattus norvegicus
taggcgtcctgaaatgttgcctgca

SEQ ID NO: 560907 - DNA, 25 bp, Rattus norvegicus
taggcgtcctgatatgttgcctgca

SEQ ID NO: 560908 - DNA, 25 bp, Rattus norvegicus
taggcgtcttcgcatatcttctcac

SEQ ID NO: 560909 - DNA, 25 bp, Rattus norvegicus
taggcgtcttcggatatcttctcac

SEQ ID NO: 560910 - DNA, 25 bp, Rattus norvegicus
taggcgtctttcctctctgtgctga

SEQ ID NO: 560911 - DNA, 25 bp, Rattus norvegicus
taggcgtctttcgtctctgtgctga

SEQ ID NO: 560912 - DNA, 25 bp, Rattus norvegicus
taggcgttctttctggccatgacaa

SEQ ID NO: 560913 - DNA, 25 bp, Rattus norvegicus
taggcgttctttgtggccatgacaa

SEQ ID NO: 560914 - DNA, 25 bp, Rattus norvegicus
taggctaagaacctaactcccactc

SEQ ID NO: 560915 - DNA, 25 bp, Rattus norvegicus
taggctaagaacgtaactcccactc

SEQ ID NO: 560916 - DNA, 25 bp, Rattus norvegicus
taggctaatcgtactgtgcatcgaa

SEQ ID NO: 560917 - DNA, 25 bp, Rattus norvegicus
taggctaatcgttctgtgcatcgaa

SEQ ID NO: 560918 - DNA, 25 bp, Rattus norvegicus
taggctaattacaatcagtcccgat

SEQ ID NO: 560919 - DNA, 25 bp, Rattus norvegicus
taggctaattactatcagtcccgat

SEQ ID NO: 560920 - DNA, 25 bp, Rattus norvegicus
taggctacaaggatttgccctccat

SEQ ID NO: 560921 - DNA, 25 bp, Rattus norvegicus
taggctacaaggttttgccctccat

SEQ ID NO: 560922 - DNA, 25 bp, Rattus norvegicus
taggctacacgacactgttccaaat

SEQ ID NO: 560923 - DNA, 25 bp, Rattus norvegicus
taggctacacgagactgttccaaat

SEQ ID NO: 560924 - DNA, 25 bp, Rattus norvegicus
taggctacacttctcctttatccgt

SEQ ID NO: 560925 - DNA, 25 bp, Rattus norvegicus
taggctacacttgtcctttatccgt

SEQ ID NO: 560926 - DNA, 25 bp, Rattus norvegicus
taggctaccattcagtatactgtaa

SEQ ID NO: 560927 - DNA, 25 bp, Rattus norvegicus
taggctaccattgagtatactgtaa

SEQ ID NO: 560928 - DNA, 25 bp, Rattus norvegicus
taggctactacaaaccctgtccagt

SEQ ID NO: 560929 - DNA, 25 bp, Rattus norvegicus
taggctactacataccctgtccagt

SEQ ID NO: 560930 - DNA, 25 bp, Rattus norvegicus
taggctagacttagggcccagtgat

SEQ ID NO: 560931 - DNA, 25 bp, Rattus norvegicus
taggctagactttgggcccagtgat

SEQ ID NO: 560932 - DNA, 25 bp, Rattus norvegicus
taggctagagcgagcctgtcatcat

SEQ ID NO: 560933 - DNA, 25 bp, Rattus norvegicus
taggctagagcgtgcctgtcatcat

SEQ ID NO: 560934 - DNA, 25 bp, Rattus norvegicus
taggctagagctagagtcccatgtc

SEQ ID NO: 560935 - DNA, 25 bp, Rattus norvegicus
taggctagagcttgagtcccatgtc

SEQ ID NO: 560936 - DNA, 25 bp, Rattus norvegicus
taggctatatatcagaccccgtctc

SEQ ID NO: 560937 - DNA, 25 bp, Rattus norvegicus
taggctatatatgagaccccgtctc

SEQ ID NO: 560938 - DNA, 25 bp, Rattus norvegicus
taggctatcctacgtacagaggtag

SEQ ID NO: 560939 - DNA, 25 bp, Rattus norvegicus
taggctatcctaggtacagaggtag

SEQ ID NO: 560940 - DNA, 25 bp, Rattus norvegicus
taggctatcttaactctctcatcaa

SEQ ID NO: 560941 - DNA, 25 bp, Rattus norvegicus
taggctatcttatctctctcatcaa

SEQ ID NO: 560942 - DNA, 25 bp, Rattus norvegicus
taggctatgatgcaaagtacactct

SEQ ID NO: 560943 - DNA, 25 bp, Rattus norvegicus
taggctatgatggaaagtacactct

SEQ ID NO: 560944 - DNA, 25 bp, Rattus norvegicus
taggctatggacctcatgtgcatat

SEQ ID NO: 560945 - DNA, 25 bp, Rattus norvegicus
taggctatggacgtcatgtgcatat

SEQ ID NO: 560946 - DNA, 25 bp, Rattus norvegicus
taggctattgtgaggctctgactgg

SEQ ID NO: 560947 - DNA, 25 bp, Rattus norvegicus
taggctattgtgtggctctgactgg

SEQ ID NO: 560948 - DNA, 25 bp, Rattus norvegicus
taggctcaaggcaccaagctcacag

SEQ ID NO: 560949 - DNA, 25 bp, Rattus norvegicus
taggctcaaggctccaagctcacag

SEQ ID NO: 560950 - DNA, 25 bp, Rattus norvegicus
taggctcacagtagtccacagtggc

SEQ ID NO: 560951 - DNA, 25 bp, Rattus norvegicus
taggctcacagttgtccacagtggc

SEQ ID NO: 560952 - DNA, 25 bp, Rattus norvegicus
taggctcacatcatctctgggtgga

SEQ ID NO: 560953 - DNA, 25 bp, Rattus norvegicus
taggctcacatcttctctgggtgga

SEQ ID NO: 560954 - DNA, 25 bp, Rattus norvegicus
taggctcacctgatgggagattttt

SEQ ID NO: 560955 - DNA, 25 bp, Rattus norvegicus
taggctcacctgttgggagattttt

SEQ ID NO: 560956 - DNA, 25 bp, Rattus norvegicus
taggctcagaacacaaacccacaga

SEQ ID NO: 560957 - DNA, 25 bp, Rattus norvegicus
taggctcagaactcaaacccacaga

SEQ ID NO: 560958 - DNA, 25 bp, Rattus norvegicus
taggctcagaccagaggctctgact

SEQ ID NO: 560959 - DNA, 25 bp, Rattus norvegicus
taggctcagacctgaggctctgact

SEQ ID NO: 560960 - DNA, 25 bp, Rattus norvegicus
taggctcagaggaaaccctggtcac

SEQ ID NO: 560961 - DNA, 25 bp, Rattus norvegicus
taggctcagaggtaaccctggtcac

SEQ ID NO: 560962 - DNA, 25 bp, Rattus norvegicus
taggctcagatgctcagtcacggaa

SEQ ID NO: 560963 - DNA, 25 bp, Rattus norvegicus
taggctcagatggtcagtcacggaa

SEQ ID NO: 560964 - DNA, 25 bp, Rattus norvegicus
taggctcagccactggttcagctcc

SEQ ID NO: 560965 - DNA, 25 bp, Rattus norvegicus
taggctcagccagtggttcagctcc

SEQ ID NO: 560966 - DNA, 25 bp, Rattus norvegicus
taggctcaggctacccgcagggaga

SEQ ID NO: 560967 - DNA, 25 bp, Rattus norvegicus
taggctcaggcttcccgcagggaga

SEQ ID NO: 560968 - DNA, 25 bp, Rattus norvegicus
taggctcagggaaacttcaggtttt

SEQ ID NO: 560969 - DNA, 25 bp, Rattus norvegicus
taggctcagggatacttcaggtttt

SEQ ID NO: 560970 - DNA, 25 bp, Rattus norvegicus
taggctcagtggattgagaccctgt

SEQ ID NO: 560971 - DNA, 25 bp, Rattus norvegicus
taggctcagtggtttgagaccctgt

SEQ ID NO: 560972 - DNA, 25 bp, Rattus norvegicus
taggctcatgcaccacagactaatt

SEQ ID NO: 560973 - DNA, 25 bp, Rattus norvegicus
taggctcatgcagcacagactaatt

SEQ ID NO: 560974 - DNA, 25 bp, Rattus norvegicus
taggctccacaaagagacccttttg

SEQ ID NO: 560975 - DNA, 25 bp, Rattus norvegicus
taggctccacaatgagacccttttg

SEQ ID NO: 560976 - DNA, 25 bp, Rattus norvegicus
taggctccagatcggttccagggaa

SEQ ID NO: 560977 - DNA, 25 bp, Rattus norvegicus
taggctccagatgggttccagggaa

SEQ ID NO: 560978 - DNA, 25 bp, Rattus norvegicus
taggctccccagatgttctatttaa

SEQ ID NO: 560979 - DNA, 25 bp, Rattus norvegicus
taggctccccagttgttctatttaa

SEQ ID NO: 560980 - DNA, 25 bp, Rattus norvegicus
taggctcccgtgaagatagtcgctc

SEQ ID NO: 560981 - DNA, 25 bp, Rattus norvegicus
taggctcccgtgtagatagtcgctc

SEQ ID NO: 560982 - DNA, 25 bp, Rattus norvegicus
taggctccctacacatttgtggcag

SEQ ID NO: 560983 - DNA, 25 bp, Rattus norvegicus
taggctccctactcatttgtggcag

SEQ ID NO: 560984 - DNA, 25 bp, Rattus norvegicus
taggctccgcctcacttttgtcatc

SEQ ID NO: 560985 - DNA, 25 bp, Rattus norvegicus
taggctccgcctgacttttgtcatc

SEQ ID NO: 560986 - DNA, 25 bp, Rattus norvegicus
taggctccgggtattactgcagcaa

SEQ ID NO: 560987 - DNA, 25 bp, Rattus norvegicus
taggctccgggttttactgcagcaa

SEQ ID NO: 560988 - DNA, 25 bp, Rattus norvegicus
taggctcctcagatgaaccacttta

SEQ ID NO: 560989 - DNA, 25 bp, Rattus norvegicus
taggctcctcagttgaaccacttta

SEQ ID NO: 560990 - DNA, 25 bp, Rattus norvegicus
taggctcctgacacgtcacatgaat

SEQ ID NO: 560991 - DNA, 25 bp, Rattus norvegicus
taggctcctgactcgtcacatgaat

SEQ ID NO: 560992 - DNA, 25 bp, Rattus norvegicus
taggctcctgagaccaaggtcatct

SEQ ID NO: 560993 - DNA, 25 bp, Rattus norvegicus
taggctcctgagtccaaggtcatct

SEQ ID NO: 560994 - DNA, 25 bp, Rattus norvegicus
taggctcctggtcaagctgccatac

SEQ ID NO: 560995 - DNA, 25 bp, Rattus norvegicus
taggctcctggtgaagctgccatac

SEQ ID NO: 560996 - DNA, 25 bp, Rattus norvegicus
taggctcgacccagaacaaccattg

SEQ ID NO: 560997 - DNA, 25 bp, Rattus norvegicus
taggctcgaccctgaacaaccattg

SEQ ID NO: 560998 - DNA, 25 bp, Rattus norvegicus
taggctcgcgggaacacagaagcgc

SEQ ID NO: 560999 - DNA, 25 bp, Rattus norvegicus
taggctcgcgggtacacagaagcgc

SEQ ID NO: 561000 - DNA, 25 bp, Rattus norvegicus
taggctctaaatcaatgtccccata

SEQ ID NO: 561001 - DNA, 25 bp, Rattus norvegicus
taggctctaaatgaatgtccccata

SEQ ID NO: 561002 - DNA, 25 bp, Rattus norvegicus
taggctctaagtcgtcccctgctag

SEQ ID NO: 561003 - DNA, 25 bp, Rattus norvegicus
taggctctaagtggtcccctgctag

SEQ ID NO: 561004 - DNA, 25 bp, Rattus norvegicus
taggctctaggcacggaagctttac

SEQ ID NO: 561005 - DNA, 25 bp, Rattus norvegicus
taggctctaggctcggaagctttac

SEQ ID NO: 561006 - DNA, 25 bp, Rattus norvegicus
taggctctagtaccctaactcagcg

SEQ ID NO: 561007 - DNA, 25 bp, Rattus norvegicus
taggctctagtagcctaactcagcg

SEQ ID NO: 561008 - DNA, 25 bp, Rattus norvegicus
taggctctagttaccagcagagact

SEQ ID NO: 561009 - DNA, 25 bp, Rattus norvegicus
taggctctagttactgttactccac

SEQ ID NO: 561010 - DNA, 25 bp, Rattus norvegicus
taggctctagtttccagcagagact

SEQ ID NO: 561011 - DNA, 25 bp, Rattus norvegicus
taggctctagtttctgttactccac

SEQ ID NO: 561012 - DNA, 25 bp, Rattus norvegicus
taggctctcacacggcattctaaaa

SEQ ID NO: 561013 - DNA, 25 bp, Rattus norvegicus
taggctctcacagggcattctaaaa

SEQ ID NO: 561014 - DNA, 25 bp, Rattus norvegicus
taggctctccacattctggcgggaa

SEQ ID NO: 561015 - DNA, 25 bp, Rattus norvegicus
taggctctccactttctggcgggaa

SEQ ID NO: 561016 - DNA, 25 bp, Rattus norvegicus
taggctctgagaaagctgtccacgc

SEQ ID NO: 561017 - DNA, 25 bp, Rattus norvegicus
taggctctgagatagctgtccacgc

SEQ ID NO: 561018 - DNA, 25 bp, Rattus norvegicus
taggctcttaacaccttcagtacac

SEQ ID NO: 561019 - DNA, 25 bp, Rattus norvegicus
taggctcttaactccttcagtacac

SEQ ID NO: 561020 - DNA, 25 bp, Rattus norvegicus
taggctcttcctcgtggctgggtaa

SEQ ID NO: 561021 - DNA, 25 bp, Rattus norvegicus
taggctcttcctggtggctgggtaa

SEQ ID NO: 561022 - DNA, 25 bp, Rattus norvegicus
taggctgaaagaacttccttgattc

SEQ ID NO: 561023 - DNA, 25 bp, Rattus norvegicus
taggctgaaagatcttccttgattc

SEQ ID NO: 561024 - DNA, 25 bp, Rattus norvegicus
taggctgacagaagcaggcaggccc

SEQ ID NO: 561025 - DNA, 25 bp, Rattus norvegicus
taggctgacagatgcaggcaggccc

SEQ ID NO: 561026 - DNA, 25 bp, Rattus norvegicus
taggctgacagcattgcgaattaaa

SEQ ID NO: 561027 - DNA, 25 bp, Rattus norvegicus
taggctgacagctttgcgaattaaa

SEQ ID NO: 561028 - DNA, 25 bp, Rattus norvegicus
taggctgaccccactagaagaggag

SEQ ID NO: 561029 - DNA, 25 bp, Rattus norvegicus
taggctgacccctctagaagaggag

SEQ ID NO: 561030 - DNA, 25 bp, Rattus norvegicus
taggctgacgttacaggctgaccaa

SEQ ID NO: 561031 - DNA, 25 bp, Rattus norvegicus
taggctgacgtttcaggctgaccaa

SEQ ID NO: 561032 - DNA, 25 bp, Rattus norvegicus
taggctgactgacctgcgacccaga

SEQ ID NO: 561033 - DNA, 25 bp, Rattus norvegicus
taggctgactgagctgcgacccaga

SEQ ID NO: 561034 - DNA, 25 bp, Rattus norvegicus
taggctgagcacaggctggctcttg

SEQ ID NO: 561035 - DNA, 25 bp, Rattus norvegicus
taggctgagcactggctggctcttg

SEQ ID NO: 561036 - DNA, 25 bp, Rattus norvegicus
taggctgagcctcacttgcctttac

SEQ ID NO: 561037 - DNA, 25 bp, Rattus norvegicus
taggctgagcctgacttgcctttac

SEQ ID NO: 561038 - DNA, 25 bp, Rattus norvegicus
taggctgagcgtaaccggaggacac

SEQ ID NO: 561039 - DNA, 25 bp, Rattus norvegicus
taggctgagcgttaccggaggacac

SEQ ID NO: 561040 - DNA, 25 bp, Rattus norvegicus
taggctgaggttagacctgtcctcc

SEQ ID NO: 561041 - DNA, 25 bp, Rattus norvegicus
taggctgaggtttgacctgtcctcc

SEQ ID NO: 561042 - DNA, 25 bp, Rattus norvegicus
taggctgatggaagctgtttgtgtc

SEQ ID NO: 561043 - DNA, 25 bp, Rattus norvegicus
taggctgatggatgctgtttgtgtc

SEQ ID NO: 561044 - DNA, 25 bp, Rattus norvegicus
taggctgcaacacgagtcactccaa

SEQ ID NO: 561045 - DNA, 25 bp, Rattus norvegicus
taggctgcaacaggagtcactccaa

SEQ ID NO: 561046 - DNA, 25 bp, Rattus norvegicus
taggctgcaggtccagactattgcc

SEQ ID NO: 561047 - DNA, 25 bp, Rattus norvegicus
taggctgcaggtgcagactattgcc

SEQ ID NO: 561048 - DNA, 25 bp, Rattus norvegicus
taggctgcagtgagaacccttggat

SEQ ID NO: 561049 - DNA, 25 bp, Rattus norvegicus
taggctgcagtgtgaacccttggat

SEQ ID NO: 561050 - DNA, 25 bp, Rattus norvegicus
taggctgccccactggtatgctgca

SEQ ID NO: 561051 - DNA, 25 bp, Rattus norvegicus
taggctgccccagtggtatgctgca

SEQ ID NO: 561052 - DNA, 25 bp, Rattus norvegicus
taggctgccgatacagtgtggacct

SEQ ID NO: 561053 - DNA, 25 bp, Rattus norvegicus
taggctgccgattcagtgtggacct

SEQ ID NO: 561054 - DNA, 25 bp, Rattus norvegicus
taggctgccgccctttgtttccggg

SEQ ID NO: 561055 - DNA, 25 bp, Rattus norvegicus
taggctgccgccgtttgtttccggg

SEQ ID NO: 561056 - DNA, 25 bp, Rattus norvegicus
taggctgccgctacacagtgtagac

SEQ ID NO: 561057 - DNA, 25 bp, Rattus norvegicus
taggctgccgcttcacagtgtagac

SEQ ID NO: 561058 - DNA, 25 bp, Rattus norvegicus
taggctgcctcgcttcagcagtggt

SEQ ID NO: 561059 - DNA, 25 bp, Rattus norvegicus
taggctgcctcggttcagcagtggt

SEQ ID NO: 561060 - DNA, 25 bp, Rattus norvegicus
taggctgctcacaagcacacgtaac

SEQ ID NO: 561061 - DNA, 25 bp, Rattus norvegicus
taggctgctcactagcacacgtaac

SEQ ID NO: 561062 - DNA, 25 bp, Rattus norvegicus
taggctgctctcaagactgatctta

SEQ ID NO: 561063 - DNA, 25 bp, Rattus norvegicus
taggctgctctctagactgatctta

SEQ ID NO: 561064 - DNA, 25 bp, Rattus norvegicus
taggctgcttggaacttagtatgta

SEQ ID NO: 561065 - DNA, 25 bp, Rattus norvegicus
taggctgcttggtacttagtatgta

SEQ ID NO: 561066 - DNA, 25 bp, Rattus norvegicus
taggctggagccagactatagctgg

SEQ ID NO: 561067 - DNA, 25 bp, Rattus norvegicus
taggctggagcctgactatagctgg

SEQ ID NO: 561068 - DNA, 25 bp, Rattus norvegicus
taggctggcaccaggtgcctgttga

SEQ ID NO: 561069 - DNA, 25 bp, Rattus norvegicus
taggctggcacctggtgcctgttga

SEQ ID NO: 561070 - DNA, 25 bp, Rattus norvegicus
taggctggccggaccacccagtgct

SEQ ID NO: 561071 - DNA, 25 bp, Rattus norvegicus
taggctggccggtccacccagtgct

SEQ ID NO: 561072 - DNA, 25 bp, Rattus norvegicus
taggctggcctacttggttagaccc

SEQ ID NO: 561073 - DNA, 25 bp, Rattus norvegicus
taggctggcctagttggttagaccc

SEQ ID NO: 561074 - DNA, 25 bp, Rattus norvegicus
taggctggctcaacacttactctta

SEQ ID NO: 561075 - DNA, 25 bp, Rattus norvegicus
taggctggctcatcacttactctta

SEQ ID NO: 561076 - DNA, 25 bp, Rattus norvegicus
taggctggtagcaagacagctttcc

SEQ ID NO: 561077 - DNA, 25 bp, Rattus norvegicus
taggctggtagctagacagctttcc

SEQ ID NO: 561078 - DNA, 25 bp, Rattus norvegicus
taggctgtagtacatcacactgcag

SEQ ID NO: 561079 - DNA, 25 bp, Rattus norvegicus
taggctgtagtagatcacactgcag

SEQ ID NO: 561080 - DNA, 25 bp, Rattus norvegicus
taggctgtcattctgaggccaccag

SEQ ID NO: 561081 - DNA, 25 bp, Rattus norvegicus
taggctgtcattgtgaggccaccag

SEQ ID NO: 561082 - DNA, 25 bp, Rattus norvegicus
taggctgtcccgcttactctttgac

SEQ ID NO: 561083 - DNA, 25 bp, Rattus norvegicus
taggctgtcccggttactctttgac

SEQ ID NO: 561084 - DNA, 25 bp, Rattus norvegicus
taggctgtccttacctgtttgatta

SEQ ID NO: 561085 - DNA, 25 bp, Rattus norvegicus
taggctgtcctttcctgtttgatta

SEQ ID NO: 561086 - DNA, 25 bp, Rattus norvegicus
taggctgtgagtcgtgcccattcgc

SEQ ID NO: 561087 - DNA, 25 bp, Rattus norvegicus
taggctgtgagtggtgcccattcgc

SEQ ID NO: 561088 - DNA, 25 bp, Rattus norvegicus
taggctgtgggaaccccgaactaaa

SEQ ID NO: 561089 - DNA, 25 bp, Rattus norvegicus
taggctgtgggatccccgaactaaa

SEQ ID NO: 561090 - DNA, 25 bp, Rattus norvegicus
taggctgtggttacagtctctgcta

SEQ ID NO: 561091 - DNA, 25 bp, Rattus norvegicus
taggctgtggtttcagtctctgcta

SEQ ID NO: 561092 - DNA, 25 bp, Rattus norvegicus
taggcttaagtacctctttcgcttt

SEQ ID NO: 561093 - DNA, 25 bp, Rattus norvegicus
taggcttaagtagctctttcgcttt

SEQ ID NO: 561094 - DNA, 25 bp, Rattus norvegicus
taggcttaccctcgcgctaaaaggg

SEQ ID NO: 561095 - DNA, 25 bp, Rattus norvegicus
taggcttaccctggcgctaaaaggg

SEQ ID NO: 561096 - DNA, 25 bp, Rattus norvegicus
taggcttattaaattctcctggaag

SEQ ID NO: 561097 - DNA, 25 bp, Rattus norvegicus
taggcttattaatttctcctggaag

SEQ ID NO: 561098 - DNA, 25 bp, Rattus norvegicus
taggcttcaaccctgttccattctg

SEQ ID NO: 561099 - DNA, 25 bp, Rattus norvegicus
taggcttcaaccgtgttccattctg

SEQ ID NO: 561100 - DNA, 25 bp, Rattus norvegicus
taggcttcacaaaacctggaacttt

SEQ ID NO: 561101 - DNA, 25 bp, Rattus norvegicus
taggcttcacaatacctggaacttt

SEQ ID NO: 561102 - DNA, 25 bp, Rattus norvegicus
taggcttcagccacagaaatccatc

SEQ ID NO: 561103 - DNA, 25 bp, Rattus norvegicus
taggcttcagcctcagaaatccatc

SEQ ID NO: 561104 - DNA, 25 bp, Rattus norvegicus
taggcttcatgcagggcctgtccca

SEQ ID NO: 561105 - DNA, 25 bp, Rattus norvegicus
taggcttcatgctgggcctgtccca

SEQ ID NO: 561106 - DNA, 25 bp, Rattus norvegicus
taggcttcatttctttgtctttttc

SEQ ID NO: 561107 - DNA, 25 bp, Rattus norvegicus
taggcttcatttgtttgtctttttc

SEQ ID NO: 561108 - DNA, 25 bp, Rattus norvegicus
taggcttcccaccaagtgttttgat

SEQ ID NO: 561109 - DNA, 25 bp, Rattus norvegicus
taggcttcccacgaagtgttttgat

SEQ ID NO: 561110 - DNA, 25 bp, Rattus norvegicus
taggcttccctcaagaaaggcccaa

SEQ ID NO: 561111 - DNA, 25 bp, Rattus norvegicus
taggcttccctctagaaaggcccaa

SEQ ID NO: 561112 - DNA, 25 bp, Rattus norvegicus
taggcttccggcagtagtttacata

SEQ ID NO: 561113 - DNA, 25 bp, Rattus norvegicus
taggcttccggctgtagtttacata

SEQ ID NO: 561114 - DNA, 25 bp, Rattus norvegicus
taggcttccgtcatgtacagcaatg

SEQ ID NO: 561115 - DNA, 25 bp, Rattus norvegicus
taggcttccgtcttgtacagcaatg

SEQ ID NO: 561116 - DNA, 25 bp, Rattus norvegicus
taggcttcctggctttcataggcaa

SEQ ID NO: 561117 - DNA, 25 bp, Rattus norvegicus
taggcttcctgggtttcataggcaa

SEQ ID NO: 561118 - DNA, 25 bp, Rattus norvegicus
taggcttctcacctgcagatgctca

SEQ ID NO: 561119 - DNA, 25 bp, Rattus norvegicus
taggcttctcacgtgcagatgctca

SEQ ID NO: 561120 - DNA, 25 bp, Rattus norvegicus
taggcttctcagctctataactgga

SEQ ID NO: 561121 - DNA, 25 bp, Rattus norvegicus
taggcttctcaggtctataactgga

SEQ ID NO: 561122 - DNA, 25 bp, Rattus norvegicus
taggcttgaagacggaaaggctcca

SEQ ID NO: 561123 - DNA, 25 bp, Rattus norvegicus
taggcttgaagagggaaaggctcca

SEQ ID NO: 561124 - DNA, 25 bp, Rattus norvegicus
taggcttgcccgctagtgccacagc

SEQ ID NO: 561125 - DNA, 25 bp, Rattus norvegicus
taggcttgcccggtagtgccacagc

SEQ ID NO: 561126 - DNA, 25 bp, Rattus norvegicus
taggcttgctttatcttggtacaga

SEQ ID NO: 561127 - DNA, 25 bp, Rattus norvegicus
taggcttgctttttcttggtacaga

SEQ ID NO: 561128 - DNA, 25 bp, Rattus norvegicus
taggcttggcaactgtgagatctcc

SEQ ID NO: 561129 - DNA, 25 bp, Rattus norvegicus
taggcttggcaagtgtgagatctcc

SEQ ID NO: 561130 - DNA, 25 bp, Rattus norvegicus
taggcttgggacacttctgtttaga

SEQ ID NO: 561131 - DNA, 25 bp, Rattus norvegicus
taggcttgggactcttctgtttaga

SEQ ID NO: 561132 - DNA, 25 bp, Rattus norvegicus
taggcttgggtcaggaatgccacct

SEQ ID NO: 561133 - DNA, 25 bp, Rattus norvegicus
taggcttgggtctggaatgccacct

SEQ ID NO: 561134 - DNA, 25 bp, Rattus norvegicus
taggcttgtgctagtcagaaagaag

SEQ ID NO: 561135 - DNA, 25 bp, Rattus norvegicus
taggcttgtgcttgtcagaaagaag

SEQ ID NO: 561136 - DNA, 25 bp, Rattus norvegicus
taggctttaaacaggacaccctcag

SEQ ID NO: 561137 - DNA, 25 bp, Rattus norvegicus
taggctttaaactggacaccctcag

SEQ ID NO: 561138 - DNA, 25 bp, Rattus norvegicus
taggctttagccatcgtcacttaaa

SEQ ID NO: 561139 - DNA, 25 bp, Rattus norvegicus
taggctttagccttcgtcacttaaa

SEQ ID NO: 561140 - DNA, 25 bp, Rattus norvegicus
taggctttagtacggtctcctggct

SEQ ID NO: 561141 - DNA, 25 bp, Rattus norvegicus
taggctttagtagggtctcctggct

SEQ ID NO: 561142 - DNA, 25 bp, Rattus norvegicus
taggctttatggcagaggtttgcac

SEQ ID NO: 561143 - DNA, 25 bp, Rattus norvegicus
taggctttatgggagaggtttgcac

SEQ ID NO: 561144 - DNA, 25 bp, Rattus norvegicus
taggctttattgattattgctggtt

SEQ ID NO: 561145 - DNA, 25 bp, Rattus norvegicus
taggctttattgtttattgctggtt

SEQ ID NO: 561146 - DNA, 25 bp, Rattus norvegicus
taggctttcagcatcaggcagcttc

SEQ ID NO: 561147 - DNA, 25 bp, Rattus norvegicus
taggctttcagcttcaggcagcttc

SEQ ID NO: 561148 - DNA, 25 bp, Rattus norvegicus
taggctttccctcgatgttcaggtt

SEQ ID NO: 561149 - DNA, 25 bp, Rattus norvegicus
taggctttccctggatgttcaggtt

SEQ ID NO: 561150 - DNA, 25 bp, Rattus norvegicus
taggctttcctactgctagtatgga

SEQ ID NO: 561151 - DNA, 25 bp, Rattus norvegicus
taggctttcctagtgctagtatgga

SEQ ID NO: 561152 - DNA, 25 bp, Rattus norvegicus
taggctttgaacatagtcccatctc

SEQ ID NO: 561153 - DNA, 25 bp, Rattus norvegicus
taggctttgaacttagtcccatctc

SEQ ID NO: 561154 - DNA, 25 bp, Rattus norvegicus
taggctttgagtaacactgctgagt

SEQ ID NO: 561155 - DNA, 25 bp, Rattus norvegicus
taggctttgagttacactgctgagt

SEQ ID NO: 561156 - DNA, 25 bp, Rattus norvegicus
taggctttgccgactttgaggacat

SEQ ID NO: 561157 - DNA, 25 bp, Rattus norvegicus
taggctttgccgtctttgaggacat

SEQ ID NO: 561158 - DNA, 25 bp, Rattus norvegicus
taggctttggctcggaacagcagct

SEQ ID NO: 561159 - DNA, 25 bp, Rattus norvegicus
taggctttggctgggaacagcagct

SEQ ID NO: 561160 - DNA, 25 bp, Rattus norvegicus
taggctttggttcttgttgttcgca

SEQ ID NO: 561161 - DNA, 25 bp, Rattus norvegicus
taggctttggttgttgttgttcgca

SEQ ID NO: 561162 - DNA, 25 bp, Rattus norvegicus
taggcttttcagacgtggatcacac

SEQ ID NO: 561163 - DNA, 25 bp, Rattus norvegicus
taggcttttcagtcgtggatcacac

SEQ ID NO: 561164 - DNA, 25 bp, Rattus norvegicus
taggcttttcctcttggatctgtgt

SEQ ID NO: 561165 - DNA, 25 bp, Rattus norvegicus
taggcttttcctgttggatctgtgt

SEQ ID NO: 561166 - DNA, 25 bp, Rattus norvegicus
tagggaaacagccatgctactcggg

SEQ ID NO: 561167 - DNA, 25 bp, Rattus norvegicus
tagggaaacagcgatgctactcggg

SEQ ID NO: 561168 - DNA, 25 bp, Rattus norvegicus
tagggaaactggactttgcctccca

SEQ ID NO: 561169 - DNA, 25 bp, Rattus norvegicus
tagggaaactggtctttgcctccca

SEQ ID NO: 561170 - DNA, 25 bp, Rattus norvegicus
tagggaaagacaacctgagcctctt

SEQ ID NO: 561171 - DNA, 25 bp, Rattus norvegicus
tagggaaagacatcctgagcctctt

SEQ ID NO: 561172 - DNA, 25 bp, Rattus norvegicus
tagggaaataacagagggcaagctt

SEQ ID NO: 561173 - DNA, 25 bp, Rattus norvegicus
tagggaaataactgagggcaagctt

SEQ ID NO: 561174 - DNA, 25 bp, Rattus norvegicus
tagggaaattaaactgtgggccatg

SEQ ID NO: 561175 - DNA, 25 bp, Rattus norvegicus
tagggaaattaatctgtgggccatg

SEQ ID NO: 561176 - DNA, 25 bp, Rattus norvegicus
tagggaaattctcggctcgcgtcaa

SEQ ID NO: 561177 - DNA, 25 bp, Rattus norvegicus
tagggaaattctgggctcgcgtcaa

SEQ ID NO: 561178 - DNA, 25 bp, Rattus norvegicus
tagggaacagaaacaccaccaccgt

SEQ ID NO: 561179 - DNA, 25 bp, Rattus norvegicus
tagggaacagaatcaccaccaccgt

SEQ ID NO: 561180 - DNA, 25 bp, Rattus norvegicus
tagggaacatccatcacaagccagg

SEQ ID NO: 561181 - DNA, 25 bp, Rattus norvegicus
tagggaacatccttcacaagccagg

SEQ ID NO: 561182 - DNA, 25 bp, Rattus norvegicus
tagggaaccacgatcagcctgtata

SEQ ID NO: 561183 - DNA, 25 bp, Rattus norvegicus
tagggaaccacgttcagcctgtata

SEQ ID NO: 561184 - DNA, 25 bp, Rattus norvegicus
tagggaacccatattgttagcgcgg

SEQ ID NO: 561185 - DNA, 25 bp, Rattus norvegicus
tagggaacccattttgttagcgcgg

SEQ ID NO: 561186 - DNA, 25 bp, Rattus norvegicus
tagggaaccccaactgtgacggcca

SEQ ID NO: 561187 - DNA, 25 bp, Rattus norvegicus
tagggaaccccatctgtgacggcca

SEQ ID NO: 561188 - DNA, 25 bp, Rattus norvegicus
tagggaaccctgattgctggcgaca

SEQ ID NO: 561189 - DNA, 25 bp, Rattus norvegicus
tagggaaccctgtttgctggcgaca

SEQ ID NO: 561190 - DNA, 25 bp, Rattus norvegicus
tagggaacctagcactacctgcatc

SEQ ID NO: 561191 - DNA, 25 bp, Rattus norvegicus
tagggaacctaggactacctgcatc

SEQ ID NO: 561192 - DNA, 25 bp, Rattus norvegicus
tagggaacctgaactgcctggtgag

SEQ ID NO: 561193 - DNA, 25 bp, Rattus norvegicus
tagggaacctgatctgcctggtgag

SEQ ID NO: 561194 - DNA, 25 bp, Rattus norvegicus
tagggaaccttcagccctggatgca

SEQ ID NO: 561195 - DNA, 25 bp, Rattus norvegicus
tagggaaccttctgccctggatgca

SEQ ID NO: 561196 - DNA, 25 bp, Rattus norvegicus
tagggaacttaacccaccctgtgtg

SEQ ID NO: 561197 - DNA, 25 bp, Rattus norvegicus
tagggaacttaagccaccctgtgtg

SEQ ID NO: 561198 - DNA, 25 bp, Rattus norvegicus
tagggaagacctaggccacacttga

SEQ ID NO: 561199 - DNA, 25 bp, Rattus norvegicus
tagggaagaccttggccacacttga

SEQ ID NO: 561200 - DNA, 25 bp, Rattus norvegicus
tagggaagactcaaccgtccttggg

SEQ ID NO: 561201 - DNA, 25 bp, Rattus norvegicus
tagggaagactctaccgtccttggg

SEQ ID NO: 561202 - DNA, 25 bp, Rattus norvegicus
tagggaaggaggacagcgtggacct

SEQ ID NO: 561203 - DNA, 25 bp, Rattus norvegicus
tagggaaggaggtcagcgtggacct

SEQ ID NO: 561204 - DNA, 25 bp, Rattus norvegicus
tagggaagtcagcttgccctcgcct

SEQ ID NO: 561205 - DNA, 25 bp, Rattus norvegicus
tagggaagtcaggttgccctcgcct

SEQ ID NO: 561206 - DNA, 25 bp, Rattus norvegicus
tagggaagtctgagcaactgagttc

SEQ ID NO: 561207 - DNA, 25 bp, Rattus norvegicus
tagggaagtctgtgcaactgagttc

SEQ ID NO: 561208 - DNA, 25 bp, Rattus norvegicus
tagggaagtgatccctcataccagg

SEQ ID NO: 561209 - DNA, 25 bp, Rattus norvegicus
tagggaagtgatgcctcataccagg

SEQ ID NO: 561210 - DNA, 25 bp, Rattus norvegicus
tagggaagtgccacttacccaagag

SEQ ID NO: 561211 - DNA, 25 bp, Rattus norvegicus
tagggaagtgcctcttacccaagag

SEQ ID NO: 561212 - DNA, 25 bp, Rattus norvegicus
tagggaagtggtcccttgttccagc

SEQ ID NO: 561213 - DNA, 25 bp, Rattus norvegicus
tagggaagtggtgccttgttccagc

SEQ ID NO: 561214 - DNA, 25 bp, Rattus norvegicus
tagggaatacctcatgccactgtca

SEQ ID NO: 561215 - DNA, 25 bp, Rattus norvegicus
tagggaatacctgatgccactgtca

SEQ ID NO: 561216 - DNA, 25 bp, Rattus norvegicus
tagggaatctccatttcttatgcgg

SEQ ID NO: 561217 - DNA, 25 bp, Rattus norvegicus
tagggaatctccttttcttatgcgg

SEQ ID NO: 561218 - DNA, 25 bp, Rattus norvegicus
tagggaatttcaagtggaattcctc

SEQ ID NO: 561219 - DNA, 25 bp, Rattus norvegicus
tagggaatttcatgtggaattcctc

SEQ ID NO: 561220 - DNA, 25 bp, Rattus norvegicus
tagggacaccctactcctgcttagg

SEQ ID NO: 561221 - DNA, 25 bp, Rattus norvegicus
tagggacacccttctcctgcttagg

SEQ ID NO: 561222 - DNA, 25 bp, Rattus norvegicus
tagggacatggtcttcacttcttgg

SEQ ID NO: 561223 - DNA, 25 bp, Rattus norvegicus
tagggacatggtgttcacttcttgg

SEQ ID NO: 561224 - DNA, 25 bp, Rattus norvegicus
tagggacatgttatgcttctcccca

SEQ ID NO: 561225 - DNA, 25 bp, Rattus norvegicus
tagggacatgttttgcttctcccca

SEQ ID NO: 561226 - DNA, 25 bp, Rattus norvegicus
tagggaccaccaaatgtgagttcac

SEQ ID NO: 561227 - DNA, 25 bp, Rattus norvegicus
tagggaccaccatatgtgagttcac

SEQ ID NO: 561228 - DNA, 25 bp, Rattus norvegicus
tagggaccacccatgagtatagttg

SEQ ID NO: 561229 - DNA, 25 bp, Rattus norvegicus
tagggaccacccttgagtatagttg

SEQ ID NO: 561230 - DNA, 25 bp, Rattus norvegicus
tagggaccacttcgagggagccatt

SEQ ID NO: 561231 - DNA, 25 bp, Rattus norvegicus
tagggaccacttggagggagccatt

SEQ ID NO: 561232 - DNA, 25 bp, Rattus norvegicus
tagggaccatgtctcctgtacttac

SEQ ID NO: 561233 - DNA, 25 bp, Rattus norvegicus
tagggaccatgtgtcctgtacttac

SEQ ID NO: 561234 - DNA, 25 bp, Rattus norvegicus
tagggacccgttctatgacatgctg

SEQ ID NO: 561235 - DNA, 25 bp, Rattus norvegicus
tagggacccgttgtatgacatgctg

SEQ ID NO: 561236 - DNA, 25 bp, Rattus norvegicus
tagggaccgatgctttaccaccaaa

SEQ ID NO: 561237 - DNA, 25 bp, Rattus norvegicus
tagggaccgatggtttaccaccaaa

SEQ ID NO: 561238 - DNA, 25 bp, Rattus norvegicus
tagggaccgccacagccaatctgtc

SEQ ID NO: 561239 - DNA, 25 bp, Rattus norvegicus
tagggaccgccagagccaatctgtc

SEQ ID NO: 561240 - DNA, 25 bp, Rattus norvegicus
tagggacggagtcccatggttagat

SEQ ID NO: 561241 - DNA, 25 bp, Rattus norvegicus
tagggacggagtgccatggttagat

SEQ ID NO: 561242 - DNA, 25 bp, Rattus norvegicus
tagggactatttcctctctgtgttc

SEQ ID NO: 561243 - DNA, 25 bp, Rattus norvegicus
tagggactatttgctctctgtgttc

SEQ ID NO: 561244 - DNA, 25 bp, Rattus norvegicus
tagggactcggacattcagattttc

SEQ ID NO: 561245 - DNA, 25 bp, Rattus norvegicus
tagggactcggagattcagattttc

SEQ ID NO: 561246 - DNA, 25 bp, Rattus norvegicus
tagggactcttgctgctatgcttgc

SEQ ID NO: 561247 - DNA, 25 bp, Rattus norvegicus
tagggactcttggtgctatgcttgc

SEQ ID NO: 561248 - DNA, 25 bp, Rattus norvegicus
tagggactggctctctggacaagta

SEQ ID NO: 561249 - DNA, 25 bp, Rattus norvegicus
tagggactggctgtctggacaagta

SEQ ID NO: 561250 - DNA, 25 bp, Rattus norvegicus
tagggactgtcccttttttgtggct

SEQ ID NO: 561251 - DNA, 25 bp, Rattus norvegicus
tagggactgtccgttttttgtggct

SEQ ID NO: 561252 - DNA, 25 bp, Rattus norvegicus
tagggacttccacatcagtctcttc

SEQ ID NO: 561253 - DNA, 25 bp, Rattus norvegicus
tagggacttccagatcagtctcttc

SEQ ID NO: 561254 - DNA, 25 bp, Rattus norvegicus
tagggacttcttcatggctaccaat

SEQ ID NO: 561255 - DNA, 25 bp, Rattus norvegicus
tagggacttcttgatggctaccaat

SEQ ID NO: 561256 - DNA, 25 bp, Rattus norvegicus
tagggacttgaaagactgacccaag

SEQ ID NO: 561257 - DNA, 25 bp, Rattus norvegicus
tagggacttgaatgactgacccaag

SEQ ID NO: 561258 - DNA, 25 bp, Rattus norvegicus
tagggactttccagtcctacttagg

SEQ ID NO: 561259 - DNA, 25 bp, Rattus norvegicus
tagggactttcctgtcctacttagg

SEQ ID NO: 561260 - DNA, 25 bp, Rattus norvegicus
tagggacttttgatagctttttcaa

SEQ ID NO: 561261 - DNA, 25 bp, Rattus norvegicus
tagggacttttgttagctttttcaa

SEQ ID NO: 561262 - DNA, 25 bp, Rattus norvegicus
tagggagaaggcaccggactgccat

SEQ ID NO: 561263 - DNA, 25 bp, Rattus norvegicus
tagggagaaggctccggactgccat

SEQ ID NO: 561264 - DNA, 25 bp, Rattus norvegicus
tagggagacgttactgcttggccag

SEQ ID NO: 561265 - DNA, 25 bp, Rattus norvegicus
tagggagacgtttctgcttggccag

SEQ ID NO: 561266 - DNA, 25 bp, Rattus norvegicus
tagggagactccaggtctttgcttc

SEQ ID NO: 561267 - DNA, 25 bp, Rattus norvegicus
tagggagactcctggtctttgcttc

SEQ ID NO: 561268 - DNA, 25 bp, Rattus norvegicus
tagggagagcctacccttcctggag

SEQ ID NO: 561269 - DNA, 25 bp, Rattus norvegicus
tagggagagccttcccttcctggag

SEQ ID NO: 561270 - DNA, 25 bp, Rattus norvegicus
tagggagagcggctttccacatctc

SEQ ID NO: 561271 - DNA, 25 bp, Rattus norvegicus
tagggagagcgggtttccacatctc

SEQ ID NO: 561272 - DNA, 25 bp, Rattus norvegicus
tagggagagttcagtcttccacggt

SEQ ID NO: 561273 - DNA, 25 bp, Rattus norvegicus
tagggagagttctgtcttccacggt

SEQ ID NO: 561274 - DNA, 25 bp, Rattus norvegicus
tagggagatcacaatacaactttat

SEQ ID NO: 561275 - DNA, 25 bp, Rattus norvegicus
tagggagatcactatacaactttat

SEQ ID NO: 561276 - DNA, 25 bp, Rattus norvegicus
tagggagcaagtccgccatcccagg

SEQ ID NO: 561277 - DNA, 25 bp, Rattus norvegicus
tagggagcaagtgcgccatcccagg

SEQ ID NO: 561278 - DNA, 25 bp, Rattus norvegicus
tagggagcacagagcccggttgctt

SEQ ID NO: 561279 - DNA, 25 bp, Rattus norvegicus
tagggagcacagtgcccggttgctt

SEQ ID NO: 561280 - DNA, 25 bp, Rattus norvegicus
tagggagcaccacaagttcagcttg

SEQ ID NO: 561281 - DNA, 25 bp, Rattus norvegicus
tagggagcaccagaagttcagcttg

SEQ ID NO: 561282 - DNA, 25 bp, Rattus norvegicus
tagggagcacttcaagccctgactc

SEQ ID NO: 561283 - DNA, 25 bp, Rattus norvegicus
tagggagcacttgaagccctgactc

SEQ ID NO: 561284 - DNA, 25 bp, Rattus norvegicus
tagggagcagcaagcagcgtcagat

SEQ ID NO: 561285 - DNA, 25 bp, Rattus norvegicus
tagggagcagcatgcagcgtcagat

SEQ ID NO: 561286 - DNA, 25 bp, Rattus norvegicus
tagggagcattgagttagtataacc

SEQ ID NO: 561287 - DNA, 25 bp, Rattus norvegicus
tagggagcattgtgttagtataacc

SEQ ID NO: 561288 - DNA, 25 bp, Rattus norvegicus
tagggagccggcaggactactcacc

SEQ ID NO: 561289 - DNA, 25 bp, Rattus norvegicus
tagggagccggctggactactcacc

SEQ ID NO: 561290 - DNA, 25 bp, Rattus norvegicus
tagggagcgaagctttgctgccatc

SEQ ID NO: 561291 - DNA, 25 bp, Rattus norvegicus
tagggagcgaaggtttgctgccatc

SEQ ID NO: 561292 - DNA, 25 bp, Rattus norvegicus
tagggagctgaaccctcaggcaagt

SEQ ID NO: 561293 - DNA, 25 bp, Rattus norvegicus
tagggagctgaagcctcaggcaagt

SEQ ID NO: 561294 - DNA, 25 bp, Rattus norvegicus
tagggagctgcgacatgccgtgcct

SEQ ID NO: 561295 - DNA, 25 bp, Rattus norvegicus
tagggagctgcgtcatgccgtgcct

SEQ ID NO: 561296 - DNA, 25 bp, Rattus norvegicus
tagggagctgttccctctcccttgg

SEQ ID NO: 561297 - DNA, 25 bp, Rattus norvegicus
tagggagctgttgcctctcccttgg

SEQ ID NO: 561298 - DNA, 25 bp, Rattus norvegicus
tagggaggagcacattccagcctgt

SEQ ID NO: 561299 - DNA, 25 bp, Rattus norvegicus
tagggaggagcagattccagcctgt

SEQ ID NO: 561300 - DNA, 25 bp, Rattus norvegicus
tagggaggagctcccgacatttcct

SEQ ID NO: 561301 - DNA, 25 bp, Rattus norvegicus
tagggaggagctgccgacatttcct

SEQ ID NO: 561302 - DNA, 25 bp, Rattus norvegicus
tagggaggcagtaaactccttgcgg

SEQ ID NO: 561303 - DNA, 25 bp, Rattus norvegicus
tagggaggcagttaactccttgcgg

SEQ ID NO: 561304 - DNA, 25 bp, Rattus norvegicus
tagggagtagcacaagttaccccac

SEQ ID NO: 561305 - DNA, 25 bp, Rattus norvegicus
tagggagtagcagaagttaccccac

SEQ ID NO: 561306 - DNA, 25 bp, Rattus norvegicus
tagggagtcagcactgtggtcttcc

SEQ ID NO: 561307 - DNA, 25 bp, Rattus norvegicus
tagggagtcagctctgtggtcttcc

SEQ ID NO: 561308 - DNA, 25 bp, Rattus norvegicus
tagggagtccaacatgtagtacaat

SEQ ID NO: 561309 - DNA, 25 bp, Rattus norvegicus
tagggagtccaagatgtagtacaat

SEQ ID NO: 561310 - DNA, 25 bp, Rattus norvegicus
tagggagtctacagtcatagctaca

SEQ ID NO: 561311 - DNA, 25 bp, Rattus norvegicus
tagggagtctactgtcatagctaca

SEQ ID NO: 561312 - DNA, 25 bp, Rattus norvegicus
tagggagtgggcagagaacaacctt

SEQ ID NO: 561313 - DNA, 25 bp, Rattus norvegicus
tagggagtgggctgagaacaacctt

SEQ ID NO: 561314 - DNA, 25 bp, Rattus norvegicus
tagggagttgcaacgtgccgcgcct

SEQ ID NO: 561315 - DNA, 25 bp, Rattus norvegicus
tagggagttgcatcgtgccgcgcct

SEQ ID NO: 561316 - DNA, 25 bp, Rattus norvegicus
tagggagttgtaagtccatccccga

SEQ ID NO: 561317 - DNA, 25 bp, Rattus norvegicus
tagggagttgtatgtccatccccga

SEQ ID NO: 561318 - DNA, 25 bp, Rattus norvegicus
tagggagtttctactccagcagcta

SEQ ID NO: 561319 - DNA, 25 bp, Rattus norvegicus
tagggagtttcttctccagcagcta

SEQ ID NO: 561320 - DNA, 25 bp, Rattus norvegicus
tagggatagccgcagccttgttcat

SEQ ID NO: 561321 - DNA, 25 bp, Rattus norvegicus
tagggatagccggagccttgttcat

SEQ ID NO: 561322 - DNA, 25 bp, Rattus norvegicus
tagggatcacacagtgtcacatgtt

SEQ ID NO: 561323 - DNA, 25 bp, Rattus norvegicus
tagggatcacactgtgtcacatgtt

SEQ ID NO: 561324 - DNA, 25 bp, Rattus norvegicus
tagggatcacagctacccgacagaa

SEQ ID NO: 561325 - DNA, 25 bp, Rattus norvegicus
tagggatcacaggtacccgacagaa

SEQ ID NO: 561326 - DNA, 25 bp, Rattus norvegicus
tagggatcacttcccattgcctgga

SEQ ID NO: 561327 - DNA, 25 bp, Rattus norvegicus
tagggatcacttgccattgcctgga

SEQ ID NO: 561328 - DNA, 25 bp, Rattus norvegicus
tagggatccatcagaaaccccgttt

SEQ ID NO: 561329 - DNA, 25 bp, Rattus norvegicus
tagggatccatctgaaaccccgttt

SEQ ID NO: 561330 - DNA, 25 bp, Rattus norvegicus
tagggatctcaacggactcctcttg

SEQ ID NO: 561331 - DNA, 25 bp, Rattus norvegicus
tagggatctcaagggactcctcttg

SEQ ID NO: 561332 - DNA, 25 bp, Rattus norvegicus
tagggatctcctcggctcaaatagc

SEQ ID NO: 561333 - DNA, 25 bp, Rattus norvegicus
tagggatctcctgggctcaaatagc

SEQ ID NO: 561334 - DNA, 25 bp, Rattus norvegicus
tagggatcttctccgaagacctgac

SEQ ID NO: 561335 - DNA, 25 bp, Rattus norvegicus
tagggatcttctgcgaagacctgac

SEQ ID NO: 561336 - DNA, 25 bp, Rattus norvegicus
tagggatcttgcactgtaacctttc

SEQ ID NO: 561337 - DNA, 25 bp, Rattus norvegicus
tagggatcttgctctgtaacctttc

SEQ ID NO: 561338 - DNA, 25 bp, Rattus norvegicus
tagggatgaagcctatttatgcctc

SEQ ID NO: 561339 - DNA, 25 bp, Rattus norvegicus
tagggatgaagcgtatttatgcctc

SEQ ID NO: 561340 - DNA, 25 bp, Rattus norvegicus
tagggatgacctatgtgacagttac

SEQ ID NO: 561341 - DNA, 25 bp, Rattus norvegicus
tagggatgacctttgtgacagttac

SEQ ID NO: 561342 - DNA, 25 bp, Rattus norvegicus
tagggatgatccacagtgtgctcac

SEQ ID NO: 561343 - DNA, 25 bp, Rattus norvegicus
tagggatgatcctcagtgtgctcac

SEQ ID NO: 561344 - DNA, 25 bp, Rattus norvegicus
tagggatgctttcgagacctcccac

SEQ ID NO: 561345 - DNA, 25 bp, Rattus norvegicus
tagggatgctttggagacctcccac

SEQ ID NO: 561346 - DNA, 25 bp, Rattus norvegicus
tagggatggaccaatggctccatct

SEQ ID NO: 561347 - DNA, 25 bp, Rattus norvegicus
tagggatggacctatggctccatct

SEQ ID NO: 561348 - DNA, 25 bp, Rattus norvegicus
tagggatggctcatgcttcagacat

SEQ ID NO: 561349 - DNA, 25 bp, Rattus norvegicus
tagggatggctcttgcttcagacat

SEQ ID NO: 561350 - DNA, 25 bp, Rattus norvegicus
tagggatgtttgcatgcattgccat

SEQ ID NO: 561351 - DNA, 25 bp, Rattus norvegicus
tagggatgtttggatgcattgccat

SEQ ID NO: 561352 - DNA, 25 bp, Rattus norvegicus
tagggattaccaactgtctagcagc

SEQ ID NO: 561353 - DNA, 25 bp, Rattus norvegicus
tagggattaccatctgtctagcagc

SEQ ID NO: 561354 - DNA, 25 bp, Rattus norvegicus
tagggatttgatcccaggcttccat

SEQ ID NO: 561355 - DNA, 25 bp, Rattus norvegicus
tagggatttgatgccaggcttccat

SEQ ID NO: 561356 - DNA, 25 bp, Rattus norvegicus
tagggcaactaaatctcacgtctcc

SEQ ID NO: 561357 - DNA, 25 bp, Rattus norvegicus
tagggcaactaattctcacgtctcc

SEQ ID NO: 561358 - DNA, 25 bp, Rattus norvegicus
tagggcaatgccaggtatccactga

SEQ ID NO: 561359 - DNA, 25 bp, Rattus norvegicus
tagggcaatgcctggtatccactga

SEQ ID NO: 561360 - DNA, 25 bp, Rattus norvegicus
tagggcaattcccattcctctggag

SEQ ID NO: 561361 - DNA, 25 bp, Rattus norvegicus
tagggcaattccgattcctctggag

SEQ ID NO: 561362 - DNA, 25 bp, Rattus norvegicus
tagggcacagccctgtgggcaccca

SEQ ID NO: 561363 - DNA, 25 bp, Rattus norvegicus
tagggcacagccgtgtgggcaccca

SEQ ID NO: 561364 - DNA, 25 bp, Rattus norvegicus
tagggcacagtcaccattgaaaatg

SEQ ID NO: 561365 - DNA, 25 bp, Rattus norvegicus
tagggcacagtctccattgaaaatg

SEQ ID NO: 561366 - DNA, 25 bp, Rattus norvegicus
tagggcaccgggaagcttagctaca

SEQ ID NO: 561367 - DNA, 25 bp, Rattus norvegicus
tagggcaccgggtagcttagctaca

SEQ ID NO: 561368 - DNA, 25 bp, Rattus norvegicus
tagggcactggtacctttgggagct

SEQ ID NO: 561369 - DNA, 25 bp, Rattus norvegicus
tagggcactggtagacactgcgcca

SEQ ID NO: 561370 - DNA, 25 bp, Rattus norvegicus
tagggcactggttcctttgggagct

SEQ ID NO: 561371 - DNA, 25 bp, Rattus norvegicus
tagggcactggttgacactgcgcca

SEQ ID NO: 561372 - DNA, 25 bp, Rattus norvegicus
tagggcactgtcatccaggcgtaag

SEQ ID NO: 561373 - DNA, 25 bp, Rattus norvegicus
tagggcactgtcttccaggcgtaag

SEQ ID NO: 561374 - DNA, 25 bp, Rattus norvegicus
tagggcagcctacctctttttgtca

SEQ ID NO: 561375 - DNA, 25 bp, Rattus norvegicus
tagggcagcctagctctttttgtca

SEQ ID NO: 561376 - DNA, 25 bp, Rattus norvegicus
tagggcagctgacgctactacttcg

SEQ ID NO: 561377 - DNA, 25 bp, Rattus norvegicus
tagggcagctgaggctactacttcg

SEQ ID NO: 561378 - DNA, 25 bp, Rattus norvegicus
tagggcagctgtagtctgaaccacc

SEQ ID NO: 561379 - DNA, 25 bp, Rattus norvegicus
tagggcagctgttgtctgaaccacc

SEQ ID NO: 561380 - DNA, 25 bp, Rattus norvegicus
tagggcataatgactccagtttaaa

SEQ ID NO: 561381 - DNA, 25 bp, Rattus norvegicus
tagggcataatgtctccagtttaaa

SEQ ID NO: 561382 - DNA, 25 bp, Rattus norvegicus
tagggcatatccagaggccactctc

SEQ ID NO: 561383 - DNA, 25 bp, Rattus norvegicus
tagggcatatcctgaggccactctc

SEQ ID NO: 561384 - DNA, 25 bp, Rattus norvegicus
tagggcatcaccctgctgggagcat

SEQ ID NO: 561385 - DNA, 25 bp, Rattus norvegicus
tagggcatcaccgtgctgggagcat

SEQ ID NO: 561386 - DNA, 25 bp, Rattus norvegicus
tagggcatgaagagttgtggaaatt

SEQ ID NO: 561387 - DNA, 25 bp, Rattus norvegicus
tagggcatgaagtgttgtggaaatt

SEQ ID NO: 561388 - DNA, 25 bp, Rattus norvegicus
tagggcattccaaaggatgcacaac

SEQ ID NO: 561389 - DNA, 25 bp, Rattus norvegicus
tagggcattccataggatgcacaac

SEQ ID NO: 561390 - DNA, 25 bp, Rattus norvegicus
tagggcattcgtcctcatctgggat

SEQ ID NO: 561391 - DNA, 25 bp, Rattus norvegicus
tagggcattcgtgctcatctgggat

SEQ ID NO: 561392 - DNA, 25 bp, Rattus norvegicus
tagggcatttgaatgctctcccttc

SEQ ID NO: 561393 - DNA, 25 bp, Rattus norvegicus
tagggcatttgattgctctcccttc

SEQ ID NO: 561394 - DNA, 25 bp, Rattus norvegicus
tagggccacctacgcagacaacaga

SEQ ID NO: 561395 - DNA, 25 bp, Rattus norvegicus
tagggccacctaggcagacaacaga

SEQ ID NO: 561396 - DNA, 25 bp, Rattus norvegicus
tagggccacgacattttcagggaga

SEQ ID NO: 561397 - DNA, 25 bp, Rattus norvegicus
tagggccacgactttttcagggaga

SEQ ID NO: 561398 - DNA, 25 bp, Rattus norvegicus
tagggccactacacttcgcaagaag

SEQ ID NO: 561399 - DNA, 25 bp, Rattus norvegicus
tagggccactactcttcgcaagaag

SEQ ID NO: 561400 - DNA, 25 bp, Rattus norvegicus
tagggccactgccactctctggaga

SEQ ID NO: 561401 - DNA, 25 bp, Rattus norvegicus
tagggccactgcgactctctggaga

SEQ ID NO: 561402 - DNA, 25 bp, Rattus norvegicus
tagggccagcctagatctcatgatt

SEQ ID NO: 561403 - DNA, 25 bp, Rattus norvegicus
tagggccagccttgatctcatgatt

SEQ ID NO: 561404 - DNA, 25 bp, Rattus norvegicus
tagggccagctacacaactaacatt

SEQ ID NO: 561405 - DNA, 25 bp, Rattus norvegicus
tagggccagctagacaactaacatt

SEQ ID NO: 561406 - DNA, 25 bp, Rattus norvegicus
tagggccagtggaaccaatgtgcat

SEQ ID NO: 561407 - DNA, 25 bp, Rattus norvegicus
tagggccagtggtaccaatgtgcat

SEQ ID NO: 561408 - DNA, 25 bp, Rattus norvegicus
tagggccagtttaaccacagcagac

SEQ ID NO: 561409 - DNA, 25 bp, Rattus norvegicus
tagggccagttttaccacagcagac

SEQ ID NO: 561410 - DNA, 25 bp, Rattus norvegicus
tagggccatggcagtgtgttactgt

SEQ ID NO: 561411 - DNA, 25 bp, Rattus norvegicus
tagggccatggctgtgtgttactgt

SEQ ID NO: 561412 - DNA, 25 bp, Rattus norvegicus
tagggccattagagctaggatgcat

SEQ ID NO: 561413 - DNA, 25 bp, Rattus norvegicus
tagggccattagtgctaggatgcat

SEQ ID NO: 561414 - DNA, 25 bp, Rattus norvegicus
tagggcccagtacagctttgaagac

SEQ ID NO: 561415 - DNA, 25 bp, Rattus norvegicus
tagggcccagtagagctttgaagac

SEQ ID NO: 561416 - DNA, 25 bp, Rattus norvegicus
tagggcccatttaaaacacactgaa

SEQ ID NO: 561417 - DNA, 25 bp, Rattus norvegicus
tagggcccattttaaacacactgaa

SEQ ID NO: 561418 - DNA, 25 bp, Rattus norvegicus
tagggccctaggagtgaacatcttc

SEQ ID NO: 561419 - DNA, 25 bp, Rattus norvegicus
tagggccctaggtgtgaacatcttc

SEQ ID NO: 561420 - DNA, 25 bp, Rattus norvegicus
tagggccctctcaggatgcttggct

SEQ ID NO: 561421 - DNA, 25 bp, Rattus norvegicus
tagggccctctctggatgcttggct

SEQ ID NO: 561422 - DNA, 25 bp, Rattus norvegicus
tagggccgatctcctgactgcagca

SEQ ID NO: 561423 - DNA, 25 bp, Rattus norvegicus
tagggccgatctgctgactgcagca

SEQ ID NO: 561424 - DNA, 25 bp, Rattus norvegicus
tagggccgcgcgagtccgcaaaagt

SEQ ID NO: 561425 - DNA, 25 bp, Rattus norvegicus
tagggccgcgcgtgtccgcaaaagt

SEQ ID NO: 561426 - DNA, 25 bp, Rattus norvegicus
tagggccgctgtccttagagacgta

SEQ ID NO: 561427 - DNA, 25 bp, Rattus norvegicus
tagggccgctgtgcttagagacgta

SEQ ID NO: 561428 - DNA, 25 bp, Rattus norvegicus
tagggcctcaaacacaatacctgtc

SEQ ID NO: 561429 - DNA, 25 bp, Rattus norvegicus
tagggcctcaaagacaatacctgtc

SEQ ID NO: 561430 - DNA, 25 bp, Rattus norvegicus
tagggcctcatacagcacagcggtt

SEQ ID NO: 561431 - DNA, 25 bp, Rattus norvegicus
tagggcctcatagagcacagcggtt

SEQ ID NO: 561432 - DNA, 25 bp, Rattus norvegicus
tagggcctcatcaggtaccaatgcc

SEQ ID NO: 561433 - DNA, 25 bp, Rattus norvegicus
tagggcctcatctggtaccaatgcc

SEQ ID NO: 561434 - DNA, 25 bp, Rattus norvegicus
tagggcctcgctaacagttttcaga

SEQ ID NO: 561435 - DNA, 25 bp, Rattus norvegicus
tagggcctcgcttacagttttcaga

SEQ ID NO: 561436 - DNA, 25 bp, Rattus norvegicus
tagggcctcgtgaatgtcatgcaag

SEQ ID NO: 561437 - DNA, 25 bp, Rattus norvegicus
tagggcctcgtgtatgtcatgcaag

SEQ ID NO: 561438 - DNA, 25 bp, Rattus norvegicus
tagggcctgaggagccaacagcagc

SEQ ID NO: 561439 - DNA, 25 bp, Rattus norvegicus
tagggcctgaggtgccaacagcagc

SEQ ID NO: 561440 - DNA, 25 bp, Rattus norvegicus
tagggcctgcttaacactcggcaag

SEQ ID NO: 561441 - DNA, 25 bp, Rattus norvegicus
tagggcctgctttacactcggcaag

SEQ ID NO: 561442 - DNA, 25 bp, Rattus norvegicus
tagggcctgggcctactgatcctga

SEQ ID NO: 561443 - DNA, 25 bp, Rattus norvegicus
tagggcctgggcgtactgatcctga

SEQ ID NO: 561444 - DNA, 25 bp, Rattus norvegicus
tagggcctgtagaacctctgggagt

SEQ ID NO: 561445 - DNA, 25 bp, Rattus norvegicus
tagggcctgtagtacctctgggagt

SEQ ID NO: 561446 - DNA, 25 bp, Rattus norvegicus
tagggccttaagaatgtactctatt

SEQ ID NO: 561447 - DNA, 25 bp, Rattus norvegicus
tagggccttaagtatgtactctatt

SEQ ID NO: 561448 - DNA, 25 bp, Rattus norvegicus
tagggccttcccagtaggaacacag

SEQ ID NO: 561449 - DNA, 25 bp, Rattus norvegicus
tagggccttccctgtaggaacacag

SEQ ID NO: 561450 - DNA, 25 bp, Rattus norvegicus
tagggccttgggatgtaaatatgac

SEQ ID NO: 561451 - DNA, 25 bp, Rattus norvegicus
tagggccttgggttgtaaatatgac

SEQ ID NO: 561452 - DNA, 25 bp, Rattus norvegicus
tagggcctttgaaaccatggtaact

SEQ ID NO: 561453 - DNA, 25 bp, Rattus norvegicus
tagggcctttgataccatggtaact

SEQ ID NO: 561454 - DNA, 25 bp, Rattus norvegicus
tagggcgaggctacgtggcttactt

SEQ ID NO: 561455 - DNA, 25 bp, Rattus norvegicus
tagggcgaggcttcgtggcttactt

SEQ ID NO: 561456 - DNA, 25 bp, Rattus norvegicus
tagggcgagtctagcgcagagccaa

SEQ ID NO: 561457 - DNA, 25 bp, Rattus norvegicus
tagggcgagtcttgcgcagagccaa

SEQ ID NO: 561458 - DNA, 25 bp, Rattus norvegicus
tagggcgcggcgatgtcgggctacg

SEQ ID NO: 561459 - DNA, 25 bp, Rattus norvegicus
tagggcgcggcgttgtcgggctacg

SEQ ID NO: 561460 - DNA, 25 bp, Rattus norvegicus
tagggcgcttaaccggcctcggaaa

SEQ ID NO: 561461 - DNA, 25 bp, Rattus norvegicus
tagggcgcttaagcggcctcggaaa

SEQ ID NO: 561462 - DNA, 25 bp, Rattus norvegicus
tagggctcagccactatagtgggat

SEQ ID NO: 561463 - DNA, 25 bp, Rattus norvegicus
tagggctcagcctctatagtgggat

SEQ ID NO: 561464 - DNA, 25 bp, Rattus norvegicus
tagggctccagtcgcatttgatgaa

SEQ ID NO: 561465 - DNA, 25 bp, Rattus norvegicus
tagggctccagtggcatttgatgaa

SEQ ID NO: 561466 - DNA, 25 bp, Rattus norvegicus
tagggctccatgaagccagcgctct

SEQ ID NO: 561467 - DNA, 25 bp, Rattus norvegicus
tagggctccatgtagccagcgctct

SEQ ID NO: 561468 - DNA, 25 bp, Rattus norvegicus
tagggctccccaactccaagtggtg

SEQ ID NO: 561469 - DNA, 25 bp, Rattus norvegicus
tagggctccccatctccaagtggtg

SEQ ID NO: 561470 - DNA, 25 bp, Rattus norvegicus
tagggctcccccaaatgtcaaggtg

SEQ ID NO: 561471 - DNA, 25 bp, Rattus norvegicus
tagggctccccctaatgtcaaggtg

SEQ ID NO: 561472 - DNA, 25 bp, Rattus norvegicus
tagggctcctctatgcagaattcag

SEQ ID NO: 561473 - DNA, 25 bp, Rattus norvegicus
tagggctcctctttgcagaattcag

SEQ ID NO: 561474 - DNA, 25 bp, Rattus norvegicus
tagggctcggagcaaacaggttccc

SEQ ID NO: 561475 - DNA, 25 bp, Rattus norvegicus
tagggctcggaggaaacaggttccc

SEQ ID NO: 561476 - DNA, 25 bp, Rattus norvegicus
tagggctctaaaatgatgtatgatt

SEQ ID NO: 561477 - DNA, 25 bp, Rattus norvegicus
tagggctctaaattgatgtatgatt

SEQ ID NO: 561478 - DNA, 25 bp, Rattus norvegicus
tagggctctcacacattgctagtgt

SEQ ID NO: 561479 - DNA, 25 bp, Rattus norvegicus
tagggctctcactcattgctagtgt

SEQ ID NO: 561480 - DNA, 25 bp, Rattus norvegicus
tagggctctgtcctgaaagacactc

SEQ ID NO: 561481 - DNA, 25 bp, Rattus norvegicus
tagggctctgtcgtgaaagacactc

SEQ ID NO: 561482 - DNA, 25 bp, Rattus norvegicus
tagggctctttcctctgcactgcgt

SEQ ID NO: 561483 - DNA, 25 bp, Rattus norvegicus
tagggctctttcgtctgcactgcgt

SEQ ID NO: 561484 - DNA, 25 bp, Rattus norvegicus
tagggctgagtacatggccgtcact

SEQ ID NO: 561485 - DNA, 25 bp, Rattus norvegicus
tagggctgagtagatggccgtcact

SEQ ID NO: 561486 - DNA, 25 bp, Rattus norvegicus
tagggctgggtcacctgtgcatctt

SEQ ID NO: 561487 - DNA, 25 bp, Rattus norvegicus
tagggctgggtctcctgtgcatctt

SEQ ID NO: 561488 - DNA, 25 bp, Rattus norvegicus
tagggcttaaagatgcaatattgac

SEQ ID NO: 561489 - DNA, 25 bp, Rattus norvegicus
tagggcttaaagttgcaatattgac

SEQ ID NO: 561490 - DNA, 25 bp, Rattus norvegicus
tagggcttaatccactttgttttga

SEQ ID NO: 561491 - DNA, 25 bp, Rattus norvegicus
tagggcttaatcgactttgttttga

SEQ ID NO: 561492 - DNA, 25 bp, Rattus norvegicus
tagggcttagtgcacttctcctaca

SEQ ID NO: 561493 - DNA, 25 bp, Rattus norvegicus
tagggcttagtggacttctcctaca

SEQ ID NO: 561494 - DNA, 25 bp, Rattus norvegicus
tagggcttatagctcttggctccca

SEQ ID NO: 561495 - DNA, 25 bp, Rattus norvegicus
tagggcttataggtcttggctccca

SEQ ID NO: 561496 - DNA, 25 bp, Rattus norvegicus
tagggcttccatattgcgagccaag

SEQ ID NO: 561497 - DNA, 25 bp, Rattus norvegicus
tagggcttccattttgcgagccaag

SEQ ID NO: 561498 - DNA, 25 bp, Rattus norvegicus
tagggcttcctacttacttggctca

SEQ ID NO: 561499 - DNA, 25 bp, Rattus norvegicus
tagggcttcctagttacttggctca

SEQ ID NO: 561500 - DNA, 25 bp, Rattus norvegicus
tagggcttgagcaacagactgttct

SEQ ID NO: 561501 - DNA, 25 bp, Rattus norvegicus
tagggcttgagctacagactgttct

SEQ ID NO: 561502 - DNA, 25 bp, Rattus norvegicus
tagggcttgccccagttcacaggtt

SEQ ID NO: 561503 - DNA, 25 bp, Rattus norvegicus
tagggcttgcccgagttcacaggtt

SEQ ID NO: 561504 - DNA, 25 bp, Rattus norvegicus
tagggcttgctgaagacgcatccgc

SEQ ID NO: 561505 - DNA, 25 bp, Rattus norvegicus
tagggcttgctgtagacgcatccgc

SEQ ID NO: 561506 - DNA, 25 bp, Rattus norvegicus
tagggcttttcaatctactgctgct

SEQ ID NO: 561507 - DNA, 25 bp, Rattus norvegicus
tagggcttttcattctactgctgct

SEQ ID NO: 561508 - DNA, 25 bp, Rattus norvegicus
taggggtcttctctttaatgttact

SEQ ID NO: 561509 - DNA, 25 bp, Rattus norvegicus
taggggtcttctgtttaatgttact

SEQ ID NO: 561510 - DNA, 25 bp, Rattus norvegicus
tagggtaagttgagcatgactgcat

SEQ ID NO: 561511 - DNA, 25 bp, Rattus norvegicus
tagggtaagttgtgcatgactgcat

SEQ ID NO: 561512 - DNA, 25 bp, Rattus norvegicus
tagggtaatgccatcttgggattgt

SEQ ID NO: 561513 - DNA, 25 bp, Rattus norvegicus
tagggtaatgccttcttgggattgt

SEQ ID NO: 561514 - DNA, 25 bp, Rattus norvegicus
tagggtacatacacacagggccaca

SEQ ID NO: 561515 - DNA, 25 bp, Rattus norvegicus
tagggtacatactcacagggccaca

SEQ ID NO: 561516 - DNA, 25 bp, Rattus norvegicus
tagggtaccacccagatcgcagtct

SEQ ID NO: 561517 - DNA, 25 bp, Rattus norvegicus
tagggtaccaccgagatcgcagtct

SEQ ID NO: 561518 - DNA, 25 bp, Rattus norvegicus
tagggtagcagccaggacctccaca

SEQ ID NO: 561519 - DNA, 25 bp, Rattus norvegicus
tagggtagcagcgaggacctccaca

SEQ ID NO: 561520 - DNA, 25 bp, Rattus norvegicus
tagggtagccgcctaatcatgttgt

SEQ ID NO: 561521 - DNA, 25 bp, Rattus norvegicus
tagggtagccgcgtaatcatgttgt

SEQ ID NO: 561522 - DNA, 25 bp, Rattus norvegicus
tagggtagtctcagttttgtcaaaa

SEQ ID NO: 561523 - DNA, 25 bp, Rattus norvegicus
tagggtagtctctgttttgtcaaaa

SEQ ID NO: 561524 - DNA, 25 bp, Rattus norvegicus
tagggtagttcgctgttgtctgcac

SEQ ID NO: 561525 - DNA, 25 bp, Rattus norvegicus
tagggtagttcggtgttgtctgcac

SEQ ID NO: 561526 - DNA, 25 bp, Rattus norvegicus
tagggtataagaacagccggcgcac

SEQ ID NO: 561527 - DNA, 25 bp, Rattus norvegicus
tagggtataagatcagccggcgcac

SEQ ID NO: 561528 - DNA, 25 bp, Rattus norvegicus
tagggtatacagaggcccagcgtcc

SEQ ID NO: 561529 - DNA, 25 bp, Rattus norvegicus
tagggtatacagtggcccagcgtcc

SEQ ID NO: 561530 - DNA, 25 bp, Rattus norvegicus
tagggtatagacaccttaatcatag

SEQ ID NO: 561531 - DNA, 25 bp, Rattus norvegicus
tagggtatagactccttaatcatag

SEQ ID NO: 561532 - DNA, 25 bp, Rattus norvegicus
tagggtatgccacttccacgaacag

SEQ ID NO: 561533 - DNA, 25 bp, Rattus norvegicus
tagggtatgccagttccacgaacag

SEQ ID NO: 561534 - DNA, 25 bp, Rattus norvegicus
tagggtatttcaaaactgccaaggg

SEQ ID NO: 561535 - DNA, 25 bp, Rattus norvegicus
tagggtatttcataactgccaaggg

SEQ ID NO: 561536 - DNA, 25 bp, Rattus norvegicus
tagggtcaagcccacgtgaggccat

SEQ ID NO: 561537 - DNA, 25 bp, Rattus norvegicus
tagggtcaagccgacgtgaggccat

SEQ ID NO: 561538 - DNA, 25 bp, Rattus norvegicus
tagggtcaagtcctagccgagcttc

SEQ ID NO: 561539 - DNA, 25 bp, Rattus norvegicus
tagggtcaagtcgtagccgagcttc

SEQ ID NO: 561540 - DNA, 25 bp, Rattus norvegicus
tagggtcacagtcagtcagctttgc

SEQ ID NO: 561541 - DNA, 25 bp, Rattus norvegicus
tagggtcacagtgagtcagctttgc

SEQ ID NO: 561542 - DNA, 25 bp, Rattus norvegicus
tagggtcacccaacactatgatgag

SEQ ID NO: 561543 - DNA, 25 bp, Rattus norvegicus
tagggtcacccatcactatgatgag

SEQ ID NO: 561544 - DNA, 25 bp, Rattus norvegicus
tagggtcagtctatgtcaccagcaa

SEQ ID NO: 561545 - DNA, 25 bp, Rattus norvegicus
tagggtcagtctttgtcaccagcaa

SEQ ID NO: 561546 - DNA, 25 bp, Rattus norvegicus
tagggtccacagagcagggaatctt

SEQ ID NO: 561547 - DNA, 25 bp, Rattus norvegicus
tagggtccacagtgcagggaatctt

SEQ ID NO: 561548 - DNA, 25 bp, Rattus norvegicus
tagggtccagtgcagtctgtcacaa

SEQ ID NO: 561549 - DNA, 25 bp, Rattus norvegicus
tagggtccagtggagtctgtcacaa

SEQ ID NO: 561550 - DNA, 25 bp, Rattus norvegicus
tagggtccattcacttaataaaaat

SEQ ID NO: 561551 - DNA, 25 bp, Rattus norvegicus
tagggtccattctcttaataaaaat

SEQ ID NO: 561552 - DNA, 25 bp, Rattus norvegicus
tagggtcccactataatgttgcttt

SEQ ID NO: 561553 - DNA, 25 bp, Rattus norvegicus
tagggtcccactttaatgttgcttt

SEQ ID NO: 561554 - DNA, 25 bp, Rattus norvegicus
tagggtcccattatggtcctaaatg

SEQ ID NO: 561555 - DNA, 25 bp, Rattus norvegicus
tagggtcccattttggtcctaaatg

SEQ ID NO: 561556 - DNA, 25 bp, Rattus norvegicus
tagggtccctgcagcccactctagg

SEQ ID NO: 561557 - DNA, 25 bp, Rattus norvegicus
tagggtccctgctgcccactctagg

SEQ ID NO: 561558 - DNA, 25 bp, Rattus norvegicus
tagggtcctgtcctaacttcctttg

SEQ ID NO: 561559 - DNA, 25 bp, Rattus norvegicus
tagggtcctgtcgtaacttcctttg

SEQ ID NO: 561560 - DNA, 25 bp, Rattus norvegicus
tagggtcctgtgcactgttgatgtc

SEQ ID NO: 561561 - DNA, 25 bp, Rattus norvegicus
tagggtcctgtggactgttgatgtc

SEQ ID NO: 561562 - DNA, 25 bp, Rattus norvegicus
tagggtccttggcagctgagatatt

SEQ ID NO: 561563 - DNA, 25 bp, Rattus norvegicus
tagggtccttgggagctgagatatt

SEQ ID NO: 561564 - DNA, 25 bp, Rattus norvegicus
tagggtcgatttcacgtacctctgg

SEQ ID NO: 561565 - DNA, 25 bp, Rattus norvegicus
tagggtcgatttgacgtacctctgg

SEQ ID NO: 561566 - DNA, 25 bp, Rattus norvegicus
tagggtctaactcaagtacctgaat

SEQ ID NO: 561567 - DNA, 25 bp, Rattus norvegicus
tagggtctaactgaagtacctgaat

SEQ ID NO: 561568 - DNA, 25 bp, Rattus norvegicus
tagggtctcactaaactaccacaga

SEQ ID NO: 561569 - DNA, 25 bp, Rattus norvegicus
tagggtctcactctggaggccaagc

SEQ ID NO: 561570 - DNA, 25 bp, Rattus norvegicus
tagggtctcactgtggaggccaagc

SEQ ID NO: 561571 - DNA, 25 bp, Rattus norvegicus
tagggtctcacttaactaccacaga

SEQ ID NO: 561572 - DNA, 25 bp, Rattus norvegicus
tagggtctccccaagtgtgtcacag

SEQ ID NO: 561573 - DNA, 25 bp, Rattus norvegicus
tagggtctcccctagtgtgtcacag

SEQ ID NO: 561574 - DNA, 25 bp, Rattus norvegicus
tagggtcttgttattactccacatt

SEQ ID NO: 561575 - DNA, 25 bp, Rattus norvegicus
tagggtcttgttctaactcctgctg

SEQ ID NO: 561576 - DNA, 25 bp, Rattus norvegicus
tagggtcttgttgtaactcctgctg

SEQ ID NO: 561577 - DNA, 25 bp, Rattus norvegicus
tagggtcttgtttttactccacatt

SEQ ID NO: 561578 - DNA, 25 bp, Rattus norvegicus
tagggtctttgaattttcatttaga

SEQ ID NO: 561579 - DNA, 25 bp, Rattus norvegicus
tagggtctttgatttttcatttaga

SEQ ID NO: 561580 - DNA, 25 bp, Rattus norvegicus
tagggtgactgaattcccgatctct

SEQ ID NO: 561581 - DNA, 25 bp, Rattus norvegicus
tagggtgactgatttcccgatctct

SEQ ID NO: 561582 - DNA, 25 bp, Rattus norvegicus
tagggtgagagtcgccctcagctta

SEQ ID NO: 561583 - DNA, 25 bp, Rattus norvegicus
tagggtgagagtggccctcagctta

SEQ ID NO: 561584 - DNA, 25 bp, Rattus norvegicus
tagggtgaggtgatgatactgaact

SEQ ID NO: 561585 - DNA, 25 bp, Rattus norvegicus
tagggtgaggtgttgatactgaact

SEQ ID NO: 561586 - DNA, 25 bp, Rattus norvegicus
tagggtgatcctatagccagcccat

SEQ ID NO: 561587 - DNA, 25 bp, Rattus norvegicus
tagggtgatcctcgtggctgaaata

SEQ ID NO: 561588 - DNA, 25 bp, Rattus norvegicus
tagggtgatcctggtggctgaaata

SEQ ID NO: 561589 - DNA, 25 bp, Rattus norvegicus
tagggtgatcctttagccagcccat

SEQ ID NO: 561590 - DNA, 25 bp, Rattus norvegicus
tagggtgattgtcggctctcccaga

SEQ ID NO: 561591 - DNA, 25 bp, Rattus norvegicus
tagggtgattgtgggctctcccaga

SEQ ID NO: 561592 - DNA, 25 bp, Rattus norvegicus
tagggtgcaacgacatcttgcgcca

SEQ ID NO: 561593 - DNA, 25 bp, Rattus norvegicus
tagggtgcaacgtcatcttgcgcca

SEQ ID NO: 561594 - DNA, 25 bp, Rattus norvegicus
tagggtgcacctataactcctgtaa

SEQ ID NO: 561595 - DNA, 25 bp, Rattus norvegicus
tagggtgcacctttaactcctgtaa

SEQ ID NO: 561596 - DNA, 25 bp, Rattus norvegicus
tagggtgcacgacagcatgccacac

SEQ ID NO: 561597 - DNA, 25 bp, Rattus norvegicus
tagggtgcacgagagcatgccacac

SEQ ID NO: 561598 - DNA, 25 bp, Rattus norvegicus
tagggtgcccacataggagtcccaa

SEQ ID NO: 561599 - DNA, 25 bp, Rattus norvegicus
tagggtgcccacttaggagtcccaa

SEQ ID NO: 561600 - DNA, 25 bp, Rattus norvegicus
tagggtgcctggagagatttcctct

SEQ ID NO: 561601 - DNA, 25 bp, Rattus norvegicus
tagggtgcctggtgagatttcctct

SEQ ID NO: 561602 - DNA, 25 bp, Rattus norvegicus
tagggtgctctcaagttactgtgta

SEQ ID NO: 561603 - DNA, 25 bp, Rattus norvegicus
tagggtgctctctagttactgtgta

SEQ ID NO: 561604 - DNA, 25 bp, Rattus norvegicus
tagggtggagacacagtcctcattt

SEQ ID NO: 561605 - DNA, 25 bp, Rattus norvegicus
tagggtggagactcagtcctcattt

SEQ ID NO: 561606 - DNA, 25 bp, Rattus norvegicus
tagggtggccacctctgggatccca

SEQ ID NO: 561607 - DNA, 25 bp, Rattus norvegicus
tagggtggccacgtctgggatccca

SEQ ID NO: 561608 - DNA, 25 bp, Rattus norvegicus
tagggtggcctcaggaacaactctc

SEQ ID NO: 561609 - DNA, 25 bp, Rattus norvegicus
tagggtggcctctggaacaactctc

SEQ ID NO: 561610 - DNA, 25 bp, Rattus norvegicus
tagggtgggccactatcaccatgtc

SEQ ID NO: 561611 - DNA, 25 bp, Rattus norvegicus
tagggtgggccagtatcaccatgtc

SEQ ID NO: 561612 - DNA, 25 bp, Rattus norvegicus
tagggtgggcctcccctttcctgat

SEQ ID NO: 561613 - DNA, 25 bp, Rattus norvegicus
tagggtgggcctgccctttcctgat

SEQ ID NO: 561614 - DNA, 25 bp, Rattus norvegicus
tagggtgtacccagatggtctgaac

SEQ ID NO: 561615 - DNA, 25 bp, Rattus norvegicus
tagggtgtaccctgatggtctgaac

SEQ ID NO: 561616 - DNA, 25 bp, Rattus norvegicus
tagggtgtcaatattcttcccacag

SEQ ID NO: 561617 - DNA, 25 bp, Rattus norvegicus
tagggtgtcaattttcttcccacag

SEQ ID NO: 561618 - DNA, 25 bp, Rattus norvegicus
tagggtgtccggaagcctagctgac

SEQ ID NO: 561619 - DNA, 25 bp, Rattus norvegicus
tagggtgtccggtagcctagctgac

SEQ ID NO: 561620 - DNA, 25 bp, Rattus norvegicus
tagggtgtcctgattacaactcttt

SEQ ID NO: 561621 - DNA, 25 bp, Rattus norvegicus
tagggtgtcctgtttacaactcttt

SEQ ID NO: 561622 - DNA, 25 bp, Rattus norvegicus
tagggtgtggctcttgacaacacat

SEQ ID NO: 561623 - DNA, 25 bp, Rattus norvegicus
tagggtgtggctgttgacaacacat

SEQ ID NO: 561624 - DNA, 25 bp, Rattus norvegicus
tagggtgtgggaaagctgctcatat

SEQ ID NO: 561625 - DNA, 25 bp, Rattus norvegicus
tagggtgtgggatagctgctcatat

SEQ ID NO: 561626 - DNA, 25 bp, Rattus norvegicus
tagggtgtggttccacacaccttaa

SEQ ID NO: 561627 - DNA, 25 bp, Rattus norvegicus
tagggtgtggttgcacacaccttaa

SEQ ID NO: 561628 - DNA, 25 bp, Rattus norvegicus
tagggtgttttcagttgctcagctc

SEQ ID NO: 561629 - DNA, 25 bp, Rattus norvegicus
tagggtgttttctgttgctcagctc

SEQ ID NO: 561630 - DNA, 25 bp, Rattus norvegicus
tagggttacgttctgttgcgtcatt

SEQ ID NO: 561631 - DNA, 25 bp, Rattus norvegicus
tagggttacgttgtgttgcgtcatt

SEQ ID NO: 561632 - DNA, 25 bp, Rattus norvegicus
tagggttagcaaatacccatccctg

SEQ ID NO: 561633 - DNA, 25 bp, Rattus norvegicus
tagggttagcaattacccatccctg

SEQ ID NO: 561634 - DNA, 25 bp, Rattus norvegicus
tagggttagtcactctttccctcta

SEQ ID NO: 561635 - DNA, 25 bp, Rattus norvegicus
tagggttagtcagtctttccctcta

SEQ ID NO: 561636 - DNA, 25 bp, Rattus norvegicus
tagggttcagcacttctagcctcag

SEQ ID NO: 561637 - DNA, 25 bp, Rattus norvegicus
tagggttcagcagttctagcctcag

SEQ ID NO: 561638 - DNA, 25 bp, Rattus norvegicus
tagggttcatcccatctttgtgtcc

SEQ ID NO: 561639 - DNA, 25 bp, Rattus norvegicus
tagggttcatccgatctttgtgtcc

SEQ ID NO: 561640 - DNA, 25 bp, Rattus norvegicus
tagggttccactcgcttctttgctg

SEQ ID NO: 561641 - DNA, 25 bp, Rattus norvegicus
tagggttccactggcttctttgctg

SEQ ID NO: 561642 - DNA, 25 bp, Rattus norvegicus
tagggttccataaacttccaggtat

SEQ ID NO: 561643 - DNA, 25 bp, Rattus norvegicus
tagggttccatatacttccaggtat

SEQ ID NO: 561644 - DNA, 25 bp, Rattus norvegicus
tagggttctctacctggctgatgaa

SEQ ID NO: 561645 - DNA, 25 bp, Rattus norvegicus
tagggttctctagctggctgatgaa

SEQ ID NO: 561646 - DNA, 25 bp, Rattus norvegicus
tagggttcttccagtaaggcgcttc

SEQ ID NO: 561647 - DNA, 25 bp, Rattus norvegicus
tagggttcttcctgtaaggcgcttc

SEQ ID NO: 561648 - DNA, 25 bp, Rattus norvegicus
tagggttgacttaggtccccagcag

SEQ ID NO: 561649 - DNA, 25 bp, Rattus norvegicus
tagggttgactttggtccccagcag

SEQ ID NO: 561650 - DNA, 25 bp, Rattus norvegicus
tagggttgagccactagatgggtct

SEQ ID NO: 561651 - DNA, 25 bp, Rattus norvegicus
tagggttgagcctctagatgggtct

SEQ ID NO: 561652 - DNA, 25 bp, Rattus norvegicus
tagggttgccaactatgtccttact

SEQ ID NO: 561653 - DNA, 25 bp, Rattus norvegicus
tagggttgccaagtatgtccttact

SEQ ID NO: 561654 - DNA, 25 bp, Rattus norvegicus
tagggttggcggaggcaggtaaagg

SEQ ID NO: 561655 - DNA, 25 bp, Rattus norvegicus
tagggttggcggtggcaggtaaagg

SEQ ID NO: 561656 - DNA, 25 bp, Rattus norvegicus
tagggttgggtacttctgtgaccct

SEQ ID NO: 561657 - DNA, 25 bp, Rattus norvegicus
tagggttgggtagttctgtgaccct

SEQ ID NO: 561658 - DNA, 25 bp, Rattus norvegicus
tagggtttagccatgtctccaagca

SEQ ID NO: 561659 - DNA, 25 bp, Rattus norvegicus
tagggtttagccttgtctccaagca

SEQ ID NO: 561660 - DNA, 25 bp, Rattus norvegicus
tagggtttagctatctctgacggac

SEQ ID NO: 561661 - DNA, 25 bp, Rattus norvegicus
tagggtttagctttctctgacggac

SEQ ID NO: 561662 - DNA, 25 bp, Rattus norvegicus
tagggtttatgtagtttccaaaatg

SEQ ID NO: 561663 - DNA, 25 bp, Rattus norvegicus
tagggtttatgttgtttccaaaatg

SEQ ID NO: 561664 - DNA, 25 bp, Rattus norvegicus
tagggtttgattacctactggctcc

SEQ ID NO: 561665 - DNA, 25 bp, Rattus norvegicus
tagggtttgatttcctactggctcc

SEQ ID NO: 561666 - DNA, 25 bp, Rattus norvegicus
tagggtttgcccattcaggtcgcaa

SEQ ID NO: 561667 - DNA, 25 bp, Rattus norvegicus
tagggtttgccctttcaggtcgcaa

SEQ ID NO: 561668 - DNA, 25 bp, Rattus norvegicus
tagggttttcacactttcacgtgca

SEQ ID NO: 561669 - DNA, 25 bp, Rattus norvegicus
tagggttttcactctttcacgtgca

SEQ ID NO: 561670 - DNA, 25 bp, Rattus norvegicus
tagggttttcagacaatgcctcgtc

SEQ ID NO: 561671 - DNA, 25 bp, Rattus norvegicus
tagggttttcagtcaatgcctcgtc

SEQ ID NO: 561672 - DNA, 25 bp, Rattus norvegicus
tagggttttttgactgctctagata

SEQ ID NO: 561673 - DNA, 25 bp, Rattus norvegicus
tagggttttttgcactgtacagtgt

SEQ ID NO: 561674 - DNA, 25 bp, Rattus norvegicus
tagggttttttggactgtacagtgt

SEQ ID NO: 561675 - DNA, 25 bp, Rattus norvegicus
tagggttttttgtctgctctagata

SEQ ID NO: 561676 - DNA, 25 bp, Rattus norvegicus
taggtaaacaggcactcagcaggct

SEQ ID NO: 561677 - DNA, 25 bp, Rattus norvegicus
taggtaaacagggactcagcaggct

SEQ ID NO: 561678 - DNA, 25 bp, Rattus norvegicus
taggtaaacctgaccctcaagtctc

SEQ ID NO: 561679 - DNA, 25 bp, Rattus norvegicus
taggtaaacctgtccctcaagtctc

SEQ ID NO: 561680 - DNA, 25 bp, Rattus norvegicus
taggtaaacgacatgctcttctctg

SEQ ID NO: 561681 - DNA, 25 bp, Rattus norvegicus
taggtaaacgacttgctcttctctg

SEQ ID NO: 561682 - DNA, 25 bp, Rattus norvegicus
taggtaaagactcagccgcagcccc

SEQ ID NO: 561683 - DNA, 25 bp, Rattus norvegicus
taggtaaagactgagccgcagcccc

SEQ ID NO: 561684 - DNA, 25 bp, Rattus norvegicus
taggtaaataccacggctttgccca

SEQ ID NO: 561685 - DNA, 25 bp, Rattus norvegicus
taggtaaatacctcggctttgccca

SEQ ID NO: 561686 - DNA, 25 bp, Rattus norvegicus
taggtaagcgtgctctacatactga

SEQ ID NO: 561687 - DNA, 25 bp, Rattus norvegicus
taggtaagcgtggtctacatactga

SEQ ID NO: 561688 - DNA, 25 bp, Rattus norvegicus
taggtaagttgtaaagcccgtcttg

SEQ ID NO: 561689 - DNA, 25 bp, Rattus norvegicus
taggtaagttgttaagcccgtcttg

SEQ ID NO: 561690 - DNA, 25 bp, Rattus norvegicus
taggtaatgagcacccaggaccacc

SEQ ID NO: 561691 - DNA, 25 bp, Rattus norvegicus
taggtaatgagctcccaggaccacc

SEQ ID NO: 561692 - DNA, 25 bp, Rattus norvegicus
taggtaatggtccacctcaactgca

SEQ ID NO: 561693 - DNA, 25 bp, Rattus norvegicus
taggtaatggtcgacctcaactgca

SEQ ID NO: 561694 - DNA, 25 bp, Rattus norvegicus
taggtaatgtggagacttaacccaa

SEQ ID NO: 561695 - DNA, 25 bp, Rattus norvegicus
taggtaatgtggtgacttaacccaa

SEQ ID NO: 561696 - DNA, 25 bp, Rattus norvegicus
taggtacaacatccttttcttgatg

SEQ ID NO: 561697 - DNA, 25 bp, Rattus norvegicus
taggtacaacatgcttttcttgatg

SEQ ID NO: 561698 - DNA, 25 bp, Rattus norvegicus
taggtacacactccacacaggcttt

SEQ ID NO: 561699 - DNA, 25 bp, Rattus norvegicus
taggtacacactgcacacaggcttt

SEQ ID NO: 561700 - DNA, 25 bp, Rattus norvegicus
taggtacacatccttgggtgcgctg

SEQ ID NO: 561701 - DNA, 25 bp, Rattus norvegicus
taggtacacatcgttgggtgcgctg

SEQ ID NO: 561702 - DNA, 25 bp, Rattus norvegicus
taggtacaccaaagagtctcttaag

SEQ ID NO: 561703 - DNA, 25 bp, Rattus norvegicus
taggtacaccaatgagtctcttaag

SEQ ID NO: 561704 - DNA, 25 bp, Rattus norvegicus
taggtacatccactgtgccaaagat

SEQ ID NO: 561705 - DNA, 25 bp, Rattus norvegicus
taggtacatccagtgtgccaaagat

SEQ ID NO: 561706 - DNA, 25 bp, Rattus norvegicus
taggtaccagttccctttttgctgg

SEQ ID NO: 561707 - DNA, 25 bp, Rattus norvegicus
taggtaccagttgcctttttgctgg

SEQ ID NO: 561708 - DNA, 25 bp, Rattus norvegicus
taggtacctccaaacttgaatccgt

SEQ ID NO: 561709 - DNA, 25 bp, Rattus norvegicus
taggtacctccatacttgaatccgt

SEQ ID NO: 561710 - DNA, 25 bp, Rattus norvegicus
taggtaccttgaaaagatgcccacc

SEQ ID NO: 561711 - DNA, 25 bp, Rattus norvegicus
taggtaccttgataagatgcccacc

SEQ ID NO: 561712 - DNA, 25 bp, Rattus norvegicus
taggtacgacttcgttgtcactgcc

SEQ ID NO: 561713 - DNA, 25 bp, Rattus norvegicus
taggtacgacttggttgtcactgcc

SEQ ID NO: 561714 - DNA, 25 bp, Rattus norvegicus
taggtactgcagactggcctgactg

SEQ ID NO: 561715 - DNA, 25 bp, Rattus norvegicus
taggtactgcagtctggcctgactg

SEQ ID NO: 561716 - DNA, 25 bp, Rattus norvegicus
taggtactgcatctagtccggttca

SEQ ID NO: 561717 - DNA, 25 bp, Rattus norvegicus
taggtactgcatgtagtccggttca

SEQ ID NO: 561718 - DNA, 25 bp, Rattus norvegicus
taggtacttcacaaaagcatgtata

SEQ ID NO: 561719 - DNA, 25 bp, Rattus norvegicus
taggtacttcaccaagagcttgtta

SEQ ID NO: 561720 - DNA, 25 bp, Rattus norvegicus
taggtacttcacgaagagcttgtta

SEQ ID NO: 561721 - DNA, 25 bp, Rattus norvegicus
taggtacttcactaaagcatgtata

SEQ ID NO: 561722 - DNA, 25 bp, Rattus norvegicus
taggtactttgactccagggccaga

SEQ ID NO: 561723 - DNA, 25 bp, Rattus norvegicus
taggtactttgagtccagggccaga

SEQ ID NO: 561724 - DNA, 25 bp, Rattus norvegicus
taggtagagggtctttcaaacacaa

SEQ ID NO: 561725 - DNA, 25 bp, Rattus norvegicus
taggtagagggtgtttcaaacacaa

SEQ ID NO: 561726 - DNA, 25 bp, Rattus norvegicus
taggtagcactcattgccagtctgt

SEQ ID NO: 561727 - DNA, 25 bp, Rattus norvegicus
taggtagcactctttgccagtctgt

SEQ ID NO: 561728 - DNA, 25 bp, Rattus norvegicus
taggtagcccaacctgccctagaag

SEQ ID NO: 561729 - DNA, 25 bp, Rattus norvegicus
taggtagcccaagctgccctagaag

SEQ ID NO: 561730 - DNA, 25 bp, Rattus norvegicus
taggtagcgactctcctcctgcagt

SEQ ID NO: 561731 - DNA, 25 bp, Rattus norvegicus
taggtagcgactgtcctcctgcagt

SEQ ID NO: 561732 - DNA, 25 bp, Rattus norvegicus
taggtagcgcgcaggtcctccggta

SEQ ID NO: 561733 - DNA, 25 bp, Rattus norvegicus
taggtagcgcgctggtcctccggta

SEQ ID NO: 561734 - DNA, 25 bp, Rattus norvegicus
taggtagctactactattaaacttt

SEQ ID NO: 561735 - DNA, 25 bp, Rattus norvegicus
taggtagctacttctattaaacttt

SEQ ID NO: 561736 - DNA, 25 bp, Rattus norvegicus
taggtagcttagcaggcgggcggcc

SEQ ID NO: 561737 - DNA, 25 bp, Rattus norvegicus
taggtagcttaggaggcgggcggcc

SEQ ID NO: 561738 - DNA, 25 bp, Rattus norvegicus
taggtaggagcccaagtcttcactg

SEQ ID NO: 561739 - DNA, 25 bp, Rattus norvegicus
taggtaggagccgaagtcttcactg

SEQ ID NO: 561740 - DNA, 25 bp, Rattus norvegicus
taggtaggtcctcaggtcaccagct

SEQ ID NO: 561741 - DNA, 25 bp, Rattus norvegicus
taggtaggtcctgaggtcaccagct

SEQ ID NO: 561742 - DNA, 25 bp, Rattus norvegicus
taggtaggtcttcaggcattttgca

SEQ ID NO: 561743 - DNA, 25 bp, Rattus norvegicus
taggtaggtcttgaggcattttgca

SEQ ID NO: 561744 - DNA, 25 bp, Rattus norvegicus
taggtaggtgtcatattccctgact

SEQ ID NO: 561745 - DNA, 25 bp, Rattus norvegicus
taggtaggtgtcttattccctgact

SEQ ID NO: 561746 - DNA, 25 bp, Rattus norvegicus
taggtagtgcccagcgctatcttct

SEQ ID NO: 561747 - DNA, 25 bp, Rattus norvegicus
taggtagtgccctgcgctatcttct

SEQ ID NO: 561748 - DNA, 25 bp, Rattus norvegicus
taggtagtttgtcctttctccgcag

SEQ ID NO: 561749 - DNA, 25 bp, Rattus norvegicus
taggtagtttgtgctttctccgcag

SEQ ID NO: 561750 - DNA, 25 bp, Rattus norvegicus
taggtataccagcaagcgcctttac

SEQ ID NO: 561751 - DNA, 25 bp, Rattus norvegicus
taggtataccaggaagcgcctttac

SEQ ID NO: 561752 - DNA, 25 bp, Rattus norvegicus
taggtatactggctgtctccctcag

SEQ ID NO: 561753 - DNA, 25 bp, Rattus norvegicus
taggtatactgggtgtctccctcag

SEQ ID NO: 561754 - DNA, 25 bp, Rattus norvegicus
taggtatatctcctttgccctttga

SEQ ID NO: 561755 - DNA, 25 bp, Rattus norvegicus
taggtatatctcgtttgccctttga

SEQ ID NO: 561756 - DNA, 25 bp, Rattus norvegicus
taggtatccgtgagggaatgttcac

SEQ ID NO: 561757 - DNA, 25 bp, Rattus norvegicus
taggtatccgtgtgggaatgttcac

SEQ ID NO: 561758 - DNA, 25 bp, Rattus norvegicus
taggtatcctgaccacttcttggaa

SEQ ID NO: 561759 - DNA, 25 bp, Rattus norvegicus
taggtatcctgagcacttcttggaa

SEQ ID NO: 561760 - DNA, 25 bp, Rattus norvegicus
taggtatcgcgactgatcagggccc

SEQ ID NO: 561761 - DNA, 25 bp, Rattus norvegicus
taggtatcgcgagtgatcagggccc

SEQ ID NO: 561762 - DNA, 25 bp, Rattus norvegicus
taggtatgcgctctgtgacacccaa

SEQ ID NO: 561763 - DNA, 25 bp, Rattus norvegicus
taggtatgcgctgtgtgacacccaa

SEQ ID NO: 561764 - DNA, 25 bp, Rattus norvegicus
taggtatgctggactctgtaccaca

SEQ ID NO: 561765 - DNA, 25 bp, Rattus norvegicus
taggtatgctggtctctgtaccaca

SEQ ID NO: 561766 - DNA, 25 bp, Rattus norvegicus
taggtatgtggtcctacacctggaa

SEQ ID NO: 561767 - DNA, 25 bp, Rattus norvegicus
taggtatgtggtgctacacctggaa

SEQ ID NO: 561768 - DNA, 25 bp, Rattus norvegicus
taggtattgcctcttctttttgttt

SEQ ID NO: 561769 - DNA, 25 bp, Rattus norvegicus
taggtattgcctgttctttttgttt

SEQ ID NO: 561770 - DNA, 25 bp, Rattus norvegicus
taggtcaaacttctgggtctgccgg

SEQ ID NO: 561771 - DNA, 25 bp, Rattus norvegicus
taggtcaaacttgtgggtctgccgg

SEQ ID NO: 561772 - DNA, 25 bp, Rattus norvegicus
taggtcaaagcacccattatttggg

SEQ ID NO: 561773 - DNA, 25 bp, Rattus norvegicus
taggtcaaagcagccattatttggg

SEQ ID NO: 561774 - DNA, 25 bp, Rattus norvegicus
taggtcaaggtgactccattctcta

SEQ ID NO: 561775 - DNA, 25 bp, Rattus norvegicus
taggtcaaggtgtctccattctcta

SEQ ID NO: 561776 - DNA, 25 bp, Rattus norvegicus
taggtcaatcatacactaggagatg

SEQ ID NO: 561777 - DNA, 25 bp, Rattus norvegicus
taggtcaatcattcactaggagatg

SEQ ID NO: 561778 - DNA, 25 bp, Rattus norvegicus
taggtcaccaggcattggaaccgtt

SEQ ID NO: 561779 - DNA, 25 bp, Rattus norvegicus
taggtcaccagggattggaaccgtt

SEQ ID NO: 561780 - DNA, 25 bp, Rattus norvegicus
taggtcacgatcctttagccagggc

SEQ ID NO: 561781 - DNA, 25 bp, Rattus norvegicus
taggtcacgatcgtttagccagggc

SEQ ID NO: 561782 - DNA, 25 bp, Rattus norvegicus
taggtcactgtgatctctcttgtat

SEQ ID NO: 561783 - DNA, 25 bp, Rattus norvegicus
taggtcactgtgttctctcttgtat

SEQ ID NO: 561784 - DNA, 25 bp, Rattus norvegicus
taggtcagaccaacttcctgaaggt

SEQ ID NO: 561785 - DNA, 25 bp, Rattus norvegicus
taggtcagaccatcttcctgaaggt

SEQ ID NO: 561786 - DNA, 25 bp, Rattus norvegicus
taggtcaggtgccttatctcagctt

SEQ ID NO: 561787 - DNA, 25 bp, Rattus norvegicus
taggtcaggtgcgttatctcagctt

SEQ ID NO: 561788 - DNA, 25 bp, Rattus norvegicus
taggtcatatcgacatgggccacat

SEQ ID NO: 561789 - DNA, 25 bp, Rattus norvegicus
taggtcatatcgtcatgggccacat

SEQ ID NO: 561790 - DNA, 25 bp, Rattus norvegicus
taggtcatcttgctagcccagccac

SEQ ID NO: 561791 - DNA, 25 bp, Rattus norvegicus
taggtcatcttggtagcccagccac

SEQ ID NO: 561792 - DNA, 25 bp, Rattus norvegicus
taggtcatgtgcaggtagtcaccgt

SEQ ID NO: 561793 - DNA, 25 bp, Rattus norvegicus
taggtcatgtgctggtagtcaccgt

SEQ ID NO: 561794 - DNA, 25 bp, Rattus norvegicus
taggtccaacataaaactcgggtca

SEQ ID NO: 561795 - DNA, 25 bp, Rattus norvegicus
taggtccaacattaaactcgggtca

SEQ ID NO: 561796 - DNA, 25 bp, Rattus norvegicus
taggtccaacccaaaagatccttgc

SEQ ID NO: 561797 - DNA, 25 bp, Rattus norvegicus
taggtccaaccctaaagatccttgc

SEQ ID NO: 561798 - DNA, 25 bp, Rattus norvegicus
taggtccaagacaggctcgttgcaa

SEQ ID NO: 561799 - DNA, 25 bp, Rattus norvegicus
taggtccaagactggctcgttgcaa

SEQ ID NO: 561800 - DNA, 25 bp, Rattus norvegicus
taggtccacctccaactactttatg

SEQ ID NO: 561801 - DNA, 25 bp, Rattus norvegicus
taggtccacctcgaactactttatg

SEQ ID NO: 561802 - DNA, 25 bp, Rattus norvegicus
taggtccacttacagagaacttgtc

SEQ ID NO: 561803 - DNA, 25 bp, Rattus norvegicus
taggtccacttagagagaacttgtc

SEQ ID NO: 561804 - DNA, 25 bp, Rattus norvegicus
taggtccaggatctcaggactacag

SEQ ID NO: 561805 - DNA, 25 bp, Rattus norvegicus
taggtccaggatgtcaggactacag

SEQ ID NO: 561806 - DNA, 25 bp, Rattus norvegicus
taggtccagtcaaccctctgtgagg

SEQ ID NO: 561807 - DNA, 25 bp, Rattus norvegicus
taggtccagtcatccctctgtgagg

SEQ ID NO: 561808 - DNA, 25 bp, Rattus norvegicus
taggtccataggcacttttcagagt

SEQ ID NO: 561809 - DNA, 25 bp, Rattus norvegicus
taggtccatagggacttttcagagt

SEQ ID NO: 561810 - DNA, 25 bp, Rattus norvegicus
taggtcccaaccctgtagttggcaa

SEQ ID NO: 561811 - DNA, 25 bp, Rattus norvegicus
taggtcccaaccgtgtagttggcaa

SEQ ID NO: 561812 - DNA, 25 bp, Rattus norvegicus
taggtccccattaggagcggtggca

SEQ ID NO: 561813 - DNA, 25 bp, Rattus norvegicus
taggtccccatttggagcggtggca

SEQ ID NO: 561814 - DNA, 25 bp, Rattus norvegicus
taggtcccctctacttttgaggttg

SEQ ID NO: 561815 - DNA, 25 bp, Rattus norvegicus
taggtcccctcttcttttgaggttg

SEQ ID NO: 561816 - DNA, 25 bp, Rattus norvegicus
taggtccctgggactctgaaaatgc

SEQ ID NO: 561817 - DNA, 25 bp, Rattus norvegicus
taggtccctgggtctctgaaaatgc

SEQ ID NO: 561818 - DNA, 25 bp, Rattus norvegicus
taggtccctttacaatggtcaccca

SEQ ID NO: 561819 - DNA, 25 bp, Rattus norvegicus
taggtccctttagaatggtcaccca

SEQ ID NO: 561820 - DNA, 25 bp, Rattus norvegicus
taggtcccttttcctgtaacttgta

SEQ ID NO: 561821 - DNA, 25 bp, Rattus norvegicus
taggtcccttttgctgtaacttgta

SEQ ID NO: 561822 - DNA, 25 bp, Rattus norvegicus
taggtccgagccagtacgctccaaa

SEQ ID NO: 561823 - DNA, 25 bp, Rattus norvegicus
taggtccgagcctgtacgctccaaa

SEQ ID NO: 561824 - DNA, 25 bp, Rattus norvegicus
taggtccgtggtaagtaagtaatag

SEQ ID NO: 561825 - DNA, 25 bp, Rattus norvegicus
taggtccgtggttagtaagtaatag

SEQ ID NO: 561826 - DNA, 25 bp, Rattus norvegicus
taggtcctccagagagctctgtata

SEQ ID NO: 561827 - DNA, 25 bp, Rattus norvegicus
taggtcctccagtgagctctgtata

SEQ ID NO: 561828 - DNA, 25 bp, Rattus norvegicus
taggtcctccgactatttaacttgt

SEQ ID NO: 561829 - DNA, 25 bp, Rattus norvegicus
taggtcctccgagtatttaacttgt

SEQ ID NO: 561830 - DNA, 25 bp, Rattus norvegicus
taggtcctctctccagtttcaagga

SEQ ID NO: 561831 - DNA, 25 bp, Rattus norvegicus
taggtcctctctgcagtttcaagga

SEQ ID NO: 561832 - DNA, 25 bp, Rattus norvegicus
taggtcctctgcagctgtacagaag

SEQ ID NO: 561833 - DNA, 25 bp, Rattus norvegicus
taggtcctctgctgctgtacagaag

SEQ ID NO: 561834 - DNA, 25 bp, Rattus norvegicus
taggtcctctggcactagagctaaa

SEQ ID NO: 561835 - DNA, 25 bp, Rattus norvegicus
taggtcctctgggactagagctaaa

SEQ ID NO: 561836 - DNA, 25 bp, Rattus norvegicus
taggtcctcttaaaacccagtgctc

SEQ ID NO: 561837 - DNA, 25 bp, Rattus norvegicus
taggtcctcttataacccagtgctc

SEQ ID NO: 561838 - DNA, 25 bp, Rattus norvegicus
taggtcctgagcaggccctaaacat

SEQ ID NO: 561839 - DNA, 25 bp, Rattus norvegicus
taggtcctgagctggccctaaacat

SEQ ID NO: 561840 - DNA, 25 bp, Rattus norvegicus
taggtcctgctcagtcatgatctca

SEQ ID NO: 561841 - DNA, 25 bp, Rattus norvegicus
taggtcctgctctgtcatgatctca

SEQ ID NO: 561842 - DNA, 25 bp, Rattus norvegicus
taggtcctggaaaagcactgcaaat

SEQ ID NO: 561843 - DNA, 25 bp, Rattus norvegicus
taggtcctggaatagcactgcaaat

SEQ ID NO: 561844 - DNA, 25 bp, Rattus norvegicus
taggtcctgtatcatattttttctt

SEQ ID NO: 561845 - DNA, 25 bp, Rattus norvegicus
taggtcctgtatgatattttttctt

SEQ ID NO: 561846 - DNA, 25 bp, Rattus norvegicus
taggtccttaaaattccaggtgtgg

SEQ ID NO: 561847 - DNA, 25 bp, Rattus norvegicus
taggtccttaaatttccaggtgtgg

SEQ ID NO: 561848 - DNA, 25 bp, Rattus norvegicus
taggtccttctgctgctaagccatg

SEQ ID NO: 561849 - DNA, 25 bp, Rattus norvegicus
taggtccttctggtgctaagccatg

SEQ ID NO: 561850 - DNA, 25 bp, Rattus norvegicus
taggtccttcttcggtggtcctcag

SEQ ID NO: 561851 - DNA, 25 bp, Rattus norvegicus
taggtccttcttgggtggtcctcag

SEQ ID NO: 561852 - DNA, 25 bp, Rattus norvegicus
taggtcgcacatcctgaccaatgcc

SEQ ID NO: 561853 - DNA, 25 bp, Rattus norvegicus
taggtcgcacatgctgaccaatgcc

SEQ ID NO: 561854 - DNA, 25 bp, Rattus norvegicus
taggtcgctctgattcagctacctg

SEQ ID NO: 561855 - DNA, 25 bp, Rattus norvegicus
taggtcgctctgtttcagctacctg

SEQ ID NO: 561856 - DNA, 25 bp, Rattus norvegicus
taggtcgctgtcatcaaactttttt

SEQ ID NO: 561857 - DNA, 25 bp, Rattus norvegicus
taggtcgctgtcttcaaactttttt

SEQ ID NO: 561858 - DNA, 25 bp, Rattus norvegicus
taggtcggctctaagggaagcccgt

SEQ ID NO: 561859 - DNA, 25 bp, Rattus norvegicus
taggtcggctcttagggaagcccgt

SEQ ID NO: 561860 - DNA, 25 bp, Rattus norvegicus
taggtcgtacttagcgttgtgaaac

SEQ ID NO: 561861 - DNA, 25 bp, Rattus norvegicus
taggtcgtactttgcgttgtgaaac

SEQ ID NO: 561862 - DNA, 25 bp, Rattus norvegicus
taggtcgttcatacatccctttctt

SEQ ID NO: 561863 - DNA, 25 bp, Rattus norvegicus
taggtcgttcattcatccctttctt

SEQ ID NO: 561864 - DNA, 25 bp, Rattus norvegicus
taggtctaaccccagccaaagatga

SEQ ID NO: 561865 - DNA, 25 bp, Rattus norvegicus
taggtctaacccgagccaaagatga

SEQ ID NO: 561866 - DNA, 25 bp, Rattus norvegicus
taggtctcaccgacaaggatggctc

SEQ ID NO: 561867 - DNA, 25 bp, Rattus norvegicus
taggtctcaccgtcaaggatggctc

SEQ ID NO: 561868 - DNA, 25 bp, Rattus norvegicus
taggtctcatctcttcaggttctca

SEQ ID NO: 561869 - DNA, 25 bp, Rattus norvegicus
taggtctcatctgttcaggttctca

SEQ ID NO: 561870 - DNA, 25 bp, Rattus norvegicus
taggtctcatgtagccattttcttt

SEQ ID NO: 561871 - DNA, 25 bp, Rattus norvegicus
taggtctcatgttgccattttcttt

SEQ ID NO: 561872 - DNA, 25 bp, Rattus norvegicus
taggtctccgtccttcggactggtg

SEQ ID NO: 561873 - DNA, 25 bp, Rattus norvegicus
taggtctccgtcgttcggactggtg

SEQ ID NO: 561874 - DNA, 25 bp, Rattus norvegicus
taggtctcctgtaatgtagcaccca

SEQ ID NO: 561875 - DNA, 25 bp, Rattus norvegicus
taggtctcctgttatgtagcaccca

SEQ ID NO: 561876 - DNA, 25 bp, Rattus norvegicus
taggtctctctccacatacaaacat

SEQ ID NO: 561877 - DNA, 25 bp, Rattus norvegicus
taggtctctctcgacatacaaacat

SEQ ID NO: 561878 - DNA, 25 bp, Rattus norvegicus
taggtctcttccctgtgatattcat

SEQ ID NO: 561879 - DNA, 25 bp, Rattus norvegicus
taggtctcttccgtgtgatattcat

SEQ ID NO: 561880 - DNA, 25 bp, Rattus norvegicus
taggtctgcagtcctgactctggga

SEQ ID NO: 561881 - DNA, 25 bp, Rattus norvegicus
taggtctgcagtgctgactctggga

SEQ ID NO: 561882 - DNA, 25 bp, Rattus norvegicus
taggtctgctgcattttgttgctgc

SEQ ID NO: 561883 - DNA, 25 bp, Rattus norvegicus
taggtctgctgctttttgttgctgc

SEQ ID NO: 561884 - DNA, 25 bp, Rattus norvegicus
taggtctgcttcctgtcacttaaca

SEQ ID NO: 561885 - DNA, 25 bp, Rattus norvegicus
taggtctgcttcgtgtcacttaaca

SEQ ID NO: 561886 - DNA, 25 bp, Rattus norvegicus
taggtctgtcagatagtctggccct

SEQ ID NO: 561887 - DNA, 25 bp, Rattus norvegicus
taggtctgtcagttagtctggccct

SEQ ID NO: 561888 - DNA, 25 bp, Rattus norvegicus
taggtctgtgatcgtccggacatac

SEQ ID NO: 561889 - DNA, 25 bp, Rattus norvegicus
taggtctgtgatggtccggacatac

SEQ ID NO: 561890 - DNA, 25 bp, Rattus norvegicus
taggtctgtgggaaggaactacaag

SEQ ID NO: 561891 - DNA, 25 bp, Rattus norvegicus
taggtctgtgggtaggaactacaag

SEQ ID NO: 561892 - DNA, 25 bp, Rattus norvegicus
taggtctgtgtgatctggctggaat

SEQ ID NO: 561893 - DNA, 25 bp, Rattus norvegicus
taggtctgtgtgttctggctggaat

SEQ ID NO: 561894 - DNA, 25 bp, Rattus norvegicus
taggtcttacttccttacctcagag

SEQ ID NO: 561895 - DNA, 25 bp, Rattus norvegicus
taggtcttacttgcttacctcagag

SEQ ID NO: 561896 - DNA, 25 bp, Rattus norvegicus
taggtcttcccacgtaccttgtaga

SEQ ID NO: 561897 - DNA, 25 bp, Rattus norvegicus
taggtcttcccaggtaccttgtaga

SEQ ID NO: 561898 - DNA, 25 bp, Rattus norvegicus
taggtcttccttatatagatatgtc

SEQ ID NO: 561899 - DNA, 25 bp, Rattus norvegicus
taggtcttccttttatagatatgtc

SEQ ID NO: 561900 - DNA, 25 bp, Rattus norvegicus
taggtcttctaaccccacatgtggg

SEQ ID NO: 561901 - DNA, 25 bp, Rattus norvegicus
taggtcttctaagcccacatgtggg

SEQ ID NO: 561902 - DNA, 25 bp, Rattus norvegicus
taggtcttgagacaacacccagctc

SEQ ID NO: 561903 - DNA, 25 bp, Rattus norvegicus
taggtcttgagagaacacccagctc

SEQ ID NO: 561904 - DNA, 25 bp, Rattus norvegicus
taggtcttgcaccactcacagaaca

SEQ ID NO: 561905 - DNA, 25 bp, Rattus norvegicus
taggtcttgcacgactcacagaaca

SEQ ID NO: 561906 - DNA, 25 bp, Rattus norvegicus
taggtcttgccccaaggcctttggc

SEQ ID NO: 561907 - DNA, 25 bp, Rattus norvegicus
taggtcttgcccgaaggcctttggc

SEQ ID NO: 561908 - DNA, 25 bp, Rattus norvegicus
taggtcttgtccactgagctcataa

SEQ ID NO: 561909 - DNA, 25 bp, Rattus norvegicus
taggtcttgtcctctgagctcataa

SEQ ID NO: 561910 - DNA, 25 bp, Rattus norvegicus
taggtctttgccatcctggagcact

SEQ ID NO: 561911 - DNA, 25 bp, Rattus norvegicus
taggtctttgccttcctggagcact

SEQ ID NO: 561912 - DNA, 25 bp, Rattus norvegicus
taggtctttgctcatgtgttctccc

SEQ ID NO: 561913 - DNA, 25 bp, Rattus norvegicus
taggtctttgctgatgtgttctccc

SEQ ID NO: 561914 - DNA, 25 bp, Rattus norvegicus
taggtcttttcccatttaggctagg

SEQ ID NO: 561915 - DNA, 25 bp, Rattus norvegicus
taggtcttttccgatttaggctagg

SEQ ID NO: 561916 - DNA, 25 bp, Rattus norvegicus
taggtgaaatgcacatttgccatga

SEQ ID NO: 561917 - DNA, 25 bp, Rattus norvegicus
taggtgaaatgctcatttgccatga

SEQ ID NO: 561918 - DNA, 25 bp, Rattus norvegicus
taggtgaactatattcccagccttc

SEQ ID NO: 561919 - DNA, 25 bp, Rattus norvegicus
taggtgaactattttcccagccttc

SEQ ID NO: 561920 - DNA, 25 bp, Rattus norvegicus
taggtgacacacatgtgcctcaaac

SEQ ID NO: 561921 - DNA, 25 bp, Rattus norvegicus
taggtgacacacttgtgcctcaaac

SEQ ID NO: 561922 - DNA, 25 bp, Rattus norvegicus
taggtgacacctctgacctacagct

SEQ ID NO: 561923 - DNA, 25 bp, Rattus norvegicus
taggtgacacctgtgacctacagct

SEQ ID NO: 561924 - DNA, 25 bp, Rattus norvegicus
taggtgacatatcccactccttact

SEQ ID NO: 561925 - DNA, 25 bp, Rattus norvegicus
taggtgacatatgccactccttact

SEQ ID NO: 561926 - DNA, 25 bp, Rattus norvegicus
taggtgacgctaacctgtcagcagc

SEQ ID NO: 561927 - DNA, 25 bp, Rattus norvegicus
taggtgacgctatcctgtcagcagc

SEQ ID NO: 561928 - DNA, 25 bp, Rattus norvegicus
taggtgacggttaatactgacagac

SEQ ID NO: 561929 - DNA, 25 bp, Rattus norvegicus
taggtgacggtttatactgacagac

SEQ ID NO: 561930 - DNA, 25 bp, Rattus norvegicus
taggtgactaaactgcgcgtgccat

SEQ ID NO: 561931 - DNA, 25 bp, Rattus norvegicus
taggtgactaaagtgcgcgtgccat

SEQ ID NO: 561932 - DNA, 25 bp, Rattus norvegicus
taggtgactcacaagcacaagtaac

SEQ ID NO: 561933 - DNA, 25 bp, Rattus norvegicus
taggtgactcactagcacaagtaac

SEQ ID NO: 561934 - DNA, 25 bp, Rattus norvegicus
taggtgactcccagagtgcagccat

SEQ ID NO: 561935 - DNA, 25 bp, Rattus norvegicus
taggtgactccctgagtgcagccat

SEQ ID NO: 561936 - DNA, 25 bp, Rattus norvegicus
taggtgactctaaaacctccagcca

SEQ ID NO: 561937 - DNA, 25 bp, Rattus norvegicus
taggtgactctataacctccagcca

SEQ ID NO: 561938 - DNA, 25 bp, Rattus norvegicus
taggtgacttacacatctaacccct

SEQ ID NO: 561939 - DNA, 25 bp, Rattus norvegicus
taggtgacttactcatctaacccct

SEQ ID NO: 561940 - DNA, 25 bp, Rattus norvegicus
taggtgacttttctaaccccatcag

SEQ ID NO: 561941 - DNA, 25 bp, Rattus norvegicus
taggtgacttttgtaaccccatcag

SEQ ID NO: 561942 - DNA, 25 bp, Rattus norvegicus
taggtgagctccattcccactgagc

SEQ ID NO: 561943 - DNA, 25 bp, Rattus norvegicus
taggtgagctcctttcccactgagc

SEQ ID NO: 561944 - DNA, 25 bp, Rattus norvegicus
taggtgaggcctacgtcatccagag

SEQ ID NO: 561945 - DNA, 25 bp, Rattus norvegicus
taggtgaggccttcgtcatccagag

SEQ ID NO: 561946 - DNA, 25 bp, Rattus norvegicus
taggtgagggccaaacccagcagca

SEQ ID NO: 561947 - DNA, 25 bp, Rattus norvegicus
taggtgagggcctaacccagcagca

SEQ ID NO: 561948 - DNA, 25 bp, Rattus norvegicus
taggtgaggtccaggctgcagcatc

SEQ ID NO: 561949 - DNA, 25 bp, Rattus norvegicus
taggtgaggtcctggctgcagcatc

SEQ ID NO: 561950 - DNA, 25 bp, Rattus norvegicus
taggtgatacctatcaaaccgccct

SEQ ID NO: 561951 - DNA, 25 bp, Rattus norvegicus
taggtgatacctttcaaaccgccct

SEQ ID NO: 561952 - DNA, 25 bp, Rattus norvegicus
taggtgatccagctcaaaagttgat

SEQ ID NO: 561953 - DNA, 25 bp, Rattus norvegicus
taggtgatccaggtcaaaagttgat

SEQ ID NO: 561954 - DNA, 25 bp, Rattus norvegicus
taggtgatgcatctgcctgggttac

SEQ ID NO: 561955 - DNA, 25 bp, Rattus norvegicus
taggtgatgcatgtgcctgggttac

SEQ ID NO: 561956 - DNA, 25 bp, Rattus norvegicus
taggtgcaaaatcccgtgcgttcct

SEQ ID NO: 561957 - DNA, 25 bp, Rattus norvegicus
taggtgcaaaatgccgtgcgttcct

SEQ ID NO: 561958 - DNA, 25 bp, Rattus norvegicus
taggtgcacggaaccaggtttctgg

SEQ ID NO: 561959 - DNA, 25 bp, Rattus norvegicus
taggtgcacggatccaggtttctgg

SEQ ID NO: 561960 - DNA, 25 bp, Rattus norvegicus
taggtgcaggcaaagactagtgttt

SEQ ID NO: 561961 - DNA, 25 bp, Rattus norvegicus
taggtgcaggcatagactagtgttt

SEQ ID NO: 561962 - DNA, 25 bp, Rattus norvegicus
taggtgccagcaacccggaagtgaa

SEQ ID NO: 561963 - DNA, 25 bp, Rattus norvegicus
taggtgccagcatcccggaagtgaa

SEQ ID NO: 561964 - DNA, 25 bp, Rattus norvegicus
taggtgccagttattaattgccgcc

SEQ ID NO: 561965 - DNA, 25 bp, Rattus norvegicus
taggtgccagtttttaattgccgcc

SEQ ID NO: 561966 - DNA, 25 bp, Rattus norvegicus
taggtgcccgacaccaaacttgagg

SEQ ID NO: 561967 - DNA, 25 bp, Rattus norvegicus
taggtgcccgactccaaacttgagg

SEQ ID NO: 561968 - DNA, 25 bp, Rattus norvegicus
taggtgcccgtcacataatgccgtg

SEQ ID NO: 561969 - DNA, 25 bp, Rattus norvegicus
taggtgcccgtctcataatgccgtg

SEQ ID NO: 561970 - DNA, 25 bp, Rattus norvegicus
taggtgcccgtgctaaggtggcctt

SEQ ID NO: 561971 - DNA, 25 bp, Rattus norvegicus
taggtgcccgtggtaaggtggcctt

SEQ ID NO: 561972 - DNA, 25 bp, Rattus norvegicus
taggtgcctcctcttttgttggtaa

SEQ ID NO: 561973 - DNA, 25 bp, Rattus norvegicus
taggtgcctcctgttttgttggtaa

SEQ ID NO: 561974 - DNA, 25 bp, Rattus norvegicus
taggtgctaggccttcttcacagaa

SEQ ID NO: 561975 - DNA, 25 bp, Rattus norvegicus
taggtgctaggcgttcttcacagaa

SEQ ID NO: 561976 - DNA, 25 bp, Rattus norvegicus
taggtgctccctactcactgttatc

SEQ ID NO: 561977 - DNA, 25 bp, Rattus norvegicus
taggtgctcccttctcactgttatc

SEQ ID NO: 561978 - DNA, 25 bp, Rattus norvegicus
taggtgctgaatccatatgccaaat

SEQ ID NO: 561979 - DNA, 25 bp, Rattus norvegicus
taggtgctgaatgcatatgccaaat

SEQ ID NO: 561980 - DNA, 25 bp, Rattus norvegicus
taggtgctgagacctttggctccca

SEQ ID NO: 561981 - DNA, 25 bp, Rattus norvegicus
taggtgctgagagctttggctccca

SEQ ID NO: 561982 - DNA, 25 bp, Rattus norvegicus
taggtgcttgggatcgcgccctata

SEQ ID NO: 561983 - DNA, 25 bp, Rattus norvegicus
taggtgcttgggttcgcgccctata

SEQ ID NO: 561984 - DNA, 25 bp, Rattus norvegicus
taggtggaccatagaccaggttaac

SEQ ID NO: 561985 - DNA, 25 bp, Rattus norvegicus
taggtggaccattgaccaggttaac

SEQ ID NO: 561986 - DNA, 25 bp, Rattus norvegicus
taggtggactctagggctcttccca

SEQ ID NO: 561987 - DNA, 25 bp, Rattus norvegicus
taggtggactcttgggctcttccca

SEQ ID NO: 561988 - DNA, 25 bp, Rattus norvegicus
taggtggatacacttaacccctgca

SEQ ID NO: 561989 - DNA, 25 bp, Rattus norvegicus
taggtggatacagttaacccctgca

SEQ ID NO: 561990 - DNA, 25 bp, Rattus norvegicus
taggtggcaacaatccccacttttc

SEQ ID NO: 561991 - DNA, 25 bp, Rattus norvegicus
taggtggcaacattccccacttttc

SEQ ID NO: 561992 - DNA, 25 bp, Rattus norvegicus
taggtggcccttatcctgagcccaa

SEQ ID NO: 561993 - DNA, 25 bp, Rattus norvegicus
taggtggcccttttcctgagcccaa

SEQ ID NO: 561994 - DNA, 25 bp, Rattus norvegicus
taggtggcctggaagttggcatcct

SEQ ID NO: 561995 - DNA, 25 bp, Rattus norvegicus
taggtggcctggtagttggcatcct

SEQ ID NO: 561996 - DNA, 25 bp, Rattus norvegicus
taggtggccttgactcatggtgacc

SEQ ID NO: 561997 - DNA, 25 bp, Rattus norvegicus
taggtggccttgtctcatggtgacc

SEQ ID NO: 561998 - DNA, 25 bp, Rattus norvegicus
taggtggcgtttacatttgcctgac

SEQ ID NO: 561999 - DNA, 25 bp, Rattus norvegicus
taggtggcgttttcatttgcctgac

SEQ ID NO: 562000 - DNA, 25 bp, Rattus norvegicus
taggtggcttcaaaggagaccctcc

SEQ ID NO: 562001 - DNA, 25 bp, Rattus norvegicus
taggtggcttcataggagaccctcc

SEQ ID NO: 562002 - DNA, 25 bp, Rattus norvegicus
taggtgggaaccagcctgaatccag

SEQ ID NO: 562003 - DNA, 25 bp, Rattus norvegicus
taggtgggaacctgcctgaatccag

SEQ ID NO: 562004 - DNA, 25 bp, Rattus norvegicus
taggtgggcagcattgtatcagaaa

SEQ ID NO: 562005 - DNA, 25 bp, Rattus norvegicus
taggtgggcagctttgtatcagaaa

SEQ ID NO: 562006 - DNA, 25 bp, Rattus norvegicus
taggtgggcagtatgtcaatttcag

SEQ ID NO: 562007 - DNA, 25 bp, Rattus norvegicus
taggtgggcagtttgtcaatttcag

SEQ ID NO: 562008 - DNA, 25 bp, Rattus norvegicus
taggtgggcccaaagcctgctaccc

SEQ ID NO: 562009 - DNA, 25 bp, Rattus norvegicus
taggtgggcccatagcctgctaccc

SEQ ID NO: 562010 - DNA, 25 bp, Rattus norvegicus
taggtgggccttaaacacacacagt

SEQ ID NO: 562011 - DNA, 25 bp, Rattus norvegicus
taggtgggcctttaacacacacagt

SEQ ID NO: 562012 - DNA, 25 bp, Rattus norvegicus
taggtgggctacacattggctttta

SEQ ID NO: 562013 - DNA, 25 bp, Rattus norvegicus
taggtgggctactcattggctttta

SEQ ID NO: 562014 - DNA, 25 bp, Rattus norvegicus
taggtgggctccagttttccttaat

SEQ ID NO: 562015 - DNA, 25 bp, Rattus norvegicus
taggtgggctcctgttttccttaat

SEQ ID NO: 562016 - DNA, 25 bp, Rattus norvegicus
taggtgggtgctactgacattgctg

SEQ ID NO: 562017 - DNA, 25 bp, Rattus norvegicus
taggtgggtgcttctgacattgctg

SEQ ID NO: 562018 - DNA, 25 bp, Rattus norvegicus
taggtggtagatctgttggcccttt

SEQ ID NO: 562019 - DNA, 25 bp, Rattus norvegicus
taggtggtagatgtgttggcccttt

SEQ ID NO: 562020 - DNA, 25 bp, Rattus norvegicus
taggtggtcccaactacctgtacaa

SEQ ID NO: 562021 - DNA, 25 bp, Rattus norvegicus
taggtggtcccatctacctgtacaa

SEQ ID NO: 562022 - DNA, 25 bp, Rattus norvegicus
taggtggtgcaccacagcctgtaat

SEQ ID NO: 562023 - DNA, 25 bp, Rattus norvegicus
taggtggtgcacgacagcctgtaat

SEQ ID NO: 562024 - DNA, 25 bp, Rattus norvegicus
taggtgtaagccctggtttcgcctt

SEQ ID NO: 562025 - DNA, 25 bp, Rattus norvegicus
taggtgtaagccgtggtttcgcctt

SEQ ID NO: 562026 - DNA, 25 bp, Rattus norvegicus
taggtgtatgctagcacgctcagtc

SEQ ID NO: 562027 - DNA, 25 bp, Rattus norvegicus
taggtgtatgcttgcacgctcagtc

SEQ ID NO: 562028 - DNA, 25 bp, Rattus norvegicus
taggtgtcacctagagagtcctgct

SEQ ID NO: 562029 - DNA, 25 bp, Rattus norvegicus
taggtgtcaccttgagagtcctgct

SEQ ID NO: 562030 - DNA, 25 bp, Rattus norvegicus
taggtgtcctaacagctaccatgtc

SEQ ID NO: 562031 - DNA, 25 bp, Rattus norvegicus
taggtgtcctaagagctaccatgtc

SEQ ID NO: 562032 - DNA, 25 bp, Rattus norvegicus
taggtgtcctggctccccacaggga

SEQ ID NO: 562033 - DNA, 25 bp, Rattus norvegicus
taggtgtcctgggtccccacaggga

SEQ ID NO: 562034 - DNA, 25 bp, Rattus norvegicus
taggtgtgaccaacgtccaaagctc

SEQ ID NO: 562035 - DNA, 25 bp, Rattus norvegicus
taggtgtgaccatcgtccaaagctc

SEQ ID NO: 562036 - DNA, 25 bp, Rattus norvegicus
taggtgtgcacccatctgctcagag

SEQ ID NO: 562037 - DNA, 25 bp, Rattus norvegicus
taggtgtgcaccgatctgctcagag

SEQ ID NO: 562038 - DNA, 25 bp, Rattus norvegicus
taggtgtgctggatgctcagatctt

SEQ ID NO: 562039 - DNA, 25 bp, Rattus norvegicus
taggtgtgctggttgctcagatctt

SEQ ID NO: 562040 - DNA, 25 bp, Rattus norvegicus
taggtgtggcatctagtttcctctc

SEQ ID NO: 562041 - DNA, 25 bp, Rattus norvegicus
taggtgtggcatgtagtttcctctc

SEQ ID NO: 562042 - DNA, 25 bp, Rattus norvegicus
taggtgtgtctcaaggtagtcccct

SEQ ID NO: 562043 - DNA, 25 bp, Rattus norvegicus
taggtgtgtctctaggtagtcccct

SEQ ID NO: 562044 - DNA, 25 bp, Rattus norvegicus
taggtgttctagagcagtccttcac

SEQ ID NO: 562045 - DNA, 25 bp, Rattus norvegicus
taggtgttctagtgcagtccttcac

SEQ ID NO: 562046 - DNA, 25 bp, Rattus norvegicus
taggtgttgaccagtaggccctgta

SEQ ID NO: 562047 - DNA, 25 bp, Rattus norvegicus
taggtgttgacctgtaggccctgta

SEQ ID NO: 562048 - DNA, 25 bp, Rattus norvegicus
taggtgtttcccattcagcattctg

SEQ ID NO: 562049 - DNA, 25 bp, Rattus norvegicus
taggtgtttccctttcagcattctg

SEQ ID NO: 562050 - DNA, 25 bp, Rattus norvegicus
taggtgtttttgaggccttgaggcc

SEQ ID NO: 562051 - DNA, 25 bp, Rattus norvegicus
taggtgtttttgtggccttgaggcc

SEQ ID NO: 562052 - DNA, 25 bp, Rattus norvegicus
taggttaacccaatgtcccattgtc

SEQ ID NO: 562053 - DNA, 25 bp, Rattus norvegicus
taggttaacccattgtcccattgtc

SEQ ID NO: 562054 - DNA, 25 bp, Rattus norvegicus
taggttaatgagaccggtcccagta

SEQ ID NO: 562055 - DNA, 25 bp, Rattus norvegicus
taggttaatgagtccggtcccagta

SEQ ID NO: 562056 - DNA, 25 bp, Rattus norvegicus
taggttaccccaccttgtctgacgc

SEQ ID NO: 562057 - DNA, 25 bp, Rattus norvegicus
taggttaccccagcttgtctgacgc

SEQ ID NO: 562058 - DNA, 25 bp, Rattus norvegicus
taggttagctctctcagtctgctac

SEQ ID NO: 562059 - DNA, 25 bp, Rattus norvegicus
taggttagctctgtcagtctgctac

SEQ ID NO: 562060 - DNA, 25 bp, Rattus norvegicus
taggttagctttagagcctcccagt

SEQ ID NO: 562061 - DNA, 25 bp, Rattus norvegicus
taggttagcttttgagcctcccagt

SEQ ID NO: 562062 - DNA, 25 bp, Rattus norvegicus
taggttatactcaccacgtacagtg

SEQ ID NO: 562063 - DNA, 25 bp, Rattus norvegicus
taggttatactctccacgtacagtg

SEQ ID NO: 562064 - DNA, 25 bp, Rattus norvegicus
taggttatatatagaattccaggcc

SEQ ID NO: 562065 - DNA, 25 bp, Rattus norvegicus
taggttatatattgaattccaggcc

SEQ ID NO: 562066 - DNA, 25 bp, Rattus norvegicus
taggttatgcagacaatggtataga

SEQ ID NO: 562067 - DNA, 25 bp, Rattus norvegicus
taggttatgcagtcaatggtataga

SEQ ID NO: 562068 - DNA, 25 bp, Rattus norvegicus
taggttattgcactcctactggccg

SEQ ID NO: 562069 - DNA, 25 bp, Rattus norvegicus
taggttattgcagtcctactggccg

SEQ ID NO: 562070 - DNA, 25 bp, Rattus norvegicus
taggttcaacctaacacattatgtt

SEQ ID NO: 562071 - DNA, 25 bp, Rattus norvegicus
taggttcaaccttacacattatgtt

SEQ ID NO: 562072 - DNA, 25 bp, Rattus norvegicus
taggttcaccgacatgatctcgcac

SEQ ID NO: 562073 - DNA, 25 bp, Rattus norvegicus
taggttcaccgagatgatctcgcac

SEQ ID NO: 562074 - DNA, 25 bp, Rattus norvegicus
taggttcaccttagtaactaagtag

SEQ ID NO: 562075 - DNA, 25 bp, Rattus norvegicus
taggttcacctttgtaactaagtag

SEQ ID NO: 562076 - DNA, 25 bp, Rattus norvegicus
taggttcaggagctcattagtgtct

SEQ ID NO: 562077 - DNA, 25 bp, Rattus norvegicus
taggttcaggaggtcattagtgtct

SEQ ID NO: 562078 - DNA, 25 bp, Rattus norvegicus
taggttcaggcccagcctaagtaac

SEQ ID NO: 562079 - DNA, 25 bp, Rattus norvegicus
taggttcaggccgagcctaagtaac

SEQ ID NO: 562080 - DNA, 25 bp, Rattus norvegicus
taggttcatattaggctgctctcaa

SEQ ID NO: 562081 - DNA, 25 bp, Rattus norvegicus
taggttcatatttggctgctctcaa

SEQ ID NO: 562082 - DNA, 25 bp, Rattus norvegicus
taggttcatgacactcatgcaggac

SEQ ID NO: 562083 - DNA, 25 bp, Rattus norvegicus
taggttcatgactctcatgcaggac

SEQ ID NO: 562084 - DNA, 25 bp, Rattus norvegicus
taggttcccaacagtggcgtggcac

SEQ ID NO: 562085 - DNA, 25 bp, Rattus norvegicus
taggttcccaactgtggcgtggcac

SEQ ID NO: 562086 - DNA, 25 bp, Rattus norvegicus
taggttcccacacagagggagcaat

SEQ ID NO: 562087 - DNA, 25 bp, Rattus norvegicus
taggttcccacagagagggagcaat

SEQ ID NO: 562088 - DNA, 25 bp, Rattus norvegicus
taggttccctagagacacatcgccc

SEQ ID NO: 562089 - DNA, 25 bp, Rattus norvegicus
taggttccctagtgacacatcgccc

SEQ ID NO: 562090 - DNA, 25 bp, Rattus norvegicus
taggttccctccagagagccagcga

SEQ ID NO: 562091 - DNA, 25 bp, Rattus norvegicus
taggttccctcctgagagccagcga

SEQ ID NO: 562092 - DNA, 25 bp, Rattus norvegicus
taggttcccttgacgtgacaaattc

SEQ ID NO: 562093 - DNA, 25 bp, Rattus norvegicus
taggttcccttgtcgtgacaaattc

SEQ ID NO: 562094 - DNA, 25 bp, Rattus norvegicus
taggttcctaatctgcttcaactgg

SEQ ID NO: 562095 - DNA, 25 bp, Rattus norvegicus
taggttcctaatgtgcttcaactgg

SEQ ID NO: 562096 - DNA, 25 bp, Rattus norvegicus
taggttcctatccactcatcttggg

SEQ ID NO: 562097 - DNA, 25 bp, Rattus norvegicus
taggttcctatcgactcatcttggg

SEQ ID NO: 562098 - DNA, 25 bp, Rattus norvegicus
taggttcctcgacgcagagttgtct

SEQ ID NO: 562099 - DNA, 25 bp, Rattus norvegicus
taggttcctcgaggcagagttgtct

SEQ ID NO: 562100 - DNA, 25 bp, Rattus norvegicus
taggttccttttcagtctgtcaacc

SEQ ID NO: 562101 - DNA, 25 bp, Rattus norvegicus
taggttccttttgagtctgtcaacc

SEQ ID NO: 562102 - DNA, 25 bp, Rattus norvegicus
taggttcgtagcatggttgtggata

SEQ ID NO: 562103 - DNA, 25 bp, Rattus norvegicus
taggttcgtagcttggttgtggata

SEQ ID NO: 562104 - DNA, 25 bp, Rattus norvegicus
taggttctagttcctttcttccggt

SEQ ID NO: 562105 - DNA, 25 bp, Rattus norvegicus
taggttctagttgctttcttccggt

SEQ ID NO: 562106 - DNA, 25 bp, Rattus norvegicus
taggttctcataatagttcaagtca

SEQ ID NO: 562107 - DNA, 25 bp, Rattus norvegicus
taggttctcatattagttcaagtca

SEQ ID NO: 562108 - DNA, 25 bp, Rattus norvegicus
taggttctgaccatttgcaaatgaa

SEQ ID NO: 562109 - DNA, 25 bp, Rattus norvegicus
taggttctgaccttttgcaaatgaa

SEQ ID NO: 562110 - DNA, 25 bp, Rattus norvegicus
taggttctgcctctgcggagtaaca

SEQ ID NO: 562111 - DNA, 25 bp, Rattus norvegicus
taggttctgcctgtgcggagtaaca

SEQ ID NO: 562112 - DNA, 25 bp, Rattus norvegicus
taggttctgtttctcggtgctgtaa

SEQ ID NO: 562113 - DNA, 25 bp, Rattus norvegicus
taggttctgtttgtcggtgctgtaa

SEQ ID NO: 562114 - DNA, 25 bp, Rattus norvegicus
taggttcttaagaaccctgactgaa

SEQ ID NO: 562115 - DNA, 25 bp, Rattus norvegicus
taggttcttaagtaccctgactgaa

SEQ ID NO: 562116 - DNA, 25 bp, Rattus norvegicus
taggttcttcaaaccttggaggatt

SEQ ID NO: 562117 - DNA, 25 bp, Rattus norvegicus
taggttcttcaatccttggaggatt

SEQ ID NO: 562118 - DNA, 25 bp, Rattus norvegicus
taggttcttggacagccgactcacc

SEQ ID NO: 562119 - DNA, 25 bp, Rattus norvegicus
taggttcttggagagccgactcacc

SEQ ID NO: 562120 - DNA, 25 bp, Rattus norvegicus
taggttgaagtcattcctccttcct

SEQ ID NO: 562121 - DNA, 25 bp, Rattus norvegicus
taggttgaagtctttcctccttcct

SEQ ID NO: 562122 - DNA, 25 bp, Rattus norvegicus
taggttgactgacttgaccctggat

SEQ ID NO: 562123 - DNA, 25 bp, Rattus norvegicus
taggttgactgagttgaccctggat

SEQ ID NO: 562124 - DNA, 25 bp, Rattus norvegicus
taggttgacttgcttctagccactt

SEQ ID NO: 562125 - DNA, 25 bp, Rattus norvegicus
taggttgacttggttctagccactt

SEQ ID NO: 562126 - DNA, 25 bp, Rattus norvegicus
taggttgatctgaggacggctccgc

SEQ ID NO: 562127 - DNA, 25 bp, Rattus norvegicus
taggttgatctgtggacggctccgc

SEQ ID NO: 562128 - DNA, 25 bp, Rattus norvegicus
taggttgccttgactagccttaata

SEQ ID NO: 562129 - DNA, 25 bp, Rattus norvegicus
taggttgccttgcaggtatgtctgt

SEQ ID NO: 562130 - DNA, 25 bp, Rattus norvegicus
taggttgccttggaggtatgtctgt

SEQ ID NO: 562131 - DNA, 25 bp, Rattus norvegicus
taggttgccttgtctagccttaata

SEQ ID NO: 562132 - DNA, 25 bp, Rattus norvegicus
taggttggcctgcaaatccacctgc

SEQ ID NO: 562133 - DNA, 25 bp, Rattus norvegicus
taggttggcctggaaatccacctgc

SEQ ID NO: 562134 - DNA, 25 bp, Rattus norvegicus
taggttggctccacggcaggatcct

SEQ ID NO: 562135 - DNA, 25 bp, Rattus norvegicus
taggttggctcctcggcaggatcct

SEQ ID NO: 562136 - DNA, 25 bp, Rattus norvegicus
taggttgtccttacaatgcatgtgc

SEQ ID NO: 562137 - DNA, 25 bp, Rattus norvegicus
taggttgtcctttcaatgcatgtgc

SEQ ID NO: 562138 - DNA, 25 bp, Rattus norvegicus
taggttgtgatcattttgccccact

SEQ ID NO: 562139 - DNA, 25 bp, Rattus norvegicus
taggttgtgatctttttgccccact

SEQ ID NO: 562140 - DNA, 25 bp, Rattus norvegicus
taggttgtgtgcctactgtagcttt

SEQ ID NO: 562141 - DNA, 25 bp, Rattus norvegicus
taggttgtgtgcgtactgtagcttt

SEQ ID NO: 562142 - DNA, 25 bp, Rattus norvegicus
taggttgtgtttctctatcagaaac

SEQ ID NO: 562143 - DNA, 25 bp, Rattus norvegicus
taggttgtgtttgtctatcagaaac

SEQ ID NO: 562144 - DNA, 25 bp, Rattus norvegicus
taggttgttgcaaaacgtgcttttc

SEQ ID NO: 562145 - DNA, 25 bp, Rattus norvegicus
taggttgttgcataacgtgcttttc

SEQ ID NO: 562146 - DNA, 25 bp, Rattus norvegicus
taggtttaaactaacagcctgattt

SEQ ID NO: 562147 - DNA, 25 bp, Rattus norvegicus
taggtttaaacttacagcctgattt

SEQ ID NO: 562148 - DNA, 25 bp, Rattus norvegicus
taggtttacactagtttcttagtga

SEQ ID NO: 562149 - DNA, 25 bp, Rattus norvegicus
taggtttacacttgtttcttagtga

SEQ ID NO: 562150 - DNA, 25 bp, Rattus norvegicus
taggtttacttcataggccagggcc

SEQ ID NO: 562151 - DNA, 25 bp, Rattus norvegicus
taggtttacttcttaggccagggcc

SEQ ID NO: 562152 - DNA, 25 bp, Rattus norvegicus
taggtttatatgctggctctcccag

SEQ ID NO: 562153 - DNA, 25 bp, Rattus norvegicus
taggtttatatggtggctctcccag

SEQ ID NO: 562154 - DNA, 25 bp, Rattus norvegicus
taggtttcctaaccatgtctagcat

SEQ ID NO: 562155 - DNA, 25 bp, Rattus norvegicus
taggtttcctaagcatgtctagcat

SEQ ID NO: 562156 - DNA, 25 bp, Rattus norvegicus
taggtttcctcaaacagctttatcc

SEQ ID NO: 562157 - DNA, 25 bp, Rattus norvegicus
taggtttcctcatacagctttatcc

SEQ ID NO: 562158 - DNA, 25 bp, Rattus norvegicus
taggtttcctggctccattttgata

SEQ ID NO: 562159 - DNA, 25 bp, Rattus norvegicus
taggtttcctgggtccattttgata

SEQ ID NO: 562160 - DNA, 25 bp, Rattus norvegicus
taggtttctaccagctcaaatctcc

SEQ ID NO: 562161 - DNA, 25 bp, Rattus norvegicus
taggtttctacctgctcaaatctcc

SEQ ID NO: 562162 - DNA, 25 bp, Rattus norvegicus
taggtttctagaaagggctcctttg

SEQ ID NO: 562163 - DNA, 25 bp, Rattus norvegicus
taggtttctagatagggctcctttg

SEQ ID NO: 562164 - DNA, 25 bp, Rattus norvegicus
taggtttcttcgctttagcgttcga

SEQ ID NO: 562165 - DNA, 25 bp, Rattus norvegicus
taggtttcttcggtttagcgttcga

SEQ ID NO: 562166 - DNA, 25 bp, Rattus norvegicus
taggtttgacgtcagcaccttccac

SEQ ID NO: 562167 - DNA, 25 bp, Rattus norvegicus
taggtttgacgtgagcaccttccac

SEQ ID NO: 562168 - DNA, 25 bp, Rattus norvegicus
taggtttgagctccacagtgtttca

SEQ ID NO: 562169 - DNA, 25 bp, Rattus norvegicus
taggtttgagctgcacagtgtttca

SEQ ID NO: 562170 - DNA, 25 bp, Rattus norvegicus
taggtttgaggcctcatcacttacc

SEQ ID NO: 562171 - DNA, 25 bp, Rattus norvegicus
taggtttgaggcgtcatcacttacc

SEQ ID NO: 562172 - DNA, 25 bp, Rattus norvegicus
taggtttgatcacacagccccagga

SEQ ID NO: 562173 - DNA, 25 bp, Rattus norvegicus
taggtttgatcagacagccccagga

SEQ ID NO: 562174 - DNA, 25 bp, Rattus norvegicus
taggtttggacacgtgcacctgcaa

SEQ ID NO: 562175 - DNA, 25 bp, Rattus norvegicus
taggtttggacaggtgcacctgcaa

SEQ ID NO: 562176 - DNA, 25 bp, Rattus norvegicus
taggtttggccgctcaggatcccgt

SEQ ID NO: 562177 - DNA, 25 bp, Rattus norvegicus
taggtttggccggtcaggatcccgt

SEQ ID NO: 562178 - DNA, 25 bp, Rattus norvegicus
taggtttgttttcccagtgtcagga

SEQ ID NO: 562179 - DNA, 25 bp, Rattus norvegicus
taggtttgttttgccagtgtcagga

SEQ ID NO: 562180 - DNA, 25 bp, Rattus norvegicus
taggttttaacgaatgccccgtcat

SEQ ID NO: 562181 - DNA, 25 bp, Rattus norvegicus
taggttttaacgtatgccccgtcat

SEQ ID NO: 562182 - DNA, 25 bp, Rattus norvegicus
taggttttacctctcatatcagttg

SEQ ID NO: 562183 - DNA, 25 bp, Rattus norvegicus
taggttttacctgtcatatcagttg

SEQ ID NO: 562184 - DNA, 25 bp, Rattus norvegicus
taggttttactaagtacgcctgccc

SEQ ID NO: 562185 - DNA, 25 bp, Rattus norvegicus
taggttttactatgtacgcctgccc

SEQ ID NO: 562186 - DNA, 25 bp, Rattus norvegicus
taggttttcacaactgttaactcag

SEQ ID NO: 562187 - DNA, 25 bp, Rattus norvegicus
taggttttcacatctgttaactcag

SEQ ID NO: 562188 - DNA, 25 bp, Rattus norvegicus
taggttttcagacccgagtaacacg

SEQ ID NO: 562189 - DNA, 25 bp, Rattus norvegicus
taggttttcagagccgagtaacacg

SEQ ID NO: 562190 - DNA, 25 bp, Rattus norvegicus
taggttttcataccgacccgattat

SEQ ID NO: 562191 - DNA, 25 bp, Rattus norvegicus
taggttttcatagcgacccgattat

SEQ ID NO: 562192 - DNA, 25 bp, Rattus norvegicus
taggttttcgtgaaagactcttgct

SEQ ID NO: 562193 - DNA, 25 bp, Rattus norvegicus
taggttttcgtgtaagactcttgct

SEQ ID NO: 562194 - DNA, 25 bp, Rattus norvegicus
taggttttctcaatcaggattgcaa

SEQ ID NO: 562195 - DNA, 25 bp, Rattus norvegicus
taggttttctcactttgacaagccc

SEQ ID NO: 562196 - DNA, 25 bp, Rattus norvegicus
taggttttctcagtttgacaagccc

SEQ ID NO: 562197 - DNA, 25 bp, Rattus norvegicus
taggttttctcattcaggattgcaa

SEQ ID NO: 562198 - DNA, 25 bp, Rattus norvegicus
taggttttgagtacctccatctgaa

SEQ ID NO: 562199 - DNA, 25 bp, Rattus norvegicus
taggttttgagttcctccatctgaa

SEQ ID NO: 562200 - DNA, 25 bp, Rattus norvegicus
taggttttggtcattactgctctgc

SEQ ID NO: 562201 - DNA, 25 bp, Rattus norvegicus
taggttttggtctttactgctctgc

SEQ ID NO: 562202 - DNA, 25 bp, Rattus norvegicus
taggttttgttacttctaatacatt

SEQ ID NO: 562203 - DNA, 25 bp, Rattus norvegicus
taggttttgttagttctaatacatt

SEQ ID NO: 562204 - DNA, 25 bp, Rattus norvegicus
taggttttgttcctgacagactccc

SEQ ID NO: 562205 - DNA, 25 bp, Rattus norvegicus
taggttttgttcgtgacagactccc

SEQ ID NO: 562206 - DNA, 25 bp, Rattus norvegicus
taggtttttctcataacagtcccag

SEQ ID NO: 562207 - DNA, 25 bp, Rattus norvegicus
taggtttttctcttaacagtcccag

SEQ ID NO: 562208 - DNA, 25 bp, Rattus norvegicus
taggtttttggcagagtactggaat

SEQ ID NO: 562209 - DNA, 25 bp, Rattus norvegicus
taggtttttggctgagtactggaat

SEQ ID NO: 562210 - DNA, 25 bp, Rattus norvegicus
tagtaaaacctcatgacttcttttt

SEQ ID NO: 562211 - DNA, 25 bp, Rattus norvegicus
tagtaaaacctcttgacttcttttt

SEQ ID NO: 562212 - DNA, 25 bp, Rattus norvegicus
tagtaaaccagccttaaatgcccca

SEQ ID NO: 562213 - DNA, 25 bp, Rattus norvegicus
tagtaaaccagcgttaaatgcccca

SEQ ID NO: 562214 - DNA, 25 bp, Rattus norvegicus
tagtaaactattatgtgcaccgaac

SEQ ID NO: 562215 - DNA, 25 bp, Rattus norvegicus
tagtaaactattttgtgcaccgaac

SEQ ID NO: 562216 - DNA, 25 bp, Rattus norvegicus
tagtaaactgtgcttgtggtctcct

SEQ ID NO: 562217 - DNA, 25 bp, Rattus norvegicus
tagtaaactgtggttgtggtctcct

SEQ ID NO: 562218 - DNA, 25 bp, Rattus norvegicus
tagtaaacttatacccacatctttc

SEQ ID NO: 562219 - DNA, 25 bp, Rattus norvegicus
tagtaaacttattcccacatctttc

SEQ ID NO: 562220 - DNA, 25 bp, Rattus norvegicus
tagtaaagtcagacactcagtggcg

SEQ ID NO: 562221 - DNA, 25 bp, Rattus norvegicus
tagtaaagtcagtcactcagtggcg

SEQ ID NO: 562222 - DNA, 25 bp, Rattus norvegicus
tagtaaatgcctctggactcgggac

SEQ ID NO: 562223 - DNA, 25 bp, Rattus norvegicus
tagtaaatgcctgtggactcgggac

SEQ ID NO: 562224 - DNA, 25 bp, Rattus norvegicus
tagtaaatgtacatatgagctcgga

SEQ ID NO: 562225 - DNA, 25 bp, Rattus norvegicus
tagtaaatgtacttatgagctcgga

SEQ ID NO: 562226 - DNA, 25 bp, Rattus norvegicus
tagtaaattctcaagcaaaaccttt

SEQ ID NO: 562227 - DNA, 25 bp, Rattus norvegicus
tagtaaattctctagcaaaaccttt

SEQ ID NO: 562228 - DNA, 25 bp, Rattus norvegicus
tagtaacacgtcctcacaaatgtcc

SEQ ID NO: 562229 - DNA, 25 bp, Rattus norvegicus
tagtaacacgtcgtcacaaatgtcc

SEQ ID NO: 562230 - DNA, 25 bp, Rattus norvegicus
tagtaacatagcacattggcctgtg

SEQ ID NO: 562231 - DNA, 25 bp, Rattus norvegicus
tagtaacatagctcattggcctgtg

SEQ ID NO: 562232 - DNA, 25 bp, Rattus norvegicus
tagtaaccacggcaggcaccaaggt

SEQ ID NO: 562233 - DNA, 25 bp, Rattus norvegicus
tagtaaccacgggaggcaccaaggt

SEQ ID NO: 562234 - DNA, 25 bp, Rattus norvegicus
tagtaaccagagacaggatggaagt

SEQ ID NO: 562235 - DNA, 25 bp, Rattus norvegicus
tagtaaccagagtcaggatggaagt

SEQ ID NO: 562236 - DNA, 25 bp, Rattus norvegicus
tagtaaccgttcctgaaaagccgct

SEQ ID NO: 562237 - DNA, 25 bp, Rattus norvegicus
tagtaaccgttcgtgaaaagccgct

SEQ ID NO: 562238 - DNA, 25 bp, Rattus norvegicus
tagtaacctcgcctctcttcttgaa

SEQ ID NO: 562239 - DNA, 25 bp, Rattus norvegicus
tagtaacctcgcgtctcttcttgaa

SEQ ID NO: 562240 - DNA, 25 bp, Rattus norvegicus
tagtaacctgctagtgttcctgtga

SEQ ID NO: 562241 - DNA, 25 bp, Rattus norvegicus
tagtaacctgcttgtgttcctgtga

SEQ ID NO: 562242 - DNA, 25 bp, Rattus norvegicus
tagtaaccttagaaacgcctccacg

SEQ ID NO: 562243 - DNA, 25 bp, Rattus norvegicus
tagtaaccttagtaacgcctccacg

SEQ ID NO: 562244 - DNA, 25 bp, Rattus norvegicus
tagtaacgaagcatccctgggagcc

SEQ ID NO: 562245 - DNA, 25 bp, Rattus norvegicus
tagtaacgaagcttccctgggagcc

SEQ ID NO: 562246 - DNA, 25 bp, Rattus norvegicus
tagtaacgtgcaagaatccccttgt

SEQ ID NO: 562247 - DNA, 25 bp, Rattus norvegicus
tagtaacgtgcatgaatccccttgt

SEQ ID NO: 562248 - DNA, 25 bp, Rattus norvegicus
tagtaactctaacctgttgtgttgg

SEQ ID NO: 562249 - DNA, 25 bp, Rattus norvegicus
tagtaactctaagctgttgtgttgg

SEQ ID NO: 562250 - DNA, 25 bp, Rattus norvegicus
tagtaactctggctgcattctgcca

SEQ ID NO: 562251 - DNA, 25 bp, Rattus norvegicus
tagtaactctgggtgcattctgcca

SEQ ID NO: 562252 - DNA, 25 bp, Rattus norvegicus
tagtaactgtagactctgctgctgc

SEQ ID NO: 562253 - DNA, 25 bp, Rattus norvegicus
tagtaactgtagtctctgctgctgc

SEQ ID NO: 562254 - DNA, 25 bp, Rattus norvegicus
tagtaactgtgtatttgctaccgtt

SEQ ID NO: 562255 - DNA, 25 bp, Rattus norvegicus
tagtaactgtgtttttgctaccgtt

SEQ ID NO: 562256 - DNA, 25 bp, Rattus norvegicus
tagtaacttgaacaatctgcccaaa

SEQ ID NO: 562257 - DNA, 25 bp, Rattus norvegicus
tagtaacttgaagaatctgcccaaa

SEQ ID NO: 562258 - DNA, 25 bp, Rattus norvegicus
tagtaacttgtacccaccgacatgt

SEQ ID NO: 562259 - DNA, 25 bp, Rattus norvegicus
tagtaacttgtagccaccgacatgt

SEQ ID NO: 562260 - DNA, 25 bp, Rattus norvegicus
tagtaactttccaaccttattgaag

SEQ ID NO: 562261 - DNA, 25 bp, Rattus norvegicus
tagtaactttcctaccttattgaag

SEQ ID NO: 562262 - DNA, 25 bp, Rattus norvegicus
tagtaagaactaagcctcataatta

SEQ ID NO: 562263 - DNA, 25 bp, Rattus norvegicus
tagtaagaactatgcctcataatta

SEQ ID NO: 562264 - DNA, 25 bp, Rattus norvegicus
tagtaagaccctcacttagaaccaa

SEQ ID NO: 562265 - DNA, 25 bp, Rattus norvegicus
tagtaagaccctgacttagaaccaa

SEQ ID NO: 562266 - DNA, 25 bp, Rattus norvegicus
tagtaagaccttccctcaaatgaaa

SEQ ID NO: 562267 - DNA, 25 bp, Rattus norvegicus
tagtaagaccttgcctcaaatgaaa

SEQ ID NO: 562268 - DNA, 25 bp, Rattus norvegicus
tagtaagagctcatagccaccgagc

SEQ ID NO: 562269 - DNA, 25 bp, Rattus norvegicus
tagtaagagctcttagccaccgagc

SEQ ID NO: 562270 - DNA, 25 bp, Rattus norvegicus
tagtaagcaattcccgtgtgtgctc

SEQ ID NO: 562271 - DNA, 25 bp, Rattus norvegicus
tagtaagcaattgccgtgtgtgctc

SEQ ID NO: 562272 - DNA, 25 bp, Rattus norvegicus
tagtaagcagatcaccaccctatgt

SEQ ID NO: 562273 - DNA, 25 bp, Rattus norvegicus
tagtaagcagatgaccaccctatgt

SEQ ID NO: 562274 - DNA, 25 bp, Rattus norvegicus
tagtaagccaccagacaaccaacag

SEQ ID NO: 562275 - DNA, 25 bp, Rattus norvegicus
tagtaagccaccagttcatgtccaa

SEQ ID NO: 562276 - DNA, 25 bp, Rattus norvegicus
tagtaagccacctgacaaccaacag

SEQ ID NO: 562277 - DNA, 25 bp, Rattus norvegicus
tagtaagccacctgttcatgtccaa

SEQ ID NO: 562278 - DNA, 25 bp, Rattus norvegicus
tagtaagccagtacaggactcctct

SEQ ID NO: 562279 - DNA, 25 bp, Rattus norvegicus
tagtaagccagttcaggactcctct

SEQ ID NO: 562280 - DNA, 25 bp, Rattus norvegicus
tagtaagccctgagcgagcgacaag

SEQ ID NO: 562281 - DNA, 25 bp, Rattus norvegicus
tagtaagccctgtgcgagcgacaag

SEQ ID NO: 562282 - DNA, 25 bp, Rattus norvegicus
tagtaagctccacgccagtcagaac

SEQ ID NO: 562283 - DNA, 25 bp, Rattus norvegicus
tagtaagctccaggccagtcagaac

SEQ ID NO: 562284 - DNA, 25 bp, Rattus norvegicus
tagtaaggagttactgttatcagtc

SEQ ID NO: 562285 - DNA, 25 bp, Rattus norvegicus
tagtaaggagtttctgttatcagtc

SEQ ID NO: 562286 - DNA, 25 bp, Rattus norvegicus
tagtaaggtgctagacggtcacatt

SEQ ID NO: 562287 - DNA, 25 bp, Rattus norvegicus
tagtaaggtgcttgacggtcacatt

SEQ ID NO: 562288 - DNA, 25 bp, Rattus norvegicus
tagtaagtacacaccttcccatgtc

SEQ ID NO: 562289 - DNA, 25 bp, Rattus norvegicus
tagtaagtacactccttcccatgtc

SEQ ID NO: 562290 - DNA, 25 bp, Rattus norvegicus
tagtaagtctcccagtacacgtcag

SEQ ID NO: 562291 - DNA, 25 bp, Rattus norvegicus
tagtaagtctccgagtacacgtcag

SEQ ID NO: 562292 - DNA, 25 bp, Rattus norvegicus
tagtaagtgtcaatctccgcagttt

SEQ ID NO: 562293 - DNA, 25 bp, Rattus norvegicus
tagtaagtgtcattctccgcagttt

SEQ ID NO: 562294 - DNA, 25 bp, Rattus norvegicus
tagtaatcacagcaccatactcgtg

SEQ ID NO: 562295 - DNA, 25 bp, Rattus norvegicus
tagtaatcacaggaccatactcgtg

SEQ ID NO: 562296 - DNA, 25 bp, Rattus norvegicus
tagtaatctactacactgcctggac

SEQ ID NO: 562297 - DNA, 25 bp, Rattus norvegicus
tagtaatctacttcactgcctggac

SEQ ID NO: 562298 - DNA, 25 bp, Rattus norvegicus
tagtaatctgtgagatcccttcctt

SEQ ID NO: 562299 - DNA, 25 bp, Rattus norvegicus
tagtaatctgtgtgatcccttcctt

SEQ ID NO: 562300 - DNA, 25 bp, Rattus norvegicus
tagtaatgcgtaacttgggttttcc

SEQ ID NO: 562301 - DNA, 25 bp, Rattus norvegicus
tagtaatgcgtatcttgggttttcc

SEQ ID NO: 562302 - DNA, 25 bp, Rattus norvegicus
tagtaatggactatgtcctgcgccc

SEQ ID NO: 562303 - DNA, 25 bp, Rattus norvegicus
tagtaatggactttgtcctgcgccc

SEQ ID NO: 562304 - DNA, 25 bp, Rattus norvegicus
tagtaatggttgcactctgccctct

SEQ ID NO: 562305 - DNA, 25 bp, Rattus norvegicus
tagtaatggttggactctgccctct

SEQ ID NO: 562306 - DNA, 25 bp, Rattus norvegicus
tagtaattaaacctccctgggtgtg

SEQ ID NO: 562307 - DNA, 25 bp, Rattus norvegicus
tagtaattaaacgtccctgggtgtg

SEQ ID NO: 562308 - DNA, 25 bp, Rattus norvegicus
tagtacaagccaaacagccctggtt

SEQ ID NO: 562309 - DNA, 25 bp, Rattus norvegicus
tagtacaagccatacagccctggtt

SEQ ID NO: 562310 - DNA, 25 bp, Rattus norvegicus
tagtacacaaagcttgcacttccgc

SEQ ID NO: 562311 - DNA, 25 bp, Rattus norvegicus
tagtacacaaaggttgcacttccgc

SEQ ID NO: 562312 - DNA, 25 bp, Rattus norvegicus
tagtacacagatccctgtgacccca

SEQ ID NO: 562313 - DNA, 25 bp, Rattus norvegicus
tagtacacagatgcctgtgacccca

SEQ ID NO: 562314 - DNA, 25 bp, Rattus norvegicus
tagtacacaggcagcactgaaggct

SEQ ID NO: 562315 - DNA, 25 bp, Rattus norvegicus
tagtacacaggctgcactgaaggct

SEQ ID NO: 562316 - DNA, 25 bp, Rattus norvegicus
tagtacactatgatctcagctccaa

SEQ ID NO: 562317 - DNA, 25 bp, Rattus norvegicus
tagtacactatgttctcagctccaa

SEQ ID NO: 562318 - DNA, 25 bp, Rattus norvegicus
tagtacagatacagtgcccagcctc

SEQ ID NO: 562319 - DNA, 25 bp, Rattus norvegicus
tagtacagatactgtgcccagcctc

SEQ ID NO: 562320 - DNA, 25 bp, Rattus norvegicus
tagtacagatgtctctctgacccct

SEQ ID NO: 562321 - DNA, 25 bp, Rattus norvegicus
tagtacagatgtgtctctgacccct

SEQ ID NO: 562322 - DNA, 25 bp, Rattus norvegicus
tagtacagggcacagctgttgtcca

SEQ ID NO: 562323 - DNA, 25 bp, Rattus norvegicus
tagtacagggcagagctgttgtcca

SEQ ID NO: 562324 - DNA, 25 bp, Rattus norvegicus
tagtacatatatcggcatcttgggt

SEQ ID NO: 562325 - DNA, 25 bp, Rattus norvegicus
tagtacatatatgggcatcttgggt

SEQ ID NO: 562326 - DNA, 25 bp, Rattus norvegicus
tagtacatcaccaggacttttcagt

SEQ ID NO: 562327 - DNA, 25 bp, Rattus norvegicus
tagtacatcacctggacttttcagt

SEQ ID NO: 562328 - DNA, 25 bp, Rattus norvegicus
tagtacatccgaacgagaaccgaga

SEQ ID NO: 562329 - DNA, 25 bp, Rattus norvegicus
tagtacatccgatcgagaaccgaga

SEQ ID NO: 562330 - DNA, 25 bp, Rattus norvegicus
tagtaccacgtgattgcagttgccc

SEQ ID NO: 562331 - DNA, 25 bp, Rattus norvegicus
tagtaccacgtgtttgcagttgccc

SEQ ID NO: 562332 - DNA, 25 bp, Rattus norvegicus
tagtaccatgtacggccgtttcttt

SEQ ID NO: 562333 - DNA, 25 bp, Rattus norvegicus
tagtaccatgtagggccgtttcttt

SEQ ID NO: 562334 - DNA, 25 bp, Rattus norvegicus
tagtaccattccagggtcttcagat

SEQ ID NO: 562335 - DNA, 25 bp, Rattus norvegicus
tagtaccattcctgggtcttcagat

SEQ ID NO: 562336 - DNA, 25 bp, Rattus norvegicus
tagtacccacaacctgaggctgttg

SEQ ID NO: 562337 - DNA, 25 bp, Rattus norvegicus
tagtacccacaagctgaggctgttg

SEQ ID NO: 562338 - DNA, 25 bp, Rattus norvegicus
tagtacccctcactctggaaagaga

SEQ ID NO: 562339 - DNA, 25 bp, Rattus norvegicus
tagtacccctcagtctggaaagaga

SEQ ID NO: 562340 - DNA, 25 bp, Rattus norvegicus
tagtaccccttcctgaggagatcca

SEQ ID NO: 562341 - DNA, 25 bp, Rattus norvegicus
tagtaccccttcgtgaggagatcca

SEQ ID NO: 562342 - DNA, 25 bp, Rattus norvegicus
tagtacctagtgacttgcaccaact

SEQ ID NO: 562343 - DNA, 25 bp, Rattus norvegicus
tagtacctagtgtcttgcaccaact

SEQ ID NO: 562344 - DNA, 25 bp, Rattus norvegicus
tagtacctcagactctctgcaacaa

SEQ ID NO: 562345 - DNA, 25 bp, Rattus norvegicus
tagtacctcagagtctctgcaacaa

SEQ ID NO: 562346 - DNA, 25 bp, Rattus norvegicus
tagtacctccaacatggtttctctg

SEQ ID NO: 562347 - DNA, 25 bp, Rattus norvegicus
tagtacctccaagatggtttctctg

SEQ ID NO: 562348 - DNA, 25 bp, Rattus norvegicus
tagtacctgcctatccgcatgaatg

SEQ ID NO: 562349 - DNA, 25 bp, Rattus norvegicus
tagtacctgcctttccgcatgaatg

SEQ ID NO: 562350 - DNA, 25 bp, Rattus norvegicus
tagtacctggaccattctcactaga

SEQ ID NO: 562351 - DNA, 25 bp, Rattus norvegicus
tagtacctggacgattctcactaga

SEQ ID NO: 562352 - DNA, 25 bp, Rattus norvegicus
tagtacctgttgctctccgagggtg

SEQ ID NO: 562353 - DNA, 25 bp, Rattus norvegicus
tagtacctgttggtctccgagggtg

SEQ ID NO: 562354 - DNA, 25 bp, Rattus norvegicus
tagtacctttgtatgggtagagtct

SEQ ID NO: 562355 - DNA, 25 bp, Rattus norvegicus
tagtacctttgtttgggtagagtct

SEQ ID NO: 562356 - DNA, 25 bp, Rattus norvegicus
tagtacgctaacaaaagtccccaag

SEQ ID NO: 562357 - DNA, 25 bp, Rattus norvegicus
tagtacgctaactaaagtccccaag

SEQ ID NO: 562358 - DNA, 25 bp, Rattus norvegicus
tagtacgtacagattccggctttgg

SEQ ID NO: 562359 - DNA, 25 bp, Rattus norvegicus
tagtacgtacagtttccggctttgg

SEQ ID NO: 562360 - DNA, 25 bp, Rattus norvegicus
tagtacgtgagaatcggcagcataa

SEQ ID NO: 562361 - DNA, 25 bp, Rattus norvegicus
tagtacgtgagattcggcagcataa

SEQ ID NO: 562362 - DNA, 25 bp, Rattus norvegicus
tagtacgtgtacacatacccggcta

SEQ ID NO: 562363 - DNA, 25 bp, Rattus norvegicus
tagtacgtgtactcatacccggcta

SEQ ID NO: 562364 - DNA, 25 bp, Rattus norvegicus
tagtactaaacccagagcccggctt

SEQ ID NO: 562365 - DNA, 25 bp, Rattus norvegicus
tagtactaaaccgagagcccggctt

SEQ ID NO: 562366 - DNA, 25 bp, Rattus norvegicus
tagtactaagccatcatttctctcc

SEQ ID NO: 562367 - DNA, 25 bp, Rattus norvegicus
tagtactaagccttcatttctctcc

SEQ ID NO: 562368 - DNA, 25 bp, Rattus norvegicus
tagtactattgcatccgggtatcag

SEQ ID NO: 562369 - DNA, 25 bp, Rattus norvegicus
tagtactattgcttccgggtatcag

SEQ ID NO: 562370 - DNA, 25 bp, Rattus norvegicus
tagtactcacgacctgaggccagtc

SEQ ID NO: 562371 - DNA, 25 bp, Rattus norvegicus
tagtactcacgagctgaggccagtc

SEQ ID NO: 562372 - DNA, 25 bp, Rattus norvegicus
tagtactcttagcactagaactggc

SEQ ID NO: 562373 - DNA, 25 bp, Rattus norvegicus
tagtactcttaggactagaactggc

SEQ ID NO: 562374 - DNA, 25 bp, Rattus norvegicus
tagtactgaaatcagcctgctgcct

SEQ ID NO: 562375 - DNA, 25 bp, Rattus norvegicus
tagtactgaaatgagcctgctgcct

SEQ ID NO: 562376 - DNA, 25 bp, Rattus norvegicus
tagtactgaattctgcccatgcaca

SEQ ID NO: 562377 - DNA, 25 bp, Rattus norvegicus
tagtactgaattgtgcccatgcaca

SEQ ID NO: 562378 - DNA, 25 bp, Rattus norvegicus
tagtactgcgttacagttaagtggt

SEQ ID NO: 562379 - DNA, 25 bp, Rattus norvegicus
tagtactgcgtttcagttaagtggt

SEQ ID NO: 562380 - DNA, 25 bp, Rattus norvegicus
tagtactggcctcagctgtccagga

SEQ ID NO: 562381 - DNA, 25 bp, Rattus norvegicus
tagtactggcctgagctgtccagga

SEQ ID NO: 562382 - DNA, 25 bp, Rattus norvegicus
tagtactgtaaactgcttctgagca

SEQ ID NO: 562383 - DNA, 25 bp, Rattus norvegicus
tagtactgtaaagtgcttctgagca

SEQ ID NO: 562384 - DNA, 25 bp, Rattus norvegicus
tagtactgtactcccatgtggtcta

SEQ ID NO: 562385 - DNA, 25 bp, Rattus norvegicus
tagtactgtactgccatgtggtcta

SEQ ID NO: 562386 - DNA, 25 bp, Rattus norvegicus
tagtactgttccaagtgtctcttca

SEQ ID NO: 562387 - DNA, 25 bp, Rattus norvegicus
tagtactgttcctagtgtctcttca

SEQ ID NO: 562388 - DNA, 25 bp, Rattus norvegicus
tagtacttccctagcctagagaaca

SEQ ID NO: 562389 - DNA, 25 bp, Rattus norvegicus
tagtacttcccttgcctagagaaca

SEQ ID NO: 562390 - DNA, 25 bp, Rattus norvegicus
tagtacttcctcatgcctcatgtac

SEQ ID NO: 562391 - DNA, 25 bp, Rattus norvegicus
tagtacttcctcttgcctcatgtac

SEQ ID NO: 562392 - DNA, 25 bp, Rattus norvegicus
tagtacttctctagtcctgcacaga

SEQ ID NO: 562393 - DNA, 25 bp, Rattus norvegicus
tagtacttctcttgtcctgcacaga

SEQ ID NO: 562394 - DNA, 25 bp, Rattus norvegicus
tagtacttctgacgttttggtggca

SEQ ID NO: 562395 - DNA, 25 bp, Rattus norvegicus
tagtacttctgaggttttggtggca

SEQ ID NO: 562396 - DNA, 25 bp, Rattus norvegicus
tagtacttggatcggagaccgcctg

SEQ ID NO: 562397 - DNA, 25 bp, Rattus norvegicus
tagtacttggatgggagaccgcctg

SEQ ID NO: 562398 - DNA, 25 bp, Rattus norvegicus
tagtacttgggcaggtgtttccgca

SEQ ID NO: 562399 - DNA, 25 bp, Rattus norvegicus
tagtacttgggctggtgtttccgca

SEQ ID NO: 562400 - DNA, 25 bp, Rattus norvegicus
tagtacttggttatgttggtctgtt

SEQ ID NO: 562401 - DNA, 25 bp, Rattus norvegicus
tagtacttggttttgttggtctgtt

SEQ ID NO: 562402 - DNA, 25 bp, Rattus norvegicus
tagtactttgtaatttaacacctca

SEQ ID NO: 562403 - DNA, 25 bp, Rattus norvegicus
tagtactttgtattttaacacctca

SEQ ID NO: 562404 - DNA, 25 bp, Rattus norvegicus
tagtagaactctatttgtccccagt

SEQ ID NO: 562405 - DNA, 25 bp, Rattus norvegicus
tagtagaactctttttgtccccagt

SEQ ID NO: 562406 - DNA, 25 bp, Rattus norvegicus
tagtagaatttcattcccacctgca

SEQ ID NO: 562407 - DNA, 25 bp, Rattus norvegicus
tagtagaatttctttcccacctgca

SEQ ID NO: 562408 - DNA, 25 bp, Rattus norvegicus
tagtagaccgtcctcgttgggaact

SEQ ID NO: 562409 - DNA, 25 bp, Rattus norvegicus
tagtagaccgtcgtcgttgggaact

SEQ ID NO: 562410 - DNA, 25 bp, Rattus norvegicus
tagtagacctatctacatgtaacac

SEQ ID NO: 562411 - DNA, 25 bp, Rattus norvegicus
tagtagacctatgtacatgtaacac

SEQ ID NO: 562412 - DNA, 25 bp, Rattus norvegicus
tagtagaccttcctgttattcttcc

SEQ ID NO: 562413 - DNA, 25 bp, Rattus norvegicus
tagtagaccttcgtgttattcttcc

SEQ ID NO: 562414 - DNA, 25 bp, Rattus norvegicus
tagtagacgcagatggaccaggagt

SEQ ID NO: 562415 - DNA, 25 bp, Rattus norvegicus
tagtagacgcagttggaccaggagt

SEQ ID NO: 562416 - DNA, 25 bp, Rattus norvegicus
tagtagacggatactgtctttaggc

SEQ ID NO: 562417 - DNA, 25 bp, Rattus norvegicus
tagtagacggattctgtctttaggc

SEQ ID NO: 562418 - DNA, 25 bp, Rattus norvegicus
tagtagaggtcgcttctttggaaat

SEQ ID NO: 562419 - DNA, 25 bp, Rattus norvegicus
tagtagaggtcggttctttggaaat

SEQ ID NO: 562420 - DNA, 25 bp, Rattus norvegicus
tagtagatcttaattttcctatgcc

SEQ ID NO: 562421 - DNA, 25 bp, Rattus norvegicus
tagtagatcttatttttcctatgcc

SEQ ID NO: 562422 - DNA, 25 bp, Rattus norvegicus
tagtagcaaactccctagctctagg

SEQ ID NO: 562423 - DNA, 25 bp, Rattus norvegicus
tagtagcaaactgcctagctctagg

SEQ ID NO: 562424 - DNA, 25 bp, Rattus norvegicus
tagtagcaattcaccagtcgccagg

SEQ ID NO: 562425 - DNA, 25 bp, Rattus norvegicus
tagtagcaattctccagtcgccagg

SEQ ID NO: 562426 - DNA, 25 bp, Rattus norvegicus
tagtagcatacaaagccgtggcggt

SEQ ID NO: 562427 - DNA, 25 bp, Rattus norvegicus
tagtagcatacatagccgtggcggt

SEQ ID NO: 562428 - DNA, 25 bp, Rattus norvegicus
tagtagcatgctctcggaactctgg

SEQ ID NO: 562429 - DNA, 25 bp, Rattus norvegicus
tagtagcatgctgtcggaactctgg

SEQ ID NO: 562430 - DNA, 25 bp, Rattus norvegicus
tagtagccaaccacctagtcttaac

SEQ ID NO: 562431 - DNA, 25 bp, Rattus norvegicus
tagtagccaacctcctagtcttaac

SEQ ID NO: 562432 - DNA, 25 bp, Rattus norvegicus
tagtagccaaggacgggcacctcta

SEQ ID NO: 562433 - DNA, 25 bp, Rattus norvegicus
tagtagccaaggtcgggcacctcta

SEQ ID NO: 562434 - DNA, 25 bp, Rattus norvegicus
tagtagccgaagaggccagctagca

SEQ ID NO: 562435 - DNA, 25 bp, Rattus norvegicus
tagtagccgaagtggccagctagca

SEQ ID NO: 562436 - DNA, 25 bp, Rattus norvegicus
tagtagcctagcctccacagtgggt

SEQ ID NO: 562437 - DNA, 25 bp, Rattus norvegicus
tagtagcctagcgtccacagtgggt

SEQ ID NO: 562438 - DNA, 25 bp, Rattus norvegicus
tagtagcctgggacttcggacaaac

SEQ ID NO: 562439 - DNA, 25 bp, Rattus norvegicus
tagtagcctgggtcttcggacaaac

SEQ ID NO: 562440 - DNA, 25 bp, Rattus norvegicus
tagtagctcagaattgtgcccttgt

SEQ ID NO: 562441 - DNA, 25 bp, Rattus norvegicus
tagtagctcagatttgtgcccttgt

SEQ ID NO: 562442 - DNA, 25 bp, Rattus norvegicus
tagtagctgccacacacctttgatc

SEQ ID NO: 562443 - DNA, 25 bp, Rattus norvegicus
tagtagctgccagacacctttgatc

SEQ ID NO: 562444 - DNA, 25 bp, Rattus norvegicus
tagtagctgcgacatcagtggaccc

SEQ ID NO: 562445 - DNA, 25 bp, Rattus norvegicus
tagtagctgcgagatcagtggaccc

SEQ ID NO: 562446 - DNA, 25 bp, Rattus norvegicus
tagtagctgctgctatgttatttta

SEQ ID NO: 562447 - DNA, 25 bp, Rattus norvegicus
tagtagctgctggtatgttatttta

SEQ ID NO: 562448 - DNA, 25 bp, Rattus norvegicus
tagtagctggaccacagttccctga

SEQ ID NO: 562449 - DNA, 25 bp, Rattus norvegicus
tagtagctggacgacagttccctga

SEQ ID NO: 562450 - DNA, 25 bp, Rattus norvegicus
tagtagcttctcactgctaggtgtc

SEQ ID NO: 562451 - DNA, 25 bp, Rattus norvegicus
tagtagcttctctctgctaggtgtc

SEQ ID NO: 562452 - DNA, 25 bp, Rattus norvegicus
tagtagcttgctattgacttcacaa

SEQ ID NO: 562453 - DNA, 25 bp, Rattus norvegicus
tagtagcttgcttttgacttcacaa

SEQ ID NO: 562454 - DNA, 25 bp, Rattus norvegicus
tagtaggagctgattgtcttgcctt

SEQ ID NO: 562455 - DNA, 25 bp, Rattus norvegicus
tagtaggagctgtttgtcttgcctt

SEQ ID NO: 562456 - DNA, 25 bp, Rattus norvegicus
tagtaggcagaccagcagacttttt

SEQ ID NO: 562457 - DNA, 25 bp, Rattus norvegicus
tagtaggcagacgagcagacttttt

SEQ ID NO: 562458 - DNA, 25 bp, Rattus norvegicus
tagtagggagtgacttgctggccac

SEQ ID NO: 562459 - DNA, 25 bp, Rattus norvegicus
tagtagggagtgtcttgctggccac

SEQ ID NO: 562460 - DNA, 25 bp, Rattus norvegicus
tagtagtaatctctctttctgctct

SEQ ID NO: 562461 - DNA, 25 bp, Rattus norvegicus
tagtagtaatctgtctttctgctct

SEQ ID NO: 562462 - DNA, 25 bp, Rattus norvegicus
tagtagtagcacaagcctttaaccc

SEQ ID NO: 562463 - DNA, 25 bp, Rattus norvegicus
tagtagtagcactagcctttaaccc

SEQ ID NO: 562464 - DNA, 25 bp, Rattus norvegicus
tagtagtatatgatattgtctcccc

SEQ ID NO: 562465 - DNA, 25 bp, Rattus norvegicus
tagtagtatatgttattgtctcccc

SEQ ID NO: 562466 - DNA, 25 bp, Rattus norvegicus
tagtagtcaagccttctgccacaga

SEQ ID NO: 562467 - DNA, 25 bp, Rattus norvegicus
tagtagtcaagcgttctgccacaga

SEQ ID NO: 562468 - DNA, 25 bp, Rattus norvegicus
tagtagtcagccaaagcctttcaga

SEQ ID NO: 562469 - DNA, 25 bp, Rattus norvegicus
tagtagtcagcctaagcctttcaga

SEQ ID NO: 562470 - DNA, 25 bp, Rattus norvegicus
tagtagtcattcacacactcatcga

SEQ ID NO: 562471 - DNA, 25 bp, Rattus norvegicus
tagtagtcattctcacactcatcga

SEQ ID NO: 562472 - DNA, 25 bp, Rattus norvegicus
tagtagtcccgaccaacttctgagc

SEQ ID NO: 562473 - DNA, 25 bp, Rattus norvegicus
tagtagtcccgagcaacttctgagc

SEQ ID NO: 562474 - DNA, 25 bp, Rattus norvegicus
tagtagtctcagagcctacctgacg

SEQ ID NO: 562475 - DNA, 25 bp, Rattus norvegicus
tagtagtctcagtgcctacctgacg

SEQ ID NO: 562476 - DNA, 25 bp, Rattus norvegicus
tagtagtggtagcagttacatcaac

SEQ ID NO: 562477 - DNA, 25 bp, Rattus norvegicus
tagtagtggtaggagttacatcaac

SEQ ID NO: 562478 - DNA, 25 bp, Rattus norvegicus
tagtagttctgtcaaagtttttctg

SEQ ID NO: 562479 - DNA, 25 bp, Rattus norvegicus
tagtagttctgtgaaagtttttctg

SEQ ID NO: 562480 - DNA, 25 bp, Rattus norvegicus
tagtagttgaagacctagccagaat

SEQ ID NO: 562481 - DNA, 25 bp, Rattus norvegicus
tagtagttgaagtcctagccagaat

SEQ ID NO: 562482 - DNA, 25 bp, Rattus norvegicus
tagtataaagccatgagactgacct

SEQ ID NO: 562483 - DNA, 25 bp, Rattus norvegicus
tagtataaagccttgagactgacct

SEQ ID NO: 562484 - DNA, 25 bp, Rattus norvegicus
tagtatactgcaccggtggtttttc

SEQ ID NO: 562485 - DNA, 25 bp, Rattus norvegicus
tagtatactgcagcggtggtttttc

SEQ ID NO: 562486 - DNA, 25 bp, Rattus norvegicus
tagtataggactacaaccccagcac

SEQ ID NO: 562487 - DNA, 25 bp, Rattus norvegicus
tagtataggacttcaaccccagcac

SEQ ID NO: 562488 - DNA, 25 bp, Rattus norvegicus
tagtatagtcatcgccgactgctgc

SEQ ID NO: 562489 - DNA, 25 bp, Rattus norvegicus
tagtatagtcatggccgactgctgc

SEQ ID NO: 562490 - DNA, 25 bp, Rattus norvegicus
tagtatatacttcctccaatcttca

SEQ ID NO: 562491 - DNA, 25 bp, Rattus norvegicus
tagtatatacttgctccaatcttca

SEQ ID NO: 562492 - DNA, 25 bp, Rattus norvegicus
tagtatatctgtaactcttgctgat

SEQ ID NO: 562493 - DNA, 25 bp, Rattus norvegicus
tagtatatctgttactcttgctgat

SEQ ID NO: 562494 - DNA, 25 bp, Rattus norvegicus
tagtatatgtctccctttccttcat

SEQ ID NO: 562495 - DNA, 25 bp, Rattus norvegicus
tagtatatgtctgcctttccttcat

SEQ ID NO: 562496 - DNA, 25 bp, Rattus norvegicus
tagtatcagtttccctattggtacg

SEQ ID NO: 562497 - DNA, 25 bp, Rattus norvegicus
tagtatcagtttgcctattggtacg

SEQ ID NO: 562498 - DNA, 25 bp, Rattus norvegicus
tagtatccagagacctggccaggct

SEQ ID NO: 562499 - DNA, 25 bp, Rattus norvegicus
tagtatccagagtcctggccaggct

SEQ ID NO: 562500 - DNA, 25 bp, Rattus norvegicus
tagtatctatcaagtgtcaagccag

SEQ ID NO: 562501 - DNA, 25 bp, Rattus norvegicus
tagtatctatcatgtgtcaagccag

SEQ ID NO: 562502 - DNA, 25 bp, Rattus norvegicus
tagtatcttgccctcagtccaaaca

SEQ ID NO: 562503 - DNA, 25 bp, Rattus norvegicus
tagtatcttgccgtcagtccaaaca

SEQ ID NO: 562504 - DNA, 25 bp, Rattus norvegicus
tagtatcttgggagatcatctgtag

SEQ ID NO: 562505 - DNA, 25 bp, Rattus norvegicus
tagtatcttgggtgatcatctgtag

SEQ ID NO: 562506 - DNA, 25 bp, Rattus norvegicus
tagtatctttagaatttcacaggaa

SEQ ID NO: 562507 - DNA, 25 bp, Rattus norvegicus
tagtatctttagtatttcacaggaa

SEQ ID NO: 562508 - DNA, 25 bp, Rattus norvegicus
tagtatgcacaaagccccaggctcc

SEQ ID NO: 562509 - DNA, 25 bp, Rattus norvegicus
tagtatgcacaatgccccaggctcc

SEQ ID NO: 562510 - DNA, 25 bp, Rattus norvegicus
tagtatgcactaccctcgcatcagc

SEQ ID NO: 562511 - DNA, 25 bp, Rattus norvegicus
tagtatgcactagcctcgcatcagc

SEQ ID NO: 562512 - DNA, 25 bp, Rattus norvegicus
tagtatggtagacctttgggactga

SEQ ID NO: 562513 - DNA, 25 bp, Rattus norvegicus
tagtatggtagagctttgggactga

SEQ ID NO: 562514 - DNA, 25 bp, Rattus norvegicus
tagtatggtgggacttgagccagcc

SEQ ID NO: 562515 - DNA, 25 bp, Rattus norvegicus
tagtatggtgggtcttgagccagcc

SEQ ID NO: 562516 - DNA, 25 bp, Rattus norvegicus
tagtatggtgtgagtgcgcccagac

SEQ ID NO: 562517 - DNA, 25 bp, Rattus norvegicus
tagtatggtgtgtgtgcgcccagac

SEQ ID NO: 562518 - DNA, 25 bp, Rattus norvegicus
tagtatgtacgcaggtgcttgctgt

SEQ ID NO: 562519 - DNA, 25 bp, Rattus norvegicus
tagtatgtacgctggtgcttgctgt

SEQ ID NO: 562520 - DNA, 25 bp, Rattus norvegicus
tagtatgttctcagccagtggtggc

SEQ ID NO: 562521 - DNA, 25 bp, Rattus norvegicus
tagtatgttctctgccagtggtggc

SEQ ID NO: 562522 - DNA, 25 bp, Rattus norvegicus
tagtatgttgagatgtcccagctgg

SEQ ID NO: 562523 - DNA, 25 bp, Rattus norvegicus
tagtatgttgagttgtcccagctgg

SEQ ID NO: 562524 - DNA, 25 bp, Rattus norvegicus
tagtattacgatcctgtcaccacca

SEQ ID NO: 562525 - DNA, 25 bp, Rattus norvegicus
tagtattacgatgctgtcaccacca

SEQ ID NO: 562526 - DNA, 25 bp, Rattus norvegicus
tagtattcaaacactgaccgcaccc

SEQ ID NO: 562527 - DNA, 25 bp, Rattus norvegicus
tagtattcaaactctgaccgcaccc

SEQ ID NO: 562528 - DNA, 25 bp, Rattus norvegicus
tagtattcaactagaccacccagtc

SEQ ID NO: 562529 - DNA, 25 bp, Rattus norvegicus
tagtattcaacttgaccacccagtc

SEQ ID NO: 562530 - DNA, 25 bp, Rattus norvegicus
tagtattcagtgagttcgctttgct

SEQ ID NO: 562531 - DNA, 25 bp, Rattus norvegicus
tagtattcagtgtgttcgctttgct

SEQ ID NO: 562532 - DNA, 25 bp, Rattus norvegicus
tagtattcctaaattgtgctgcaaa

SEQ ID NO: 562533 - DNA, 25 bp, Rattus norvegicus
tagtattcctaatttgtgctgcaaa

SEQ ID NO: 562534 - DNA, 25 bp, Rattus norvegicus
tagtattctgtacagctattgcata

SEQ ID NO: 562535 - DNA, 25 bp, Rattus norvegicus
tagtattctgtagagctattgcata

SEQ ID NO: 562536 - DNA, 25 bp, Rattus norvegicus
tagtattcttttctcttggtgcggt

SEQ ID NO: 562537 - DNA, 25 bp, Rattus norvegicus
tagtattcttttgtcttggtgcggt

SEQ ID NO: 562538 - DNA, 25 bp, Rattus norvegicus
tagtattgagtgctgggcctgtacc

SEQ ID NO: 562539 - DNA, 25 bp, Rattus norvegicus
tagtattgagtggtgggcctgtacc

SEQ ID NO: 562540 - DNA, 25 bp, Rattus norvegicus
tagtattgtctacacctgcaaatag

SEQ ID NO: 562541 - DNA, 25 bp, Rattus norvegicus
tagtattgtctagacctgcaaatag

SEQ ID NO: 562542 - DNA, 25 bp, Rattus norvegicus
tagtatttaaccatacacggatgta

SEQ ID NO: 562543 - DNA, 25 bp, Rattus norvegicus
tagtatttaaccttacacggatgta

SEQ ID NO: 562544 - DNA, 25 bp, Rattus norvegicus
tagtatttaactcccatctccctgt

SEQ ID NO: 562545 - DNA, 25 bp, Rattus norvegicus
tagtatttaactgccatctccctgt

SEQ ID NO: 562546 - DNA, 25 bp, Rattus norvegicus
tagtatttacagctggcttctttta

SEQ ID NO: 562547 - DNA, 25 bp, Rattus norvegicus
tagtatttacaggtggcttctttta

SEQ ID NO: 562548 - DNA, 25 bp, Rattus norvegicus
tagtatttgatgacagcctggtcca

SEQ ID NO: 562549 - DNA, 25 bp, Rattus norvegicus
tagtatttgatgtcagcctggtcca

SEQ ID NO: 562550 - DNA, 25 bp, Rattus norvegicus
tagtattttggcacgggtatctaaa

SEQ ID NO: 562551 - DNA, 25 bp, Rattus norvegicus
tagtattttggctcgggtatctaaa

SEQ ID NO: 562552 - DNA, 25 bp, Rattus norvegicus
tagtattttgtcacgtgtttcttaa

SEQ ID NO: 562553 - DNA, 25 bp, Rattus norvegicus
tagtattttgtcattggctctgtct

SEQ ID NO: 562554 - DNA, 25 bp, Rattus norvegicus
tagtattttgtctcgtgtttcttaa

SEQ ID NO: 562555 - DNA, 25 bp, Rattus norvegicus
tagtattttgtctttggctctgtct

SEQ ID NO: 562556 - DNA, 25 bp, Rattus norvegicus
tagtcaaaaccaacttccttcaatt

SEQ ID NO: 562557 - DNA, 25 bp, Rattus norvegicus
tagtcaaaaccatcttccttcaatt

SEQ ID NO: 562558 - DNA, 25 bp, Rattus norvegicus
tagtcaaaccttagggacatgccca

SEQ ID NO: 562559 - DNA, 25 bp, Rattus norvegicus
tagtcaaacctttgggacatgccca

SEQ ID NO: 562560 - DNA, 25 bp, Rattus norvegicus
tagtcaaagagtacccaccattctg

SEQ ID NO: 562561 - DNA, 25 bp, Rattus norvegicus
tagtcaaagagttcccaccattctg

SEQ ID NO: 562562 - DNA, 25 bp, Rattus norvegicus
tagtcaaataaaagtcccctccttt

SEQ ID NO: 562563 - DNA, 25 bp, Rattus norvegicus
tagtcaaataaatgtcccctccttt

SEQ ID NO: 562564 - DNA, 25 bp, Rattus norvegicus
tagtcaaatattacccttggaaggg

SEQ ID NO: 562565 - DNA, 25 bp, Rattus norvegicus
tagtcaaatatttcccttggaaggg

SEQ ID NO: 562566 - DNA, 25 bp, Rattus norvegicus
tagtcaaattctcatgctctcatct

SEQ ID NO: 562567 - DNA, 25 bp, Rattus norvegicus
tagtcaaattctgatgctctcatct

SEQ ID NO: 562568 - DNA, 25 bp, Rattus norvegicus
tagtcaacagcaagcaggcggcgcc

SEQ ID NO: 562569 - DNA, 25 bp, Rattus norvegicus
tagtcaacagcatgcaggcggcgcc

SEQ ID NO: 562570 - DNA, 25 bp, Rattus norvegicus
tagtcaacgtcaaatcccagggctt

SEQ ID NO: 562571 - DNA, 25 bp, Rattus norvegicus
tagtcaacgtcatatcccagggctt

SEQ ID NO: 562572 - DNA, 25 bp, Rattus norvegicus
tagtcaactacgaggtactcctaaa

SEQ ID NO: 562573 - DNA, 25 bp, Rattus norvegicus
tagtcaactacgtggtactcctaaa

SEQ ID NO: 562574 - DNA, 25 bp, Rattus norvegicus
tagtcaactaggaaacagccagcaa

SEQ ID NO: 562575 - DNA, 25 bp, Rattus norvegicus
tagtcaactaggtaacagccagcaa

SEQ ID NO: 562576 - DNA, 25 bp, Rattus norvegicus
tagtcaagcattagacatctagaca

SEQ ID NO: 562577 - DNA, 25 bp, Rattus norvegicus
tagtcaagcatttgacatctagaca

SEQ ID NO: 562578 - DNA, 25 bp, Rattus norvegicus
tagtcaagcgctcgctagtcaagcg

SEQ ID NO: 562579 - DNA, 25 bp, Rattus norvegicus
tagtcaagcgctggctagtcaagcg

SEQ ID NO: 562580 - DNA, 25 bp, Rattus norvegicus
tagtcaagctcgactgatagcctgc

SEQ ID NO: 562581 - DNA, 25 bp, Rattus norvegicus
tagtcaagctcgtctgatagcctgc

SEQ ID NO: 562582 - DNA, 25 bp, Rattus norvegicus
tagtcaagctgcacgagggcactgg

SEQ ID NO: 562583 - DNA, 25 bp, Rattus norvegicus
tagtcaagctgctcgagggcactgg

SEQ ID NO: 562584 - DNA, 25 bp, Rattus norvegicus
tagtcaaggaagacacccagggtga

SEQ ID NO: 562585 - DNA, 25 bp, Rattus norvegicus
tagtcaaggaagtcacccagggtga

SEQ ID NO: 562586 - DNA, 25 bp, Rattus norvegicus
tagtcaagtgccatctgtctctcaa

SEQ ID NO: 562587 - DNA, 25 bp, Rattus norvegicus
tagtcaagtgccttctgtctctcaa

SEQ ID NO: 562588 - DNA, 25 bp, Rattus norvegicus
tagtcaatcaagaagccgcccggaa

SEQ ID NO: 562589 - DNA, 25 bp, Rattus norvegicus
tagtcaatcaagtagccgcccggaa

SEQ ID NO: 562590 - DNA, 25 bp, Rattus norvegicus
tagtcaatctctagccactgtgtgg

SEQ ID NO: 562591 - DNA, 25 bp, Rattus norvegicus
tagtcaatctcttgccactgtgtgg

SEQ ID NO: 562592 - DNA, 25 bp, Rattus norvegicus
tagtcaatgtacagaactctcccgg

SEQ ID NO: 562593 - DNA, 25 bp, Rattus norvegicus
tagtcaatgtactgaactctcccgg

SEQ ID NO: 562594 - DNA, 25 bp, Rattus norvegicus
tagtcaattgccaaggttcttctga

SEQ ID NO: 562595 - DNA, 25 bp, Rattus norvegicus
tagtcaattgcctaggttcttctga

SEQ ID NO: 562596 - DNA, 25 bp, Rattus norvegicus
tagtcacagataagctttgctacaa

SEQ ID NO: 562597 - DNA, 25 bp, Rattus norvegicus
tagtcacagatatgctttgctacaa

SEQ ID NO: 562598 - DNA, 25 bp, Rattus norvegicus
tagtcacaggacatccatgggccag

SEQ ID NO: 562599 - DNA, 25 bp, Rattus norvegicus
tagtcacaggacttccatgggccag

SEQ ID NO: 562600 - DNA, 25 bp, Rattus norvegicus
tagtcacatggtattcccttctctt

SEQ ID NO: 562601 - DNA, 25 bp, Rattus norvegicus
tagtcacatggttttcccttctctt

SEQ ID NO: 562602 - DNA, 25 bp, Rattus norvegicus
tagtcaccaccaagtctgccgaaat

SEQ ID NO: 562603 - DNA, 25 bp, Rattus norvegicus
tagtcaccaccatgtctgccgaaat

SEQ ID NO: 562604 - DNA, 25 bp, Rattus norvegicus
tagtcaccacttaaattctgatttc

SEQ ID NO: 562605 - DNA, 25 bp, Rattus norvegicus
tagtcaccactttaattctgatttc

SEQ ID NO: 562606 - DNA, 25 bp, Rattus norvegicus
tagtcaccccgtaacgatcatgatc

SEQ ID NO: 562607 - DNA, 25 bp, Rattus norvegicus
tagtcaccccgttacgatcatgatc

SEQ ID NO: 562608 - DNA, 25 bp, Rattus norvegicus
tagtcacccttcaggagaatcttct

SEQ ID NO: 562609 - DNA, 25 bp, Rattus norvegicus
tagtcacccttctggagaatcttct

SEQ ID NO: 562610 - DNA, 25 bp, Rattus norvegicus
tagtcaccgtgtattaacttgtaca

SEQ ID NO: 562611 - DNA, 25 bp, Rattus norvegicus
tagtcaccgtgttttaacttgtaca

SEQ ID NO: 562612 - DNA, 25 bp, Rattus norvegicus
tagtcaccttttactgtagcaccat

SEQ ID NO: 562613 - DNA, 25 bp, Rattus norvegicus
tagtcacctttttctgtagcaccat

SEQ ID NO: 562614 - DNA, 25 bp, Rattus norvegicus
tagtcactatttatctcatcctgaa

SEQ ID NO: 562615 - DNA, 25 bp, Rattus norvegicus
tagtcactatttttctcatcctgaa

SEQ ID NO: 562616 - DNA, 25 bp, Rattus norvegicus
tagtcactctatatgtctggccaca

SEQ ID NO: 562617 - DNA, 25 bp, Rattus norvegicus
tagtcactctatttgtctggccaca

SEQ ID NO: 562618 - DNA, 25 bp, Rattus norvegicus
tagtcactgtgacccaaagtctcag

SEQ ID NO: 562619 - DNA, 25 bp, Rattus norvegicus
tagtcactgtgagccaaagtctcag

SEQ ID NO: 562620 - DNA, 25 bp, Rattus norvegicus
tagtcacttatgaagctcagatgct

SEQ ID NO: 562621 - DNA, 25 bp, Rattus norvegicus
tagtcacttatgtagctcagatgct

SEQ ID NO: 562622 - DNA, 25 bp, Rattus norvegicus
tagtcacttcttccatagtcttctg

SEQ ID NO: 562623 - DNA, 25 bp, Rattus norvegicus
tagtcacttcttgcatagtcttctg

SEQ ID NO: 562624 - DNA, 25 bp, Rattus norvegicus
tagtcacttgacctcttatctagaa

SEQ ID NO: 562625 - DNA, 25 bp, Rattus norvegicus
tagtcacttgacgtcttatctagaa

SEQ ID NO: 562626 - DNA, 25 bp, Rattus norvegicus
tagtcactttagatcctggcagttt

SEQ ID NO: 562627 - DNA, 25 bp, Rattus norvegicus
tagtcactttagttcctggcagttt

SEQ ID NO: 562628 - DNA, 25 bp, Rattus norvegicus
tagtcactttcaaacagttttcccc

SEQ ID NO: 562629 - DNA, 25 bp, Rattus norvegicus
tagtcactttcatacagttttcccc

SEQ ID NO: 562630 - DNA, 25 bp, Rattus norvegicus
tagtcagaactgctcactctgcaga

SEQ ID NO: 562631 - DNA, 25 bp, Rattus norvegicus
tagtcagaactggtcactctgcaga

SEQ ID NO: 562632 - DNA, 25 bp, Rattus norvegicus
tagtcagacacacttccctgtggac

SEQ ID NO: 562633 - DNA, 25 bp, Rattus norvegicus
tagtcagacacagttccctgtggac

SEQ ID NO: 562634 - DNA, 25 bp, Rattus norvegicus
tagtcagacactcgctgggagttct

SEQ ID NO: 562635 - DNA, 25 bp, Rattus norvegicus
tagtcagacactggctgggagttct

SEQ ID NO: 562636 - DNA, 25 bp, Rattus norvegicus
tagtcagaggccaaccctgggtacc

SEQ ID NO: 562637 - DNA, 25 bp, Rattus norvegicus
tagtcagaggcctaccctgggtacc

SEQ ID NO: 562638 - DNA, 25 bp, Rattus norvegicus
tagtcagatttcacctgactggctg

SEQ ID NO: 562639 - DNA, 25 bp, Rattus norvegicus
tagtcagatttctcctgactggctg

SEQ ID NO: 562640 - DNA, 25 bp, Rattus norvegicus
tagtcagcacctacatatgcgccag

SEQ ID NO: 562641 - DNA, 25 bp, Rattus norvegicus
tagtcagcaccttcatatgcgccag

SEQ ID NO: 562642 - DNA, 25 bp, Rattus norvegicus
tagtcagcctgtaagtgcaacttca

SEQ ID NO: 562643 - DNA, 25 bp, Rattus norvegicus
tagtcagcctgttagtgcaacttca

SEQ ID NO: 562644 - DNA, 25 bp, Rattus norvegicus
tagtcagcgtccacgggccggaatt

SEQ ID NO: 562645 - DNA, 25 bp, Rattus norvegicus
tagtcagcgtcctcgggccggaatt

SEQ ID NO: 562646 - DNA, 25 bp, Rattus norvegicus
tagtcagctccaccaaaagcaggct

SEQ ID NO: 562647 - DNA, 25 bp, Rattus norvegicus
tagtcagctccagcaaaagcaggct

SEQ ID NO: 562648 - DNA, 25 bp, Rattus norvegicus
tagtcagctctcctgcttgaagaag

SEQ ID NO: 562649 - DNA, 25 bp, Rattus norvegicus
tagtcagctctcgtgcttgaagaag

SEQ ID NO: 562650 - DNA, 25 bp, Rattus norvegicus
tagtcagctttcacttctacaggag

SEQ ID NO: 562651 - DNA, 25 bp, Rattus norvegicus
tagtcagctttctcttctacaggag

SEQ ID NO: 562652 - DNA, 25 bp, Rattus norvegicus
tagtcagctttgacctcactgcata

SEQ ID NO: 562653 - DNA, 25 bp, Rattus norvegicus
tagtcagctttgtcctcactgcata

SEQ ID NO: 562654 - DNA, 25 bp, Rattus norvegicus
tagtcaggaccaactactctcatgc

SEQ ID NO: 562655 - DNA, 25 bp, Rattus norvegicus
tagtcaggaccatctactctcatgc

SEQ ID NO: 562656 - DNA, 25 bp, Rattus norvegicus
tagtcaggacccagtggctgcttgg

SEQ ID NO: 562657 - DNA, 25 bp, Rattus norvegicus
tagtcaggacccctggatgggacta

SEQ ID NO: 562658 - DNA, 25 bp, Rattus norvegicus
tagtcaggacccgtggatgggacta

SEQ ID NO: 562659 - DNA, 25 bp, Rattus norvegicus
tagtcaggaccctgtggctgcttgg

SEQ ID NO: 562660 - DNA, 25 bp, Rattus norvegicus
tagtcaggagctccactgtcaggac

SEQ ID NO: 562661 - DNA, 25 bp, Rattus norvegicus
tagtcaggagctgcactgtcaggac

SEQ ID NO: 562662 - DNA, 25 bp, Rattus norvegicus
tagtcagggcttcagtgccatcaac

SEQ ID NO: 562663 - DNA, 25 bp, Rattus norvegicus
tagtcagggcttgagtgccatcaac

SEQ ID NO: 562664 - DNA, 25 bp, Rattus norvegicus
tagtcagggtttctactgctacaat

SEQ ID NO: 562665 - DNA, 25 bp, Rattus norvegicus
tagtcagggtttgtactgctacaat

SEQ ID NO: 562666 - DNA, 25 bp, Rattus norvegicus
tagtcaggtaggaacccaccatctt

SEQ ID NO: 562667 - DNA, 25 bp, Rattus norvegicus
tagtcaggtaggtacccaccatctt

SEQ ID NO: 562668 - DNA, 25 bp, Rattus norvegicus
tagtcaggttggatgtctactagtt

SEQ ID NO: 562669 - DNA, 25 bp, Rattus norvegicus
tagtcaggttggttgtctactagtt

SEQ ID NO: 562670 - DNA, 25 bp, Rattus norvegicus
tagtcaggtttaccagccagctaaa

SEQ ID NO: 562671 - DNA, 25 bp, Rattus norvegicus
tagtcaggtttagcagccagctaaa

SEQ ID NO: 562672 - DNA, 25 bp, Rattus norvegicus
tagtcagtcacacaaatccgctcct

SEQ ID NO: 562673 - DNA, 25 bp, Rattus norvegicus
tagtcagtcacagaaatccgctcct

SEQ ID NO: 562674 - DNA, 25 bp, Rattus norvegicus
tagtcagtcagaacctctcgtgaat

SEQ ID NO: 562675 - DNA, 25 bp, Rattus norvegicus
tagtcagtcagatcctctcgtgaat

SEQ ID NO: 562676 - DNA, 25 bp, Rattus norvegicus
tagtcagtcttcactcatgggcagc

SEQ ID NO: 562677 - DNA, 25 bp, Rattus norvegicus
tagtcagtcttcctatctaacttta

SEQ ID NO: 562678 - DNA, 25 bp, Rattus norvegicus
tagtcagtcttcgtatctaacttta

SEQ ID NO: 562679 - DNA, 25 bp, Rattus norvegicus
tagtcagtcttctctcatgggcagc

SEQ ID NO: 562680 - DNA, 25 bp, Rattus norvegicus
tagtcagtgagccagagcctgctgt

SEQ ID NO: 562681 - DNA, 25 bp, Rattus norvegicus
tagtcagtgagcgagagcctgctgt

SEQ ID NO: 562682 - DNA, 25 bp, Rattus norvegicus
tagtcagtgcctacatttgggctct

SEQ ID NO: 562683 - DNA, 25 bp, Rattus norvegicus
tagtcagtgccttcatttgggctct

SEQ ID NO: 562684 - DNA, 25 bp, Rattus norvegicus
tagtcagtgtggacaccatgcccca

SEQ ID NO: 562685 - DNA, 25 bp, Rattus norvegicus
tagtcagtgtggtcaccatgcccca

SEQ ID NO: 562686 - DNA, 25 bp, Rattus norvegicus
tagtcagtgttgaagggaggcctct

SEQ ID NO: 562687 - DNA, 25 bp, Rattus norvegicus
tagtcagtgttgtagggaggcctct

SEQ ID NO: 562688 - DNA, 25 bp, Rattus norvegicus
tagtcagttatcaatttcctgtcac

SEQ ID NO: 562689 - DNA, 25 bp, Rattus norvegicus
tagtcagttatctatttcctgtcac

SEQ ID NO: 562690 - DNA, 25 bp, Rattus norvegicus
tagtcagttggtcctagtgctgtcg

SEQ ID NO: 562691 - DNA, 25 bp, Rattus norvegicus
tagtcagttggtctgtatcagccaa

SEQ ID NO: 562692 - DNA, 25 bp, Rattus norvegicus
tagtcagttggtgctagtgctgtcg

SEQ ID NO: 562693 - DNA, 25 bp, Rattus norvegicus
tagtcagttggtgtgtatcagccaa

SEQ ID NO: 562694 - DNA, 25 bp, Rattus norvegicus
tagtcagtttgaatccagcctggag

SEQ ID NO: 562695 - DNA, 25 bp, Rattus norvegicus
tagtcagtttgattccagcctggag

SEQ ID NO: 562696 - DNA, 25 bp, Rattus norvegicus
tagtcatagtcgctctcgaagccgg

SEQ ID NO: 562697 - DNA, 25 bp, Rattus norvegicus
tagtcatagtcggtctcgaagccgg

SEQ ID NO: 562698 - DNA, 25 bp, Rattus norvegicus
tagtcatcacatcgtgcccatcatt

SEQ ID NO: 562699 - DNA, 25 bp, Rattus norvegicus
tagtcatcacatggtgcccatcatt

SEQ ID NO: 562700 - DNA, 25 bp, Rattus norvegicus
tagtcatcagccattctgcaacatc

SEQ ID NO: 562701 - DNA, 25 bp, Rattus norvegicus
tagtcatcagcctttctgcaacatc

SEQ ID NO: 562702 - DNA, 25 bp, Rattus norvegicus
tagtcatccattaaataaccccggg

SEQ ID NO: 562703 - DNA, 25 bp, Rattus norvegicus
tagtcatccatttaataaccccggg

SEQ ID NO: 562704 - DNA, 25 bp, Rattus norvegicus
tagtcatccctacagccatgtgaac

SEQ ID NO: 562705 - DNA, 25 bp, Rattus norvegicus
tagtcatccctagagccatgtgaac

SEQ ID NO: 562706 - DNA, 25 bp, Rattus norvegicus
tagtcatcctccacgaggaagcagg

SEQ ID NO: 562707 - DNA, 25 bp, Rattus norvegicus
tagtcatcctcctcgaggaagcagg

SEQ ID NO: 562708 - DNA, 25 bp, Rattus norvegicus
tagtcatctacgactgggcttgctc

SEQ ID NO: 562709 - DNA, 25 bp, Rattus norvegicus
tagtcatctacgtctgggcttgctc

SEQ ID NO: 562710 - DNA, 25 bp, Rattus norvegicus
tagtcatgggaaacgggctctgcac

SEQ ID NO: 562711 - DNA, 25 bp, Rattus norvegicus
tagtcatgggaatcgggctctgcac

SEQ ID NO: 562712 - DNA, 25 bp, Rattus norvegicus
tagtcatgtcacaaatagcatcagt

SEQ ID NO: 562713 - DNA, 25 bp, Rattus norvegicus
tagtcatgtcactaatagcatcagt

SEQ ID NO: 562714 - DNA, 25 bp, Rattus norvegicus
tagtcattaagtctcattcccttcc

SEQ ID NO: 562715 - DNA, 25 bp, Rattus norvegicus
tagtcattaagtgtcattcccttcc

SEQ ID NO: 562716 - DNA, 25 bp, Rattus norvegicus
tagtcattagaccatataacagtaa

SEQ ID NO: 562717 - DNA, 25 bp, Rattus norvegicus
tagtcattagacgatataacagtaa

SEQ ID NO: 562718 - DNA, 25 bp, Rattus norvegicus
tagtcattcctcactgtgctcatgt

SEQ ID NO: 562719 - DNA, 25 bp, Rattus norvegicus
tagtcattcctctctgtgctcatgt

SEQ ID NO: 562720 - DNA, 25 bp, Rattus norvegicus
tagtcattcttcactggtgtaaggt

SEQ ID NO: 562721 - DNA, 25 bp, Rattus norvegicus
tagtcattcttctctggtgtaaggt

SEQ ID NO: 562722 - DNA, 25 bp, Rattus norvegicus
tagtcattgggcacccgtgatatca

SEQ ID NO: 562723 - DNA, 25 bp, Rattus norvegicus
tagtcattgggctcccgtgatatca

SEQ ID NO: 562724 - DNA, 25 bp, Rattus norvegicus
tagtcatttaatcgcaggctcaatt

SEQ ID NO: 562725 - DNA, 25 bp, Rattus norvegicus
tagtcatttaatggcaggctcaatt

SEQ ID NO: 562726 - DNA, 25 bp, Rattus norvegicus
tagtcatttagcagtttgtcccttg

SEQ ID NO: 562727 - DNA, 25 bp, Rattus norvegicus
tagtcatttagctgtttgtcccttg

SEQ ID NO: 562728 - DNA, 25 bp, Rattus norvegicus
tagtcatttgctacaaggccttcgc

SEQ ID NO: 562729 - DNA, 25 bp, Rattus norvegicus
tagtcatttgctagttttgcacaaa

SEQ ID NO: 562730 - DNA, 25 bp, Rattus norvegicus
tagtcatttgcttcaaggccttcgc

SEQ ID NO: 562731 - DNA, 25 bp, Rattus norvegicus
tagtcatttgcttgttttgcacaaa

SEQ ID NO: 562732 - DNA, 25 bp, Rattus norvegicus
tagtcattttaccattctctgttgc

SEQ ID NO: 562733 - DNA, 25 bp, Rattus norvegicus
tagtcattttacgattctctgttgc

SEQ ID NO: 562734 - DNA, 25 bp, Rattus norvegicus
tagtccaaggacactaattcagtca

SEQ ID NO: 562735 - DNA, 25 bp, Rattus norvegicus
tagtccaaggactctaattcagtca

SEQ ID NO: 562736 - DNA, 25 bp, Rattus norvegicus
tagtccaataaaaatcccctctctg

SEQ ID NO: 562737 - DNA, 25 bp, Rattus norvegicus
tagtccaataaatatcccctctctg

SEQ ID NO: 562738 - DNA, 25 bp, Rattus norvegicus
tagtccaatccaacgttctttacaa

SEQ ID NO: 562739 - DNA, 25 bp, Rattus norvegicus
tagtccaatccatcgttctttacaa

SEQ ID NO: 562740 - DNA, 25 bp, Rattus norvegicus
tagtccacaatgagaagctgctgaa

SEQ ID NO: 562741 - DNA, 25 bp, Rattus norvegicus
tagtccacaatgtgaagctgctgaa

SEQ ID NO: 562742 - DNA, 25 bp, Rattus norvegicus
tagtccacagaaccttccctaagag

SEQ ID NO: 562743 - DNA, 25 bp, Rattus norvegicus
tagtccacagaagcttccctaagag

SEQ ID NO: 562744 - DNA, 25 bp, Rattus norvegicus
tagtccacagtaccagtaaaaacca

SEQ ID NO: 562745 - DNA, 25 bp, Rattus norvegicus
tagtccacagtagcagtaaaaacca

SEQ ID NO: 562746 - DNA, 25 bp, Rattus norvegicus
tagtccacatagctatgccagcatc

SEQ ID NO: 562747 - DNA, 25 bp, Rattus norvegicus
tagtccacataggtatgccagcatc

SEQ ID NO: 562748 - DNA, 25 bp, Rattus norvegicus
tagtccacctctcagatgatggctg

SEQ ID NO: 562749 - DNA, 25 bp, Rattus norvegicus
tagtccacctctgagatgatggctg

SEQ ID NO: 562750 - DNA, 25 bp, Rattus norvegicus
tagtccacgttaaccgctggtatgg

SEQ ID NO: 562751 - DNA, 25 bp, Rattus norvegicus
tagtccacgttatccgctggtatgg

SEQ ID NO: 562752 - DNA, 25 bp, Rattus norvegicus
tagtccactcaccagtctctggatg

SEQ ID NO: 562753 - DNA, 25 bp, Rattus norvegicus
tagtccactcacgagtctctggatg

SEQ ID NO: 562754 - DNA, 25 bp, Rattus norvegicus
tagtccagaggacctctcagcagtg

SEQ ID NO: 562755 - DNA, 25 bp, Rattus norvegicus
tagtccagaggagctctcagcagtg

SEQ ID NO: 562756 - DNA, 25 bp, Rattus norvegicus
tagtccagcaacagctaccagtgcc

SEQ ID NO: 562757 - DNA, 25 bp, Rattus norvegicus
tagtccagcaacagtgcacattgtg

SEQ ID NO: 562758 - DNA, 25 bp, Rattus norvegicus
tagtccagcaactgctaccagtgcc

SEQ ID NO: 562759 - DNA, 25 bp, Rattus norvegicus
tagtccagcaactgtgcacattgtg

SEQ ID NO: 562760 - DNA, 25 bp, Rattus norvegicus
tagtccagctctaactcactaggaa

SEQ ID NO: 562761 - DNA, 25 bp, Rattus norvegicus
tagtccagctcttactcactaggaa

SEQ ID NO: 562762 - DNA, 25 bp, Rattus norvegicus
tagtccaggacaatcaaagctatac

SEQ ID NO: 562763 - DNA, 25 bp, Rattus norvegicus
tagtccaggacattcaaagctatac

SEQ ID NO: 562764 - DNA, 25 bp, Rattus norvegicus
tagtccagggtgacctcacaggaac

SEQ ID NO: 562765 - DNA, 25 bp, Rattus norvegicus
tagtccagggtgtcctcacaggaac

SEQ ID NO: 562766 - DNA, 25 bp, Rattus norvegicus
tagtccaggtacagtgggagcccct

SEQ ID NO: 562767 - DNA, 25 bp, Rattus norvegicus
tagtccaggtactgtgggagcccct

SEQ ID NO: 562768 - DNA, 25 bp, Rattus norvegicus
tagtccaggtttagtaccattaggg

SEQ ID NO: 562769 - DNA, 25 bp, Rattus norvegicus
tagtccaggttttgtaccattaggg

SEQ ID NO: 562770 - DNA, 25 bp, Rattus norvegicus
tagtccagtcgcagctcggggttgc

SEQ ID NO: 562771 - DNA, 25 bp, Rattus norvegicus
tagtccagtcgctgctcggggttgc

SEQ ID NO: 562772 - DNA, 25 bp, Rattus norvegicus
tagtccataggaccttgtgttcccc

SEQ ID NO: 562773 - DNA, 25 bp, Rattus norvegicus
tagtccataggagcttgtgttcccc

SEQ ID NO: 562774 - DNA, 25 bp, Rattus norvegicus
tagtccatggataatgcacccctta

SEQ ID NO: 562775 - DNA, 25 bp, Rattus norvegicus
tagtccatggattatgcacccctta

SEQ ID NO: 562776 - DNA, 25 bp, Rattus norvegicus
tagtccattatcatctgcaggtagc

SEQ ID NO: 562777 - DNA, 25 bp, Rattus norvegicus
tagtccattatcttctgcaggtagc

SEQ ID NO: 562778 - DNA, 25 bp, Rattus norvegicus
tagtccattatgatcttcctcttgc

SEQ ID NO: 562779 - DNA, 25 bp, Rattus norvegicus
tagtccattatgttcttcctcttgc

SEQ ID NO: 562780 - DNA, 25 bp, Rattus norvegicus
tagtccattttacagtcttcagaga

SEQ ID NO: 562781 - DNA, 25 bp, Rattus norvegicus
tagtccattttagagtcttcagaga

SEQ ID NO: 562782 - DNA, 25 bp, Rattus norvegicus
tagtccattttcaaagtcagaacaa

SEQ ID NO: 562783 - DNA, 25 bp, Rattus norvegicus
tagtccattttctaagtcagaacaa

SEQ ID NO: 562784 - DNA, 25 bp, Rattus norvegicus
tagtcccaggagactaccatgtgat

SEQ ID NO: 562785 - DNA, 25 bp, Rattus norvegicus
tagtcccaggagaggtaggtgaatc

SEQ ID NO: 562786 - DNA, 25 bp, Rattus norvegicus
tagtcccaggagtctaccatgtgat

SEQ ID NO: 562787 - DNA, 25 bp, Rattus norvegicus
tagtcccaggagtggtaggtgaatc

SEQ ID NO: 562788 - DNA, 25 bp, Rattus norvegicus
tagtcccaggttacccttggatgga

SEQ ID NO: 562789 - DNA, 25 bp, Rattus norvegicus
tagtcccaggtttcccttggatgga

SEQ ID NO: 562790 - DNA, 25 bp, Rattus norvegicus
tagtcccagtcaagtcagtcctact

SEQ ID NO: 562791 - DNA, 25 bp, Rattus norvegicus
tagtcccagtcatgtcagtcctact

SEQ ID NO: 562792 - DNA, 25 bp, Rattus norvegicus
tagtcccatccgatagcaacaagag

SEQ ID NO: 562793 - DNA, 25 bp, Rattus norvegicus
tagtcccatccgttagcaacaagag

SEQ ID NO: 562794 - DNA, 25 bp, Rattus norvegicus
tagtccccaagcctaccaagtatgt

SEQ ID NO: 562795 - DNA, 25 bp, Rattus norvegicus
tagtccccaagcgtaccaagtatgt

SEQ ID NO: 562796 - DNA, 25 bp, Rattus norvegicus
tagtccccagcgctgtatatactgg

SEQ ID NO: 562797 - DNA, 25 bp, Rattus norvegicus
tagtccccagcggtgtatatactgg

SEQ ID NO: 562798 - DNA, 25 bp, Rattus norvegicus
tagtccccagtacctgttttgatac

SEQ ID NO: 562799 - DNA, 25 bp, Rattus norvegicus
tagtccccagtagctgttttgatac

SEQ ID NO: 562800 - DNA, 25 bp, Rattus norvegicus
tagtccccagtccttgtaagtgctt

SEQ ID NO: 562801 - DNA, 25 bp, Rattus norvegicus
tagtccccagtcgttgtaagtgctt

SEQ ID NO: 562802 - DNA, 25 bp, Rattus norvegicus
tagtccccggctactaggaaggaag

SEQ ID NO: 562803 - DNA, 25 bp, Rattus norvegicus
tagtccccggcttctaggaaggaag

SEQ ID NO: 562804 - DNA, 25 bp, Rattus norvegicus
tagtccccgggaacgagcttctcgg

SEQ ID NO: 562805 - DNA, 25 bp, Rattus norvegicus
tagtccccgggatcgagcttctcgg

SEQ ID NO: 562806 - DNA, 25 bp, Rattus norvegicus
tagtccccgggtcagctaaggcaag

SEQ ID NO: 562807 - DNA, 25 bp, Rattus norvegicus
tagtccccgggtgagctaaggcaag

SEQ ID NO: 562808 - DNA, 25 bp, Rattus norvegicus
tagtcccctcatcatgctcactgtg

SEQ ID NO: 562809 - DNA, 25 bp, Rattus norvegicus
tagtcccctcatgatgctcactgtg

SEQ ID NO: 562810 - DNA, 25 bp, Rattus norvegicus
tagtcccctggactttgactgaaaa

SEQ ID NO: 562811 - DNA, 25 bp, Rattus norvegicus
tagtcccctggagtttgactgaaaa

SEQ ID NO: 562812 - DNA, 25 bp, Rattus norvegicus
tagtccccttgtaccaggtaaactg

SEQ ID NO: 562813 - DNA, 25 bp, Rattus norvegicus
tagtccccttgttccaggtaaactg

SEQ ID NO: 562814 - DNA, 25 bp, Rattus norvegicus
tagtcccgaagaaatgaacaagctc

SEQ ID NO: 562815 - DNA, 25 bp, Rattus norvegicus
tagtcccgaagatatgaacaagctc

SEQ ID NO: 562816 - DNA, 25 bp, Rattus norvegicus
tagtcccggcctagcaaagagctgg

SEQ ID NO: 562817 - DNA, 25 bp, Rattus norvegicus
tagtcccggccttgcaaagagctgg

SEQ ID NO: 562818 - DNA, 25 bp, Rattus norvegicus
tagtcccggctgcagagctagacca

SEQ ID NO: 562819 - DNA, 25 bp, Rattus norvegicus
tagtcccggctggagagctagacca

SEQ ID NO: 562820 - DNA, 25 bp, Rattus norvegicus
tagtccctacaaccgctgagtctat

SEQ ID NO: 562821 - DNA, 25 bp, Rattus norvegicus
tagtccctacaagcgctgagtctat

SEQ ID NO: 562822 - DNA, 25 bp, Rattus norvegicus
tagtccctcgtgcagggtacaagca

SEQ ID NO: 562823 - DNA, 25 bp, Rattus norvegicus
tagtccctcgtggagggtacaagca

SEQ ID NO: 562824 - DNA, 25 bp, Rattus norvegicus
tagtccctctcgaccaagatgtgat

SEQ ID NO: 562825 - DNA, 25 bp, Rattus norvegicus
tagtccctctcgtccaagatgtgat

SEQ ID NO: 562826 - DNA, 25 bp, Rattus norvegicus
tagtccctgagaccttttctctgat

SEQ ID NO: 562827 - DNA, 25 bp, Rattus norvegicus
tagtccctgagagcttttctctgat

SEQ ID NO: 562828 - DNA, 25 bp, Rattus norvegicus
tagtccctgatcattgatggctgag

SEQ ID NO: 562829 - DNA, 25 bp, Rattus norvegicus
tagtccctgatctttgatggctgag

SEQ ID NO: 562830 - DNA, 25 bp, Rattus norvegicus
tagtccctgttcatagagtctagca

SEQ ID NO: 562831 - DNA, 25 bp, Rattus norvegicus
tagtccctgttcttagagtctagca

SEQ ID NO: 562832 - DNA, 25 bp, Rattus norvegicus
tagtccctgtttacttcaaacctgt

SEQ ID NO: 562833 - DNA, 25 bp, Rattus norvegicus
tagtccctgttttcttcaaacctgt

SEQ ID NO: 562834 - DNA, 25 bp, Rattus norvegicus
tagtcccttcttcctagacccaggt

SEQ ID NO: 562835 - DNA, 25 bp, Rattus norvegicus
tagtcccttcttgctagacccaggt

SEQ ID NO: 562836 - DNA, 25 bp, Rattus norvegicus
tagtccgaaggtctgcaaagcgcac

SEQ ID NO: 562837 - DNA, 25 bp, Rattus norvegicus
tagtccgaaggtgtgcaaagcgcac

SEQ ID NO: 562838 - DNA, 25 bp, Rattus norvegicus
tagtccgaccaccacaagggaacag

SEQ ID NO: 562839 - DNA, 25 bp, Rattus norvegicus
tagtccgaccacgacaagggaacag

SEQ ID NO: 562840 - DNA, 25 bp, Rattus norvegicus
tagtccgagaccagagcatacgtgt

SEQ ID NO: 562841 - DNA, 25 bp, Rattus norvegicus
tagtccgagacctgagcatacgtgt

SEQ ID NO: 562842 - DNA, 25 bp, Rattus norvegicus
tagtccgaggctctccgagttccca

SEQ ID NO: 562843 - DNA, 25 bp, Rattus norvegicus
tagtccgaggctgtccgagttccca

SEQ ID NO: 562844 - DNA, 25 bp, Rattus norvegicus
tagtccgctcaccagcagcctagaa

SEQ ID NO: 562845 - DNA, 25 bp, Rattus norvegicus
tagtccgctcacgagcagcctagaa

SEQ ID NO: 562846 - DNA, 25 bp, Rattus norvegicus
tagtccgtctgccagaagactcaga

SEQ ID NO: 562847 - DNA, 25 bp, Rattus norvegicus
tagtccgtctgcgagaagactcaga

SEQ ID NO: 562848 - DNA, 25 bp, Rattus norvegicus
tagtccgtgagacagtggcgcacct

SEQ ID NO: 562849 - DNA, 25 bp, Rattus norvegicus
tagtccgtgagagagtggcgcacct

SEQ ID NO: 562850 - DNA, 25 bp, Rattus norvegicus
tagtcctaaccacattcttaaaagg

SEQ ID NO: 562851 - DNA, 25 bp, Rattus norvegicus
tagtcctaaccagattcttaaaagg

SEQ ID NO: 562852 - DNA, 25 bp, Rattus norvegicus
tagtcctaacgtcagcagtaacctt

SEQ ID NO: 562853 - DNA, 25 bp, Rattus norvegicus
tagtcctaacgtgagcagtaacctt

SEQ ID NO: 562854 - DNA, 25 bp, Rattus norvegicus
tagtcctaccttaatttgcctagag

SEQ ID NO: 562855 - DNA, 25 bp, Rattus norvegicus
tagtcctacctttatttgcctagag

SEQ ID NO: 562856 - DNA, 25 bp, Rattus norvegicus
tagtcctagatcaggaatgccgccc

SEQ ID NO: 562857 - DNA, 25 bp, Rattus norvegicus
tagtcctagatctggaatgccgccc

SEQ ID NO: 562858 - DNA, 25 bp, Rattus norvegicus
tagtcctagcacaggtgggtggtac

SEQ ID NO: 562859 - DNA, 25 bp, Rattus norvegicus
tagtcctagcactggtgggtggtac

SEQ ID NO: 562860 - DNA, 25 bp, Rattus norvegicus
tagtcctatagtcctgtagtcctgt

SEQ ID NO: 562861 - DNA, 25 bp, Rattus norvegicus
tagtcctatagtgctgtagtcctgt

SEQ ID NO: 562862 - DNA, 25 bp, Rattus norvegicus
tagtcctcaccaccatcggttggaa

SEQ ID NO: 562863 - DNA, 25 bp, Rattus norvegicus
tagtcctcaccagcatcggttggaa

SEQ ID NO: 562864 - DNA, 25 bp, Rattus norvegicus
tagtcctcagccatgttttacagtt

SEQ ID NO: 562865 - DNA, 25 bp, Rattus norvegicus
tagtcctcagccttgttttacagtt

SEQ ID NO: 562866 - DNA, 25 bp, Rattus norvegicus
tagtcctcaggacagtttccagaac

SEQ ID NO: 562867 - DNA, 25 bp, Rattus norvegicus
tagtcctcaggagagtttccagaac

SEQ ID NO: 562868 - DNA, 25 bp, Rattus norvegicus
tagtcctccgtcctagtcagtttta

SEQ ID NO: 562869 - DNA, 25 bp, Rattus norvegicus
tagtcctccgtcgtagtcagtttta

SEQ ID NO: 562870 - DNA, 25 bp, Rattus norvegicus
tagtcctcctcaagaacagcaagtg

SEQ ID NO: 562871 - DNA, 25 bp, Rattus norvegicus
tagtcctcctcatgaacagcaagtg

SEQ ID NO: 562872 - DNA, 25 bp, Rattus norvegicus
tagtcctcctgacagtttggatttc

SEQ ID NO: 562873 - DNA, 25 bp, Rattus norvegicus
tagtcctcctgagagtttggatttc

SEQ ID NO: 562874 - DNA, 25 bp, Rattus norvegicus
tagtcctcgtggacgcggcgagatc

SEQ ID NO: 562875 - DNA, 25 bp, Rattus norvegicus
tagtcctcgtggtcgcggcgagatc

SEQ ID NO: 562876 - DNA, 25 bp, Rattus norvegicus
tagtcctctgaacaatcccctagtg

SEQ ID NO: 562877 - DNA, 25 bp, Rattus norvegicus
tagtcctctgaagaatcccctagtg

SEQ ID NO: 562878 - DNA, 25 bp, Rattus norvegicus
tagtcctctgacatactccaggttt

SEQ ID NO: 562879 - DNA, 25 bp, Rattus norvegicus
tagtcctctgacttactccaggttt

SEQ ID NO: 562880 - DNA, 25 bp, Rattus norvegicus
tagtcctctggaaccgtaagccaaa

SEQ ID NO: 562881 - DNA, 25 bp, Rattus norvegicus
tagtcctctggatccgtaagccaaa

SEQ ID NO: 562882 - DNA, 25 bp, Rattus norvegicus
tagtcctgactacatccttcataca

SEQ ID NO: 562883 - DNA, 25 bp, Rattus norvegicus
tagtcctgactagatccttcataca

SEQ ID NO: 562884 - DNA, 25 bp, Rattus norvegicus
tagtcctgagtgagtggcactccat

SEQ ID NO: 562885 - DNA, 25 bp, Rattus norvegicus
tagtcctgagtgtgtggcactccat

SEQ ID NO: 562886 - DNA, 25 bp, Rattus norvegicus
tagtcctgcctacaaatgtcctcac

SEQ ID NO: 562887 - DNA, 25 bp, Rattus norvegicus
tagtcctgcctagaaatgtcctcac

SEQ ID NO: 562888 - DNA, 25 bp, Rattus norvegicus
tagtcctgccttactgtttgttttt

SEQ ID NO: 562889 - DNA, 25 bp, Rattus norvegicus
tagtcctgcctttctgtttgttttt

SEQ ID NO: 562890 - DNA, 25 bp, Rattus norvegicus
tagtcctgcgccaagatcctggcag

SEQ ID NO: 562891 - DNA, 25 bp, Rattus norvegicus
tagtcctgcgcctagatcctggcag

SEQ ID NO: 562892 - DNA, 25 bp, Rattus norvegicus
tagtcctggacacagccaagtcaca

SEQ ID NO: 562893 - DNA, 25 bp, Rattus norvegicus
tagtcctggacagagccaagtcaca

SEQ ID NO: 562894 - DNA, 25 bp, Rattus norvegicus
tagtcctggccaacagtgccgagaa

SEQ ID NO: 562895 - DNA, 25 bp, Rattus norvegicus
tagtcctggccatcagtgccgagaa

SEQ ID NO: 562896 - DNA, 25 bp, Rattus norvegicus
tagtcctggtgacaggcaatctgtt

SEQ ID NO: 562897 - DNA, 25 bp, Rattus norvegicus
tagtcctggtgagaggcaatctgtt

SEQ ID NO: 562898 - DNA, 25 bp, Rattus norvegicus
tagtcctgtttcaactagctgtcag

SEQ ID NO: 562899 - DNA, 25 bp, Rattus norvegicus
tagtcctgtttctactagctgtcag

SEQ ID NO: 562900 - DNA, 25 bp, Rattus norvegicus
tagtccttagccagtgcccgtgata

SEQ ID NO: 562901 - DNA, 25 bp, Rattus norvegicus
tagtccttagcctgtgcccgtgata

SEQ ID NO: 562902 - DNA, 25 bp, Rattus norvegicus
tagtccttcagacaggcttttctaa

SEQ ID NO: 562903 - DNA, 25 bp, Rattus norvegicus
tagtccttcagagaggcttttctaa

SEQ ID NO: 562904 - DNA, 25 bp, Rattus norvegicus
tagtccttcaggcattggcattcat

SEQ ID NO: 562905 - DNA, 25 bp, Rattus norvegicus
tagtccttcagggattggcattcat

SEQ ID NO: 562906 - DNA, 25 bp, Rattus norvegicus
tagtccttccagatgcttccaggac

SEQ ID NO: 562907 - DNA, 25 bp, Rattus norvegicus
tagtccttccagttgcttccaggac

SEQ ID NO: 562908 - DNA, 25 bp, Rattus norvegicus
tagtccttctgtatccaacgagctg

SEQ ID NO: 562909 - DNA, 25 bp, Rattus norvegicus
tagtccttctgtttccaacgagctg

SEQ ID NO: 562910 - DNA, 25 bp, Rattus norvegicus
tagtccttgccacagaccttcgtac

SEQ ID NO: 562911 - DNA, 25 bp, Rattus norvegicus
tagtccttgccagagaccttcgtac

SEQ ID NO: 562912 - DNA, 25 bp, Rattus norvegicus
tagtcctttagtattcactgtcata

SEQ ID NO: 562913 - DNA, 25 bp, Rattus norvegicus
tagtcctttagttttcactgtcata

SEQ ID NO: 562914 - DNA, 25 bp, Rattus norvegicus
tagtcctttcacaaccattgcatca

SEQ ID NO: 562915 - DNA, 25 bp, Rattus norvegicus
tagtcctttcactaccattgcatca

SEQ ID NO: 562916 - DNA, 25 bp, Rattus norvegicus
tagtcctttccgaagcctggatgga

SEQ ID NO: 562917 - DNA, 25 bp, Rattus norvegicus
tagtcctttccgtagcctggatgga

SEQ ID NO: 562918 - DNA, 25 bp, Rattus norvegicus
tagtccttttgcagccccagagggt

SEQ ID NO: 562919 - DNA, 25 bp, Rattus norvegicus
tagtccttttgctgccccagagggt

SEQ ID NO: 562920 - DNA, 25 bp, Rattus norvegicus
tagtcgaccttaaccaaagctccat

SEQ ID NO: 562921 - DNA, 25 bp, Rattus norvegicus
tagtcgaccttatccaaagctccat

SEQ ID NO: 562922 - DNA, 25 bp, Rattus norvegicus
tagtcgactactacccagaatatga

SEQ ID NO: 562923 - DNA, 25 bp, Rattus norvegicus
tagtcgactacttcccagaatatga

SEQ ID NO: 562924 - DNA, 25 bp, Rattus norvegicus
tagtcgagcctgaacagtccggcat

SEQ ID NO: 562925 - DNA, 25 bp, Rattus norvegicus
tagtcgagcctgtacagtccggcat

SEQ ID NO: 562926 - DNA, 25 bp, Rattus norvegicus
tagtcgaggactattcgcttttctg

SEQ ID NO: 562927 - DNA, 25 bp, Rattus norvegicus
tagtcgaggacttttcgcttttctg

SEQ ID NO: 562928 - DNA, 25 bp, Rattus norvegicus
tagtcgagtcttcggtcttctgggc

SEQ ID NO: 562929 - DNA, 25 bp, Rattus norvegicus
tagtcgagtcttgggtcttctgggc

SEQ ID NO: 562930 - DNA, 25 bp, Rattus norvegicus
tagtcgagttctacagcgatctact

SEQ ID NO: 562931 - DNA, 25 bp, Rattus norvegicus
tagtcgagttcttcagcgatctact

SEQ ID NO: 562932 - DNA, 25 bp, Rattus norvegicus
tagtcgataacacatcagctgcctc

SEQ ID NO: 562933 - DNA, 25 bp, Rattus norvegicus
tagtcgataacagatcagctgcctc

SEQ ID NO: 562934 - DNA, 25 bp, Rattus norvegicus
tagtcgcccctccattgagagttgg

SEQ ID NO: 562935 - DNA, 25 bp, Rattus norvegicus
tagtcgcccctcgattgagagttgg

SEQ ID NO: 562936 - DNA, 25 bp, Rattus norvegicus
tagtcgccgtaccagtaaacgttag

SEQ ID NO: 562937 - DNA, 25 bp, Rattus norvegicus
tagtcgccgtacgagtaaacgttag

SEQ ID NO: 562938 - DNA, 25 bp, Rattus norvegicus
tagtcgcgctcgctggccaggatct

SEQ ID NO: 562939 - DNA, 25 bp, Rattus norvegicus
tagtcgcgctcggtggccaggatct

SEQ ID NO: 562940 - DNA, 25 bp, Rattus norvegicus
tagtcgctttgcacatggcggtgag

SEQ ID NO: 562941 - DNA, 25 bp, Rattus norvegicus
tagtcgctttgctcatggcggtgag

SEQ ID NO: 562942 - DNA, 25 bp, Rattus norvegicus
tagtcggacaggctgttttcctcag

SEQ ID NO: 562943 - DNA, 25 bp, Rattus norvegicus
tagtcggacagggtgttttcctcag

SEQ ID NO: 562944 - DNA, 25 bp, Rattus norvegicus
tagtcggagtaacagcccaggcctg

SEQ ID NO: 562945 - DNA, 25 bp, Rattus norvegicus
tagtcggagtaagagcccaggcctg

SEQ ID NO: 562946 - DNA, 25 bp, Rattus norvegicus
tagtcggatcccatttctgtggaga

SEQ ID NO: 562947 - DNA, 25 bp, Rattus norvegicus
tagtcggatcccttttctgtggaga

SEQ ID NO: 562948 - DNA, 25 bp, Rattus norvegicus
tagtcggattccctgtagatcactc

SEQ ID NO: 562949 - DNA, 25 bp, Rattus norvegicus
tagtcggattccgtgtagatcactc

SEQ ID NO: 562950 - DNA, 25 bp, Rattus norvegicus
tagtcggctctcactgtatgaactg

SEQ ID NO: 562951 - DNA, 25 bp, Rattus norvegicus
tagtcggctctctctgtatgaactg

SEQ ID NO: 562952 - DNA, 25 bp, Rattus norvegicus
tagtcggctgtaccttttcaattag

SEQ ID NO: 562953 - DNA, 25 bp, Rattus norvegicus
tagtcggctgtagcttttcaattag

SEQ ID NO: 562954 - DNA, 25 bp, Rattus norvegicus
tagtcgtagccaccaggttggctcc

SEQ ID NO: 562955 - DNA, 25 bp, Rattus norvegicus
tagtcgtagccacctcacaacgagc

SEQ ID NO: 562956 - DNA, 25 bp, Rattus norvegicus
tagtcgtagccagcaggttggctcc

SEQ ID NO: 562957 - DNA, 25 bp, Rattus norvegicus
tagtcgtagccagctcacaacgagc

SEQ ID NO: 562958 - DNA, 25 bp, Rattus norvegicus
tagtcgtcaggaaggctctgggtaa

SEQ ID NO: 562959 - DNA, 25 bp, Rattus norvegicus
tagtcgtcaggatggctctgggtaa

SEQ ID NO: 562960 - DNA, 25 bp, Rattus norvegicus
tagtcgtccctcactgaaatttgga

SEQ ID NO: 562961 - DNA, 25 bp, Rattus norvegicus
tagtcgtccctctctgaaatttgga

SEQ ID NO: 562962 - DNA, 25 bp, Rattus norvegicus
tagtcgtccttacagcttgcttatc

SEQ ID NO: 562963 - DNA, 25 bp, Rattus norvegicus
tagtcgtccttagagcttgcttatc

SEQ ID NO: 562964 - DNA, 25 bp, Rattus norvegicus
tagtcgtcgttgactttggttctgc

SEQ ID NO: 562965 - DNA, 25 bp, Rattus norvegicus
tagtcgtcgttgtctttggttctgc

SEQ ID NO: 562966 - DNA, 25 bp, Rattus norvegicus
tagtcgtctacaccaatgccagaca

SEQ ID NO: 562967 - DNA, 25 bp, Rattus norvegicus
tagtcgtctacagcaatgccagaca

SEQ ID NO: 562968 - DNA, 25 bp, Rattus norvegicus
tagtcgtggcgaccaagcaacccag

SEQ ID NO: 562969 - DNA, 25 bp, Rattus norvegicus
tagtcgtggcgagcaagcaacccag

SEQ ID NO: 562970 - DNA, 25 bp, Rattus norvegicus
tagtcgttgcagagagcctgattcc

SEQ ID NO: 562971 - DNA, 25 bp, Rattus norvegicus
tagtcgttgcagtgagcctgattcc

SEQ ID NO: 562972 - DNA, 25 bp, Rattus norvegicus
tagtcgtttgaaagccttctggaga

SEQ ID NO: 562973 - DNA, 25 bp, Rattus norvegicus
tagtcgtttgaatgccttctggaga

SEQ ID NO: 562974 - DNA, 25 bp, Rattus norvegicus
tagtcgtttgccagttgaatctttc

SEQ ID NO: 562975 - DNA, 25 bp, Rattus norvegicus
tagtcgtttgcctgttgaatctttc

SEQ ID NO: 562976 - DNA, 25 bp, Rattus norvegicus
tagtctaacacactggaccctattt

SEQ ID NO: 562977 - DNA, 25 bp, Rattus norvegicus
tagtctaacacagtggaccctattt

SEQ ID NO: 562978 - DNA, 25 bp, Rattus norvegicus
tagtctaacttgacttccccaggga

SEQ ID NO: 562979 - DNA, 25 bp, Rattus norvegicus
tagtctaacttgtcttccccaggga

SEQ ID NO: 562980 - DNA, 25 bp, Rattus norvegicus
tagtctaagacaaatcagctccttg

SEQ ID NO: 562981 - DNA, 25 bp, Rattus norvegicus
tagtctaagacatatcagctccttg

SEQ ID NO: 562982 - DNA, 25 bp, Rattus norvegicus
tagtctaagaggagccgaggccacc

SEQ ID NO: 562983 - DNA, 25 bp, Rattus norvegicus
tagtctaagaggtgccgaggccacc

SEQ ID NO: 562984 - DNA, 25 bp, Rattus norvegicus
tagtctaagggcaacgtggctcccg

SEQ ID NO: 562985 - DNA, 25 bp, Rattus norvegicus
tagtctaagggctacgtggctcccg

SEQ ID NO: 562986 - DNA, 25 bp, Rattus norvegicus
tagtctaataaaaccccacacttcc

SEQ ID NO: 562987 - DNA, 25 bp, Rattus norvegicus
tagtctaataaatccccacacttcc

SEQ ID NO: 562988 - DNA, 25 bp, Rattus norvegicus
tagtctaatggacgcagtttcattg

SEQ ID NO: 562989 - DNA, 25 bp, Rattus norvegicus
tagtctaatggaggcagtttcattg

SEQ ID NO: 562990 - DNA, 25 bp, Rattus norvegicus
tagtctacagcacatgcgttaaggg

SEQ ID NO: 562991 - DNA, 25 bp, Rattus norvegicus
tagtctacagcagatgcgttaaggg

SEQ ID NO: 562992 - DNA, 25 bp, Rattus norvegicus
tagtctacattgctcttcccagaga

SEQ ID NO: 562993 - DNA, 25 bp, Rattus norvegicus
tagtctacattggtcttcccagaga

SEQ ID NO: 562994 - DNA, 25 bp, Rattus norvegicus
tagtctacgtttacccagcaccagc

SEQ ID NO: 562995 - DNA, 25 bp, Rattus norvegicus
tagtctacgttttcccagcaccagc

SEQ ID NO: 562996 - DNA, 25 bp, Rattus norvegicus
tagtctactctcaggtacaacttct

SEQ ID NO: 562997 - DNA, 25 bp, Rattus norvegicus
tagtctactctctggtacaacttct

SEQ ID NO: 562998 - DNA, 25 bp, Rattus norvegicus
tagtctagaactcatgattttgggt

SEQ ID NO: 562999 - DNA, 25 bp, Rattus norvegicus
tagtctagaactgatgattttgggt

SEQ ID NO: 563000 - DNA, 25 bp, Rattus norvegicus
tagtctagacgtagctcttggtgtg

SEQ ID NO: 563001 - DNA, 25 bp, Rattus norvegicus
tagtctagacgttgctcttggtgtg

SEQ ID NO: 563002 - DNA, 25 bp, Rattus norvegicus
tagtctagatttatgtcctgctgcc

SEQ ID NO: 563003 - DNA, 25 bp, Rattus norvegicus
tagtctagatttttgtcctgctgcc

SEQ ID NO: 563004 - DNA, 25 bp, Rattus norvegicus
tagtctagccttccctactgtgaat

SEQ ID NO: 563005 - DNA, 25 bp, Rattus norvegicus
tagtctagccttgcctactgtgaat

SEQ ID NO: 563006 - DNA, 25 bp, Rattus norvegicus
tagtctaggcggcaggtaaccaaga

SEQ ID NO: 563007 - DNA, 25 bp, Rattus norvegicus
tagtctaggcgggaggtaaccaaga

SEQ ID NO: 563008 - DNA, 25 bp, Rattus norvegicus
tagtctaggttgacaagttcaccac

SEQ ID NO: 563009 - DNA, 25 bp, Rattus norvegicus
tagtctaggttgtcaagttcaccac

SEQ ID NO: 563010 - DNA, 25 bp, Rattus norvegicus
tagtctatcactacctcaatttagt

SEQ ID NO: 563011 - DNA, 25 bp, Rattus norvegicus
tagtctatcacttcctcaatttagt

SEQ ID NO: 563012 - DNA, 25 bp, Rattus norvegicus
tagtctcaaactatgccaacagagt

SEQ ID NO: 563013 - DNA, 25 bp, Rattus norvegicus
tagtctcaaactttgccaacagagt

SEQ ID NO: 563014 - DNA, 25 bp, Rattus norvegicus
tagtctcaagacagcattacaggaa

SEQ ID NO: 563015 - DNA, 25 bp, Rattus norvegicus
tagtctcaagactgcattacaggaa

SEQ ID NO: 563016 - DNA, 25 bp, Rattus norvegicus
tagtctcacataacctacagctgca

SEQ ID NO: 563017 - DNA, 25 bp, Rattus norvegicus
tagtctcacatatcctacagctgca

SEQ ID NO: 563018 - DNA, 25 bp, Rattus norvegicus
tagtctcacggcatttgtaacgcct

SEQ ID NO: 563019 - DNA, 25 bp, Rattus norvegicus
tagtctcacggcttttgtaacgcct

SEQ ID NO: 563020 - DNA, 25 bp, Rattus norvegicus
tagtctcagaatccatcgaagcctc

SEQ ID NO: 563021 - DNA, 25 bp, Rattus norvegicus
tagtctcagaatgcatcgaagcctc

SEQ ID NO: 563022 - DNA, 25 bp, Rattus norvegicus
tagtctcagcagagctttccagtgt

SEQ ID NO: 563023 - DNA, 25 bp, Rattus norvegicus
tagtctcagcagtgctttccagtgt

SEQ ID NO: 563024 - DNA, 25 bp, Rattus norvegicus
tagtctcataggatcgtcacagtgg

SEQ ID NO: 563025 - DNA, 25 bp, Rattus norvegicus
tagtctcataggttcgtcacagtgg

SEQ ID NO: 563026 - DNA, 25 bp, Rattus norvegicus
tagtctcatgccaatttgctgtggt

SEQ ID NO: 563027 - DNA, 25 bp, Rattus norvegicus
tagtctcatgcctatttgctgtggt

SEQ ID NO: 563028 - DNA, 25 bp, Rattus norvegicus
tagtctcatggtcctgtcaacatgg

SEQ ID NO: 563029 - DNA, 25 bp, Rattus norvegicus
tagtctcatggtgctgtcaacatgg

SEQ ID NO: 563030 - DNA, 25 bp, Rattus norvegicus
tagtctcatttccagatgcttttgt

SEQ ID NO: 563031 - DNA, 25 bp, Rattus norvegicus
tagtctcatttcgagatgcttttgt

SEQ ID NO: 563032 - DNA, 25 bp, Rattus norvegicus
tagtctccacagcaacccagggtgc

SEQ ID NO: 563033 - DNA, 25 bp, Rattus norvegicus
tagtctccacaggaacccagggtgc

SEQ ID NO: 563034 - DNA, 25 bp, Rattus norvegicus
tagtctccagcacagttttcactga

SEQ ID NO: 563035 - DNA, 25 bp, Rattus norvegicus
tagtctccagcagagttttcactga

SEQ ID NO: 563036 - DNA, 25 bp, Rattus norvegicus
tagtctccagctaactctgtgggtt

SEQ ID NO: 563037 - DNA, 25 bp, Rattus norvegicus
tagtctccagcttactctgtgggtt

SEQ ID NO: 563038 - DNA, 25 bp, Rattus norvegicus
tagtctccatgcagcccacaagcag

SEQ ID NO: 563039 - DNA, 25 bp, Rattus norvegicus
tagtctccatgctgcccacaagcag

SEQ ID NO: 563040 - DNA, 25 bp, Rattus norvegicus
tagtctccattgctctcaagtaggg

SEQ ID NO: 563041 - DNA, 25 bp, Rattus norvegicus
tagtctccattggtctcaagtaggg

SEQ ID NO: 563042 - DNA, 25 bp, Rattus norvegicus
tagtctccccggactctttggaaat

SEQ ID NO: 563043 - DNA, 25 bp, Rattus norvegicus
tagtctccccggtctctttggaaat

SEQ ID NO: 563044 - DNA, 25 bp, Rattus norvegicus
tagtctccctgtagagtttcctcca

SEQ ID NO: 563045 - DNA, 25 bp, Rattus norvegicus
tagtctccctgttgagtttcctcca

SEQ ID NO: 563046 - DNA, 25 bp, Rattus norvegicus
tagtctccgaagaatcctgtcccgt

SEQ ID NO: 563047 - DNA, 25 bp, Rattus norvegicus
tagtctccgaagtatcctgtcccgt

SEQ ID NO: 563048 - DNA, 25 bp, Rattus norvegicus
tagtctcctgcaagcaagaggcaaa

SEQ ID NO: 563049 - DNA, 25 bp, Rattus norvegicus
tagtctcctgcatgcaagaggcaaa

SEQ ID NO: 563050 - DNA, 25 bp, Rattus norvegicus
tagtctcctgggatagctgatgcct

SEQ ID NO: 563051 - DNA, 25 bp, Rattus norvegicus
tagtctcctgggttagctgatgcct

SEQ ID NO: 563052 - DNA, 25 bp, Rattus norvegicus
tagtctcctgttctgttgtctgtta

SEQ ID NO: 563053 - DNA, 25 bp, Rattus norvegicus
tagtctcctgttgtgttgtctgtta

SEQ ID NO: 563054 - DNA, 25 bp, Rattus norvegicus
tagtctccttagagaccagtgcttc

SEQ ID NO: 563055 - DNA, 25 bp, Rattus norvegicus
tagtctccttagtgaccagtgcttc

SEQ ID NO: 563056 - DNA, 25 bp, Rattus norvegicus
tagtctccttcactgccaatttaaa

SEQ ID NO: 563057 - DNA, 25 bp, Rattus norvegicus
tagtctccttcagtgccaatttaaa

SEQ ID NO: 563058 - DNA, 25 bp, Rattus norvegicus
tagtctcgggttacctgaggacttt

SEQ ID NO: 563059 - DNA, 25 bp, Rattus norvegicus
tagtctcgggtttcctgaggacttt

SEQ ID NO: 563060 - DNA, 25 bp, Rattus norvegicus
tagtctcgtctgcaggctctctcag

SEQ ID NO: 563061 - DNA, 25 bp, Rattus norvegicus
tagtctcgtctggaggctctctcag

SEQ ID NO: 563062 - DNA, 25 bp, Rattus norvegicus
tagtctcgttgtcactagctaggcc

SEQ ID NO: 563063 - DNA, 25 bp, Rattus norvegicus
tagtctcgttgtgactagctaggcc

SEQ ID NO: 563064 - DNA, 25 bp, Rattus norvegicus
tagtctctagtgaagcaacagcagt

SEQ ID NO: 563065 - DNA, 25 bp, Rattus norvegicus
tagtctctagtgtagcaacagcagt

SEQ ID NO: 563066 - DNA, 25 bp, Rattus norvegicus
tagtctctcctccttgatgcatatg

SEQ ID NO: 563067 - DNA, 25 bp, Rattus norvegicus
tagtctctcctcgttgatgcatatg

SEQ ID NO: 563068 - DNA, 25 bp, Rattus norvegicus
tagtctctctgcctagcactatatt

SEQ ID NO: 563069 - DNA, 25 bp, Rattus norvegicus
tagtctctctgcgtagcactatatt

SEQ ID NO: 563070 - DNA, 25 bp, Rattus norvegicus
tagtctctgctgctgcttcagtact

SEQ ID NO: 563071 - DNA, 25 bp, Rattus norvegicus
tagtctctgctggtgcttcagtact

SEQ ID NO: 563072 - DNA, 25 bp, Rattus norvegicus
tagtctctgtaaccaaataagcccc

SEQ ID NO: 563073 - DNA, 25 bp, Rattus norvegicus
tagtctctgtaagcaaataagcccc

SEQ ID NO: 563074 - DNA, 25 bp, Rattus norvegicus
tagtctctgtcaagccatgtaacaa

SEQ ID NO: 563075 - DNA, 25 bp, Rattus norvegicus
tagtctctgtcaccgagccactgaa

SEQ ID NO: 563076 - DNA, 25 bp, Rattus norvegicus
tagtctctgtcagcgagccactgaa

SEQ ID NO: 563077 - DNA, 25 bp, Rattus norvegicus
tagtctctgtcatgccatgtaacaa

SEQ ID NO: 563078 - DNA, 25 bp, Rattus norvegicus
tagtctctgtggatgacgtcagtct

SEQ ID NO: 563079 - DNA, 25 bp, Rattus norvegicus
tagtctctgtggttgacgtcagtct

SEQ ID NO: 563080 - DNA, 25 bp, Rattus norvegicus
tagtctgaactgacccaaggtggcg

SEQ ID NO: 563081 - DNA, 25 bp, Rattus norvegicus
tagtctgaactgtcccaaggtggcg

SEQ ID NO: 563082 - DNA, 25 bp, Rattus norvegicus
tagtctgaagcccatgccactcgat

SEQ ID NO: 563083 - DNA, 25 bp, Rattus norvegicus
tagtctgaagccgatgccactcgat

SEQ ID NO: 563084 - DNA, 25 bp, Rattus norvegicus
tagtctgacttcacctgaactagca

SEQ ID NO: 563085 - DNA, 25 bp, Rattus norvegicus
tagtctgacttctcctgaactagca

SEQ ID NO: 563086 - DNA, 25 bp, Rattus norvegicus
tagtctgattgccacattagctcat

SEQ ID NO: 563087 - DNA, 25 bp, Rattus norvegicus
tagtctgattgcgacattagctcat

SEQ ID NO: 563088 - DNA, 25 bp, Rattus norvegicus
tagtctgcaaataccaaagatggct

SEQ ID NO: 563089 - DNA, 25 bp, Rattus norvegicus
tagtctgcaaattccaaagatggct

SEQ ID NO: 563090 - DNA, 25 bp, Rattus norvegicus
tagtctgcaagtatatggcctgctg

SEQ ID NO: 563091 - DNA, 25 bp, Rattus norvegicus
tagtctgcaagtttatggcctgctg

SEQ ID NO: 563092 - DNA, 25 bp, Rattus norvegicus
tagtctgcagataccccagtgggca

SEQ ID NO: 563093 - DNA, 25 bp, Rattus norvegicus
tagtctgcagattccccagtgggca

SEQ ID NO: 563094 - DNA, 25 bp, Rattus norvegicus
tagtctgcagcaatccgtgagtgaa

SEQ ID NO: 563095 - DNA, 25 bp, Rattus norvegicus
tagtctgcagcattccgtgagtgaa

SEQ ID NO: 563096 - DNA, 25 bp, Rattus norvegicus
tagtctgcccagatactgtgtttgg

SEQ ID NO: 563097 - DNA, 25 bp, Rattus norvegicus
tagtctgcccagttactgtgtttgg

SEQ ID NO: 563098 - DNA, 25 bp, Rattus norvegicus
tagtctgcccgaagcgatgctggaa

SEQ ID NO: 563099 - DNA, 25 bp, Rattus norvegicus
tagtctgcccgatgcgatgctggaa

SEQ ID NO: 563100 - DNA, 25 bp, Rattus norvegicus
tagtctgctcttccaattactcaaa

SEQ ID NO: 563101 - DNA, 25 bp, Rattus norvegicus
tagtctgctcttgcaattactcaaa

SEQ ID NO: 563102 - DNA, 25 bp, Rattus norvegicus
tagtctgctggtacttatcactttc

SEQ ID NO: 563103 - DNA, 25 bp, Rattus norvegicus
tagtctgctggttcttatcactttc

SEQ ID NO: 563104 - DNA, 25 bp, Rattus norvegicus
tagtctggatgcattgacgcggcgc

SEQ ID NO: 563105 - DNA, 25 bp, Rattus norvegicus
tagtctggatgctttgacgcggcgc

SEQ ID NO: 563106 - DNA, 25 bp, Rattus norvegicus
tagtctggcaccatcacttttctaa

SEQ ID NO: 563107 - DNA, 25 bp, Rattus norvegicus
tagtctggcaccttcacttttctaa

SEQ ID NO: 563108 - DNA, 25 bp, Rattus norvegicus
tagtctggccacctggtcccgcgag

SEQ ID NO: 563109 - DNA, 25 bp, Rattus norvegicus
tagtctggccacgtggtcccgcgag

SEQ ID NO: 563110 - DNA, 25 bp, Rattus norvegicus
tagtctggccatcgatcccaagtat

SEQ ID NO: 563111 - DNA, 25 bp, Rattus norvegicus
tagtctggccatggatcccaagtat

SEQ ID NO: 563112 - DNA, 25 bp, Rattus norvegicus
tagtctggccctctaggctgatgac

SEQ ID NO: 563113 - DNA, 25 bp, Rattus norvegicus
tagtctggccctgtaggctgatgac

SEQ ID NO: 563114 - DNA, 25 bp, Rattus norvegicus
tagtctggcctcatcctagttgata

SEQ ID NO: 563115 - DNA, 25 bp, Rattus norvegicus
tagtctggcctcttcctagttgata

SEQ ID NO: 563116 - DNA, 25 bp, Rattus norvegicus
tagtctgggaacaggtccggtttag

SEQ ID NO: 563117 - DNA, 25 bp, Rattus norvegicus
tagtctgggaactggtccggtttag

SEQ ID NO: 563118 - DNA, 25 bp, Rattus norvegicus
tagtctgggctcattgtctgatcgt

SEQ ID NO: 563119 - DNA, 25 bp, Rattus norvegicus
tagtctgggctctttgtctgatcgt

SEQ ID NO: 563120 - DNA, 25 bp, Rattus norvegicus
tagtctggtgatcggacttgccctt

SEQ ID NO: 563121 - DNA, 25 bp, Rattus norvegicus
tagtctggtgatgggacttgccctt

SEQ ID NO: 563122 - DNA, 25 bp, Rattus norvegicus
tagtctgtacagcaccttctagctg

SEQ ID NO: 563123 - DNA, 25 bp, Rattus norvegicus
tagtctgtacaggaccttctagctg

SEQ ID NO: 563124 - DNA, 25 bp, Rattus norvegicus
tagtctgtacatagacctcctgcta

SEQ ID NO: 563125 - DNA, 25 bp, Rattus norvegicus
tagtctgtacattgacctcctgcta

SEQ ID NO: 563126 - DNA, 25 bp, Rattus norvegicus
tagtctgtcaccataagcatgcctt

SEQ ID NO: 563127 - DNA, 25 bp, Rattus norvegicus
tagtctgtcaccttaagcatgcctt

SEQ ID NO: 563128 - DNA, 25 bp, Rattus norvegicus
tagtctgtcactattgatcacatta

SEQ ID NO: 563129 - DNA, 25 bp, Rattus norvegicus
tagtctgtcacttttgatcacatta

SEQ ID NO: 563130 - DNA, 25 bp, Rattus norvegicus
tagtctgtccaaatttgtttgaatt

SEQ ID NO: 563131 - DNA, 25 bp, Rattus norvegicus
tagtctgtccaattttgtttgaatt

SEQ ID NO: 563132 - DNA, 25 bp, Rattus norvegicus
tagtctgtctcaagggtacttaagc

SEQ ID NO: 563133 - DNA, 25 bp, Rattus norvegicus
tagtctgtctcatgggtacttaagc

SEQ ID NO: 563134 - DNA, 25 bp, Rattus norvegicus
tagtctgtgagactcttatggtcaa

SEQ ID NO: 563135 - DNA, 25 bp, Rattus norvegicus
tagtctgtgagagtcttatggtcaa

SEQ ID NO: 563136 - DNA, 25 bp, Rattus norvegicus
tagtctgtgagtatcggtctgacct

SEQ ID NO: 563137 - DNA, 25 bp, Rattus norvegicus
tagtctgtgagtttcggtctgacct

SEQ ID NO: 563138 - DNA, 25 bp, Rattus norvegicus
tagtctgtgatccttgtgactgccg

SEQ ID NO: 563139 - DNA, 25 bp, Rattus norvegicus
tagtctgtgatcgttgtgactgccg

SEQ ID NO: 563140 - DNA, 25 bp, Rattus norvegicus
tagtctgtgtagacttctgtgctcc

SEQ ID NO: 563141 - DNA, 25 bp, Rattus norvegicus
tagtctgtgtagtcttctgtgctcc

SEQ ID NO: 563142 - DNA, 25 bp, Rattus norvegicus
tagtctgtgtttaaccttggtttat

SEQ ID NO: 563143 - DNA, 25 bp, Rattus norvegicus
tagtctgtgttttaccttggtttat

SEQ ID NO: 563144 - DNA, 25 bp, Rattus norvegicus
tagtctgttgaaaagtgtttaccat

SEQ ID NO: 563145 - DNA, 25 bp, Rattus norvegicus
tagtctgttgaatagtgtttaccat

SEQ ID NO: 563146 - DNA, 25 bp, Rattus norvegicus
tagtctgttgggatttcctcacggg

SEQ ID NO: 563147 - DNA, 25 bp, Rattus norvegicus
tagtctgttgggttttcctcacggg

SEQ ID NO: 563148 - DNA, 25 bp, Rattus norvegicus
tagtcttaacaaagcctgactcacc

SEQ ID NO: 563149 - DNA, 25 bp, Rattus norvegicus
tagtcttaacaatgcctgactcacc

SEQ ID NO: 563150 - DNA, 25 bp, Rattus norvegicus
tagtcttaccgcagccaaggttcaa

SEQ ID NO: 563151 - DNA, 25 bp, Rattus norvegicus
tagtcttaccgctgccaaggttcaa

SEQ ID NO: 563152 - DNA, 25 bp, Rattus norvegicus
tagtcttacgttattttatcctgct

SEQ ID NO: 563153 - DNA, 25 bp, Rattus norvegicus
tagtcttacgtttttttatcctgct

SEQ ID NO: 563154 - DNA, 25 bp, Rattus norvegicus
tagtcttactttcagtgcctcacag

SEQ ID NO: 563155 - DNA, 25 bp, Rattus norvegicus
tagtcttactttgagtgcctcacag

SEQ ID NO: 563156 - DNA, 25 bp, Rattus norvegicus
tagtcttatcgacgcagagttcctt

SEQ ID NO: 563157 - DNA, 25 bp, Rattus norvegicus
tagtcttatcgaggcagagttcctt

SEQ ID NO: 563158 - DNA, 25 bp, Rattus norvegicus
tagtcttatgttacctcacagcctg

SEQ ID NO: 563159 - DNA, 25 bp, Rattus norvegicus
tagtcttatgtttcctcacagcctg

SEQ ID NO: 563160 - DNA, 25 bp, Rattus norvegicus
tagtcttcacgtactgcaagcagca

SEQ ID NO: 563161 - DNA, 25 bp, Rattus norvegicus
tagtcttcacgttctgcaagcagca

SEQ ID NO: 563162 - DNA, 25 bp, Rattus norvegicus
tagtcttcagataccttccagctca

SEQ ID NO: 563163 - DNA, 25 bp, Rattus norvegicus
tagtcttcagattccttccagctca

SEQ ID NO: 563164 - DNA, 25 bp, Rattus norvegicus
tagtcttctcctcttaagatctcag

SEQ ID NO: 563165 - DNA, 25 bp, Rattus norvegicus
tagtcttctcctgttaagatctcag

SEQ ID NO: 563166 - DNA, 25 bp, Rattus norvegicus
tagtcttctgcaagtgagtcttcaa

SEQ ID NO: 563167 - DNA, 25 bp, Rattus norvegicus
tagtcttctgcatgtgagtcttcaa

SEQ ID NO: 563168 - DNA, 25 bp, Rattus norvegicus
tagtcttgaccccagtcttatttga

SEQ ID NO: 563169 - DNA, 25 bp, Rattus norvegicus
tagtcttgacccgagtcttatttga

SEQ ID NO: 563170 - DNA, 25 bp, Rattus norvegicus
tagtcttggcacacgtagcttgtca

SEQ ID NO: 563171 - DNA, 25 bp, Rattus norvegicus
tagtcttggcactcgtagcttgtca

SEQ ID NO: 563172 - DNA, 25 bp, Rattus norvegicus
tagtcttggcgaatacttgtggtaa

SEQ ID NO: 563173 - DNA, 25 bp, Rattus norvegicus
tagtcttggcgattacttgtggtaa

SEQ ID NO: 563174 - DNA, 25 bp, Rattus norvegicus
tagtcttgtcttagctctggacgtg

SEQ ID NO: 563175 - DNA, 25 bp, Rattus norvegicus
tagtcttgtctttgctctggacgtg

SEQ ID NO: 563176 - DNA, 25 bp, Rattus norvegicus
tagtcttgtgttcttcacttcccat

SEQ ID NO: 563177 - DNA, 25 bp, Rattus norvegicus
tagtcttgtgttgttcacttcccat

SEQ ID NO: 563178 - DNA, 25 bp, Rattus norvegicus
tagtctttagggacctcaagaacat

SEQ ID NO: 563179 - DNA, 25 bp, Rattus norvegicus
tagtctttagggtcctcaagaacat

SEQ ID NO: 563180 - DNA, 25 bp, Rattus norvegicus
tagtctttatttacaagtgctctga

SEQ ID NO: 563181 - DNA, 25 bp, Rattus norvegicus
tagtctttattttcaagtgctctga

SEQ ID NO: 563182 - DNA, 25 bp, Rattus norvegicus
tagtctttccctctggtatcaggtc

SEQ ID NO: 563183 - DNA, 25 bp, Rattus norvegicus
tagtctttccctgtggtatcaggtc

SEQ ID NO: 563184 - DNA, 25 bp, Rattus norvegicus
tagtctttctatactgtgtcagata

SEQ ID NO: 563185 - DNA, 25 bp, Rattus norvegicus
tagtctttctattctgtgtcagata

SEQ ID NO: 563186 - DNA, 25 bp, Rattus norvegicus
tagtctttctctcgttttctctaac

SEQ ID NO: 563187 - DNA, 25 bp, Rattus norvegicus
tagtctttctctggttttctctaac

SEQ ID NO: 563188 - DNA, 25 bp, Rattus norvegicus
tagtctttctgtattggtgtcctga

SEQ ID NO: 563189 - DNA, 25 bp, Rattus norvegicus
tagtctttctgttttggtgtcctga

SEQ ID NO: 563190 - DNA, 25 bp, Rattus norvegicus
tagtctttgaatcaccagcttcagt

SEQ ID NO: 563191 - DNA, 25 bp, Rattus norvegicus
tagtctttgaatgaccagcttcagt

SEQ ID NO: 563192 - DNA, 25 bp, Rattus norvegicus
tagtctttgacactaagcccacaga

SEQ ID NO: 563193 - DNA, 25 bp, Rattus norvegicus
tagtctttgacagtaagcccacaga

SEQ ID NO: 563194 - DNA, 25 bp, Rattus norvegicus
tagtctttgcttatcctaatgcatg

SEQ ID NO: 563195 - DNA, 25 bp, Rattus norvegicus
tagtctttgcttttcctaatgcatg

SEQ ID NO: 563196 - DNA, 25 bp, Rattus norvegicus
tagtctttggaacacactcaggatt

SEQ ID NO: 563197 - DNA, 25 bp, Rattus norvegicus
tagtctttggaagacactcaggatt

SEQ ID NO: 563198 - DNA, 25 bp, Rattus norvegicus
tagtctttggctacctgggcaatgc

SEQ ID NO: 563199 - DNA, 25 bp, Rattus norvegicus
tagtctttggcttcctgggcaatgc

SEQ ID NO: 563200 - DNA, 25 bp, Rattus norvegicus
tagtctttgtttaaccttaggtctg

SEQ ID NO: 563201 - DNA, 25 bp, Rattus norvegicus
tagtctttgttttaccttaggtctg

SEQ ID NO: 563202 - DNA, 25 bp, Rattus norvegicus
tagtcttttaagaagccttgtcctt

SEQ ID NO: 563203 - DNA, 25 bp, Rattus norvegicus
tagtcttttaagtagccttgtcctt

SEQ ID NO: 563204 - DNA, 25 bp, Rattus norvegicus
tagtcttttgccagtctggttttat

SEQ ID NO: 563205 - DNA, 25 bp, Rattus norvegicus
tagtcttttgcctgtctggttttat

SEQ ID NO: 563206 - DNA, 25 bp, Rattus norvegicus
tagtcttttgcgctgttacatctgc

SEQ ID NO: 563207 - DNA, 25 bp, Rattus norvegicus
tagtcttttgcggtgttacatctgc

SEQ ID NO: 563208 - DNA, 25 bp, Rattus norvegicus
tagtgaaacactacgggagcagctc

SEQ ID NO: 563209 - DNA, 25 bp, Rattus norvegicus
tagtgaaacacttcgggagcagctc

SEQ ID NO: 563210 - DNA, 25 bp, Rattus norvegicus
tagtgaaacaggcgcaatggtgcgc

SEQ ID NO: 563211 - DNA, 25 bp, Rattus norvegicus
tagtgaaacaggggcaatggtgcgc

SEQ ID NO: 563212 - DNA, 25 bp, Rattus norvegicus
tagtgaaactagaaaggctcgcttt

SEQ ID NO: 563213 - DNA, 25 bp, Rattus norvegicus
tagtgaaactagtaaggctcgcttt

SEQ ID NO: 563214 - DNA, 25 bp, Rattus norvegicus
tagtgaaacttcattgatggcaatt

SEQ ID NO: 563215 - DNA, 25 bp, Rattus norvegicus
tagtgaaacttctttgatggcaatt

SEQ ID NO: 563216 - DNA, 25 bp, Rattus norvegicus
tagtgaaagcccacaggatgcagag

SEQ ID NO: 563217 - DNA, 25 bp, Rattus norvegicus
tagtgaaagccctcaggatgcagag

SEQ ID NO: 563218 - DNA, 25 bp, Rattus norvegicus
tagtgaaatctacagagcgcagcgg

SEQ ID NO: 563219 - DNA, 25 bp, Rattus norvegicus
tagtgaaatctagagagcgcagcgg

SEQ ID NO: 563220 - DNA, 25 bp, Rattus norvegicus
tagtgaaccaacagccttaaccttt

SEQ ID NO: 563221 - DNA, 25 bp, Rattus norvegicus
tagtgaaccaactgccttaaccttt

SEQ ID NO: 563222 - DNA, 25 bp, Rattus norvegicus
tagtgaaccgaacttagctgcccgc

SEQ ID NO: 563223 - DNA, 25 bp, Rattus norvegicus
tagtgaaccgaagttagctgcccgc

SEQ ID NO: 563224 - DNA, 25 bp, Rattus norvegicus
tagtgaacggaaacgcaaggaacct

SEQ ID NO: 563225 - DNA, 25 bp, Rattus norvegicus
tagtgaacggaatcgcaaggaacct

SEQ ID NO: 563226 - DNA, 25 bp, Rattus norvegicus
tagtgaactctaccctctgtcttgg

SEQ ID NO: 563227 - DNA, 25 bp, Rattus norvegicus
tagtgaactctagcctctgtcttgg

SEQ ID NO: 563228 - DNA, 25 bp, Rattus norvegicus
tagtgaacttttactacccacttct

SEQ ID NO: 563229 - DNA, 25 bp, Rattus norvegicus
tagtgaactttttctacccacttct

SEQ ID NO: 563230 - DNA, 25 bp, Rattus norvegicus
tagtgaagcagtacctctctgagtc

SEQ ID NO: 563231 - DNA, 25 bp, Rattus norvegicus
tagtgaagcagttcctctctgagtc

SEQ ID NO: 563232 - DNA, 25 bp, Rattus norvegicus
tagtgaagctttacccttccactgg

SEQ ID NO: 563233 - DNA, 25 bp, Rattus norvegicus
tagtgaagcttttcccttccactgg

SEQ ID NO: 563234 - DNA, 25 bp, Rattus norvegicus
tagtgaaggccaaccggttttaaag

SEQ ID NO: 563235 - DNA, 25 bp, Rattus norvegicus
tagtgaaggccatccggttttaaag

SEQ ID NO: 563236 - DNA, 25 bp, Rattus norvegicus
tagtgaatcatgacagcataagata

SEQ ID NO: 563237 - DNA, 25 bp, Rattus norvegicus
tagtgaatcatgtcagcataagata

SEQ ID NO: 563238 - DNA, 25 bp, Rattus norvegicus
tagtgaatcccaagtccctatcctg

SEQ ID NO: 563239 - DNA, 25 bp, Rattus norvegicus
tagtgaatcccatgtccctatcctg

SEQ ID NO: 563240 - DNA, 25 bp, Rattus norvegicus
tagtgaatcgcactgtgcctcagct

SEQ ID NO: 563241 - DNA, 25 bp, Rattus norvegicus
tagtgaatcgcagtgtgcctcagct

SEQ ID NO: 563242 - DNA, 25 bp, Rattus norvegicus
tagtgaatgccaagccagcctgtgt

SEQ ID NO: 563243 - DNA, 25 bp, Rattus norvegicus
tagtgaatgccatgccagcctgtgt

SEQ ID NO: 563244 - DNA, 25 bp, Rattus norvegicus
tagtgaatggctacccaacacagga

SEQ ID NO: 563245 - DNA, 25 bp, Rattus norvegicus
tagtgaatggcttcccaacacagga

SEQ ID NO: 563246 - DNA, 25 bp, Rattus norvegicus
tagtgaattctaagccagccagggc

SEQ ID NO: 563247 - DNA, 25 bp, Rattus norvegicus
tagtgaattctatgccagccagggc

SEQ ID NO: 563248 - DNA, 25 bp, Rattus norvegicus
tagtgacacactcctctggcaattt

SEQ ID NO: 563249 - DNA, 25 bp, Rattus norvegicus
tagtgacacactgctctggcaattt

SEQ ID NO: 563250 - DNA, 25 bp, Rattus norvegicus
tagtgacacctcatttgtctggtcc

SEQ ID NO: 563251 - DNA, 25 bp, Rattus norvegicus
tagtgacacctcttttgtctggtcc

SEQ ID NO: 563252 - DNA, 25 bp, Rattus norvegicus
tagtgacacttcagccctttgggtt

SEQ ID NO: 563253 - DNA, 25 bp, Rattus norvegicus
tagtgacacttctgccctttgggtt

SEQ ID NO: 563254 - DNA, 25 bp, Rattus norvegicus
tagtgacagagtcctccataccagg

SEQ ID NO: 563255 - DNA, 25 bp, Rattus norvegicus
tagtgacagagtctaggccctttgt

SEQ ID NO: 563256 - DNA, 25 bp, Rattus norvegicus
tagtgacagagtgctccataccagg

SEQ ID NO: 563257 - DNA, 25 bp, Rattus norvegicus
tagtgacagagtgtaggccctttgt

SEQ ID NO: 563258 - DNA, 25 bp, Rattus norvegicus
tagtgaccacataccagtttccttt

SEQ ID NO: 563259 - DNA, 25 bp, Rattus norvegicus
tagtgaccacattccagtttccttt

SEQ ID NO: 563260 - DNA, 25 bp, Rattus norvegicus
tagtgaccagggaaccacacataca

SEQ ID NO: 563261 - DNA, 25 bp, Rattus norvegicus
tagtgaccagggaccacttgcgtgg

SEQ ID NO: 563262 - DNA, 25 bp, Rattus norvegicus
tagtgaccagggtaccacacataca

SEQ ID NO: 563263 - DNA, 25 bp, Rattus norvegicus
tagtgaccagggtccacttgcgtgg

SEQ ID NO: 563264 - DNA, 25 bp, Rattus norvegicus
tagtgacccaggagataatgaggta

SEQ ID NO: 563265 - DNA, 25 bp, Rattus norvegicus
tagtgacccaggtgataatgaggta

SEQ ID NO: 563266 - DNA, 25 bp, Rattus norvegicus
tagtgaccctcgcacgggagtgcca

SEQ ID NO: 563267 - DNA, 25 bp, Rattus norvegicus
tagtgaccctcggacgggagtgcca

SEQ ID NO: 563268 - DNA, 25 bp, Rattus norvegicus
tagtgacctcagaacagagctacag

SEQ ID NO: 563269 - DNA, 25 bp, Rattus norvegicus
tagtgacctcagtacagagctacag

SEQ ID NO: 563270 - DNA, 25 bp, Rattus norvegicus
tagtgacgcagacttccgtctactt

SEQ ID NO: 563271 - DNA, 25 bp, Rattus norvegicus
tagtgacgcagagttccgtctactt

SEQ ID NO: 563272 - DNA, 25 bp, Rattus norvegicus
tagtgacgcccgcatgacatcagct

SEQ ID NO: 563273 - DNA, 25 bp, Rattus norvegicus
tagtgacgcccggatgacatcagct

SEQ ID NO: 563274 - DNA, 25 bp, Rattus norvegicus
tagtgacgtaaaactctgctgctga

SEQ ID NO: 563275 - DNA, 25 bp, Rattus norvegicus
tagtgacgtaaatctctgctgctga

SEQ ID NO: 563276 - DNA, 25 bp, Rattus norvegicus
tagtgacgtatcaccttcttggacc

SEQ ID NO: 563277 - DNA, 25 bp, Rattus norvegicus
tagtgacgtatctccttcttggacc

SEQ ID NO: 563278 - DNA, 25 bp, Rattus norvegicus
tagtgacgtggccaaagccctgcac

SEQ ID NO: 563279 - DNA, 25 bp, Rattus norvegicus
tagtgacgtggcgaaagccctgcac

SEQ ID NO: 563280 - DNA, 25 bp, Rattus norvegicus
tagtgactcaagagggcttcggaaa

SEQ ID NO: 563281 - DNA, 25 bp, Rattus norvegicus
tagtgactcaagtgggcttcggaaa

SEQ ID NO: 563282 - DNA, 25 bp, Rattus norvegicus
tagtgactcaccagctgccttttag

SEQ ID NO: 563283 - DNA, 25 bp, Rattus norvegicus
tagtgactcacctgctgccttttag

SEQ ID NO: 563284 - DNA, 25 bp, Rattus norvegicus
tagtgactcatgcagtcagcctccc

SEQ ID NO: 563285 - DNA, 25 bp, Rattus norvegicus
tagtgactcatggagtcagcctccc

SEQ ID NO: 563286 - DNA, 25 bp, Rattus norvegicus
tagtgactccaacttctacttctgg

SEQ ID NO: 563287 - DNA, 25 bp, Rattus norvegicus
tagtgactccaagttctacttctgg

SEQ ID NO: 563288 - DNA, 25 bp, Rattus norvegicus
tagtgactccgcagagtggctctga

SEQ ID NO: 563289 - DNA, 25 bp, Rattus norvegicus
tagtgactccgctgagtggctctga

SEQ ID NO: 563290 - DNA, 25 bp, Rattus norvegicus
tagtgactcgaacaaccccaacggt

SEQ ID NO: 563291 - DNA, 25 bp, Rattus norvegicus
tagtgactcgaagaaccccaacggt

SEQ ID NO: 563292 - DNA, 25 bp, Rattus norvegicus
tagtgactgaagaggctggtgcccc

SEQ ID NO: 563293 - DNA, 25 bp, Rattus norvegicus
tagtgactgaagtggctggtgcccc

SEQ ID NO: 563294 - DNA, 25 bp, Rattus norvegicus
tagtgactgcctatcctacttttgc

SEQ ID NO: 563295 - DNA, 25 bp, Rattus norvegicus
tagtgactgcctttcctacttttgc

SEQ ID NO: 563296 - DNA, 25 bp, Rattus norvegicus
tagtgactgtttaaggcgggtactg

SEQ ID NO: 563297 - DNA, 25 bp, Rattus norvegicus
tagtgactgttttaggcgggtactg

SEQ ID NO: 563298 - DNA, 25 bp, Rattus norvegicus
tagtgacttataatagctgctggaa

SEQ ID NO: 563299 - DNA, 25 bp, Rattus norvegicus
tagtgacttatattagctgctggaa

SEQ ID NO: 563300 - DNA, 25 bp, Rattus norvegicus
tagtgacttccacaaacccggcaag

SEQ ID NO: 563301 - DNA, 25 bp, Rattus norvegicus
tagtgacttccagaaacccggcaag

SEQ ID NO: 563302 - DNA, 25 bp, Rattus norvegicus
tagtgactttcaagacaggctgagc

SEQ ID NO: 563303 - DNA, 25 bp, Rattus norvegicus
tagtgactttcatgacaggctgagc

SEQ ID NO: 563304 - DNA, 25 bp, Rattus norvegicus
tagtgacttttaatcccacaactgt

SEQ ID NO: 563305 - DNA, 25 bp, Rattus norvegicus
tagtgacttttattcccacaactgt

SEQ ID NO: 563306 - DNA, 25 bp, Rattus norvegicus
tagtgactttttaatacggttcttg

SEQ ID NO: 563307 - DNA, 25 bp, Rattus norvegicus
tagtgacttttttatacggttcttg

SEQ ID NO: 563308 - DNA, 25 bp, Rattus norvegicus
tagtgagaccctaatcccttaacat

SEQ ID NO: 563309 - DNA, 25 bp, Rattus norvegicus
tagtgagacccttatcccttaacat

SEQ ID NO: 563310 - DNA, 25 bp, Rattus norvegicus
tagtgagacctgagtggcagccacc

SEQ ID NO: 563311 - DNA, 25 bp, Rattus norvegicus
tagtgagacctgtgtggcagccacc

SEQ ID NO: 563312 - DNA, 25 bp, Rattus norvegicus
tagtgagaccttctcccaagataaa

SEQ ID NO: 563313 - DNA, 25 bp, Rattus norvegicus
tagtgagaccttgtcccaagataaa

SEQ ID NO: 563314 - DNA, 25 bp, Rattus norvegicus
tagtgagagacaagccatatggccc

SEQ ID NO: 563315 - DNA, 25 bp, Rattus norvegicus
tagtgagagacatgccatatggccc

SEQ ID NO: 563316 - DNA, 25 bp, Rattus norvegicus
tagtgagagccacttcacacttctt

SEQ ID NO: 563317 - DNA, 25 bp, Rattus norvegicus
tagtgagagccagttcacacttctt

SEQ ID NO: 563318 - DNA, 25 bp, Rattus norvegicus
tagtgagatgctcttgccccaaagt

SEQ ID NO: 563319 - DNA, 25 bp, Rattus norvegicus
tagtgagatgctgttgccccaaagt

SEQ ID NO: 563320 - DNA, 25 bp, Rattus norvegicus
tagtgagcaagcctcagcagccaac

SEQ ID NO: 563321 - DNA, 25 bp, Rattus norvegicus
tagtgagcaagcgtcagcagccaac

SEQ ID NO: 563322 - DNA, 25 bp, Rattus norvegicus
tagtgagcacctagaatgtccttgt

SEQ ID NO: 563323 - DNA, 25 bp, Rattus norvegicus
tagtgagcaccttgaatgtccttgt

SEQ ID NO: 563324 - DNA, 25 bp, Rattus norvegicus
tagtgagcacggcttacccttgcac

SEQ ID NO: 563325 - DNA, 25 bp, Rattus norvegicus
tagtgagcacgggttacccttgcac

SEQ ID NO: 563326 - DNA, 25 bp, Rattus norvegicus
tagtgagcacgtctgtaattccttc

SEQ ID NO: 563327 - DNA, 25 bp, Rattus norvegicus
tagtgagcacgtgtgtaattccttc

SEQ ID NO: 563328 - DNA, 25 bp, Rattus norvegicus
tagtgagcatttcacctgtcttcag

SEQ ID NO: 563329 - DNA, 25 bp, Rattus norvegicus
tagtgagcatttgacctgtcttcag

SEQ ID NO: 563330 - DNA, 25 bp, Rattus norvegicus
tagtgagccggcagaagttttttct

SEQ ID NO: 563331 - DNA, 25 bp, Rattus norvegicus
tagtgagccggctgaagttttttct

SEQ ID NO: 563332 - DNA, 25 bp, Rattus norvegicus
tagtgagcgaagcacccggcaccaa

SEQ ID NO: 563333 - DNA, 25 bp, Rattus norvegicus
tagtgagcgaaggacccggcaccaa

SEQ ID NO: 563334 - DNA, 25 bp, Rattus norvegicus
tagtgaggtgaacccctactttctt

SEQ ID NO: 563335 - DNA, 25 bp, Rattus norvegicus
tagtgaggtgaagccctactttctt

SEQ ID NO: 563336 - DNA, 25 bp, Rattus norvegicus
tagtgagtcacaccagcatagtaat

SEQ ID NO: 563337 - DNA, 25 bp, Rattus norvegicus
tagtgagtcacagcagcatagtaat

SEQ ID NO: 563338 - DNA, 25 bp, Rattus norvegicus
tagtgagtcatcatccagtgggagt

SEQ ID NO: 563339 - DNA, 25 bp, Rattus norvegicus
tagtgagtcatcttccagtgggagt

SEQ ID NO: 563340 - DNA, 25 bp, Rattus norvegicus
tagtgagtcatgacttcccttcaga

SEQ ID NO: 563341 - DNA, 25 bp, Rattus norvegicus
tagtgagtcatgtcttcccttcaga

SEQ ID NO: 563342 - DNA, 25 bp, Rattus norvegicus
tagtgagtgggtccccttggttatc

SEQ ID NO: 563343 - DNA, 25 bp, Rattus norvegicus
tagtgagtgggtgcccttggttatc

SEQ ID NO: 563344 - DNA, 25 bp, Rattus norvegicus
tagtgagtgtggactgctgtaaaac

SEQ ID NO: 563345 - DNA, 25 bp, Rattus norvegicus
tagtgagtgtggtctgctgtaaaac

SEQ ID NO: 563346 - DNA, 25 bp, Rattus norvegicus
tagtgagttagacctgcctccgagt

SEQ ID NO: 563347 - DNA, 25 bp, Rattus norvegicus
tagtgagttagagctgcctccgagt

SEQ ID NO: 563348 - DNA, 25 bp, Rattus norvegicus
tagtgagttcagaccacaccaacca

SEQ ID NO: 563349 - DNA, 25 bp, Rattus norvegicus
tagtgagttcagtccacaccaacca

SEQ ID NO: 563350 - DNA, 25 bp, Rattus norvegicus
tagtgagttcatcgccaatcctgag

SEQ ID NO: 563351 - DNA, 25 bp, Rattus norvegicus
tagtgagttcatggccaatcctgag

SEQ ID NO: 563352 - DNA, 25 bp, Rattus norvegicus
tagtgagttctccatgccagtttaa

SEQ ID NO: 563353 - DNA, 25 bp, Rattus norvegicus
tagtgagttctcgatgccagtttaa

SEQ ID NO: 563354 - DNA, 25 bp, Rattus norvegicus
tagtgagtttttcccgtgttcaggc

SEQ ID NO: 563355 - DNA, 25 bp, Rattus norvegicus
tagtgagtttttgccgtgttcaggc

SEQ ID NO: 563356 - DNA, 25 bp, Rattus norvegicus
tagtgatcctgaactcatgagccca

SEQ ID NO: 563357 - DNA, 25 bp, Rattus norvegicus
tagtgatcctgatctcatgagccca

SEQ ID NO: 563358 - DNA, 25 bp, Rattus norvegicus
tagtgatctcagactcctcaaggag

SEQ ID NO: 563359 - DNA, 25 bp, Rattus norvegicus
tagtgatctcagtctcctcaaggag

SEQ ID NO: 563360 - DNA, 25 bp, Rattus norvegicus
tagtgatgaaggagcccagtgccag

SEQ ID NO: 563361 - DNA, 25 bp, Rattus norvegicus
tagtgatgaaggtgcccagtgccag

SEQ ID NO: 563362 - DNA, 25 bp, Rattus norvegicus
tagtgatgccccattacccttgggt

SEQ ID NO: 563363 - DNA, 25 bp, Rattus norvegicus
tagtgatgcccctttacccttgggt

SEQ ID NO: 563364 - DNA, 25 bp, Rattus norvegicus
tagtgatgctggagcccctatctgt

SEQ ID NO: 563365 - DNA, 25 bp, Rattus norvegicus
tagtgatgctggtgcccctatctgt

SEQ ID NO: 563366 - DNA, 25 bp, Rattus norvegicus
tagtgatggagcctgactgctgtta

SEQ ID NO: 563367 - DNA, 25 bp, Rattus norvegicus
tagtgatggagcgtgactgctgtta

SEQ ID NO: 563368 - DNA, 25 bp, Rattus norvegicus
tagtgatggattccgtactcctcga

SEQ ID NO: 563369 - DNA, 25 bp, Rattus norvegicus
tagtgatggattgcgtactcctcga

SEQ ID NO: 563370 - DNA, 25 bp, Rattus norvegicus
tagtgatgtgaaatgctcctgcctc

SEQ ID NO: 563371 - DNA, 25 bp, Rattus norvegicus
tagtgatgtgaattgctcctgcctc

SEQ ID NO: 563372 - DNA, 25 bp, Rattus norvegicus
tagtgatgtgctcagtaatttcccc

SEQ ID NO: 563373 - DNA, 25 bp, Rattus norvegicus
tagtgatgtgctctaacttgccctc

SEQ ID NO: 563374 - DNA, 25 bp, Rattus norvegicus
tagtgatgtgctgagtaatttcccc

SEQ ID NO: 563375 - DNA, 25 bp, Rattus norvegicus
tagtgatgtgctgtaacttgccctc

SEQ ID NO: 563376 - DNA, 25 bp, Rattus norvegicus
tagtgatgttgtcccattgatgctg

SEQ ID NO: 563377 - DNA, 25 bp, Rattus norvegicus
tagtgatgttgtgccattgatgctg

SEQ ID NO: 563378 - DNA, 25 bp, Rattus norvegicus
tagtgatgttttacaggtgccagat

SEQ ID NO: 563379 - DNA, 25 bp, Rattus norvegicus
tagtgatgtttttcaggtgccagat

SEQ ID NO: 563380 - DNA, 25 bp, Rattus norvegicus
tagtgattaactccttagctcccac

SEQ ID NO: 563381 - DNA, 25 bp, Rattus norvegicus
tagtgattaactgcttagctcccac

SEQ ID NO: 563382 - DNA, 25 bp, Rattus norvegicus
tagtgattctgtattgaggtgcaaa

SEQ ID NO: 563383 - DNA, 25 bp, Rattus norvegicus
tagtgattctgttttgaggtgcaaa

SEQ ID NO: 563384 - DNA, 25 bp, Rattus norvegicus
tagtgattgggtacgctcccgagga

SEQ ID NO: 563385 - DNA, 25 bp, Rattus norvegicus
tagtgattgggttcgctcccgagga

SEQ ID NO: 563386 - DNA, 25 bp, Rattus norvegicus
tagtgcaaactaattccttactggg

SEQ ID NO: 563387 - DNA, 25 bp, Rattus norvegicus
tagtgcaaactatttccttactggg

SEQ ID NO: 563388 - DNA, 25 bp, Rattus norvegicus
tagtgcaattaacaataccccgaaa

SEQ ID NO: 563389 - DNA, 25 bp, Rattus norvegicus
tagtgcaattaagaataccccgaaa

SEQ ID NO: 563390 - DNA, 25 bp, Rattus norvegicus
tagtgcacagatacacgcgcaggca

SEQ ID NO: 563391 - DNA, 25 bp, Rattus norvegicus
tagtgcacagattcacgcgcaggca

SEQ ID NO: 563392 - DNA, 25 bp, Rattus norvegicus
tagtgcacatctccagtcccagtat

SEQ ID NO: 563393 - DNA, 25 bp, Rattus norvegicus
tagtgcacatctgcagtcccagtat

SEQ ID NO: 563394 - DNA, 25 bp, Rattus norvegicus
tagtgcaccaatcctgatgtgaggg

SEQ ID NO: 563395 - DNA, 25 bp, Rattus norvegicus
tagtgcaccaatgctgatgtgaggg

SEQ ID NO: 563396 - DNA, 25 bp, Rattus norvegicus
tagtgcactaagctctgggatcctt

SEQ ID NO: 563397 - DNA, 25 bp, Rattus norvegicus
tagtgcactaaggtctgggatcctt

SEQ ID NO: 563398 - DNA, 25 bp, Rattus norvegicus
tagtgcactgttactgcttctccaa

SEQ ID NO: 563399 - DNA, 25 bp, Rattus norvegicus
tagtgcactgtttctgcttctccaa

SEQ ID NO: 563400 - DNA, 25 bp, Rattus norvegicus
tagtgcagagtcagaccctggtgct

SEQ ID NO: 563401 - DNA, 25 bp, Rattus norvegicus
tagtgcagagtctgaccctggtgct

SEQ ID NO: 563402 - DNA, 25 bp, Rattus norvegicus
tagtgcagatttccctgttgctctt

SEQ ID NO: 563403 - DNA, 25 bp, Rattus norvegicus
tagtgcagatttgcctgttgctctt

SEQ ID NO: 563404 - DNA, 25 bp, Rattus norvegicus
tagtgcagcctgaccaaatgccaag

SEQ ID NO: 563405 - DNA, 25 bp, Rattus norvegicus
tagtgcagcctgtccaaatgccaag

SEQ ID NO: 563406 - DNA, 25 bp, Rattus norvegicus
tagtgcagccttactgcatcgtagt

SEQ ID NO: 563407 - DNA, 25 bp, Rattus norvegicus
tagtgcagcctttctgcatcgtagt

SEQ ID NO: 563408 - DNA, 25 bp, Rattus norvegicus
tagtgcagctgcctgtaagttgcct

SEQ ID NO: 563409 - DNA, 25 bp, Rattus norvegicus
tagtgcagctgcgtgtaagttgcct

SEQ ID NO: 563410 - DNA, 25 bp, Rattus norvegicus
tagtgcaggtcgaggccacgccgat

SEQ ID NO: 563411 - DNA, 25 bp, Rattus norvegicus
tagtgcaggtcgtggccacgccgat

SEQ ID NO: 563412 - DNA, 25 bp, Rattus norvegicus
tagtgcaggtgaattctacgtgcgc

SEQ ID NO: 563413 - DNA, 25 bp, Rattus norvegicus
tagtgcaggtgatttctacgtgcgc

SEQ ID NO: 563414 - DNA, 25 bp, Rattus norvegicus
tagtgcagtgtactgcagcgcacaa

SEQ ID NO: 563415 - DNA, 25 bp, Rattus norvegicus
tagtgcagtgtagtgcagcgcacaa

SEQ ID NO: 563416 - DNA, 25 bp, Rattus norvegicus
tagtgcatacctcttcgcttctcat

SEQ ID NO: 563417 - DNA, 25 bp, Rattus norvegicus
tagtgcatacctgttcgcttctcat

SEQ ID NO: 563418 - DNA, 25 bp, Rattus norvegicus
tagtgcatcctgctcttctggttat

SEQ ID NO: 563419 - DNA, 25 bp, Rattus norvegicus
tagtgcatcctggtcttctggttat

SEQ ID NO: 563420 - DNA, 25 bp, Rattus norvegicus
tagtgcatctctagaggccgcatgt

SEQ ID NO: 563421 - DNA, 25 bp, Rattus norvegicus
tagtgcatctcttgaggccgcatgt

SEQ ID NO: 563422 - DNA, 25 bp, Rattus norvegicus
tagtgcattctgctgatttggtccc

SEQ ID NO: 563423 - DNA, 25 bp, Rattus norvegicus
tagtgcattctggtgatttggtccc

SEQ ID NO: 563424 - DNA, 25 bp, Rattus norvegicus
tagtgccaaacgacttttctttggg

SEQ ID NO: 563425 - DNA, 25 bp, Rattus norvegicus
tagtgccaaacgtcttttctttggg

SEQ ID NO: 563426 - DNA, 25 bp, Rattus norvegicus
tagtgccaagccatgtgatccccaa

SEQ ID NO: 563427 - DNA, 25 bp, Rattus norvegicus
tagtgccaagccttgtgatccccaa

SEQ ID NO: 563428 - DNA, 25 bp, Rattus norvegicus
tagtgccacacccataactctgact

SEQ ID NO: 563429 - DNA, 25 bp, Rattus norvegicus
tagtgccacaccgataactctgact

SEQ ID NO: 563430 - DNA, 25 bp, Rattus norvegicus
tagtgccacagcagcaagcgatgga

SEQ ID NO: 563431 - DNA, 25 bp, Rattus norvegicus
tagtgccacagctgcaagcgatgga

SEQ ID NO: 563432 - DNA, 25 bp, Rattus norvegicus
tagtgccacaggcacatcagttcct

SEQ ID NO: 563433 - DNA, 25 bp, Rattus norvegicus
tagtgccacagggacatcagttcct

SEQ ID NO: 563434 - DNA, 25 bp, Rattus norvegicus
tagtgccaccaaactgtacacttaa

SEQ ID NO: 563435 - DNA, 25 bp, Rattus norvegicus
tagtgccaccaatctgtacacttaa

SEQ ID NO: 563436 - DNA, 25 bp, Rattus norvegicus
tagtgccacctgagcatggtttaag

SEQ ID NO: 563437 - DNA, 25 bp, Rattus norvegicus
tagtgccacctgtgcatggtttaag

SEQ ID NO: 563438 - DNA, 25 bp, Rattus norvegicus
tagtgccactgtattttgtctccaa

SEQ ID NO: 563439 - DNA, 25 bp, Rattus norvegicus
tagtgccactgttttttgtctccaa

SEQ ID NO: 563440 - DNA, 25 bp, Rattus norvegicus
tagtgccattttcgccggacatggt

SEQ ID NO: 563441 - DNA, 25 bp, Rattus norvegicus
tagtgccattttggccggacatggt

SEQ ID NO: 563442 - DNA, 25 bp, Rattus norvegicus
tagtgcccaaggaagtgacaccagc

SEQ ID NO: 563443 - DNA, 25 bp, Rattus norvegicus
tagtgcccaaggtagtgacaccagc

SEQ ID NO: 563444 - DNA, 25 bp, Rattus norvegicus
tagtgcccaagtagctggagtccaa

SEQ ID NO: 563445 - DNA, 25 bp, Rattus norvegicus
tagtgcccaagttgctggagtccaa

SEQ ID NO: 563446 - DNA, 25 bp, Rattus norvegicus
tagtgccccttgcacattgattgct

SEQ ID NO: 563447 - DNA, 25 bp, Rattus norvegicus
tagtgccccttggacattgattgct

SEQ ID NO: 563448 - DNA, 25 bp, Rattus norvegicus
tagtgcccctttaattatccaagcc

SEQ ID NO: 563449 - DNA, 25 bp, Rattus norvegicus
tagtgcccctttactgttaagcaag

SEQ ID NO: 563450 - DNA, 25 bp, Rattus norvegicus
tagtgccccttttattatccaagcc

SEQ ID NO: 563451 - DNA, 25 bp, Rattus norvegicus
tagtgccccttttctgttaagcaag

SEQ ID NO: 563452 - DNA, 25 bp, Rattus norvegicus
tagtgcccggctcttttttaatcta

SEQ ID NO: 563453 - DNA, 25 bp, Rattus norvegicus
tagtgcccggctgttttttaatcta

SEQ ID NO: 563454 - DNA, 25 bp, Rattus norvegicus
tagtgccctatactttcagttcctg

SEQ ID NO: 563455 - DNA, 25 bp, Rattus norvegicus
tagtgccctatagtttcagttcctg

SEQ ID NO: 563456 - DNA, 25 bp, Rattus norvegicus
tagtgccctggaccaagtccatgac

SEQ ID NO: 563457 - DNA, 25 bp, Rattus norvegicus
tagtgccctggagcaagtccatgac

SEQ ID NO: 563458 - DNA, 25 bp, Rattus norvegicus
tagtgcccttgacgacttgagcaga

SEQ ID NO: 563459 - DNA, 25 bp, Rattus norvegicus
tagtgcccttgactcttatccagag

SEQ ID NO: 563460 - DNA, 25 bp, Rattus norvegicus
tagtgcccttgaggacttgagcaga

SEQ ID NO: 563461 - DNA, 25 bp, Rattus norvegicus
tagtgcccttgagtcttatccagag

SEQ ID NO: 563462 - DNA, 25 bp, Rattus norvegicus
tagtgccctttcatgaccttgcatt

SEQ ID NO: 563463 - DNA, 25 bp, Rattus norvegicus
tagtgccctttcttgaccttgcatt

SEQ ID NO: 563464 - DNA, 25 bp, Rattus norvegicus
tagtgccgttgccaaaggtccccgg

SEQ ID NO: 563465 - DNA, 25 bp, Rattus norvegicus
tagtgccgttgcgaaaggtccccgg

SEQ ID NO: 563466 - DNA, 25 bp, Rattus norvegicus
tagtgcctacctccacctataggaa

SEQ ID NO: 563467 - DNA, 25 bp, Rattus norvegicus
tagtgcctacctgcacctataggaa

SEQ ID NO: 563468 - DNA, 25 bp, Rattus norvegicus
tagtgcctcaacacgatgagagatc

SEQ ID NO: 563469 - DNA, 25 bp, Rattus norvegicus
tagtgcctcaactcgatgagagatc

SEQ ID NO: 563470 - DNA, 25 bp, Rattus norvegicus
tagtgcctcacacaatggagtcgta

SEQ ID NO: 563471 - DNA, 25 bp, Rattus norvegicus
tagtgcctcacagaatggagtcgta

SEQ ID NO: 563472 - DNA, 25 bp, Rattus norvegicus
tagtgcctcatacctgtttctcaaa

SEQ ID NO: 563473 - DNA, 25 bp, Rattus norvegicus
tagtgcctcatagctgtttctcaaa

SEQ ID NO: 563474 - DNA, 25 bp, Rattus norvegicus
tagtgcctctagctaactgcccaag

SEQ ID NO: 563475 - DNA, 25 bp, Rattus norvegicus
tagtgcctctaggtaactgcccaag

SEQ ID NO: 563476 - DNA, 25 bp, Rattus norvegicus
tagtgcctcttccagggtacccaat

SEQ ID NO: 563477 - DNA, 25 bp, Rattus norvegicus
tagtgcctcttcgagggtacccaat

SEQ ID NO: 563478 - DNA, 25 bp, Rattus norvegicus
tagtgcctgattctctgggtgagtc

SEQ ID NO: 563479 - DNA, 25 bp, Rattus norvegicus
tagtgcctgattgtctgggtgagtc

SEQ ID NO: 563480 - DNA, 25 bp, Rattus norvegicus
tagtgcctggcgcattcaagagctc

SEQ ID NO: 563481 - DNA, 25 bp, Rattus norvegicus
tagtgcctggcggattcaagagctc

SEQ ID NO: 563482 - DNA, 25 bp, Rattus norvegicus
tagtgcctggtgcaatactgttctc

SEQ ID NO: 563483 - DNA, 25 bp, Rattus norvegicus
tagtgcctggtggaatactgttctc

SEQ ID NO: 563484 - DNA, 25 bp, Rattus norvegicus
tagtgcctgtaccatgatgatcctc

SEQ ID NO: 563485 - DNA, 25 bp, Rattus norvegicus
tagtgcctgtacgatgatgatcctc

SEQ ID NO: 563486 - DNA, 25 bp, Rattus norvegicus
tagtgcctgttacacttttaccttt

SEQ ID NO: 563487 - DNA, 25 bp, Rattus norvegicus
tagtgcctgttagacttttaccttt

SEQ ID NO: 563488 - DNA, 25 bp, Rattus norvegicus
tagtgccttagacctgtctgtagac

SEQ ID NO: 563489 - DNA, 25 bp, Rattus norvegicus
tagtgccttagagctgtctgtagac

SEQ ID NO: 563490 - DNA, 25 bp, Rattus norvegicus
tagtgccttattacttttacgtgac

SEQ ID NO: 563491 - DNA, 25 bp, Rattus norvegicus
tagtgccttatttcttttacgtgac

SEQ ID NO: 563492 - DNA, 25 bp, Rattus norvegicus
tagtgccttctgcagactcttggaa

SEQ ID NO: 563493 - DNA, 25 bp, Rattus norvegicus
tagtgccttctggagactcttggaa

SEQ ID NO: 563494 - DNA, 25 bp, Rattus norvegicus
tagtgccttcttaaccttctgtaac

SEQ ID NO: 563495 - DNA, 25 bp, Rattus norvegicus
tagtgccttctttaccttctgtaac

SEQ ID NO: 563496 - DNA, 25 bp, Rattus norvegicus
tagtgcctttgacctgcccctgcag

SEQ ID NO: 563497 - DNA, 25 bp, Rattus norvegicus
tagtgcctttgagctgcccctgcag

SEQ ID NO: 563498 - DNA, 25 bp, Rattus norvegicus
tagtgcgcaggcacagctgcctgtg

SEQ ID NO: 563499 - DNA, 25 bp, Rattus norvegicus
tagtgcgcaggctcagctgcctgtg

SEQ ID NO: 563500 - DNA, 25 bp, Rattus norvegicus
tagtgcgccacaaggacctccgtcg

SEQ ID NO: 563501 - DNA, 25 bp, Rattus norvegicus
tagtgcgccacatggacctccgtcg

SEQ ID NO: 563502 - DNA, 25 bp, Rattus norvegicus
tagtgcgccagacagtaacttgccg

SEQ ID NO: 563503 - DNA, 25 bp, Rattus norvegicus
tagtgcgccagagagtaacttgccg

SEQ ID NO: 563504 - DNA, 25 bp, Rattus norvegicus
tagtgcgggccgagaccctacggcc

SEQ ID NO: 563505 - DNA, 25 bp, Rattus norvegicus
tagtgcgggccgtgaccctacggcc

SEQ ID NO: 563506 - DNA, 25 bp, Rattus norvegicus
tagtgcgtattcctaacaggtcaca

SEQ ID NO: 563507 - DNA, 25 bp, Rattus norvegicus
tagtgcgtattcgtaacaggtcaca

SEQ ID NO: 563508 - DNA, 25 bp, Rattus norvegicus
tagtgcgtgcttcattgctgtcatc

SEQ ID NO: 563509 - DNA, 25 bp, Rattus norvegicus
tagtgcgtgcttgattgctgtcatc

SEQ ID NO: 563510 - DNA, 25 bp, Rattus norvegicus
tagtgctaacagacgcctgctctga

SEQ ID NO: 563511 - DNA, 25 bp, Rattus norvegicus
tagtgctaacagtcgcctgctctga

SEQ ID NO: 563512 - DNA, 25 bp, Rattus norvegicus
tagtgctactcccaagacatgcatt

SEQ ID NO: 563513 - DNA, 25 bp, Rattus norvegicus
tagtgctactccgaagacatgcatt

SEQ ID NO: 563514 - DNA, 25 bp, Rattus norvegicus
tagtgctagcatctcttccttctga

SEQ ID NO: 563515 - DNA, 25 bp, Rattus norvegicus
tagtgctagcatgtcttccttctga

SEQ ID NO: 563516 - DNA, 25 bp, Rattus norvegicus
tagtgctaggccactcgctattttc

SEQ ID NO: 563517 - DNA, 25 bp, Rattus norvegicus
tagtgctaggcctctcgctattttc

SEQ ID NO: 563518 - DNA, 25 bp, Rattus norvegicus
tagtgctatctgaggctgtttggag

SEQ ID NO: 563519 - DNA, 25 bp, Rattus norvegicus
tagtgctatctgtggctgtttggag

SEQ ID NO: 563520 - DNA, 25 bp, Rattus norvegicus
tagtgctatgagctgttgagaaatt

SEQ ID NO: 563521 - DNA, 25 bp, Rattus norvegicus
tagtgctatgaggtgttgagaaatt

SEQ ID NO: 563522 - DNA, 25 bp, Rattus norvegicus
tagtgctatggtaattgagtcaaaa

SEQ ID NO: 563523 - DNA, 25 bp, Rattus norvegicus
tagtgctatggttattgagtcaaaa

SEQ ID NO: 563524 - DNA, 25 bp, Rattus norvegicus
tagtgctcacacaagacactgtgcc

SEQ ID NO: 563525 - DNA, 25 bp, Rattus norvegicus
tagtgctcacactagacactgtgcc

SEQ ID NO: 563526 - DNA, 25 bp, Rattus norvegicus
tagtgctcacagcacgggcacgtgt

SEQ ID NO: 563527 - DNA, 25 bp, Rattus norvegicus
tagtgctcacaggacgggcacgtgt

SEQ ID NO: 563528 - DNA, 25 bp, Rattus norvegicus
tagtgctcatctcgttggatccgga

SEQ ID NO: 563529 - DNA, 25 bp, Rattus norvegicus
tagtgctcatctggttggatccgga

SEQ ID NO: 563530 - DNA, 25 bp, Rattus norvegicus
tagtgctccactctggtgcctaaaa

SEQ ID NO: 563531 - DNA, 25 bp, Rattus norvegicus
tagtgctccactgtggtgcctaaaa

SEQ ID NO: 563532 - DNA, 25 bp, Rattus norvegicus
tagtgctccgcgcaagagctggact

SEQ ID NO: 563533 - DNA, 25 bp, Rattus norvegicus
tagtgctccgcggaagagctggact

SEQ ID NO: 563534 - DNA, 25 bp, Rattus norvegicus
tagtgctctactagatccttcctct

SEQ ID NO: 563535 - DNA, 25 bp, Rattus norvegicus
tagtgctctacttgatccttcctct

SEQ ID NO: 563536 - DNA, 25 bp, Rattus norvegicus
tagtgctctagcaagggagtccctt

SEQ ID NO: 563537 - DNA, 25 bp, Rattus norvegicus
tagtgctctagctagggagtccctt

SEQ ID NO: 563538 - DNA, 25 bp, Rattus norvegicus
tagtgctctcccactccgaagagga

SEQ ID NO: 563539 - DNA, 25 bp, Rattus norvegicus
tagtgctctccctctccgaagagga

SEQ ID NO: 563540 - DNA, 25 bp, Rattus norvegicus
tagtgctctgaacggagcatcccct

SEQ ID NO: 563541 - DNA, 25 bp, Rattus norvegicus
tagtgctctgaagggagcatcccct

SEQ ID NO: 563542 - DNA, 25 bp, Rattus norvegicus
tagtgctctgtgaagagcgttctcc

SEQ ID NO: 563543 - DNA, 25 bp, Rattus norvegicus
tagtgctctgtgagacctttcgaaa

SEQ ID NO: 563544 - DNA, 25 bp, Rattus norvegicus
tagtgctctgtgtagagcgttctcc

SEQ ID NO: 563545 - DNA, 25 bp, Rattus norvegicus
tagtgctctgtgtgacctttcgaaa

SEQ ID NO: 563546 - DNA, 25 bp, Rattus norvegicus
tagtgctcttaaccccagatttcca

SEQ ID NO: 563547 - DNA, 25 bp, Rattus norvegicus
tagtgctcttaagcccagatttcca

SEQ ID NO: 563548 - DNA, 25 bp, Rattus norvegicus
tagtgctgacccaggcttctgttca

SEQ ID NO: 563549 - DNA, 25 bp, Rattus norvegicus
tagtgctgaccctggcttctgttca

SEQ ID NO: 563550 - DNA, 25 bp, Rattus norvegicus
tagtgctgactgaatggtacccttg

SEQ ID NO: 563551 - DNA, 25 bp, Rattus norvegicus
tagtgctgactgtatggtacccttg

SEQ ID NO: 563552 - DNA, 25 bp, Rattus norvegicus
tagtgctgagaaaggacttgaacat

SEQ ID NO: 563553 - DNA, 25 bp, Rattus norvegicus
tagtgctgagaatggacttgaacat

SEQ ID NO: 563554 - DNA, 25 bp, Rattus norvegicus
tagtgctgagtcaaacatacaagcc

SEQ ID NO: 563555 - DNA, 25 bp, Rattus norvegicus
tagtgctgagtctaacatacaagcc

SEQ ID NO: 563556 - DNA, 25 bp, Rattus norvegicus
tagtgctgccgtattccttctttat

SEQ ID NO: 563557 - DNA, 25 bp, Rattus norvegicus
tagtgctgccgttttccttctttat

SEQ ID NO: 563558 - DNA, 25 bp, Rattus norvegicus
tagtgctgcctaatctgtgtggtct

SEQ ID NO: 563559 - DNA, 25 bp, Rattus norvegicus
tagtgctgcctattctgtgtggtct

SEQ ID NO: 563560 - DNA, 25 bp, Rattus norvegicus
tagtgctgctgacctatgccttaca

SEQ ID NO: 563561 - DNA, 25 bp, Rattus norvegicus
tagtgctgctgagctatgccttaca

SEQ ID NO: 563562 - DNA, 25 bp, Rattus norvegicus
tagtgctgggatacagccagggcct

SEQ ID NO: 563563 - DNA, 25 bp, Rattus norvegicus
tagtgctgggattcagccagggcct

SEQ ID NO: 563564 - DNA, 25 bp, Rattus norvegicus
tagtgctgtgacaactccagagaga

SEQ ID NO: 563565 - DNA, 25 bp, Rattus norvegicus
tagtgctgtgactactccagagaga

SEQ ID NO: 563566 - DNA, 25 bp, Rattus norvegicus
tagtgcttcatccttgccatatagg

SEQ ID NO: 563567 - DNA, 25 bp, Rattus norvegicus
tagtgcttcatcgttgccatatagg

SEQ ID NO: 563568 - DNA, 25 bp, Rattus norvegicus
tagtgcttccctacgttttctagta

SEQ ID NO: 563569 - DNA, 25 bp, Rattus norvegicus
tagtgcttcccttcgttttctagta

SEQ ID NO: 563570 - DNA, 25 bp, Rattus norvegicus
tagtgcttcctcattgtttgtgtgc

SEQ ID NO: 563571 - DNA, 25 bp, Rattus norvegicus
tagtgcttcctctttgtttgtgtgc

SEQ ID NO: 563572 - DNA, 25 bp, Rattus norvegicus
tagtgcttctacagcctccaaatta

SEQ ID NO: 563573 - DNA, 25 bp, Rattus norvegicus
tagtgcttctactgcctccaaatta

SEQ ID NO: 563574 - DNA, 25 bp, Rattus norvegicus
tagtgcttctggacttgggagtgac

SEQ ID NO: 563575 - DNA, 25 bp, Rattus norvegicus
tagtgcttctggtcttgggagtgac

SEQ ID NO: 563576 - DNA, 25 bp, Rattus norvegicus
tagtgcttgtggactactcaggtcc

SEQ ID NO: 563577 - DNA, 25 bp, Rattus norvegicus
tagtgcttgtggtctactcaggtcc

SEQ ID NO: 563578 - DNA, 25 bp, Rattus norvegicus
tagtgctttgccatctcatagatga

SEQ ID NO: 563579 - DNA, 25 bp, Rattus norvegicus
tagtgctttgccttctcatagatga

SEQ ID NO: 563580 - DNA, 25 bp, Rattus norvegicus
tagtggacatccatcccagtgtgag

SEQ ID NO: 563581 - DNA, 25 bp, Rattus norvegicus
tagtggacatccttcccagtgtgag

SEQ ID NO: 563582 - DNA, 25 bp, Rattus norvegicus
tagtggaccaaactacttccttgct

SEQ ID NO: 563583 - DNA, 25 bp, Rattus norvegicus
tagtggaccaaagtacttccttgct

SEQ ID NO: 563584 - DNA, 25 bp, Rattus norvegicus
tagtggacgccgagaaggccaccga

SEQ ID NO: 563585 - DNA, 25 bp, Rattus norvegicus
tagtggacgccgtgaaggccaccga

SEQ ID NO: 563586 - DNA, 25 bp, Rattus norvegicus
tagtggactagaacctcatatcagt

SEQ ID NO: 563587 - DNA, 25 bp, Rattus norvegicus
tagtggactagatcctcatatcagt

SEQ ID NO: 563588 - DNA, 25 bp, Rattus norvegicus
tagtggacttgtacctggagggatc

SEQ ID NO: 563589 - DNA, 25 bp, Rattus norvegicus
tagtggacttgttcctggagggatc

SEQ ID NO: 563590 - DNA, 25 bp, Rattus norvegicus
tagtggagatgaccggcctcagtcc

SEQ ID NO: 563591 - DNA, 25 bp, Rattus norvegicus
tagtggagatgagcggcctcagtcc

SEQ ID NO: 563592 - DNA, 25 bp, Rattus norvegicus
tagtggaggcacacgagcatctcgc

SEQ ID NO: 563593 - DNA, 25 bp, Rattus norvegicus
tagtggaggcactcgagcatctcgc

SEQ ID NO: 563594 - DNA, 25 bp, Rattus norvegicus
tagtggagtcccatttgcattattg

SEQ ID NO: 563595 - DNA, 25 bp, Rattus norvegicus
tagtggagtcccttttgcattattg

SEQ ID NO: 563596 - DNA, 25 bp, Rattus norvegicus
tagtggagtggcatctcgccgacca

SEQ ID NO: 563597 - DNA, 25 bp, Rattus norvegicus
tagtggagtggcttctcgccgacca

SEQ ID NO: 563598 - DNA, 25 bp, Rattus norvegicus
tagtggataccgaggccctagtgac

SEQ ID NO: 563599 - DNA, 25 bp, Rattus norvegicus
tagtggataccgtggccctagtgac

SEQ ID NO: 563600 - DNA, 25 bp, Rattus norvegicus
tagtggatccccacacagtgaagga

SEQ ID NO: 563601 - DNA, 25 bp, Rattus norvegicus
tagtggatcccctcacagtgaagga

SEQ ID NO: 563602 - DNA, 25 bp, Rattus norvegicus
tagtggatcttactccgtgcatcat

SEQ ID NO: 563603 - DNA, 25 bp, Rattus norvegicus
tagtggatcttagtccgtgcatcat

SEQ ID NO: 563604 - DNA, 25 bp, Rattus norvegicus
tagtggatgaccacgtggcatgtat

SEQ ID NO: 563605 - DNA, 25 bp, Rattus norvegicus
tagtggatgacctcgtggcatgtat

SEQ ID NO: 563606 - DNA, 25 bp, Rattus norvegicus
tagtggattcccagagtcagcacca

SEQ ID NO: 563607 - DNA, 25 bp, Rattus norvegicus
tagtggattccctgagtcagcacca

SEQ ID NO: 563608 - DNA, 25 bp, Rattus norvegicus
tagtggatttcacctcctggtggac

SEQ ID NO: 563609 - DNA, 25 bp, Rattus norvegicus
tagtggatttcagctcctggtggac

SEQ ID NO: 563610 - DNA, 25 bp, Rattus norvegicus
tagtggcacctcactgaagttctat

SEQ ID NO: 563611 - DNA, 25 bp, Rattus norvegicus
tagtggcacctctctgaagttctat

SEQ ID NO: 563612 - DNA, 25 bp, Rattus norvegicus
tagtggcactagaccctttatgaac

SEQ ID NO: 563613 - DNA, 25 bp, Rattus norvegicus
tagtggcactagtccctttatgaac

SEQ ID NO: 563614 - DNA, 25 bp, Rattus norvegicus
tagtggcagaaaatttgatcgaaac

SEQ ID NO: 563615 - DNA, 25 bp, Rattus norvegicus
tagtggcagaaattttgatcgaaac

SEQ ID NO: 563616 - DNA, 25 bp, Rattus norvegicus
tagtggcataggcactcaggagaca

SEQ ID NO: 563617 - DNA, 25 bp, Rattus norvegicus
tagtggcatagggactcaggagaca

SEQ ID NO: 563618 - DNA, 25 bp, Rattus norvegicus
tagtggccccaaccaaaagacgtgc

SEQ ID NO: 563619 - DNA, 25 bp, Rattus norvegicus
tagtggccccaagcaaaagacgtgc

SEQ ID NO: 563620 - DNA, 25 bp, Rattus norvegicus
tagtggcctactacaacatcgagtt

SEQ ID NO: 563621 - DNA, 25 bp, Rattus norvegicus
tagtggcctacttcaacatcgagtt

SEQ ID NO: 563622 - DNA, 25 bp, Rattus norvegicus
tagtggcctataccagccgacagaa

SEQ ID NO: 563623 - DNA, 25 bp, Rattus norvegicus
tagtggcctatagcagccgacagaa

SEQ ID NO: 563624 - DNA, 25 bp, Rattus norvegicus
tagtggcctcttacctgatgctcga

SEQ ID NO: 563625 - DNA, 25 bp, Rattus norvegicus
tagtggcctctttcctgatgctcga

SEQ ID NO: 563626 - DNA, 25 bp, Rattus norvegicus
tagtggcctgttctttatttcgtgt

SEQ ID NO: 563627 - DNA, 25 bp, Rattus norvegicus
tagtggcctgttgtttatttcgtgt

SEQ ID NO: 563628 - DNA, 25 bp, Rattus norvegicus
tagtggcgtttgctggaagcccttc

SEQ ID NO: 563629 - DNA, 25 bp, Rattus norvegicus
tagtggcgtttggtggaagcccttc

SEQ ID NO: 563630 - DNA, 25 bp, Rattus norvegicus
tagtggctactaatctgtttggcag

SEQ ID NO: 563631 - DNA, 25 bp, Rattus norvegicus
tagtggctactattctgtttggcag

SEQ ID NO: 563632 - DNA, 25 bp, Rattus norvegicus
tagtggctagagcaataaataaatg

SEQ ID NO: 563633 - DNA, 25 bp, Rattus norvegicus
tagtggctagaggaataaataaatg

SEQ ID NO: 563634 - DNA, 25 bp, Rattus norvegicus
tagtggctccaactgtcaggtgtta

SEQ ID NO: 563635 - DNA, 25 bp, Rattus norvegicus
tagtggctccaagtgtcaggtgtta

SEQ ID NO: 563636 - DNA, 25 bp, Rattus norvegicus
tagtggctccctccgagtgaatgcc

SEQ ID NO: 563637 - DNA, 25 bp, Rattus norvegicus
tagtggctccctgcgagtgaatgcc

SEQ ID NO: 563638 - DNA, 25 bp, Rattus norvegicus
tagtggctccggagaatcctgtggt

SEQ ID NO: 563639 - DNA, 25 bp, Rattus norvegicus
tagtggctccggtgaatcctgtggt

SEQ ID NO: 563640 - DNA, 25 bp, Rattus norvegicus
tagtggctcgagcttttgacaccgg

SEQ ID NO: 563641 - DNA, 25 bp, Rattus norvegicus
tagtggctcgaggttttgacaccgg

SEQ ID NO: 563642 - DNA, 25 bp, Rattus norvegicus
tagtggctgctgatctgtcaactta

SEQ ID NO: 563643 - DNA, 25 bp, Rattus norvegicus
tagtggctgctgttctgtcaactta

SEQ ID NO: 563644 - DNA, 25 bp, Rattus norvegicus
tagtggctgttgcttttctgtgtta

SEQ ID NO: 563645 - DNA, 25 bp, Rattus norvegicus
tagtggctgttggttttctgtgtta

SEQ ID NO: 563646 - DNA, 25 bp, Rattus norvegicus
tagtggctttagatttgttctcttt

SEQ ID NO: 563647 - DNA, 25 bp, Rattus norvegicus
tagtggctttagttttgttctcttt

SEQ ID NO: 563648 - DNA, 25 bp, Rattus norvegicus
tagtggcttttcactgatcagtaca

SEQ ID NO: 563649 - DNA, 25 bp, Rattus norvegicus
tagtggcttttctctgatcagtaca

SEQ ID NO: 563650 - DNA, 25 bp, Rattus norvegicus
tagtgggaataccaggcccttttct

SEQ ID NO: 563651 - DNA, 25 bp, Rattus norvegicus
tagtgggaatacgaggcccttttct

SEQ ID NO: 563652 - DNA, 25 bp, Rattus norvegicus
tagtgggagccacgcaagtttcctt

SEQ ID NO: 563653 - DNA, 25 bp, Rattus norvegicus
tagtgggagccaggcaagtttcctt

SEQ ID NO: 563654 - DNA, 25 bp, Rattus norvegicus
tagtgggcacgcagctcaaggattt

SEQ ID NO: 563655 - DNA, 25 bp, Rattus norvegicus
tagtgggcacgctgctcaaggattt

SEQ ID NO: 563656 - DNA, 25 bp, Rattus norvegicus
tagtgggcccaccaacactgacaag

SEQ ID NO: 563657 - DNA, 25 bp, Rattus norvegicus
tagtgggcccacgaacactgacaag

SEQ ID NO: 563658 - DNA, 25 bp, Rattus norvegicus
tagtgggcgatgaccgtggacacat

SEQ ID NO: 563659 - DNA, 25 bp, Rattus norvegicus
tagtgggcgatgtccgtggacacat

SEQ ID NO: 563660 - DNA, 25 bp, Rattus norvegicus
tagtgggcgctgcaaccacggttcc

SEQ ID NO: 563661 - DNA, 25 bp, Rattus norvegicus
tagtgggcgctggaaccacggttcc

SEQ ID NO: 563662 - DNA, 25 bp, Rattus norvegicus
tagtgggctgagacaatcctgaatg

SEQ ID NO: 563663 - DNA, 25 bp, Rattus norvegicus
tagtgggctgagtcaatcctgaatg

SEQ ID NO: 563664 - DNA, 25 bp, Rattus norvegicus
tagtgggctgccatctggatgagac

SEQ ID NO: 563665 - DNA, 25 bp, Rattus norvegicus
tagtgggctgccttctggatgagac

SEQ ID NO: 563666 - DNA, 25 bp, Rattus norvegicus
tagtgggtattcaccagtcaactgg

SEQ ID NO: 563667 - DNA, 25 bp, Rattus norvegicus
tagtgggtattccttttgttcaact

SEQ ID NO: 563668 - DNA, 25 bp, Rattus norvegicus
tagtgggtattcgttttgttcaact

SEQ ID NO: 563669 - DNA, 25 bp, Rattus norvegicus
tagtgggtattctccagtcaactgg

SEQ ID NO: 563670 - DNA, 25 bp, Rattus norvegicus
tagtgggtcttcagctgctccacag

SEQ ID NO: 563671 - DNA, 25 bp, Rattus norvegicus
tagtgggtcttctgctgctccacag

SEQ ID NO: 563672 - DNA, 25 bp, Rattus norvegicus
tagtgggtgcatctgcacgatctcg

SEQ ID NO: 563673 - DNA, 25 bp, Rattus norvegicus
tagtgggtgcatgtgcacgatctcg

SEQ ID NO: 563674 - DNA, 25 bp, Rattus norvegicus
tagtgggtggccctgatagaaacaa

SEQ ID NO: 563675 - DNA, 25 bp, Rattus norvegicus
tagtgggtggccgtgatagaaacaa

SEQ ID NO: 563676 - DNA, 25 bp, Rattus norvegicus
tagtgggtggcgacgactcggacgg

SEQ ID NO: 563677 - DNA, 25 bp, Rattus norvegicus
tagtgggtggcgtcgactcggacgg

SEQ ID NO: 563678 - DNA, 25 bp, Rattus norvegicus
tagtgggttccacttggatcaaaat

SEQ ID NO: 563679 - DNA, 25 bp, Rattus norvegicus
tagtgggttccagttggatcaaaat

SEQ ID NO: 563680 - DNA, 25 bp, Rattus norvegicus
tagtggtaaaataccaagcccaaag

SEQ ID NO: 563681 - DNA, 25 bp, Rattus norvegicus
tagtggtaaaattccaagcccaaag

SEQ ID NO: 563682 - DNA, 25 bp, Rattus norvegicus
tagtggtagaaacaagcctcataac

SEQ ID NO: 563683 - DNA, 25 bp, Rattus norvegicus
tagtggtagaaagaagcctcataac

SEQ ID NO: 563684 - DNA, 25 bp, Rattus norvegicus
tagtggtcaaagactaaccctacaa

SEQ ID NO: 563685 - DNA, 25 bp, Rattus norvegicus
tagtggtcaaagtctaaccctacaa

SEQ ID NO: 563686 - DNA, 25 bp, Rattus norvegicus
tagtggtcagcaaggcccgtggaaa

SEQ ID NO: 563687 - DNA, 25 bp, Rattus norvegicus
tagtggtcagcatggcccgtggaaa

SEQ ID NO: 563688 - DNA, 25 bp, Rattus norvegicus
tagtggtcatttctcatttcataac

SEQ ID NO: 563689 - DNA, 25 bp, Rattus norvegicus
tagtggtcatttgtcatttcataac

SEQ ID NO: 563690 - DNA, 25 bp, Rattus norvegicus
tagtggtccaccctttattccagca

SEQ ID NO: 563691 - DNA, 25 bp, Rattus norvegicus
tagtggtccaccgtttattccagca

SEQ ID NO: 563692 - DNA, 25 bp, Rattus norvegicus
tagtggtctctcatcttgatgatta

SEQ ID NO: 563693 - DNA, 25 bp, Rattus norvegicus
tagtggtctctcttcttgatgatta

SEQ ID NO: 563694 - DNA, 25 bp, Rattus norvegicus
tagtggtgactgatccccgggctga

SEQ ID NO: 563695 - DNA, 25 bp, Rattus norvegicus
tagtggtgactgttccccgggctga

SEQ ID NO: 563696 - DNA, 25 bp, Rattus norvegicus
tagtggtgctagagcacttggctct

SEQ ID NO: 563697 - DNA, 25 bp, Rattus norvegicus
tagtggtgctagtgcacttggctct

SEQ ID NO: 563698 - DNA, 25 bp, Rattus norvegicus
tagtggtgctgcctgacagtagtcc

SEQ ID NO: 563699 - DNA, 25 bp, Rattus norvegicus
tagtggtgctgcgtgacagtagtcc

SEQ ID NO: 563700 - DNA, 25 bp, Rattus norvegicus
tagtggtgtaacagtccaggaaact

SEQ ID NO: 563701 - DNA, 25 bp, Rattus norvegicus
tagtggtgtaactgtccaggaaact

SEQ ID NO: 563702 - DNA, 25 bp, Rattus norvegicus
tagtggttacctctcttcctgaatc

SEQ ID NO: 563703 - DNA, 25 bp, Rattus norvegicus
tagtggttacctgtcttcctgaatc

SEQ ID NO: 563704 - DNA, 25 bp, Rattus norvegicus
tagtggttgaagactggtctcctcc

SEQ ID NO: 563705 - DNA, 25 bp, Rattus norvegicus
tagtggttgaagtctggtctcctcc

SEQ ID NO: 563706 - DNA, 25 bp, Rattus norvegicus
tagtggttgatgaaggaaagccctt

SEQ ID NO: 563707 - DNA, 25 bp, Rattus norvegicus
tagtggttgatgtaggaaagccctt

SEQ ID NO: 563708 - DNA, 25 bp, Rattus norvegicus
tagtggtttcttagcctctcttaca

SEQ ID NO: 563709 - DNA, 25 bp, Rattus norvegicus
tagtggtttctttgcctctcttaca

SEQ ID NO: 563710 - DNA, 25 bp, Rattus norvegicus
tagtggttttgtcagagctgccaac

SEQ ID NO: 563711 - DNA, 25 bp, Rattus norvegicus
tagtggttttgtgagagctgccaac

SEQ ID NO: 563712 - DNA, 25 bp, Rattus norvegicus
tagtgtaagaaacgcacccttctcc

SEQ ID NO: 563713 - DNA, 25 bp, Rattus norvegicus
tagtgtaagaaaggcacccttctcc

SEQ ID NO: 563714 - DNA, 25 bp, Rattus norvegicus
tagtgtaagctaccttcacagtccc

SEQ ID NO: 563715 - DNA, 25 bp, Rattus norvegicus
tagtgtaagctagcttcacagtccc

SEQ ID NO: 563716 - DNA, 25 bp, Rattus norvegicus
tagtgtaagctccttatgtttcaga

SEQ ID NO: 563717 - DNA, 25 bp, Rattus norvegicus
tagtgtaagctcgttatgtttcaga

SEQ ID NO: 563718 - DNA, 25 bp, Rattus norvegicus
tagtgtaatcatctgtatagtcttg

SEQ ID NO: 563719 - DNA, 25 bp, Rattus norvegicus
tagtgtaatcatgtgtatagtcttg

SEQ ID NO: 563720 - DNA, 25 bp, Rattus norvegicus
tagtgtacatctcgtttgtctgcaa

SEQ ID NO: 563721 - DNA, 25 bp, Rattus norvegicus
tagtgtacatctggtttgtctgcaa

SEQ ID NO: 563722 - DNA, 25 bp, Rattus norvegicus
tagtgtaccaccaacagattcaatg

SEQ ID NO: 563723 - DNA, 25 bp, Rattus norvegicus
tagtgtaccacctacagattcaatg

SEQ ID NO: 563724 - DNA, 25 bp, Rattus norvegicus
tagtgtacccatatccatttttgtt

SEQ ID NO: 563725 - DNA, 25 bp, Rattus norvegicus
tagtgtacccatttccatttttgtt

SEQ ID NO: 563726 - DNA, 25 bp, Rattus norvegicus
tagtgtactaacagatctacccacc

SEQ ID NO: 563727 - DNA, 25 bp, Rattus norvegicus
tagtgtactaactgatctacccacc

SEQ ID NO: 563728 - DNA, 25 bp, Rattus norvegicus
tagtgtactttgagactgcgtgcat

SEQ ID NO: 563729 - DNA, 25 bp, Rattus norvegicus
tagtgtactttgtgactgcgtgcat

SEQ ID NO: 563730 - DNA, 25 bp, Rattus norvegicus
tagtgtagacatcttgccccataca

SEQ ID NO: 563731 - DNA, 25 bp, Rattus norvegicus
tagtgtagacatgttgccccataca

SEQ ID NO: 563732 - DNA, 25 bp, Rattus norvegicus
tagtgtagtaccaaacccggagaga

SEQ ID NO: 563733 - DNA, 25 bp, Rattus norvegicus
tagtgtagtacctaacccggagaga

SEQ ID NO: 563734 - DNA, 25 bp, Rattus norvegicus
tagtgtatctcaatcaccagctcct

SEQ ID NO: 563735 - DNA, 25 bp, Rattus norvegicus
tagtgtatctcattcaccagctcct

SEQ ID NO: 563736 - DNA, 25 bp, Rattus norvegicus
tagtgtatgatcagggacggcgtct

SEQ ID NO: 563737 - DNA, 25 bp, Rattus norvegicus
tagtgtatgatctgggacggcgtct

SEQ ID NO: 563738 - DNA, 25 bp, Rattus norvegicus
tagtgtattttcactccacattcca

SEQ ID NO: 563739 - DNA, 25 bp, Rattus norvegicus
tagtgtattttctctccacattcca

SEQ ID NO: 563740 - DNA, 25 bp, Rattus norvegicus
tagtgtcactgtcactgtagctgtg

SEQ ID NO: 563741 - DNA, 25 bp, Rattus norvegicus
tagtgtcactgtgactgtagctgtg

SEQ ID NO: 563742 - DNA, 25 bp, Rattus norvegicus
tagtgtcacttaatggcaacgccat

SEQ ID NO: 563743 - DNA, 25 bp, Rattus norvegicus
tagtgtcacttattggcaacgccat

SEQ ID NO: 563744 - DNA, 25 bp, Rattus norvegicus
tagtgtcagctgctacttaactgct

SEQ ID NO: 563745 - DNA, 25 bp, Rattus norvegicus
tagtgtcagctggtacttaactgct

SEQ ID NO: 563746 - DNA, 25 bp, Rattus norvegicus
tagtgtccaatactcatattctgta

SEQ ID NO: 563747 - DNA, 25 bp, Rattus norvegicus
tagtgtccaatagtcatattctgta

SEQ ID NO: 563748 - DNA, 25 bp, Rattus norvegicus
tagtgtccacatctcaggcatgtga

SEQ ID NO: 563749 - DNA, 25 bp, Rattus norvegicus
tagtgtccacatgtcaggcatgtga

SEQ ID NO: 563750 - DNA, 25 bp, Rattus norvegicus
tagtgtccagccagagtcctgaggt

SEQ ID NO: 563751 - DNA, 25 bp, Rattus norvegicus
tagtgtccagcctgagtcctgaggt

SEQ ID NO: 563752 - DNA, 25 bp, Rattus norvegicus
tagtgtccagctataacatgccgaa

SEQ ID NO: 563753 - DNA, 25 bp, Rattus norvegicus
tagtgtccagctttaacatgccgaa

SEQ ID NO: 563754 - DNA, 25 bp, Rattus norvegicus
tagtgtcccaggattctctgaggtc

SEQ ID NO: 563755 - DNA, 25 bp, Rattus norvegicus
tagtgtcccaggtttctctgaggtc

SEQ ID NO: 563756 - DNA, 25 bp, Rattus norvegicus
tagtgtcctaccaggaagctttcct

SEQ ID NO: 563757 - DNA, 25 bp, Rattus norvegicus
tagtgtcctacctggaagctttcct

SEQ ID NO: 563758 - DNA, 25 bp, Rattus norvegicus
tagtgtcctcttagttgtcatgtct

SEQ ID NO: 563759 - DNA, 25 bp, Rattus norvegicus
tagtgtcctctttgttgtcatgtct

SEQ ID NO: 563760 - DNA, 25 bp, Rattus norvegicus
tagtgtcctgtgatgtcctggctct

SEQ ID NO: 563761 - DNA, 25 bp, Rattus norvegicus
tagtgtcctgtgttgtcctggctct

SEQ ID NO: 563762 - DNA, 25 bp, Rattus norvegicus
tagtgtcgctgaacaatttgccgaa

SEQ ID NO: 563763 - DNA, 25 bp, Rattus norvegicus
tagtgtcgctgatcaatttgccgaa

SEQ ID NO: 563764 - DNA, 25 bp, Rattus norvegicus
tagtgtcgtcgtatagtcctgaccg

SEQ ID NO: 563765 - DNA, 25 bp, Rattus norvegicus
tagtgtcgtcgtttagtcctgaccg

SEQ ID NO: 563766 - DNA, 25 bp, Rattus norvegicus
tagtgtctagaacggcccacagccg

SEQ ID NO: 563767 - DNA, 25 bp, Rattus norvegicus
tagtgtctagaagggcccacagccg

SEQ ID NO: 563768 - DNA, 25 bp, Rattus norvegicus
tagtgtctagtccagcctcttaaaa

SEQ ID NO: 563769 - DNA, 25 bp, Rattus norvegicus
tagtgtctagtcgagcctcttaaaa

SEQ ID NO: 563770 - DNA, 25 bp, Rattus norvegicus
tagtgtctcatgatataattgtttc

SEQ ID NO: 563771 - DNA, 25 bp, Rattus norvegicus
tagtgtctcatgttataattgtttc

SEQ ID NO: 563772 - DNA, 25 bp, Rattus norvegicus
tagtgtctcccaacactcaggaaat

SEQ ID NO: 563773 - DNA, 25 bp, Rattus norvegicus
tagtgtctcccatcactcaggaaat

SEQ ID NO: 563774 - DNA, 25 bp, Rattus norvegicus
tagtgtctctataaagcctttttga

SEQ ID NO: 563775 - DNA, 25 bp, Rattus norvegicus
tagtgtctctattaagcctttttga

SEQ ID NO: 563776 - DNA, 25 bp, Rattus norvegicus
tagtgtctctgcacatttacctgga

SEQ ID NO: 563777 - DNA, 25 bp, Rattus norvegicus
tagtgtctctgctcatttacctgga

SEQ ID NO: 563778 - DNA, 25 bp, Rattus norvegicus
tagtgtctcttcaactctagtgcca

SEQ ID NO: 563779 - DNA, 25 bp, Rattus norvegicus
tagtgtctcttctactctagtgcca

SEQ ID NO: 563780 - DNA, 25 bp, Rattus norvegicus
tagtgtctgattatggaatcccaat

SEQ ID NO: 563781 - DNA, 25 bp, Rattus norvegicus
tagtgtctgattttggaatcccaat

SEQ ID NO: 563782 - DNA, 25 bp, Rattus norvegicus
tagtgtctgtgcaggcctgcaacct

SEQ ID NO: 563783 - DNA, 25 bp, Rattus norvegicus
tagtgtctgtgctggcctgcaacct

SEQ ID NO: 563784 - DNA, 25 bp, Rattus norvegicus
tagtgtcttagtattatctgcaatc

SEQ ID NO: 563785 - DNA, 25 bp, Rattus norvegicus
tagtgtcttagttttatctgcaatc

SEQ ID NO: 563786 - DNA, 25 bp, Rattus norvegicus
tagtgtcttcaaccggattggctgc

SEQ ID NO: 563787 - DNA, 25 bp, Rattus norvegicus
tagtgtcttcaagcggattggctgc

SEQ ID NO: 563788 - DNA, 25 bp, Rattus norvegicus
tagtgtcttctactgtcgtacccct

SEQ ID NO: 563789 - DNA, 25 bp, Rattus norvegicus
tagtgtcttctagtgtcgtacccct

SEQ ID NO: 563790 - DNA, 25 bp, Rattus norvegicus
tagtgtctttctactgggcttaccc

SEQ ID NO: 563791 - DNA, 25 bp, Rattus norvegicus
tagtgtctttcttctgggcttaccc

SEQ ID NO: 563792 - DNA, 25 bp, Rattus norvegicus
tagtgtgaacttaaatgtctgttac

SEQ ID NO: 563793 - DNA, 25 bp, Rattus norvegicus
tagtgtgaactttaatgtctgttac

SEQ ID NO: 563794 - DNA, 25 bp, Rattus norvegicus
tagtgtgaatccactggcacagtgt

SEQ ID NO: 563795 - DNA, 25 bp, Rattus norvegicus
tagtgtgaatcctctggcacagtgt

SEQ ID NO: 563796 - DNA, 25 bp, Rattus norvegicus
tagtgtgactcaaattatagatgta

SEQ ID NO: 563797 - DNA, 25 bp, Rattus norvegicus
tagtgtgactcatattatagatgta

SEQ ID NO: 563798 - DNA, 25 bp, Rattus norvegicus
tagtgtgagaccaacctggaggaag

SEQ ID NO: 563799 - DNA, 25 bp, Rattus norvegicus
tagtgtgagacctacctggaggaag

SEQ ID NO: 563800 - DNA, 25 bp, Rattus norvegicus
tagtgtgagagaagccgacttgcct

SEQ ID NO: 563801 - DNA, 25 bp, Rattus norvegicus
tagtgtgagagactgcccttcctag

SEQ ID NO: 563802 - DNA, 25 bp, Rattus norvegicus
tagtgtgagagagtgcccttcctag

SEQ ID NO: 563803 - DNA, 25 bp, Rattus norvegicus
tagtgtgagagatgccgacttgcct

SEQ ID NO: 563804 - DNA, 25 bp, Rattus norvegicus
tagtgtgagctactacttggaccac

SEQ ID NO: 563805 - DNA, 25 bp, Rattus norvegicus
tagtgtgagctagtacttggaccac

SEQ ID NO: 563806 - DNA, 25 bp, Rattus norvegicus
tagtgtgagcttataggcctgcgtc

SEQ ID NO: 563807 - DNA, 25 bp, Rattus norvegicus
tagtgtgagcttttaggcctgcgtc

SEQ ID NO: 563808 - DNA, 25 bp, Rattus norvegicus
tagtgtgagtcgactgtcccttctc

SEQ ID NO: 563809 - DNA, 25 bp, Rattus norvegicus
tagtgtgagtcgtctgtcccttctc

SEQ ID NO: 563810 - DNA, 25 bp, Rattus norvegicus
tagtgtgcacatcgtgagctgcgat

SEQ ID NO: 563811 - DNA, 25 bp, Rattus norvegicus
tagtgtgcacatggtgagctgcgat

SEQ ID NO: 563812 - DNA, 25 bp, Rattus norvegicus
tagtgtgcatggactgttagttcat

SEQ ID NO: 563813 - DNA, 25 bp, Rattus norvegicus
tagtgtgcatggtctgttagttcat

SEQ ID NO: 563814 - DNA, 25 bp, Rattus norvegicus
tagtgtgcattcacttatgtgtata

SEQ ID NO: 563815 - DNA, 25 bp, Rattus norvegicus
tagtgtgcattctcttatgtgtata

SEQ ID NO: 563816 - DNA, 25 bp, Rattus norvegicus
tagtgtgccacgcaagctgtcgcct

SEQ ID NO: 563817 - DNA, 25 bp, Rattus norvegicus
tagtgtgccacggaagctgtcgcct

SEQ ID NO: 563818 - DNA, 25 bp, Rattus norvegicus
tagtgtgcccctcgaggccttgctg

SEQ ID NO: 563819 - DNA, 25 bp, Rattus norvegicus
tagtgtgcccctggaggccttgctg

SEQ ID NO: 563820 - DNA, 25 bp, Rattus norvegicus
tagtgtgcgctgacacagaactgtg

SEQ ID NO: 563821 - DNA, 25 bp, Rattus norvegicus
tagtgtgcgctgtcacagaactgtg

SEQ ID NO: 563822 - DNA, 25 bp, Rattus norvegicus
tagtgtgctctaccctgtttgctgc

SEQ ID NO: 563823 - DNA, 25 bp, Rattus norvegicus
tagtgtgctctagcctgtttgctgc

SEQ ID NO: 563824 - DNA, 25 bp, Rattus norvegicus
tagtgtgctgcacttaccttagaag

SEQ ID NO: 563825 - DNA, 25 bp, Rattus norvegicus
tagtgtgctgcagttaccttagaag

SEQ ID NO: 563826 - DNA, 25 bp, Rattus norvegicus
tagtgtgctgtcagtgaaccatcat

SEQ ID NO: 563827 - DNA, 25 bp, Rattus norvegicus
tagtgtgctgtctgtgaaccatcat

SEQ ID NO: 563828 - DNA, 25 bp, Rattus norvegicus
tagtgtgctgttatctacctttttt

SEQ ID NO: 563829 - DNA, 25 bp, Rattus norvegicus
tagtgtgctgttttctacctttttt

SEQ ID NO: 563830 - DNA, 25 bp, Rattus norvegicus
tagtgtggacacagcccagaaggcc

SEQ ID NO: 563831 - DNA, 25 bp, Rattus norvegicus
tagtgtggacactgcccagaaggcc

SEQ ID NO: 563832 - DNA, 25 bp, Rattus norvegicus
tagtgtggaggaccccagcactgca

SEQ ID NO: 563833 - DNA, 25 bp, Rattus norvegicus
tagtgtggaggagcccagcactgca

SEQ ID NO: 563834 - DNA, 25 bp, Rattus norvegicus
tagtgtggcaagagtgctcatgcga

SEQ ID NO: 563835 - DNA, 25 bp, Rattus norvegicus
tagtgtggcaagtgtgctcatgcga

SEQ ID NO: 563836 - DNA, 25 bp, Rattus norvegicus
tagtgtggccatactgactctgtag

SEQ ID NO: 563837 - DNA, 25 bp, Rattus norvegicus
tagtgtggccatacttacctgagga

SEQ ID NO: 563838 - DNA, 25 bp, Rattus norvegicus
tagtgtggccattctgactctgtag

SEQ ID NO: 563839 - DNA, 25 bp, Rattus norvegicus
tagtgtggccattcttacctgagga

SEQ ID NO: 563840 - DNA, 25 bp, Rattus norvegicus
tagtgtggctagatcccaagatggc

SEQ ID NO: 563841 - DNA, 25 bp, Rattus norvegicus
tagtgtggctagttcccaagatggc

SEQ ID NO: 563842 - DNA, 25 bp, Rattus norvegicus
tagtgtgggctacccaatctgccat

SEQ ID NO: 563843 - DNA, 25 bp, Rattus norvegicus
tagtgtgggctagccaatctgccat

SEQ ID NO: 563844 - DNA, 25 bp, Rattus norvegicus
tagtgtggtcctaacaagcagagtg

SEQ ID NO: 563845 - DNA, 25 bp, Rattus norvegicus
tagtgtggtccttacaagcagagtg

SEQ ID NO: 563846 - DNA, 25 bp, Rattus norvegicus
tagtgtggtcttatctgctggtctc

SEQ ID NO: 563847 - DNA, 25 bp, Rattus norvegicus
tagtgtggtcttttctgctggtctc

SEQ ID NO: 563848 - DNA, 25 bp, Rattus norvegicus
tagtgtgtaaacactgtgtagcaga

SEQ ID NO: 563849 - DNA, 25 bp, Rattus norvegicus
tagtgtgtaaactctgtgtagcaga

SEQ ID NO: 563850 - DNA, 25 bp, Rattus norvegicus
tagtgtgtacacaatttctgtgcac

SEQ ID NO: 563851 - DNA, 25 bp, Rattus norvegicus
tagtgtgtacactatttctgtgcac

SEQ ID NO: 563852 - DNA, 25 bp, Rattus norvegicus
tagtgtgtatatatgtcgcccctgt

SEQ ID NO: 563853 - DNA, 25 bp, Rattus norvegicus
tagtgtgtatatttgtcgcccctgt

SEQ ID NO: 563854 - DNA, 25 bp, Rattus norvegicus
tagtgtgtatggaatccactcccca

SEQ ID NO: 563855 - DNA, 25 bp, Rattus norvegicus
tagtgtgtatggtatccactcccca

SEQ ID NO: 563856 - DNA, 25 bp, Rattus norvegicus
tagtgtgtcatactcctaagcgtaa

SEQ ID NO: 563857 - DNA, 25 bp, Rattus norvegicus
tagtgtgtcatagtcctaagcgtaa

SEQ ID NO: 563858 - DNA, 25 bp, Rattus norvegicus
tagtgtgtcttgatcacttgtctcc

SEQ ID NO: 563859 - DNA, 25 bp, Rattus norvegicus
tagtgtgtcttgttcacttgtctcc

SEQ ID NO: 563860 - DNA, 25 bp, Rattus norvegicus
tagtgtgtgagcctattcttcttcg

SEQ ID NO: 563861 - DNA, 25 bp, Rattus norvegicus
tagtgtgtgagcgtattcttcttcg

SEQ ID NO: 563862 - DNA, 25 bp, Rattus norvegicus
tagtgtgtgagtcaacgaaagccct

SEQ ID NO: 563863 - DNA, 25 bp, Rattus norvegicus
tagtgtgtgagtgaacgaaagccct

SEQ ID NO: 563864 - DNA, 25 bp, Rattus norvegicus
tagtgtgtgatgagtccccagacac

SEQ ID NO: 563865 - DNA, 25 bp, Rattus norvegicus
tagtgtgtgatgtgtccccagacac

SEQ ID NO: 563866 - DNA, 25 bp, Rattus norvegicus
tagtgtgtgctaagccatttggaaa

SEQ ID NO: 563867 - DNA, 25 bp, Rattus norvegicus
tagtgtgtgctactcttgtaaggga

SEQ ID NO: 563868 - DNA, 25 bp, Rattus norvegicus
tagtgtgtgctagtcttgtaaggga

SEQ ID NO: 563869 - DNA, 25 bp, Rattus norvegicus
tagtgtgtgctatgccatttggaaa

SEQ ID NO: 563870 - DNA, 25 bp, Rattus norvegicus
tagtgtgtggggagacctcgcacag

SEQ ID NO: 563871 - DNA, 25 bp, Rattus norvegicus
tagtgtgtggggtgacctcgcacag

SEQ ID NO: 563872 - DNA, 25 bp, Rattus norvegicus
tagtgtgtgtccaaatcttctctct

SEQ ID NO: 563873 - DNA, 25 bp, Rattus norvegicus
tagtgtgtgtcctaatcttctctct

SEQ ID NO: 563874 - DNA, 25 bp, Rattus norvegicus
tagtgtgtgtgcagagtccattccc

SEQ ID NO: 563875 - DNA, 25 bp, Rattus norvegicus
tagtgtgtgtgctgagtccattccc

SEQ ID NO: 563876 - DNA, 25 bp, Rattus norvegicus
tagtgtgttcaaagttccctgtatt

SEQ ID NO: 563877 - DNA, 25 bp, Rattus norvegicus
tagtgtgttcaatgttccctgtatt

SEQ ID NO: 563878 - DNA, 25 bp, Rattus norvegicus
tagtgtgttcacacagatgatctga

SEQ ID NO: 563879 - DNA, 25 bp, Rattus norvegicus
tagtgtgttcactcagatgatctga

SEQ ID NO: 563880 - DNA, 25 bp, Rattus norvegicus
tagtgtgttgacagcaggattaccc

SEQ ID NO: 563881 - DNA, 25 bp, Rattus norvegicus
tagtgtgttgactgcaggattaccc

SEQ ID NO: 563882 - DNA, 25 bp, Rattus norvegicus
tagtgttaaatcagaaatgctttga

SEQ ID NO: 563883 - DNA, 25 bp, Rattus norvegicus
tagtgttaaatctgaaatgctttga

SEQ ID NO: 563884 - DNA, 25 bp, Rattus norvegicus
tagtgttaattcacccctttattgg

SEQ ID NO: 563885 - DNA, 25 bp, Rattus norvegicus
tagtgttaattctcccctttattgg

SEQ ID NO: 563886 - DNA, 25 bp, Rattus norvegicus
tagtgttaccacaagttgagcccaa

SEQ ID NO: 563887 - DNA, 25 bp, Rattus norvegicus
tagtgttaccactagttgagcccaa

SEQ ID NO: 563888 - DNA, 25 bp, Rattus norvegicus
tagtgttagactcctgtggtttcct

SEQ ID NO: 563889 - DNA, 25 bp, Rattus norvegicus
tagtgttagactgctgtggtttcct

SEQ ID NO: 563890 - DNA, 25 bp, Rattus norvegicus
tagtgttatacacacgcacaccaca

SEQ ID NO: 563891 - DNA, 25 bp, Rattus norvegicus
tagtgttatacagacgcacaccaca

SEQ ID NO: 563892 - DNA, 25 bp, Rattus norvegicus
tagtgttcacaaatgtgtactttat

SEQ ID NO: 563893 - DNA, 25 bp, Rattus norvegicus
tagtgttcacaattgtgtactttat

SEQ ID NO: 563894 - DNA, 25 bp, Rattus norvegicus
tagtgttcagcaacagctacggata

SEQ ID NO: 563895 - DNA, 25 bp, Rattus norvegicus
tagtgttcagcatcagctacggata

SEQ ID NO: 563896 - DNA, 25 bp, Rattus norvegicus
tagtgttcagccatggttctccatt

SEQ ID NO: 563897 - DNA, 25 bp, Rattus norvegicus
tagtgttcagccttggttctccatt

SEQ ID NO: 563898 - DNA, 25 bp, Rattus norvegicus
tagtgttcagtcactgtatgcccag

SEQ ID NO: 563899 - DNA, 25 bp, Rattus norvegicus
tagtgttcagtctctgtatgcccag

SEQ ID NO: 563900 - DNA, 25 bp, Rattus norvegicus
tagtgttccactaacatgaggtcat

SEQ ID NO: 563901 - DNA, 25 bp, Rattus norvegicus
tagtgttccacttacatgaggtcat

SEQ ID NO: 563902 - DNA, 25 bp, Rattus norvegicus
tagtgttcccaaagccatgtcacaa

SEQ ID NO: 563903 - DNA, 25 bp, Rattus norvegicus
tagtgttcccaatgccatgtcacaa

SEQ ID NO: 563904 - DNA, 25 bp, Rattus norvegicus
tagtgttccccgagatctccagttt

SEQ ID NO: 563905 - DNA, 25 bp, Rattus norvegicus
tagtgttccccgtgatctccagttt

SEQ ID NO: 563906 - DNA, 25 bp, Rattus norvegicus
tagtgttccgagatgtagcccctca

SEQ ID NO: 563907 - DNA, 25 bp, Rattus norvegicus
tagtgttccgagttgtagcccctca

SEQ ID NO: 563908 - DNA, 25 bp, Rattus norvegicus
tagtgttctagaactgggacagcct

SEQ ID NO: 563909 - DNA, 25 bp, Rattus norvegicus
tagtgttctagatctgggacagcct

SEQ ID NO: 563910 - DNA, 25 bp, Rattus norvegicus
tagtgttctcacaacctgaaacggg

SEQ ID NO: 563911 - DNA, 25 bp, Rattus norvegicus
tagtgttctcactacctgaaacggg

SEQ ID NO: 563912 - DNA, 25 bp, Rattus norvegicus
tagtgttgacgccagccaggcaaag

SEQ ID NO: 563913 - DNA, 25 bp, Rattus norvegicus
tagtgttgacgcgagccaggcaaag

SEQ ID NO: 563914 - DNA, 25 bp, Rattus norvegicus
tagtgttgagcccagtattgcccag

SEQ ID NO: 563915 - DNA, 25 bp, Rattus norvegicus
tagtgttgagccgagtattgcccag

SEQ ID NO: 563916 - DNA, 25 bp, Rattus norvegicus
tagtgttgagctcccagtgaaccaa

SEQ ID NO: 563917 - DNA, 25 bp, Rattus norvegicus
tagtgttgagctgccagtgaaccaa

SEQ ID NO: 563918 - DNA, 25 bp, Rattus norvegicus
tagtgttgggccactcttgcctaca

SEQ ID NO: 563919 - DNA, 25 bp, Rattus norvegicus
tagtgttgggcctctcttgcctaca

SEQ ID NO: 563920 - DNA, 25 bp, Rattus norvegicus
tagtgttggtagcacctgccatgct

SEQ ID NO: 563921 - DNA, 25 bp, Rattus norvegicus
tagtgttggtaggacctgccatgct

SEQ ID NO: 563922 - DNA, 25 bp, Rattus norvegicus
tagtgttggttcactcatctccaga

SEQ ID NO: 563923 - DNA, 25 bp, Rattus norvegicus
tagtgttggttctctcatctccaga

SEQ ID NO: 563924 - DNA, 25 bp, Rattus norvegicus
tagtgttgtaggcacttgccctgaa

SEQ ID NO: 563925 - DNA, 25 bp, Rattus norvegicus
tagtgttgtagggacttgccctgaa

SEQ ID NO: 563926 - DNA, 25 bp, Rattus norvegicus
tagtgttgtcggacttctacatttc

SEQ ID NO: 563927 - DNA, 25 bp, Rattus norvegicus
tagtgttgtcggtcttctacatttc

SEQ ID NO: 563928 - DNA, 25 bp, Rattus norvegicus
tagtgttgtgttcttttctcttgtc

SEQ ID NO: 563929 - DNA, 25 bp, Rattus norvegicus
tagtgttgtgttgttttctcttgtc

SEQ ID NO: 563930 - DNA, 25 bp, Rattus norvegicus
tagtgtttaacaactctcaccttcc

SEQ ID NO: 563931 - DNA, 25 bp, Rattus norvegicus
tagtgtttaacatctctcaccttcc

SEQ ID NO: 563932 - DNA, 25 bp, Rattus norvegicus
tagtgtttcaacatgacaagcaata

SEQ ID NO: 563933 - DNA, 25 bp, Rattus norvegicus
tagtgtttcaacttgacaagcaata

SEQ ID NO: 563934 - DNA, 25 bp, Rattus norvegicus
tagtgtttccgcagatgccaggagc

SEQ ID NO: 563935 - DNA, 25 bp, Rattus norvegicus
tagtgtttccgctgatgccaggagc

SEQ ID NO: 563936 - DNA, 25 bp, Rattus norvegicus
tagtgtttcggtatttcgcatcctg

SEQ ID NO: 563937 - DNA, 25 bp, Rattus norvegicus
tagtgtttcggtttttcgcatcctg

SEQ ID NO: 563938 - DNA, 25 bp, Rattus norvegicus
tagtgtttcgtgagagccatgctgc

SEQ ID NO: 563939 - DNA, 25 bp, Rattus norvegicus
tagtgtttcgtgtgagccatgctgc

SEQ ID NO: 563940 - DNA, 25 bp, Rattus norvegicus
tagtgtttctagaatggtgcctgtg

SEQ ID NO: 563941 - DNA, 25 bp, Rattus norvegicus
tagtgtttctagtatggtgcctgtg

SEQ ID NO: 563942 - DNA, 25 bp, Rattus norvegicus
tagtgtttgcatcttatgtccctcc

SEQ ID NO: 563943 - DNA, 25 bp, Rattus norvegicus
tagtgtttgcatgttatgtccctcc

SEQ ID NO: 563944 - DNA, 25 bp, Rattus norvegicus
tagtgtttgtacctcctaggctggg

SEQ ID NO: 563945 - DNA, 25 bp, Rattus norvegicus
tagtgtttgtacgtcctaggctggg

SEQ ID NO: 563946 - DNA, 25 bp, Rattus norvegicus
tagtgttttccgcatctccatttgg

SEQ ID NO: 563947 - DNA, 25 bp, Rattus norvegicus
tagtgttttccggatctccatttgg

SEQ ID NO: 563948 - DNA, 25 bp, Rattus norvegicus
tagtgttttcctaacctgcttttga

SEQ ID NO: 563949 - DNA, 25 bp, Rattus norvegicus
tagtgttttccttacctgcttttga

SEQ ID NO: 563950 - DNA, 25 bp, Rattus norvegicus
tagtgttttgagctgtctctggtct

SEQ ID NO: 563951 - DNA, 25 bp, Rattus norvegicus
tagtgttttgaggtgtctctggtct

SEQ ID NO: 563952 - DNA, 25 bp, Rattus norvegicus
tagttaaaaagaccaaagcccaatg

SEQ ID NO: 563953 - DNA, 25 bp, Rattus norvegicus
tagttaaaaagagcaaagcccaatg

SEQ ID NO: 563954 - DNA, 25 bp, Rattus norvegicus
tagttaacaaacacctccacaacgg

SEQ ID NO: 563955 - DNA, 25 bp, Rattus norvegicus
tagttaacaaactcctccacaacgg

SEQ ID NO: 563956 - DNA, 25 bp, Rattus norvegicus
tagttaacacccactcgagagctgc

SEQ ID NO: 563957 - DNA, 25 bp, Rattus norvegicus
tagttaacaccctctcgagagctgc

SEQ ID NO: 563958 - DNA, 25 bp, Rattus norvegicus
tagttaagatctctgggtgcgcctg

SEQ ID NO: 563959 - DNA, 25 bp, Rattus norvegicus
tagttaagatctgtgggtgcgcctg

SEQ ID NO: 563960 - DNA, 25 bp, Rattus norvegicus
tagttaagcacccttctgtggctgc

SEQ ID NO: 563961 - DNA, 25 bp, Rattus norvegicus
tagttaagcaccgttctgtggctgc

SEQ ID NO: 563962 - DNA, 25 bp, Rattus norvegicus
tagttaagtccacggcatttgtgtc

SEQ ID NO: 563963 - DNA, 25 bp, Rattus norvegicus
tagttaagtccagggcatttgtgtc

SEQ ID NO: 563964 - DNA, 25 bp, Rattus norvegicus
tagttaatgcttaccgatgggctgc

SEQ ID NO: 563965 - DNA, 25 bp, Rattus norvegicus
tagttaatgctttccgatgggctgc

SEQ ID NO: 563966 - DNA, 25 bp, Rattus norvegicus
tagttaatgtctacctcagcacctc

SEQ ID NO: 563967 - DNA, 25 bp, Rattus norvegicus
tagttaatgtcttcctcagcacctc

SEQ ID NO: 563968 - DNA, 25 bp, Rattus norvegicus
tagttaatgtgtctcgtgggccagc

SEQ ID NO: 563969 - DNA, 25 bp, Rattus norvegicus
tagttaatgtgtgtcgtgggccagc

SEQ ID NO: 563970 - DNA, 25 bp, Rattus norvegicus
tagttacaagggaatggcaccattt

SEQ ID NO: 563971 - DNA, 25 bp, Rattus norvegicus
tagttacaagggtatggcaccattt

SEQ ID NO: 563972 - DNA, 25 bp, Rattus norvegicus
tagttacaggcccttctatttgtgc

SEQ ID NO: 563973 - DNA, 25 bp, Rattus norvegicus
tagttacaggccgttctatttgtgc

SEQ ID NO: 563974 - DNA, 25 bp, Rattus norvegicus
tagttaccacttcttttcttgccag

SEQ ID NO: 563975 - DNA, 25 bp, Rattus norvegicus
tagttaccacttgttttcttgccag

SEQ ID NO: 563976 - DNA, 25 bp, Rattus norvegicus
tagttaccagagacctttctaccca

SEQ ID NO: 563977 - DNA, 25 bp, Rattus norvegicus
tagttaccagagtcctttctaccca

SEQ ID NO: 563978 - DNA, 25 bp, Rattus norvegicus
tagttaccatagagactgcctgctg

SEQ ID NO: 563979 - DNA, 25 bp, Rattus norvegicus
tagttaccatagtgactgcctgctg

SEQ ID NO: 563980 - DNA, 25 bp, Rattus norvegicus
tagttacctcaacgcctattgacca

SEQ ID NO: 563981 - DNA, 25 bp, Rattus norvegicus
tagttacctcaaggcctattgacca

SEQ ID NO: 563982 - DNA, 25 bp, Rattus norvegicus
tagttacctcccactaacgtcttat

SEQ ID NO: 563983 - DNA, 25 bp, Rattus norvegicus
tagttacctccctctaacgtcttat

SEQ ID NO: 563984 - DNA, 25 bp, Rattus norvegicus
tagttacctgatcacgttctgctgt

SEQ ID NO: 563985 - DNA, 25 bp, Rattus norvegicus
tagttacctgatgacgttctgctgt

SEQ ID NO: 563986 - DNA, 25 bp, Rattus norvegicus
tagttacgcataccctcatgtcaag

SEQ ID NO: 563987 - DNA, 25 bp, Rattus norvegicus
tagttacgcatagcctcatgtcaag

SEQ ID NO: 563988 - DNA, 25 bp, Rattus norvegicus
tagttacgggttatctccattgcat

SEQ ID NO: 563989 - DNA, 25 bp, Rattus norvegicus
tagttacgggttttctccattgcat

SEQ ID NO: 563990 - DNA, 25 bp, Rattus norvegicus
tagttactagtgaaggaccctgatc

SEQ ID NO: 563991 - DNA, 25 bp, Rattus norvegicus
tagttactagtgtaggaccctgatc

SEQ ID NO: 563992 - DNA, 25 bp, Rattus norvegicus
tagttactcatcatgatggccctta

SEQ ID NO: 563993 - DNA, 25 bp, Rattus norvegicus
tagttactcatcttgatggccctta

SEQ ID NO: 563994 - DNA, 25 bp, Rattus norvegicus
tagttactgctgagtactcttcctc

SEQ ID NO: 563995 - DNA, 25 bp, Rattus norvegicus
tagttactgctgtgtactcttcctc

SEQ ID NO: 563996 - DNA, 25 bp, Rattus norvegicus
tagttactgcttacgactggtgggc

SEQ ID NO: 563997 - DNA, 25 bp, Rattus norvegicus
tagttactgctttcgactggtgggc

SEQ ID NO: 563998 - DNA, 25 bp, Rattus norvegicus
tagttacttcacctccaggagcaga

SEQ ID NO: 563999 - DNA, 25 bp, Rattus norvegicus
tagttacttcacgtccaggagcaga

SEQ ID NO: 564000 - DNA, 25 bp, Rattus norvegicus
tagttagacattatatttccatgta

SEQ ID NO: 564001 - DNA, 25 bp, Rattus norvegicus
tagttagacattttatttccatgta

SEQ ID NO: 564002 - DNA, 25 bp, Rattus norvegicus
tagttagaccctccatggctttatg

SEQ ID NO: 564003 - DNA, 25 bp, Rattus norvegicus
tagttagaccctgcatggctttatg

SEQ ID NO: 564004 - DNA, 25 bp, Rattus norvegicus
tagttagagctgctgtgcgctcagc

SEQ ID NO: 564005 - DNA, 25 bp, Rattus norvegicus
tagttagagctggtgtgcgctcagc

SEQ ID NO: 564006 - DNA, 25 bp, Rattus norvegicus
tagttagatcacaggctgcgggtgc

SEQ ID NO: 564007 - DNA, 25 bp, Rattus norvegicus
tagttagatcactggctgcgggtgc

SEQ ID NO: 564008 - DNA, 25 bp, Rattus norvegicus
tagttagcaactctgatgtcattcc

SEQ ID NO: 564009 - DNA, 25 bp, Rattus norvegicus
tagttagcaactgtgatgtcattcc

SEQ ID NO: 564010 - DNA, 25 bp, Rattus norvegicus
tagttagccaaaccctctgtgccag

SEQ ID NO: 564011 - DNA, 25 bp, Rattus norvegicus
tagttagccaaagcctctgtgccag

SEQ ID NO: 564012 - DNA, 25 bp, Rattus norvegicus
tagttaggtgtcatgtggcccttct

SEQ ID NO: 564013 - DNA, 25 bp, Rattus norvegicus
tagttaggtgtcttgtggcccttct

SEQ ID NO: 564014 - DNA, 25 bp, Rattus norvegicus
tagttaggttatatcctgccaaaat

SEQ ID NO: 564015 - DNA, 25 bp, Rattus norvegicus
tagttaggttatttcctgccaaaat

SEQ ID NO: 564016 - DNA, 25 bp, Rattus norvegicus
tagttaggttctaacctcaacgatt

SEQ ID NO: 564017 - DNA, 25 bp, Rattus norvegicus
tagttaggttcttacctcaacgatt

SEQ ID NO: 564018 - DNA, 25 bp, Rattus norvegicus
tagttagtactccattccctgtgct

SEQ ID NO: 564019 - DNA, 25 bp, Rattus norvegicus
tagttagtactcgattccctgtgct

SEQ ID NO: 564020 - DNA, 25 bp, Rattus norvegicus
tagttataccttaattcctctgacc

SEQ ID NO: 564021 - DNA, 25 bp, Rattus norvegicus
tagttatacctttattcctctgacc

SEQ ID NO: 564022 - DNA, 25 bp, Rattus norvegicus
tagttatatcttccttcagcgttgc

SEQ ID NO: 564023 - DNA, 25 bp, Rattus norvegicus
tagttatatcttgcttcagcgttgc

SEQ ID NO: 564024 - DNA, 25 bp, Rattus norvegicus
tagttatcaacacagtccccagggc

SEQ ID NO: 564025 - DNA, 25 bp, Rattus norvegicus
tagttatcaacagagtccccagggc

SEQ ID NO: 564026 - DNA, 25 bp, Rattus norvegicus
tagttatccctgatccttacaagta

SEQ ID NO: 564027 - DNA, 25 bp, Rattus norvegicus
tagttatccctgttccttacaagta

SEQ ID NO: 564028 - DNA, 25 bp, Rattus norvegicus
tagttatccttcactgtcctgttta

SEQ ID NO: 564029 - DNA, 25 bp, Rattus norvegicus
tagttatccttctctgtcctgttta

SEQ ID NO: 564030 - DNA, 25 bp, Rattus norvegicus
tagttatggatgctcagtgtctcga

SEQ ID NO: 564031 - DNA, 25 bp, Rattus norvegicus
tagttatggatggtcagtgtctcga

SEQ ID NO: 564032 - DNA, 25 bp, Rattus norvegicus
tagttcaaccatatcctcactggga

SEQ ID NO: 564033 - DNA, 25 bp, Rattus norvegicus
tagttcaaccatttcctcactggga

SEQ ID NO: 564034 - DNA, 25 bp, Rattus norvegicus
tagttcaagagtctcccctagcctt

SEQ ID NO: 564035 - DNA, 25 bp, Rattus norvegicus
tagttcaagagtgtcccctagcctt

SEQ ID NO: 564036 - DNA, 25 bp, Rattus norvegicus
tagttcacaacaatccatctacgga

SEQ ID NO: 564037 - DNA, 25 bp, Rattus norvegicus
tagttcacaacattccatctacgga

SEQ ID NO: 564038 - DNA, 25 bp, Rattus norvegicus
tagttcacacgtctctggtcaataa

SEQ ID NO: 564039 - DNA, 25 bp, Rattus norvegicus
tagttcacacgtgtctggtcaataa

SEQ ID NO: 564040 - DNA, 25 bp, Rattus norvegicus
tagttcacccacacctttaaatgtt

SEQ ID NO: 564041 - DNA, 25 bp, Rattus norvegicus
tagttcacccactcctttaaatgtt

SEQ ID NO: 564042 - DNA, 25 bp, Rattus norvegicus
tagttcacctcacgtccatccaaag

SEQ ID NO: 564043 - DNA, 25 bp, Rattus norvegicus
tagttcacctcaggtccatccaaag

SEQ ID NO: 564044 - DNA, 25 bp, Rattus norvegicus
tagttcaccttgctcaccctgcggt

SEQ ID NO: 564045 - DNA, 25 bp, Rattus norvegicus
tagttcaccttggtcaccctgcggt

SEQ ID NO: 564046 - DNA, 25 bp, Rattus norvegicus
tagttcacgatgcatgccgagcacc

SEQ ID NO: 564047 - DNA, 25 bp, Rattus norvegicus
tagttcacgatggatgccgagcacc

SEQ ID NO: 564048 - DNA, 25 bp, Rattus norvegicus
tagttcactgttatacagatcgctt

SEQ ID NO: 564049 - DNA, 25 bp, Rattus norvegicus
tagttcactgttttacagatcgctt

SEQ ID NO: 564050 - DNA, 25 bp, Rattus norvegicus
tagttcagactacaagccaaaagaa

SEQ ID NO: 564051 - DNA, 25 bp, Rattus norvegicus
tagttcagactagaagccaaaagaa

SEQ ID NO: 564052 - DNA, 25 bp, Rattus norvegicus
tagttcagccttcccttaaaacctg

SEQ ID NO: 564053 - DNA, 25 bp, Rattus norvegicus
tagttcagccttgccttaaaacctg

SEQ ID NO: 564054 - DNA, 25 bp, Rattus norvegicus
tagttcagctttaacttcctggagc

SEQ ID NO: 564055 - DNA, 25 bp, Rattus norvegicus
tagttcagcttttacttcctggagc

SEQ ID NO: 564056 - DNA, 25 bp, Rattus norvegicus
tagttcaggtggatgtaggtcacca

SEQ ID NO: 564057 - DNA, 25 bp, Rattus norvegicus
tagttcaggtggttgtaggtcacca

SEQ ID NO: 564058 - DNA, 25 bp, Rattus norvegicus
tagttcagtataccacccagaggtt

SEQ ID NO: 564059 - DNA, 25 bp, Rattus norvegicus
tagttcagtatagcacccagaggtt

SEQ ID NO: 564060 - DNA, 25 bp, Rattus norvegicus
tagttcatctgcacctgtgtatgta

SEQ ID NO: 564061 - DNA, 25 bp, Rattus norvegicus
tagttcatctgctcctgtgtatgta

SEQ ID NO: 564062 - DNA, 25 bp, Rattus norvegicus
tagttcattcagcacggaggagcac

SEQ ID NO: 564063 - DNA, 25 bp, Rattus norvegicus
tagttcattcaggacggaggagcac

SEQ ID NO: 564064 - DNA, 25 bp, Rattus norvegicus
tagttcattctcactaacaggcaga

SEQ ID NO: 564065 - DNA, 25 bp, Rattus norvegicus
tagttcattctctctaacaggcaga

SEQ ID NO: 564066 - DNA, 25 bp, Rattus norvegicus
tagttcatttacagggaatacttga

SEQ ID NO: 564067 - DNA, 25 bp, Rattus norvegicus
tagttcatttactgggaatacttga

SEQ ID NO: 564068 - DNA, 25 bp, Rattus norvegicus
tagttccaagggacccagtgctctc

SEQ ID NO: 564069 - DNA, 25 bp, Rattus norvegicus
tagttccaagggtcccagtgctctc

SEQ ID NO: 564070 - DNA, 25 bp, Rattus norvegicus
tagttccaagttcctattctggttt

SEQ ID NO: 564071 - DNA, 25 bp, Rattus norvegicus
tagttccaagttgctattctggttt

SEQ ID NO: 564072 - DNA, 25 bp, Rattus norvegicus
tagttccacaagacgccttaccttg

SEQ ID NO: 564073 - DNA, 25 bp, Rattus norvegicus
tagttccacaagtcgccttaccttg

SEQ ID NO: 564074 - DNA, 25 bp, Rattus norvegicus
tagttccacactatgctgacagatg

SEQ ID NO: 564075 - DNA, 25 bp, Rattus norvegicus
tagttccacactttgctgacagatg

SEQ ID NO: 564076 - DNA, 25 bp, Rattus norvegicus
tagttccacccaagactgtcaaacc

SEQ ID NO: 564077 - DNA, 25 bp, Rattus norvegicus
tagttccacccatgactgtcaaacc

SEQ ID NO: 564078 - DNA, 25 bp, Rattus norvegicus
tagttccactgactgcaaaccaagc

SEQ ID NO: 564079 - DNA, 25 bp, Rattus norvegicus
tagttccactgagtgcaaaccaagc

SEQ ID NO: 564080 - DNA, 25 bp, Rattus norvegicus
tagttccagctgacaccacgtggct

SEQ ID NO: 564081 - DNA, 25 bp, Rattus norvegicus
tagttccagctgtcaccacgtggct

SEQ ID NO: 564082 - DNA, 25 bp, Rattus norvegicus
tagttccagggtaatggcctcgttc

SEQ ID NO: 564083 - DNA, 25 bp, Rattus norvegicus
tagttccagggtctccaacatctac

SEQ ID NO: 564084 - DNA, 25 bp, Rattus norvegicus
tagttccagggtgtccaacatctac

SEQ ID NO: 564085 - DNA, 25 bp, Rattus norvegicus
tagttccagggttatggcctcgttc

SEQ ID NO: 564086 - DNA, 25 bp, Rattus norvegicus
tagttccatcagagtcagtagcgct

SEQ ID NO: 564087 - DNA, 25 bp, Rattus norvegicus
tagttccatcagtgtcagtagcgct

SEQ ID NO: 564088 - DNA, 25 bp, Rattus norvegicus
tagttccatcccaggctcccaaagg

SEQ ID NO: 564089 - DNA, 25 bp, Rattus norvegicus
tagttccatccctggctcccaaagg

SEQ ID NO: 564090 - DNA, 25 bp, Rattus norvegicus
tagttcccatgccagcaagtgccgg

SEQ ID NO: 564091 - DNA, 25 bp, Rattus norvegicus
tagttcccatgcgagcaagtgccgg

SEQ ID NO: 564092 - DNA, 25 bp, Rattus norvegicus
tagttcccatgtatggattgtgttt

SEQ ID NO: 564093 - DNA, 25 bp, Rattus norvegicus
tagttcccatgtttggattgtgttt

SEQ ID NO: 564094 - DNA, 25 bp, Rattus norvegicus
tagttcccctttcaacagtcacttt

SEQ ID NO: 564095 - DNA, 25 bp, Rattus norvegicus
tagttcccctttgaacagtcacttt

SEQ ID NO: 564096 - DNA, 25 bp, Rattus norvegicus
tagttcccgcctcagtttgagaaat

SEQ ID NO: 564097 - DNA, 25 bp, Rattus norvegicus
tagttcccgcctgagtttgagaaat

SEQ ID NO: 564098 - DNA, 25 bp, Rattus norvegicus
tagttccctggcattttggtcaaag

SEQ ID NO: 564099 - DNA, 25 bp, Rattus norvegicus
tagttccctggccaaataattttca

SEQ ID NO: 564100 - DNA, 25 bp, Rattus norvegicus
tagttccctggcgaaataattttca

SEQ ID NO: 564101 - DNA, 25 bp, Rattus norvegicus
tagttccctggctttttggtcaaag

SEQ ID NO: 564102 - DNA, 25 bp, Rattus norvegicus
tagttccctgttagctgacagctgt

SEQ ID NO: 564103 - DNA, 25 bp, Rattus norvegicus
tagttccctgtttgctgacagctgt

SEQ ID NO: 564104 - DNA, 25 bp, Rattus norvegicus
tagttcctctgactggagtcatcca

SEQ ID NO: 564105 - DNA, 25 bp, Rattus norvegicus
tagttcctctgagtggagtcatcca

SEQ ID NO: 564106 - DNA, 25 bp, Rattus norvegicus
tagttcctggttcttgtccttgaaa

SEQ ID NO: 564107 - DNA, 25 bp, Rattus norvegicus
tagttcctggttgttgtccttgaaa

SEQ ID NO: 564108 - DNA, 25 bp, Rattus norvegicus
tagttcctgtgaatcttcagctaga

SEQ ID NO: 564109 - DNA, 25 bp, Rattus norvegicus
tagttcctgtgattcttcagctaga

SEQ ID NO: 564110 - DNA, 25 bp, Rattus norvegicus
tagttcctgtttcttctgagccaga

SEQ ID NO: 564111 - DNA, 25 bp, Rattus norvegicus
tagttcctgtttgttctgagccaga

SEQ ID NO: 564112 - DNA, 25 bp, Rattus norvegicus
tagttccttagtcaaggccatccca

SEQ ID NO: 564113 - DNA, 25 bp, Rattus norvegicus
tagttccttagtgaaggccatccca

SEQ ID NO: 564114 - DNA, 25 bp, Rattus norvegicus
tagttccttgtcaccacgtacttgg

SEQ ID NO: 564115 - DNA, 25 bp, Rattus norvegicus
tagttccttgtctccacgtacttgg

SEQ ID NO: 564116 - DNA, 25 bp, Rattus norvegicus
tagttcgagttcatcggttccgcca

SEQ ID NO: 564117 - DNA, 25 bp, Rattus norvegicus
tagttcgagttcttcggttccgcca

SEQ ID NO: 564118 - DNA, 25 bp, Rattus norvegicus
tagttcgatgccagcttggaccata

SEQ ID NO: 564119 - DNA, 25 bp, Rattus norvegicus
tagttcgatgcctgcttggaccata

SEQ ID NO: 564120 - DNA, 25 bp, Rattus norvegicus
tagttcgctaacagtattttaagat

SEQ ID NO: 564121 - DNA, 25 bp, Rattus norvegicus
tagttcgctaactgtattttaagat

SEQ ID NO: 564122 - DNA, 25 bp, Rattus norvegicus
tagttctacatacctcggaggccaa

SEQ ID NO: 564123 - DNA, 25 bp, Rattus norvegicus
tagttctacatagctcggaggccaa

SEQ ID NO: 564124 - DNA, 25 bp, Rattus norvegicus
tagttctagcgtcttctccatgtca

SEQ ID NO: 564125 - DNA, 25 bp, Rattus norvegicus
tagttctagcgtgttctccatgtca

SEQ ID NO: 564126 - DNA, 25 bp, Rattus norvegicus
tagttctaggctctgggagctgctc

SEQ ID NO: 564127 - DNA, 25 bp, Rattus norvegicus
tagttctaggctgtgggagctgctc

SEQ ID NO: 564128 - DNA, 25 bp, Rattus norvegicus
tagttctcacacagcggttcaaacc

SEQ ID NO: 564129 - DNA, 25 bp, Rattus norvegicus
tagttctcacactgcggttcaaacc

SEQ ID NO: 564130 - DNA, 25 bp, Rattus norvegicus
tagttctcagcactactcgcatgtc

SEQ ID NO: 564131 - DNA, 25 bp, Rattus norvegicus
tagttctcagcagtactcgcatgtc

SEQ ID NO: 564132 - DNA, 25 bp, Rattus norvegicus
tagttctcagcccttcgaatagagg

SEQ ID NO: 564133 - DNA, 25 bp, Rattus norvegicus
tagttctcagccgttcgaatagagg

SEQ ID NO: 564134 - DNA, 25 bp, Rattus norvegicus
tagttctcccggattcctggagctg

SEQ ID NO: 564135 - DNA, 25 bp, Rattus norvegicus
tagttctcccggtttcctggagctg

SEQ ID NO: 564136 - DNA, 25 bp, Rattus norvegicus
tagttctcctccaagatttctctga

SEQ ID NO: 564137 - DNA, 25 bp, Rattus norvegicus
tagttctcctcctagatttctctga

SEQ ID NO: 564138 - DNA, 25 bp, Rattus norvegicus
tagttctgaaaccaaccacccgaat

SEQ ID NO: 564139 - DNA, 25 bp, Rattus norvegicus
tagttctgaaacgaaccacccgaat

SEQ ID NO: 564140 - DNA, 25 bp, Rattus norvegicus
tagttctgaactctccttttataag

SEQ ID NO: 564141 - DNA, 25 bp, Rattus norvegicus
tagttctgaactgtccttttataag

SEQ ID NO: 564142 - DNA, 25 bp, Rattus norvegicus
tagttctgacagatttaaaagacaa

SEQ ID NO: 564143 - DNA, 25 bp, Rattus norvegicus
tagttctgacagttttaaaagacaa

SEQ ID NO: 564144 - DNA, 25 bp, Rattus norvegicus
tagttctgatttctcttccaccaag

SEQ ID NO: 564145 - DNA, 25 bp, Rattus norvegicus
tagttctgatttgtcttccaccaag

SEQ ID NO: 564146 - DNA, 25 bp, Rattus norvegicus
tagttctgcgagatctgcctggaga

SEQ ID NO: 564147 - DNA, 25 bp, Rattus norvegicus
tagttctgcgagttctgcctggaga

SEQ ID NO: 564148 - DNA, 25 bp, Rattus norvegicus
tagttctgggctacgtgaggtttca

SEQ ID NO: 564149 - DNA, 25 bp, Rattus norvegicus
tagttctgggcttcgtgaggtttca

SEQ ID NO: 564150 - DNA, 25 bp, Rattus norvegicus
tagttctggtacagagtggctcttt

SEQ ID NO: 564151 - DNA, 25 bp, Rattus norvegicus
tagttctggtactgagtggctcttt

SEQ ID NO: 564152 - DNA, 25 bp, Rattus norvegicus
tagttctgtctgaacgcgtccttga

SEQ ID NO: 564153 - DNA, 25 bp, Rattus norvegicus
tagttctgtctgtacgcgtccttga

SEQ ID NO: 564154 - DNA, 25 bp, Rattus norvegicus
tagttcttaaccattccagaccttc

SEQ ID NO: 564155 - DNA, 25 bp, Rattus norvegicus
tagttcttaacctttccagaccttc

SEQ ID NO: 564156 - DNA, 25 bp, Rattus norvegicus
tagttcttatgcatggaggcggctc

SEQ ID NO: 564157 - DNA, 25 bp, Rattus norvegicus
tagttcttatgcttggaggcggctc

SEQ ID NO: 564158 - DNA, 25 bp, Rattus norvegicus
tagttcttcacacttctttacctca

SEQ ID NO: 564159 - DNA, 25 bp, Rattus norvegicus
tagttcttcacagttctttacctca

SEQ ID NO: 564160 - DNA, 25 bp, Rattus norvegicus
tagttcttcttgaatggcgtctgta

SEQ ID NO: 564161 - DNA, 25 bp, Rattus norvegicus
tagttcttcttgtatggcgtctgta

SEQ ID NO: 564162 - DNA, 25 bp, Rattus norvegicus
tagttcttgctcctaggtcacgtga

SEQ ID NO: 564163 - DNA, 25 bp, Rattus norvegicus
tagttcttgctcgtaggtcacgtga

SEQ ID NO: 564164 - DNA, 25 bp, Rattus norvegicus
tagttctttcctcaagcacaaacct

SEQ ID NO: 564165 - DNA, 25 bp, Rattus norvegicus
tagttctttcctgaagcacaaacct

SEQ ID NO: 564166 - DNA, 25 bp, Rattus norvegicus
tagttcttttccacagcaccttggc

SEQ ID NO: 564167 - DNA, 25 bp, Rattus norvegicus
tagttcttttcctcagcaccttggc

SEQ ID NO: 564168 - DNA, 25 bp, Rattus norvegicus
tagttcttttctctttgccctggac

SEQ ID NO: 564169 - DNA, 25 bp, Rattus norvegicus
tagttcttttctgtttgccctggac

SEQ ID NO: 564170 - DNA, 25 bp, Rattus norvegicus
tagttcttttggctagtgtgtcccc

SEQ ID NO: 564171 - DNA, 25 bp, Rattus norvegicus
tagttcttttgggtagtgtgtcccc

SEQ ID NO: 564172 - DNA, 25 bp, Rattus norvegicus
tagttgaagctaacaaattcctgtc

SEQ ID NO: 564173 - DNA, 25 bp, Rattus norvegicus
tagttgaagctatcaaattcctgtc

SEQ ID NO: 564174 - DNA, 25 bp, Rattus norvegicus
tagttgaattcgagctgtcacagca

SEQ ID NO: 564175 - DNA, 25 bp, Rattus norvegicus
tagttgaattcgtgctgtcacagca

SEQ ID NO: 564176 - DNA, 25 bp, Rattus norvegicus
tagttgacacagaccttgggtaact

SEQ ID NO: 564177 - DNA, 25 bp, Rattus norvegicus
tagttgacacagtccttgggtaact

SEQ ID NO: 564178 - DNA, 25 bp, Rattus norvegicus
tagttgacagctaccgagcctgact

SEQ ID NO: 564179 - DNA, 25 bp, Rattus norvegicus
tagttgacagcttccgagcctgact

SEQ ID NO: 564180 - DNA, 25 bp, Rattus norvegicus
tagttgacggctctgtcttagttgg

SEQ ID NO: 564181 - DNA, 25 bp, Rattus norvegicus
tagttgacggctgtgtcttagttgg

SEQ ID NO: 564182 - DNA, 25 bp, Rattus norvegicus
tagttgagaggaaactccccagccc

SEQ ID NO: 564183 - DNA, 25 bp, Rattus norvegicus
tagttgagaggatactccccagccc

SEQ ID NO: 564184 - DNA, 25 bp, Rattus norvegicus
tagttgagcaccaccatcgtttata

SEQ ID NO: 564185 - DNA, 25 bp, Rattus norvegicus
tagttgagcacctccatcgtttata

SEQ ID NO: 564186 - DNA, 25 bp, Rattus norvegicus
tagttgaggatcatacggttcttag

SEQ ID NO: 564187 - DNA, 25 bp, Rattus norvegicus
tagttgaggatcttacggttcttag

SEQ ID NO: 564188 - DNA, 25 bp, Rattus norvegicus
tagttgagggaactcaccccaagcc

SEQ ID NO: 564189 - DNA, 25 bp, Rattus norvegicus
tagttgagggaagtcaccccaagcc

SEQ ID NO: 564190 - DNA, 25 bp, Rattus norvegicus
tagttgatggtcctacttgctttgg

SEQ ID NO: 564191 - DNA, 25 bp, Rattus norvegicus
tagttgatggtcgtacttgctttgg

SEQ ID NO: 564192 - DNA, 25 bp, Rattus norvegicus
tagttgatttcaattaaaggtttct

SEQ ID NO: 564193 - DNA, 25 bp, Rattus norvegicus
tagttgatttcatttaaaggtttct

SEQ ID NO: 564194 - DNA, 25 bp, Rattus norvegicus
tagttgcaagctctgagttttctca

SEQ ID NO: 564195 - DNA, 25 bp, Rattus norvegicus
tagttgcaagctgtgagttttctca

SEQ ID NO: 564196 - DNA, 25 bp, Rattus norvegicus
tagttgcagctgctttctccaaggc

SEQ ID NO: 564197 - DNA, 25 bp, Rattus norvegicus
tagttgcagctggtttctccaaggc

SEQ ID NO: 564198 - DNA, 25 bp, Rattus norvegicus
tagttgctaatacccgtctaaccta

SEQ ID NO: 564199 - DNA, 25 bp, Rattus norvegicus
tagttgctaatagccgtctaaccta

SEQ ID NO: 564200 - DNA, 25 bp, Rattus norvegicus
tagttgctagtaccgcacagcggct

SEQ ID NO: 564201 - DNA, 25 bp, Rattus norvegicus
tagttgctagtagcgcacagcggct

SEQ ID NO: 564202 - DNA, 25 bp, Rattus norvegicus
tagttgctcaggcagaggaagccac

SEQ ID NO: 564203 - DNA, 25 bp, Rattus norvegicus
tagttgctcagggagaggaagccac

SEQ ID NO: 564204 - DNA, 25 bp, Rattus norvegicus
tagttgctgcaaatgctactcccta

SEQ ID NO: 564205 - DNA, 25 bp, Rattus norvegicus
tagttgctgcaattgctactcccta

SEQ ID NO: 564206 - DNA, 25 bp, Rattus norvegicus
tagttgctgggtctctgctggtcca

SEQ ID NO: 564207 - DNA, 25 bp, Rattus norvegicus
tagttgctgggtgtctgctggtcca

SEQ ID NO: 564208 - DNA, 25 bp, Rattus norvegicus
tagttgcttagcacctgggtggaat

SEQ ID NO: 564209 - DNA, 25 bp, Rattus norvegicus
tagttgcttagctcctgggtggaat

SEQ ID NO: 564210 - DNA, 25 bp, Rattus norvegicus
tagttggaaaccagggctttctcag

SEQ ID NO: 564211 - DNA, 25 bp, Rattus norvegicus
tagttggaaacctgggctttctcag

SEQ ID NO: 564212 - DNA, 25 bp, Rattus norvegicus
tagttggatctcatagttccaggac

SEQ ID NO: 564213 - DNA, 25 bp, Rattus norvegicus
tagttggatctcttagttccaggac

SEQ ID NO: 564214 - DNA, 25 bp, Rattus norvegicus
tagttggcctgtccctgaagctgag

SEQ ID NO: 564215 - DNA, 25 bp, Rattus norvegicus
tagttggcctgtgcctgaagctgag

SEQ ID NO: 564216 - DNA, 25 bp, Rattus norvegicus
tagttggccttgaggcttagtcctc

SEQ ID NO: 564217 - DNA, 25 bp, Rattus norvegicus
tagttggccttgtggcttagtcctc

SEQ ID NO: 564218 - DNA, 25 bp, Rattus norvegicus
tagttggctcttagcagcatcaagc

SEQ ID NO: 564219 - DNA, 25 bp, Rattus norvegicus
tagttggctctttgcagcatcaagc

SEQ ID NO: 564220 - DNA, 25 bp, Rattus norvegicus
tagttggctgtgcatggtacaaatt

SEQ ID NO: 564221 - DNA, 25 bp, Rattus norvegicus
tagttggctgtggatggtacaaatt

SEQ ID NO: 564222 - DNA, 25 bp, Rattus norvegicus
tagttgggatccaccactgggcgac

SEQ ID NO: 564223 - DNA, 25 bp, Rattus norvegicus
tagttgggatcctccactgggcgac

SEQ ID NO: 564224 - DNA, 25 bp, Rattus norvegicus
tagttgggcccaatcagatttttca

SEQ ID NO: 564225 - DNA, 25 bp, Rattus norvegicus
tagttgggcccattcagatttttca

SEQ ID NO: 564226 - DNA, 25 bp, Rattus norvegicus
tagttggggtagacccaccttcaga

SEQ ID NO: 564227 - DNA, 25 bp, Rattus norvegicus
tagttggggtagtcccaccttcaga

SEQ ID NO: 564228 - DNA, 25 bp, Rattus norvegicus
tagttggtatgcatacttttcctcc

SEQ ID NO: 564229 - DNA, 25 bp, Rattus norvegicus
tagttggtatgcttacttttcctcc

SEQ ID NO: 564230 - DNA, 25 bp, Rattus norvegicus
tagttggtccaaagcaggcagcact

SEQ ID NO: 564231 - DNA, 25 bp, Rattus norvegicus
tagttggtccaatgcaggcagcact

SEQ ID NO: 564232 - DNA, 25 bp, Rattus norvegicus
tagttggtctgtcggtttcttaggc

SEQ ID NO: 564233 - DNA, 25 bp, Rattus norvegicus
tagttggtctgtgggtttcttaggc

SEQ ID NO: 564234 - DNA, 25 bp, Rattus norvegicus
tagttggtgatcaacttgcaaacac

SEQ ID NO: 564235 - DNA, 25 bp, Rattus norvegicus
tagttggtgatctacttgcaaacac

SEQ ID NO: 564236 - DNA, 25 bp, Rattus norvegicus
tagttggtggccaggtcctgaaaaa

SEQ ID NO: 564237 - DNA, 25 bp, Rattus norvegicus
tagttggtggcctggtcctgaaaaa

SEQ ID NO: 564238 - DNA, 25 bp, Rattus norvegicus
tagttggttccaattcctgacctag

SEQ ID NO: 564239 - DNA, 25 bp, Rattus norvegicus
tagttggttccatttcctgacctag

SEQ ID NO: 564240 - DNA, 25 bp, Rattus norvegicus
tagttggttcccatagttttcaata

SEQ ID NO: 564241 - DNA, 25 bp, Rattus norvegicus
tagttggttcccttagttttcaata

SEQ ID NO: 564242 - DNA, 25 bp, Rattus norvegicus
tagttggtttcccaacttcattggg

SEQ ID NO: 564243 - DNA, 25 bp, Rattus norvegicus
tagttggtttccgaacttcattggg

SEQ ID NO: 564244 - DNA, 25 bp, Rattus norvegicus
tagttgtaaatccaacctcgtcgcc

SEQ ID NO: 564245 - DNA, 25 bp, Rattus norvegicus
tagttgtaaatcgaacctcgtcgcc

SEQ ID NO: 564246 - DNA, 25 bp, Rattus norvegicus
tagttgtatcccaccataagccatt

SEQ ID NO: 564247 - DNA, 25 bp, Rattus norvegicus
tagttgtatccctccataagccatt

SEQ ID NO: 564248 - DNA, 25 bp, Rattus norvegicus
tagttgtcatttcagacctttctcc

SEQ ID NO: 564249 - DNA, 25 bp, Rattus norvegicus
tagttgtcatttgagacctttctcc

SEQ ID NO: 564250 - DNA, 25 bp, Rattus norvegicus
tagttgtcctctcatctttgtgatg

SEQ ID NO: 564251 - DNA, 25 bp, Rattus norvegicus
tagttgtcctctgatctttgtgatg

SEQ ID NO: 564252 - DNA, 25 bp, Rattus norvegicus
tagttgtcgtgaaccatcttgtgtc

SEQ ID NO: 564253 - DNA, 25 bp, Rattus norvegicus
tagttgtcgtgatccatcttgtgtc

SEQ ID NO: 564254 - DNA, 25 bp, Rattus norvegicus
tagttgtctggtaaactcggttcct

SEQ ID NO: 564255 - DNA, 25 bp, Rattus norvegicus
tagttgtctggttaactcggttcct

SEQ ID NO: 564256 - DNA, 25 bp, Rattus norvegicus
tagttgtctgttatgtgagcccttt

SEQ ID NO: 564257 - DNA, 25 bp, Rattus norvegicus
tagttgtctgttttgtgagcccttt

SEQ ID NO: 564258 - DNA, 25 bp, Rattus norvegicus
tagttgtgccacagccaggaagtgt

SEQ ID NO: 564259 - DNA, 25 bp, Rattus norvegicus
tagttgtgccactgccaggaagtgt

SEQ ID NO: 564260 - DNA, 25 bp, Rattus norvegicus
tagttgtggacacccctttgcttga

SEQ ID NO: 564261 - DNA, 25 bp, Rattus norvegicus
tagttgtggacagccctttgcttga

SEQ ID NO: 564262 - DNA, 25 bp, Rattus norvegicus
tagttgttaagcactgcagtagctt

SEQ ID NO: 564263 - DNA, 25 bp, Rattus norvegicus
tagttgttaagctctgcagtagctt

SEQ ID NO: 564264 - DNA, 25 bp, Rattus norvegicus
tagttgttatggctgacccctacga

SEQ ID NO: 564265 - DNA, 25 bp, Rattus norvegicus
tagttgttatgggtgacccctacga

SEQ ID NO: 564266 - DNA, 25 bp, Rattus norvegicus
tagttgttccggcagtctcaggttc

SEQ ID NO: 564267 - DNA, 25 bp, Rattus norvegicus
tagttgttccgggagtctcaggttc

SEQ ID NO: 564268 - DNA, 25 bp, Rattus norvegicus
tagttgtttcttacattggcacggg

SEQ ID NO: 564269 - DNA, 25 bp, Rattus norvegicus
tagttgtttctttcattggcacggg

SEQ ID NO: 564270 - DNA, 25 bp, Rattus norvegicus
tagttgtttttaaagctttctccct

SEQ ID NO: 564271 - DNA, 25 bp, Rattus norvegicus
tagttgtttttatagctttctccct

SEQ ID NO: 564272 - DNA, 25 bp, Rattus norvegicus
tagttgtttttcaacctttttgcat

SEQ ID NO: 564273 - DNA, 25 bp, Rattus norvegicus
tagttgtttttctacctttttgcat

SEQ ID NO: 564274 - DNA, 25 bp, Rattus norvegicus
tagtttaaacagacggcagctggga

SEQ ID NO: 564275 - DNA, 25 bp, Rattus norvegicus
tagtttaaacagtcggcagctggga

SEQ ID NO: 564276 - DNA, 25 bp, Rattus norvegicus
tagtttaaagcgcttgtaccccaag

SEQ ID NO: 564277 - DNA, 25 bp, Rattus norvegicus
tagtttaaagcggttgtaccccaag

SEQ ID NO: 564278 - DNA, 25 bp, Rattus norvegicus
tagtttacaagccatacttccactt

SEQ ID NO: 564279 - DNA, 25 bp, Rattus norvegicus
tagtttacaagcgatacttccactt

SEQ ID NO: 564280 - DNA, 25 bp, Rattus norvegicus
tagtttacacctagacattcagtct

SEQ ID NO: 564281 - DNA, 25 bp, Rattus norvegicus
tagtttacaccttgacattcagtct

SEQ ID NO: 564282 - DNA, 25 bp, Rattus norvegicus
tagtttacagagcaaccaggtgcca

SEQ ID NO: 564283 - DNA, 25 bp, Rattus norvegicus
tagtttacagaggaaccaggtgcca

SEQ ID NO: 564284 - DNA, 25 bp, Rattus norvegicus
tagtttacagcactgagctttcctg

SEQ ID NO: 564285 - DNA, 25 bp, Rattus norvegicus
tagtttacagcagtgagctttcctg

SEQ ID NO: 564286 - DNA, 25 bp, Rattus norvegicus
tagtttaccttacttgtcttatcaa

SEQ ID NO: 564287 - DNA, 25 bp, Rattus norvegicus
tagtttaccttagttgtcttatcaa

SEQ ID NO: 564288 - DNA, 25 bp, Rattus norvegicus
tagtttactaaacctcccataccag

SEQ ID NO: 564289 - DNA, 25 bp, Rattus norvegicus
tagtttactaaagctcccataccag

SEQ ID NO: 564290 - DNA, 25 bp, Rattus norvegicus
tagtttactttcagcttattttcca

SEQ ID NO: 564291 - DNA, 25 bp, Rattus norvegicus
tagtttactttctgcttattttcca

SEQ ID NO: 564292 - DNA, 25 bp, Rattus norvegicus
tagtttagcacaaatcgttcccctc

SEQ ID NO: 564293 - DNA, 25 bp, Rattus norvegicus
tagtttagcacatatcgttcccctc

SEQ ID NO: 564294 - DNA, 25 bp, Rattus norvegicus
tagtttagctcacaagccaacccat

SEQ ID NO: 564295 - DNA, 25 bp, Rattus norvegicus
tagtttagctcagaagccaacccat

SEQ ID NO: 564296 - DNA, 25 bp, Rattus norvegicus
tagtttaggcttagtctatccctct

SEQ ID NO: 564297 - DNA, 25 bp, Rattus norvegicus
tagtttaggctttgtctatccctct

SEQ ID NO: 564298 - DNA, 25 bp, Rattus norvegicus
tagtttagggatagccccagttcct

SEQ ID NO: 564299 - DNA, 25 bp, Rattus norvegicus
tagtttagggattgccccagttcct

SEQ ID NO: 564300 - DNA, 25 bp, Rattus norvegicus
tagtttagttaccaacacccatgcc

SEQ ID NO: 564301 - DNA, 25 bp, Rattus norvegicus
tagtttagttacctctgccacacag

SEQ ID NO: 564302 - DNA, 25 bp, Rattus norvegicus
tagtttagttacgaacacccatgcc

SEQ ID NO: 564303 - DNA, 25 bp, Rattus norvegicus
tagtttagttacgtctgccacacag

SEQ ID NO: 564304 - DNA, 25 bp, Rattus norvegicus
tagtttataggtacttcgccagtaa

SEQ ID NO: 564305 - DNA, 25 bp, Rattus norvegicus
tagtttataggttcttcgccagtaa

SEQ ID NO: 564306 - DNA, 25 bp, Rattus norvegicus
tagtttattaataaatggcttccta

SEQ ID NO: 564307 - DNA, 25 bp, Rattus norvegicus
tagtttattaattaatggcttccta

SEQ ID NO: 564308 - DNA, 25 bp, Rattus norvegicus
tagtttattcatccaggccctgttt

SEQ ID NO: 564309 - DNA, 25 bp, Rattus norvegicus
tagtttattcatgcaggccctgttt

SEQ ID NO: 564310 - DNA, 25 bp, Rattus norvegicus
tagtttattcctctagctttcctgt

SEQ ID NO: 564311 - DNA, 25 bp, Rattus norvegicus
tagtttattcctgtagctttcctgt

SEQ ID NO: 564312 - DNA, 25 bp, Rattus norvegicus
tagtttcaatggagtggtgccaaga

SEQ ID NO: 564313 - DNA, 25 bp, Rattus norvegicus
tagtttcaatggtgtggtgccaaga

SEQ ID NO: 564314 - DNA, 25 bp, Rattus norvegicus
tagtttcacccaaacccaaggctgg

SEQ ID NO: 564315 - DNA, 25 bp, Rattus norvegicus
tagtttcacccatacccaaggctgg

SEQ ID NO: 564316 - DNA, 25 bp, Rattus norvegicus
tagtttcaccgccaaaatgcacaga

SEQ ID NO: 564317 - DNA, 25 bp, Rattus norvegicus
tagtttcaccgcgaaaatgcacaga

SEQ ID NO: 564318 - DNA, 25 bp, Rattus norvegicus
tagtttcaggcaccaacctaagttt

SEQ ID NO: 564319 - DNA, 25 bp, Rattus norvegicus
tagtttcaggcagcaacctaagttt

SEQ ID NO: 564320 - DNA, 25 bp, Rattus norvegicus
tagtttcagtcccagccttgatggt

SEQ ID NO: 564321 - DNA, 25 bp, Rattus norvegicus
tagtttcagtccgagccttgatggt

SEQ ID NO: 564322 - DNA, 25 bp, Rattus norvegicus
tagtttcattttacttgtggtcatt

SEQ ID NO: 564323 - DNA, 25 bp, Rattus norvegicus
tagtttcatttttcttgtggtcatt

SEQ ID NO: 564324 - DNA, 25 bp, Rattus norvegicus
tagtttccaagacagcaagcctcac

SEQ ID NO: 564325 - DNA, 25 bp, Rattus norvegicus
tagtttccaagagagcaagcctcac

SEQ ID NO: 564326 - DNA, 25 bp, Rattus norvegicus
tagtttccactgaagtcactgtcgg

SEQ ID NO: 564327 - DNA, 25 bp, Rattus norvegicus
tagtttccactgtagtcactgtcgg

SEQ ID NO: 564328 - DNA, 25 bp, Rattus norvegicus
tagtttccaggcattgttttcgagg

SEQ ID NO: 564329 - DNA, 25 bp, Rattus norvegicus
tagtttccaggctttgttttcgagg

SEQ ID NO: 564330 - DNA, 25 bp, Rattus norvegicus
tagtttccagtgagtcttcccggtg

SEQ ID NO: 564331 - DNA, 25 bp, Rattus norvegicus
tagtttccagtgtgtcttcccggtg

SEQ ID NO: 564332 - DNA, 25 bp, Rattus norvegicus
tagtttcccatgaagatggttccgt

SEQ ID NO: 564333 - DNA, 25 bp, Rattus norvegicus
tagtttcccatgtagatggttccgt

SEQ ID NO: 564334 - DNA, 25 bp, Rattus norvegicus
tagtttccgactaagcaaagagccg

SEQ ID NO: 564335 - DNA, 25 bp, Rattus norvegicus
tagtttccgacttagcaaagagccg

SEQ ID NO: 564336 - DNA, 25 bp, Rattus norvegicus
tagtttcctgcaccccttaaaagaa

SEQ ID NO: 564337 - DNA, 25 bp, Rattus norvegicus
tagtttcctgcagcccttaaaagaa

SEQ ID NO: 564338 - DNA, 25 bp, Rattus norvegicus
tagtttcctgccctaagacctggag

SEQ ID NO: 564339 - DNA, 25 bp, Rattus norvegicus
tagtttcctgccgtaagacctggag

SEQ ID NO: 564340 - DNA, 25 bp, Rattus norvegicus
tagtttcctggtcaacttctttcta

SEQ ID NO: 564341 - DNA, 25 bp, Rattus norvegicus
tagtttcctggtcacttagagctga

SEQ ID NO: 564342 - DNA, 25 bp, Rattus norvegicus
tagtttcctggtgaacttctttcta

SEQ ID NO: 564343 - DNA, 25 bp, Rattus norvegicus
tagtttcctggtgacttagagctga

SEQ ID NO: 564344 - DNA, 25 bp, Rattus norvegicus
tagtttcctttgatttgacacaggg

SEQ ID NO: 564345 - DNA, 25 bp, Rattus norvegicus
tagtttcctttgttttgacacaggg

SEQ ID NO: 564346 - DNA, 25 bp, Rattus norvegicus
tagtttctaattcccagtttctgta

SEQ ID NO: 564347 - DNA, 25 bp, Rattus norvegicus
tagtttctaattgccagtttctgta

SEQ ID NO: 564348 - DNA, 25 bp, Rattus norvegicus
tagtttctacccctctactagagtt

SEQ ID NO: 564349 - DNA, 25 bp, Rattus norvegicus
tagtttctacccgtctactagagtt

SEQ ID NO: 564350 - DNA, 25 bp, Rattus norvegicus
tagtttctactccacacatagccag

SEQ ID NO: 564351 - DNA, 25 bp, Rattus norvegicus
tagtttctactcgacacatagccag

SEQ ID NO: 564352 - DNA, 25 bp, Rattus norvegicus
tagtttctcacgcttgtccttttgg

SEQ ID NO: 564353 - DNA, 25 bp, Rattus norvegicus
tagtttctcacggttgtccttttgg

SEQ ID NO: 564354 - DNA, 25 bp, Rattus norvegicus
tagtttctcatgaaacagtcctcaa

SEQ ID NO: 564355 - DNA, 25 bp, Rattus norvegicus
tagtttctcatgtaacagtcctcaa

SEQ ID NO: 564356 - DNA, 25 bp, Rattus norvegicus
tagtttctctccactgcactgttac

SEQ ID NO: 564357 - DNA, 25 bp, Rattus norvegicus
tagtttctctcctctgcactgttac

SEQ ID NO: 564358 - DNA, 25 bp, Rattus norvegicus
tagtttctctttccccagcttctac

SEQ ID NO: 564359 - DNA, 25 bp, Rattus norvegicus
tagtttctctttgcccagcttctac

SEQ ID NO: 564360 - DNA, 25 bp, Rattus norvegicus
tagtttctgggcagtcaggaccttg

SEQ ID NO: 564361 - DNA, 25 bp, Rattus norvegicus
tagtttctgggctgtcaggaccttg

SEQ ID NO: 564362 - DNA, 25 bp, Rattus norvegicus
tagtttctggtaattgcttctgcaa

SEQ ID NO: 564363 - DNA, 25 bp, Rattus norvegicus
tagtttctggtatttgcttctgcaa

SEQ ID NO: 564364 - DNA, 25 bp, Rattus norvegicus
tagtttcttaggatcaacttccatg

SEQ ID NO: 564365 - DNA, 25 bp, Rattus norvegicus
tagtttcttaggttcaacttccatg

SEQ ID NO: 564366 - DNA, 25 bp, Rattus norvegicus
tagtttcttcttcacatggcattac

SEQ ID NO: 564367 - DNA, 25 bp, Rattus norvegicus
tagtttcttcttgacatggcattac

SEQ ID NO: 564368 - DNA, 25 bp, Rattus norvegicus
tagtttgaaaggctccttgctctct

SEQ ID NO: 564369 - DNA, 25 bp, Rattus norvegicus
tagtttgaaagggtccttgctctct

SEQ ID NO: 564370 - DNA, 25 bp, Rattus norvegicus
tagtttgaagttattctccccagat

SEQ ID NO: 564371 - DNA, 25 bp, Rattus norvegicus
tagtttgaagtttttctccccagat

SEQ ID NO: 564372 - DNA, 25 bp, Rattus norvegicus
tagtttgagaacaacctggcctaca

SEQ ID NO: 564373 - DNA, 25 bp, Rattus norvegicus
tagtttgagaactacctggcctaca

SEQ ID NO: 564374 - DNA, 25 bp, Rattus norvegicus
tagtttgagtttcacctctgtctgc

SEQ ID NO: 564375 - DNA, 25 bp, Rattus norvegicus
tagtttgagtttgacctctgtctgc

SEQ ID NO: 564376 - DNA, 25 bp, Rattus norvegicus
tagtttgattcaagtccccagagca

SEQ ID NO: 564377 - DNA, 25 bp, Rattus norvegicus
tagtttgattcatgtccccagagca

SEQ ID NO: 564378 - DNA, 25 bp, Rattus norvegicus
tagtttgattccatgggccttgctc

SEQ ID NO: 564379 - DNA, 25 bp, Rattus norvegicus
tagtttgattccttgggccttgctc

SEQ ID NO: 564380 - DNA, 25 bp, Rattus norvegicus
tagtttgcattaccccaacagtagc

SEQ ID NO: 564381 - DNA, 25 bp, Rattus norvegicus
tagtttgcattagcccaacagtagc

SEQ ID NO: 564382 - DNA, 25 bp, Rattus norvegicus
tagtttgcctacagtttttcctcca

SEQ ID NO: 564383 - DNA, 25 bp, Rattus norvegicus
tagtttgcctactgtttttcctcca

SEQ ID NO: 564384 - DNA, 25 bp, Rattus norvegicus
tagtttggaggcagctgcacggaca

SEQ ID NO: 564385 - DNA, 25 bp, Rattus norvegicus
tagtttggaggctgctgcacggaca

SEQ ID NO: 564386 - DNA, 25 bp, Rattus norvegicus
tagtttgggcaacgcctggttccct

SEQ ID NO: 564387 - DNA, 25 bp, Rattus norvegicus
tagtttgggcaaggcctggttccct

SEQ ID NO: 564388 - DNA, 25 bp, Rattus norvegicus
tagtttggttaaccccttctgagtg

SEQ ID NO: 564389 - DNA, 25 bp, Rattus norvegicus
tagtttggttaagcccttctgagtg

SEQ ID NO: 564390 - DNA, 25 bp, Rattus norvegicus
tagtttgtcaatacaaggccttttt

SEQ ID NO: 564391 - DNA, 25 bp, Rattus norvegicus
tagtttgtcaattcaaggccttttt

SEQ ID NO: 564392 - DNA, 25 bp, Rattus norvegicus
tagtttgtcctgaagcacatcctgt

SEQ ID NO: 564393 - DNA, 25 bp, Rattus norvegicus
tagtttgtcctgtagcacatcctgt

SEQ ID NO: 564394 - DNA, 25 bp, Rattus norvegicus
tagtttgtgacaaatccctgctgca

SEQ ID NO: 564395 - DNA, 25 bp, Rattus norvegicus
tagtttgtgacatatccctgctgca

SEQ ID NO: 564396 - DNA, 25 bp, Rattus norvegicus
tagtttgtgaggcagcttaccccat

SEQ ID NO: 564397 - DNA, 25 bp, Rattus norvegicus
tagtttgtgagggagcttaccccat

SEQ ID NO: 564398 - DNA, 25 bp, Rattus norvegicus
tagtttgtggttccctcaaacccag

SEQ ID NO: 564399 - DNA, 25 bp, Rattus norvegicus
tagtttgtggttgcctcaaacccag

SEQ ID NO: 564400 - DNA, 25 bp, Rattus norvegicus
tagtttgttcgaatcacactctccg

SEQ ID NO: 564401 - DNA, 25 bp, Rattus norvegicus
tagtttgttcgattcacactctccg

SEQ ID NO: 564402 - DNA, 25 bp, Rattus norvegicus
tagttttaatcacgacctgggctgc

SEQ ID NO: 564403 - DNA, 25 bp, Rattus norvegicus
tagttttaatcaggacctgggctgc

SEQ ID NO: 564404 - DNA, 25 bp, Rattus norvegicus
tagttttaattccatgtcacataca

SEQ ID NO: 564405 - DNA, 25 bp, Rattus norvegicus
tagttttaattcgatgtcacataca

SEQ ID NO: 564406 - DNA, 25 bp, Rattus norvegicus
tagttttacaacagcaaccataatg

SEQ ID NO: 564407 - DNA, 25 bp, Rattus norvegicus
tagttttacaactgcaaccataatg

SEQ ID NO: 564408 - DNA, 25 bp, Rattus norvegicus
tagttttacagtctctcctccctga

SEQ ID NO: 564409 - DNA, 25 bp, Rattus norvegicus
tagttttacagtgtctcctccctga

SEQ ID NO: 564410 - DNA, 25 bp, Rattus norvegicus
tagttttacgatcttgttccacctc

SEQ ID NO: 564411 - DNA, 25 bp, Rattus norvegicus
tagttttacgatgttgttccacctc

SEQ ID NO: 564412 - DNA, 25 bp, Rattus norvegicus
tagttttcacataattccccttata

SEQ ID NO: 564413 - DNA, 25 bp, Rattus norvegicus
tagttttcacattattccccttata

SEQ ID NO: 564414 - DNA, 25 bp, Rattus norvegicus
tagttttccataatcgacaggtaaa

SEQ ID NO: 564415 - DNA, 25 bp, Rattus norvegicus
tagttttccatattcgacaggtaaa

SEQ ID NO: 564416 - DNA, 25 bp, Rattus norvegicus
tagttttccattactctgaggttca

SEQ ID NO: 564417 - DNA, 25 bp, Rattus norvegicus
tagttttccatttctctgaggttca

SEQ ID NO: 564418 - DNA, 25 bp, Rattus norvegicus
tagttttccctaacttttaagctgt

SEQ ID NO: 564419 - DNA, 25 bp, Rattus norvegicus
tagttttccctatcttttaagctgt

SEQ ID NO: 564420 - DNA, 25 bp, Rattus norvegicus
tagttttccctccaagtcaggtagt

SEQ ID NO: 564421 - DNA, 25 bp, Rattus norvegicus
tagttttccctcgaagtcaggtagt

SEQ ID NO: 564422 - DNA, 25 bp, Rattus norvegicus
tagttttcctctcgtttcttgtgta

SEQ ID NO: 564423 - DNA, 25 bp, Rattus norvegicus
tagttttcctctggtttcttgtgta

SEQ ID NO: 564424 - DNA, 25 bp, Rattus norvegicus
tagttttccttacctctacctacaa

SEQ ID NO: 564425 - DNA, 25 bp, Rattus norvegicus
tagttttccttagctctacctacaa

SEQ ID NO: 564426 - DNA, 25 bp, Rattus norvegicus
tagttttctatcacttttttcaagg

SEQ ID NO: 564427 - DNA, 25 bp, Rattus norvegicus
tagttttctatctcttttttcaagg

SEQ ID NO: 564428 - DNA, 25 bp, Rattus norvegicus
tagttttctatgaggcggcttcttc

SEQ ID NO: 564429 - DNA, 25 bp, Rattus norvegicus
tagttttctatgtggcggcttcttc

SEQ ID NO: 564430 - DNA, 25 bp, Rattus norvegicus
tagttttctccaaggatgtagacct

SEQ ID NO: 564431 - DNA, 25 bp, Rattus norvegicus
tagttttctccatggatgtagacct

SEQ ID NO: 564432 - DNA, 25 bp, Rattus norvegicus
tagttttctctacccaactgggaca

SEQ ID NO: 564433 - DNA, 25 bp, Rattus norvegicus
tagttttctctagccaactgggaca

SEQ ID NO: 564434 - DNA, 25 bp, Rattus norvegicus
tagttttctcttaacccaggattgg

SEQ ID NO: 564435 - DNA, 25 bp, Rattus norvegicus
tagttttctctttacccaggattgg

SEQ ID NO: 564436 - DNA, 25 bp, Rattus norvegicus
tagttttcttataaggtggcctatt

SEQ ID NO: 564437 - DNA, 25 bp, Rattus norvegicus
tagttttcttattaggtggcctatt

SEQ ID NO: 564438 - DNA, 25 bp, Rattus norvegicus
tagttttcttcccagtgcaaattcc

SEQ ID NO: 564439 - DNA, 25 bp, Rattus norvegicus
tagttttcttccgagtgcaaattcc

SEQ ID NO: 564440 - DNA, 25 bp, Rattus norvegicus
tagttttcttctaaccatccatgtt

SEQ ID NO: 564441 - DNA, 25 bp, Rattus norvegicus
tagttttcttcttaccatccatgtt

SEQ ID NO: 564442 - DNA, 25 bp, Rattus norvegicus
tagttttgaaacaccctcaggaagc

SEQ ID NO: 564443 - DNA, 25 bp, Rattus norvegicus
tagttttgaaactccctcaggaagc

SEQ ID NO: 564444 - DNA, 25 bp, Rattus norvegicus
tagttttgaataataataccctggt

SEQ ID NO: 564445 - DNA, 25 bp, Rattus norvegicus
tagttttgaatattaataccctggt

SEQ ID NO: 564446 - DNA, 25 bp, Rattus norvegicus
tagttttgacatcacaggtcccttc

SEQ ID NO: 564447 - DNA, 25 bp, Rattus norvegicus
tagttttgacatgacaggtcccttc

SEQ ID NO: 564448 - DNA, 25 bp, Rattus norvegicus
tagttttgaccgaaccattgagatg

SEQ ID NO: 564449 - DNA, 25 bp, Rattus norvegicus
tagttttgaccgtaccattgagatg

SEQ ID NO: 564450 - DNA, 25 bp, Rattus norvegicus
tagttttgacttattccgtccgatg

SEQ ID NO: 564451 - DNA, 25 bp, Rattus norvegicus
tagttttgactttttccgtccgatg

SEQ ID NO: 564452 - DNA, 25 bp, Rattus norvegicus
tagttttgaggtcacctcccagcat

SEQ ID NO: 564453 - DNA, 25 bp, Rattus norvegicus
tagttttgaggtgacctcccagcat

SEQ ID NO: 564454 - DNA, 25 bp, Rattus norvegicus
tagttttgatccacagtttctttga

SEQ ID NO: 564455 - DNA, 25 bp, Rattus norvegicus
tagttttgatcctcagtttctttga

SEQ ID NO: 564456 - DNA, 25 bp, Rattus norvegicus
tagttttggcaccaggagcacctgt

SEQ ID NO: 564457 - DNA, 25 bp, Rattus norvegicus
tagttttggcacgaggagcacctgt

SEQ ID NO: 564458 - DNA, 25 bp, Rattus norvegicus
tagttttggcccctctaatggtctc

SEQ ID NO: 564459 - DNA, 25 bp, Rattus norvegicus
tagttttggcccgtctaatggtctc

SEQ ID NO: 564460 - DNA, 25 bp, Rattus norvegicus
tagttttggtccataacctcatccg

SEQ ID NO: 564461 - DNA, 25 bp, Rattus norvegicus
tagttttggtccttaacctcatccg

SEQ ID NO: 564462 - DNA, 25 bp, Rattus norvegicus
tagttttgtagtctctgctccatca

SEQ ID NO: 564463 - DNA, 25 bp, Rattus norvegicus
tagttttgtagtgtctgctccatca

SEQ ID NO: 564464 - DNA, 25 bp, Rattus norvegicus
tagttttgtcccagaaattcccatg

SEQ ID NO: 564465 - DNA, 25 bp, Rattus norvegicus
tagttttgtccctgaaattcccatg

SEQ ID NO: 564466 - DNA, 25 bp, Rattus norvegicus
tagttttgtcttcgctaacagcctg

SEQ ID NO: 564467 - DNA, 25 bp, Rattus norvegicus
tagttttgtcttggctaacagcctg

SEQ ID NO: 564468 - DNA, 25 bp, Rattus norvegicus
tagttttgttagcatgactcggcat

SEQ ID NO: 564469 - DNA, 25 bp, Rattus norvegicus
tagttttgttaggatgactcggcat

SEQ ID NO: 564470 - DNA, 25 bp, Rattus norvegicus
tagttttgttgtcgcctcgtctgga

SEQ ID NO: 564471 - DNA, 25 bp, Rattus norvegicus
tagttttgttgtggcctcgtctgga

SEQ ID NO: 564472 - DNA, 25 bp, Rattus norvegicus
tagtttttcccaagagaccgtcaat

SEQ ID NO: 564473 - DNA, 25 bp, Rattus norvegicus
tagtttttcccatgagaccgtcaat

SEQ ID NO: 564474 - DNA, 25 bp, Rattus norvegicus
tagtttttcctactcgtcatgtatg

SEQ ID NO: 564475 - DNA, 25 bp, Rattus norvegicus
tagtttttcctagtcgtcatgtatg

SEQ ID NO: 564476 - DNA, 25 bp, Rattus norvegicus
tagtttttcttccttgccagtttga

SEQ ID NO: 564477 - DNA, 25 bp, Rattus norvegicus
tagtttttcttcgttgccagtttga

SEQ ID NO: 564478 - DNA, 25 bp, Rattus norvegicus
tagtttttgagcctgttcttacctt

SEQ ID NO: 564479 - DNA, 25 bp, Rattus norvegicus
tagtttttgagcgtgttcttacctt

SEQ ID NO: 564480 - DNA, 25 bp, Rattus norvegicus
tagtttttgcctaccacagtgtcta

SEQ ID NO: 564481 - DNA, 25 bp, Rattus norvegicus
tagtttttgccttccacagtgtcta

SEQ ID NO: 564482 - DNA, 25 bp, Rattus norvegicus
tagtttttgtcacttggatggatgt

SEQ ID NO: 564483 - DNA, 25 bp, Rattus norvegicus
tagtttttgtcagttggatggatgt

SEQ ID NO: 564484 - DNA, 25 bp, Rattus norvegicus
tagttttttcagcagtggccatccc

SEQ ID NO: 564485 - DNA, 25 bp, Rattus norvegicus
tagttttttcaggagtggccatccc

SEQ ID NO: 564486 - DNA, 25 bp, Rattus norvegicus
tataaaaactgcatttcctaccaaa

SEQ ID NO: 564487 - DNA, 25 bp, Rattus norvegicus
tataaaaactgcttttcctaccaaa

SEQ ID NO: 564488 - DNA, 25 bp, Rattus norvegicus
tataaaacacctatcagcacaattg

SEQ ID NO: 564489 - DNA, 25 bp, Rattus norvegicus
tataaaacacctttcagcacaattg

SEQ ID NO: 564490 - DNA, 25 bp, Rattus norvegicus
tataaaacgaccatctacagccacc

SEQ ID NO: 564491 - DNA, 25 bp, Rattus norvegicus
tataaaacgaccttctacagccacc

SEQ ID NO: 564492 - DNA, 25 bp, Rattus norvegicus
tataaaagccgtcgcgtggcgtcga

SEQ ID NO: 564493 - DNA, 25 bp, Rattus norvegicus
tataaaagccgtggcgtggcgtcga

SEQ ID NO: 564494 - DNA, 25 bp, Rattus norvegicus
tataaaatatatagctgctgtccag

SEQ ID NO: 564495 - DNA, 25 bp, Rattus norvegicus
tataaaatatattgctgctgtccag

SEQ ID NO: 564496 - DNA, 25 bp, Rattus norvegicus
tataaaatatccctcccggtacagt

SEQ ID NO: 564497 - DNA, 25 bp, Rattus norvegicus
tataaaatatccgtcccggtacagt

SEQ ID NO: 564498 - DNA, 25 bp, Rattus norvegicus
tataaaatcgcccagtgtccagtcc

SEQ ID NO: 564499 - DNA, 25 bp, Rattus norvegicus
tataaaatcgccgagtgtccagtcc

SEQ ID NO: 564500 - DNA, 25 bp, Rattus norvegicus
tataaaattccaaccttacctcttg

SEQ ID NO: 564501 - DNA, 25 bp, Rattus norvegicus
tataaaattccacctctcttgggcc

SEQ ID NO: 564502 - DNA, 25 bp, Rattus norvegicus
tataaaattccagctctcttgggcc

SEQ ID NO: 564503 - DNA, 25 bp, Rattus norvegicus
tataaaattccatccttacctcttg

SEQ ID NO: 564504 - DNA, 25 bp, Rattus norvegicus
tataaacaacctacccttctagacg

SEQ ID NO: 564505 - DNA, 25 bp, Rattus norvegicus
tataaacaaccttcccttctagacg

SEQ ID NO: 564506 - DNA, 25 bp, Rattus norvegicus
tataaacaccttctggtaccaaacg

SEQ ID NO: 564507 - DNA, 25 bp, Rattus norvegicus
tataaacaccttgtggtaccaaacg

SEQ ID NO: 564508 - DNA, 25 bp, Rattus norvegicus
tataaacactgcctgttgccgtgag

SEQ ID NO: 564509 - DNA, 25 bp, Rattus norvegicus
tataaacactgcgtgttgccgtgag

SEQ ID NO: 564510 - DNA, 25 bp, Rattus norvegicus
tataaacactgtaacctctcctctc

SEQ ID NO: 564511 - DNA, 25 bp, Rattus norvegicus
tataaacactgttacctctcctctc

SEQ ID NO: 564512 - DNA, 25 bp, Rattus norvegicus
tataaacatatccaagcccacatca

SEQ ID NO: 564513 - DNA, 25 bp, Rattus norvegicus
tataaacatatcgaagcccacatca

SEQ ID NO: 564514 - DNA, 25 bp, Rattus norvegicus
tataaacattcaaaaccccagagac

SEQ ID NO: 564515 - DNA, 25 bp, Rattus norvegicus
tataaacattcataaccccagagac

SEQ ID NO: 564516 - DNA, 25 bp, Rattus norvegicus
tataaaccaacaccttttaccattg

SEQ ID NO: 564517 - DNA, 25 bp, Rattus norvegicus
tataaaccaacagcttttaccattg

SEQ ID NO: 564518 - DNA, 25 bp, Rattus norvegicus
tataaaccatctcaggaggccaagt

SEQ ID NO: 564519 - DNA, 25 bp, Rattus norvegicus
tataaaccatctgaggaggccaagt

SEQ ID NO: 564520 - DNA, 25 bp, Rattus norvegicus
tataaaccctaacctcctagacctg

SEQ ID NO: 564521 - DNA, 25 bp, Rattus norvegicus
tataaaccctaagctcctagacctg

SEQ ID NO: 564522 - DNA, 25 bp, Rattus norvegicus
tataaacctagaagcctgaccactg

SEQ ID NO: 564523 - DNA, 25 bp, Rattus norvegicus
tataaacctagatgcctgaccactg

SEQ ID NO: 564524 - DNA, 25 bp, Rattus norvegicus
tataaacctcatacttcttgccatc

SEQ ID NO: 564525 - DNA, 25 bp, Rattus norvegicus
tataaacctcattcttcttgccatc

SEQ ID NO: 564526 - DNA, 25 bp, Rattus norvegicus
tataaacgacctacagttgaactct

SEQ ID NO: 564527 - DNA, 25 bp, Rattus norvegicus
tataaacgaccttcagttgaactct

SEQ ID NO: 564528 - DNA, 25 bp, Rattus norvegicus
tataaacgccagcttctcaattgcc

SEQ ID NO: 564529 - DNA, 25 bp, Rattus norvegicus
tataaacgccaggttctcaattgcc

SEQ ID NO: 564530 - DNA, 25 bp, Rattus norvegicus
tataaacgctcaaagctggcctcca

SEQ ID NO: 564531 - DNA, 25 bp, Rattus norvegicus
tataaacgctcatagctggcctcca

SEQ ID NO: 564532 - DNA, 25 bp, Rattus norvegicus
tataaacgcttcagttagctccctc

SEQ ID NO: 564533 - DNA, 25 bp, Rattus norvegicus
tataaacgcttctgttagctccctc

SEQ ID NO: 564534 - DNA, 25 bp, Rattus norvegicus
tataaacgtaggctcttgggtcccg

SEQ ID NO: 564535 - DNA, 25 bp, Rattus norvegicus
tataaacgtagggtcttgggtcccg

SEQ ID NO: 564536 - DNA, 25 bp, Rattus norvegicus
tataaactacccatcgcaactattg

SEQ ID NO: 564537 - DNA, 25 bp, Rattus norvegicus
tataaactacccttcgcaactattg

SEQ ID NO: 564538 - DNA, 25 bp, Rattus norvegicus
tataaactacctaaccagctagcca

SEQ ID NO: 564539 - DNA, 25 bp, Rattus norvegicus
tataaactaccttaccagctagcca

SEQ ID NO: 564540 - DNA, 25 bp, Rattus norvegicus
tataaactagtcactctcagtcctg

SEQ ID NO: 564541 - DNA, 25 bp, Rattus norvegicus
tataaactagtctctctcagtcctg

SEQ ID NO: 564542 - DNA, 25 bp, Rattus norvegicus
tataaactatccagaggtcctctca

SEQ ID NO: 564543 - DNA, 25 bp, Rattus norvegicus
tataaactatcctgaggtcctctca

SEQ ID NO: 564544 - DNA, 25 bp, Rattus norvegicus
tataaactcagtcgccagcttgccg

SEQ ID NO: 564545 - DNA, 25 bp, Rattus norvegicus
tataaactcagtggccagcttgccg

SEQ ID NO: 564546 - DNA, 25 bp, Rattus norvegicus
tataaactctctaggaacagcgtcc

SEQ ID NO: 564547 - DNA, 25 bp, Rattus norvegicus
tataaactctcttggaacagcgtcc

SEQ ID NO: 564548 - DNA, 25 bp, Rattus norvegicus
tataaacttagtccactgtccagtt

SEQ ID NO: 564549 - DNA, 25 bp, Rattus norvegicus
tataaacttagtgcactgtccagtt

SEQ ID NO: 564550 - DNA, 25 bp, Rattus norvegicus
tataaagaaagactctccctccctc

SEQ ID NO: 564551 - DNA, 25 bp, Rattus norvegicus
tataaagaaagagtctccctccctc

SEQ ID NO: 564552 - DNA, 25 bp, Rattus norvegicus
tataaagatcttcccttgggctgga

SEQ ID NO: 564553 - DNA, 25 bp, Rattus norvegicus
tataaagatcttgccttgggctgga

SEQ ID NO: 564554 - DNA, 25 bp, Rattus norvegicus
tataaagcagaaagcctgtccttct

SEQ ID NO: 564555 - DNA, 25 bp, Rattus norvegicus
tataaagcagaatgcctgtccttct

SEQ ID NO: 564556 - DNA, 25 bp, Rattus norvegicus
tataaagccatgcagctcaggtctg

SEQ ID NO: 564557 - DNA, 25 bp, Rattus norvegicus
tataaagccatggagctcaggtctg

SEQ ID NO: 564558 - DNA, 25 bp, Rattus norvegicus
tataaagccggcaccagtgcccagg

SEQ ID NO: 564559 - DNA, 25 bp, Rattus norvegicus
tataaagccggctccagtgcccagg

SEQ ID NO: 564560 - DNA, 25 bp, Rattus norvegicus
tataaagctaaactccttcctgtcc

SEQ ID NO: 564561 - DNA, 25 bp, Rattus norvegicus
tataaagctaaagtccttcctgtcc

SEQ ID NO: 564562 - DNA, 25 bp, Rattus norvegicus
tataaagctagccatgtccgcagtc

SEQ ID NO: 564563 - DNA, 25 bp, Rattus norvegicus
tataaagctagcgatgtccgcagtc

SEQ ID NO: 564564 - DNA, 25 bp, Rattus norvegicus
tataaagctccacgaccgtggtctt

SEQ ID NO: 564565 - DNA, 25 bp, Rattus norvegicus
tataaagctccaggaccgtggtctt

SEQ ID NO: 564566 - DNA, 25 bp, Rattus norvegicus
tataaaggcagaagctcccaccgtc

SEQ ID NO: 564567 - DNA, 25 bp, Rattus norvegicus
tataaaggcagatgctcccaccgtc

SEQ ID NO: 564568 - DNA, 25 bp, Rattus norvegicus
tataaaggccatacggacccagtgc

SEQ ID NO: 564569 - DNA, 25 bp, Rattus norvegicus
tataaaggccattcggacccagtgc

SEQ ID NO: 564570 - DNA, 25 bp, Rattus norvegicus
tataaaggcttactccccaaacctg

SEQ ID NO: 564571 - DNA, 25 bp, Rattus norvegicus
tataaaggcttagtccccaaacctg

SEQ ID NO: 564572 - DNA, 25 bp, Rattus norvegicus
tataaagtcacaatcggttcctctg

SEQ ID NO: 564573 - DNA, 25 bp, Rattus norvegicus
tataaagtcacattcggttcctctg

SEQ ID NO: 564574 - DNA, 25 bp, Rattus norvegicus
tataaagtcttccactgtacacaga

SEQ ID NO: 564575 - DNA, 25 bp, Rattus norvegicus
tataaagtcttcgactgtacacaga

SEQ ID NO: 564576 - DNA, 25 bp, Rattus norvegicus
tataaagtttagactggtgtgacga

SEQ ID NO: 564577 - DNA, 25 bp, Rattus norvegicus
tataaagtttagtctggtgtgacga

SEQ ID NO: 564578 - DNA, 25 bp, Rattus norvegicus
tataaataagccatcgccatgtccc

SEQ ID NO: 564579 - DNA, 25 bp, Rattus norvegicus
tataaataagccttcgccatgtccc

SEQ ID NO: 564580 - DNA, 25 bp, Rattus norvegicus
tataaatacacaaacctgcagcttt

SEQ ID NO: 564581 - DNA, 25 bp, Rattus norvegicus
tataaatacacatacctgcagcttt

SEQ ID NO: 564582 - DNA, 25 bp, Rattus norvegicus
tataaatatcacacgcgaccacctt

SEQ ID NO: 564583 - DNA, 25 bp, Rattus norvegicus
tataaatatcactcgcgaccacctt

SEQ ID NO: 564584 - DNA, 25 bp, Rattus norvegicus
tataaatcccgtccacacgtgtgca

SEQ ID NO: 564585 - DNA, 25 bp, Rattus norvegicus
tataaatcccgtgcacacgtgtgca

SEQ ID NO: 564586 - DNA, 25 bp, Rattus norvegicus
tataaatccctgaatgaaagcatga

SEQ ID NO: 564587 - DNA, 25 bp, Rattus norvegicus
tataaatccctgtatgaaagcatga

SEQ ID NO: 564588 - DNA, 25 bp, Rattus norvegicus
tataaatccgcaatccgtctaatct

SEQ ID NO: 564589 - DNA, 25 bp, Rattus norvegicus
tataaatccgcattccgtctaatct

SEQ ID NO: 564590 - DNA, 25 bp, Rattus norvegicus
tataaatcctgacttttttctcttg

SEQ ID NO: 564591 - DNA, 25 bp, Rattus norvegicus
tataaatcctgagttttttctcttg

SEQ ID NO: 564592 - DNA, 25 bp, Rattus norvegicus
tataaatctccgcttgatctgcgcc

SEQ ID NO: 564593 - DNA, 25 bp, Rattus norvegicus
tataaatctccggttgatctgcgcc

SEQ ID NO: 564594 - DNA, 25 bp, Rattus norvegicus
tataaatctttgacccaccaggcat

SEQ ID NO: 564595 - DNA, 25 bp, Rattus norvegicus
tataaatctttgtcccaccaggcat

SEQ ID NO: 564596 - DNA, 25 bp, Rattus norvegicus
tataaatgccctatttcctttcctg

SEQ ID NO: 564597 - DNA, 25 bp, Rattus norvegicus
tataaatgccctttttcctttcctg

SEQ ID NO: 564598 - DNA, 25 bp, Rattus norvegicus
tataaatggcctacacagtcttagc

SEQ ID NO: 564599 - DNA, 25 bp, Rattus norvegicus
tataaatggccttcacagtcttagc

SEQ ID NO: 564600 - DNA, 25 bp, Rattus norvegicus
tataaatggcggatctttgtaccct

SEQ ID NO: 564601 - DNA, 25 bp, Rattus norvegicus
tataaatggcggttctttgtaccct

SEQ ID NO: 564602 - DNA, 25 bp, Rattus norvegicus
tataaatgggagcttgtcccgggcc

SEQ ID NO: 564603 - DNA, 25 bp, Rattus norvegicus
tataaatgggaggttgtcccgggcc

SEQ ID NO: 564604 - DNA, 25 bp, Rattus norvegicus
tataaatgtgccatacttcagtctc

SEQ ID NO: 564605 - DNA, 25 bp, Rattus norvegicus
tataaatgtgccttacttcagtctc

SEQ ID NO: 564606 - DNA, 25 bp, Rattus norvegicus
tataaatgtgcgactgacctccgat

SEQ ID NO: 564607 - DNA, 25 bp, Rattus norvegicus
tataaatgtgcgtctgacctccgat

SEQ ID NO: 564608 - DNA, 25 bp, Rattus norvegicus
tataaatgttccagccttcataatc

SEQ ID NO: 564609 - DNA, 25 bp, Rattus norvegicus
tataaatgttcctgccttcataatc

SEQ ID NO: 564610 - DNA, 25 bp, Rattus norvegicus
tataaattcatcattctcctaccct

SEQ ID NO: 564611 - DNA, 25 bp, Rattus norvegicus
tataaattcatctttctcctaccct

SEQ ID NO: 564612 - DNA, 25 bp, Rattus norvegicus
tataacaacattcggtgcctgcgca

SEQ ID NO: 564613 - DNA, 25 bp, Rattus norvegicus
tataacaacattgggtgcctgcgca

SEQ ID NO: 564614 - DNA, 25 bp, Rattus norvegicus
tataacaactttcggacaaggcttg

SEQ ID NO: 564615 - DNA, 25 bp, Rattus norvegicus
tataacaactttgggacaaggcttg

SEQ ID NO: 564616 - DNA, 25 bp, Rattus norvegicus
tataacaagagcagccccggaaagg

SEQ ID NO: 564617 - DNA, 25 bp, Rattus norvegicus
tataacaagagctgccccggaaagg

SEQ ID NO: 564618 - DNA, 25 bp, Rattus norvegicus
tataacacctttcccgccggattca

SEQ ID NO: 564619 - DNA, 25 bp, Rattus norvegicus
tataacacctttgccgccggattca

SEQ ID NO: 564620 - DNA, 25 bp, Rattus norvegicus
tataacactattcatggccccactg

SEQ ID NO: 564621 - DNA, 25 bp, Rattus norvegicus
tataacactattgatggccccactg

SEQ ID NO: 564622 - DNA, 25 bp, Rattus norvegicus
tataacagacccaccttctagcttc

SEQ ID NO: 564623 - DNA, 25 bp, Rattus norvegicus
tataacagaccctccttctagcttc

SEQ ID NO: 564624 - DNA, 25 bp, Rattus norvegicus
tataacatcctgctctttggcttga

SEQ ID NO: 564625 - DNA, 25 bp, Rattus norvegicus
tataacatcctggtctttggcttga

SEQ ID NO: 564626 - DNA, 25 bp, Rattus norvegicus
tataacatgtgtccgcccttaggta

SEQ ID NO: 564627 - DNA, 25 bp, Rattus norvegicus
tataacatgtgtgcgcccttaggta

SEQ ID NO: 564628 - DNA, 25 bp, Rattus norvegicus
tataaccaatgcatctgtgtctctg

SEQ ID NO: 564629 - DNA, 25 bp, Rattus norvegicus
tataaccaatgcttctgtgtctctg

SEQ ID NO: 564630 - DNA, 25 bp, Rattus norvegicus
tataaccatgccaagagtgcctgtc

SEQ ID NO: 564631 - DNA, 25 bp, Rattus norvegicus
tataaccatgcctagagtgcctgtc

SEQ ID NO: 564632 - DNA, 25 bp, Rattus norvegicus
tataacccacctatgactaactcta

SEQ ID NO: 564633 - DNA, 25 bp, Rattus norvegicus
tataacccacctttgactaactcta

SEQ ID NO: 564634 - DNA, 25 bp, Rattus norvegicus
tataacccacgcacttacaaagcaa

SEQ ID NO: 564635 - DNA, 25 bp, Rattus norvegicus
tataacccacgctcttacaaagcaa

SEQ ID NO: 564636 - DNA, 25 bp, Rattus norvegicus
tataacccactgaggttggcattta

SEQ ID NO: 564637 - DNA, 25 bp, Rattus norvegicus
tataacccactgtggttggcattta

SEQ ID NO: 564638 - DNA, 25 bp, Rattus norvegicus
tataacccctgtctgatgtacttca

SEQ ID NO: 564639 - DNA, 25 bp, Rattus norvegicus
tataacccctgtgtgatgtacttca

SEQ ID NO: 564640 - DNA, 25 bp, Rattus norvegicus
tataaccctgatcttcttgagtcct

SEQ ID NO: 564641 - DNA, 25 bp, Rattus norvegicus
tataaccctgatgttcttgagtcct

SEQ ID NO: 564642 - DNA, 25 bp, Rattus norvegicus
tataaccctttgactgctgcggcaa

SEQ ID NO: 564643 - DNA, 25 bp, Rattus norvegicus
tataaccctttgtctgctgcggcaa

SEQ ID NO: 564644 - DNA, 25 bp, Rattus norvegicus
tataacctaacaccatcacttgcag

SEQ ID NO: 564645 - DNA, 25 bp, Rattus norvegicus
tataacctaacagcatcacttgcag

SEQ ID NO: 564646 - DNA, 25 bp, Rattus norvegicus
tataacctgggtcggcttttggaga

SEQ ID NO: 564647 - DNA, 25 bp, Rattus norvegicus
tataacctgggtgggcttttggaga

SEQ ID NO: 564648 - DNA, 25 bp, Rattus norvegicus
tataacgacctgactcagtaccctg

SEQ ID NO: 564649 - DNA, 25 bp, Rattus norvegicus
tataacgacctgtctcagtaccctg

SEQ ID NO: 564650 - DNA, 25 bp, Rattus norvegicus
tataacggacacacttttacctttg

SEQ ID NO: 564651 - DNA, 25 bp, Rattus norvegicus
tataacggacactcttttacctttg

SEQ ID NO: 564652 - DNA, 25 bp, Rattus norvegicus
tataacgggtgtccagccatagcga

SEQ ID NO: 564653 - DNA, 25 bp, Rattus norvegicus
tataacgggtgtgcagccatagcga

SEQ ID NO: 564654 - DNA, 25 bp, Rattus norvegicus
tataacgtgatactcttcattttca

SEQ ID NO: 564655 - DNA, 25 bp, Rattus norvegicus
tataacgtgatagtcttcattttca

SEQ ID NO: 564656 - DNA, 25 bp, Rattus norvegicus
tataacgttttgagcagtattctgt

SEQ ID NO: 564657 - DNA, 25 bp, Rattus norvegicus
tataacgttttgatctggtctacaa

SEQ ID NO: 564658 - DNA, 25 bp, Rattus norvegicus
tataacgttttgtgcagtattctgt

SEQ ID NO: 564659 - DNA, 25 bp, Rattus norvegicus
tataacgttttgttctggtctacaa

SEQ ID NO: 564660 - DNA, 25 bp, Rattus norvegicus
tataactagtgcacgggatctcagg

SEQ ID NO: 564661 - DNA, 25 bp, Rattus norvegicus
tataactagtgctcgggatctcagg

SEQ ID NO: 564662 - DNA, 25 bp, Rattus norvegicus
tataactatggcatcgtggtggaga

SEQ ID NO: 564663 - DNA, 25 bp, Rattus norvegicus
tataactatggcttcgtggtggaga

SEQ ID NO: 564664 - DNA, 25 bp, Rattus norvegicus
tataactcactaacctagtttccta

SEQ ID NO: 564665 - DNA, 25 bp, Rattus norvegicus
tataactcactatcctagtttccta

SEQ ID NO: 564666 - DNA, 25 bp, Rattus norvegicus
tataactccgtgaatgccatatgct

SEQ ID NO: 564667 - DNA, 25 bp, Rattus norvegicus
tataactccgtgtatgccatatgct

SEQ ID NO: 564668 - DNA, 25 bp, Rattus norvegicus
tataactcgaaaacctcccggaggg

SEQ ID NO: 564669 - DNA, 25 bp, Rattus norvegicus
tataactcgaaatcctcccggaggg

SEQ ID NO: 564670 - DNA, 25 bp, Rattus norvegicus
tataactgcaagacactctagctcc

SEQ ID NO: 564671 - DNA, 25 bp, Rattus norvegicus
tataactgcaagtcactctagctcc

SEQ ID NO: 564672 - DNA, 25 bp, Rattus norvegicus
tataactgtgttctataggctcaga

SEQ ID NO: 564673 - DNA, 25 bp, Rattus norvegicus
tataactgtgttgtataggctcaga

SEQ ID NO: 564674 - DNA, 25 bp, Rattus norvegicus
tataacttatatctgcctgtgcttg

SEQ ID NO: 564675 - DNA, 25 bp, Rattus norvegicus
tataacttatatgtgcctgtgcttg

SEQ ID NO: 564676 - DNA, 25 bp, Rattus norvegicus
tataacttcaatcgccttggctagg

SEQ ID NO: 564677 - DNA, 25 bp, Rattus norvegicus
tataacttcaatggccttggctagg

SEQ ID NO: 564678 - DNA, 25 bp, Rattus norvegicus
tataacttgacaccaaacacaccca

SEQ ID NO: 564679 - DNA, 25 bp, Rattus norvegicus
tataacttgacagcaaacacaccca

SEQ ID NO: 564680 - DNA, 25 bp, Rattus norvegicus
tataacttggctattcagcttaaaa

SEQ ID NO: 564681 - DNA, 25 bp, Rattus norvegicus
tataacttggcttttcagcttaaaa

SEQ ID NO: 564682 - DNA, 25 bp, Rattus norvegicus
tataactttgttatgacctctgaaa

SEQ ID NO: 564683 - DNA, 25 bp, Rattus norvegicus
tataactttgttttgacctctgaaa

SEQ ID NO: 564684 - DNA, 25 bp, Rattus norvegicus
tataacttttcccaaggtcctcaat

SEQ ID NO: 564685 - DNA, 25 bp, Rattus norvegicus
tataacttttccgaaggtcctcaat

SEQ ID NO: 564686 - DNA, 25 bp, Rattus norvegicus
tataagaatcatatatcctgctggg

SEQ ID NO: 564687 - DNA, 25 bp, Rattus norvegicus
tataagaatcatttatcctgctggg

SEQ ID NO: 564688 - DNA, 25 bp, Rattus norvegicus
tataagacacacctcttggcatgtc

SEQ ID NO: 564689 - DNA, 25 bp, Rattus norvegicus
tataagacacacgtcttggcatgtc

SEQ ID NO: 564690 - DNA, 25 bp, Rattus norvegicus
tataagacgagtctggccacccagt

SEQ ID NO: 564691 - DNA, 25 bp, Rattus norvegicus
tataagacgagtgtggccacccagt

SEQ ID NO: 564692 - DNA, 25 bp, Rattus norvegicus
tataagactagccaacacccaactc

SEQ ID NO: 564693 - DNA, 25 bp, Rattus norvegicus
tataagactagcgaacacccaactc

SEQ ID NO: 564694 - DNA, 25 bp, Rattus norvegicus
tataagagcctgagatccttctgca

SEQ ID NO: 564695 - DNA, 25 bp, Rattus norvegicus
tataagagcctgtgatccttctgca

SEQ ID NO: 564696 - DNA, 25 bp, Rattus norvegicus
tataagcacccgaagcaggtagccc

SEQ ID NO: 564697 - DNA, 25 bp, Rattus norvegicus
tataagcacccgtagcaggtagccc

SEQ ID NO: 564698 - DNA, 25 bp, Rattus norvegicus
tataagcagagtattcaggtttttt

SEQ ID NO: 564699 - DNA, 25 bp, Rattus norvegicus
tataagcagagttttcaggtttttt

SEQ ID NO: 564700 - DNA, 25 bp, Rattus norvegicus
tataagcatgttctcagccgtcatc

SEQ ID NO: 564701 - DNA, 25 bp, Rattus norvegicus
tataagcatgttgtcagccgtcatc

SEQ ID NO: 564702 - DNA, 25 bp, Rattus norvegicus
tataagccaaacactctgaaacccc

SEQ ID NO: 564703 - DNA, 25 bp, Rattus norvegicus
tataagccaaactctctgaaacccc

SEQ ID NO: 564704 - DNA, 25 bp, Rattus norvegicus
tataagccagagctgcaactccgga

SEQ ID NO: 564705 - DNA, 25 bp, Rattus norvegicus
tataagccagaggtgcaactccgga

SEQ ID NO: 564706 - DNA, 25 bp, Rattus norvegicus
tataagccagctccaggaacctact

SEQ ID NO: 564707 - DNA, 25 bp, Rattus norvegicus
tataagccagctgcaggaacctact

SEQ ID NO: 564708 - DNA, 25 bp, Rattus norvegicus
tataagcccaaaccagtgaccagtg

SEQ ID NO: 564709 - DNA, 25 bp, Rattus norvegicus
tataagcccaaagcagtgaccagtg

SEQ ID NO: 564710 - DNA, 25 bp, Rattus norvegicus
tataagcctgctacccagtgatgta

SEQ ID NO: 564711 - DNA, 25 bp, Rattus norvegicus
tataagcctgcttcccagtgatgta

SEQ ID NO: 564712 - DNA, 25 bp, Rattus norvegicus
tataagcctttgactctctcttcat

SEQ ID NO: 564713 - DNA, 25 bp, Rattus norvegicus
tataagcctttgtctctctcttcat

SEQ ID NO: 564714 - DNA, 25 bp, Rattus norvegicus
tataagcggctcatctgagattctc

SEQ ID NO: 564715 - DNA, 25 bp, Rattus norvegicus
tataagcggctcttctgagattctc

SEQ ID NO: 564716 - DNA, 25 bp, Rattus norvegicus
tataagctcactcctgtgaactgac

SEQ ID NO: 564717 - DNA, 25 bp, Rattus norvegicus
tataagctcactgctgtgaactgac

SEQ ID NO: 564718 - DNA, 25 bp, Rattus norvegicus
tataagctgaagagcaccaaagagg

SEQ ID NO: 564719 - DNA, 25 bp, Rattus norvegicus
tataagctgaagtgcaccaaagagg

SEQ ID NO: 564720 - DNA, 25 bp, Rattus norvegicus
tataagctgggcatgctgtgacgca

SEQ ID NO: 564721 - DNA, 25 bp, Rattus norvegicus
tataagctgggcttgctgtgacgca

SEQ ID NO: 564722 - DNA, 25 bp, Rattus norvegicus
tataagctttcgataggtggcgcac

SEQ ID NO: 564723 - DNA, 25 bp, Rattus norvegicus
tataagctttcgttaggtggcgcac

SEQ ID NO: 564724 - DNA, 25 bp, Rattus norvegicus
tataagctttttacttcgggctagc

SEQ ID NO: 564725 - DNA, 25 bp, Rattus norvegicus
tataagcttttttcttcgggctagc

SEQ ID NO: 564726 - DNA, 25 bp, Rattus norvegicus
tataaggaaaataccaaaccccatg

SEQ ID NO: 564727 - DNA, 25 bp, Rattus norvegicus
tataaggaaaattccaaaccccatg

SEQ ID NO: 564728 - DNA, 25 bp, Rattus norvegicus
tataaggaacttcattactccccgt

SEQ ID NO: 564729 - DNA, 25 bp, Rattus norvegicus
tataaggaacttgattactccccgt

SEQ ID NO: 564730 - DNA, 25 bp, Rattus norvegicus
tataaggaatgcagcctcggtggct

SEQ ID NO: 564731 - DNA, 25 bp, Rattus norvegicus
tataaggaatgctgcctcggtggct

SEQ ID NO: 564732 - DNA, 25 bp, Rattus norvegicus
tataaggagtcacactacggccaga

SEQ ID NO: 564733 - DNA, 25 bp, Rattus norvegicus
tataaggagtcagactacggccaga

SEQ ID NO: 564734 - DNA, 25 bp, Rattus norvegicus
tataaggcagtgagtcccagcgtag

SEQ ID NO: 564735 - DNA, 25 bp, Rattus norvegicus
tataaggcagtgtgtcccagcgtag

SEQ ID NO: 564736 - DNA, 25 bp, Rattus norvegicus
tataaggcatgactgtttccccggg

SEQ ID NO: 564737 - DNA, 25 bp, Rattus norvegicus
tataaggcatgagtgtttccccggg

SEQ ID NO: 564738 - DNA, 25 bp, Rattus norvegicus
tataaggcccagacctgttcaagat

SEQ ID NO: 564739 - DNA, 25 bp, Rattus norvegicus
tataaggcccagtcctgttcaagat

SEQ ID NO: 564740 - DNA, 25 bp, Rattus norvegicus
tataaggccgtgagtcatgctgcca

SEQ ID NO: 564741 - DNA, 25 bp, Rattus norvegicus
tataaggccgtgtgtcatgctgcca

SEQ ID NO: 564742 - DNA, 25 bp, Rattus norvegicus
tataagggtgctctgtgtatgcctg

SEQ ID NO: 564743 - DNA, 25 bp, Rattus norvegicus
tataagggtgctgtgtgtatgcctg

SEQ ID NO: 564744 - DNA, 25 bp, Rattus norvegicus
tataaggtgtacatcacaaccgccg

SEQ ID NO: 564745 - DNA, 25 bp, Rattus norvegicus
tataaggtgtacttcacaaccgccg

SEQ ID NO: 564746 - DNA, 25 bp, Rattus norvegicus
tataagtaccttctcacagccatga

SEQ ID NO: 564747 - DNA, 25 bp, Rattus norvegicus
tataagtaccttgtcacagccatga

SEQ ID NO: 564748 - DNA, 25 bp, Rattus norvegicus
tataagtatcttacctctgacccat

SEQ ID NO: 564749 - DNA, 25 bp, Rattus norvegicus
tataagtatctttcctctgacccat

SEQ ID NO: 564750 - DNA, 25 bp, Rattus norvegicus
tataagtcccatatataaacccact

SEQ ID NO: 564751 - DNA, 25 bp, Rattus norvegicus
tataagtcccatttataaacccact

SEQ ID NO: 564752 - DNA, 25 bp, Rattus norvegicus
tataagtcctttagcctttggcgca

SEQ ID NO: 564753 - DNA, 25 bp, Rattus norvegicus
tataagtccttttgcctttggcgca

SEQ ID NO: 564754 - DNA, 25 bp, Rattus norvegicus
tataagtgcgtcctcactgcacggg

SEQ ID NO: 564755 - DNA, 25 bp, Rattus norvegicus
tataagtgcgtcgtcactgcacggg

SEQ ID NO: 564756 - DNA, 25 bp, Rattus norvegicus
tataagtgcgttacggtacagaggc

SEQ ID NO: 564757 - DNA, 25 bp, Rattus norvegicus
tataagtgcgtttcggtacagaggc

SEQ ID NO: 564758 - DNA, 25 bp, Rattus norvegicus
tataagtggcacatctccgtcagat

SEQ ID NO: 564759 - DNA, 25 bp, Rattus norvegicus
tataagtggcaccatgtgtctccct

SEQ ID NO: 564760 - DNA, 25 bp, Rattus norvegicus
tataagtggcacgatgtgtctccct

SEQ ID NO: 564761 - DNA, 25 bp, Rattus norvegicus
tataagtggcacttctccgtcagat

SEQ ID NO: 564762 - DNA, 25 bp, Rattus norvegicus
tataagtgtcttatgttcttccctt

SEQ ID NO: 564763 - DNA, 25 bp, Rattus norvegicus
tataagtgtcttttgttcttccctt

SEQ ID NO: 564764 - DNA, 25 bp, Rattus norvegicus
tataagtgttttagcccctgtatgt

SEQ ID NO: 564765 - DNA, 25 bp, Rattus norvegicus
tataagtgtttttgcccctgtatgt

SEQ ID NO: 564766 - DNA, 25 bp, Rattus norvegicus
tataagttgaagaccagttcccctg

SEQ ID NO: 564767 - DNA, 25 bp, Rattus norvegicus
tataagttgaagtccagttcccctg

SEQ ID NO: 564768 - DNA, 25 bp, Rattus norvegicus
tataataaatatcccctactgtcaa

SEQ ID NO: 564769 - DNA, 25 bp, Rattus norvegicus
tataataaatatgccctactgtcaa

SEQ ID NO: 564770 - DNA, 25 bp, Rattus norvegicus
tataataaccgacctcagacctgct

SEQ ID NO: 564771 - DNA, 25 bp, Rattus norvegicus
tataataaccgagctcagacctgct

SEQ ID NO: 564772 - DNA, 25 bp, Rattus norvegicus
tataataggcaccttactctctggg

SEQ ID NO: 564773 - DNA, 25 bp, Rattus norvegicus
tataataggcacgttactctctggg

SEQ ID NO: 564774 - DNA, 25 bp, Rattus norvegicus
tataataggtctccctttcctttat

SEQ ID NO: 564775 - DNA, 25 bp, Rattus norvegicus
tataataggtctgcctttcctttat

SEQ ID NO: 564776 - DNA, 25 bp, Rattus norvegicus
tataataggtggagcttcccctgta

SEQ ID NO: 564777 - DNA, 25 bp, Rattus norvegicus
tataataggtggtgcttcccctgta

SEQ ID NO: 564778 - DNA, 25 bp, Rattus norvegicus
tataatatactccttgttgatgaca

SEQ ID NO: 564779 - DNA, 25 bp, Rattus norvegicus
tataatatactcgttgttgatgaca

SEQ ID NO: 564780 - DNA, 25 bp, Rattus norvegicus
tataatatctacatgctggtttgga

SEQ ID NO: 564781 - DNA, 25 bp, Rattus norvegicus
tataatatctacttgctggtttgga

SEQ ID NO: 564782 - DNA, 25 bp, Rattus norvegicus
tataatcaagcgctagcatcccctg

SEQ ID NO: 564783 - DNA, 25 bp, Rattus norvegicus
tataatcaagcggtagcatcccctg

SEQ ID NO: 564784 - DNA, 25 bp, Rattus norvegicus
tataatcacagtcccttatagcaca

SEQ ID NO: 564785 - DNA, 25 bp, Rattus norvegicus
tataatcacagtgccttatagcaca

SEQ ID NO: 564786 - DNA, 25 bp, Rattus norvegicus
tataatcagcaaactaacccatccc

SEQ ID NO: 564787 - DNA, 25 bp, Rattus norvegicus
tataatcagcaatctaacccatccc

SEQ ID NO: 564788 - DNA, 25 bp, Rattus norvegicus
tataatcaggctctatacatgcaga

SEQ ID NO: 564789 - DNA, 25 bp, Rattus norvegicus
tataatcaggctgtatacatgcaga

SEQ ID NO: 564790 - DNA, 25 bp, Rattus norvegicus
tataatcagtctcctatttgccttc

SEQ ID NO: 564791 - DNA, 25 bp, Rattus norvegicus
tataatcagtctgctatttgccttc

SEQ ID NO: 564792 - DNA, 25 bp, Rattus norvegicus
tataatcatctcagcaaaggtgtct

SEQ ID NO: 564793 - DNA, 25 bp, Rattus norvegicus
tataatcatctctgcaaaggtgtct

SEQ ID NO: 564794 - DNA, 25 bp, Rattus norvegicus
tataatccacagagccagaaaacca

SEQ ID NO: 564795 - DNA, 25 bp, Rattus norvegicus
tataatccacagtgccagaaaacca

SEQ ID NO: 564796 - DNA, 25 bp, Rattus norvegicus
tataatcccacacagataagacttt

SEQ ID NO: 564797 - DNA, 25 bp, Rattus norvegicus
tataatcccacagagataagacttt

SEQ ID NO: 564798 - DNA, 25 bp, Rattus norvegicus
tataatcccttgagaatccagctcc

SEQ ID NO: 564799 - DNA, 25 bp, Rattus norvegicus
tataatcccttgtgaatccagctcc

SEQ ID NO: 564800 - DNA, 25 bp, Rattus norvegicus
tataatcctatgctatgttgcctgt

SEQ ID NO: 564801 - DNA, 25 bp, Rattus norvegicus
tataatcctatggtatgttgcctgt

SEQ ID NO: 564802 - DNA, 25 bp, Rattus norvegicus
tataatccttttcttttgccattga

SEQ ID NO: 564803 - DNA, 25 bp, Rattus norvegicus
tataatccttttgttttgccattga

SEQ ID NO: 564804 - DNA, 25 bp, Rattus norvegicus
tataatcgcggactaaggcagcccc

SEQ ID NO: 564805 - DNA, 25 bp, Rattus norvegicus
tataatcgcggagtaaggcagcccc

SEQ ID NO: 564806 - DNA, 25 bp, Rattus norvegicus
tataatcgggttatccatttctgga

SEQ ID NO: 564807 - DNA, 25 bp, Rattus norvegicus
tataatcgggttttccatttctgga

SEQ ID NO: 564808 - DNA, 25 bp, Rattus norvegicus
tataatctcattacatactaccctg

SEQ ID NO: 564809 - DNA, 25 bp, Rattus norvegicus
tataatctcatttcatactaccctg

SEQ ID NO: 564810 - DNA, 25 bp, Rattus norvegicus
tataatctgctaccccgaatcattg

SEQ ID NO: 564811 - DNA, 25 bp, Rattus norvegicus
tataatctgctagcccgaatcattg

SEQ ID NO: 564812 - DNA, 25 bp, Rattus norvegicus
tataatgatccacccttctatgaag

SEQ ID NO: 564813 - DNA, 25 bp, Rattus norvegicus
tataatgatccagccttctatgaag

SEQ ID NO: 564814 - DNA, 25 bp, Rattus norvegicus
tataatgctaatagcctttgaggat

SEQ ID NO: 564815 - DNA, 25 bp, Rattus norvegicus
tataatgctaattgcctttgaggat

SEQ ID NO: 564816 - DNA, 25 bp, Rattus norvegicus
tataatggacttacccaagaaccct

SEQ ID NO: 564817 - DNA, 25 bp, Rattus norvegicus
tataatggactttcccaagaaccct

SEQ ID NO: 564818 - DNA, 25 bp, Rattus norvegicus
tataatgtagctacttcgctggctc

SEQ ID NO: 564819 - DNA, 25 bp, Rattus norvegicus
tataatgtagcttcttcgctggctc

SEQ ID NO: 564820 - DNA, 25 bp, Rattus norvegicus
tataatgtccatctaaacatgctct

SEQ ID NO: 564821 - DNA, 25 bp, Rattus norvegicus
tataatgtccatgtaaacatgctct

SEQ ID NO: 564822 - DNA, 25 bp, Rattus norvegicus
tataatgtcttcattccccttaaag

SEQ ID NO: 564823 - DNA, 25 bp, Rattus norvegicus
tataatgtcttctttccccttaaag

SEQ ID NO: 564824 - DNA, 25 bp, Rattus norvegicus
tataatgtgaaccatcctgcctttc

SEQ ID NO: 564825 - DNA, 25 bp, Rattus norvegicus
tataatgtgaacgatcctgcctttc

SEQ ID NO: 564826 - DNA, 25 bp, Rattus norvegicus
tataatgttgcgcaagcctccgttc

SEQ ID NO: 564827 - DNA, 25 bp, Rattus norvegicus
tataatgttgcggaagcctccgttc

SEQ ID NO: 564828 - DNA, 25 bp, Rattus norvegicus
tataattattcaccccagccagaag

SEQ ID NO: 564829 - DNA, 25 bp, Rattus norvegicus
tataattattcagcccagccagaag

SEQ ID NO: 564830 - DNA, 25 bp, Rattus norvegicus
tataattctatcattgctgcatctc

SEQ ID NO: 564831 - DNA, 25 bp, Rattus norvegicus
tataattctatctttgctgcatctc

SEQ ID NO: 564832 - DNA, 25 bp, Rattus norvegicus
tataattgtgtaatcgtgcccttcc

SEQ ID NO: 564833 - DNA, 25 bp, Rattus norvegicus
tataattgtgtattcgtgcccttcc

SEQ ID NO: 564834 - DNA, 25 bp, Rattus norvegicus
tataatttatccctctgctcagagt

SEQ ID NO: 564835 - DNA, 25 bp, Rattus norvegicus
tataatttatccgtctgctcagagt

SEQ ID NO: 564836 - DNA, 25 bp, Rattus norvegicus
tataatttgttaccggcatccccat

SEQ ID NO: 564837 - DNA, 25 bp, Rattus norvegicus
tataatttgttagcggcatccccat

SEQ ID NO: 564838 - DNA, 25 bp, Rattus norvegicus
tataattttatgctttacccagatg

SEQ ID NO: 564839 - DNA, 25 bp, Rattus norvegicus
tataattttatggtttacccagatg

SEQ ID NO: 564840 - DNA, 25 bp, Rattus norvegicus
tataattttgtgcagaaccgatgac

SEQ ID NO: 564841 - DNA, 25 bp, Rattus norvegicus
tataattttgtggagaaccgatgac

SEQ ID NO: 564842 - DNA, 25 bp, Rattus norvegicus
tatacaaactgtctggtgcgccgtg

SEQ ID NO: 564843 - DNA, 25 bp, Rattus norvegicus
tatacaaactgtgtggtgcgccgtg

SEQ ID NO: 564844 - DNA, 25 bp, Rattus norvegicus
tatacaaacttaccctgtgcctatg

SEQ ID NO: 564845 - DNA, 25 bp, Rattus norvegicus
tatacaaacttagcctgtgcctatg

SEQ ID NO: 564846 - DNA, 25 bp, Rattus norvegicus
tatacaaagtttctacagtaccaaa

SEQ ID NO: 564847 - DNA, 25 bp, Rattus norvegicus
tatacaaagtttgtacagtaccaaa

SEQ ID NO: 564848 - DNA, 25 bp, Rattus norvegicus
tatacaaattacagttctcccctac

SEQ ID NO: 564849 - DNA, 25 bp, Rattus norvegicus
tatacaaattactgttctcccctac

SEQ ID NO: 564850 - DNA, 25 bp, Rattus norvegicus
tatacaactcatcattttgcctttg

SEQ ID NO: 564851 - DNA, 25 bp, Rattus norvegicus
tatacaactcatgattttgcctttg

SEQ ID NO: 564852 - DNA, 25 bp, Rattus norvegicus
tatacaagagcacaacacacactgg

SEQ ID NO: 564853 - DNA, 25 bp, Rattus norvegicus
tatacaagagcagaacacacactgg

SEQ ID NO: 564854 - DNA, 25 bp, Rattus norvegicus
tatacaagcaatctggtcataccca

SEQ ID NO: 564855 - DNA, 25 bp, Rattus norvegicus
tatacaagcaatgtggtcataccca

SEQ ID NO: 564856 - DNA, 25 bp, Rattus norvegicus
tatacaagcactatcttcagtccgg

SEQ ID NO: 564857 - DNA, 25 bp, Rattus norvegicus
tatacaagcactttcttcagtccgg

SEQ ID NO: 564858 - DNA, 25 bp, Rattus norvegicus
tatacaagccaaacaaccttcttcc

SEQ ID NO: 564859 - DNA, 25 bp, Rattus norvegicus
tatacaagccaatcaaccttcttcc

SEQ ID NO: 564860 - DNA, 25 bp, Rattus norvegicus
tatacaaggcttcagaaacgactaa

SEQ ID NO: 564861 - DNA, 25 bp, Rattus norvegicus
tatacaaggcttgagaaacgactaa

SEQ ID NO: 564862 - DNA, 25 bp, Rattus norvegicus
tatacaagggctcgctggctatgga

SEQ ID NO: 564863 - DNA, 25 bp, Rattus norvegicus
tatacaagggctggctggctatgga

SEQ ID NO: 564864 - DNA, 25 bp, Rattus norvegicus
tatacaagtcgtatctctttcctcc

SEQ ID NO: 564865 - DNA, 25 bp, Rattus norvegicus
tatacaagtcgtttctctttcctcc

SEQ ID NO: 564866 - DNA, 25 bp, Rattus norvegicus
tatacaatgcctattggtcacctct

SEQ ID NO: 564867 - DNA, 25 bp, Rattus norvegicus
tatacaatgccttttggtcacctct

SEQ ID NO: 564868 - DNA, 25 bp, Rattus norvegicus
tatacaatgctcaggcacatagtga

SEQ ID NO: 564869 - DNA, 25 bp, Rattus norvegicus
tatacaatgctctggcacatagtga

SEQ ID NO: 564870 - DNA, 25 bp, Rattus norvegicus
tatacaattgctagaccacggaata

SEQ ID NO: 564871 - DNA, 25 bp, Rattus norvegicus
tatacaattgcttgaccacggaata

SEQ ID NO: 564872 - DNA, 25 bp, Rattus norvegicus
tatacaattgtaagtctagacacct

SEQ ID NO: 564873 - DNA, 25 bp, Rattus norvegicus
tatacaattgtatgtctagacacct

SEQ ID NO: 564874 - DNA, 25 bp, Rattus norvegicus
tatacacacaggacagcacgggcgc

SEQ ID NO: 564875 - DNA, 25 bp, Rattus norvegicus
tatacacacaggtcagcacgggcgc

SEQ ID NO: 564876 - DNA, 25 bp, Rattus norvegicus
tatacacatacaacagacttccctg

SEQ ID NO: 564877 - DNA, 25 bp, Rattus norvegicus
tatacacatacatcagacttccctg

SEQ ID NO: 564878 - DNA, 25 bp, Rattus norvegicus
tatacacatacccataggcgctcaa

SEQ ID NO: 564879 - DNA, 25 bp, Rattus norvegicus
tatacacataccgataggcgctcaa

SEQ ID NO: 564880 - DNA, 25 bp, Rattus norvegicus
tatacaccagagaagaaagccgcag

SEQ ID NO: 564881 - DNA, 25 bp, Rattus norvegicus
tatacaccagagtagaaagccgcag

SEQ ID NO: 564882 - DNA, 25 bp, Rattus norvegicus
tatacaccaggtaggacaccttccc

SEQ ID NO: 564883 - DNA, 25 bp, Rattus norvegicus
tatacaccaggttggacaccttccc

SEQ ID NO: 564884 - DNA, 25 bp, Rattus norvegicus
tatacaccatttctgggccaggttc

SEQ ID NO: 564885 - DNA, 25 bp, Rattus norvegicus
tatacaccatttgtgggccaggttc

SEQ ID NO: 564886 - DNA, 25 bp, Rattus norvegicus
tatacacgcactagacacattccag

SEQ ID NO: 564887 - DNA, 25 bp, Rattus norvegicus
tatacacgcacttgacacattccag

SEQ ID NO: 564888 - DNA, 25 bp, Rattus norvegicus
tatacacggcctcggtcagactcgg

SEQ ID NO: 564889 - DNA, 25 bp, Rattus norvegicus
tatacacggcctgggtcagactcgg

SEQ ID NO: 564890 - DNA, 25 bp, Rattus norvegicus
tatacactcacccagatgactcttg

SEQ ID NO: 564891 - DNA, 25 bp, Rattus norvegicus
tatacactcaccgagatgactcttg

SEQ ID NO: 564892 - DNA, 25 bp, Rattus norvegicus
tatacactctgactcctttggctag

SEQ ID NO: 564893 - DNA, 25 bp, Rattus norvegicus
tatacactctgagtcctttggctag

SEQ ID NO: 564894 - DNA, 25 bp, Rattus norvegicus
tatacactggagacgcggactcttc

SEQ ID NO: 564895 - DNA, 25 bp, Rattus norvegicus
tatacactggagtcgcggactcttc

SEQ ID NO: 564896 - DNA, 25 bp, Rattus norvegicus
tatacacttgtgatgctcttctcta

SEQ ID NO: 564897 - DNA, 25 bp, Rattus norvegicus
tatacacttgtgttgctcttctcta

SEQ ID NO: 564898 - DNA, 25 bp, Rattus norvegicus
tatacacttttgactccctacctga

SEQ ID NO: 564899 - DNA, 25 bp, Rattus norvegicus
tatacacttttgtctccctacctga

SEQ ID NO: 564900 - DNA, 25 bp, Rattus norvegicus
tatacagaactgagcgattccgccg

SEQ ID NO: 564901 - DNA, 25 bp, Rattus norvegicus
tatacagaactgtgcgattccgccg

SEQ ID NO: 564902 - DNA, 25 bp, Rattus norvegicus
tatacagacagacctgggctcccgt

SEQ ID NO: 564903 - DNA, 25 bp, Rattus norvegicus
tatacagacagagctgggctcccgt

SEQ ID NO: 564904 - DNA, 25 bp, Rattus norvegicus
tatacagacgaccaagaaagcaagt

SEQ ID NO: 564905 - DNA, 25 bp, Rattus norvegicus
tatacagacgacgaagaaagcaagt

SEQ ID NO: 564906 - DNA, 25 bp, Rattus norvegicus
tatacagacgtgcaaaggccggaga

SEQ ID NO: 564907 - DNA, 25 bp, Rattus norvegicus
tatacagacgtggaaaggccggaga

SEQ ID NO: 564908 - DNA, 25 bp, Rattus norvegicus
tatacagagctcactgcttactcca

SEQ ID NO: 564909 - DNA, 25 bp, Rattus norvegicus
tatacagagctctctgcttactcca

SEQ ID NO: 564910 - DNA, 25 bp, Rattus norvegicus
tatacagcaactattacaggccctc

SEQ ID NO: 564911 - DNA, 25 bp, Rattus norvegicus
tatacagcaacttttacaggccctc

SEQ ID NO: 564912 - DNA, 25 bp, Rattus norvegicus
tatacagcagcacgcccgaagacgt

SEQ ID NO: 564913 - DNA, 25 bp, Rattus norvegicus
tatacagcagcaggcccgaagacgt

SEQ ID NO: 564914 - DNA, 25 bp, Rattus norvegicus
tatacagcagccactgatgtggtgt

SEQ ID NO: 564915 - DNA, 25 bp, Rattus norvegicus
tatacagcagcctctgatgtggtgt

SEQ ID NO: 564916 - DNA, 25 bp, Rattus norvegicus
tatacagcctacatcactctcaatg

SEQ ID NO: 564917 - DNA, 25 bp, Rattus norvegicus
tatacagcctacttcactctcaatg

SEQ ID NO: 564918 - DNA, 25 bp, Rattus norvegicus
tatacagcgagtctgtaggcccctt

SEQ ID NO: 564919 - DNA, 25 bp, Rattus norvegicus
tatacagcgagtgtgtaggcccctt

SEQ ID NO: 564920 - DNA, 25 bp, Rattus norvegicus
tatacagcgtgactcaccgggaggc

SEQ ID NO: 564921 - DNA, 25 bp, Rattus norvegicus
tatacagcgtgagtcaccgggaggc

SEQ ID NO: 564922 - DNA, 25 bp, Rattus norvegicus
tatacagcttttcacgatacgacga

SEQ ID NO: 564923 - DNA, 25 bp, Rattus norvegicus
tatacagcttttgacgatacgacga

SEQ ID NO: 564924 - DNA, 25 bp, Rattus norvegicus
tatacaggaacccaaggcccggagt

SEQ ID NO: 564925 - DNA, 25 bp, Rattus norvegicus
tatacaggaaccgaaggcccggagt

SEQ ID NO: 564926 - DNA, 25 bp, Rattus norvegicus
tatacaggcccaagtttccctctct

SEQ ID NO: 564927 - DNA, 25 bp, Rattus norvegicus
tatacaggcccatgtttccctctct

SEQ ID NO: 564928 - DNA, 25 bp, Rattus norvegicus
tatacagggtctcttttccttaccg

SEQ ID NO: 564929 - DNA, 25 bp, Rattus norvegicus
tatacagggtctgttttccttaccg

SEQ ID NO: 564930 - DNA, 25 bp, Rattus norvegicus
tatacaggtgctctccatctcgaag

SEQ ID NO: 564931 - DNA, 25 bp, Rattus norvegicus
tatacaggtgctgtccatctcgaag

SEQ ID NO: 564932 - DNA, 25 bp, Rattus norvegicus
tatacagtcatcctgagcagccgta

SEQ ID NO: 564933 - DNA, 25 bp, Rattus norvegicus
tatacagtcatcgtgagcagccgta

SEQ ID NO: 564934 - DNA, 25 bp, Rattus norvegicus
tatacagtccatcgtatccacgaca

SEQ ID NO: 564935 - DNA, 25 bp, Rattus norvegicus
tatacagtccatggtatccacgaca

SEQ ID NO: 564936 - DNA, 25 bp, Rattus norvegicus
tatacagtcttcaggcttcgtctca

SEQ ID NO: 564937 - DNA, 25 bp, Rattus norvegicus
tatacagtcttctggcttcgtctca

SEQ ID NO: 564938 - DNA, 25 bp, Rattus norvegicus
tatacagtgctaagccaaaagggag

SEQ ID NO: 564939 - DNA, 25 bp, Rattus norvegicus
tatacagtgctatgccaaaagggag

SEQ ID NO: 564940 - DNA, 25 bp, Rattus norvegicus
tatacagtgtctattttactaaact

SEQ ID NO: 564941 - DNA, 25 bp, Rattus norvegicus
tatacagtgtcttttttactaaact

SEQ ID NO: 564942 - DNA, 25 bp, Rattus norvegicus
tatacagttattcctgcaccactat

SEQ ID NO: 564943 - DNA, 25 bp, Rattus norvegicus
tatacagttattgctgcaccactat

SEQ ID NO: 564944 - DNA, 25 bp, Rattus norvegicus
tatacatactttacagactgccttt

SEQ ID NO: 564945 - DNA, 25 bp, Rattus norvegicus
tatacatacttttcagactgccttt

SEQ ID NO: 564946 - DNA, 25 bp, Rattus norvegicus
tatacatagcgcaacacagtgaaac

SEQ ID NO: 564947 - DNA, 25 bp, Rattus norvegicus
tatacatagcgctacacagtgaaac

SEQ ID NO: 564948 - DNA, 25 bp, Rattus norvegicus
tatacatatacccttgccacagctg

SEQ ID NO: 564949 - DNA, 25 bp, Rattus norvegicus
tatacatataccgttgccacagctg

SEQ ID NO: 564950 - DNA, 25 bp, Rattus norvegicus
tatacatcatttccgatgcgcctct

SEQ ID NO: 564951 - DNA, 25 bp, Rattus norvegicus
tatacatcatttgcgatgcgcctct

SEQ ID NO: 564952 - DNA, 25 bp, Rattus norvegicus
tatacatccgatcctgaccattgtg

SEQ ID NO: 564953 - DNA, 25 bp, Rattus norvegicus
tatacatccgatgctgaccattgtg

SEQ ID NO: 564954 - DNA, 25 bp, Rattus norvegicus
tatacatcctgacacatacctgaac

SEQ ID NO: 564955 - DNA, 25 bp, Rattus norvegicus
tatacatcctgagacatacctgaac

SEQ ID NO: 564956 - DNA, 25 bp, Rattus norvegicus
tatacatcgtgtcccatatagctgt

SEQ ID NO: 564957 - DNA, 25 bp, Rattus norvegicus
tatacatcgtgtgccatatagctgt

SEQ ID NO: 564958 - DNA, 25 bp, Rattus norvegicus
tatacatcgttcagtttgatctggg

SEQ ID NO: 564959 - DNA, 25 bp, Rattus norvegicus
tatacatcgttctgtttgatctggg

SEQ ID NO: 564960 - DNA, 25 bp, Rattus norvegicus
tatacatgagccattcctctgccaa

SEQ ID NO: 564961 - DNA, 25 bp, Rattus norvegicus
tatacatgagcctttcctctgccaa

SEQ ID NO: 564962 - DNA, 25 bp, Rattus norvegicus
tatacatgcaggagcaatgctgtat

SEQ ID NO: 564963 - DNA, 25 bp, Rattus norvegicus
tatacatgcaggtgcaatgctgtat

SEQ ID NO: 564964 - DNA, 25 bp, Rattus norvegicus
tatacatgtattaaccaccctaaaa

SEQ ID NO: 564965 - DNA, 25 bp, Rattus norvegicus
tatacatgtatttaccaccctaaaa

SEQ ID NO: 564966 - DNA, 25 bp, Rattus norvegicus
tatacattatttacctagcttacag

SEQ ID NO: 564967 - DNA, 25 bp, Rattus norvegicus
tatacattattttcctagcttacag

SEQ ID NO: 564968 - DNA, 25 bp, Rattus norvegicus
tatacatttgcaaatacccacaggg

SEQ ID NO: 564969 - DNA, 25 bp, Rattus norvegicus
tatacatttgcatatacccacaggg

SEQ ID NO: 564970 - DNA, 25 bp, Rattus norvegicus
tatacattttacatcaggctactgg

SEQ ID NO: 564971 - DNA, 25 bp, Rattus norvegicus
tatacattttacttcaggctactgg

SEQ ID NO: 564972 - DNA, 25 bp, Rattus norvegicus
tataccaaatcaacagagctgccct

SEQ ID NO: 564973 - DNA, 25 bp, Rattus norvegicus
tataccaaatcatcagagctgccct

SEQ ID NO: 564974 - DNA, 25 bp, Rattus norvegicus
tataccaaccatcacccacaggtgt

SEQ ID NO: 564975 - DNA, 25 bp, Rattus norvegicus
tataccaaccatgacccacaggtgt

SEQ ID NO: 564976 - DNA, 25 bp, Rattus norvegicus
tataccaagtgcacattaccccatg

SEQ ID NO: 564977 - DNA, 25 bp, Rattus norvegicus
tataccaagtgctcattaccccatg

SEQ ID NO: 564978 - DNA, 25 bp, Rattus norvegicus
tataccaattgtacttctttctctg

SEQ ID NO: 564979 - DNA, 25 bp, Rattus norvegicus
tataccaattgttcttctttctctg

SEQ ID NO: 564980 - DNA, 25 bp, Rattus norvegicus
tataccacagacaggtccacctgac

SEQ ID NO: 564981 - DNA, 25 bp, Rattus norvegicus
tataccacagactggtccacctgac

SEQ ID NO: 564982 - DNA, 25 bp, Rattus norvegicus
tataccacattcattcaagtgcagt

SEQ ID NO: 564983 - DNA, 25 bp, Rattus norvegicus
tataccacattctttcaagtgcagt

SEQ ID NO: 564984 - DNA, 25 bp, Rattus norvegicus
tataccaccgagacttgatagccac

SEQ ID NO: 564985 - DNA, 25 bp, Rattus norvegicus
tataccaccgagtcttgatagccac

SEQ ID NO: 564986 - DNA, 25 bp, Rattus norvegicus
tataccacttgtccatatgccttaa

SEQ ID NO: 564987 - DNA, 25 bp, Rattus norvegicus
tataccacttgtgcatatgccttaa

SEQ ID NO: 564988 - DNA, 25 bp, Rattus norvegicus
tataccagcagacgccgggaacagc

SEQ ID NO: 564989 - DNA, 25 bp, Rattus norvegicus
tataccagcagaggccgggaacagc

SEQ ID NO: 564990 - DNA, 25 bp, Rattus norvegicus
tataccatacttacctgcatgctgc

SEQ ID NO: 564991 - DNA, 25 bp, Rattus norvegicus
tataccatactttcctgcatgctgc

SEQ ID NO: 564992 - DNA, 25 bp, Rattus norvegicus
tataccatgggcagttctgtgctac

SEQ ID NO: 564993 - DNA, 25 bp, Rattus norvegicus
tataccatgggctgttctgtgctac

SEQ ID NO: 564994 - DNA, 25 bp, Rattus norvegicus
tataccattataatacacaaagaac

SEQ ID NO: 564995 - DNA, 25 bp, Rattus norvegicus
tataccattatattacacaaagaac

SEQ ID NO: 564996 - DNA, 25 bp, Rattus norvegicus
tataccattcttcggaatataccca

SEQ ID NO: 564997 - DNA, 25 bp, Rattus norvegicus
tataccattcttgggaatataccca

SEQ ID NO: 564998 - DNA, 25 bp, Rattus norvegicus
tataccattgctactccataactgt

SEQ ID NO: 564999 - DNA, 25 bp, Rattus norvegicus
tataccattgcttctccataactgt

SEQ ID NO: 565000 - DNA, 25 bp, Rattus norvegicus
tatacccacaccagcactagtagta

SEQ ID NO: 565001 - DNA, 25 bp, Rattus norvegicus
tatacccacacctgcactagtagta

SEQ ID NO: 565002 - DNA, 25 bp, Rattus norvegicus
tatacccacccaactttagtctgat

SEQ ID NO: 565003 - DNA, 25 bp, Rattus norvegicus
tatacccacccatctttagtctgat

SEQ ID NO: 565004 - DNA, 25 bp, Rattus norvegicus
tatacccagagtacccctttgtgaa

SEQ ID NO: 565005 - DNA, 25 bp, Rattus norvegicus
tatacccagagttcccctttgtgaa

SEQ ID NO: 565006 - DNA, 25 bp, Rattus norvegicus
tatacccaggacatacgtacacaca

SEQ ID NO: 565007 - DNA, 25 bp, Rattus norvegicus
tatacccaggacttacgtacacaca

SEQ ID NO: 565008 - DNA, 25 bp, Rattus norvegicus
tatacccatataacaggaccagtga

SEQ ID NO: 565009 - DNA, 25 bp, Rattus norvegicus
tatacccatatatcaggaccagtga

SEQ ID NO: 565010 - DNA, 25 bp, Rattus norvegicus
tatacccatccaaactccatttaaa

SEQ ID NO: 565011 - DNA, 25 bp, Rattus norvegicus
tatacccatccatactccatttaaa

SEQ ID NO: 565012 - DNA, 25 bp, Rattus norvegicus
tataccccaccgaccaagatcggag

SEQ ID NO: 565013 - DNA, 25 bp, Rattus norvegicus
tataccccaccgtccaagatcggag

SEQ ID NO: 565014 - DNA, 25 bp, Rattus norvegicus
tataccccatgcctgaggacgacgg

SEQ ID NO: 565015 - DNA, 25 bp, Rattus norvegicus
tataccccatgcgtgaggacgacgg

SEQ ID NO: 565016 - DNA, 25 bp, Rattus norvegicus
tatacccccgtgattctatagagaa

SEQ ID NO: 565017 - DNA, 25 bp, Rattus norvegicus
tatacccccgtgtttctatagagaa

SEQ ID NO: 565018 - DNA, 25 bp, Rattus norvegicus
tatacccgagtcagggacttcatcc

SEQ ID NO: 565019 - DNA, 25 bp, Rattus norvegicus
tatacccgagtctgggacttcatcc

SEQ ID NO: 565020 - DNA, 25 bp, Rattus norvegicus
tatacccggaacactgatatgaatg

SEQ ID NO: 565021 - DNA, 25 bp, Rattus norvegicus
tatacccggaactctgatatgaatg

SEQ ID NO: 565022 - DNA, 25 bp, Rattus norvegicus
tatacccggtccacaggagaacagg

SEQ ID NO: 565023 - DNA, 25 bp, Rattus norvegicus
tatacccggtcctcaggagaacagg

SEQ ID NO: 565024 - DNA, 25 bp, Rattus norvegicus
tatacccgtagtaagccacataaat

SEQ ID NO: 565025 - DNA, 25 bp, Rattus norvegicus
tatacccgtagttagccacataaat

SEQ ID NO: 565026 - DNA, 25 bp, Rattus norvegicus
tataccctcaatcacaagctgtttg

SEQ ID NO: 565027 - DNA, 25 bp, Rattus norvegicus
tataccctcaatgacaagctgtttg

SEQ ID NO: 565028 - DNA, 25 bp, Rattus norvegicus
tataccctgggtcccttggagcaaa

SEQ ID NO: 565029 - DNA, 25 bp, Rattus norvegicus
tataccctgggtgccttggagcaaa

SEQ ID NO: 565030 - DNA, 25 bp, Rattus norvegicus
tataccgatccgagccaggaaagtg

SEQ ID NO: 565031 - DNA, 25 bp, Rattus norvegicus
tataccgatccgtgccaggaaagtg

SEQ ID NO: 565032 - DNA, 25 bp, Rattus norvegicus
tatacctaccccacgagacagatgg

SEQ ID NO: 565033 - DNA, 25 bp, Rattus norvegicus
tatacctacccctcgagacagatgg

SEQ ID NO: 565034 - DNA, 25 bp, Rattus norvegicus
tatacctacgaccaggagggctccc

SEQ ID NO: 565035 - DNA, 25 bp, Rattus norvegicus
tatacctacgacgaggagggctccc

SEQ ID NO: 565036 - DNA, 25 bp, Rattus norvegicus
tatacctactacagctcgcgtttgt

SEQ ID NO: 565037 - DNA, 25 bp, Rattus norvegicus
tatacctactactgctcgcgtttgt

SEQ ID NO: 565038 - DNA, 25 bp, Rattus norvegicus
tatacctagagaaacattcccctcc

SEQ ID NO: 565039 - DNA, 25 bp, Rattus norvegicus
tatacctagagatacattcccctcc

SEQ ID NO: 565040 - DNA, 25 bp, Rattus norvegicus
tatacctagaggactccgagttctt

SEQ ID NO: 565041 - DNA, 25 bp, Rattus norvegicus
tatacctagaggtctccgagttctt

SEQ ID NO: 565042 - DNA, 25 bp, Rattus norvegicus
tatacctccaggagacgggacggga

SEQ ID NO: 565043 - DNA, 25 bp, Rattus norvegicus
tatacctccaggtgacgggacggga

SEQ ID NO: 565044 - DNA, 25 bp, Rattus norvegicus
tatacctcccagatgaactacaggc

SEQ ID NO: 565045 - DNA, 25 bp, Rattus norvegicus
tatacctcccagttgaactacaggc

SEQ ID NO: 565046 - DNA, 25 bp, Rattus norvegicus
tatacctcctcgcagatgtttctcg

SEQ ID NO: 565047 - DNA, 25 bp, Rattus norvegicus
tatacctcctcggagatgtttctcg

SEQ ID NO: 565048 - DNA, 25 bp, Rattus norvegicus
tatacctctcagctgtcttcaagac

SEQ ID NO: 565049 - DNA, 25 bp, Rattus norvegicus
tatacctctcaggtgtcttcaagac

SEQ ID NO: 565050 - DNA, 25 bp, Rattus norvegicus
tatacctctgccaaaatcagcgaga

SEQ ID NO: 565051 - DNA, 25 bp, Rattus norvegicus
tatacctctgcctaaatcagcgaga

SEQ ID NO: 565052 - DNA, 25 bp, Rattus norvegicus
tatacctcttggctacagggtgggc

SEQ ID NO: 565053 - DNA, 25 bp, Rattus norvegicus
tatacctcttgggtacagggtgggc

SEQ ID NO: 565054 - DNA, 25 bp, Rattus norvegicus
tatacctgacagctctgtttttatt

SEQ ID NO: 565055 - DNA, 25 bp, Rattus norvegicus
tatacctgacaggtctgtttttatt

SEQ ID NO: 565056 - DNA, 25 bp, Rattus norvegicus
tatacctgaccccaagctcatggac

SEQ ID NO: 565057 - DNA, 25 bp, Rattus norvegicus
tatacctgacccgaagctcatggac

SEQ ID NO: 565058 - DNA, 25 bp, Rattus norvegicus
tatacctgagccacaaccttctggg

SEQ ID NO: 565059 - DNA, 25 bp, Rattus norvegicus
tatacctgagcctcaaccttctggg

SEQ ID NO: 565060 - DNA, 25 bp, Rattus norvegicus
tatacctgtatgcttttgcgggtcc

SEQ ID NO: 565061 - DNA, 25 bp, Rattus norvegicus
tatacctgtatggttttgcgggtcc

SEQ ID NO: 565062 - DNA, 25 bp, Rattus norvegicus
tatacctgtgcactgggagcttcca

SEQ ID NO: 565063 - DNA, 25 bp, Rattus norvegicus
tatacctgtgcagtgggagcttcca

SEQ ID NO: 565064 - DNA, 25 bp, Rattus norvegicus
tatacctgttacatctgcttctcaa

SEQ ID NO: 565065 - DNA, 25 bp, Rattus norvegicus
tatacctgttacttctgcttctcaa

SEQ ID NO: 565066 - DNA, 25 bp, Rattus norvegicus
tataccttctgccatcaagggctaa

SEQ ID NO: 565067 - DNA, 25 bp, Rattus norvegicus
tataccttctgcgatcaagggctaa

SEQ ID NO: 565068 - DNA, 25 bp, Rattus norvegicus
tataccttgaagcttttggaccagt

SEQ ID NO: 565069 - DNA, 25 bp, Rattus norvegicus
tataccttgaaggttttggaccagt

SEQ ID NO: 565070 - DNA, 25 bp, Rattus norvegicus
tataccttgcttaatgacagtccag

SEQ ID NO: 565071 - DNA, 25 bp, Rattus norvegicus
tataccttgctttatgacagtccag

SEQ ID NO: 565072 - DNA, 25 bp, Rattus norvegicus
tataccttggttaaccatcacctct

SEQ ID NO: 565073 - DNA, 25 bp, Rattus norvegicus
tataccttggtttaccatcacctct

SEQ ID NO: 565074 - DNA, 25 bp, Rattus norvegicus
tatacctttaatcttggtacccagg

SEQ ID NO: 565075 - DNA, 25 bp, Rattus norvegicus
tatacctttaatgttggtacccagg

SEQ ID NO: 565076 - DNA, 25 bp, Rattus norvegicus
tatacctttcttacagcagtggtgg

SEQ ID NO: 565077 - DNA, 25 bp, Rattus norvegicus
tatacctttctttcagcagtggtgg

SEQ ID NO: 565078 - DNA, 25 bp, Rattus norvegicus
tatacctttggtattgtttggccct

SEQ ID NO: 565079 - DNA, 25 bp, Rattus norvegicus
tatacctttggttttgtttggccct

SEQ ID NO: 565080 - DNA, 25 bp, Rattus norvegicus
tatacgaaccgcattccagtgttaa

SEQ ID NO: 565081 - DNA, 25 bp, Rattus norvegicus
tatacgaaccgctttccagtgttaa

SEQ ID NO: 565082 - DNA, 25 bp, Rattus norvegicus
tatacgaaccttctcgcgtaagcag

SEQ ID NO: 565083 - DNA, 25 bp, Rattus norvegicus
tatacgaaccttgtcgcgtaagcag

SEQ ID NO: 565084 - DNA, 25 bp, Rattus norvegicus
tatacgagacctacagactctgaca

SEQ ID NO: 565085 - DNA, 25 bp, Rattus norvegicus
tatacgagaccttcagactctgaca

SEQ ID NO: 565086 - DNA, 25 bp, Rattus norvegicus
tatacgatgttgactcactagaggg

SEQ ID NO: 565087 - DNA, 25 bp, Rattus norvegicus
tatacgatgttgtctcactagaggg

SEQ ID NO: 565088 - DNA, 25 bp, Rattus norvegicus
tatacgattaccatcaggaacccct

SEQ ID NO: 565089 - DNA, 25 bp, Rattus norvegicus
tatacgattaccttcaggaacccct

SEQ ID NO: 565090 - DNA, 25 bp, Rattus norvegicus
tatacgcaatgccttcactagataa

SEQ ID NO: 565091 - DNA, 25 bp, Rattus norvegicus
tatacgcaatgcgttcactagataa

SEQ ID NO: 565092 - DNA, 25 bp, Rattus norvegicus
tatacgcagtcgagccacatgaaat

SEQ ID NO: 565093 - DNA, 25 bp, Rattus norvegicus
tatacgcagtcgtgccacatgaaat

SEQ ID NO: 565094 - DNA, 25 bp, Rattus norvegicus
tatacgcttttcattgacacccttc

SEQ ID NO: 565095 - DNA, 25 bp, Rattus norvegicus
tatacgcttttctttgacacccttc

SEQ ID NO: 565096 - DNA, 25 bp, Rattus norvegicus
tatacggcctctcggttcctgtaga

SEQ ID NO: 565097 - DNA, 25 bp, Rattus norvegicus
tatacggcctctgggttcctgtaga

SEQ ID NO: 565098 - DNA, 25 bp, Rattus norvegicus
tatacgggaagtccgctgtccactg

SEQ ID NO: 565099 - DNA, 25 bp, Rattus norvegicus
tatacgggaagtgcgctgtccactg

SEQ ID NO: 565100 - DNA, 25 bp, Rattus norvegicus
tatacgggctgaatcgctactcgga

SEQ ID NO: 565101 - DNA, 25 bp, Rattus norvegicus
tatacgggctgattcgctactcgga

SEQ ID NO: 565102 - DNA, 25 bp, Rattus norvegicus
tatacggtccgtcaccagagtattt

SEQ ID NO: 565103 - DNA, 25 bp, Rattus norvegicus
tatacggtccgtgaccagagtattt

SEQ ID NO: 565104 - DNA, 25 bp, Rattus norvegicus
tatacggtggttctcagagctccat

SEQ ID NO: 565105 - DNA, 25 bp, Rattus norvegicus
tatacggtggttgtcagagctccat

SEQ ID NO: 565106 - DNA, 25 bp, Rattus norvegicus
tatacggtgtaaactctcctctgta

SEQ ID NO: 565107 - DNA, 25 bp, Rattus norvegicus
tatacggtgtaatctctcctctgta

SEQ ID NO: 565108 - DNA, 25 bp, Rattus norvegicus
tatacgtaattgacagtgcagacag

SEQ ID NO: 565109 - DNA, 25 bp, Rattus norvegicus
tatacgtaattgtcagtgcagacag

SEQ ID NO: 565110 - DNA, 25 bp, Rattus norvegicus
tatacgtcaacaacagtcatcccga

SEQ ID NO: 565111 - DNA, 25 bp, Rattus norvegicus
tatacgtcaacatcagtcatcccga

SEQ ID NO: 565112 - DNA, 25 bp, Rattus norvegicus
tatacgtgtgggattgtttctcctg

SEQ ID NO: 565113 - DNA, 25 bp, Rattus norvegicus
tatacgtgtgggtttgtttctcctg

SEQ ID NO: 565114 - DNA, 25 bp, Rattus norvegicus
tatacgttgcttcatttgcttcata

SEQ ID NO: 565115 - DNA, 25 bp, Rattus norvegicus
tatacgttgcttgatttgcttcata

SEQ ID NO: 565116 - DNA, 25 bp, Rattus norvegicus
tatactaaatgcctcctagctctag

SEQ ID NO: 565117 - DNA, 25 bp, Rattus norvegicus
tatactaaatgcgtcctagctctag

SEQ ID NO: 565118 - DNA, 25 bp, Rattus norvegicus
tatactaatcctattctgaaactgt

SEQ ID NO: 565119 - DNA, 25 bp, Rattus norvegicus
tatactaatccttttctgaaactgt

SEQ ID NO: 565120 - DNA, 25 bp, Rattus norvegicus
tatactaatcggcaaggctgtgaga

SEQ ID NO: 565121 - DNA, 25 bp, Rattus norvegicus
tatactaatcgggaaggctgtgaga

SEQ ID NO: 565122 - DNA, 25 bp, Rattus norvegicus
tatactacactgatgctgcttgata

SEQ ID NO: 565123 - DNA, 25 bp, Rattus norvegicus
tatactacactgttgctgcttgata

SEQ ID NO: 565124 - DNA, 25 bp, Rattus norvegicus
tatactactactaacactcttcaac

SEQ ID NO: 565125 - DNA, 25 bp, Rattus norvegicus
tatactactacttacactcttcaac

SEQ ID NO: 565126 - DNA, 25 bp, Rattus norvegicus
tatactagacttattacattgccca

SEQ ID NO: 565127 - DNA, 25 bp, Rattus norvegicus
tatactagactttttacattgccca

SEQ ID NO: 565128 - DNA, 25 bp, Rattus norvegicus
tatactatattgatgctctctgctc

SEQ ID NO: 565129 - DNA, 25 bp, Rattus norvegicus
tatactatattgttgctctctgctc

SEQ ID NO: 565130 - DNA, 25 bp, Rattus norvegicus
tatactatgtggacaggctcccaaa

SEQ ID NO: 565131 - DNA, 25 bp, Rattus norvegicus
tatactatgtggtcaggctcccaaa

SEQ ID NO: 565132 - DNA, 25 bp, Rattus norvegicus
tatactatttatatccatttcatgg

SEQ ID NO: 565133 - DNA, 25 bp, Rattus norvegicus
tatactatttatttccatttcatgg

SEQ ID NO: 565134 - DNA, 25 bp, Rattus norvegicus
tatactcaagccactgtgcgccatg

SEQ ID NO: 565135 - DNA, 25 bp, Rattus norvegicus
tatactcaagcctctgtgcgccatg

SEQ ID NO: 565136 - DNA, 25 bp, Rattus norvegicus
tatactcacacacacacgtacctat

SEQ ID NO: 565137 - DNA, 25 bp, Rattus norvegicus
tatactcacacagacacgtacctat

SEQ ID NO: 565138 - DNA, 25 bp, Rattus norvegicus
tatactcaggaaccacatgccatgt

SEQ ID NO: 565139 - DNA, 25 bp, Rattus norvegicus
tatactcaggaagcacatgccatgt

SEQ ID NO: 565140 - DNA, 25 bp, Rattus norvegicus
tatactcaggctacacatgcacaag

SEQ ID NO: 565141 - DNA, 25 bp, Rattus norvegicus
tatactcaggcttcacatgcacaag

SEQ ID NO: 565142 - DNA, 25 bp, Rattus norvegicus
tatactcattacattgtcattgtca

SEQ ID NO: 565143 - DNA, 25 bp, Rattus norvegicus
tatactcattactttgtcattgtca

SEQ ID NO: 565144 - DNA, 25 bp, Rattus norvegicus
tatactccatggctgtgacgggctg

SEQ ID NO: 565145 - DNA, 25 bp, Rattus norvegicus
tatactccatgggtgtgacgggctg

SEQ ID NO: 565146 - DNA, 25 bp, Rattus norvegicus
tatactccctatcctcttagagacc

SEQ ID NO: 565147 - DNA, 25 bp, Rattus norvegicus
tatactccctatgctcttagagacc

SEQ ID NO: 565148 - DNA, 25 bp, Rattus norvegicus
tatactccggagcacaccattttat

SEQ ID NO: 565149 - DNA, 25 bp, Rattus norvegicus
tatactccggaggacaccattttat

SEQ ID NO: 565150 - DNA, 25 bp, Rattus norvegicus
tatactccgggcaagtatgcatcat

SEQ ID NO: 565151 - DNA, 25 bp, Rattus norvegicus
tatactccgggctagtatgcatcat

SEQ ID NO: 565152 - DNA, 25 bp, Rattus norvegicus
tatactcctctcaaaagccgtgggt

SEQ ID NO: 565153 - DNA, 25 bp, Rattus norvegicus
tatactcctctcagagaagcataga

SEQ ID NO: 565154 - DNA, 25 bp, Rattus norvegicus
tatactcctctctaaagccgtgggt

SEQ ID NO: 565155 - DNA, 25 bp, Rattus norvegicus
tatactcctctctgagaagcataga

SEQ ID NO: 565156 - DNA, 25 bp, Rattus norvegicus
tatactcgagttcttcagtacagaa

SEQ ID NO: 565157 - DNA, 25 bp, Rattus norvegicus
tatactcgagttgttcagtacagaa

SEQ ID NO: 565158 - DNA, 25 bp, Rattus norvegicus
tatactcgctggcaacatctatcgt

SEQ ID NO: 565159 - DNA, 25 bp, Rattus norvegicus
tatactcgctgggaacatctatcgt

SEQ ID NO: 565160 - DNA, 25 bp, Rattus norvegicus
tatactctctctctagggtttttcg

SEQ ID NO: 565161 - DNA, 25 bp, Rattus norvegicus
tatactctctctgtagggtttttcg

SEQ ID NO: 565162 - DNA, 25 bp, Rattus norvegicus
tatactctctgtccctgttgcaaat

SEQ ID NO: 565163 - DNA, 25 bp, Rattus norvegicus
tatactctctgtgcctgttgcaaat

SEQ ID NO: 565164 - DNA, 25 bp, Rattus norvegicus
tatactcttctgagaggtctgcgtc

SEQ ID NO: 565165 - DNA, 25 bp, Rattus norvegicus
tatactcttctgtgaggtctgcgtc

SEQ ID NO: 565166 - DNA, 25 bp, Rattus norvegicus
tatactgaaactagctattggctag

SEQ ID NO: 565167 - DNA, 25 bp, Rattus norvegicus
tatactgaaacttgctattggctag

SEQ ID NO: 565168 - DNA, 25 bp, Rattus norvegicus
tatactgacaccaaactcatgctgt

SEQ ID NO: 565169 - DNA, 25 bp, Rattus norvegicus
tatactgacacctaactcatgctgt

SEQ ID NO: 565170 - DNA, 25 bp, Rattus norvegicus
tatactgacccgcagcctaggaatt

SEQ ID NO: 565171 - DNA, 25 bp, Rattus norvegicus
tatactgacccggagcctaggaatt

SEQ ID NO: 565172 - DNA, 25 bp, Rattus norvegicus
tatactgagacacctctgcctgcaa

SEQ ID NO: 565173 - DNA, 25 bp, Rattus norvegicus
tatactgagacagctctgcctgcaa

SEQ ID NO: 565174 - DNA, 25 bp, Rattus norvegicus
tatactgcactaagtggatttccaa

SEQ ID NO: 565175 - DNA, 25 bp, Rattus norvegicus
tatactgcactatgtggatttccaa

SEQ ID NO: 565176 - DNA, 25 bp, Rattus norvegicus
tatactgcccagcagttccgcaatg

SEQ ID NO: 565177 - DNA, 25 bp, Rattus norvegicus
tatactgcccaggagttccgcaatg

SEQ ID NO: 565178 - DNA, 25 bp, Rattus norvegicus
tatactgcccggagaagtcctcaga

SEQ ID NO: 565179 - DNA, 25 bp, Rattus norvegicus
tatactgcccggtgaagtcctcaga

SEQ ID NO: 565180 - DNA, 25 bp, Rattus norvegicus
tatactgctcagcttaaccatctca

SEQ ID NO: 565181 - DNA, 25 bp, Rattus norvegicus
tatactgctcaggttaaccatctca

SEQ ID NO: 565182 - DNA, 25 bp, Rattus norvegicus
tatactgctgaacgcggttgtccgt

SEQ ID NO: 565183 - DNA, 25 bp, Rattus norvegicus
tatactgctgaaggcggttgtccgt

SEQ ID NO: 565184 - DNA, 25 bp, Rattus norvegicus
tatactggaatcctacagctcccaa

SEQ ID NO: 565185 - DNA, 25 bp, Rattus norvegicus
tatactggaatcgtacagctcccaa

SEQ ID NO: 565186 - DNA, 25 bp, Rattus norvegicus
tatactgtagttaggctgtgctgcc

SEQ ID NO: 565187 - DNA, 25 bp, Rattus norvegicus
tatactgtagtttggctgtgctgcc

SEQ ID NO: 565188 - DNA, 25 bp, Rattus norvegicus
tatactgtcatccatctggttccta

SEQ ID NO: 565189 - DNA, 25 bp, Rattus norvegicus
tatactgtcatcgatctggttccta

SEQ ID NO: 565190 - DNA, 25 bp, Rattus norvegicus
tatactgtgggcaagtggttctggt

SEQ ID NO: 565191 - DNA, 25 bp, Rattus norvegicus
tatactgtgggctagtggttctggt

SEQ ID NO: 565192 - DNA, 25 bp, Rattus norvegicus
tatactgttctgagaggactgccct

SEQ ID NO: 565193 - DNA, 25 bp, Rattus norvegicus
tatactgttctgtgaggactgccct

SEQ ID NO: 565194 - DNA, 25 bp, Rattus norvegicus
tatactgtttacctttttccatgga

SEQ ID NO: 565195 - DNA, 25 bp, Rattus norvegicus
tatactgtttacgtttttccatgga

SEQ ID NO: 565196 - DNA, 25 bp, Rattus norvegicus
tatacttacaggatggtctcttttt

SEQ ID NO: 565197 - DNA, 25 bp, Rattus norvegicus
tatacttacaggttggtctcttttt

SEQ ID NO: 565198 - DNA, 25 bp, Rattus norvegicus
tatacttagcctccattcttccttt

SEQ ID NO: 565199 - DNA, 25 bp, Rattus norvegicus
tatacttagcctgcattcttccttt

SEQ ID NO: 565200 - DNA, 25 bp, Rattus norvegicus
tatacttagtccaacagtctccttt

SEQ ID NO: 565201 - DNA, 25 bp, Rattus norvegicus
tatacttagtcctacagtctccttt

SEQ ID NO: 565202 - DNA, 25 bp, Rattus norvegicus
tatacttcagaaccgttggagtcca

SEQ ID NO: 565203 - DNA, 25 bp, Rattus norvegicus
tatacttcagaagcgttggagtcca

SEQ ID NO: 565204 - DNA, 25 bp, Rattus norvegicus
tatacttcagtaactctgtccgtta

SEQ ID NO: 565205 - DNA, 25 bp, Rattus norvegicus
tatacttcagtatctctgtccgtta

SEQ ID NO: 565206 - DNA, 25 bp, Rattus norvegicus
tatacttcattgattttcctccata

SEQ ID NO: 565207 - DNA, 25 bp, Rattus norvegicus
tatacttcattgtttttcctccata

SEQ ID NO: 565208 - DNA, 25 bp, Rattus norvegicus
tatacttccggtatcttgcagattc

SEQ ID NO: 565209 - DNA, 25 bp, Rattus norvegicus
tatacttccggtttcttgcagattc

SEQ ID NO: 565210 - DNA, 25 bp, Rattus norvegicus
tatacttcctagctaactcagccaa

SEQ ID NO: 565211 - DNA, 25 bp, Rattus norvegicus
tatacttcctaggtaactcagccaa

SEQ ID NO: 565212 - DNA, 25 bp, Rattus norvegicus
tatacttctacacccgtgtgtgatt

SEQ ID NO: 565213 - DNA, 25 bp, Rattus norvegicus
tatacttctacagccgtgtgtgatt

SEQ ID NO: 565214 - DNA, 25 bp, Rattus norvegicus
tatacttctcagctgccatagtgga

SEQ ID NO: 565215 - DNA, 25 bp, Rattus norvegicus
tatacttctcaggtgccatagtgga

SEQ ID NO: 565216 - DNA, 25 bp, Rattus norvegicus
tatacttctgaaatcccaacgggtg

SEQ ID NO: 565217 - DNA, 25 bp, Rattus norvegicus
tatacttctgaattcccaacgggtg

SEQ ID NO: 565218 - DNA, 25 bp, Rattus norvegicus
tatacttctggcatttccacattgc

SEQ ID NO: 565219 - DNA, 25 bp, Rattus norvegicus
tatacttctggcttttccacattgc

SEQ ID NO: 565220 - DNA, 25 bp, Rattus norvegicus
tatacttcttctcttgcttgtcaca

SEQ ID NO: 565221 - DNA, 25 bp, Rattus norvegicus
tatacttcttctgttgcttgtcaca

SEQ ID NO: 565222 - DNA, 25 bp, Rattus norvegicus
tatacttgtacaaattcctgcctgt

SEQ ID NO: 565223 - DNA, 25 bp, Rattus norvegicus
tatacttgtacatattcctgcctgt

SEQ ID NO: 565224 - DNA, 25 bp, Rattus norvegicus
tatacttgtcgcagaagtgccatat

SEQ ID NO: 565225 - DNA, 25 bp, Rattus norvegicus
tatacttgtcgctgaagtgccatat

SEQ ID NO: 565226 - DNA, 25 bp, Rattus norvegicus
tatacttgttctcatccctgtacac

SEQ ID NO: 565227 - DNA, 25 bp, Rattus norvegicus
tatacttgttctgatccctgtacac

SEQ ID NO: 565228 - DNA, 25 bp, Rattus norvegicus
tatactttctgaaaggtcgtttgcc

SEQ ID NO: 565229 - DNA, 25 bp, Rattus norvegicus
tatactttctgataggtcgtttgcc

SEQ ID NO: 565230 - DNA, 25 bp, Rattus norvegicus
tatactttgagtattagattggcca

SEQ ID NO: 565231 - DNA, 25 bp, Rattus norvegicus
tatactttgagttttagattggcca

SEQ ID NO: 565232 - DNA, 25 bp, Rattus norvegicus
tatacttttctaattttccctgcct

SEQ ID NO: 565233 - DNA, 25 bp, Rattus norvegicus
tatacttttctatttttccctgcct

SEQ ID NO: 565234 - DNA, 25 bp, Rattus norvegicus
tatagaaaatgtccccaggttcctg

SEQ ID NO: 565235 - DNA, 25 bp, Rattus norvegicus
tatagaaaatgtgcccaggttcctg

SEQ ID NO: 565236 - DNA, 25 bp, Rattus norvegicus
tatagaaagcctcaccctgtatttg

SEQ ID NO: 565237 - DNA, 25 bp, Rattus norvegicus
tatagaaagcctgaccctgtatttg

SEQ ID NO: 565238 - DNA, 25 bp, Rattus norvegicus
tatagaacatctctcaggcctctaa

SEQ ID NO: 565239 - DNA, 25 bp, Rattus norvegicus
tatagaacatctgtcaggcctctaa

SEQ ID NO: 565240 - DNA, 25 bp, Rattus norvegicus
tatagaactccccatattagcactc

SEQ ID NO: 565241 - DNA, 25 bp, Rattus norvegicus
tatagaactcccgatattagcactc

SEQ ID NO: 565242 - DNA, 25 bp, Rattus norvegicus
tatagaactctcagcgacctcttca

SEQ ID NO: 565243 - DNA, 25 bp, Rattus norvegicus
tatagaactctctgcgacctcttca

SEQ ID NO: 565244 - DNA, 25 bp, Rattus norvegicus
tatagaacttttcgctccttcagca

SEQ ID NO: 565245 - DNA, 25 bp, Rattus norvegicus
tatagaacttttggctccttcagca

SEQ ID NO: 565246 - DNA, 25 bp, Rattus norvegicus
tatagaagataactggcctcatttc

SEQ ID NO: 565247 - DNA, 25 bp, Rattus norvegicus
tatagaagataagtggcctcatttc

SEQ ID NO: 565248 - DNA, 25 bp, Rattus norvegicus
tatagaagatccctagcggccttgg

SEQ ID NO: 565249 - DNA, 25 bp, Rattus norvegicus
tatagaagatccgtagcggccttgg

SEQ ID NO: 565250 - DNA, 25 bp, Rattus norvegicus
tatagaaggaacacccttagccctt

SEQ ID NO: 565251 - DNA, 25 bp, Rattus norvegicus
tatagaaggaactcccttagccctt

SEQ ID NO: 565252 - DNA, 25 bp, Rattus norvegicus
tatagaagggtcatatcccctctgc

SEQ ID NO: 565253 - DNA, 25 bp, Rattus norvegicus
tatagaagggtcttatcccctctgc

SEQ ID NO: 565254 - DNA, 25 bp, Rattus norvegicus
tatagaagtagcacctgaacacccc

SEQ ID NO: 565255 - DNA, 25 bp, Rattus norvegicus
tatagaagtagctcctgaacacccc

SEQ ID NO: 565256 - DNA, 25 bp, Rattus norvegicus
tatagaagtcatcggctgtgagctg

SEQ ID NO: 565257 - DNA, 25 bp, Rattus norvegicus
tatagaagtcatgggctgtgagctg

SEQ ID NO: 565258 - DNA, 25 bp, Rattus norvegicus
tatagaatctcacagcaccggaagt

SEQ ID NO: 565259 - DNA, 25 bp, Rattus norvegicus
tatagaatctcagagcaccggaagt

SEQ ID NO: 565260 - DNA, 25 bp, Rattus norvegicus
tatagaatgccgagttaccctgccc

SEQ ID NO: 565261 - DNA, 25 bp, Rattus norvegicus
tatagaatgccgtgttaccctgccc

SEQ ID NO: 565262 - DNA, 25 bp, Rattus norvegicus
tatagaatggagagccacccctggt

SEQ ID NO: 565263 - DNA, 25 bp, Rattus norvegicus
tatagaatggagtgccacccctggt

SEQ ID NO: 565264 - DNA, 25 bp, Rattus norvegicus
tatagaatgtataccccgtctcttc

SEQ ID NO: 565265 - DNA, 25 bp, Rattus norvegicus
tatagaatgtattccccgtctcttc

SEQ ID NO: 565266 - DNA, 25 bp, Rattus norvegicus
tatagaatttatcccttagccacat

SEQ ID NO: 565267 - DNA, 25 bp, Rattus norvegicus
tatagaatttatgccttagccacat

SEQ ID NO: 565268 - DNA, 25 bp, Rattus norvegicus
tatagacaaaccagtccccaatcta

SEQ ID NO: 565269 - DNA, 25 bp, Rattus norvegicus
tatagacaaacctgtccccaatcta

SEQ ID NO: 565270 - DNA, 25 bp, Rattus norvegicus
tatagacaatgaccagcggccgggt

SEQ ID NO: 565271 - DNA, 25 bp, Rattus norvegicus
tatagacaatgagcagcggccgggt

SEQ ID NO: 565272 - DNA, 25 bp, Rattus norvegicus
tatagacaccaccatgcgcggaggc

SEQ ID NO: 565273 - DNA, 25 bp, Rattus norvegicus
tatagacaccacgatgcgcggaggc

SEQ ID NO: 565274 - DNA, 25 bp, Rattus norvegicus
tatagacaccagatatagacggctg

SEQ ID NO: 565275 - DNA, 25 bp, Rattus norvegicus
tatagacaccagttatagacggctg

SEQ ID NO: 565276 - DNA, 25 bp, Rattus norvegicus
tatagacatgacattatgagtcaag

SEQ ID NO: 565277 - DNA, 25 bp, Rattus norvegicus
tatagacatgactttatgagtcaag

SEQ ID NO: 565278 - DNA, 25 bp, Rattus norvegicus
tatagaccactcagatcaagcctct

SEQ ID NO: 565279 - DNA, 25 bp, Rattus norvegicus
tatagaccactctgatcaagcctct

SEQ ID NO: 565280 - DNA, 25 bp, Rattus norvegicus
tatagaccaggcaacatagaccacc

SEQ ID NO: 565281 - DNA, 25 bp, Rattus norvegicus
tatagaccaggctacatagaccacc

SEQ ID NO: 565282 - DNA, 25 bp, Rattus norvegicus
tatagacccaagaatgctgctcatg

SEQ ID NO: 565283 - DNA, 25 bp, Rattus norvegicus
tatagacccaagtatgctgctcatg

SEQ ID NO: 565284 - DNA, 25 bp, Rattus norvegicus
tatagaccgctaagggcctgggcac

SEQ ID NO: 565285 - DNA, 25 bp, Rattus norvegicus
tatagaccgctatgggcctgggcac

SEQ ID NO: 565286 - DNA, 25 bp, Rattus norvegicus
tatagacctttgctccagtatgtgc

SEQ ID NO: 565287 - DNA, 25 bp, Rattus norvegicus
tatagacctttggtccagtatgtgc

SEQ ID NO: 565288 - DNA, 25 bp, Rattus norvegicus
tatagactccagcaacgggcaagat

SEQ ID NO: 565289 - DNA, 25 bp, Rattus norvegicus
tatagactccaggaacgggcaagat

SEQ ID NO: 565290 - DNA, 25 bp, Rattus norvegicus
tatagactcgccaaacacctacata

SEQ ID NO: 565291 - DNA, 25 bp, Rattus norvegicus
tatagactcgcctaacacctacata

SEQ ID NO: 565292 - DNA, 25 bp, Rattus norvegicus
tatagactggataactagctgccct

SEQ ID NO: 565293 - DNA, 25 bp, Rattus norvegicus
tatagactggattactagctgccct

SEQ ID NO: 565294 - DNA, 25 bp, Rattus norvegicus
tatagacttgtaccccatcgtgaaa

SEQ ID NO: 565295 - DNA, 25 bp, Rattus norvegicus
tatagacttgtagcccatcgtgaaa

SEQ ID NO: 565296 - DNA, 25 bp, Rattus norvegicus
tatagactttccaccaatctacagg

SEQ ID NO: 565297 - DNA, 25 bp, Rattus norvegicus
tatagactttcctccaatctacagg

SEQ ID NO: 565298 - DNA, 25 bp, Rattus norvegicus
tatagagagttacccctagctcact

SEQ ID NO: 565299 - DNA, 25 bp, Rattus norvegicus
tatagagagttagccctagctcact

SEQ ID NO: 565300 - DNA, 25 bp, Rattus norvegicus
tatagagatgtgagccttctgggat

SEQ ID NO: 565301 - DNA, 25 bp, Rattus norvegicus
tatagagatgtgtgccttctgggat

SEQ ID NO: 565302 - DNA, 25 bp, Rattus norvegicus
tatagagcaggcaacccattctggg

SEQ ID NO: 565303 - DNA, 25 bp, Rattus norvegicus
tatagagcaggctacccattctggg

SEQ ID NO: 565304 - DNA, 25 bp, Rattus norvegicus
tatagagccaataacctcttcctta

SEQ ID NO: 565305 - DNA, 25 bp, Rattus norvegicus
tatagagccaattacctcttcctta

SEQ ID NO: 565306 - DNA, 25 bp, Rattus norvegicus
tatagagcccaactatctttccctt

SEQ ID NO: 565307 - DNA, 25 bp, Rattus norvegicus
tatagagcccaagtatctttccctt

SEQ ID NO: 565308 - DNA, 25 bp, Rattus norvegicus
tatagagctgatccaagacgaatgt

SEQ ID NO: 565309 - DNA, 25 bp, Rattus norvegicus
tatagagctgatgcaagacgaatgt

SEQ ID NO: 565310 - DNA, 25 bp, Rattus norvegicus
tatagaggacacattttcccatttc

SEQ ID NO: 565311 - DNA, 25 bp, Rattus norvegicus
tatagaggacactttttcccatttc

SEQ ID NO: 565312 - DNA, 25 bp, Rattus norvegicus
tatagaggtccgagtgttcgcatca

SEQ ID NO: 565313 - DNA, 25 bp, Rattus norvegicus
tatagaggtccgtgtgttcgcatca

SEQ ID NO: 565314 - DNA, 25 bp, Rattus norvegicus
tatagatacagactggcactcctcc

SEQ ID NO: 565315 - DNA, 25 bp, Rattus norvegicus
tatagatacagagtggcactcctcc

SEQ ID NO: 565316 - DNA, 25 bp, Rattus norvegicus
tatagatatcaacctgccttacctg

SEQ ID NO: 565317 - DNA, 25 bp, Rattus norvegicus
tatagatatcaagctgccttacctg

SEQ ID NO: 565318 - DNA, 25 bp, Rattus norvegicus
tatagatctatcctagcatccctga

SEQ ID NO: 565319 - DNA, 25 bp, Rattus norvegicus
tatagatctatcgtagcatccctga

SEQ ID NO: 565320 - DNA, 25 bp, Rattus norvegicus
tatagatctgtgacccacatgctaa

SEQ ID NO: 565321 - DNA, 25 bp, Rattus norvegicus
tatagatctgtgtcccacatgctaa

SEQ ID NO: 565322 - DNA, 25 bp, Rattus norvegicus
tatagatgtacaattcccagccacc

SEQ ID NO: 565323 - DNA, 25 bp, Rattus norvegicus
tatagatgtacatttcccagccacc

SEQ ID NO: 565324 - DNA, 25 bp, Rattus norvegicus
tatagatgtcccaaggctgcatttg

SEQ ID NO: 565325 - DNA, 25 bp, Rattus norvegicus
tatagatgtccctaggctgcatttg

SEQ ID NO: 565326 - DNA, 25 bp, Rattus norvegicus
tatagattaatgacctcctcagtcc

SEQ ID NO: 565327 - DNA, 25 bp, Rattus norvegicus
tatagattaatgtcctcctcagtcc

SEQ ID NO: 565328 - DNA, 25 bp, Rattus norvegicus
tatagatttcatctagagcatccca

SEQ ID NO: 565329 - DNA, 25 bp, Rattus norvegicus
tatagatttcatgtagagcatccca

SEQ ID NO: 565330 - DNA, 25 bp, Rattus norvegicus
tatagattttccagcctccgtgtgc

SEQ ID NO: 565331 - DNA, 25 bp, Rattus norvegicus
tatagattttcctgcctccgtgtgc

SEQ ID NO: 565332 - DNA, 25 bp, Rattus norvegicus
tatagcaaacacctcaatcgccatt

SEQ ID NO: 565333 - DNA, 25 bp, Rattus norvegicus
tatagcaaacacgtcaatcgccatt

SEQ ID NO: 565334 - DNA, 25 bp, Rattus norvegicus
tatagcaacagcagggagtccctgg

SEQ ID NO: 565335 - DNA, 25 bp, Rattus norvegicus
tatagcaacagctgggagtccctgg

SEQ ID NO: 565336 - DNA, 25 bp, Rattus norvegicus
tatagcaaccccagtgaagcctgag

SEQ ID NO: 565337 - DNA, 25 bp, Rattus norvegicus
tatagcaacccctgtgaagcctgag

SEQ ID NO: 565338 - DNA, 25 bp, Rattus norvegicus
tatagcaactttactgactctggtc

SEQ ID NO: 565339 - DNA, 25 bp, Rattus norvegicus
tatagcaacttttctgactctggtc

SEQ ID NO: 565340 - DNA, 25 bp, Rattus norvegicus
tatagcacaataaaccccacttcag

SEQ ID NO: 565341 - DNA, 25 bp, Rattus norvegicus
tatagcacaatataccccacttcag

SEQ ID NO: 565342 - DNA, 25 bp, Rattus norvegicus
tatagcacacacaattctcaggaat

SEQ ID NO: 565343 - DNA, 25 bp, Rattus norvegicus
tatagcacacactattctcaggaat

SEQ ID NO: 565344 - DNA, 25 bp, Rattus norvegicus
tatagcactcgtattcaggaagcaa

SEQ ID NO: 565345 - DNA, 25 bp, Rattus norvegicus
tatagcactcgttttcaggaagcaa

SEQ ID NO: 565346 - DNA, 25 bp, Rattus norvegicus
tatagcactgcgatcatgtgtgagt

SEQ ID NO: 565347 - DNA, 25 bp, Rattus norvegicus
tatagcactgcgttcatgtgtgagt

SEQ ID NO: 565348 - DNA, 25 bp, Rattus norvegicus
tatagcagcatcatttcctttttcg

SEQ ID NO: 565349 - DNA, 25 bp, Rattus norvegicus
tatagcagcatcttttcctttttcg

SEQ ID NO: 565350 - DNA, 25 bp, Rattus norvegicus
tatagcagcctcctctcatttagtc

SEQ ID NO: 565351 - DNA, 25 bp, Rattus norvegicus
tatagcagcctcgtctcatttagtc

SEQ ID NO: 565352 - DNA, 25 bp, Rattus norvegicus
tatagcaggtgcagccagttgggca

SEQ ID NO: 565353 - DNA, 25 bp, Rattus norvegicus
tatagcaggtgctgccagttgggca

SEQ ID NO: 565354 - DNA, 25 bp, Rattus norvegicus
tatagcatcaagaaggcacacatct

SEQ ID NO: 565355 - DNA, 25 bp, Rattus norvegicus
tatagcatcaagtaggcacacatct

SEQ ID NO: 565356 - DNA, 25 bp, Rattus norvegicus
tatagcatcataacactgctgtgtt

SEQ ID NO: 565357 - DNA, 25 bp, Rattus norvegicus
tatagcatcatatcactgctgtgtt

SEQ ID NO: 565358 - DNA, 25 bp, Rattus norvegicus
tatagcatgccaagagtccttcctc

SEQ ID NO: 565359 - DNA, 25 bp, Rattus norvegicus
tatagcatgccatgagtccttcctc

SEQ ID NO: 565360 - DNA, 25 bp, Rattus norvegicus
tatagcatgtcccattaagccctgc

SEQ ID NO: 565361 - DNA, 25 bp, Rattus norvegicus
tatagcatgtccgattaagccctgc

SEQ ID NO: 565362 - DNA, 25 bp, Rattus norvegicus
tatagccacgtacggtgtcactatc

SEQ ID NO: 565363 - DNA, 25 bp, Rattus norvegicus
tatagccacgtagggtgtcactatc

SEQ ID NO: 565364 - DNA, 25 bp, Rattus norvegicus
tatagccactgcaggataggttccc

SEQ ID NO: 565365 - DNA, 25 bp, Rattus norvegicus
tatagccactgctggataggttccc

SEQ ID NO: 565366 - DNA, 25 bp, Rattus norvegicus
tatagccaggctacatccccaaaat

SEQ ID NO: 565367 - DNA, 25 bp, Rattus norvegicus
tatagccaggcttcatccccaaaat

SEQ ID NO: 565368 - DNA, 25 bp, Rattus norvegicus
tatagccagggcagactgctgcttc

SEQ ID NO: 565369 - DNA, 25 bp, Rattus norvegicus
tatagccagggccaactctcaaaat

SEQ ID NO: 565370 - DNA, 25 bp, Rattus norvegicus
tatagccagggcgaactctcaaaat

SEQ ID NO: 565371 - DNA, 25 bp, Rattus norvegicus
tatagccagggctgactgctgcttc

SEQ ID NO: 565372 - DNA, 25 bp, Rattus norvegicus
tatagccatcacagtcttgtttttt

SEQ ID NO: 565373 - DNA, 25 bp, Rattus norvegicus
tatagccatcactgtcttgtttttt

SEQ ID NO: 565374 - DNA, 25 bp, Rattus norvegicus
tatagccatttcactccacttttaa

SEQ ID NO: 565375 - DNA, 25 bp, Rattus norvegicus
tatagccatttctctccacttttaa

SEQ ID NO: 565376 - DNA, 25 bp, Rattus norvegicus
tatagcccatgtcatttgcttacat

SEQ ID NO: 565377 - DNA, 25 bp, Rattus norvegicus
tatagcccatgtgatttgcttacat

SEQ ID NO: 565378 - DNA, 25 bp, Rattus norvegicus
tatagccctcgcaggactggaactc

SEQ ID NO: 565379 - DNA, 25 bp, Rattus norvegicus
tatagccctcgctggactggaactc

SEQ ID NO: 565380 - DNA, 25 bp, Rattus norvegicus
tatagcctctgccaccttgtataaa

SEQ ID NO: 565381 - DNA, 25 bp, Rattus norvegicus
tatagcctctgcgaccttgtataaa

SEQ ID NO: 565382 - DNA, 25 bp, Rattus norvegicus
tatagcctcttcagaggcatcttct

SEQ ID NO: 565383 - DNA, 25 bp, Rattus norvegicus
tatagcctcttctgaggcatcttct

SEQ ID NO: 565384 - DNA, 25 bp, Rattus norvegicus
tatagcctgattagtcttgctctca

SEQ ID NO: 565385 - DNA, 25 bp, Rattus norvegicus
tatagcctgatttgtcttgctctca

SEQ ID NO: 565386 - DNA, 25 bp, Rattus norvegicus
tatagccttctcatctagcagatca

SEQ ID NO: 565387 - DNA, 25 bp, Rattus norvegicus
tatagccttctcttctagcagatca

SEQ ID NO: 565388 - DNA, 25 bp, Rattus norvegicus
tatagccttttgcttacttggtaag

SEQ ID NO: 565389 - DNA, 25 bp, Rattus norvegicus
tatagccttttggttacttggtaag

SEQ ID NO: 565390 - DNA, 25 bp, Rattus norvegicus
tatagcgaccaaaagtcacttctgg

SEQ ID NO: 565391 - DNA, 25 bp, Rattus norvegicus
tatagcgaccaatagtcacttctgg

SEQ ID NO: 565392 - DNA, 25 bp, Rattus norvegicus
tatagcgactttcctcctggaggca

SEQ ID NO: 565393 - DNA, 25 bp, Rattus norvegicus
tatagcgactttgctcctggaggca

SEQ ID NO: 565394 - DNA, 25 bp, Rattus norvegicus
tatagcgagtccatcacaaggtgat

SEQ ID NO: 565395 - DNA, 25 bp, Rattus norvegicus
tatagcgagtccttcacaaggtgat

SEQ ID NO: 565396 - DNA, 25 bp, Rattus norvegicus
tatagcgccccaccgagttccgtgg

SEQ ID NO: 565397 - DNA, 25 bp, Rattus norvegicus
tatagcgccccagcgagttccgtgg

SEQ ID NO: 565398 - DNA, 25 bp, Rattus norvegicus
tatagcgccgagagtagagctactc

SEQ ID NO: 565399 - DNA, 25 bp, Rattus norvegicus
tatagcgccgagtgtagagctactc

SEQ ID NO: 565400 - DNA, 25 bp, Rattus norvegicus
tatagcgcttttcagtccttgtaac

SEQ ID NO: 565401 - DNA, 25 bp, Rattus norvegicus
tatagcgcttttgagtccttgtaac

SEQ ID NO: 565402 - DNA, 25 bp, Rattus norvegicus
tatagcgtctttctcctgagcaata

SEQ ID NO: 565403 - DNA, 25 bp, Rattus norvegicus
tatagcgtctttgtcctgagcaata

SEQ ID NO: 565404 - DNA, 25 bp, Rattus norvegicus
tatagctagcacacagcaggcacca

SEQ ID NO: 565405 - DNA, 25 bp, Rattus norvegicus
tatagctagcactcagcaggcacca

SEQ ID NO: 565406 - DNA, 25 bp, Rattus norvegicus
tatagctagcctcggtgtacctttt

SEQ ID NO: 565407 - DNA, 25 bp, Rattus norvegicus
tatagctagcctgggtgtacctttt

SEQ ID NO: 565408 - DNA, 25 bp, Rattus norvegicus
tatagctatcctcccacagtgcttc

SEQ ID NO: 565409 - DNA, 25 bp, Rattus norvegicus
tatagctatcctgccacagtgcttc

SEQ ID NO: 565410 - DNA, 25 bp, Rattus norvegicus
tatagctatctccatcctgcctgag

SEQ ID NO: 565411 - DNA, 25 bp, Rattus norvegicus
tatagctatctcgatcctgcctgag

SEQ ID NO: 565412 - DNA, 25 bp, Rattus norvegicus
tatagctcagctacgccttgttaac

SEQ ID NO: 565413 - DNA, 25 bp, Rattus norvegicus
tatagctcagcttcgccttgttaac

SEQ ID NO: 565414 - DNA, 25 bp, Rattus norvegicus
tatagctcaggtcttgcaattatca

SEQ ID NO: 565415 - DNA, 25 bp, Rattus norvegicus
tatagctcaggtgttgcaattatca

SEQ ID NO: 565416 - DNA, 25 bp, Rattus norvegicus
tatagctccaatagcagcctgtttc

SEQ ID NO: 565417 - DNA, 25 bp, Rattus norvegicus
tatagctccaattgcagcctgtttc

SEQ ID NO: 565418 - DNA, 25 bp, Rattus norvegicus
tatagctccttgaactgttttttcc

SEQ ID NO: 565419 - DNA, 25 bp, Rattus norvegicus
tatagctccttgtactgttttttcc

SEQ ID NO: 565420 - DNA, 25 bp, Rattus norvegicus
tatagctcgattatcccctggaatg

SEQ ID NO: 565421 - DNA, 25 bp, Rattus norvegicus
tatagctcgattttcccctggaatg

SEQ ID NO: 565422 - DNA, 25 bp, Rattus norvegicus
tatagctcgtcccagtggatcagat

SEQ ID NO: 565423 - DNA, 25 bp, Rattus norvegicus
tatagctcgtccgagtggatcagat

SEQ ID NO: 565424 - DNA, 25 bp, Rattus norvegicus
tatagctctggtagtcctggcctca

SEQ ID NO: 565425 - DNA, 25 bp, Rattus norvegicus
tatagctctggttgtcctggcctca

SEQ ID NO: 565426 - DNA, 25 bp, Rattus norvegicus
tatagctgacttatttgaactgtag

SEQ ID NO: 565427 - DNA, 25 bp, Rattus norvegicus
tatagctgacttttttgaactgtag

SEQ ID NO: 565428 - DNA, 25 bp, Rattus norvegicus
tatagctgcaccacaacacacgaga

SEQ ID NO: 565429 - DNA, 25 bp, Rattus norvegicus
tatagctgcacctcaacacacgaga

SEQ ID NO: 565430 - DNA, 25 bp, Rattus norvegicus
tatagctgcagcactttgcacgaat

SEQ ID NO: 565431 - DNA, 25 bp, Rattus norvegicus
tatagctgcagctctttgcacgaat

SEQ ID NO: 565432 - DNA, 25 bp, Rattus norvegicus
tatagctgcctaaacgttctgctct

SEQ ID NO: 565433 - DNA, 25 bp, Rattus norvegicus
tatagctgcctatacgttctgctct

SEQ ID NO: 565434 - DNA, 25 bp, Rattus norvegicus
tatagctgcctgcattcctcaagga

SEQ ID NO: 565435 - DNA, 25 bp, Rattus norvegicus
tatagctgcctggattcctcaagga

SEQ ID NO: 565436 - DNA, 25 bp, Rattus norvegicus
tatagcttcaccaagaacttggctg

SEQ ID NO: 565437 - DNA, 25 bp, Rattus norvegicus
tatagcttcacctagaacttggctg

SEQ ID NO: 565438 - DNA, 25 bp, Rattus norvegicus
tatagctttcctaccctctagctga

SEQ ID NO: 565439 - DNA, 25 bp, Rattus norvegicus
tatagctttccttccctctagctga

SEQ ID NO: 565440 - DNA, 25 bp, Rattus norvegicus
tataggaaccctcaaagcaaagtag

SEQ ID NO: 565441 - DNA, 25 bp, Rattus norvegicus
tataggaaccctgaaagcaaagtag

SEQ ID NO: 565442 - DNA, 25 bp, Rattus norvegicus
tataggaccaccaccccttgttgtg

SEQ ID NO: 565443 - DNA, 25 bp, Rattus norvegicus
tataggaccacctccccttgttgtg

SEQ ID NO: 565444 - DNA, 25 bp, Rattus norvegicus
tataggactttgctctttccttttg

SEQ ID NO: 565445 - DNA, 25 bp, Rattus norvegicus
tataggactttggtctttccttttg

SEQ ID NO: 565446 - DNA, 25 bp, Rattus norvegicus
tataggattccccatgaccaagaat

SEQ ID NO: 565447 - DNA, 25 bp, Rattus norvegicus
tataggattcccgatgaccaagaat

SEQ ID NO: 565448 - DNA, 25 bp, Rattus norvegicus
tataggcaagccagtagagcatttt

SEQ ID NO: 565449 - DNA, 25 bp, Rattus norvegicus
tataggcaagcctgtagagcatttt

SEQ ID NO: 565450 - DNA, 25 bp, Rattus norvegicus
tataggcacgtgctttgggctgtac

SEQ ID NO: 565451 - DNA, 25 bp, Rattus norvegicus
tataggcacgtggtttgggctgtac

SEQ ID NO: 565452 - DNA, 25 bp, Rattus norvegicus
tataggcatgggatcttcccatcca

SEQ ID NO: 565453 - DNA, 25 bp, Rattus norvegicus
tataggcatgggttcttcccatcca

SEQ ID NO: 565454 - DNA, 25 bp, Rattus norvegicus
tataggccatttcccggctcccaga

SEQ ID NO: 565455 - DNA, 25 bp, Rattus norvegicus
tataggccatttgccggctcccaga

SEQ ID NO: 565456 - DNA, 25 bp, Rattus norvegicus
tataggccccacctcttgatcgagg

SEQ ID NO: 565457 - DNA, 25 bp, Rattus norvegicus
tataggccccacgtcttgatcgagg

SEQ ID NO: 565458 - DNA, 25 bp, Rattus norvegicus
tataggcctgggacctagtggttca

SEQ ID NO: 565459 - DNA, 25 bp, Rattus norvegicus
tataggcctgggtcctagtggttca

SEQ ID NO: 565460 - DNA, 25 bp, Rattus norvegicus
tataggcctggtacaccccaaataa

SEQ ID NO: 565461 - DNA, 25 bp, Rattus norvegicus
tataggcctggttcaccccaaataa

SEQ ID NO: 565462 - DNA, 25 bp, Rattus norvegicus
tataggccttggattcctcaatgct

SEQ ID NO: 565463 - DNA, 25 bp, Rattus norvegicus
tataggccttggtttcctcaatgct

SEQ ID NO: 565464 - DNA, 25 bp, Rattus norvegicus
tataggctaaaactccagaaacacc

SEQ ID NO: 565465 - DNA, 25 bp, Rattus norvegicus
tataggctaaaagtccagaaacacc

SEQ ID NO: 565466 - DNA, 25 bp, Rattus norvegicus
tataggctcagcacccagttagaac

SEQ ID NO: 565467 - DNA, 25 bp, Rattus norvegicus
tataggctcagctcccagttagaac

SEQ ID NO: 565468 - DNA, 25 bp, Rattus norvegicus
tataggctcattcatctcacttacg

SEQ ID NO: 565469 - DNA, 25 bp, Rattus norvegicus
tataggctcattgatctcacttacg

SEQ ID NO: 565470 - DNA, 25 bp, Rattus norvegicus
tataggctctaacgcccctattcca

SEQ ID NO: 565471 - DNA, 25 bp, Rattus norvegicus
tataggctctaaggcccctattcca

SEQ ID NO: 565472 - DNA, 25 bp, Rattus norvegicus
tataggctctggaagcttgtgtccc

SEQ ID NO: 565473 - DNA, 25 bp, Rattus norvegicus
tataggctctggtagcttgtgtccc

SEQ ID NO: 565474 - DNA, 25 bp, Rattus norvegicus
tataggctgcacatccatggactta

SEQ ID NO: 565475 - DNA, 25 bp, Rattus norvegicus
tataggctgcacttccatggactta

SEQ ID NO: 565476 - DNA, 25 bp, Rattus norvegicus
tataggcttatcaccatgatgggtg

SEQ ID NO: 565477 - DNA, 25 bp, Rattus norvegicus
tataggcttatctccatgatgggtg

SEQ ID NO: 565478 - DNA, 25 bp, Rattus norvegicus
tataggcttccgacacgtggtaatt

SEQ ID NO: 565479 - DNA, 25 bp, Rattus norvegicus
tataggcttccgtcacgtggtaatt

SEQ ID NO: 565480 - DNA, 25 bp, Rattus norvegicus
tatagggaaggtcttccctcaccca

SEQ ID NO: 565481 - DNA, 25 bp, Rattus norvegicus
tatagggaaggtgttccctcaccca

SEQ ID NO: 565482 - DNA, 25 bp, Rattus norvegicus
tatagggagacaagggtccaaggcc

SEQ ID NO: 565483 - DNA, 25 bp, Rattus norvegicus
tatagggagacatgggtccaaggcc

SEQ ID NO: 565484 - DNA, 25 bp, Rattus norvegicus
tatagggcactcagaggtaccctgt

SEQ ID NO: 565485 - DNA, 25 bp, Rattus norvegicus
tatagggcactctgaggtaccctgt

SEQ ID NO: 565486 - DNA, 25 bp, Rattus norvegicus
tatagggccaccaaggcagacaaca

SEQ ID NO: 565487 - DNA, 25 bp, Rattus norvegicus
tatagggccacctaggcagacaaca

SEQ ID NO: 565488 - DNA, 25 bp, Rattus norvegicus
tatagggccttgattcttgtgcacc

SEQ ID NO: 565489 - DNA, 25 bp, Rattus norvegicus
tatagggccttgtttcttgtgcacc

SEQ ID NO: 565490 - DNA, 25 bp, Rattus norvegicus
tatagggctcttctgtctactttca

SEQ ID NO: 565491 - DNA, 25 bp, Rattus norvegicus
tatagggctcttgtgtctactttca

SEQ ID NO: 565492 - DNA, 25 bp, Rattus norvegicus
tatagggtcctactgaagagccgat

SEQ ID NO: 565493 - DNA, 25 bp, Rattus norvegicus
tatagggtcctagtgaagagccgat

SEQ ID NO: 565494 - DNA, 25 bp, Rattus norvegicus
tatagggtcgagaacaccagccacc

SEQ ID NO: 565495 - DNA, 25 bp, Rattus norvegicus
tatagggtcgagtacaccagccacc

SEQ ID NO: 565496 - DNA, 25 bp, Rattus norvegicus
tatagggttcagagtcaggcttgtg

SEQ ID NO: 565497 - DNA, 25 bp, Rattus norvegicus
tatagggttcagtgtcaggcttgtg

SEQ ID NO: 565498 - DNA, 25 bp, Rattus norvegicus
tatagggtttctcacctttcaactt

SEQ ID NO: 565499 - DNA, 25 bp, Rattus norvegicus
tatagggtttctgacctttcaactt

SEQ ID NO: 565500 - DNA, 25 bp, Rattus norvegicus
tataggtaacttccacctcactggt

SEQ ID NO: 565501 - DNA, 25 bp, Rattus norvegicus
tataggtaacttgcacctcactggt

SEQ ID NO: 565502 - DNA, 25 bp, Rattus norvegicus
tataggtactcgcatccttcttatc

SEQ ID NO: 565503 - DNA, 25 bp, Rattus norvegicus
tataggtactcggatccttcttatc

SEQ ID NO: 565504 - DNA, 25 bp, Rattus norvegicus
tataggtaggtactcctgcccttag

SEQ ID NO: 565505 - DNA, 25 bp, Rattus norvegicus
tataggtaggtagtcctgcccttag

SEQ ID NO: 565506 - DNA, 25 bp, Rattus norvegicus
tataggtcacacacggccatttatg

SEQ ID NO: 565507 - DNA, 25 bp, Rattus norvegicus
tataggtcacactcggccatttatg

SEQ ID NO: 565508 - DNA, 25 bp, Rattus norvegicus
tataggtgagcacgcgccccgagaa

SEQ ID NO: 565509 - DNA, 25 bp, Rattus norvegicus
tataggtgagcaggcgccccgagaa

SEQ ID NO: 565510 - DNA, 25 bp, Rattus norvegicus
tataggtgtcacagggtccagtcca

SEQ ID NO: 565511 - DNA, 25 bp, Rattus norvegicus
tataggtgtcactgggtccagtcca

SEQ ID NO: 565512 - DNA, 25 bp, Rattus norvegicus
tataggttcaacatggctgccgggc

SEQ ID NO: 565513 - DNA, 25 bp, Rattus norvegicus
tataggttcaacttggctgccgggc

SEQ ID NO: 565514 - DNA, 25 bp, Rattus norvegicus
tataggttcattatggtgccaagtg

SEQ ID NO: 565515 - DNA, 25 bp, Rattus norvegicus
tataggttcattttggtgccaagtg

SEQ ID NO: 565516 - DNA, 25 bp, Rattus norvegicus
tataggttctagctcctctgtgaga

SEQ ID NO: 565517 - DNA, 25 bp, Rattus norvegicus
tataggttctaggtcctctgtgaga

SEQ ID NO: 565518 - DNA, 25 bp, Rattus norvegicus
tataggtttcctctatcgtcacttc

SEQ ID NO: 565519 - DNA, 25 bp, Rattus norvegicus
tataggtttcctgtatcgtcacttc

SEQ ID NO: 565520 - DNA, 25 bp, Rattus norvegicus
tatagtaaacggattgacgttgtcg

SEQ ID NO: 565521 - DNA, 25 bp, Rattus norvegicus
tatagtaaacggtttgacgttgtcg

SEQ ID NO: 565522 - DNA, 25 bp, Rattus norvegicus
tatagtaaccagaacactcatgttt

SEQ ID NO: 565523 - DNA, 25 bp, Rattus norvegicus
tatagtaaccagtacactcatgttt

SEQ ID NO: 565524 - DNA, 25 bp, Rattus norvegicus
tatagtaaggcaaaacactgtatta

SEQ ID NO: 565525 - DNA, 25 bp, Rattus norvegicus
tatagtaaggcataacactgtatta

SEQ ID NO: 565526 - DNA, 25 bp, Rattus norvegicus
tatagtacttagaccgcagcgtttc

SEQ ID NO: 565527 - DNA, 25 bp, Rattus norvegicus
tatagtacttagtccgcagcgtttc

SEQ ID NO: 565528 - DNA, 25 bp, Rattus norvegicus
tatagtagagatccattgcttgttt

SEQ ID NO: 565529 - DNA, 25 bp, Rattus norvegicus
tatagtagagatgcattgcttgttt

SEQ ID NO: 565530 - DNA, 25 bp, Rattus norvegicus
tatagtagggacctgaccaagcccc

SEQ ID NO: 565531 - DNA, 25 bp, Rattus norvegicus
tatagtagggacgtgaccaagcccc

SEQ ID NO: 565532 - DNA, 25 bp, Rattus norvegicus
tatagtagtaccctcatctctgtgc

SEQ ID NO: 565533 - DNA, 25 bp, Rattus norvegicus
tatagtagtaccgtcatctctgtgc

SEQ ID NO: 565534 - DNA, 25 bp, Rattus norvegicus
tatagtattactctgaggcttaaga

SEQ ID NO: 565535 - DNA, 25 bp, Rattus norvegicus
tatagtattactgtgaggcttaaga

SEQ ID NO: 565536 - DNA, 25 bp, Rattus norvegicus
tatagtcaccacacttgggccacat

SEQ ID NO: 565537 - DNA, 25 bp, Rattus norvegicus
tatagtcaccactcttgggccacat

SEQ ID NO: 565538 - DNA, 25 bp, Rattus norvegicus
tatagtcacccccaggacgaatggg

SEQ ID NO: 565539 - DNA, 25 bp, Rattus norvegicus
tatagtcaccccgaggacgaatggg

SEQ ID NO: 565540 - DNA, 25 bp, Rattus norvegicus
tatagtcactgtaaggaagctttcc

SEQ ID NO: 565541 - DNA, 25 bp, Rattus norvegicus
tatagtcactgttaggaagctttcc

SEQ ID NO: 565542 - DNA, 25 bp, Rattus norvegicus
tatagtcagtaacaccaaaagcatg

SEQ ID NO: 565543 - DNA, 25 bp, Rattus norvegicus
tatagtcagtaagaccaaaagcatg

SEQ ID NO: 565544 - DNA, 25 bp, Rattus norvegicus
tatagtcattctaaacgttcgtcat

SEQ ID NO: 565545 - DNA, 25 bp, Rattus norvegicus
tatagtcattcttaacgttcgtcat

SEQ ID NO: 565546 - DNA, 25 bp, Rattus norvegicus
tatagtccaattacaacaaggagtt

SEQ ID NO: 565547 - DNA, 25 bp, Rattus norvegicus
tatagtccaatttcaacaaggagtt

SEQ ID NO: 565548 - DNA, 25 bp, Rattus norvegicus
tatagtccatttcccaggtctgaga

SEQ ID NO: 565549 - DNA, 25 bp, Rattus norvegicus
tatagtccatttgccaggtctgaga

SEQ ID NO: 565550 - DNA, 25 bp, Rattus norvegicus
tatagtcctaacacagaagccactg

SEQ ID NO: 565551 - DNA, 25 bp, Rattus norvegicus
tatagtcctaactcagaagccactg

SEQ ID NO: 565552 - DNA, 25 bp, Rattus norvegicus
tatagtcctggacgccatgtggcca

SEQ ID NO: 565553 - DNA, 25 bp, Rattus norvegicus
tatagtcctggaggccatgtggcca

SEQ ID NO: 565554 - DNA, 25 bp, Rattus norvegicus
tatagtcctttgacactcctttgga

SEQ ID NO: 565555 - DNA, 25 bp, Rattus norvegicus
tatagtcctttgtcactcctttgga

SEQ ID NO: 565556 - DNA, 25 bp, Rattus norvegicus
tatagtcgagctccacttgatcaca

SEQ ID NO: 565557 - DNA, 25 bp, Rattus norvegicus
tatagtcgagctgcacttgatcaca

SEQ ID NO: 565558 - DNA, 25 bp, Rattus norvegicus
tatagtcgtacccttgagcaaacag

SEQ ID NO: 565559 - DNA, 25 bp, Rattus norvegicus
tatagtcgtaccgttgagcaaacag

SEQ ID NO: 565560 - DNA, 25 bp, Rattus norvegicus
tatagtcgtcatacagaacccagcc

SEQ ID NO: 565561 - DNA, 25 bp, Rattus norvegicus
tatagtcgtcattcagaacccagcc

SEQ ID NO: 565562 - DNA, 25 bp, Rattus norvegicus
tatagtctctagacgtgtgtgtgtg

SEQ ID NO: 565563 - DNA, 25 bp, Rattus norvegicus
tatagtctctagtcgtgtgtgtgtg

SEQ ID NO: 565564 - DNA, 25 bp, Rattus norvegicus
tatagtctgcagcacacgttttctt

SEQ ID NO: 565565 - DNA, 25 bp, Rattus norvegicus
tatagtctgcaggacacgttttctt

SEQ ID NO: 565566 - DNA, 25 bp, Rattus norvegicus
tatagtctgtcaattgttctcattt

SEQ ID NO: 565567 - DNA, 25 bp, Rattus norvegicus
tatagtctgtcatttgttctcattt

SEQ ID NO: 565568 - DNA, 25 bp, Rattus norvegicus
tatagtgagagacctgctgcagcct

SEQ ID NO: 565569 - DNA, 25 bp, Rattus norvegicus
tatagtgagagagctgctgcagcct

SEQ ID NO: 565570 - DNA, 25 bp, Rattus norvegicus
tatagtgagtcacgagtgcacaggc

SEQ ID NO: 565571 - DNA, 25 bp, Rattus norvegicus
tatagtgagtcaggagtgcacaggc

SEQ ID NO: 565572 - DNA, 25 bp, Rattus norvegicus
tatagtgatgcacaggtccctggtg

SEQ ID NO: 565573 - DNA, 25 bp, Rattus norvegicus
tatagtgatgcagaggtccctggtg

SEQ ID NO: 565574 - DNA, 25 bp, Rattus norvegicus
tatagtgatggccttcagcatcctc

SEQ ID NO: 565575 - DNA, 25 bp, Rattus norvegicus
tatagtgatggcgttcagcatcctc

SEQ ID NO: 565576 - DNA, 25 bp, Rattus norvegicus
tatagtgatgtcctcctaaagggag

SEQ ID NO: 565577 - DNA, 25 bp, Rattus norvegicus
tatagtgatgtcgtcctaaagggag

SEQ ID NO: 565578 - DNA, 25 bp, Rattus norvegicus
tatagtgcaactcacggcttcctac

SEQ ID NO: 565579 - DNA, 25 bp, Rattus norvegicus
tatagtgcaactgacggcttcctac

SEQ ID NO: 565580 - DNA, 25 bp, Rattus norvegicus
tatagtgtcagcagcctaggccttt

SEQ ID NO: 565581 - DNA, 25 bp, Rattus norvegicus
tatagtgtcagctgcctaggccttt

SEQ ID NO: 565582 - DNA, 25 bp, Rattus norvegicus
tatagtgtcgagatgcaagcatgtc

SEQ ID NO: 565583 - DNA, 25 bp, Rattus norvegicus
tatagtgtcgagttgcaagcatgtc

SEQ ID NO: 565584 - DNA, 25 bp, Rattus norvegicus
tatagtgtctccaacctgctcaaag

SEQ ID NO: 565585 - DNA, 25 bp, Rattus norvegicus
tatagtgtctcctacctgctcaaag

SEQ ID NO: 565586 - DNA, 25 bp, Rattus norvegicus
tatagtgtctgtatctcctttttct

SEQ ID NO: 565587 - DNA, 25 bp, Rattus norvegicus
tatagtgtctgtttctcctttttct

SEQ ID NO: 565588 - DNA, 25 bp, Rattus norvegicus
tatagtgtgatacttttgtgtgatt

SEQ ID NO: 565589 - DNA, 25 bp, Rattus norvegicus
tatagtgtgatagttttgtgtgatt

SEQ ID NO: 565590 - DNA, 25 bp, Rattus norvegicus
tatagtgtgattaatcccagggcat

SEQ ID NO: 565591 - DNA, 25 bp, Rattus norvegicus
tatagtgtgatttatcccagggcat

SEQ ID NO: 565592 - DNA, 25 bp, Rattus norvegicus
tatagtgtgtaccagaagggcttac

SEQ ID NO: 565593 - DNA, 25 bp, Rattus norvegicus
tatagtgtgtacgagaagggcttac

SEQ ID NO: 565594 - DNA, 25 bp, Rattus norvegicus
tatagtgttaaaactcagctaacag

SEQ ID NO: 565595 - DNA, 25 bp, Rattus norvegicus
tatagtgttaaatctcagctaacag

SEQ ID NO: 565596 - DNA, 25 bp, Rattus norvegicus
tatagtgttctgctcatccctgctt

SEQ ID NO: 565597 - DNA, 25 bp, Rattus norvegicus
tatagtgttctggtcatccctgctt

SEQ ID NO: 565598 - DNA, 25 bp, Rattus norvegicus
tatagttagcttatcattgacagat

SEQ ID NO: 565599 - DNA, 25 bp, Rattus norvegicus
tatagttagcttttcattgacagat

SEQ ID NO: 565600 - DNA, 25 bp, Rattus norvegicus
tatagttatctactcccttggtgaa

SEQ ID NO: 565601 - DNA, 25 bp, Rattus norvegicus
tatagttatctagtcccttggtgaa

SEQ ID NO: 565602 - DNA, 25 bp, Rattus norvegicus
tatagttccgtgaggtcttttgggc

SEQ ID NO: 565603 - DNA, 25 bp, Rattus norvegicus
tatagttccgtgtggtcttttgggc

SEQ ID NO: 565604 - DNA, 25 bp, Rattus norvegicus
tatagttccttcaaattctttaaat

SEQ ID NO: 565605 - DNA, 25 bp, Rattus norvegicus
tatagttccttctaattctttaaat

SEQ ID NO: 565606 - DNA, 25 bp, Rattus norvegicus
tatagttcgtggaccctgaacaatg

SEQ ID NO: 565607 - DNA, 25 bp, Rattus norvegicus
tatagttcgtggtccctgaacaatg

SEQ ID NO: 565608 - DNA, 25 bp, Rattus norvegicus
tatagttctatgcttaccgttgtgc

SEQ ID NO: 565609 - DNA, 25 bp, Rattus norvegicus
tatagttctatggttaccgttgtgc

SEQ ID NO: 565610 - DNA, 25 bp, Rattus norvegicus
tatagttctattctcagtggatatc

SEQ ID NO: 565611 - DNA, 25 bp, Rattus norvegicus
tatagttctattgtcagtggatatc

SEQ ID NO: 565612 - DNA, 25 bp, Rattus norvegicus
tatagttctcctactctaaggtgaa

SEQ ID NO: 565613 - DNA, 25 bp, Rattus norvegicus
tatagttctccttctctaaggtgaa

SEQ ID NO: 565614 - DNA, 25 bp, Rattus norvegicus
tatagttctgaaatccccgttctgt

SEQ ID NO: 565615 - DNA, 25 bp, Rattus norvegicus
tatagttctgaattccccgttctgt

SEQ ID NO: 565616 - DNA, 25 bp, Rattus norvegicus
tatagttgagggaagcctcctgctt

SEQ ID NO: 565617 - DNA, 25 bp, Rattus norvegicus
tatagttgagggtagcctcctgctt

SEQ ID NO: 565618 - DNA, 25 bp, Rattus norvegicus
tatagttgggttagcggcctttgcc

SEQ ID NO: 565619 - DNA, 25 bp, Rattus norvegicus
tatagttgggtttgcggcctttgcc

SEQ ID NO: 565620 - DNA, 25 bp, Rattus norvegicus
tatagttgtcttcgattgcctccca

SEQ ID NO: 565621 - DNA, 25 bp, Rattus norvegicus
tatagttgtcttggattgcctccca

SEQ ID NO: 565622 - DNA, 25 bp, Rattus norvegicus
tatagtttacttctgctcttctgtg

SEQ ID NO: 565623 - DNA, 25 bp, Rattus norvegicus
tatagtttacttgtgctcttctgtg

SEQ ID NO: 565624 - DNA, 25 bp, Rattus norvegicus
tatagtttccaaaggtcgagagcaa

SEQ ID NO: 565625 - DNA, 25 bp, Rattus norvegicus
tatagtttccaatggtcgagagcaa

SEQ ID NO: 565626 - DNA, 25 bp, Rattus norvegicus
tatagttttctccattttcccaagt

SEQ ID NO: 565627 - DNA, 25 bp, Rattus norvegicus
tatagttttctcgattttcccaagt

SEQ ID NO: 565628 - DNA, 25 bp, Rattus norvegicus
tatagttttgggacttttgctgctc

SEQ ID NO: 565629 - DNA, 25 bp, Rattus norvegicus
tatagttttgggtcttttgctgctc

SEQ ID NO: 565630 - DNA, 25 bp, Rattus norvegicus
tatataaaaacgctgacctcaggtc

SEQ ID NO: 565631 - DNA, 25 bp, Rattus norvegicus
tatataaaaacggtgacctcaggtc

SEQ ID NO: 565632 - DNA, 25 bp, Rattus norvegicus
tatataaatattacagtgccccatg

SEQ ID NO: 565633 - DNA, 25 bp, Rattus norvegicus
tatataaatatttcagtgccccatg

SEQ ID NO: 565634 - DNA, 25 bp, Rattus norvegicus
tatataactctgcactacttctctg

SEQ ID NO: 565635 - DNA, 25 bp, Rattus norvegicus
tatataactctggactacttctctg

SEQ ID NO: 565636 - DNA, 25 bp, Rattus norvegicus
tatataataagtatgggaccctgtt

SEQ ID NO: 565637 - DNA, 25 bp, Rattus norvegicus
tatataataagtttgggaccctgtt

SEQ ID NO: 565638 - DNA, 25 bp, Rattus norvegicus
tatataatctggcttctgcctctac

SEQ ID NO: 565639 - DNA, 25 bp, Rattus norvegicus
tatataatctgggttctgcctctac

SEQ ID NO: 565640 - DNA, 25 bp, Rattus norvegicus
tatataattatacgccgttacccaa

SEQ ID NO: 565641 - DNA, 25 bp, Rattus norvegicus
tatataattataggccgttacccaa

SEQ ID NO: 565642 - DNA, 25 bp, Rattus norvegicus
tatataattttaagccaccagggcc

SEQ ID NO: 565643 - DNA, 25 bp, Rattus norvegicus
tatataattttatgccaccagggcc

SEQ ID NO: 565644 - DNA, 25 bp, Rattus norvegicus
tatataatttttactctcttccttt

SEQ ID NO: 565645 - DNA, 25 bp, Rattus norvegicus
tatataattttttctctcttccttt

SEQ ID NO: 565646 - DNA, 25 bp, Rattus norvegicus
tatatacaatgccatgcctctctga

SEQ ID NO: 565647 - DNA, 25 bp, Rattus norvegicus
tatatacaatgcgatgcctctctga

SEQ ID NO: 565648 - DNA, 25 bp, Rattus norvegicus
tatatacacctaccttgactccttc

SEQ ID NO: 565649 - DNA, 25 bp, Rattus norvegicus
tatatacacctagcttgactccttc

SEQ ID NO: 565650 - DNA, 25 bp, Rattus norvegicus
tatatacacgccaagttgctgcact

SEQ ID NO: 565651 - DNA, 25 bp, Rattus norvegicus
tatatacacgcctagttgctgcact

SEQ ID NO: 565652 - DNA, 25 bp, Rattus norvegicus
tatatacatgctcagatttcctttt

SEQ ID NO: 565653 - DNA, 25 bp, Rattus norvegicus
tatatacatgctgagatttcctttt

SEQ ID NO: 565654 - DNA, 25 bp, Rattus norvegicus
tatataccctagatgtttcctaaca

SEQ ID NO: 565655 - DNA, 25 bp, Rattus norvegicus
tatataccctagttgtttcctaaca

SEQ ID NO: 565656 - DNA, 25 bp, Rattus norvegicus
tatatacctgggactaaccacgctc

SEQ ID NO: 565657 - DNA, 25 bp, Rattus norvegicus
tatatacctgggtctaaccacgctc

SEQ ID NO: 565658 - DNA, 25 bp, Rattus norvegicus
tatataccttatacatccttatgca

SEQ ID NO: 565659 - DNA, 25 bp, Rattus norvegicus
tatataccttattcatccttatgca

SEQ ID NO: 565660 - DNA, 25 bp, Rattus norvegicus
tatatacgacgtaccagggtgcagg

SEQ ID NO: 565661 - DNA, 25 bp, Rattus norvegicus
tatatacgacgttccagggtgcagg

SEQ ID NO: 565662 - DNA, 25 bp, Rattus norvegicus
tatatactatctcccttcgttccta

SEQ ID NO: 565663 - DNA, 25 bp, Rattus norvegicus
tatatactatctgccttcgttccta

SEQ ID NO: 565664 - DNA, 25 bp, Rattus norvegicus
tatatactgtataacctagacggat

SEQ ID NO: 565665 - DNA, 25 bp, Rattus norvegicus
tatatactgtattacctagacggat

SEQ ID NO: 565666 - DNA, 25 bp, Rattus norvegicus
tatatacttacaccctgagagccct

SEQ ID NO: 565667 - DNA, 25 bp, Rattus norvegicus
tatatacttacagcctgagagccct

SEQ ID NO: 565668 - DNA, 25 bp, Rattus norvegicus
tatatactttccagtatagcccctc

SEQ ID NO: 565669 - DNA, 25 bp, Rattus norvegicus
tatatactttcctgtatagcccctc

SEQ ID NO: 565670 - DNA, 25 bp, Rattus norvegicus
tatatagacattactgcgcacgcgc

SEQ ID NO: 565671 - DNA, 25 bp, Rattus norvegicus
tatatagacatttctgcgcacgcgc

SEQ ID NO: 565672 - DNA, 25 bp, Rattus norvegicus
tatatagaccagaccggccatgagc

SEQ ID NO: 565673 - DNA, 25 bp, Rattus norvegicus
tatatagaccagtccggccatgagc

SEQ ID NO: 565674 - DNA, 25 bp, Rattus norvegicus
tatatagatgcaaacctgcccttgc

SEQ ID NO: 565675 - DNA, 25 bp, Rattus norvegicus
tatatagatgcatacctgcccttgc

SEQ ID NO: 565676 - DNA, 25 bp, Rattus norvegicus
tatatagcatctcaaagcccgtgga

SEQ ID NO: 565677 - DNA, 25 bp, Rattus norvegicus
tatatagcatctgaaagcccgtgga

SEQ ID NO: 565678 - DNA, 25 bp, Rattus norvegicus
tatatagccacacagtcctttcttg

SEQ ID NO: 565679 - DNA, 25 bp, Rattus norvegicus
tatatagccacagagtcctttcttg

SEQ ID NO: 565680 - DNA, 25 bp, Rattus norvegicus
tatatagccctgcatggtctggaac

SEQ ID NO: 565681 - DNA, 25 bp, Rattus norvegicus
tatatagccctggatggtctggaac

SEQ ID NO: 565682 - DNA, 25 bp, Rattus norvegicus
tatatagcgagtaccagtacagtca

SEQ ID NO: 565683 - DNA, 25 bp, Rattus norvegicus
tatatagcgagttccagtacagtca

SEQ ID NO: 565684 - DNA, 25 bp, Rattus norvegicus
tatatagctccaccttatcaaacca

SEQ ID NO: 565685 - DNA, 25 bp, Rattus norvegicus
tatatagctccagcttatcaaacca

SEQ ID NO: 565686 - DNA, 25 bp, Rattus norvegicus
tatataggtccccagctagcatggg

SEQ ID NO: 565687 - DNA, 25 bp, Rattus norvegicus
tatataggtcccgagctagcatggg

SEQ ID NO: 565688 - DNA, 25 bp, Rattus norvegicus
tatataggtcctagctctggcctct

SEQ ID NO: 565689 - DNA, 25 bp, Rattus norvegicus
tatataggtccttgctctggcctct

SEQ ID NO: 565690 - DNA, 25 bp, Rattus norvegicus
tatataggtgttagtgtttttcaat

SEQ ID NO: 565691 - DNA, 25 bp, Rattus norvegicus
tatataggtgtttgtgtttttcaat

SEQ ID NO: 565692 - DNA, 25 bp, Rattus norvegicus
tatatagtacccctgatctttcctc

SEQ ID NO: 565693 - DNA, 25 bp, Rattus norvegicus
tatatagtacccgtgatctttcctc

SEQ ID NO: 565694 - DNA, 25 bp, Rattus norvegicus
tatatagttaacacaggcactgtct

SEQ ID NO: 565695 - DNA, 25 bp, Rattus norvegicus
tatatagttaactcaggcactgtct

SEQ ID NO: 565696 - DNA, 25 bp, Rattus norvegicus
tatatagttccgatacacccagggc

SEQ ID NO: 565697 - DNA, 25 bp, Rattus norvegicus
tatatagttccgttacacccagggc

SEQ ID NO: 565698 - DNA, 25 bp, Rattus norvegicus
tatatatactccacatttcctctaa

SEQ ID NO: 565699 - DNA, 25 bp, Rattus norvegicus
tatatatactcctcatttcctctaa

SEQ ID NO: 565700 - DNA, 25 bp, Rattus norvegicus
tatatatactgcagacggtctcttc

SEQ ID NO: 565701 - DNA, 25 bp, Rattus norvegicus
tatatatactgctgacggtctcttc

SEQ ID NO: 565702 - DNA, 25 bp, Rattus norvegicus
tatatatcaaatcaacaaggtccct

SEQ ID NO: 565703 - DNA, 25 bp, Rattus norvegicus
tatatatcaaatgaacaaggtccct

SEQ ID NO: 565704 - DNA, 25 bp, Rattus norvegicus
tatatatctataagcatactgtgtg

SEQ ID NO: 565705 - DNA, 25 bp, Rattus norvegicus
tatatatctatatgcatactgtgtg

SEQ ID NO: 565706 - DNA, 25 bp, Rattus norvegicus
tatatatctcagatttctgcagcag

SEQ ID NO: 565707 - DNA, 25 bp, Rattus norvegicus
tatatatctcagttttctgcagcag

SEQ ID NO: 565708 - DNA, 25 bp, Rattus norvegicus
tatatatctgacctcatcacccttt

SEQ ID NO: 565709 - DNA, 25 bp, Rattus norvegicus
tatatatctgacgtcatcacccttt

SEQ ID NO: 565710 - DNA, 25 bp, Rattus norvegicus
tatatatcttggctggactcatcat

SEQ ID NO: 565711 - DNA, 25 bp, Rattus norvegicus
tatatatcttgggtggactcatcat

SEQ ID NO: 565712 - DNA, 25 bp, Rattus norvegicus
tatatatgaaaactcttgtgcctga

SEQ ID NO: 565713 - DNA, 25 bp, Rattus norvegicus
tatatatgaaaagtcttgtgcctga

SEQ ID NO: 565714 - DNA, 25 bp, Rattus norvegicus
tatatatgatctactgctcttccct

SEQ ID NO: 565715 - DNA, 25 bp, Rattus norvegicus
tatatatgatcttctgctcttccct

SEQ ID NO: 565716 - DNA, 25 bp, Rattus norvegicus
tatatatgccttcttcaaccgggac

SEQ ID NO: 565717 - DNA, 25 bp, Rattus norvegicus
tatatatgccttgttcaaccgggac

SEQ ID NO: 565718 - DNA, 25 bp, Rattus norvegicus
tatatatgcgctaaacttttgggtt

SEQ ID NO: 565719 - DNA, 25 bp, Rattus norvegicus
tatatatgcgcttaacttttgggtt

SEQ ID NO: 565720 - DNA, 25 bp, Rattus norvegicus
tatatatggttacactccacgcctg

SEQ ID NO: 565721 - DNA, 25 bp, Rattus norvegicus
tatatatggttagactccacgcctg

SEQ ID NO: 565722 - DNA, 25 bp, Rattus norvegicus
tatatatgtcttcaccatcacccat

SEQ ID NO: 565723 - DNA, 25 bp, Rattus norvegicus
tatatatgtcttgaccatcacccat

SEQ ID NO: 565724 - DNA, 25 bp, Rattus norvegicus
tatatattaaacatactgtaactgt

SEQ ID NO: 565725 - DNA, 25 bp, Rattus norvegicus
tatatattaaacttactgtaactgt

SEQ ID NO: 565726 - DNA, 25 bp, Rattus norvegicus
tatatattatttattgttctctctc

SEQ ID NO: 565727 - DNA, 25 bp, Rattus norvegicus
tatatattattttttgttctctctc

SEQ ID NO: 565728 - DNA, 25 bp, Rattus norvegicus
tatatattccttacagccccattaa

SEQ ID NO: 565729 - DNA, 25 bp, Rattus norvegicus
tatatattcctttcagccccattaa

SEQ ID NO: 565730 - DNA, 25 bp, Rattus norvegicus
tatatattctcactctgaccacaca

SEQ ID NO: 565731 - DNA, 25 bp, Rattus norvegicus
tatatattctcagtctgaccacaca

SEQ ID NO: 565732 - DNA, 25 bp, Rattus norvegicus
tatatatttcccctctaagaaccct

SEQ ID NO: 565733 - DNA, 25 bp, Rattus norvegicus
tatatatttcccgtctaagaaccct

SEQ ID NO: 565734 - DNA, 25 bp, Rattus norvegicus
tatatcaacccaccctgtttttata

SEQ ID NO: 565735 - DNA, 25 bp, Rattus norvegicus
tatatcaacccagcctgtttttata

SEQ ID NO: 565736 - DNA, 25 bp, Rattus norvegicus
tatatcaattacacctttcccaagc

SEQ ID NO: 565737 - DNA, 25 bp, Rattus norvegicus
tatatcaattactcctttcccaagc

SEQ ID NO: 565738 - DNA, 25 bp, Rattus norvegicus
tatatcaatttcaaggcacgtggga

SEQ ID NO: 565739 - DNA, 25 bp, Rattus norvegicus
tatatcaatttctaggcacgtggga

SEQ ID NO: 565740 - DNA, 25 bp, Rattus norvegicus
tatatcacacctctaatatcagccc

SEQ ID NO: 565741 - DNA, 25 bp, Rattus norvegicus
tatatcacacctgtaatatcagccc

SEQ ID NO: 565742 - DNA, 25 bp, Rattus norvegicus
tatatcacaggacctgccctctacg

SEQ ID NO: 565743 - DNA, 25 bp, Rattus norvegicus
tatatcacaggagctgccctctacg

SEQ ID NO: 565744 - DNA, 25 bp, Rattus norvegicus
tatatcacagtcctatgtcctactc

SEQ ID NO: 565745 - DNA, 25 bp, Rattus norvegicus
tatatcacagtcgtatgtcctactc

SEQ ID NO: 565746 - DNA, 25 bp, Rattus norvegicus
tatatcactctaatccatgcttatg

SEQ ID NO: 565747 - DNA, 25 bp, Rattus norvegicus
tatatcactctattccatgcttatg

SEQ ID NO: 565748 - DNA, 25 bp, Rattus norvegicus
tatatcactgtcagtctctgttgga

SEQ ID NO: 565749 - DNA, 25 bp, Rattus norvegicus
tatatcactgtctgtctctgttgga

SEQ ID NO: 565750 - DNA, 25 bp, Rattus norvegicus
tatatcagccatatagttcggccag

SEQ ID NO: 565751 - DNA, 25 bp, Rattus norvegicus
tatatcagccatttagttcggccag

SEQ ID NO: 565752 - DNA, 25 bp, Rattus norvegicus
tatatcagcctcctagtgagtcgga

SEQ ID NO: 565753 - DNA, 25 bp, Rattus norvegicus
tatatcagcctcgtagtgagtcgga

SEQ ID NO: 565754 - DNA, 25 bp, Rattus norvegicus
tatatcatacacaagcatgtgcttt

SEQ ID NO: 565755 - DNA, 25 bp, Rattus norvegicus
tatatcatacactagcatgtgcttt

SEQ ID NO: 565756 - DNA, 25 bp, Rattus norvegicus
tatatcatagtactagagttcgtta

SEQ ID NO: 565757 - DNA, 25 bp, Rattus norvegicus
tatatcatagtagtagagttcgtta

SEQ ID NO: 565758 - DNA, 25 bp, Rattus norvegicus
tatatcatgcttataaactttcaga

SEQ ID NO: 565759 - DNA, 25 bp, Rattus norvegicus
tatatcatgcttttaaactttcaga

SEQ ID NO: 565760 - DNA, 25 bp, Rattus norvegicus
tatatccacagcaaagggcactagt

SEQ ID NO: 565761 - DNA, 25 bp, Rattus norvegicus
tatatccacagctaagggcactagt

SEQ ID NO: 565762 - DNA, 25 bp, Rattus norvegicus
tatatccaccctaatcccaaaaacg

SEQ ID NO: 565763 - DNA, 25 bp, Rattus norvegicus
tatatccacccttatcccaaaaacg

SEQ ID NO: 565764 - DNA, 25 bp, Rattus norvegicus
tatatccaccttatccttttgttca

SEQ ID NO: 565765 - DNA, 25 bp, Rattus norvegicus
tatatccaccttttccttttgttca

SEQ ID NO: 565766 - DNA, 25 bp, Rattus norvegicus
tatatccacttcctcaactatcaat

SEQ ID NO: 565767 - DNA, 25 bp, Rattus norvegicus
tatatccacttcgtcaactatcaat

SEQ ID NO: 565768 - DNA, 25 bp, Rattus norvegicus
tatatccagaagctggcccaggtgg

SEQ ID NO: 565769 - DNA, 25 bp, Rattus norvegicus
tatatccagaaggtggcccaggtgg

SEQ ID NO: 565770 - DNA, 25 bp, Rattus norvegicus
tatatccaggacatggcccagtgat

SEQ ID NO: 565771 - DNA, 25 bp, Rattus norvegicus
tatatccaggacttggcccagtgat

SEQ ID NO: 565772 - DNA, 25 bp, Rattus norvegicus
tatatccattccagacatcacgtgt

SEQ ID NO: 565773 - DNA, 25 bp, Rattus norvegicus
tatatccattcctgacatcacgtgt

SEQ ID NO: 565774 - DNA, 25 bp, Rattus norvegicus
tatatccatttcaccactactaaaa

SEQ ID NO: 565775 - DNA, 25 bp, Rattus norvegicus
tatatccatttctccactactaaaa

SEQ ID NO: 565776 - DNA, 25 bp, Rattus norvegicus
tatatcccaaaactcatcatctcta

SEQ ID NO: 565777 - DNA, 25 bp, Rattus norvegicus
tatatcccaaaagtcatcatctcta

SEQ ID NO: 565778 - DNA, 25 bp, Rattus norvegicus
tatatcccactcatcgtgacgaatg

SEQ ID NO: 565779 - DNA, 25 bp, Rattus norvegicus
tatatcccactcttcgtgacgaatg

SEQ ID NO: 565780 - DNA, 25 bp, Rattus norvegicus
tatatcccagaaaatcattaagaac

SEQ ID NO: 565781 - DNA, 25 bp, Rattus norvegicus
tatatcccagaatatcattaagaac

SEQ ID NO: 565782 - DNA, 25 bp, Rattus norvegicus
tatatcccagatcaggcagactttc

SEQ ID NO: 565783 - DNA, 25 bp, Rattus norvegicus
tatatcccagatgaggcagactttc

SEQ ID NO: 565784 - DNA, 25 bp, Rattus norvegicus
tatatcccagcacccacttatggta

SEQ ID NO: 565785 - DNA, 25 bp, Rattus norvegicus
tatatcccagcagccacttatggta

SEQ ID NO: 565786 - DNA, 25 bp, Rattus norvegicus
tatatcccaggaatctgcgcggcgt

SEQ ID NO: 565787 - DNA, 25 bp, Rattus norvegicus
tatatcccaggattctgcgcggcgt

SEQ ID NO: 565788 - DNA, 25 bp, Rattus norvegicus
tatatcccgaatagcaaatcgagag

SEQ ID NO: 565789 - DNA, 25 bp, Rattus norvegicus
tatatcccgaattgcaaatcgagag

SEQ ID NO: 565790 - DNA, 25 bp, Rattus norvegicus
tatatcccgttgcagttgctggaga

SEQ ID NO: 565791 - DNA, 25 bp, Rattus norvegicus
tatatcccgttggagttgctggaga

SEQ ID NO: 565792 - DNA, 25 bp, Rattus norvegicus
tatatccctagacgcgtctggcaca

SEQ ID NO: 565793 - DNA, 25 bp, Rattus norvegicus
tatatccctagaggcgtctggcaca

SEQ ID NO: 565794 - DNA, 25 bp, Rattus norvegicus
tatatccctttcaatggcatcttgg

SEQ ID NO: 565795 - DNA, 25 bp, Rattus norvegicus
tatatccctttctatggcatcttgg

SEQ ID NO: 565796 - DNA, 25 bp, Rattus norvegicus
tatatcctaggcctacctgttaaaa

SEQ ID NO: 565797 - DNA, 25 bp, Rattus norvegicus
tatatcctaggcgtacctgttaaaa

SEQ ID NO: 565798 - DNA, 25 bp, Rattus norvegicus
tatatcctcatgctgctgggtttct

SEQ ID NO: 565799 - DNA, 25 bp, Rattus norvegicus
tatatcctcatggtgctgggtttct

SEQ ID NO: 565800 - DNA, 25 bp, Rattus norvegicus
tatatcctccctaagcaacagttaa

SEQ ID NO: 565801 - DNA, 25 bp, Rattus norvegicus
tatatcctcccttagcaacagttaa

SEQ ID NO: 565802 - DNA, 25 bp, Rattus norvegicus
tatatcctgcctatttcatgttttc

SEQ ID NO: 565803 - DNA, 25 bp, Rattus norvegicus
tatatcctgcctttttcatgttttc

SEQ ID NO: 565804 - DNA, 25 bp, Rattus norvegicus
tatatcctgctgatactgctatcct

SEQ ID NO: 565805 - DNA, 25 bp, Rattus norvegicus
tatatcctgctgttactgctatcct

SEQ ID NO: 565806 - DNA, 25 bp, Rattus norvegicus
tatatcctggagcatactactgtga

SEQ ID NO: 565807 - DNA, 25 bp, Rattus norvegicus
tatatcctggaggatactactgtga

SEQ ID NO: 565808 - DNA, 25 bp, Rattus norvegicus
tatatcgaacaccacacggtcgtga

SEQ ID NO: 565809 - DNA, 25 bp, Rattus norvegicus
tatatcgaacacgacacggtcgtga

SEQ ID NO: 565810 - DNA, 25 bp, Rattus norvegicus
tatatcgagtccctgcccatggtgt

SEQ ID NO: 565811 - DNA, 25 bp, Rattus norvegicus
tatatcgagtccgtgcccatggtgt

SEQ ID NO: 565812 - DNA, 25 bp, Rattus norvegicus
tatatcgtcggcatcgtgctgggct

SEQ ID NO: 565813 - DNA, 25 bp, Rattus norvegicus
tatatcgtcggcttcgtgctgggct

SEQ ID NO: 565814 - DNA, 25 bp, Rattus norvegicus
tatatcgtggacccaaagtcgatac

SEQ ID NO: 565815 - DNA, 25 bp, Rattus norvegicus
tatatcgtggacgcaaagtcgatac

SEQ ID NO: 565816 - DNA, 25 bp, Rattus norvegicus
tatatctacaggacccagggttcct

SEQ ID NO: 565817 - DNA, 25 bp, Rattus norvegicus
tatatctacaggtcccagggttcct

SEQ ID NO: 565818 - DNA, 25 bp, Rattus norvegicus
tatatctattctacagtcctttgcc

SEQ ID NO: 565819 - DNA, 25 bp, Rattus norvegicus
tatatctattcttcagtcctttgcc

SEQ ID NO: 565820 - DNA, 25 bp, Rattus norvegicus
tatatctcaattcctgtggttccct

SEQ ID NO: 565821 - DNA, 25 bp, Rattus norvegicus
tatatctcaattgctgtggttccct

SEQ ID NO: 565822 - DNA, 25 bp, Rattus norvegicus
tatatctcctggattctcactgaat

SEQ ID NO: 565823 - DNA, 25 bp, Rattus norvegicus
tatatctcctggtttctcactgaat

SEQ ID NO: 565824 - DNA, 25 bp, Rattus norvegicus
tatatctccttcaagtcttactcaa

SEQ ID NO: 565825 - DNA, 25 bp, Rattus norvegicus
tatatctccttctagtcttactcaa

SEQ ID NO: 565826 - DNA, 25 bp, Rattus norvegicus
tatatctctctactctctgtaagta

SEQ ID NO: 565827 - DNA, 25 bp, Rattus norvegicus
tatatctctctagtctctgtaagta

SEQ ID NO: 565828 - DNA, 25 bp, Rattus norvegicus
tatatctctcttatgtgggtagcga

SEQ ID NO: 565829 - DNA, 25 bp, Rattus norvegicus
tatatctctcttttgtgggtagcga

SEQ ID NO: 565830 - DNA, 25 bp, Rattus norvegicus
tatatctctgaactatccatttttt

SEQ ID NO: 565831 - DNA, 25 bp, Rattus norvegicus
tatatctctgaagtatccatttttt

SEQ ID NO: 565832 - DNA, 25 bp, Rattus norvegicus
tatatctgggtacggttttcttggg

SEQ ID NO: 565833 - DNA, 25 bp, Rattus norvegicus
tatatctgggtagggttttcttggg

SEQ ID NO: 565834 - DNA, 25 bp, Rattus norvegicus
tatatcttcattattgccaccatcc

SEQ ID NO: 565835 - DNA, 25 bp, Rattus norvegicus
tatatcttcatttttgccaccatcc

SEQ ID NO: 565836 - DNA, 25 bp, Rattus norvegicus
tatatcttctatctctttgtttggg

SEQ ID NO: 565837 - DNA, 25 bp, Rattus norvegicus
tatatcttctatgtctttgtttggg

SEQ ID NO: 565838 - DNA, 25 bp, Rattus norvegicus
tatatcttgccactaattttgactg

SEQ ID NO: 565839 - DNA, 25 bp, Rattus norvegicus
tatatcttgccagtaattttgactg

SEQ ID NO: 565840 - DNA, 25 bp, Rattus norvegicus
tatatcttgggactcctcagtccag

SEQ ID NO: 565841 - DNA, 25 bp, Rattus norvegicus
tatatcttgggagtcctcagtccag

SEQ ID NO: 565842 - DNA, 25 bp, Rattus norvegicus
tatatcttttctattgaccttatca

SEQ ID NO: 565843 - DNA, 25 bp, Rattus norvegicus
tatatcttttcttttgaccttatca

SEQ ID NO: 565844 - DNA, 25 bp, Rattus norvegicus
tatatctttttcatatcttagccag

SEQ ID NO: 565845 - DNA, 25 bp, Rattus norvegicus
tatatctttttcttatcttagccag

SEQ ID NO: 565846 - DNA, 25 bp, Rattus norvegicus
tatatgaaaccaccatgcctcggcc

SEQ ID NO: 565847 - DNA, 25 bp, Rattus norvegicus
tatatgaaaccagcatgcctcggcc

SEQ ID NO: 565848 - DNA, 25 bp, Rattus norvegicus
tatatgacagctctccgaggagcct

SEQ ID NO: 565849 - DNA, 25 bp, Rattus norvegicus
tatatgacagctgtccgaggagcct

SEQ ID NO: 565850 - DNA, 25 bp, Rattus norvegicus
tatatgacccaaatcctactagccg

SEQ ID NO: 565851 - DNA, 25 bp, Rattus norvegicus
tatatgacccaattcctactagccg

SEQ ID NO: 565852 - DNA, 25 bp, Rattus norvegicus
tatatgagatctccctggtctgctg

SEQ ID NO: 565853 - DNA, 25 bp, Rattus norvegicus
tatatgagatctgcctggtctgctg

SEQ ID NO: 565854 - DNA, 25 bp, Rattus norvegicus
tatatgagtttacacctattccgct

SEQ ID NO: 565855 - DNA, 25 bp, Rattus norvegicus
tatatgagtttagacctattccgct

SEQ ID NO: 565856 - DNA, 25 bp, Rattus norvegicus
tatatgcaaattccttctacccact

SEQ ID NO: 565857 - DNA, 25 bp, Rattus norvegicus
tatatgcaaattgcttctacccact

SEQ ID NO: 565858 - DNA, 25 bp, Rattus norvegicus
tatatgcaagccaacatctatgaga

SEQ ID NO: 565859 - DNA, 25 bp, Rattus norvegicus
tatatgcaagcctacatctatgaga

SEQ ID NO: 565860 - DNA, 25 bp, Rattus norvegicus
tatatgcaaggtcgccaagttaata

SEQ ID NO: 565861 - DNA, 25 bp, Rattus norvegicus
tatatgcaaggtggccaagttaata

SEQ ID NO: 565862 - DNA, 25 bp, Rattus norvegicus
tatatgcagagccagttgtgtgtgt

SEQ ID NO: 565863 - DNA, 25 bp, Rattus norvegicus
tatatgcagagcgagttgtgtgtgt

SEQ ID NO: 565864 - DNA, 25 bp, Rattus norvegicus
tatatgcagctgagtctgtgacatc

SEQ ID NO: 565865 - DNA, 25 bp, Rattus norvegicus
tatatgcagctgtgtctgtgacatc

SEQ ID NO: 565866 - DNA, 25 bp, Rattus norvegicus
tatatgcatgaactaggctcctatc

SEQ ID NO: 565867 - DNA, 25 bp, Rattus norvegicus
tatatgcatgaagtaggctcctatc

SEQ ID NO: 565868 - DNA, 25 bp, Rattus norvegicus
tatatgccacatattcattttaggt

SEQ ID NO: 565869 - DNA, 25 bp, Rattus norvegicus
tatatgccacattttcattttaggt

SEQ ID NO: 565870 - DNA, 25 bp, Rattus norvegicus
tatatgccaggcaagctggccctaa

SEQ ID NO: 565871 - DNA, 25 bp, Rattus norvegicus
tatatgccaggctagctggccctaa

SEQ ID NO: 565872 - DNA, 25 bp, Rattus norvegicus
tatatgccctggcacccatttttaa

SEQ ID NO: 565873 - DNA, 25 bp, Rattus norvegicus
tatatgccctgggacccatttttaa

SEQ ID NO: 565874 - DNA, 25 bp, Rattus norvegicus
tatatgccgccacttctgccagagg

SEQ ID NO: 565875 - DNA, 25 bp, Rattus norvegicus
tatatgccgccagttctgccagagg

SEQ ID NO: 565876 - DNA, 25 bp, Rattus norvegicus
tatatgcctgcaatctctatctaca

SEQ ID NO: 565877 - DNA, 25 bp, Rattus norvegicus
tatatgcctgcattctctatctaca

SEQ ID NO: 565878 - DNA, 25 bp, Rattus norvegicus
tatatgcgtctgactcctaaatgct

SEQ ID NO: 565879 - DNA, 25 bp, Rattus norvegicus
tatatgcgtctgtctcctaaatgct

SEQ ID NO: 565880 - DNA, 25 bp, Rattus norvegicus
tatatgctctagattcagactgaaa

SEQ ID NO: 565881 - DNA, 25 bp, Rattus norvegicus
tatatgctctagtttcagactgaaa

SEQ ID NO: 565882 - DNA, 25 bp, Rattus norvegicus
tatatgctgggcagttggacctctt

SEQ ID NO: 565883 - DNA, 25 bp, Rattus norvegicus
tatatgctgggctgttggacctctt

SEQ ID NO: 565884 - DNA, 25 bp, Rattus norvegicus
tatatgcttcctcctctgggatgag

SEQ ID NO: 565885 - DNA, 25 bp, Rattus norvegicus
tatatgcttcctgctctgggatgag

SEQ ID NO: 565886 - DNA, 25 bp, Rattus norvegicus
tatatggcgcatccctgggaggaat

SEQ ID NO: 565887 - DNA, 25 bp, Rattus norvegicus
tatatggcgcatgcctgggaggaat

SEQ ID NO: 565888 - DNA, 25 bp, Rattus norvegicus
tatatggctgtgataacccgtggac

SEQ ID NO: 565889 - DNA, 25 bp, Rattus norvegicus
tatatggctgtgttaacccgtggac

SEQ ID NO: 565890 - DNA, 25 bp, Rattus norvegicus
tatatgggttgacttctactcctgc

SEQ ID NO: 565891 - DNA, 25 bp, Rattus norvegicus
tatatgggttgagttctactcctgc

SEQ ID NO: 565892 - DNA, 25 bp, Rattus norvegicus
tatatgtatcaccaaaagctctctg

SEQ ID NO: 565893 - DNA, 25 bp, Rattus norvegicus
tatatgtatcacgaaaagctctctg

SEQ ID NO: 565894 - DNA, 25 bp, Rattus norvegicus
tatatgtgaatcacctcttcagcca

SEQ ID NO: 565895 - DNA, 25 bp, Rattus norvegicus
tatatgtgaatctcctcttcagcca

SEQ ID NO: 565896 - DNA, 25 bp, Rattus norvegicus
tatatgtgagagacgccaagcagga

SEQ ID NO: 565897 - DNA, 25 bp, Rattus norvegicus
tatatgtgagagtcgccaagcagga

SEQ ID NO: 565898 - DNA, 25 bp, Rattus norvegicus
tatatgtgcagccaaaacacctata

SEQ ID NO: 565899 - DNA, 25 bp, Rattus norvegicus
tatatgtgcagcgaaaacacctata

SEQ ID NO: 565900 - DNA, 25 bp, Rattus norvegicus
tatatgtgcagtcttgacaagacaa

SEQ ID NO: 565901 - DNA, 25 bp, Rattus norvegicus
tatatgtgcagtgttgacaagacaa

SEQ ID NO: 565902 - DNA, 25 bp, Rattus norvegicus
tatatgtgccaccttctagctgccc

SEQ ID NO: 565903 - DNA, 25 bp, Rattus norvegicus
tatatgtgccacgttctagctgccc

SEQ ID NO: 565904 - DNA, 25 bp, Rattus norvegicus
tatatgtgcgtccacgtgagtgcgt

SEQ ID NO: 565905 - DNA, 25 bp, Rattus norvegicus
tatatgtgcgtcgacgtgagtgcgt

SEQ ID NO: 565906 - DNA, 25 bp, Rattus norvegicus
tatatgtggtctcttttgatccctc

SEQ ID NO: 565907 - DNA, 25 bp, Rattus norvegicus
tatatgtggtctgttttgatccctc

SEQ ID NO: 565908 - DNA, 25 bp, Rattus norvegicus
tatatgttccatcaactgataccta

SEQ ID NO: 565909 - DNA, 25 bp, Rattus norvegicus
tatatgttccatgaactgataccta

SEQ ID NO: 565910 - DNA, 25 bp, Rattus norvegicus
tatatgttcctactcttcttttcct

SEQ ID NO: 565911 - DNA, 25 bp, Rattus norvegicus
tatatgttcctagtcttcttttcct

SEQ ID NO: 565912 - DNA, 25 bp, Rattus norvegicus
tatatgtttttgcagaactactggg

SEQ ID NO: 565913 - DNA, 25 bp, Rattus norvegicus
tatatgtttttggagaactactggg

SEQ ID NO: 565914 - DNA, 25 bp, Rattus norvegicus
tatattaaagccctcggcaacccaa

SEQ ID NO: 565915 - DNA, 25 bp, Rattus norvegicus
tatattaaagccgtcggcaacccaa

SEQ ID NO: 565916 - DNA, 25 bp, Rattus norvegicus
tatattaactggcagaggctacttc

SEQ ID NO: 565917 - DNA, 25 bp, Rattus norvegicus
tatattaactgggagaggctacttc

SEQ ID NO: 565918 - DNA, 25 bp, Rattus norvegicus
tatattaagcgtctggttccttctg

SEQ ID NO: 565919 - DNA, 25 bp, Rattus norvegicus
tatattaagcgtgtggttccttctg

SEQ ID NO: 565920 - DNA, 25 bp, Rattus norvegicus
tatattaatgccacggttcaccatc

SEQ ID NO: 565921 - DNA, 25 bp, Rattus norvegicus
tatattaatgcctcggttcaccatc

SEQ ID NO: 565922 - DNA, 25 bp, Rattus norvegicus
tatattacagatatttgttctggct

SEQ ID NO: 565923 - DNA, 25 bp, Rattus norvegicus
tatattacagatttttgttctggct

SEQ ID NO: 565924 - DNA, 25 bp, Rattus norvegicus
tatattacatgcatatatgcttggg

SEQ ID NO: 565925 - DNA, 25 bp, Rattus norvegicus
tatattacatgcttatatgcttggg

SEQ ID NO: 565926 - DNA, 25 bp, Rattus norvegicus
tatattacgaagatgccctggaggt

SEQ ID NO: 565927 - DNA, 25 bp, Rattus norvegicus
tatattacgaagttgccctggaggt

SEQ ID NO: 565928 - DNA, 25 bp, Rattus norvegicus
tatattagaggtcctgcttggagtc

SEQ ID NO: 565929 - DNA, 25 bp, Rattus norvegicus
tatattagaggtgctgcttggagtc

SEQ ID NO: 565930 - DNA, 25 bp, Rattus norvegicus
tatattaggtttcctcggtggtgtt

SEQ ID NO: 565931 - DNA, 25 bp, Rattus norvegicus
tatattaggtttgctcggtggtgtt

SEQ ID NO: 565932 - DNA, 25 bp, Rattus norvegicus
tatattattctcctttagtacccct

SEQ ID NO: 565933 - DNA, 25 bp, Rattus norvegicus
tatattattctcgtttagtacccct

SEQ ID NO: 565934 - DNA, 25 bp, Rattus norvegicus
tatattcaacccagagtggagacct

SEQ ID NO: 565935 - DNA, 25 bp, Rattus norvegicus
tatattcaaccctgagtggagacct

SEQ ID NO: 565936 - DNA, 25 bp, Rattus norvegicus
tatattcacccaaccttcagtaaag

SEQ ID NO: 565937 - DNA, 25 bp, Rattus norvegicus
tatattcacccatccttcagtaaag

SEQ ID NO: 565938 - DNA, 25 bp, Rattus norvegicus
tatattcagcttaccttcttacaag

SEQ ID NO: 565939 - DNA, 25 bp, Rattus norvegicus
tatattcagctttccttcttacaag

SEQ ID NO: 565940 - DNA, 25 bp, Rattus norvegicus
tatattccaatcattactctctcct

SEQ ID NO: 565941 - DNA, 25 bp, Rattus norvegicus
tatattccaatctttactctctcct

SEQ ID NO: 565942 - DNA, 25 bp, Rattus norvegicus
tatattcccagaacatttcaacatg

SEQ ID NO: 565943 - DNA, 25 bp, Rattus norvegicus
tatattcccagatcatttcaacatg

SEQ ID NO: 565944 - DNA, 25 bp, Rattus norvegicus
tatattcccctacggctccaggata

SEQ ID NO: 565945 - DNA, 25 bp, Rattus norvegicus
tatattcccctagggctccaggata

SEQ ID NO: 565946 - DNA, 25 bp, Rattus norvegicus
tatattcctgtacgcaaccctgagg

SEQ ID NO: 565947 - DNA, 25 bp, Rattus norvegicus
tatattcctgtaggcaaccctgagg

SEQ ID NO: 565948 - DNA, 25 bp, Rattus norvegicus
tatattcgacgactactgagcagta

SEQ ID NO: 565949 - DNA, 25 bp, Rattus norvegicus
tatattcgacgagtactgagcagta

SEQ ID NO: 565950 - DNA, 25 bp, Rattus norvegicus
tatattctctggcttctgttgtggc

SEQ ID NO: 565951 - DNA, 25 bp, Rattus norvegicus
tatattctctgggttctgttgtggc

SEQ ID NO: 565952 - DNA, 25 bp, Rattus norvegicus
tatattctgagcagcctgttggtca

SEQ ID NO: 565953 - DNA, 25 bp, Rattus norvegicus
tatattctgagctgcctgttggtca

SEQ ID NO: 565954 - DNA, 25 bp, Rattus norvegicus
tatattgagtctaaaccgcttccca

SEQ ID NO: 565955 - DNA, 25 bp, Rattus norvegicus
tatattgagtcttaaccgcttccca

SEQ ID NO: 565956 - DNA, 25 bp, Rattus norvegicus
tatattgcaagtatttcccacgtca

SEQ ID NO: 565957 - DNA, 25 bp, Rattus norvegicus
tatattgcaagtttttcccacgtca

SEQ ID NO: 565958 - DNA, 25 bp, Rattus norvegicus
tatattgcactgatggtttattcca

SEQ ID NO: 565959 - DNA, 25 bp, Rattus norvegicus
tatattgcactgttggtttattcca

SEQ ID NO: 565960 - DNA, 25 bp, Rattus norvegicus
tatattgccactcagggtcctttat

SEQ ID NO: 565961 - DNA, 25 bp, Rattus norvegicus
tatattgccactgagggtcctttat

SEQ ID NO: 565962 - DNA, 25 bp, Rattus norvegicus
tatattgccttcaatagcacggact

SEQ ID NO: 565963 - DNA, 25 bp, Rattus norvegicus
tatattgccttcagtcttcagtcat

SEQ ID NO: 565964 - DNA, 25 bp, Rattus norvegicus
tatattgccttctatagcacggact

SEQ ID NO: 565965 - DNA, 25 bp, Rattus norvegicus
tatattgccttctgtcttcagtcat

SEQ ID NO: 565966 - DNA, 25 bp, Rattus norvegicus
tatattgctagcattcccaactaca

SEQ ID NO: 565967 - DNA, 25 bp, Rattus norvegicus
tatattgctagctttcccaactaca

SEQ ID NO: 565968 - DNA, 25 bp, Rattus norvegicus
tatattgctcttaaacgccaacctg

SEQ ID NO: 565969 - DNA, 25 bp, Rattus norvegicus
tatattgctctttaacgccaacctg

SEQ ID NO: 565970 - DNA, 25 bp, Rattus norvegicus
tatattgctgctacaccagctgatt

SEQ ID NO: 565971 - DNA, 25 bp, Rattus norvegicus
tatattgctgcttcaccagctgatt

SEQ ID NO: 565972 - DNA, 25 bp, Rattus norvegicus
tatattgcttagagccccgtgaaca

SEQ ID NO: 565973 - DNA, 25 bp, Rattus norvegicus
tatattgcttagtgccccgtgaaca

SEQ ID NO: 565974 - DNA, 25 bp, Rattus norvegicus
tatattgcttttcttatctcagagt

SEQ ID NO: 565975 - DNA, 25 bp, Rattus norvegicus
tatattgcttttgttatctcagagt

SEQ ID NO: 565976 - DNA, 25 bp, Rattus norvegicus
tatattggacggaccctccagagta

SEQ ID NO: 565977 - DNA, 25 bp, Rattus norvegicus
tatattggacggtccctccagagta

SEQ ID NO: 565978 - DNA, 25 bp, Rattus norvegicus
tatattggtgtcatgtctttcttgg

SEQ ID NO: 565979 - DNA, 25 bp, Rattus norvegicus
tatattggtgtcttgtctttcttgg

SEQ ID NO: 565980 - DNA, 25 bp, Rattus norvegicus
tatattgtaaatagctttctgaagt

SEQ ID NO: 565981 - DNA, 25 bp, Rattus norvegicus
tatattgtaaattgctttctgaagt

SEQ ID NO: 565982 - DNA, 25 bp, Rattus norvegicus
tatattgtaactagctgtttttagc

SEQ ID NO: 565983 - DNA, 25 bp, Rattus norvegicus
tatattgtaacttgctgtttttagc

SEQ ID NO: 565984 - DNA, 25 bp, Rattus norvegicus
tatattgtctgtctggttcctttaa

SEQ ID NO: 565985 - DNA, 25 bp, Rattus norvegicus
tatattgtctgtgtggttcctttaa

SEQ ID NO: 565986 - DNA, 25 bp, Rattus norvegicus
tatattgtgctcagaacttaggcag

SEQ ID NO: 565987 - DNA, 25 bp, Rattus norvegicus
tatattgtgctctgaacttaggcag

SEQ ID NO: 565988 - DNA, 25 bp, Rattus norvegicus
tatattgttagcctgtttccttctc

SEQ ID NO: 565989 - DNA, 25 bp, Rattus norvegicus
tatattgttagcgtgtttccttctc

SEQ ID NO: 565990 - DNA, 25 bp, Rattus norvegicus
tatattgttctaagctgttcctggg

SEQ ID NO: 565991 - DNA, 25 bp, Rattus norvegicus
tatattgttctatgctgttcctggg

SEQ ID NO: 565992 - DNA, 25 bp, Rattus norvegicus
tatatttaacaccttccatcagccc

SEQ ID NO: 565993 - DNA, 25 bp, Rattus norvegicus
tatatttaacacgttccatcagccc

SEQ ID NO: 565994 - DNA, 25 bp, Rattus norvegicus
tatatttaatgtcacgggctccgct

SEQ ID NO: 565995 - DNA, 25 bp, Rattus norvegicus
tatatttaatgtgacgggctccgct

SEQ ID NO: 565996 - DNA, 25 bp, Rattus norvegicus
tatatttacactagcttagccagca

SEQ ID NO: 565997 - DNA, 25 bp, Rattus norvegicus
tatatttacacttgcttagccagca

SEQ ID NO: 565998 - DNA, 25 bp, Rattus norvegicus
tatatttattttagggtttggccag

SEQ ID NO: 565999 - DNA, 25 bp, Rattus norvegicus
tatatttatttttgggtttggccag

SEQ ID NO: 566000 - DNA, 25 bp, Rattus norvegicus
tatatttcacttcgctgtacttggt

SEQ ID NO: 566001 - DNA, 25 bp, Rattus norvegicus
tatatttcacttggctgtacttggt

SEQ ID NO: 566002 - DNA, 25 bp, Rattus norvegicus
tatatttcatgacctgaggcagaaa

SEQ ID NO: 566003 - DNA, 25 bp, Rattus norvegicus
tatatttcatgagctgaggcagaaa

SEQ ID NO: 566004 - DNA, 25 bp, Rattus norvegicus
tatatttcccagaggacccaggcag

SEQ ID NO: 566005 - DNA, 25 bp, Rattus norvegicus
tatatttcccagtggacccaggcag

SEQ ID NO: 566006 - DNA, 25 bp, Rattus norvegicus
tatatttcgttaacggcgggagagc

SEQ ID NO: 566007 - DNA, 25 bp, Rattus norvegicus
tatatttcgttatcggcgggagagc

SEQ ID NO: 566008 - DNA, 25 bp, Rattus norvegicus
tatatttctcgaattatgggctaat

SEQ ID NO: 566009 - DNA, 25 bp, Rattus norvegicus
tatatttctcgatttatgggctaat

SEQ ID NO: 566010 - DNA, 25 bp, Rattus norvegicus
tatatttctctcaatcttgggacta

SEQ ID NO: 566011 - DNA, 25 bp, Rattus norvegicus
tatatttctctctatcttgggacta

SEQ ID NO: 566012 - DNA, 25 bp, Rattus norvegicus
tatatttctgttcagccgttgagct

SEQ ID NO: 566013 - DNA, 25 bp, Rattus norvegicus
tatatttctgttgagccgttgagct

SEQ ID NO: 566014 - DNA, 25 bp, Rattus norvegicus
tatatttcttcccaaacacctgagt

SEQ ID NO: 566015 - DNA, 25 bp, Rattus norvegicus
tatatttcttccgaaacacctgagt

SEQ ID NO: 566016 - DNA, 25 bp, Rattus norvegicus
tatatttcttctatccctcacaaag

SEQ ID NO: 566017 - DNA, 25 bp, Rattus norvegicus
tatatttcttctttccctcacaaag

SEQ ID NO: 566018 - DNA, 25 bp, Rattus norvegicus
tatatttgagttcccttagcagtac

SEQ ID NO: 566019 - DNA, 25 bp, Rattus norvegicus
tatatttgagttgccttagcagtac

SEQ ID NO: 566020 - DNA, 25 bp, Rattus norvegicus
tatatttgatctaagctggcacccc

SEQ ID NO: 566021 - DNA, 25 bp, Rattus norvegicus
tatatttgatcttagctggcacccc

SEQ ID NO: 566022 - DNA, 25 bp, Rattus norvegicus
tatatttgctacagtgttcccagct

SEQ ID NO: 566023 - DNA, 25 bp, Rattus norvegicus
tatatttgctactgtgttcccagct

SEQ ID NO: 566024 - DNA, 25 bp, Rattus norvegicus
tatatttgtttcctttagctggcca

SEQ ID NO: 566025 - DNA, 25 bp, Rattus norvegicus
tatatttgtttcgtttagctggcca

SEQ ID NO: 566026 - DNA, 25 bp, Rattus norvegicus
tatattttcaataagctactgccag

SEQ ID NO: 566027 - DNA, 25 bp, Rattus norvegicus
tatattttcaattagctactgccag

SEQ ID NO: 566028 - DNA, 25 bp, Rattus norvegicus
tatattttccccatcacagagtgat

SEQ ID NO: 566029 - DNA, 25 bp, Rattus norvegicus
tatattttccccttcacagagtgat

SEQ ID NO: 566030 - DNA, 25 bp, Rattus norvegicus
tatattttcgaacttggcccaatgg

SEQ ID NO: 566031 - DNA, 25 bp, Rattus norvegicus
tatattttcgaagttggcccaatgg

SEQ ID NO: 566032 - DNA, 25 bp, Rattus norvegicus
tatattttctcaatttttgcgtaat

SEQ ID NO: 566033 - DNA, 25 bp, Rattus norvegicus
tatattttctcattttttgcgtaat

SEQ ID NO: 566034 - DNA, 25 bp, Rattus norvegicus
tatattttcttaagcatgctcgatg

SEQ ID NO: 566035 - DNA, 25 bp, Rattus norvegicus
tatattttcttatgcatgctcgatg

SEQ ID NO: 566036 - DNA, 25 bp, Rattus norvegicus
tatattttcttcacttcctctattc

SEQ ID NO: 566037 - DNA, 25 bp, Rattus norvegicus
tatattttcttctcttcctctattc

SEQ ID NO: 566038 - DNA, 25 bp, Rattus norvegicus
tatattttgttcacactcagacaga

SEQ ID NO: 566039 - DNA, 25 bp, Rattus norvegicus
tatattttgttctcactcagacaga

SEQ ID NO: 566040 - DNA, 25 bp, Rattus norvegicus
tatatttttgcacccctggagtctc

SEQ ID NO: 566041 - DNA, 25 bp, Rattus norvegicus
tatatttttgcagccctggagtctc

SEQ ID NO: 566042 - DNA, 25 bp, Rattus norvegicus
tatattttttcaactgtgagtcatg

SEQ ID NO: 566043 - DNA, 25 bp, Rattus norvegicus
tatattttttcatctgtgagtcatg

SEQ ID NO: 566044 - DNA, 25 bp, Rattus norvegicus
tatattttttctccggaatcctgag

SEQ ID NO: 566045 - DNA, 25 bp, Rattus norvegicus
tatattttttctgcggaatcctgag

SEQ ID NO: 566046 - DNA, 25 bp, Rattus norvegicus
tatcaaaaatacaaaccagggctgg

SEQ ID NO: 566047 - DNA, 25 bp, Rattus norvegicus
tatcaaaaatactaaccagggctgg

SEQ ID NO: 566048 - DNA, 25 bp, Rattus norvegicus
tatcaaaacatgcattggtccagac

SEQ ID NO: 566049 - DNA, 25 bp, Rattus norvegicus
tatcaaaacatggattggtccagac

SEQ ID NO: 566050 - DNA, 25 bp, Rattus norvegicus
tatcaaaagcatcattgtgtttagc

SEQ ID NO: 566051 - DNA, 25 bp, Rattus norvegicus
tatcaaaagcatgattgtgtttagc

SEQ ID NO: 566052 - DNA, 25 bp, Rattus norvegicus
tatcaaagcggtctccttgctgtca

SEQ ID NO: 566053 - DNA, 25 bp, Rattus norvegicus
tatcaaagcggtgtccttgctgtca

SEQ ID NO: 566054 - DNA, 25 bp, Rattus norvegicus
tatcaaagtaatcgcctgttgctgt

SEQ ID NO: 566055 - DNA, 25 bp, Rattus norvegicus
tatcaaagtaatggcctgttgctgt

SEQ ID NO: 566056 - DNA, 25 bp, Rattus norvegicus
tatcaaatcagtcctggcaacctca

SEQ ID NO: 566057 - DNA, 25 bp, Rattus norvegicus
tatcaaatcagtgctggcaacctca

SEQ ID NO: 566058 - DNA, 25 bp, Rattus norvegicus
tatcaaatctcaatagacctggact

SEQ ID NO: 566059 - DNA, 25 bp, Rattus norvegicus
tatcaaatctcattagacctggact

SEQ ID NO: 566060 - DNA, 25 bp, Rattus norvegicus
tatcaaatctgcctggaccatcttg

SEQ ID NO: 566061 - DNA, 25 bp, Rattus norvegicus
tatcaaatctgcgtggaccatcttg

SEQ ID NO: 566062 - DNA, 25 bp, Rattus norvegicus
tatcaaatgtccagtgagagtacac

SEQ ID NO: 566063 - DNA, 25 bp, Rattus norvegicus
tatcaaatgtcctgtgagagtacac

SEQ ID NO: 566064 - DNA, 25 bp, Rattus norvegicus
tatcaacaagtgacccctgctgaag

SEQ ID NO: 566065 - DNA, 25 bp, Rattus norvegicus
tatcaacaagtgtcccctgctgaag

SEQ ID NO: 566066 - DNA, 25 bp, Rattus norvegicus
tatcaacaattgctacacagtcaca

SEQ ID NO: 566067 - DNA, 25 bp, Rattus norvegicus
tatcaacaattggtacacagtcaca

SEQ ID NO: 566068 - DNA, 25 bp, Rattus norvegicus
tatcaacactggcactctgcagttt

SEQ ID NO: 566069 - DNA, 25 bp, Rattus norvegicus
tatcaacactgggactctgcagttt

SEQ ID NO: 566070 - DNA, 25 bp, Rattus norvegicus
tatcaacagcatcacatggcaggtt

SEQ ID NO: 566071 - DNA, 25 bp, Rattus norvegicus
tatcaacagcatgacatggcaggtt

SEQ ID NO: 566072 - DNA, 25 bp, Rattus norvegicus
tatcaaccacagatcacttgtgcat

SEQ ID NO: 566073 - DNA, 25 bp, Rattus norvegicus
tatcaaccacagatttcttcctaaa

SEQ ID NO: 566074 - DNA, 25 bp, Rattus norvegicus
tatcaaccacagttcacttgtgcat

SEQ ID NO: 566075 - DNA, 25 bp, Rattus norvegicus
tatcaaccacagttttcttcctaaa

SEQ ID NO: 566076 - DNA, 25 bp, Rattus norvegicus
tatcaaccacttatctagcaccatg

SEQ ID NO: 566077 - DNA, 25 bp, Rattus norvegicus
tatcaaccacttttctagcaccatg

SEQ ID NO: 566078 - DNA, 25 bp, Rattus norvegicus
tatcaacgagatctgagccctgtgc

SEQ ID NO: 566079 - DNA, 25 bp, Rattus norvegicus
tatcaacgagatgtgagccctgtgc

SEQ ID NO: 566080 - DNA, 25 bp, Rattus norvegicus
tatcaacgttttccctctaccgagt

SEQ ID NO: 566081 - DNA, 25 bp, Rattus norvegicus
tatcaacgttttgcctctaccgagt

SEQ ID NO: 566082 - DNA, 25 bp, Rattus norvegicus
tatcaactgccaccatgttttgtaa

SEQ ID NO: 566083 - DNA, 25 bp, Rattus norvegicus
tatcaactgccagcatgttttgtaa

SEQ ID NO: 566084 - DNA, 25 bp, Rattus norvegicus
tatcaactttctacactgtgatgca

SEQ ID NO: 566085 - DNA, 25 bp, Rattus norvegicus
tatcaactttcttcactgtgatgca

SEQ ID NO: 566086 - DNA, 25 bp, Rattus norvegicus
tatcaagcagcaacaggtcacattt

SEQ ID NO: 566087 - DNA, 25 bp, Rattus norvegicus
tatcaagcagcatcaggtcacattt

SEQ ID NO: 566088 - DNA, 25 bp, Rattus norvegicus
tatcaagcagcgagccagcaacggt

SEQ ID NO: 566089 - DNA, 25 bp, Rattus norvegicus
tatcaagcagcgtgccagcaacggt

SEQ ID NO: 566090 - DNA, 25 bp, Rattus norvegicus
tatcaagcagggatctagccacagt

SEQ ID NO: 566091 - DNA, 25 bp, Rattus norvegicus
tatcaagcagggttctagccacagt

SEQ ID NO: 566092 - DNA, 25 bp, Rattus norvegicus
tatcaagcccataaacctgagtttg

SEQ ID NO: 566093 - DNA, 25 bp, Rattus norvegicus
tatcaagcccattaacctgagtttg

SEQ ID NO: 566094 - DNA, 25 bp, Rattus norvegicus
tatcaagcctgcctggacagctgtt

SEQ ID NO: 566095 - DNA, 25 bp, Rattus norvegicus
tatcaagcctgcgtggacagctgtt

SEQ ID NO: 566096 - DNA, 25 bp, Rattus norvegicus
tatcaagctctgcttctcttcaaga

SEQ ID NO: 566097 - DNA, 25 bp, Rattus norvegicus
tatcaagctctggttctcttcaaga

SEQ ID NO: 566098 - DNA, 25 bp, Rattus norvegicus
tatcaaggaggtcctgttggtccac

SEQ ID NO: 566099 - DNA, 25 bp, Rattus norvegicus
tatcaaggaggtgctgttggtccac

SEQ ID NO: 566100 - DNA, 25 bp, Rattus norvegicus
tatcaaggatcaccaaggcctctgg

SEQ ID NO: 566101 - DNA, 25 bp, Rattus norvegicus
tatcaaggatcagcaaggcctctgg

SEQ ID NO: 566102 - DNA, 25 bp, Rattus norvegicus
tatcaaggcacacttcatcggtccc

SEQ ID NO: 566103 - DNA, 25 bp, Rattus norvegicus
tatcaaggcacagttcatcggtccc

SEQ ID NO: 566104 - DNA, 25 bp, Rattus norvegicus
tatcaagggtctccgcaaacatgag

SEQ ID NO: 566105 - DNA, 25 bp, Rattus norvegicus
tatcaagggtctgcgcaaacatgag

SEQ ID NO: 566106 - DNA, 25 bp, Rattus norvegicus
tatcaaggtcctaactctagccaac

SEQ ID NO: 566107 - DNA, 25 bp, Rattus norvegicus
tatcaaggtccttactctagccaac

SEQ ID NO: 566108 - DNA, 25 bp, Rattus norvegicus
tatcaagtaatcaactggcagtacc

SEQ ID NO: 566109 - DNA, 25 bp, Rattus norvegicus
tatcaagtaatctactggcagtacc

SEQ ID NO: 566110 - DNA, 25 bp, Rattus norvegicus
tatcaagtccctagatggctccgtg

SEQ ID NO: 566111 - DNA, 25 bp, Rattus norvegicus
tatcaagtcccttgatggctccgtg

SEQ ID NO: 566112 - DNA, 25 bp, Rattus norvegicus
tatcaagtgagaatcagttctctcc

SEQ ID NO: 566113 - DNA, 25 bp, Rattus norvegicus
tatcaagtgagattcagttctctcc

SEQ ID NO: 566114 - DNA, 25 bp, Rattus norvegicus
tatcaagtgctgattgatgcccgtg

SEQ ID NO: 566115 - DNA, 25 bp, Rattus norvegicus
tatcaagtgctgtttgatgcccgtg

SEQ ID NO: 566116 - DNA, 25 bp, Rattus norvegicus
tatcaagtgggcaggctgattcctt

SEQ ID NO: 566117 - DNA, 25 bp, Rattus norvegicus
tatcaagtgggctggctgattcctt

SEQ ID NO: 566118 - DNA, 25 bp, Rattus norvegicus
tatcaagttgatcctttaaggaggg

SEQ ID NO: 566119 - DNA, 25 bp, Rattus norvegicus
tatcaagttgatgctttaaggaggg

SEQ ID NO: 566120 - DNA, 25 bp, Rattus norvegicus
tatcaatactacatggaccatttaa

SEQ ID NO: 566121 - DNA, 25 bp, Rattus norvegicus
tatcaatactacttggaccatttaa

SEQ ID NO: 566122 - DNA, 25 bp, Rattus norvegicus
tatcaatccaagagtttcctggtgg

SEQ ID NO: 566123 - DNA, 25 bp, Rattus norvegicus
tatcaatccaagtgtttcctggtgg

SEQ ID NO: 566124 - DNA, 25 bp, Rattus norvegicus
tatcaatccatacactcctatagcc

SEQ ID NO: 566125 - DNA, 25 bp, Rattus norvegicus
tatcaatccatagactcctatagcc

SEQ ID NO: 566126 - DNA, 25 bp, Rattus norvegicus
tatcaatcgagtccttcgggcacta

SEQ ID NO: 566127 - DNA, 25 bp, Rattus norvegicus
tatcaatcgagtgcttcgggcacta

SEQ ID NO: 566128 - DNA, 25 bp, Rattus norvegicus
tatcaatctcacaggtggccaggag

SEQ ID NO: 566129 - DNA, 25 bp, Rattus norvegicus
tatcaatctcactggtggccaggag

SEQ ID NO: 566130 - DNA, 25 bp, Rattus norvegicus
tatcaattaggcacttttcccactt

SEQ ID NO: 566131 - DNA, 25 bp, Rattus norvegicus
tatcaattaggctcttttcccactt

SEQ ID NO: 566132 - DNA, 25 bp, Rattus norvegicus
tatcaattctagactgttaccggtg

SEQ ID NO: 566133 - DNA, 25 bp, Rattus norvegicus
tatcaattctagtctgttaccggtg

SEQ ID NO: 566134 - DNA, 25 bp, Rattus norvegicus
tatcacaagttgaccacttactgga

SEQ ID NO: 566135 - DNA, 25 bp, Rattus norvegicus
tatcacaagttgtccacttactgga

SEQ ID NO: 566136 - DNA, 25 bp, Rattus norvegicus
tatcacacagtaacctcatctcaac

SEQ ID NO: 566137 - DNA, 25 bp, Rattus norvegicus
tatcacacagtatcctcatctcaac

SEQ ID NO: 566138 - DNA, 25 bp, Rattus norvegicus
tatcacacgcatcatgtgggcagcc

SEQ ID NO: 566139 - DNA, 25 bp, Rattus norvegicus
tatcacacgcatgatgtgggcagcc

SEQ ID NO: 566140 - DNA, 25 bp, Rattus norvegicus
tatcacactgtcaagtcgtgggcct

SEQ ID NO: 566141 - DNA, 25 bp, Rattus norvegicus
tatcacactgtctagtcgtgggcct

SEQ ID NO: 566142 - DNA, 25 bp, Rattus norvegicus
tatcacagccagaaggcctgacaga

SEQ ID NO: 566143 - DNA, 25 bp, Rattus norvegicus
tatcacagccagtaggcctgacaga

SEQ ID NO: 566144 - DNA, 25 bp, Rattus norvegicus
tatcacagcctgaacctgaaggtca

SEQ ID NO: 566145 - DNA, 25 bp, Rattus norvegicus
tatcacagcctgtacctgaaggtca

SEQ ID NO: 566146 - DNA, 25 bp, Rattus norvegicus
tatcacagggccaggtcgtgtgttg

SEQ ID NO: 566147 - DNA, 25 bp, Rattus norvegicus
tatcacagggcctggtcgtgtgttg

SEQ ID NO: 566148 - DNA, 25 bp, Rattus norvegicus
tatcacagtatcaaccttgttcagg

SEQ ID NO: 566149 - DNA, 25 bp, Rattus norvegicus
tatcacagtatctaccttgttcagg

SEQ ID NO: 566150 - DNA, 25 bp, Rattus norvegicus
tatcacagttagagtctggccgacg

SEQ ID NO: 566151 - DNA, 25 bp, Rattus norvegicus
tatcacagttagtgtctggccgacg

SEQ ID NO: 566152 - DNA, 25 bp, Rattus norvegicus
tatcacagttatcgccgctcgccaa

SEQ ID NO: 566153 - DNA, 25 bp, Rattus norvegicus
tatcacagttatggccgctcgccaa

SEQ ID NO: 566154 - DNA, 25 bp, Rattus norvegicus
tatcacagttgcacgatgccctcca

SEQ ID NO: 566155 - DNA, 25 bp, Rattus norvegicus
tatcacagttgctcgatgccctcca

SEQ ID NO: 566156 - DNA, 25 bp, Rattus norvegicus
tatcacatacccagagcattgccaa

SEQ ID NO: 566157 - DNA, 25 bp, Rattus norvegicus
tatcacataccctgagcattgccaa

SEQ ID NO: 566158 - DNA, 25 bp, Rattus norvegicus
tatcacatgctaattgagcccagga

SEQ ID NO: 566159 - DNA, 25 bp, Rattus norvegicus
tatcacatgctatttgagcccagga

SEQ ID NO: 566160 - DNA, 25 bp, Rattus norvegicus
tatcaccaaccccaaagcagtatta

SEQ ID NO: 566161 - DNA, 25 bp, Rattus norvegicus
tatcaccaacccgaaagcagtatta

SEQ ID NO: 566162 - DNA, 25 bp, Rattus norvegicus
tatcaccagctgaggcgaagcacgt

SEQ ID NO: 566163 - DNA, 25 bp, Rattus norvegicus
tatcaccagctgtggcgaagcacgt

SEQ ID NO: 566164 - DNA, 25 bp, Rattus norvegicus
tatcacccaatcacctgagcagtgg

SEQ ID NO: 566165 - DNA, 25 bp, Rattus norvegicus
tatcacccaatctcctgagcagtgg

SEQ ID NO: 566166 - DNA, 25 bp, Rattus norvegicus
tatcacccagatcgacatacagctt

SEQ ID NO: 566167 - DNA, 25 bp, Rattus norvegicus
tatcacccagatggacatacagctt

SEQ ID NO: 566168 - DNA, 25 bp, Rattus norvegicus
tatcacccatctctttcagtagcta

SEQ ID NO: 566169 - DNA, 25 bp, Rattus norvegicus
tatcacccatctgtttcagtagcta

SEQ ID NO: 566170 - DNA, 25 bp, Rattus norvegicus
tatcaccccacaatagactgtgagg

SEQ ID NO: 566171 - DNA, 25 bp, Rattus norvegicus
tatcaccccacattagactgtgagg

SEQ ID NO: 566172 - DNA, 25 bp, Rattus norvegicus
tatcaccctgatctatacgcagcag

SEQ ID NO: 566173 - DNA, 25 bp, Rattus norvegicus
tatcaccctgatgtatacgcagcag

SEQ ID NO: 566174 - DNA, 25 bp, Rattus norvegicus
tatcaccctgcaaggttacagtcat

SEQ ID NO: 566175 - DNA, 25 bp, Rattus norvegicus
tatcaccctgcatggttacagtcat

SEQ ID NO: 566176 - DNA, 25 bp, Rattus norvegicus
tatcaccctgtcatgtgcacagagt

SEQ ID NO: 566177 - DNA, 25 bp, Rattus norvegicus
tatcaccctgtcttgtgcacagagt

SEQ ID NO: 566178 - DNA, 25 bp, Rattus norvegicus
tatcacctcacaacatccatttgta

SEQ ID NO: 566179 - DNA, 25 bp, Rattus norvegicus
tatcacctcacatcatccatttgta

SEQ ID NO: 566180 - DNA, 25 bp, Rattus norvegicus
tatcacctcagcactctgactgttg

SEQ ID NO: 566181 - DNA, 25 bp, Rattus norvegicus
tatcacctcagctctctgactgttg

SEQ ID NO: 566182 - DNA, 25 bp, Rattus norvegicus
tatcaccttggtaacctggcatgga

SEQ ID NO: 566183 - DNA, 25 bp, Rattus norvegicus
tatcaccttggttacctggcatgga

SEQ ID NO: 566184 - DNA, 25 bp, Rattus norvegicus
tatcacggaagccatgctgtacgcc

SEQ ID NO: 566185 - DNA, 25 bp, Rattus norvegicus
tatcacggaagcgatgctgtacgcc

SEQ ID NO: 566186 - DNA, 25 bp, Rattus norvegicus
tatcacggagttacaccagacagta

SEQ ID NO: 566187 - DNA, 25 bp, Rattus norvegicus
tatcacggagtttcaccagacagta

SEQ ID NO: 566188 - DNA, 25 bp, Rattus norvegicus
tatcacgtcctaaatgtattctatg

SEQ ID NO: 566189 - DNA, 25 bp, Rattus norvegicus
tatcacgtcctatatgtattctatg

SEQ ID NO: 566190 - DNA, 25 bp, Rattus norvegicus
tatcacgtgacacgtgtctctgctt

SEQ ID NO: 566191 - DNA, 25 bp, Rattus norvegicus
tatcacgtgacaggtgtctctgctt

SEQ ID NO: 566192 - DNA, 25 bp, Rattus norvegicus
tatcacgtggtgactggagatggcc

SEQ ID NO: 566193 - DNA, 25 bp, Rattus norvegicus
tatcacgtggtgtctggagatggcc

SEQ ID NO: 566194 - DNA, 25 bp, Rattus norvegicus
tatcactaagtgctttctgggcctg

SEQ ID NO: 566195 - DNA, 25 bp, Rattus norvegicus
tatcactaagtggtttctgggcctg

SEQ ID NO: 566196 - DNA, 25 bp, Rattus norvegicus
tatcactatggtcggaaaactgttc

SEQ ID NO: 566197 - DNA, 25 bp, Rattus norvegicus
tatcactatggtgggaaaactgttc

SEQ ID NO: 566198 - DNA, 25 bp, Rattus norvegicus
tatcactcacaaatcgggaggagtt

SEQ ID NO: 566199 - DNA, 25 bp, Rattus norvegicus
tatcactcacaattcgggaggagtt

SEQ ID NO: 566200 - DNA, 25 bp, Rattus norvegicus
tatcactccatacacttttgttttg

SEQ ID NO: 566201 - DNA, 25 bp, Rattus norvegicus
tatcactccatagacttttgttttg

SEQ ID NO: 566202 - DNA, 25 bp, Rattus norvegicus
tatcactctgggacttgggagccct

SEQ ID NO: 566203 - DNA, 25 bp, Rattus norvegicus
tatcactctgggtcttgggagccct

SEQ ID NO: 566204 - DNA, 25 bp, Rattus norvegicus
tatcactgacaacagggacctgctg

SEQ ID NO: 566205 - DNA, 25 bp, Rattus norvegicus
tatcactgacaagagggacctgctg

SEQ ID NO: 566206 - DNA, 25 bp, Rattus norvegicus
tatcactgacagcagtaaagaccga

SEQ ID NO: 566207 - DNA, 25 bp, Rattus norvegicus
tatcactgacaggagtaaagaccga

SEQ ID NO: 566208 - DNA, 25 bp, Rattus norvegicus
tatcactgatctcacctgggtggtc

SEQ ID NO: 566209 - DNA, 25 bp, Rattus norvegicus
tatcactgatctgacctgggtggtc

SEQ ID NO: 566210 - DNA, 25 bp, Rattus norvegicus
tatcactgccatattagccctcatt

SEQ ID NO: 566211 - DNA, 25 bp, Rattus norvegicus
tatcactgccattttagccctcatt

SEQ ID NO: 566212 - DNA, 25 bp, Rattus norvegicus
tatcactggcatcctgtgtgacatc

SEQ ID NO: 566213 - DNA, 25 bp, Rattus norvegicus
tatcactggcatgctgtgtgacatc

SEQ ID NO: 566214 - DNA, 25 bp, Rattus norvegicus
tatcactgggtgactggctgcaagc

SEQ ID NO: 566215 - DNA, 25 bp, Rattus norvegicus
tatcactgggtgtctggctgcaagc

SEQ ID NO: 566216 - DNA, 25 bp, Rattus norvegicus
tatcactggtgtcgctgtgggcaaa

SEQ ID NO: 566217 - DNA, 25 bp, Rattus norvegicus
tatcactggtgtggctgtgggcaaa

SEQ ID NO: 566218 - DNA, 25 bp, Rattus norvegicus
tatcactgtgtactggtggccaggc

SEQ ID NO: 566219 - DNA, 25 bp, Rattus norvegicus
tatcactgtgtagtggtggccaggc

SEQ ID NO: 566220 - DNA, 25 bp, Rattus norvegicus
tatcactttcaaaggatcactcaga

SEQ ID NO: 566221 - DNA, 25 bp, Rattus norvegicus
tatcactttcaatggatcactcaga

SEQ ID NO: 566222 - DNA, 25 bp, Rattus norvegicus
tatcactttgatctcatacggccac

SEQ ID NO: 566223 - DNA, 25 bp, Rattus norvegicus
tatcactttgatgtcatacggccac

SEQ ID NO: 566224 - DNA, 25 bp, Rattus norvegicus
tatcagaaaagcatcgcgccgggat

SEQ ID NO: 566225 - DNA, 25 bp, Rattus norvegicus
tatcagaaaagcttcgcgccgggat

SEQ ID NO: 566226 - DNA, 25 bp, Rattus norvegicus
tatcagaacttcagtagtagcctca

SEQ ID NO: 566227 - DNA, 25 bp, Rattus norvegicus
tatcagaacttctgtagtagcctca

SEQ ID NO: 566228 - DNA, 25 bp, Rattus norvegicus
tatcagaagtcaacagctccttgcc

SEQ ID NO: 566229 - DNA, 25 bp, Rattus norvegicus
tatcagaagtcatcagctccttgcc

SEQ ID NO: 566230 - DNA, 25 bp, Rattus norvegicus
tatcagaattaccagatgatctcca

SEQ ID NO: 566231 - DNA, 25 bp, Rattus norvegicus
tatcagaattacgagatgatctcca

SEQ ID NO: 566232 - DNA, 25 bp, Rattus norvegicus
tatcagacagctaccaggagctctg

SEQ ID NO: 566233 - DNA, 25 bp, Rattus norvegicus
tatcagacagcttccaggagctctg

SEQ ID NO: 566234 - DNA, 25 bp, Rattus norvegicus
tatcagaccccgactgtaagtcccg

SEQ ID NO: 566235 - DNA, 25 bp, Rattus norvegicus
tatcagaccccgtctgtaagtcccg

SEQ ID NO: 566236 - DNA, 25 bp, Rattus norvegicus
tatcagactcagaagcaggcgactt

SEQ ID NO: 566237 - DNA, 25 bp, Rattus norvegicus
tatcagactcagtagcaggcgactt

SEQ ID NO: 566238 - DNA, 25 bp, Rattus norvegicus
tatcagagcaccacacccaggagag

SEQ ID NO: 566239 - DNA, 25 bp, Rattus norvegicus
tatcagagcacctcacccaggagag

SEQ ID NO: 566240 - DNA, 25 bp, Rattus norvegicus
tatcagagtacaacgatcactgttg

SEQ ID NO: 566241 - DNA, 25 bp, Rattus norvegicus
tatcagagtacatcgatcactgttg

SEQ ID NO: 566242 - DNA, 25 bp, Rattus norvegicus
tatcagatgcagctcttacagccgt

SEQ ID NO: 566243 - DNA, 25 bp, Rattus norvegicus
tatcagatgcaggtcttacagccgt

SEQ ID NO: 566244 - DNA, 25 bp, Rattus norvegicus
tatcagatgcctcgatccttgtgtt

SEQ ID NO: 566245 - DNA, 25 bp, Rattus norvegicus
tatcagatgcctggatccttgtgtt

SEQ ID NO: 566246 - DNA, 25 bp, Rattus norvegicus
tatcagcaacttatttaatacccag

SEQ ID NO: 566247 - DNA, 25 bp, Rattus norvegicus
tatcagcaacttttttaatacccag

SEQ ID NO: 566248 - DNA, 25 bp, Rattus norvegicus
tatcagcagactctgttcctgtctt

SEQ ID NO: 566249 - DNA, 25 bp, Rattus norvegicus
tatcagcagactgtgttcctgtctt

SEQ ID NO: 566250 - DNA, 25 bp, Rattus norvegicus
tatcagcagcagacctgaggagctt

SEQ ID NO: 566251 - DNA, 25 bp, Rattus norvegicus
tatcagcagcagtcctgaggagctt

SEQ ID NO: 566252 - DNA, 25 bp, Rattus norvegicus
tatcagcagtgacgatgcgccggcc

SEQ ID NO: 566253 - DNA, 25 bp, Rattus norvegicus
tatcagcagtgaggatgcgccggcc

SEQ ID NO: 566254 - DNA, 25 bp, Rattus norvegicus
tatcagcgtgtcactgtggacggca

SEQ ID NO: 566255 - DNA, 25 bp, Rattus norvegicus
tatcagcgtgtctctgtggacggca

SEQ ID NO: 566256 - DNA, 25 bp, Rattus norvegicus
tatcagctaccgacgtgcatgtcag

SEQ ID NO: 566257 - DNA, 25 bp, Rattus norvegicus
tatcagctaccgtcgtgcatgtcag

SEQ ID NO: 566258 - DNA, 25 bp, Rattus norvegicus
tatcagctagagaccactgcttgcc

SEQ ID NO: 566259 - DNA, 25 bp, Rattus norvegicus
tatcagctagagtccactgcttgcc

SEQ ID NO: 566260 - DNA, 25 bp, Rattus norvegicus
tatcagctcaagagtcctcccggag

SEQ ID NO: 566261 - DNA, 25 bp, Rattus norvegicus
tatcagctcaagtgtcctcccggag

SEQ ID NO: 566262 - DNA, 25 bp, Rattus norvegicus
tatcagctgatcccccgtgtagaag

SEQ ID NO: 566263 - DNA, 25 bp, Rattus norvegicus
tatcagctgatcgcccgtgtagaag

SEQ ID NO: 566264 - DNA, 25 bp, Rattus norvegicus
tatcagctggtcaaggtggtgcccc

SEQ ID NO: 566265 - DNA, 25 bp, Rattus norvegicus
tatcagctggtctaggtggtgcccc

SEQ ID NO: 566266 - DNA, 25 bp, Rattus norvegicus
tatcagcttcacagtatgggacgta

SEQ ID NO: 566267 - DNA, 25 bp, Rattus norvegicus
tatcagcttcactgtatgggacgta

SEQ ID NO: 566268 - DNA, 25 bp, Rattus norvegicus
tatcagcttgatattttgtctgctc

SEQ ID NO: 566269 - DNA, 25 bp, Rattus norvegicus
tatcagcttgattttttgtctgctc

SEQ ID NO: 566270 - DNA, 25 bp, Rattus norvegicus
tatcaggaatccatgtcttggcctt

SEQ ID NO: 566271 - DNA, 25 bp, Rattus norvegicus
tatcaggaatccttgtcttggcctt

SEQ ID NO: 566272 - DNA, 25 bp, Rattus norvegicus
tatcaggacactacgtggctgtgct

SEQ ID NO: 566273 - DNA, 25 bp, Rattus norvegicus
tatcaggacacttcgtggctgtgct

SEQ ID NO: 566274 - DNA, 25 bp, Rattus norvegicus
tatcaggactgacactagggtagct

SEQ ID NO: 566275 - DNA, 25 bp, Rattus norvegicus
tatcaggactgagactagggtagct

SEQ ID NO: 566276 - DNA, 25 bp, Rattus norvegicus
tatcaggatcttctcttaggccacg

SEQ ID NO: 566277 - DNA, 25 bp, Rattus norvegicus
tatcaggatcttgtcttaggccacg

SEQ ID NO: 566278 - DNA, 25 bp, Rattus norvegicus
tatcaggcatttagtggcagcaaca

SEQ ID NO: 566279 - DNA, 25 bp, Rattus norvegicus
tatcaggcattttgtggcagcaaca

SEQ ID NO: 566280 - DNA, 25 bp, Rattus norvegicus
tatcaggcctctcgcagggtaggat

SEQ ID NO: 566281 - DNA, 25 bp, Rattus norvegicus
tatcaggcctctggcagggtaggat

SEQ ID NO: 566282 - DNA, 25 bp, Rattus norvegicus
tatcaggcttctctgggttattcca

SEQ ID NO: 566283 - DNA, 25 bp, Rattus norvegicus
tatcaggcttctgtgggttattcca

SEQ ID NO: 566284 - DNA, 25 bp, Rattus norvegicus
tatcagggatctctcagcactcctc

SEQ ID NO: 566285 - DNA, 25 bp, Rattus norvegicus
tatcagggatctgtcagcactcctc

SEQ ID NO: 566286 - DNA, 25 bp, Rattus norvegicus
tatcagggcaatcgacggccgaaga

SEQ ID NO: 566287 - DNA, 25 bp, Rattus norvegicus
tatcagggcaatggacggccgaaga

SEQ ID NO: 566288 - DNA, 25 bp, Rattus norvegicus
tatcaggtgaaaatgcttgccccaa

SEQ ID NO: 566289 - DNA, 25 bp, Rattus norvegicus
tatcaggtgaaattgcttgccccaa

SEQ ID NO: 566290 - DNA, 25 bp, Rattus norvegicus
tatcaggttctaaattgctatccag

SEQ ID NO: 566291 - DNA, 25 bp, Rattus norvegicus
tatcaggttctatattgctatccag

SEQ ID NO: 566292 - DNA, 25 bp, Rattus norvegicus
tatcagtacgtccgcaatggaagaa

SEQ ID NO: 566293 - DNA, 25 bp, Rattus norvegicus
tatcagtacgtcggcaatggaagaa

SEQ ID NO: 566294 - DNA, 25 bp, Rattus norvegicus
tatcagtagactctccacaccttgt

SEQ ID NO: 566295 - DNA, 25 bp, Rattus norvegicus
tatcagtagactgtccacaccttgt

SEQ ID NO: 566296 - DNA, 25 bp, Rattus norvegicus
tatcagtatctcatccttggtatgc

SEQ ID NO: 566297 - DNA, 25 bp, Rattus norvegicus
tatcagtatctcttccttggtatgc

SEQ ID NO: 566298 - DNA, 25 bp, Rattus norvegicus
tatcagtattgaatttggctagtat

SEQ ID NO: 566299 - DNA, 25 bp, Rattus norvegicus
tatcagtattgattttggctagtat

SEQ ID NO: 566300 - DNA, 25 bp, Rattus norvegicus
tatcagtgaacccaaggcgacccca

SEQ ID NO: 566301 - DNA, 25 bp, Rattus norvegicus
tatcagtgaaccgaaggcgacccca

SEQ ID NO: 566302 - DNA, 25 bp, Rattus norvegicus
tatcagtgactgctggactcagcca

SEQ ID NO: 566303 - DNA, 25 bp, Rattus norvegicus
tatcagtgactggtggactcagcca

SEQ ID NO: 566304 - DNA, 25 bp, Rattus norvegicus
tatcagtgagcacacctgttcctga

SEQ ID NO: 566305 - DNA, 25 bp, Rattus norvegicus
tatcagtgagcagacctgttcctga

SEQ ID NO: 566306 - DNA, 25 bp, Rattus norvegicus
tatcagtgatctcgtccagacatgc

SEQ ID NO: 566307 - DNA, 25 bp, Rattus norvegicus
tatcagtgatctggtccagacatgc

SEQ ID NO: 566308 - DNA, 25 bp, Rattus norvegicus
tatcagtgctgcagttcatgcgggc

SEQ ID NO: 566309 - DNA, 25 bp, Rattus norvegicus
tatcagtgctgctgttcatgcgggc

SEQ ID NO: 566310 - DNA, 25 bp, Rattus norvegicus
tatcagtgcttcagtgactgacaca

SEQ ID NO: 566311 - DNA, 25 bp, Rattus norvegicus
tatcagtgcttctgtgactgacaca

SEQ ID NO: 566312 - DNA, 25 bp, Rattus norvegicus
tatcagttctggagtctggattctc

SEQ ID NO: 566313 - DNA, 25 bp, Rattus norvegicus
tatcagttctggtgtctggattctc

SEQ ID NO: 566314 - DNA, 25 bp, Rattus norvegicus
tatcagttctgtcctggccctttca

SEQ ID NO: 566315 - DNA, 25 bp, Rattus norvegicus
tatcagttctgtgctggccctttca

SEQ ID NO: 566316 - DNA, 25 bp, Rattus norvegicus
tatcagttgaaaccatgctccctgt

SEQ ID NO: 566317 - DNA, 25 bp, Rattus norvegicus
tatcagttgaaagcatgctccctgt

SEQ ID NO: 566318 - DNA, 25 bp, Rattus norvegicus
tatcagttgaacaagcgccttcctt

SEQ ID NO: 566319 - DNA, 25 bp, Rattus norvegicus
tatcagttgaactagcgccttcctt

SEQ ID NO: 566320 - DNA, 25 bp, Rattus norvegicus
tatcataaggagctcaacaggcttt

SEQ ID NO: 566321 - DNA, 25 bp, Rattus norvegicus
tatcataaggaggtcaacaggcttt

SEQ ID NO: 566322 - DNA, 25 bp, Rattus norvegicus
tatcatacacctagaaggaggcgtt

SEQ ID NO: 566323 - DNA, 25 bp, Rattus norvegicus
tatcatacaccttgaaggaggcgtt

SEQ ID NO: 566324 - DNA, 25 bp, Rattus norvegicus
tatcatacagcaaggtgctatgacc

SEQ ID NO: 566325 - DNA, 25 bp, Rattus norvegicus
tatcatacagcatggtgctatgacc

SEQ ID NO: 566326 - DNA, 25 bp, Rattus norvegicus
tatcatactgttacttcatctcctt

SEQ ID NO: 566327 - DNA, 25 bp, Rattus norvegicus
tatcatactgtttcttcatctcctt

SEQ ID NO: 566328 - DNA, 25 bp, Rattus norvegicus
tatcatacttatcggtcgctccttc

SEQ ID NO: 566329 - DNA, 25 bp, Rattus norvegicus
tatcatacttatgggtcgctccttc

SEQ ID NO: 566330 - DNA, 25 bp, Rattus norvegicus
tatcatattcctcatctttgccatg

SEQ ID NO: 566331 - DNA, 25 bp, Rattus norvegicus
tatcatattcctgatctttgccatg

SEQ ID NO: 566332 - DNA, 25 bp, Rattus norvegicus
tatcatcactttccatgtccaagag

SEQ ID NO: 566333 - DNA, 25 bp, Rattus norvegicus
tatcatcactttgcatgtccaagag

SEQ ID NO: 566334 - DNA, 25 bp, Rattus norvegicus
tatcatcagagcaggagccgcgacg

SEQ ID NO: 566335 - DNA, 25 bp, Rattus norvegicus
tatcatcagagctggagccgcgacg

SEQ ID NO: 566336 - DNA, 25 bp, Rattus norvegicus
tatcatcagctgaccatttatctag

SEQ ID NO: 566337 - DNA, 25 bp, Rattus norvegicus
tatcatcagctgtccatttatctag

SEQ ID NO: 566338 - DNA, 25 bp, Rattus norvegicus
tatcatcatccactggcaacagcag

SEQ ID NO: 566339 - DNA, 25 bp, Rattus norvegicus
tatcatcatccagtggcaacagcag

SEQ ID NO: 566340 - DNA, 25 bp, Rattus norvegicus
tatcatccaaaacgctttctgccct

SEQ ID NO: 566341 - DNA, 25 bp, Rattus norvegicus
tatcatccaaaaggctttctgccct

SEQ ID NO: 566342 - DNA, 25 bp, Rattus norvegicus
tatcatccaggtatcatgcccaatt

SEQ ID NO: 566343 - DNA, 25 bp, Rattus norvegicus
tatcatccaggtttcatgcccaatt

SEQ ID NO: 566344 - DNA, 25 bp, Rattus norvegicus
tatcatctattgaattttctacagg

SEQ ID NO: 566345 - DNA, 25 bp, Rattus norvegicus
tatcatctattgtattttctacagg

SEQ ID NO: 566346 - DNA, 25 bp, Rattus norvegicus
tatcatctcagcaactcgatttaga

SEQ ID NO: 566347 - DNA, 25 bp, Rattus norvegicus
tatcatctcagctactcgatttaga

SEQ ID NO: 566348 - DNA, 25 bp, Rattus norvegicus
tatcatctcctccagagcccttttt

SEQ ID NO: 566349 - DNA, 25 bp, Rattus norvegicus
tatcatctcctcgagagcccttttt

SEQ ID NO: 566350 - DNA, 25 bp, Rattus norvegicus
tatcatctcggtagaaactcccagc

SEQ ID NO: 566351 - DNA, 25 bp, Rattus norvegicus
tatcatctcggttgaaactcccagc

SEQ ID NO: 566352 - DNA, 25 bp, Rattus norvegicus
tatcatctctccacagttcatggtt

SEQ ID NO: 566353 - DNA, 25 bp, Rattus norvegicus
tatcatctctcctcagttcatggtt

SEQ ID NO: 566354 - DNA, 25 bp, Rattus norvegicus
tatcatctgttcagctttgtgtcaa

SEQ ID NO: 566355 - DNA, 25 bp, Rattus norvegicus
tatcatctgttctgctttgtgtcaa

SEQ ID NO: 566356 - DNA, 25 bp, Rattus norvegicus
tatcatcttctcacggttgtatcca

SEQ ID NO: 566357 - DNA, 25 bp, Rattus norvegicus
tatcatcttctctcggttgtatcca

SEQ ID NO: 566358 - DNA, 25 bp, Rattus norvegicus
tatcatctttagcagtggtggccaa

SEQ ID NO: 566359 - DNA, 25 bp, Rattus norvegicus
tatcatctttaggagtggtggccaa

SEQ ID NO: 566360 - DNA, 25 bp, Rattus norvegicus
tatcatctttggaccttatttcaag

SEQ ID NO: 566361 - DNA, 25 bp, Rattus norvegicus
tatcatctttggtccttatttcaag

SEQ ID NO: 566362 - DNA, 25 bp, Rattus norvegicus
tatcatgaatgaaccagcaggaaac

SEQ ID NO: 566363 - DNA, 25 bp, Rattus norvegicus
tatcatgaatgatccagcaggaaac

SEQ ID NO: 566364 - DNA, 25 bp, Rattus norvegicus
tatcatgacatgcagactgcagact

SEQ ID NO: 566365 - DNA, 25 bp, Rattus norvegicus
tatcatgacatggagactgcagact

SEQ ID NO: 566366 - DNA, 25 bp, Rattus norvegicus
tatcatgactgtatgcctatctttg

SEQ ID NO: 566367 - DNA, 25 bp, Rattus norvegicus
tatcatgactgtttgcctatctttg

SEQ ID NO: 566368 - DNA, 25 bp, Rattus norvegicus
tatcatgaggaaatctccgtgctcc

SEQ ID NO: 566369 - DNA, 25 bp, Rattus norvegicus
tatcatgaggaattctccgtgctcc

SEQ ID NO: 566370 - DNA, 25 bp, Rattus norvegicus
tatcatgcacccagattatgctcac

SEQ ID NO: 566371 - DNA, 25 bp, Rattus norvegicus
tatcatgcaccctgattatgctcac

SEQ ID NO: 566372 - DNA, 25 bp, Rattus norvegicus
tatcatgcacttcatcgccacagta

SEQ ID NO: 566373 - DNA, 25 bp, Rattus norvegicus
tatcatgcacttgatcgccacagta

SEQ ID NO: 566374 - DNA, 25 bp, Rattus norvegicus
tatcatgcccctaatgtattcacac

SEQ ID NO: 566375 - DNA, 25 bp, Rattus norvegicus
tatcatgccccttatgtattcacac

SEQ ID NO: 566376 - DNA, 25 bp, Rattus norvegicus
tatcatgctaatcctcaacatatgg

SEQ ID NO: 566377 - DNA, 25 bp, Rattus norvegicus
tatcatgctaatgctcaacatatgg

SEQ ID NO: 566378 - DNA, 25 bp, Rattus norvegicus
tatcatggagaacgcccaactggga

SEQ ID NO: 566379 - DNA, 25 bp, Rattus norvegicus
tatcatggagaaggcccaactggga

SEQ ID NO: 566380 - DNA, 25 bp, Rattus norvegicus
tatcatggagggagcttcgattgct

SEQ ID NO: 566381 - DNA, 25 bp, Rattus norvegicus
tatcatggagggtgcttcgattgct

SEQ ID NO: 566382 - DNA, 25 bp, Rattus norvegicus
tatcatggcccaaaagtcttcagag

SEQ ID NO: 566383 - DNA, 25 bp, Rattus norvegicus
tatcatggcccataagtcttcagag

SEQ ID NO: 566384 - DNA, 25 bp, Rattus norvegicus
tatcatggtggactagagctgcttt

SEQ ID NO: 566385 - DNA, 25 bp, Rattus norvegicus
tatcatggtggagtagagctgcttt

SEQ ID NO: 566386 - DNA, 25 bp, Rattus norvegicus
tatcatgtactcactctgactctga

SEQ ID NO: 566387 - DNA, 25 bp, Rattus norvegicus
tatcatgtactctctctgactctga

SEQ ID NO: 566388 - DNA, 25 bp, Rattus norvegicus
tatcatgtcctccttatacctggga

SEQ ID NO: 566389 - DNA, 25 bp, Rattus norvegicus
tatcatgtcctcgttatacctggga

SEQ ID NO: 566390 - DNA, 25 bp, Rattus norvegicus
tatcatgtcgacacacttcttcagc

SEQ ID NO: 566391 - DNA, 25 bp, Rattus norvegicus
tatcatgtcgactcacttcttcagc

SEQ ID NO: 566392 - DNA, 25 bp, Rattus norvegicus
tatcatgtgtgcactgtcgaggcca

SEQ ID NO: 566393 - DNA, 25 bp, Rattus norvegicus
tatcatgtgtgctctgtcgaggcca

SEQ ID NO: 566394 - DNA, 25 bp, Rattus norvegicus
tatcattatcggcttcatactggag

SEQ ID NO: 566395 - DNA, 25 bp, Rattus norvegicus
tatcattatcgggttcatactggag

SEQ ID NO: 566396 - DNA, 25 bp, Rattus norvegicus
tatcattcctgtcgcaatttctgtc

SEQ ID NO: 566397 - DNA, 25 bp, Rattus norvegicus
tatcattcctgtggcaatttctgtc

SEQ ID NO: 566398 - DNA, 25 bp, Rattus norvegicus
tatcattcgtgtaacagctgcaaag

SEQ ID NO: 566399 - DNA, 25 bp, Rattus norvegicus
tatcattcgtgttacagctgcaaag

SEQ ID NO: 566400 - DNA, 25 bp, Rattus norvegicus
tatcattggtcaccatggtctccaa

SEQ ID NO: 566401 - DNA, 25 bp, Rattus norvegicus
tatcattggtcagcatggtctccaa

SEQ ID NO: 566402 - DNA, 25 bp, Rattus norvegicus
tatcattgtcatatagtcctctact

SEQ ID NO: 566403 - DNA, 25 bp, Rattus norvegicus
tatcattgtcatccgagtgtcacca

SEQ ID NO: 566404 - DNA, 25 bp, Rattus norvegicus
tatcattgtcatgcgagtgtcacca

SEQ ID NO: 566405 - DNA, 25 bp, Rattus norvegicus
tatcattgtcatttagtcctctact

SEQ ID NO: 566406 - DNA, 25 bp, Rattus norvegicus
tatcatttactccatctaccattct

SEQ ID NO: 566407 - DNA, 25 bp, Rattus norvegicus
tatcatttactcgatctaccattct

SEQ ID NO: 566408 - DNA, 25 bp, Rattus norvegicus
tatcatttagatcctgcgagccttc

SEQ ID NO: 566409 - DNA, 25 bp, Rattus norvegicus
tatcatttagatgctgcgagccttc

SEQ ID NO: 566410 - DNA, 25 bp, Rattus norvegicus
tatcatttcggaagtcactcgggtc

SEQ ID NO: 566411 - DNA, 25 bp, Rattus norvegicus
tatcatttcggatgtcactcgggtc

SEQ ID NO: 566412 - DNA, 25 bp, Rattus norvegicus
tatcattttaaacagtgccactgtg

SEQ ID NO: 566413 - DNA, 25 bp, Rattus norvegicus
tatcattttaaagagtgccactgtg

SEQ ID NO: 566414 - DNA, 25 bp, Rattus norvegicus
tatcattttatcacccagatcacga

SEQ ID NO: 566415 - DNA, 25 bp, Rattus norvegicus
tatcattttatctcccagatcacga

SEQ ID NO: 566416 - DNA, 25 bp, Rattus norvegicus
tatcattttcctcggcccaaaagca

SEQ ID NO: 566417 - DNA, 25 bp, Rattus norvegicus
tatcattttcctgggcccaaaagca

SEQ ID NO: 566418 - DNA, 25 bp, Rattus norvegicus
tatcattttgataccaactgtgttt

SEQ ID NO: 566419 - DNA, 25 bp, Rattus norvegicus
tatcattttgattccaactgtgttt

SEQ ID NO: 566420 - DNA, 25 bp, Rattus norvegicus
tatcattttttcatggaacttagca

SEQ ID NO: 566421 - DNA, 25 bp, Rattus norvegicus
tatcattttttcttggaacttagca

SEQ ID NO: 566422 - DNA, 25 bp, Rattus norvegicus
tatccaaacgcaagcatatagacag

SEQ ID NO: 566423 - DNA, 25 bp, Rattus norvegicus
tatccaaacgcatgcatatagacag

SEQ ID NO: 566424 - DNA, 25 bp, Rattus norvegicus
tatccaaagaccatactgtactgac

SEQ ID NO: 566425 - DNA, 25 bp, Rattus norvegicus
tatccaaagaccttactgtactgac

SEQ ID NO: 566426 - DNA, 25 bp, Rattus norvegicus
tatccaaagcagctacaattgtaca

SEQ ID NO: 566427 - DNA, 25 bp, Rattus norvegicus
tatccaaagcaggtacaattgtaca

SEQ ID NO: 566428 - DNA, 25 bp, Rattus norvegicus
tatccaacacttaaacacctatttg

SEQ ID NO: 566429 - DNA, 25 bp, Rattus norvegicus
tatccaacactttaacacctatttg

SEQ ID NO: 566430 - DNA, 25 bp, Rattus norvegicus
tatccaacagttacaatgtccttgt

SEQ ID NO: 566431 - DNA, 25 bp, Rattus norvegicus
tatccaacagtttcaatgtccttgt

SEQ ID NO: 566432 - DNA, 25 bp, Rattus norvegicus
tatccaacccatcacaccggtaata

SEQ ID NO: 566433 - DNA, 25 bp, Rattus norvegicus
tatccaacccatccctgtaaaaatt

SEQ ID NO: 566434 - DNA, 25 bp, Rattus norvegicus
tatccaacccatgacaccggtaata

SEQ ID NO: 566435 - DNA, 25 bp, Rattus norvegicus
tatccaacccatgcctgtaaaaatt

SEQ ID NO: 566436 - DNA, 25 bp, Rattus norvegicus
tatccaagattcagcccttcctggt

SEQ ID NO: 566437 - DNA, 25 bp, Rattus norvegicus
tatccaagattctgcccttcctggt

SEQ ID NO: 566438 - DNA, 25 bp, Rattus norvegicus
tatccaagcaccaaaattatcccag

SEQ ID NO: 566439 - DNA, 25 bp, Rattus norvegicus
tatccaagcacctaaattatcccag

SEQ ID NO: 566440 - DNA, 25 bp, Rattus norvegicus
tatccaagcatacctcatctctgag

SEQ ID NO: 566441 - DNA, 25 bp, Rattus norvegicus
tatccaagcatagctcatctctgag

SEQ ID NO: 566442 - DNA, 25 bp, Rattus norvegicus
tatccaagcctgataaaatctgaga

SEQ ID NO: 566443 - DNA, 25 bp, Rattus norvegicus
tatccaagcctgttaaaatctgaga

SEQ ID NO: 566444 - DNA, 25 bp, Rattus norvegicus
tatccaaggaggcttctaaatgcaa

SEQ ID NO: 566445 - DNA, 25 bp, Rattus norvegicus
tatccaaggagggttctaaatgcaa

SEQ ID NO: 566446 - DNA, 25 bp, Rattus norvegicus
tatccaaggcaaccgagtgctggtc

SEQ ID NO: 566447 - DNA, 25 bp, Rattus norvegicus
tatccaaggcaagcgagtgctggtc

SEQ ID NO: 566448 - DNA, 25 bp, Rattus norvegicus
tatccaagggagcattgttcagttc

SEQ ID NO: 566449 - DNA, 25 bp, Rattus norvegicus
tatccaagggaggattgttcagttc

SEQ ID NO: 566450 - DNA, 25 bp, Rattus norvegicus
tatccaaggtgcagaatcttggagg

SEQ ID NO: 566451 - DNA, 25 bp, Rattus norvegicus
tatccaaggtgctgaatcttggagg

SEQ ID NO: 566452 - DNA, 25 bp, Rattus norvegicus
tatccaagtcataatctccatgctc

SEQ ID NO: 566453 - DNA, 25 bp, Rattus norvegicus
tatccaagtcattatctccatgctc

SEQ ID NO: 566454 - DNA, 25 bp, Rattus norvegicus
tatccaagtctacaccagtggtccc

SEQ ID NO: 566455 - DNA, 25 bp, Rattus norvegicus
tatccaagtctagaccagtggtccc

SEQ ID NO: 566456 - DNA, 25 bp, Rattus norvegicus
tatccaatccctattgcctatgttg

SEQ ID NO: 566457 - DNA, 25 bp, Rattus norvegicus
tatccaatcccttttgcctatgttg

SEQ ID NO: 566458 - DNA, 25 bp, Rattus norvegicus
tatccacaagatccaattccagagt

SEQ ID NO: 566459 - DNA, 25 bp, Rattus norvegicus
tatccacaagatgcaattccagagt

SEQ ID NO: 566460 - DNA, 25 bp, Rattus norvegicus
tatccacacggaagctgtgtctggc

SEQ ID NO: 566461 - DNA, 25 bp, Rattus norvegicus
tatccacacggatgctgtgtctggc

SEQ ID NO: 566462 - DNA, 25 bp, Rattus norvegicus
tatccacacttaaccaaaaccattc

SEQ ID NO: 566463 - DNA, 25 bp, Rattus norvegicus
tatccacacttatccaaaaccattc

SEQ ID NO: 566464 - DNA, 25 bp, Rattus norvegicus
tatccacacttcatatttatcccag

SEQ ID NO: 566465 - DNA, 25 bp, Rattus norvegicus
tatccacacttcttatttatcccag

SEQ ID NO: 566466 - DNA, 25 bp, Rattus norvegicus
tatccacatgcactgatgctgggta

SEQ ID NO: 566467 - DNA, 25 bp, Rattus norvegicus
tatccacatgcagtgatgctgggta

SEQ ID NO: 566468 - DNA, 25 bp, Rattus norvegicus
tatccacatgccagtgtcacacaag

SEQ ID NO: 566469 - DNA, 25 bp, Rattus norvegicus
tatccacatgcctgtgtcacacaag

SEQ ID NO: 566470 - DNA, 25 bp, Rattus norvegicus
tatccacatggaatggtgttgctgg

SEQ ID NO: 566471 - DNA, 25 bp, Rattus norvegicus
tatccacatggattggtgttgctgg

SEQ ID NO: 566472 - DNA, 25 bp, Rattus norvegicus
tatccaccatgtcacgtgatgctat

SEQ ID NO: 566473 - DNA, 25 bp, Rattus norvegicus
tatccaccatgtgacgtgatgctat

SEQ ID NO: 566474 - DNA, 25 bp, Rattus norvegicus
tatccacccgtcaggcaagttggct

SEQ ID NO: 566475 - DNA, 25 bp, Rattus norvegicus
tatccacccgtctggcaagttggct

SEQ ID NO: 566476 - DNA, 25 bp, Rattus norvegicus
tatccaccttcactttttacacagt

SEQ ID NO: 566477 - DNA, 25 bp, Rattus norvegicus
tatccaccttcagtttttacacagt

SEQ ID NO: 566478 - DNA, 25 bp, Rattus norvegicus
tatccacggactactaagatgtttc

SEQ ID NO: 566479 - DNA, 25 bp, Rattus norvegicus
tatccacggacttctaagatgtttc

SEQ ID NO: 566480 - DNA, 25 bp, Rattus norvegicus
tatccacggtctcggcaacaatagc

SEQ ID NO: 566481 - DNA, 25 bp, Rattus norvegicus
tatccacggtctgggcaacaatagc

SEQ ID NO: 566482 - DNA, 25 bp, Rattus norvegicus
tatccacgttctaattacttccttg

SEQ ID NO: 566483 - DNA, 25 bp, Rattus norvegicus
tatccacgttcttattacttccttg

SEQ ID NO: 566484 - DNA, 25 bp, Rattus norvegicus
tatccactcctccagaactagggtt

SEQ ID NO: 566485 - DNA, 25 bp, Rattus norvegicus
tatccactcctcgagaactagggtt

SEQ ID NO: 566486 - DNA, 25 bp, Rattus norvegicus
tatccactgccccaatccatgtgtg

SEQ ID NO: 566487 - DNA, 25 bp, Rattus norvegicus
tatccactgcccgaatccatgtgtg

SEQ ID NO: 566488 - DNA, 25 bp, Rattus norvegicus
tatccacttataactgcctattgcc

SEQ ID NO: 566489 - DNA, 25 bp, Rattus norvegicus
tatccacttatatctgcctattgcc

SEQ ID NO: 566490 - DNA, 25 bp, Rattus norvegicus
tatccacttcatccataggctagtt

SEQ ID NO: 566491 - DNA, 25 bp, Rattus norvegicus
tatccacttcatgcataggctagtt

SEQ ID NO: 566492 - DNA, 25 bp, Rattus norvegicus
tatccacttcccattttctaatgtt

SEQ ID NO: 566493 - DNA, 25 bp, Rattus norvegicus
tatccacttccctttttctaatgtt

SEQ ID NO: 566494 - DNA, 25 bp, Rattus norvegicus
tatccagaacacactacaccagcag

SEQ ID NO: 566495 - DNA, 25 bp, Rattus norvegicus
tatccagaacactctacaccagcag

SEQ ID NO: 566496 - DNA, 25 bp, Rattus norvegicus
tatccagaagcacagtggttgcccc

SEQ ID NO: 566497 - DNA, 25 bp, Rattus norvegicus
tatccagaagcagagtggttgcccc

SEQ ID NO: 566498 - DNA, 25 bp, Rattus norvegicus
tatccagacagcaacccatgtactt

SEQ ID NO: 566499 - DNA, 25 bp, Rattus norvegicus
tatccagacagctacccatgtactt

SEQ ID NO: 566500 - DNA, 25 bp, Rattus norvegicus
tatccagacattaactgtatctcta

SEQ ID NO: 566501 - DNA, 25 bp, Rattus norvegicus
tatccagacatttactgtatctcta

SEQ ID NO: 566502 - DNA, 25 bp, Rattus norvegicus
tatccagagctgcagatcacaaatg

SEQ ID NO: 566503 - DNA, 25 bp, Rattus norvegicus
tatccagagctggagatcacaaatg

SEQ ID NO: 566504 - DNA, 25 bp, Rattus norvegicus
tatccagaggagacccaatcctttg

SEQ ID NO: 566505 - DNA, 25 bp, Rattus norvegicus
tatccagaggagtcccaatcctttg

SEQ ID NO: 566506 - DNA, 25 bp, Rattus norvegicus
tatccagaggcccagatccttttac

SEQ ID NO: 566507 - DNA, 25 bp, Rattus norvegicus
tatccagaggccgagatccttttac

SEQ ID NO: 566508 - DNA, 25 bp, Rattus norvegicus
tatccagatcgtagcttcagttctc

SEQ ID NO: 566509 - DNA, 25 bp, Rattus norvegicus
tatccagatcgttgcttcagttctc

SEQ ID NO: 566510 - DNA, 25 bp, Rattus norvegicus
tatccagcaccacttgcagagggct

SEQ ID NO: 566511 - DNA, 25 bp, Rattus norvegicus
tatccagcaccagttgcagagggct

SEQ ID NO: 566512 - DNA, 25 bp, Rattus norvegicus
tatccagcccgtcatgacgaaggtg

SEQ ID NO: 566513 - DNA, 25 bp, Rattus norvegicus
tatccagcccgtgatgacgaaggtg

SEQ ID NO: 566514 - DNA, 25 bp, Rattus norvegicus
tatccagcctacactaagcctagat

SEQ ID NO: 566515 - DNA, 25 bp, Rattus norvegicus
tatccagcctactctaagcctagat

SEQ ID NO: 566516 - DNA, 25 bp, Rattus norvegicus
tatccagccttgctcgtggttcttg

SEQ ID NO: 566517 - DNA, 25 bp, Rattus norvegicus
tatccagccttggtcgtggttcttg

SEQ ID NO: 566518 - DNA, 25 bp, Rattus norvegicus
tatccagctgtgaaggactcctgcc

SEQ ID NO: 566519 - DNA, 25 bp, Rattus norvegicus
tatccagctgtgtaggactcctgcc

SEQ ID NO: 566520 - DNA, 25 bp, Rattus norvegicus
tatccagcttcaacaggtggtcgtg

SEQ ID NO: 566521 - DNA, 25 bp, Rattus norvegicus
tatccagcttcatcaggtggtcgtg

SEQ ID NO: 566522 - DNA, 25 bp, Rattus norvegicus
tatccaggaagtcgtaaaacacctt

SEQ ID NO: 566523 - DNA, 25 bp, Rattus norvegicus
tatccaggaagtggtaaaacacctt

SEQ ID NO: 566524 - DNA, 25 bp, Rattus norvegicus
tatccaggacacatgatgctctgga

SEQ ID NO: 566525 - DNA, 25 bp, Rattus norvegicus
tatccaggacacttgatgctctgga

SEQ ID NO: 566526 - DNA, 25 bp, Rattus norvegicus
tatccaggacagagggaagaccttc

SEQ ID NO: 566527 - DNA, 25 bp, Rattus norvegicus
tatccaggacagtgggaagaccttc

SEQ ID NO: 566528 - DNA, 25 bp, Rattus norvegicus
tatccaggcacaacattattaactt

SEQ ID NO: 566529 - DNA, 25 bp, Rattus norvegicus
tatccaggcacatcattattaactt

SEQ ID NO: 566530 - DNA, 25 bp, Rattus norvegicus
tatccaggcagactcattcccgagc

SEQ ID NO: 566531 - DNA, 25 bp, Rattus norvegicus
tatccaggcagagtcattcccgagc

SEQ ID NO: 566532 - DNA, 25 bp, Rattus norvegicus
tatccaggcaggctgtggtccattt

SEQ ID NO: 566533 - DNA, 25 bp, Rattus norvegicus
tatccaggcagggtgtggtccattt

SEQ ID NO: 566534 - DNA, 25 bp, Rattus norvegicus
tatccaggcccaacttctagtgaag

SEQ ID NO: 566535 - DNA, 25 bp, Rattus norvegicus
tatccaggcccatcttctagtgaag

SEQ ID NO: 566536 - DNA, 25 bp, Rattus norvegicus
tatccaggctgcacagcttttgcaa

SEQ ID NO: 566537 - DNA, 25 bp, Rattus norvegicus
tatccaggctgctcagcttttgcaa

SEQ ID NO: 566538 - DNA, 25 bp, Rattus norvegicus
tatccaggcttaagtacacccatgt

SEQ ID NO: 566539 - DNA, 25 bp, Rattus norvegicus
tatccaggcttatgtacacccatgt

SEQ ID NO: 566540 - DNA, 25 bp, Rattus norvegicus
tatccagggcctcttaattatagct

SEQ ID NO: 566541 - DNA, 25 bp, Rattus norvegicus
tatccagggcctgttaattatagct

SEQ ID NO: 566542 - DNA, 25 bp, Rattus norvegicus
tatccagggtccctttgttaccagg

SEQ ID NO: 566543 - DNA, 25 bp, Rattus norvegicus
tatccagggtccgtttgttaccagg

SEQ ID NO: 566544 - DNA, 25 bp, Rattus norvegicus
tatccaggtatgaacttgtccaaga

SEQ ID NO: 566545 - DNA, 25 bp, Rattus norvegicus
tatccaggtatgtacttgtccaaga

SEQ ID NO: 566546 - DNA, 25 bp, Rattus norvegicus
tatccaggtggacagtgcattcact
